United States Patent 7,888,497 (BIOINFORMATICALLY DETECTABLE GROUP OF NOVEL REGULATORY OLIGONUCLEOTIDES AND USES THEREOF) - sequence listing, part 74

SEQ ID NO: 3119189 - DNA, 18 bp, Homo sapiens
ccatctctcatcctccag

SEQ ID NO: 3119190 - DNA, 20 bp, Homo sapiens
ccatctctctactcctacct

SEQ ID NO: 3119191 - DNA, 18 bp, Homo sapiens
ccatctctgattttcaaa

SEQ ID NO: 3119192 - DNA, 19 bp, Homo sapiens
ccatctgatgtttcatatt

SEQ ID NO: 3119193 - DNA, 17 bp, Homo sapiens
ccatctgcaccccttct

SEQ ID NO: 3119194 - DNA, 22 bp, Homo sapiens
ccatctgcaccccttctctcct

SEQ ID NO: 3119195 - DNA, 14 bp, Homo sapiens
ccatctgccacagg

SEQ ID NO: 3119196 - DNA, 13 bp, Homo sapiens
ccatctgcccagg

SEQ ID NO: 3119197 - DNA, 17 bp, Homo sapiens
ccatctgcccaggggtg

SEQ ID NO: 3119198 - DNA, 20 bp, Homo sapiens
ccatctgcctgttctgagga

SEQ ID NO: 3119199 - DNA, 19 bp, Homo sapiens
ccatctgcttggttggctg

SEQ ID NO: 3119200 - DNA, 12 bp, Homo sapiens
ccatctggcctg

SEQ ID NO: 3119201 - DNA, 19 bp, Homo sapiens
ccatcttccacctgtgccc

SEQ ID NO: 3119202 - DNA, 14 bp, Homo sapiens
ccatcttcctgctg

SEQ ID NO: 3119203 - DNA, 16 bp, Homo sapiens
ccatcttcctgctgct

SEQ ID NO: 3119204 - DNA, 22 bp, Homo sapiens
ccatcttgagatggtgaggctg

SEQ ID NO: 3119205 - DNA, 14 bp, Homo sapiens
ccatcttgctaata

SEQ ID NO: 3119206 - DNA, 16 bp, Homo sapiens
ccatcttgctaataaa

SEQ ID NO: 3119207 - DNA, 21 bp, Homo sapiens
ccatcttgcttccctaatcta

SEQ ID NO: 3119208 - DNA, 20 bp, Homo sapiens
ccatctttactcccaagact

SEQ ID NO: 3119209 - DNA, 16 bp, Homo sapiens
ccatcttttattcttt

SEQ ID NO: 3119210 - DNA, 21 bp, Homo sapiens
ccatgaaaacgttttattgtg

SEQ ID NO: 3119211 - DNA, 22 bp, Homo sapiens
ccatgaacagaaaacattctga

SEQ ID NO: 3119212 - DNA, 12 bp, Homo sapiens
ccatgaagacag

SEQ ID NO: 3119213 - DNA, 18 bp, Homo sapiens
ccatgaatgtatcaggaa

SEQ ID NO: 3119214 - DNA, 21 bp, Homo sapiens
ccatgacaggcctgaagatat

SEQ ID NO: 3119215 - DNA, 18 bp, Homo sapiens
ccatgacccacccctgtg

SEQ ID NO: 3119216 - DNA, 13 bp, Homo sapiens
ccatgactgcacc

SEQ ID NO: 3119217 - DNA, 14 bp, Homo sapiens
ccatgactgcaccc

SEQ ID NO: 3119218 - DNA, 16 bp, Homo sapiens
ccatgactgcacccag

SEQ ID NO: 3119219 - DNA, 16 bp, Homo sapiens
ccatgactggctgtct

SEQ ID NO: 3119220 - DNA, 22 bp, Homo sapiens
ccatgactggctgtctgcctgt

SEQ ID NO: 3119221 - DNA, 21 bp, Homo sapiens
ccatgagaagagggcctgtgg

SEQ ID NO: 3119222 - DNA, 22 bp, Homo sapiens
ccatgagaataagagaaagaaa

SEQ ID NO: 3119223 - DNA, 15 bp, Homo sapiens
ccatgagaccctggt

SEQ ID NO: 3119224 - DNA, 19 bp, Homo sapiens
ccatgagcctcagcatcct

SEQ ID NO: 3119225 - DNA, 17 bp, Homo sapiens
ccatgaggaaggaacag

SEQ ID NO: 3119226 - DNA, 17 bp, Homo sapiens
ccatgagggacagggtc

SEQ ID NO: 3119227 - DNA, 20 bp, Homo sapiens
ccatgagggacagggtcttt

SEQ ID NO: 3119228 - DNA, 18 bp, Homo sapiens
ccatgagtttgccctggt

SEQ ID NO: 3119229 - DNA, 14 bp, Homo sapiens
ccatgatccctgtg

SEQ ID NO: 3119230 - DNA, 16 bp, Homo sapiens
ccatgatccctgtgtt

SEQ ID NO: 3119231 - DNA, 17 bp, Homo sapiens
ccatgatccctgtgttg

SEQ ID NO: 3119232 - DNA, 17 bp, Homo sapiens
ccatgcaattcatccca

SEQ ID NO: 3119233 - DNA, 21 bp, Homo sapiens
ccatgcaccctcatacacaga

SEQ ID NO: 3119234 - DNA, 16 bp, Homo sapiens
ccatgcagccttgggg

SEQ ID NO: 3119235 - DNA, 18 bp, Homo sapiens
ccatgcaggaaggaaaac

SEQ ID NO: 3119236 - DNA, 14 bp, Homo sapiens
ccatgcaggccctt

SEQ ID NO: 3119237 - DNA, 17 bp, Homo sapiens
ccatgcaggccctttga

SEQ ID NO: 3119238 - DNA, 20 bp, Homo sapiens
ccatgccaaagctagggtgg

SEQ ID NO: 3119239 - DNA, 15 bp, Homo sapiens
ccatgccactgccag

SEQ ID NO: 3119240 - DNA, 16 bp, Homo sapiens
ccatgccactgccagg

SEQ ID NO: 3119241 - DNA, 17 bp, Homo sapiens
ccatgccactgccaggc

SEQ ID NO: 3119242 - DNA, 19 bp, Homo sapiens
ccatgccactgccaggcac

SEQ ID NO: 3119243 - DNA, 15 bp, Homo sapiens
ccatgccaggaacct

SEQ ID NO: 3119244 - DNA, 15 bp, Homo sapiens
ccatgcccacctgcc

SEQ ID NO: 3119245 - DNA, 13 bp, Homo sapiens
ccatgcccaggac

SEQ ID NO: 3119246 - DNA, 13 bp, Homo sapiens
ccatgccccagtc

SEQ ID NO: 3119247 - DNA, 14 bp, Homo sapiens
ccatgcctcatgcc

SEQ ID NO: 3119248 - DNA, 15 bp, Homo sapiens
ccatgcctcatgcca

SEQ ID NO: 3119249 - DNA, 18 bp, Homo sapiens
ccatgcctcatgccacac

SEQ ID NO: 3119250 - DNA, 12 bp, Homo sapiens
ccatgcctctgg

SEQ ID NO: 3119251 - DNA, 12 bp, Homo sapiens
ccatgcctgagg

SEQ ID NO: 3119252 - DNA, 15 bp, Homo sapiens
ccatgcctgagggtg

SEQ ID NO: 3119253 - DNA, 18 bp, Homo sapiens
ccatgcctgagggtggag

SEQ ID NO: 3119254 - DNA, 19 bp, Homo sapiens
ccatgcctggtcccaagac

SEQ ID NO: 3119255 - DNA, 23 bp, Homo sapiens
ccatgcctggtcccaagacagtg

SEQ ID NO: 3119256 - DNA, 18 bp, Homo sapiens
ccatgcctgtccagcctg

SEQ ID NO: 3119257 - DNA, 13 bp, Homo sapiens
ccatgcgctcagg

SEQ ID NO: 3119258 - DNA, 18 bp, Homo sapiens
ccatgcgtgccgcctgct

SEQ ID NO: 3119259 - DNA, 21 bp, Homo sapiens
ccatgcgtgccgcctgctcct

SEQ ID NO: 3119260 - DNA, 22 bp, Homo sapiens
ccatgctcctcactgcccgcac

SEQ ID NO: 3119261 - DNA, 15 bp, Homo sapiens
ccatgctctgcccca

SEQ ID NO: 3119262 - DNA, 19 bp, Homo sapiens
ccatgctgaggcctgggcc

SEQ ID NO: 3119263 - DNA, 20 bp, Homo sapiens
ccatgctgaggcctgggccg

SEQ ID NO: 3119264 - DNA, 22 bp, Homo sapiens
ccatgctgctttttggcacagt

SEQ ID NO: 3119265 - DNA, 16 bp, Homo sapiens
ccatgctgggaagacg

SEQ ID NO: 3119266 - DNA, 14 bp, Homo sapiens
ccatggacactcca

SEQ ID NO: 3119267 - DNA, 21 bp, Homo sapiens
ccatggacactccagtgccag

SEQ ID NO: 3119268 - DNA, 18 bp, Homo sapiens
ccatggagccagctccct

SEQ ID NO: 3119269 - DNA, 21 bp, Homo sapiens
ccatggatttcgtttttcttg

SEQ ID NO: 3119270 - DNA, 14 bp, Homo sapiens
ccatggccccaggc

SEQ ID NO: 3119271 - DNA, 15 bp, Homo sapiens
ccatggcccccaata

SEQ ID NO: 3119272 - DNA, 21 bp, Homo sapiens
ccatggcccccaataaaggca

SEQ ID NO: 3119273 - DNA, 22 bp, Homo sapiens
ccatggcccccaataaaggcag

SEQ ID NO: 3119274 - DNA, 13 bp, Homo sapiens
ccatggcctttct

SEQ ID NO: 3119275 - DNA, 17 bp, Homo sapiens
ccatggcctttctaata

SEQ ID NO: 3119276 - DNA, 21 bp, Homo sapiens
ccatggcgtgtccctctcgga

SEQ ID NO: 3119277 - DNA, 14 bp, Homo sapiens
ccatggctcaggca

SEQ ID NO: 3119278 - DNA, 21 bp, Homo sapiens
ccatgggaaatgtcaacaagt

SEQ ID NO: 3119279 - DNA, 16 bp, Homo sapiens
ccatgggatacaacct

SEQ ID NO: 3119280 - DNA, 14 bp, Homo sapiens
ccatgggatatgtg

SEQ ID NO: 3119281 - DNA, 17 bp, Homo sapiens
ccatgggccagcctagc

SEQ ID NO: 3119282 - DNA, 18 bp, Homo sapiens
ccatgggccagcctagcc

SEQ ID NO: 3119283 - DNA, 13 bp, Homo sapiens
ccatgggcctcct

SEQ ID NO: 3119284 - DNA, 14 bp, Homo sapiens
ccatgggcctcctg

SEQ ID NO: 3119285 - DNA, 17 bp, Homo sapiens
ccatgggcctcctgtgt

SEQ ID NO: 3119286 - DNA, 12 bp, Homo sapiens
ccatgggcctgg

SEQ ID NO: 3119287 - DNA, 17 bp, Homo sapiens
ccatgggctagtgtgag

SEQ ID NO: 3119288 - DNA, 20 bp, Homo sapiens
ccatgggctagtgtgagtgg

SEQ ID NO: 3119289 - DNA, 11 bp, Homo sapiens
ccatgggcttg

SEQ ID NO: 3119290 - DNA, 23 bp, Homo sapiens
ccatggtctttccactttcatct

SEQ ID NO: 3119291 - DNA, 16 bp, Homo sapiens
ccatgtacatgaagaa

SEQ ID NO: 3119292 - DNA, 17 bp, Homo sapiens
ccatgtactagttttag

SEQ ID NO: 3119293 - DNA, 14 bp, Homo sapiens
ccatgtactgtagt

SEQ ID NO: 3119294 - DNA, 22 bp, Homo sapiens
ccatgtagccccctggcctctg

SEQ ID NO: 3119295 - DNA, 23 bp, Homo sapiens
ccatgtagccccctggcctctgt

SEQ ID NO: 3119296 - DNA, 22 bp, Homo sapiens
ccatgtatttatctctatttaa

SEQ ID NO: 3119297 - DNA, 17 bp, Homo sapiens
ccatgtccaaagaggct

SEQ ID NO: 3119298 - DNA, 20 bp, Homo sapiens
ccatgtccaaagaggctgcc

SEQ ID NO: 3119299 - DNA, 21 bp, Homo sapiens
ccatgtccaagttcttcacct

SEQ ID NO: 3119300 - DNA, 16 bp, Homo sapiens
ccatgtcgcctctgca

SEQ ID NO: 3119301 - DNA, 17 bp, Homo sapiens
ccatgtcgcctctgcat

SEQ ID NO: 3119302 - DNA, 19 bp, Homo sapiens
ccatgtcgcctctgcattc

SEQ ID NO: 3119303 - DNA, 14 bp, Homo sapiens
ccatgtcgcttttg

SEQ ID NO: 3119304 - DNA, 20 bp, Homo sapiens
ccatgtctgcagtgtgcccc

SEQ ID NO: 3119305 - DNA, 16 bp, Homo sapiens
ccatgtgaacagcata

SEQ ID NO: 3119306 - DNA, 13 bp, Homo sapiens
ccatgtgagccac

SEQ ID NO: 3119307 - DNA, 17 bp, Homo sapiens
ccatgtgagccaccgct

SEQ ID NO: 3119308 - DNA, 13 bp, Homo sapiens
ccatgtgccaggt

SEQ ID NO: 3119309 - DNA, 20 bp, Homo sapiens
ccatgtgccatctgtacata

SEQ ID NO: 3119310 - DNA, 22 bp, Homo sapiens
ccatgtgccatctgtacatatt

SEQ ID NO: 3119311 - DNA, 17 bp, Homo sapiens
ccatgtggtggcacagg

SEQ ID NO: 3119312 - DNA, 13 bp, Homo sapiens
ccatgtgtacatt

SEQ ID NO: 3119313 - DNA, 12 bp, Homo sapiens
ccatgtgtcact

SEQ ID NO: 3119314 - DNA, 19 bp, Homo sapiens
ccatgtgtcacttgtgctt

SEQ ID NO: 3119315 - DNA, 20 bp, Homo sapiens
ccatgtgtcacttgtgcttt

SEQ ID NO: 3119316 - DNA, 15 bp, Homo sapiens
ccatgtgtcccctca

SEQ ID NO: 3119317 - DNA, 17 bp, Homo sapiens
ccatgtgtcccctcact

SEQ ID NO: 3119318 - DNA, 15 bp, Homo sapiens
ccaactactcagaag

SEQ ID NO: 3119319 - DNA, 13 bp, Homo sapiens
ccaactactgagc

SEQ ID NO: 3119320 - DNA, 18 bp, Homo sapiens
ccaactagacattctgtc

SEQ ID NO: 3119321 - DNA, 13 bp, Homo sapiens
ccaactccagcaa

SEQ ID NO: 3119322 - DNA, 22 bp, Homo sapiens
ccaactccgtgtggtaagcaac

SEQ ID NO: 3119323 - DNA, 17 bp, Homo sapiens
ccaactctaacaggcac

SEQ ID NO: 3119324 - DNA, 18 bp, Homo sapiens
ccaactctaacaggcact

SEQ ID NO: 3119325 - DNA, 13 bp, Homo sapiens
ccaactctcctgg

SEQ ID NO: 3119326 - DNA, 19 bp, Homo sapiens
ccaactgcaaaaaaagcct

SEQ ID NO: 3119327 - DNA, 21 bp, Homo sapiens
ccaactgcaaaaaaagcctcc

SEQ ID NO: 3119328 - DNA, 12 bp, Homo sapiens
ccaactgctgct

SEQ ID NO: 3119329 - DNA, 17 bp, Homo sapiens
ccaactgggcccaagac

SEQ ID NO: 3119330 - DNA, 13 bp, Homo sapiens
ccaactgtgagca

SEQ ID NO: 3119331 - DNA, 18 bp, Homo sapiens
ccaactgtgttcattaga

SEQ ID NO: 3119332 - DNA, 20 bp, Homo sapiens
ccaactgtgttgtattaaca

SEQ ID NO: 3119333 - DNA, 21 bp, Homo sapiens
ccaacttcatttgatgctaaa

SEQ ID NO: 3119334 - DNA, 20 bp, Homo sapiens
ccaacttgagggcccagagc

SEQ ID NO: 3119335 - DNA, 21 bp, Homo sapiens
ccaacttgagggcccagagca

SEQ ID NO: 3119336 - DNA, 11 bp, Homo sapiens
ccaacttgtaa

SEQ ID NO: 3119337 - DNA, 17 bp, Homo sapiens
ccaacttgtaaatacac

SEQ ID NO: 3119338 - DNA, 22 bp, Homo sapiens
ccaagaaagatgaatacatttt

SEQ ID NO: 3119339 - DNA, 13 bp, Homo sapiens
ccaagaaagcagg

SEQ ID NO: 3119340 - DNA, 14 bp, Homo sapiens
ccaagaactgcatg

SEQ ID NO: 3119341 - DNA, 18 bp, Homo sapiens
ccaagaatccacatttct

SEQ ID NO: 3119342 - DNA, 19 bp, Homo sapiens
ccaagacagatgccccaga

SEQ ID NO: 3119343 - DNA, 21 bp, Homo sapiens
ccaagacagatgccccagagc

SEQ ID NO: 3119344 - DNA, 22 bp, Homo sapiens
ccaagacagatgccccagagct

SEQ ID NO: 3119345 - DNA, 21 bp, Homo sapiens
ccaagacatgtctgttctaca

SEQ ID NO: 3119346 - DNA, 17 bp, Homo sapiens
ccaagacattgtcaata

SEQ ID NO: 3119347 - DNA, 17 bp, Homo sapiens
ccaagactcctcaggca

SEQ ID NO: 3119348 - DNA, 22 bp, Homo sapiens
ccaagactctagagtccaaggt

SEQ ID NO: 3119349 - DNA, 19 bp, Homo sapiens
ccaagacttcattgtccct

SEQ ID NO: 3119350 - DNA, 23 bp, Homo sapiens
ccaagagaactcgcgctcagtaa

SEQ ID NO: 3119351 - DNA, 12 bp, Homo sapiens
ccaagagagaaa

SEQ ID NO: 3119352 - DNA, 13 bp, Homo sapiens
ccaagagagaaag

SEQ ID NO: 3119353 - DNA, 14 bp, Homo sapiens
ccaagagagaaaga

SEQ ID NO: 3119354 - DNA, 20 bp, Homo sapiens
ccaagagagggccatgcaat

SEQ ID NO: 3119355 - DNA, 14 bp, Homo sapiens
ccaagagatgaaga

SEQ ID NO: 3119356 - DNA, 15 bp, Homo sapiens
ccaagagcagagtct

SEQ ID NO: 3119357 - DNA, 17 bp, Homo sapiens
ccaagaggactgagact

SEQ ID NO: 3119358 - DNA, 15 bp, Homo sapiens
ccaagaggtctgagc

SEQ ID NO: 3119359 - DNA, 16 bp, Homo sapiens
ccaagaggtctgagcc

SEQ ID NO: 3119360 - DNA, 17 bp, Homo sapiens
ccaagaggtctgagccc

SEQ ID NO: 3119361 - DNA, 11 bp, Homo sapiens
ccaagagtcta

SEQ ID NO: 3119362 - DNA, 21 bp, Homo sapiens
ccaagatctacaggacaaagg

SEQ ID NO: 3119363 - DNA, 13 bp, Homo sapiens
ccaagattccgga

SEQ ID NO: 3119364 - DNA, 13 bp, Homo sapiens
ccaagattctaga

SEQ ID NO: 3119365 - DNA, 14 bp, Homo sapiens
ccaagattctagat

SEQ ID NO: 3119366 - DNA, 20 bp, Homo sapiens
ccaagattttcctcttgtga

SEQ ID NO: 3119367 - DNA, 14 bp, Homo sapiens
ccaagcaaaccaat

SEQ ID NO: 3119368 - DNA, 22 bp, Homo sapiens
ccaagcaagtagctttccacat

SEQ ID NO: 3119369 - DNA, 22 bp, Homo sapiens
ccaagcacctccaaccaaataa

SEQ ID NO: 3119370 - DNA, 19 bp, Homo sapiens
ccaagcactttcagtccaa

SEQ ID NO: 3119371 - DNA, 11 bp, Homo sapiens
ccaagcagcca

SEQ ID NO: 3119372 - DNA, 13 bp, Homo sapiens
ccaagcagccagc

SEQ ID NO: 3119373 - DNA, 14 bp, Homo sapiens
ccaagcaggagacg

SEQ ID NO: 3119374 - DNA, 13 bp, Homo sapiens
ccaagcatagaga

SEQ ID NO: 3119375 - DNA, 18 bp, Homo sapiens
ccaagccaagggaacctg

SEQ ID NO: 3119376 - DNA, 20 bp, Homo sapiens
ccaagccaagggaacctgtg

SEQ ID NO: 3119377 - DNA, 19 bp, Homo sapiens
ccaagccagattctcttga

SEQ ID NO: 3119378 - DNA, 18 bp, Homo sapiens
ccaagccattcacttccc

SEQ ID NO: 3119379 - DNA, 13 bp, Homo sapiens
ccaagccccatct

SEQ ID NO: 3119380 - DNA, 15 bp, Homo sapiens
ccaagccccccgagt

SEQ ID NO: 3119381 - DNA, 23 bp, Homo sapiens
ccaagccctgaggcctgaggcct

SEQ ID NO: 3119382 - DNA, 14 bp, Homo sapiens
ccaagcctccacag

SEQ ID NO: 3119383 - DNA, 18 bp, Homo sapiens
ccaagcctccacagcgag

SEQ ID NO: 3119384 - DNA, 19 bp, Homo sapiens
ccaagcctccacagcgagg

SEQ ID NO: 3119385 - DNA, 20 bp, Homo sapiens
ccaagcctccacagcgaggg

SEQ ID NO: 3119386 - DNA, 15 bp, Homo sapiens
ccaagcctgctggct

SEQ ID NO: 3119387 - DNA, 16 bp, Homo sapiens
ccaagcctgctggctg

SEQ ID NO: 3119388 - DNA, 18 bp, Homo sapiens
ccaagcctgctggctgcg

SEQ ID NO: 3119389 - DNA, 17 bp, Homo sapiens
ccaagctaagcactgcc

SEQ ID NO: 3119390 - DNA, 13 bp, Homo sapiens
ccaagctccaagc

SEQ ID NO: 3119391 - DNA, 17 bp, Homo sapiens
ccaagctccctgcccca

SEQ ID NO: 3119392 - DNA, 22 bp, Homo sapiens
ccaagctccctgccccaaataa

SEQ ID NO: 3119393 - DNA, 14 bp, Homo sapiens
ccaagctccctgga

SEQ ID NO: 3119394 - DNA, 20 bp, Homo sapiens
ccaagctccctggagccctg

SEQ ID NO: 3119395 - DNA, 22 bp, Homo sapiens
ccaagctcctcctcggaaccgc

SEQ ID NO: 3119396 - DNA, 12 bp, Homo sapiens
ccaagctctgct

SEQ ID NO: 3119397 - DNA, 15 bp, Homo sapiens
ccaagctgagtttcc

SEQ ID NO: 3119398 - DNA, 17 bp, Homo sapiens
ccaagctgcctctgggc

SEQ ID NO: 3119399 - DNA, 19 bp, Homo sapiens
ccaagctgcctctgggcca

SEQ ID NO: 3119400 - DNA, 12 bp, Homo sapiens
ccaagctgcggg

SEQ ID NO: 3119401 - DNA, 12 bp, Homo sapiens
ccaagctggtcc

SEQ ID NO: 3119402 - DNA, 20 bp, Homo sapiens
ccaagctggtcccactcagt

SEQ ID NO: 3119403 - DNA, 21 bp, Homo sapiens
ccaagcttaatagccctcccc

SEQ ID NO: 3119404 - DNA, 17 bp, Homo sapiens
ccaagcttgttatcagc

SEQ ID NO: 3119405 - DNA, 22 bp, Homo sapiens
ccaaggaaacgctacctctctg

SEQ ID NO: 3119406 - DNA, 15 bp, Homo sapiens
ccaaggactgactga

SEQ ID NO: 3119407 - DNA, 19 bp, Homo sapiens
ccaaggactgactgagaca

SEQ ID NO: 3119408 - DNA, 15 bp, Homo sapiens
ccaaggagaaacaga

SEQ ID NO: 3119409 - DNA, 12 bp, Homo sapiens
ccaaggagacca

SEQ ID NO: 3119410 - DNA, 14 bp, Homo sapiens
ccaaggagcacagg

SEQ ID NO: 3119411 - DNA, 15 bp, Homo sapiens
ccaaggatcctctcc

SEQ ID NO: 3119412 - DNA, 17 bp, Homo sapiens
ccaaggcaaggcaggtg

SEQ ID NO: 3119413 - DNA, 13 bp, Homo sapiens
ccaaggccaggtt

SEQ ID NO: 3119414 - DNA, 18 bp, Homo sapiens
ccaaggccgaagctctgg

SEQ ID NO: 3119415 - DNA, 16 bp, Homo sapiens
ccaaggctctgagcaa

SEQ ID NO: 3119416 - DNA, 17 bp, Homo sapiens
ccaagggaaaggggtgc

SEQ ID NO: 3119417 - DNA, 22 bp, Homo sapiens
ccaagggaaaggggtgctttta

SEQ ID NO: 3119418 - DNA, 16 bp, Homo sapiens
ccaagggaacctgtgt

SEQ ID NO: 3119419 - DNA, 15 bp, Homo sapiens
ccaagggcagaaagt

SEQ ID NO: 3119420 - DNA, 14 bp, Homo sapiens
ccaagggccctggc

SEQ ID NO: 3119421 - DNA, 22 bp, Homo sapiens
ccaagggcctcccaccagagac

SEQ ID NO: 3119422 - DNA, 18 bp, Homo sapiens
ccaaggggtgggccacag

SEQ ID NO: 3119423 - DNA, 14 bp, Homo sapiens
ccaaggtcctctca

SEQ ID NO: 3119424 - DNA, 16 bp, Homo sapiens
ccaaggtcctctcagt

SEQ ID NO: 3119425 - DNA, 15 bp, Homo sapiens
ccaaggtgccaccac

SEQ ID NO: 3119426 - DNA, 18 bp, Homo sapiens
ccaaggtgggctgagccc

SEQ ID NO: 3119427 - DNA, 20 bp, Homo sapiens
ccaaggtttaaagagtctag

SEQ ID NO: 3119428 - DNA, 19 bp, Homo sapiens
ccaaggttttataaggctg

SEQ ID NO: 3119429 - DNA, 20 bp, Homo sapiens
ccaaggttttataaggctga

SEQ ID NO: 3119430 - DNA, 16 bp, Homo sapiens
ccaagtaatataatgg

SEQ ID NO: 3119431 - DNA, 20 bp, Homo sapiens
ccaagtagtctgctcacagt

SEQ ID NO: 3119432 - DNA, 16 bp, Homo sapiens
ccaagtcagacagatg

SEQ ID NO: 3119433 - DNA, 23 bp, Homo sapiens
ccaagtccctgttttctgagccc

SEQ ID NO: 3119434 - DNA, 21 bp, Homo sapiens
ccacagagagggagagcagag

SEQ ID NO: 3119435 - DNA, 13 bp, Homo sapiens
ccacagagagtcc

SEQ ID NO: 3119436 - DNA, 18 bp, Homo sapiens
ccacagagagtcccactg

SEQ ID NO: 3119437 - DNA, 19 bp, Homo sapiens
ccacagagagtcccactgc

SEQ ID NO: 3119438 - DNA, 19 bp, Homo sapiens
ccacagagtgagccagtga

SEQ ID NO: 3119439 - DNA, 18 bp, Homo sapiens
ccacagagtgctggactg

SEQ ID NO: 3119440 - DNA, 18 bp, Homo sapiens
ccacagcagcagaacaag

SEQ ID NO: 3119441 - DNA, 18 bp, Homo sapiens
ccacagccagcacctggc

SEQ ID NO: 3119442 - DNA, 15 bp, Homo sapiens
ccacagccgcagcct

SEQ ID NO: 3119443 - DNA, 18 bp, Homo sapiens
ccacagccgcctttgggt

SEQ ID NO: 3119444 - DNA, 20 bp, Homo sapiens
ccacagccgcctttgggttc

SEQ ID NO: 3119445 - DNA, 19 bp, Homo sapiens
ccacagcgagggcagctgc

SEQ ID NO: 3119446 - DNA, 11 bp, Homo sapiens
ccacagctacc

SEQ ID NO: 3119447 - DNA, 14 bp, Homo sapiens
ccacaggaaagtgt

SEQ ID NO: 3119448 - DNA, 22 bp, Homo sapiens
ccacaggaagcctgcagtcctg

SEQ ID NO: 3119449 - DNA, 21 bp, Homo sapiens
ccacaggaggcaagcaagctc

SEQ ID NO: 3119450 - DNA, 22 bp, Homo sapiens
ccacaggcccttcctctccact

SEQ ID NO: 3119451 - DNA, 12 bp, Homo sapiens
ccacaggcctcc

SEQ ID NO: 3119452 - DNA, 15 bp, Homo sapiens
ccacagggccagagg

SEQ ID NO: 3119453 - DNA, 17 bp, Homo sapiens
ccacagggccagaggga

SEQ ID NO: 3119454 - DNA, 17 bp, Homo sapiens
cattgccattccctgcc

SEQ ID NO: 3119455 - DNA, 18 bp, Homo sapiens
cattgcccccacctctgg

SEQ ID NO: 3119456 - DNA, 23 bp, Homo sapiens
cattgcctcttttcacatttttt

SEQ ID NO: 3119457 - DNA, 17 bp, Homo sapiens
cattgcctggccttcct

SEQ ID NO: 3119458 - DNA, 16 bp, Homo sapiens
cattgcggccccagga

SEQ ID NO: 3119459 - DNA, 18 bp, Homo sapiens
cattgcggccccaggagg

SEQ ID NO: 3119460 - DNA, 19 bp, Homo sapiens
cattgcggccccaggaggg

SEQ ID NO: 3119461 - DNA, 17 bp, Homo sapiens
cattgctctctgggctt

SEQ ID NO: 3119462 - DNA, 13 bp, Homo sapiens
cattgctgctgct

SEQ ID NO: 3119463 - DNA, 15 bp, Homo sapiens
cattgctgctgctac

SEQ ID NO: 3119464 - DNA, 21 bp, Homo sapiens
cattgctgctgctaccagcgc

SEQ ID NO: 3119465 - DNA, 17 bp, Homo sapiens
cattgctggtagagacc

SEQ ID NO: 3119466 - DNA, 22 bp, Homo sapiens
cattgctggtagagacccccag

SEQ ID NO: 3119467 - DNA, 23 bp, Homo sapiens
cattgctggtagagacccccagg

SEQ ID NO: 3119468 - DNA, 20 bp, Homo sapiens
cattgctgtaccacatctgc

SEQ ID NO: 3119469 - DNA, 15 bp, Homo sapiens
cattgctttctgaaa

SEQ ID NO: 3119470 - DNA, 18 bp, Homo sapiens
cattgctttgaagcagtt

SEQ ID NO: 3119471 - DNA, 15 bp, Homo sapiens
cattgcttttatttt

SEQ ID NO: 3119472 - DNA, 19 bp, Homo sapiens
cattgcttttattttgaaa

SEQ ID NO: 3119473 - DNA, 21 bp, Homo sapiens
cattgcttttattttgaaaag

SEQ ID NO: 3119474 - DNA, 22 bp, Homo sapiens
cattggaataaggcatggctca

SEQ ID NO: 3119475 - DNA, 18 bp, Homo sapiens
cattggacccacatgagg

SEQ ID NO: 3119476 - DNA, 20 bp, Homo sapiens
cattggatttttgttaattt

SEQ ID NO: 3119477 - DNA, 18 bp, Homo sapiens
cattggcaagatgaaata

SEQ ID NO: 3119478 - DNA, 18 bp, Homo sapiens
cattggccagctcataaa

SEQ ID NO: 3119479 - DNA, 20 bp, Homo sapiens
cattggccagctcataaaat

SEQ ID NO: 3119480 - DNA, 16 bp, Homo sapiens
cattgggaccctccag

SEQ ID NO: 3119481 - DNA, 17 bp, Homo sapiens
cattgggaccctccagt

SEQ ID NO: 3119482 - DNA, 20 bp, Homo sapiens
cattgggaccctccagtgct

SEQ ID NO: 3119483 - DNA, 23 bp, Homo sapiens
cattgggaccctccagtgctgga

SEQ ID NO: 3119484 - DNA, 19 bp, Homo sapiens
cattggggggccgggcagg

SEQ ID NO: 3119485 - DNA, 23 bp, Homo sapiens
cattggggtagttgtgtttcaac

SEQ ID NO: 3119486 - DNA, 13 bp, Homo sapiens
cattggtccaaga

SEQ ID NO: 3119487 - DNA, 14 bp, Homo sapiens
cattggtgactcac

SEQ ID NO: 3119488 - DNA, 23 bp, Homo sapiens
cattgtaaacaaactcttgaaga

SEQ ID NO: 3119489 - DNA, 21 bp, Homo sapiens
cattgtaaatatttactcttt

SEQ ID NO: 3119490 - DNA, 16 bp, Homo sapiens
cattgtaatgttactg

SEQ ID NO: 3119491 - DNA, 18 bp, Homo sapiens
cattgtaatgttactgat

SEQ ID NO: 3119492 - DNA, 15 bp, Homo sapiens
cattgtactacctgt

SEQ ID NO: 3119493 - DNA, 14 bp, Homo sapiens
cattgtagaaacac

SEQ ID NO: 3119494 - DNA, 14 bp, Homo sapiens
cattgtatatgtga

SEQ ID NO: 3119495 - DNA, 20 bp, Homo sapiens
cattgtatgatgtgttgtga

SEQ ID NO: 3119496 - DNA, 18 bp, Homo sapiens
cattgtcaataaggagca

SEQ ID NO: 3119497 - DNA, 17 bp, Homo sapiens
cattgtccctcttcact

SEQ ID NO: 3119498 - DNA, 20 bp, Homo sapiens
cattgtccctcttcactccc

SEQ ID NO: 3119499 - DNA, 22 bp, Homo sapiens
cattgtcttgttctgtcccttc

SEQ ID NO: 3119500 - DNA, 21 bp, Homo sapiens
cattgtctttatatgaacata

SEQ ID NO: 3119501 - DNA, 15 bp, Homo sapiens
cattgtctttgctgt

SEQ ID NO: 3119502 - DNA, 19 bp, Homo sapiens
cattgtctttgctgtactc

SEQ ID NO: 3119503 - DNA, 20 bp, Homo sapiens
cattgtctttgctgtactct

SEQ ID NO: 3119504 - DNA, 16 bp, Homo sapiens
cattgtgaagcaccta

SEQ ID NO: 3119505 - DNA, 16 bp, Homo sapiens
cattgtgattggcctg

SEQ ID NO: 3119506 - DNA, 22 bp, Homo sapiens
cattgtgtcagaaacatgaaat

SEQ ID NO: 3119507 - DNA, 19 bp, Homo sapiens
cattgttattgtggaagat

SEQ ID NO: 3119508 - DNA, 21 bp, Homo sapiens
cattgttgaggtggtctgaat

SEQ ID NO: 3119509 - DNA, 16 bp, Homo sapiens
cattgttgctccctgt

SEQ ID NO: 3119510 - DNA, 16 bp, Homo sapiens
cattgttgtgtctgtg

SEQ ID NO: 3119511 - DNA, 14 bp, Homo sapiens
cattgtttgctgct

SEQ ID NO: 3119512 - DNA, 16 bp, Homo sapiens
cattgtttgctgctat

SEQ ID NO: 3119513 - DNA, 18 bp, Homo sapiens
cattgtttgcttattgtt

SEQ ID NO: 3119514 - DNA, 22 bp, Homo sapiens
cattgtttgcttattgttccaa

SEQ ID NO: 3119515 - DNA, 22 bp, Homo sapiens
cattgtttgtctgtcttcatag

SEQ ID NO: 3119516 - DNA, 18 bp, Homo sapiens
cattgttttgaatattac

SEQ ID NO: 3119517 - DNA, 19 bp, Homo sapiens
cattgttttgaatattact

SEQ ID NO: 3119518 - DNA, 17 bp, Homo sapiens
catttaaaacagacact

SEQ ID NO: 3119519 - DNA, 23 bp, Homo sapiens
catttaaaacagacactggcatg

SEQ ID NO: 3119520 - DNA, 15 bp, Homo sapiens
catttaaaatgatta

SEQ ID NO: 3119521 - DNA, 15 bp, Homo sapiens
catttaaaattgcta

SEQ ID NO: 3119522 - DNA, 18 bp, Homo sapiens
catttaaattttttggca

SEQ ID NO: 3119523 - DNA, 17 bp, Homo sapiens
catttaacttttctacc

SEQ ID NO: 3119524 - DNA, 14 bp, Homo sapiens
catttaataaagat

SEQ ID NO: 3119525 - DNA, 17 bp, Homo sapiens
catttaataaagatgag

SEQ ID NO: 3119526 - DNA, 21 bp, Homo sapiens
catttacaccacactttcaaa

SEQ ID NO: 3119527 - DNA, 16 bp, Homo sapiens
catttacagtctcttt

SEQ ID NO: 3119528 - DNA, 15 bp, Homo sapiens
catttacatgtcatt

SEQ ID NO: 3119529 - DNA, 16 bp, Homo sapiens
catttacatgttttaa

SEQ ID NO: 3119530 - DNA, 17 bp, Homo sapiens
catttactaaacatatg

SEQ ID NO: 3119531 - DNA, 13 bp, Homo sapiens
catttactgacca

SEQ ID NO: 3119532 - DNA, 17 bp, Homo sapiens
catttactttgtgttca

SEQ ID NO: 3119533 - DNA, 21 bp, Homo sapiens
catttactttgtgttcacctt

SEQ ID NO: 3119534 - DNA, 15 bp, Homo sapiens
catttacttttaata

SEQ ID NO: 3119535 - DNA, 13 bp, Homo sapiens
catttagaagaaa

SEQ ID NO: 3119536 - DNA, 23 bp, Homo sapiens
catttagagaactgtggccgtta

SEQ ID NO: 3119537 - DNA, 12 bp, Homo sapiens
catttagataat

SEQ ID NO: 3119538 - DNA, 15 bp, Homo sapiens
catttagataatttg

SEQ ID NO: 3119539 - DNA, 16 bp, Homo sapiens
catttagataatttga

SEQ ID NO: 3119540 - DNA, 21 bp, Homo sapiens
catttagataatttgaaaaag

SEQ ID NO: 3119541 - DNA, 22 bp, Homo sapiens
catttagatcctggtttcataa

SEQ ID NO: 3119542 - DNA, 15 bp, Homo sapiens
catttagcaataaat

SEQ ID NO: 3119543 - DNA, 18 bp, Homo sapiens
catttagcaataaataac

SEQ ID NO: 3119544 - DNA, 21 bp, Homo sapiens
catttagcttgttccactgca

SEQ ID NO: 3119545 - DNA, 14 bp, Homo sapiens
catttagtaagaat

SEQ ID NO: 3119546 - DNA, 15 bp, Homo sapiens
catttagtcatgtga

SEQ ID NO: 3119547 - DNA, 15 bp, Homo sapiens
catttagtcctgtac

SEQ ID NO: 3119548 - DNA, 23 bp, Homo sapiens
catttataaccccagcctgacct

SEQ ID NO: 3119549 - DNA, 12 bp, Homo sapiens
catttatacaaa

SEQ ID NO: 3119550 - DNA, 19 bp, Homo sapiens
catttatacaaattagaaa

SEQ ID NO: 3119551 - DNA, 20 bp, Homo sapiens
catttatacaaattagaaaa

SEQ ID NO: 3119552 - DNA, 15 bp, Homo sapiens
catttatatattgaa

SEQ ID NO: 3119553 - DNA, 16 bp, Homo sapiens
catttatatttgtgta

SEQ ID NO: 3119554 - DNA, 18 bp, Homo sapiens
catttatgatttaataaa

SEQ ID NO: 3119555 - DNA, 14 bp, Homo sapiens
catttatgtttatt

SEQ ID NO: 3119556 - DNA, 16 bp, Homo sapiens
catttattctgctcac

SEQ ID NO: 3119557 - DNA, 13 bp, Homo sapiens
catttattgttta

SEQ ID NO: 3119558 - DNA, 23 bp, Homo sapiens
catttatttatacagtgccttgc

SEQ ID NO: 3119559 - DNA, 15 bp, Homo sapiens
catttattttaagca

SEQ ID NO: 3119560 - DNA, 19 bp, Homo sapiens
catttatttttagttaaaa

SEQ ID NO: 3119561 - DNA, 21 bp, Homo sapiens
catttatttttagttaaaaat

SEQ ID NO: 3119562 - DNA, 18 bp, Homo sapiens
catttcaaatgtgctgtc

SEQ ID NO: 3119563 - DNA, 12 bp, Homo sapiens
catttcaatcat

SEQ ID NO: 3119564 - DNA, 13 bp, Homo sapiens
catttcacattaa

SEQ ID NO: 3119565 - DNA, 16 bp, Homo sapiens
catttcacattgaatc

SEQ ID NO: 3119566 - DNA, 14 bp, Homo sapiens
catttcaggaattt

SEQ ID NO: 3119567 - DNA, 16 bp, Homo sapiens
catttcagtggcttcc

SEQ ID NO: 3119568 - DNA, 15 bp, Homo sapiens
catttcatacaacag

SEQ ID NO: 3119569 - DNA, 16 bp, Homo sapiens
catttcatacaacaga

SEQ ID NO: 3119570 - DNA, 18 bp, Homo sapiens
catttcatcattgtttct

SEQ ID NO: 3119571 - DNA, 15 bp, Homo sapiens
catttcattcctaac

SEQ ID NO: 3119572 - DNA, 22 bp, Homo sapiens
catttccaacaccacagacaca

SEQ ID NO: 3119573 - DNA, 14 bp, Homo sapiens
catttccattgctt

SEQ ID NO: 3119574 - DNA, 14 bp, Homo sapiens
catttcccatctgc

SEQ ID NO: 3119575 - DNA, 15 bp, Homo sapiens
catttcccatctgca

SEQ ID NO: 3119576 - DNA, 20 bp, Homo sapiens
catttcccatctgcacccct

SEQ ID NO: 3119577 - DNA, 14 bp, Homo sapiens
catttccccctcct

SEQ ID NO: 3119578 - DNA, 15 bp, Homo sapiens
catttccgaataaag

SEQ ID NO: 3119579 - DNA, 12 bp, Homo sapiens
catttcctgtgt

SEQ ID NO: 3119580 - DNA, 13 bp, Homo sapiens
catttctaattaa

SEQ ID NO: 3119581 - DNA, 23 bp, Homo sapiens
catttctaattaaccttactaat

SEQ ID NO: 3119582 - DNA, 23 bp, Homo sapiens
catttctatttatttactgagct

SEQ ID NO: 3119583 - DNA, 12 bp, Homo sapiens
catttctcactg

SEQ ID NO: 3119584 - DNA, 13 bp, Homo sapiens
catttctcactga

SEQ ID NO: 3119585 - DNA, 21 bp, Homo sapiens
catttctctaactcctgccat

SEQ ID NO: 3119586 - DNA, 17 bp, Homo sapiens
catttctgaactgttac

SEQ ID NO: 3119587 - DNA, 17 bp, Homo sapiens
catttctgaatagaaat

SEQ ID NO: 3119588 - DNA, 23 bp, Homo sapiens
catttcttcagtcagaaaacttt

SEQ ID NO: 3119589 - DNA, 16 bp, Homo sapiens
catttgaaagaggagt

SEQ ID NO: 3119590 - DNA, 22 bp, Homo sapiens
catttgaacctggatccagcac

SEQ ID NO: 3119591 - DNA, 15 bp, Homo sapiens
catttgagagaagcc

SEQ ID NO: 3119592 - DNA, 19 bp, Homo sapiens
catttgatgcatgtctttt

SEQ ID NO: 3119593 - DNA, 15 bp, Homo sapiens
catttgatgctaaat

SEQ ID NO: 3119594 - DNA, 21 bp, Homo sapiens
catttgcaatatggatttctt

SEQ ID NO: 3119595 - DNA, 15 bp, Homo sapiens
catttgcaccctccg

SEQ ID NO: 3119596 - DNA, 22 bp, Homo sapiens
catttgcagggtcctcttctgg

SEQ ID NO: 3119597 - DNA, 15 bp, Homo sapiens
catttgccttgcaga

SEQ ID NO: 3119598 - DNA, 21 bp, Homo sapiens
catttgccttgcagaactgcc

SEQ ID NO: 3119599 - DNA, 17 bp, Homo sapiens
catttgcctttctggga

SEQ ID NO: 3119600 - DNA, 20 bp, Homo sapiens
catttgcctttctgggagca

SEQ ID NO: 3119601 - DNA, 15 bp, Homo sapiens
catttggattggatg

SEQ ID NO: 3119602 - DNA, 18 bp, Homo sapiens
catttgggagacatgtga

SEQ ID NO: 3119603 - DNA, 22 bp, Homo sapiens
catttggtgagagtcaaagctg

SEQ ID NO: 3119604 - DNA, 20 bp, Homo sapiens
catttggtgctggtctattt

SEQ ID NO: 3119605 - DNA, 19 bp, Homo sapiens
catttggtgttcctggaag

SEQ ID NO: 3119606 - DNA, 20 bp, Homo sapiens
catttggttcattaattcta

SEQ ID NO: 3119607 - DNA, 11 bp, Homo sapiens
catttgtaaaa

SEQ ID NO: 3119608 - DNA, 14 bp, Homo sapiens
catttgtaaatgct

SEQ ID NO: 3119609 - DNA, 16 bp, Homo sapiens
catttgtaataaagta

SEQ ID NO: 3119610 - DNA, 12 bp, Homo sapiens
catttgtacaag

SEQ ID NO: 3119611 - DNA, 23 bp, Homo sapiens
catttgtacaaggtaattgtttt

SEQ ID NO: 3119612 - DNA, 22 bp, Homo sapiens
catttgtacagaattttggaag

SEQ ID NO: 3119613 - DNA, 14 bp, Homo sapiens
catttgtatattgt

SEQ ID NO: 3119614 - DNA, 18 bp, Homo sapiens
catttgtattgcttattt

SEQ ID NO: 3119615 - DNA, 15 bp, Homo sapiens
catttgtctttttat

SEQ ID NO: 3119616 - DNA, 11 bp, Homo sapiens
catttgtgagg

SEQ ID NO: 3119617 - DNA, 16 bp, Homo sapiens
catttgtgctagaaat

SEQ ID NO: 3119618 - DNA, 21 bp, Homo sapiens
catttgtgctagaaattttca

SEQ ID NO: 3119619 - DNA, 20 bp, Homo sapiens
catttgtgctccattttttc

SEQ ID NO: 3119620 - DNA, 18 bp, Homo sapiens
catttgttaaaattatca

SEQ ID NO: 3119621 - DNA, 22 bp, Homo sapiens
catttgttaaaattatcaatat

SEQ ID NO: 3119622 - DNA, 18 bp, Homo sapiens
catttgttggtaactaat

SEQ ID NO: 3119623 - DNA, 18 bp, Homo sapiens
catttgttgtgatgtctt

SEQ ID NO: 3119624 - DNA, 20 bp, Homo sapiens
catttgttgtgatgtctttt

SEQ ID NO: 3119625 - DNA, 16 bp, Homo sapiens
catttgtttttctcac

SEQ ID NO: 3119626 - DNA, 15 bp, Homo sapiens
catttgttttttcaa

SEQ ID NO: 3119627 - DNA, 13 bp, Homo sapiens
cattttaaaaaca

SEQ ID NO: 3119628 - DNA, 13 bp, Homo sapiens
cattttaaaaagt

SEQ ID NO: 3119629 - DNA, 16 bp, Homo sapiens
cattttaaaggataat

SEQ ID NO: 3119630 - DNA, 16 bp, Homo sapiens
cattttaaataaaaga

SEQ ID NO: 3119631 - DNA, 17 bp, Homo sapiens
cattttaacgctgccta

SEQ ID NO: 3119632 - DNA, 14 bp, Homo sapiens
cattttaattctct

SEQ ID NO: 3119633 - DNA, 14 bp, Homo sapiens
cattttagtgactg

SEQ ID NO: 3119634 - DNA, 15 bp, Homo sapiens
cattttagtgactgt

SEQ ID NO: 3119635 - DNA, 15 bp, Homo sapiens
cattttatatttaaa

SEQ ID NO: 3119636 - DNA, 22 bp, Homo sapiens
cattttatatttttgtacatat

SEQ ID NO: 3119637 - DNA, 11 bp, Homo sapiens
cattttatgca

SEQ ID NO: 3119638 - DNA, 16 bp, Homo sapiens
cattttcaccccaccc

SEQ ID NO: 3119639 - DNA, 17 bp, Homo sapiens
cattttcaccccaccct

SEQ ID NO: 3119640 - DNA, 15 bp, Homo sapiens
cattttcatcactgg

SEQ ID NO: 3119641 - DNA, 16 bp, Homo sapiens
cattttcatgcttcca

SEQ ID NO: 3119642 - DNA, 16 bp, Homo sapiens
cattttcccatcatcc

SEQ ID NO: 3119643 - DNA, 19 bp, Homo sapiens
cattttctgacatgcattg

SEQ ID NO: 3119644 - DNA, 20 bp, Homo sapiens
cattttcttgtatgatagtg

SEQ ID NO: 3119645 - DNA, 17 bp, Homo sapiens
cattttcttttttaacc

SEQ ID NO: 3119646 - DNA, 13 bp, Homo sapiens
cattttgcaaaat

SEQ ID NO: 3119647 - DNA, 18 bp, Homo sapiens
cattttgcagcagtgagt

SEQ ID NO: 3119648 - DNA, 22 bp, Homo sapiens
cattttggaagttttcaggact

SEQ ID NO: 3119649 - DNA, 20 bp, Homo sapiens
cattttgggggtttttaatc

SEQ ID NO: 3119650 - DNA, 21 bp, Homo sapiens
cattttggggtacccactgct

SEQ ID NO: 3119651 - DNA, 22 bp, Homo sapiens
cattttggggtacccactgctc

SEQ ID NO: 3119652 - DNA, 22 bp, Homo sapiens
cattttggtttatttttgtaat

SEQ ID NO: 3119653 - DNA, 20 bp, Homo sapiens
cattttggttttgtgttttg

SEQ ID NO: 3119654 - DNA, 15 bp, Homo sapiens
cattttgttcttaca

SEQ ID NO: 3119655 - DNA, 21 bp, Homo sapiens
cattttgttcttacacataca

SEQ ID NO: 3119656 - DNA, 12 bp, Homo sapiens
cattttgttgta

SEQ ID NO: 3119657 - DNA, 13 bp, Homo sapiens
cattttgttgtaa

SEQ ID NO: 3119658 - DNA, 14 bp, Homo sapiens
cattttgttgtaaa

SEQ ID NO: 3119659 - DNA, 20 bp, Homo sapiens
cattttgttgtaaaaagaaa

SEQ ID NO: 3119660 - DNA, 23 bp, Homo sapiens
cattttgttgtaaaaagaaaaac

SEQ ID NO: 3119661 - DNA, 18 bp, Homo sapiens
catttttaaggctgtgtg

SEQ ID NO: 3119662 - DNA, 16 bp, Homo sapiens
catttttaatttaaca

SEQ ID NO: 3119663 - DNA, 23 bp, Homo sapiens
catttttaatttaacaaactaaa

SEQ ID NO: 3119664 - DNA, 17 bp, Homo sapiens
catttttacaataaata

SEQ ID NO: 3119665 - DNA, 23 bp, Homo sapiens
catttttacaccaatttggtaaa

SEQ ID NO: 3119666 - DNA, 16 bp, Homo sapiens
catttttagaaatcac

SEQ ID NO: 3119667 - DNA, 17 bp, Homo sapiens
catttttagtagagaca

SEQ ID NO: 3119668 - DNA, 19 bp, Homo sapiens
catttttagtagagacagg

SEQ ID NO: 3119669 - DNA, 12 bp, Homo sapiens
catttttatagc

SEQ ID NO: 3119670 - DNA, 17 bp, Homo sapiens
catttttcactgtacat

SEQ ID NO: 3119671 - DNA, 11 bp, Homo sapiens
catttttcata

SEQ ID NO: 3119672 - DNA, 21 bp, Homo sapiens
catttttcattcacttctctt

SEQ ID NO: 3119673 - DNA, 15 bp, Homo sapiens
catttttctataaat

SEQ ID NO: 3119674 - DNA, 17 bp, Homo sapiens
catttttctataaatca

SEQ ID NO: 3119675 - DNA, 23 bp, Homo sapiens
catttttctataaatcagtattt

SEQ ID NO: 3119676 - DNA, 23 bp, Homo sapiens
catttttggtaggcttatcaaaa

SEQ ID NO: 3119677 - DNA, 14 bp, Homo sapiens
catttttgtacagt

SEQ ID NO: 3119678 - DNA, 21 bp, Homo sapiens
catttttgtacagtttgctgt

SEQ ID NO: 3119679 - DNA, 22 bp, Homo sapiens
catttttgtacagtttgctgta

SEQ ID NO: 3119680 - DNA, 16 bp, Homo sapiens
cattttttaaaaaatc

SEQ ID NO: 3119681 - DNA, 14 bp, Homo sapiens
cattttttcttccc

SEQ ID NO: 3119682 - DNA, 14 bp, Homo sapiens
cattttttgctata

SEQ ID NO: 3119683 - DNA, 16 bp, Homo sapiens
catttttttctaccta

SEQ ID NO: 3119684 - DNA, 22 bp, Homo sapiens
cattttttttatattgccttat

SEQ ID NO: 3119685 - DNA, 18 bp, Homo sapiens
catttttttttcaatcaa

SEQ ID NO: 3119686 - DNA, 14 bp, Homo sapiens
ccaaaaaaaggaaa

SEQ ID NO: 3119687 - DNA, 16 bp, Homo sapiens
ccaaaaaaaggaaaaa

SEQ ID NO: 3119688 - DNA, 17 bp, Homo sapiens
ccaaaaaaaggaaaaat

SEQ ID NO: 3119689 - DNA, 22 bp, Homo sapiens
ccaaaaaaaggaaaaataatca

SEQ ID NO: 3119690 - DNA, 16 bp, Homo sapiens
ccaaaaaagtattttt

SEQ ID NO: 3119691 - DNA, 23 bp, Homo sapiens
ccaaaaaggttgctgtttcacaa

SEQ ID NO: 3119692 - DNA, 16 bp, Homo sapiens
ccaaaaataaatatat

SEQ ID NO: 3119693 - DNA, 14 bp, Homo sapiens
ccaaaaattattat

SEQ ID NO: 3119694 - DNA, 12 bp, Homo sapiens
ccaaaacaaaca

SEQ ID NO: 3119695 - DNA, 13 bp, Homo sapiens
ccaaaacacagga

SEQ ID NO: 3119696 - DNA, 19 bp, Homo sapiens
ccaaaacataaaaaccaaa

SEQ ID NO: 3119697 - DNA, 22 bp, Homo sapiens
ccaaaacatattcaaagcagca

SEQ ID NO: 3119698 - DNA, 21 bp, Homo sapiens
ccaaaacatcgtctaaacttt

SEQ ID NO: 3119699 - DNA, 13 bp, Homo sapiens
ccaaaacatttct

SEQ ID NO: 3119700 - DNA, 11 bp, Homo sapiens
ccaaaaccatc

SEQ ID NO: 3119701 - DNA, 17 bp, Homo sapiens
ccaaaacttagacccat

SEQ ID NO: 3119702 - DNA, 13 bp, Homo sapiens
ccaaaacttccaa

SEQ ID NO: 3119703 - DNA, 23 bp, Homo sapiens
ccaaaagattgctgaaattttat

SEQ ID NO: 3119704 - DNA, 18 bp, Homo sapiens
ccaaaagttttcctgaga

SEQ ID NO: 3119705 - DNA, 18 bp, Homo sapiens
ccaaaatattttttgcaa

SEQ ID NO: 3119706 - DNA, 14 bp, Homo sapiens
ccaaaatcagcttt

SEQ ID NO: 3119707 - DNA, 15 bp, Homo sapiens
ccaaaattttaaaaa

SEQ ID NO: 3119708 - DNA, 13 bp, Homo sapiens
ccaaacaattatt

SEQ ID NO: 3119709 - DNA, 15 bp, Homo sapiens
ccaaacaccttccag

SEQ ID NO: 3119710 - DNA, 15 bp, Homo sapiens
ccaaacatagcccct

SEQ ID NO: 3119711 - DNA, 14 bp, Homo sapiens
cattatgattcttt

SEQ ID NO: 3119712 - DNA, 18 bp, Homo sapiens
cattatgtgtgcatgtgt

SEQ ID NO: 3119713 - DNA, 16 bp, Homo sapiens
cattatgttcatgtaa

SEQ ID NO: 3119714 - DNA, 19 bp, Homo sapiens
cattattagtactgctctt

SEQ ID NO: 3119715 - DNA, 14 bp, Homo sapiens
cattattcctccag

SEQ ID NO: 3119716 - DNA, 16 bp, Homo sapiens
cattattgcttattgc

SEQ ID NO: 3119717 - DNA, 12 bp, Homo sapiens
cattattggaat

SEQ ID NO: 3119718 - DNA, 18 bp, Homo sapiens
cattattggaattaacct

SEQ ID NO: 3119719 - DNA, 20 bp, Homo sapiens
cattattggaattaacctgg

SEQ ID NO: 3119720 - DNA, 22 bp, Homo sapiens
cattattggaattaacctggtg

SEQ ID NO: 3119721 - DNA, 16 bp, Homo sapiens
cattattgtcccacaa

SEQ ID NO: 3119722 - DNA, 17 bp, Homo sapiens
cattatttattaaaaat

SEQ ID NO: 3119723 - DNA, 20 bp, Homo sapiens
cattatttattaaaaatgtt

SEQ ID NO: 3119724 - DNA, 13 bp, Homo sapiens
cattatttctagt

SEQ ID NO: 3119725 - DNA, 20 bp, Homo sapiens
cattatttctagtccaaaat

SEQ ID NO: 3119726 - DNA, 13 bp, Homo sapiens
cattatttgcatg

SEQ ID NO: 3119727 - DNA, 14 bp, Homo sapiens
cattattttctgtc

SEQ ID NO: 3119728 - DNA, 16 bp, Homo sapiens
catggcccccaggggc

SEQ ID NO: 3119729 - DNA, 20 bp, Homo sapiens
catggcccccaggggcagga

SEQ ID NO: 3119730 - DNA, 23 bp, Homo sapiens
catggcccccaggggcaggactg

SEQ ID NO: 3119731 - DNA, 16 bp, Homo sapiens
catggcccctctgacc

SEQ ID NO: 3119732 - DNA, 16 bp, Homo sapiens
catggcctatgcacat

SEQ ID NO: 3119733 - DNA, 20 bp, Homo sapiens
catggcctattatattaaaa

SEQ ID NO: 3119734 - DNA, 18 bp, Homo sapiens
catggcctctggccaggc

SEQ ID NO: 3119735 - DNA, 18 bp, Homo sapiens
catggccttgaaacagtt

SEQ ID NO: 3119736 - DNA, 13 bp, Homo sapiens
catggcgaggctg

SEQ ID NO: 3119737 - DNA, 22 bp, Homo sapiens
catggcgtaatgggcctgccca

SEQ ID NO: 3119738 - DNA, 14 bp, Homo sapiens
catggctaactggc

SEQ ID NO: 3119739 - DNA, 14 bp, Homo sapiens
catggctcagagct

SEQ ID NO: 3119740 - DNA, 20 bp, Homo sapiens
catggctcagagcttgaaga

SEQ ID NO: 3119741 - DNA, 13 bp, Homo sapiens
catggctcaggca

SEQ ID NO: 3119742 - DNA, 17 bp, Homo sapiens
catggcttaatgtttat

SEQ ID NO: 3119743 - DNA, 13 bp, Homo sapiens
catgggaaaggag

SEQ ID NO: 3119744 - DNA, 17 bp, Homo sapiens
catgggacagggaggac

SEQ ID NO: 3119745 - DNA, 12 bp, Homo sapiens
catgggagccag

SEQ ID NO: 3119746 - DNA, 19 bp, Homo sapiens
catgggagtaagttcttca

SEQ ID NO: 3119747 - DNA, 16 bp, Homo sapiens
catgggatacaacctc

SEQ ID NO: 3119748 - DNA, 13 bp, Homo sapiens
catgggccagagc

SEQ ID NO: 3119749 - DNA, 15 bp, Homo sapiens
catgggccagagcct

SEQ ID NO: 3119750 - DNA, 15 bp, Homo sapiens
catgggccagcctag

SEQ ID NO: 3119751 - DNA, 17 bp, Homo sapiens
catgggccagcctagcc

SEQ ID NO: 3119752 - DNA, 17 bp, Homo sapiens
catgggcctcctgtgtg

SEQ ID NO: 3119753 - DNA, 18 bp, Homo sapiens
catgggcctcctgtgtgt

SEQ ID NO: 3119754 - DNA, 13 bp, Homo sapiens
catgggcctgggc

SEQ ID NO: 3119755 - DNA, 15 bp, Homo sapiens
catgggcctgggcct

SEQ ID NO: 3119756 - DNA, 18 bp, Homo sapiens
catgggcctgggcctgct

SEQ ID NO: 3119757 - DNA, 20 bp, Homo sapiens
catgggcctttaagaacctt

SEQ ID NO: 3119758 - DNA, 18 bp, Homo sapiens
catgggcgcaggcccagt

SEQ ID NO: 3119759 - DNA, 20 bp, Homo sapiens
catgggcgcaggcccagtga

SEQ ID NO: 3119760 - DNA, 21 bp, Homo sapiens
catgggcttcactgtataaat

SEQ ID NO: 3119761 - DNA, 13 bp, Homo sapiens
catgggcttggac

SEQ ID NO: 3119762 - DNA, 11 bp, Homo sapiens
catggggaggg

SEQ ID NO: 3119763 - DNA, 14 bp, Homo sapiens
catgggggcaccgg

SEQ ID NO: 3119764 - DNA, 14 bp, Homo sapiens
catgggtccaagag

SEQ ID NO: 3119765 - DNA, 23 bp, Homo sapiens
catgggtccaagagacatggaag

SEQ ID NO: 3119766 - DNA, 22 bp, Homo sapiens
catgggtcccttgaaggaagag

SEQ ID NO: 3119767 - DNA, 22 bp, Homo sapiens
catgggtgaagggagagccagc

SEQ ID NO: 3119768 - DNA, 18 bp, Homo sapiens
catgggtgtgcccttggg

SEQ ID NO: 3119769 - DNA, 23 bp, Homo sapiens
catgggttatgtgtatgtgccat

SEQ ID NO: 3119770 - DNA, 14 bp, Homo sapiens
catggtaccagccc

SEQ ID NO: 3119771 - DNA, 15 bp, Homo sapiens
catggtaccagccct

SEQ ID NO: 3119772 - DNA, 18 bp, Homo sapiens
catggtacccccttctgg

SEQ ID NO: 3119773 - DNA, 14 bp, Homo sapiens
catggtcacacact

SEQ ID NO: 3119774 - DNA, 15 bp, Homo sapiens
catggtcacacactg

SEQ ID NO: 3119775 - DNA, 17 bp, Homo sapiens
catggtcacacactgat

SEQ ID NO: 3119776 - DNA, 17 bp, Homo sapiens
catggtcccttaaggca

SEQ ID NO: 3119777 - DNA, 18 bp, Homo sapiens
catggtcctttctggaag

SEQ ID NO: 3119778 - DNA, 21 bp, Homo sapiens
catggtgaaaatgtactgaga

SEQ ID NO: 3119779 - DNA, 18 bp, Homo sapiens
catggtgattccagcaag

SEQ ID NO: 3119780 - DNA, 14 bp, Homo sapiens
catggtgcctgaga

SEQ ID NO: 3119781 - DNA, 17 bp, Homo sapiens
catggtgcctgagaggc

SEQ ID NO: 3119782 - DNA, 21 bp, Homo sapiens
catggtgctagtgggccctct

SEQ ID NO: 3119783 - DNA, 16 bp, Homo sapiens
catggtggacccagcg

SEQ ID NO: 3119784 - DNA, 15 bp, Homo sapiens
catggtgtaataaga

SEQ ID NO: 3119785 - DNA, 16 bp, Homo sapiens
catggtgtaataagac

SEQ ID NO: 3119786 - DNA, 23 bp, Homo sapiens
catggtgtgaaagtcagatgccc

SEQ ID NO: 3119787 - DNA, 16 bp, Homo sapiens
catggtgtttttataa

SEQ ID NO: 3119788 - DNA, 14 bp, Homo sapiens
catggttccttccc

SEQ ID NO: 3119789 - DNA, 19 bp, Homo sapiens
catggtttaaaagaaaaaa

SEQ ID NO: 3119790 - DNA, 17 bp, Homo sapiens
catgtaacattggtgaa

SEQ ID NO: 3119791 - DNA, 16 bp, Homo sapiens
catgtaactatagact

SEQ ID NO: 3119792 - DNA, 14 bp, Homo sapiens
catgtaagaagccc

SEQ ID NO: 3119793 - DNA, 21 bp, Homo sapiens
catgtaataaaaagtatatgt

SEQ ID NO: 3119794 - DNA, 22 bp, Homo sapiens
catgtactgagccttgtaattc

SEQ ID NO: 3119795 - DNA, 13 bp, Homo sapiens
catgtactgtagt

SEQ ID NO: 3119796 - DNA, 14 bp, Homo sapiens
catgtactgtagtt

SEQ ID NO: 3119797 - DNA, 13 bp, Homo sapiens
catgtacttgttt

SEQ ID NO: 3119798 - DNA, 15 bp, Homo sapiens
catgtactttggcat

SEQ ID NO: 3119799 - DNA, 16 bp, Homo sapiens
catgtagaactcagca

SEQ ID NO: 3119800 - DNA, 21 bp, Homo sapiens
catgtagaactcagcagttga

SEQ ID NO: 3119801 - DNA, 17 bp, Homo sapiens
catgtagccccctggcc

SEQ ID NO: 3119802 - DNA, 20 bp, Homo sapiens
catgtagccccctggcctct

SEQ ID NO: 3119803 - DNA, 14 bp, Homo sapiens
catgtagctgagtt

SEQ ID NO: 3119804 - DNA, 15 bp, Homo sapiens
catgtagctgagttt

SEQ ID NO: 3119805 - DNA, 16 bp, Homo sapiens
catgtaggaccctgca

SEQ ID NO: 3119806 - DNA, 15 bp, Homo sapiens
catgtataaccaagt

SEQ ID NO: 3119807 - DNA, 20 bp, Homo sapiens
catgtataaccaagtgtgct

SEQ ID NO: 3119808 - DNA, 22 bp, Homo sapiens
catgtatggaatcccactgtat

SEQ ID NO: 3119809 - DNA, 19 bp, Homo sapiens
catgtatggttactaaaaa

SEQ ID NO: 3119810 - DNA, 13 bp, Homo sapiens
catgtatgtcttg

SEQ ID NO: 3119811 - DNA, 17 bp, Homo sapiens
catgtatgtcttggaca

SEQ ID NO: 3119812 - DNA, 18 bp, Homo sapiens
catgtatgtcttggacac

SEQ ID NO: 3119813 - DNA, 13 bp, Homo sapiens
catgtatgttatg

SEQ ID NO: 3119814 - DNA, 22 bp, Homo sapiens
catgtattgaagaggatattct

SEQ ID NO: 3119815 - DNA, 20 bp, Homo sapiens
catgtatttatctctattta

SEQ ID NO: 3119816 - DNA, 15 bp, Homo sapiens
catgtatttatgtaa

SEQ ID NO: 3119817 - DNA, 22 bp, Homo sapiens
catgtcaacttctggctcctca

SEQ ID NO: 3119818 - DNA, 19 bp, Homo sapiens
catgtcaccggtcagtgcc

SEQ ID NO: 3119819 - DNA, 23 bp, Homo sapiens
catgtcaccggtcagtgcctttt

SEQ ID NO: 3119820 - DNA, 13 bp, Homo sapiens
catgtcactgtgg

SEQ ID NO: 3119821 - DNA, 15 bp, Homo sapiens
catgtcactgtggtc

SEQ ID NO: 3119822 - DNA, 16 bp, Homo sapiens
catgtcactgtggtcc

SEQ ID NO: 3119823 - DNA, 16 bp, Homo sapiens
catgtcaggcctgtgt

SEQ ID NO: 3119824 - DNA, 20 bp, Homo sapiens
catgtcatttgactgtctca

SEQ ID NO: 3119825 - DNA, 17 bp, Homo sapiens
catgtccaaagaggctg

SEQ ID NO: 3119826 - DNA, 17 bp, Homo sapiens
catgtccaagttcttca

SEQ ID NO: 3119827 - DNA, 23 bp, Homo sapiens
catgatgggaatagggagacagg

SEQ ID NO: 3119828 - DNA, 12 bp, Homo sapiens
catgatggtgag

SEQ ID NO: 3119829 - DNA, 14 bp, Homo sapiens
catgattctattta

SEQ ID NO: 3119830 - DNA, 14 bp, Homo sapiens
catgattctctgag

SEQ ID NO: 3119831 - DNA, 16 bp, Homo sapiens
catgattctctgagtg

SEQ ID NO: 3119832 - DNA, 12 bp, Homo sapiens
catgatttcctt

SEQ ID NO: 3119833 - DNA, 14 bp, Homo sapiens
catgatttccttga

SEQ ID NO: 3119834 - DNA, 21 bp, Homo sapiens
catgatttgtcccagcctggg

SEQ ID NO: 3119835 - DNA, 23 bp, Homo sapiens
catgatttgtcccagcctggggc

SEQ ID NO: 3119836 - DNA, 17 bp, Homo sapiens
catgcaaaatatgttta

SEQ ID NO: 3119837 - DNA, 22 bp, Homo sapiens
catgcaaatgagctctgaaatc

SEQ ID NO: 3119838 - DNA, 14 bp, Homo sapiens
catgcaataaaatt

SEQ ID NO: 3119839 - DNA, 18 bp, Homo sapiens
catgcaataaaatttaaa

SEQ ID NO: 3119840 - DNA, 14 bp, Homo sapiens
catgcaattttatt

SEQ ID NO: 3119841 - DNA, 11 bp, Homo sapiens
catgcacacac

SEQ ID NO: 3119842 - DNA, 19 bp, Homo sapiens
catgcactgacccttccag

SEQ ID NO: 3119843 - DNA, 20 bp, Homo sapiens
catgcactgacccttccaga

SEQ ID NO: 3119844 - DNA, 17 bp, Homo sapiens
catgcagactcctcaga

SEQ ID NO: 3119845 - DNA, 19 bp, Homo sapiens
catgcagcccatgcccacc

SEQ ID NO: 3119846 - DNA, 22 bp, Homo sapiens
catgcagcccatgcccacctgc

SEQ ID NO: 3119847 - DNA, 18 bp, Homo sapiens
catgcagccttggggcat

SEQ ID NO: 3119848 - DNA, 19 bp, Homo sapiens
catgcagccttggggcatt

SEQ ID NO: 3119849 - DNA, 15 bp, Homo sapiens
catgcaggaaggaaa

SEQ ID NO: 3119850 - DNA, 20 bp, Homo sapiens
catgcagttcattattttgt

SEQ ID NO: 3119851 - DNA, 14 bp, Homo sapiens
catgcagttcctgg

SEQ ID NO: 3119852 - DNA, 15 bp, Homo sapiens
catgcataaatatgc

SEQ ID NO: 3119853 - DNA, 17 bp, Homo sapiens
catgcataaatatgcag

SEQ ID NO: 3119854 - DNA, 14 bp, Homo sapiens
catgcattcataca

SEQ ID NO: 3119855 - DNA, 18 bp, Homo sapiens
catgcattgttggctatt

SEQ ID NO: 3119856 - DNA, 14 bp, Homo sapiens
catgcatttcaagc

SEQ ID NO: 3119857 - DNA, 17 bp, Homo sapiens
catgcatttgaggtcaa

SEQ ID NO: 3119858 - DNA, 19 bp, Homo sapiens
catgcattttgcagcagtg

SEQ ID NO: 3119859 - DNA, 11 bp, Homo sapiens
catgccaccct

SEQ ID NO: 3119860 - DNA, 13 bp, Homo sapiens
catgccaccctca

SEQ ID NO: 3119861 - DNA, 21 bp, Homo sapiens
catgccactgccaggcacctg

SEQ ID NO: 3119862 - DNA, 23 bp, Homo sapiens
catgccactgccaggcacctggc

SEQ ID NO: 3119863 - DNA, 19 bp, Homo sapiens
catgccaggaacctgtcct

SEQ ID NO: 3119864 - DNA, 15 bp, Homo sapiens
catgcccaccccctg

SEQ ID NO: 3119865 - DNA, 19 bp, Homo sapiens
catgcccaccccctgccct

SEQ ID NO: 3119866 - DNA, 19 bp, Homo sapiens
catgcccacgttctttccc

SEQ ID NO: 3119867 - DNA, 18 bp, Homo sapiens
catgcccggtcccacccc

SEQ ID NO: 3119868 - DNA, 20 bp, Homo sapiens
catgcccggtcccacccctc

SEQ ID NO: 3119869 - DNA, 11 bp, Homo sapiens
catgccctcct

SEQ ID NO: 3119870 - DNA, 12 bp, Homo sapiens
catgccctcctg

SEQ ID NO: 3119871 - DNA, 20 bp, Homo sapiens
catgccctgccttgtccctc

SEQ ID NO: 3119872 - DNA, 18 bp, Homo sapiens
catgcctcactaattttt

SEQ ID NO: 3119873 - DNA, 13 bp, Homo sapiens
catgcctcatgcc

SEQ ID NO: 3119874 - DNA, 15 bp, Homo sapiens
catgcctcatgccac

SEQ ID NO: 3119875 - DNA, 21 bp, Homo sapiens
catgcctctgatatgggactg

SEQ ID NO: 3119876 - DNA, 23 bp, Homo sapiens
catgcctctgatatgggactgag

SEQ ID NO: 3119877 - DNA, 13 bp, Homo sapiens
catgcctgagggt

SEQ ID NO: 3119878 - DNA, 16 bp, Homo sapiens
catgcctgagggtgga

SEQ ID NO: 3119879 - DNA, 15 bp, Homo sapiens
catgcctgctgagag

SEQ ID NO: 3119880 - DNA, 21 bp, Homo sapiens
catgcctgtagctttcctggt

SEQ ID NO: 3119881 - DNA, 16 bp, Homo sapiens
catgcctgtccagcct

SEQ ID NO: 3119882 - DNA, 18 bp, Homo sapiens
catgcctgtccagcctgg

SEQ ID NO: 3119883 - DNA, 17 bp, Homo sapiens
catgccttgataaatat

SEQ ID NO: 3119884 - DNA, 21 bp, Homo sapiens
catgccttgataaatatatat

SEQ ID NO: 3119885 - DNA, 15 bp, Homo sapiens
catgcctttgtaagt

SEQ ID NO: 3119886 - DNA, 13 bp, Homo sapiens
catgcgcacaagg

SEQ ID NO: 3119887 - DNA, 21 bp, Homo sapiens
catgcgccccctccgccctgc

SEQ ID NO: 3119888 - DNA, 14 bp, Homo sapiens
catgcgctcagggc

SEQ ID NO: 3119889 - DNA, 22 bp, Homo sapiens
catgcgtgccgcctgctcctca

SEQ ID NO: 3119890 - DNA, 16 bp, Homo sapiens
catgctcatctgctgg

SEQ ID NO: 3119891 - DNA, 18 bp, Homo sapiens
catgctcctcacctgtct

SEQ ID NO: 3119892 - DNA, 14 bp, Homo sapiens
catgctcctcactg

SEQ ID NO: 3119893 - DNA, 15 bp, Homo sapiens
catgctcctcactgc

SEQ ID NO: 3119894 - DNA, 19 bp, Homo sapiens
catgctcctcactgcccgc

SEQ ID NO: 3119895 - DNA, 12 bp, Homo sapiens
catgctctgccc

SEQ ID NO: 3119896 - DNA, 22 bp, Homo sapiens
catgctctgccccaagccccca

SEQ ID NO: 3119897 - DNA, 19 bp, Homo sapiens
catgctgaaggctgaaaga

SEQ ID NO: 3119898 - DNA, 17 bp, Homo sapiens
catgctgagtctcccaa

SEQ ID NO: 3119899 - DNA, 12 bp, Homo sapiens
catgctgcctcc

SEQ ID NO: 3119900 - DNA, 23 bp, Homo sapiens
catgctgctatacacaagcaatg

SEQ ID NO: 3119901 - DNA, 13 bp, Homo sapiens
catgctggccagc

SEQ ID NO: 3119902 - DNA, 14 bp, Homo sapiens
catgctgggatttc

SEQ ID NO: 3119903 - DNA, 20 bp, Homo sapiens
catgctgggccactggggac

SEQ ID NO: 3119904 - DNA, 13 bp, Homo sapiens
catgctggtcaga

SEQ ID NO: 3119905 - DNA, 13 bp, Homo sapiens
catgctgtgctct

SEQ ID NO: 3119906 - DNA, 19 bp, Homo sapiens
catgcttagcttatctttc

SEQ ID NO: 3119907 - DNA, 21 bp, Homo sapiens
catgcttagcttatctttctt

SEQ ID NO: 3119908 - DNA, 13 bp, Homo sapiens
catgcttcccaga

SEQ ID NO: 3119909 - DNA, 14 bp, Homo sapiens
catgcttcccagag

SEQ ID NO: 3119910 - DNA, 20 bp, Homo sapiens
catgcttcccagagggagca

SEQ ID NO: 3119911 - DNA, 20 bp, Homo sapiens
catgcttctcatcttgtgaa

SEQ ID NO: 3119912 - DNA, 21 bp, Homo sapiens
catgcttctcatcttgtgaaa

SEQ ID NO: 3119913 - DNA, 14 bp, Homo sapiens
catgcttggttttc

SEQ ID NO: 3119914 - DNA, 15 bp, Homo sapiens
catgctttaaagtgt

SEQ ID NO: 3119915 - DNA, 23 bp, Homo sapiens
catgctttaaagtgtaataatat

SEQ ID NO: 3119916 - DNA, 19 bp, Homo sapiens
catgctttgctgctatgaa

SEQ ID NO: 3119917 - DNA, 14 bp, Homo sapiens
catggaaaaatggt

SEQ ID NO: 3119918 - DNA, 23 bp, Homo sapiens
catggaatatttataggccaggg

SEQ ID NO: 3119919 - DNA, 14 bp, Homo sapiens
catccctttctccc

SEQ ID NO: 3119920 - DNA, 15 bp, Homo sapiens
catccctttctccca

SEQ ID NO: 3119921 - DNA, 17 bp, Homo sapiens
catcccttttcctgtca

SEQ ID NO: 3119922 - DNA, 21 bp, Homo sapiens
catccctttttttacatttca

SEQ ID NO: 3119923 - DNA, 20 bp, Homo sapiens
catccggtcccctgcctgga

SEQ ID NO: 3119924 - DNA, 21 bp, Homo sapiens
catccggtcccctgcctggaa

SEQ ID NO: 3119925 - DNA, 21 bp, Homo sapiens
catcctaccctcgggcccacc

SEQ ID NO: 3119926 - DNA, 15 bp, Homo sapiens
catcctaccgtcttt

SEQ ID NO: 3119927 - DNA, 20 bp, Homo sapiens
catcctcaaagaaagtgtat

SEQ ID NO: 3119928 - DNA, 22 bp, Homo sapiens
catcctcaaagaaagtgtattg

SEQ ID NO: 3119929 - DNA, 17 bp, Homo sapiens
catcctcatccctgact

SEQ ID NO: 3119930 - DNA, 20 bp, Homo sapiens
catcctcatccctgactggc

SEQ ID NO: 3119931 - DNA, 18 bp, Homo sapiens
catcctcattgcctcctg

SEQ ID NO: 3119932 - DNA, 17 bp, Homo sapiens
catcctccagatagtgt

SEQ ID NO: 3119933 - DNA, 12 bp, Homo sapiens
catcctccagct

SEQ ID NO: 3119934 - DNA, 15 bp, Homo sapiens
catcctccagcttct

SEQ ID NO: 3119935 - DNA, 20 bp, Homo sapiens
catcctcctcagcccccagg

SEQ ID NO: 3119936 - DNA, 13 bp, Homo sapiens
catcctcctccca

SEQ ID NO: 3119937 - DNA, 21 bp, Homo sapiens
catcctcctggaaccttgctg

SEQ ID NO: 3119938 - DNA, 23 bp, Homo sapiens
catcctcctggaaccttgctgtc

SEQ ID NO: 3119939 - DNA, 12 bp, Homo sapiens
catcctctgctg

SEQ ID NO: 3119940 - DNA, 14 bp, Homo sapiens
catcctctgctggt

SEQ ID NO: 3119941 - DNA, 21 bp, Homo sapiens
catcctctgctggttcctgac

SEQ ID NO: 3119942 - DNA, 14 bp, Homo sapiens
catcctgagccccg

SEQ ID NO: 3119943 - DNA, 16 bp, Homo sapiens
catcctgagccccgcc

SEQ ID NO: 3119944 - DNA, 20 bp, Homo sapiens
catcctgagccccgccctct

SEQ ID NO: 3119945 - DNA, 19 bp, Homo sapiens
catcctgccagccccacac

SEQ ID NO: 3119946 - DNA, 21 bp, Homo sapiens
catcctgccagccccacacag

SEQ ID NO: 3119947 - DNA, 13 bp, Homo sapiens
catcctgcctggg

SEQ ID NO: 3119948 - DNA, 14 bp, Homo sapiens
catcctgcctgggt

SEQ ID NO: 3119949 - DNA, 20 bp, Homo sapiens
catcctgcctgggtgggaca

SEQ ID NO: 3119950 - DNA, 21 bp, Homo sapiens
catcctggcacgccctactcc

SEQ ID NO: 3119951 - DNA, 18 bp, Homo sapiens
catcctggggcagcactc

SEQ ID NO: 3119952 - DNA, 15 bp, Homo sapiens
catcctgtataagca

SEQ ID NO: 3119953 - DNA, 16 bp, Homo sapiens
catcctttgcagggca

SEQ ID NO: 3119954 - DNA, 17 bp, Homo sapiens
catcctttgcagggcag

SEQ ID NO: 3119955 - DNA, 18 bp, Homo sapiens
catcctttgcagggcagc

SEQ ID NO: 3119956 - DNA, 18 bp, Homo sapiens
catcctttgttctgagca

SEQ ID NO: 3119957 - DNA, 19 bp, Homo sapiens
catcctttgttctgagcat

SEQ ID NO: 3119958 - DNA, 17 bp, Homo sapiens
catccttttctgcagag

SEQ ID NO: 3119959 - DNA, 20 bp, Homo sapiens
catcgaaaattcatttcaca

SEQ ID NO: 3119960 - DNA, 22 bp, Homo sapiens
catcgcaggagtctctgccacc

SEQ ID NO: 3119961 - DNA, 19 bp, Homo sapiens
catcgccaaggactgactg

SEQ ID NO: 3119962 - DNA, 22 bp, Homo sapiens
catcgccaaggactgactgaga

SEQ ID NO: 3119963 - DNA, 20 bp, Homo sapiens
catcgccagaggtgcttcac

SEQ ID NO: 3119964 - DNA, 16 bp, Homo sapiens
catcgctcgtgtgttc

SEQ ID NO: 3119965 - DNA, 21 bp, Homo sapiens
catcggtgaaactaacagata

SEQ ID NO: 3119966 - DNA, 14 bp, Homo sapiens
catcgtagaagaga

SEQ ID NO: 3119967 - DNA, 21 bp, Homo sapiens
catcgtataacacaatatgaa

SEQ ID NO: 3119968 - DNA, 13 bp, Homo sapiens
catcgtcctggga

SEQ ID NO: 3119969 - DNA, 15 bp, Homo sapiens
catcgtcctgggact

SEQ ID NO: 3119970 - DNA, 16 bp, Homo sapiens
catcgtccttcctctc

SEQ ID NO: 3119971 - DNA, 13 bp, Homo sapiens
catcgtgaccctt

SEQ ID NO: 3119972 - DNA, 15 bp, Homo sapiens
catcgtgacccttca

SEQ ID NO: 3119973 - DNA, 18 bp, Homo sapiens
catcgtgacccttcaggg

SEQ ID NO: 3119974 - DNA, 19 bp, Homo sapiens
catcgtgacccttcagggc

SEQ ID NO: 3119975 - DNA, 20 bp, Homo sapiens
catcgtgacccttcagggcc

SEQ ID NO: 3119976 - DNA, 17 bp, Homo sapiens
catctaatgcttgttta

SEQ ID NO: 3119977 - DNA, 13 bp, Homo sapiens
catctaattctga

SEQ ID NO: 3119978 - DNA, 17 bp, Homo sapiens
catctagccagcccctc

SEQ ID NO: 3119979 - DNA, 17 bp, Homo sapiens
catctaggtaattttta

SEQ ID NO: 3119980 - DNA, 18 bp, Homo sapiens
catctagtacttgaaaaa

SEQ ID NO: 3119981 - DNA, 17 bp, Homo sapiens
catctatctagttctaa

SEQ ID NO: 3119982 - DNA, 20 bp, Homo sapiens
catctatctcatctatctca

SEQ ID NO: 3119983 - DNA, 19 bp, Homo sapiens
catctatgagggtgtttcc

SEQ ID NO: 3119984 - DNA, 13 bp, Homo sapiens
catctcagcccac

SEQ ID NO: 3119985 - DNA, 20 bp, Homo sapiens
catctcagcctaccatgaga

SEQ ID NO: 3119986 - DNA, 18 bp, Homo sapiens
catctcaggagatttcat

SEQ ID NO: 3119987 - DNA, 19 bp, Homo sapiens
catctcaggggccagagga

SEQ ID NO: 3119988 - DNA, 19 bp, Homo sapiens
catctcaggtgccactccc

SEQ ID NO: 3119989 - DNA, 21 bp, Homo sapiens
catctcaggtgccactccctg

SEQ ID NO: 3119990 - DNA, 22 bp, Homo sapiens
catctcaggtgccactccctga

SEQ ID NO: 3119991 - DNA, 12 bp, Homo sapiens
catctcatcctg

SEQ ID NO: 3119992 - DNA, 14 bp, Homo sapiens
catctcatcctggc

SEQ ID NO: 3119993 - DNA, 16 bp, Homo sapiens
catctcatcctggcac

SEQ ID NO: 3119994 - DNA, 17 bp, Homo sapiens
catctcatcctggcacg

SEQ ID NO: 3119995 - DNA, 21 bp, Homo sapiens
catctcatcctggcacgccct

SEQ ID NO: 3119996 - DNA, 22 bp, Homo sapiens
catctccaagataagcctgagc

SEQ ID NO: 3119997 - DNA, 20 bp, Homo sapiens
cagtgctgtggcctgggcaa

SEQ ID NO: 3119998 - DNA, 14 bp, Homo sapiens
cagtgcttcagcct

SEQ ID NO: 3119999 - DNA, 15 bp, Homo sapiens
cagtgcttcagcctg

SEQ ID NO: 3120000 - DNA, 16 bp, Homo sapiens
cagtgcttcagcctga

SEQ ID NO: 3120001 - DNA, 19 bp, Homo sapiens
cagtgcttcagcctgaggc

SEQ ID NO: 3120002 - DNA, 20 bp, Homo sapiens
cagtgcttcagcctgaggct

SEQ ID NO: 3120003 - DNA, 15 bp, Homo sapiens
cagtgcttgggctcc

SEQ ID NO: 3120004 - DNA, 16 bp, Homo sapiens
cagtgcttgggctcca

SEQ ID NO: 3120005 - DNA, 18 bp, Homo sapiens
cagtgcttgggctccacg

SEQ ID NO: 3120006 - DNA, 16 bp, Homo sapiens
cagtgctttaatggca

SEQ ID NO: 3120007 - DNA, 12 bp, Homo sapiens
cagtggaagaaa

SEQ ID NO: 3120008 - DNA, 19 bp, Homo sapiens
cagtggaattgtacaagag

SEQ ID NO: 3120009 - DNA, 20 bp, Homo sapiens
cagtggaattgtacaagagt

SEQ ID NO: 3120010 - DNA, 20 bp, Homo sapiens
cagtggaggaagagggacag

SEQ ID NO: 3120011 - DNA, 17 bp, Homo sapiens
cagtggatcacaaagtg

SEQ ID NO: 3120012 - DNA, 15 bp, Homo sapiens
cagtggatcccctgc

SEQ ID NO: 3120013 - DNA, 18 bp, Homo sapiens
cagtggatcttcagaact

SEQ ID NO: 3120014 - DNA, 17 bp, Homo sapiens
cagtggcacaaaaaaat

SEQ ID NO: 3120015 - DNA, 13 bp, Homo sapiens
cagtggcagagaa

SEQ ID NO: 3120016 - DNA, 18 bp, Homo sapiens
cagtggcagagaatccaa

SEQ ID NO: 3120017 - DNA, 13 bp, Homo sapiens
cagtggcagctgc

SEQ ID NO: 3120018 - DNA, 15 bp, Homo sapiens
cagtggcagggctca

SEQ ID NO: 3120019 - DNA, 21 bp, Homo sapiens
cagtggctcataaaaataaaa

SEQ ID NO: 3120020 - DNA, 13 bp, Homo sapiens
cagtggctcgctc

SEQ ID NO: 3120021 - DNA, 18 bp, Homo sapiens
cagtggctcgctccctgt

SEQ ID NO: 3120022 - DNA, 20 bp, Homo sapiens
cagtggctgggtgggcccag

SEQ ID NO: 3120023 - DNA, 12 bp, Homo sapiens
cagtggcttttc

SEQ ID NO: 3120024 - DNA, 13 bp, Homo sapiens
cagtgggacagag

SEQ ID NO: 3120025 - DNA, 14 bp, Homo sapiens
cagtgggagccctg

SEQ ID NO: 3120026 - DNA, 16 bp, Homo sapiens
cagtgggagccctgac

SEQ ID NO: 3120027 - DNA, 13 bp, Homo sapiens
cagtgggagctga

SEQ ID NO: 3120028 - DNA, 23 bp, Homo sapiens
cagtgggagctgcctgttcagct

SEQ ID NO: 3120029 - DNA, 18 bp, Homo sapiens
cagtgggaggggcaggct

SEQ ID NO: 3120030 - DNA, 18 bp, Homo sapiens
cagtgggcgggccatgag

SEQ ID NO: 3120031 - DNA, 18 bp, Homo sapiens
cagtgggcgttgggagcc

SEQ ID NO: 3120032 - DNA, 15 bp, Homo sapiens
cagtgggctgatgct

SEQ ID NO: 3120033 - DNA, 21 bp, Homo sapiens
cagtgggctgatgctgggacc

SEQ ID NO: 3120034 - DNA, 14 bp, Homo sapiens
cagtggggcctgtg

SEQ ID NO: 3120035 - DNA, 16 bp, Homo sapiens
cagtggggcctgtgga

SEQ ID NO: 3120036 - DNA, 22 bp, Homo sapiens
cagtgggtggcacctcctgaga

SEQ ID NO: 3120037 - DNA, 20 bp, Homo sapiens
cagtggtatgatcacggctc

SEQ ID NO: 3120038 - DNA, 19 bp, Homo sapiens
cagtggtgcgatctgggtt

SEQ ID NO: 3120039 - DNA, 20 bp, Homo sapiens
cagtggtgcgatctgggttc

SEQ ID NO: 3120040 - DNA, 20 bp, Homo sapiens
cagtggtgtgtggtgtcgtc

SEQ ID NO: 3120041 - DNA, 14 bp, Homo sapiens
cagtggttgcctgg

SEQ ID NO: 3120042 - DNA, 16 bp, Homo sapiens
cagtggttgcctgggg

SEQ ID NO: 3120043 - DNA, 17 bp, Homo sapiens
cagtggttgcctggggg

SEQ ID NO: 3120044 - DNA, 20 bp, Homo sapiens
cagtggttttatactgaagg

SEQ ID NO: 3120045 - DNA, 20 bp, Homo sapiens
cagtgtacaaaactgtaaat

SEQ ID NO: 3120046 - DNA, 16 bp, Homo sapiens
cagtgtacacgtctgg

SEQ ID NO: 3120047 - DNA, 22 bp, Homo sapiens
cagtgtacacgtctggaccccg

SEQ ID NO: 3120048 - DNA, 17 bp, Homo sapiens
cagtgtagttaatttat

SEQ ID NO: 3120049 - DNA, 17 bp, Homo sapiens
cagtgtatcaggtcagg

SEQ ID NO: 3120050 - DNA, 23 bp, Homo sapiens
cagtgtatggggcagcttccggc

SEQ ID NO: 3120051 - DNA, 17 bp, Homo sapiens
cagtgtcacctctctca

SEQ ID NO: 3120052 - DNA, 18 bp, Homo sapiens
cagtgtcacctctctcag

SEQ ID NO: 3120053 - DNA, 23 bp, Homo sapiens
cagtgtcattttattttttccct

SEQ ID NO: 3120054 - DNA, 13 bp, Homo sapiens
cagtgtcccaggc

SEQ ID NO: 3120055 - DNA, 16 bp, Homo sapiens
cagtgtcccagggccc

SEQ ID NO: 3120056 - DNA, 19 bp, Homo sapiens
cagtgtcccctccactgtc

SEQ ID NO: 3120057 - DNA, 20 bp, Homo sapiens
cagtgtcccctccactgtca

SEQ ID NO: 3120058 - DNA, 12 bp, Homo sapiens
cagtgtctcaca

SEQ ID NO: 3120059 - DNA, 14 bp, Homo sapiens
cagtgtcttccata

SEQ ID NO: 3120060 - DNA, 15 bp, Homo sapiens
cagtgtcttccataa

SEQ ID NO: 3120061 - DNA, 23 bp, Homo sapiens
cagtgtcttccataatgtataaa

SEQ ID NO: 3120062 - DNA, 15 bp, Homo sapiens
cagtgtctttctttg

SEQ ID NO: 3120063 - DNA, 18 bp, Homo sapiens
cagtgtctttctttggtg

SEQ ID NO: 3120064 - DNA, 22 bp, Homo sapiens
cagtgtgatcccaagtgccagt

SEQ ID NO: 3120065 - DNA, 11 bp, Homo sapiens
cagtgtggaac

SEQ ID NO: 3120066 - DNA, 15 bp, Homo sapiens
catagcctatattta

SEQ ID NO: 3120067 - DNA, 18 bp, Homo sapiens
catagcgccgtgctgtaa

SEQ ID NO: 3120068 - DNA, 16 bp, Homo sapiens
catagcgctgctctta

SEQ ID NO: 3120069 - DNA, 16 bp, Homo sapiens
catagctatcaagtgt

SEQ ID NO: 3120070 - DNA, 18 bp, Homo sapiens
catagctcctctccctca

SEQ ID NO: 3120071 - DNA, 16 bp, Homo sapiens
catagctccttggagc

SEQ ID NO: 3120072 - DNA, 21 bp, Homo sapiens
catagctccttggagcaggca

SEQ ID NO: 3120073 - DNA, 13 bp, Homo sapiens
catagctctattt

SEQ ID NO: 3120074 - DNA, 12 bp, Homo sapiens
catagctctcct

SEQ ID NO: 3120075 - DNA, 14 bp, Homo sapiens
catagctctccttc

SEQ ID NO: 3120076 - DNA, 12 bp, Homo sapiens
catagctctggg

SEQ ID NO: 3120077 - DNA, 15 bp, Homo sapiens
catagctgtctagag

SEQ ID NO: 3120078 - DNA, 20 bp, Homo sapiens
catagcttattattgaagga

SEQ ID NO: 3120079 - DNA, 19 bp, Homo sapiens
cataggaaaagtacattta

SEQ ID NO: 3120080 - DNA, 17 bp, Homo sapiens
cataggaggcttctgtt

SEQ ID NO: 3120081 - DNA, 22 bp, Homo sapiens
cataggcccaggatatttctga

SEQ ID NO: 3120082 - DNA, 14 bp, Homo sapiens
cataggcctgggtg

SEQ ID NO: 3120083 - DNA, 19 bp, Homo sapiens
cataggcctgggtgctggc

SEQ ID NO: 3120084 - DNA, 15 bp, Homo sapiens
catagggtctcttca

SEQ ID NO: 3120085 - DNA, 16 bp, Homo sapiens
cataggtatttcaaaa

SEQ ID NO: 3120086 - DNA, 15 bp, Homo sapiens
cataggtcactggct

SEQ ID NO: 3120087 - DNA, 17 bp, Homo sapiens
cataggtcactggctct

SEQ ID NO: 3120088 - DNA, 18 bp, Homo sapiens
cataggtcactggctctc

SEQ ID NO: 3120089 - DNA, 23 bp, Homo sapiens
cataggttaaaaaaaaaagtcac

SEQ ID NO: 3120090 - DNA, 15 bp, Homo sapiens
catagtaactgacat

SEQ ID NO: 3120091 - DNA, 20 bp, Homo sapiens
catagtaactgacatgatta

SEQ ID NO: 3120092 - DNA, 21 bp, Homo sapiens
catagtaattcttaagtcttt

SEQ ID NO: 3120093 - DNA, 16 bp, Homo sapiens
catagtaccatttata

SEQ ID NO: 3120094 - DNA, 19 bp, Homo sapiens
catagtaccatttatacaa

SEQ ID NO: 3120095 - DNA, 21 bp, Homo sapiens
catagtactctttgtagcaaa

SEQ ID NO: 3120096 - DNA, 18 bp, Homo sapiens
catagtatggtggctggg

SEQ ID NO: 3120097 - DNA, 20 bp, Homo sapiens
catagtgagacccctgtctc

SEQ ID NO: 3120098 - DNA, 17 bp, Homo sapiens
catagtgctgggatgga

SEQ ID NO: 3120099 - DNA, 19 bp, Homo sapiens
catagtggggcctgggagg

SEQ ID NO: 3120100 - DNA, 12 bp, Homo sapiens
catagttcagaa

SEQ ID NO: 3120101 - DNA, 13 bp, Homo sapiens
catagttcagaat

SEQ ID NO: 3120102 - DNA, 19 bp, Homo sapiens
catagttcgtttaccttca

SEQ ID NO: 3120103 - DNA, 20 bp, Homo sapiens
catagttgtagacaaagtac

SEQ ID NO: 3120104 - DNA, 17 bp, Homo sapiens
catagtttttactgaac

SEQ ID NO: 3120105 - DNA, 17 bp, Homo sapiens
catataaaaacatcagt

SEQ ID NO: 3120106 - DNA, 18 bp, Homo sapiens
catataaatatatttaac

SEQ ID NO: 3120107 - DNA, 20 bp, Homo sapiens
catataaatgaatctggtgt

SEQ ID NO: 3120108 - DNA, 14 bp, Homo sapiens
catataagtttgaa

SEQ ID NO: 3120109 - DNA, 22 bp, Homo sapiens
catataagtttgaaggaaacag

SEQ ID NO: 3120110 - DNA, 23 bp, Homo sapiens
catataagtttgaaggaaacagt

SEQ ID NO: 3120111 - DNA, 15 bp, Homo sapiens
catataatgttgtta

SEQ ID NO: 3120112 - DNA, 13 bp, Homo sapiens
catataattttca

SEQ ID NO: 3120113 - DNA, 21 bp, Homo sapiens
catatacctataatgtgtgta

SEQ ID NO: 3120114 - DNA, 20 bp, Homo sapiens
catatagcattgataatctt

SEQ ID NO: 3120115 - DNA, 19 bp, Homo sapiens
catatagtaaacactcaat

SEQ ID NO: 3120116 - DNA, 20 bp, Homo sapiens
catatataacagatacattt

SEQ ID NO: 3120117 - DNA, 22 bp, Homo sapiens
catatatatgttttaagaggca

SEQ ID NO: 3120118 - DNA, 18 bp, Homo sapiens
catatatattttttgctt

SEQ ID NO: 3120119 - DNA, 17 bp, Homo sapiens
catatatgaggacttgt

SEQ ID NO: 3120120 - DNA, 14 bp, Homo sapiens
catatatgttcttc

SEQ ID NO: 3120121 - DNA, 17 bp, Homo sapiens
catatattttttagaaa

SEQ ID NO: 3120122 - DNA, 23 bp, Homo sapiens
catatcaattggcagtgactttg

SEQ ID NO: 3120123 - DNA, 22 bp, Homo sapiens
catatcatcaatgtgacattta

SEQ ID NO: 3120124 - DNA, 12 bp, Homo sapiens
catatcattttt

SEQ ID NO: 3120125 - DNA, 17 bp, Homo sapiens
catatccaagtaccaat

SEQ ID NO: 3120126 - DNA, 14 bp, Homo sapiens
catatccttgccct

SEQ ID NO: 3120127 - DNA, 14 bp, Homo sapiens
catatctccttccc

SEQ ID NO: 3120128 - DNA, 19 bp, Homo sapiens
catatcttctatatctgaa

SEQ ID NO: 3120129 - DNA, 22 bp, Homo sapiens
catatcttctatatctgaagag

SEQ ID NO: 3120130 - DNA, 22 bp, Homo sapiens
catatgactcacatgatgcata

SEQ ID NO: 3120131 - DNA, 23 bp, Homo sapiens
catatgactgattactcagagca

SEQ ID NO: 3120132 - DNA, 15 bp, Homo sapiens
catatgacttgatct

SEQ ID NO: 3120133 - DNA, 17 bp, Homo sapiens
catatgagtgtggaagc

SEQ ID NO: 3120134 - DNA, 15 bp, Homo sapiens
catatgctctgcttt

SEQ ID NO: 3120135 - DNA, 14 bp, Homo sapiens
catcacactgggtg

SEQ ID NO: 3120136 - DNA, 13 bp, Homo sapiens
catcacagcagcc

SEQ ID NO: 3120137 - DNA, 14 bp, Homo sapiens
catcacagcagcct

SEQ ID NO: 3120138 - DNA, 15 bp, Homo sapiens
catcacagggcagag

SEQ ID NO: 3120139 - DNA, 19 bp, Homo sapiens
catcacagggttgggccca

SEQ ID NO: 3120140 - DNA, 20 bp, Homo sapiens
catcaccaccgcctctggcc

SEQ ID NO: 3120141 - DNA, 19 bp, Homo sapiens
catcaccgacgcgtctcct

SEQ ID NO: 3120142 - DNA, 22 bp, Homo sapiens
catcaccgacgcgtctcctgtt

SEQ ID NO: 3120143 - DNA, 18 bp, Homo sapiens
catcacctcaggccaggt

SEQ ID NO: 3120144 - DNA, 22 bp, Homo sapiens
catcactatccatgcaccaaac

SEQ ID NO: 3120145 - DNA, 15 bp, Homo sapiens
catcactccctggat

SEQ ID NO: 3120146 - DNA, 16 bp, Homo sapiens
catcactctgctgctt

SEQ ID NO: 3120147 - DNA, 20 bp, Homo sapiens
catcactgcttgatgaagca

SEQ ID NO: 3120148 - DNA, 15 bp, Homo sapiens
catcacttttcagtg

SEQ ID NO: 3120149 - DNA, 12 bp, Homo sapiens
catcagacctgt

SEQ ID NO: 3120150 - DNA, 20 bp, Homo sapiens
catcagacctgtcttccaag

SEQ ID NO: 3120151 - DNA, 23 bp, Homo sapiens
catcagacctgtcttccaaggag

SEQ ID NO: 3120152 - DNA, 21 bp, Homo sapiens
catcagaggtttgcttcctca

SEQ ID NO: 3120153 - DNA, 12 bp, Homo sapiens
catcagcagcag

SEQ ID NO: 3120154 - DNA, 15 bp, Homo sapiens
catcagcagcagggt

SEQ ID NO: 3120155 - DNA, 22 bp, Homo sapiens
catcagcggcgcgccctgcaga

SEQ ID NO: 3120156 - DNA, 19 bp, Homo sapiens
catcagctgtaagaagaga

SEQ ID NO: 3120157 - DNA, 23 bp, Homo sapiens
catcagctgtaagaagagactgg

SEQ ID NO: 3120158 - DNA, 19 bp, Homo sapiens
catcaggaaggaaatgaca

SEQ ID NO: 3120159 - DNA, 15 bp, Homo sapiens
catcagggcctgggg

SEQ ID NO: 3120160 - DNA, 21 bp, Homo sapiens
catcagggcctggggcctgag

SEQ ID NO: 3120161 - DNA, 22 bp, Homo sapiens
catcagggcctggggcctgaga

SEQ ID NO: 3120162 - DNA, 15 bp, Homo sapiens
catcagtccctatgt

SEQ ID NO: 3120163 - DNA, 15 bp, Homo sapiens
catcagttattcatt

SEQ ID NO: 3120164 - DNA, 18 bp, Homo sapiens
catcagttcccccagtac

SEQ ID NO: 3120165 - DNA, 12 bp, Homo sapiens
catcataaaata

SEQ ID NO: 3120166 - DNA, 14 bp, Homo sapiens
catcataaaataaa

SEQ ID NO: 3120167 - DNA, 18 bp, Homo sapiens
catcataaaataaagtat

SEQ ID NO: 3120168 - DNA, 15 bp, Homo sapiens
catcataaaattttt

SEQ ID NO: 3120169 - DNA, 22 bp, Homo sapiens
catcataggaagggaccaaggc

SEQ ID NO: 3120170 - DNA, 15 bp, Homo sapiens
catcatatcccctgt

SEQ ID NO: 3120171 - DNA, 13 bp, Homo sapiens
catcatatgcctg

SEQ ID NO: 3120172 - DNA, 14 bp, Homo sapiens
catcatatgcctga

SEQ ID NO: 3120173 - DNA, 18 bp, Homo sapiens
catcatatgcctgacccc

SEQ ID NO: 3120174 - DNA, 14 bp, Homo sapiens
catcatcagggcct

SEQ ID NO: 3120175 - DNA, 13 bp, Homo sapiens
catcatcccagct

SEQ ID NO: 3120176 - DNA, 16 bp, Homo sapiens
catcatcctaagctat

SEQ ID NO: 3120177 - DNA, 14 bp, Homo sapiens
catcatcctttgtt

SEQ ID NO: 3120178 - DNA, 21 bp, Homo sapiens
catcatcctttgttctgagca

SEQ ID NO: 3120179 - DNA, 21 bp, Homo sapiens
catcatgccttgataaatata

SEQ ID NO: 3120180 - DNA, 14 bp, Homo sapiens
catcatggtggata

SEQ ID NO: 3120181 - DNA, 23 bp, Homo sapiens
catcatggtggatatggtgcaga

SEQ ID NO: 3120182 - DNA, 19 bp, Homo sapiens
catcattactgttccagat

SEQ ID NO: 3120183 - DNA, 17 bp, Homo sapiens
catcattataaacgtga

SEQ ID NO: 3120184 - DNA, 14 bp, Homo sapiens
catcattccctctc

SEQ ID NO: 3120185 - DNA, 20 bp, Homo sapiens
catcattccctctcatctca

SEQ ID NO: 3120186 - DNA, 20 bp, Homo sapiens
catcattgtttaggggtgaa

SEQ ID NO: 3120187 - DNA, 12 bp, Homo sapiens
catcattttaca

SEQ ID NO: 3120188 - DNA, 17 bp, Homo sapiens
catccaaaatatttttt

SEQ ID NO: 3120189 - DNA, 15 bp, Homo sapiens
catccaaccccccac

SEQ ID NO: 3120190 - DNA, 19 bp, Homo sapiens
catccaaccccccacctgc

SEQ ID NO: 3120191 - DNA, 21 bp, Homo sapiens
catccaaccccccacctgcca

SEQ ID NO: 3120192 - DNA, 14 bp, Homo sapiens
catccaaccttccc

SEQ ID NO: 3120193 - DNA, 15 bp, Homo sapiens
catccaactccagca

SEQ ID NO: 3120194 - DNA, 23 bp, Homo sapiens
catccaaggagaaacagagacag

SEQ ID NO: 3120195 - DNA, 16 bp, Homo sapiens
catccaaggcaaacaa

SEQ ID NO: 3120196 - DNA, 21 bp, Homo sapiens
catccaaggccaggttctccg

SEQ ID NO: 3120197 - DNA, 15 bp, Homo sapiens
catccaagtggcata

SEQ ID NO: 3120198 - DNA, 15 bp, Homo sapiens
catccaatcctcact

SEQ ID NO: 3120199 - DNA, 17 bp, Homo sapiens
catccaatcctcactgg

SEQ ID NO: 3120200 - DNA, 18 bp, Homo sapiens
catccaatcctcactggg

SEQ ID NO: 3120201 - DNA, 15 bp, Homo sapiens
catccacccagtgct

SEQ ID NO: 3120202 - DNA, 17 bp, Homo sapiens
catccacccagtgctgc

SEQ ID NO: 3120203 - DNA, 20 bp, Homo sapiens
catccacccagtgctgccat

SEQ ID NO: 3120204 - DNA, 22 bp, Homo sapiens
catccacccagtgctgccatgc

SEQ ID NO: 3120205 - DNA, 14 bp, Homo sapiens
catccaccccatcc

SEQ ID NO: 3120206 - DNA, 18 bp, Homo sapiens
catccaccgctgctccac

SEQ ID NO: 3120207 - DNA, 15 bp, Homo sapiens
catccaccttggctc

SEQ ID NO: 3120208 - DNA, 15 bp, Homo sapiens
catccactctaccct

SEQ ID NO: 3120209 - DNA, 18 bp, Homo sapiens
catccactctaccctccc

SEQ ID NO: 3120210 - DNA, 13 bp, Homo sapiens
cagtgagctgtgt

SEQ ID NO: 3120211 - DNA, 12 bp, Homo sapiens
cagtgaggaggg

SEQ ID NO: 3120212 - DNA, 21 bp, Homo sapiens
cagtgaggagggtggaggaag

SEQ ID NO: 3120213 - DNA, 23 bp, Homo sapiens
cagtgaggggtatatctgggctg

SEQ ID NO: 3120214 - DNA, 16 bp, Homo sapiens
cagtgagggtcttctt

SEQ ID NO: 3120215 - DNA, 17 bp, Homo sapiens
cagtgagtcgaggacag

SEQ ID NO: 3120216 - DNA, 18 bp, Homo sapiens
cagtgagtcgaggacagg

SEQ ID NO: 3120217 - DNA, 14 bp, Homo sapiens
cagtgagtgagcct

SEQ ID NO: 3120218 - DNA, 19 bp, Homo sapiens
cagtgagtgagcctggctc

SEQ ID NO: 3120219 - DNA, 16 bp, Homo sapiens
cagtgagtgtaaataa

SEQ ID NO: 3120220 - DNA, 19 bp, Homo sapiens
cagtgagtgtaaataattt

SEQ ID NO: 3120221 - DNA, 19 bp, Homo sapiens
cagtgataggcccaaggtc

SEQ ID NO: 3120222 - DNA, 15 bp, Homo sapiens
cagtgatatggcaga

SEQ ID NO: 3120223 - DNA, 22 bp, Homo sapiens
cagtgatatggcagaagacacc

SEQ ID NO: 3120224 - DNA, 13 bp, Homo sapiens
cagtgatctccat

SEQ ID NO: 3120225 - DNA, 22 bp, Homo sapiens
cagtgatggcgcgggaggcacc

SEQ ID NO: 3120226 - DNA, 17 bp, Homo sapiens
cagtgatgggagagtag

SEQ ID NO: 3120227 - DNA, 14 bp, Homo sapiens
cagtgattagcact

SEQ ID NO: 3120228 - DNA, 19 bp, Homo sapiens
cagtgatttttttcttgta

SEQ ID NO: 3120229 - DNA, 17 bp, Homo sapiens
cagtgcagaaatgaaat

SEQ ID NO: 3120230 - DNA, 21 bp, Homo sapiens
cagtgcagacaggccatgtga

SEQ ID NO: 3120231 - DNA, 14 bp, Homo sapiens
cagtgcagcagagg

SEQ ID NO: 3120232 - DNA, 15 bp, Homo sapiens
cagtgcagcagagga

SEQ ID NO: 3120233 - DNA, 16 bp, Homo sapiens
cagtgcagcagaggac

SEQ ID NO: 3120234 - DNA, 23 bp, Homo sapiens
cagtgcatagttgtagacaaagt

SEQ ID NO: 3120235 - DNA, 18 bp, Homo sapiens
cagtgcatattcctttct

SEQ ID NO: 3120236 - DNA, 12 bp, Homo sapiens
cagtgcatctca

SEQ ID NO: 3120237 - DNA, 22 bp, Homo sapiens
cagtgcatgtgaagcatgcttt

SEQ ID NO: 3120238 - DNA, 12 bp, Homo sapiens
cagtgccaagga

SEQ ID NO: 3120239 - DNA, 10 bp, Homo sapiens
cagtgccatt

SEQ ID NO: 3120240 - DNA, 18 bp, Homo sapiens
cagtgccattccactcca

SEQ ID NO: 3120241 - DNA, 22 bp, Homo sapiens
cagtgccattccactccactca

SEQ ID NO: 3120242 - DNA, 21 bp, Homo sapiens
cagtgccattgtctttatatg

SEQ ID NO: 3120243 - DNA, 22 bp, Homo sapiens
cagtgccattgtctttatatga

SEQ ID NO: 3120244 - DNA, 12 bp, Homo sapiens
cagtgcccacag

SEQ ID NO: 3120245 - DNA, 14 bp, Homo sapiens
cagtgcccatgcaa

SEQ ID NO: 3120246 - DNA, 23 bp, Homo sapiens
cagtgcccatgtgtacattctgc

SEQ ID NO: 3120247 - DNA, 18 bp, Homo sapiens
cagtgcctcgaggcaccg

SEQ ID NO: 3120248 - DNA, 19 bp, Homo sapiens
cagtgcctcgaggcaccgg

SEQ ID NO: 3120249 - DNA, 14 bp, Homo sapiens
cagtgcctgggaat

SEQ ID NO: 3120250 - DNA, 18 bp, Homo sapiens
cagtgcctgggaatgtat

SEQ ID NO: 3120251 - DNA, 14 bp, Homo sapiens
cagtgccttccata

SEQ ID NO: 3120252 - DNA, 23 bp, Homo sapiens
cagtgccttccataattatgaca

SEQ ID NO: 3120253 - DNA, 12 bp, Homo sapiens
cagtgccttgct

SEQ ID NO: 3120254 - DNA, 21 bp, Homo sapiens
cagtgccttggggaatttcct

SEQ ID NO: 3120255 - DNA, 17 bp, Homo sapiens
cagtgccttttggaact

SEQ ID NO: 3120256 - DNA, 24 bp, Homo sapiens
cagtgcgcgtgcacgtggagagct

SEQ ID NO: 3120257 - DNA, 16 bp, Homo sapiens
cagtgctagtgagctg

SEQ ID NO: 3120258 - DNA, 22 bp, Homo sapiens
cagtgctgccatgccactgcca

SEQ ID NO: 3120259 - DNA, 23 bp, Homo sapiens
cagtgctgccatgccactgccag

SEQ ID NO: 3120260 - DNA, 17 bp, Homo sapiens
cagtgctgctgtaaata

SEQ ID NO: 3120261 - DNA, 11 bp, Homo sapiens
cagtgctgctt

SEQ ID NO: 3120262 - DNA, 17 bp, Homo sapiens
cagtgctgggaccagag

SEQ ID NO: 3120263 - DNA, 12 bp, Homo sapiens
cagtgctgtggc

SEQ ID NO: 3120264 - DNA, 23 bp, Homo sapiens
cagggcctgcatgggggcaccgg

SEQ ID NO: 3120265 - DNA, 13 bp, Homo sapiens
cagggcctggagc

SEQ ID NO: 3120266 - DNA, 14 bp, Homo sapiens
cagggcctggagcc

SEQ ID NO: 3120267 - DNA, 12 bp, Homo sapiens
cagggcctgggg

SEQ ID NO: 3120268 - DNA, 22 bp, Homo sapiens
cagggcctggggagatggagga

SEQ ID NO: 3120269 - DNA, 15 bp, Homo sapiens
cagggcctggggcct

SEQ ID NO: 3120270 - DNA, 18 bp, Homo sapiens
cagggcctggggcctgag

SEQ ID NO: 3120271 - DNA, 23 bp, Homo sapiens
cagggcctggggcctgagagaat

SEQ ID NO: 3120272 - DNA, 20 bp, Homo sapiens
cagggcctgggggcagtgac

SEQ ID NO: 3120273 - DNA, 22 bp, Homo sapiens
cagggcctgggggcagtgactg

SEQ ID NO: 3120274 - DNA, 23 bp, Homo sapiens
cagggcctgggggcagtgactgg

SEQ ID NO: 3120275 - DNA, 20 bp, Homo sapiens
cagggcgagactctgtctca

SEQ ID NO: 3120276 - DNA, 15 bp, Homo sapiens
cagggcgctcagacg

SEQ ID NO: 3120277 - DNA, 19 bp, Homo sapiens
cagggcgctcagacggcgg

SEQ ID NO: 3120278 - DNA, 23 bp, Homo sapiens
cagggcgctcagacggcggccag

SEQ ID NO: 3120279 - DNA, 18 bp, Homo sapiens
cagggcgctgggaagggg

SEQ ID NO: 3120280 - DNA, 17 bp, Homo sapiens
cagggcgggcagagggc

SEQ ID NO: 3120281 - DNA, 17 bp, Homo sapiens
cagggctaccctccccc

SEQ ID NO: 3120282 - DNA, 23 bp, Homo sapiens
cagggctcagcggggacagctcc

SEQ ID NO: 3120283 - DNA, 15 bp, Homo sapiens
cagggctcctcccag

SEQ ID NO: 3120284 - DNA, 16 bp, Homo sapiens
cagggctcctcccagc

SEQ ID NO: 3120285 - DNA, 20 bp, Homo sapiens
cagggctcctcccagcttgt

SEQ ID NO: 3120286 - DNA, 22 bp, Homo sapiens
cagggctcctgccttctgtcct

SEQ ID NO: 3120287 - DNA, 17 bp, Homo sapiens
cagggctctgccccagt

SEQ ID NO: 3120288 - DNA, 19 bp, Homo sapiens
cagggctctgccccagtcg

SEQ ID NO: 3120289 - DNA, 16 bp, Homo sapiens
cagggctgccctgaga

SEQ ID NO: 3120290 - DNA, 20 bp, Homo sapiens
cagggctggagtgcgctctt

SEQ ID NO: 3120291 - DNA, 17 bp, Homo sapiens
cagggctggctctgcac

SEQ ID NO: 3120292 - DNA, 11 bp, Homo sapiens
cagggctgggg

SEQ ID NO: 3120293 - DNA, 12 bp, Homo sapiens
cagggctgggga

SEQ ID NO: 3120294 - DNA, 20 bp, Homo sapiens
cagggctggggacagagggt

SEQ ID NO: 3120295 - DNA, 16 bp, Homo sapiens
caggggaaaatgaagg

SEQ ID NO: 3120296 - DNA, 15 bp, Homo sapiens
caggggaacctgcca

SEQ ID NO: 3120297 - DNA, 22 bp, Homo sapiens
caggggacaggagtccactttg

SEQ ID NO: 3120298 - DNA, 17 bp, Homo sapiens
caggggaccacacctcc

SEQ ID NO: 3120299 - DNA, 17 bp, Homo sapiens
caggggactcagccctg

SEQ ID NO: 3120300 - DNA, 18 bp, Homo sapiens
caggggactcagccctga

SEQ ID NO: 3120301 - DNA, 20 bp, Homo sapiens
caggggactcagccctgagg

SEQ ID NO: 3120302 - DNA, 22 bp, Homo sapiens
caggggagacaggagcctagcg

SEQ ID NO: 3120303 - DNA, 18 bp, Homo sapiens
caggggagcgtgttcctg

SEQ ID NO: 3120304 - DNA, 16 bp, Homo sapiens
caggggaggaaaaaag

SEQ ID NO: 3120305 - DNA, 19 bp, Homo sapiens
caggggaggaaaaaagaac

SEQ ID NO: 3120306 - DNA, 21 bp, Homo sapiens
caggggattgtctcagggccg

SEQ ID NO: 3120307 - DNA, 14 bp, Homo sapiens
caggggcaggactg

SEQ ID NO: 3120308 - DNA, 15 bp, Homo sapiens
caggggcaggactga

SEQ ID NO: 3120309 - DNA, 20 bp, Homo sapiens
caggggcaggagaggctggg

SEQ ID NO: 3120310 - DNA, 23 bp, Homo sapiens
caggggcaggagaggctgggctg

SEQ ID NO: 3120311 - DNA, 13 bp, Homo sapiens
caggggcaggcct

SEQ ID NO: 3120312 - DNA, 17 bp, Homo sapiens
caggggccccagatctg

SEQ ID NO: 3120313 - DNA, 14 bp, Homo sapiens
caggggcctggaga

SEQ ID NO: 3120314 - DNA, 15 bp, Homo sapiens
caggggcctggagat

SEQ ID NO: 3120315 - DNA, 16 bp, Homo sapiens
caggggcgagttcctc

SEQ ID NO: 3120316 - DNA, 19 bp, Homo sapiens
caggggcggggcaggaatg

SEQ ID NO: 3120317 - DNA, 12 bp, Homo sapiens
caggggctccag

SEQ ID NO: 3120318 - DNA, 15 bp, Homo sapiens
caggggctctggaga

SEQ ID NO: 3120319 - DNA, 16 bp, Homo sapiens
caggggctctggagag

SEQ ID NO: 3120320 - DNA, 17 bp, Homo sapiens
caggggctctggagaga

SEQ ID NO: 3120321 - DNA, 19 bp, Homo sapiens
caggggctgacacttcaag

SEQ ID NO: 3120322 - DNA, 13 bp, Homo sapiens
caggggctgcttc

SEQ ID NO: 3120323 - DNA, 19 bp, Homo sapiens
caggggctgcttcctcctg

SEQ ID NO: 3120324 - DNA, 14 bp, Homo sapiens
caggggctgggggt

SEQ ID NO: 3120325 - DNA, 18 bp, Homo sapiens
cagggggactagcccctg

SEQ ID NO: 3120326 - DNA, 22 bp, Homo sapiens
cagggggatgccactcctccct

SEQ ID NO: 3120327 - DNA, 16 bp, Homo sapiens
cagggggatttggtag

SEQ ID NO: 3120328 - DNA, 20 bp, Homo sapiens
cagggggccccgccagggct

SEQ ID NO: 3120329 - DNA, 13 bp, Homo sapiens
caggggggctgtg

SEQ ID NO: 3120330 - DNA, 17 bp, Homo sapiens
caggggggctgtgccaa

SEQ ID NO: 3120331 - DNA, 13 bp, Homo sapiens
caggggtcagtgc

SEQ ID NO: 3120332 - DNA, 14 bp, Homo sapiens
caggggtcagtgca

SEQ ID NO: 3120333 - DNA, 20 bp, Homo sapiens
caggggtcccagccaccccg

SEQ ID NO: 3120334 - DNA, 17 bp, Homo sapiens
caggggtctccctggct

SEQ ID NO: 3120335 - DNA, 19 bp, Homo sapiens
caggggtctccctggctcc

SEQ ID NO: 3120336 - DNA, 16 bp, Homo sapiens
caggggtgccccctcc

SEQ ID NO: 3120337 - DNA, 17 bp, Homo sapiens
caggggtgccccctcct

SEQ ID NO: 3120338 - DNA, 22 bp, Homo sapiens
caggggtgccccctcctctccc

SEQ ID NO: 3120339 - DNA, 15 bp, Homo sapiens
caggggtggggggtg

SEQ ID NO: 3120340 - DNA, 16 bp, Homo sapiens
caggggtggggggtgc

SEQ ID NO: 3120341 - DNA, 19 bp, Homo sapiens
caggggtggggggtgcagg

SEQ ID NO: 3120342 - DNA, 16 bp, Homo sapiens
caggggttggctggga

SEQ ID NO: 3120343 - DNA, 22 bp, Homo sapiens
cagggtacccgcctgagctcct

SEQ ID NO: 3120344 - DNA, 23 bp, Homo sapiens
cagggtatggactatctgtctgg

SEQ ID NO: 3120345 - DNA, 17 bp, Homo sapiens
cagggtcccatttctca

SEQ ID NO: 3120346 - DNA, 21 bp, Homo sapiens
cagggtcccatttctcactga

SEQ ID NO: 3120347 - DNA, 19 bp, Homo sapiens
cagggtccccgagtgccta

SEQ ID NO: 3120348 - DNA, 13 bp, Homo sapiens
cagggtccctctg

SEQ ID NO: 3120349 - DNA, 15 bp, Homo sapiens
cagggtccgcaccag

SEQ ID NO: 3120350 - DNA, 16 bp, Homo sapiens
cagggtccgcaccagc

SEQ ID NO: 3120351 - DNA, 19 bp, Homo sapiens
cagggtccgcaccagctgc

SEQ ID NO: 3120352 - DNA, 23 bp, Homo sapiens
cagggtccgcaccagctgctctg

SEQ ID NO: 3120353 - DNA, 16 bp, Homo sapiens
cagggtcctcagctca

SEQ ID NO: 3120354 - DNA, 19 bp, Homo sapiens
cagggtccttttgacactg

SEQ ID NO: 3120355 - DNA, 23 bp, Homo sapiens
cagggtccttttgacactgctct

SEQ ID NO: 3120356 - DNA, 17 bp, Homo sapiens
cagggtctcactctgtc

SEQ ID NO: 3120357 - DNA, 21 bp, Homo sapiens
cagggtctctccctcaggtgt

SEQ ID NO: 3120358 - DNA, 21 bp, Homo sapiens
cagggtctgctctttctctgc

SEQ ID NO: 3120359 - DNA, 13 bp, Homo sapiens
cagggtcttccct

SEQ ID NO: 3120360 - DNA, 15 bp, Homo sapiens
cagggtcttgggcta

SEQ ID NO: 3120361 - DNA, 19 bp, Homo sapiens
cagggtcttgggctactgg

SEQ ID NO: 3120362 - DNA, 21 bp, Homo sapiens
cagggtcttgggctactggca

SEQ ID NO: 3120363 - DNA, 22 bp, Homo sapiens
cagggtggacttagaaagcagg

SEQ ID NO: 3120364 - DNA, 17 bp, Homo sapiens
cagggtgggcagcctat

SEQ ID NO: 3120365 - DNA, 20 bp, Homo sapiens
cagggtgggcagcctatggg

SEQ ID NO: 3120366 - DNA, 12 bp, Homo sapiens
cagggtgggggg

SEQ ID NO: 3120367 - DNA, 20 bp, Homo sapiens
cagggtggggggtgacagtg

SEQ ID NO: 3120368 - DNA, 13 bp, Homo sapiens
cagggttcatctg

SEQ ID NO: 3120369 - DNA, 23 bp, Homo sapiens
cagggttctcttagcaactcaga

SEQ ID NO: 3120370 - DNA, 15 bp, Homo sapiens
cagggttggcccctg

SEQ ID NO: 3120371 - DNA, 16 bp, Homo sapiens
cagggttggcccctgc

SEQ ID NO: 3120372 - DNA, 14 bp, Homo sapiens
cagggttgggccca

SEQ ID NO: 3120373 - DNA, 20 bp, Homo sapiens
cagggttgggcccagatctg

SEQ ID NO: 3120374 - DNA, 15 bp, Homo sapiens
cagggttggtgtgct

SEQ ID NO: 3120375 - DNA, 20 bp, Homo sapiens
caggtaaaacagggccacat

SEQ ID NO: 3120376 - DNA, 19 bp, Homo sapiens
caggtaaagggcaaataat

SEQ ID NO: 3120377 - DNA, 22 bp, Homo sapiens
caggtaaagggcaaataatgat

SEQ ID NO: 3120378 - DNA, 18 bp, Homo sapiens
caggtacaggagaggcag

SEQ ID NO: 3120379 - DNA, 21 bp, Homo sapiens
caggtaccacccttcagaccc

SEQ ID NO: 3120380 - DNA, 16 bp, Homo sapiens
caggtacggagaagaa

SEQ ID NO: 3120381 - DNA, 17 bp, Homo sapiens
caggtacttcctcctga

SEQ ID NO: 3120382 - DNA, 19 bp, Homo sapiens
caggtacttcctcctgatg

SEQ ID NO: 3120383 - DNA, 18 bp, Homo sapiens
caggtagatcgcttgagc

SEQ ID NO: 3120384 - DNA, 20 bp, Homo sapiens
caggtagatcgcttgagccc

SEQ ID NO: 3120385 - DNA, 12 bp, Homo sapiens
caggtaggccct

SEQ ID NO: 3120386 - DNA, 16 bp, Homo sapiens
caggtagggaaataat

SEQ ID NO: 3120387 - DNA, 16 bp, Homo sapiens
caggtagtttgtacca

SEQ ID NO: 3120388 - DNA, 23 bp, Homo sapiens
caggtatggaagggtttgtggct

SEQ ID NO: 3120389 - DNA, 16 bp, Homo sapiens
caggtatggctctgca

SEQ ID NO: 3120390 - DNA, 15 bp, Homo sapiens
caggtatgttgcctt

SEQ ID NO: 3120391 - DNA, 13 bp, Homo sapiens
caggtcaataaac

SEQ ID NO: 3120392 - DNA, 22 bp, Homo sapiens
caggtcaataaacttagaggaa

SEQ ID NO: 3120393 - DNA, 18 bp, Homo sapiens
caggtcagctgttacttt

SEQ ID NO: 3120394 - DNA, 21 bp, Homo sapiens
caggtcagctgttactttctt

SEQ ID NO: 3120395 - DNA, 22 bp, Homo sapiens
caggtcagggacttggacagga

SEQ ID NO: 3120396 - DNA, 15 bp, Homo sapiens
caggtccagatgtgc

SEQ ID NO: 3120397 - DNA, 17 bp, Homo sapiens
caggtccagctctggag

SEQ ID NO: 3120398 - DNA, 23 bp, Homo sapiens
caggtccagctctggaggggagg

SEQ ID NO: 3120399 - DNA, 18 bp, Homo sapiens
caggtccattttgcctga

SEQ ID NO: 3120400 - DNA, 19 bp, Homo sapiens
caggtcccacctccagccc

SEQ ID NO: 3120401 - DNA, 19 bp, Homo sapiens
caggtcccacgtctggcca

SEQ ID NO: 3120402 - DNA, 20 bp, Homo sapiens
caggtcccagccccttttcc

SEQ ID NO: 3120403 - DNA, 22 bp, Homo sapiens
caggtccctccgcggctggagc

SEQ ID NO: 3120404 - DNA, 18 bp, Homo sapiens
caggtcctgcccatgtgt

SEQ ID NO: 3120405 - DNA, 21 bp, Homo sapiens
caggtcctgcccatgtgtccc

SEQ ID NO: 3120406 - DNA, 12 bp, Homo sapiens
caggtctagact

SEQ ID NO: 3120407 - DNA, 12 bp, Homo sapiens
caggtctcccac

SEQ ID NO: 3120408 - DNA, 22 bp, Homo sapiens
caggtctcccacgtgggagaca

SEQ ID NO: 3120409 - DNA, 14 bp, Homo sapiens
caggtcttcatatt

SEQ ID NO: 3120410 - DNA, 22 bp, Homo sapiens
caggtcttcatatttttgatca

SEQ ID NO: 3120411 - DNA, 17 bp, Homo sapiens
caggtcttccagacctg

SEQ ID NO: 3120412 - DNA, 20 bp, Homo sapiens
caggtcttgaactcctggcc

SEQ ID NO: 3120413 - DNA, 23 bp, Homo sapiens
caggtcttgaactcctggcctca

SEQ ID NO: 3120414 - DNA, 18 bp, Homo sapiens
caggtgacatgtgaaacc

SEQ ID NO: 3120415 - DNA, 21 bp, Homo sapiens
caggtgaggtctgttcctttt

SEQ ID NO: 3120416 - DNA, 23 bp, Homo sapiens
caggtgatccacccacctcagcc

SEQ ID NO: 3120417 - DNA, 17 bp, Homo sapiens
caggtgcagatgggctg

SEQ ID NO: 3120418 - DNA, 21 bp, Homo sapiens
caggtgcagcccttcctccct

SEQ ID NO: 3120419 - DNA, 23 bp, Homo sapiens
caggtgcagcccttcctccctgt

SEQ ID NO: 3120420 - DNA, 12 bp, Homo sapiens
caggtgcagtgg

SEQ ID NO: 3120421 - DNA, 15 bp, Homo sapiens
caggtgcagtggctc

SEQ ID NO: 3120422 - DNA, 18 bp, Homo sapiens
caggtgccactccctgag

SEQ ID NO: 3120423 - DNA, 23 bp, Homo sapiens
caggtgccagcctgaggcagcca

SEQ ID NO: 3120424 - DNA, 12 bp, Homo sapiens
caggtgcctcca

SEQ ID NO: 3120425 - DNA, 13 bp, Homo sapiens
caggtgcctccag

SEQ ID NO: 3120426 - DNA, 16 bp, Homo sapiens
caggtgcctccaggtg

SEQ ID NO: 3120427 - DNA, 18 bp, Homo sapiens
caggtgcctccaggtgtg

SEQ ID NO: 3120428 - DNA, 19 bp, Homo sapiens
caggtgcctccaggtgtgc

SEQ ID NO: 3120429 - DNA, 19 bp, Homo sapiens
caggtgctcaataaatgat

SEQ ID NO: 3120430 - DNA, 23 bp, Homo sapiens
caggtgctcccctgacagtccct

SEQ ID NO: 3120431 - DNA, 19 bp, Homo sapiens
caggtggaaggcagacagc

SEQ ID NO: 3120432 - DNA, 22 bp, Homo sapiens
caatgtatgtgaaagtgtaaaa

SEQ ID NO: 3120433 - DNA, 19 bp, Homo sapiens
caatgtcacaacctctctg

SEQ ID NO: 3120434 - DNA, 21 bp, Homo sapiens
caatgtcatatactgccatgt

SEQ ID NO: 3120435 - DNA, 21 bp, Homo sapiens
caatgtcgagtatattattat

SEQ ID NO: 3120436 - DNA, 15 bp, Homo sapiens
caatgtgaactttat

SEQ ID NO: 3120437 - DNA, 18 bp, Homo sapiens
caatgtgaactttattaa

SEQ ID NO: 3120438 - DNA, 21 bp, Homo sapiens
caatgtgaactttattaaata

SEQ ID NO: 3120439 - DNA, 23 bp, Homo sapiens
caatgtgacacctaactcttttc

SEQ ID NO: 3120440 - DNA, 15 bp, Homo sapiens
caatgtgacatttac

SEQ ID NO: 3120441 - DNA, 14 bp, Homo sapiens
caatgtgagtccca

SEQ ID NO: 3120442 - DNA, 18 bp, Homo sapiens
caatgtgagtcccagagc

SEQ ID NO: 3120443 - DNA, 19 bp, Homo sapiens
caatgtgagtcccagagcc

SEQ ID NO: 3120444 - DNA, 13 bp, Homo sapiens
caatgtgcagtgt

SEQ ID NO: 3120445 - DNA, 16 bp, Homo sapiens
caatgtgctactgatt

SEQ ID NO: 3120446 - DNA, 16 bp, Homo sapiens
caatgtgtataaattg

SEQ ID NO: 3120447 - DNA, 15 bp, Homo sapiens
caatgtgtctttcta

SEQ ID NO: 3120448 - DNA, 22 bp, Homo sapiens
caatgtgtctttctaagaaatc

SEQ ID NO: 3120449 - DNA, 16 bp, Homo sapiens
caatgtgtttttctcc

SEQ ID NO: 3120450 - DNA, 19 bp, Homo sapiens
caatgttaaggaaactctt

SEQ ID NO: 3120451 - DNA, 18 bp, Homo sapiens
caatgttcattgtaatgt

SEQ ID NO: 3120452 - DNA, 12 bp, Homo sapiens
caatgttccatt

SEQ ID NO: 3120453 - DNA, 20 bp, Homo sapiens
caatgttgtccaacaataaa

SEQ ID NO: 3120454 - DNA, 14 bp, Homo sapiens
caatgtttgatgtc

SEQ ID NO: 3120455 - DNA, 17 bp, Homo sapiens
caattaaaccgcatgtg

SEQ ID NO: 3120456 - DNA, 12 bp, Homo sapiens
caattaaatgta

SEQ ID NO: 3120457 - DNA, 13 bp, Homo sapiens
caattaaatgtag

SEQ ID NO: 3120458 - DNA, 22 bp, Homo sapiens
caattaagttacaattacatct

SEQ ID NO: 3120459 - DNA, 23 bp, Homo sapiens
caattaagttacaattacatctc

SEQ ID NO: 3120460 - DNA, 18 bp, Homo sapiens
caattaatagtttgtcta

SEQ ID NO: 3120461 - DNA, 19 bp, Homo sapiens
caattaatagtttgtctat

SEQ ID NO: 3120462 - DNA, 19 bp, Homo sapiens
caattacagggtgactcac

SEQ ID NO: 3120463 - DNA, 15 bp, Homo sapiens
caattacatctctaa

SEQ ID NO: 3120464 - DNA, 19 bp, Homo sapiens
caattactaaattgtatac

SEQ ID NO: 3120465 - DNA, 15 bp, Homo sapiens
caattactttggtag

SEQ ID NO: 3120466 - DNA, 15 bp, Homo sapiens
caattaggaagtgta

SEQ ID NO: 3120467 - DNA, 16 bp, Homo sapiens
caattaggaagtgtaa

SEQ ID NO: 3120468 - DNA, 22 bp, Homo sapiens
caattaggaagtgtaacagctg

SEQ ID NO: 3120469 - DNA, 23 bp, Homo sapiens
caattaggaagtgtaacagctga

SEQ ID NO: 3120470 - DNA, 16 bp, Homo sapiens
caattagggcctagcc

SEQ ID NO: 3120471 - DNA, 17 bp, Homo sapiens
caattaggtttttcctt

SEQ ID NO: 3120472 - DNA, 13 bp, Homo sapiens
caattagtttcct

SEQ ID NO: 3120473 - DNA, 18 bp, Homo sapiens
caattatagtttctgagg

SEQ ID NO: 3120474 - DNA, 14 bp, Homo sapiens
caattattgatata

SEQ ID NO: 3120475 - DNA, 17 bp, Homo sapiens
caattattgatatatat

SEQ ID NO: 3120476 - DNA, 17 bp, Homo sapiens
caattattgttacacat

SEQ ID NO: 3120477 - DNA, 23 bp, Homo sapiens
caattatttatttcatgtcttta

SEQ ID NO: 3120478 - DNA, 17 bp, Homo sapiens
caattcaaaagttccaa

SEQ ID NO: 3120479 - DNA, 15 bp, Homo sapiens
caattccaaaggaat

SEQ ID NO: 3120480 - DNA, 16 bp, Homo sapiens
caattccaatatttct

SEQ ID NO: 3120481 - DNA, 17 bp, Homo sapiens
caattccaatatttctg

SEQ ID NO: 3120482 - DNA, 13 bp, Homo sapiens
caattccacctgc

SEQ ID NO: 3120483 - DNA, 18 bp, Homo sapiens
caattccatgctataaaa

SEQ ID NO: 3120484 - DNA, 12 bp, Homo sapiens
caattcccctct

SEQ ID NO: 3120485 - DNA, 16 bp, Homo sapiens
caattcctagataaaa

SEQ ID NO: 3120486 - DNA, 16 bp, Homo sapiens
caattctcctgcctca

SEQ ID NO: 3120487 - DNA, 13 bp, Homo sapiens
caattctgtccca

SEQ ID NO: 3120488 - DNA, 15 bp, Homo sapiens
caattctgtcccaat

SEQ ID NO: 3120489 - DNA, 14 bp, Homo sapiens
caattctgttttta

SEQ ID NO: 3120490 - DNA, 23 bp, Homo sapiens
caattctgtttttaatgctattt

SEQ ID NO: 3120491 - DNA, 17 bp, Homo sapiens
caattgaagtaaacttt

SEQ ID NO: 3120492 - DNA, 15 bp, Homo sapiens
caattgacaaatgat

SEQ ID NO: 3120493 - DNA, 19 bp, Homo sapiens
caattgactgtcactgttc

SEQ ID NO: 3120494 - DNA, 21 bp, Homo sapiens
caattggtaaaactcactgtg

SEQ ID NO: 3120495 - DNA, 15 bp, Homo sapiens
caattgtcatttata

SEQ ID NO: 3120496 - DNA, 21 bp, Homo sapiens
caattgtgagccaccacgtcc

SEQ ID NO: 3120497 - DNA, 21 bp, Homo sapiens
caattgtgggcataaactgtt

SEQ ID NO: 3120498 - DNA, 21 bp, Homo sapiens
caattgttgacagttctgaag

SEQ ID NO: 3120499 - DNA, 22 bp, Homo sapiens
caattgtttggggttgaaaatt

SEQ ID NO: 3120500 - DNA, 21 bp, Homo sapiens
caattgttttaatctgaaatt

SEQ ID NO: 3120501 - DNA, 15 bp, Homo sapiens
caatttatgggagaa

SEQ ID NO: 3120502 - DNA, 16 bp, Homo sapiens
caatttattactgaaa

SEQ ID NO: 3120503 - DNA, 11 bp, Homo sapiens
caatttcaagt

SEQ ID NO: 3120504 - DNA, 23 bp, Homo sapiens
caatttccctcaggttctatttt

SEQ ID NO: 3120505 - DNA, 13 bp, Homo sapiens
caatttcggattt

SEQ ID NO: 3120506 - DNA, 17 bp, Homo sapiens
caatttctaatttttaa

SEQ ID NO: 3120507 - DNA, 19 bp, Homo sapiens
caatttctaatttttaaga

SEQ ID NO: 3120508 - DNA, 22 bp, Homo sapiens
caatttctgtccttcagatgga

SEQ ID NO: 3120509 - DNA, 15 bp, Homo sapiens
caatttctgtgttgc

SEQ ID NO: 3120510 - DNA, 20 bp, Homo sapiens
caatttctgtgttgccaagc

SEQ ID NO: 3120511 - DNA, 14 bp, Homo sapiens
caatttcttccttc

SEQ ID NO: 3120512 - DNA, 17 bp, Homo sapiens
caatttcttggtattat

SEQ ID NO: 3120513 - DNA, 22 bp, Homo sapiens
caatttctttctttccttaata

SEQ ID NO: 3120514 - DNA, 20 bp, Homo sapiens
caatttgcactaaatcagag

SEQ ID NO: 3120515 - DNA, 22 bp, Homo sapiens
caatttggtaaaaatgctgctc

SEQ ID NO: 3120516 - DNA, 19 bp, Homo sapiens
caatttgtaaaaacagcat

SEQ ID NO: 3120517 - DNA, 23 bp, Homo sapiens
caatttgtaaaaacagcattgct

SEQ ID NO: 3120518 - DNA, 15 bp, Homo sapiens
caatttgtattactt

SEQ ID NO: 3120519 - DNA, 15 bp, Homo sapiens
caattttatctgttt

SEQ ID NO: 3120520 - DNA, 18 bp, Homo sapiens
caattttattaaatgcat

SEQ ID NO: 3120521 - DNA, 18 bp, Homo sapiens
caattttcattaaacttg

SEQ ID NO: 3120522 - DNA, 20 bp, Homo sapiens
caattttcattaaacttgaa

SEQ ID NO: 3120523 - DNA, 20 bp, Homo sapiens
caattttctggaatacatga

SEQ ID NO: 3120524 - DNA, 12 bp, Homo sapiens
caatttttaata

SEQ ID NO: 3120525 - DNA, 14 bp, Homo sapiens
caatttttaggaag

SEQ ID NO: 3120526 - DNA, 16 bp, Homo sapiens
caatttttgtctcaga

SEQ ID NO: 3120527 - DNA, 21 bp, Homo sapiens
caattttttatcatgcatgtc

SEQ ID NO: 3120528 - DNA, 17 bp, Homo sapiens
caattttttatttttat

SEQ ID NO: 3120529 - DNA, 16 bp, Homo sapiens
caattttttttttcct

SEQ ID NO: 3120530 - DNA, 22 bp, Homo sapiens
cacaaaaaaaatttaaaaaaat

SEQ ID NO: 3120531 - DNA, 20 bp, Homo sapiens
cacaaaactccgcccccagc

SEQ ID NO: 3120532 - DNA, 22 bp, Homo sapiens
cacaaaactccgcccccagcct

SEQ ID NO: 3120533 - DNA, 22 bp, Homo sapiens
cacaaaatatattttgtttaca

SEQ ID NO: 3120534 - DNA, 13 bp, Homo sapiens
cacaaaattcaaa

SEQ ID NO: 3120535 - DNA, 13 bp, Homo sapiens
cacaaacattttt

SEQ ID NO: 3120536 - DNA, 18 bp, Homo sapiens
cacaaaccacaactgaca

SEQ ID NO: 3120537 - DNA, 19 bp, Homo sapiens
cacaaaccacaactgacac

SEQ ID NO: 3120538 - DNA, 17 bp, Homo sapiens
cacaaaccttctgcctt

SEQ ID NO: 3120539 - DNA, 23 bp, Homo sapiens
cacaaacgtttacttatcttatg

SEQ ID NO: 3120540 - DNA, 12 bp, Homo sapiens
cacaaactgtaa

SEQ ID NO: 3120541 - DNA, 15 bp, Homo sapiens
cacaaactgtaaata

SEQ ID NO: 3120542 - DNA, 17 bp, Homo sapiens
cacaaagactccttcgt

SEQ ID NO: 3120543 - DNA, 15 bp, Homo sapiens
cacaaagagttctgg

SEQ ID NO: 3120544 - DNA, 21 bp, Homo sapiens
cacaaagagttctggaaaaga

SEQ ID NO: 3120545 - DNA, 16 bp, Homo sapiens
cacaaagattttctaa

SEQ ID NO: 3120546 - DNA, 20 bp, Homo sapiens
cacaaagccttatcaagtgt

SEQ ID NO: 3120547 - DNA, 19 bp, Homo sapiens
cacaaagcggggggagggt

SEQ ID NO: 3120548 - DNA, 14 bp, Homo sapiens
cacaaatattattt

SEQ ID NO: 3120549 - DNA, 19 bp, Homo sapiens
cacaaatgtgatttttgta

SEQ ID NO: 3120550 - DNA, 13 bp, Homo sapiens
cacaaattttcaa

SEQ ID NO: 3120551 - DNA, 18 bp, Homo sapiens
cacaaattttcaagttta

SEQ ID NO: 3120552 - DNA, 16 bp, Homo sapiens
cacaacagaataaagc

SEQ ID NO: 3120553 - DNA, 23 bp, Homo sapiens
cacaacagaataaagcagcctga

SEQ ID NO: 3120554 - DNA, 12 bp, Homo sapiens
cacaacagcagt

SEQ ID NO: 3120555 - DNA, 14 bp, Homo sapiens
cacatgtttcctct

SEQ ID NO: 3120556 - DNA, 15 bp, Homo sapiens
cacatgtttcctcta

SEQ ID NO: 3120557 - DNA, 19 bp, Homo sapiens
cacattaaaaaatgaaata

SEQ ID NO: 3120558 - DNA, 13 bp, Homo sapiens
cacattaattaat

SEQ ID NO: 3120559 - DNA, 19 bp, Homo sapiens
cacattaattaattaaagc

SEQ ID NO: 3120560 - DNA, 16 bp, Homo sapiens
cacattatcgggagca

SEQ ID NO: 3120561 - DNA, 17 bp, Homo sapiens
cacattatcgggagcag

SEQ ID NO: 3120562 - DNA, 22 bp, Homo sapiens
cacattatcgggagcagtgtct

SEQ ID NO: 3120563 - DNA, 23 bp, Homo sapiens
cacattatcgggagcagtgtctt

SEQ ID NO: 3120564 - DNA, 13 bp, Homo sapiens
cacattatttgca

SEQ ID NO: 3120565 - DNA, 15 bp, Homo sapiens
cacattatttgcatg

SEQ ID NO: 3120566 - DNA, 13 bp, Homo sapiens
cacattcttggct

SEQ ID NO: 3120567 - DNA, 24 bp, Homo sapiens
cacattgaatcatgtaggatcttg

SEQ ID NO: 3120568 - DNA, 23 bp, Homo sapiens
cacattgagctgatataaattct

SEQ ID NO: 3120569 - DNA, 19 bp, Homo sapiens
cacattgtttgctgctatt

SEQ ID NO: 3120570 - DNA, 16 bp, Homo sapiens
cacatttcacattgaa

SEQ ID NO: 3120571 - DNA, 17 bp, Homo sapiens
cacatttctaaaatctt

SEQ ID NO: 3120572 - DNA, 13 bp, Homo sapiens
cacatttctggat

SEQ ID NO: 3120573 - DNA, 17 bp, Homo sapiens
cacatttgattctgtgt

SEQ ID NO: 3120574 - DNA, 16 bp, Homo sapiens
cacatttggaatactt

SEQ ID NO: 3120575 - DNA, 22 bp, Homo sapiens
cacatttgggatgttccttttt

SEQ ID NO: 3120576 - DNA, 22 bp, Homo sapiens
cacatttgtcagtatttttgcc

SEQ ID NO: 3120577 - DNA, 18 bp, Homo sapiens
cacattttccttttcaaa

SEQ ID NO: 3120578 - DNA, 14 bp, Homo sapiens
caccaaagacatca

SEQ ID NO: 3120579 - DNA, 16 bp, Homo sapiens
caccaaagttctaata

SEQ ID NO: 3120580 - DNA, 23 bp, Homo sapiens
caccaaccagacagcacagggca

SEQ ID NO: 3120581 - DNA, 13 bp, Homo sapiens
caccaaccctcag

SEQ ID NO: 3120582 - DNA, 18 bp, Homo sapiens
caccaactcctaatttta

SEQ ID NO: 3120583 - DNA, 15 bp, Homo sapiens
caccaagaaagcagg

SEQ ID NO: 3120584 - DNA, 22 bp, Homo sapiens
caccaatcccagggctggctct

SEQ ID NO: 3120585 - DNA, 23 bp, Homo sapiens
caccaatcccagggctggctctg

SEQ ID NO: 3120586 - DNA, 23 bp, Homo sapiens
caccaatttggtaaaaatgctgc

SEQ ID NO: 3120587 - DNA, 13 bp, Homo sapiens
caccacacccagc

SEQ ID NO: 3120588 - DNA, 14 bp, Homo sapiens
caccacacccagcc

SEQ ID NO: 3120589 - DNA, 18 bp, Homo sapiens
caccacacccagcctcag

SEQ ID NO: 3120590 - DNA, 21 bp, Homo sapiens
caccacagacacacacacgca

SEQ ID NO: 3120591 - DNA, 18 bp, Homo sapiens
caccacatcctccgtcca

SEQ ID NO: 3120592 - DNA, 19 bp, Homo sapiens
caccacatctgccagacct

SEQ ID NO: 3120593 - DNA, 15 bp, Homo sapiens
caccacatgtgcaca

SEQ ID NO: 3120594 - DNA, 19 bp, Homo sapiens
caccacatgtgcacatgca

SEQ ID NO: 3120595 - DNA, 13 bp, Homo sapiens
caccaccaagcca

SEQ ID NO: 3120596 - DNA, 15 bp, Homo sapiens
caccaccactggcca

SEQ ID NO: 3120597 - DNA, 16 bp, Homo sapiens
caccaccactggccac

SEQ ID NO: 3120598 - DNA, 23 bp, Homo sapiens
caccaccactggccaccaggctg

SEQ ID NO: 3120599 - DNA, 18 bp, Homo sapiens
caccaccccctcaagccc

SEQ ID NO: 3120600 - DNA, 16 bp, Homo sapiens
caccacccgaaatgcc

SEQ ID NO: 3120601 - DNA, 14 bp, Homo sapiens
caccaccgcctctg

SEQ ID NO: 3120602 - DNA, 22 bp, Homo sapiens
caccaccgcctctggccgccac

SEQ ID NO: 3120603 - DNA, 22 bp, Homo sapiens
caccacggcgttgtacctgtag

SEQ ID NO: 3120604 - DNA, 16 bp, Homo sapiens
caccacggcgtttttt

SEQ ID NO: 3120605 - DNA, 16 bp, Homo sapiens
caccacgtctgccagg

SEQ ID NO: 3120606 - DNA, 19 bp, Homo sapiens
caccacgtctgccaggccc

SEQ ID NO: 3120607 - DNA, 15 bp, Homo sapiens
caccactgcactcca

SEQ ID NO: 3120608 - DNA, 19 bp, Homo sapiens
caccactgcactccagcct

SEQ ID NO: 3120609 - DNA, 21 bp, Homo sapiens
caccactgcactccagcctgg

SEQ ID NO: 3120610 - DNA, 18 bp, Homo sapiens
caccactgccctgcctgc

SEQ ID NO: 3120611 - DNA, 14 bp, Homo sapiens
caccactgcctgac

SEQ ID NO: 3120612 - DNA, 16 bp, Homo sapiens
caccactggccaccag

SEQ ID NO: 3120613 - DNA, 16 bp, Homo sapiens
caccagagaccgtcct

SEQ ID NO: 3120614 - DNA, 21 bp, Homo sapiens
caccagagaccgtcctcaccc

SEQ ID NO: 3120615 - DNA, 18 bp, Homo sapiens
caccagagcaacctctca

SEQ ID NO: 3120616 - DNA, 17 bp, Homo sapiens
caccagagcagatgcag

SEQ ID NO: 3120617 - DNA, 20 bp, Homo sapiens
caccagagcccaccttggct

SEQ ID NO: 3120618 - DNA, 22 bp, Homo sapiens
caccagagcccaccttggctca

SEQ ID NO: 3120619 - DNA, 23 bp, Homo sapiens
caccagagtgaaagggctatggc

SEQ ID NO: 3120620 - DNA, 16 bp, Homo sapiens
caccagatagcagagg

SEQ ID NO: 3120621 - DNA, 12 bp, Homo sapiens
caccagatgctg

SEQ ID NO: 3120622 - DNA, 12 bp, Homo sapiens
caccagccagcg

SEQ ID NO: 3120623 - DNA, 21 bp, Homo sapiens
caccagcccatggccctgtgc

SEQ ID NO: 3120624 - DNA, 12 bp, Homo sapiens
caccagccccac

SEQ ID NO: 3120625 - DNA, 16 bp, Homo sapiens
caccagccccagtgcc

SEQ ID NO: 3120626 - DNA, 17 bp, Homo sapiens
caccagccccagtgccc

SEQ ID NO: 3120627 - DNA, 18 bp, Homo sapiens
caccagccccagtgccca

SEQ ID NO: 3120628 - DNA, 22 bp, Homo sapiens
caccagccccagtgcccacagg

SEQ ID NO: 3120629 - DNA, 24 bp, Homo sapiens
caccagccccctggatgggcattg

SEQ ID NO: 3120630 - DNA, 14 bp, Homo sapiens
caccagcccctgcc

SEQ ID NO: 3120631 - DNA, 15 bp, Homo sapiens
caccagcccctgccc

SEQ ID NO: 3120632 - DNA, 21 bp, Homo sapiens
caccagcccctgccccagccc

SEQ ID NO: 3120633 - DNA, 18 bp, Homo sapiens
caccagcccggcctgctc

SEQ ID NO: 3120634 - DNA, 15 bp, Homo sapiens
caccagccgccccag

SEQ ID NO: 3120635 - DNA, 16 bp, Homo sapiens
caccagccgccccagc

SEQ ID NO: 3120636 - DNA, 17 bp, Homo sapiens
caccagccgctgcaggg

SEQ ID NO: 3120637 - DNA, 21 bp, Homo sapiens
caccagcctggtgcccatcct

SEQ ID NO: 3120638 - DNA, 11 bp, Homo sapiens
caccagctctg

SEQ ID NO: 3120639 - DNA, 19 bp, Homo sapiens
caccagctctgtggcctgt

SEQ ID NO: 3120640 - DNA, 15 bp, Homo sapiens
caccagctgctctgc

SEQ ID NO: 3120641 - DNA, 16 bp, Homo sapiens
caccagctgctctgcc

SEQ ID NO: 3120642 - DNA, 19 bp, Homo sapiens
caccaggccacctccccag

SEQ ID NO: 3120643 - DNA, 17 bp, Homo sapiens
caccaggcgctaattca

SEQ ID NO: 3120644 - DNA, 16 bp, Homo sapiens
caccaggctgtgggcc

SEQ ID NO: 3120645 - DNA, 17 bp, Homo sapiens
caccaggctgtgggcct

SEQ ID NO: 3120646 - DNA, 15 bp, Homo sapiens
caccagggaagaaga

SEQ ID NO: 3120647 - DNA, 18 bp, Homo sapiens
caccagggcgctgggaag

SEQ ID NO: 3120648 - DNA, 18 bp, Homo sapiens
caccaggggaggagcctg

SEQ ID NO: 3120649 - DNA, 20 bp, Homo sapiens
caccaggggaggagcctgtg

SEQ ID NO: 3120650 - DNA, 19 bp, Homo sapiens
caccagggtccgcaccagc

SEQ ID NO: 3120651 - DNA, 20 bp, Homo sapiens
caccagggtccgcaccagct

SEQ ID NO: 3120652 - DNA, 21 bp, Homo sapiens
caccagggtccgcaccagctg

SEQ ID NO: 3120653 - DNA, 23 bp, Homo sapiens
caccagtcacatgacctgatcac

SEQ ID NO: 3120654 - DNA, 16 bp, Homo sapiens
caccagtgaaagaagc

SEQ ID NO: 3120655 - DNA, 14 bp, Homo sapiens
caccagtgtcccct

SEQ ID NO: 3120656 - DNA, 23 bp, Homo sapiens
caccagtgtggggttctgctggg

SEQ ID NO: 3120657 - DNA, 11 bp, Homo sapiens
caccagttctc

SEQ ID NO: 3120658 - DNA, 14 bp, Homo sapiens
caccatatgaattg

SEQ ID NO: 3120659 - DNA, 21 bp, Homo sapiens
caccatattcagtgctgtggc

SEQ ID NO: 3120660 - DNA, 18 bp, Homo sapiens
caccatcatgtctggcta

SEQ ID NO: 3120661 - DNA, 15 bp, Homo sapiens
caccatcctgcagcc

SEQ ID NO: 3120662 - DNA, 10 bp, Homo sapiens
caccatctct

SEQ ID NO: 3120663 - DNA, 13 bp, Homo sapiens
caccatctcttca

SEQ ID NO: 3120664 - DNA, 13 bp, Homo sapiens
caccatctgcttg

SEQ ID NO: 3120665 - DNA, 14 bp, Homo sapiens
caccatgtctggct

SEQ ID NO: 3120666 - DNA, 15 bp, Homo sapiens
caccatgtgccatct

SEQ ID NO: 3120667 - DNA, 20 bp, Homo sapiens
caccatgttgcccaggctgg

SEQ ID NO: 3120668 - DNA, 19 bp, Homo sapiens
caccattatattttgaaag

SEQ ID NO: 3120669 - DNA, 14 bp, Homo sapiens
caccattcctgcct

SEQ ID NO: 3120670 - DNA, 13 bp, Homo sapiens
caccattcctgga

SEQ ID NO: 3120671 - DNA, 20 bp, Homo sapiens
caccattgtgaagcacctac

SEQ ID NO: 3120672 - DNA, 13 bp, Homo sapiens
cacccaactactg

SEQ ID NO: 3120673 - DNA, 18 bp, Homo sapiens
cacccaagcctgctggct

SEQ ID NO: 3120674 - DNA, 19 bp, Homo sapiens
cacccaatcaagggaagaa

SEQ ID NO: 3120675 - DNA, 15 bp, Homo sapiens
cacccaatgctgctc

SEQ ID NO: 3120676 - DNA, 18 bp, Homo sapiens
cacccaatgctgctccac

SEQ ID NO: 3120677 - DNA, 14 bp, Homo sapiens
cacccacaatccca

SEQ ID NO: 3120678 - DNA, 22 bp, Homo sapiens
cacccaccatcatgtctggcta

SEQ ID NO: 3120679 - DNA, 20 bp, Homo sapiens
cacccaccgtccgccctgct

SEQ ID NO: 3120680 - DNA, 22 bp, Homo sapiens
cacccaccgtccgccctgctcc

SEQ ID NO: 3120681 - DNA, 23 bp, Homo sapiens
cacccaccgtccgccctgctcct

SEQ ID NO: 3120682 - DNA, 12 bp, Homo sapiens
cacccacctcag

SEQ ID NO: 3120683 - DNA, 13 bp, Homo sapiens
cacccacctcagc

SEQ ID NO: 3120684 - DNA, 12 bp, Homo sapiens
cacccacctcca

SEQ ID NO: 3120685 - DNA, 21 bp, Homo sapiens
cacccacgcatacacacatgc

SEQ ID NO: 3120686 - DNA, 16 bp, Homo sapiens
cacccactcaggattg

SEQ ID NO: 3120687 - DNA, 12 bp, Homo sapiens
cacccagcccac

SEQ ID NO: 3120688 - DNA, 15 bp, Homo sapiens
cacccagcccctggc

SEQ ID NO: 3120689 - DNA, 15 bp, Homo sapiens
cacccagcctcagtc

SEQ ID NO: 3120690 - DNA, 15 bp, Homo sapiens
cacccagctccaggg

SEQ ID NO: 3120691 - DNA, 24 bp, Homo sapiens
cacccaggagccccgaggccttct

SEQ ID NO: 3120692 - DNA, 16 bp, Homo sapiens
cacccagtgctgccat

SEQ ID NO: 3120693 - DNA, 17 bp, Homo sapiens
cacccagtgctgccatg

SEQ ID NO: 3120694 - DNA, 21 bp, Homo sapiens
cacccagtgctgccatgccac

SEQ ID NO: 3120695 - DNA, 17 bp, Homo sapiens
cacccatcttcctgctg

SEQ ID NO: 3120696 - DNA, 18 bp, Homo sapiens
cacccatcttcctgctgc

SEQ ID NO: 3120697 - DNA, 15 bp, Homo sapiens
cacccatgaagacag

SEQ ID NO: 3120698 - DNA, 20 bp, Homo sapiens
cacccatgacaatcaccttc

SEQ ID NO: 3120699 - DNA, 16 bp, Homo sapiens
caccccacaccccagc

SEQ ID NO: 3120700 - DNA, 20 bp, Homo sapiens
caccccacaccccagcccac

SEQ ID NO: 3120701 - DNA, 16 bp, Homo sapiens
caccccacagaacctt

SEQ ID NO: 3120702 - DNA, 23 bp, Homo sapiens
caccccacagactccggcctgta

SEQ ID NO: 3120703 - DNA, 11 bp, Homo sapiens
caccccacctg

SEQ ID NO: 3120704 - DNA, 22 bp, Homo sapiens
caccccactgcaatcctgtctt

SEQ ID NO: 3120705 - DNA, 14 bp, Homo sapiens
caccccagcccacc

SEQ ID NO: 3120706 - DNA, 19 bp, Homo sapiens
caccccagctaccccttct

SEQ ID NO: 3120707 - DNA, 14 bp, Homo sapiens
caccccaggccctt

SEQ ID NO: 3120708 - DNA, 12 bp, Homo sapiens
caccccatccca

SEQ ID NO: 3120709 - DNA, 15 bp, Homo sapiens
caccccatcccacac

SEQ ID NO: 3120710 - DNA, 23 bp, Homo sapiens
cacccccacaagctgtccctgca

SEQ ID NO: 3120711 - DNA, 13 bp, Homo sapiens
cacccccacccac

SEQ ID NO: 3120712 - DNA, 13 bp, Homo sapiens
cacccccatctct

SEQ ID NO: 3120713 - DNA, 17 bp, Homo sapiens
cacccccatctctccct

SEQ ID NO: 3120714 - DNA, 13 bp, Homo sapiens
cacccccatcttc

SEQ ID NO: 3120715 - DNA, 12 bp, Homo sapiens
cacccccatggc

SEQ ID NO: 3120716 - DNA, 16 bp, Homo sapiens
cacccccctgttctaa

SEQ ID NO: 3120717 - DNA, 18 bp, Homo sapiens
caccccctcaagccccag

SEQ ID NO: 3120718 - DNA, 21 bp, Homo sapiens
caccccctcaagccccagcag

SEQ ID NO: 3120719 - DNA, 18 bp, Homo sapiens
caccccctgctccaccag

SEQ ID NO: 3120720 - DNA, 13 bp, Homo sapiens
cacccccttcccc

SEQ ID NO: 3120721 - DNA, 14 bp, Homo sapiens
cacccccttccccc

SEQ ID NO: 3120722 - DNA, 16 bp, Homo sapiens
cacccccttctctgct

SEQ ID NO: 3120723 - DNA, 17 bp, Homo sapiens
cacccccttctctgctc

SEQ ID NO: 3120724 - DNA, 22 bp, Homo sapiens
cacccccttctctgctccacca

SEQ ID NO: 3120725 - DNA, 16 bp, Homo sapiens
caccccgcctgccctc

SEQ ID NO: 3120726 - DNA, 18 bp, Homo sapiens
caccccggcctcagggcg

SEQ ID NO: 3120727 - DNA, 19 bp, Homo sapiens
caccccggcctccactccc

SEQ ID NO: 3120728 - DNA, 18 bp, Homo sapiens
caccccgggctctctgct

SEQ ID NO: 3120729 - DNA, 17 bp, Homo sapiens
caccccggggaccctgt

SEQ ID NO: 3120730 - DNA, 20 bp, Homo sapiens
caccccgttacagctcccca

SEQ ID NO: 3120731 - DNA, 12 bp, Homo sapiens
cacccctcactc

SEQ ID NO: 3120732 - DNA, 16 bp, Homo sapiens
cacccctctgccctca

SEQ ID NO: 3120733 - DNA, 18 bp, Homo sapiens
cacccctgcccccagccc

SEQ ID NO: 3120734 - DNA, 22 bp, Homo sapiens
cacccctgcctcccatgcctgg

SEQ ID NO: 3120735 - DNA, 12 bp, Homo sapiens
cacccctgggca

SEQ ID NO: 3120736 - DNA, 17 bp, Homo sapiens
cacccctgtcctcactg

SEQ ID NO: 3120737 - DNA, 21 bp, Homo sapiens
cacccctgtcctcactgctcc

SEQ ID NO: 3120738 - DNA, 12 bp, Homo sapiens
cacccctgtgct

SEQ ID NO: 3120739 - DNA, 13 bp, Homo sapiens
cacccctgtgctc

SEQ ID NO: 3120740 - DNA, 17 bp, Homo sapiens
cacccctgtgctccgtg

SEQ ID NO: 3120741 - DNA, 14 bp, Homo sapiens
caccccttaggccc

SEQ ID NO: 3120742 - DNA, 15 bp, Homo sapiens
caccccttccatgtg

SEQ ID NO: 3120743 - DNA, 13 bp, Homo sapiens
caccccttcccca

SEQ ID NO: 3120744 - DNA, 19 bp, Homo sapiens
caccccttggaggagagag

SEQ ID NO: 3120745 - DNA, 21 bp, Homo sapiens
caccccttggaggagagagac

SEQ ID NO: 3120746 - DNA, 22 bp, Homo sapiens
caccccttggaggagagagacc

SEQ ID NO: 3120747 - DNA, 12 bp, Homo sapiens
cacccctttcta

SEQ ID NO: 3120748 - DNA, 14 bp, Homo sapiens
cacccgaaatgcca

SEQ ID NO: 3120749 - DNA, 14 bp, Homo sapiens
cacccgatgctgct

SEQ ID NO: 3120750 - DNA, 16 bp, Homo sapiens
cacccgatgctgcttt

SEQ ID NO: 3120751 - DNA, 18 bp, Homo sapiens
cacccgatgctgctttcc

SEQ ID NO: 3120752 - DNA, 14 bp, Homo sapiens
cacccgcctctccc

SEQ ID NO: 3120753 - DNA, 12 bp, Homo sapiens
cacccggcccct

SEQ ID NO: 3120754 - DNA, 19 bp, Homo sapiens
cacccggggccagagacat

SEQ ID NO: 3120755 - DNA, 21 bp, Homo sapiens
cacccggttaccttggccgtg

SEQ ID NO: 3120756 - DNA, 17 bp, Homo sapiens
cacccgtgagcgcctgt

SEQ ID NO: 3120757 - DNA, 17 bp, Homo sapiens
cacccgtggggtgctgc

SEQ ID NO: 3120758 - DNA, 18 bp, Homo sapiens
cacccgtggggtgctgcc

SEQ ID NO: 3120759 - DNA, 21 bp, Homo sapiens
cacccgttcccactgccctgg

SEQ ID NO: 3120760 - DNA, 20 bp, Homo sapiens
cacccgttctgctggcctgg

SEQ ID NO: 3120761 - DNA, 16 bp, Homo sapiens
caccctacctgtgcct

SEQ ID NO: 3120762 - DNA, 15 bp, Homo sapiens
caccctactctggat

SEQ ID NO: 3120763 - DNA, 16 bp, Homo sapiens
caccctagtcccttcc

SEQ ID NO: 3120764 - DNA, 18 bp, Homo sapiens
caccctagtcccttcccc

SEQ ID NO: 3120765 - DNA, 18 bp, Homo sapiens
caccctcaacctcttctg

SEQ ID NO: 3120766 - DNA, 14 bp, Homo sapiens
caccctcacacaca

SEQ ID NO: 3120767 - DNA, 23 bp, Homo sapiens
caccctcacacacacagctgggc

SEQ ID NO: 3120768 - DNA, 17 bp, Homo sapiens
caccctcactctgccag

SEQ ID NO: 3120769 - DNA, 16 bp, Homo sapiens
caccctcagcacccct

SEQ ID NO: 3120770 - DNA, 20 bp, Homo sapiens
caccctcagcaccccttcca

SEQ ID NO: 3120771 - DNA, 17 bp, Homo sapiens
caccctccaccctgtcc

SEQ ID NO: 3120772 - DNA, 17 bp, Homo sapiens
caccctccacctcttca

SEQ ID NO: 3120773 - DNA, 15 bp, Homo sapiens
caccctccacttccc

SEQ ID NO: 3120774 - DNA, 21 bp, Homo sapiens
caccctccatgctcctcacct

SEQ ID NO: 3120775 - DNA, 22 bp, Homo sapiens
caccctccatgctcctcacctg

SEQ ID NO: 3120776 - DNA, 20 bp, Homo sapiens
caccctcccccagacacagc

SEQ ID NO: 3120777 - DNA, 20 bp, Homo sapiens
caccctcccccgccactcct

SEQ ID NO: 3120778 - DNA, 13 bp, Homo sapiens
caccctcccctct

SEQ ID NO: 3120779 - DNA, 14 bp, Homo sapiens
caccctcctcttgg

SEQ ID NO: 3120780 - DNA, 18 bp, Homo sapiens
caccctcctcttggaatt

SEQ ID NO: 3120781 - DNA, 12 bp, Homo sapiens
caccctctggcc

SEQ ID NO: 3120782 - DNA, 15 bp, Homo sapiens
caccctcttcctgtg

SEQ ID NO: 3120783 - DNA, 18 bp, Homo sapiens
caccctgaatggttccat

SEQ ID NO: 3120784 - DNA, 23 bp, Homo sapiens
caccctgaatggttccatgcctg

SEQ ID NO: 3120785 - DNA, 11 bp, Homo sapiens
caccctgcaag

SEQ ID NO: 3120786 - DNA, 13 bp, Homo sapiens
caccctgcaaggc

SEQ ID NO: 3120787 - DNA, 23 bp, Homo sapiens
caccctgcaaggcccacaggagg

SEQ ID NO: 3120788 - DNA, 14 bp, Homo sapiens
caccctgcacctgc

SEQ ID NO: 3120789 - DNA, 17 bp, Homo sapiens
caccctgcacctgctgc

SEQ ID NO: 3120790 - DNA, 19 bp, Homo sapiens
caccctgccaagactcctc

SEQ ID NO: 3120791 - DNA, 21 bp, Homo sapiens
caccctgccccccctaagaga

SEQ ID NO: 3120792 - DNA, 17 bp, Homo sapiens
caccctgcccctgcaaa

SEQ ID NO: 3120793 - DNA, 21 bp, Homo sapiens
caccctgcccctgcaaagaca

SEQ ID NO: 3120794 - DNA, 13 bp, Homo sapiens
caccctgcccgct

SEQ ID NO: 3120795 - DNA, 17 bp, Homo sapiens
caccctgcccgctccca

SEQ ID NO: 3120796 - DNA, 15 bp, Homo sapiens
caccctgctgccttc

SEQ ID NO: 3120797 - DNA, 21 bp, Homo sapiens
caccctggaggatttcatctc

SEQ ID NO: 3120798 - DNA, 21 bp, Homo sapiens
caccctggattgatcggagcc

SEQ ID NO: 3120799 - DNA, 12 bp, Homo sapiens
caccctggcctg

SEQ ID NO: 3120800 - DNA, 15 bp, Homo sapiens
caccctgggagccag

SEQ ID NO: 3120801 - DNA, 14 bp, Homo sapiens
caccctgggccctg

SEQ ID NO: 3120802 - DNA, 16 bp, Homo sapiens
caccctggggagaaag

SEQ ID NO: 3120803 - DNA, 14 bp, Homo sapiens
caccctgggtgcca

SEQ ID NO: 3120804 - DNA, 21 bp, Homo sapiens
caccctgtactgttctgtgtc

SEQ ID NO: 3120805 - DNA, 11 bp, Homo sapiens
caccctgtaga

SEQ ID NO: 3120806 - DNA, 14 bp, Homo sapiens
caccctgtagatgt

SEQ ID NO: 3120807 - DNA, 18 bp, Homo sapiens
caccctgtagatgttcta

SEQ ID NO: 3120808 - DNA, 21 bp, Homo sapiens
caccctgtagatgttctagga

SEQ ID NO: 3120809 - DNA, 15 bp, Homo sapiens
caccctgtcccccag

SEQ ID NO: 3120810 - DNA, 18 bp, Homo sapiens
caccctgtcccccagctc

SEQ ID NO: 3120811 - DNA, 20 bp, Homo sapiens
caccctgtcccccagctctg

SEQ ID NO: 3120812 - DNA, 17 bp, Homo sapiens
caccctgtggccctggc

SEQ ID NO: 3120813 - DNA, 14 bp, Homo sapiens
cacccttagaaaat

SEQ ID NO: 3120814 - DNA, 13 bp, Homo sapiens
cacccttcccctc

SEQ ID NO: 3120815 - DNA, 18 bp, Homo sapiens
cacccttctttcctcttc

SEQ ID NO: 3120816 - DNA, 12 bp, Homo sapiens
cacccttggcct

SEQ ID NO: 3120817 - DNA, 19 bp, Homo sapiens
caccctttccggcacactg

SEQ ID NO: 3120818 - DNA, 22 bp, Homo sapiens
caccctttgctgtgaggctgtc

SEQ ID NO: 3120819 - DNA, 13 bp, Homo sapiens
caccgagaatgtt

SEQ ID NO: 3120820 - DNA, 19 bp, Homo sapiens
caccgagtgatttccatct

SEQ ID NO: 3120821 - DNA, 16 bp, Homo sapiens
caccgcagtcaccacc

SEQ ID NO: 3120822 - DNA, 19 bp, Homo sapiens
caccgccacgtcccagcat

SEQ ID NO: 3120823 - DNA, 16 bp, Homo sapiens
caccgcccccacccct

SEQ ID NO: 3120824 - DNA, 21 bp, Homo sapiens
caccgcccccaccccttcccc

SEQ ID NO: 3120825 - DNA, 22 bp, Homo sapiens
caccgcccccaccccttcccca

SEQ ID NO: 3120826 - DNA, 19 bp, Homo sapiens
caccgccgactttgtaccc

SEQ ID NO: 3120827 - DNA, 21 bp, Homo sapiens
caccgccgccaccagcccgca

SEQ ID NO: 3120828 - DNA, 14 bp, Homo sapiens
caccgccgtggagt

SEQ ID NO: 3120829 - DNA, 20 bp, Homo sapiens
caccgcctctggccgccacc

SEQ ID NO: 3120830 - DNA, 17 bp, Homo sapiens
caccgctgccagcacag

SEQ ID NO: 3120831 - DNA, 17 bp, Homo sapiens
caccggaggtcactcca

SEQ ID NO: 3120832 - DNA, 16 bp, Homo sapiens
caccggcccctggcag

SEQ ID NO: 3120833 - DNA, 14 bp, Homo sapiens
caccggcgctgcag

SEQ ID NO: 3120834 - DNA, 15 bp, Homo sapiens
caccggcgctgcagg

SEQ ID NO: 3120835 - DNA, 22 bp, Homo sapiens
caccgggctccatgcctctgga

SEQ ID NO: 3120836 - DNA, 17 bp, Homo sapiens
caccggtccagctggcc

SEQ ID NO: 3120837 - DNA, 22 bp, Homo sapiens
caccgtacatctgcaatatgaa

SEQ ID NO: 3120838 - DNA, 15 bp, Homo sapiens
caccgtcatggctta

SEQ ID NO: 3120839 - DNA, 17 bp, Homo sapiens
caccgtgatggagagga

SEQ ID NO: 3120840 - DNA, 20 bp, Homo sapiens
caccgtgctgtcttctggtc

SEQ ID NO: 3120841 - DNA, 17 bp, Homo sapiens
caccgtgttagccagga

SEQ ID NO: 3120842 - DNA, 22 bp, Homo sapiens
caccgtttcttcctgccagcag

SEQ ID NO: 3120843 - DNA, 20 bp, Homo sapiens
cacctaaaggtgtatttaaa

SEQ ID NO: 3120844 - DNA, 14 bp, Homo sapiens
cacctaatgtttat

SEQ ID NO: 3120845 - DNA, 18 bp, Homo sapiens
cacctaccactcacatga

SEQ ID NO: 3120846 - DNA, 22 bp, Homo sapiens
cacctaccatcagggacaggat

SEQ ID NO: 3120847 - DNA, 18 bp, Homo sapiens
cacctactaaaaaagtta

SEQ ID NO: 3120848 - DNA, 19 bp, Homo sapiens
cacctacttgtgactgaag

SEQ ID NO: 3120849 - DNA, 23 bp, Homo sapiens
cacctagaacactaactcaccag

SEQ ID NO: 3120850 - DNA, 16 bp, Homo sapiens
cacctagagccagacc

SEQ ID NO: 3120851 - DNA, 17 bp, Homo sapiens
cacctagagctccagtt

SEQ ID NO: 3120852 - DNA, 12 bp, Homo sapiens
cacctagcagcc

SEQ ID NO: 3120853 - DNA, 14 bp, Homo sapiens
cacctagcagcctc

SEQ ID NO: 3120854 - DNA, 15 bp, Homo sapiens
cacctagcagcctca

SEQ ID NO: 3120855 - DNA, 17 bp, Homo sapiens
cacctagcagcctcaaa

SEQ ID NO: 3120856 - DNA, 13 bp, Homo sapiens
cacctagcccagg

SEQ ID NO: 3120857 - DNA, 17 bp, Homo sapiens
cacctagcttagtcatg

SEQ ID NO: 3120858 - DNA, 17 bp, Homo sapiens
cacctatgttattttgt

SEQ ID NO: 3120859 - DNA, 13 bp, Homo sapiens
cacctatttccat

SEQ ID NO: 3120860 - DNA, 13 bp, Homo sapiens
cacctcactcctg

SEQ ID NO: 3120861 - DNA, 11 bp, Homo sapiens
cacctcagaaa

SEQ ID NO: 3120862 - DNA, 17 bp, Homo sapiens
cacctcagaaagtcacc

SEQ ID NO: 3120863 - DNA, 14 bp, Homo sapiens
cacctcagcctccc

SEQ ID NO: 3120864 - DNA, 23 bp, Homo sapiens
cacctcaggccaggtgcagtggc

SEQ ID NO: 3120865 - DNA, 17 bp, Homo sapiens
cacctcagttcccttgg

SEQ ID NO: 3120866 - DNA, 19 bp, Homo sapiens
cacctcagttcccttggcc

SEQ ID NO: 3120867 - DNA, 20 bp, Homo sapiens
cacctcagttcccttggcct

SEQ ID NO: 3120868 - DNA, 23 bp, Homo sapiens
cacctcagttcccttggcctcag

SEQ ID NO: 3120869 - DNA, 17 bp, Homo sapiens
cacctcatgcccacccc

SEQ ID NO: 3120870 - DNA, 19 bp, Homo sapiens
cacctcatgcccaccccct

SEQ ID NO: 3120871 - DNA, 14 bp, Homo sapiens
cacctccacagttc

SEQ ID NO: 3120872 - DNA, 18 bp, Homo sapiens
cacctccaccacatctgc

SEQ ID NO: 3120873 - DNA, 13 bp, Homo sapiens
cacctccacccag

SEQ ID NO: 3120874 - DNA, 18 bp, Homo sapiens
cacctccacccagcccct

SEQ ID NO: 3120875 - DNA, 20 bp, Homo sapiens
cacctccacccagcccctgg

SEQ ID NO: 3120876 - DNA, 12 bp, Homo sapiens
cacctccacctg

SEQ ID NO: 3120877 - DNA, 18 bp, Homo sapiens
cacctccagcccgggagc

SEQ ID NO: 3120878 - DNA, 15 bp, Homo sapiens
cacctccatcccaga

SEQ ID NO: 3120879 - DNA, 21 bp, Homo sapiens
cacctccattaaagtctgaat

SEQ ID NO: 3120880 - DNA, 13 bp, Homo sapiens
cacctccccacgc

SEQ ID NO: 3120881 - DNA, 14 bp, Homo sapiens
cacctccccacgcc

SEQ ID NO: 3120882 - DNA, 23 bp, Homo sapiens
cacctccccccacaagtgccctc

SEQ ID NO: 3120883 - DNA, 21 bp, Homo sapiens
cacctccctactcccctgggc

SEQ ID NO: 3120884 - DNA, 10 bp, Homo sapiens
cacctccctc

SEQ ID NO: 3120885 - DNA, 14 bp, Homo sapiens
cacctccctcccca

SEQ ID NO: 3120886 - DNA, 15 bp, Homo sapiens
cacctccctgcccag

SEQ ID NO: 3120887 - DNA, 22 bp, Homo sapiens
cacctccctgctcagtgcttgg

SEQ ID NO: 3120888 - DNA, 15 bp, Homo sapiens
cacctcctccccctg

SEQ ID NO: 3120889 - DNA, 14 bp, Homo sapiens
cacctcctgagaag

SEQ ID NO: 3120890 - DNA, 19 bp, Homo sapiens
cacctcctgagaaggcgag

SEQ ID NO: 3120891 - DNA, 23 bp, Homo sapiens
cacctcctgagaaggcgaggaga

SEQ ID NO: 3120892 - DNA, 15 bp, Homo sapiens
cacctctatccaaag

SEQ ID NO: 3120893 - DNA, 12 bp, Homo sapiens
cacctctccaag

SEQ ID NO: 3120894 - DNA, 18 bp, Homo sapiens
cacctctccaagggcttc

SEQ ID NO: 3120895 - DNA, 15 bp, Homo sapiens
cacctctccaagtct

SEQ ID NO: 3120896 - DNA, 13 bp, Homo sapiens
cacctctccctca

SEQ ID NO: 3120897 - DNA, 15 bp, Homo sapiens
cacctctctcagagc

SEQ ID NO: 3120898 - DNA, 17 bp, Homo sapiens
cacctctctcagagcat

SEQ ID NO: 3120899 - DNA, 20 bp, Homo sapiens
cacctctgcggaccccagct

SEQ ID NO: 3120900 - DNA, 15 bp, Homo sapiens
cacctctggccctgt

SEQ ID NO: 3120901 - DNA, 18 bp, Homo sapiens
cacctctggccctgtgta

SEQ ID NO: 3120902 - DNA, 15 bp, Homo sapiens
cacctctgtgacctc

SEQ ID NO: 3120903 - DNA, 13 bp, Homo sapiens
cacctctgtggca

SEQ ID NO: 3120904 - DNA, 20 bp, Homo sapiens
cacctctgtggcattgaaat

SEQ ID NO: 3120905 - DNA, 21 bp, Homo sapiens
cacctctgttaaggttgaact

SEQ ID NO: 3120906 - DNA, 14 bp, Homo sapiens
cacctcttcacccc

SEQ ID NO: 3120907 - DNA, 20 bp, Homo sapiens
cacctcttcaccccccactc

SEQ ID NO: 3120908 - DNA, 22 bp, Homo sapiens
cacctgaaccccatgggcttgg

SEQ ID NO: 3120909 - DNA, 17 bp, Homo sapiens
cacctgaactgaacacc

SEQ ID NO: 3120910 - DNA, 19 bp, Homo sapiens
cacctgaactgaacaccat

SEQ ID NO: 3120911 - DNA, 23 bp, Homo sapiens
cacctgaagactcattcttctgt

SEQ ID NO: 3120912 - DNA, 21 bp, Homo sapiens
cacctgacaatggcagctaga

SEQ ID NO: 3120913 - DNA, 15 bp, Homo sapiens
cacctgactctgaaa

SEQ ID NO: 3120914 - DNA, 20 bp, Homo sapiens
cacctgagaccctgggagag

SEQ ID NO: 3120915 - DNA, 18 bp, Homo sapiens
cacctgaggttaggagtt

SEQ ID NO: 3120916 - DNA, 18 bp, Homo sapiens
cacctgcaagccccaggg

SEQ ID NO: 3120917 - DNA, 21 bp, Homo sapiens
cacctgcaagccccagggcct

SEQ ID NO: 3120918 - DNA, 15 bp, Homo sapiens
cacctgcaatcccag

SEQ ID NO: 3120919 - DNA, 18 bp, Homo sapiens
cacctgcaatcccagcac

SEQ ID NO: 3120920 - DNA, 20 bp, Homo sapiens
cacctgcaatcccagcacct

SEQ ID NO: 3120921 - DNA, 23 bp, Homo sapiens
cacctgcaatcccagcaccttag

SEQ ID NO: 3120922 - DNA, 15 bp, Homo sapiens
cacctgcactaacag

SEQ ID NO: 3120923 - DNA, 15 bp, Homo sapiens
cacctgcagggctgc

SEQ ID NO: 3120924 - DNA, 12 bp, Homo sapiens
cacctgccacca

SEQ ID NO: 3120925 - DNA, 20 bp, Homo sapiens
cacctgccagcctggcttct

SEQ ID NO: 3120926 - DNA, 13 bp, Homo sapiens
cacctgcccaacc

SEQ ID NO: 3120927 - DNA, 22 bp, Homo sapiens
cacctgcccatcacagggttgg

SEQ ID NO: 3120928 - DNA, 21 bp, Homo sapiens
cacctgccccctggtggacag

SEQ ID NO: 3120929 - DNA, 12 bp, Homo sapiens
cacctgccctgc

SEQ ID NO: 3120930 - DNA, 13 bp, Homo sapiens
cacctgccctgcc

SEQ ID NO: 3120931 - DNA, 13 bp, Homo sapiens
cacggccaggcca

SEQ ID NO: 3120932 - DNA, 16 bp, Homo sapiens
cacggccaggccagag

SEQ ID NO: 3120933 - DNA, 17 bp, Homo sapiens
cacggccgctccagggg

SEQ ID NO: 3120934 - DNA, 13 bp, Homo sapiens
cacggcctggctg

SEQ ID NO: 3120935 - DNA, 16 bp, Homo sapiens
cacggctaagaggctg

SEQ ID NO: 3120936 - DNA, 20 bp, Homo sapiens
cacggctaagaggctgctga

SEQ ID NO: 3120937 - DNA, 14 bp, Homo sapiens
cacggctcactgca

SEQ ID NO: 3120938 - DNA, 20 bp, Homo sapiens
cacggctcactgcagcctca

SEQ ID NO: 3120939 - DNA, 20 bp, Homo sapiens
cacggtgcgtggctgtggca

SEQ ID NO: 3120940 - DNA, 16 bp, Homo sapiens
cacgtatacacccaga

SEQ ID NO: 3120941 - DNA, 18 bp, Homo sapiens
cacgtatttatatttgga

SEQ ID NO: 3120942 - DNA, 19 bp, Homo sapiens
cacgtatttatatttggaa

SEQ ID NO: 3120943 - DNA, 14 bp, Homo sapiens
cacgtcatgggagg

SEQ ID NO: 3120944 - DNA, 16 bp, Homo sapiens
cacgtccccctggggc

SEQ ID NO: 3120945 - DNA, 14 bp, Homo sapiens
cacgtctgccaggc

SEQ ID NO: 3120946 - DNA, 20 bp, Homo sapiens
cacgtctgccaggcccatct

SEQ ID NO: 3120947 - DNA, 15 bp, Homo sapiens
cacgtctggaccccg

SEQ ID NO: 3120948 - DNA, 22 bp, Homo sapiens
cacgtctggccaggcactgcct

SEQ ID NO: 3120949 - DNA, 13 bp, Homo sapiens
cacgtggagagct

SEQ ID NO: 3120950 - DNA, 19 bp, Homo sapiens
cacgtggcatgtggcctgt

SEQ ID NO: 3120951 - DNA, 17 bp, Homo sapiens
cacgtggcctcttgagc

SEQ ID NO: 3120952 - DNA, 16 bp, Homo sapiens
cacgtggtcactgtgc

SEQ ID NO: 3120953 - DNA, 15 bp, Homo sapiens
cacgtgtcctgtagt

SEQ ID NO: 3120954 - DNA, 21 bp, Homo sapiens
cacgttggggtgatttaatcc

SEQ ID NO: 3120955 - DNA, 17 bp, Homo sapiens
cacgtttggtttgcgca

SEQ ID NO: 3120956 - DNA, 14 bp, Homo sapiens
cactaaaattttag

SEQ ID NO: 3120957 - DNA, 22 bp, Homo sapiens
cactaaactttacccaaaaact

SEQ ID NO: 3120958 - DNA, 13 bp, Homo sapiens
cactaaactttat

SEQ ID NO: 3120959 - DNA, 15 bp, Homo sapiens
cactaaactttattt

SEQ ID NO: 3120960 - DNA, 15 bp, Homo sapiens
cactaaagccagcct

SEQ ID NO: 3120961 - DNA, 21 bp, Homo sapiens
cactaaagccagcctgacctt

SEQ ID NO: 3120962 - DNA, 13 bp, Homo sapiens
cactaaatcagag

SEQ ID NO: 3120963 - DNA, 14 bp, Homo sapiens
cactaacagagtgg

SEQ ID NO: 3120964 - DNA, 21 bp, Homo sapiens
cactaacatttcccccgagct

SEQ ID NO: 3120965 - DNA, 14 bp, Homo sapiens
cactaaccacgctg

SEQ ID NO: 3120966 - DNA, 15 bp, Homo sapiens
cactaaccacgctgg

SEQ ID NO: 3120967 - DNA, 14 bp, Homo sapiens
cactaactcaccag

SEQ ID NO: 3120968 - DNA, 14 bp, Homo sapiens
cactaagttatagt

SEQ ID NO: 3120969 - DNA, 22 bp, Homo sapiens
cactaagttatagtatatctgg

SEQ ID NO: 3120970 - DNA, 12 bp, Homo sapiens
cactaataaagt

SEQ ID NO: 3120971 - DNA, 12 bp, Homo sapiens
cactaattcata

SEQ ID NO: 3120972 - DNA, 21 bp, Homo sapiens
cactacaagtcagctccagct

SEQ ID NO: 3120973 - DNA, 18 bp, Homo sapiens
cactacactccagcctga

SEQ ID NO: 3120974 - DNA, 21 bp, Homo sapiens
cactacaggtgaaggctctca

SEQ ID NO: 3120975 - DNA, 17 bp, Homo sapiens
cactacctgaacattgt

SEQ ID NO: 3120976 - DNA, 14 bp, Homo sapiens
cactactacatctg

SEQ ID NO: 3120977 - DNA, 18 bp, Homo sapiens
cactactcctctgcagtg

SEQ ID NO: 3120978 - DNA, 12 bp, Homo sapiens
cactactgcagc

SEQ ID NO: 3120979 - DNA, 17 bp, Homo sapiens
cactactgctaaatcct

SEQ ID NO: 3120980 - DNA, 13 bp, Homo sapiens
cactagaagaaaa

SEQ ID NO: 3120981 - DNA, 15 bp, Homo sapiens
cactagaagaaaagc

SEQ ID NO: 3120982 - DNA, 19 bp, Homo sapiens
cactagaagaaaagcccat

SEQ ID NO: 3120983 - DNA, 14 bp, Homo sapiens
cactagacatgtca

SEQ ID NO: 3120984 - DNA, 19 bp, Homo sapiens
cactagcccaatgaaatga

SEQ ID NO: 3120985 - DNA, 16 bp, Homo sapiens
cactagcctctccagg

SEQ ID NO: 3120986 - DNA, 16 bp, Homo sapiens
cactaggactctgagg

SEQ ID NO: 3120987 - DNA, 20 bp, Homo sapiens
cactaggcccccacttgcct

SEQ ID NO: 3120988 - DNA, 21 bp, Homo sapiens
cactaggcccccacttgcctc

SEQ ID NO: 3120989 - DNA, 18 bp, Homo sapiens
cactagggccttggaaat

SEQ ID NO: 3120990 - DNA, 14 bp, Homo sapiens
cactataatgtaag

SEQ ID NO: 3120991 - DNA, 18 bp, Homo sapiens
cactataatgtaagctct

SEQ ID NO: 3120992 - DNA, 17 bp, Homo sapiens
cactatagtttaaaaca

SEQ ID NO: 3120993 - DNA, 18 bp, Homo sapiens
cactatcttcttcaaata

SEQ ID NO: 3120994 - DNA, 21 bp, Homo sapiens
cactatcttcttcaaatacaa

SEQ ID NO: 3120995 - DNA, 19 bp, Homo sapiens
cactatggtatgctggcca

SEQ ID NO: 3120996 - DNA, 18 bp, Homo sapiens
cactatgttgcccaggca

SEQ ID NO: 3120997 - DNA, 19 bp, Homo sapiens
cactatgttgcccaggcag

SEQ ID NO: 3120998 - DNA, 20 bp, Homo sapiens
cactatgttgcccaggcagg

SEQ ID NO: 3120999 - DNA, 18 bp, Homo sapiens
cactattttatatttaaa

SEQ ID NO: 3121000 - DNA, 13 bp, Homo sapiens
cactattttcaga

SEQ ID NO: 3121001 - DNA, 17 bp, Homo sapiens
cactatttttatttata

SEQ ID NO: 3121002 - DNA, 15 bp, Homo sapiens
cactcaaaagacaaa

SEQ ID NO: 3121003 - DNA, 18 bp, Homo sapiens
cactcaaaagacaaacat

SEQ ID NO: 3121004 - DNA, 20 bp, Homo sapiens
cactcaactctgagcccata

SEQ ID NO: 3121005 - DNA, 13 bp, Homo sapiens
cactcaagcactg

SEQ ID NO: 3121006 - DNA, 14 bp, Homo sapiens
cactcaagcactga

SEQ ID NO: 3121007 - DNA, 16 bp, Homo sapiens
cactcaagcactgata

SEQ ID NO: 3121008 - DNA, 13 bp, Homo sapiens
cactcaagcttgg

SEQ ID NO: 3121009 - DNA, 13 bp, Homo sapiens
cactcaataaatt

SEQ ID NO: 3121010 - DNA, 19 bp, Homo sapiens
cactcacagacctggagcc

SEQ ID NO: 3121011 - DNA, 23 bp, Homo sapiens
cactcacagacctggagcccctg

SEQ ID NO: 3121012 - DNA, 14 bp, Homo sapiens
cactcacatgacac

SEQ ID NO: 3121013 - DNA, 20 bp, Homo sapiens
cactcacatttattctgctc

SEQ ID NO: 3121014 - DNA, 13 bp, Homo sapiens
cactcacattttc

SEQ ID NO: 3121015 - DNA, 12 bp, Homo sapiens
cactcaccaggg

SEQ ID NO: 3121016 - DNA, 14 bp, Homo sapiens
cactcaccagggtc

SEQ ID NO: 3121017 - DNA, 24 bp, Homo sapiens
cactcaccagggtccgcaccagct

SEQ ID NO: 3121018 - DNA, 18 bp, Homo sapiens
cactcaccagtgtcccct

SEQ ID NO: 3121019 - DNA, 13 bp, Homo sapiens
cactcaccccctt

SEQ ID NO: 3121020 - DNA, 13 bp, Homo sapiens
cactcagaaagag

SEQ ID NO: 3121021 - DNA, 16 bp, Homo sapiens
cactcagaagacactg

SEQ ID NO: 3121022 - DNA, 12 bp, Homo sapiens
cactcagccacg

SEQ ID NO: 3121023 - DNA, 22 bp, Homo sapiens
cactcagccacgaccagcccct

SEQ ID NO: 3121024 - DNA, 22 bp, Homo sapiens
cactcagccatttccccctcct

SEQ ID NO: 3121025 - DNA, 23 bp, Homo sapiens
cactcagccatttccccctcctc

SEQ ID NO: 3121026 - DNA, 15 bp, Homo sapiens
cactcagcccctagg

SEQ ID NO: 3121027 - DNA, 20 bp, Homo sapiens
cactcagctgtcctgcagca

SEQ ID NO: 3121028 - DNA, 16 bp, Homo sapiens
cactcagtccatagca

SEQ ID NO: 3121029 - DNA, 16 bp, Homo sapiens
cactcagtctcttcca

SEQ ID NO: 3121030 - DNA, 22 bp, Homo sapiens
cactcatacatatgtagaaaca

SEQ ID NO: 3121031 - DNA, 13 bp, Homo sapiens
cactcattcctgt

SEQ ID NO: 3121032 - DNA, 20 bp, Homo sapiens
cactcattccttcactcatc

SEQ ID NO: 3121033 - DNA, 16 bp, Homo sapiens
cactccaatctgggtg

SEQ ID NO: 3121034 - DNA, 21 bp, Homo sapiens
cactccaccctccaccttcca

SEQ ID NO: 3121035 - DNA, 17 bp, Homo sapiens
cactccagacccctggc

SEQ ID NO: 3121036 - DNA, 13 bp, Homo sapiens
cactccagcctga

SEQ ID NO: 3121037 - DNA, 21 bp, Homo sapiens
cactccagcctgggcgacaga

SEQ ID NO: 3121038 - DNA, 15 bp, Homo sapiens
cactccagcctgggg

SEQ ID NO: 3121039 - DNA, 16 bp, Homo sapiens
cactccagtgccagca

SEQ ID NO: 3121040 - DNA, 22 bp, Homo sapiens
cactccagtttttgtttttgca

SEQ ID NO: 3121041 - DNA, 22 bp, Homo sapiens
cactcccacctgcatctggggc

SEQ ID NO: 3121042 - DNA, 20 bp, Homo sapiens
cactccccaaggaagagcca

SEQ ID NO: 3121043 - DNA, 14 bp, Homo sapiens
cactccccaccttc

SEQ ID NO: 3121044 - DNA, 17 bp, Homo sapiens
cactccccagagctgtg

SEQ ID NO: 3121045 - DNA, 15 bp, Homo sapiens
cactccccagcccca

SEQ ID NO: 3121046 - DNA, 16 bp, Homo sapiens
cactccccatgccacg

SEQ ID NO: 3121047 - DNA, 15 bp, Homo sapiens
cactcccccacctga

SEQ ID NO: 3121048 - DNA, 16 bp, Homo sapiens
cactcccccacctgac

SEQ ID NO: 3121049 - DNA, 21 bp, Homo sapiens
cactccccctaaacccctgtc

SEQ ID NO: 3121050 - DNA, 15 bp, Homo sapiens
cactccccttgcctt

SEQ ID NO: 3121051 - DNA, 22 bp, Homo sapiens
cactccccttgccttcccctgt

SEQ ID NO: 3121052 - DNA, 14 bp, Homo sapiens
cactccctaattta

SEQ ID NO: 3121053 - DNA, 15 bp, Homo sapiens
cactccctccatcaa

SEQ ID NO: 3121054 - DNA, 16 bp, Homo sapiens
cactccctgctccacg

SEQ ID NO: 3121055 - DNA, 17 bp, Homo sapiens
cactccctgctccacga

SEQ ID NO: 3121056 - DNA, 20 bp, Homo sapiens
cactccctgctccacgaagc

SEQ ID NO: 3121057 - DNA, 14 bp, Homo sapiens
cactcccttgctgg

SEQ ID NO: 3121058 - DNA, 22 bp, Homo sapiens
cagcgagttgtggaaagcctct

SEQ ID NO: 3121059 - DNA, 21 bp, Homo sapiens
cagcgccaaatgttcatcctc

SEQ ID NO: 3121060 - DNA, 22 bp, Homo sapiens
cagcgccaaatgttcatcctca

SEQ ID NO: 3121061 - DNA, 23 bp, Homo sapiens
cagcgccaagtgcgtgccgtgtg

SEQ ID NO: 3121062 - DNA, 14 bp, Homo sapiens
cagcgcccctgctg

SEQ ID NO: 3121063 - DNA, 16 bp, Homo sapiens
cagcgcccctgctgtc

SEQ ID NO: 3121064 - DNA, 17 bp, Homo sapiens
cagcgcggccagcgtcc

SEQ ID NO: 3121065 - DNA, 15 bp, Homo sapiens
cagcgctcctcctgt

SEQ ID NO: 3121066 - DNA, 18 bp, Homo sapiens
cagcgctcctcctgtgtg

SEQ ID NO: 3121067 - DNA, 14 bp, Homo sapiens
cagcggccccccgc

SEQ ID NO: 3121068 - DNA, 15 bp, Homo sapiens
cagcgggcacagggc

SEQ ID NO: 3121069 - DNA, 13 bp, Homo sapiens
cagcgggccaggc

SEQ ID NO: 3121070 - DNA, 16 bp, Homo sapiens
cagcgggccaggcccg

SEQ ID NO: 3121071 - DNA, 17 bp, Homo sapiens
cagcggggacagctcct

SEQ ID NO: 3121072 - DNA, 21 bp, Homo sapiens
cagcggggacagctccttctg

SEQ ID NO: 3121073 - DNA, 20 bp, Homo sapiens
cagcggggcctggcgggatg

SEQ ID NO: 3121074 - DNA, 23 bp, Homo sapiens
cagcggggcctggcgggatgggc

SEQ ID NO: 3121075 - DNA, 14 bp, Homo sapiens
cagcggggcgaagc

SEQ ID NO: 3121076 - DNA, 13 bp, Homo sapiens
cagcgtccctggc

SEQ ID NO: 3121077 - DNA, 23 bp, Homo sapiens
cagcgtcctcgttcaaaacattc

SEQ ID NO: 3121078 - DNA, 15 bp, Homo sapiens
cagcgtcctgtccac

SEQ ID NO: 3121079 - DNA, 14 bp, Homo sapiens
cagcgtgtgtatcc

SEQ ID NO: 3121080 - DNA, 15 bp, Homo sapiens
cagctaaatttggag

SEQ ID NO: 3121081 - DNA, 16 bp, Homo sapiens
cagctaacaaactaga

SEQ ID NO: 3121082 - DNA, 15 bp, Homo sapiens
cagctaagctaggaa

SEQ ID NO: 3121083 - DNA, 19 bp, Homo sapiens
cagctaatcagcattctca

SEQ ID NO: 3121084 - DNA, 16 bp, Homo sapiens
cagctaatctgtaggg

SEQ ID NO: 3121085 - DNA, 16 bp, Homo sapiens
cagctaatgggacact

SEQ ID NO: 3121086 - DNA, 18 bp, Homo sapiens
cagctacccactatcctt

SEQ ID NO: 3121087 - DNA, 22 bp, Homo sapiens
cagctaccccttctttgcaggg

SEQ ID NO: 3121088 - DNA, 17 bp, Homo sapiens
cagctaccctgtgtata

SEQ ID NO: 3121089 - DNA, 21 bp, Homo sapiens
cagctaccctttttctccagc

SEQ ID NO: 3121090 - DNA, 12 bp, Homo sapiens
cagctacctgag

SEQ ID NO: 3121091 - DNA, 15 bp, Homo sapiens
cagctacctgagacg

SEQ ID NO: 3121092 - DNA, 17 bp, Homo sapiens
cagctactaatgatgtt

SEQ ID NO: 3121093 - DNA, 14 bp, Homo sapiens
cagctactcagaag

SEQ ID NO: 3121094 - DNA, 13 bp, Homo sapiens
cagctactctccc

SEQ ID NO: 3121095 - DNA, 15 bp, Homo sapiens
cagctactctcccca

SEQ ID NO: 3121096 - DNA, 16 bp, Homo sapiens
cagctactctgtccag

SEQ ID NO: 3121097 - DNA, 16 bp, Homo sapiens
cagctactgatttttg

SEQ ID NO: 3121098 - DNA, 17 bp, Homo sapiens
cagctacttaagagaaa

SEQ ID NO: 3121099 - DNA, 15 bp, Homo sapiens
cagctacttgggaag

SEQ ID NO: 3121100 - DNA, 20 bp, Homo sapiens
cagctactttccatttggta

SEQ ID NO: 3121101 - DNA, 13 bp, Homo sapiens
cagctagactgga

SEQ ID NO: 3121102 - DNA, 20 bp, Homo sapiens
cagctaggaagagcaggact

SEQ ID NO: 3121103 - DNA, 19 bp, Homo sapiens
cagctagggggcgttattt

SEQ ID NO: 3121104 - DNA, 12 bp, Homo sapiens
cagctagtgcct

SEQ ID NO: 3121105 - DNA, 13 bp, Homo sapiens
cagctagtgcctt

SEQ ID NO: 3121106 - DNA, 17 bp, Homo sapiens
cagctatgggagcccca

SEQ ID NO: 3121107 - DNA, 22 bp, Homo sapiens
cagctcaagtcttccctgatca

SEQ ID NO: 3121108 - DNA, 21 bp, Homo sapiens
cagctcaccagccccagtgcc

SEQ ID NO: 3121109 - DNA, 22 bp, Homo sapiens
cagctcaccagccccagtgccc

SEQ ID NO: 3121110 - DNA, 17 bp, Homo sapiens
cagctcacccctgggca

SEQ ID NO: 3121111 - DNA, 14 bp, Homo sapiens
cagctcagaaccca

SEQ ID NO: 3121112 - DNA, 15 bp, Homo sapiens
cagctcagaacccag

SEQ ID NO: 3121113 - DNA, 19 bp, Homo sapiens
cagctcagaacccagggct

SEQ ID NO: 3121114 - DNA, 21 bp, Homo sapiens
cagctcagaacccagggctct

SEQ ID NO: 3121115 - DNA, 13 bp, Homo sapiens
cagctcagccagt

SEQ ID NO: 3121116 - DNA, 15 bp, Homo sapiens
cagctcaggggcagc

SEQ ID NO: 3121117 - DNA, 17 bp, Homo sapiens
cagctcatctccaagga

SEQ ID NO: 3121118 - DNA, 18 bp, Homo sapiens
cagctccagctcaccagc

SEQ ID NO: 3121119 - DNA, 21 bp, Homo sapiens
cagctccagggaatccaagcc

SEQ ID NO: 3121120 - DNA, 19 bp, Homo sapiens
cagctccaggggcccttgg

SEQ ID NO: 3121121 - DNA, 10 bp, Homo sapiens
cagctccccc

SEQ ID NO: 3121122 - DNA, 22 bp, Homo sapiens
cagctcccccgacggtgggcat

SEQ ID NO: 3121123 - DNA, 13 bp, Homo sapiens
cagctccccctgt

SEQ ID NO: 3121124 - DNA, 19 bp, Homo sapiens
cagctccccctgtcccctc

SEQ ID NO: 3121125 - DNA, 14 bp, Homo sapiens
cagctccctgccaa

SEQ ID NO: 3121126 - DNA, 14 bp, Homo sapiens
cagctcccttccct

SEQ ID NO: 3121127 - DNA, 17 bp, Homo sapiens
cagctccgcctctgtcc

SEQ ID NO: 3121128 - DNA, 13 bp, Homo sapiens
cagctcctcagcg

SEQ ID NO: 3121129 - DNA, 17 bp, Homo sapiens
cagctcctctccttggg

SEQ ID NO: 3121130 - DNA, 21 bp, Homo sapiens
cagctcctctccttgggctcc

SEQ ID NO: 3121131 - DNA, 12 bp, Homo sapiens
cagctcctctta

SEQ ID NO: 3121132 - DNA, 16 bp, Homo sapiens
cagctccttctgtcct

SEQ ID NO: 3121133 - DNA, 13 bp, Homo sapiens
cagctcgaggccc

SEQ ID NO: 3121134 - DNA, 14 bp, Homo sapiens
cagctcgatccaaa

SEQ ID NO: 3121135 - DNA, 18 bp, Homo sapiens
cagctcgatccaaattgt

SEQ ID NO: 3121136 - DNA, 20 bp, Homo sapiens
cagctcgtttttcagcaccc

SEQ ID NO: 3121137 - DNA, 21 bp, Homo sapiens
cagctcgtttttcagcacccc

SEQ ID NO: 3121138 - DNA, 22 bp, Homo sapiens
cagctcgtttttcagcaccccc

SEQ ID NO: 3121139 - DNA, 20 bp, Homo sapiens
cagctctagttttcagcctt

SEQ ID NO: 3121140 - DNA, 17 bp, Homo sapiens
cagctctcccctccctt

SEQ ID NO: 3121141 - DNA, 13 bp, Homo sapiens
cagctctctggga

SEQ ID NO: 3121142 - DNA, 14 bp, Homo sapiens
cagctctgacatcc

SEQ ID NO: 3121143 - DNA, 18 bp, Homo sapiens
cagctctgacatcccttc

SEQ ID NO: 3121144 - DNA, 13 bp, Homo sapiens
cagctctgagatc

SEQ ID NO: 3121145 - DNA, 16 bp, Homo sapiens
cagctctgagccagat

SEQ ID NO: 3121146 - DNA, 17 bp, Homo sapiens
cagctctgaggggaggg

SEQ ID NO: 3121147 - DNA, 11 bp, Homo sapiens
cagctctggag

SEQ ID NO: 3121148 - DNA, 16 bp, Homo sapiens
cagctctggagaacag

SEQ ID NO: 3121149 - DNA, 14 bp, Homo sapiens
cagctctggcttcc

SEQ ID NO: 3121150 - DNA, 14 bp, Homo sapiens
cagctctgggagag

SEQ ID NO: 3121151 - DNA, 17 bp, Homo sapiens
cagctctgtcctgggag

SEQ ID NO: 3121152 - DNA, 18 bp, Homo sapiens
cagctctgtcctgggagt

SEQ ID NO: 3121153 - DNA, 20 bp, Homo sapiens
cagctctgtggcctgtgtcc

SEQ ID NO: 3121154 - DNA, 23 bp, Homo sapiens
cagctctgtggcctgtgtccagc

SEQ ID NO: 3121155 - DNA, 15 bp, Homo sapiens
cagctcttcattcca

SEQ ID NO: 3121156 - DNA, 17 bp, Homo sapiens
cagctcttctccaggct

SEQ ID NO: 3121157 - DNA, 19 bp, Homo sapiens
cagctcttctccaggctgt

SEQ ID NO: 3121158 - DNA, 16 bp, Homo sapiens
cagctcttgcccttcc

SEQ ID NO: 3121159 - DNA, 20 bp, Homo sapiens
cagctcttgcccttccctgt

SEQ ID NO: 3121160 - DNA, 21 bp, Homo sapiens
cagctcttgctaatcagtgtc

SEQ ID NO: 3121161 - DNA, 20 bp, Homo sapiens
cagccccgctcctcccctct

SEQ ID NO: 3121162 - DNA, 13 bp, Homo sapiens
cagcccctagccc

SEQ ID NO: 3121163 - DNA, 16 bp, Homo sapiens
cagcccctagcccagg

SEQ ID NO: 3121164 - DNA, 24 bp, Homo sapiens
cagcccctagcccaggagagagaa

SEQ ID NO: 3121165 - DNA, 12 bp, Homo sapiens
cagcccctagga

SEQ ID NO: 3121166 - DNA, 13 bp, Homo sapiens
cagcccctccacg

SEQ ID NO: 3121167 - DNA, 11 bp, Homo sapiens
cagcccctccc

SEQ ID NO: 3121168 - DNA, 21 bp, Homo sapiens
cagcccctcccccatctccca

SEQ ID NO: 3121169 - DNA, 22 bp, Homo sapiens
cagcccctcccccatctcccac

SEQ ID NO: 3121170 - DNA, 14 bp, Homo sapiens
cagcccctctggtc

SEQ ID NO: 3121171 - DNA, 13 bp, Homo sapiens
cagcccctgcaca

SEQ ID NO: 3121172 - DNA, 17 bp, Homo sapiens
cagcccctgcctgggtt

SEQ ID NO: 3121173 - DNA, 14 bp, Homo sapiens
cagccccttcctgg

SEQ ID NO: 3121174 - DNA, 16 bp, Homo sapiens
cagccccttcctgggt

SEQ ID NO: 3121175 - DNA, 20 bp, Homo sapiens
cagccccttctcccagcaca

SEQ ID NO: 3121176 - DNA, 15 bp, Homo sapiens
cagccccttctcccc

SEQ ID NO: 3121177 - DNA, 16 bp, Homo sapiens
cagcccgcacacctgc

SEQ ID NO: 3121178 - DNA, 21 bp, Homo sapiens
cagcccggcctgctcccagca

SEQ ID NO: 3121179 - DNA, 23 bp, Homo sapiens
cagcccggcctgctcccagcagc

SEQ ID NO: 3121180 - DNA, 21 bp, Homo sapiens
cagcccggcgccaccatcctg

SEQ ID NO: 3121181 - DNA, 15 bp, Homo sapiens
cagcccgggagccta

SEQ ID NO: 3121182 - DNA, 19 bp, Homo sapiens
cagcccggggcaggtgcag

SEQ ID NO: 3121183 - DNA, 23 bp, Homo sapiens
cagcccgtgaagcagtgcctcga

SEQ ID NO: 3121184 - DNA, 19 bp, Homo sapiens
cagccctaaggatctctca

SEQ ID NO: 3121185 - DNA, 20 bp, Homo sapiens
cagccctaaggatctctcag

SEQ ID NO: 3121186 - DNA, 22 bp, Homo sapiens
cagccctcaacaggcccaggga

SEQ ID NO: 3121187 - DNA, 18 bp, Homo sapiens
cagccctcctctgcactc

SEQ ID NO: 3121188 - DNA, 22 bp, Homo sapiens
cagccctgaggtgaaagggagc

SEQ ID NO: 3121189 - DNA, 13 bp, Homo sapiens
cagccctgctggg

SEQ ID NO: 3121190 - DNA, 20 bp, Homo sapiens
cagccctgctggggatcccc

SEQ ID NO: 3121191 - DNA, 13 bp, Homo sapiens
cagccctgctttg

SEQ ID NO: 3121192 - DNA, 20 bp, Homo sapiens
cagccctgctttgggctgcc

SEQ ID NO: 3121193 - DNA, 21 bp, Homo sapiens
cagccctgctttgggctgccc

SEQ ID NO: 3121194 - DNA, 15 bp, Homo sapiens
cagccctggctctgc

SEQ ID NO: 3121195 - DNA, 13 bp, Homo sapiens
cagccctggggct

SEQ ID NO: 3121196 - DNA, 14 bp, Homo sapiens
cagccctggggctg

SEQ ID NO: 3121197 - DNA, 13 bp, Homo sapiens
cagccctgttctg

SEQ ID NO: 3121198 - DNA, 16 bp, Homo sapiens
cagcccttcctctcac

SEQ ID NO: 3121199 - DNA, 22 bp, Homo sapiens
cagcccttcctctcactcctgc

SEQ ID NO: 3121200 - DNA, 15 bp, Homo sapiens
cagcccttctgcctt

SEQ ID NO: 3121201 - DNA, 16 bp, Homo sapiens
cagcccttctgccttt

SEQ ID NO: 3121202 - DNA, 11 bp, Homo sapiens
cagcccttgct

SEQ ID NO: 3121203 - DNA, 12 bp, Homo sapiens
cagccgagccgg

SEQ ID NO: 3121204 - DNA, 15 bp, Homo sapiens
cagccgccagctggg

SEQ ID NO: 3121205 - DNA, 18 bp, Homo sapiens
cagccgccagctgggagc

SEQ ID NO: 3121206 - DNA, 16 bp, Homo sapiens
cagccgccccagcccc

SEQ ID NO: 3121207 - DNA, 16 bp, Homo sapiens
cagccgctaggagaga

SEQ ID NO: 3121208 - DNA, 19 bp, Homo sapiens
cagccgctcggaggcccca

SEQ ID NO: 3121209 - DNA, 20 bp, Homo sapiens
cagccgctcggaggccccaa

SEQ ID NO: 3121210 - DNA, 13 bp, Homo sapiens
cagccgctgcagg

SEQ ID NO: 3121211 - DNA, 21 bp, Homo sapiens
cagccgctgcagggctcccat

SEQ ID NO: 3121212 - DNA, 23 bp, Homo sapiens
cagccggcacagggtctgctctt

SEQ ID NO: 3121213 - DNA, 14 bp, Homo sapiens
cagccggcacccac

SEQ ID NO: 3121214 - DNA, 15 bp, Homo sapiens
cagccggcctctctg

SEQ ID NO: 3121215 - DNA, 17 bp, Homo sapiens
cagccggcctctctggc

SEQ ID NO: 3121216 - DNA, 14 bp, Homo sapiens
cagccgtattttac

SEQ ID NO: 3121217 - DNA, 16 bp, Homo sapiens
cagccgtattttacat

SEQ ID NO: 3121218 - DNA, 16 bp, Homo sapiens
cagccgtcgtctccct

SEQ ID NO: 3121219 - DNA, 19 bp, Homo sapiens
cagcctacccttcctgcat

SEQ ID NO: 3121220 - DNA, 15 bp, Homo sapiens
cagcctactctcctt

SEQ ID NO: 3121221 - DNA, 16 bp, Homo sapiens
cagcctactctccttg

SEQ ID NO: 3121222 - DNA, 14 bp, Homo sapiens
cagcctagcccttg

SEQ ID NO: 3121223 - DNA, 13 bp, Homo sapiens
cagcctatgagca

SEQ ID NO: 3121224 - DNA, 21 bp, Homo sapiens
cagcctatgagcatcctgagc

SEQ ID NO: 3121225 - DNA, 23 bp, Homo sapiens
cagcctatgagcatcctgagccc

SEQ ID NO: 3121226 - DNA, 21 bp, Homo sapiens
cagcctcaacctcctgggcta

SEQ ID NO: 3121227 - DNA, 12 bp, Homo sapiens
cagcctcagagg

SEQ ID NO: 3121228 - DNA, 13 bp, Homo sapiens
cagcctcagagga

SEQ ID NO: 3121229 - DNA, 21 bp, Homo sapiens
cagcctcagaggagctctacc

SEQ ID NO: 3121230 - DNA, 17 bp, Homo sapiens
cagcctcattctgaggc

SEQ ID NO: 3121231 - DNA, 14 bp, Homo sapiens
cagcctccaagctc

SEQ ID NO: 3121232 - DNA, 13 bp, Homo sapiens
cagcctccagagc

SEQ ID NO: 3121233 - DNA, 16 bp, Homo sapiens
cagcctccagagccag

SEQ ID NO: 3121234 - DNA, 19 bp, Homo sapiens
cagcctccagagccagcct

SEQ ID NO: 3121235 - DNA, 22 bp, Homo sapiens
cagcctccagagccagcctggg

SEQ ID NO: 3121236 - DNA, 14 bp, Homo sapiens
cagcctccagggcc

SEQ ID NO: 3121237 - DNA, 14 bp, Homo sapiens
cagcctccatgctg

SEQ ID NO: 3121238 - DNA, 19 bp, Homo sapiens
cagcctcccaaagtgctgg

SEQ ID NO: 3121239 - DNA, 23 bp, Homo sapiens
cagcctcccaaagtgctgggatt

SEQ ID NO: 3121240 - DNA, 20 bp, Homo sapiens
cagcctcccaattagcttgg

SEQ ID NO: 3121241 - DNA, 18 bp, Homo sapiens
cagcctcccacccccatc

SEQ ID NO: 3121242 - DNA, 23 bp, Homo sapiens
cagcctccccctgtcccctctat

SEQ ID NO: 3121243 - DNA, 19 bp, Homo sapiens
cagcctcccgagtagctgg

SEQ ID NO: 3121244 - DNA, 13 bp, Homo sapiens
cagcctccctctg

SEQ ID NO: 3121245 - DNA, 22 bp, Homo sapiens
cagcctccctctgacctgcagg

SEQ ID NO: 3121246 - DNA, 20 bp, Homo sapiens
cagcctccgagagggagaga

SEQ ID NO: 3121247 - DNA, 19 bp, Homo sapiens
cagcctccgccaagatcta

SEQ ID NO: 3121248 - DNA, 15 bp, Homo sapiens
cagcctcctcctgac

SEQ ID NO: 3121249 - DNA, 17 bp, Homo sapiens
cagcctcctctggacgg

SEQ ID NO: 3121250 - DNA, 21 bp, Homo sapiens
cagcctcctctggacggcagg

SEQ ID NO: 3121251 - DNA, 17 bp, Homo sapiens
cagcctcctgagcctgt

SEQ ID NO: 3121252 - DNA, 18 bp, Homo sapiens
cagcctcctgagcctgtg

SEQ ID NO: 3121253 - DNA, 20 bp, Homo sapiens
cagcctcctgagcctgtggg

SEQ ID NO: 3121254 - DNA, 21 bp, Homo sapiens
cagcctcctgagcctgtgggt

SEQ ID NO: 3121255 - DNA, 19 bp, Homo sapiens
cagcctctccccaggtcca

SEQ ID NO: 3121256 - DNA, 20 bp, Homo sapiens
cagcctctccccaggtccag

SEQ ID NO: 3121257 - DNA, 23 bp, Homo sapiens
cagcctctcccggctgcctgccg

SEQ ID NO: 3121258 - DNA, 15 bp, Homo sapiens
cagcctctgacccct

SEQ ID NO: 3121259 - DNA, 17 bp, Homo sapiens
cagcctctgacccctcc

SEQ ID NO: 3121260 - DNA, 19 bp, Homo sapiens
cagcctctgacccctcctc

SEQ ID NO: 3121261 - DNA, 13 bp, Homo sapiens
cagcctctggcat

SEQ ID NO: 3121262 - DNA, 16 bp, Homo sapiens
cagcctctggctccac

SEQ ID NO: 3121263 - DNA, 11 bp, Homo sapiens
cagcctcttaa

SEQ ID NO: 3121264 - DNA, 19 bp, Homo sapiens
cagcctcttaaagctgcct

SEQ ID NO: 3121265 - DNA, 21 bp, Homo sapiens
cagcctcttaaagctgcctgt

SEQ ID NO: 3121266 - DNA, 18 bp, Homo sapiens
cagcctcttggccccaga

SEQ ID NO: 3121267 - DNA, 22 bp, Homo sapiens
cagcctgaccttccttcctgtt

SEQ ID NO: 3121268 - DNA, 21 bp, Homo sapiens
cagcctgagcaactcttgatt

SEQ ID NO: 3121269 - DNA, 23 bp, Homo sapiens
cagcctgaggcagccacttcggc

SEQ ID NO: 3121270 - DNA, 18 bp, Homo sapiens
cagcctgaggctgagact

SEQ ID NO: 3121271 - DNA, 14 bp, Homo sapiens
cagcctgagtctcc

SEQ ID NO: 3121272 - DNA, 18 bp, Homo sapiens
cagcctgagtctcctgtg

SEQ ID NO: 3121273 - DNA, 19 bp, Homo sapiens
cagcctgagtctcctgtgc

SEQ ID NO: 3121274 - DNA, 20 bp, Homo sapiens
cagcctgagtctcctgtgcc

SEQ ID NO: 3121275 - DNA, 21 bp, Homo sapiens
cagcctgcccaagcccaggcc

SEQ ID NO: 3121276 - DNA, 19 bp, Homo sapiens
cagcctgcctggcaggctg

SEQ ID NO: 3121277 - DNA, 23 bp, Homo sapiens
cagcctgcgctcggcaggaagga

SEQ ID NO: 3121278 - DNA, 24 bp, Homo sapiens
cagcctgcgctcggcaggaaggag

SEQ ID NO: 3121279 - DNA, 21 bp, Homo sapiens
cagcctgctctagtgggacag

SEQ ID NO: 3121280 - DNA, 23 bp, Homo sapiens
cagcctgctctagtgggacagcc

SEQ ID NO: 3121281 - DNA, 11 bp, Homo sapiens
cagcctgctga

SEQ ID NO: 3121282 - DNA, 14 bp, Homo sapiens
cagcctgctgccca

SEQ ID NO: 3121283 - DNA, 23 bp, Homo sapiens
cagcctgcttcccacctccctgc

SEQ ID NO: 3121284 - DNA, 15 bp, Homo sapiens
cagcctggaccccca

SEQ ID NO: 3121285 - DNA, 16 bp, Homo sapiens
cagcctggacccccag

SEQ ID NO: 3121286 - DNA, 20 bp, Homo sapiens
cagcctggcacagggcagtg

SEQ ID NO: 3121287 - DNA, 13 bp, Homo sapiens
cagcctgggagcc

SEQ ID NO: 3121288 - DNA, 18 bp, Homo sapiens
cagcctgggagcccagag

SEQ ID NO: 3121289 - DNA, 21 bp, Homo sapiens
cagcctgggcagccaggctgc

SEQ ID NO: 3121290 - DNA, 21 bp, Homo sapiens
cagcaatgacatctcaggggc

SEQ ID NO: 3121291 - DNA, 22 bp, Homo sapiens
cagcaatgatgtccagaagaat

SEQ ID NO: 3121292 - DNA, 13 bp, Homo sapiens
cagcaatttctaa

SEQ ID NO: 3121293 - DNA, 15 bp, Homo sapiens
cagcacaccagccgc

SEQ ID NO: 3121294 - DNA, 17 bp, Homo sapiens
cagcacaccagccgctg

SEQ ID NO: 3121295 - DNA, 20 bp, Homo sapiens
cagcacaccagccgctgcag

SEQ ID NO: 3121296 - DNA, 13 bp, Homo sapiens
cagcacagcccag

SEQ ID NO: 3121297 - DNA, 14 bp, Homo sapiens
cagcacagcccagg

SEQ ID NO: 3121298 - DNA, 15 bp, Homo sapiens
cagcacagctccctg

SEQ ID NO: 3121299 - DNA, 16 bp, Homo sapiens
cagcacagctccctgc

SEQ ID NO: 3121300 - DNA, 22 bp, Homo sapiens
cagcacagcttagatttcatag

SEQ ID NO: 3121301 - DNA, 21 bp, Homo sapiens
cagcacagcttgacctgaggc

SEQ ID NO: 3121302 - DNA, 13 bp, Homo sapiens
cagcacagggcag

SEQ ID NO: 3121303 - DNA, 20 bp, Homo sapiens
cagcacagggcaggggtggt

SEQ ID NO: 3121304 - DNA, 15 bp, Homo sapiens
cagcaccaaccacag

SEQ ID NO: 3121305 - DNA, 22 bp, Homo sapiens
cagcaccaccctagtcccttcc

SEQ ID NO: 3121306 - DNA, 12 bp, Homo sapiens
cagcacccccac

SEQ ID NO: 3121307 - DNA, 15 bp, Homo sapiens
cagcacccccaccca

SEQ ID NO: 3121308 - DNA, 13 bp, Homo sapiens
cagcaccccttcc

SEQ ID NO: 3121309 - DNA, 14 bp, Homo sapiens
cagcaccccttcca

SEQ ID NO: 3121310 - DNA, 16 bp, Homo sapiens
cagcaccccttccatg

SEQ ID NO: 3121311 - DNA, 22 bp, Homo sapiens
cagcaccccttccatgtggaga

SEQ ID NO: 3121312 - DNA, 13 bp, Homo sapiens
cagcaccctaaga

SEQ ID NO: 3121313 - DNA, 12 bp, Homo sapiens
cagcaccctccc

SEQ ID NO: 3121314 - DNA, 14 bp, Homo sapiens
cagcaccctccccc

SEQ ID NO: 3121315 - DNA, 17 bp, Homo sapiens
cagcaccctctcctggg

SEQ ID NO: 3121316 - DNA, 13 bp, Homo sapiens
cagcaccctgggt

SEQ ID NO: 3121317 - DNA, 20 bp, Homo sapiens
cagcaccctgggtgccattc

SEQ ID NO: 3121318 - DNA, 14 bp, Homo sapiens
cagcacctccaggc

SEQ ID NO: 3121319 - DNA, 20 bp, Homo sapiens
cagcacctgtaagaaacaga

SEQ ID NO: 3121320 - DNA, 23 bp, Homo sapiens
cagcacctgtaagaaacagagca

SEQ ID NO: 3121321 - DNA, 22 bp, Homo sapiens
cagcaccttctttctggactgg

SEQ ID NO: 3121322 - DNA, 15 bp, Homo sapiens
cagcacggacaataa

SEQ ID NO: 3121323 - DNA, 23 bp, Homo sapiens
cagcacggcgtggtgtgtccctg

SEQ ID NO: 3121324 - DNA, 22 bp, Homo sapiens
cagcactaaggccgtgtctctg

SEQ ID NO: 3121325 - DNA, 14 bp, Homo sapiens
cagcactactctgt

SEQ ID NO: 3121326 - DNA, 23 bp, Homo sapiens
cagcactcagaaaagaaaaccat

SEQ ID NO: 3121327 - DNA, 12 bp, Homo sapiens
cagcactcccca

SEQ ID NO: 3121328 - DNA, 20 bp, Homo sapiens
cagcactccccttgccttcc

SEQ ID NO: 3121329 - DNA, 22 bp, Homo sapiens
cagcactccccttgccttcccc

SEQ ID NO: 3121330 - DNA, 14 bp, Homo sapiens
cagcactgaaaata

SEQ ID NO: 3121331 - DNA, 14 bp, Homo sapiens
cagcactgatttca

SEQ ID NO: 3121332 - DNA, 17 bp, Homo sapiens
cagcactggctctctcc

SEQ ID NO: 3121333 - DNA, 18 bp, Homo sapiens
cagccagccgccctgggc

SEQ ID NO: 3121334 - DNA, 14 bp, Homo sapiens
cagccaggagcaga

SEQ ID NO: 3121335 - DNA, 16 bp, Homo sapiens
cagccaggccaacagc

SEQ ID NO: 3121336 - DNA, 14 bp, Homo sapiens
cagccaggcgggct

SEQ ID NO: 3121337 - DNA, 18 bp, Homo sapiens
cagccaggcgggctcaag

SEQ ID NO: 3121338 - DNA, 20 bp, Homo sapiens
cagccaggcgggctcaagga

SEQ ID NO: 3121339 - DNA, 21 bp, Homo sapiens
cagccaggctatggttgccac

SEQ ID NO: 3121340 - DNA, 22 bp, Homo sapiens
cagccaggctatggttgccacc

SEQ ID NO: 3121341 - DNA, 23 bp, Homo sapiens
cagccaggctatggttgccaccc

SEQ ID NO: 3121342 - DNA, 12 bp, Homo sapiens
cagccaggctgc

SEQ ID NO: 3121343 - DNA, 22 bp, Homo sapiens
cagccaggctgccaaggccaga

SEQ ID NO: 3121344 - DNA, 23 bp, Homo sapiens
cagccaggctgctaacctggaaa

SEQ ID NO: 3121345 - DNA, 18 bp, Homo sapiens
cagccagtcttgcctagg

SEQ ID NO: 3121346 - DNA, 19 bp, Homo sapiens
cagccagtcttgcctaggc

SEQ ID NO: 3121347 - DNA, 23 bp, Homo sapiens
cagccagtcttgcctaggccaaa

SEQ ID NO: 3121348 - DNA, 15 bp, Homo sapiens
cagccagttcaaaaa

SEQ ID NO: 3121349 - DNA, 20 bp, Homo sapiens
cagccagttggtggggccag

SEQ ID NO: 3121350 - DNA, 17 bp, Homo sapiens
cagccatcaaaatgctt

SEQ ID NO: 3121351 - DNA, 15 bp, Homo sapiens
cagccatcgtcctgg

SEQ ID NO: 3121352 - DNA, 20 bp, Homo sapiens
cagccatcgtcctgggactc

SEQ ID NO: 3121353 - DNA, 13 bp, Homo sapiens
cagccatctgccc

SEQ ID NO: 3121354 - DNA, 19 bp, Homo sapiens
cagccatctgcccaggggt

SEQ ID NO: 3121355 - DNA, 14 bp, Homo sapiens
cagccatgcccagg

SEQ ID NO: 3121356 - DNA, 13 bp, Homo sapiens
cagccatgcctca

SEQ ID NO: 3121357 - DNA, 14 bp, Homo sapiens
cagccatgcctcat

SEQ ID NO: 3121358 - DNA, 16 bp, Homo sapiens
cagccatgcctcatgc

SEQ ID NO: 3121359 - DNA, 19 bp, Homo sapiens
cagccatgcctcatgccac

SEQ ID NO: 3121360 - DNA, 20 bp, Homo sapiens
cagccatgcctcatgccaca

SEQ ID NO: 3121361 - DNA, 15 bp, Homo sapiens
cagccatgtccaagt

SEQ ID NO: 3121362 - DNA, 16 bp, Homo sapiens
cagccattaccatgga

SEQ ID NO: 3121363 - DNA, 20 bp, Homo sapiens
cagccattaccatggagaca

SEQ ID NO: 3121364 - DNA, 18 bp, Homo sapiens
cagccattgcggccccag

SEQ ID NO: 3121365 - DNA, 19 bp, Homo sapiens
cagccattgcggccccagg

SEQ ID NO: 3121366 - DNA, 19 bp, Homo sapiens
cagccatttccccctcctc

SEQ ID NO: 3121367 - DNA, 13 bp, Homo sapiens
cagccatttgtaa

SEQ ID NO: 3121368 - DNA, 16 bp, Homo sapiens
cagccatttgtaatga

SEQ ID NO: 3121369 - DNA, 18 bp, Homo sapiens
cagcccaaaacccagggc

SEQ ID NO: 3121370 - DNA, 20 bp, Homo sapiens
cagcccaaaggggacaggcc

SEQ ID NO: 3121371 - DNA, 11 bp, Homo sapiens
cagcccaccct

SEQ ID NO: 3121372 - DNA, 19 bp, Homo sapiens
cagcccacctgcacccagg

SEQ ID NO: 3121373 - DNA, 16 bp, Homo sapiens
cagcccactgagaagt

SEQ ID NO: 3121374 - DNA, 15 bp, Homo sapiens
cagcccacttctgcc

SEQ ID NO: 3121375 - DNA, 18 bp, Homo sapiens
cagcccacttctgccata

SEQ ID NO: 3121376 - DNA, 19 bp, Homo sapiens
cagcccagaagaaaattct

SEQ ID NO: 3121377 - DNA, 17 bp, Homo sapiens
cagcccagagactttgt

SEQ ID NO: 3121378 - DNA, 15 bp, Homo sapiens
cagcccagcttcctg

SEQ ID NO: 3121379 - DNA, 23 bp, Homo sapiens
cagcccagcttggccctttcctt

SEQ ID NO: 3121380 - DNA, 17 bp, Homo sapiens
cagcccaggaggcagag

SEQ ID NO: 3121381 - DNA, 18 bp, Homo sapiens
cagcccaggcatctcctt

SEQ ID NO: 3121382 - DNA, 20 bp, Homo sapiens
cagcccaggcatctccttgg

SEQ ID NO: 3121383 - DNA, 12 bp, Homo sapiens
cagcccagggcc

SEQ ID NO: 3121384 - DNA, 16 bp, Homo sapiens
cagcccagggcctgca

SEQ ID NO: 3121385 - DNA, 19 bp, Homo sapiens
cagcccagggcctgcatgg

SEQ ID NO: 3121386 - DNA, 21 bp, Homo sapiens
cagcccatccattaggccagc

SEQ ID NO: 3121387 - DNA, 22 bp, Homo sapiens
cagcccatccattaggccagca

SEQ ID NO: 3121388 - DNA, 16 bp, Homo sapiens
cagcccatctcggagc

SEQ ID NO: 3121389 - DNA, 15 bp, Homo sapiens
cagcccatgcccacc

SEQ ID NO: 3121390 - DNA, 24 bp, Homo sapiens
cagcccatgcccacctgcccatca

SEQ ID NO: 3121391 - DNA, 16 bp, Homo sapiens
cagcccatggccccca

SEQ ID NO: 3121392 - DNA, 19 bp, Homo sapiens
cagcccatggcccccaata

SEQ ID NO: 3121393 - DNA, 22 bp, Homo sapiens
cagcccatggcccccaataaag

SEQ ID NO: 3121394 - DNA, 16 bp, Homo sapiens
cagcccatggccctgt

SEQ ID NO: 3121395 - DNA, 21 bp, Homo sapiens
cagcccatggcctctggccag

SEQ ID NO: 3121396 - DNA, 15 bp, Homo sapiens
cagccccacacagct

SEQ ID NO: 3121397 - DNA, 12 bp, Homo sapiens
cagccccaccca

SEQ ID NO: 3121398 - DNA, 16 bp, Homo sapiens
cagccccacccaggag

SEQ ID NO: 3121399 - DNA, 21 bp, Homo sapiens
cagccccacccaggagggagg

SEQ ID NO: 3121400 - DNA, 18 bp, Homo sapiens
cagccccacccccagcca

SEQ ID NO: 3121401 - DNA, 20 bp, Homo sapiens
cagccccacccccagccagg

SEQ ID NO: 3121402 - DNA, 21 bp, Homo sapiens
cagccccacccccagccaggc

SEQ ID NO: 3121403 - DNA, 21 bp, Homo sapiens
cagccccacccctaagtgccc

SEQ ID NO: 3121404 - DNA, 13 bp, Homo sapiens
cagccccactgcc

SEQ ID NO: 3121405 - DNA, 16 bp, Homo sapiens
cagccccactgccagc

SEQ ID NO: 3121406 - DNA, 20 bp, Homo sapiens
cagccccagacaacagccca

SEQ ID NO: 3121407 - DNA, 23 bp, Homo sapiens
cagccccagacaacagcccaggc

SEQ ID NO: 3121408 - DNA, 17 bp, Homo sapiens
cagccccagtcttcctt

SEQ ID NO: 3121409 - DNA, 13 bp, Homo sapiens
cagccccattctg

SEQ ID NO: 3121410 - DNA, 20 bp, Homo sapiens
cagccccattctgcctgccc

SEQ ID NO: 3121411 - DNA, 22 bp, Homo sapiens
cagccccattctgcctgcccag

SEQ ID NO: 3121412 - DNA, 24 bp, Homo sapiens
cagccccattctgcctgcccaggc

SEQ ID NO: 3121413 - DNA, 12 bp, Homo sapiens
cagcccccaggc

SEQ ID NO: 3121414 - DNA, 13 bp, Homo sapiens
cagcccccaggcc

SEQ ID NO: 3121415 - DNA, 19 bp, Homo sapiens
cagccccctaaaagcactc

SEQ ID NO: 3121416 - DNA, 15 bp, Homo sapiens
cagccccctccacac

SEQ ID NO: 3121417 - DNA, 14 bp, Homo sapiens
cagcccccttgccc

SEQ ID NO: 3121418 - DNA, 23 bp, Homo sapiens
cagcccccttgccctccgcctgg

SEQ ID NO: 3121419 - DNA, 19 bp, Homo sapiens
cagccccgagttgtttcct

SEQ ID NO: 3121420 - DNA, 18 bp, Homo sapiens
cagccccgcgcctccttc

SEQ ID NO: 3121421 - DNA, 19 bp, Homo sapiens
cagccccgctcaggcctag

SEQ ID NO: 3121422 - DNA, 22 bp, Homo sapiens
cactgaagtttttgaaatacct

SEQ ID NO: 3121423 - DNA, 15 bp, Homo sapiens
cactgaatttataaa

SEQ ID NO: 3121424 - DNA, 15 bp, Homo sapiens
cactgacagcctccc

SEQ ID NO: 3121425 - DNA, 23 bp, Homo sapiens
cactgacattgttggccaaagcc

SEQ ID NO: 3121426 - DNA, 16 bp, Homo sapiens
cactgaccatccactc

SEQ ID NO: 3121427 - DNA, 15 bp, Homo sapiens
cactgacccttccag

SEQ ID NO: 3121428 - DNA, 16 bp, Homo sapiens
cactgacccttccaga

SEQ ID NO: 3121429 - DNA, 18 bp, Homo sapiens
cactgacccttccagaca

SEQ ID NO: 3121430 - DNA, 19 bp, Homo sapiens
cactgacccttccagacat

SEQ ID NO: 3121431 - DNA, 20 bp, Homo sapiens
cactgaccttggagagacac

SEQ ID NO: 3121432 - DNA, 14 bp, Homo sapiens
cactgagaggcctg

SEQ ID NO: 3121433 - DNA, 16 bp, Homo sapiens
cactgagaggcctgga

SEQ ID NO: 3121434 - DNA, 22 bp, Homo sapiens
cactgagattgacctgaggaga

SEQ ID NO: 3121435 - DNA, 19 bp, Homo sapiens
cactgagatttaaatgcaa

SEQ ID NO: 3121436 - DNA, 11 bp, Homo sapiens
cactgagcccc

SEQ ID NO: 3121437 - DNA, 14 bp, Homo sapiens
cactgagccccacc

SEQ ID NO: 3121438 - DNA, 13 bp, Homo sapiens
cactgagcccccc

SEQ ID NO: 3121439 - DNA, 14 bp, Homo sapiens
cactgagccccccc

SEQ ID NO: 3121440 - DNA, 10 bp, Homo sapiens
cactgagggc

SEQ ID NO: 3121441 - DNA, 13 bp, Homo sapiens
cactgagggccac

SEQ ID NO: 3121442 - DNA, 23 bp, Homo sapiens
cactgagttgggcaaaacccagg

SEQ ID NO: 3121443 - DNA, 20 bp, Homo sapiens
cactgatatatcatgagtga

SEQ ID NO: 3121444 - DNA, 22 bp, Homo sapiens
cactgatattttacctcttatt

SEQ ID NO: 3121445 - DNA, 15 bp, Homo sapiens
cactgatcacccaat

SEQ ID NO: 3121446 - DNA, 15 bp, Homo sapiens
cactgatgcttagat

SEQ ID NO: 3121447 - DNA, 13 bp, Homo sapiens
cactgatttcaca

SEQ ID NO: 3121448 - DNA, 18 bp, Homo sapiens
cactgatttcacaacaga

SEQ ID NO: 3121449 - DNA, 13 bp, Homo sapiens
cactgcaacctcc

SEQ ID NO: 3121450 - DNA, 19 bp, Homo sapiens
cactgcacagtgcatctca

SEQ ID NO: 3121451 - DNA, 21 bp, Homo sapiens
cactgcacagtgcatctcagc

SEQ ID NO: 3121452 - DNA, 19 bp, Homo sapiens
cactgcactatagcctagg

SEQ ID NO: 3121453 - DNA, 21 bp, Homo sapiens
cactgcactcaaccttaagac

SEQ ID NO: 3121454 - DNA, 19 bp, Homo sapiens
cactgcactccagcctggg

SEQ ID NO: 3121455 - DNA, 13 bp, Homo sapiens
cactgcagcccag

SEQ ID NO: 3121456 - DNA, 14 bp, Homo sapiens
cactgcagcccagg

SEQ ID NO: 3121457 - DNA, 14 bp, Homo sapiens
cactgcagcctcaa

SEQ ID NO: 3121458 - DNA, 19 bp, Homo sapiens
cactgcagcctcaacctcc

SEQ ID NO: 3121459 - DNA, 22 bp, Homo sapiens
cactgcagcctcaacctcctgg

SEQ ID NO: 3121460 - DNA, 23 bp, Homo sapiens
cactgcagtccgcagtctggcct

SEQ ID NO: 3121461 - DNA, 16 bp, Homo sapiens
cactgcagtcttattt

SEQ ID NO: 3121462 - DNA, 15 bp, Homo sapiens
cactgcagtgatggc

SEQ ID NO: 3121463 - DNA, 22 bp, Homo sapiens
cactgcatgagcttttatacta

SEQ ID NO: 3121464 - DNA, 21 bp, Homo sapiens
cactgccaaataaacagctat

SEQ ID NO: 3121465 - DNA, 14 bp, Homo sapiens
cactgccagcagca

SEQ ID NO: 3121466 - DNA, 13 bp, Homo sapiens
cactgccaggcac

SEQ ID NO: 3121467 - DNA, 21 bp, Homo sapiens
cactgccaggcacctggcctg

SEQ ID NO: 3121468 - DNA, 23 bp, Homo sapiens
cactgccaggcacctggcctgct

SEQ ID NO: 3121469 - DNA, 17 bp, Homo sapiens
cactgccaggccagcct

SEQ ID NO: 3121470 - DNA, 19 bp, Homo sapiens
cactgccaggccagcctcc

SEQ ID NO: 3121471 - DNA, 16 bp, Homo sapiens
cactgcccaccccctc

SEQ ID NO: 3121472 - DNA, 18 bp, Homo sapiens
cactgcccaccccctcaa

SEQ ID NO: 3121473 - DNA, 21 bp, Homo sapiens
cactgccccccgaggctgcta

SEQ ID NO: 3121474 - DNA, 22 bp, Homo sapiens
cactgccccccgaggctgctag

SEQ ID NO: 3121475 - DNA, 17 bp, Homo sapiens
cactgcccgcacaccct

SEQ ID NO: 3121476 - DNA, 18 bp, Homo sapiens
cactgcccgcacaccctc

SEQ ID NO: 3121477 - DNA, 14 bp, Homo sapiens
cactgccctggcag

SEQ ID NO: 3121478 - DNA, 15 bp, Homo sapiens
cactgccctggcagc

SEQ ID NO: 3121479 - DNA, 20 bp, Homo sapiens
cactgccctgttcatgtgcc

SEQ ID NO: 3121480 - DNA, 23 bp, Homo sapiens
cactgcctctgccttagaggagc

SEQ ID NO: 3121481 - DNA, 16 bp, Homo sapiens
cactgcctgtatactt

SEQ ID NO: 3121482 - DNA, 19 bp, Homo sapiens
cactgccttcgcttcttgc

SEQ ID NO: 3121483 - DNA, 17 bp, Homo sapiens
cactgccttctcctctc

SEQ ID NO: 3121484 - DNA, 20 bp, Homo sapiens
cactgcgaagaccctcttgc

SEQ ID NO: 3121485 - DNA, 18 bp, Homo sapiens
cactgctccctgaagcca

SEQ ID NO: 3121486 - DNA, 20 bp, Homo sapiens
cactgctccctgaagccagc

SEQ ID NO: 3121487 - DNA, 18 bp, Homo sapiens
cactgctctaacagccct

SEQ ID NO: 3121488 - DNA, 22 bp, Homo sapiens
cactgctgatcgtagaaaattt

SEQ ID NO: 3121489 - DNA, 13 bp, Homo sapiens
cactgctgcacca

SEQ ID NO: 3121490 - DNA, 16 bp, Homo sapiens
cactgctgcaccagag

SEQ ID NO: 3121491 - DNA, 18 bp, Homo sapiens
cactgctgcaccagagtg

SEQ ID NO: 3121492 - DNA, 17 bp, Homo sapiens
cactgctgcccagcctc

SEQ ID NO: 3121493 - DNA, 14 bp, Homo sapiens
cactgctgtaccca

SEQ ID NO: 3121494 - DNA, 19 bp, Homo sapiens
cactgctgtacccagatgc

SEQ ID NO: 3121495 - DNA, 19 bp, Homo sapiens
cactgctgttcctgctcca

SEQ ID NO: 3121496 - DNA, 16 bp, Homo sapiens
cactgctttccagcct

SEQ ID NO: 3121497 - DNA, 24 bp, Homo sapiens
cactggaaaggggagagcctgctg

SEQ ID NO: 3121498 - DNA, 13 bp, Homo sapiens
cactggagcccag

SEQ ID NO: 3121499 - DNA, 20 bp, Homo sapiens
cactggagtgcagggaggag

SEQ ID NO: 3121500 - DNA, 19 bp, Homo sapiens
cactggatgcaaagaaaat

SEQ ID NO: 3121501 - DNA, 15 bp, Homo sapiens
cagagattgcttctc

SEQ ID NO: 3121502 - DNA, 16 bp, Homo sapiens
cagagattgcttctca

SEQ ID NO: 3121503 - DNA, 19 bp, Homo sapiens
cagagatttatataaatgt

SEQ ID NO: 3121504 - DNA, 19 bp, Homo sapiens
cagagatttctcattgact

SEQ ID NO: 3121505 - DNA, 14 bp, Homo sapiens
cagagcaaaataat

SEQ ID NO: 3121506 - DNA, 16 bp, Homo sapiens
cagagcaacgaccagg

SEQ ID NO: 3121507 - DNA, 15 bp, Homo sapiens
cagagcaagactcca

SEQ ID NO: 3121508 - DNA, 19 bp, Homo sapiens
cagagcaagactccatctc

SEQ ID NO: 3121509 - DNA, 18 bp, Homo sapiens
cagagcacagcagcccct

SEQ ID NO: 3121510 - DNA, 22 bp, Homo sapiens
cagagcacctttgcacaggatg

SEQ ID NO: 3121511 - DNA, 21 bp, Homo sapiens
cagagcactaggttcaattcc

SEQ ID NO: 3121512 - DNA, 13 bp, Homo sapiens
cagagcaggagca

SEQ ID NO: 3121513 - DNA, 15 bp, Homo sapiens
cagagcaggagcatc

SEQ ID NO: 3121514 - DNA, 16 bp, Homo sapiens
cagagcaggagcatcc

SEQ ID NO: 3121515 - DNA, 15 bp, Homo sapiens
cagagcaggggcagg

SEQ ID NO: 3121516 - DNA, 16 bp, Homo sapiens
cagagcaggggctcca

SEQ ID NO: 3121517 - DNA, 16 bp, Homo sapiens
cagagcatctggctgt

SEQ ID NO: 3121518 - DNA, 19 bp, Homo sapiens
cagagcatctggctgttta

SEQ ID NO: 3121519 - DNA, 18 bp, Homo sapiens
cagagcatgtgtcagagt

SEQ ID NO: 3121520 - DNA, 18 bp, Homo sapiens
cagagcatttaaggaaac

SEQ ID NO: 3121521 - DNA, 22 bp, Homo sapiens
cagagccacccctaaagagata

SEQ ID NO: 3121522 - DNA, 12 bp, Homo sapiens
cagagccactct

SEQ ID NO: 3121523 - DNA, 13 bp, Homo sapiens
cagagccagatgc

SEQ ID NO: 3121524 - DNA, 18 bp, Homo sapiens
cagagccagcctgggact

SEQ ID NO: 3121525 - DNA, 19 bp, Homo sapiens
cagagccagcctgggactc

SEQ ID NO: 3121526 - DNA, 11 bp, Homo sapiens
cagagccagtg

SEQ ID NO: 3121527 - DNA, 13 bp, Homo sapiens
cagagccagtgaa

SEQ ID NO: 3121528 - DNA, 13 bp, Homo sapiens
cagagccatgggc

SEQ ID NO: 3121529 - DNA, 17 bp, Homo sapiens
cagagccatgggcctgg

SEQ ID NO: 3121530 - DNA, 21 bp, Homo sapiens
cagagccatgggcctgggcct

SEQ ID NO: 3121531 - DNA, 23 bp, Homo sapiens
cagagccatgggcctgggcctgc

SEQ ID NO: 3121532 - DNA, 15 bp, Homo sapiens
cagagcccaccttgg

SEQ ID NO: 3121533 - DNA, 20 bp, Homo sapiens
cagagccccacacggaggca

SEQ ID NO: 3121534 - DNA, 16 bp, Homo sapiens
cagagcccccagccct

SEQ ID NO: 3121535 - DNA, 18 bp, Homo sapiens
cagagcccccagccctgg

SEQ ID NO: 3121536 - DNA, 12 bp, Homo sapiens
cagagccctggc

SEQ ID NO: 3121537 - DNA, 14 bp, Homo sapiens
cagagccctggctg

SEQ ID NO: 3121538 - DNA, 16 bp, Homo sapiens
cagagccctggctggg

SEQ ID NO: 3121539 - DNA, 17 bp, Homo sapiens
cagagcccttcactgcc

SEQ ID NO: 3121540 - DNA, 14 bp, Homo sapiens
cagagcctgcagtt

SEQ ID NO: 3121541 - DNA, 14 bp, Homo sapiens
cagagcctgcctaa

SEQ ID NO: 3121542 - DNA, 16 bp, Homo sapiens
cagagcctgcctaacc

SEQ ID NO: 3121543 - DNA, 20 bp, Homo sapiens
cagagcctgcctaaccaggc

SEQ ID NO: 3121544 - DNA, 23 bp, Homo sapiens
cagagcctgcctaaccaggccca

SEQ ID NO: 3121545 - DNA, 20 bp, Homo sapiens
cagagcctggggtgttctct

SEQ ID NO: 3121546 - DNA, 15 bp, Homo sapiens
cagagccttcaagtg

SEQ ID NO: 3121547 - DNA, 18 bp, Homo sapiens
cagagccttcaagtgcca

SEQ ID NO: 3121548 - DNA, 19 bp, Homo sapiens
cagagccttcaagtgccaa

SEQ ID NO: 3121549 - DNA, 20 bp, Homo sapiens
cagagcgaggaaaggatttt

SEQ ID NO: 3121550 - DNA, 13 bp, Homo sapiens
cagagcgcacagg

SEQ ID NO: 3121551 - DNA, 15 bp, Homo sapiens
cagagcgcacaggga

SEQ ID NO: 3121552 - DNA, 14 bp, Homo sapiens
cagagcgcccctcc

SEQ ID NO: 3121553 - DNA, 19 bp, Homo sapiens
cagagcgccgtgagttctc

SEQ ID NO: 3121554 - DNA, 20 bp, Homo sapiens
cagagcgccgtgagttctca

SEQ ID NO: 3121555 - DNA, 17 bp, Homo sapiens
cagagcggaggctgtgt

SEQ ID NO: 3121556 - DNA, 19 bp, Homo sapiens
cagagcggaggctgtgtgc

SEQ ID NO: 3121557 - DNA, 21 bp, Homo sapiens
cagagcgtggctgtgctctca

SEQ ID NO: 3121558 - DNA, 21 bp, Homo sapiens
cagagctaagggtgggtgctc

SEQ ID NO: 3121559 - DNA, 20 bp, Homo sapiens
cagagctctccagctccaag

SEQ ID NO: 3121560 - DNA, 19 bp, Homo sapiens
cagagctgacgggaggccc

SEQ ID NO: 3121561 - DNA, 15 bp, Homo sapiens
cagagctgcacttgg

SEQ ID NO: 3121562 - DNA, 21 bp, Homo sapiens
cagagctgcacttggcctcag

SEQ ID NO: 3121563 - DNA, 22 bp, Homo sapiens
cagagctgccgacttggagact

SEQ ID NO: 3121564 - DNA, 20 bp, Homo sapiens
cagagctggaaggcagggca

SEQ ID NO: 3121565 - DNA, 21 bp, Homo sapiens
cagagctggaaggcagggcag

SEQ ID NO: 3121566 - DNA, 23 bp, Homo sapiens
cagagctggaccagtggtgcctt

SEQ ID NO: 3121567 - DNA, 13 bp, Homo sapiens
cagagctggctct

SEQ ID NO: 3121568 - DNA, 17 bp, Homo sapiens
cagagctggctctgagc

SEQ ID NO: 3121569 - DNA, 14 bp, Homo sapiens
cagagctgggaggc

SEQ ID NO: 3121570 - DNA, 23 bp, Homo sapiens
cagagctgggaggcatggccctg

SEQ ID NO: 3121571 - DNA, 13 bp, Homo sapiens
cagagctgggtgg

SEQ ID NO: 3121572 - DNA, 11 bp, Homo sapiens
cagagctgtgc

SEQ ID NO: 3121573 - DNA, 13 bp, Homo sapiens
cagagctgtgcca

SEQ ID NO: 3121574 - DNA, 15 bp, Homo sapiens
cagagctgtgccagc

SEQ ID NO: 3121575 - DNA, 17 bp, Homo sapiens
cagagctgtgccagcag

SEQ ID NO: 3121576 - DNA, 20 bp, Homo sapiens
cagagctgtttatggcctca

SEQ ID NO: 3121577 - DNA, 23 bp, Homo sapiens
cagagcttggagagtcttgggcc

SEQ ID NO: 3121578 - DNA, 20 bp, Homo sapiens
cagaggaactgtccagagag

SEQ ID NO: 3121579 - DNA, 22 bp, Homo sapiens
cagaggaactgtccagagagca

SEQ ID NO: 3121580 - DNA, 12 bp, Homo sapiens
cagaggaagagc

SEQ ID NO: 3121581 - DNA, 14 bp, Homo sapiens
cagaggaagagcag

SEQ ID NO: 3121582 - DNA, 15 bp, Homo sapiens
cagaggaagagcagg

SEQ ID NO: 3121583 - DNA, 16 bp, Homo sapiens
cagaggaagagcaggc

SEQ ID NO: 3121584 - DNA, 17 bp, Homo sapiens
cagaggaatcctggcag

SEQ ID NO: 3121585 - DNA, 16 bp, Homo sapiens
cagaggaattatgaac

SEQ ID NO: 3121586 - DNA, 15 bp, Homo sapiens
cagaggacagtctgg

SEQ ID NO: 3121587 - DNA, 14 bp, Homo sapiens
cagaggacgcacgc

SEQ ID NO: 3121588 - DNA, 22 bp, Homo sapiens
cagaggacgcacgctcgctgcc

SEQ ID NO: 3121589 - DNA, 21 bp, Homo sapiens
cagaggactcccaaccctggc

SEQ ID NO: 3121590 - DNA, 22 bp, Homo sapiens
cagaggagtgattgaaccagct

SEQ ID NO: 3121591 - DNA, 13 bp, Homo sapiens
cagaggatggcca

SEQ ID NO: 3121592 - DNA, 15 bp, Homo sapiens
cagaggatggccagt

SEQ ID NO: 3121593 - DNA, 16 bp, Homo sapiens
cagaggatggccagtg

SEQ ID NO: 3121594 - DNA, 19 bp, Homo sapiens
cagaggatggccagtgtct

SEQ ID NO: 3121595 - DNA, 14 bp, Homo sapiens
cagaggcaataggt

SEQ ID NO: 3121596 - DNA, 19 bp, Homo sapiens
cagaggcagccccattctg

SEQ ID NO: 3121597 - DNA, 22 bp, Homo sapiens
cagaggcagccccattctgcct

SEQ ID NO: 3121598 - DNA, 23 bp, Homo sapiens
cagaggcagccccattctgcctg

SEQ ID NO: 3121599 - DNA, 24 bp, Homo sapiens
cagaggcccccagcccagggctcc

SEQ ID NO: 3121600 - DNA, 12 bp, Homo sapiens
cagaggccctgg

SEQ ID NO: 3121601 - DNA, 21 bp, Homo sapiens
cagaggccgaaggtgcctcag

SEQ ID NO: 3121602 - DNA, 17 bp, Homo sapiens
cagaggcctgctgccag

SEQ ID NO: 3121603 - DNA, 22 bp, Homo sapiens
cagaggcctgctgccagtgcag

SEQ ID NO: 3121604 - DNA, 22 bp, Homo sapiens
cagaggctgagttttctctttg

SEQ ID NO: 3121605 - DNA, 14 bp, Homo sapiens
cagaggctgggagc

SEQ ID NO: 3121606 - DNA, 13 bp, Homo sapiens
cagaggctgggtt

SEQ ID NO: 3121607 - DNA, 18 bp, Homo sapiens
cagagggaatgttccctg

SEQ ID NO: 3121608 - DNA, 17 bp, Homo sapiens
cagagggagctggaacc

SEQ ID NO: 3121609 - DNA, 14 bp, Homo sapiens
cagagggagtgaca

SEQ ID NO: 3121610 - DNA, 21 bp, Homo sapiens
cagagggagtgacagaggcag

SEQ ID NO: 3121611 - DNA, 15 bp, Homo sapiens
cagagggcagtggcc

SEQ ID NO: 3121612 - DNA, 13 bp, Homo sapiens
cagagggcccagg

SEQ ID NO: 3121613 - DNA, 10 bp, Homo sapiens
cagagggctg

SEQ ID NO: 3121614 - DNA, 15 bp, Homo sapiens
cagagggctggaggc

SEQ ID NO: 3121615 - DNA, 17 bp, Homo sapiens
cagagggctggaggccc

SEQ ID NO: 3121616 - DNA, 18 bp, Homo sapiens
cagagggctggaggccca

SEQ ID NO: 3121617 - DNA, 12 bp, Homo sapiens
cagaggggaagg

SEQ ID NO: 3121618 - DNA, 19 bp, Homo sapiens
cagaggggatggggataga

SEQ ID NO: 3121619 - DNA, 16 bp, Homo sapiens
cagaggggcagccgct

SEQ ID NO: 3121620 - DNA, 21 bp, Homo sapiens
cagaggggcagccgctaggag

SEQ ID NO: 3121621 - DNA, 18 bp, Homo sapiens
cagaggggccaggcccag

SEQ ID NO: 3121622 - DNA, 22 bp, Homo sapiens
cagagggggagtagccaagctg

SEQ ID NO: 3121623 - DNA, 15 bp, Homo sapiens
cagaggtaacagaac

SEQ ID NO: 3121624 - DNA, 18 bp, Homo sapiens
cagaggtcaggaagcagg

SEQ ID NO: 3121625 - DNA, 14 bp, Homo sapiens
cagaggtccagccc

SEQ ID NO: 3121626 - DNA, 15 bp, Homo sapiens
cagaggtctctgccg

SEQ ID NO: 3121627 - DNA, 16 bp, Homo sapiens
caatagtgtgttctga

SEQ ID NO: 3121628 - DNA, 23 bp, Homo sapiens
caatagtgtgttctgattagaaa

SEQ ID NO: 3121629 - DNA, 16 bp, Homo sapiens
caatagtttgcataga

SEQ ID NO: 3121630 - DNA, 22 bp, Homo sapiens
caatataaaaggcaaatgtgta

SEQ ID NO: 3121631 - DNA, 23 bp, Homo sapiens
caatataaagttctacagttaat

SEQ ID NO: 3121632 - DNA, 23 bp, Homo sapiens
caatataactatgtggctgaaaa

SEQ ID NO: 3121633 - DNA, 20 bp, Homo sapiens
caatatataaaaatatatat

SEQ ID NO: 3121634 - DNA, 23 bp, Homo sapiens
caatatcatatcatcacattgag

SEQ ID NO: 3121635 - DNA, 23 bp, Homo sapiens
caatatctgaagccctcccaggt

SEQ ID NO: 3121636 - DNA, 14 bp, Homo sapiens
caatatgcaagcag

SEQ ID NO: 3121637 - DNA, 15 bp, Homo sapiens
caatatgcaagcagc

SEQ ID NO: 3121638 - DNA, 16 bp, Homo sapiens
caatatggatttctta

SEQ ID NO: 3121639 - DNA, 15 bp, Homo sapiens
caatatgtatgcttt

SEQ ID NO: 3121640 - DNA, 21 bp, Homo sapiens
caatatgtatgctttttacct

SEQ ID NO: 3121641 - DNA, 22 bp, Homo sapiens
caatatgtatgctttttaccta

SEQ ID NO: 3121642 - DNA, 22 bp, Homo sapiens
caatatgtattgtaaacatgtg

SEQ ID NO: 3121643 - DNA, 16 bp, Homo sapiens
caatatgtgagtgcct

SEQ ID NO: 3121644 - DNA, 20 bp, Homo sapiens
caatatgtgagtgccttttg

SEQ ID NO: 3121645 - DNA, 20 bp, Homo sapiens
caatattaaatacagacact

SEQ ID NO: 3121646 - DNA, 21 bp, Homo sapiens
caatattaaatacagacacta

SEQ ID NO: 3121647 - DNA, 23 bp, Homo sapiens
caatattaaatacagacactaag

SEQ ID NO: 3121648 - DNA, 13 bp, Homo sapiens
caatattataatt

SEQ ID NO: 3121649 - DNA, 14 bp, Homo sapiens
caatattatactaa

SEQ ID NO: 3121650 - DNA, 22 bp, Homo sapiens
caatattatactaagaaaagat

SEQ ID NO: 3121651 - DNA, 21 bp, Homo sapiens
caatattcctgaatgaaatat

SEQ ID NO: 3121652 - DNA, 16 bp, Homo sapiens
caatattgattgggaa

SEQ ID NO: 3121653 - DNA, 20 bp, Homo sapiens
caatattgattgggaaaaca

SEQ ID NO: 3121654 - DNA, 14 bp, Homo sapiens
caatatttattatt

SEQ ID NO: 3121655 - DNA, 20 bp, Homo sapiens
caatattttctttaatgctt

SEQ ID NO: 3121656 - DNA, 15 bp, Homo sapiens
caatcaaaacacact

SEQ ID NO: 3121657 - DNA, 15 bp, Homo sapiens
caatcaaagaattac

SEQ ID NO: 3121658 - DNA, 17 bp, Homo sapiens
caatcaactttactgta

SEQ ID NO: 3121659 - DNA, 18 bp, Homo sapiens
caatcaatacagcttcat

SEQ ID NO: 3121660 - DNA, 19 bp, Homo sapiens
caatcactaaactttattt

SEQ ID NO: 3121661 - DNA, 20 bp, Homo sapiens
caatcactaaactttatttg

SEQ ID NO: 3121662 - DNA, 16 bp, Homo sapiens
caatcactgcactgca

SEQ ID NO: 3121663 - DNA, 16 bp, Homo sapiens
caatcagcactgaaaa

SEQ ID NO: 3121664 - DNA, 17 bp, Homo sapiens
caatcagcactgaaaat

SEQ ID NO: 3121665 - DNA, 12 bp, Homo sapiens
caatcagctcct

SEQ ID NO: 3121666 - DNA, 14 bp, Homo sapiens
caatcagtcccctc

SEQ ID NO: 3121667 - DNA, 17 bp, Homo sapiens
caatcagtcccctccca

SEQ ID NO: 3121668 - DNA, 21 bp, Homo sapiens
caatcagtcccctcccatctg

SEQ ID NO: 3121669 - DNA, 17 bp, Homo sapiens
caatcatctgtgtgaaa

SEQ ID NO: 3121670 - DNA, 17 bp, Homo sapiens
caatcatgaacagctct

SEQ ID NO: 3121671 - DNA, 18 bp, Homo sapiens
caatcatgaacagctctg

SEQ ID NO: 3121672 - DNA, 19 bp, Homo sapiens
caatcatgaacagctctga

SEQ ID NO: 3121673 - DNA, 17 bp, Homo sapiens
caatcattgaagtatat

SEQ ID NO: 3121674 - DNA, 22 bp, Homo sapiens
caatcattgaagtatattctta

SEQ ID NO: 3121675 - DNA, 15 bp, Homo sapiens
caatcccaattctgt

SEQ ID NO: 3121676 - DNA, 15 bp, Homo sapiens
caatcccagggctgg

SEQ ID NO: 3121677 - DNA, 19 bp, Homo sapiens
caatcccagggctggctct

SEQ ID NO: 3121678 - DNA, 22 bp, Homo sapiens
caatcccagggctggctctgca

SEQ ID NO: 3121679 - DNA, 12 bp, Homo sapiens
caatcccctcct

SEQ ID NO: 3121680 - DNA, 17 bp, Homo sapiens
caatcctcactgggtgg

SEQ ID NO: 3121681 - DNA, 12 bp, Homo sapiens
caatcctggctc

SEQ ID NO: 3121682 - DNA, 21 bp, Homo sapiens
caatcgagatttgggagctga

SEQ ID NO: 3121683 - DNA, 20 bp, Homo sapiens
caatctctacccctttcttc

SEQ ID NO: 3121684 - DNA, 23 bp, Homo sapiens
caatctctacccctttcttctcg

SEQ ID NO: 3121685 - DNA, 15 bp, Homo sapiens
caatctctctctgtg

SEQ ID NO: 3121686 - DNA, 16 bp, Homo sapiens
caatctctctctgtgt

SEQ ID NO: 3121687 - DNA, 11 bp, Homo sapiens
caatctctgac

SEQ ID NO: 3121688 - DNA, 14 bp, Homo sapiens
caatctctttttgt

SEQ ID NO: 3121689 - DNA, 16 bp, Homo sapiens
caatctggaagaaaaa

SEQ ID NO: 3121690 - DNA, 19 bp, Homo sapiens
caatctggcttagtgccac

SEQ ID NO: 3121691 - DNA, 15 bp, Homo sapiens
caatctgtaaactgt

SEQ ID NO: 3121692 - DNA, 17 bp, Homo sapiens
caatctgtgtaagaaaa

SEQ ID NO: 3121693 - DNA, 19 bp, Homo sapiens
caatcttaccagatgctac

SEQ ID NO: 3121694 - DNA, 16 bp, Homo sapiens
caatcttattccgagc

SEQ ID NO: 3121695 - DNA, 16 bp, Homo sapiens
caatctttattatgca

SEQ ID NO: 3121696 - DNA, 21 bp, Homo sapiens
caatctttctatataaaatgt

SEQ ID NO: 3121697 - DNA, 17 bp, Homo sapiens
caatgaaaaatgtaatt

SEQ ID NO: 3121698 - DNA, 18 bp, Homo sapiens
caatgaaaaatgtaattt

SEQ ID NO: 3121699 - DNA, 22 bp, Homo sapiens
caatgaaatacacaagtaaaca

SEQ ID NO: 3121700 - DNA, 23 bp, Homo sapiens
caatgaaatgaattaaagtggac

SEQ ID NO: 3121701 - DNA, 15 bp, Homo sapiens
caatgaaccataaat

SEQ ID NO: 3121702 - DNA, 21 bp, Homo sapiens
caatgaagccagctcacagtg

SEQ ID NO: 3121703 - DNA, 20 bp, Homo sapiens
caatgaaggaaataaaaaag

SEQ ID NO: 3121704 - DNA, 14 bp, Homo sapiens
caatgaatgtatat

SEQ ID NO: 3121705 - DNA, 13 bp, Homo sapiens
caatgaattatta

SEQ ID NO: 3121706 - DNA, 19 bp, Homo sapiens
caatgactagtcacctggg

SEQ ID NO: 3121707 - DNA, 21 bp, Homo sapiens
caatgagactctagggtccag

SEQ ID NO: 3121708 - DNA, 17 bp, Homo sapiens
caatgaggtctgaaatg

SEQ ID NO: 3121709 - DNA, 18 bp, Homo sapiens
caatgaggtctgaaatgg

SEQ ID NO: 3121710 - DNA, 20 bp, Homo sapiens
caatgaggtgtccaactggc

SEQ ID NO: 3121711 - DNA, 15 bp, Homo sapiens
caatgatcaaatttt

SEQ ID NO: 3121712 - DNA, 16 bp, Homo sapiens
caatgatcaaattttg

SEQ ID NO: 3121713 - DNA, 14 bp, Homo sapiens
caatgatgaatgag

SEQ ID NO: 3121714 - DNA, 13 bp, Homo sapiens
caatgatggcaat

SEQ ID NO: 3121715 - DNA, 21 bp, Homo sapiens
caatgatggcaattttgtaac

SEQ ID NO: 3121716 - DNA, 24 bp, Homo sapiens
caatgatggcaattttgtaacgaa

SEQ ID NO: 3121717 - DNA, 13 bp, Homo sapiens
caatgatggtcac

SEQ ID NO: 3121718 - DNA, 19 bp, Homo sapiens
caatgattcataacaatgt

SEQ ID NO: 3121719 - DNA, 14 bp, Homo sapiens
caatgcacatccat

SEQ ID NO: 3121720 - DNA, 18 bp, Homo sapiens
caatgcagcaaggccctg

SEQ ID NO: 3121721 - DNA, 22 bp, Homo sapiens
caatgcagcaaggccctgctgc

SEQ ID NO: 3121722 - DNA, 18 bp, Homo sapiens
caatgcatagagccctgg

SEQ ID NO: 3121723 - DNA, 22 bp, Homo sapiens
caatgcatagagccctggccag

SEQ ID NO: 3121724 - DNA, 13 bp, Homo sapiens
caatgcccagcag

SEQ ID NO: 3121725 - DNA, 20 bp, Homo sapiens
caatgcccgtaatgcttaga

SEQ ID NO: 3121726 - DNA, 19 bp, Homo sapiens
caatgctgatgaatcactg

SEQ ID NO: 3121727 - DNA, 14 bp, Homo sapiens
caatgctgatttgg

SEQ ID NO: 3121728 - DNA, 16 bp, Homo sapiens
caatgctgatttggtg

SEQ ID NO: 3121729 - DNA, 22 bp, Homo sapiens
caatgctggctgttggctgggg

SEQ ID NO: 3121730 - DNA, 11 bp, Homo sapiens
caatgcttaaa

SEQ ID NO: 3121731 - DNA, 23 bp, Homo sapiens
caatgcttctgtagcttctaatg

SEQ ID NO: 3121732 - DNA, 13 bp, Homo sapiens
caatgctttggga

SEQ ID NO: 3121733 - DNA, 23 bp, Homo sapiens
caatgctttgggaggccaaggca

SEQ ID NO: 3121734 - DNA, 16 bp, Homo sapiens
caatggaaacctcacg

SEQ ID NO: 3121735 - DNA, 17 bp, Homo sapiens
caatggaaacctcacgc

SEQ ID NO: 3121736 - DNA, 13 bp, Homo sapiens
caatggaagattt

SEQ ID NO: 3121737 - DNA, 11 bp, Homo sapiens
caatggcagcc

SEQ ID NO: 3121738 - DNA, 12 bp, Homo sapiens
caatggcagcct

SEQ ID NO: 3121739 - DNA, 15 bp, Homo sapiens
caatggcagccttgg

SEQ ID NO: 3121740 - DNA, 16 bp, Homo sapiens
caatggcagccttggc

SEQ ID NO: 3121741 - DNA, 22 bp, Homo sapiens
caatggcagctagactggagtg

SEQ ID NO: 3121742 - DNA, 22 bp, Homo sapiens
caatggctatatggcaagaaag

SEQ ID NO: 3121743 - DNA, 17 bp, Homo sapiens
caatgggcactgggatg

SEQ ID NO: 3121744 - DNA, 18 bp, Homo sapiens
caatgggcactgggatga

SEQ ID NO: 3121745 - DNA, 16 bp, Homo sapiens
caatggtcctgacttt

SEQ ID NO: 3121746 - DNA, 11 bp, Homo sapiens
caatgtaaaaa

SEQ ID NO: 3121747 - DNA, 20 bp, Homo sapiens
caatgtaaaaatacactaat

SEQ ID NO: 3121748 - DNA, 17 bp, Homo sapiens
caatgtaagcatacttt

SEQ ID NO: 3121749 - DNA, 13 bp, Homo sapiens
caatgtataaaga

SEQ ID NO: 3121750 - DNA, 18 bp, Homo sapiens
caatgtataaagattgta

SEQ ID NO: 3121751 - DNA, 22 bp, Homo sapiens
caatgtataaagattgtactta

SEQ ID NO: 3121752 - DNA, 15 bp, Homo sapiens
caaagattgagaagc

SEQ ID NO: 3121753 - DNA, 14 bp, Homo sapiens
caaagcaagggctc

SEQ ID NO: 3121754 - DNA, 15 bp, Homo sapiens
caaagcaagggctcc

SEQ ID NO: 3121755 - DNA, 17 bp, Homo sapiens
caaagcaagggctccag

SEQ ID NO: 3121756 - DNA, 13 bp, Homo sapiens
caaagcacagtgt

SEQ ID NO: 3121757 - DNA, 19 bp, Homo sapiens
caaagcacagtgttaaatg

SEQ ID NO: 3121758 - DNA, 19 bp, Homo sapiens
caaagcacatgcttagctt

SEQ ID NO: 3121759 - DNA, 22 bp, Homo sapiens
caaagcacatgcttagcttatc

SEQ ID NO: 3121760 - DNA, 23 bp, Homo sapiens
caaagcacatgcttagcttatct

SEQ ID NO: 3121761 - DNA, 17 bp, Homo sapiens
caaagcacattgaaaga

SEQ ID NO: 3121762 - DNA, 18 bp, Homo sapiens
caaagcacattgaaagag

SEQ ID NO: 3121763 - DNA, 22 bp, Homo sapiens
caaagcacttggactcttgctc

SEQ ID NO: 3121764 - DNA, 23 bp, Homo sapiens
caaagcacttggactcttgctct

SEQ ID NO: 3121765 - DNA, 14 bp, Homo sapiens
caaagcagcagcca

SEQ ID NO: 3121766 - DNA, 12 bp, Homo sapiens
caaagcagtgtt

SEQ ID NO: 3121767 - DNA, 24 bp, Homo sapiens
caaagcatggacatttagaagaaa

SEQ ID NO: 3121768 - DNA, 20 bp, Homo sapiens
caaagccaaagctaggcctg

SEQ ID NO: 3121769 - DNA, 19 bp, Homo sapiens
caaagccacaaggctggcc

SEQ ID NO: 3121770 - DNA, 15 bp, Homo sapiens
caaagccagggtctc

SEQ ID NO: 3121771 - DNA, 23 bp, Homo sapiens
caaagccagggtctctccctcag

SEQ ID NO: 3121772 - DNA, 18 bp, Homo sapiens
caaagcccttccatgtcg

SEQ ID NO: 3121773 - DNA, 22 bp, Homo sapiens
caaagcctcttcaaaaagcaga

SEQ ID NO: 3121774 - DNA, 11 bp, Homo sapiens
caaagccttat

SEQ ID NO: 3121775 - DNA, 20 bp, Homo sapiens
caaagcgagatcccatctct

SEQ ID NO: 3121776 - DNA, 17 bp, Homo sapiens
caaagcggggggagggt

SEQ ID NO: 3121777 - DNA, 17 bp, Homo sapiens
caaagctaaaatatata

SEQ ID NO: 3121778 - DNA, 19 bp, Homo sapiens
caaagctaggcctggccag

SEQ ID NO: 3121779 - DNA, 18 bp, Homo sapiens
caaagctcaaataaaaat

SEQ ID NO: 3121780 - DNA, 14 bp, Homo sapiens
caaagctgaatatt

SEQ ID NO: 3121781 - DNA, 21 bp, Homo sapiens
caaagctgagttacttgtctg

SEQ ID NO: 3121782 - DNA, 20 bp, Homo sapiens
caaagctgcccactgtttct

SEQ ID NO: 3121783 - DNA, 13 bp, Homo sapiens
caaagctgttaaa

SEQ ID NO: 3121784 - DNA, 17 bp, Homo sapiens
caaagctgttaaactgt

SEQ ID NO: 3121785 - DNA, 18 bp, Homo sapiens
caaagctgttaaactgtt

SEQ ID NO: 3121786 - DNA, 19 bp, Homo sapiens
caaagcttctatcccagga

SEQ ID NO: 3121787 - DNA, 20 bp, Homo sapiens
caaagcttctatcccaggag

SEQ ID NO: 3121788 - DNA, 16 bp, Homo sapiens
caaagctttcctgccc

SEQ ID NO: 3121789 - DNA, 18 bp, Homo sapiens
caaagctttcctgcccca

SEQ ID NO: 3121790 - DNA, 23 bp, Homo sapiens
caaagctttgctacaaatttatg

SEQ ID NO: 3121791 - DNA, 16 bp, Homo sapiens
caaagcttttagaaat

SEQ ID NO: 3121792 - DNA, 21 bp, Homo sapiens
caaaggaaaaagcacaagaag

SEQ ID NO: 3121793 - DNA, 17 bp, Homo sapiens
caaaggaaggtggatgg

SEQ ID NO: 3121794 - DNA, 19 bp, Homo sapiens
caaaggaagtgccccctcc

SEQ ID NO: 3121795 - DNA, 21 bp, Homo sapiens
caaaggaataacctttctgga

SEQ ID NO: 3121796 - DNA, 18 bp, Homo sapiens
caaaggacattatgtgtg

SEQ ID NO: 3121797 - DNA, 20 bp, Homo sapiens
caaaggacattatgtgtgca

SEQ ID NO: 3121798 - DNA, 14 bp, Homo sapiens
caaaggagaaaaaa

SEQ ID NO: 3121799 - DNA, 19 bp, Homo sapiens
caaaggagaaaaaaaacct

SEQ ID NO: 3121800 - DNA, 17 bp, Homo sapiens
caaaggagctcgaagga

SEQ ID NO: 3121801 - DNA, 19 bp, Homo sapiens
caaaggagctcgaaggata

SEQ ID NO: 3121802 - DNA, 17 bp, Homo sapiens
caaaggaggctggcagg

SEQ ID NO: 3121803 - DNA, 13 bp, Homo sapiens
caaaggatgtgat

SEQ ID NO: 3121804 - DNA, 17 bp, Homo sapiens
caaaggatgtgatatat

SEQ ID NO: 3121805 - DNA, 15 bp, Homo sapiens
caaaggccctcagtg

SEQ ID NO: 3121806 - DNA, 13 bp, Homo sapiens
caaaggcctgggc

SEQ ID NO: 3121807 - DNA, 15 bp, Homo sapiens
caaagggaaatatca

SEQ ID NO: 3121808 - DNA, 14 bp, Homo sapiens
caaagggagggagc

SEQ ID NO: 3121809 - DNA, 19 bp, Homo sapiens
caaaggggacaggcctcac

SEQ ID NO: 3121810 - DNA, 14 bp, Homo sapiens
caaaggggctgctg

SEQ ID NO: 3121811 - DNA, 15 bp, Homo sapiens
caaaggggctgctgg

SEQ ID NO: 3121812 - DNA, 17 bp, Homo sapiens
caaaggggctgctgggg

SEQ ID NO: 3121813 - DNA, 18 bp, Homo sapiens
caaagggtatcaggtgct

SEQ ID NO: 3121814 - DNA, 19 bp, Homo sapiens
caaagggtatcaggtgctg

SEQ ID NO: 3121815 - DNA, 21 bp, Homo sapiens
caaagggtatcaggtgctgcc

SEQ ID NO: 3121816 - DNA, 23 bp, Homo sapiens
caaagggtatcaggtgctgccat

SEQ ID NO: 3121817 - DNA, 19 bp, Homo sapiens
caaagggtgaagctattta

SEQ ID NO: 3121818 - DNA, 23 bp, Homo sapiens
caaagggtgaagctatttatctg

SEQ ID NO: 3121819 - DNA, 12 bp, Homo sapiens
caaaggttctag

SEQ ID NO: 3121820 - DNA, 16 bp, Homo sapiens
caaagtaaaggcctcc

SEQ ID NO: 3121821 - DNA, 22 bp, Homo sapiens
caaagtaaaggcctcctccccc

SEQ ID NO: 3121822 - DNA, 16 bp, Homo sapiens
caaagtaaatacaaga

SEQ ID NO: 3121823 - DNA, 20 bp, Homo sapiens
caaagtacaatgtgtttttc

SEQ ID NO: 3121824 - DNA, 22 bp, Homo sapiens
caaagtagaaactactaatttt

SEQ ID NO: 3121825 - DNA, 22 bp, Homo sapiens
caaagtagaagtcttagatgta

SEQ ID NO: 3121826 - DNA, 14 bp, Homo sapiens
caaagtataatctt

SEQ ID NO: 3121827 - DNA, 14 bp, Homo sapiens
caaagtcctttttt

SEQ ID NO: 3121828 - DNA, 17 bp, Homo sapiens
caaagtcctttttttcc

SEQ ID NO: 3121829 - DNA, 23 bp, Homo sapiens
caaagtcctttttttccatcttt

SEQ ID NO: 3121830 - DNA, 12 bp, Homo sapiens
caaagtctctaa

SEQ ID NO: 3121831 - DNA, 13 bp, Homo sapiens
caaagtctctaat

SEQ ID NO: 3121832 - DNA, 14 bp, Homo sapiens
caaagtctgtgtga

SEQ ID NO: 3121833 - DNA, 15 bp, Homo sapiens
caagtcacagctgca

SEQ ID NO: 3121834 - DNA, 18 bp, Homo sapiens
caagtcacagctgcagct

SEQ ID NO: 3121835 - DNA, 19 bp, Homo sapiens
caagtcacagctgcagctg

SEQ ID NO: 3121836 - DNA, 23 bp, Homo sapiens
caagtcacagctgcagctgggcc

SEQ ID NO: 3121837 - DNA, 18 bp, Homo sapiens
caagtcacatgcgtaaac

SEQ ID NO: 3121838 - DNA, 18 bp, Homo sapiens
caagtcagattgctggga

SEQ ID NO: 3121839 - DNA, 19 bp, Homo sapiens
caagtcaggcccttatttt

SEQ ID NO: 3121840 - DNA, 20 bp, Homo sapiens
caagtcataggttaatattt

SEQ ID NO: 3121841 - DNA, 17 bp, Homo sapiens
caagtcattttaacttt

SEQ ID NO: 3121842 - DNA, 14 bp, Homo sapiens
caagtccccaagat

SEQ ID NO: 3121843 - DNA, 19 bp, Homo sapiens
caagtccctgttttctgag

SEQ ID NO: 3121844 - DNA, 15 bp, Homo sapiens
caagtcctccctctc

SEQ ID NO: 3121845 - DNA, 24 bp, Homo sapiens
caagtcctccctctctactggagt

SEQ ID NO: 3121846 - DNA, 14 bp, Homo sapiens
caagtcctcttttc

SEQ ID NO: 3121847 - DNA, 19 bp, Homo sapiens
caagtcctgaagaggcggg

SEQ ID NO: 3121848 - DNA, 12 bp, Homo sapiens
caagtcctggct

SEQ ID NO: 3121849 - DNA, 22 bp, Homo sapiens
caagtcctggctacatcccagc

SEQ ID NO: 3121850 - DNA, 15 bp, Homo sapiens
caagtcctgtgaatt

SEQ ID NO: 3121851 - DNA, 22 bp, Homo sapiens
caagtccttacctcttccggag

SEQ ID NO: 3121852 - DNA, 14 bp, Homo sapiens
caagtctccttccc

SEQ ID NO: 3121853 - DNA, 15 bp, Homo sapiens
caagtctctctgtga

SEQ ID NO: 3121854 - DNA, 22 bp, Homo sapiens
caagtctctgctggcccagcca

SEQ ID NO: 3121855 - DNA, 23 bp, Homo sapiens
caagtctctgctggcccagccaa

SEQ ID NO: 3121856 - DNA, 15 bp, Homo sapiens
caagtctgtacctca

SEQ ID NO: 3121857 - DNA, 22 bp, Homo sapiens
caagtctgtgagtgcgtctgag

SEQ ID NO: 3121858 - DNA, 23 bp, Homo sapiens
caagtctgtgagtgcgtctgagg

SEQ ID NO: 3121859 - DNA, 14 bp, Homo sapiens
caagtcttccctga

SEQ ID NO: 3121860 - DNA, 22 bp, Homo sapiens
caagtcttgggtctgaatttat

SEQ ID NO: 3121861 - DNA, 17 bp, Homo sapiens
caagtgagagctgggtg

SEQ ID NO: 3121862 - DNA, 21 bp, Homo sapiens
caagtgatctgccgcctcagc

SEQ ID NO: 3121863 - DNA, 14 bp, Homo sapiens
caagtgcacggggc

SEQ ID NO: 3121864 - DNA, 20 bp, Homo sapiens
caagtgcacggggcacagcg

SEQ ID NO: 3121865 - DNA, 15 bp, Homo sapiens
caagtgccaaacaga

SEQ ID NO: 3121866 - DNA, 14 bp, Homo sapiens
caagtgccagaggt

SEQ ID NO: 3121867 - DNA, 16 bp, Homo sapiens
caagtgccagaggtgg

SEQ ID NO: 3121868 - DNA, 21 bp, Homo sapiens
caagtgccagaggtgggcagg

SEQ ID NO: 3121869 - DNA, 22 bp, Homo sapiens
caagtgccagaggtgggcaggt

SEQ ID NO: 3121870 - DNA, 15 bp, Homo sapiens
caagtgcctagactg

SEQ ID NO: 3121871 - DNA, 12 bp, Homo sapiens
caagtggacctt

SEQ ID NO: 3121872 - DNA, 21 bp, Homo sapiens
caagtggaccttaggccttcc

SEQ ID NO: 3121873 - DNA, 20 bp, Homo sapiens
caagtggatgtttttaatga

SEQ ID NO: 3121874 - DNA, 19 bp, Homo sapiens
caagtggcatgtgctgtga

SEQ ID NO: 3121875 - DNA, 16 bp, Homo sapiens
caagtggggctcgcca

SEQ ID NO: 3121876 - DNA, 21 bp, Homo sapiens
caagtggggctcgccatgccg

SEQ ID NO: 3121877 - DNA, 17 bp, Homo sapiens
caagtggggtgctggga

SEQ ID NO: 3121878 - DNA, 19 bp, Homo sapiens
caagtggggtgctgggagg

SEQ ID NO: 3121879 - DNA, 19 bp, Homo sapiens
caagtggtttccacatgct

SEQ ID NO: 3121880 - DNA, 21 bp, Homo sapiens
caagtggtttccacatgctct

SEQ ID NO: 3121881 - DNA, 22 bp, Homo sapiens
caagtggtttccacatgctctg

SEQ ID NO: 3121882 - DNA, 13 bp, Homo sapiens
caagtgtctggag

SEQ ID NO: 3121883 - DNA, 13 bp, Homo sapiens
caagtgtcttcca

SEQ ID NO: 3121884 - DNA, 18 bp, Homo sapiens
caagtgtggggggtcctt

SEQ ID NO: 3121885 - DNA, 16 bp, Homo sapiens
caagttaacaaggaat

SEQ ID NO: 3121886 - DNA, 18 bp, Homo sapiens
caagttaacaaggaatgc

SEQ ID NO: 3121887 - DNA, 19 bp, Homo sapiens
caagttagctcaggaggct

SEQ ID NO: 3121888 - DNA, 16 bp, Homo sapiens
caagttagggtctatg

SEQ ID NO: 3121889 - DNA, 19 bp, Homo sapiens
caagttaggtatgtttgca

SEQ ID NO: 3121890 - DNA, 14 bp, Homo sapiens
caagttatctttcc

SEQ ID NO: 3121891 - DNA, 12 bp, Homo sapiens
caagttattgta

SEQ ID NO: 3121892 - DNA, 23 bp, Homo sapiens
caagttccccatccctgtcattt

SEQ ID NO: 3121893 - DNA, 21 bp, Homo sapiens
caagttcctctagtgccctcc

SEQ ID NO: 3121894 - DNA, 12 bp, Homo sapiens
caagttctaaga

SEQ ID NO: 3121895 - DNA, 13 bp, Homo sapiens
caagttctaagat

SEQ ID NO: 3121896 - DNA, 18 bp, Homo sapiens
caagttctaagattctaa

SEQ ID NO: 3121897 - DNA, 16 bp, Homo sapiens
caagttcttcacctct

SEQ ID NO: 3121898 - DNA, 15 bp, Homo sapiens
caagttgcgacggag

SEQ ID NO: 3121899 - DNA, 20 bp, Homo sapiens
caagttgcgacggagagaaa

SEQ ID NO: 3121900 - DNA, 15 bp, Homo sapiens
caagttgctaataca

SEQ ID NO: 3121901 - DNA, 22 bp, Homo sapiens
caagttgtcagctttttgatcc

SEQ ID NO: 3121902 - DNA, 20 bp, Homo sapiens
caagttgttattgttgaaca

SEQ ID NO: 3121903 - DNA, 16 bp, Homo sapiens
caagtttacacttcat

SEQ ID NO: 3121904 - DNA, 19 bp, Homo sapiens
caagtttacacttcatata

SEQ ID NO: 3121905 - DNA, 17 bp, Homo sapiens
caagtttatttctctct

SEQ ID NO: 3121906 - DNA, 14 bp, Homo sapiens
caagtttcagacag

SEQ ID NO: 3121907 - DNA, 16 bp, Homo sapiens
caagtttccatagcaa

SEQ ID NO: 3121908 - DNA, 20 bp, Homo sapiens
caagtttccatagcaacagg

SEQ ID NO: 3121909 - DNA, 22 bp, Homo sapiens
caagtttctagctagaaatatg

SEQ ID NO: 3121910 - DNA, 17 bp, Homo sapiens
caagttttcttccatga

SEQ ID NO: 3121911 - DNA, 19 bp, Homo sapiens
caataaaaagttcagagtt

SEQ ID NO: 3121912 - DNA, 20 bp, Homo sapiens
caataaaaagttcagagttc

SEQ ID NO: 3121913 - DNA, 17 bp, Homo sapiens
caataaaaatgtttaac

SEQ ID NO: 3121914 - DNA, 16 bp, Homo sapiens
caataaaatgtgattt

SEQ ID NO: 3121915 - DNA, 20 bp, Homo sapiens
caataaaatgtgatttttct

SEQ ID NO: 3121916 - DNA, 22 bp, Homo sapiens
caataaaatgtgatttttctga

SEQ ID NO: 3121917 - DNA, 20 bp, Homo sapiens
caataaaatttaaaaaataa

SEQ ID NO: 3121918 - DNA, 12 bp, Homo sapiens
caataaacagga

SEQ ID NO: 3121919 - DNA, 17 bp, Homo sapiens
caataaacaggaatttt

SEQ ID NO: 3121920 - DNA, 19 bp, Homo sapiens
caataaacaggaattttat

SEQ ID NO: 3121921 - DNA, 22 bp, Homo sapiens
caataaacaggaattttatttt

SEQ ID NO: 3121922 - DNA, 19 bp, Homo sapiens
caataaacatttcatttcc

SEQ ID NO: 3121923 - DNA, 14 bp, Homo sapiens
caataaacttagag

SEQ ID NO: 3121924 - DNA, 18 bp, Homo sapiens
caataaacttagaggaaa

SEQ ID NO: 3121925 - DNA, 20 bp, Homo sapiens
caataaacttagaggaaaat

SEQ ID NO: 3121926 - DNA, 19 bp, Homo sapiens
caataaagaaaacttccat

SEQ ID NO: 3121927 - DNA, 22 bp, Homo sapiens
caataaagcagcctcattctga

SEQ ID NO: 3121928 - DNA, 17 bp, Homo sapiens
caataaagcttttggaa

SEQ ID NO: 3121929 - DNA, 21 bp, Homo sapiens
caataaaggcagctgcctctg

SEQ ID NO: 3121930 - DNA, 16 bp, Homo sapiens
caataaagtataatgt

SEQ ID NO: 3121931 - DNA, 18 bp, Homo sapiens
caataaagtataatgttt

SEQ ID NO: 3121932 - DNA, 20 bp, Homo sapiens
caataaagtataatgtttat

SEQ ID NO: 3121933 - DNA, 18 bp, Homo sapiens
caataaataacacttgtc

SEQ ID NO: 3121934 - DNA, 15 bp, Homo sapiens
caataaatgtctgtt

SEQ ID NO: 3121935 - DNA, 17 bp, Homo sapiens
caataaatgtgcttatg

SEQ ID NO: 3121936 - DNA, 13 bp, Homo sapiens
caataacactgtc

SEQ ID NO: 3121937 - DNA, 18 bp, Homo sapiens
caataacccagttacttt

SEQ ID NO: 3121938 - DNA, 19 bp, Homo sapiens
caataacccagttactttt

SEQ ID NO: 3121939 - DNA, 16 bp, Homo sapiens
caataacttctatatt

SEQ ID NO: 3121940 - DNA, 18 bp, Homo sapiens
caataacttctatatttt

SEQ ID NO: 3121941 - DNA, 20 bp, Homo sapiens
caataacttctatattttaa

SEQ ID NO: 3121942 - DNA, 14 bp, Homo sapiens
caataaggagcatc

SEQ ID NO: 3121943 - DNA, 21 bp, Homo sapiens
caataagtttgaacctttttt

SEQ ID NO: 3121944 - DNA, 23 bp, Homo sapiens
caataatattgttgtataatttc

SEQ ID NO: 3121945 - DNA, 22 bp, Homo sapiens
caataatcagaaaagtaatttt

SEQ ID NO: 3121946 - DNA, 20 bp, Homo sapiens
caataatggtcccatccagg

SEQ ID NO: 3121947 - DNA, 14 bp, Homo sapiens
caatacaaatggat

SEQ ID NO: 3121948 - DNA, 21 bp, Homo sapiens
caatacaaatggattttggga

SEQ ID NO: 3121949 - DNA, 18 bp, Homo sapiens
caatacagataacattag

SEQ ID NO: 3121950 - DNA, 15 bp, Homo sapiens
caatacatgctgcta

SEQ ID NO: 3121951 - DNA, 17 bp, Homo sapiens
caatacatgctgctaat

SEQ ID NO: 3121952 - DNA, 18 bp, Homo sapiens
caatacctacaataaact

SEQ ID NO: 3121953 - DNA, 15 bp, Homo sapiens
caatactacctcact

SEQ ID NO: 3121954 - DNA, 13 bp, Homo sapiens
caatactacctct

SEQ ID NO: 3121955 - DNA, 23 bp, Homo sapiens
caatactacctctgaatgttaca

SEQ ID NO: 3121956 - DNA, 12 bp, Homo sapiens
caatagagactg

SEQ ID NO: 3121957 - DNA, 16 bp, Homo sapiens
caatagagactgtaga

SEQ ID NO: 3121958 - DNA, 22 bp, Homo sapiens
caatagagactgtagattgctt

SEQ ID NO: 3121959 - DNA, 20 bp, Homo sapiens
caatagcactttcattgcca

SEQ ID NO: 3121960 - DNA, 19 bp, Homo sapiens
caatagcagttataacaga

SEQ ID NO: 3121961 - DNA, 14 bp, Homo sapiens
caaaacattccaag

SEQ ID NO: 3121962 - DNA, 12 bp, Homo sapiens
caaaacatttct

SEQ ID NO: 3121963 - DNA, 21 bp, Homo sapiens
caaaacatttctggacagtac

SEQ ID NO: 3121964 - DNA, 22 bp, Homo sapiens
caaaaccaaacttgttcattta

SEQ ID NO: 3121965 - DNA, 17 bp, Homo sapiens
caaaaccatctctcttc

SEQ ID NO: 3121966 - DNA, 21 bp, Homo sapiens
caaaaccatcttctgtgttta

SEQ ID NO: 3121967 - DNA, 12 bp, Homo sapiens
caaaacccagga

SEQ ID NO: 3121968 - DNA, 13 bp, Homo sapiens
caaaacccaggac

SEQ ID NO: 3121969 - DNA, 15 bp, Homo sapiens
caaaacccaggacat

SEQ ID NO: 3121970 - DNA, 15 bp, Homo sapiens
caaaacccagggcaa

SEQ ID NO: 3121971 - DNA, 17 bp, Homo sapiens
caaaacctgtgccaggc

SEQ ID NO: 3121972 - DNA, 15 bp, Homo sapiens
caaaacgagggctga

SEQ ID NO: 3121973 - DNA, 22 bp, Homo sapiens
caaaacgatgaagttatgctgt

SEQ ID NO: 3121974 - DNA, 23 bp, Homo sapiens
caaaacgcatggagtgtgtattg

SEQ ID NO: 3121975 - DNA, 17 bp, Homo sapiens
caaaacggatccgggca

SEQ ID NO: 3121976 - DNA, 14 bp, Homo sapiens
caaaacgggtcagt

SEQ ID NO: 3121977 - DNA, 13 bp, Homo sapiens
caaaacgtcttat

SEQ ID NO: 3121978 - DNA, 17 bp, Homo sapiens
caaaactatttttgtaa

SEQ ID NO: 3121979 - DNA, 19 bp, Homo sapiens
caaaactctacttaatcca

SEQ ID NO: 3121980 - DNA, 22 bp, Homo sapiens
caaaactgcctcaggaggcagg

SEQ ID NO: 3121981 - DNA, 13 bp, Homo sapiens
caaaactgttctt

SEQ ID NO: 3121982 - DNA, 23 bp, Homo sapiens
caaaactttaggccctgccccag

SEQ ID NO: 3121983 - DNA, 15 bp, Homo sapiens
caaaagaaatacctt

SEQ ID NO: 3121984 - DNA, 21 bp, Homo sapiens
caaaagacatgttgtaaatta

SEQ ID NO: 3121985 - DNA, 14 bp, Homo sapiens
caaaagagaaaaaa

SEQ ID NO: 3121986 - DNA, 18 bp, Homo sapiens
caaaagattgctgaaaaa

SEQ ID NO: 3121987 - DNA, 16 bp, Homo sapiens
caaaagcaagactgtt

SEQ ID NO: 3121988 - DNA, 20 bp, Homo sapiens
caaaagcaagggaccttcat

SEQ ID NO: 3121989 - DNA, 18 bp, Homo sapiens
caaaagcacttacttttt

SEQ ID NO: 3121990 - DNA, 21 bp, Homo sapiens
caaaagcatttatcattcttg

SEQ ID NO: 3121991 - DNA, 18 bp, Homo sapiens
caaaagccttgtgtatat

SEQ ID NO: 3121992 - DNA, 17 bp, Homo sapiens
caaaagctgtaaattac

SEQ ID NO: 3121993 - DNA, 17 bp, Homo sapiens
caaaagcttcaaattaa

SEQ ID NO: 3121994 - DNA, 13 bp, Homo sapiens
caaaagcttttta

SEQ ID NO: 3121995 - DNA, 16 bp, Homo sapiens
caaaaggaaagctgtg

SEQ ID NO: 3121996 - DNA, 12 bp, Homo sapiens
caaaaggcagct

SEQ ID NO: 3121997 - DNA, 14 bp, Homo sapiens
caaaaggcagctca

SEQ ID NO: 3121998 - DNA, 16 bp, Homo sapiens
caaaaggcctcttgta

SEQ ID NO: 3121999 - DNA, 22 bp, Homo sapiens
caaaaggcctcttgtaaagact

SEQ ID NO: 3122000 - DNA, 23 bp, Homo sapiens
caaaaggcctcttgtaaagactg

SEQ ID NO: 3122001 - DNA, 18 bp, Homo sapiens
caaaagttccaagagtct

SEQ ID NO: 3122002 - DNA, 19 bp, Homo sapiens
caaaagttggactaaatgc

SEQ ID NO: 3122003 - DNA, 14 bp, Homo sapiens
caaaagtttctctt

SEQ ID NO: 3122004 - DNA, 17 bp, Homo sapiens
caaaagttttcctgaga

SEQ ID NO: 3122005 - DNA, 22 bp, Homo sapiens
caaaataaaaagtgacacagca

SEQ ID NO: 3122006 - DNA, 14 bp, Homo sapiens
caaaataaatgttg

SEQ ID NO: 3122007 - DNA, 14 bp, Homo sapiens
caaaataataaaaa

SEQ ID NO: 3122008 - DNA, 11 bp, Homo sapiens
caaaataattc

SEQ ID NO: 3122009 - DNA, 14 bp, Homo sapiens
caaaataattctaa

SEQ ID NO: 3122010 - DNA, 16 bp, Homo sapiens
caaaatacaatcctgt

SEQ ID NO: 3122011 - DNA, 19 bp, Homo sapiens
caaaatatattttcagtac

SEQ ID NO: 3122012 - DNA, 14 bp, Homo sapiens
caaaatatattttg

SEQ ID NO: 3122013 - DNA, 22 bp, Homo sapiens
caaaatatattttgtttacaaa

SEQ ID NO: 3122014 - DNA, 17 bp, Homo sapiens
caaaatatttgtacata

SEQ ID NO: 3122015 - DNA, 18 bp, Homo sapiens
caaaatcagtttttcata

SEQ ID NO: 3122016 - DNA, 16 bp, Homo sapiens
caaaatcattttaatg

SEQ ID NO: 3122017 - DNA, 18 bp, Homo sapiens
caaaatccttccaaagaa

SEQ ID NO: 3122018 - DNA, 19 bp, Homo sapiens
caaaatccttccaaagaat

SEQ ID NO: 3122019 - DNA, 16 bp, Homo sapiens
caaaatccttgcttat

SEQ ID NO: 3122020 - DNA, 20 bp, Homo sapiens
caaaatccttgcttatgaca

SEQ ID NO: 3122021 - DNA, 14 bp, Homo sapiens
caaaatctgaactc

SEQ ID NO: 3122022 - DNA, 15 bp, Homo sapiens
caaaattaaatctgt

SEQ ID NO: 3122023 - DNA, 21 bp, Homo sapiens
caaaattagatcctaagatgt

SEQ ID NO: 3122024 - DNA, 23 bp, Homo sapiens
caaaattagatcctaagatgtgt

SEQ ID NO: 3122025 - DNA, 15 bp, Homo sapiens
caaaattcatttcta

SEQ ID NO: 3122026 - DNA, 17 bp, Homo sapiens
caaaattgcaaatcttg

SEQ ID NO: 3122027 - DNA, 22 bp, Homo sapiens
caaaattgcaaatcttgaaatt

SEQ ID NO: 3122028 - DNA, 20 bp, Homo sapiens
caaaattgtctaaaatgtca

SEQ ID NO: 3122029 - DNA, 21 bp, Homo sapiens
caaaatttagtttttgttctt

SEQ ID NO: 3122030 - DNA, 14 bp, Homo sapiens
caaaatttccagta

SEQ ID NO: 3122031 - DNA, 20 bp, Homo sapiens
caaaatttccagtacctttg

SEQ ID NO: 3122032 - DNA, 13 bp, Homo sapiens
caaaatttgacta

SEQ ID NO: 3122033 - DNA, 12 bp, Homo sapiens
caaaattttaaa

SEQ ID NO: 3122034 - DNA, 20 bp, Homo sapiens
caaaattttctcattttctt

SEQ ID NO: 3122035 - DNA, 21 bp, Homo sapiens
caaacaaaaaatacaataaat

SEQ ID NO: 3122036 - DNA, 21 bp, Homo sapiens
caaacaaaaaggttctcaggt

SEQ ID NO: 3122037 - DNA, 22 bp, Homo sapiens
caaacaacagaaagtcattcct

SEQ ID NO: 3122038 - DNA, 23 bp, Homo sapiens
caaacaagaaacgtgtcacactt

SEQ ID NO: 3122039 - DNA, 18 bp, Homo sapiens
caaacaatcccaatcttt

SEQ ID NO: 3122040 - DNA, 21 bp, Homo sapiens
caaacaatcccaatctttcta

SEQ ID NO: 3122041 - DNA, 13 bp, Homo sapiens
caaacaattcgaa

SEQ ID NO: 3122042 - DNA, 15 bp, Homo sapiens
caaacacatacagga

SEQ ID NO: 3122043 - DNA, 12 bp, Homo sapiens
caaacaccttcc

SEQ ID NO: 3122044 - DNA, 13 bp, Homo sapiens
caaacagaacagg

SEQ ID NO: 3122045 - DNA, 17 bp, Homo sapiens
caaacagaacagggtca

SEQ ID NO: 3122046 - DNA, 14 bp, Homo sapiens
caaacagagtatgt

SEQ ID NO: 3122047 - DNA, 22 bp, Homo sapiens
caaacagagtatgtccgatggt

SEQ ID NO: 3122048 - DNA, 18 bp, Homo sapiens
caaacagccaagattttc

SEQ ID NO: 3122049 - DNA, 21 bp, Homo sapiens
caaacagccccagtcttcctt

SEQ ID NO: 3122050 - DNA, 17 bp, Homo sapiens
caaacagtctcccttcc

SEQ ID NO: 3122051 - DNA, 20 bp, Homo sapiens
caaacatagcccctgccccg

SEQ ID NO: 3122052 - DNA, 17 bp, Homo sapiens
caaacatcaaataaatt

SEQ ID NO: 3122053 - DNA, 20 bp, Homo sapiens
caaacatcaaataaatttct

SEQ ID NO: 3122054 - DNA, 18 bp, Homo sapiens
caaacatcactctgctgc

SEQ ID NO: 3122055 - DNA, 22 bp, Homo sapiens
caaacatcagacctgtcttcca

SEQ ID NO: 3122056 - DNA, 11 bp, Homo sapiens
caaacatgcag

SEQ ID NO: 3122057 - DNA, 18 bp, Homo sapiens
caaacatggatacttcct

SEQ ID NO: 3122058 - DNA, 20 bp, Homo sapiens
caaacatggatacttcctgg

SEQ ID NO: 3122059 - DNA, 21 bp, Homo sapiens
caaacatggatacttcctggg

SEQ ID NO: 3122060 - DNA, 15 bp, Homo sapiens
caaacatgtatttat

SEQ ID NO: 3122061 - DNA, 18 bp, Homo sapiens
caaacatgtatttatgta

SEQ ID NO: 3122062 - DNA, 19 bp, Homo sapiens
caaacattcgtgagctggg

SEQ ID NO: 3122063 - DNA, 14 bp, Homo sapiens
caaacatttcaaag

SEQ ID NO: 3122064 - DNA, 15 bp, Homo sapiens
caaacatttcaaagt

SEQ ID NO: 3122065 - DNA, 14 bp, Homo sapiens
caaaccaaataaaa

SEQ ID NO: 3122066 - DNA, 13 bp, Homo sapiens
caaaccaacatct

SEQ ID NO: 3122067 - DNA, 19 bp, Homo sapiens
caaaccaacatctttgcga

SEQ ID NO: 3122068 - DNA, 18 bp, Homo sapiens
caaaccaatttcttcctt

SEQ ID NO: 3122069 - DNA, 19 bp, Homo sapiens
caaaccaatttcttccttc

SEQ ID NO: 3122070 - DNA, 18 bp, Homo sapiens
caaaccagccttcggagc

SEQ ID NO: 3122071 - DNA, 22 bp, Homo sapiens
caaaccagcttgttctgggctc

SEQ ID NO: 3122072 - DNA, 21 bp, Homo sapiens
caaaccatttttaaagtagaa

SEQ ID NO: 3122073 - DNA, 21 bp, Homo sapiens
caaacccacgattttctccag

SEQ ID NO: 3122074 - DNA, 19 bp, Homo sapiens
caaacccagacaaccaaaa

SEQ ID NO: 3122075 - DNA, 21 bp, Homo sapiens
caaacccagacaaccaaaaca

SEQ ID NO: 3122076 - DNA, 20 bp, Homo sapiens
caaaccctagccttgcttgt

SEQ ID NO: 3122077 - DNA, 18 bp, Homo sapiens
caaacccttaactgacat

SEQ ID NO: 3122078 - DNA, 15 bp, Homo sapiens
caaaccttcctggga

SEQ ID NO: 3122079 - DNA, 18 bp, Homo sapiens
caaacctttattttagaa

SEQ ID NO: 3122080 - DNA, 20 bp, Homo sapiens
caaacctttattttagaatt

SEQ ID NO: 3122081 - DNA, 13 bp, Homo sapiens
caaacgctaaaga

SEQ ID NO: 3122082 - DNA, 21 bp, Homo sapiens
caaacgctaaagagcccttgc

SEQ ID NO: 3122083 - DNA, 22 bp, Homo sapiens
caaacgctaaagagcccttgcc

SEQ ID NO: 3122084 - DNA, 16 bp, Homo sapiens
caaactactgaatgaa

SEQ ID NO: 3122085 - DNA, 23 bp, Homo sapiens
caaactactgaatgaagcagtat

SEQ ID NO: 3122086 - DNA, 22 bp, Homo sapiens
caaactgcacacacagctcctc

SEQ ID NO: 3122087 - DNA, 21 bp, Homo sapiens
caaactgcttcccttactttg

SEQ ID NO: 3122088 - DNA, 17 bp, Homo sapiens
caaactggagtctggag

SEQ ID NO: 3122089 - DNA, 14 bp, Homo sapiens
atttttaaagtttt

SEQ ID NO: 3122090 - DNA, 14 bp, Homo sapiens
atttttaaattata

SEQ ID NO: 3122091 - DNA, 23 bp, Homo sapiens
atttttaactttttatttctaaa

SEQ ID NO: 3122092 - DNA, 21 bp, Homo sapiens
atttttaagcaaaatattatt

SEQ ID NO: 3122093 - DNA, 11 bp, Homo sapiens
atttttaatgg

SEQ ID NO: 3122094 - DNA, 12 bp, Homo sapiens
atttttaatggg

SEQ ID NO: 3122095 - DNA, 17 bp, Homo sapiens
atttttacaagatccat

SEQ ID NO: 3122096 - DNA, 20 bp, Homo sapiens
atttttacaagatccatttg

SEQ ID NO: 3122097 - DNA, 14 bp, Homo sapiens
atttttacatttaa

SEQ ID NO: 3122098 - DNA, 21 bp, Homo sapiens
atttttacatttaaacctttt

SEQ ID NO: 3122099 - DNA, 19 bp, Homo sapiens
atttttaccctaatgtctt

SEQ ID NO: 3122100 - DNA, 21 bp, Homo sapiens
atttttagatagttagaacct

SEQ ID NO: 3122101 - DNA, 20 bp, Homo sapiens
atttttagatggttacactg

SEQ ID NO: 3122102 - DNA, 22 bp, Homo sapiens
atttttagatggttacactgtt

SEQ ID NO: 3122103 - DNA, 23 bp, Homo sapiens
atttttagatggttacactgtta

SEQ ID NO: 3122104 - DNA, 23 bp, Homo sapiens
atttttagccataattttgcata

SEQ ID NO: 3122105 - DNA, 19 bp, Homo sapiens
atttttatatcatgcaaaa

SEQ ID NO: 3122106 - DNA, 22 bp, Homo sapiens
atttttatatcatgcaaaatat

SEQ ID NO: 3122107 - DNA, 15 bp, Homo sapiens
atttttatatttagt

SEQ ID NO: 3122108 - DNA, 14 bp, Homo sapiens
atttttatcatgaa

SEQ ID NO: 3122109 - DNA, 17 bp, Homo sapiens
atttttatcatgaattc

SEQ ID NO: 3122110 - DNA, 16 bp, Homo sapiens
atttttattaaattat

SEQ ID NO: 3122111 - DNA, 16 bp, Homo sapiens
atttttatttcttttt

SEQ ID NO: 3122112 - DNA, 16 bp, Homo sapiens
atttttcaataaagca

SEQ ID NO: 3122113 - DNA, 17 bp, Homo sapiens
atttttcaataataaaa

SEQ ID NO: 3122114 - DNA, 18 bp, Homo sapiens
atttttcatattgtgcca

SEQ ID NO: 3122115 - DNA, 10 bp, Homo sapiens
atttttccta

SEQ ID NO: 3122116 - DNA, 19 bp, Homo sapiens
atttttcctctgttcacaa

SEQ ID NO: 3122117 - DNA, 20 bp, Homo sapiens
atttttctaaagaaattaca

SEQ ID NO: 3122118 - DNA, 13 bp, Homo sapiens
atttttctataaa

SEQ ID NO: 3122119 - DNA, 17 bp, Homo sapiens
atttttctataaatcag

SEQ ID NO: 3122120 - DNA, 13 bp, Homo sapiens
atttttctcttca

SEQ ID NO: 3122121 - DNA, 14 bp, Homo sapiens
atttttctcttcat

SEQ ID NO: 3122122 - DNA, 20 bp, Homo sapiens
atttttcttgttgcatcttt

SEQ ID NO: 3122123 - DNA, 16 bp, Homo sapiens
atttttctttaactgc

SEQ ID NO: 3122124 - DNA, 14 bp, Homo sapiens
atttttgaaaaggc

SEQ ID NO: 3122125 - DNA, 23 bp, Homo sapiens
atttttgatttatgcatggaaac

SEQ ID NO: 3122126 - DNA, 20 bp, Homo sapiens
atttttgcttttagaaaagg

SEQ ID NO: 3122127 - DNA, 19 bp, Homo sapiens
atttttggggaaaaaagca

SEQ ID NO: 3122128 - DNA, 19 bp, Homo sapiens
atttttgtaaactggaatt

SEQ ID NO: 3122129 - DNA, 20 bp, Homo sapiens
atttttgtaatgtgaaaagt

SEQ ID NO: 3122130 - DNA, 12 bp, Homo sapiens
atttttgtacag

SEQ ID NO: 3122131 - DNA, 20 bp, Homo sapiens
atttttgtacagtttgctgt

SEQ ID NO: 3122132 - DNA, 13 bp, Homo sapiens
atttttgtacata

SEQ ID NO: 3122133 - DNA, 14 bp, Homo sapiens
atttttgtacttga

SEQ ID NO: 3122134 - DNA, 15 bp, Homo sapiens
atttttgtacttgat

SEQ ID NO: 3122135 - DNA, 21 bp, Homo sapiens
atttttgtacttgatttgatg

SEQ ID NO: 3122136 - DNA, 22 bp, Homo sapiens
atttttgtgtcatttattcaag

SEQ ID NO: 3122137 - DNA, 22 bp, Homo sapiens
atttttgtgtttgaaagtgaaa

SEQ ID NO: 3122138 - DNA, 16 bp, Homo sapiens
atttttgttactctct

SEQ ID NO: 3122139 - DNA, 16 bp, Homo sapiens
atttttgttagcaaag

SEQ ID NO: 3122140 - DNA, 13 bp, Homo sapiens
attttttaaaaca

SEQ ID NO: 3122141 - DNA, 14 bp, Homo sapiens
attttttaaaagaa

SEQ ID NO: 3122142 - DNA, 20 bp, Homo sapiens
attttttaaagttactttgt

SEQ ID NO: 3122143 - DNA, 13 bp, Homo sapiens
attttttaaattc

SEQ ID NO: 3122144 - DNA, 12 bp, Homo sapiens
attttttaagag

SEQ ID NO: 3122145 - DNA, 21 bp, Homo sapiens
attttttaagcttcagttgct

SEQ ID NO: 3122146 - DNA, 16 bp, Homo sapiens
attttttaagtattta

SEQ ID NO: 3122147 - DNA, 17 bp, Homo sapiens
attttttaagtatttat

SEQ ID NO: 3122148 - DNA, 24 bp, Homo sapiens
accacttcaggggatgggtgtgga

SEQ ID NO: 3122149 - DNA, 17 bp, Homo sapiens
accacttcattcttgaa

SEQ ID NO: 3122150 - DNA, 22 bp, Homo sapiens
accacttcctgctacaggaggg

SEQ ID NO: 3122151 - DNA, 22 bp, Homo sapiens
accactttccttttctattcct

SEQ ID NO: 3122152 - DNA, 14 bp, Homo sapiens
accagaagccaaag

SEQ ID NO: 3122153 - DNA, 19 bp, Homo sapiens
accagacaaaaaaatttaa

SEQ ID NO: 3122154 - DNA, 14 bp, Homo sapiens
accagacaccttga

SEQ ID NO: 3122155 - DNA, 17 bp, Homo sapiens
accagacaccttgacag

SEQ ID NO: 3122156 - DNA, 21 bp, Homo sapiens
accagactacttgggagcacc

SEQ ID NO: 3122157 - DNA, 23 bp, Homo sapiens
accagactacttgggagcaccgc

SEQ ID NO: 3122158 - DNA, 14 bp, Homo sapiens
accagactgcaggt

SEQ ID NO: 3122159 - DNA, 19 bp, Homo sapiens
accagagcaacctctcact

SEQ ID NO: 3122160 - DNA, 22 bp, Homo sapiens
accagagcagatgcagagagcc

SEQ ID NO: 3122161 - DNA, 12 bp, Homo sapiens
accagagccaga

SEQ ID NO: 3122162 - DNA, 17 bp, Homo sapiens
accagagcccaccttgg

SEQ ID NO: 3122163 - DNA, 22 bp, Homo sapiens
accagagcccaccttggctcaa

SEQ ID NO: 3122164 - DNA, 14 bp, Homo sapiens
accagagccccaca

SEQ ID NO: 3122165 - DNA, 20 bp, Homo sapiens
accagagccttcaagtgcca

SEQ ID NO: 3122166 - DNA, 11 bp, Homo sapiens
accagaggccg

SEQ ID NO: 3122167 - DNA, 22 bp, Homo sapiens
accagaggccgaaggtgcctca

SEQ ID NO: 3122168 - DNA, 16 bp, Homo sapiens
accagaggtgcttctg

SEQ ID NO: 3122169 - DNA, 16 bp, Homo sapiens
accagagtcagcacag

SEQ ID NO: 3122170 - DNA, 11 bp, Homo sapiens
accagatgcta

SEQ ID NO: 3122171 - DNA, 13 bp, Homo sapiens
accagcaggtgtg

SEQ ID NO: 3122172 - DNA, 18 bp, Homo sapiens
accagcaggtgtggtggc

SEQ ID NO: 3122173 - DNA, 22 bp, Homo sapiens
accagcaggtgtggtggctcat

SEQ ID NO: 3122174 - DNA, 19 bp, Homo sapiens
accagcccatggccctgtg

SEQ ID NO: 3122175 - DNA, 16 bp, Homo sapiens
accagccccactgcca

SEQ ID NO: 3122176 - DNA, 17 bp, Homo sapiens
accagccccactgccag

SEQ ID NO: 3122177 - DNA, 20 bp, Homo sapiens
accagccccactgccagcag

SEQ ID NO: 3122178 - DNA, 13 bp, Homo sapiens
accagcccccagg

SEQ ID NO: 3122179 - DNA, 22 bp, Homo sapiens
accagcccccaggaagacatta

SEQ ID NO: 3122180 - DNA, 15 bp, Homo sapiens
accagcccctgcccc

SEQ ID NO: 3122181 - DNA, 17 bp, Homo sapiens
accagccccttcctggg

SEQ ID NO: 3122182 - DNA, 18 bp, Homo sapiens
accagcccgacagtgcca

SEQ ID NO: 3122183 - DNA, 22 bp, Homo sapiens
accagcccgacagtgccatccc

SEQ ID NO: 3122184 - DNA, 15 bp, Homo sapiens
accagcccggcctgc

SEQ ID NO: 3122185 - DNA, 16 bp, Homo sapiens
accagcccggcctgct

SEQ ID NO: 3122186 - DNA, 11 bp, Homo sapiens
accagccctgg

SEQ ID NO: 3122187 - DNA, 15 bp, Homo sapiens
accagccctggggct

SEQ ID NO: 3122188 - DNA, 20 bp, Homo sapiens
accagccctggggctgggcc

SEQ ID NO: 3122189 - DNA, 22 bp, Homo sapiens
accagcccttgagggagaactt

SEQ ID NO: 3122190 - DNA, 15 bp, Homo sapiens
accagccgctgcagg

SEQ ID NO: 3122191 - DNA, 14 bp, Homo sapiens
accagcctccatgc

SEQ ID NO: 3122192 - DNA, 21 bp, Homo sapiens
accagcctccatgctgcctcc

SEQ ID NO: 3122193 - DNA, 20 bp, Homo sapiens
accagcctggtgcccatcct

SEQ ID NO: 3122194 - DNA, 22 bp, Homo sapiens
accagccttcctgtgggcccct

SEQ ID NO: 3122195 - DNA, 15 bp, Homo sapiens
accagccttcggagc

SEQ ID NO: 3122196 - DNA, 20 bp, Homo sapiens
accagcgccaaatgttcatc

SEQ ID NO: 3122197 - DNA, 23 bp, Homo sapiens
accagctatctgtcatctctctg

SEQ ID NO: 3122198 - DNA, 12 bp, Homo sapiens
accagctctgtg

SEQ ID NO: 3122199 - DNA, 14 bp, Homo sapiens
accagctctgtggc

SEQ ID NO: 3122200 - DNA, 18 bp, Homo sapiens
accagctctgtggcctgt

SEQ ID NO: 3122201 - DNA, 18 bp, Homo sapiens
accagctgcgcttgcttt

SEQ ID NO: 3122202 - DNA, 20 bp, Homo sapiens
accagctgcgcttgcttttc

SEQ ID NO: 3122203 - DNA, 16 bp, Homo sapiens
accagctgctctgccc

SEQ ID NO: 3122204 - DNA, 18 bp, Homo sapiens
accagctgctctgcccct

SEQ ID NO: 3122205 - DNA, 19 bp, Homo sapiens
accagctgctctgcccctt

SEQ ID NO: 3122206 - DNA, 20 bp, Homo sapiens
accagctggggcgtggggag

SEQ ID NO: 3122207 - DNA, 24 bp, Homo sapiens
accagcttaagcgttcatatgctc

SEQ ID NO: 3122208 - DNA, 16 bp, Homo sapiens
accagcttagatttta

SEQ ID NO: 3122209 - DNA, 18 bp, Homo sapiens
accagcttgttctgggct

SEQ ID NO: 3122210 - DNA, 12 bp, Homo sapiens
accaggaccctg

SEQ ID NO: 3122211 - DNA, 17 bp, Homo sapiens
accaggactccctcctc

SEQ ID NO: 3122212 - DNA, 18 bp, Homo sapiens
accaggactccctcctca

SEQ ID NO: 3122213 - DNA, 21 bp, Homo sapiens
accaggactccctcctcacct

SEQ ID NO: 3122214 - DNA, 14 bp, Homo sapiens
accaggatttctaa

SEQ ID NO: 3122215 - DNA, 13 bp, Homo sapiens
accaggatttttt

SEQ ID NO: 3122216 - DNA, 14 bp, Homo sapiens
accaggcccagcca

SEQ ID NO: 3122217 - DNA, 15 bp, Homo sapiens
accaggcccagccag

SEQ ID NO: 3122218 - DNA, 16 bp, Homo sapiens
accagggaggagagga

SEQ ID NO: 3122219 - DNA, 18 bp, Homo sapiens
accagggatgctgggctg

SEQ ID NO: 3122220 - DNA, 19 bp, Homo sapiens
accagggatgctgggctgg

SEQ ID NO: 3122221 - DNA, 20 bp, Homo sapiens
accagggatgctgggctggg

SEQ ID NO: 3122222 - DNA, 22 bp, Homo sapiens
accagggatgctgggctgggcc

SEQ ID NO: 3122223 - DNA, 22 bp, Homo sapiens
accagggcgaacgacaatagct

SEQ ID NO: 3122224 - DNA, 23 bp, Homo sapiens
accagggcgaacgacaatagctt

SEQ ID NO: 3122225 - DNA, 17 bp, Homo sapiens
accaggggaggagcctg

SEQ ID NO: 3122226 - DNA, 21 bp, Homo sapiens
accaggggtgctcacctctgc

SEQ ID NO: 3122227 - DNA, 20 bp, Homo sapiens
accagggtccgcaccagctg

SEQ ID NO: 3122228 - DNA, 14 bp, Homo sapiens
accaggttgaaaga

SEQ ID NO: 3122229 - DNA, 14 bp, Homo sapiens
accagtatttagaa

SEQ ID NO: 3122230 - DNA, 19 bp, Homo sapiens
accagtatttagaagccaa

SEQ ID NO: 3122231 - DNA, 14 bp, Homo sapiens
accagtcacatgac

SEQ ID NO: 3122232 - DNA, 20 bp, Homo sapiens
accagtctcctcactctgtc

SEQ ID NO: 3122233 - DNA, 12 bp, Homo sapiens
accagtctgtct

SEQ ID NO: 3122234 - DNA, 19 bp, Homo sapiens
accagtctgtctactgtgg

SEQ ID NO: 3122235 - DNA, 13 bp, Homo sapiens
accagtctgtgtt

SEQ ID NO: 3122236 - DNA, 19 bp, Homo sapiens
accagtctgtgtttacaga

SEQ ID NO: 3122237 - DNA, 22 bp, Homo sapiens
accagtctttaaaggcccagcc

SEQ ID NO: 3122238 - DNA, 18 bp, Homo sapiens
accagtgcaacagcactg

SEQ ID NO: 3122239 - DNA, 16 bp, Homo sapiens
accagtgccaaggacc

SEQ ID NO: 3122240 - DNA, 16 bp, Homo sapiens
accagtgtagccttgc

SEQ ID NO: 3122241 - DNA, 21 bp, Homo sapiens
accagtgtagccttgcccgga

SEQ ID NO: 3122242 - DNA, 18 bp, Homo sapiens
accagtgtatcaggtcag

SEQ ID NO: 3122243 - DNA, 22 bp, Homo sapiens
accagtgtatcaggtcagggac

SEQ ID NO: 3122244 - DNA, 13 bp, Homo sapiens
accagtgtcccct

SEQ ID NO: 3122245 - DNA, 18 bp, Homo sapiens
accagtgtcccctccact

SEQ ID NO: 3122246 - DNA, 20 bp, Homo sapiens
accagtgtcccctccactgt

SEQ ID NO: 3122247 - DNA, 21 bp, Homo sapiens
accagtgtggtttgtgtttga

SEQ ID NO: 3122248 - DNA, 14 bp, Homo sapiens
accagttaaaagca

SEQ ID NO: 3122249 - DNA, 14 bp, Homo sapiens
accagttaattact

SEQ ID NO: 3122250 - DNA, 22 bp, Homo sapiens
accagttgccctagcccagact

SEQ ID NO: 3122251 - DNA, 14 bp, Homo sapiens
accagttgcctttt

SEQ ID NO: 3122252 - DNA, 16 bp, Homo sapiens
accagttgccttttat

SEQ ID NO: 3122253 - DNA, 15 bp, Homo sapiens
accagttgggagcac

SEQ ID NO: 3122254 - DNA, 17 bp, Homo sapiens
accagtttgactgtgct

SEQ ID NO: 3122255 - DNA, 18 bp, Homo sapiens
accagtttgtccatcttg

SEQ ID NO: 3122256 - DNA, 14 bp, Homo sapiens
accataaattcaac

SEQ ID NO: 3122257 - DNA, 22 bp, Homo sapiens
accataaattcaactttgtaaa

SEQ ID NO: 3122258 - DNA, 22 bp, Homo sapiens
accataaggtttcgtttctgta

SEQ ID NO: 3122259 - DNA, 15 bp, Homo sapiens
accataatcttagag

SEQ ID NO: 3122260 - DNA, 13 bp, Homo sapiens
accataatgttac

SEQ ID NO: 3122261 - DNA, 18 bp, Homo sapiens
accataattttttttaaa

SEQ ID NO: 3122262 - DNA, 17 bp, Homo sapiens
accatactcatttctaa

SEQ ID NO: 3122263 - DNA, 20 bp, Homo sapiens
accatagtaccatttataca

SEQ ID NO: 3122264 - DNA, 21 bp, Homo sapiens
accatagtaccatttatacaa

SEQ ID NO: 3122265 - DNA, 13 bp, Homo sapiens
acagttttaactg

SEQ ID NO: 3122266 - DNA, 13 bp, Homo sapiens
acagttttatgct

SEQ ID NO: 3122267 - DNA, 16 bp, Homo sapiens
acagttttccatgaaa

SEQ ID NO: 3122268 - DNA, 21 bp, Homo sapiens
acagttttccatgaaaacgtt

SEQ ID NO: 3122269 - DNA, 16 bp, Homo sapiens
acagttttctagcaat

SEQ ID NO: 3122270 - DNA, 15 bp, Homo sapiens
acagttttgaaagaa

SEQ ID NO: 3122271 - DNA, 21 bp, Homo sapiens
acataaaaagcagaattttaa

SEQ ID NO: 3122272 - DNA, 18 bp, Homo sapiens
acataaatagtagaaaaa

SEQ ID NO: 3122273 - DNA, 15 bp, Homo sapiens
acataacgtttttcc

SEQ ID NO: 3122274 - DNA, 12 bp, Homo sapiens
acataactgaaa

SEQ ID NO: 3122275 - DNA, 14 bp, Homo sapiens
acataagaaatgta

SEQ ID NO: 3122276 - DNA, 19 bp, Homo sapiens
acataagaccgtgtcccaa

SEQ ID NO: 3122277 - DNA, 18 bp, Homo sapiens
acataagcttccatttta

SEQ ID NO: 3122278 - DNA, 19 bp, Homo sapiens
acataagtttaggataaaa

SEQ ID NO: 3122279 - DNA, 18 bp, Homo sapiens
acataataaatcacacat

SEQ ID NO: 3122280 - DNA, 20 bp, Homo sapiens
acataatgtttttcctttct

SEQ ID NO: 3122281 - DNA, 22 bp, Homo sapiens
acataatgtttttcctttctta

SEQ ID NO: 3122282 - DNA, 19 bp, Homo sapiens
acataattaaattttgagt

SEQ ID NO: 3122283 - DNA, 15 bp, Homo sapiens
acataattgtggatt

SEQ ID NO: 3122284 - DNA, 12 bp, Homo sapiens
acataatttttt

SEQ ID NO: 3122285 - DNA, 18 bp, Homo sapiens
acataattttttattcaa

SEQ ID NO: 3122286 - DNA, 16 bp, Homo sapiens
acatacaattccaaac

SEQ ID NO: 3122287 - DNA, 16 bp, Homo sapiens
acatacacttgtataa

SEQ ID NO: 3122288 - DNA, 21 bp, Homo sapiens
acatacacttgtataaatgta

SEQ ID NO: 3122289 - DNA, 23 bp, Homo sapiens
acatacagagtgggccccgggct

SEQ ID NO: 3122290 - DNA, 14 bp, Homo sapiens
acatacagatttta

SEQ ID NO: 3122291 - DNA, 15 bp, Homo sapiens
acatacagttttatg

SEQ ID NO: 3122292 - DNA, 20 bp, Homo sapiens
acatacagttttatgctctt

SEQ ID NO: 3122293 - DNA, 15 bp, Homo sapiens
acatacattaaaact

SEQ ID NO: 3122294 - DNA, 14 bp, Homo sapiens
acataccctccccc

SEQ ID NO: 3122295 - DNA, 13 bp, Homo sapiens
acatacctctctg

SEQ ID NO: 3122296 - DNA, 22 bp, Homo sapiens
acatacggtcaggtttaacatt

SEQ ID NO: 3122297 - DNA, 20 bp, Homo sapiens
acatactctctgcctggtgg

SEQ ID NO: 3122298 - DNA, 18 bp, Homo sapiens
acatactggcctggactg

SEQ ID NO: 3122299 - DNA, 19 bp, Homo sapiens
acatactggcctggactgt

SEQ ID NO: 3122300 - DNA, 20 bp, Homo sapiens
acatacttcaaaaataatgt

SEQ ID NO: 3122301 - DNA, 22 bp, Homo sapiens
acatacttcaaaaataatgtgc

SEQ ID NO: 3122302 - DNA, 14 bp, Homo sapiens
acatacttttgcaa

SEQ ID NO: 3122303 - DNA, 20 bp, Homo sapiens
acatagaaatggaaattttg

SEQ ID NO: 3122304 - DNA, 22 bp, Homo sapiens
acatagaaatggaaattttgct

SEQ ID NO: 3122305 - DNA, 14 bp, Homo sapiens
acatagaggtatat

SEQ ID NO: 3122306 - DNA, 18 bp, Homo sapiens
acatagaggtatattgga

SEQ ID NO: 3122307 - DNA, 15 bp, Homo sapiens
acatagatattttca

SEQ ID NO: 3122308 - DNA, 18 bp, Homo sapiens
acatagattaatggcact

SEQ ID NO: 3122309 - DNA, 20 bp, Homo sapiens
acatagcaggggcaccttcc

SEQ ID NO: 3122310 - DNA, 20 bp, Homo sapiens
acatagcatccaagtggcat

SEQ ID NO: 3122311 - DNA, 14 bp, Homo sapiens
acatagcccatccc

SEQ ID NO: 3122312 - DNA, 12 bp, Homo sapiens
acatagcccctg

SEQ ID NO: 3122313 - DNA, 15 bp, Homo sapiens
acatagcccctgccc

SEQ ID NO: 3122314 - DNA, 16 bp, Homo sapiens
acatagcctatattta

SEQ ID NO: 3122315 - DNA, 19 bp, Homo sapiens
acatagcctatatttacag

SEQ ID NO: 3122316 - DNA, 20 bp, Homo sapiens
acatagcctatatttacagt

SEQ ID NO: 3122317 - DNA, 22 bp, Homo sapiens
acatagcgccgtgctgtaaata

SEQ ID NO: 3122318 - DNA, 17 bp, Homo sapiens
acataggcaaattggaa

SEQ ID NO: 3122319 - DNA, 18 bp, Homo sapiens
acataggcaaattggaaa

SEQ ID NO: 3122320 - DNA, 17 bp, Homo sapiens
acatagttctccagttg

SEQ ID NO: 3122321 - DNA, 20 bp, Homo sapiens
acatagttttaaactcattt

SEQ ID NO: 3122322 - DNA, 16 bp, Homo sapiens
acatatacctataatg

SEQ ID NO: 3122323 - DNA, 22 bp, Homo sapiens
acatatacctataatgtgtgta

SEQ ID NO: 3122324 - DNA, 15 bp, Homo sapiens
acatatcaaaatagg

SEQ ID NO: 3122325 - DNA, 22 bp, Homo sapiens
acatatcagcaggagtaataaa

SEQ ID NO: 3122326 - DNA, 13 bp, Homo sapiens
acatatcattttt

SEQ ID NO: 3122327 - DNA, 17 bp, Homo sapiens
acatatcgctgacttca

SEQ ID NO: 3122328 - DNA, 18 bp, Homo sapiens
acatatctttattaatca

SEQ ID NO: 3122329 - DNA, 15 bp, Homo sapiens
acatatgatttcact

SEQ ID NO: 3122330 - DNA, 20 bp, Homo sapiens
acatatgcaccttgtgtctg

SEQ ID NO: 3122331 - DNA, 20 bp, Homo sapiens
acatatgtagactatataca

SEQ ID NO: 3122332 - DNA, 23 bp, Homo sapiens
acatatgtagactatatacatgt

SEQ ID NO: 3122333 - DNA, 17 bp, Homo sapiens
acatattatgcctgaat

SEQ ID NO: 3122334 - DNA, 20 bp, Homo sapiens
acatattgcaggagacattt

SEQ ID NO: 3122335 - DNA, 23 bp, Homo sapiens
acatattgcaggagacattttca

SEQ ID NO: 3122336 - DNA, 13 bp, Homo sapiens
acatatttcattt

SEQ ID NO: 3122337 - DNA, 16 bp, Homo sapiens
acatatttgaatgact

SEQ ID NO: 3122338 - DNA, 15 bp, Homo sapiens
acatatttgtggaat

SEQ ID NO: 3122339 - DNA, 17 bp, Homo sapiens
acatatttgtggaataa

SEQ ID NO: 3122340 - DNA, 17 bp, Homo sapiens
acatattttcctttaga

SEQ ID NO: 3122341 - DNA, 17 bp, Homo sapiens
acatcaaacctttgagt

SEQ ID NO: 3122342 - DNA, 14 bp, Homo sapiens
acatcaaataaatt

SEQ ID NO: 3122343 - DNA, 23 bp, Homo sapiens
acatcaaataaatttctgggata

SEQ ID NO: 3122344 - DNA, 14 bp, Homo sapiens
acatcaatgttcat

SEQ ID NO: 3122345 - DNA, 17 bp, Homo sapiens
acatcaatgttcattgt

SEQ ID NO: 3122346 - DNA, 18 bp, Homo sapiens
acatcaatgttcattgta

SEQ ID NO: 3122347 - DNA, 14 bp, Homo sapiens
acatcacaagacta

SEQ ID NO: 3122348 - DNA, 13 bp, Homo sapiens
acatcacagcagc

SEQ ID NO: 3122349 - DNA, 14 bp, Homo sapiens
acatcacagcagcc

SEQ ID NO: 3122350 - DNA, 13 bp, Homo sapiens
acatcaccagtcc

SEQ ID NO: 3122351 - DNA, 21 bp, Homo sapiens
acatcactgcttgatgaagca

SEQ ID NO: 3122352 - DNA, 12 bp, Homo sapiens
acatcagataag

SEQ ID NO: 3122353 - DNA, 14 bp, Homo sapiens
acatcaggagttca

SEQ ID NO: 3122354 - DNA, 11 bp, Homo sapiens
acatcagttcc

SEQ ID NO: 3122355 - DNA, 16 bp, Homo sapiens
acatcataattacatt

SEQ ID NO: 3122356 - DNA, 17 bp, Homo sapiens
acatcataattacattc

SEQ ID NO: 3122357 - DNA, 20 bp, Homo sapiens
acatcataattacattccta

SEQ ID NO: 3122358 - DNA, 13 bp, Homo sapiens
acatccaaatcta

SEQ ID NO: 3122359 - DNA, 18 bp, Homo sapiens
acatccaactccagcaac

SEQ ID NO: 3122360 - DNA, 23 bp, Homo sapiens
acatccaaggagaaacagagaca

SEQ ID NO: 3122361 - DNA, 23 bp, Homo sapiens
cttttattattattattgctgaa

SEQ ID NO: 3122362 - DNA, 16 bp, Homo sapiens
cttttattgtataaac

SEQ ID NO: 3122363 - DNA, 19 bp, Homo sapiens
cttttattgtataaactat

SEQ ID NO: 3122364 - DNA, 15 bp, Homo sapiens
cttttatttcctgta

SEQ ID NO: 3122365 - DNA, 18 bp, Homo sapiens
cttttatttctccatctt

SEQ ID NO: 3122366 - DNA, 19 bp, Homo sapiens
cttttatttgcaacattta

SEQ ID NO: 3122367 - DNA, 18 bp, Homo sapiens
cttttattttaatattga

SEQ ID NO: 3122368 - DNA, 23 bp, Homo sapiens
cttttattttaatattgatgtca

SEQ ID NO: 3122369 - DNA, 13 bp, Homo sapiens
cttttattttgaa

SEQ ID NO: 3122370 - DNA, 15 bp, Homo sapiens
cttttattttttctt

SEQ ID NO: 3122371 - DNA, 19 bp, Homo sapiens
cttttattttttcttttgt

SEQ ID NO: 3122372 - DNA, 16 bp, Homo sapiens
cttttcactgctggct

SEQ ID NO: 3122373 - DNA, 15 bp, Homo sapiens
cttttcagctgagcc

SEQ ID NO: 3122374 - DNA, 17 bp, Homo sapiens
cttttcagctgagccct

SEQ ID NO: 3122375 - DNA, 20 bp, Homo sapiens
cttttcataaagggttgaaa

SEQ ID NO: 3122376 - DNA, 20 bp, Homo sapiens
cttttcataacctagcctta

SEQ ID NO: 3122377 - DNA, 22 bp, Homo sapiens
cttttcataacctagccttaga

SEQ ID NO: 3122378 - DNA, 15 bp, Homo sapiens
cttttcatggaagtg

SEQ ID NO: 3122379 - DNA, 19 bp, Homo sapiens
cttttcattgtgtatcagt

SEQ ID NO: 3122380 - DNA, 14 bp, Homo sapiens
cttttccattgtca

SEQ ID NO: 3122381 - DNA, 14 bp, Homo sapiens
cttttccccgcctg

SEQ ID NO: 3122382 - DNA, 18 bp, Homo sapiens
cttttccccgcctgcagt

SEQ ID NO: 3122383 - DNA, 19 bp, Homo sapiens
cttttccccgcctgcagtc

SEQ ID NO: 3122384 - DNA, 16 bp, Homo sapiens
cttttcccctacagaa

SEQ ID NO: 3122385 - DNA, 19 bp, Homo sapiens
cttttcccctacagaattt

SEQ ID NO: 3122386 - DNA, 20 bp, Homo sapiens
cttttccctctttggctccc

SEQ ID NO: 3122387 - DNA, 22 bp, Homo sapiens
cttttccctctttggctcccct

SEQ ID NO: 3122388 - DNA, 15 bp, Homo sapiens
cttttccctgcttcc

SEQ ID NO: 3122389 - DNA, 14 bp, Homo sapiens
cttttcccttcttt

SEQ ID NO: 3122390 - DNA, 17 bp, Homo sapiens
cttttccgttctgttct

SEQ ID NO: 3122391 - DNA, 18 bp, Homo sapiens
cttttccgttctgttctg

SEQ ID NO: 3122392 - DNA, 22 bp, Homo sapiens
cttttccgttctgttctgctgg

SEQ ID NO: 3122393 - DNA, 20 bp, Homo sapiens
cttttcctcaagcaataatt

SEQ ID NO: 3122394 - DNA, 21 bp, Homo sapiens
cttttcctggacttaaagaaa

SEQ ID NO: 3122395 - DNA, 14 bp, Homo sapiens
cttttcctgtcagt

SEQ ID NO: 3122396 - DNA, 15 bp, Homo sapiens
cttttccttcattca

SEQ ID NO: 3122397 - DNA, 19 bp, Homo sapiens
cttttccttcattcatagg

SEQ ID NO: 3122398 - DNA, 11 bp, Homo sapiens
cttttcgttaa

SEQ ID NO: 3122399 - DNA, 15 bp, Homo sapiens
cttttcgttaacatt

SEQ ID NO: 3122400 - DNA, 16 bp, Homo sapiens
cttttcgttaacattg

SEQ ID NO: 3122401 - DNA, 13 bp, Homo sapiens
cttttctaagaaa

SEQ ID NO: 3122402 - DNA, 17 bp, Homo sapiens
cttttctcagtgttggt

SEQ ID NO: 3122403 - DNA, 17 bp, Homo sapiens
cttttctcctcactgta

SEQ ID NO: 3122404 - DNA, 17 bp, Homo sapiens
cttttctctggtaatat

SEQ ID NO: 3122405 - DNA, 13 bp, Homo sapiens
cttttctctttct

SEQ ID NO: 3122406 - DNA, 19 bp, Homo sapiens
cttttctcttttgctttct

SEQ ID NO: 3122407 - DNA, 16 bp, Homo sapiens
cttttctctttttagt

SEQ ID NO: 3122408 - DNA, 17 bp, Homo sapiens
cttttctgattaatata

SEQ ID NO: 3122409 - DNA, 20 bp, Homo sapiens
cttttctgattaatatattt

SEQ ID NO: 3122410 - DNA, 15 bp, Homo sapiens
cttttctgccctggc

SEQ ID NO: 3122411 - DNA, 19 bp, Homo sapiens
cttttctgccctggctgct

SEQ ID NO: 3122412 - DNA, 16 bp, Homo sapiens
cttttctggggcccag

SEQ ID NO: 3122413 - DNA, 19 bp, Homo sapiens
cttttctggggcccaggaa

SEQ ID NO: 3122414 - DNA, 13 bp, Homo sapiens
cttttctgtactt

SEQ ID NO: 3122415 - DNA, 15 bp, Homo sapiens
cttttcttaaacctt

SEQ ID NO: 3122416 - DNA, 12 bp, Homo sapiens
cttttcttggca

SEQ ID NO: 3122417 - DNA, 21 bp, Homo sapiens
cttttcttggcaaaagccttg

SEQ ID NO: 3122418 - DNA, 23 bp, Homo sapiens
cttttcttggcaaaagccttgtg

SEQ ID NO: 3122419 - DNA, 14 bp, Homo sapiens
cttttctttaaaga

SEQ ID NO: 3122420 - DNA, 12 bp, Homo sapiens
cttttctttcaa

SEQ ID NO: 3122421 - DNA, 17 bp, Homo sapiens
cttttgaaaactgctga

SEQ ID NO: 3122422 - DNA, 22 bp, Homo sapiens
cttttgaactgttagatgctga

SEQ ID NO: 3122423 - DNA, 21 bp, Homo sapiens
cttttgaagggagaagacact

SEQ ID NO: 3122424 - DNA, 18 bp, Homo sapiens
cttttgacactgctctaa

SEQ ID NO: 3122425 - DNA, 14 bp, Homo sapiens
cttttgacatgtgg

SEQ ID NO: 3122426 - DNA, 14 bp, Homo sapiens
cttttgagcctcag

SEQ ID NO: 3122427 - DNA, 15 bp, Homo sapiens
cttttgagcctcaga

SEQ ID NO: 3122428 - DNA, 12 bp, Homo sapiens
cttttgaggctt

SEQ ID NO: 3122429 - DNA, 17 bp, Homo sapiens
cttttgaggtccctgta

SEQ ID NO: 3122430 - DNA, 22 bp, Homo sapiens
cttttgcaaaataagtaaataa

SEQ ID NO: 3122431 - DNA, 15 bp, Homo sapiens
cttttgcacccctcc

SEQ ID NO: 3122432 - DNA, 20 bp, Homo sapiens
cttttgcacccctcccatta

SEQ ID NO: 3122433 - DNA, 18 bp, Homo sapiens
cttttgcagaagagggtg

SEQ ID NO: 3122434 - DNA, 17 bp, Homo sapiens
cttttgcataatgcaat

SEQ ID NO: 3122435 - DNA, 19 bp, Homo sapiens
cttttgcataatgcaatca

SEQ ID NO: 3122436 - DNA, 13 bp, Homo sapiens
cttttgccactcc

SEQ ID NO: 3122437 - DNA, 17 bp, Homo sapiens
cttttgccattaaactt

SEQ ID NO: 3122438 - DNA, 15 bp, Homo sapiens
cttttgcctggctgt

SEQ ID NO: 3122439 - DNA, 24 bp, Homo sapiens
cttttgctgcgcaccaatgcccag

SEQ ID NO: 3122440 - DNA, 20 bp, Homo sapiens
cttttgcttgccaaagtaca

SEQ ID NO: 3122441 - DNA, 16 bp, Homo sapiens
cttttggaacatttct

SEQ ID NO: 3122442 - DNA, 14 bp, Homo sapiens
cttttggcttccat

SEQ ID NO: 3122443 - DNA, 15 bp, Homo sapiens
cttttgtaaagaaat

SEQ ID NO: 3122444 - DNA, 22 bp, Homo sapiens
cttttgtaattgtgtaaaaaat

SEQ ID NO: 3122445 - DNA, 17 bp, Homo sapiens
cttttgtacatctggct

SEQ ID NO: 3122446 - DNA, 17 bp, Homo sapiens
cttttgtctatgggact

SEQ ID NO: 3122447 - DNA, 13 bp, Homo sapiens
cttttgtgaatta

SEQ ID NO: 3122448 - DNA, 17 bp, Homo sapiens
cttttgtgtaatgaaaa

SEQ ID NO: 3122449 - DNA, 23 bp, Homo sapiens
cttttgtgtacagtgtgtaaagt

SEQ ID NO: 3122450 - DNA, 23 bp, Homo sapiens
cttttgtgtgcctggtagaaact

SEQ ID NO: 3122451 - DNA, 15 bp, Homo sapiens
cttttgttactgttc

SEQ ID NO: 3122452 - DNA, 18 bp, Homo sapiens
cttttgttactgttcttg

SEQ ID NO: 3122453 - DNA, 19 bp, Homo sapiens
cttttgttactgttcttgc

SEQ ID NO: 3122454 - DNA, 23 bp, Homo sapiens
cttttgttactgttcttgctgct

SEQ ID NO: 3122455 - DNA, 22 bp, Homo sapiens
cttttgttctgctttatctttt

SEQ ID NO: 3122456 - DNA, 19 bp, Homo sapiens
cttttgttgtatgggattg

SEQ ID NO: 3122457 - DNA, 14 bp, Homo sapiens
cttttgttgtgact

SEQ ID NO: 3122458 - DNA, 22 bp, Homo sapiens
cttttgtttcccttgctttgtt

SEQ ID NO: 3122459 - DNA, 18 bp, Homo sapiens
ctttttaaaaactcttca

SEQ ID NO: 3122460 - DNA, 23 bp, Homo sapiens
ctttttaaagtgtttctgttatt

SEQ ID NO: 3122461 - DNA, 21 bp, Homo sapiens
ctttttaaccctaatctttca

SEQ ID NO: 3122462 - DNA, 22 bp, Homo sapiens
ctttttaagaattctgtacttc

SEQ ID NO: 3122463 - DNA, 19 bp, Homo sapiens
ctttttaagtaatgtggaa

SEQ ID NO: 3122464 - DNA, 21 bp, Homo sapiens
ctttttaatcatgaatatgat

SEQ ID NO: 3122465 - DNA, 14 bp, Homo sapiens
ctttttacagcatt

SEQ ID NO: 3122466 - DNA, 15 bp, Homo sapiens
ctttttacctttcat

SEQ ID NO: 3122467 - DNA, 17 bp, Homo sapiens
ctttttacctttcatac

SEQ ID NO: 3122468 - DNA, 12 bp, Homo sapiens
ctttttagttta

SEQ ID NO: 3122469 - DNA, 21 bp, Homo sapiens
ctttttagtttacccggtttc

SEQ ID NO: 3122470 - DNA, 13 bp, Homo sapiens
ctttttataaaaa

SEQ ID NO: 3122471 - DNA, 14 bp, Homo sapiens
ctttttataaaaag

SEQ ID NO: 3122472 - DNA, 15 bp, Homo sapiens
ctttttattccctgc

SEQ ID NO: 3122473 - DNA, 18 bp, Homo sapiens
ctttttattccctgccca

SEQ ID NO: 3122474 - DNA, 13 bp, Homo sapiens
ctttttatttctg

SEQ ID NO: 3122475 - DNA, 16 bp, Homo sapiens
ctttttatttctgcat

SEQ ID NO: 3122476 - DNA, 12 bp, Homo sapiens
ctttttcattta

SEQ ID NO: 3122477 - DNA, 13 bp, Homo sapiens
ctttttcatttat

SEQ ID NO: 3122478 - DNA, 18 bp, Homo sapiens
ctttttcatttgcctatt

SEQ ID NO: 3122479 - DNA, 12 bp, Homo sapiens
ctttttccatca

SEQ ID NO: 3122480 - DNA, 21 bp, Homo sapiens
ctttttccatcattttacagt

SEQ ID NO: 3122481 - DNA, 17 bp, Homo sapiens
ctttttcccaataaatt

SEQ ID NO: 3122482 - DNA, 19 bp, Homo sapiens
ctttttcgtataatcttgt

SEQ ID NO: 3122483 - DNA, 21 bp, Homo sapiens
ctttttctccagctgggctct

SEQ ID NO: 3122484 - DNA, 19 bp, Homo sapiens
gaaaataactgaaccaaat

SEQ ID NO: 3122485 - DNA, 20 bp, Homo sapiens
gaaaataactgaaccaaatt

SEQ ID NO: 3122486 - DNA, 19 bp, Homo sapiens
gaaaataagtgaataataa

SEQ ID NO: 3122487 - DNA, 19 bp, Homo sapiens
gaaaatacaacttaaataa

SEQ ID NO: 3122488 - DNA, 16 bp, Homo sapiens
gaaaatacaataaact

SEQ ID NO: 3122489 - DNA, 21 bp, Homo sapiens
gaaaatacctattttatatga

SEQ ID NO: 3122490 - DNA, 17 bp, Homo sapiens
gaaaatacgctcaggtg

SEQ ID NO: 3122491 - DNA, 20 bp, Homo sapiens
gaaaatagaatgtggccact

SEQ ID NO: 3122492 - DNA, 17 bp, Homo sapiens
gaaaataggcaggaagc

SEQ ID NO: 3122493 - DNA, 15 bp, Homo sapiens
ctgatggtcagctcc

SEQ ID NO: 3122494 - DNA, 20 bp, Homo sapiens
ctgatgtacaattaaaaacc

SEQ ID NO: 3122495 - DNA, 22 bp, Homo sapiens
ctgatgtcaatttctgtgttgc

SEQ ID NO: 3122496 - DNA, 19 bp, Homo sapiens
ctgatgtccctagaaaaca

SEQ ID NO: 3122497 - DNA, 18 bp, Homo sapiens
ctgatgtgtgttgtcagc

SEQ ID NO: 3122498 - DNA, 22 bp, Homo sapiens
ctgatgtgtgttgtcagcctgt

SEQ ID NO: 3122499 - DNA, 12 bp, Homo sapiens
ctgatgttgtgt

SEQ ID NO: 3122500 - DNA, 16 bp, Homo sapiens
ctgatgtttgaagagt

SEQ ID NO: 3122501 - DNA, 13 bp, Homo sapiens
ctgatgttttagc

SEQ ID NO: 3122502 - DNA, 21 bp, Homo sapiens
ctgattaaaatgcttcctccc

SEQ ID NO: 3122503 - DNA, 15 bp, Homo sapiens
ctgattaatatattt

SEQ ID NO: 3122504 - DNA, 14 bp, Homo sapiens
ctgattactgtcaa

SEQ ID NO: 3122505 - DNA, 16 bp, Homo sapiens
ctgattactgtcaata

SEQ ID NO: 3122506 - DNA, 17 bp, Homo sapiens
ctgattactgtcaataa

SEQ ID NO: 3122507 - DNA, 20 bp, Homo sapiens
ctgattactgtcaataaaca

SEQ ID NO: 3122508 - DNA, 23 bp, Homo sapiens
ctgattactgtcaataaacagct

SEQ ID NO: 3122509 - DNA, 11 bp, Homo sapiens
ctgattagaaa

SEQ ID NO: 3122510 - DNA, 13 bp, Homo sapiens
ctgattagaaatg

SEQ ID NO: 3122511 - DNA, 16 bp, Homo sapiens
gaaatcattgtagaaa

SEQ ID NO: 3122512 - DNA, 21 bp, Homo sapiens
gaaatccattgtttaaagatg

SEQ ID NO: 3122513 - DNA, 23 bp, Homo sapiens
gaaatccctgtttaatatttaaa

SEQ ID NO: 3122514 - DNA, 23 bp, Homo sapiens
gaaatcctagtttcctctccttc

SEQ ID NO: 3122515 - DNA, 14 bp, Homo sapiens
gaaatcctgccctg

SEQ ID NO: 3122516 - DNA, 16 bp, Homo sapiens
gaaatcgttggaaaat

SEQ ID NO: 3122517 - DNA, 17 bp, Homo sapiens
gaaatctaaatttcttt

SEQ ID NO: 3122518 - DNA, 22 bp, Homo sapiens
gaaatctaaatttcttttgcta

SEQ ID NO: 3122519 - DNA, 15 bp, Homo sapiens
gaaatctagtatttc

SEQ ID NO: 3122520 - DNA, 12 bp, Homo sapiens
gaaatctcaccc

SEQ ID NO: 3122521 - DNA, 19 bp, Homo sapiens
gaaatgaaaacatgtaata

SEQ ID NO: 3122522 - DNA, 12 bp, Homo sapiens
gaaatgaacatt

SEQ ID NO: 3122523 - DNA, 15 bp, Homo sapiens
gaaatgaacattcca

SEQ ID NO: 3122524 - DNA, 16 bp, Homo sapiens
gaaatgaacattccaa

SEQ ID NO: 3122525 - DNA, 24 bp, Homo sapiens
gaaatgaataagctttctctcaga

SEQ ID NO: 3122526 - DNA, 14 bp, Homo sapiens
gaaatgaataattt

SEQ ID NO: 3122527 - DNA, 22 bp, Homo sapiens
gaaatgagcacctccattaaag

SEQ ID NO: 3122528 - DNA, 21 bp, Homo sapiens
gaaatgagcatgcattttctt

SEQ ID NO: 3122529 - DNA, 18 bp, Homo sapiens
gaaatgaggtcagagcct

SEQ ID NO: 3122530 - DNA, 21 bp, Homo sapiens
gaaatgattcaaattgctgct

SEQ ID NO: 3122531 - DNA, 14 bp, Homo sapiens
gaaatgcacaattt

SEQ ID NO: 3122532 - DNA, 21 bp, Homo sapiens
gaaatgctattgttgtgggct

SEQ ID NO: 3122533 - DNA, 18 bp, Homo sapiens
gaaatgctgatggataac

SEQ ID NO: 3122534 - DNA, 16 bp, Homo sapiens
gaaatggctttgtgat

SEQ ID NO: 3122535 - DNA, 14 bp, Homo sapiens
gaaatgtaaactgc

SEQ ID NO: 3122536 - DNA, 16 bp, Homo sapiens
gaaatgtaaactgcca

SEQ ID NO: 3122537 - DNA, 21 bp, Homo sapiens
gaaatgtcacgtactgtctga

SEQ ID NO: 3122538 - DNA, 17 bp, Homo sapiens
gaaatgtcatctaacca

SEQ ID NO: 3122539 - DNA, 23 bp, Homo sapiens
gaaatgtcccctcaaactcattg

SEQ ID NO: 3122540 - DNA, 12 bp, Homo sapiens
gaaatgtgaagg

SEQ ID NO: 3122541 - DNA, 21 bp, Homo sapiens
gaaatgttattttttaattat

SEQ ID NO: 3122542 - DNA, 17 bp, Homo sapiens
gaaattacacccaaaga

SEQ ID NO: 3122543 - DNA, 16 bp, Homo sapiens
gaaattacctgtggat

SEQ ID NO: 3122544 - DNA, 18 bp, Homo sapiens
gaaattactacaaaattt

SEQ ID NO: 3122545 - DNA, 16 bp, Homo sapiens
gaaattagctgtgtga

SEQ ID NO: 3122546 - DNA, 19 bp, Homo sapiens
gaaattaggggttaaagca

SEQ ID NO: 3122547 - DNA, 21 bp, Homo sapiens
gaaattatgtatgtttacata

SEQ ID NO: 3122548 - DNA, 17 bp, Homo sapiens
gaaattatttaataaaa

SEQ ID NO: 3122549 - DNA, 19 bp, Homo sapiens
gaaattcgtgtgttttttt

SEQ ID NO: 3122550 - DNA, 16 bp, Homo sapiens
gaaattctaaagagca

SEQ ID NO: 3122551 - DNA, 20 bp, Homo sapiens
gaaattctatttataataca

SEQ ID NO: 3122552 - DNA, 14 bp, Homo sapiens
gaaattctcctgga

SEQ ID NO: 3122553 - DNA, 16 bp, Homo sapiens
gaaattctcctggagg

SEQ ID NO: 3122554 - DNA, 16 bp, Homo sapiens
gaaattgcatactttg

SEQ ID NO: 3122555 - DNA, 22 bp, Homo sapiens
gaaattggaacagaatgtttta

SEQ ID NO: 3122556 - DNA, 15 bp, Homo sapiens
gaaatttgatttcta

SEQ ID NO: 3122557 - DNA, 21 bp, Homo sapiens
gaaatttgatttctattcaag

SEQ ID NO: 3122558 - DNA, 20 bp, Homo sapiens
gaaatttgttatacttcaaa

SEQ ID NO: 3122559 - DNA, 14 bp, Homo sapiens
gaaattttagaaat

SEQ ID NO: 3122560 - DNA, 15 bp, Homo sapiens
gaaattttatatgct

SEQ ID NO: 3122561 - DNA, 19 bp, Homo sapiens
gaaattttatatgcttact

SEQ ID NO: 3122562 - DNA, 21 bp, Homo sapiens
gaaattttctagactttctgt

SEQ ID NO: 3122563 - DNA, 16 bp, Homo sapiens
gaaattttgcaaatat

SEQ ID NO: 3122564 - DNA, 22 bp, Homo sapiens
gaaattttgcaaatataaacat

SEQ ID NO: 3122565 - DNA, 20 bp, Homo sapiens
gaaatttttcagatgcttct

SEQ ID NO: 3122566 - DNA, 14 bp, Homo sapiens
gaacaaaaaaacca

SEQ ID NO: 3122567 - DNA, 20 bp, Homo sapiens
gaacaaaaagaaatcttgtc

SEQ ID NO: 3122568 - DNA, 14 bp, Homo sapiens
gaacaaagctgtta

SEQ ID NO: 3122569 - DNA, 15 bp, Homo sapiens
gaacaaagctgttaa

SEQ ID NO: 3122570 - DNA, 18 bp, Homo sapiens
gaacaaagctgttaaact

SEQ ID NO: 3122571 - DNA, 18 bp, Homo sapiens
gaacaaatcaaattgctt

SEQ ID NO: 3122572 - DNA, 15 bp, Homo sapiens
gaacaagtaatgtat

SEQ ID NO: 3122573 - DNA, 16 bp, Homo sapiens
gaacaagtaatgtatt

SEQ ID NO: 3122574 - DNA, 14 bp, Homo sapiens
gaacaagtcacagc

SEQ ID NO: 3122575 - DNA, 18 bp, Homo sapiens
gaacaagtcacagctgca

SEQ ID NO: 3122576 - DNA, 17 bp, Homo sapiens
gaacacaaactgtaaat

SEQ ID NO: 3122577 - DNA, 18 bp, Homo sapiens
gaacacacagactttctg

SEQ ID NO: 3122578 - DNA, 21 bp, Homo sapiens
gaacacacagactttctgtga

SEQ ID NO: 3122579 - DNA, 11 bp, Homo sapiens
gaacacaggca

SEQ ID NO: 3122580 - DNA, 14 bp, Homo sapiens
gaacacaggcagct

SEQ ID NO: 3122581 - DNA, 16 bp, Homo sapiens
gaacacaggcagcttt

SEQ ID NO: 3122582 - DNA, 16 bp, Homo sapiens
gaacaccattgaaggc

SEQ ID NO: 3122583 - DNA, 23 bp, Homo sapiens
gaacaccttggggtccctccacc

SEQ ID NO: 3122584 - DNA, 17 bp, Homo sapiens
gaacacgtttttacata

SEQ ID NO: 3122585 - DNA, 18 bp, Homo sapiens
gaacactattttcagaat

SEQ ID NO: 3122586 - DNA, 19 bp, Homo sapiens
gaacactattttcagaatc

SEQ ID NO: 3122587 - DNA, 22 bp, Homo sapiens
gaacactggcacactgctctta

SEQ ID NO: 3122588 - DNA, 12 bp, Homo sapiens
gaacagaatgtt

SEQ ID NO: 3122589 - DNA, 16 bp, Homo sapiens
gaacagactggaagca

SEQ ID NO: 3122590 - DNA, 20 bp, Homo sapiens
gaacagactggaagcacagc

SEQ ID NO: 3122591 - DNA, 22 bp, Homo sapiens
gaacagactggaagcacagctt

SEQ ID NO: 3122592 - DNA, 20 bp, Homo sapiens
gaacagagagacccttgtgg

SEQ ID NO: 3122593 - DNA, 21 bp, Homo sapiens
gaacagagagacccttgtggg

SEQ ID NO: 3122594 - DNA, 22 bp, Homo sapiens
gaacagatcttttactttggcc

SEQ ID NO: 3122595 - DNA, 21 bp, Homo sapiens
gaacagctatgggagccccag

SEQ ID NO: 3122596 - DNA, 19 bp, Homo sapiens
gaacagctctgagatcctg

SEQ ID NO: 3122597 - DNA, 21 bp, Homo sapiens
gaacagctctgagatcctgga

SEQ ID NO: 3122598 - DNA, 22 bp, Homo sapiens
gaacagctctgagatcctggag

SEQ ID NO: 3122599 - DNA, 15 bp, Homo sapiens
gaacagcttcaggtt

SEQ ID NO: 3122600 - DNA, 20 bp, Homo sapiens
gaacaggaggtgtgaatgca

SEQ ID NO: 3122601 - DNA, 20 bp, Homo sapiens
gaacagggaaaataggcagg

SEQ ID NO: 3122602 - DNA, 21 bp, Homo sapiens
gaacagggaaaataggcagga

SEQ ID NO: 3122603 - DNA, 21 bp, Homo sapiens
gaacaggttcttaaaaaggaa

SEQ ID NO: 3122604 - DNA, 13 bp, Homo sapiens
gaacagtaaacat

SEQ ID NO: 3122605 - DNA, 14 bp, Homo sapiens
gaacagtaagaaca

SEQ ID NO: 3122606 - DNA, 12 bp, Homo sapiens
gaacagtgaaag

SEQ ID NO: 3122607 - DNA, 16 bp, Homo sapiens
gaacagtggctgggtg

SEQ ID NO: 3122608 - DNA, 17 bp, Homo sapiens
gaacagtggctgggtgg

SEQ ID NO: 3122609 - DNA, 22 bp, Homo sapiens
gaacagtggctgggtgggccca

SEQ ID NO: 3122610 - DNA, 20 bp, Homo sapiens
gaacagtggttgcctggggg

SEQ ID NO: 3122611 - DNA, 14 bp, Homo sapiens
gaacagtgtttccc

SEQ ID NO: 3122612 - DNA, 17 bp, Homo sapiens
gaacagtgtttcccata

SEQ ID NO: 3122613 - DNA, 21 bp, Homo sapiens
gaacagtgtttcccataattt

SEQ ID NO: 3122614 - DNA, 18 bp, Homo sapiens
gaacatagactagagaaa

SEQ ID NO: 3122615 - DNA, 12 bp, Homo sapiens
gaacatattgtt

SEQ ID NO: 3122616 - DNA, 18 bp, Homo sapiens
gaacatattgttgaaagg

SEQ ID NO: 3122617 - DNA, 17 bp, Homo sapiens
gaacatcacattcctct

SEQ ID NO: 3122618 - DNA, 18 bp, Homo sapiens
gaacatccaaccttccca

SEQ ID NO: 3122619 - DNA, 19 bp, Homo sapiens
gaacatcctttgcagggca

SEQ ID NO: 3122620 - DNA, 19 bp, Homo sapiens
gaacatcgatatgtatatc

SEQ ID NO: 3122621 - DNA, 22 bp, Homo sapiens
gaacatctttgacactctgcag

SEQ ID NO: 3122622 - DNA, 13 bp, Homo sapiens
gaacatgaagcca

SEQ ID NO: 3122623 - DNA, 16 bp, Homo sapiens
gaacatgcagttcatt

SEQ ID NO: 3122624 - DNA, 21 bp, Homo sapiens
gaacatgcagttcattatttt

SEQ ID NO: 3122625 - DNA, 14 bp, Homo sapiens
gaacatgccccctg

SEQ ID NO: 3122626 - DNA, 24 bp, Homo sapiens
gaacatgtcctaattcttctgtcc

SEQ ID NO: 3122627 - DNA, 16 bp, Homo sapiens
gaacattcagctctgg

SEQ ID NO: 3122628 - DNA, 18 bp, Homo sapiens
gaacattcagctctggag

SEQ ID NO: 3122629 - DNA, 20 bp, Homo sapiens
gaacattccaaggagttgga

SEQ ID NO: 3122630 - DNA, 21 bp, Homo sapiens
gaacattggaatgttctcaga

SEQ ID NO: 3122631 - DNA, 22 bp, Homo sapiens
gaacattggaatgttctcagat

SEQ ID NO: 3122632 - DNA, 10 bp, Homo sapiens
gaacattgta

SEQ ID NO: 3122633 - DNA, 14 bp, Homo sapiens
gaacatttatatca

SEQ ID NO: 3122634 - DNA, 13 bp, Homo sapiens
gaaccaaaacttc

SEQ ID NO: 3122635 - DNA, 16 bp, Homo sapiens
gaaccaaatctggaag

SEQ ID NO: 3122636 - DNA, 24 bp, Homo sapiens
gaaccaacaacctcaactgcctac

SEQ ID NO: 3122637 - DNA, 15 bp, Homo sapiens
gaaccaacactaaca

SEQ ID NO: 3122638 - DNA, 17 bp, Homo sapiens
gaaccaagcaggagacg

SEQ ID NO: 3122639 - DNA, 16 bp, Homo sapiens
gaagaacatccaagga

SEQ ID NO: 3122640 - DNA, 21 bp, Homo sapiens
gaagaacgcggtgtgtaacac

SEQ ID NO: 3122641 - DNA, 22 bp, Homo sapiens
gaagaacgttttttcctcagtg

SEQ ID NO: 3122642 - DNA, 13 bp, Homo sapiens
gaagaactgcagg

SEQ ID NO: 3122643 - DNA, 19 bp, Homo sapiens
gaagaactgcaggccctgg

SEQ ID NO: 3122644 - DNA, 22 bp, Homo sapiens
gaagaactgtgtttcaagttca

SEQ ID NO: 3122645 - DNA, 14 bp, Homo sapiens
gaagaagggagaag

SEQ ID NO: 3122646 - DNA, 18 bp, Homo sapiens
gaagaagggagaagaaag

SEQ ID NO: 3122647 - DNA, 19 bp, Homo sapiens
gaagaatattcaggactta

SEQ ID NO: 3122648 - DNA, 15 bp, Homo sapiens
gaagaatatttaaga

SEQ ID NO: 3122649 - DNA, 15 bp, Homo sapiens
gaagaatggagagga

SEQ ID NO: 3122650 - DNA, 14 bp, Homo sapiens
gaagaatgtctgta

SEQ ID NO: 3122651 - DNA, 14 bp, Homo sapiens
gaagaattatgtaa

SEQ ID NO: 3122652 - DNA, 18 bp, Homo sapiens
gaagaattgaaaagtttt

SEQ ID NO: 3122653 - DNA, 18 bp, Homo sapiens
gaagaatttagatcttat

SEQ ID NO: 3122654 - DNA, 14 bp, Homo sapiens
gaagaatttgttat

SEQ ID NO: 3122655 - DNA, 15 bp, Homo sapiens
gaagacaccagagca

SEQ ID NO: 3122656 - DNA, 16 bp, Homo sapiens
gaagacaccagagcag

SEQ ID NO: 3122657 - DNA, 22 bp, Homo sapiens
gaagacaccagagcagatgcag

SEQ ID NO: 3122658 - DNA, 23 bp, Homo sapiens
gaagacaccagagcagatgcaga

SEQ ID NO: 3122659 - DNA, 17 bp, Homo sapiens
gaagacagcatttaaag

SEQ ID NO: 3122660 - DNA, 21 bp, Homo sapiens
gaagacattttttgctataat

SEQ ID NO: 3122661 - DNA, 22 bp, Homo sapiens
gaagaccattctgtgaccaaaa

SEQ ID NO: 3122662 - DNA, 19 bp, Homo sapiens
gaagacccctgactcatca

SEQ ID NO: 3122663 - DNA, 19 bp, Homo sapiens
gaagacctcacctagaaat

SEQ ID NO: 3122664 - DNA, 19 bp, Homo sapiens
gaagacgcagagcaaatga

SEQ ID NO: 3122665 - DNA, 21 bp, Homo sapiens
gaagacgccgtctccatggca

SEQ ID NO: 3122666 - DNA, 17 bp, Homo sapiens
gaagactcattcttctg

SEQ ID NO: 3122667 - DNA, 15 bp, Homo sapiens
gaagactggaagcta

SEQ ID NO: 3122668 - DNA, 20 bp, Homo sapiens
gaagactgtcagcttccaaa

SEQ ID NO: 3122669 - DNA, 16 bp, Homo sapiens
gaagagactgggaaga

SEQ ID NO: 3122670 - DNA, 21 bp, Homo sapiens
gaagagaggagaggagagagg

SEQ ID NO: 3122671 - DNA, 14 bp, Homo sapiens
gaagagaggggaag

SEQ ID NO: 3122672 - DNA, 16 bp, Homo sapiens
gaagagatgcactata

SEQ ID NO: 3122673 - DNA, 18 bp, Homo sapiens
gaagagatgggcttgttt

SEQ ID NO: 3122674 - DNA, 22 bp, Homo sapiens
gaagagatgtggcaaagtgctg

SEQ ID NO: 3122675 - DNA, 13 bp, Homo sapiens
gaagagcaaaaat

SEQ ID NO: 3122676 - DNA, 16 bp, Homo sapiens
gaagagcaaaaatatc

SEQ ID NO: 3122677 - DNA, 14 bp, Homo sapiens
gaagagcagcctga

SEQ ID NO: 3122678 - DNA, 18 bp, Homo sapiens
gaagagcagcctgatggc

SEQ ID NO: 3122679 - DNA, 22 bp, Homo sapiens
gaagagcagcctgatggccaag

SEQ ID NO: 3122680 - DNA, 18 bp, Homo sapiens
gaagagcaggcacatgga

SEQ ID NO: 3122681 - DNA, 23 bp, Homo sapiens
gaagagcaggcacatggaggagc

SEQ ID NO: 3122682 - DNA, 17 bp, Homo sapiens
gaagagctattatataa

SEQ ID NO: 3122683 - DNA, 16 bp, Homo sapiens
gaagaggaacagtgtg

SEQ ID NO: 3122684 - DNA, 17 bp, Homo sapiens
gaagaggaactgggcct

SEQ ID NO: 3122685 - DNA, 20 bp, Homo sapiens
gaagaggcatcctgcctggg

SEQ ID NO: 3122686 - DNA, 23 bp, Homo sapiens
gaagaggcatcctgcctgggtgg

SEQ ID NO: 3122687 - DNA, 17 bp, Homo sapiens
gaagaggcgggccagcc

SEQ ID NO: 3122688 - DNA, 19 bp, Homo sapiens
gaagaggcgggccagccag

SEQ ID NO: 3122689 - DNA, 19 bp, Homo sapiens
gaagagggcagtacctggg

SEQ ID NO: 3122690 - DNA, 17 bp, Homo sapiens
gaagagggcccagccca

SEQ ID NO: 3122691 - DNA, 19 bp, Homo sapiens
gaagagggcccagcccaga

SEQ ID NO: 3122692 - DNA, 16 bp, Homo sapiens
gaagagggctgagctg

SEQ ID NO: 3122693 - DNA, 18 bp, Homo sapiens
gaagaggggcagcccttg

SEQ ID NO: 3122694 - DNA, 17 bp, Homo sapiens
gaagaggggctggggca

SEQ ID NO: 3122695 - DNA, 20 bp, Homo sapiens
gaagagtagcatttcattct

SEQ ID NO: 3122696 - DNA, 23 bp, Homo sapiens
gaagagttgaggaactgtacaga

SEQ ID NO: 3122697 - DNA, 23 bp, Homo sapiens
gaagagtttttgtgatgggggag

SEQ ID NO: 3122698 - DNA, 17 bp, Homo sapiens
gaagataattgttgaaa

SEQ ID NO: 3122699 - DNA, 19 bp, Homo sapiens
gaagataattgttgaaatt

SEQ ID NO: 3122700 - DNA, 19 bp, Homo sapiens
gaagatacactgagattga

SEQ ID NO: 3122701 - DNA, 21 bp, Homo sapiens
gaagatagtcttggaagctgt

SEQ ID NO: 3122702 - DNA, 17 bp, Homo sapiens
gaagatcacgctccccg

SEQ ID NO: 3122703 - DNA, 14 bp, Homo sapiens
gaagatcctgcggg

SEQ ID NO: 3122704 - DNA, 16 bp, Homo sapiens
gaagatgaggttctga

SEQ ID NO: 3122705 - DNA, 22 bp, Homo sapiens
gaagatgaggttctgagaccag

SEQ ID NO: 3122706 - DNA, 20 bp, Homo sapiens
gaagattaggagaaacacat

SEQ ID NO: 3122707 - DNA, 20 bp, Homo sapiens
gaagattcttgtatttatta

SEQ ID NO: 3122708 - DNA, 22 bp, Homo sapiens
gaagatttgatgctggagaggt

SEQ ID NO: 3122709 - DNA, 21 bp, Homo sapiens
gaagatttgcccatttacact

SEQ ID NO: 3122710 - DNA, 16 bp, Homo sapiens
gaagattttcagtcta

SEQ ID NO: 3122711 - DNA, 23 bp, Homo sapiens
gaagattttgaaatttttattaa

SEQ ID NO: 3122712 - DNA, 18 bp, Homo sapiens
gaagcaagacacgtggcc

SEQ ID NO: 3122713 - DNA, 22 bp, Homo sapiens
gaagcaagaggcaagctgaaat

SEQ ID NO: 3122714 - DNA, 15 bp, Homo sapiens
gaagcacaactccct

SEQ ID NO: 3122715 - DNA, 13 bp, Homo sapiens
gaagcacagcttc

SEQ ID NO: 3122716 - DNA, 13 bp, Homo sapiens
gaagcacatgtgt

SEQ ID NO: 3122717 - DNA, 16 bp, Homo sapiens
gaagcaggacctagag

SEQ ID NO: 3122718 - DNA, 22 bp, Homo sapiens
gaagcaggggtggggggtgcag

SEQ ID NO: 3122719 - DNA, 23 bp, Homo sapiens
gaagcagtcgtggctttggcagt

SEQ ID NO: 3122720 - DNA, 15 bp, Homo sapiens
gaagcagtcttgctc

SEQ ID NO: 3122721 - DNA, 18 bp, Homo sapiens
gaagcagtgcctcgaggc

SEQ ID NO: 3122722 - DNA, 22 bp, Homo sapiens
gaagcagtgcctcgaggcaccg

SEQ ID NO: 3122723 - DNA, 17 bp, Homo sapiens
gaagcagtgccttccat

SEQ ID NO: 3122724 - DNA, 14 bp, Homo sapiens
gaagcagttgtgtc

SEQ ID NO: 3122725 - DNA, 18 bp, Homo sapiens
gaagcatcctccacatcc

SEQ ID NO: 3122726 - DNA, 16 bp, Homo sapiens
gaagcatgaaaaagca

SEQ ID NO: 3122727 - DNA, 18 bp, Homo sapiens
gaagcatgtgacacccac

SEQ ID NO: 3122728 - DNA, 18 bp, Homo sapiens
gaagcattaacttctctg

SEQ ID NO: 3122729 - DNA, 21 bp, Homo sapiens
gaagcattaacttctctggaa

SEQ ID NO: 3122730 - DNA, 15 bp, Homo sapiens
gaagcattcagagag

SEQ ID NO: 3122731 - DNA, 17 bp, Homo sapiens
gaagcattctccccagt

SEQ ID NO: 3122732 - DNA, 17 bp, Homo sapiens
gaagcatttactttgtg

SEQ ID NO: 3122733 - DNA, 14 bp, Homo sapiens
gaagcatttgtatt

SEQ ID NO: 3122734 - DNA, 18 bp, Homo sapiens
gaagcatttgtattttgt

SEQ ID NO: 3122735 - DNA, 13 bp, Homo sapiens
gaagccaaagaaa

SEQ ID NO: 3122736 - DNA, 13 bp, Homo sapiens
gaaccaaggcagc

SEQ ID NO: 3122737 - DNA, 20 bp, Homo sapiens
gaaccaaggcagcctccaga

SEQ ID NO: 3122738 - DNA, 22 bp, Homo sapiens
gaaccaaggcagcctccagagc

SEQ ID NO: 3122739 - DNA, 16 bp, Homo sapiens
gaaccacagggccaga

SEQ ID NO: 3122740 - DNA, 18 bp, Homo sapiens
gaaccacagggccagagg

SEQ ID NO: 3122741 - DNA, 19 bp, Homo sapiens
gaaccacagggccagaggg

SEQ ID NO: 3122742 - DNA, 20 bp, Homo sapiens
gaaccacagggccagaggga

SEQ ID NO: 3122743 - DNA, 18 bp, Homo sapiens
gaaccacatcttgctctg

SEQ ID NO: 3122744 - DNA, 21 bp, Homo sapiens
gaaccacatcttgctctgctg

SEQ ID NO: 3122745 - DNA, 21 bp, Homo sapiens
gaaccaccaaaattatagctt

SEQ ID NO: 3122746 - DNA, 17 bp, Homo sapiens
gaaccaccacacccagc

SEQ ID NO: 3122747 - DNA, 21 bp, Homo sapiens
gaaccaccacacccagcccac

SEQ ID NO: 3122748 - DNA, 16 bp, Homo sapiens
gaaccacttcctgcta

SEQ ID NO: 3122749 - DNA, 19 bp, Homo sapiens
gaaccagctcatctccaag

SEQ ID NO: 3122750 - DNA, 19 bp, Homo sapiens
gaaccagtttcaggtgttt

SEQ ID NO: 3122751 - DNA, 20 bp, Homo sapiens
gaaccatcattataaacgtg

SEQ ID NO: 3122752 - DNA, 19 bp, Homo sapiens
gaaccatgcaggaaggaaa

SEQ ID NO: 3122753 - DNA, 19 bp, Homo sapiens
gaaccattatactttatat

SEQ ID NO: 3122754 - DNA, 19 bp, Homo sapiens
gaaccatttgcaatatgga

SEQ ID NO: 3122755 - DNA, 18 bp, Homo sapiens
gaacccagcagttctgtt

SEQ ID NO: 3122756 - DNA, 13 bp, Homo sapiens
gaacccagggctc

SEQ ID NO: 3122757 - DNA, 18 bp, Homo sapiens
gaacccagggctctgccc

SEQ ID NO: 3122758 - DNA, 13 bp, Homo sapiens
gaaccccgcagcc

SEQ ID NO: 3122759 - DNA, 15 bp, Homo sapiens
gaacccttgtgcttg

SEQ ID NO: 3122760 - DNA, 12 bp, Homo sapiens
gaaccctttgtt

SEQ ID NO: 3122761 - DNA, 20 bp, Homo sapiens
gaaccctttgtttcttgttt

SEQ ID NO: 3122762 - DNA, 21 bp, Homo sapiens
gaaccgagcaaagatcaaaat

SEQ ID NO: 3122763 - DNA, 17 bp, Homo sapiens
gaaccgcacagctcagg

SEQ ID NO: 3122764 - DNA, 21 bp, Homo sapiens
gaaccgcacagctcaggaggc

SEQ ID NO: 3122765 - DNA, 18 bp, Homo sapiens
gaaccgctcacctagagc

SEQ ID NO: 3122766 - DNA, 18 bp, Homo sapiens
gaaccgttttgaagctac

SEQ ID NO: 3122767 - DNA, 19 bp, Homo sapiens
gaacctacagttttaactg

SEQ ID NO: 3122768 - DNA, 15 bp, Homo sapiens
gaacctaccttcatt

SEQ ID NO: 3122769 - DNA, 19 bp, Homo sapiens
gaacctagtactctctgct

SEQ ID NO: 3122770 - DNA, 19 bp, Homo sapiens
gaacctattttcatttgta

SEQ ID NO: 3122771 - DNA, 19 bp, Homo sapiens
gaacctcccagaggtccag

SEQ ID NO: 3122772 - DNA, 22 bp, Homo sapiens
gaacctcccagaggtccagccc

SEQ ID NO: 3122773 - DNA, 15 bp, Homo sapiens
gaacctctgtctcat

SEQ ID NO: 3122774 - DNA, 14 bp, Homo sapiens
gaacctcttcccca

SEQ ID NO: 3122775 - DNA, 17 bp, Homo sapiens
gaacctggatccagcac

SEQ ID NO: 3122776 - DNA, 12 bp, Homo sapiens
gaacctgggctg

SEQ ID NO: 3122777 - DNA, 14 bp, Homo sapiens
gaaccttaatgaca

SEQ ID NO: 3122778 - DNA, 19 bp, Homo sapiens
gaaccttctagaacctggg

SEQ ID NO: 3122779 - DNA, 21 bp, Homo sapiens
gaaccttctagaacctgggct

SEQ ID NO: 3122780 - DNA, 23 bp, Homo sapiens
gaaccttctagaacctgggctgt

SEQ ID NO: 3122781 - DNA, 16 bp, Homo sapiens
gaacgaaaatgaaagc

SEQ ID NO: 3122782 - DNA, 19 bp, Homo sapiens
gaacgaacacaagaaaaag

SEQ ID NO: 3122783 - DNA, 17 bp, Homo sapiens
gaacgagcactggccag

SEQ ID NO: 3122784 - DNA, 16 bp, Homo sapiens
gaacgatgtgtctgta

SEQ ID NO: 3122785 - DNA, 18 bp, Homo sapiens
gaacgatttagaaagaag

SEQ ID NO: 3122786 - DNA, 15 bp, Homo sapiens
gaacgccagtctccc

SEQ ID NO: 3122787 - DNA, 13 bp, Homo sapiens
gaacgctcttagc

SEQ ID NO: 3122788 - DNA, 17 bp, Homo sapiens
gaacgggcagcctgggc

SEQ ID NO: 3122789 - DNA, 16 bp, Homo sapiens
gaacggggtccttcaa

SEQ ID NO: 3122790 - DNA, 23 bp, Homo sapiens
gaactaagaaacttttgtaaaga

SEQ ID NO: 3122791 - DNA, 15 bp, Homo sapiens
gaactaataaaagca

SEQ ID NO: 3122792 - DNA, 16 bp, Homo sapiens
gaactaataaatacat

SEQ ID NO: 3122793 - DNA, 15 bp, Homo sapiens
gaactactgtacttt

SEQ ID NO: 3122794 - DNA, 19 bp, Homo sapiens
gaactagactgcctgggtt

SEQ ID NO: 3122795 - DNA, 22 bp, Homo sapiens
gaactattggagggtgggagag

SEQ ID NO: 3122796 - DNA, 16 bp, Homo sapiens
gaactcaactttgaca

SEQ ID NO: 3122797 - DNA, 22 bp, Homo sapiens
gaactcaccctgggagccagtc

SEQ ID NO: 3122798 - DNA, 17 bp, Homo sapiens
gaactcagcagttgaca

SEQ ID NO: 3122799 - DNA, 20 bp, Homo sapiens
gaactcattctatccccaat

SEQ ID NO: 3122800 - DNA, 12 bp, Homo sapiens
gaactccactct

SEQ ID NO: 3122801 - DNA, 17 bp, Homo sapiens
gaactccaggccctcct

SEQ ID NO: 3122802 - DNA, 14 bp, Homo sapiens
gaactccctttcaa

SEQ ID NO: 3122803 - DNA, 19 bp, Homo sapiens
gaactcctgccacaacaga

SEQ ID NO: 3122804 - DNA, 23 bp, Homo sapiens
gaactcctgccacaacagaataa

SEQ ID NO: 3122805 - DNA, 13 bp, Homo sapiens
gaactcctggcct

SEQ ID NO: 3122806 - DNA, 12 bp, Homo sapiens
gaactccttggc

SEQ ID NO: 3122807 - DNA, 21 bp, Homo sapiens
gaactccttggcctagcccac

SEQ ID NO: 3122808 - DNA, 17 bp, Homo sapiens
gaactctcaaaagtcta

SEQ ID NO: 3122809 - DNA, 13 bp, Homo sapiens
gaactctgacaag

SEQ ID NO: 3122810 - DNA, 17 bp, Homo sapiens
gaactctgacaagggct

SEQ ID NO: 3122811 - DNA, 13 bp, Homo sapiens
gaactctgttccc

SEQ ID NO: 3122812 - DNA, 19 bp, Homo sapiens
gaactctgttcccccaccc

SEQ ID NO: 3122813 - DNA, 13 bp, Homo sapiens
gaactcttcagaa

SEQ ID NO: 3122814 - DNA, 22 bp, Homo sapiens
gaactctttctggcctgccttc

SEQ ID NO: 3122815 - DNA, 23 bp, Homo sapiens
gaactgaacaccattgaaggctt

SEQ ID NO: 3122816 - DNA, 16 bp, Homo sapiens
gaactgactgaaggaa

SEQ ID NO: 3122817 - DNA, 12 bp, Homo sapiens
gaactgcaggcc

SEQ ID NO: 3122818 - DNA, 14 bp, Homo sapiens
gaactgcatggacc

SEQ ID NO: 3122819 - DNA, 23 bp, Homo sapiens
gaactgcatggacctaacattcg

SEQ ID NO: 3122820 - DNA, 20 bp, Homo sapiens
gaactgccattattttctgt

SEQ ID NO: 3122821 - DNA, 23 bp, Homo sapiens
gaactgccattattttctgtcag

SEQ ID NO: 3122822 - DNA, 17 bp, Homo sapiens
gaactgcctctttcctg

SEQ ID NO: 3122823 - DNA, 17 bp, Homo sapiens
gaactgcttttcctcaa

SEQ ID NO: 3122824 - DNA, 16 bp, Homo sapiens
gaactggaagaaagca

SEQ ID NO: 3122825 - DNA, 15 bp, Homo sapiens
gaactggacacaata

SEQ ID NO: 3122826 - DNA, 23 bp, Homo sapiens
gaactggacacaataggtctttc

SEQ ID NO: 3122827 - DNA, 18 bp, Homo sapiens
gaactggcaattgtctat

SEQ ID NO: 3122828 - DNA, 11 bp, Homo sapiens
gaactgggctg

SEQ ID NO: 3122829 - DNA, 17 bp, Homo sapiens
gaactgggctgggcctc

SEQ ID NO: 3122830 - DNA, 12 bp, Homo sapiens
gaactgggtaaa

SEQ ID NO: 3122831 - DNA, 16 bp, Homo sapiens
gaactgggtaaatgca

SEQ ID NO: 3122832 - DNA, 19 bp, Homo sapiens
gaactgggtaaatgcaaag

SEQ ID NO: 3122833 - DNA, 22 bp, Homo sapiens
gaactgtccagagagcaactct

SEQ ID NO: 3122834 - DNA, 22 bp, Homo sapiens
gaactgtgcatagtgctgggat

SEQ ID NO: 3122835 - DNA, 13 bp, Homo sapiens
gaactgtgccttc

SEQ ID NO: 3122836 - DNA, 21 bp, Homo sapiens
gaactgttacaacttgtattt

SEQ ID NO: 3122837 - DNA, 15 bp, Homo sapiens
gaactgttagatgct

SEQ ID NO: 3122838 - DNA, 16 bp, Homo sapiens
gaactgttagatgctg

SEQ ID NO: 3122839 - DNA, 17 bp, Homo sapiens
gaactgttagatgctga

SEQ ID NO: 3122840 - DNA, 19 bp, Homo sapiens
gaactgttgcctaattgga

SEQ ID NO: 3122841 - DNA, 12 bp, Homo sapiens
gaactgttgtct

SEQ ID NO: 3122842 - DNA, 18 bp, Homo sapiens
gaacttacacttggagcc

SEQ ID NO: 3122843 - DNA, 17 bp, Homo sapiens
gaacttacattgttcaa

SEQ ID NO: 3122844 - DNA, 15 bp, Homo sapiens
gaacttactattcat

SEQ ID NO: 3122845 - DNA, 20 bp, Homo sapiens
gaacttatcctaaaacaaat

SEQ ID NO: 3122846 - DNA, 15 bp, Homo sapiens
gaacttattctgtag

SEQ ID NO: 3122847 - DNA, 14 bp, Homo sapiens
gaacttgaatgtgt

SEQ ID NO: 3122848 - DNA, 15 bp, Homo sapiens
gaacttgactgggtg

SEQ ID NO: 3122849 - DNA, 21 bp, Homo sapiens
gaacttgcagctgatgttgga

SEQ ID NO: 3122850 - DNA, 12 bp, Homo sapiens
gaacttgcatgg

SEQ ID NO: 3122851 - DNA, 21 bp, Homo sapiens
gaacttggctttcctgtttct

SEQ ID NO: 3122852 - DNA, 15 bp, Homo sapiens
gaacttgtagctgta

SEQ ID NO: 3122853 - DNA, 18 bp, Homo sapiens
gaacttgttacttgcagc

SEQ ID NO: 3122854 - DNA, 14 bp, Homo sapiens
gaactttctccctc

SEQ ID NO: 3122855 - DNA, 18 bp, Homo sapiens
gaactttctccctcatcg

SEQ ID NO: 3122856 - DNA, 14 bp, Homo sapiens
gaactttctgcttt

SEQ ID NO: 3122857 - DNA, 21 bp, Homo sapiens
gaacttttttaaataaacttt

SEQ ID NO: 3122858 - DNA, 16 bp, Homo sapiens
gaagaaaaaaaataac

SEQ ID NO: 3122859 - DNA, 17 bp, Homo sapiens
gaagaaaaaaaataaca

SEQ ID NO: 3122860 - DNA, 18 bp, Homo sapiens
gaagaaaaaaaataacac

SEQ ID NO: 3122861 - DNA, 18 bp, Homo sapiens
gaagaaacactttctctt

SEQ ID NO: 3122862 - DNA, 16 bp, Homo sapiens
gaagaaatctttccag

SEQ ID NO: 3122863 - DNA, 21 bp, Homo sapiens
gaagaacacagcatgtgccaa

SEQ ID NO: 3122864 - DNA, 22 bp, Homo sapiens
gaagaacacagcatgtgccaag

SEQ ID NO: 3122865 - DNA, 13 bp, Homo sapiens
gaattataactgt

SEQ ID NO: 3122866 - DNA, 21 bp, Homo sapiens
gaattataactgtaaagatgt

SEQ ID NO: 3122867 - DNA, 14 bp, Homo sapiens
gaattatatatttc

SEQ ID NO: 3122868 - DNA, 15 bp, Homo sapiens
gaattatcagcaaag

SEQ ID NO: 3122869 - DNA, 17 bp, Homo sapiens
gaattatcagcaaagaa

SEQ ID NO: 3122870 - DNA, 21 bp, Homo sapiens
gaattatgtaatatattgtac

SEQ ID NO: 3122871 - DNA, 23 bp, Homo sapiens
gaattatgtaatatattgtacaa

SEQ ID NO: 3122872 - DNA, 21 bp, Homo sapiens
gaattatttctgtcacagtaa

SEQ ID NO: 3122873 - DNA, 18 bp, Homo sapiens
gaattcaaactggggcct

SEQ ID NO: 3122874 - DNA, 23 bp, Homo sapiens
gaattcaaactggggcctccaga

SEQ ID NO: 3122875 - DNA, 11 bp, Homo sapiens
gaattcaaagc

SEQ ID NO: 3122876 - DNA, 18 bp, Homo sapiens
gaattcaaagcttgtgaa

SEQ ID NO: 3122877 - DNA, 16 bp, Homo sapiens
gaattcagcaccctgg

SEQ ID NO: 3122878 - DNA, 11 bp, Homo sapiens
gaattcagtaa

SEQ ID NO: 3122879 - DNA, 15 bp, Homo sapiens
gaattcccttttaat

SEQ ID NO: 3122880 - DNA, 19 bp, Homo sapiens
gaattctaattgtcagtga

SEQ ID NO: 3122881 - DNA, 21 bp, Homo sapiens
gaattctaattgtcagtgatt

SEQ ID NO: 3122882 - DNA, 23 bp, Homo sapiens
gaattctaattgtcagtgatttt

SEQ ID NO: 3122883 - DNA, 17 bp, Homo sapiens
gaattctcagaatctca

SEQ ID NO: 3122884 - DNA, 18 bp, Homo sapiens
gaattctcggaatggcag

SEQ ID NO: 3122885 - DNA, 15 bp, Homo sapiens
gaattctgattgatt

SEQ ID NO: 3122886 - DNA, 22 bp, Homo sapiens
gaattgaatcgctgcgatactg

SEQ ID NO: 3122887 - DNA, 17 bp, Homo sapiens
gaattgaccatctgctt

SEQ ID NO: 3122888 - DNA, 18 bp, Homo sapiens
gaattgaccatctgcttt

SEQ ID NO: 3122889 - DNA, 17 bp, Homo sapiens
gaattgatttgcattga

SEQ ID NO: 3122890 - DNA, 17 bp, Homo sapiens
gaattgcccgtttccat

SEQ ID NO: 3122891 - DNA, 12 bp, Homo sapiens
gaattgtacaga

SEQ ID NO: 3122892 - DNA, 15 bp, Homo sapiens
gaattgtagactgat

SEQ ID NO: 3122893 - DNA, 13 bp, Homo sapiens
gaattgtctttta

SEQ ID NO: 3122894 - DNA, 20 bp, Homo sapiens
gaattgttttctttaaagat

SEQ ID NO: 3122895 - DNA, 18 bp, Homo sapiens
gaatttaaaattaagtag

SEQ ID NO: 3122896 - DNA, 17 bp, Homo sapiens
gaatttaaatataattc

SEQ ID NO: 3122897 - DNA, 20 bp, Homo sapiens
gaatttaaatataattctgt

SEQ ID NO: 3122898 - DNA, 19 bp, Homo sapiens
gaatttaggtttttattag

SEQ ID NO: 3122899 - DNA, 15 bp, Homo sapiens
gaatttataacaaat

SEQ ID NO: 3122900 - DNA, 17 bp, Homo sapiens
gaatttattgaatattt

SEQ ID NO: 3122901 - DNA, 12 bp, Homo sapiens
gaatttcacctg

SEQ ID NO: 3122902 - DNA, 18 bp, Homo sapiens
gaatttctaaaaagatta

SEQ ID NO: 3122903 - DNA, 14 bp, Homo sapiens
gaatttcttaactt

SEQ ID NO: 3122904 - DNA, 15 bp, Homo sapiens
gaatttcttaacttc

SEQ ID NO: 3122905 - DNA, 16 bp, Homo sapiens
gaatttcttaacttct

SEQ ID NO: 3122906 - DNA, 19 bp, Homo sapiens
gaatttcttaacttcttgc

SEQ ID NO: 3122907 - DNA, 14 bp, Homo sapiens
gaatttgaatgaaa

SEQ ID NO: 3122908 - DNA, 13 bp, Homo sapiens
gaatttgctgggg

SEQ ID NO: 3122909 - DNA, 19 bp, Homo sapiens
gaatttggagactctgtgg

SEQ ID NO: 3122910 - DNA, 12 bp, Homo sapiens
gaatttgtactt

SEQ ID NO: 3122911 - DNA, 21 bp, Homo sapiens
gaatttgtcagcgttctacca

SEQ ID NO: 3122912 - DNA, 12 bp, Homo sapiens
gaattttaaagt

SEQ ID NO: 3122913 - DNA, 15 bp, Homo sapiens
gaattttaagtgctt

SEQ ID NO: 3122914 - DNA, 23 bp, Homo sapiens
gaattttctccctttatgtatct

SEQ ID NO: 3122915 - DNA, 21 bp, Homo sapiens
gaattttctttgtgtagcttt

SEQ ID NO: 3122916 - DNA, 23 bp, Homo sapiens
gaattttctttgtgtagctttgc

SEQ ID NO: 3122917 - DNA, 15 bp, Homo sapiens
gaattttgttgctgt

SEQ ID NO: 3122918 - DNA, 20 bp, Homo sapiens
gacaaaaaaatttaaaatta

SEQ ID NO: 3122919 - DNA, 21 bp, Homo sapiens
gacaaaaatgaactgaagttt

SEQ ID NO: 3122920 - DNA, 22 bp, Homo sapiens
gacaaaattttagtccaaataa

SEQ ID NO: 3122921 - DNA, 19 bp, Homo sapiens
gacaaacacctcccaggag

SEQ ID NO: 3122922 - DNA, 22 bp, Homo sapiens
gacaaacacctcccaggagaca

SEQ ID NO: 3122923 - DNA, 18 bp, Homo sapiens
gacaaaccttaaaacagc

SEQ ID NO: 3122924 - DNA, 18 bp, Homo sapiens
gacaaactggagtctgga

SEQ ID NO: 3122925 - DNA, 14 bp, Homo sapiens
gacaaagactcctc

SEQ ID NO: 3122926 - DNA, 18 bp, Homo sapiens
gacaaagactcctctggg

SEQ ID NO: 3122927 - DNA, 16 bp, Homo sapiens
gacaaagctgctaaat

SEQ ID NO: 3122928 - DNA, 14 bp, Homo sapiens
gacaaagggaggga

SEQ ID NO: 3122929 - DNA, 19 bp, Homo sapiens
gacaaagggagggagcaag

SEQ ID NO: 3122930 - DNA, 18 bp, Homo sapiens
gacaaaggttttcctctt

SEQ ID NO: 3122931 - DNA, 16 bp, Homo sapiens
gacaaagtcccagaat

SEQ ID NO: 3122932 - DNA, 23 bp, Homo sapiens
gacaaagttactgattcactgca

SEQ ID NO: 3122933 - DNA, 23 bp, Homo sapiens
gacaaatcaacagaagcatttgt

SEQ ID NO: 3122934 - DNA, 20 bp, Homo sapiens
gacaaatctgtgtatattat

SEQ ID NO: 3122935 - DNA, 14 bp, Homo sapiens
gacaaatgacagat

SEQ ID NO: 3122936 - DNA, 20 bp, Homo sapiens
gacaaatgacagattctgac

SEQ ID NO: 3122937 - DNA, 16 bp, Homo sapiens
gacaaattatatttga

SEQ ID NO: 3122938 - DNA, 21 bp, Homo sapiens
gacaacacttaatagcaacag

SEQ ID NO: 3122939 - DNA, 14 bp, Homo sapiens
gacaacagaaaaac

SEQ ID NO: 3122940 - DNA, 18 bp, Homo sapiens
gacaacagaaaaacaatc

SEQ ID NO: 3122941 - DNA, 15 bp, Homo sapiens
gacaacagcccaggc

SEQ ID NO: 3122942 - DNA, 20 bp, Homo sapiens
gacaacaggtaaaacagggc

SEQ ID NO: 3122943 - DNA, 16 bp, Homo sapiens
gacaaccaaaacatat

SEQ ID NO: 3122944 - DNA, 18 bp, Homo sapiens
gacaactagatttgtcct

SEQ ID NO: 3122945 - DNA, 13 bp, Homo sapiens
gacaactgtgact

SEQ ID NO: 3122946 - DNA, 20 bp, Homo sapiens
gacaacttttaaagaaaaat

SEQ ID NO: 3122947 - DNA, 14 bp, Homo sapiens
gacagccacggcca

SEQ ID NO: 3122948 - DNA, 18 bp, Homo sapiens
gacagccacggccaggcc

SEQ ID NO: 3122949 - DNA, 17 bp, Homo sapiens
gacagccatttgtaatg

SEQ ID NO: 3122950 - DNA, 11 bp, Homo sapiens
gacagcccaga

SEQ ID NO: 3122951 - DNA, 14 bp, Homo sapiens
gacagccccagagc

SEQ ID NO: 3122952 - DNA, 17 bp, Homo sapiens
gacagccccagagcagg

SEQ ID NO: 3122953 - DNA, 20 bp, Homo sapiens
gacagcctccccctgtcccc

SEQ ID NO: 3122954 - DNA, 20 bp, Homo sapiens
gacagcctccgccaagatct

SEQ ID NO: 3122955 - DNA, 18 bp, Homo sapiens
gacagcctcttcagcccc

SEQ ID NO: 3122956 - DNA, 19 bp, Homo sapiens
gacagcctggcacagggca

SEQ ID NO: 3122957 - DNA, 17 bp, Homo sapiens
gacagcgcccctgctgt

SEQ ID NO: 3122958 - DNA, 18 bp, Homo sapiens
gacagcgcccctgctgtc

SEQ ID NO: 3122959 - DNA, 15 bp, Homo sapiens
gacagctccttctgt

SEQ ID NO: 3122960 - DNA, 16 bp, Homo sapiens
gacagctccttctgtc

SEQ ID NO: 3122961 - DNA, 17 bp, Homo sapiens
gacagctccttctgtcc

SEQ ID NO: 3122962 - DNA, 19 bp, Homo sapiens
gacagctccttctgtccta

SEQ ID NO: 3122963 - DNA, 15 bp, Homo sapiens
gacagcttctctgca

SEQ ID NO: 3122964 - DNA, 15 bp, Homo sapiens
gacagcttgagccgg

SEQ ID NO: 3122965 - DNA, 20 bp, Homo sapiens
gacagctttcccctcatttt

SEQ ID NO: 3122966 - DNA, 14 bp, Homo sapiens
gacagctttgctcc

SEQ ID NO: 3122967 - DNA, 16 bp, Homo sapiens
gacagctttgctccgc

SEQ ID NO: 3122968 - DNA, 19 bp, Homo sapiens
gacagctttgctccgctcc

SEQ ID NO: 3122969 - DNA, 23 bp, Homo sapiens
gacagctttgctccgctcccacc

SEQ ID NO: 3122970 - DNA, 16 bp, Homo sapiens
gacaggaaagccctcc

SEQ ID NO: 3122971 - DNA, 17 bp, Homo sapiens
gacaggaaagccctccc

SEQ ID NO: 3122972 - DNA, 11 bp, Homo sapiens
gacaggaccct

SEQ ID NO: 3122973 - DNA, 15 bp, Homo sapiens
gacaggaccctcagg

SEQ ID NO: 3122974 - DNA, 22 bp, Homo sapiens
gacaggaccctcaggaattcag

SEQ ID NO: 3122975 - DNA, 21 bp, Homo sapiens
gacaggagacctggcactgga

SEQ ID NO: 3122976 - DNA, 19 bp, Homo sapiens
gacaggagcctagcggagc

SEQ ID NO: 3122977 - DNA, 14 bp, Homo sapiens
gacaggaggaggag

SEQ ID NO: 3122978 - DNA, 17 bp, Homo sapiens
gacaggaggcggcccgg

SEQ ID NO: 3122979 - DNA, 22 bp, Homo sapiens
gacaggaggcggcccggccagc

SEQ ID NO: 3122980 - DNA, 23 bp, Homo sapiens
gacaggaggcggcccggccagcg

SEQ ID NO: 3122981 - DNA, 19 bp, Homo sapiens
gacaggagtcagtgtctgg

SEQ ID NO: 3122982 - DNA, 20 bp, Homo sapiens
gacaggagtcagtgtctggc

SEQ ID NO: 3122983 - DNA, 13 bp, Homo sapiens
gacaggcaagcac

SEQ ID NO: 3122984 - DNA, 17 bp, Homo sapiens
gacaggcaagcacctcc

SEQ ID NO: 3122985 - DNA, 20 bp, Homo sapiens
gacaggcaagcacctcctgc

SEQ ID NO: 3122986 - DNA, 21 bp, Homo sapiens
gacaggcaagcacctcctgcc

SEQ ID NO: 3122987 - DNA, 16 bp, Homo sapiens
gacaggcaatgctggc

SEQ ID NO: 3122988 - DNA, 22 bp, Homo sapiens
gacaggcactccaaacctgtct

SEQ ID NO: 3122989 - DNA, 12 bp, Homo sapiens
gacaggcaggcc

SEQ ID NO: 3122990 - DNA, 14 bp, Homo sapiens
gacaggcaggccag

SEQ ID NO: 3122991 - DNA, 23 bp, Homo sapiens
gacaggcaggccagatggcccct

SEQ ID NO: 3122992 - DNA, 20 bp, Homo sapiens
gacaggcatgttctctgagg

SEQ ID NO: 3122993 - DNA, 19 bp, Homo sapiens
gacaggccatgtgagccac

SEQ ID NO: 3122994 - DNA, 13 bp, Homo sapiens
gacaggccctggc

SEQ ID NO: 3122995 - DNA, 19 bp, Homo sapiens
gacaggcctcacctctacc

SEQ ID NO: 3122996 - DNA, 19 bp, Homo sapiens
gacaggcgagagaggagcc

SEQ ID NO: 3122997 - DNA, 17 bp, Homo sapiens
gaagtctacctgctgga

SEQ ID NO: 3122998 - DNA, 17 bp, Homo sapiens
gaagtctcatgggaagc

SEQ ID NO: 3122999 - DNA, 15 bp, Homo sapiens
gaagtctcttttctt

SEQ ID NO: 3123000 - DNA, 15 bp, Homo sapiens
gaagtgaagaatgca

SEQ ID NO: 3123001 - DNA, 16 bp, Homo sapiens
gaagtgcatttctgaa

SEQ ID NO: 3123002 - DNA, 20 bp, Homo sapiens
gaagtgccttctccttcccc

SEQ ID NO: 3123003 - DNA, 21 bp, Homo sapiens
gaagtgccttctccttcccca

SEQ ID NO: 3123004 - DNA, 22 bp, Homo sapiens
gaagtgccttctccttccccag

SEQ ID NO: 3123005 - DNA, 16 bp, Homo sapiens
gaagtgcgtgaatgta

SEQ ID NO: 3123006 - DNA, 18 bp, Homo sapiens
gaagtgctgtttattaat

SEQ ID NO: 3123007 - DNA, 23 bp, Homo sapiens
gaagtggagacagtcctttccca

SEQ ID NO: 3123008 - DNA, 17 bp, Homo sapiens
gaagtggtactagtgtg

SEQ ID NO: 3123009 - DNA, 23 bp, Homo sapiens
gaagtgtaacagctgaggtctct

SEQ ID NO: 3123010 - DNA, 19 bp, Homo sapiens
gaagtgtgagcgccttggt

SEQ ID NO: 3123011 - DNA, 10 bp, Homo sapiens
gaagtgttca

SEQ ID NO: 3123012 - DNA, 18 bp, Homo sapiens
gaagtgttcaagaaataa

SEQ ID NO: 3123013 - DNA, 16 bp, Homo sapiens
gaagttactttgtaat

SEQ ID NO: 3123014 - DNA, 22 bp, Homo sapiens
gaagttcatacctaagtactgt

SEQ ID NO: 3123015 - DNA, 16 bp, Homo sapiens
gaagttctatttattt

SEQ ID NO: 3123016 - DNA, 17 bp, Homo sapiens
gaagtttacattgtaaa

SEQ ID NO: 3123017 - DNA, 15 bp, Homo sapiens
gaagtttcaagtttt

SEQ ID NO: 3123018 - DNA, 21 bp, Homo sapiens
gaagtttcaagttttaaagtt

SEQ ID NO: 3123019 - DNA, 21 bp, Homo sapiens
gaagtttgtgttctgtttgtt

SEQ ID NO: 3123020 - DNA, 12 bp, Homo sapiens
gaagttttccta

SEQ ID NO: 3123021 - DNA, 12 bp, Homo sapiens
gaagttttgcat

SEQ ID NO: 3123022 - DNA, 15 bp, Homo sapiens
gaagtttttgaaata

SEQ ID NO: 3123023 - DNA, 16 bp, Homo sapiens
gaagtttttgaaatac

SEQ ID NO: 3123024 - DNA, 17 bp, Homo sapiens
gaagtttttgaaatacc

SEQ ID NO: 3123025 - DNA, 14 bp, Homo sapiens
gaagtttttgtact

SEQ ID NO: 3123026 - DNA, 21 bp, Homo sapiens
gaataaaaggcttgaagctgt

SEQ ID NO: 3123027 - DNA, 14 bp, Homo sapiens
gaataaaatcctaa

SEQ ID NO: 3123028 - DNA, 17 bp, Homo sapiens
gaataaaattattttgg

SEQ ID NO: 3123029 - DNA, 15 bp, Homo sapiens
gaataaacacacaga

SEQ ID NO: 3123030 - DNA, 12 bp, Homo sapiens
gaataaactgaa

SEQ ID NO: 3123031 - DNA, 21 bp, Homo sapiens
gaataaactgaatattttgga

SEQ ID NO: 3123032 - DNA, 15 bp, Homo sapiens
gaataaaggcagttt

SEQ ID NO: 3123033 - DNA, 16 bp, Homo sapiens
gaataaaggcagtttt

SEQ ID NO: 3123034 - DNA, 20 bp, Homo sapiens
gaataaaggcagttttctaa

SEQ ID NO: 3123035 - DNA, 13 bp, Homo sapiens
gaataaagttctg

SEQ ID NO: 3123036 - DNA, 22 bp, Homo sapiens
gaataaataaatgtatcttatt

SEQ ID NO: 3123037 - DNA, 17 bp, Homo sapiens
gaataaatgcctttata

SEQ ID NO: 3123038 - DNA, 23 bp, Homo sapiens
gaataaccacttaaaaaatgtcc

SEQ ID NO: 3123039 - DNA, 21 bp, Homo sapiens
gaataactctgtggcattatt

SEQ ID NO: 3123040 - DNA, 19 bp, Homo sapiens
gaataaggaggaggaggga

SEQ ID NO: 3123041 - DNA, 12 bp, Homo sapiens
gaataaggcctt

SEQ ID NO: 3123042 - DNA, 14 bp, Homo sapiens
gaataataaaatca

SEQ ID NO: 3123043 - DNA, 22 bp, Homo sapiens
gaataataattatccagagttt

SEQ ID NO: 3123044 - DNA, 13 bp, Homo sapiens
gaataatggaaac

SEQ ID NO: 3123045 - DNA, 14 bp, Homo sapiens
gaataatggaaaca

SEQ ID NO: 3123046 - DNA, 20 bp, Homo sapiens
gaataattatttatttaata

SEQ ID NO: 3123047 - DNA, 14 bp, Homo sapiens
gaataatttcccaa

SEQ ID NO: 3123048 - DNA, 14 bp, Homo sapiens
gaatacaattaaag

SEQ ID NO: 3123049 - DNA, 14 bp, Homo sapiens
gaatacagaaagat

SEQ ID NO: 3123050 - DNA, 16 bp, Homo sapiens
gaataccacatcaaat

SEQ ID NO: 3123051 - DNA, 19 bp, Homo sapiens
gaataccacatcaaataag

SEQ ID NO: 3123052 - DNA, 22 bp, Homo sapiens
gaataccacatcaaataagaaa

SEQ ID NO: 3123053 - DNA, 18 bp, Homo sapiens
gaataccacttacctcaa

SEQ ID NO: 3123054 - DNA, 12 bp, Homo sapiens
gaatacttattt

SEQ ID NO: 3123055 - DNA, 13 bp, Homo sapiens
gaatacttatttt

SEQ ID NO: 3123056 - DNA, 15 bp, Homo sapiens
gaatactttttaaaa

SEQ ID NO: 3123057 - DNA, 14 bp, Homo sapiens
gaatagaggaagaa

SEQ ID NO: 3123058 - DNA, 16 bp, Homo sapiens
gaatagatatgaaagc

SEQ ID NO: 3123059 - DNA, 17 bp, Homo sapiens
gaatagatcagtatttc

SEQ ID NO: 3123060 - DNA, 15 bp, Homo sapiens
gaatagatgtgatca

SEQ ID NO: 3123061 - DNA, 14 bp, Homo sapiens
gaatagctgggact

SEQ ID NO: 3123062 - DNA, 18 bp, Homo sapiens
gaatagggagacagggta

SEQ ID NO: 3123063 - DNA, 15 bp, Homo sapiens
gaataggtagtatca

SEQ ID NO: 3123064 - DNA, 13 bp, Homo sapiens
gaatataaaaaat

SEQ ID NO: 3123065 - DNA, 15 bp, Homo sapiens
gaatataacatgtaa

SEQ ID NO: 3123066 - DNA, 16 bp, Homo sapiens
gaatatagcctgcctc

SEQ ID NO: 3123067 - DNA, 20 bp, Homo sapiens
gaatataggtctcttctccc

SEQ ID NO: 3123068 - DNA, 22 bp, Homo sapiens
gaatataggtctcttctcccag

SEQ ID NO: 3123069 - DNA, 17 bp, Homo sapiens
gaatatatttatttaaa

SEQ ID NO: 3123070 - DNA, 21 bp, Homo sapiens
gaatatatttatttaaagcat

SEQ ID NO: 3123071 - DNA, 20 bp, Homo sapiens
gaatatcatctgtcattata

SEQ ID NO: 3123072 - DNA, 16 bp, Homo sapiens
gaatatcattgatttt

SEQ ID NO: 3123073 - DNA, 16 bp, Homo sapiens
gaatatccatgaccta

SEQ ID NO: 3123074 - DNA, 14 bp, Homo sapiens
gaatatctgggatt

SEQ ID NO: 3123075 - DNA, 17 bp, Homo sapiens
gaatatctgtaatggta

SEQ ID NO: 3123076 - DNA, 19 bp, Homo sapiens
gaatatgacggaagaacat

SEQ ID NO: 3123077 - DNA, 15 bp, Homo sapiens
gaatatgtttccttg

SEQ ID NO: 3123078 - DNA, 18 bp, Homo sapiens
gaatattcccaagcccat

SEQ ID NO: 3123079 - DNA, 17 bp, Homo sapiens
gaatattgatgttaaca

SEQ ID NO: 3123080 - DNA, 22 bp, Homo sapiens
gaatattgctttggtcatatga

SEQ ID NO: 3123081 - DNA, 12 bp, Homo sapiens
gaatattgtgtt

SEQ ID NO: 3123082 - DNA, 15 bp, Homo sapiens
gaatatttataacag

SEQ ID NO: 3123083 - DNA, 16 bp, Homo sapiens
gaatatttataacagc

SEQ ID NO: 3123084 - DNA, 19 bp, Homo sapiens
gaatatttataggccaggg

SEQ ID NO: 3123085 - DNA, 12 bp, Homo sapiens
gaatatttatta

SEQ ID NO: 3123086 - DNA, 18 bp, Homo sapiens
gaatatttattacctctg

SEQ ID NO: 3123087 - DNA, 21 bp, Homo sapiens
gaatatttattacctctgata

SEQ ID NO: 3123088 - DNA, 17 bp, Homo sapiens
gagtgtggaagccggag

SEQ ID NO: 3123089 - DNA, 16 bp, Homo sapiens
gagtgtgtattgttcc

SEQ ID NO: 3123090 - DNA, 18 bp, Homo sapiens
gagtgtgtattgttccca

SEQ ID NO: 3123091 - DNA, 22 bp, Homo sapiens
gagtgtttgtgtctgactcagg

SEQ ID NO: 3123092 - DNA, 17 bp, Homo sapiens
gagttaaaaagggcagg

SEQ ID NO: 3123093 - DNA, 13 bp, Homo sapiens
gagttaaaatgca

SEQ ID NO: 3123094 - DNA, 20 bp, Homo sapiens
gagttaactgtgaaatacca

SEQ ID NO: 3123095 - DNA, 21 bp, Homo sapiens
gagttaagaagctgttgtaca

SEQ ID NO: 3123096 - DNA, 15 bp, Homo sapiens
gagttacagttctgt

SEQ ID NO: 3123097 - DNA, 17 bp, Homo sapiens
gagttacagttctgtgg

SEQ ID NO: 3123098 - DNA, 18 bp, Homo sapiens
gagttaggggccttaggg

SEQ ID NO: 3123099 - DNA, 15 bp, Homo sapiens
gagttaggtcctcac

SEQ ID NO: 3123100 - DNA, 17 bp, Homo sapiens
gagttatagtttgcttt

SEQ ID NO: 3123101 - DNA, 19 bp, Homo sapiens
gagttatcatgaattttaa

SEQ ID NO: 3123102 - DNA, 23 bp, Homo sapiens
gagttatcatgaattttaaagta

SEQ ID NO: 3123103 - DNA, 18 bp, Homo sapiens
gagttatctaaaagaaat

SEQ ID NO: 3123104 - DNA, 21 bp, Homo sapiens
gagttattgaatcttaatttt

SEQ ID NO: 3123105 - DNA, 22 bp, Homo sapiens
gagttcaataaatgtctgttga

SEQ ID NO: 3123106 - DNA, 20 bp, Homo sapiens
gagttcataccctgttacca

SEQ ID NO: 3123107 - DNA, 13 bp, Homo sapiens
gagttcatcccag

SEQ ID NO: 3123108 - DNA, 16 bp, Homo sapiens
gagttccacagattgt

SEQ ID NO: 3123109 - DNA, 15 bp, Homo sapiens
gagttcctcgctctg

SEQ ID NO: 3123110 - DNA, 23 bp, Homo sapiens
gagttcctgcggagtgaagaggg

SEQ ID NO: 3123111 - DNA, 20 bp, Homo sapiens
gagttcgagaccagcctggc

SEQ ID NO: 3123112 - DNA, 21 bp, Homo sapiens
gagttcgagaccagcctggcc

SEQ ID NO: 3123113 - DNA, 14 bp, Homo sapiens
gagttctagaacca

SEQ ID NO: 3123114 - DNA, 15 bp, Homo sapiens
gaggggatccagcca

SEQ ID NO: 3123115 - DNA, 18 bp, Homo sapiens
gaggggatggggatagag

SEQ ID NO: 3123116 - DNA, 23 bp, Homo sapiens
gaggggcaagctaggccccagag

SEQ ID NO: 3123117 - DNA, 13 bp, Homo sapiens
gaggggcagccct

SEQ ID NO: 3123118 - DNA, 13 bp, Homo sapiens
gaggggccaggcc

SEQ ID NO: 3123119 - DNA, 20 bp, Homo sapiens
gaggggcccggtggcggcag

SEQ ID NO: 3123120 - DNA, 13 bp, Homo sapiens
gaggggccctggc

SEQ ID NO: 3123121 - DNA, 18 bp, Homo sapiens
gaggggccctggccagga

SEQ ID NO: 3123122 - DNA, 19 bp, Homo sapiens
gaggggccctggccaggac

SEQ ID NO: 3123123 - DNA, 13 bp, Homo sapiens
gaggggcctggag

SEQ ID NO: 3123124 - DNA, 20 bp, Homo sapiens
gaggggcctggcagccgtgc

SEQ ID NO: 3123125 - DNA, 11 bp, Homo sapiens
gaggggcgcgg

SEQ ID NO: 3123126 - DNA, 14 bp, Homo sapiens
gaggggcgcgggag

SEQ ID NO: 3123127 - DNA, 14 bp, Homo sapiens
gaggggcgctggcc

SEQ ID NO: 3123128 - DNA, 16 bp, Homo sapiens
gaggggcgctggccca

SEQ ID NO: 3123129 - DNA, 22 bp, Homo sapiens
gaggggcgctggcccagccggc

SEQ ID NO: 3123130 - DNA, 14 bp, Homo sapiens
gaggggctcctgga

SEQ ID NO: 3123131 - DNA, 12 bp, Homo sapiens
gaggggctctca

SEQ ID NO: 3123132 - DNA, 23 bp, Homo sapiens
gaggggctggggacttgtgtctg

SEQ ID NO: 3123133 - DNA, 21 bp, Homo sapiens
gagggggccgggcgcggtggc

SEQ ID NO: 3123134 - DNA, 16 bp, Homo sapiens
gagggggcgctcagga

SEQ ID NO: 3123135 - DNA, 14 bp, Homo sapiens
gaggggggggtggg

SEQ ID NO: 3123136 - DNA, 15 bp, Homo sapiens
gagggggttacaaac

SEQ ID NO: 3123137 - DNA, 16 bp, Homo sapiens
gaggggtctcggatga

SEQ ID NO: 3123138 - DNA, 23 bp, Homo sapiens
gaggggtctcggatgacaccctg

SEQ ID NO: 3123139 - DNA, 20 bp, Homo sapiens
gaggggtgagtcccctactc

SEQ ID NO: 3123140 - DNA, 21 bp, Homo sapiens
gaggggtgagtcccctactcc

SEQ ID NO: 3123141 - DNA, 23 bp, Homo sapiens
gaggggtgagtcccctactccct

SEQ ID NO: 3123142 - DNA, 15 bp, Homo sapiens
gaggggtgcacccac

SEQ ID NO: 3123143 - DNA, 15 bp, Homo sapiens
gaggggtgggctggt

SEQ ID NO: 3123144 - DNA, 14 bp, Homo sapiens
gaggggtgtggcag

SEQ ID NO: 3123145 - DNA, 22 bp, Homo sapiens
gaggggttgccacaggcctccc

SEQ ID NO: 3123146 - DNA, 23 bp, Homo sapiens
gaggggttgccacaggcctccct

SEQ ID NO: 3123147 - DNA, 19 bp, Homo sapiens
gagggtcaggactgtgact

SEQ ID NO: 3123148 - DNA, 15 bp, Homo sapiens
gagggtcctggctcc

SEQ ID NO: 3123149 - DNA, 17 bp, Homo sapiens
gagggtcctggctcctg

SEQ ID NO: 3123150 - DNA, 21 bp, Homo sapiens
gagggtcctggctcctgaggg

SEQ ID NO: 3123151 - DNA, 13 bp, Homo sapiens
gagggtctgagga

SEQ ID NO: 3123152 - DNA, 17 bp, Homo sapiens
gagggtgaaaggcaggg

SEQ ID NO: 3123153 - DNA, 20 bp, Homo sapiens
gagggtgaaggaggtcaggc

SEQ ID NO: 3123154 - DNA, 11 bp, Homo sapiens
gagggtgactg

SEQ ID NO: 3123155 - DNA, 20 bp, Homo sapiens
gagggtggagactaagccct

SEQ ID NO: 3123156 - DNA, 18 bp, Homo sapiens
gagggtgggagagcccag

SEQ ID NO: 3123157 - DNA, 19 bp, Homo sapiens
gagggtgggagagcccagc

SEQ ID NO: 3123158 - DNA, 14 bp, Homo sapiens
gagggtggtgacct

SEQ ID NO: 3123159 - DNA, 14 bp, Homo sapiens
gagggttcccctgg

SEQ ID NO: 3123160 - DNA, 21 bp, Homo sapiens
gagggttcctcttaggtcaga

SEQ ID NO: 3123161 - DNA, 24 bp, Homo sapiens
gagggttcctcttaggtcagatgg

SEQ ID NO: 3123162 - DNA, 13 bp, Homo sapiens
gagggttgtgcta

SEQ ID NO: 3123163 - DNA, 21 bp, Homo sapiens
gagggttttaggtagaaaaac

SEQ ID NO: 3123164 - DNA, 15 bp, Homo sapiens
gaggtaaagatatgg

SEQ ID NO: 3123165 - DNA, 18 bp, Homo sapiens
gaggtaacagaacagctt

SEQ ID NO: 3123166 - DNA, 14 bp, Homo sapiens
gaggtataaagaca

SEQ ID NO: 3123167 - DNA, 17 bp, Homo sapiens
gaggtataaagacaagt

SEQ ID NO: 3123168 - DNA, 14 bp, Homo sapiens
gaggtattaaaact

SEQ ID NO: 3123169 - DNA, 19 bp, Homo sapiens
gaggtatttatctttactt

SEQ ID NO: 3123170 - DNA, 19 bp, Homo sapiens
gaggtcaaggctgcagtga

SEQ ID NO: 3123171 - DNA, 20 bp, Homo sapiens
gaggtcaccaggggaggagc

SEQ ID NO: 3123172 - DNA, 17 bp, Homo sapiens
gaggtcactggaaaggg

SEQ ID NO: 3123173 - DNA, 18 bp, Homo sapiens
gaggtcactggaaagggg

SEQ ID NO: 3123174 - DNA, 21 bp, Homo sapiens
gaggtcactggaaaggggaga

SEQ ID NO: 3123175 - DNA, 20 bp, Homo sapiens
gaggtcagagcctgcagtta

SEQ ID NO: 3123176 - DNA, 23 bp, Homo sapiens
gaggtcagcatgtctattcagct

SEQ ID NO: 3123177 - DNA, 23 bp, Homo sapiens
gaggtcaggaagcaggggtgggg

SEQ ID NO: 3123178 - DNA, 11 bp, Homo sapiens
gaggtcaggga

SEQ ID NO: 3123179 - DNA, 14 bp, Homo sapiens
gaggtcagggagtg

SEQ ID NO: 3123180 - DNA, 22 bp, Homo sapiens
gaggtcagggagtgctggctca

SEQ ID NO: 3123181 - DNA, 23 bp, Homo sapiens
gaggtcagggagtgctggctcac

SEQ ID NO: 3123182 - DNA, 19 bp, Homo sapiens
gaggtccaccggcccctgg

SEQ ID NO: 3123183 - DNA, 12 bp, Homo sapiens
gaggtccagccc

SEQ ID NO: 3123184 - DNA, 14 bp, Homo sapiens
gaggtccagcccat

SEQ ID NO: 3123185 - DNA, 13 bp, Homo sapiens
gaggtcccaggaa

SEQ ID NO: 3123186 - DNA, 10 bp, Homo sapiens
gaggtccctg

SEQ ID NO: 3123187 - DNA, 23 bp, Homo sapiens
gaggtccctgtgtgtaggctggg

SEQ ID NO: 3123188 - DNA, 14 bp, Homo sapiens
gaggtcctctggag

SEQ ID NO: 3123189 - DNA, 22 bp, Homo sapiens
gaggtcggtaggttcagccaag

SEQ ID NO: 3123190 - DNA, 23 bp, Homo sapiens
gaggtcggtaggttcagccaagg

SEQ ID NO: 3123191 - DNA, 12 bp, Homo sapiens
gaggtctatttt

SEQ ID NO: 3123192 - DNA, 18 bp, Homo sapiens
gaggtctcttgagggagc

SEQ ID NO: 3123193 - DNA, 12 bp, Homo sapiens
gaggtctgagcc

SEQ ID NO: 3123194 - DNA, 13 bp, Homo sapiens
gaggtctgagccc

SEQ ID NO: 3123195 - DNA, 14 bp, Homo sapiens
gaggtctgagccct

SEQ ID NO: 3123196 - DNA, 15 bp, Homo sapiens
gaggtctgagccctg

SEQ ID NO: 3123197 - DNA, 16 bp, Homo sapiens
gaggtctgagccctgg

SEQ ID NO: 3123198 - DNA, 16 bp, Homo sapiens
gaggtgaaagggagct

SEQ ID NO: 3123199 - DNA, 21 bp, Homo sapiens
gaggtgcctgtcccaccccca

SEQ ID NO: 3123200 - DNA, 13 bp, Homo sapiens
gaggtggaagaag

SEQ ID NO: 3123201 - DNA, 16 bp, Homo sapiens
gaggtggaagaaggga

SEQ ID NO: 3123202 - DNA, 17 bp, Homo sapiens
gaggtggaagaagggag

SEQ ID NO: 3123203 - DNA, 18 bp, Homo sapiens
gaggtggcagccctgtag

SEQ ID NO: 3123204 - DNA, 22 bp, Homo sapiens
gaggtggccagagctgggaggc

SEQ ID NO: 3123205 - DNA, 13 bp, Homo sapiens
gaggtgggagcag

SEQ ID NO: 3123206 - DNA, 14 bp, Homo sapiens
gaggtgggagcagg

SEQ ID NO: 3123207 - DNA, 15 bp, Homo sapiens
gaggtgggagcagga

SEQ ID NO: 3123208 - DNA, 13 bp, Homo sapiens
gaggtgggagggc

SEQ ID NO: 3123209 - DNA, 17 bp, Homo sapiens
gaggtgggatcctccct

SEQ ID NO: 3123210 - DNA, 12 bp, Homo sapiens
gaggtgggcagc

SEQ ID NO: 3123211 - DNA, 19 bp, Homo sapiens
gaggtgggcagctgggccc

SEQ ID NO: 3123212 - DNA, 20 bp, Homo sapiens
gaggaggccacctctccaag

SEQ ID NO: 3123213 - DNA, 14 bp, Homo sapiens
gaggaggccgcctc

SEQ ID NO: 3123214 - DNA, 17 bp, Homo sapiens
gaggaggcctgcacagg

SEQ ID NO: 3123215 - DNA, 17 bp, Homo sapiens
gaggagggagaagagaa

SEQ ID NO: 3123216 - DNA, 14 bp, Homo sapiens
gaggagggatgctg

SEQ ID NO: 3123217 - DNA, 15 bp, Homo sapiens
gaggaggtgcctgga

SEQ ID NO: 3123218 - DNA, 20 bp, Homo sapiens
gaggaggtggcagccctgta

SEQ ID NO: 3123219 - DNA, 15 bp, Homo sapiens
gaggaggtgtgagga

SEQ ID NO: 3123220 - DNA, 21 bp, Homo sapiens
gaggaggtgtgaggaggaggc

SEQ ID NO: 3123221 - DNA, 21 bp, Homo sapiens
gaggagtaaaattcagttttt

SEQ ID NO: 3123222 - DNA, 20 bp, Homo sapiens
gaggagtaacaatacaaatg

SEQ ID NO: 3123223 - DNA, 22 bp, Homo sapiens
gaggagtaacaatacaaatgga

SEQ ID NO: 3123224 - DNA, 20 bp, Homo sapiens
gaggatcactggagcccagg

SEQ ID NO: 3123225 - DNA, 14 bp, Homo sapiens
gaggatcagttttt

SEQ ID NO: 3123226 - DNA, 22 bp, Homo sapiens
gaggatgaatagatgtgatcac

SEQ ID NO: 3123227 - DNA, 14 bp, Homo sapiens
gaggatggccagtg

SEQ ID NO: 3123228 - DNA, 19 bp, Homo sapiens
gaggatgtccctgggccag

SEQ ID NO: 3123229 - DNA, 20 bp, Homo sapiens
gaggatgttctgggacacag

SEQ ID NO: 3123230 - DNA, 14 bp, Homo sapiens
gaggattattgata

SEQ ID NO: 3123231 - DNA, 16 bp, Homo sapiens
gaggattcaggggctg

SEQ ID NO: 3123232 - DNA, 14 bp, Homo sapiens
gaggcaacaggatt

SEQ ID NO: 3123233 - DNA, 13 bp, Homo sapiens
gaggcaagaaaag

SEQ ID NO: 3123234 - DNA, 15 bp, Homo sapiens
gaggcaagaaaagga

SEQ ID NO: 3123235 - DNA, 13 bp, Homo sapiens
gaggcaagagaat

SEQ ID NO: 3123236 - DNA, 19 bp, Homo sapiens
gaggcaccagctctgtggc

SEQ ID NO: 3123237 - DNA, 22 bp, Homo sapiens
gaggcaccagctctgtggcctg

SEQ ID NO: 3123238 - DNA, 16 bp, Homo sapiens
gaggcaccggcgctgc

SEQ ID NO: 3123239 - DNA, 19 bp, Homo sapiens
gaggcaccggcgctgcagg

SEQ ID NO: 3123240 - DNA, 13 bp, Homo sapiens
gaggcagagagcg

SEQ ID NO: 3123241 - DNA, 12 bp, Homo sapiens
gaggcagagttt

SEQ ID NO: 3123242 - DNA, 13 bp, Homo sapiens
gaggcagccccat

SEQ ID NO: 3123243 - DNA, 20 bp, Homo sapiens
gaggcagccccattctgcct

SEQ ID NO: 3123244 - DNA, 9 bp, Homo sapiens
gaggcaggg

SEQ ID NO: 3123245 - DNA, 16 bp, Homo sapiens
gaggcagggaggggac

SEQ ID NO: 3123246 - DNA, 19 bp, Homo sapiens
gaggcagggcaaatgacat

SEQ ID NO: 3123247 - DNA, 23 bp, Homo sapiens
gaggcagggcaaatgacatgcac

SEQ ID NO: 3123248 - DNA, 22 bp, Homo sapiens
gaggcagggtctcactctgtcg

SEQ ID NO: 3123249 - DNA, 15 bp, Homo sapiens
gaggcaggtgagaga

SEQ ID NO: 3123250 - DNA, 22 bp, Homo sapiens
gaggcagttgacggggcagtca

SEQ ID NO: 3123251 - DNA, 15 bp, Homo sapiens
gaggcatggccctgg

SEQ ID NO: 3123252 - DNA, 18 bp, Homo sapiens
gaggcatggccctggggt

SEQ ID NO: 3123253 - DNA, 14 bp, Homo sapiens
gaggcattcgggga

SEQ ID NO: 3123254 - DNA, 16 bp, Homo sapiens
gaggcattcggggaag

SEQ ID NO: 3123255 - DNA, 17 bp, Homo sapiens
gaggccaataaaaagtt

SEQ ID NO: 3123256 - DNA, 15 bp, Homo sapiens
gaggccacctctcca

SEQ ID NO: 3123257 - DNA, 16 bp, Homo sapiens
gaggccacctctccaa

SEQ ID NO: 3123258 - DNA, 17 bp, Homo sapiens
gaggccacctctccaag

SEQ ID NO: 3123259 - DNA, 21 bp, Homo sapiens
gaggccagaggcccccagccc

SEQ ID NO: 3123260 - DNA, 14 bp, Homo sapiens
gaggccagccccac

SEQ ID NO: 3123261 - DNA, 16 bp, Homo sapiens
gaggccagccccaccc

SEQ ID NO: 3123262 - DNA, 21 bp, Homo sapiens
gaggccagccccacccaggag

SEQ ID NO: 3123263 - DNA, 17 bp, Homo sapiens
gaggccagtacctttcc

SEQ ID NO: 3123264 - DNA, 12 bp, Homo sapiens
gaggccagtggg

SEQ ID NO: 3123265 - DNA, 16 bp, Homo sapiens
gaggccatctcaggag

SEQ ID NO: 3123266 - DNA, 14 bp, Homo sapiens
gaggccatgggcct

SEQ ID NO: 3123267 - DNA, 19 bp, Homo sapiens
gaggcccagcgggcagatg

SEQ ID NO: 3123268 - DNA, 20 bp, Homo sapiens
gaggcccagcgggcagatgg

SEQ ID NO: 3123269 - DNA, 16 bp, Homo sapiens
gaggcccaggctggga

SEQ ID NO: 3123270 - DNA, 14 bp, Homo sapiens
gaggccccagctct

SEQ ID NO: 3123271 - DNA, 16 bp, Homo sapiens
gaggcccccagcccag

SEQ ID NO: 3123272 - DNA, 13 bp, Homo sapiens
gaggcccccgacc

SEQ ID NO: 3123273 - DNA, 17 bp, Homo sapiens
gaggccccttctctccc

SEQ ID NO: 3123274 - DNA, 10 bp, Homo sapiens
gaggccctgg

SEQ ID NO: 3123275 - DNA, 11 bp, Homo sapiens
gaggccctggc

SEQ ID NO: 3123276 - DNA, 15 bp, Homo sapiens
gaggccctggccctt

SEQ ID NO: 3123277 - DNA, 18 bp, Homo sapiens
gaggccctggccctttcc

SEQ ID NO: 3123278 - DNA, 19 bp, Homo sapiens
gaggccgaaggtgcctcag

SEQ ID NO: 3123279 - DNA, 20 bp, Homo sapiens
gaggccgaaggtgcctcaga

SEQ ID NO: 3123280 - DNA, 23 bp, Homo sapiens
gaggcctcagtttctccatcagc

SEQ ID NO: 3123281 - DNA, 13 bp, Homo sapiens
gaggcctcatccc

SEQ ID NO: 3123282 - DNA, 16 bp, Homo sapiens
gaggcctcatgcctgc

SEQ ID NO: 3123283 - DNA, 13 bp, Homo sapiens
gaggcctctggcc

SEQ ID NO: 3123284 - DNA, 16 bp, Homo sapiens
gaggcctctggccctc

SEQ ID NO: 3123285 - DNA, 14 bp, Homo sapiens
gaggcctgaggcct

SEQ ID NO: 3123286 - DNA, 15 bp, Homo sapiens
gaggcctgatgctgc

SEQ ID NO: 3123287 - DNA, 23 bp, Homo sapiens
gaggcctgcaaaccttcctggga

SEQ ID NO: 3123288 - DNA, 21 bp, Homo sapiens
gaggcctgctgccagtgcagc

SEQ ID NO: 3123289 - DNA, 18 bp, Homo sapiens
gaggcctggactttcctg

SEQ ID NO: 3123290 - DNA, 22 bp, Homo sapiens
gaggcctgggccgctgccacgt

SEQ ID NO: 3123291 - DNA, 21 bp, Homo sapiens
gaggcctggggccggtagagg

SEQ ID NO: 3123292 - DNA, 14 bp, Homo sapiens
gaggccttctctga

SEQ ID NO: 3123293 - DNA, 16 bp, Homo sapiens
gaggccttctctgaag

SEQ ID NO: 3123294 - DNA, 14 bp, Homo sapiens
gaggcggcccggcc

SEQ ID NO: 3123295 - DNA, 14 bp, Homo sapiens
gaggcgggccagcc

SEQ ID NO: 3123296 - DNA, 15 bp, Homo sapiens
gaggcgggccagcca

SEQ ID NO: 3123297 - DNA, 12 bp, Homo sapiens
gaggcgggtgga

SEQ ID NO: 3123298 - DNA, 15 bp, Homo sapiens
gaggcggtttcctga

SEQ ID NO: 3123299 - DNA, 23 bp, Homo sapiens
gaggctaagatgagatttgccag

SEQ ID NO: 3123300 - DNA, 14 bp, Homo sapiens
gaggctccaggact

SEQ ID NO: 3123301 - DNA, 16 bp, Homo sapiens
gaggctctttctgggc

SEQ ID NO: 3123302 - DNA, 22 bp, Homo sapiens
gaggctgagcctacagatgaac

SEQ ID NO: 3123303 - DNA, 16 bp, Homo sapiens
gaggctgaggcaagag

SEQ ID NO: 3123304 - DNA, 15 bp, Homo sapiens
gaggctgaggcagga

SEQ ID NO: 3123305 - DNA, 14 bp, Homo sapiens
gaggctgaggcctg

SEQ ID NO: 3123306 - DNA, 18 bp, Homo sapiens
gaggctgaggcctggact

SEQ ID NO: 3123307 - DNA, 12 bp, Homo sapiens
gaggctgaggcg

SEQ ID NO: 3123308 - DNA, 14 bp, Homo sapiens
gaggctgcccctct

SEQ ID NO: 3123309 - DNA, 19 bp, Homo sapiens
gaggctgcccctctcacca

SEQ ID NO: 3123310 - DNA, 15 bp, Homo sapiens
gaggctggaggaagg

SEQ ID NO: 3123311 - DNA, 17 bp, Homo sapiens
gaggctgggcccctggg

SEQ ID NO: 3123312 - DNA, 18 bp, Homo sapiens
gaggctggtgccaggcgc

SEQ ID NO: 3123313 - DNA, 17 bp, Homo sapiens
gaggctgtcacagtcct

SEQ ID NO: 3123314 - DNA, 15 bp, Homo sapiens
gaggctgtctggggc

SEQ ID NO: 3123315 - DNA, 22 bp, Homo sapiens
gaggctgtgtgcctgggggagt

SEQ ID NO: 3123316 - DNA, 14 bp, Homo sapiens
gaggcttccaggct

SEQ ID NO: 3123317 - DNA, 15 bp, Homo sapiens
gaggcttccaggctc

SEQ ID NO: 3123318 - DNA, 15 bp, Homo sapiens
gaggcttcctgcgtc

SEQ ID NO: 3123319 - DNA, 13 bp, Homo sapiens
gaggcttctcctg

SEQ ID NO: 3123320 - DNA, 23 bp, Homo sapiens
gaggcttctcctgttttatatat

SEQ ID NO: 3123321 - DNA, 15 bp, Homo sapiens
gaggcttggaaagca

SEQ ID NO: 3123322 - DNA, 19 bp, Homo sapiens
gaggcttgtttacctttct

SEQ ID NO: 3123323 - DNA, 15 bp, Homo sapiens
gaggcttttcactgc

SEQ ID NO: 3123324 - DNA, 15 bp, Homo sapiens
gagggaaagtgcata

SEQ ID NO: 3123325 - DNA, 14 bp, Homo sapiens
gagggaagggacgg

SEQ ID NO: 3123326 - DNA, 19 bp, Homo sapiens
gagggaagtgtgagcgcct

SEQ ID NO: 3123327 - DNA, 22 bp, Homo sapiens
gagggaagtgtgagcgccttgg

SEQ ID NO: 3123328 - DNA, 21 bp, Homo sapiens
gagggaatgttccctgcaccc

SEQ ID NO: 3123329 - DNA, 15 bp, Homo sapiens
gagggacaagggatt

SEQ ID NO: 3123330 - DNA, 17 bp, Homo sapiens
gagggacaggctgaaga

SEQ ID NO: 3123331 - DNA, 20 bp, Homo sapiens
gagggacaggctgaagagag

SEQ ID NO: 3123332 - DNA, 17 bp, Homo sapiens
gagggaccaactgggcc

SEQ ID NO: 3123333 - DNA, 15 bp, Homo sapiens
gagggaccatgtgtc

SEQ ID NO: 3123334 - DNA, 21 bp, Homo sapiens
gagggactttgctgatttccc

SEQ ID NO: 3123335 - DNA, 12 bp, Homo sapiens
gagggagaagag

SEQ ID NO: 3123336 - DNA, 13 bp, Homo sapiens
gagggagagggag

SEQ ID NO: 3123337 - DNA, 15 bp, Homo sapiens
gagggagatctttcc

SEQ ID NO: 3123338 - DNA, 14 bp, Homo sapiens
gagggagcaagccc

SEQ ID NO: 3123339 - DNA, 19 bp, Homo sapiens
gagggagcaagccctactc

SEQ ID NO: 3123340 - DNA, 13 bp, Homo sapiens
gagggagccttgt

SEQ ID NO: 3123341 - DNA, 15 bp, Homo sapiens
gagggagcttagcca

SEQ ID NO: 3123342 - DNA, 17 bp, Homo sapiens
gagggagggggaagtcg

SEQ ID NO: 3123343 - DNA, 20 bp, Homo sapiens
gaccctgtcttctgggcaca

SEQ ID NO: 3123344 - DNA, 23 bp, Homo sapiens
gacccttaggatggggctcccag

SEQ ID NO: 3123345 - DNA, 14 bp, Homo sapiens
gacccttcagggcc

SEQ ID NO: 3123346 - DNA, 17 bp, Homo sapiens
gacccttcagggccaga

SEQ ID NO: 3123347 - DNA, 21 bp, Homo sapiens
gacccttcccaatcagcactg

SEQ ID NO: 3123348 - DNA, 22 bp, Homo sapiens
gaccctttgcctttcttctgcc

SEQ ID NO: 3123349 - DNA, 18 bp, Homo sapiens
gaccgactaccccagtcc

SEQ ID NO: 3123350 - DNA, 18 bp, Homo sapiens
gaccgaggacacagtgga

SEQ ID NO: 3123351 - DNA, 12 bp, Homo sapiens
gaccgcacttat

SEQ ID NO: 3123352 - DNA, 16 bp, Homo sapiens
gaccgcttcacccctg

SEQ ID NO: 3123353 - DNA, 21 bp, Homo sapiens
gaccgggcctcccctccatgg

SEQ ID NO: 3123354 - DNA, 17 bp, Homo sapiens
gaccgggtgggcctggc

SEQ ID NO: 3123355 - DNA, 18 bp, Homo sapiens
gaccgggtgggcctggcc

SEQ ID NO: 3123356 - DNA, 16 bp, Homo sapiens
gaccgtactctcacat

SEQ ID NO: 3123357 - DNA, 14 bp, Homo sapiens
gaccgtggacaggc

SEQ ID NO: 3123358 - DNA, 17 bp, Homo sapiens
gaccgtggacaggccca

SEQ ID NO: 3123359 - DNA, 16 bp, Homo sapiens
gaccgtgtcccaagga

SEQ ID NO: 3123360 - DNA, 16 bp, Homo sapiens
gacctaaatggcctca

SEQ ID NO: 3123361 - DNA, 17 bp, Homo sapiens
gacctaacattcgatct

SEQ ID NO: 3123362 - DNA, 14 bp, Homo sapiens
gacctacattccct

SEQ ID NO: 3123363 - DNA, 19 bp, Homo sapiens
gacctacattccctctcct

SEQ ID NO: 3123364 - DNA, 16 bp, Homo sapiens
gacctaccaggacaga

SEQ ID NO: 3123365 - DNA, 18 bp, Homo sapiens
gacctaccaggacagaac

SEQ ID NO: 3123366 - DNA, 13 bp, Homo sapiens
gacctacctcagg

SEQ ID NO: 3123367 - DNA, 16 bp, Homo sapiens
gacctacctcaggttg

SEQ ID NO: 3123368 - DNA, 19 bp, Homo sapiens
gacctacctgcagtgggaa

SEQ ID NO: 3123369 - DNA, 13 bp, Homo sapiens
gacctactctcat

SEQ ID NO: 3123370 - DNA, 13 bp, Homo sapiens
gacctagcaggga

SEQ ID NO: 3123371 - DNA, 17 bp, Homo sapiens
gacctagggaggacctt

SEQ ID NO: 3123372 - DNA, 21 bp, Homo sapiens
gacctagggaggaccttatct

SEQ ID NO: 3123373 - DNA, 19 bp, Homo sapiens
gacctattcaccctccact

SEQ ID NO: 3123374 - DNA, 20 bp, Homo sapiens
gacctcacagtgacccttcc

SEQ ID NO: 3123375 - DNA, 21 bp, Homo sapiens
gacctcacagtgacccttccc

SEQ ID NO: 3123376 - DNA, 19 bp, Homo sapiens
gacctcaggcactagcctt

SEQ ID NO: 3123377 - DNA, 20 bp, Homo sapiens
gacctcaggtgatccaccca

SEQ ID NO: 3123378 - DNA, 21 bp, Homo sapiens
gacctcagttttatcattttc

SEQ ID NO: 3123379 - DNA, 15 bp, Homo sapiens
gacctcatctgtgga

SEQ ID NO: 3123380 - DNA, 17 bp, Homo sapiens
gacctcatctgtggagc

SEQ ID NO: 3123381 - DNA, 19 bp, Homo sapiens
gacctccaataaagtgcct

SEQ ID NO: 3123382 - DNA, 14 bp, Homo sapiens
gacctcccagccct

SEQ ID NO: 3123383 - DNA, 15 bp, Homo sapiens
gacctcccagcccta

SEQ ID NO: 3123384 - DNA, 22 bp, Homo sapiens
gacctcccagccctatggatgt

SEQ ID NO: 3123385 - DNA, 13 bp, Homo sapiens
gacctccccagcc

SEQ ID NO: 3123386 - DNA, 12 bp, Homo sapiens
gacctcccttcc

SEQ ID NO: 3123387 - DNA, 20 bp, Homo sapiens
gacctcccttccgaccctct

SEQ ID NO: 3123388 - DNA, 22 bp, Homo sapiens
gacctcccttccgaccctctgg

SEQ ID NO: 3123389 - DNA, 15 bp, Homo sapiens
gacctccgcccctgc

SEQ ID NO: 3123390 - DNA, 20 bp, Homo sapiens
gacctcctcttcccccttcc

SEQ ID NO: 3123391 - DNA, 19 bp, Homo sapiens
gacctccttagccctgtct

SEQ ID NO: 3123392 - DNA, 20 bp, Homo sapiens
gacctccttagccctgtctg

SEQ ID NO: 3123393 - DNA, 13 bp, Homo sapiens
gacctctcagcag

SEQ ID NO: 3123394 - DNA, 15 bp, Homo sapiens
gacctctcagcagaa

SEQ ID NO: 3123395 - DNA, 19 bp, Homo sapiens
gacctctcagcagaaacac

SEQ ID NO: 3123396 - DNA, 14 bp, Homo sapiens
gacctctcagggcc

SEQ ID NO: 3123397 - DNA, 18 bp, Homo sapiens
gacctctcagggcctggc

SEQ ID NO: 3123398 - DNA, 19 bp, Homo sapiens
gacctctcagggcctggca

SEQ ID NO: 3123399 - DNA, 13 bp, Homo sapiens
gacctctgcctga

SEQ ID NO: 3123400 - DNA, 13 bp, Homo sapiens
gacctcttgctgt

SEQ ID NO: 3123401 - DNA, 15 bp, Homo sapiens
gacctcttgctgtct

SEQ ID NO: 3123402 - DNA, 16 bp, Homo sapiens
gacctcttgctgtctc

SEQ ID NO: 3123403 - DNA, 14 bp, Homo sapiens
gacctgaggagaca

SEQ ID NO: 3123404 - DNA, 17 bp, Homo sapiens
gacctgagtcggcccca

SEQ ID NO: 3123405 - DNA, 18 bp, Homo sapiens
gacctgatttcagaagag

SEQ ID NO: 3123406 - DNA, 21 bp, Homo sapiens
gacctgatttcagaagagact

SEQ ID NO: 3123407 - DNA, 20 bp, Homo sapiens
gacctgcactggggagcccg

SEQ ID NO: 3123408 - DNA, 22 bp, Homo sapiens
gagctgcctgttcagctccagc

SEQ ID NO: 3123409 - DNA, 12 bp, Homo sapiens
gagctgctggct

SEQ ID NO: 3123410 - DNA, 13 bp, Homo sapiens
gagctggaagggg

SEQ ID NO: 3123411 - DNA, 22 bp, Homo sapiens
gagctggaaggggccacgtgga

SEQ ID NO: 3123412 - DNA, 17 bp, Homo sapiens
gagctggctctgagcgc

SEQ ID NO: 3123413 - DNA, 21 bp, Homo sapiens
gagctgggacacttaacagat

SEQ ID NO: 3123414 - DNA, 11 bp, Homo sapiens
gagctgggccc

SEQ ID NO: 3123415 - DNA, 15 bp, Homo sapiens
gagctgggcccagcc

SEQ ID NO: 3123416 - DNA, 12 bp, Homo sapiens
gagctgggcccc

SEQ ID NO: 3123417 - DNA, 15 bp, Homo sapiens
gagctggggacctgg

SEQ ID NO: 3123418 - DNA, 19 bp, Homo sapiens
gagctggggacctggtacc

SEQ ID NO: 3123419 - DNA, 18 bp, Homo sapiens
gagctggggactcaggga

SEQ ID NO: 3123420 - DNA, 13 bp, Homo sapiens
gagctggggccac

SEQ ID NO: 3123421 - DNA, 19 bp, Homo sapiens
gagctggggtacaggtttg

SEQ ID NO: 3123422 - DNA, 12 bp, Homo sapiens
gagctgggtggc

SEQ ID NO: 3123423 - DNA, 15 bp, Homo sapiens
gagctgggtggcctg

SEQ ID NO: 3123424 - DNA, 17 bp, Homo sapiens
gagctggtgcattacag

SEQ ID NO: 3123425 - DNA, 17 bp, Homo sapiens
gagctgtcaccaaggaa

SEQ ID NO: 3123426 - DNA, 19 bp, Homo sapiens
gagctgtcaccaaggaaac

SEQ ID NO: 3123427 - DNA, 12 bp, Homo sapiens
gagctgtgccag

SEQ ID NO: 3123428 - DNA, 18 bp, Homo sapiens
gagctgtttatggcctca

SEQ ID NO: 3123429 - DNA, 21 bp, Homo sapiens
gagcttaatgctacatgtgag

SEQ ID NO: 3123430 - DNA, 19 bp, Homo sapiens
gagcttagccttgtgccct

SEQ ID NO: 3123431 - DNA, 23 bp, Homo sapiens
gagcttcctcggtagcagaggcc

SEQ ID NO: 3123432 - DNA, 10 bp, Homo sapiens
gagcttctct

SEQ ID NO: 3123433 - DNA, 16 bp, Homo sapiens
gagcttctctgtgaac

SEQ ID NO: 3123434 - DNA, 14 bp, Homo sapiens
gagcttctggcact

SEQ ID NO: 3123435 - DNA, 16 bp, Homo sapiens
gagcttgaggtgggag

SEQ ID NO: 3123436 - DNA, 16 bp, Homo sapiens
gagcttgtaataaata

SEQ ID NO: 3123437 - DNA, 17 bp, Homo sapiens
gagctttccttctccag

SEQ ID NO: 3123438 - DNA, 18 bp, Homo sapiens
gagcttttttctttaaga

SEQ ID NO: 3123439 - DNA, 13 bp, Homo sapiens
gaggaaaaaagaa

SEQ ID NO: 3123440 - DNA, 21 bp, Homo sapiens
gaggaaaaccaagccgtggct

SEQ ID NO: 3123441 - DNA, 14 bp, Homo sapiens
gaggaaaatgagta

SEQ ID NO: 3123442 - DNA, 16 bp, Homo sapiens
gaggaaaatgagtatt

SEQ ID NO: 3123443 - DNA, 13 bp, Homo sapiens
gaggaaaattctt

SEQ ID NO: 3123444 - DNA, 18 bp, Homo sapiens
gaggaaacttaagatgaa

SEQ ID NO: 3123445 - DNA, 16 bp, Homo sapiens
gaggaaagagagcagg

SEQ ID NO: 3123446 - DNA, 22 bp, Homo sapiens
gaggaaaggattttaccaaagc

SEQ ID NO: 3123447 - DNA, 15 bp, Homo sapiens
gaggaactccttggc

SEQ ID NO: 3123448 - DNA, 15 bp, Homo sapiens
gaggaactgtccaga

SEQ ID NO: 3123449 - DNA, 16 bp, Homo sapiens
gaggaactgtccagag

SEQ ID NO: 3123450 - DNA, 17 bp, Homo sapiens
gaggaactgtccagaga

SEQ ID NO: 3123451 - DNA, 21 bp, Homo sapiens
gaggaactgtccagagagcaa

SEQ ID NO: 3123452 - DNA, 13 bp, Homo sapiens
gaggaagagtctt

SEQ ID NO: 3123453 - DNA, 14 bp, Homo sapiens
gaggaaggattgta

SEQ ID NO: 3123454 - DNA, 13 bp, Homo sapiens
gaggaaggggggt

SEQ ID NO: 3123455 - DNA, 17 bp, Homo sapiens
gaggaagtgtggaaaaa

SEQ ID NO: 3123456 - DNA, 21 bp, Homo sapiens
gaggaagtgtggaaaaatagc

SEQ ID NO: 3123457 - DNA, 22 bp, Homo sapiens
gaggaataagaatggagcagta

SEQ ID NO: 3123458 - DNA, 18 bp, Homo sapiens
gaggaataattatttatt

SEQ ID NO: 3123459 - DNA, 19 bp, Homo sapiens
gaggaatctgtgggtctgg

SEQ ID NO: 3123460 - DNA, 20 bp, Homo sapiens
gaggaatctgtgggtctggg

SEQ ID NO: 3123461 - DNA, 14 bp, Homo sapiens
gaggaatttataac

SEQ ID NO: 3123462 - DNA, 22 bp, Homo sapiens
gaggacaaaacttcttgtcaga

SEQ ID NO: 3123463 - DNA, 19 bp, Homo sapiens
gaggacaccagtgaaagaa

SEQ ID NO: 3123464 - DNA, 18 bp, Homo sapiens
gaggacacgtggcctgca

SEQ ID NO: 3123465 - DNA, 15 bp, Homo sapiens
gaggacagcttgagc

SEQ ID NO: 3123466 - DNA, 18 bp, Homo sapiens
gaggacaggcaggccaga

SEQ ID NO: 3123467 - DNA, 22 bp, Homo sapiens
gaggacagggaggtgaccccag

SEQ ID NO: 3123468 - DNA, 23 bp, Homo sapiens
gaggaccacagtgggtggcacct

SEQ ID NO: 3123469 - DNA, 22 bp, Homo sapiens
gaggaccactttggagactggg

SEQ ID NO: 3123470 - DNA, 20 bp, Homo sapiens
gaggaccctggaaatggact

SEQ ID NO: 3123471 - DNA, 16 bp, Homo sapiens
gaggacctgaccctac

SEQ ID NO: 3123472 - DNA, 20 bp, Homo sapiens
gaggacctgaccctactccc

SEQ ID NO: 3123473 - DNA, 15 bp, Homo sapiens
gaggaccttatctgt

SEQ ID NO: 3123474 - DNA, 18 bp, Homo sapiens
gaggactcccaaccctgg

SEQ ID NO: 3123475 - DNA, 22 bp, Homo sapiens
gaggactcgcttgtaaatacca

SEQ ID NO: 3123476 - DNA, 22 bp, Homo sapiens
gaggactctgcaagtgtctgga

SEQ ID NO: 3123477 - DNA, 15 bp, Homo sapiens
gaggactgagactgg

SEQ ID NO: 3123478 - DNA, 12 bp, Homo sapiens
gaggactggacc

SEQ ID NO: 3123479 - DNA, 20 bp, Homo sapiens
gaggacttttctttgtggct

SEQ ID NO: 3123480 - DNA, 23 bp, Homo sapiens
gaggacttttctttgtggcttcc

SEQ ID NO: 3123481 - DNA, 13 bp, Homo sapiens
gaggagagacggt

SEQ ID NO: 3123482 - DNA, 14 bp, Homo sapiens
gaggagagagaccc

SEQ ID NO: 3123483 - DNA, 13 bp, Homo sapiens
gaggagagaggca

SEQ ID NO: 3123484 - DNA, 17 bp, Homo sapiens
gaggagagaggcagaga

SEQ ID NO: 3123485 - DNA, 20 bp, Homo sapiens
gaggagagtggttgttgcca

SEQ ID NO: 3123486 - DNA, 18 bp, Homo sapiens
gaggagatgaccagggat

SEQ ID NO: 3123487 - DNA, 18 bp, Homo sapiens
gaggagccaccagttctc

SEQ ID NO: 3123488 - DNA, 16 bp, Homo sapiens
gaggagccagacagac

SEQ ID NO: 3123489 - DNA, 21 bp, Homo sapiens
gaggagcccatactcagcctg

SEQ ID NO: 3123490 - DNA, 15 bp, Homo sapiens
gaggagccccagcta

SEQ ID NO: 3123491 - DNA, 22 bp, Homo sapiens
gaggagcctgtgcgtcccagct

SEQ ID NO: 3123492 - DNA, 23 bp, Homo sapiens
gaggagctgcctgcttggcccgg

SEQ ID NO: 3123493 - DNA, 12 bp, Homo sapiens
gaggagctgctg

SEQ ID NO: 3123494 - DNA, 13 bp, Homo sapiens
gaggagctgggcc

SEQ ID NO: 3123495 - DNA, 14 bp, Homo sapiens
gaggaggagggaga

SEQ ID NO: 3123496 - DNA, 22 bp, Homo sapiens
gaggaggatgtccctgggccag

SEQ ID NO: 3123497 - DNA, 12 bp, Homo sapiens
gaggaggccacc

SEQ ID NO: 3123498 - DNA, 18 bp, Homo sapiens
gaggaggccacctctcca

SEQ ID NO: 3123499 - DNA, 19 bp, Homo sapiens
gaggaggccacctctccaa

SEQ ID NO: 3123500 - DNA, 17 bp, Homo sapiens
gcaacttccgctgaggg

SEQ ID NO: 3123501 - DNA, 18 bp, Homo sapiens
gcaacttccgctgagggg

SEQ ID NO: 3123502 - DNA, 18 bp, Homo sapiens
gcaacttcttctccatcc

SEQ ID NO: 3123503 - DNA, 23 bp, Homo sapiens
gcaacttgtctttttctggactg

SEQ ID NO: 3123504 - DNA, 16 bp, Homo sapiens
gcaacttttaaagctc

SEQ ID NO: 3123505 - DNA, 20 bp, Homo sapiens
gcaacttttgtgtaatgaaa

SEQ ID NO: 3123506 - DNA, 12 bp, Homo sapiens
gcaagaacttgt

SEQ ID NO: 3123507 - DNA, 14 bp, Homo sapiens
gcaagaacttgttt

SEQ ID NO: 3123508 - DNA, 20 bp, Homo sapiens
gcaagaagctgcttctgccc

SEQ ID NO: 3123509 - DNA, 21 bp, Homo sapiens
gcaagaagctgcttctgccca

SEQ ID NO: 3123510 - DNA, 23 bp, Homo sapiens
gcaagaagctgcttctgcccaca

SEQ ID NO: 3123511 - DNA, 14 bp, Homo sapiens
gcaagaaggaaaga

SEQ ID NO: 3123512 - DNA, 19 bp, Homo sapiens
gcaagacagagacgcagga

SEQ ID NO: 3123513 - DNA, 16 bp, Homo sapiens
gcaagaccctgtctct

SEQ ID NO: 3123514 - DNA, 12 bp, Homo sapiens
gcaagacctcat

SEQ ID NO: 3123515 - DNA, 17 bp, Homo sapiens
gcaagactccatctcag

SEQ ID NO: 3123516 - DNA, 19 bp, Homo sapiens
gcaagactgcaaacttttt

SEQ ID NO: 3123517 - DNA, 15 bp, Homo sapiens
gcaagaggcctcatg

SEQ ID NO: 3123518 - DNA, 20 bp, Homo sapiens
gcaagagggggtggaggggt

SEQ ID NO: 3123519 - DNA, 13 bp, Homo sapiens
gcaagatatttat

SEQ ID NO: 3123520 - DNA, 16 bp, Homo sapiens
gcaagatatttatata

SEQ ID NO: 3123521 - DNA, 15 bp, Homo sapiens
gcaagcacctcctgc

SEQ ID NO: 3123522 - DNA, 20 bp, Homo sapiens
gcaagcacctcctgcctcga

SEQ ID NO: 3123523 - DNA, 11 bp, Homo sapiens
gcaagcagctt

SEQ ID NO: 3123524 - DNA, 15 bp, Homo sapiens
gcaagcaggacctgg

SEQ ID NO: 3123525 - DNA, 14 bp, Homo sapiens
gcaagccccagggc

SEQ ID NO: 3123526 - DNA, 17 bp, Homo sapiens
gcaagccccagggcctg

SEQ ID NO: 3123527 - DNA, 19 bp, Homo sapiens
gcaagccccagggcctggg

SEQ ID NO: 3123528 - DNA, 15 bp, Homo sapiens
gcaagcccctcagcc

SEQ ID NO: 3123529 - DNA, 16 bp, Homo sapiens
gcaagcccctcagccc

SEQ ID NO: 3123530 - DNA, 21 bp, Homo sapiens
gcaagctaggccccagaggcc

SEQ ID NO: 3123531 - DNA, 22 bp, Homo sapiens
gcaagctaggccccagaggccc

SEQ ID NO: 3123532 - DNA, 14 bp, Homo sapiens
gcaagctggcctct

SEQ ID NO: 3123533 - DNA, 16 bp, Homo sapiens
gcaaggagcacaagcc

SEQ ID NO: 3123534 - DNA, 18 bp, Homo sapiens
gcaaggatccttccctgt

SEQ ID NO: 3123535 - DNA, 15 bp, Homo sapiens
gcaaggattacagaa

SEQ ID NO: 3123536 - DNA, 16 bp, Homo sapiens
gcaaggattacagaaa

SEQ ID NO: 3123537 - DNA, 19 bp, Homo sapiens
gcaaggattacagaaactg

SEQ ID NO: 3123538 - DNA, 22 bp, Homo sapiens
gcaaggcaggtgcctccaggtg

SEQ ID NO: 3123539 - DNA, 16 bp, Homo sapiens
gcaaggccctgctgcc

SEQ ID NO: 3123540 - DNA, 22 bp, Homo sapiens
gcaaggccgagcgttcccagca

SEQ ID NO: 3123541 - DNA, 22 bp, Homo sapiens
gcaagggcacaagtcctggatg

SEQ ID NO: 3123542 - DNA, 14 bp, Homo sapiens
gcaagggcatcagg

SEQ ID NO: 3123543 - DNA, 20 bp, Homo sapiens
gcaagggctccagcatccag

SEQ ID NO: 3123544 - DNA, 22 bp, Homo sapiens
gcaagggctccagcatccagcc

SEQ ID NO: 3123545 - DNA, 21 bp, Homo sapiens
gcaagggggtgtcatctgagg

SEQ ID NO: 3123546 - DNA, 15 bp, Homo sapiens
gcaaggtactctggt

SEQ ID NO: 3123547 - DNA, 18 bp, Homo sapiens
gcaaggtatttctccagt

SEQ ID NO: 3123548 - DNA, 23 bp, Homo sapiens
gcaaggtctccttactctgagcc

SEQ ID NO: 3123549 - DNA, 21 bp, Homo sapiens
gcaaggtgctcacaccccatt

SEQ ID NO: 3123550 - DNA, 18 bp, Homo sapiens
gcaagtagataaatattt

SEQ ID NO: 3123551 - DNA, 21 bp, Homo sapiens
gcaagtcagaggatggccagt

SEQ ID NO: 3123552 - DNA, 18 bp, Homo sapiens
gcaagtctgagggtctgg

SEQ ID NO: 3123553 - DNA, 12 bp, Homo sapiens
gcaagtctgtga

SEQ ID NO: 3123554 - DNA, 11 bp, Homo sapiens
gcaagtcttaa

SEQ ID NO: 3123555 - DNA, 15 bp, Homo sapiens
gcaagtgagagctgg

SEQ ID NO: 3123556 - DNA, 16 bp, Homo sapiens
gcaagtgagagctggg

SEQ ID NO: 3123557 - DNA, 21 bp, Homo sapiens
gcaagtggatgggaatttgtc

SEQ ID NO: 3123558 - DNA, 23 bp, Homo sapiens
gcaagtggatgggaatttgtcag

SEQ ID NO: 3123559 - DNA, 19 bp, Homo sapiens
gcaagtgtctggagcggct

SEQ ID NO: 3123560 - DNA, 15 bp, Homo sapiens
gcaagttcatgtgtg

SEQ ID NO: 3123561 - DNA, 13 bp, Homo sapiens
gcaataaaattta

SEQ ID NO: 3123562 - DNA, 14 bp, Homo sapiens
gcaataaaatttaa

SEQ ID NO: 3123563 - DNA, 19 bp, Homo sapiens
gcaataaaatttaaaaaat

SEQ ID NO: 3123564 - DNA, 15 bp, Homo sapiens
gcaataaataacact

SEQ ID NO: 3123565 - DNA, 22 bp, Homo sapiens
gcaataacttctatattttaat

SEQ ID NO: 3123566 - DNA, 15 bp, Homo sapiens
gcaataacttctgac

SEQ ID NO: 3123567 - DNA, 17 bp, Homo sapiens
gcaataacttctgacct

SEQ ID NO: 3123568 - DNA, 21 bp, Homo sapiens
gcaataagaatttagggagaa

SEQ ID NO: 3123569 - DNA, 20 bp, Homo sapiens
gcaataagttccatgttaaa

SEQ ID NO: 3123570 - DNA, 14 bp, Homo sapiens
gcaataattgtttc

SEQ ID NO: 3123571 - DNA, 23 bp, Homo sapiens
gcaatacgacgtgggaatttcaa

SEQ ID NO: 3123572 - DNA, 13 bp, Homo sapiens
gcaatagtgtgtt

SEQ ID NO: 3123573 - DNA, 17 bp, Homo sapiens
gcaatcaaatctgcttt

SEQ ID NO: 3123574 - DNA, 21 bp, Homo sapiens
gcaatccatgttagtttttac

SEQ ID NO: 3123575 - DNA, 22 bp, Homo sapiens
gcaatccatgttagtttttact

SEQ ID NO: 3123576 - DNA, 14 bp, Homo sapiens
gcaatcccagcacc

SEQ ID NO: 3123577 - DNA, 18 bp, Homo sapiens
gcaatcccagcaccttag

SEQ ID NO: 3123578 - DNA, 23 bp, Homo sapiens
gcaatctccccttgatttaaaca

SEQ ID NO: 3123579 - DNA, 13 bp, Homo sapiens
gcaatctctctct

SEQ ID NO: 3123580 - DNA, 14 bp, Homo sapiens
gcaatctctctctg

SEQ ID NO: 3123581 - DNA, 23 bp, Homo sapiens
gcaatgaaaagtcgttttccaaa

SEQ ID NO: 3123582 - DNA, 16 bp, Homo sapiens
gcaatgacatctcagg

SEQ ID NO: 3123583 - DNA, 16 bp, Homo sapiens
gcaatgacatcttcaa

SEQ ID NO: 3123584 - DNA, 17 bp, Homo sapiens
gcaatgatgaatgagaa

SEQ ID NO: 3123585 - DNA, 20 bp, Homo sapiens
gcaatgctgatgaatcactg

SEQ ID NO: 3123586 - DNA, 14 bp, Homo sapiens
gcaatgctgtactt

SEQ ID NO: 3123587 - DNA, 14 bp, Homo sapiens
gcaatggcagcctt

SEQ ID NO: 3123588 - DNA, 16 bp, Homo sapiens
gcaatgggcactggga

SEQ ID NO: 3123589 - DNA, 21 bp, Homo sapiens
gcaatgtcacaacctctctga

SEQ ID NO: 3123590 - DNA, 17 bp, Homo sapiens
gcaatgtgaaaaatctg

SEQ ID NO: 3123591 - DNA, 15 bp, Homo sapiens
gcaatgtgttttttc

SEQ ID NO: 3123592 - DNA, 16 bp, Homo sapiens
gcaattcaaaagttcc

SEQ ID NO: 3123593 - DNA, 11 bp, Homo sapiens
gcaattccaat

SEQ ID NO: 3123594 - DNA, 14 bp, Homo sapiens
gcaattcccctctg

SEQ ID NO: 3123595 - DNA, 17 bp, Homo sapiens
gcaattccgcatttaat

SEQ ID NO: 3123596 - DNA, 15 bp, Homo sapiens
gcaattgatttcttt

SEQ ID NO: 3123597 - DNA, 18 bp, Homo sapiens
gcaattggaacaaagtga

SEQ ID NO: 3123598 - DNA, 18 bp, Homo sapiens
gcaattgggctccctttg

SEQ ID NO: 3123599 - DNA, 14 bp, Homo sapiens
gcaatttcatatgc

SEQ ID NO: 3123600 - DNA, 14 bp, Homo sapiens
gcaatttcctggcc

SEQ ID NO: 3123601 - DNA, 23 bp, Homo sapiens
gcaattttacctagtttgcacta

SEQ ID NO: 3123602 - DNA, 13 bp, Homo sapiens
gcaattttctttg

SEQ ID NO: 3123603 - DNA, 15 bp, Homo sapiens
gcaattttctttgtt

SEQ ID NO: 3123604 - DNA, 17 bp, Homo sapiens
gcaattttctttgtttc

SEQ ID NO: 3123605 - DNA, 13 bp, Homo sapiens
gcacaaacatttt

SEQ ID NO: 3123606 - DNA, 18 bp, Homo sapiens
gcacaaacatttttcaac

SEQ ID NO: 3123607 - DNA, 22 bp, Homo sapiens
gcacaaactttagggtaaaaat

SEQ ID NO: 3123608 - DNA, 15 bp, Homo sapiens
gcacaaatatttatt

SEQ ID NO: 3123609 - DNA, 16 bp, Homo sapiens
gcacaaatatttattt

SEQ ID NO: 3123610 - DNA, 22 bp, Homo sapiens
gcacaactgcaataacttctga

SEQ ID NO: 3123611 - DNA, 11 bp, Homo sapiens
gcacaagaagc

SEQ ID NO: 3123612 - DNA, 22 bp, Homo sapiens
gcacaagccacaagtcttccag

SEQ ID NO: 3123613 - DNA, 14 bp, Homo sapiens
gcacaagcgtgttt

SEQ ID NO: 3123614 - DNA, 12 bp, Homo sapiens
gcacaagctcag

SEQ ID NO: 3123615 - DNA, 14 bp, Homo sapiens
gcacaagctcagaa

SEQ ID NO: 3123616 - DNA, 18 bp, Homo sapiens
gcacaagctcagaataga

SEQ ID NO: 3123617 - DNA, 18 bp, Homo sapiens
gcacaaggattgaaaatt

SEQ ID NO: 3123618 - DNA, 17 bp, Homo sapiens
gcacaatgtttgatgtc

SEQ ID NO: 3123619 - DNA, 14 bp, Homo sapiens
gcacacaaatatta

SEQ ID NO: 3123620 - DNA, 15 bp, Homo sapiens
gcacacacagctcct

SEQ ID NO: 3123621 - DNA, 12 bp, Homo sapiens
gcacacaccaga

SEQ ID NO: 3123622 - DNA, 14 bp, Homo sapiens
gcacacaccagagc

SEQ ID NO: 3123623 - DNA, 15 bp, Homo sapiens
gcacacaccagagcc

SEQ ID NO: 3123624 - DNA, 17 bp, Homo sapiens
gcacacaccagagccca

SEQ ID NO: 3123625 - DNA, 18 bp, Homo sapiens
gatccagatccagactgt

SEQ ID NO: 3123626 - DNA, 14 bp, Homo sapiens
gatccagcactggt

SEQ ID NO: 3123627 - DNA, 11 bp, Homo sapiens
gatccagccac

SEQ ID NO: 3123628 - DNA, 19 bp, Homo sapiens
gatccaggaagcatgagtg

SEQ ID NO: 3123629 - DNA, 17 bp, Homo sapiens
gatccatccatctccag

SEQ ID NO: 3123630 - DNA, 12 bp, Homo sapiens
gatccatttgcc

SEQ ID NO: 3123631 - DNA, 17 bp, Homo sapiens
gatccatttgcctttct

SEQ ID NO: 3123632 - DNA, 21 bp, Homo sapiens
gatccatttgcctttctggga

SEQ ID NO: 3123633 - DNA, 15 bp, Homo sapiens
gatcccactggaaga

SEQ ID NO: 3123634 - DNA, 15 bp, Homo sapiens
gatccccactgtcct

SEQ ID NO: 3123635 - DNA, 13 bp, Homo sapiens
gatccccgcctgg

SEQ ID NO: 3123636 - DNA, 17 bp, Homo sapiens
gatccccgcctggccag

SEQ ID NO: 3123637 - DNA, 18 bp, Homo sapiens
gatccccgcctggccagg

SEQ ID NO: 3123638 - DNA, 21 bp, Homo sapiens
gatccctgtgttgtctctaga

SEQ ID NO: 3123639 - DNA, 24 bp, Homo sapiens
gatccctgtgttgtctctagagca

SEQ ID NO: 3123640 - DNA, 18 bp, Homo sapiens
gatccctgttacccagag

SEQ ID NO: 3123641 - DNA, 20 bp, Homo sapiens
gatccctgttacccagagaa

SEQ ID NO: 3123642 - DNA, 17 bp, Homo sapiens
gatcccttaagaagtta

SEQ ID NO: 3123643 - DNA, 17 bp, Homo sapiens
gcacacagcagcccccc

SEQ ID NO: 3123644 - DNA, 16 bp, Homo sapiens
gcacacagctgagcac

SEQ ID NO: 3123645 - DNA, 23 bp, Homo sapiens
gcacacagctgagcacttagcag

SEQ ID NO: 3123646 - DNA, 13 bp, Homo sapiens
gcacacagggccc

SEQ ID NO: 3123647 - DNA, 19 bp, Homo sapiens
gcacacagggcccggccac

SEQ ID NO: 3123648 - DNA, 20 bp, Homo sapiens
gcacacagggcccggccaca

SEQ ID NO: 3123649 - DNA, 15 bp, Homo sapiens
gcacaccaccctccc

SEQ ID NO: 3123650 - DNA, 15 bp, Homo sapiens
gcacaccactgccct

SEQ ID NO: 3123651 - DNA, 16 bp, Homo sapiens
gcacaccactgccctg

SEQ ID NO: 3123652 - DNA, 17 bp, Homo sapiens
gcacaccactgccctgc

SEQ ID NO: 3123653 - DNA, 19 bp, Homo sapiens
gcacaccactgccctgcct

SEQ ID NO: 3123654 - DNA, 20 bp, Homo sapiens
gcacaccactgccctgcctg

SEQ ID NO: 3123655 - DNA, 22 bp, Homo sapiens
gcacaccactgccctgcctgcc

SEQ ID NO: 3123656 - DNA, 17 bp, Homo sapiens
gcacaccagccgctgca

SEQ ID NO: 3123657 - DNA, 19 bp, Homo sapiens
gcacaccagccgctgcagg

SEQ ID NO: 3123658 - DNA, 23 bp, Homo sapiens
gcacaccagccgctgcagggctc

SEQ ID NO: 3123659 - DNA, 23 bp, Homo sapiens
gcacaccctcactctgccagggc

SEQ ID NO: 3123660 - DNA, 13 bp, Homo sapiens
gcacactctgcca

SEQ ID NO: 3123661 - DNA, 12 bp, Homo sapiens
gcacactgccaa

SEQ ID NO: 3123662 - DNA, 13 bp, Homo sapiens
gcacactgccaaa

SEQ ID NO: 3123663 - DNA, 19 bp, Homo sapiens
gcacactgccaaataaaca

SEQ ID NO: 3123664 - DNA, 21 bp, Homo sapiens
gcacactgccaaataaacagc

SEQ ID NO: 3123665 - DNA, 18 bp, Homo sapiens
gcacactgctcttaagaa

SEQ ID NO: 3123666 - DNA, 21 bp, Homo sapiens
gcacactgctcttaagaaact

SEQ ID NO: 3123667 - DNA, 16 bp, Homo sapiens
gcacacttttccacat

SEQ ID NO: 3123668 - DNA, 20 bp, Homo sapiens
gcacagaaacacaatatttt

SEQ ID NO: 3123669 - DNA, 16 bp, Homo sapiens
gcacagaacaggaggt

SEQ ID NO: 3123670 - DNA, 15 bp, Homo sapiens
gcacagacaagcagc

SEQ ID NO: 3123671 - DNA, 18 bp, Homo sapiens
gcacagacaagcagccct

SEQ ID NO: 3123672 - DNA, 18 bp, Homo sapiens
gcacagacttctggaagg

SEQ ID NO: 3123673 - DNA, 17 bp, Homo sapiens
gcacagagcccaatgca

SEQ ID NO: 3123674 - DNA, 18 bp, Homo sapiens
gcacagagcgtccttccc

SEQ ID NO: 3123675 - DNA, 19 bp, Homo sapiens
gcacagagggctagggagg

SEQ ID NO: 3123676 - DNA, 19 bp, Homo sapiens
gcacagatggatttgcctg

SEQ ID NO: 3123677 - DNA, 14 bp, Homo sapiens
gcacagcagcctgc

SEQ ID NO: 3123678 - DNA, 14 bp, Homo sapiens
gcacagccctccga

SEQ ID NO: 3123679 - DNA, 20 bp, Homo sapiens
gcacagccctccgaccctca

SEQ ID NO: 3123680 - DNA, 23 bp, Homo sapiens
gcacagccctccgaccctcatgg

SEQ ID NO: 3123681 - DNA, 15 bp, Homo sapiens
gcacagctcaggagg

SEQ ID NO: 3123682 - DNA, 20 bp, Homo sapiens
gcacagctcaggaggcgccc

SEQ ID NO: 3123683 - DNA, 16 bp, Homo sapiens
gcacagctccctgcca

SEQ ID NO: 3123684 - DNA, 17 bp, Homo sapiens
gcacagctccctgccaa

SEQ ID NO: 3123685 - DNA, 19 bp, Homo sapiens
gcacagcttagatttcata

SEQ ID NO: 3123686 - DNA, 14 bp, Homo sapiens
gcacagcttgacct

SEQ ID NO: 3123687 - DNA, 18 bp, Homo sapiens
gcacagcttgacctgagg

SEQ ID NO: 3123688 - DNA, 17 bp, Homo sapiens
gcacagggagtgcacat

SEQ ID NO: 3123689 - DNA, 16 bp, Homo sapiens
gcacagggcaggggtg

SEQ ID NO: 3123690 - DNA, 18 bp, Homo sapiens
gcacagggcaggggtggt

SEQ ID NO: 3123691 - DNA, 15 bp, Homo sapiens
gcacagggcccgcag

SEQ ID NO: 3123692 - DNA, 20 bp, Homo sapiens
gcacagggcccgcagtgctg

SEQ ID NO: 3123693 - DNA, 20 bp, Homo sapiens
gcacaggggccccagatctg

SEQ ID NO: 3123694 - DNA, 12 bp, Homo sapiens
gcacagggtctg

SEQ ID NO: 3123695 - DNA, 17 bp, Homo sapiens
gcacaggtcccacctcc

SEQ ID NO: 3123696 - DNA, 13 bp, Homo sapiens
gcacagtgcatct

SEQ ID NO: 3123697 - DNA, 13 bp, Homo sapiens
gcacagtgggagc

SEQ ID NO: 3123698 - DNA, 19 bp, Homo sapiens
gcacagtgggagctgagct

SEQ ID NO: 3123699 - DNA, 22 bp, Homo sapiens
gcacagtgggagctgagctgga

SEQ ID NO: 3123700 - DNA, 20 bp, Homo sapiens
gcacagtgttaaatgaaatt

SEQ ID NO: 3123701 - DNA, 13 bp, Homo sapiens
gcacagtttgaac

SEQ ID NO: 3123702 - DNA, 15 bp, Homo sapiens
gcacagtttgaacaa

SEQ ID NO: 3123703 - DNA, 14 bp, Homo sapiens
gcacataaactttg

SEQ ID NO: 3123704 - DNA, 19 bp, Homo sapiens
gcacatacattaaaactag

SEQ ID NO: 3123705 - DNA, 18 bp, Homo sapiens
gcacatatggactctgca

SEQ ID NO: 3123706 - DNA, 15 bp, Homo sapiens
gcacatccattccca

SEQ ID NO: 3123707 - DNA, 15 bp, Homo sapiens
gcacatgctggccag

SEQ ID NO: 3123708 - DNA, 22 bp, Homo sapiens
gcacatgctggccagcctgggg

SEQ ID NO: 3123709 - DNA, 23 bp, Homo sapiens
gcacatgctggccagcctggggc

SEQ ID NO: 3123710 - DNA, 15 bp, Homo sapiens
gcacatgcttagctt

SEQ ID NO: 3123711 - DNA, 15 bp, Homo sapiens
gcacatgtaataaat

SEQ ID NO: 3123712 - DNA, 21 bp, Homo sapiens
gcacatgtcttgtacatgtgt

SEQ ID NO: 3123713 - DNA, 21 bp, Homo sapiens
gcacatgtgccacacagtgac

SEQ ID NO: 3123714 - DNA, 17 bp, Homo sapiens
gcacatgtgtatttata

SEQ ID NO: 3123715 - DNA, 11 bp, Homo sapiens
gcacatttcag

SEQ ID NO: 3123716 - DNA, 19 bp, Homo sapiens
gcaccaaagatgcagccgc

SEQ ID NO: 3123717 - DNA, 21 bp, Homo sapiens
gcaccaaagatgcagccgcct

SEQ ID NO: 3123718 - DNA, 12 bp, Homo sapiens
gcaccaatgccc

SEQ ID NO: 3123719 - DNA, 14 bp, Homo sapiens
gcaccacaaaatat

SEQ ID NO: 3123720 - DNA, 20 bp, Homo sapiens
gcaccaccctagtcccttcc

SEQ ID NO: 3123721 - DNA, 22 bp, Homo sapiens
gcaccaccctagtcccttcccc

SEQ ID NO: 3123722 - DNA, 20 bp, Homo sapiens
gcaccacggcgtttttttac

SEQ ID NO: 3123723 - DNA, 21 bp, Homo sapiens
gcaccacggcgtttttttaca

SEQ ID NO: 3123724 - DNA, 21 bp, Homo sapiens
gcaccactgcactccagcctg

SEQ ID NO: 3123725 - DNA, 18 bp, Homo sapiens
gcaccactgtgtatttaa

SEQ ID NO: 3123726 - DNA, 18 bp, Homo sapiens
gcaccagagcaacctctc

SEQ ID NO: 3123727 - DNA, 22 bp, Homo sapiens
gcaccagagtgaaagggctatg

SEQ ID NO: 3123728 - DNA, 17 bp, Homo sapiens
gcaccagatgcaacctc

SEQ ID NO: 3123729 - DNA, 17 bp, Homo sapiens
gcaccagccccctggat

SEQ ID NO: 3123730 - DNA, 14 bp, Homo sapiens
gcaccagctctgtg

SEQ ID NO: 3123731 - DNA, 20 bp, Homo sapiens
gcaccagctctgtggcctgt

SEQ ID NO: 3123732 - DNA, 22 bp, Homo sapiens
gcaccagctctgtggcctgtgt

SEQ ID NO: 3123733 - DNA, 14 bp, Homo sapiens
gcaccagctgctct

SEQ ID NO: 3123734 - DNA, 13 bp, Homo sapiens
gcaccaggagaca

SEQ ID NO: 3123735 - DNA, 23 bp, Homo sapiens
gcaccagggcattcgggccacag

SEQ ID NO: 3123736 - DNA, 20 bp, Homo sapiens
gcaccagggcgctgggaagg

SEQ ID NO: 3123737 - DNA, 18 bp, Homo sapiens
gcaccaggggtttctcgc

SEQ ID NO: 3123738 - DNA, 15 bp, Homo sapiens
gcaccatctgcttgg

SEQ ID NO: 3123739 - DNA, 18 bp, Homo sapiens
gcacccaccgtggaggag

SEQ ID NO: 3123740 - DNA, 12 bp, Homo sapiens
gcacccagagca

SEQ ID NO: 3123741 - DNA, 17 bp, Homo sapiens
gcacccagagcaccccc

SEQ ID NO: 3123742 - DNA, 18 bp, Homo sapiens
gcacccagctccaggggc

SEQ ID NO: 3123743 - DNA, 19 bp, Homo sapiens
gcaccccagctaccccttc

SEQ ID NO: 3123744 - DNA, 20 bp, Homo sapiens
gcaccccagctaccccttct

SEQ ID NO: 3123745 - DNA, 15 bp, Homo sapiens
gcacccccaagcctg

SEQ ID NO: 3123746 - DNA, 22 bp, Homo sapiens
gcacccccacaagctgtccctg

SEQ ID NO: 3123747 - DNA, 13 bp, Homo sapiens
gcacccccaccca

SEQ ID NO: 3123748 - DNA, 20 bp, Homo sapiens
gcacccccctgttctaaggg

SEQ ID NO: 3123749 - DNA, 16 bp, Homo sapiens
gcacccccgcaccctt

SEQ ID NO: 3123750 - DNA, 23 bp, Homo sapiens
gcaccccctgctccaccagcagc

SEQ ID NO: 3123751 - DNA, 18 bp, Homo sapiens
gcaccccgatgtggacct

SEQ ID NO: 3123752 - DNA, 14 bp, Homo sapiens
gcaccccgctgcgg

SEQ ID NO: 3123753 - DNA, 16 bp, Homo sapiens
gcaccccggcctcagg

SEQ ID NO: 3123754 - DNA, 19 bp, Homo sapiens
gcaccccttctctcctccc

SEQ ID NO: 3123755 - DNA, 20 bp, Homo sapiens
gcaccccttctctcctcccc

SEQ ID NO: 3123756 - DNA, 14 bp, Homo sapiens
gcacccggcccctg

SEQ ID NO: 3123757 - DNA, 18 bp, Homo sapiens
gcacccggcccctgctgg

SEQ ID NO: 3123758 - DNA, 18 bp, Homo sapiens
gcaccctccaccctgtcc

SEQ ID NO: 3123759 - DNA, 22 bp, Homo sapiens
gcaccctccaccctgtccccca

SEQ ID NO: 3123760 - DNA, 15 bp, Homo sapiens
gcaccctccctcctg

SEQ ID NO: 3123761 - DNA, 15 bp, Homo sapiens
gcaccctctcctggg

SEQ ID NO: 3123762 - DNA, 22 bp, Homo sapiens
gcaccctctcctgggggtggca

SEQ ID NO: 3123763 - DNA, 16 bp, Homo sapiens
gcaccctgcacctgct

SEQ ID NO: 3123764 - DNA, 19 bp, Homo sapiens
gcaccctgcacctgctgcg

SEQ ID NO: 3123765 - DNA, 19 bp, Homo sapiens
gcaccctgtggccctggct

SEQ ID NO: 3123766 - DNA, 18 bp, Homo sapiens
gcaccgccacgtcccagc

SEQ ID NO: 3123767 - DNA, 22 bp, Homo sapiens
gcaccgcggcgcttcccagcac

SEQ ID NO: 3123768 - DNA, 22 bp, Homo sapiens
gcaccgcttttgttctcgcaaa

SEQ ID NO: 3123769 - DNA, 17 bp, Homo sapiens
gcaccgtcatggcttaa

SEQ ID NO: 3123770 - DNA, 21 bp, Homo sapiens
gcaccgtcatggcttaatgtt

SEQ ID NO: 3123771 - DNA, 16 bp, Homo sapiens
gcaccgtgatggagag

SEQ ID NO: 3123772 - DNA, 19 bp, Homo sapiens
gcacctaaaccaccagtgc

SEQ ID NO: 3123773 - DNA, 15 bp, Homo sapiens
gcacctaccatcagg

SEQ ID NO: 3123774 - DNA, 19 bp, Homo sapiens
gcacctactatgtgctggg

SEQ ID NO: 3123775 - DNA, 21 bp, Homo sapiens
gcacctactatgtgctgggtg

SEQ ID NO: 3123776 - DNA, 16 bp, Homo sapiens
gcacctagtccagtga

SEQ ID NO: 3123777 - DNA, 10 bp, Homo sapiens
gcacctcaga

SEQ ID NO: 3123778 - DNA, 21 bp, Homo sapiens
gcacctcagaaagtcaccagg

SEQ ID NO: 3123779 - DNA, 20 bp, Homo sapiens
gcacctccaggcctgttgct

SEQ ID NO: 3123780 - DNA, 15 bp, Homo sapiens
gcacctccccgctgg

SEQ ID NO: 3123781 - DNA, 16 bp, Homo sapiens
gcacctcctgagaagg

SEQ ID NO: 3123782 - DNA, 18 bp, Homo sapiens
gcacctgaaccccatggg

SEQ ID NO: 3123783 - DNA, 20 bp, Homo sapiens
gcacctgaaccccatgggct

SEQ ID NO: 3123784 - DNA, 24 bp, Homo sapiens
gcacctgaaccccatgggcttgga

SEQ ID NO: 3123785 - DNA, 14 bp, Homo sapiens
gcacctgccagcct

SEQ ID NO: 3123786 - DNA, 16 bp, Homo sapiens
gcacctgccagcctgg

SEQ ID NO: 3123787 - DNA, 17 bp, Homo sapiens
gcacctgccagcctggc

SEQ ID NO: 3123788 - DNA, 16 bp, Homo sapiens
gcacctgctgcgtccc

SEQ ID NO: 3123789 - DNA, 17 bp, Homo sapiens
gcacctgctgcgtcccc

SEQ ID NO: 3123790 - DNA, 20 bp, Homo sapiens
gcacctgctgcgtccccact

SEQ ID NO: 3123791 - DNA, 12 bp, Homo sapiens
gcacctggcctg

SEQ ID NO: 3123792 - DNA, 13 bp, Homo sapiens
gcacctggcctgc

SEQ ID NO: 3123793 - DNA, 16 bp, Homo sapiens
gcacctggcctgctgg

SEQ ID NO: 3123794 - DNA, 17 bp, Homo sapiens
gcacctggcctgctggg

SEQ ID NO: 3123795 - DNA, 20 bp, Homo sapiens
gcacctggcctgctgggaac

SEQ ID NO: 3123796 - DNA, 21 bp, Homo sapiens
gcacctgtactcaggaggctg

SEQ ID NO: 3123797 - DNA, 16 bp, Homo sapiens
gcacctgtagtcccag

SEQ ID NO: 3123798 - DNA, 20 bp, Homo sapiens
gcaccttaccaactttctgt

SEQ ID NO: 3123799 - DNA, 16 bp, Homo sapiens
gcaccttcctcacttc

SEQ ID NO: 3123800 - DNA, 19 bp, Homo sapiens
gcaccttcttggcgctgga

SEQ ID NO: 3123801 - DNA, 16 bp, Homo sapiens
gcaccttctttctgga

SEQ ID NO: 3123802 - DNA, 20 bp, Homo sapiens
gcaccttctttctggactgg

SEQ ID NO: 3123803 - DNA, 14 bp, Homo sapiens
gcaccttgtgtctg

SEQ ID NO: 3123804 - DNA, 22 bp, Homo sapiens
gcaccttgtgtctgtacacgtg

SEQ ID NO: 3123805 - DNA, 19 bp, Homo sapiens
gcacctttgcacaggatgc

SEQ ID NO: 3123806 - DNA, 14 bp, Homo sapiens
gcacgccctactcc

SEQ ID NO: 3123807 - DNA, 13 bp, Homo sapiens
gcacgcctgcccc

SEQ ID NO: 3123808 - DNA, 14 bp, Homo sapiens
gcacgctcgctgcc

SEQ ID NO: 3123809 - DNA, 17 bp, Homo sapiens
gcacgctcgctgccatc

SEQ ID NO: 3123810 - DNA, 19 bp, Homo sapiens
gcacgcttgcgtatgtctg

SEQ ID NO: 3123811 - DNA, 20 bp, Homo sapiens
gcacgcttgcgtatgtctgt

SEQ ID NO: 3123812 - DNA, 17 bp, Homo sapiens
gcacggacaataaacct

SEQ ID NO: 3123813 - DNA, 18 bp, Homo sapiens
gcacggacaataaacctc

SEQ ID NO: 3123814 - DNA, 18 bp, Homo sapiens
gcacggcctcgcgtctgt

SEQ ID NO: 3123815 - DNA, 14 bp, Homo sapiens
gcacgggtccctgc

SEQ ID NO: 3123816 - DNA, 15 bp, Homo sapiens
gcacgggtggtcccc

SEQ ID NO: 3123817 - DNA, 16 bp, Homo sapiens
gcacgggtggtccccg

SEQ ID NO: 3123818 - DNA, 19 bp, Homo sapiens
gcacgtatacacccagatg

SEQ ID NO: 3123819 - DNA, 16 bp, Homo sapiens
gcacgtggagagctgg

SEQ ID NO: 3123820 - DNA, 20 bp, Homo sapiens
gcacgtggagagctggtgcc

SEQ ID NO: 3123821 - DNA, 19 bp, Homo sapiens
gcacgtggcctcttgagca

SEQ ID NO: 3123822 - DNA, 15 bp, Homo sapiens
gcacgtttaaagttc

SEQ ID NO: 3123823 - DNA, 17 bp, Homo sapiens
gcacgtttaaagttctg

SEQ ID NO: 3123824 - DNA, 17 bp, Homo sapiens
gcactaaagccagcctg

SEQ ID NO: 3123825 - DNA, 19 bp, Homo sapiens
gcactaaagccagcctgac

SEQ ID NO: 3123826 - DNA, 14 bp, Homo sapiens
gcactaaatatgaa

SEQ ID NO: 3123827 - DNA, 19 bp, Homo sapiens
gcactaacgttgagcccct

SEQ ID NO: 3123828 - DNA, 20 bp, Homo sapiens
gcactaacgttgagcccctg

SEQ ID NO: 3123829 - DNA, 14 bp, Homo sapiens
gcactaaggccgtg

SEQ ID NO: 3123830 - DNA, 19 bp, Homo sapiens
gcactaaggccgtgtctct

SEQ ID NO: 3123831 - DNA, 17 bp, Homo sapiens
gcactaaggtgtgctct

SEQ ID NO: 3123832 - DNA, 18 bp, Homo sapiens
gcactaaggtgtgctctg

SEQ ID NO: 3123833 - DNA, 16 bp, Homo sapiens
gcactacataaactga

SEQ ID NO: 3123834 - DNA, 13 bp, Homo sapiens
gcactacatgtgg

SEQ ID NO: 3123835 - DNA, 21 bp, Homo sapiens
gcactaccatagctacatcag

SEQ ID NO: 3123836 - DNA, 16 bp, Homo sapiens
gcactaccgattcttt

SEQ ID NO: 3123837 - DNA, 13 bp, Homo sapiens
gcactactcctct

SEQ ID NO: 3123838 - DNA, 17 bp, Homo sapiens
gcactactctgtgccag

SEQ ID NO: 3123839 - DNA, 17 bp, Homo sapiens
gcactactgacatgtgg

SEQ ID NO: 3123840 - DNA, 16 bp, Homo sapiens
gcactagagaatgcac

SEQ ID NO: 3123841 - DNA, 20 bp, Homo sapiens
gcactagcctttggctctgg

SEQ ID NO: 3123842 - DNA, 21 bp, Homo sapiens
gcactagcctttggctctgga

SEQ ID NO: 3123843 - DNA, 21 bp, Homo sapiens
gcactaggggatataggagag

SEQ ID NO: 3123844 - DNA, 15 bp, Homo sapiens
gcactataatgtaag

SEQ ID NO: 3123845 - DNA, 19 bp, Homo sapiens
gcactattttatatttaaa

SEQ ID NO: 3123846 - DNA, 20 bp, Homo sapiens
gcactcacagacctggagcc

SEQ ID NO: 3123847 - DNA, 22 bp, Homo sapiens
gcactcagaaaagaaaaccatt

SEQ ID NO: 3123848 - DNA, 16 bp, Homo sapiens
gcactcagaagacact

SEQ ID NO: 3123849 - DNA, 16 bp, Homo sapiens
gcactcagccacgacc

SEQ ID NO: 3123850 - DNA, 21 bp, Homo sapiens
gcactcagccacgaccagccc

SEQ ID NO: 3123851 - DNA, 12 bp, Homo sapiens
gcactccagcct

SEQ ID NO: 3123852 - DNA, 13 bp, Homo sapiens
gcactccagcctg

SEQ ID NO: 3123853 - DNA, 21 bp, Homo sapiens
gcactccagcctgggcgacag

SEQ ID NO: 3123854 - DNA, 18 bp, Homo sapiens
gcactcccacctgacaca

SEQ ID NO: 3123855 - DNA, 14 bp, Homo sapiens
gcactccccagagc

SEQ ID NO: 3123856 - DNA, 18 bp, Homo sapiens
gcactccccagagctgtg

SEQ ID NO: 3123857 - DNA, 11 bp, Homo sapiens
gcactcccctt

SEQ ID NO: 3123858 - DNA, 21 bp, Homo sapiens
gcactccccttgccttcccct

SEQ ID NO: 3123859 - DNA, 22 bp, Homo sapiens
gcactccccttgccttcccctg

SEQ ID NO: 3123860 - DNA, 19 bp, Homo sapiens
gcactccctaatttatgtg

SEQ ID NO: 3123861 - DNA, 14 bp, Homo sapiens
gcactctgccccca

SEQ ID NO: 3123862 - DNA, 19 bp, Homo sapiens
gcactgaaaacttagccag

SEQ ID NO: 3123863 - DNA, 17 bp, Homo sapiens
gcactgaagtgcttagt

SEQ ID NO: 3123864 - DNA, 17 bp, Homo sapiens
gcactgacccttccaga

SEQ ID NO: 3123865 - DNA, 21 bp, Homo sapiens
gcactgacccttccagacata

SEQ ID NO: 3123866 - DNA, 15 bp, Homo sapiens
gcactgagatattta

SEQ ID NO: 3123867 - DNA, 20 bp, Homo sapiens
gcactgagggccacactatt

SEQ ID NO: 3123868 - DNA, 19 bp, Homo sapiens
gcactgagggtggcactca

SEQ ID NO: 3123869 - DNA, 14 bp, Homo sapiens
gcactgatatttta

SEQ ID NO: 3123870 - DNA, 17 bp, Homo sapiens
gcactgatcaatccttc

SEQ ID NO: 3123871 - DNA, 14 bp, Homo sapiens
gcactgctgcccag

SEQ ID NO: 3123872 - DNA, 15 bp, Homo sapiens
gcactgctgcccagc

SEQ ID NO: 3123873 - DNA, 18 bp, Homo sapiens
gcactgctgcccagcctc

SEQ ID NO: 3123874 - DNA, 20 bp, Homo sapiens
gcactgctgcccagcctcca

SEQ ID NO: 3123875 - DNA, 11 bp, Homo sapiens
gcactgctgtt

SEQ ID NO: 3123876 - DNA, 16 bp, Homo sapiens
gcactggagtgcaggg

SEQ ID NO: 3123877 - DNA, 15 bp, Homo sapiens
gcactggccagagag

SEQ ID NO: 3123878 - DNA, 19 bp, Homo sapiens
gcactggccagagagggcc

SEQ ID NO: 3123879 - DNA, 22 bp, Homo sapiens
gcactggccagagagggcccag

SEQ ID NO: 3123880 - DNA, 13 bp, Homo sapiens
gcactgggccacg

SEQ ID NO: 3123881 - DNA, 14 bp, Homo sapiens
gcactgggccacgg

SEQ ID NO: 3123882 - DNA, 18 bp, Homo sapiens
gcactgggccacggagga

SEQ ID NO: 3123883 - DNA, 22 bp, Homo sapiens
gcactggggagcccgtctcagt

SEQ ID NO: 3123884 - DNA, 19 bp, Homo sapiens
gcactggtaggttgggaca

SEQ ID NO: 3123885 - DNA, 22 bp, Homo sapiens
gcactggtaggttgggacacca

SEQ ID NO: 3123886 - DNA, 22 bp, Homo sapiens
gcactggtggcccgacagcctg

SEQ ID NO: 3123887 - DNA, 23 bp, Homo sapiens
gcactggtggcccgacagcctgg

SEQ ID NO: 3123888 - DNA, 24 bp, Homo sapiens
gcactggtggcccgacagcctggc

SEQ ID NO: 3123889 - DNA, 20 bp, Homo sapiens
gcactggtgtgaactcaccc

SEQ ID NO: 3123890 - DNA, 16 bp, Homo sapiens
gcactgtagttctaag

SEQ ID NO: 3123891 - DNA, 16 bp, Homo sapiens
gcactgtatgctggac

SEQ ID NO: 3123892 - DNA, 20 bp, Homo sapiens
gcactgtcactttgctctgg

SEQ ID NO: 3123893 - DNA, 19 bp, Homo sapiens
gcactgtctcagtttcact

SEQ ID NO: 3123894 - DNA, 22 bp, Homo sapiens
gcactgttaatacacagtactt

SEQ ID NO: 3123895 - DNA, 12 bp, Homo sapiens
gcacttaaaaat

SEQ ID NO: 3123896 - DNA, 16 bp, Homo sapiens
gcacttaagtgcactt

SEQ ID NO: 3123897 - DNA, 17 bp, Homo sapiens
gcacttaagtgcacttt

SEQ ID NO: 3123898 - DNA, 19 bp, Homo sapiens
gcacttaagtgcacttttt

SEQ ID NO: 3123899 - DNA, 14 bp, Homo sapiens
gcacttaatggctg

SEQ ID NO: 3123900 - DNA, 18 bp, Homo sapiens
gcacttaatttgtaaact

SEQ ID NO: 3123901 - DNA, 22 bp, Homo sapiens
gcacttactggtaggaccaagc

SEQ ID NO: 3123902 - DNA, 20 bp, Homo sapiens
gcacttatatagcacctttc

SEQ ID NO: 3123903 - DNA, 21 bp, Homo sapiens
gcacttatatagcacctttca

SEQ ID NO: 3123904 - DNA, 16 bp, Homo sapiens
gcacttattgtaaatt

SEQ ID NO: 3123905 - DNA, 18 bp, Homo sapiens
gcacttatttaatgccga

SEQ ID NO: 3123906 - DNA, 23 bp, Homo sapiens
gcacttcattgagagttttgtct

SEQ ID NO: 3123907 - DNA, 12 bp, Homo sapiens
gcacttccaaaa

SEQ ID NO: 3123908 - DNA, 18 bp, Homo sapiens
gcacttccaaaattctta

SEQ ID NO: 3123909 - DNA, 21 bp, Homo sapiens
gcacttccttttacctgccca

SEQ ID NO: 3123910 - DNA, 14 bp, Homo sapiens
gcacttgcagactc

SEQ ID NO: 3123911 - DNA, 15 bp, Homo sapiens
gcacttgcgtcctgc

SEQ ID NO: 3123912 - DNA, 17 bp, Homo sapiens
gcacttgcgtcctgcag

SEQ ID NO: 3123913 - DNA, 18 bp, Homo sapiens
gcacttggagacttgtat

SEQ ID NO: 3123914 - DNA, 20 bp, Homo sapiens
gcacttgtgattatttatta

SEQ ID NO: 3123915 - DNA, 22 bp, Homo sapiens
gcactttcattgccagtgtctt

SEQ ID NO: 3123916 - DNA, 22 bp, Homo sapiens
gcactttctacaatgtgaactt

SEQ ID NO: 3123917 - DNA, 13 bp, Homo sapiens
gcactttgaaata

SEQ ID NO: 3123918 - DNA, 23 bp, Homo sapiens
gcactttgaaatacctcatgttt

SEQ ID NO: 3123919 - DNA, 16 bp, Homo sapiens
gcactttgggaggcct

SEQ ID NO: 3123920 - DNA, 21 bp, Homo sapiens
gcactttgggaggctgaggcg

SEQ ID NO: 3123921 - DNA, 21 bp, Homo sapiens
gcactttgggaggctgaggtg

SEQ ID NO: 3123922 - DNA, 14 bp, Homo sapiens
gcacttttgttatt

SEQ ID NO: 3123923 - DNA, 14 bp, Homo sapiens
gcactttttcattt

SEQ ID NO: 3123924 - DNA, 20 bp, Homo sapiens
gcacttttttatgaagaaaa

SEQ ID NO: 3123925 - DNA, 15 bp, Homo sapiens
gcagaaaacagagcc

SEQ ID NO: 3123926 - DNA, 22 bp, Homo sapiens
gcagaaaacggagagtgcttgg

SEQ ID NO: 3123927 - DNA, 16 bp, Homo sapiens
gcagaaatagacaaaa

SEQ ID NO: 3123928 - DNA, 14 bp, Homo sapiens
gcagaaatctagaa

SEQ ID NO: 3123929 - DNA, 14 bp, Homo sapiens
gcagaacagtgaaa

SEQ ID NO: 3123930 - DNA, 17 bp, Homo sapiens
gcagaacggtttttgga

SEQ ID NO: 3123931 - DNA, 19 bp, Homo sapiens
gcagaactgccattatttt

SEQ ID NO: 3123932 - DNA, 14 bp, Homo sapiens
gcagaagaaaggaa

SEQ ID NO: 3123933 - DNA, 15 bp, Homo sapiens
gcagaagaaaggaac

SEQ ID NO: 3123934 - DNA, 16 bp, Homo sapiens
gcagaagaaaggaaca

SEQ ID NO: 3123935 - DNA, 22 bp, Homo sapiens
gcagaagaatgggaatatttta

SEQ ID NO: 3123936 - DNA, 21 bp, Homo sapiens
gcagaagacaccagagcagat

SEQ ID NO: 3123937 - DNA, 14 bp, Homo sapiens
gcagaagagggtgt

SEQ ID NO: 3123938 - DNA, 15 bp, Homo sapiens
gcagaaggaaagaag

SEQ ID NO: 3123939 - DNA, 15 bp, Homo sapiens
gcagaataatggaaa

SEQ ID NO: 3123940 - DNA, 17 bp, Homo sapiens
gcagaataatggaaaca

SEQ ID NO: 3123941 - DNA, 23 bp, Homo sapiens
gcagaatcctaggctccacccca

SEQ ID NO: 3123942 - DNA, 18 bp, Homo sapiens
gcagaattttaatgtgaa

SEQ ID NO: 3123943 - DNA, 19 bp, Homo sapiens
gcagaattttaatgtgaag

SEQ ID NO: 3123944 - DNA, 15 bp, Homo sapiens
gcagacacctggact

SEQ ID NO: 3123945 - DNA, 22 bp, Homo sapiens
gcagacacctggactgagccaa

SEQ ID NO: 3123946 - DNA, 15 bp, Homo sapiens
gcagacaccttggac

SEQ ID NO: 3123947 - DNA, 20 bp, Homo sapiens
gcagacacgccttcccctca

SEQ ID NO: 3123948 - DNA, 15 bp, Homo sapiens
gcagacagaaactgg

SEQ ID NO: 3123949 - DNA, 16 bp, Homo sapiens
gcagacagaaactgga

SEQ ID NO: 3123950 - DNA, 15 bp, Homo sapiens
gcagacagcaggcag

SEQ ID NO: 3123951 - DNA, 14 bp, Homo sapiens
gcagacaggaggaa

SEQ ID NO: 3123952 - DNA, 19 bp, Homo sapiens
gcagacaggcaagcacctc

SEQ ID NO: 3123953 - DNA, 21 bp, Homo sapiens
gcagacaggccatgtgagcca

SEQ ID NO: 3123954 - DNA, 19 bp, Homo sapiens
gcagacatgtgcacttgaa

SEQ ID NO: 3123955 - DNA, 15 bp, Homo sapiens
gcagacctccccagc

SEQ ID NO: 3123956 - DNA, 16 bp, Homo sapiens
gcagacctccccagcc

SEQ ID NO: 3123957 - DNA, 23 bp, Homo sapiens
gcagacctccccagcccctagcc

SEQ ID NO: 3123958 - DNA, 14 bp, Homo sapiens
gcagacgggcaaga

SEQ ID NO: 3123959 - DNA, 17 bp, Homo sapiens
gcagacgggcaagaagc

SEQ ID NO: 3123960 - DNA, 22 bp, Homo sapiens
gcagacgggcaagaagctgctt

SEQ ID NO: 3123961 - DNA, 14 bp, Homo sapiens
gcagacgggcacag

SEQ ID NO: 3123962 - DNA, 17 bp, Homo sapiens
gcagacgggcacagaca

SEQ ID NO: 3123963 - DNA, 21 bp, Homo sapiens
gcagactcctcagatctgaac

SEQ ID NO: 3123964 - DNA, 15 bp, Homo sapiens
gcagactctacagag

SEQ ID NO: 3123965 - DNA, 19 bp, Homo sapiens
gcagactggcggagaagga

SEQ ID NO: 3123966 - DNA, 21 bp, Homo sapiens
gcagactggcggagaaggaga

SEQ ID NO: 3123967 - DNA, 22 bp, Homo sapiens
gcagactggcggagaaggagag

SEQ ID NO: 3123968 - DNA, 16 bp, Homo sapiens
gcagacttcccagcta

SEQ ID NO: 3123969 - DNA, 15 bp, Homo sapiens
gcagagaagctggac

SEQ ID NO: 3123970 - DNA, 15 bp, Homo sapiens
gcagagaagttctca

SEQ ID NO: 3123971 - DNA, 10 bp, Homo sapiens
gcagagaatg

SEQ ID NO: 3123972 - DNA, 21 bp, Homo sapiens
gcagagaattctcttatccaa

SEQ ID NO: 3123973 - DNA, 21 bp, Homo sapiens
gcagagcacctttgcacagga

SEQ ID NO: 3123974 - DNA, 14 bp, Homo sapiens
gcagagcaggggca

SEQ ID NO: 3123975 - DNA, 20 bp, Homo sapiens
gcagagcaggggcagggtga

SEQ ID NO: 3123976 - DNA, 19 bp, Homo sapiens
gcagagccatgggcctggg

SEQ ID NO: 3123977 - DNA, 20 bp, Homo sapiens
gcagagcgccgtgagttctc

SEQ ID NO: 3123978 - DNA, 22 bp, Homo sapiens
gcagagctgacgggaggcccca

SEQ ID NO: 3123979 - DNA, 18 bp, Homo sapiens
gcagagctgcacttggcc

SEQ ID NO: 3123980 - DNA, 12 bp, Homo sapiens
gcagagctggct

SEQ ID NO: 3123981 - DNA, 17 bp, Homo sapiens
gcagaggaattatgaac

SEQ ID NO: 3123982 - DNA, 19 bp, Homo sapiens
gcagaggacagtctggaga

SEQ ID NO: 3123983 - DNA, 22 bp, Homo sapiens
gcagaggacagtctggagaagg

SEQ ID NO: 3123984 - DNA, 14 bp, Homo sapiens
gcagaggacgcacg

SEQ ID NO: 3123985 - DNA, 20 bp, Homo sapiens
gcagaggacgcacgctcgct

SEQ ID NO: 3123986 - DNA, 24 bp, Homo sapiens
gcagaggacgcacgctcgctgcca

SEQ ID NO: 3123987 - DNA, 15 bp, Homo sapiens
gcagaggccagaggc

SEQ ID NO: 3123988 - DNA, 17 bp, Homo sapiens
gcagagggaatgttccc

SEQ ID NO: 3123989 - DNA, 12 bp, Homo sapiens
gcagagggctgg

SEQ ID NO: 3123990 - DNA, 13 bp, Homo sapiens
gcagagggctgga

SEQ ID NO: 3123991 - DNA, 17 bp, Homo sapiens
gcagaggggcagccgct

SEQ ID NO: 3123992 - DNA, 19 bp, Homo sapiens
gcagaggggccaggcccag

SEQ ID NO: 3123993 - DNA, 20 bp, Homo sapiens
gcagaggggccaggcccagg

SEQ ID NO: 3123994 - DNA, 21 bp, Homo sapiens
gcagaggggccaggcccaggc

SEQ ID NO: 3123995 - DNA, 22 bp, Homo sapiens
gcagaggggccaggcccaggca

SEQ ID NO: 3123996 - DNA, 12 bp, Homo sapiens
gcagaggggctt

SEQ ID NO: 3123997 - DNA, 18 bp, Homo sapiens
gcagaggggctttctgga

SEQ ID NO: 3123998 - DNA, 23 bp, Homo sapiens
gcagagggggagtagccaagctg

SEQ ID NO: 3123999 - DNA, 14 bp, Homo sapiens
gcagaggtggccag

SEQ ID NO: 3124000 - DNA, 15 bp, Homo sapiens
gcagaggtggccaga

SEQ ID NO: 3124001 - DNA, 23 bp, Homo sapiens
gcagaggtggccagagctgggag

SEQ ID NO: 3124002 - DNA, 22 bp, Homo sapiens
gcagagtcgttggagactgaag

SEQ ID NO: 3124003 - DNA, 14 bp, Homo sapiens
gcagagtctgggcc

SEQ ID NO: 3124004 - DNA, 17 bp, Homo sapiens
gcagagtgcacagctgt

SEQ ID NO: 3124005 - DNA, 17 bp, Homo sapiens
gcagagttctgtgaaga

SEQ ID NO: 3124006 - DNA, 20 bp, Homo sapiens
gcagagtttgtgtgttgtct

SEQ ID NO: 3124007 - DNA, 24 bp, Homo sapiens
gcagagtttgtgtgttgtcttgaa

SEQ ID NO: 3124008 - DNA, 12 bp, Homo sapiens
gcagagttttca

SEQ ID NO: 3124009 - DNA, 14 bp, Homo sapiens
gcagagttttcatt

SEQ ID NO: 3124010 - DNA, 17 bp, Homo sapiens
gcagataatcagcctct

SEQ ID NO: 3124011 - DNA, 19 bp, Homo sapiens
gcagataatcagcctctta

SEQ ID NO: 3124012 - DNA, 14 bp, Homo sapiens
gcagatctgtgccc

SEQ ID NO: 3124013 - DNA, 20 bp, Homo sapiens
gcagatctgtgccccatgcc

SEQ ID NO: 3124014 - DNA, 14 bp, Homo sapiens
gcagatgatccatg

SEQ ID NO: 3124015 - DNA, 17 bp, Homo sapiens
gcagatgcagagagcca

SEQ ID NO: 3124016 - DNA, 18 bp, Homo sapiens
gcagatgcagagagccat

SEQ ID NO: 3124017 - DNA, 16 bp, Homo sapiens
gcagatgccaccctag

SEQ ID NO: 3124018 - DNA, 18 bp, Homo sapiens
gcagatggaatgctgtgt

SEQ ID NO: 3124019 - DNA, 12 bp, Homo sapiens
gcagatgggctg

SEQ ID NO: 3124020 - DNA, 18 bp, Homo sapiens
gcagatgtattgactgta

SEQ ID NO: 3124021 - DNA, 18 bp, Homo sapiens
gcagattcctgggcctgt

SEQ ID NO: 3124022 - DNA, 21 bp, Homo sapiens
gcagattcctgggcctgtccc

SEQ ID NO: 3124023 - DNA, 22 bp, Homo sapiens
gcagatttatttttgaaacaaa

SEQ ID NO: 3124024 - DNA, 20 bp, Homo sapiens
gcagattttacaaaagatgt

SEQ ID NO: 3124025 - DNA, 15 bp, Homo sapiens
gcagcaaaaatataa

SEQ ID NO: 3124026 - DNA, 16 bp, Homo sapiens
gcagcaaaaatataaa

SEQ ID NO: 3124027 - DNA, 16 bp, Homo sapiens
gcagcaaacactccac

SEQ ID NO: 3124028 - DNA, 11 bp, Homo sapiens
gcattcatttt

SEQ ID NO: 3124029 - DNA, 23 bp, Homo sapiens
gcattccagacttcaaaaataaa

SEQ ID NO: 3124030 - DNA, 12 bp, Homo sapiens
gcattccagccc

SEQ ID NO: 3124031 - DNA, 15 bp, Homo sapiens
gcattccagcccctc

SEQ ID NO: 3124032 - DNA, 16 bp, Homo sapiens
gcattcctacaaagat

SEQ ID NO: 3124033 - DNA, 19 bp, Homo sapiens
gcattcctacaaagatgtt

SEQ ID NO: 3124034 - DNA, 19 bp, Homo sapiens
gcattcctgtaacttttaa

SEQ ID NO: 3124035 - DNA, 15 bp, Homo sapiens
gcattccttctttga

SEQ ID NO: 3124036 - DNA, 16 bp, Homo sapiens
gcattcgggccacagg

SEQ ID NO: 3124037 - DNA, 13 bp, Homo sapiens
gcattctagtact

SEQ ID NO: 3124038 - DNA, 15 bp, Homo sapiens
gcattctcactccta

SEQ ID NO: 3124039 - DNA, 16 bp, Homo sapiens
gcattctctcccatcc

SEQ ID NO: 3124040 - DNA, 20 bp, Homo sapiens
gcattctctcccatcctggg

SEQ ID NO: 3124041 - DNA, 22 bp, Homo sapiens
gcattcttagcctgtggcagta

SEQ ID NO: 3124042 - DNA, 14 bp, Homo sapiens
gcattcttctctgt

SEQ ID NO: 3124043 - DNA, 19 bp, Homo sapiens
gcattcttgtcacaataaa

SEQ ID NO: 3124044 - DNA, 22 bp, Homo sapiens
gcattcttgtcacaataaatgt

SEQ ID NO: 3124045 - DNA, 12 bp, Homo sapiens
gcattctttccc

SEQ ID NO: 3124046 - DNA, 13 bp, Homo sapiens
gcattctttccca

SEQ ID NO: 3124047 - DNA, 17 bp, Homo sapiens
gcattctttggtaattt

SEQ ID NO: 3124048 - DNA, 12 bp, Homo sapiens
gcattgaacaca

SEQ ID NO: 3124049 - DNA, 16 bp, Homo sapiens
gcattgaacacaaact

SEQ ID NO: 3124050 - DNA, 18 bp, Homo sapiens
gcattgaacacaaactgt

SEQ ID NO: 3124051 - DNA, 21 bp, Homo sapiens
gcattgaacacaaactgtaaa

SEQ ID NO: 3124052 - DNA, 16 bp, Homo sapiens
gcattgacaaatctgt

SEQ ID NO: 3124053 - DNA, 23 bp, Homo sapiens
gcattgactggtttacaggccct

SEQ ID NO: 3124054 - DNA, 14 bp, Homo sapiens
gcattgataatctt

SEQ ID NO: 3124055 - DNA, 18 bp, Homo sapiens
gcattgataatcttcagg

SEQ ID NO: 3124056 - DNA, 12 bp, Homo sapiens
gcattgcctggc

SEQ ID NO: 3124057 - DNA, 20 bp, Homo sapiens
gcattgctttctgaaattag

SEQ ID NO: 3124058 - DNA, 20 bp, Homo sapiens
gcattgcttttattttgaaa

SEQ ID NO: 3124059 - DNA, 12 bp, Homo sapiens
gcattggatatt

SEQ ID NO: 3124060 - DNA, 20 bp, Homo sapiens
gcattgtatagatataatga

SEQ ID NO: 3124061 - DNA, 16 bp, Homo sapiens
gcattgtccctgtgcc

SEQ ID NO: 3124062 - DNA, 13 bp, Homo sapiens
gcattgtctctct

SEQ ID NO: 3124063 - DNA, 13 bp, Homo sapiens
gcattgtcttgtt

SEQ ID NO: 3124064 - DNA, 21 bp, Homo sapiens
gcattgtcttgttctgtccct

SEQ ID NO: 3124065 - DNA, 22 bp, Homo sapiens
gcattgtcttgttctgtccctt

SEQ ID NO: 3124066 - DNA, 15 bp, Homo sapiens
gcattgtctttgctg

SEQ ID NO: 3124067 - DNA, 20 bp, Homo sapiens
gcattgtgtcagaaacatga

SEQ ID NO: 3124068 - DNA, 15 bp, Homo sapiens
gcattgttagtttag

SEQ ID NO: 3124069 - DNA, 21 bp, Homo sapiens
gcattgttagtttagtgtgtg

SEQ ID NO: 3124070 - DNA, 23 bp, Homo sapiens
gcattgttgaggtggtctgaatg

SEQ ID NO: 3124071 - DNA, 22 bp, Homo sapiens
gcattgtttgcttattgttcca

SEQ ID NO: 3124072 - DNA, 12 bp, Homo sapiens
gcatttaaatca

SEQ ID NO: 3124073 - DNA, 13 bp, Homo sapiens
gcatttaataaag

SEQ ID NO: 3124074 - DNA, 19 bp, Homo sapiens
gcatttaataaagatgagt

SEQ ID NO: 3124075 - DNA, 19 bp, Homo sapiens
gcatttaggccatgggaca

SEQ ID NO: 3124076 - DNA, 19 bp, Homo sapiens
gcatttatggtcaacactt

SEQ ID NO: 3124077 - DNA, 21 bp, Homo sapiens
gcatttatttatacagtgcct

SEQ ID NO: 3124078 - DNA, 22 bp, Homo sapiens
gcatttatttatacagtgcctt

SEQ ID NO: 3124079 - DNA, 17 bp, Homo sapiens
gcatttcaaatgttaga

SEQ ID NO: 3124080 - DNA, 18 bp, Homo sapiens
gcatttcaaggaatggaa

SEQ ID NO: 3124081 - DNA, 14 bp, Homo sapiens
gcatttcattcaaa

SEQ ID NO: 3124082 - DNA, 22 bp, Homo sapiens
gcatttcattcttctctagctg

SEQ ID NO: 3124083 - DNA, 15 bp, Homo sapiens
gcatttctcttctca

SEQ ID NO: 3124084 - DNA, 23 bp, Homo sapiens
gcatttgcacctctgttcatttc

SEQ ID NO: 3124085 - DNA, 13 bp, Homo sapiens
gcatttgtcaatg

SEQ ID NO: 3124086 - DNA, 20 bp, Homo sapiens
gcatttttgatttatgcatg

SEQ ID NO: 3124087 - DNA, 18 bp, Homo sapiens
gccaaaaaaaaaagaagt

SEQ ID NO: 3124088 - DNA, 15 bp, Homo sapiens
gccaaacaaaactga

SEQ ID NO: 3124089 - DNA, 13 bp, Homo sapiens
gccaaacaagcct

SEQ ID NO: 3124090 - DNA, 20 bp, Homo sapiens
gccaaacatcagacctgtct

SEQ ID NO: 3124091 - DNA, 21 bp, Homo sapiens
gccaaaccaggaccctgtcca

SEQ ID NO: 3124092 - DNA, 17 bp, Homo sapiens
gccaaacccttgctttc

SEQ ID NO: 3124093 - DNA, 17 bp, Homo sapiens
gccaaactctgccagcc

SEQ ID NO: 3124094 - DNA, 18 bp, Homo sapiens
gccaaactctgccagcca

SEQ ID NO: 3124095 - DNA, 13 bp, Homo sapiens
gccaaactgctgg

SEQ ID NO: 3124096 - DNA, 19 bp, Homo sapiens
gccaaagaaacaagctgtg

SEQ ID NO: 3124097 - DNA, 23 bp, Homo sapiens
gccaaagaaacaagctgtgcagg

SEQ ID NO: 3124098 - DNA, 17 bp, Homo sapiens
gccaaagaaatgaacat

SEQ ID NO: 3124099 - DNA, 22 bp, Homo sapiens
gccaaagaaatgaacattccaa

SEQ ID NO: 3124100 - DNA, 19 bp, Homo sapiens
gccaaagacttagtatatt

SEQ ID NO: 3124101 - DNA, 22 bp, Homo sapiens
gccaaagctaggcctggccaga

SEQ ID NO: 3124102 - DNA, 20 bp, Homo sapiens
gccaaagctagggtggccct

SEQ ID NO: 3124103 - DNA, 16 bp, Homo sapiens
gccaaaggatgtgata

SEQ ID NO: 3124104 - DNA, 12 bp, Homo sapiens
gccaaagtgtta

SEQ ID NO: 3124105 - DNA, 15 bp, Homo sapiens
gccaaatatgtcctg

SEQ ID NO: 3124106 - DNA, 13 bp, Homo sapiens
gccaaatgttcat

SEQ ID NO: 3124107 - DNA, 11 bp, Homo sapiens
gccaaattatt

SEQ ID NO: 3124108 - DNA, 18 bp, Homo sapiens
gccaaattatttgtgtaa

SEQ ID NO: 3124109 - DNA, 17 bp, Homo sapiens
gccaacagaagcttcca

SEQ ID NO: 3124110 - DNA, 23 bp, Homo sapiens
gccaacatcgtgaaaccctgtct

SEQ ID NO: 3124111 - DNA, 14 bp, Homo sapiens
gccaacgacaaagc

SEQ ID NO: 3124112 - DNA, 18 bp, Homo sapiens
gccaacggcaacagcatg

SEQ ID NO: 3124113 - DNA, 15 bp, Homo sapiens
gccaactaagccctc

SEQ ID NO: 3124114 - DNA, 18 bp, Homo sapiens
gccaactatgattattaa

SEQ ID NO: 3124115 - DNA, 20 bp, Homo sapiens
gccaactcacaggtgctttt

SEQ ID NO: 3124116 - DNA, 18 bp, Homo sapiens
gccaactctaacaggcac

SEQ ID NO: 3124117 - DNA, 17 bp, Homo sapiens
gccaactgctaatgcaa

SEQ ID NO: 3124118 - DNA, 12 bp, Homo sapiens
gccaactgctgc

SEQ ID NO: 3124119 - DNA, 15 bp, Homo sapiens
gccaacttgagggcc

SEQ ID NO: 3124120 - DNA, 23 bp, Homo sapiens
gccaacttgagggcccagagcag

SEQ ID NO: 3124121 - DNA, 14 bp, Homo sapiens
gccaacttgtaaat

SEQ ID NO: 3124122 - DNA, 17 bp, Homo sapiens
gccaacttgtaaataca

SEQ ID NO: 3124123 - DNA, 22 bp, Homo sapiens
gccaagaaaattgcctttaaaa

SEQ ID NO: 3124124 - DNA, 17 bp, Homo sapiens
gccaagacaaatcaaca

SEQ ID NO: 3124125 - DNA, 19 bp, Homo sapiens
gccaagacaaatcaacaga

SEQ ID NO: 3124126 - DNA, 23 bp, Homo sapiens
gccaagacaaatcaacagaagca

SEQ ID NO: 3124127 - DNA, 12 bp, Homo sapiens
gccaagactcct

SEQ ID NO: 3124128 - DNA, 17 bp, Homo sapiens
gccaagactcctcaggc

SEQ ID NO: 3124129 - DNA, 21 bp, Homo sapiens
gccaagagaaaggcctgcaca

SEQ ID NO: 3124130 - DNA, 16 bp, Homo sapiens
gccaagagcagaggca

SEQ ID NO: 3124131 - DNA, 13 bp, Homo sapiens
gccaagcaacctg

SEQ ID NO: 3124132 - DNA, 22 bp, Homo sapiens
gccaagccagattctcttgaat

SEQ ID NO: 3124133 - DNA, 21 bp, Homo sapiens
gccaagccctccccatcccat

SEQ ID NO: 3124134 - DNA, 19 bp, Homo sapiens
gccaagctccctggagccc

SEQ ID NO: 3124135 - DNA, 21 bp, Homo sapiens
gccaagctccctggagccctg

SEQ ID NO: 3124136 - DNA, 14 bp, Homo sapiens
gccaaggagcccct

SEQ ID NO: 3124137 - DNA, 20 bp, Homo sapiens
gccaaggaggtgaggagcag

SEQ ID NO: 3124138 - DNA, 15 bp, Homo sapiens
gccaaggcaggtaga

SEQ ID NO: 3124139 - DNA, 19 bp, Homo sapiens
gccaaggtgggctgagccc

SEQ ID NO: 3124140 - DNA, 21 bp, Homo sapiens
gccaaggtgggctgagccctg

SEQ ID NO: 3124141 - DNA, 21 bp, Homo sapiens
gccaagtccgcagaagccctg

SEQ ID NO: 3124142 - DNA, 22 bp, Homo sapiens
gccaagtgtgaccccactgcca

SEQ ID NO: 3124143 - DNA, 21 bp, Homo sapiens
gccaagttcctctagtgccct

SEQ ID NO: 3124144 - DNA, 14 bp, Homo sapiens
gccaataaaaagtt

SEQ ID NO: 3124145 - DNA, 20 bp, Homo sapiens
gccaataaagcttttggaag

SEQ ID NO: 3124146 - DNA, 19 bp, Homo sapiens
gccaatcccctccttgggc

SEQ ID NO: 3124147 - DNA, 17 bp, Homo sapiens
gccaatctattctcaaa

SEQ ID NO: 3124148 - DNA, 19 bp, Homo sapiens
gccaatgaggtctgaaatg

SEQ ID NO: 3124149 - DNA, 21 bp, Homo sapiens
gccaatggagactgtctcaag

SEQ ID NO: 3124150 - DNA, 19 bp, Homo sapiens
gccaattgaataggatcaa

SEQ ID NO: 3124151 - DNA, 13 bp, Homo sapiens
gccaattgctacc

SEQ ID NO: 3124152 - DNA, 16 bp, Homo sapiens
gccacaaatgccttga

SEQ ID NO: 3124153 - DNA, 21 bp, Homo sapiens
gccacaacagaataaagcagc

SEQ ID NO: 3124154 - DNA, 22 bp, Homo sapiens
gccacaacagaataaagcagcc

SEQ ID NO: 3124155 - DNA, 14 bp, Homo sapiens
gccacaagaaattt

SEQ ID NO: 3124156 - DNA, 16 bp, Homo sapiens
gccacaagaaatttga

SEQ ID NO: 3124157 - DNA, 17 bp, Homo sapiens
gcagcaaggccctgctg

SEQ ID NO: 3124158 - DNA, 16 bp, Homo sapiens
gcagcacagtgtgtga

SEQ ID NO: 3124159 - DNA, 12 bp, Homo sapiens
gcagcaccctcc

SEQ ID NO: 3124160 - DNA, 19 bp, Homo sapiens
gcagcaccctcccccgcag

SEQ ID NO: 3124161 - DNA, 16 bp, Homo sapiens
gcagcacctccaggcc

SEQ ID NO: 3124162 - DNA, 17 bp, Homo sapiens
gcagcacctccaggcct

SEQ ID NO: 3124163 - DNA, 18 bp, Homo sapiens
gcagcacctccaggcctg

SEQ ID NO: 3124164 - DNA, 15 bp, Homo sapiens
gcagcacggacaata

SEQ ID NO: 3124165 - DNA, 22 bp, Homo sapiens
gcagcactccccagagctgtgc

SEQ ID NO: 3124166 - DNA, 23 bp, Homo sapiens
gcagcactccccagagctgtgcc

SEQ ID NO: 3124167 - DNA, 14 bp, Homo sapiens
gcagcagataactt

SEQ ID NO: 3124168 - DNA, 13 bp, Homo sapiens
gcagcagcaccaa

SEQ ID NO: 3124169 - DNA, 15 bp, Homo sapiens
gcagcagcaccaacc

SEQ ID NO: 3124170 - DNA, 12 bp, Homo sapiens
gcagcagccacc

SEQ ID NO: 3124171 - DNA, 14 bp, Homo sapiens
gcagcagccatcat

SEQ ID NO: 3124172 - DNA, 16 bp, Homo sapiens
gcagcagctaggactg

SEQ ID NO: 3124173 - DNA, 17 bp, Homo sapiens
gcagcagctctgagcca

SEQ ID NO: 3124174 - DNA, 18 bp, Homo sapiens
gcagcagctctgagccag

SEQ ID NO: 3124175 - DNA, 20 bp, Homo sapiens
gcagcagctctgagccagat

SEQ ID NO: 3124176 - DNA, 23 bp, Homo sapiens
gcagcatcggacaagacccccag

SEQ ID NO: 3124177 - DNA, 19 bp, Homo sapiens
gcagcatcttcacttctaa

SEQ ID NO: 3124178 - DNA, 14 bp, Homo sapiens
gcagcatgcttggg

SEQ ID NO: 3124179 - DNA, 14 bp, Homo sapiens
gcagcatggaaaaa

SEQ ID NO: 3124180 - DNA, 17 bp, Homo sapiens
gcagcatggaaaaatgg

SEQ ID NO: 3124181 - DNA, 20 bp, Homo sapiens
gcagcatgttgctgaggagt

SEQ ID NO: 3124182 - DNA, 15 bp, Homo sapiens
gcagcattgactggt

SEQ ID NO: 3124183 - DNA, 14 bp, Homo sapiens
gcagccaacctaag

SEQ ID NO: 3124184 - DNA, 12 bp, Homo sapiens
gcagccaaggcc

SEQ ID NO: 3124185 - DNA, 22 bp, Homo sapiens
gcagccaaggccgaagctctgg

SEQ ID NO: 3124186 - DNA, 22 bp, Homo sapiens
gcagccacccaagcctgctggc

SEQ ID NO: 3124187 - DNA, 15 bp, Homo sapiens
gcagccagcagaggg

SEQ ID NO: 3124188 - DNA, 19 bp, Homo sapiens
gcagcccaaaacccagggc

SEQ ID NO: 3124189 - DNA, 13 bp, Homo sapiens
gcagcccagagac

SEQ ID NO: 3124190 - DNA, 14 bp, Homo sapiens
gcagcccagagact

SEQ ID NO: 3124191 - DNA, 18 bp, Homo sapiens
gcagcccagagactttgt

SEQ ID NO: 3124192 - DNA, 22 bp, Homo sapiens
gcagcccagagactttgtagat

SEQ ID NO: 3124193 - DNA, 22 bp, Homo sapiens
gcagcccatgcccacctgccca

SEQ ID NO: 3124194 - DNA, 16 bp, Homo sapiens
gcagccccagagagag

SEQ ID NO: 3124195 - DNA, 14 bp, Homo sapiens
gcagccccccagca

SEQ ID NO: 3124196 - DNA, 16 bp, Homo sapiens
gcagccccccagcact

SEQ ID NO: 3124197 - DNA, 20 bp, Homo sapiens
gcagcccgtgaagcagtgcc

SEQ ID NO: 3124198 - DNA, 21 bp, Homo sapiens
gcagcccgtgaagcagtgcct

SEQ ID NO: 3124199 - DNA, 12 bp, Homo sapiens
gcagcccttggg

SEQ ID NO: 3124200 - DNA, 16 bp, Homo sapiens
gcagcccttgggcagt

SEQ ID NO: 3124201 - DNA, 15 bp, Homo sapiens
gcagccgccagctgg

SEQ ID NO: 3124202 - DNA, 17 bp, Homo sapiens
gcagccgccagctggga

SEQ ID NO: 3124203 - DNA, 17 bp, Homo sapiens
gcagccgctaggagaga

SEQ ID NO: 3124204 - DNA, 19 bp, Homo sapiens
gcagccgctaggagagact

SEQ ID NO: 3124205 - DNA, 21 bp, Homo sapiens
gcagccgctaggagagactga

SEQ ID NO: 3124206 - DNA, 19 bp, Homo sapiens
gcagccggcacagggtctg

SEQ ID NO: 3124207 - DNA, 14 bp, Homo sapiens
gcagccgtgccttc

SEQ ID NO: 3124208 - DNA, 15 bp, Homo sapiens
gcagccgtgccttca

SEQ ID NO: 3124209 - DNA, 17 bp, Homo sapiens
gcagcctccaacacaag

SEQ ID NO: 3124210 - DNA, 18 bp, Homo sapiens
gcagcctccaacacaagg

SEQ ID NO: 3124211 - DNA, 16 bp, Homo sapiens
gcagcctccagagcca

SEQ ID NO: 3124212 - DNA, 21 bp, Homo sapiens
gcagcctccagagccagcctg

SEQ ID NO: 3124213 - DNA, 22 bp, Homo sapiens
gcagcctccagagccagcctgg

SEQ ID NO: 3124214 - DNA, 20 bp, Homo sapiens
gcagcctctccccaggtcca

SEQ ID NO: 3124215 - DNA, 12 bp, Homo sapiens
gcagcctgatgg

SEQ ID NO: 3124216 - DNA, 20 bp, Homo sapiens
gcagcctggagacccacccc

SEQ ID NO: 3124217 - DNA, 22 bp, Homo sapiens
gcagcctgtggcatctttgcct

SEQ ID NO: 3124218 - DNA, 15 bp, Homo sapiens
gcagcctttccagcc

SEQ ID NO: 3124219 - DNA, 14 bp, Homo sapiens
gcagcgaccgcccc

SEQ ID NO: 3124220 - DNA, 22 bp, Homo sapiens
gcagcgagctatgatcgcgcca

SEQ ID NO: 3124221 - DNA, 14 bp, Homo sapiens
gcagcgagggcgga

SEQ ID NO: 3124222 - DNA, 15 bp, Homo sapiens
gcagcgccaagcaac

SEQ ID NO: 3124223 - DNA, 18 bp, Homo sapiens
gcagcgccgtgtcctctc

SEQ ID NO: 3124224 - DNA, 13 bp, Homo sapiens
gcagcgggccagg

SEQ ID NO: 3124225 - DNA, 17 bp, Homo sapiens
gcagcgggccaggcccg

SEQ ID NO: 3124226 - DNA, 19 bp, Homo sapiens
gcagcgggccaggcccgca

SEQ ID NO: 3124227 - DNA, 13 bp, Homo sapiens
gcagcgggcggag

SEQ ID NO: 3124228 - DNA, 22 bp, Homo sapiens
gcagcgggcggaggggatccag

SEQ ID NO: 3124229 - DNA, 19 bp, Homo sapiens
gcagctagactggagtgag

SEQ ID NO: 3124230 - DNA, 17 bp, Homo sapiens
gcagctaggactgagga

SEQ ID NO: 3124231 - DNA, 21 bp, Homo sapiens
gcagctaggactgaggagtgg

SEQ ID NO: 3124232 - DNA, 15 bp, Homo sapiens
gcagctagtgccttt

SEQ ID NO: 3124233 - DNA, 22 bp, Homo sapiens
gcagctatgcgcaatgtggcat

SEQ ID NO: 3124234 - DNA, 23 bp, Homo sapiens
gcagctcaagcagcgaccgcccc

SEQ ID NO: 3124235 - DNA, 14 bp, Homo sapiens
gcagctcacccctg

SEQ ID NO: 3124236 - DNA, 23 bp, Homo sapiens
gcagctcatagagtcccccctcc

SEQ ID NO: 3124237 - DNA, 14 bp, Homo sapiens
gcagctcctctcct

SEQ ID NO: 3124238 - DNA, 16 bp, Homo sapiens
gcagctctagctttgc

SEQ ID NO: 3124239 - DNA, 21 bp, Homo sapiens
gcagctctccagtcaggaggc

SEQ ID NO: 3124240 - DNA, 19 bp, Homo sapiens
gcagctctgagccagatta

SEQ ID NO: 3124241 - DNA, 15 bp, Homo sapiens
gcagctcttgccctt

SEQ ID NO: 3124242 - DNA, 17 bp, Homo sapiens
gcagctgaagaaaaaat

SEQ ID NO: 3124243 - DNA, 15 bp, Homo sapiens
gcagctgagagccct

SEQ ID NO: 3124244 - DNA, 21 bp, Homo sapiens
gcagctgagagccctgctgtg

SEQ ID NO: 3124245 - DNA, 23 bp, Homo sapiens
gcagctgagagccctgctgtggg

SEQ ID NO: 3124246 - DNA, 21 bp, Homo sapiens
gcagctgaggacacaccccac

SEQ ID NO: 3124247 - DNA, 14 bp, Homo sapiens
gcagctgattttaa

SEQ ID NO: 3124248 - DNA, 18 bp, Homo sapiens
gcagctgattttaacaat

SEQ ID NO: 3124249 - DNA, 12 bp, Homo sapiens
gcagctgcctct

SEQ ID NO: 3124250 - DNA, 18 bp, Homo sapiens
gcagctgcctctgctccc

SEQ ID NO: 3124251 - DNA, 19 bp, Homo sapiens
gcagctgcctctgctccct

SEQ ID NO: 3124252 - DNA, 15 bp, Homo sapiens
gcagctgcgcgggct

SEQ ID NO: 3124253 - DNA, 20 bp, Homo sapiens
gcagctgcgggtctgaagga

SEQ ID NO: 3124254 - DNA, 23 bp, Homo sapiens
gcagctgcggtccacccaggagc

SEQ ID NO: 3124255 - DNA, 23 bp, Homo sapiens
gcagctgctatccccatctccct

SEQ ID NO: 3124256 - DNA, 13 bp, Homo sapiens
gcagctgctctta

SEQ ID NO: 3124257 - DNA, 18 bp, Homo sapiens
gcagctgctcttagtgcc

SEQ ID NO: 3124258 - DNA, 13 bp, Homo sapiens
gccatctcaggag

SEQ ID NO: 3124259 - DNA, 23 bp, Homo sapiens
gccatctccctccccagaaacag

SEQ ID NO: 3124260 - DNA, 22 bp, Homo sapiens
gccatctgactgccaagccaga

SEQ ID NO: 3124261 - DNA, 23 bp, Homo sapiens
gccatctgactgccaagccagat

SEQ ID NO: 3124262 - DNA, 13 bp, Homo sapiens
gccatctgcccag

SEQ ID NO: 3124263 - DNA, 16 bp, Homo sapiens
gccatgaaccaaatgg

SEQ ID NO: 3124264 - DNA, 11 bp, Homo sapiens
gccatgaatta

SEQ ID NO: 3124265 - DNA, 18 bp, Homo sapiens
gccatgatcgagccactg

SEQ ID NO: 3124266 - DNA, 15 bp, Homo sapiens
gccatgatggcctta

SEQ ID NO: 3124267 - DNA, 16 bp, Homo sapiens
gccatgatttgtccca

SEQ ID NO: 3124268 - DNA, 21 bp, Homo sapiens
gccatgatttgtcccagcctg

SEQ ID NO: 3124269 - DNA, 13 bp, Homo sapiens
gccatgccactgc

SEQ ID NO: 3124270 - DNA, 15 bp, Homo sapiens
gccatgccactgcca

SEQ ID NO: 3124271 - DNA, 21 bp, Homo sapiens
gccatgccactgccaggcacc

SEQ ID NO: 3124272 - DNA, 22 bp, Homo sapiens
gccatgccactgccaggcacct

SEQ ID NO: 3124273 - DNA, 15 bp, Homo sapiens
gccatgccaggaacc

SEQ ID NO: 3124274 - DNA, 14 bp, Homo sapiens
gccatgctgaggcc

SEQ ID NO: 3124275 - DNA, 17 bp, Homo sapiens
gccatgctgaggcctgg

SEQ ID NO: 3124276 - DNA, 21 bp, Homo sapiens
gccatgctgaggcctgggccg

SEQ ID NO: 3124277 - DNA, 22 bp, Homo sapiens
gccatgctgggccactggggac

SEQ ID NO: 3124278 - DNA, 17 bp, Homo sapiens
gccatggcgtgtccctc

SEQ ID NO: 3124279 - DNA, 19 bp, Homo sapiens
gccatgggacagggaggac

SEQ ID NO: 3124280 - DNA, 22 bp, Homo sapiens
gccatgggacagggaggacgct

SEQ ID NO: 3124281 - DNA, 23 bp, Homo sapiens
gccatgggacagggaggacgctc

SEQ ID NO: 3124282 - DNA, 14 bp, Homo sapiens
gccatgggccagcc

SEQ ID NO: 3124283 - DNA, 17 bp, Homo sapiens
gccatgggccagcctag

SEQ ID NO: 3124284 - DNA, 18 bp, Homo sapiens
gccatgggccagcctagc

SEQ ID NO: 3124285 - DNA, 15 bp, Homo sapiens
gccatgggcctcctg

SEQ ID NO: 3124286 - DNA, 14 bp, Homo sapiens
gccatgggcctggg

SEQ ID NO: 3124287 - DNA, 16 bp, Homo sapiens
gccatgggcctgggcc

SEQ ID NO: 3124288 - DNA, 17 bp, Homo sapiens
gccatgggcctgggcct

SEQ ID NO: 3124289 - DNA, 18 bp, Homo sapiens
gccatgggcctgggcctg

SEQ ID NO: 3124290 - DNA, 16 bp, Homo sapiens
gccatggtaccccctt

SEQ ID NO: 3124291 - DNA, 15 bp, Homo sapiens
gccatgtactagttt

SEQ ID NO: 3124292 - DNA, 22 bp, Homo sapiens
gccatgtccaaagaggctgccc

SEQ ID NO: 3124293 - DNA, 17 bp, Homo sapiens
gccatgtgaagagggag

SEQ ID NO: 3124294 - DNA, 20 bp, Homo sapiens
gccatgtgagccaccgctgc

SEQ ID NO: 3124295 - DNA, 16 bp, Homo sapiens
gccatgttggccaggc

SEQ ID NO: 3124296 - DNA, 23 bp, Homo sapiens
gccatgtttagtgaatgactttt

SEQ ID NO: 3124297 - DNA, 21 bp, Homo sapiens
gccattaaatgaatattttga

SEQ ID NO: 3124298 - DNA, 23 bp, Homo sapiens
gccattaaatgaatattttgata

SEQ ID NO: 3124299 - DNA, 18 bp, Homo sapiens
gccattaccatggagaca

SEQ ID NO: 3124300 - DNA, 19 bp, Homo sapiens
gccattattttctgtcaga

SEQ ID NO: 3124301 - DNA, 20 bp, Homo sapiens
gccattattttctgtcagat

SEQ ID NO: 3124302 - DNA, 22 bp, Homo sapiens
gccattcacactttttatttaa

SEQ ID NO: 3124303 - DNA, 14 bp, Homo sapiens
gccattccactcca

SEQ ID NO: 3124304 - DNA, 13 bp, Homo sapiens
gccattcccagcg

SEQ ID NO: 3124305 - DNA, 20 bp, Homo sapiens
gccattcttctggtgctact

SEQ ID NO: 3124306 - DNA, 14 bp, Homo sapiens
gccattgaccaccc

SEQ ID NO: 3124307 - DNA, 18 bp, Homo sapiens
gccattgccaccaggaga

SEQ ID NO: 3124308 - DNA, 16 bp, Homo sapiens
gccattgcggccccag

SEQ ID NO: 3124309 - DNA, 19 bp, Homo sapiens
gccattgcggccccaggag

SEQ ID NO: 3124310 - DNA, 21 bp, Homo sapiens
gccattgcggccccaggaggg

SEQ ID NO: 3124311 - DNA, 12 bp, Homo sapiens
gccattgtcttt

SEQ ID NO: 3124312 - DNA, 18 bp, Homo sapiens
gccatttaaaaagttgta

SEQ ID NO: 3124313 - DNA, 16 bp, Homo sapiens
gccatttagcaataaa

SEQ ID NO: 3124314 - DNA, 21 bp, Homo sapiens
gccatttatgtgagtgtgtgt

SEQ ID NO: 3124315 - DNA, 16 bp, Homo sapiens
gccatttctgaactgt

SEQ ID NO: 3124316 - DNA, 16 bp, Homo sapiens
gcccaaacccttaact

SEQ ID NO: 3124317 - DNA, 14 bp, Homo sapiens
gcccaaagtgggga

SEQ ID NO: 3124318 - DNA, 16 bp, Homo sapiens
gcccaaagtggggagg

SEQ ID NO: 3124319 - DNA, 10 bp, Homo sapiens
gcccaaatga

SEQ ID NO: 3124320 - DNA, 14 bp, Homo sapiens
gcccaaatttttct

SEQ ID NO: 3124321 - DNA, 17 bp, Homo sapiens
gcccaacaccagcccct

SEQ ID NO: 3124322 - DNA, 23 bp, Homo sapiens
gcccaacagacaccatcttttgt

SEQ ID NO: 3124323 - DNA, 13 bp, Homo sapiens
gcccaacctcctg

SEQ ID NO: 3124324 - DNA, 14 bp, Homo sapiens
gcccaacctgctct

SEQ ID NO: 3124325 - DNA, 20 bp, Homo sapiens
gcccaagacagatgccccag

SEQ ID NO: 3124326 - DNA, 21 bp, Homo sapiens
gcccaagacagatgccccaga

SEQ ID NO: 3124327 - DNA, 17 bp, Homo sapiens
gcccaagagcagagtct

SEQ ID NO: 3124328 - DNA, 19 bp, Homo sapiens
gcccaagagccctgtggcc

SEQ ID NO: 3124329 - DNA, 21 bp, Homo sapiens
gcccaagagccctgtggccgc

SEQ ID NO: 3124330 - DNA, 17 bp, Homo sapiens
gcccaagaggactgaga

SEQ ID NO: 3124331 - DNA, 22 bp, Homo sapiens
gcccaagaggactgagactggc

SEQ ID NO: 3124332 - DNA, 14 bp, Homo sapiens
gcccaagaggtctg

SEQ ID NO: 3124333 - DNA, 16 bp, Homo sapiens
gcccaagccagaggct

SEQ ID NO: 3124334 - DNA, 21 bp, Homo sapiens
gcccaagccagaggctgggtt

SEQ ID NO: 3124335 - DNA, 23 bp, Homo sapiens
gcccaagccagaggctgggttca

SEQ ID NO: 3124336 - DNA, 14 bp, Homo sapiens
gcccaagcccaggc

SEQ ID NO: 3124337 - DNA, 13 bp, Homo sapiens
gcccaagccccat

SEQ ID NO: 3124338 - DNA, 21 bp, Homo sapiens
gcccaagcttaatagccctcc

SEQ ID NO: 3124339 - DNA, 14 bp, Homo sapiens
gcccaaggctcccg

SEQ ID NO: 3124340 - DNA, 20 bp, Homo sapiens
gcccaagggcctcccaccag

SEQ ID NO: 3124341 - DNA, 12 bp, Homo sapiens
gcccaatattat

SEQ ID NO: 3124342 - DNA, 18 bp, Homo sapiens
gcccaatattataatttt

SEQ ID NO: 3124343 - DNA, 14 bp, Homo sapiens
gcccaatgaaatga

SEQ ID NO: 3124344 - DNA, 16 bp, Homo sapiens
gcccacaatcctcctg

SEQ ID NO: 3124345 - DNA, 14 bp, Homo sapiens
gcccacaccctcgg

SEQ ID NO: 3124346 - DNA, 22 bp, Homo sapiens
gcccacaggaggcaagcaagct

SEQ ID NO: 3124347 - DNA, 20 bp, Homo sapiens
gcccacatagtgatggttcc

SEQ ID NO: 3124348 - DNA, 21 bp, Homo sapiens
gcccaccaccccctcaagccc

SEQ ID NO: 3124349 - DNA, 13 bp, Homo sapiens
gcccacccacgca

SEQ ID NO: 3124350 - DNA, 16 bp, Homo sapiens
gcccaccccctgccct

SEQ ID NO: 3124351 - DNA, 17 bp, Homo sapiens
gcccaccccctgccctg

SEQ ID NO: 3124352 - DNA, 22 bp, Homo sapiens
gcccaccccctgccctgcacgt

SEQ ID NO: 3124353 - DNA, 18 bp, Homo sapiens
gcccaccctgctgccttc

SEQ ID NO: 3124354 - DNA, 21 bp, Homo sapiens
gcccacctccccacgccctcc

SEQ ID NO: 3124355 - DNA, 14 bp, Homo sapiens
gcccacctgcaccc

SEQ ID NO: 3124356 - DNA, 19 bp, Homo sapiens
gcccacctggccacctgag

SEQ ID NO: 3124357 - DNA, 18 bp, Homo sapiens
gcccacgccctccctctc

SEQ ID NO: 3124358 - DNA, 17 bp, Homo sapiens
gcccacgctcaccccct

SEQ ID NO: 3124359 - DNA, 19 bp, Homo sapiens
gcccacgctggagtgcagt

SEQ ID NO: 3124360 - DNA, 18 bp, Homo sapiens
gcccacggctaagaggct

SEQ ID NO: 3124361 - DNA, 22 bp, Homo sapiens
gcccactctgtaatagttcagt

SEQ ID NO: 3124362 - DNA, 18 bp, Homo sapiens
gcccactgcccaccccct

SEQ ID NO: 3124363 - DNA, 20 bp, Homo sapiens
gcccactgcccaccccctca

SEQ ID NO: 3124364 - DNA, 21 bp, Homo sapiens
gcccactgctgcagtagggga

SEQ ID NO: 3124365 - DNA, 14 bp, Homo sapiens
gcccacttctgcca

SEQ ID NO: 3124366 - DNA, 11 bp, Homo sapiens
gcccagaactg

SEQ ID NO: 3124367 - DNA, 19 bp, Homo sapiens
gcccagaactgcccccact

SEQ ID NO: 3124368 - DNA, 22 bp, Homo sapiens
gcccagaactgcccccactgtc

SEQ ID NO: 3124369 - DNA, 15 bp, Homo sapiens
gcccagaacttccct

SEQ ID NO: 3124370 - DNA, 16 bp, Homo sapiens
gcccagaacttccctg

SEQ ID NO: 3124371 - DNA, 17 bp, Homo sapiens
gcccagaacttccctga

SEQ ID NO: 3124372 - DNA, 17 bp, Homo sapiens
gcccagaagggtagctg

SEQ ID NO: 3124373 - DNA, 13 bp, Homo sapiens
gcccagactctga

SEQ ID NO: 3124374 - DNA, 20 bp, Homo sapiens
gcccagactctgagctgctc

SEQ ID NO: 3124375 - DNA, 14 bp, Homo sapiens
gcccagactttagt

SEQ ID NO: 3124376 - DNA, 19 bp, Homo sapiens
gcccagactttagtgccct

SEQ ID NO: 3124377 - DNA, 21 bp, Homo sapiens
gcccagactttagtgccctgc

SEQ ID NO: 3124378 - DNA, 13 bp, Homo sapiens
gcccagagaacag

SEQ ID NO: 3124379 - DNA, 15 bp, Homo sapiens
gcccagagccacctg

SEQ ID NO: 3124380 - DNA, 13 bp, Homo sapiens
gcccagagcctgg

SEQ ID NO: 3124381 - DNA, 16 bp, Homo sapiens
gcccagaggactccca

SEQ ID NO: 3124382 - DNA, 13 bp, Homo sapiens
gcccagaggctga

SEQ ID NO: 3124383 - DNA, 17 bp, Homo sapiens
gcccagatgaactgact

SEQ ID NO: 3124384 - DNA, 19 bp, Homo sapiens
gcccagcattgctggttct

SEQ ID NO: 3124385 - DNA, 21 bp, Homo sapiens
gcccagccaaaccctgtctga

SEQ ID NO: 3124386 - DNA, 22 bp, Homo sapiens
gcccagccattaccatggagac

SEQ ID NO: 3124387 - DNA, 12 bp, Homo sapiens
gcccagcccaga

SEQ ID NO: 3124388 - DNA, 17 bp, Homo sapiens
gcccagcccagagccac

SEQ ID NO: 3124389 - DNA, 14 bp, Homo sapiens
gcccagcccctaga

SEQ ID NO: 3124390 - DNA, 16 bp, Homo sapiens
gcccagccctgttctg

SEQ ID NO: 3124391 - DNA, 16 bp, Homo sapiens
gcccagccggcctctc

SEQ ID NO: 3124392 - DNA, 13 bp, Homo sapiens
gcccagcctggaa

SEQ ID NO: 3124393 - DNA, 14 bp, Homo sapiens
gcccagcctgggag

SEQ ID NO: 3124394 - DNA, 14 bp, Homo sapiens
gcccagcgggcaga

SEQ ID NO: 3124395 - DNA, 15 bp, Homo sapiens
gcccagcgggcagat

SEQ ID NO: 3124396 - DNA, 14 bp, Homo sapiens
gcccagctgcacct

SEQ ID NO: 3124397 - DNA, 24 bp, Homo sapiens
gcccagctgcacctgccagcctgg

SEQ ID NO: 3124398 - DNA, 14 bp, Homo sapiens
gcccagctgtagcc

SEQ ID NO: 3124399 - DNA, 15 bp, Homo sapiens
gcccagctgtagcca

SEQ ID NO: 3124400 - DNA, 17 bp, Homo sapiens
gcccagctgtagccatg

SEQ ID NO: 3124401 - DNA, 18 bp, Homo sapiens
gcccagctgtagccatgg

SEQ ID NO: 3124402 - DNA, 19 bp, Homo sapiens
gcccagctgtagccatggc

SEQ ID NO: 3124403 - DNA, 14 bp, Homo sapiens
gcccaggaagccca

SEQ ID NO: 3124404 - DNA, 19 bp, Homo sapiens
gcccaggaagcccacacta

SEQ ID NO: 3124405 - DNA, 23 bp, Homo sapiens
gcccaggaagcccacactatgca

SEQ ID NO: 3124406 - DNA, 23 bp, Homo sapiens
gcccaggaattagagaagctgaa

SEQ ID NO: 3124407 - DNA, 13 bp, Homo sapiens
gcccaggaccagc

SEQ ID NO: 3124408 - DNA, 14 bp, Homo sapiens
gcccaggaccagct

SEQ ID NO: 3124409 - DNA, 22 bp, Homo sapiens
gcccaggacgtcctatctcccc

SEQ ID NO: 3124410 - DNA, 21 bp, Homo sapiens
gcccaggagaccacggggagc

SEQ ID NO: 3124411 - DNA, 13 bp, Homo sapiens
gcccaggagagag

SEQ ID NO: 3124412 - DNA, 14 bp, Homo sapiens
gcccaggagagaga

SEQ ID NO: 3124413 - DNA, 22 bp, Homo sapiens
gcccaggagggcatccatacca

SEQ ID NO: 3124414 - DNA, 14 bp, Homo sapiens
gcccaggcagagct

SEQ ID NO: 3124415 - DNA, 16 bp, Homo sapiens
gcccaggcaggtcttg

SEQ ID NO: 3124416 - DNA, 18 bp, Homo sapiens
gcccaggcatctccttgg

SEQ ID NO: 3124417 - DNA, 14 bp, Homo sapiens
gcccaggccacagc

SEQ ID NO: 3124418 - DNA, 16 bp, Homo sapiens
gcccaggccacagccg

SEQ ID NO: 3124419 - DNA, 19 bp, Homo sapiens
gcccaggccacagccgcct

SEQ ID NO: 3124420 - DNA, 12 bp, Homo sapiens
gcccaggcccct

SEQ ID NO: 3124421 - DNA, 13 bp, Homo sapiens
gcccaggcccctg

SEQ ID NO: 3124422 - DNA, 22 bp, Homo sapiens
gcccaggcccctgccaccctgg

SEQ ID NO: 3124423 - DNA, 15 bp, Homo sapiens
gcccaggccggccag

SEQ ID NO: 3124424 - DNA, 18 bp, Homo sapiens
gcccaggccggccagcct

SEQ ID NO: 3124425 - DNA, 19 bp, Homo sapiens
gcccaggccggccagcctc

SEQ ID NO: 3124426 - DNA, 17 bp, Homo sapiens
gcccaggcctgcctgtt

SEQ ID NO: 3124427 - DNA, 20 bp, Homo sapiens
gcccaggctggagtgcagtg

SEQ ID NO: 3124428 - DNA, 15 bp, Homo sapiens
gcccaggctgggaac

SEQ ID NO: 3124429 - DNA, 16 bp, Homo sapiens
gcccaggctggtttcg

SEQ ID NO: 3124430 - DNA, 15 bp, Homo sapiens
gcccagggagggaag

SEQ ID NO: 3124431 - DNA, 14 bp, Homo sapiens
gcccagggcctgca

SEQ ID NO: 3124432 - DNA, 16 bp, Homo sapiens
gcccagggctcctgca

SEQ ID NO: 3124433 - DNA, 23 bp, Homo sapiens
gcccaggggctgtggccgtctcc

SEQ ID NO: 3124434 - DNA, 18 bp, Homo sapiens
gcccaggggtgccccctc

SEQ ID NO: 3124435 - DNA, 15 bp, Homo sapiens
gcccaggtaccaccc

SEQ ID NO: 3124436 - DNA, 22 bp, Homo sapiens
gcccagtacctagctggctctg

SEQ ID NO: 3124437 - DNA, 15 bp, Homo sapiens
gcccagtagaccttg

SEQ ID NO: 3124438 - DNA, 15 bp, Homo sapiens
gcccagtcccccaac

SEQ ID NO: 3124439 - DNA, 17 bp, Homo sapiens
gcccagtcccccaaccc

SEQ ID NO: 3124440 - DNA, 17 bp, Homo sapiens
gccacgtggtcactgtg

SEQ ID NO: 3124441 - DNA, 23 bp, Homo sapiens
gccacgtggtcactgtgcactgc

SEQ ID NO: 3124442 - DNA, 15 bp, Homo sapiens
gccacgttccacagt

SEQ ID NO: 3124443 - DNA, 17 bp, Homo sapiens
gccactacactccagcc

SEQ ID NO: 3124444 - DNA, 20 bp, Homo sapiens
gccactacactccagcctga

SEQ ID NO: 3124445 - DNA, 16 bp, Homo sapiens
gccactcattcctgta

SEQ ID NO: 3124446 - DNA, 20 bp, Homo sapiens
gccactccagacccctggct

SEQ ID NO: 3124447 - DNA, 13 bp, Homo sapiens
gccactccctgag

SEQ ID NO: 3124448 - DNA, 16 bp, Homo sapiens
gccactccctgagctt

SEQ ID NO: 3124449 - DNA, 15 bp, Homo sapiens
gccactcctgaaccc

SEQ ID NO: 3124450 - DNA, 18 bp, Homo sapiens
gccactcgcagtcgcagg

SEQ ID NO: 3124451 - DNA, 19 bp, Homo sapiens
gccactcgcagtcgcagga

SEQ ID NO: 3124452 - DNA, 15 bp, Homo sapiens
gccactctatgagtt

SEQ ID NO: 3124453 - DNA, 19 bp, Homo sapiens
gccactgaagctgggattc

SEQ ID NO: 3124454 - DNA, 16 bp, Homo sapiens
gccactgagcctggcc

SEQ ID NO: 3124455 - DNA, 15 bp, Homo sapiens
gccactgcacagagc

SEQ ID NO: 3124456 - DNA, 18 bp, Homo sapiens
gccactgcaccgggccac

SEQ ID NO: 3124457 - DNA, 19 bp, Homo sapiens
gccactgcaccgggccaca

SEQ ID NO: 3124458 - DNA, 23 bp, Homo sapiens
gccactgcaccgggccacagaga

SEQ ID NO: 3124459 - DNA, 18 bp, Homo sapiens
gccactgcactccagcct

SEQ ID NO: 3124460 - DNA, 19 bp, Homo sapiens
gccactgcactccagcctg

SEQ ID NO: 3124461 - DNA, 15 bp, Homo sapiens
gccactgccaggcac

SEQ ID NO: 3124462 - DNA, 18 bp, Homo sapiens
gccactgccaggcacctg

SEQ ID NO: 3124463 - DNA, 19 bp, Homo sapiens
gccactgccaggcacctgg

SEQ ID NO: 3124464 - DNA, 23 bp, Homo sapiens
gccactgccaggcacctggcctg

SEQ ID NO: 3124465 - DNA, 13 bp, Homo sapiens
gccactgcccccc

SEQ ID NO: 3124466 - DNA, 13 bp, Homo sapiens
gccactgcctctt

SEQ ID NO: 3124467 - DNA, 18 bp, Homo sapiens
gccactgccttcgcttct

SEQ ID NO: 3124468 - DNA, 22 bp, Homo sapiens
gccactgccttcgcttcttgcc

SEQ ID NO: 3124469 - DNA, 23 bp, Homo sapiens
gccactggggactttatttattt

SEQ ID NO: 3124470 - DNA, 12 bp, Homo sapiens
gccactgtggcc

SEQ ID NO: 3124471 - DNA, 13 bp, Homo sapiens
gccactgtggcca

SEQ ID NO: 3124472 - DNA, 20 bp, Homo sapiens
gccactgtggccagagctgg

SEQ ID NO: 3124473 - DNA, 16 bp, Homo sapiens
gccactgttgttttgg

SEQ ID NO: 3124474 - DNA, 16 bp, Homo sapiens
gccacttaatgtatgt

SEQ ID NO: 3124475 - DNA, 19 bp, Homo sapiens
gccacttaatgtatgttac

SEQ ID NO: 3124476 - DNA, 12 bp, Homo sapiens
gccacttccttt

SEQ ID NO: 3124477 - DNA, 16 bp, Homo sapiens
gccacttcggccaggt

SEQ ID NO: 3124478 - DNA, 21 bp, Homo sapiens
gccacttgatgacccccaacc

SEQ ID NO: 3124479 - DNA, 15 bp, Homo sapiens
gccactttaagagag

SEQ ID NO: 3124480 - DNA, 17 bp, Homo sapiens
gccactttaagagagaa

SEQ ID NO: 3124481 - DNA, 20 bp, Homo sapiens
gccactttaagagagaaatc

SEQ ID NO: 3124482 - DNA, 18 bp, Homo sapiens
gccactttacccacctag

SEQ ID NO: 3124483 - DNA, 19 bp, Homo sapiens
gccactttgactcagaggc

SEQ ID NO: 3124484 - DNA, 15 bp, Homo sapiens
gccagaaggagggca

SEQ ID NO: 3124485 - DNA, 17 bp, Homo sapiens
gccagaaggagggcaga

SEQ ID NO: 3124486 - DNA, 18 bp, Homo sapiens
gccagaaggagggcagag

SEQ ID NO: 3124487 - DNA, 19 bp, Homo sapiens
gccagaaggagggcagagc

SEQ ID NO: 3124488 - DNA, 14 bp, Homo sapiens
gccccttcctttaa

SEQ ID NO: 3124489 - DNA, 17 bp, Homo sapiens
gccccttctctccctgc

SEQ ID NO: 3124490 - DNA, 19 bp, Homo sapiens
gccccttctctccctgcca

SEQ ID NO: 3124491 - DNA, 23 bp, Homo sapiens
gccccttctctccctgccagagg

SEQ ID NO: 3124492 - DNA, 22 bp, Homo sapiens
gccccttggctggatcagggaa

SEQ ID NO: 3124493 - DNA, 21 bp, Homo sapiens
gccccttttcactccctccat

SEQ ID NO: 3124494 - DNA, 19 bp, Homo sapiens
gcccgaagtctgctgctgt

SEQ ID NO: 3124495 - DNA, 12 bp, Homo sapiens
gcccgacagcct

SEQ ID NO: 3124496 - DNA, 15 bp, Homo sapiens
gcccgacagcctggc

SEQ ID NO: 3124497 - DNA, 14 bp, Homo sapiens
gcccgagctggtgc

SEQ ID NO: 3124498 - DNA, 15 bp, Homo sapiens
gcccgagctggtgca

SEQ ID NO: 3124499 - DNA, 23 bp, Homo sapiens
gcccgcacaccctcactctgcca

SEQ ID NO: 3124500 - DNA, 16 bp, Homo sapiens
gcccgcacagcagcct

SEQ ID NO: 3124501 - DNA, 18 bp, Homo sapiens
gcccgcacagcagcctgc

SEQ ID NO: 3124502 - DNA, 18 bp, Homo sapiens
gcccgcaccccggcctca

SEQ ID NO: 3124503 - DNA, 19 bp, Homo sapiens
gcccgcaccccggcctcag

SEQ ID NO: 3124504 - DNA, 15 bp, Homo sapiens
gcccgccacacagac

SEQ ID NO: 3124505 - DNA, 16 bp, Homo sapiens
gcccgcccctgcagca

SEQ ID NO: 3124506 - DNA, 18 bp, Homo sapiens
gcccgcctaggagttgag

SEQ ID NO: 3124507 - DNA, 17 bp, Homo sapiens
gcccgcgtctgtgccgc

SEQ ID NO: 3124508 - DNA, 20 bp, Homo sapiens
gcccgctcccaacccccctc

SEQ ID NO: 3124509 - DNA, 23 bp, Homo sapiens
gcccgctcccaacccccctcctg

SEQ ID NO: 3124510 - DNA, 18 bp, Homo sapiens
gcccgctcctgccgcaga

SEQ ID NO: 3124511 - DNA, 22 bp, Homo sapiens
gcccgctcctgccgcagacggg

SEQ ID NO: 3124512 - DNA, 20 bp, Homo sapiens
gcccgctgagctgagtggcc

SEQ ID NO: 3124513 - DNA, 21 bp, Homo sapiens
gcccgctgagctgagtggcca

SEQ ID NO: 3124514 - DNA, 22 bp, Homo sapiens
gcccgctgagctgagtggccag

SEQ ID NO: 3124515 - DNA, 15 bp, Homo sapiens
gcccgctgagtgggg

SEQ ID NO: 3124516 - DNA, 20 bp, Homo sapiens
gcccgctgcaatgcctagac

SEQ ID NO: 3124517 - DNA, 15 bp, Homo sapiens
gcccgcttttgttct

SEQ ID NO: 3124518 - DNA, 19 bp, Homo sapiens
gcccggagattggacggcc

SEQ ID NO: 3124519 - DNA, 21 bp, Homo sapiens
gcccggagattggacggcctg

SEQ ID NO: 3124520 - DNA, 22 bp, Homo sapiens
gcccggagattggacggcctga

SEQ ID NO: 3124521 - DNA, 15 bp, Homo sapiens
gcccggatgctgctt

SEQ ID NO: 3124522 - DNA, 17 bp, Homo sapiens
gcccggcagggcgggca

SEQ ID NO: 3124523 - DNA, 12 bp, Homo sapiens
gcccggccagcg

SEQ ID NO: 3124524 - DNA, 16 bp, Homo sapiens
gcccggccagcgggca

SEQ ID NO: 3124525 - DNA, 14 bp, Homo sapiens
gcccggccggcctg

SEQ ID NO: 3124526 - DNA, 14 bp, Homo sapiens
gcccggcctgctcc

SEQ ID NO: 3124527 - DNA, 18 bp, Homo sapiens
gcccggcctgctcccagc

SEQ ID NO: 3124528 - DNA, 22 bp, Homo sapiens
gcccggcctgctcccagcagcc

SEQ ID NO: 3124529 - DNA, 16 bp, Homo sapiens
gcccggcgccgggcac

SEQ ID NO: 3124530 - DNA, 20 bp, Homo sapiens
gcccggcgccgggcaccaac

SEQ ID NO: 3124531 - DNA, 20 bp, Homo sapiens
gcccggcgctgattcctcgt

SEQ ID NO: 3124532 - DNA, 12 bp, Homo sapiens
gcccggctccag

SEQ ID NO: 3124533 - DNA, 14 bp, Homo sapiens
gcccggctccaggc

SEQ ID NO: 3124534 - DNA, 15 bp, Homo sapiens
gcccggctccaggct

SEQ ID NO: 3124535 - DNA, 17 bp, Homo sapiens
gcccggctccaggctcc

SEQ ID NO: 3124536 - DNA, 16 bp, Homo sapiens
gcccgggctgcctggg

SEQ ID NO: 3124537 - DNA, 13 bp, Homo sapiens
gcccgtcctgcct

SEQ ID NO: 3124538 - DNA, 17 bp, Homo sapiens
gcccgtcctgcctgtgg

SEQ ID NO: 3124539 - DNA, 18 bp, Homo sapiens
gcccgtgcagtacaggca

SEQ ID NO: 3124540 - DNA, 19 bp, Homo sapiens
gcccgtgcccgcaggaact

SEQ ID NO: 3124541 - DNA, 23 bp, Homo sapiens
gcccgtggggtctgcgcttggtc

SEQ ID NO: 3124542 - DNA, 22 bp, Homo sapiens
gcccgtggtggcggtggctgcc

SEQ ID NO: 3124543 - DNA, 23 bp, Homo sapiens
gcccgtgtagtccccaaccgtgt

SEQ ID NO: 3124544 - DNA, 16 bp, Homo sapiens
gccctacagaggtctc

SEQ ID NO: 3124545 - DNA, 14 bp, Homo sapiens
gccctactattcag

SEQ ID NO: 3124546 - DNA, 15 bp, Homo sapiens
gccctactcattggg

SEQ ID NO: 3124547 - DNA, 16 bp, Homo sapiens
gccctactccactgcc

SEQ ID NO: 3124548 - DNA, 18 bp, Homo sapiens
gccctactccactgccct

SEQ ID NO: 3124549 - DNA, 17 bp, Homo sapiens
gccctactccctgcaga

SEQ ID NO: 3124550 - DNA, 20 bp, Homo sapiens
gccctactccctgcagatgc

SEQ ID NO: 3124551 - DNA, 22 bp, Homo sapiens
gccctactccctgcagatgcca

SEQ ID NO: 3124552 - DNA, 16 bp, Homo sapiens
gccctactcggatggg

SEQ ID NO: 3124553 - DNA, 19 bp, Homo sapiens
gccctagcccagactctga

SEQ ID NO: 3124554 - DNA, 16 bp, Homo sapiens
gccccagcccaagtcc

SEQ ID NO: 3124555 - DNA, 11 bp, Homo sapiens
gccccagcccc

SEQ ID NO: 3124556 - DNA, 16 bp, Homo sapiens
gccccagccctgctgg

SEQ ID NO: 3124557 - DNA, 17 bp, Homo sapiens
gccccagccctgctggg

SEQ ID NO: 3124558 - DNA, 11 bp, Homo sapiens
gccccagctct

SEQ ID NO: 3124559 - DNA, 14 bp, Homo sapiens
gccccagctctggc

SEQ ID NO: 3124560 - DNA, 15 bp, Homo sapiens
gccccaggaaaggcc

SEQ ID NO: 3124561 - DNA, 13 bp, Homo sapiens
gccccaggccctc

SEQ ID NO: 3124562 - DNA, 14 bp, Homo sapiens
gccccaggccctcc

SEQ ID NO: 3124563 - DNA, 15 bp, Homo sapiens
gccccaggccctccc

SEQ ID NO: 3124564 - DNA, 20 bp, Homo sapiens
gccccaggccctccctgact

SEQ ID NO: 3124565 - DNA, 13 bp, Homo sapiens
gccccagggcacc

SEQ ID NO: 3124566 - DNA, 15 bp, Homo sapiens
gccccagggcaccct

SEQ ID NO: 3124567 - DNA, 16 bp, Homo sapiens
gccccaggggggcctc

SEQ ID NO: 3124568 - DNA, 17 bp, Homo sapiens
gccccagggtcttccct

SEQ ID NO: 3124569 - DNA, 12 bp, Homo sapiens
gccccagtgccc

SEQ ID NO: 3124570 - DNA, 16 bp, Homo sapiens
gccccagtgcccacag

SEQ ID NO: 3124571 - DNA, 12 bp, Homo sapiens
gccccatcctca

SEQ ID NO: 3124572 - DNA, 14 bp, Homo sapiens
gccccatctcatcc

SEQ ID NO: 3124573 - DNA, 20 bp, Homo sapiens
gccccatctcatcctggcac

SEQ ID NO: 3124574 - DNA, 14 bp, Homo sapiens
gccccatgcctgtc

SEQ ID NO: 3124575 - DNA, 23 bp, Homo sapiens
gccccatgcctgtccagcctggg

SEQ ID NO: 3124576 - DNA, 15 bp, Homo sapiens
gccccatgctctgcc

SEQ ID NO: 3124577 - DNA, 18 bp, Homo sapiens
gccccattctgcctgccc

SEQ ID NO: 3124578 - DNA, 22 bp, Homo sapiens
gccccattctgcctgcccaggc

SEQ ID NO: 3124579 - DNA, 16 bp, Homo sapiens
gcccccaacactccag

SEQ ID NO: 3124580 - DNA, 18 bp, Homo sapiens
gcccccaacactccaggc

SEQ ID NO: 3124581 - DNA, 20 bp, Homo sapiens
gcccccaacactccaggccc

SEQ ID NO: 3124582 - DNA, 21 bp, Homo sapiens
gcccccaacactccaggccct

SEQ ID NO: 3124583 - DNA, 12 bp, Homo sapiens
gcccccaataaa

SEQ ID NO: 3124584 - DNA, 13 bp, Homo sapiens
gcccccaataaag

SEQ ID NO: 3124585 - DNA, 17 bp, Homo sapiens
gcccccaataaaggcag

SEQ ID NO: 3124586 - DNA, 18 bp, Homo sapiens
gcccccaataaaggcagc

SEQ ID NO: 3124587 - DNA, 21 bp, Homo sapiens
gcccccaataaaggcagctgc

SEQ ID NO: 3124588 - DNA, 23 bp, Homo sapiens
gcccccaataaaggcagctgcct

SEQ ID NO: 3124589 - DNA, 22 bp, Homo sapiens
gcccccaccccggggaccctgt

SEQ ID NO: 3124590 - DNA, 23 bp, Homo sapiens
gcccccaccccttccccaggccc

SEQ ID NO: 3124591 - DNA, 12 bp, Homo sapiens
gcccccacctct

SEQ ID NO: 3124592 - DNA, 18 bp, Homo sapiens
gcccccagcccagggctc

SEQ ID NO: 3124593 - DNA, 21 bp, Homo sapiens
gcccccaggattcccccagcc

SEQ ID NO: 3124594 - DNA, 16 bp, Homo sapiens
gcccccaggggcagga

SEQ ID NO: 3124595 - DNA, 18 bp, Homo sapiens
gcccccagtccccacccc

SEQ ID NO: 3124596 - DNA, 23 bp, Homo sapiens
gcccccagtgtgcacgagtggga

SEQ ID NO: 3124597 - DNA, 16 bp, Homo sapiens
gccccccagcctctgg

SEQ ID NO: 3124598 - DNA, 15 bp, Homo sapiens
gccccccagctcagg

SEQ ID NO: 3124599 - DNA, 17 bp, Homo sapiens
gcccccccaacactgtg

SEQ ID NO: 3124600 - DNA, 18 bp, Homo sapiens
gccccccgcgctcgccca

SEQ ID NO: 3124601 - DNA, 23 bp, Homo sapiens
gccccccgcgctcgcccagcagg

SEQ ID NO: 3124602 - DNA, 14 bp, Homo sapiens
gcccccctcaaacc

SEQ ID NO: 3124603 - DNA, 14 bp, Homo sapiens
gcccccgcctgcca

SEQ ID NO: 3124604 - DNA, 15 bp, Homo sapiens
gccccctcccactct

SEQ ID NO: 3124605 - DNA, 14 bp, Homo sapiens
gccccctccccacc

SEQ ID NO: 3124606 - DNA, 14 bp, Homo sapiens
gccccctccctgga

SEQ ID NO: 3124607 - DNA, 22 bp, Homo sapiens
gccccctccgccctgccactca

SEQ ID NO: 3124608 - DNA, 20 bp, Homo sapiens
gccccctcctctagctgtgg

SEQ ID NO: 3124609 - DNA, 21 bp, Homo sapiens
gccccctcctctagctgtggg

SEQ ID NO: 3124610 - DNA, 17 bp, Homo sapiens
gccccctcctctcccat

SEQ ID NO: 3124611 - DNA, 19 bp, Homo sapiens
gccccctcctctcccatcc

SEQ ID NO: 3124612 - DNA, 15 bp, Homo sapiens
gccccctcctgaacc

SEQ ID NO: 3124613 - DNA, 20 bp, Homo sapiens
gccccctctcggccaggcat

SEQ ID NO: 3124614 - DNA, 16 bp, Homo sapiens
gccccctggcctctgt

SEQ ID NO: 3124615 - DNA, 15 bp, Homo sapiens
gccccctggctgact

SEQ ID NO: 3124616 - DNA, 14 bp, Homo sapiens
gcccccttgccctc

SEQ ID NO: 3124617 - DNA, 19 bp, Homo sapiens
gccagccttgagccctggc

SEQ ID NO: 3124618 - DNA, 20 bp, Homo sapiens
gccagcgggcacagggcacc

SEQ ID NO: 3124619 - DNA, 23 bp, Homo sapiens
gccagcgggcacagggcaccaga

SEQ ID NO: 3124620 - DNA, 13 bp, Homo sapiens
gccagcgtcccag

SEQ ID NO: 3124621 - DNA, 21 bp, Homo sapiens
gccagctctagttttcagcct

SEQ ID NO: 3124622 - DNA, 14 bp, Homo sapiens
gccagctgcagctg

SEQ ID NO: 3124623 - DNA, 18 bp, Homo sapiens
gccagctgccccagccag

SEQ ID NO: 3124624 - DNA, 15 bp, Homo sapiens
gccagctgccgacca

SEQ ID NO: 3124625 - DNA, 20 bp, Homo sapiens
gccagctgccgaccagagcc

SEQ ID NO: 3124626 - DNA, 18 bp, Homo sapiens
gccagctgcctgtgcctg

SEQ ID NO: 3124627 - DNA, 21 bp, Homo sapiens
gccagctgcctgtgcctgcca

SEQ ID NO: 3124628 - DNA, 22 bp, Homo sapiens
gccagctgcctgtgcctgccat

SEQ ID NO: 3124629 - DNA, 14 bp, Homo sapiens
gccagctgccttcc

SEQ ID NO: 3124630 - DNA, 13 bp, Homo sapiens
gccagctgctttt

SEQ ID NO: 3124631 - DNA, 17 bp, Homo sapiens
gccagcttttcctccct

SEQ ID NO: 3124632 - DNA, 15 bp, Homo sapiens
gccaggaacctgtcc

SEQ ID NO: 3124633 - DNA, 16 bp, Homo sapiens
gccaggacagtcagct

SEQ ID NO: 3124634 - DNA, 11 bp, Homo sapiens
gccaggaccac

SEQ ID NO: 3124635 - DNA, 19 bp, Homo sapiens
gccaggaccacacagtccc

SEQ ID NO: 3124636 - DNA, 18 bp, Homo sapiens
gccaggaccctgacctcc

SEQ ID NO: 3124637 - DNA, 21 bp, Homo sapiens
gccaggagcaggcacgggtgg

SEQ ID NO: 3124638 - DNA, 23 bp, Homo sapiens
gccaggagctgtcaccaaggaaa

SEQ ID NO: 3124639 - DNA, 19 bp, Homo sapiens
gccaggagtctgtgctctt

SEQ ID NO: 3124640 - DNA, 12 bp, Homo sapiens
gccaggatgccc

SEQ ID NO: 3124641 - DNA, 19 bp, Homo sapiens
gccaggcaacttcagtcct

SEQ ID NO: 3124642 - DNA, 14 bp, Homo sapiens
gccaggcacagggc

SEQ ID NO: 3124643 - DNA, 15 bp, Homo sapiens
gccaggcacagggcc

SEQ ID NO: 3124644 - DNA, 16 bp, Homo sapiens
gccaggcacagggccc

SEQ ID NO: 3124645 - DNA, 13 bp, Homo sapiens
gccaggcacctgg

SEQ ID NO: 3124646 - DNA, 15 bp, Homo sapiens
gccaggcacctggcc

SEQ ID NO: 3124647 - DNA, 22 bp, Homo sapiens
gccaggcacctggcctgctggg

SEQ ID NO: 3124648 - DNA, 23 bp, Homo sapiens
gccaggcacctggcctgctggga

SEQ ID NO: 3124649 - DNA, 13 bp, Homo sapiens
gccaggcactgcc

SEQ ID NO: 3124650 - DNA, 19 bp, Homo sapiens
gccaggcaggcgggcgcca

SEQ ID NO: 3124651 - DNA, 18 bp, Homo sapiens
gccaggcaggtgcctgga

SEQ ID NO: 3124652 - DNA, 19 bp, Homo sapiens
gccaggcattggctcagcc

SEQ ID NO: 3124653 - DNA, 22 bp, Homo sapiens
gccaggccagagggagtgacag

SEQ ID NO: 3124654 - DNA, 15 bp, Homo sapiens
gccaggccagcctcc

SEQ ID NO: 3124655 - DNA, 11 bp, Homo sapiens
gccaggccagg

SEQ ID NO: 3124656 - DNA, 13 bp, Homo sapiens
gccaggccaggac

SEQ ID NO: 3124657 - DNA, 21 bp, Homo sapiens
gccaggccaggaccacacagt

SEQ ID NO: 3124658 - DNA, 12 bp, Homo sapiens
gccaggcccagg

SEQ ID NO: 3124659 - DNA, 14 bp, Homo sapiens
gccaggcccaggca

SEQ ID NO: 3124660 - DNA, 18 bp, Homo sapiens
gccaggcccatctcaggt

SEQ ID NO: 3124661 - DNA, 19 bp, Homo sapiens
gccaggcccatctcaggtg

SEQ ID NO: 3124662 - DNA, 14 bp, Homo sapiens
gccaggcctgggtc

SEQ ID NO: 3124663 - DNA, 16 bp, Homo sapiens
gccaggcgggctcaag

SEQ ID NO: 3124664 - DNA, 17 bp, Homo sapiens
gccaggcgttggtgcca

SEQ ID NO: 3124665 - DNA, 17 bp, Homo sapiens
gccaggctatggttgcc

SEQ ID NO: 3124666 - DNA, 23 bp, Homo sapiens
gccaggctatggttgccacccca

SEQ ID NO: 3124667 - DNA, 13 bp, Homo sapiens
gccctgccctgca

SEQ ID NO: 3124668 - DNA, 20 bp, Homo sapiens
gccctgccgccgcctcccgg

SEQ ID NO: 3124669 - DNA, 13 bp, Homo sapiens
gccctgcctcctg

SEQ ID NO: 3124670 - DNA, 14 bp, Homo sapiens
gccctgcctcctgg

SEQ ID NO: 3124671 - DNA, 15 bp, Homo sapiens
gccctgcctcctggg

SEQ ID NO: 3124672 - DNA, 16 bp, Homo sapiens
gccctgcctcctggga

SEQ ID NO: 3124673 - DNA, 17 bp, Homo sapiens
gccctgcctcctgggaa

SEQ ID NO: 3124674 - DNA, 20 bp, Homo sapiens
gccctgcctcctgggaagat

SEQ ID NO: 3124675 - DNA, 13 bp, Homo sapiens
gccctgcctgccc

SEQ ID NO: 3124676 - DNA, 19 bp, Homo sapiens
gccctgccttgtccctctc

SEQ ID NO: 3124677 - DNA, 10 bp, Homo sapiens
gccctgctac

SEQ ID NO: 3124678 - DNA, 14 bp, Homo sapiens
gccctgctcctccc

SEQ ID NO: 3124679 - DNA, 16 bp, Homo sapiens
gccctgctcctccctg

SEQ ID NO: 3124680 - DNA, 22 bp, Homo sapiens
gccctgctcctccctggctgcc

SEQ ID NO: 3124681 - DNA, 23 bp, Homo sapiens
gccctgctcctccctggctgccc

SEQ ID NO: 3124682 - DNA, 13 bp, Homo sapiens
gccctgctgggga

SEQ ID NO: 3124683 - DNA, 14 bp, Homo sapiens
gccctgctgtggga

SEQ ID NO: 3124684 - DNA, 22 bp, Homo sapiens
gccctgctgtgggagagcgaag

SEQ ID NO: 3124685 - DNA, 21 bp, Homo sapiens
gccctgctttgggctgccctg

SEQ ID NO: 3124686 - DNA, 23 bp, Homo sapiens
gccctgctttgggctgccctggt

SEQ ID NO: 3124687 - DNA, 22 bp, Homo sapiens
gccctgcttttgcataatgcaa

SEQ ID NO: 3124688 - DNA, 20 bp, Homo sapiens
gccctgctttttttcttaaa

SEQ ID NO: 3124689 - DNA, 14 bp, Homo sapiens
gccctggacttggt

SEQ ID NO: 3124690 - DNA, 19 bp, Homo sapiens
gccctggagccaactgctg

SEQ ID NO: 3124691 - DNA, 20 bp, Homo sapiens
gccctggagccaactgctgc

SEQ ID NO: 3124692 - DNA, 19 bp, Homo sapiens
gccctggaggtctccaggg

SEQ ID NO: 3124693 - DNA, 10 bp, Homo sapiens
gccctggcaa

SEQ ID NO: 3124694 - DNA, 19 bp, Homo sapiens
gccctggcaacatagtgag

SEQ ID NO: 3124695 - DNA, 20 bp, Homo sapiens
gccctggcacccccacaagc

SEQ ID NO: 3124696 - DNA, 13 bp, Homo sapiens
gccctggccagcc

SEQ ID NO: 3124697 - DNA, 14 bp, Homo sapiens
gccctggccagccc

SEQ ID NO: 3124698 - DNA, 13 bp, Homo sapiens
gccctggccctga

SEQ ID NO: 3124699 - DNA, 19 bp, Homo sapiens
gccctggcctcccctgcca

SEQ ID NO: 3124700 - DNA, 24 bp, Homo sapiens
gccctggcctcccctgccaccagg

SEQ ID NO: 3124701 - DNA, 12 bp, Homo sapiens
gccctggctctg

SEQ ID NO: 3124702 - DNA, 10 bp, Homo sapiens
gccctggctg

SEQ ID NO: 3124703 - DNA, 11 bp, Homo sapiens
gccctggctgc

SEQ ID NO: 3124704 - DNA, 14 bp, Homo sapiens
gccctggctgctgc

SEQ ID NO: 3124705 - DNA, 22 bp, Homo sapiens
gccctggctgctgcccccaccc

SEQ ID NO: 3124706 - DNA, 23 bp, Homo sapiens
gccctggctgttctgtggttcct

SEQ ID NO: 3124707 - DNA, 21 bp, Homo sapiens
gccctgggaaccactcccacc

SEQ ID NO: 3124708 - DNA, 16 bp, Homo sapiens
gccctgggagggggct

SEQ ID NO: 3124709 - DNA, 12 bp, Homo sapiens
gccctgggcctc

SEQ ID NO: 3124710 - DNA, 14 bp, Homo sapiens
gccctgggcctcag

SEQ ID NO: 3124711 - DNA, 23 bp, Homo sapiens
gccctgggcctcagttcaacctg

SEQ ID NO: 3124712 - DNA, 11 bp, Homo sapiens
gccctgggctg

SEQ ID NO: 3124713 - DNA, 12 bp, Homo sapiens
gccctgggctgg

SEQ ID NO: 3124714 - DNA, 18 bp, Homo sapiens
gccctgggctggaatcag

SEQ ID NO: 3124715 - DNA, 17 bp, Homo sapiens
gccctgggctggactgg

SEQ ID NO: 3124716 - DNA, 18 bp, Homo sapiens
gccctgggctggactgga

SEQ ID NO: 3124717 - DNA, 20 bp, Homo sapiens
gccctgggctggactggagg

SEQ ID NO: 3124718 - DNA, 22 bp, Homo sapiens
gccctgggctgtctgtcaccag

SEQ ID NO: 3124719 - DNA, 15 bp, Homo sapiens
gccctggggctgggc

SEQ ID NO: 3124720 - DNA, 16 bp, Homo sapiens
gccctggggctgggcc

SEQ ID NO: 3124721 - DNA, 22 bp, Homo sapiens
gccctggtaaaagggatacaca

SEQ ID NO: 3124722 - DNA, 15 bp, Homo sapiens
gccctggtccttcca

SEQ ID NO: 3124723 - DNA, 17 bp, Homo sapiens
gccctggtgctgccaca

SEQ ID NO: 3124724 - DNA, 21 bp, Homo sapiens
gccctggtgctgccacacttc

SEQ ID NO: 3124725 - DNA, 14 bp, Homo sapiens
gccctggtggcagt

SEQ ID NO: 3124726 - DNA, 20 bp, Homo sapiens
gccctggtttcactggccca

SEQ ID NO: 3124727 - DNA, 18 bp, Homo sapiens
gccctgtccctcccacct

SEQ ID NO: 3124728 - DNA, 22 bp, Homo sapiens
gccctgtccctcccacctctgt

SEQ ID NO: 3124729 - DNA, 16 bp, Homo sapiens
gccctgtccctgtccc

SEQ ID NO: 3124730 - DNA, 16 bp, Homo sapiens
gccctgtcgagacact

SEQ ID NO: 3124731 - DNA, 11 bp, Homo sapiens
gccctgtctgt

SEQ ID NO: 3124732 - DNA, 17 bp, Homo sapiens
gccctgtggccgccacc

SEQ ID NO: 3124733 - DNA, 19 bp, Homo sapiens
gccctgtggccgccacctg

SEQ ID NO: 3124734 - DNA, 17 bp, Homo sapiens
gccctgttcatgtgcct

SEQ ID NO: 3124735 - DNA, 20 bp, Homo sapiens
gccctgttcatgtgcctctg

SEQ ID NO: 3124736 - DNA, 21 bp, Homo sapiens
gccctgttcatgtgcctctgc

SEQ ID NO: 3124737 - DNA, 15 bp, Homo sapiens
gccctgttggcagct

SEQ ID NO: 3124738 - DNA, 18 bp, Homo sapiens
gccctgttggcagctcta

SEQ ID NO: 3124739 - DNA, 20 bp, Homo sapiens
gcctggtgcttccaaatatt

SEQ ID NO: 3124740 - DNA, 13 bp, Homo sapiens
gcctggtggcagc

SEQ ID NO: 3124741 - DNA, 16 bp, Homo sapiens
gcctggtggcagctgc

SEQ ID NO: 3124742 - DNA, 22 bp, Homo sapiens
gcctgtaatcagctctcctggc

SEQ ID NO: 3124743 - DNA, 22 bp, Homo sapiens
gcctgtagagacaatacagtaa

SEQ ID NO: 3124744 - DNA, 13 bp, Homo sapiens
gcctgtagagttg

SEQ ID NO: 3124745 - DNA, 20 bp, Homo sapiens
gcctgtagctttcctggtcc

SEQ ID NO: 3124746 - DNA, 19 bp, Homo sapiens
gcctgtagttaggaaataa

SEQ ID NO: 3124747 - DNA, 21 bp, Homo sapiens
gcctgtatcctccctggcaga

SEQ ID NO: 3124748 - DNA, 14 bp, Homo sapiens
gcctgtcaggctct

SEQ ID NO: 3124749 - DNA, 15 bp, Homo sapiens
gcctgtcaggctctg

SEQ ID NO: 3124750 - DNA, 21 bp, Homo sapiens
gcctgtcaggctctggccctt

SEQ ID NO: 3124751 - DNA, 19 bp, Homo sapiens
gcctgtcatccttggtctt

SEQ ID NO: 3124752 - DNA, 15 bp, Homo sapiens
gcctgtccaccctgc

SEQ ID NO: 3124753 - DNA, 12 bp, Homo sapiens
gcctgtccagcc

SEQ ID NO: 3124754 - DNA, 14 bp, Homo sapiens
gcctgtccagcctg

SEQ ID NO: 3124755 - DNA, 17 bp, Homo sapiens
gcctgtccagcctgggc

SEQ ID NO: 3124756 - DNA, 21 bp, Homo sapiens
gcctgtcccatggacactcca

SEQ ID NO: 3124757 - DNA, 22 bp, Homo sapiens
gcctgtcccatggacactccag

SEQ ID NO: 3124758 - DNA, 21 bp, Homo sapiens
gcctgtctctgttcagatgtg

SEQ ID NO: 3124759 - DNA, 17 bp, Homo sapiens
gcctgtgcagcagccca

SEQ ID NO: 3124760 - DNA, 20 bp, Homo sapiens
gcctgtgcagcagcccagct

SEQ ID NO: 3124761 - DNA, 21 bp, Homo sapiens
gcctgtgcagcagcccagctt

SEQ ID NO: 3124762 - DNA, 19 bp, Homo sapiens
gcctgtgcctcctcacccc

SEQ ID NO: 3124763 - DNA, 17 bp, Homo sapiens
gcctgtgcctctgggac

SEQ ID NO: 3124764 - DNA, 14 bp, Homo sapiens
gcctgtgcctgcca

SEQ ID NO: 3124765 - DNA, 18 bp, Homo sapiens
gcctgtgcctgccatggg

SEQ ID NO: 3124766 - DNA, 23 bp, Homo sapiens
gcctgtgcctgccatgggccagc

SEQ ID NO: 3124767 - DNA, 15 bp, Homo sapiens
gcctgtgcctgtcag

SEQ ID NO: 3124768 - DNA, 23 bp, Homo sapiens
gcctgtgcgtcccagctgaaggc

SEQ ID NO: 3124769 - DNA, 18 bp, Homo sapiens
gcctgtggagctcagccc

SEQ ID NO: 3124770 - DNA, 19 bp, Homo sapiens
gcctgtggcagtaaagaga

SEQ ID NO: 3124771 - DNA, 18 bp, Homo sapiens
gcctgtggcctgtgtccc

SEQ ID NO: 3124772 - DNA, 19 bp, Homo sapiens
gcctgtggttacagtgcag

SEQ ID NO: 3124773 - DNA, 21 bp, Homo sapiens
gcctgtggttacagtgcagac

SEQ ID NO: 3124774 - DNA, 13 bp, Homo sapiens
gcctgtgtccagc

SEQ ID NO: 3124775 - DNA, 16 bp, Homo sapiens
gcctgtgtccagcagc

SEQ ID NO: 3124776 - DNA, 19 bp, Homo sapiens
gcctgtgtccagcagctgc

SEQ ID NO: 3124777 - DNA, 19 bp, Homo sapiens
gcctgtgtccatgcgctca

SEQ ID NO: 3124778 - DNA, 19 bp, Homo sapiens
gcctgtgtcccatgaccca

SEQ ID NO: 3124779 - DNA, 20 bp, Homo sapiens
gcctgtgtcccatgacccac

SEQ ID NO: 3124780 - DNA, 21 bp, Homo sapiens
gcctgtgtcccatgacccacc

SEQ ID NO: 3124781 - DNA, 19 bp, Homo sapiens
gcctgttataactctgcac

SEQ ID NO: 3124782 - DNA, 19 bp, Homo sapiens
gcctgttcccattcttgca

SEQ ID NO: 3124783 - DNA, 23 bp, Homo sapiens
gcctgttcccattcttgcatggc

SEQ ID NO: 3124784 - DNA, 18 bp, Homo sapiens
gcctgttctatgccttta

SEQ ID NO: 3124785 - DNA, 20 bp, Homo sapiens
gcctgttgctatagagccta

SEQ ID NO: 3124786 - DNA, 12 bp, Homo sapiens
gcctgtttgatg

SEQ ID NO: 3124787 - DNA, 20 bp, Homo sapiens
gcctgtttgatgtatgtgtg

SEQ ID NO: 3124788 - DNA, 20 bp, Homo sapiens
gccttaaacactcaccttct

SEQ ID NO: 3124789 - DNA, 14 bp, Homo sapiens
gccttaaagaggga

SEQ ID NO: 3124790 - DNA, 19 bp, Homo sapiens
gccttaaagagggacaggc

SEQ ID NO: 3124791 - DNA, 22 bp, Homo sapiens
gccttagaaatgtaaactgcca

SEQ ID NO: 3124792 - DNA, 23 bp, Homo sapiens
gccttagaaatgtaaactgccat

SEQ ID NO: 3124793 - DNA, 17 bp, Homo sapiens
gccttagaacctttctt

SEQ ID NO: 3124794 - DNA, 17 bp, Homo sapiens
gccttagcatgtttgct

SEQ ID NO: 3124795 - DNA, 20 bp, Homo sapiens
gccttagcatgtttgctgaa

SEQ ID NO: 3124796 - DNA, 20 bp, Homo sapiens
gccttagctgccagtgctgg

SEQ ID NO: 3124797 - DNA, 15 bp, Homo sapiens
gccttaggcctacct

SEQ ID NO: 3124798 - DNA, 22 bp, Homo sapiens
gccttagggaagctggcctgag

SEQ ID NO: 3124799 - DNA, 19 bp, Homo sapiens
gccttagggcactgggctg

SEQ ID NO: 3124800 - DNA, 12 bp, Homo sapiens
gccttagtgggc

SEQ ID NO: 3124801 - DNA, 14 bp, Homo sapiens
gccttagtgggcca

SEQ ID NO: 3124802 - DNA, 20 bp, Homo sapiens
gccttagtgggccagggctg

SEQ ID NO: 3124803 - DNA, 20 bp, Homo sapiens
gccttataaaccaatcttaa

SEQ ID NO: 3124804 - DNA, 14 bp, Homo sapiens
gccttatcaagtgt

SEQ ID NO: 3124805 - DNA, 17 bp, Homo sapiens
gccttatcaagtgtctt

SEQ ID NO: 3124806 - DNA, 19 bp, Homo sapiens
gccttatcaagtgtcttcc

SEQ ID NO: 3124807 - DNA, 16 bp, Homo sapiens
gccttatgttgaaaaa

SEQ ID NO: 3124808 - DNA, 14 bp, Homo sapiens
gccttatttcccta

SEQ ID NO: 3124809 - DNA, 22 bp, Homo sapiens
gccttcaacaacgtgagagaaa

SEQ ID NO: 3124810 - DNA, 17 bp, Homo sapiens
gccttcaagtgccaaac

SEQ ID NO: 3124811 - DNA, 20 bp, Homo sapiens
gccttcactccggtgtgcct

SEQ ID NO: 3124812 - DNA, 18 bp, Homo sapiens
gccttcatctgggacaaa

SEQ ID NO: 3124813 - DNA, 16 bp, Homo sapiens
gccttcattctgcaag

SEQ ID NO: 3124814 - DNA, 13 bp, Homo sapiens
gccttccataatt

SEQ ID NO: 3124815 - DNA, 21 bp, Homo sapiens
gccttcccaagttgtgcttga

SEQ ID NO: 3124816 - DNA, 18 bp, Homo sapiens
gccttccccctcccaggg

SEQ ID NO: 3124817 - DNA, 12 bp, Homo sapiens
gccttcccctca

SEQ ID NO: 3124818 - DNA, 15 bp, Homo sapiens
gccttcccctgtctt

SEQ ID NO: 3124819 - DNA, 22 bp, Homo sapiens
gccttccccttttgcctggctg

SEQ ID NO: 3124820 - DNA, 23 bp, Homo sapiens
gccttccctagctttagaccctg

SEQ ID NO: 3124821 - DNA, 16 bp, Homo sapiens
gccttcctcatcccct

SEQ ID NO: 3124822 - DNA, 15 bp, Homo sapiens
gccttcctcctccac

SEQ ID NO: 3124823 - DNA, 17 bp, Homo sapiens
gccttcctcctccacag

SEQ ID NO: 3124824 - DNA, 19 bp, Homo sapiens
gccttcctcctccacagtg

SEQ ID NO: 3124825 - DNA, 17 bp, Homo sapiens
gccttcctctctccaga

SEQ ID NO: 3124826 - DNA, 18 bp, Homo sapiens
gccttcctctctccagat

SEQ ID NO: 3124827 - DNA, 19 bp, Homo sapiens
gccttcctgtttttcacat

SEQ ID NO: 3124828 - DNA, 11 bp, Homo sapiens
gccttccttcc

SEQ ID NO: 3124829 - DNA, 19 bp, Homo sapiens
gccttccttgaccttcctc

SEQ ID NO: 3124830 - DNA, 13 bp, Homo sapiens
gccttcctttctc

SEQ ID NO: 3124831 - DNA, 21 bp, Homo sapiens
gccttcgccccagtgttctgc

SEQ ID NO: 3124832 - DNA, 21 bp, Homo sapiens
gccttcgcttcttgcctctgt

SEQ ID NO: 3124833 - DNA, 20 bp, Homo sapiens
gccttcggcctccatcctga

SEQ ID NO: 3124834 - DNA, 17 bp, Homo sapiens
gccttctcatgatccaa

SEQ ID NO: 3124835 - DNA, 20 bp, Homo sapiens
gccttctgacggccctgcaa

SEQ ID NO: 3124836 - DNA, 12 bp, Homo sapiens
gccttctgcagc

SEQ ID NO: 3124837 - DNA, 14 bp, Homo sapiens
gccttctgcagcag

SEQ ID NO: 3124838 - DNA, 16 bp, Homo sapiens
gccttctgctgcccag

SEQ ID NO: 3124839 - DNA, 18 bp, Homo sapiens
gccttctgctgcccaggc

SEQ ID NO: 3124840 - DNA, 13 bp, Homo sapiens
gccttctgggctt

SEQ ID NO: 3124841 - DNA, 11 bp, Homo sapiens
gccttctgtat

SEQ ID NO: 3124842 - DNA, 18 bp, Homo sapiens
gccttctgtcctggtgtc

SEQ ID NO: 3124843 - DNA, 17 bp, Homo sapiens
gccttcttcacccagct

SEQ ID NO: 3124844 - DNA, 11 bp, Homo sapiens
gccttcttctt

SEQ ID NO: 3124845 - DNA, 15 bp, Homo sapiens
gccttcttttgatta

SEQ ID NO: 3124846 - DNA, 21 bp, Homo sapiens
gccttgacatcagttcctttg

SEQ ID NO: 3124847 - DNA, 13 bp, Homo sapiens
gccttgcagaact

SEQ ID NO: 3124848 - DNA, 15 bp, Homo sapiens
gccttgcagaactgc

SEQ ID NO: 3124849 - DNA, 20 bp, Homo sapiens
gccttgcagaactgccatta

SEQ ID NO: 3124850 - DNA, 23 bp, Homo sapiens
gccttgctcctagcagacagaaa

SEQ ID NO: 3124851 - DNA, 14 bp, Homo sapiens
gccttgctgagtgg

SEQ ID NO: 3124852 - DNA, 13 bp, Homo sapiens
gccttgctgctgc

SEQ ID NO: 3124853 - DNA, 19 bp, Homo sapiens
gccttgctgctgctgcacc

SEQ ID NO: 3124854 - DNA, 14 bp, Homo sapiens
gccttgctggacgg

SEQ ID NO: 3124855 - DNA, 11 bp, Homo sapiens
gccttgcttgt

SEQ ID NO: 3124856 - DNA, 13 bp, Homo sapiens
gccttgcttgtta

SEQ ID NO: 3124857 - DNA, 19 bp, Homo sapiens
gccttggcatgggcgcagg

SEQ ID NO: 3124858 - DNA, 12 bp, Homo sapiens
gccttggctcag

SEQ ID NO: 3124859 - DNA, 14 bp, Homo sapiens
gccttggctcagac

SEQ ID NO: 3124860 - DNA, 15 bp, Homo sapiens
gccttggctcagaca

SEQ ID NO: 3124861 - DNA, 17 bp, Homo sapiens
gccttggctcctgagaa

SEQ ID NO: 3124862 - DNA, 18 bp, Homo sapiens
gccttgggccttgctgct

SEQ ID NO: 3124863 - DNA, 15 bp, Homo sapiens
gccttgggctgctcc

SEQ ID NO: 3124864 - DNA, 18 bp, Homo sapiens
gccttgggctgctcctca

SEQ ID NO: 3124865 - DNA, 17 bp, Homo sapiens
gcctgcagtcttctggg

SEQ ID NO: 3124866 - DNA, 21 bp, Homo sapiens
gcctgcagtcttctgggctgc

SEQ ID NO: 3124867 - DNA, 21 bp, Homo sapiens
gcctgccacctccccccacaa

SEQ ID NO: 3124868 - DNA, 13 bp, Homo sapiens
gcctgccatgggc

SEQ ID NO: 3124869 - DNA, 18 bp, Homo sapiens
gcctgccatgggccagcc

SEQ ID NO: 3124870 - DNA, 17 bp, Homo sapiens
gcctgcccaagcccagg

SEQ ID NO: 3124871 - DNA, 20 bp, Homo sapiens
gcctgcccaagcccaggcca

SEQ ID NO: 3124872 - DNA, 17 bp, Homo sapiens
gcctgcccaatgctttg

SEQ ID NO: 3124873 - DNA, 12 bp, Homo sapiens
gcctgcccaggc

SEQ ID NO: 3124874 - DNA, 15 bp, Homo sapiens
gcctgcccaggcccc

SEQ ID NO: 3124875 - DNA, 17 bp, Homo sapiens
gcctgcccaggcccctg

SEQ ID NO: 3124876 - DNA, 20 bp, Homo sapiens
gcctgcccaggcccctgcca

SEQ ID NO: 3124877 - DNA, 20 bp, Homo sapiens
gcctgccccgcccccagtcc

SEQ ID NO: 3124878 - DNA, 21 bp, Homo sapiens
gcctgcccctaccctggactt

SEQ ID NO: 3124879 - DNA, 17 bp, Homo sapiens
gcctgcccgcacagcag

SEQ ID NO: 3124880 - DNA, 21 bp, Homo sapiens
gcctgccctcatggcccctct

SEQ ID NO: 3124881 - DNA, 16 bp, Homo sapiens
gcctgccctccagctg

SEQ ID NO: 3124882 - DNA, 18 bp, Homo sapiens
gcctgccctccccagagc

SEQ ID NO: 3124883 - DNA, 17 bp, Homo sapiens
gcctgcctaaccaggcc

SEQ ID NO: 3124884 - DNA, 19 bp, Homo sapiens
gcctgcctaaccaggccca

SEQ ID NO: 3124885 - DNA, 20 bp, Homo sapiens
gcctgcctaaccaggcccag

SEQ ID NO: 3124886 - DNA, 12 bp, Homo sapiens
gcctgcctcagt

SEQ ID NO: 3124887 - DNA, 14 bp, Homo sapiens
gcctgcctctgcct

SEQ ID NO: 3124888 - DNA, 17 bp, Homo sapiens
gcctgcgctcggcagga

SEQ ID NO: 3124889 - DNA, 20 bp, Homo sapiens
gcctgcgctcggcaggaagg

SEQ ID NO: 3124890 - DNA, 21 bp, Homo sapiens
gcctgcggcccagaagtttcc

SEQ ID NO: 3124891 - DNA, 19 bp, Homo sapiens
gcctgctaaggctcctcct

SEQ ID NO: 3124892 - DNA, 17 bp, Homo sapiens
gcctgctaattccccag

SEQ ID NO: 3124893 - DNA, 23 bp, Homo sapiens
gcctgctaattccccagattgca

SEQ ID NO: 3124894 - DNA, 16 bp, Homo sapiens
gcctgctagagcaacc

SEQ ID NO: 3124895 - DNA, 17 bp, Homo sapiens
gcctgctcccagcagcc

SEQ ID NO: 3124896 - DNA, 20 bp, Homo sapiens
gcctgctcccagcagcccta

SEQ ID NO: 3124897 - DNA, 13 bp, Homo sapiens
gcctgctgagagc

SEQ ID NO: 3124898 - DNA, 15 bp, Homo sapiens
gcctgctgagagccc

SEQ ID NO: 3124899 - DNA, 18 bp, Homo sapiens
gcctgctgcatggggtgg

SEQ ID NO: 3124900 - DNA, 16 bp, Homo sapiens
gcctgctgccagtgca

SEQ ID NO: 3124901 - DNA, 21 bp, Homo sapiens
gcctgctgccagtgcagccac

SEQ ID NO: 3124902 - DNA, 13 bp, Homo sapiens
gcctgctgcccag

SEQ ID NO: 3124903 - DNA, 16 bp, Homo sapiens
gcctgctggcacccac

SEQ ID NO: 3124904 - DNA, 17 bp, Homo sapiens
gcctgctggcacccacc

SEQ ID NO: 3124905 - DNA, 19 bp, Homo sapiens
gcctgctggcacccaccgt

SEQ ID NO: 3124906 - DNA, 13 bp, Homo sapiens
gcctgctgggaac

SEQ ID NO: 3124907 - DNA, 22 bp, Homo sapiens
gcctgctgtgattccactacac

SEQ ID NO: 3124908 - DNA, 22 bp, Homo sapiens
gcctgcttcccacctccctgcc

SEQ ID NO: 3124909 - DNA, 18 bp, Homo sapiens
gcctgcttttccaggatc

SEQ ID NO: 3124910 - DNA, 16 bp, Homo sapiens
gcctgctttttggaaa

SEQ ID NO: 3124911 - DNA, 19 bp, Homo sapiens
gcctggaaccagggaggag

SEQ ID NO: 3124912 - DNA, 19 bp, Homo sapiens
gcctggaagagccgagcac

SEQ ID NO: 3124913 - DNA, 20 bp, Homo sapiens
gcctggacatttgccttgct

SEQ ID NO: 3124914 - DNA, 15 bp, Homo sapiens
gcctggacccccagc

SEQ ID NO: 3124915 - DNA, 16 bp, Homo sapiens
gcctggactctgcccc

SEQ ID NO: 3124916 - DNA, 24 bp, Homo sapiens
gcctggactctgccccacgctgtg

SEQ ID NO: 3124917 - DNA, 16 bp, Homo sapiens
gcctggactttcctgc

SEQ ID NO: 3124918 - DNA, 17 bp, Homo sapiens
gcctggactttcctgca

SEQ ID NO: 3124919 - DNA, 13 bp, Homo sapiens
gcctggagagcga

SEQ ID NO: 3124920 - DNA, 16 bp, Homo sapiens
gcctggagatcctcct

SEQ ID NO: 3124921 - DNA, 18 bp, Homo sapiens
gcctggagccccatcggc

SEQ ID NO: 3124922 - DNA, 12 bp, Homo sapiens
gcctggatctcc

SEQ ID NO: 3124923 - DNA, 12 bp, Homo sapiens
gcctggatgaga

SEQ ID NO: 3124924 - DNA, 21 bp, Homo sapiens
gcctggatgagaaacagctca

SEQ ID NO: 3124925 - DNA, 16 bp, Homo sapiens
gcctggatttctggtt

SEQ ID NO: 3124926 - DNA, 23 bp, Homo sapiens
gcctggatttctggttctgatgc

SEQ ID NO: 3124927 - DNA, 16 bp, Homo sapiens
gcctggcacacatcag

SEQ ID NO: 3124928 - DNA, 13 bp, Homo sapiens
gcctggcacagga

SEQ ID NO: 3124929 - DNA, 17 bp, Homo sapiens
gcctggcacaggactga

SEQ ID NO: 3124930 - DNA, 19 bp, Homo sapiens
gcctggcacagggcagtgg

SEQ ID NO: 3124931 - DNA, 21 bp, Homo sapiens
gcctggcacatttcagggaga

SEQ ID NO: 3124932 - DNA, 21 bp, Homo sapiens
gcctggcagccgtgccttcag

SEQ ID NO: 3124933 - DNA, 18 bp, Homo sapiens
gcctggcaggccagtgtc

SEQ ID NO: 3124934 - DNA, 19 bp, Homo sapiens
gcctggcaggccagtgtct

SEQ ID NO: 3124935 - DNA, 20 bp, Homo sapiens
gcctggcaggccagtgtctg

SEQ ID NO: 3124936 - DNA, 19 bp, Homo sapiens
gcctggcagggaggtcagg

SEQ ID NO: 3124937 - DNA, 20 bp, Homo sapiens
gcctggcagggaggtcaggc

SEQ ID NO: 3124938 - DNA, 9 bp, Homo sapiens
gcctggcca

SEQ ID NO: 3124939 - DNA, 20 bp, Homo sapiens
gcctggccagatgcaccagc

SEQ ID NO: 3124940 - DNA, 22 bp, Homo sapiens
gcctggccagatgcaccagccc

SEQ ID NO: 3124941 - DNA, 17 bp, Homo sapiens
gcctggccaggagcagg

SEQ ID NO: 3124942 - DNA, 19 bp, Homo sapiens
gcctggccaggagctcttc

SEQ ID NO: 3124943 - DNA, 14 bp, Homo sapiens
gcctggccaggcag

SEQ ID NO: 3124944 - DNA, 15 bp, Homo sapiens
gcctggccagggcag

SEQ ID NO: 3124945 - DNA, 16 bp, Homo sapiens
gcctggccagggcagg

SEQ ID NO: 3124946 - DNA, 22 bp, Homo sapiens
gcctggccagggcagggccacc

SEQ ID NO: 3124947 - DNA, 14 bp, Homo sapiens
gcctggccatctcc

SEQ ID NO: 3124948 - DNA, 19 bp, Homo sapiens
gcctggcccatagaaacat

SEQ ID NO: 3124949 - DNA, 10 bp, Homo sapiens
gcctggcccc

SEQ ID NO: 3124950 - DNA, 13 bp, Homo sapiens
gcctggcccccaa

SEQ ID NO: 3124951 - DNA, 20 bp, Homo sapiens
gcctggccccggcctttatg

SEQ ID NO: 3124952 - DNA, 20 bp, Homo sapiens
gcctggcctgagctggggcc

SEQ ID NO: 3124953 - DNA, 15 bp, Homo sapiens
gcctggcctggctcc

SEQ ID NO: 3124954 - DNA, 22 bp, Homo sapiens
gcctggcgggatgggccaccgc

SEQ ID NO: 3124955 - DNA, 14 bp, Homo sapiens
gcgtgagccactgc

SEQ ID NO: 3124956 - DNA, 23 bp, Homo sapiens
gcgtgagccactgcaccgggcca

SEQ ID NO: 3124957 - DNA, 14 bp, Homo sapiens
gcgtgcacacacca

SEQ ID NO: 3124958 - DNA, 19 bp, Homo sapiens
gcgtgcacacaccagagcc

SEQ ID NO: 3124959 - DNA, 15 bp, Homo sapiens
gcgtgccgcctgctc

SEQ ID NO: 3124960 - DNA, 20 bp, Homo sapiens
gcgtgccgtgtgagtgtgac

SEQ ID NO: 3124961 - DNA, 22 bp, Homo sapiens
gcgtgccgtgtgagtgtgacag

SEQ ID NO: 3124962 - DNA, 24 bp, Homo sapiens
gcgtgccgtgtgagtgtgacaggg

SEQ ID NO: 3124963 - DNA, 13 bp, Homo sapiens
gcgtggactctgc

SEQ ID NO: 3124964 - DNA, 14 bp, Homo sapiens
gcgtggactctgca

SEQ ID NO: 3124965 - DNA, 17 bp, Homo sapiens
gcgtggactctgcacat

SEQ ID NO: 3124966 - DNA, 21 bp, Homo sapiens
gcgtggagactggcaggcggg

SEQ ID NO: 3124967 - DNA, 15 bp, Homo sapiens
gcgtggcctgagtcc

SEQ ID NO: 3124968 - DNA, 18 bp, Homo sapiens
gcgtggcctgagtcctgg

SEQ ID NO: 3124969 - DNA, 12 bp, Homo sapiens
gcgtggctgact

SEQ ID NO: 3124970 - DNA, 14 bp, Homo sapiens
gcgtggctgtggca

SEQ ID NO: 3124971 - DNA, 16 bp, Homo sapiens
gcgtgggagccagcct

SEQ ID NO: 3124972 - DNA, 13 bp, Homo sapiens
gcgtggggagggc

SEQ ID NO: 3124973 - DNA, 12 bp, Homo sapiens
gcgtgtgtagag

SEQ ID NO: 3124974 - DNA, 13 bp, Homo sapiens
gcgcttcccaact

SEQ ID NO: 3124975 - DNA, 20 bp, Homo sapiens
gcggaacaaggagtcagaca

SEQ ID NO: 3124976 - DNA, 19 bp, Homo sapiens
gcggaagtacttccctcag

SEQ ID NO: 3124977 - DNA, 16 bp, Homo sapiens
gcggacagccacggcc

SEQ ID NO: 3124978 - DNA, 13 bp, Homo sapiens
gcggaccccagct

SEQ ID NO: 3124979 - DNA, 20 bp, Homo sapiens
gcggaccccagctgtgagcc

SEQ ID NO: 3124980 - DNA, 14 bp, Homo sapiens
gcggacggctgtgg

SEQ ID NO: 3124981 - DNA, 17 bp, Homo sapiens
gcggactcctcctttct

SEQ ID NO: 3124982 - DNA, 13 bp, Homo sapiens
gcggaggagctgc

SEQ ID NO: 3124983 - DNA, 14 bp, Homo sapiens
gcggaggagctgcc

SEQ ID NO: 3124984 - DNA, 13 bp, Homo sapiens
gcggaggaggagg

SEQ ID NO: 3124985 - DNA, 14 bp, Homo sapiens
gcggaggctgtgtg

SEQ ID NO: 3124986 - DNA, 18 bp, Homo sapiens
gcggaggctgtgtgcctg

SEQ ID NO: 3124987 - DNA, 19 bp, Homo sapiens
gcggaggttgcagtgagct

SEQ ID NO: 3124988 - DNA, 14 bp, Homo sapiens
gcggagtgaagagg

SEQ ID NO: 3124989 - DNA, 16 bp, Homo sapiens
gcggcaaaaggaaagc

SEQ ID NO: 3124990 - DNA, 21 bp, Homo sapiens
gcggcagacgggaggggaaag

SEQ ID NO: 3124991 - DNA, 14 bp, Homo sapiens
gcggcagcagccat

SEQ ID NO: 3124992 - DNA, 17 bp, Homo sapiens
gcggcagcagccatcat

SEQ ID NO: 3124993 - DNA, 16 bp, Homo sapiens
gcggccaggcacaggg

SEQ ID NO: 3124994 - DNA, 21 bp, Homo sapiens
gcggccaggcacagggcccgc

SEQ ID NO: 3124995 - DNA, 15 bp, Homo sapiens
gcggccccaggaggg

SEQ ID NO: 3124996 - DNA, 18 bp, Homo sapiens
gcggccccaggaggggaa

SEQ ID NO: 3124997 - DNA, 20 bp, Homo sapiens
gcggccccccgcacagccac

SEQ ID NO: 3124998 - DNA, 22 bp, Homo sapiens
gcggccccctctcggccaggca

SEQ ID NO: 3124999 - DNA, 14 bp, Homo sapiens
gcggcccggccagc

SEQ ID NO: 3125000 - DNA, 21 bp, Homo sapiens
gcggcccggccagcgggcaca

SEQ ID NO: 3125001 - DNA, 22 bp, Homo sapiens
gcggcccggccagcgggcacag

SEQ ID NO: 3125002 - DNA, 23 bp, Homo sapiens
gcggcccggccagcgggcacagg

SEQ ID NO: 3125003 - DNA, 18 bp, Homo sapiens
gcggcgaccgccctccgc

SEQ ID NO: 3125004 - DNA, 14 bp, Homo sapiens
gcggcgggcggctg

SEQ ID NO: 3125005 - DNA, 15 bp, Homo sapiens
gcggcgtggagactg

SEQ ID NO: 3125006 - DNA, 19 bp, Homo sapiens
gcggctccagccccagaca

SEQ ID NO: 3125007 - DNA, 20 bp, Homo sapiens
gcggctgctcgcccaggaag

SEQ ID NO: 3125008 - DNA, 12 bp, Homo sapiens
gcggctggagcg

SEQ ID NO: 3125009 - DNA, 14 bp, Homo sapiens
gcggctggctctgt

SEQ ID NO: 3125010 - DNA, 22 bp, Homo sapiens
gcgggacaaagccttaaaatgc

SEQ ID NO: 3125011 - DNA, 13 bp, Homo sapiens
gcgggacagccaa

SEQ ID NO: 3125012 - DNA, 23 bp, Homo sapiens
gcgggacgagaccctacaggaga

SEQ ID NO: 3125013 - DNA, 14 bp, Homo sapiens
gcgggagacagctt

SEQ ID NO: 3125014 - DNA, 21 bp, Homo sapiens
gcgggagccatgcgccccctc

SEQ ID NO: 3125015 - DNA, 17 bp, Homo sapiens
gcgggaggcaccagctc

SEQ ID NO: 3125016 - DNA, 19 bp, Homo sapiens
gcgggaggcaccagctctg

SEQ ID NO: 3125017 - DNA, 15 bp, Homo sapiens
gcgggaggccctggc

SEQ ID NO: 3125018 - DNA, 16 bp, Homo sapiens
gcgggatggtcctggg

SEQ ID NO: 3125019 - DNA, 17 bp, Homo sapiens
gcgggatggtcctgggg

SEQ ID NO: 3125020 - DNA, 9 bp, Homo sapiens
gcgggcaca

SEQ ID NO: 3125021 - DNA, 17 bp, Homo sapiens
gcgggcacagggcacca

SEQ ID NO: 3125022 - DNA, 20 bp, Homo sapiens
gcgggcacagggcaccagag

SEQ ID NO: 3125023 - DNA, 21 bp, Homo sapiens
gcgggcacagggcaccagagg

SEQ ID NO: 3125024 - DNA, 22 bp, Homo sapiens
gcgggcacagggcaccagaggc

SEQ ID NO: 3125025 - DNA, 16 bp, Homo sapiens
gcgggcagagggctgg

SEQ ID NO: 3125026 - DNA, 18 bp, Homo sapiens
gcgggcagcgggccaggc

SEQ ID NO: 3125027 - DNA, 19 bp, Homo sapiens
gcgggcagcgggccaggcc

SEQ ID NO: 3125028 - DNA, 15 bp, Homo sapiens
gcgggccaggcccgc

SEQ ID NO: 3125029 - DNA, 18 bp, Homo sapiens
gcgggccatgagggacag

SEQ ID NO: 3125030 - DNA, 15 bp, Homo sapiens
gcgggcccaggccta

SEQ ID NO: 3125031 - DNA, 23 bp, Homo sapiens
gcgggcggaggggatccagccac

SEQ ID NO: 3125032 - DNA, 19 bp, Homo sapiens
gcgggcggctgggtctgtg

SEQ ID NO: 3125033 - DNA, 20 bp, Homo sapiens
gcgggctaacgggaggctgg

SEQ ID NO: 3125034 - DNA, 14 bp, Homo sapiens
gcgggctcaaggaa

SEQ ID NO: 3125035 - DNA, 21 bp, Homo sapiens
gcgggctccctggcaggatgc

SEQ ID NO: 3125036 - DNA, 23 bp, Homo sapiens
gcgggcttttctggggcccagga

SEQ ID NO: 3125037 - DNA, 17 bp, Homo sapiens
gcggggacagctccttc

SEQ ID NO: 3125038 - DNA, 23 bp, Homo sapiens
gcggggacagctccttctgtcct

SEQ ID NO: 3125039 - DNA, 14 bp, Homo sapiens
gcggggaccttggt

SEQ ID NO: 3125040 - DNA, 11 bp, Homo sapiens
gcggggggagg

SEQ ID NO: 3125041 - DNA, 19 bp, Homo sapiens
gcgggtggatcacgaggtc

SEQ ID NO: 3125042 - DNA, 17 bp, Homo sapiens
gcgggttccgcaggcag

SEQ ID NO: 3125043 - DNA, 14 bp, Homo sapiens
gcggtcacagcatg

SEQ ID NO: 3125044 - DNA, 18 bp, Homo sapiens
gcggtccctgtccctcta

SEQ ID NO: 3125045 - DNA, 21 bp, Homo sapiens
gcggtccctgtccctctagtg

SEQ ID NO: 3125046 - DNA, 15 bp, Homo sapiens
gcggtgccatgtctg

SEQ ID NO: 3125047 - DNA, 12 bp, Homo sapiens
gcggtgctctgg

SEQ ID NO: 3125048 - DNA, 15 bp, Homo sapiens
gcggtggccctgtcc

SEQ ID NO: 3125049 - DNA, 16 bp, Homo sapiens
gcggtggctgccccgg

SEQ ID NO: 3125050 - DNA, 21 bp, Homo sapiens
gcggtggctgccccggcctcc

SEQ ID NO: 3125051 - DNA, 19 bp, Homo sapiens
gcggttataaaaaatggtt

SEQ ID NO: 3125052 - DNA, 22 bp, Homo sapiens
gcggttataaaaaatggttcag

SEQ ID NO: 3125053 - DNA, 20 bp, Homo sapiens
gcggtttactcactgctgca

SEQ ID NO: 3125054 - DNA, 15 bp, Homo sapiens
gcgtaatgggcctgc

SEQ ID NO: 3125055 - DNA, 15 bp, Homo sapiens
gcgtagaagtttttg

SEQ ID NO: 3125056 - DNA, 13 bp, Homo sapiens
gcgtatgtctgtt

SEQ ID NO: 3125057 - DNA, 14 bp, Homo sapiens
gcgtcagctgctcc

SEQ ID NO: 3125058 - DNA, 17 bp, Homo sapiens
gcgtcagctgctccctg

SEQ ID NO: 3125059 - DNA, 16 bp, Homo sapiens
gcgtcccagggtaccc

SEQ ID NO: 3125060 - DNA, 23 bp, Homo sapiens
gcgtcctcgttcaaaacattcca

SEQ ID NO: 3125061 - DNA, 17 bp, Homo sapiens
gcgtcctgacgccctgc

SEQ ID NO: 3125062 - DNA, 17 bp, Homo sapiens
gcgtcctgacggcgccc

SEQ ID NO: 3125063 - DNA, 18 bp, Homo sapiens
gcgtcctgcagaggacca

SEQ ID NO: 3125064 - DNA, 19 bp, Homo sapiens
gcgtcctgtccacacccag

SEQ ID NO: 3125065 - DNA, 21 bp, Homo sapiens
gcgtcctgtccacacccagct

SEQ ID NO: 3125066 - DNA, 21 bp, Homo sapiens
gcgtctggaagtccaatgtgg

SEQ ID NO: 3125067 - DNA, 20 bp, Homo sapiens
gcgtctggaggggcccctgc

SEQ ID NO: 3125068 - DNA, 12 bp, Homo sapiens
gcgtcttcctga

SEQ ID NO: 3125069 - DNA, 13 bp, Homo sapiens
gcgtcttcctgag

SEQ ID NO: 3125070 - DNA, 14 bp, Homo sapiens
gcgtcttcctgagt

SEQ ID NO: 3125071 - DNA, 11 bp, Homo sapiens
gcgtgaaacac

SEQ ID NO: 3125072 - DNA, 12 bp, Homo sapiens
gcgtgaaacaca

SEQ ID NO: 3125073 - DNA, 20 bp, Homo sapiens
gcgtgaaacacaccaggctg

SEQ ID NO: 3125074 - DNA, 23 bp, Homo sapiens
gcgtgaaacacaccaggctgtgg

SEQ ID NO: 3125075 - DNA, 12 bp, Homo sapiens
gcgtgacggagc

SEQ ID NO: 3125076 - DNA, 15 bp, Homo sapiens
gcgtgactcagcagc

SEQ ID NO: 3125077 - DNA, 11 bp, Homo sapiens
gcgtgagacgc

SEQ ID NO: 3125078 - DNA, 16 bp, Homo sapiens
gctcttctccaggctg

SEQ ID NO: 3125079 - DNA, 17 bp, Homo sapiens
gctcttctcctttcaca

SEQ ID NO: 3125080 - DNA, 15 bp, Homo sapiens
gctcttgaaatatgt

SEQ ID NO: 3125081 - DNA, 19 bp, Homo sapiens
gctcttgatacccccctct

SEQ ID NO: 3125082 - DNA, 22 bp, Homo sapiens
gctcttgatacccccctctgtc

SEQ ID NO: 3125083 - DNA, 12 bp, Homo sapiens
gctcttgccctt

SEQ ID NO: 3125084 - DNA, 18 bp, Homo sapiens
gctcttgcccttccctgt

SEQ ID NO: 3125085 - DNA, 22 bp, Homo sapiens
gctcttgcccttccctgtccct

SEQ ID NO: 3125086 - DNA, 23 bp, Homo sapiens
gctcttgcccttccctgtccctc

SEQ ID NO: 3125087 - DNA, 13 bp, Homo sapiens
gctcttgctaatc

SEQ ID NO: 3125088 - DNA, 22 bp, Homo sapiens
gctcttggaaagctgatgatgt

SEQ ID NO: 3125089 - DNA, 17 bp, Homo sapiens
gctcttggagctgtgag

SEQ ID NO: 3125090 - DNA, 16 bp, Homo sapiens
gctcttggcctttgca

SEQ ID NO: 3125091 - DNA, 17 bp, Homo sapiens
gctcttggtccctggtc

SEQ ID NO: 3125092 - DNA, 22 bp, Homo sapiens
gctcttgtttttattaatttat

SEQ ID NO: 3125093 - DNA, 13 bp, Homo sapiens
gctctttcagaga

SEQ ID NO: 3125094 - DNA, 14 bp, Homo sapiens
gctctttcagagag

SEQ ID NO: 3125095 - DNA, 20 bp, Homo sapiens
gctctttcccttttctgttt

SEQ ID NO: 3125096 - DNA, 22 bp, Homo sapiens
gctctttctacatgactgggcc

SEQ ID NO: 3125097 - DNA, 23 bp, Homo sapiens
gctctttctacatgactgggcct

SEQ ID NO: 3125098 - DNA, 16 bp, Homo sapiens
gctctttctctgccag

SEQ ID NO: 3125099 - DNA, 17 bp, Homo sapiens
gctctttctctgccagt

SEQ ID NO: 3125100 - DNA, 13 bp, Homo sapiens
gctctttctgggc

SEQ ID NO: 3125101 - DNA, 15 bp, Homo sapiens
gctcttttaagcagt

SEQ ID NO: 3125102 - DNA, 15 bp, Homo sapiens
gctcttttcaatgaa

SEQ ID NO: 3125103 - DNA, 20 bp, Homo sapiens
gctcttttggtggggagcac

SEQ ID NO: 3125104 - DNA, 14 bp, Homo sapiens
gctcttttttactc

SEQ ID NO: 3125105 - DNA, 17 bp, Homo sapiens
gctcttttttactcatt

SEQ ID NO: 3125106 - DNA, 16 bp, Homo sapiens
gctctttttttaaaag

SEQ ID NO: 3125107 - DNA, 12 bp, Homo sapiens
gctgaaaatata

SEQ ID NO: 3125108 - DNA, 21 bp, Homo sapiens
gctgaaaatgcaaagctgaag

SEQ ID NO: 3125109 - DNA, 20 bp, Homo sapiens
gctgaaacattccgaagagg

SEQ ID NO: 3125110 - DNA, 10 bp, Homo sapiens
gctgaaagca

SEQ ID NO: 3125111 - DNA, 15 bp, Homo sapiens
gctgaaattctcctg

SEQ ID NO: 3125112 - DNA, 17 bp, Homo sapiens
gctgaaattttatatgc

SEQ ID NO: 3125113 - DNA, 16 bp, Homo sapiens
gctgaaccctgtgctg

SEQ ID NO: 3125114 - DNA, 21 bp, Homo sapiens
gctgaaccctgtgctggtgtc

SEQ ID NO: 3125115 - DNA, 19 bp, Homo sapiens
gctgaactcttcagaacac

SEQ ID NO: 3125116 - DNA, 19 bp, Homo sapiens
gctgaagaaaaaatcagaa

SEQ ID NO: 3125117 - DNA, 16 bp, Homo sapiens
gctgaagaattgaaaa

SEQ ID NO: 3125118 - DNA, 19 bp, Homo sapiens
gctgaagaccatggatttc

SEQ ID NO: 3125119 - DNA, 16 bp, Homo sapiens
gctgaagagagggaca

SEQ ID NO: 3125120 - DNA, 17 bp, Homo sapiens
gctgaatggttttcaaa

SEQ ID NO: 3125121 - DNA, 17 bp, Homo sapiens
gctgacacctaccatgc

SEQ ID NO: 3125122 - DNA, 18 bp, Homo sapiens
gctgacacctaccatgct

SEQ ID NO: 3125123 - DNA, 22 bp, Homo sapiens
gctgacacctaccatgctgctt

SEQ ID NO: 3125124 - DNA, 22 bp, Homo sapiens
gctgacacttcaaggtgacaga

SEQ ID NO: 3125125 - DNA, 15 bp, Homo sapiens
gctgacagacacagg

SEQ ID NO: 3125126 - DNA, 16 bp, Homo sapiens
gctgacagacacaggc

SEQ ID NO: 3125127 - DNA, 18 bp, Homo sapiens
gctgacagacacaggccc

SEQ ID NO: 3125128 - DNA, 20 bp, Homo sapiens
gctgaccaagagagaaagaa

SEQ ID NO: 3125129 - DNA, 22 bp, Homo sapiens
gctgacccagccccttgagaaa

SEQ ID NO: 3125130 - DNA, 19 bp, Homo sapiens
gctgacgggaggccccagc

SEQ ID NO: 3125131 - DNA, 21 bp, Homo sapiens
gctgacgggaggccccagctc

SEQ ID NO: 3125132 - DNA, 20 bp, Homo sapiens
gctgactaaactttttttct

SEQ ID NO: 3125133 - DNA, 21 bp, Homo sapiens
gctgactccacgatcctgcca

SEQ ID NO: 3125134 - DNA, 18 bp, Homo sapiens
gctgactctccagggagc

SEQ ID NO: 3125135 - DNA, 14 bp, Homo sapiens
gctgactgaatgca

SEQ ID NO: 3125136 - DNA, 22 bp, Homo sapiens
gctgactggccagttgcccaga

SEQ ID NO: 3125137 - DNA, 13 bp, Homo sapiens
gctgactgtggcc

SEQ ID NO: 3125138 - DNA, 14 bp, Homo sapiens
gctgacttggcact

SEQ ID NO: 3125139 - DNA, 20 bp, Homo sapiens
gctgactttaaaaggattaa

SEQ ID NO: 3125140 - DNA, 14 bp, Homo sapiens
gctgagactgcggg

SEQ ID NO: 3125141 - DNA, 13 bp, Homo sapiens
gctgagagccctg

SEQ ID NO: 3125142 - DNA, 17 bp, Homo sapiens
gctgagagccctgctgt

SEQ ID NO: 3125143 - DNA, 23 bp, Homo sapiens
gctgagatcacaccactgtactc

SEQ ID NO: 3125144 - DNA, 20 bp, Homo sapiens
gctgagcacttagcaggcac

SEQ ID NO: 3125145 - DNA, 12 bp, Homo sapiens
gctgagccactc

SEQ ID NO: 3125146 - DNA, 13 bp, Homo sapiens
gctgagccactcg

SEQ ID NO: 3125147 - DNA, 15 bp, Homo sapiens
gctgagccactcgca

SEQ ID NO: 3125148 - DNA, 16 bp, Homo sapiens
gctgagccactcgcag

SEQ ID NO: 3125149 - DNA, 16 bp, Homo sapiens
gctgagccctggcagg

SEQ ID NO: 3125150 - DNA, 23 bp, Homo sapiens
gctgagccctggggactgttcca

SEQ ID NO: 3125151 - DNA, 13 bp, Homo sapiens
gctgagcctctgc

SEQ ID NO: 3125152 - DNA, 20 bp, Homo sapiens
gctgagcctctgctccccag

SEQ ID NO: 3125153 - DNA, 14 bp, Homo sapiens
gctgagctctctgt

SEQ ID NO: 3125154 - DNA, 22 bp, Homo sapiens
gctgagcttagccttgtgccct

SEQ ID NO: 3125155 - DNA, 22 bp, Homo sapiens
gctgagcttcggttctccagaa

SEQ ID NO: 3125156 - DNA, 22 bp, Homo sapiens
gctgagcttgtcttttctgctg

SEQ ID NO: 3125157 - DNA, 14 bp, Homo sapiens
gctgaggactctgc

SEQ ID NO: 3125158 - DNA, 15 bp, Homo sapiens
gctgaggactctgca

SEQ ID NO: 3125159 - DNA, 16 bp, Homo sapiens
gctgaggactctgcaa

SEQ ID NO: 3125160 - DNA, 19 bp, Homo sapiens
gctgaggatttcaagcctg

SEQ ID NO: 3125161 - DNA, 12 bp, Homo sapiens
gctgaggcagga

SEQ ID NO: 3125162 - DNA, 16 bp, Homo sapiens
gctgaggcagggggat

SEQ ID NO: 3125163 - DNA, 13 bp, Homo sapiens
gctgaggcctgga

SEQ ID NO: 3125164 - DNA, 14 bp, Homo sapiens
gctgaggcctggac

SEQ ID NO: 3125165 - DNA, 14 bp, Homo sapiens
gctgaggcctgggc

SEQ ID NO: 3125166 - DNA, 15 bp, Homo sapiens
gctgaggcctgggcc

SEQ ID NO: 3125167 - DNA, 17 bp, Homo sapiens
gctgaggcctgggccgc

SEQ ID NO: 3125168 - DNA, 20 bp, Homo sapiens
gctgaggcctgggccgctgc

SEQ ID NO: 3125169 - DNA, 16 bp, Homo sapiens
gctgaggcgggagaat

SEQ ID NO: 3125170 - DNA, 16 bp, Homo sapiens
gctgagggcagactgg

SEQ ID NO: 3125171 - DNA, 11 bp, Homo sapiens
gctgaggggca

SEQ ID NO: 3125172 - DNA, 17 bp, Homo sapiens
gctgaggtctcttgagg

SEQ ID NO: 3125173 - DNA, 19 bp, Homo sapiens
gctgaggtgggaggatcac

SEQ ID NO: 3125174 - DNA, 17 bp, Homo sapiens
gctgaggttcctctgcc

SEQ ID NO: 3125175 - DNA, 18 bp, Homo sapiens
gctgaggttcctctgcct

SEQ ID NO: 3125176 - DNA, 19 bp, Homo sapiens
gctgaggttcctctgcctg

SEQ ID NO: 3125177 - DNA, 21 bp, Homo sapiens
gctgaggttcctctgcctgcc

SEQ ID NO: 3125178 - DNA, 23 bp, Homo sapiens
gctgaggttcctctgcctgcccc

SEQ ID NO: 3125179 - DNA, 15 bp, Homo sapiens
gctgagtctcccaag

SEQ ID NO: 3125180 - DNA, 21 bp, Homo sapiens
gctgagtggcaggggacagga

SEQ ID NO: 3125181 - DNA, 18 bp, Homo sapiens
gctgagtggccagccagt

SEQ ID NO: 3125182 - DNA, 22 bp, Homo sapiens
gctgagttacttgtctgaggcc

SEQ ID NO: 3125183 - DNA, 23 bp, Homo sapiens
gctgagttacttgtctgaggcct

SEQ ID NO: 3125184 - DNA, 12 bp, Homo sapiens
gctgagttgttc

SEQ ID NO: 3125185 - DNA, 20 bp, Homo sapiens
gctgagttttctctttgtgg

SEQ ID NO: 3125186 - DNA, 18 bp, Homo sapiens
gctgatacataactaaat

SEQ ID NO: 3125187 - DNA, 19 bp, Homo sapiens
gctgatacataactaaatt

SEQ ID NO: 3125188 - DNA, 14 bp, Homo sapiens
gctgatacttcatt

SEQ ID NO: 3125189 - DNA, 16 bp, Homo sapiens
gctgatcgtgctaaat

SEQ ID NO: 3125190 - DNA, 18 bp, Homo sapiens
gctgatgaatcactgttt

SEQ ID NO: 3125191 - DNA, 21 bp, Homo sapiens
gctgatgaatcactgttttta

SEQ ID NO: 3125192 - DNA, 14 bp, Homo sapiens
gctgatgcttgaag

SEQ ID NO: 3125193 - DNA, 23 bp, Homo sapiens
gctgatggataacctatatgatt

SEQ ID NO: 3125194 - DNA, 13 bp, Homo sapiens
gctgatggctgcc

SEQ ID NO: 3125195 - DNA, 17 bp, Homo sapiens
gctgatggctgcccctg

SEQ ID NO: 3125196 - DNA, 13 bp, Homo sapiens
gctgatggctgct

SEQ ID NO: 3125197 - DNA, 23 bp, Homo sapiens
gctgatggctgctagattttaat

SEQ ID NO: 3125198 - DNA, 20 bp, Homo sapiens
gctgatgtcaatttctgtgt

SEQ ID NO: 3125199 - DNA, 23 bp, Homo sapiens
gctgatgtcaatttctgtgttgc

SEQ ID NO: 3125200 - DNA, 17 bp, Homo sapiens
gctgattcctcgtgtcc

SEQ ID NO: 3125201 - DNA, 19 bp, Homo sapiens
gctgatttacatgtatggt

SEQ ID NO: 3125202 - DNA, 20 bp, Homo sapiens
gctgatttccaggcccctga

SEQ ID NO: 3125203 - DNA, 15 bp, Homo sapiens
gctgatttcccctct

SEQ ID NO: 3125204 - DNA, 14 bp, Homo sapiens
gctgattttaacaa

SEQ ID NO: 3125205 - DNA, 23 bp, Homo sapiens
gctgcaaagggtatcaggtgctg

SEQ ID NO: 3125206 - DNA, 18 bp, Homo sapiens
gctgcaagcacagccctt

SEQ ID NO: 3125207 - DNA, 12 bp, Homo sapiens
gctgcaaggtac

SEQ ID NO: 3125208 - DNA, 14 bp, Homo sapiens
gctgcacagaaggg

SEQ ID NO: 3125209 - DNA, 20 bp, Homo sapiens
gctgcacagaagggctcttt

SEQ ID NO: 3125210 - DNA, 17 bp, Homo sapiens
gctgcacatgtgccaca

SEQ ID NO: 3125211 - DNA, 14 bp, Homo sapiens
gctgcaccagagca

SEQ ID NO: 3125212 - DNA, 17 bp, Homo sapiens
gctgcaccagagcaacc

SEQ ID NO: 3125213 - DNA, 22 bp, Homo sapiens
gctgcaccagagcaacctctca

SEQ ID NO: 3125214 - DNA, 13 bp, Homo sapiens
gctgcaccagagt

SEQ ID NO: 3125215 - DNA, 13 bp, Homo sapiens
gctgcacccaact

SEQ ID NO: 3125216 - DNA, 21 bp, Homo sapiens
gctgcacctgccagcctggct

SEQ ID NO: 3125217 - DNA, 22 bp, Homo sapiens
gctgcacctgccagcctggctt

SEQ ID NO: 3125218 - DNA, 16 bp, Homo sapiens
gctgcacttggcctca

SEQ ID NO: 3125219 - DNA, 20 bp, Homo sapiens
gctgcacttggcctcagctg

SEQ ID NO: 3125220 - DNA, 24 bp, Homo sapiens
gctgcacttggcctcagctggctg

SEQ ID NO: 3125221 - DNA, 17 bp, Homo sapiens
gctgcagagctgaccca

SEQ ID NO: 3125222 - DNA, 18 bp, Homo sapiens
gctgcagaggcacctcaa

SEQ ID NO: 3125223 - DNA, 15 bp, Homo sapiens
gctgcagaggccaga

SEQ ID NO: 3125224 - DNA, 22 bp, Homo sapiens
gctgcagaggccagaggccccc

SEQ ID NO: 3125225 - DNA, 17 bp, Homo sapiens
gctgcagcagagtgagc

SEQ ID NO: 3125226 - DNA, 12 bp, Homo sapiens
gctgcagcatgt

SEQ ID NO: 3125227 - DNA, 12 bp, Homo sapiens
gctgcagctggg

SEQ ID NO: 3125228 - DNA, 16 bp, Homo sapiens
gctgcagctgggcccc

SEQ ID NO: 3125229 - DNA, 19 bp, Homo sapiens
gctgcagctgggccccatg

SEQ ID NO: 3125230 - DNA, 10 bp, Homo sapiens
gctgcagctt

SEQ ID NO: 3125231 - DNA, 17 bp, Homo sapiens
gctgcagggctcccatg

SEQ ID NO: 3125232 - DNA, 20 bp, Homo sapiens
gctgcaggggctctggagag

SEQ ID NO: 3125233 - DNA, 17 bp, Homo sapiens
gctgcatagctctattt

SEQ ID NO: 3125234 - DNA, 13 bp, Homo sapiens
gctgcatcttata

SEQ ID NO: 3125235 - DNA, 14 bp, Homo sapiens
gctgcatgcctggt

SEQ ID NO: 3125236 - DNA, 15 bp, Homo sapiens
gctgcattagaaaaa

SEQ ID NO: 3125237 - DNA, 20 bp, Homo sapiens
gctgccaagagtgaagggaa

SEQ ID NO: 3125238 - DNA, 21 bp, Homo sapiens
gctgccacaaccagccaggca

SEQ ID NO: 3125239 - DNA, 21 bp, Homo sapiens
gctgccaccacgtctgccagg

SEQ ID NO: 3125240 - DNA, 14 bp, Homo sapiens
gctgccagcacaga

SEQ ID NO: 3125241 - DNA, 16 bp, Homo sapiens
gctgccagcccagaac

SEQ ID NO: 3125242 - DNA, 22 bp, Homo sapiens
gctgccagccttgagccctggc

SEQ ID NO: 3125243 - DNA, 23 bp, Homo sapiens
gctgccagccttgagccctggct

SEQ ID NO: 3125244 - DNA, 20 bp, Homo sapiens
gctgccaggcgttggtgcca

SEQ ID NO: 3125245 - DNA, 17 bp, Homo sapiens
gctgccagtgcagccac

SEQ ID NO: 3125246 - DNA, 22 bp, Homo sapiens
gctgccagtgcagccactggct

SEQ ID NO: 3125247 - DNA, 16 bp, Homo sapiens
gctgccagtgctggtc

SEQ ID NO: 3125248 - DNA, 14 bp, Homo sapiens
gctgccataattct

SEQ ID NO: 3125249 - DNA, 13 bp, Homo sapiens
gctgccatcaccg

SEQ ID NO: 3125250 - DNA, 16 bp, Homo sapiens
gctgccatcaccgctg

SEQ ID NO: 3125251 - DNA, 17 bp, Homo sapiens
gctgccatcaccgctgg

SEQ ID NO: 3125252 - DNA, 13 bp, Homo sapiens
gctgccatccagg

SEQ ID NO: 3125253 - DNA, 17 bp, Homo sapiens
gctgccatccaggttca

SEQ ID NO: 3125254 - DNA, 23 bp, Homo sapiens
gctgccatccaggttcagcttgt

SEQ ID NO: 3125255 - DNA, 12 bp, Homo sapiens
gctgccatgcca

SEQ ID NO: 3125256 - DNA, 17 bp, Homo sapiens
gctgccatgccactgcc

SEQ ID NO: 3125257 - DNA, 20 bp, Homo sapiens
gctgccatgccactgccagg

SEQ ID NO: 3125258 - DNA, 22 bp, Homo sapiens
gctgccatgccactgccaggca

SEQ ID NO: 3125259 - DNA, 17 bp, Homo sapiens
gctgcccaatctccatc

SEQ ID NO: 3125260 - DNA, 21 bp, Homo sapiens
gctgcccagacacagactggc

SEQ ID NO: 3125261 - DNA, 12 bp, Homo sapiens
gctgcccaggag

SEQ ID NO: 3125262 - DNA, 18 bp, Homo sapiens
gctgcccaggccacagcc

SEQ ID NO: 3125263 - DNA, 22 bp, Homo sapiens
gctgcccaggccacagccgcct

SEQ ID NO: 3125264 - DNA, 21 bp, Homo sapiens
gctgccccagggcctgcttcc

SEQ ID NO: 3125265 - DNA, 22 bp, Homo sapiens
gctgcccccaacactccaggcc

SEQ ID NO: 3125266 - DNA, 15 bp, Homo sapiens
gctgcccccaccccg

SEQ ID NO: 3125267 - DNA, 16 bp, Homo sapiens
gctgccccggcccctc

SEQ ID NO: 3125268 - DNA, 22 bp, Homo sapiens
gctgccccggcccctccccctg

SEQ ID NO: 3125269 - DNA, 17 bp, Homo sapiens
gctgccccggcctcctc

SEQ ID NO: 3125270 - DNA, 18 bp, Homo sapiens
gctgccccgttccctgtc

SEQ ID NO: 3125271 - DNA, 20 bp, Homo sapiens
gctgccccgttccctgtcag

SEQ ID NO: 3125272 - DNA, 13 bp, Homo sapiens
gctgcccctctca

SEQ ID NO: 3125273 - DNA, 14 bp, Homo sapiens
gctgcccctctcac

SEQ ID NO: 3125274 - DNA, 16 bp, Homo sapiens
gctgccctgagaagct

SEQ ID NO: 3125275 - DNA, 15 bp, Homo sapiens
gctgccctgccactt

SEQ ID NO: 3125276 - DNA, 21 bp, Homo sapiens
gctgcccttatgcccggcgcc

SEQ ID NO: 3125277 - DNA, 18 bp, Homo sapiens
gctgccgacttggagact

SEQ ID NO: 3125278 - DNA, 22 bp, Homo sapiens
gctgccgacttggagactcctg

SEQ ID NO: 3125279 - DNA, 24 bp, Homo sapiens
gctgccgacttggagactcctggt

SEQ ID NO: 3125280 - DNA, 19 bp, Homo sapiens
gctgccgcctcccagcctg

SEQ ID NO: 3125281 - DNA, 20 bp, Homo sapiens
gctgccgcctcccagcctgg

SEQ ID NO: 3125282 - DNA, 14 bp, Homo sapiens
gctgccgctgcacc

SEQ ID NO: 3125283 - DNA, 22 bp, Homo sapiens
gctgcctagcaagctggcctct

SEQ ID NO: 3125284 - DNA, 13 bp, Homo sapiens
gctgcctctgctc

SEQ ID NO: 3125285 - DNA, 14 bp, Homo sapiens
gctgcctctgctcc

SEQ ID NO: 3125286 - DNA, 17 bp, Homo sapiens
gctgcctctgctccctc

SEQ ID NO: 3125287 - DNA, 13 bp, Homo sapiens
gctgcctctttcc

SEQ ID NO: 3125288 - DNA, 22 bp, Homo sapiens
gctgcctgacactgagccccac

SEQ ID NO: 3125289 - DNA, 19 bp, Homo sapiens
gctgcctgcccgcacagca

SEQ ID NO: 3125290 - DNA, 15 bp, Homo sapiens
gctgcctgccgccca

SEQ ID NO: 3125291 - DNA, 20 bp, Homo sapiens
gctgcctgccgcccaaagag

SEQ ID NO: 3125292 - DNA, 14 bp, Homo sapiens
gctgcctgcttggc

SEQ ID NO: 3125293 - DNA, 18 bp, Homo sapiens
gctgcctgcttggcccgg

SEQ ID NO: 3125294 - DNA, 12 bp, Homo sapiens
gctgcctggaga

SEQ ID NO: 3125295 - DNA, 18 bp, Homo sapiens
gctgcctggagagggtct

SEQ ID NO: 3125296 - DNA, 14 bp, Homo sapiens
gctgcctgggctgt

SEQ ID NO: 3125297 - DNA, 16 bp, Homo sapiens
gctgcctgtagttagg

SEQ ID NO: 3125298 - DNA, 20 bp, Homo sapiens
gctgcctgtgcctgccatgg

SEQ ID NO: 3125299 - DNA, 13 bp, Homo sapiens
gctgcctgttcag

SEQ ID NO: 3125300 - DNA, 18 bp, Homo sapiens
gctgcctgttcagctcca

SEQ ID NO: 3125301 - DNA, 20 bp, Homo sapiens
gctgcctgttcagctccagc

SEQ ID NO: 3125302 - DNA, 22 bp, Homo sapiens
gctgccttaatgacattcccct

SEQ ID NO: 3125303 - DNA, 15 bp, Homo sapiens
gctgccttagaacct

SEQ ID NO: 3125304 - DNA, 16 bp, Homo sapiens
gctgccttcctcatcc

SEQ ID NO: 3125305 - DNA, 14 bp, Homo sapiens
gctgccttggctca

SEQ ID NO: 3125306 - DNA, 19 bp, Homo sapiens
gctgccttggctcagacat

SEQ ID NO: 3125307 - DNA, 16 bp, Homo sapiens
gctgcgcttgcttttc

SEQ ID NO: 3125308 - DNA, 17 bp, Homo sapiens
gctgcgcttgcttttct

SEQ ID NO: 3125309 - DNA, 20 bp, Homo sapiens
gctgcgggaggccctggccc

SEQ ID NO: 3125310 - DNA, 21 bp, Homo sapiens
gctgcgggaggccctggccct

SEQ ID NO: 3125311 - DNA, 16 bp, Homo sapiens
gctgcggtccacccag

SEQ ID NO: 3125312 - DNA, 17 bp, Homo sapiens
gctgcggtccacccagg

SEQ ID NO: 3125313 - DNA, 18 bp, Homo sapiens
gctgcggtccacccagga

SEQ ID NO: 3125314 - DNA, 19 bp, Homo sapiens
gctgcggtccacccaggag

SEQ ID NO: 3125315 - DNA, 15 bp, Homo sapiens
gctgcgtccccactc

SEQ ID NO: 3125316 - DNA, 18 bp, Homo sapiens
gctgcgtccccactccct

SEQ ID NO: 3125317 - DNA, 16 bp, Homo sapiens
gctgcgtctggagggg

SEQ ID NO: 3125318 - DNA, 17 bp, Homo sapiens
gctgctaacctggaaag

SEQ ID NO: 3125319 - DNA, 15 bp, Homo sapiens
gctgctaccagcgcc

SEQ ID NO: 3125320 - DNA, 10 bp, Homo sapiens
gctgctagaa

SEQ ID NO: 3125321 - DNA, 13 bp, Homo sapiens
gctgctagaactt

SEQ ID NO: 3125322 - DNA, 15 bp, Homo sapiens
gctgctagaactttt

SEQ ID NO: 3125323 - DNA, 16 bp, Homo sapiens
gctgctagaacttttt

SEQ ID NO: 3125324 - DNA, 17 bp, Homo sapiens
gctgctagaactttttt

SEQ ID NO: 3125325 - DNA, 14 bp, Homo sapiens
gctgctagatttta

SEQ ID NO: 3125326 - DNA, 16 bp, Homo sapiens
gctgggactcagcctt

SEQ ID NO: 3125327 - DNA, 13 bp, Homo sapiens
gctgggactcctg

SEQ ID NO: 3125328 - DNA, 18 bp, Homo sapiens
gctgggactcctggtgcc

SEQ ID NO: 3125329 - DNA, 22 bp, Homo sapiens
gctgggactcctggtgcccctc

SEQ ID NO: 3125330 - DNA, 15 bp, Homo sapiens
gctgggactggccag

SEQ ID NO: 3125331 - DNA, 22 bp, Homo sapiens
gctgggagcatagcagaggggc

SEQ ID NO: 3125332 - DNA, 13 bp, Homo sapiens
gctgggagctcca

SEQ ID NO: 3125333 - DNA, 16 bp, Homo sapiens
gctgggagctccactc

SEQ ID NO: 3125334 - DNA, 17 bp, Homo sapiens
gctgggaggactggacc

SEQ ID NO: 3125335 - DNA, 21 bp, Homo sapiens
gctgggaggcaagaggggtgg

SEQ ID NO: 3125336 - DNA, 15 bp, Homo sapiens
gctgggaggcatggc

SEQ ID NO: 3125337 - DNA, 18 bp, Homo sapiens
gctgggatcagagcagga

SEQ ID NO: 3125338 - DNA, 19 bp, Homo sapiens
gctgggatgtgtgctttcc

SEQ ID NO: 3125339 - DNA, 18 bp, Homo sapiens
gctgggattacaggtgtg

SEQ ID NO: 3125340 - DNA, 18 bp, Homo sapiens
gctgggcaaagccacaag

SEQ ID NO: 3125341 - DNA, 14 bp, Homo sapiens
gctgggcagcccca

SEQ ID NO: 3125342 - DNA, 21 bp, Homo sapiens
gctgggcagccccagagagag

SEQ ID NO: 3125343 - DNA, 13 bp, Homo sapiens
gctgggcaggaag

SEQ ID NO: 3125344 - DNA, 13 bp, Homo sapiens
gctgggcatactt

SEQ ID NO: 3125345 - DNA, 23 bp, Homo sapiens
gctgggcatggtaccagccctgg

SEQ ID NO: 3125346 - DNA, 17 bp, Homo sapiens
gctgggccatgtccaaa

SEQ ID NO: 3125347 - DNA, 13 bp, Homo sapiens
gctgggcccagcc

SEQ ID NO: 3125348 - DNA, 16 bp, Homo sapiens
gctgggcccagcccct

SEQ ID NO: 3125349 - DNA, 19 bp, Homo sapiens
gctgggccccatgctctgc

SEQ ID NO: 3125350 - DNA, 23 bp, Homo sapiens
gctgggccccatgctctgcccca

SEQ ID NO: 3125351 - DNA, 18 bp, Homo sapiens
gctgggccccccagctca

SEQ ID NO: 3125352 - DNA, 20 bp, Homo sapiens
gctgggccccccagctcagg

SEQ ID NO: 3125353 - DNA, 20 bp, Homo sapiens
gctgggcccctgcacaggca

SEQ ID NO: 3125354 - DNA, 17 bp, Homo sapiens
gctgggcccctgggatg

SEQ ID NO: 3125355 - DNA, 19 bp, Homo sapiens
gctgggcttcagtggcagc

SEQ ID NO: 3125356 - DNA, 16 bp, Homo sapiens
gctggggacctggtac

SEQ ID NO: 3125357 - DNA, 23 bp, Homo sapiens
gctggggacctggtaccctcctg

SEQ ID NO: 3125358 - DNA, 13 bp, Homo sapiens
gctggggactcag

SEQ ID NO: 3125359 - DNA, 15 bp, Homo sapiens
gctggggagaggaaa

SEQ ID NO: 3125360 - DNA, 23 bp, Homo sapiens
gctggggatccccgcctggccag

SEQ ID NO: 3125361 - DNA, 18 bp, Homo sapiens
gctggggcagaggggcag

SEQ ID NO: 3125362 - DNA, 13 bp, Homo sapiens
gctggggccacaa

SEQ ID NO: 3125363 - DNA, 18 bp, Homo sapiens
gctggggccgccacggcc

SEQ ID NO: 3125364 - DNA, 14 bp, Homo sapiens
gctggggcggggcc

SEQ ID NO: 3125365 - DNA, 18 bp, Homo sapiens
gctggggcgtggggaggg

SEQ ID NO: 3125366 - DNA, 23 bp, Homo sapiens
gctggggctcacggggcctccaa

SEQ ID NO: 3125367 - DNA, 17 bp, Homo sapiens
gctggggctctctgaga

SEQ ID NO: 3125368 - DNA, 21 bp, Homo sapiens
gctgggggaatgagcccagag

SEQ ID NO: 3125369 - DNA, 20 bp, Homo sapiens
gctgggggcaggagggccct

SEQ ID NO: 3125370 - DNA, 19 bp, Homo sapiens
gctgggggcctcagtgcca

SEQ ID NO: 3125371 - DNA, 15 bp, Homo sapiens
gctggggtacaggtt

SEQ ID NO: 3125372 - DNA, 21 bp, Homo sapiens
gctgggtaaactgtggatgat

SEQ ID NO: 3125373 - DNA, 22 bp, Homo sapiens
gctgggtaatgtgaaggcccaa

SEQ ID NO: 3125374 - DNA, 15 bp, Homo sapiens
gctgggtattggaaa

SEQ ID NO: 3125375 - DNA, 23 bp, Homo sapiens
gctgggtattggaaatggatgca

SEQ ID NO: 3125376 - DNA, 22 bp, Homo sapiens
gctgggtggcacaccacccgag

SEQ ID NO: 3125377 - DNA, 13 bp, Homo sapiens
gctgggtgtttca

SEQ ID NO: 3125378 - DNA, 15 bp, Homo sapiens
gctggtaaactattt

SEQ ID NO: 3125379 - DNA, 18 bp, Homo sapiens
gctggtagagacccccag

SEQ ID NO: 3125380 - DNA, 22 bp, Homo sapiens
gctggtagcataaataaaactg

SEQ ID NO: 3125381 - DNA, 13 bp, Homo sapiens
gctggtagctcag

SEQ ID NO: 3125382 - DNA, 13 bp, Homo sapiens
gctggtagttagt

SEQ ID NO: 3125383 - DNA, 18 bp, Homo sapiens
gctggtattggtggcttt

SEQ ID NO: 3125384 - DNA, 19 bp, Homo sapiens
gctggtcccactcagtcca

SEQ ID NO: 3125385 - DNA, 13 bp, Homo sapiens
gctggtgcccgga

SEQ ID NO: 3125386 - DNA, 20 bp, Homo sapiens
gctggtggaaagcgattcac

SEQ ID NO: 3125387 - DNA, 14 bp, Homo sapiens
gctggtggcctctg

SEQ ID NO: 3125388 - DNA, 12 bp, Homo sapiens
gctggtgggaag

SEQ ID NO: 3125389 - DNA, 13 bp, Homo sapiens
gctggtgggaagg

SEQ ID NO: 3125390 - DNA, 22 bp, Homo sapiens
gctggtgggaaggccggcagcg

SEQ ID NO: 3125391 - DNA, 18 bp, Homo sapiens
gctggtgtcctgaccacc

SEQ ID NO: 3125392 - DNA, 19 bp, Homo sapiens
gctggtgtcctgaccaccc

SEQ ID NO: 3125393 - DNA, 14 bp, Homo sapiens
gctggttagaaatg

SEQ ID NO: 3125394 - DNA, 15 bp, Homo sapiens
gctggttcagggttg

SEQ ID NO: 3125395 - DNA, 15 bp, Homo sapiens
gctggttgctgtgtg

SEQ ID NO: 3125396 - DNA, 15 bp, Homo sapiens
gctggtttcctcatt

SEQ ID NO: 3125397 - DNA, 21 bp, Homo sapiens
gctggttttgtaagatgctgg

SEQ ID NO: 3125398 - DNA, 17 bp, Homo sapiens
gctgtaactgctgagcc

SEQ ID NO: 3125399 - DNA, 16 bp, Homo sapiens
gctgtaacttaaaata

SEQ ID NO: 3125400 - DNA, 23 bp, Homo sapiens
gctgtaaggatccggaaagaaga

SEQ ID NO: 3125401 - DNA, 13 bp, Homo sapiens
gctgtaaggctct

SEQ ID NO: 3125402 - DNA, 17 bp, Homo sapiens
gctgtaaggctctagat

SEQ ID NO: 3125403 - DNA, 16 bp, Homo sapiens
gctgtaagggcagtgc

SEQ ID NO: 3125404 - DNA, 18 bp, Homo sapiens
gctgtaagggcagtgccc

SEQ ID NO: 3125405 - DNA, 22 bp, Homo sapiens
gctgtaatctatgaattctaag

SEQ ID NO: 3125406 - DNA, 16 bp, Homo sapiens
gctgtacatctatttt

SEQ ID NO: 3125407 - DNA, 16 bp, Homo sapiens
gctgtacccagatgcc

SEQ ID NO: 3125408 - DNA, 18 bp, Homo sapiens
gctgtacccttccacctc

SEQ ID NO: 3125409 - DNA, 13 bp, Homo sapiens
gctgtactataag

SEQ ID NO: 3125410 - DNA, 20 bp, Homo sapiens
gctgtactcagagcagagca

SEQ ID NO: 3125411 - DNA, 17 bp, Homo sapiens
gctgtactcttgctgat

SEQ ID NO: 3125412 - DNA, 16 bp, Homo sapiens
gctgtagtcctttctg

SEQ ID NO: 3125413 - DNA, 18 bp, Homo sapiens
gctgtagtcctttctgcc

SEQ ID NO: 3125414 - DNA, 14 bp, Homo sapiens
gctgtataagttat

SEQ ID NO: 3125415 - DNA, 23 bp, Homo sapiens
gctgtatcccatgagcctcagca

SEQ ID NO: 3125416 - DNA, 14 bp, Homo sapiens
gctgtatgatttgt

SEQ ID NO: 3125417 - DNA, 12 bp, Homo sapiens
gctgtattgtct

SEQ ID NO: 3125418 - DNA, 14 bp, Homo sapiens
gctgtattttaaca

SEQ ID NO: 3125419 - DNA, 17 bp, Homo sapiens
gctgtattttaacactt

SEQ ID NO: 3125420 - DNA, 12 bp, Homo sapiens
gctgtccctgca

SEQ ID NO: 3125421 - DNA, 18 bp, Homo sapiens
gctgtccctgcagggcca

SEQ ID NO: 3125422 - DNA, 13 bp, Homo sapiens
gctgtcctaggcc

SEQ ID NO: 3125423 - DNA, 16 bp, Homo sapiens
gctgtcctaggccaca

SEQ ID NO: 3125424 - DNA, 15 bp, Homo sapiens
gctgtcctggagggg

SEQ ID NO: 3125425 - DNA, 16 bp, Homo sapiens
gctgtcctggaggggc

SEQ ID NO: 3125426 - DNA, 23 bp, Homo sapiens
gctgtcctggaggggctggggac

SEQ ID NO: 3125427 - DNA, 20 bp, Homo sapiens
gctgtcgccccaggccctcc

SEQ ID NO: 3125428 - DNA, 18 bp, Homo sapiens
gctgtctatgcagcctgc

SEQ ID NO: 3125429 - DNA, 12 bp, Homo sapiens
gctgtctctgct

SEQ ID NO: 3125430 - DNA, 13 bp, Homo sapiens
gctgtctctgctc

SEQ ID NO: 3125431 - DNA, 14 bp, Homo sapiens
gctgtctctgctcg

SEQ ID NO: 3125432 - DNA, 13 bp, Homo sapiens
gctgtctggccag

SEQ ID NO: 3125433 - DNA, 14 bp, Homo sapiens
gctgtctggggcct

SEQ ID NO: 3125434 - DNA, 16 bp, Homo sapiens
gctgtcttccccaccg

SEQ ID NO: 3125435 - DNA, 20 bp, Homo sapiens
gctgtcttccccaccgcagt

SEQ ID NO: 3125436 - DNA, 19 bp, Homo sapiens
gctgtcttgatgactgctg

SEQ ID NO: 3125437 - DNA, 23 bp, Homo sapiens
gctgtgacaagccaatgtgaatt

SEQ ID NO: 3125438 - DNA, 17 bp, Homo sapiens
gctgtgagccttggctg

SEQ ID NO: 3125439 - DNA, 23 bp, Homo sapiens
gctgtgaggaatgctctgtgcca

SEQ ID NO: 3125440 - DNA, 13 bp, Homo sapiens
gctgtgaggctgt

SEQ ID NO: 3125441 - DNA, 16 bp, Homo sapiens
gctgtgaggctgtcct

SEQ ID NO: 3125442 - DNA, 17 bp, Homo sapiens
gctgtgaggctgtcctg

SEQ ID NO: 3125443 - DNA, 18 bp, Homo sapiens
gctgtgaggctgtcctgt

SEQ ID NO: 3125444 - DNA, 20 bp, Homo sapiens
gctgtgagtctttggttcta

SEQ ID NO: 3125445 - DNA, 19 bp, Homo sapiens
gctgtgccaacctgttctt

SEQ ID NO: 3125446 - DNA, 12 bp, Homo sapiens
gctgtgcctctg

SEQ ID NO: 3125447 - DNA, 15 bp, Homo sapiens
gctgtgcctgctaga

SEQ ID NO: 3125448 - DNA, 16 bp, Homo sapiens
gctgtgcctgctagag

SEQ ID NO: 3125449 - DNA, 14 bp, Homo sapiens
gctgtgctatgaat

SEQ ID NO: 3125450 - DNA, 16 bp, Homo sapiens
gctgtgctatgaattt

SEQ ID NO: 3125451 - DNA, 12 bp, Homo sapiens
gctgtgctcaga

SEQ ID NO: 3125452 - DNA, 16 bp, Homo sapiens
gctgtgctctggacag

SEQ ID NO: 3125453 - DNA, 14 bp, Homo sapiens
gctgtgctgctcaa

SEQ ID NO: 3125454 - DNA, 22 bp, Homo sapiens
gctgtgctgcttttgagcctca

SEQ ID NO: 3125455 - DNA, 19 bp, Homo sapiens
gctgtggaccgtggacagg

SEQ ID NO: 3125456 - DNA, 22 bp, Homo sapiens
gctgggaaccccgcagcccgtg

SEQ ID NO: 3125457 - DNA, 23 bp, Homo sapiens
gctgggaagagaagagggcccag

SEQ ID NO: 3125458 - DNA, 13 bp, Homo sapiens
gctgggaccagag

SEQ ID NO: 3125459 - DNA, 15 bp, Homo sapiens
gctgggaccagagcc

SEQ ID NO: 3125460 - DNA, 17 bp, Homo sapiens
gctgggaccagagccag

SEQ ID NO: 3125461 - DNA, 19 bp, Homo sapiens
gctgggactacaggcaccc

SEQ ID NO: 3125462 - DNA, 14 bp, Homo sapiens
gctgggactcagcc

SEQ ID NO: 3125463 - DNA, 15 bp, Homo sapiens
gctgggactcagcct

SEQ ID NO: 3125464 - DNA, 17 bp, Homo sapiens
gtattttgaagaatatt

SEQ ID NO: 3125465 - DNA, 11 bp, Homo sapiens
gtattttgaat

SEQ ID NO: 3125466 - DNA, 15 bp, Homo sapiens
gtattttgaatacca

SEQ ID NO: 3125467 - DNA, 16 bp, Homo sapiens
gtattttgaataccat

SEQ ID NO: 3125468 - DNA, 17 bp, Homo sapiens
gtattttggagaaatta

SEQ ID NO: 3125469 - DNA, 12 bp, Homo sapiens
gtattttgtgtg

SEQ ID NO: 3125470 - DNA, 17 bp, Homo sapiens
gtattttgttaaagctg

SEQ ID NO: 3125471 - DNA, 18 bp, Homo sapiens
gtattttgttaaagctgg

SEQ ID NO: 3125472 - DNA, 13 bp, Homo sapiens
gtatttttaaagg

SEQ ID NO: 3125473 - DNA, 14 bp, Homo sapiens
gtatttttataaat

SEQ ID NO: 3125474 - DNA, 18 bp, Homo sapiens
gtatttttatacaaacct

SEQ ID NO: 3125475 - DNA, 17 bp, Homo sapiens
gtatttttcagagattt

SEQ ID NO: 3125476 - DNA, 20 bp, Homo sapiens
gtatttttcaggtaggccct

SEQ ID NO: 3125477 - DNA, 17 bp, Homo sapiens
gtatttttctgttagct

SEQ ID NO: 3125478 - DNA, 18 bp, Homo sapiens
gtattttttaaaacacta

SEQ ID NO: 3125479 - DNA, 21 bp, Homo sapiens
gtcaaaacactgtggaactaa

SEQ ID NO: 3125480 - DNA, 12 bp, Homo sapiens
gtcaaaaggaac

SEQ ID NO: 3125481 - DNA, 21 bp, Homo sapiens
gtcaaaagttggactaaatgc

SEQ ID NO: 3125482 - DNA, 23 bp, Homo sapiens
gtcaaactccctagtctccacct

SEQ ID NO: 3125483 - DNA, 16 bp, Homo sapiens
gtcaaactgtagaaat

SEQ ID NO: 3125484 - DNA, 21 bp, Homo sapiens
gtcaaacttggatacttggat

SEQ ID NO: 3125485 - DNA, 12 bp, Homo sapiens
gtcaaagaaatg

SEQ ID NO: 3125486 - DNA, 15 bp, Homo sapiens
gtcaaattatgtatt

SEQ ID NO: 3125487 - DNA, 21 bp, Homo sapiens
gtcaacaagtatgaataaaga

SEQ ID NO: 3125488 - DNA, 19 bp, Homo sapiens
gtcaacacttaagggtttt

SEQ ID NO: 3125489 - DNA, 18 bp, Homo sapiens
gtcaacagccataataat

SEQ ID NO: 3125490 - DNA, 14 bp, Homo sapiens
gtcaactacacaaa

SEQ ID NO: 3125491 - DNA, 15 bp, Homo sapiens
gtcaacttctggctc

SEQ ID NO: 3125492 - DNA, 17 bp, Homo sapiens
gtcaacttctggctcct

SEQ ID NO: 3125493 - DNA, 15 bp, Homo sapiens
gtcaagaagaaaaag

SEQ ID NO: 3125494 - DNA, 12 bp, Homo sapiens
gtcaagaagaat

SEQ ID NO: 3125495 - DNA, 22 bp, Homo sapiens
gtcaagggctgtcattgcacat

SEQ ID NO: 3125496 - DNA, 20 bp, Homo sapiens
gtcaagggcttactatttct

SEQ ID NO: 3125497 - DNA, 14 bp, Homo sapiens
gtcaagtctctgct

SEQ ID NO: 3125498 - DNA, 21 bp, Homo sapiens
gtcaagtctctgctggcccag

SEQ ID NO: 3125499 - DNA, 17 bp, Homo sapiens
gtcaagttaacaaggaa

SEQ ID NO: 3125500 - DNA, 20 bp, Homo sapiens
gtcaataaacaacagctgaa

SEQ ID NO: 3125501 - DNA, 20 bp, Homo sapiens
gtcaataaacagcttcatgc

SEQ ID NO: 3125502 - DNA, 20 bp, Homo sapiens
gtcaatattaaatacagaca

SEQ ID NO: 3125503 - DNA, 15 bp, Homo sapiens
gtcaatcatttctca

SEQ ID NO: 3125504 - DNA, 16 bp, Homo sapiens
gtcaatcatttctcac

SEQ ID NO: 3125505 - DNA, 17 bp, Homo sapiens
gtcaatttctgtgttgc

SEQ ID NO: 3125506 - DNA, 15 bp, Homo sapiens
gtcacaacctctctg

SEQ ID NO: 3125507 - DNA, 11 bp, Homo sapiens
gtcacaataaa

SEQ ID NO: 3125508 - DNA, 20 bp, Homo sapiens
gtcacaatgagattgaattt

SEQ ID NO: 3125509 - DNA, 21 bp, Homo sapiens
gtcacacagtattacttctgc

SEQ ID NO: 3125510 - DNA, 13 bp, Homo sapiens
gtcacacctgtgc

SEQ ID NO: 3125511 - DNA, 18 bp, Homo sapiens
gtcacagctgcagctggg

SEQ ID NO: 3125512 - DNA, 20 bp, Homo sapiens
gtcacagctgcagctgggcc

SEQ ID NO: 3125513 - DNA, 18 bp, Homo sapiens
gtcacaggactctgcctc

SEQ ID NO: 3125514 - DNA, 11 bp, Homo sapiens
gtcacaggccc

SEQ ID NO: 3125515 - DNA, 12 bp, Homo sapiens
gtcacaggccca

SEQ ID NO: 3125516 - DNA, 13 bp, Homo sapiens
gtcacaggcccag

SEQ ID NO: 3125517 - DNA, 15 bp, Homo sapiens
gtcacaggcccagaa

SEQ ID NO: 3125518 - DNA, 17 bp, Homo sapiens
gtcacaggcccagaagg

SEQ ID NO: 3125519 - DNA, 13 bp, Homo sapiens
gtcacagggccaa

SEQ ID NO: 3125520 - DNA, 21 bp, Homo sapiens
gtcacatggcctatgcacata

SEQ ID NO: 3125521 - DNA, 15 bp, Homo sapiens
gtcacattatttatt

SEQ ID NO: 3125522 - DNA, 15 bp, Homo sapiens
gtcaccaagcccagt

SEQ ID NO: 3125523 - DNA, 23 bp, Homo sapiens
gtcaccaccacccgaaatgccac

SEQ ID NO: 3125524 - DNA, 17 bp, Homo sapiens
gtcaccacgactggcca

SEQ ID NO: 3125525 - DNA, 19 bp, Homo sapiens
gtcaccacgactggccagg

SEQ ID NO: 3125526 - DNA, 12 bp, Homo sapiens
gtcaccacgtgg

SEQ ID NO: 3125527 - DNA, 18 bp, Homo sapiens
gtcaccactccattccca

SEQ ID NO: 3125528 - DNA, 19 bp, Homo sapiens
gtcaccagctatctgtcat

SEQ ID NO: 3125529 - DNA, 23 bp, Homo sapiens
gtcaccagctatctgtcatctct

SEQ ID NO: 3125530 - DNA, 19 bp, Homo sapiens
gtcaccagttaaaagcatt

SEQ ID NO: 3125531 - DNA, 20 bp, Homo sapiens
gtcacccagactggaatgca

SEQ ID NO: 3125532 - DNA, 20 bp, Homo sapiens
gtcacccaggctggagtgca

SEQ ID NO: 3125533 - DNA, 16 bp, Homo sapiens
gtcaccctccacctct

SEQ ID NO: 3125534 - DNA, 16 bp, Homo sapiens
gtcaccggtcagtgcc

SEQ ID NO: 3125535 - DNA, 17 bp, Homo sapiens
gtcaccggtcagtgcct

SEQ ID NO: 3125536 - DNA, 19 bp, Homo sapiens
gtcacctagcaagctgccg

SEQ ID NO: 3125537 - DNA, 21 bp, Homo sapiens
gtcacctctctcagagcatct

SEQ ID NO: 3125538 - DNA, 13 bp, Homo sapiens
gtcacctgcaagc

SEQ ID NO: 3125539 - DNA, 18 bp, Homo sapiens
gtcacctgcaagccccag

SEQ ID NO: 3125540 - DNA, 14 bp, Homo sapiens
gtcaccttcgagta

SEQ ID NO: 3125541 - DNA, 16 bp, Homo sapiens
gtcacgtgtattttca

SEQ ID NO: 3125542 - DNA, 14 bp, Homo sapiens
gtcactactcacag

SEQ ID NO: 3125543 - DNA, 22 bp, Homo sapiens
gtcactactcacagtctcttta

SEQ ID NO: 3125544 - DNA, 18 bp, Homo sapiens
gtcactcattgctgagcc

SEQ ID NO: 3125545 - DNA, 19 bp, Homo sapiens
gtcactcattgctgagcct

SEQ ID NO: 3125546 - DNA, 20 bp, Homo sapiens
gtcactcattgctgagcctc

SEQ ID NO: 3125547 - DNA, 15 bp, Homo sapiens
gtcactccaccatcc

SEQ ID NO: 3125548 - DNA, 19 bp, Homo sapiens
gtcactccctctgccttca

SEQ ID NO: 3125549 - DNA, 13 bp, Homo sapiens
gtcactcctgggg

SEQ ID NO: 3125550 - DNA, 16 bp, Homo sapiens
gtcactgacacaaagg

SEQ ID NO: 3125551 - DNA, 22 bp, Homo sapiens
gtcactgatgtacaattaaaaa

SEQ ID NO: 3125552 - DNA, 23 bp, Homo sapiens
gtcactgcacagtgcatctcagc

SEQ ID NO: 3125553 - DNA, 15 bp, Homo sapiens
gtcactggaaagggg

SEQ ID NO: 3125554 - DNA, 23 bp, Homo sapiens
gtcactggaaaggggagagcctg

SEQ ID NO: 3125555 - DNA, 19 bp, Homo sapiens
gtcactggaccactgggca

SEQ ID NO: 3125556 - DNA, 18 bp, Homo sapiens
gtcactggaggttgaagc

SEQ ID NO: 3125557 - DNA, 20 bp, Homo sapiens
gtcactggaggttgaagcca

SEQ ID NO: 3125558 - DNA, 23 bp, Homo sapiens
gtcactggaggttgaagccaagt

SEQ ID NO: 3125559 - DNA, 12 bp, Homo sapiens
gtcactggctct

SEQ ID NO: 3125560 - DNA, 20 bp, Homo sapiens
gtcactggctctccaagtgc

SEQ ID NO: 3125561 - DNA, 12 bp, Homo sapiens
gtcactggctgg

SEQ ID NO: 3125562 - DNA, 13 bp, Homo sapiens
gtcactggctggc

SEQ ID NO: 3125563 - DNA, 21 bp, Homo sapiens
gtcactggtagaccaaaataa

SEQ ID NO: 3125564 - DNA, 15 bp, Homo sapiens
gtcactgtttctctg

SEQ ID NO: 3125565 - DNA, 18 bp, Homo sapiens
gtccaaatgtttacaggg

SEQ ID NO: 3125566 - DNA, 21 bp, Homo sapiens
gtccaaggtttaaagagtcta

SEQ ID NO: 3125567 - DNA, 20 bp, Homo sapiens
gtccaagttcttcacctcta

SEQ ID NO: 3125568 - DNA, 12 bp, Homo sapiens
gtccaatgtggc

SEQ ID NO: 3125569 - DNA, 16 bp, Homo sapiens
gtccaattagtttcct

SEQ ID NO: 3125570 - DNA, 13 bp, Homo sapiens
gtccacagagagg

SEQ ID NO: 3125571 - DNA, 18 bp, Homo sapiens
gtccacagccatgccctt

SEQ ID NO: 3125572 - DNA, 16 bp, Homo sapiens
gtccacaggggcaggc

SEQ ID NO: 3125573 - DNA, 21 bp, Homo sapiens
gtccacaggggcaggcctggg

SEQ ID NO: 3125574 - DNA, 22 bp, Homo sapiens
gtccacaggggcaggcctggga

SEQ ID NO: 3125575 - DNA, 19 bp, Homo sapiens
gtccaccacttcaggggat

SEQ ID NO: 3125576 - DNA, 13 bp, Homo sapiens
gtccacccaggag

SEQ ID NO: 3125577 - DNA, 14 bp, Homo sapiens
gtccacccaggagc

SEQ ID NO: 3125578 - DNA, 15 bp, Homo sapiens
gtccacccaggagcc

SEQ ID NO: 3125579 - DNA, 13 bp, Homo sapiens
gtccacccaggct

SEQ ID NO: 3125580 - DNA, 14 bp, Homo sapiens
gtccaccggcccct

SEQ ID NO: 3125581 - DNA, 19 bp, Homo sapiens
gtccaccggcccctggcag

SEQ ID NO: 3125582 - DNA, 13 bp, Homo sapiens
gtccacctgtggg

SEQ ID NO: 3125583 - DNA, 14 bp, Homo sapiens
gtccacctgtgggt

SEQ ID NO: 3125584 - DNA, 23 bp, Homo sapiens
gtccacctgtgggtgtagccagg

SEQ ID NO: 3125585 - DNA, 16 bp, Homo sapiens
gtccactccctgctcc

SEQ ID NO: 3125586 - DNA, 19 bp, Homo sapiens
gtccactctcggggccctt

SEQ ID NO: 3125587 - DNA, 20 bp, Homo sapiens
gtccactctcggggcccttg

SEQ ID NO: 3125588 - DNA, 20 bp, Homo sapiens
gtccactgtcactgtttctc

SEQ ID NO: 3125589 - DNA, 23 bp, Homo sapiens
gtccactgtgtatagaagtagat

SEQ ID NO: 3125590 - DNA, 13 bp, Homo sapiens
gtccagcctgggc

SEQ ID NO: 3125591 - DNA, 12 bp, Homo sapiens
gtccagctctgg

SEQ ID NO: 3125592 - DNA, 17 bp, Homo sapiens
gtccagctggcctggac

SEQ ID NO: 3125593 - DNA, 19 bp, Homo sapiens
gtccagctgggaagccctt

SEQ ID NO: 3125594 - DNA, 22 bp, Homo sapiens
gtccaggaaggcagctgctctt

SEQ ID NO: 3125595 - DNA, 15 bp, Homo sapiens
gtccaggccactgtg

SEQ ID NO: 3125596 - DNA, 17 bp, Homo sapiens
gtatattttaatgaata

SEQ ID NO: 3125597 - DNA, 22 bp, Homo sapiens
gtatcaagacgtttaactgcag

SEQ ID NO: 3125598 - DNA, 19 bp, Homo sapiens
gtatcaagtggcatgtgct

SEQ ID NO: 3125599 - DNA, 16 bp, Homo sapiens
gtatcagaggcctata

SEQ ID NO: 3125600 - DNA, 16 bp, Homo sapiens
gtatcaggtgctgcca

SEQ ID NO: 3125601 - DNA, 17 bp, Homo sapiens
gtatcagtgttttaaat

SEQ ID NO: 3125602 - DNA, 13 bp, Homo sapiens
gtatcagtttcca

SEQ ID NO: 3125603 - DNA, 14 bp, Homo sapiens
gtatcatctccatc

SEQ ID NO: 3125604 - DNA, 18 bp, Homo sapiens
gtatcccgagtctgggac

SEQ ID NO: 3125605 - DNA, 13 bp, Homo sapiens
gtatcccttctca

SEQ ID NO: 3125606 - DNA, 16 bp, Homo sapiens
gtatccgactctaagc

SEQ ID NO: 3125607 - DNA, 22 bp, Homo sapiens
gtatccgactctaagctgtgtg

SEQ ID NO: 3125608 - DNA, 24 bp, Homo sapiens
gtatccgactctaagctgtgtgca

SEQ ID NO: 3125609 - DNA, 16 bp, Homo sapiens
gtatcctgcccagtgt

SEQ ID NO: 3125610 - DNA, 17 bp, Homo sapiens
gtatcctgcccagtgtt

SEQ ID NO: 3125611 - DNA, 15 bp, Homo sapiens
gtatcgatgttttat

SEQ ID NO: 3125612 - DNA, 14 bp, Homo sapiens
gtatcggagacagt

SEQ ID NO: 3125613 - DNA, 20 bp, Homo sapiens
gtatctatatatgtgtatgt

SEQ ID NO: 3125614 - DNA, 21 bp, Homo sapiens
gtatctcagaaagtgcctgac

SEQ ID NO: 3125615 - DNA, 16 bp, Homo sapiens
gtatctcatactgtct

SEQ ID NO: 3125616 - DNA, 20 bp, Homo sapiens
gtatctctgaagcatgtttc

SEQ ID NO: 3125617 - DNA, 20 bp, Homo sapiens
gtatctctttcacattgttt

SEQ ID NO: 3125618 - DNA, 20 bp, Homo sapiens
gtatctgagttgccaagaca

SEQ ID NO: 3125619 - DNA, 21 bp, Homo sapiens
gtatctgtttacatccagagt

SEQ ID NO: 3125620 - DNA, 15 bp, Homo sapiens
gtatctttatgctgt

SEQ ID NO: 3125621 - DNA, 14 bp, Homo sapiens
gtatgaaaatgagt

SEQ ID NO: 3125622 - DNA, 23 bp, Homo sapiens
gtatgaaagatggctgtgcctct

SEQ ID NO: 3125623 - DNA, 19 bp, Homo sapiens
gtatgaactttatctaaag

SEQ ID NO: 3125624 - DNA, 16 bp, Homo sapiens
gtatgaataattgcat

SEQ ID NO: 3125625 - DNA, 16 bp, Homo sapiens
gtatgacgctgataca

SEQ ID NO: 3125626 - DNA, 14 bp, Homo sapiens
gtatgactaaagag

SEQ ID NO: 3125627 - DNA, 20 bp, Homo sapiens
gtatgactaaagagagaatg

SEQ ID NO: 3125628 - DNA, 16 bp, Homo sapiens
gtatgagatggttaaa

SEQ ID NO: 3125629 - DNA, 15 bp, Homo sapiens
gtatgattccaatct

SEQ ID NO: 3125630 - DNA, 22 bp, Homo sapiens
gtatgatttgttttgaattttg

SEQ ID NO: 3125631 - DNA, 16 bp, Homo sapiens
gtatgcaagtctgtga

SEQ ID NO: 3125632 - DNA, 18 bp, Homo sapiens
gtatgcattattaaattg

SEQ ID NO: 3125633 - DNA, 15 bp, Homo sapiens
gtatgccttctgtat

SEQ ID NO: 3125634 - DNA, 14 bp, Homo sapiens
gtatgctggccagc

SEQ ID NO: 3125635 - DNA, 18 bp, Homo sapiens
gtatgctggccagcaccc

SEQ ID NO: 3125636 - DNA, 20 bp, Homo sapiens
gtatgctggccagcaccctc

SEQ ID NO: 3125637 - DNA, 17 bp, Homo sapiens
gtatggaatacagtgtt

SEQ ID NO: 3125638 - DNA, 18 bp, Homo sapiens
gtatggaatacagtgtta

SEQ ID NO: 3125639 - DNA, 18 bp, Homo sapiens
gtatggactatctgtctg

SEQ ID NO: 3125640 - DNA, 14 bp, Homo sapiens
gtatggctctgcac

SEQ ID NO: 3125641 - DNA, 20 bp, Homo sapiens
gtatggctctgcacccctct

SEQ ID NO: 3125642 - DNA, 21 bp, Homo sapiens
gtatggctctgcacccctctg

SEQ ID NO: 3125643 - DNA, 19 bp, Homo sapiens
gtatgggtagggtaaatca

SEQ ID NO: 3125644 - DNA, 14 bp, Homo sapiens
gtatggtggctggg

SEQ ID NO: 3125645 - DNA, 16 bp, Homo sapiens
gtatggtggctgggtt

SEQ ID NO: 3125646 - DNA, 13 bp, Homo sapiens
gtatgtctccagt

SEQ ID NO: 3125647 - DNA, 14 bp, Homo sapiens
gtatgtctctttaa

SEQ ID NO: 3125648 - DNA, 22 bp, Homo sapiens
gtatgtctctttaagttttgat

SEQ ID NO: 3125649 - DNA, 21 bp, Homo sapiens
gtatgtctgtttttgtatctt

SEQ ID NO: 3125650 - DNA, 18 bp, Homo sapiens
gtatgtgaaagtgtaaaa

SEQ ID NO: 3125651 - DNA, 21 bp, Homo sapiens
gtatgtgaacaaatcaaattg

SEQ ID NO: 3125652 - DNA, 19 bp, Homo sapiens
gtatgtgacttttctgatt

SEQ ID NO: 3125653 - DNA, 11 bp, Homo sapiens
gtatgtgccat

SEQ ID NO: 3125654 - DNA, 14 bp, Homo sapiens
gtatgtgccattta

SEQ ID NO: 3125655 - DNA, 15 bp, Homo sapiens
gtatgttatgaacat

SEQ ID NO: 3125656 - DNA, 14 bp, Homo sapiens
gtatgttgtacaat

SEQ ID NO: 3125657 - DNA, 11 bp, Homo sapiens
gtatgttgtcc

SEQ ID NO: 3125658 - DNA, 21 bp, Homo sapiens
gtatgttgtccaattgttgac

SEQ ID NO: 3125659 - DNA, 17 bp, Homo sapiens
gtattaaatcttaaaca

SEQ ID NO: 3125660 - DNA, 11 bp, Homo sapiens
gtattaataaa

SEQ ID NO: 3125661 - DNA, 15 bp, Homo sapiens
gtattaataaaaaga

SEQ ID NO: 3125662 - DNA, 13 bp, Homo sapiens
gtattaataaagc

SEQ ID NO: 3125663 - DNA, 17 bp, Homo sapiens
gtattaataaagcattc

SEQ ID NO: 3125664 - DNA, 16 bp, Homo sapiens
gtattaatactaaaat

SEQ ID NO: 3125665 - DNA, 14 bp, Homo sapiens
gtattaatttagaa

SEQ ID NO: 3125666 - DNA, 22 bp, Homo sapiens
gtattacttaggttattttgct

SEQ ID NO: 3125667 - DNA, 17 bp, Homo sapiens
gtattattctgttttgc

SEQ ID NO: 3125668 - DNA, 18 bp, Homo sapiens
gtattcaacaatttcaat

SEQ ID NO: 3125669 - DNA, 20 bp, Homo sapiens
gtattcaacaatttcaataa

SEQ ID NO: 3125670 - DNA, 21 bp, Homo sapiens
gtattcaagcaaacatcaaat

SEQ ID NO: 3125671 - DNA, 16 bp, Homo sapiens
gtattcccttgtattt

SEQ ID NO: 3125672 - DNA, 18 bp, Homo sapiens
gtattcctgaaaagctgc

SEQ ID NO: 3125673 - DNA, 22 bp, Homo sapiens
gtattctcagagcatgtgtcag

SEQ ID NO: 3125674 - DNA, 18 bp, Homo sapiens
gtattctcataggagact

SEQ ID NO: 3125675 - DNA, 11 bp, Homo sapiens
gtattctgtac

SEQ ID NO: 3125676 - DNA, 15 bp, Homo sapiens
gtattcttctgtatt

SEQ ID NO: 3125677 - DNA, 18 bp, Homo sapiens
gtattcttctgtatttct

SEQ ID NO: 3125678 - DNA, 14 bp, Homo sapiens
gtattcttgtcaaa

SEQ ID NO: 3125679 - DNA, 14 bp, Homo sapiens
gtattgaaaacttc

SEQ ID NO: 3125680 - DNA, 16 bp, Homo sapiens
gtattgaaaacttcaa

SEQ ID NO: 3125681 - DNA, 21 bp, Homo sapiens
gtattgactgtaccacagaca

SEQ ID NO: 3125682 - DNA, 18 bp, Homo sapiens
gtattgactttatgttgt

SEQ ID NO: 3125683 - DNA, 14 bp, Homo sapiens
gtattgtcagccat

SEQ ID NO: 3125684 - DNA, 12 bp, Homo sapiens
gtattgtggtat

SEQ ID NO: 3125685 - DNA, 14 bp, Homo sapiens
gtattgttcccagt

SEQ ID NO: 3125686 - DNA, 18 bp, Homo sapiens
gtatttaaactatcttgt

SEQ ID NO: 3125687 - DNA, 22 bp, Homo sapiens
gtatttaaactatcttgtgtga

SEQ ID NO: 3125688 - DNA, 14 bp, Homo sapiens
gtatttaaatgttc

SEQ ID NO: 3125689 - DNA, 17 bp, Homo sapiens
gtatttaattgtaaact

SEQ ID NO: 3125690 - DNA, 20 bp, Homo sapiens
gtatttaattgtaaactgta

SEQ ID NO: 3125691 - DNA, 22 bp, Homo sapiens
gtatttaattgtaaactgtact

SEQ ID NO: 3125692 - DNA, 17 bp, Homo sapiens
gtatttacgctttgatt

SEQ ID NO: 3125693 - DNA, 19 bp, Homo sapiens
gtatttacgctttgattca

SEQ ID NO: 3125694 - DNA, 16 bp, Homo sapiens
gtatttatatatttat

SEQ ID NO: 3125695 - DNA, 15 bp, Homo sapiens
gtatttatatttgga

SEQ ID NO: 3125696 - DNA, 15 bp, Homo sapiens
gtatttattccatat

SEQ ID NO: 3125697 - DNA, 21 bp, Homo sapiens
gtatttattccatattcatgt

SEQ ID NO: 3125698 - DNA, 23 bp, Homo sapiens
gtatttattccatattcatgtaa

SEQ ID NO: 3125699 - DNA, 15 bp, Homo sapiens
gtatttattctctat

SEQ ID NO: 3125700 - DNA, 22 bp, Homo sapiens
gtatttattctctatttattgg

SEQ ID NO: 3125701 - DNA, 14 bp, Homo sapiens
gtagagttgctgag

SEQ ID NO: 3125702 - DNA, 15 bp, Homo sapiens
gtagagttgctgaga

SEQ ID NO: 3125703 - DNA, 18 bp, Homo sapiens
gtagatatgtattctttt

SEQ ID NO: 3125704 - DNA, 22 bp, Homo sapiens
gtagatccatttccattgctta

SEQ ID NO: 3125705 - DNA, 18 bp, Homo sapiens
gtagatcgcttgagccca

SEQ ID NO: 3125706 - DNA, 19 bp, Homo sapiens
gtagatcgcttgagcccag

SEQ ID NO: 3125707 - DNA, 13 bp, Homo sapiens
gtagattctgtgg

SEQ ID NO: 3125708 - DNA, 23 bp, Homo sapiens
gtagattgcagaaaattctgtgc

SEQ ID NO: 3125709 - DNA, 11 bp, Homo sapiens
gtagcactgag

SEQ ID NO: 3125710 - DNA, 12 bp, Homo sapiens
gtagcactgagg

SEQ ID NO: 3125711 - DNA, 17 bp, Homo sapiens
gtagcagagttaaatct

SEQ ID NO: 3125712 - DNA, 17 bp, Homo sapiens
gtagcaggttctaggct

SEQ ID NO: 3125713 - DNA, 20 bp, Homo sapiens
gtagcataaataaaactgaa

SEQ ID NO: 3125714 - DNA, 21 bp, Homo sapiens
gtagcataaataaaactgaat

SEQ ID NO: 3125715 - DNA, 15 bp, Homo sapiens
gtagcataactgtag

SEQ ID NO: 3125716 - DNA, 18 bp, Homo sapiens
gtagcataactgtagctc

SEQ ID NO: 3125717 - DNA, 21 bp, Homo sapiens
gtagcattctttggagttaaa

SEQ ID NO: 3125718 - DNA, 19 bp, Homo sapiens
gtagccaaggtgggctgag

SEQ ID NO: 3125719 - DNA, 13 bp, Homo sapiens
gtagccagctgtg

SEQ ID NO: 3125720 - DNA, 14 bp, Homo sapiens
gtagccagctgtgc

SEQ ID NO: 3125721 - DNA, 15 bp, Homo sapiens
gtacatctgcaatat

SEQ ID NO: 3125722 - DNA, 18 bp, Homo sapiens
gtacatctgcaatatgaa

SEQ ID NO: 3125723 - DNA, 13 bp, Homo sapiens
gtacatctggctt

SEQ ID NO: 3125724 - DNA, 11 bp, Homo sapiens
gtacatgagaa

SEQ ID NO: 3125725 - DNA, 19 bp, Homo sapiens
gtacatggaataacatgta

SEQ ID NO: 3125726 - DNA, 16 bp, Homo sapiens
gtacatggcagagttt

SEQ ID NO: 3125727 - DNA, 21 bp, Homo sapiens
gtacattataaaccttcagaa

SEQ ID NO: 3125728 - DNA, 13 bp, Homo sapiens
gtacatttattca

SEQ ID NO: 3125729 - DNA, 13 bp, Homo sapiens
gtaccaaagtttt

SEQ ID NO: 3125730 - DNA, 21 bp, Homo sapiens
gtaccaaagttttatcaagtt

SEQ ID NO: 3125731 - DNA, 17 bp, Homo sapiens
gtaccaaatctgacata

SEQ ID NO: 3125732 - DNA, 15 bp, Homo sapiens
gtaccacagacacaa

SEQ ID NO: 3125733 - DNA, 16 bp, Homo sapiens
gtaccagcaatatgta

SEQ ID NO: 3125734 - DNA, 16 bp, Homo sapiens
gtaccagccctggggc

SEQ ID NO: 3125735 - DNA, 17 bp, Homo sapiens
gtaccagccctggggct

SEQ ID NO: 3125736 - DNA, 22 bp, Homo sapiens
gtaccagcgctctaaaagcacc

SEQ ID NO: 3125737 - DNA, 16 bp, Homo sapiens
gtaccagctgcgcttg

SEQ ID NO: 3125738 - DNA, 21 bp, Homo sapiens
gggctgttgaagtcaccttgt

SEQ ID NO: 3125739 - DNA, 16 bp, Homo sapiens
gggctgttggcactca

SEQ ID NO: 3125740 - DNA, 16 bp, Homo sapiens
gggcttcagtggcagc

SEQ ID NO: 3125741 - DNA, 15 bp, Homo sapiens
gggcttcctgggtcc

SEQ ID NO: 3125742 - DNA, 19 bp, Homo sapiens
gggcttctgcaccctccac

SEQ ID NO: 3125743 - DNA, 17 bp, Homo sapiens
gggcttggcctgctgtg

SEQ ID NO: 3125744 - DNA, 14 bp, Homo sapiens
gggctttctggaga

SEQ ID NO: 3125745 - DNA, 15 bp, Homo sapiens
gggctttgcaggctc

SEQ ID NO: 3125746 - DNA, 20 bp, Homo sapiens
gggcttttctggggcccagg

SEQ ID NO: 3125747 - DNA, 24 bp, Homo sapiens
gggcttttctggggcccaggaagc

SEQ ID NO: 3125748 - DNA, 18 bp, Homo sapiens
ggggaaaaaagcacatac

SEQ ID NO: 3125749 - DNA, 16 bp, Homo sapiens
ggggaaagggaggaag

SEQ ID NO: 3125750 - DNA, 13 bp, Homo sapiens
ggggaacagacca

SEQ ID NO: 3125751 - DNA, 23 bp, Homo sapiens
ggggaacatttctgtaaatacca

SEQ ID NO: 3125752 - DNA, 21 bp, Homo sapiens
ggggaacctgccatgccagga

SEQ ID NO: 3125753 - DNA, 15 bp, Homo sapiens
ggggaagccttgcac

SEQ ID NO: 3125754 - DNA, 19 bp, Homo sapiens
ggggaagctgcagcttggg

SEQ ID NO: 3125755 - DNA, 21 bp, Homo sapiens
ggggaaggagccagtttgccg

SEQ ID NO: 3125756 - DNA, 13 bp, Homo sapiens
ggggaagggccag

SEQ ID NO: 3125757 - DNA, 19 bp, Homo sapiens
ggggaatgagcccagagaa

SEQ ID NO: 3125758 - DNA, 19 bp, Homo sapiens
ggggtcctgtggcaggcag

SEQ ID NO: 3125759 - DNA, 13 bp, Homo sapiens
ggggtctccctgg

SEQ ID NO: 3125760 - DNA, 14 bp, Homo sapiens
ggggtctccctggc

SEQ ID NO: 3125761 - DNA, 14 bp, Homo sapiens
ggggtctgtgctgt

SEQ ID NO: 3125762 - DNA, 17 bp, Homo sapiens
ggggtctgtgctgtgcc

SEQ ID NO: 3125763 - DNA, 18 bp, Homo sapiens
ggggtctgtgctgtgcct

SEQ ID NO: 3125764 - DNA, 20 bp, Homo sapiens
ggggtctgtgctgtgcctgc

SEQ ID NO: 3125765 - DNA, 20 bp, Homo sapiens
ggggtgccccctcctctccc

SEQ ID NO: 3125766 - DNA, 17 bp, Homo sapiens
ggggtggaggcttcctg

SEQ ID NO: 3125767 - DNA, 14 bp, Homo sapiens
ggggtggcctcaag

SEQ ID NO: 3125768 - DNA, 19 bp, Homo sapiens
ggggtgtggctccttccca

SEQ ID NO: 3125769 - DNA, 20 bp, Homo sapiens
ggggtgtttgggaggctgcg

SEQ ID NO: 3125770 - DNA, 22 bp, Homo sapiens
ggggttaacttggtcagagcca

SEQ ID NO: 3125771 - DNA, 22 bp, Homo sapiens
ggggttctttcttcctctgctg

SEQ ID NO: 3125772 - DNA, 15 bp, Homo sapiens
ggggttgtgttgtca

SEQ ID NO: 3125773 - DNA, 13 bp, Homo sapiens
gggtaaactgtgg

SEQ ID NO: 3125774 - DNA, 16 bp, Homo sapiens
gggtaatgagaggtgg

SEQ ID NO: 3125775 - DNA, 18 bp, Homo sapiens
gggtaatgtgaaggccca

SEQ ID NO: 3125776 - DNA, 13 bp, Homo sapiens
gggtacagctggg

SEQ ID NO: 3125777 - DNA, 15 bp, Homo sapiens
gggtacatttataat

SEQ ID NO: 3125778 - DNA, 12 bp, Homo sapiens
gggtactaaatt

SEQ ID NO: 3125779 - DNA, 19 bp, Homo sapiens
gggtacttgtggacacagc

SEQ ID NO: 3125780 - DNA, 21 bp, Homo sapiens
gggtatccaagttggactggg

SEQ ID NO: 3125781 - DNA, 10 bp, Homo sapiens
gggtatcctg

SEQ ID NO: 3125782 - DNA, 12 bp, Homo sapiens
gggtattggaaa

SEQ ID NO: 3125783 - DNA, 19 bp, Homo sapiens
gggtcaagaaacagccagc

SEQ ID NO: 3125784 - DNA, 12 bp, Homo sapiens
gggtcacaggcc

SEQ ID NO: 3125785 - DNA, 13 bp, Homo sapiens
gggtcacaggccc

SEQ ID NO: 3125786 - DNA, 14 bp, Homo sapiens
gggtcacaggccca

SEQ ID NO: 3125787 - DNA, 21 bp, Homo sapiens
gggtcatgtttgcaggggtga

SEQ ID NO: 3125788 - DNA, 19 bp, Homo sapiens
gggtcattgacctctcagg

SEQ ID NO: 3125789 - DNA, 13 bp, Homo sapiens
gggtccaaataaa

SEQ ID NO: 3125790 - DNA, 15 bp, Homo sapiens
gggtccaagagacat

SEQ ID NO: 3125791 - DNA, 20 bp, Homo sapiens
gggtccaggaaggcagctgc

SEQ ID NO: 3125792 - DNA, 22 bp, Homo sapiens
gggtccaggaaggcagctgctc

SEQ ID NO: 3125793 - DNA, 23 bp, Homo sapiens
gggtccctcctctcacctctccc

SEQ ID NO: 3125794 - DNA, 16 bp, Homo sapiens
gggtccgcaccagctg

SEQ ID NO: 3125795 - DNA, 21 bp, Homo sapiens
gggtccgcaccagctgctctg

SEQ ID NO: 3125796 - DNA, 18 bp, Homo sapiens
gggtccgtggtagaggcc

SEQ ID NO: 3125797 - DNA, 19 bp, Homo sapiens
gggtcctcttctgggcctg

SEQ ID NO: 3125798 - DNA, 18 bp, Homo sapiens
gggtcctgtggcaggcag

SEQ ID NO: 3125799 - DNA, 19 bp, Homo sapiens
gggtcctgtggcaggcagc

SEQ ID NO: 3125800 - DNA, 23 bp, Homo sapiens
gggtcggaacccaagcttagaac

SEQ ID NO: 3125801 - DNA, 16 bp, Homo sapiens
gggtcggccctgccca

SEQ ID NO: 3125802 - DNA, 23 bp, Homo sapiens
gggtctcactatgttgcccaggc

SEQ ID NO: 3125803 - DNA, 22 bp, Homo sapiens
gggtctcgctgtcactggctgg

SEQ ID NO: 3125804 - DNA, 14 bp, Homo sapiens
gggtctctccctca

SEQ ID NO: 3125805 - DNA, 17 bp, Homo sapiens
gggtctctccctcaggt

SEQ ID NO: 3125806 - DNA, 22 bp, Homo sapiens
gggtctgaaggaatagccagag

SEQ ID NO: 3125807 - DNA, 19 bp, Homo sapiens
gggtctgctctttctctgc

SEQ ID NO: 3125808 - DNA, 17 bp, Homo sapiens
gggtctgtgctgtgcct

SEQ ID NO: 3125809 - DNA, 20 bp, Homo sapiens
gggtctgtgctgtgcctgct

SEQ ID NO: 3125810 - DNA, 24 bp, Homo sapiens
gggtctgtgtgaatgtgggcactg

SEQ ID NO: 3125811 - DNA, 23 bp, Homo sapiens
gggtcttccctacctcaggcagg

SEQ ID NO: 3125812 - DNA, 21 bp, Homo sapiens
gggtcttgggctactggcagc

SEQ ID NO: 3125813 - DNA, 15 bp, Homo sapiens
gggtgaaaggcaggg

SEQ ID NO: 3125814 - DNA, 19 bp, Homo sapiens
gggtgaaaggcagggccct

SEQ ID NO: 3125815 - DNA, 21 bp, Homo sapiens
gggtgaaggcctggctggaag

SEQ ID NO: 3125816 - DNA, 22 bp, Homo sapiens
gggtgaccgactaccccagtcc

SEQ ID NO: 3125817 - DNA, 12 bp, Homo sapiens
gggtgagagagg

SEQ ID NO: 3125818 - DNA, 15 bp, Homo sapiens
gggtgaggaccactc

SEQ ID NO: 3125819 - DNA, 17 bp, Homo sapiens
gggtgagggtcccatgt

SEQ ID NO: 3125820 - DNA, 14 bp, Homo sapiens
gggtgcacccactc

SEQ ID NO: 3125821 - DNA, 18 bp, Homo sapiens
gggtgcaggtgggcactg

SEQ ID NO: 3125822 - DNA, 23 bp, Homo sapiens
gggtgcaggtgggcactggagca

SEQ ID NO: 3125823 - DNA, 18 bp, Homo sapiens
gggtgcatcctcctcagc

SEQ ID NO: 3125824 - DNA, 20 bp, Homo sapiens
gggtgcatcctcctcagccc

SEQ ID NO: 3125825 - DNA, 21 bp, Homo sapiens
gggtgcatcctcctcagcccc

SEQ ID NO: 3125826 - DNA, 21 bp, Homo sapiens
gggtgcatttgagagaagcca

SEQ ID NO: 3125827 - DNA, 20 bp, Homo sapiens
gggtgcctcccacacttgct

SEQ ID NO: 3125828 - DNA, 23 bp, Homo sapiens
gggtgcctgctgcggcagacggg

SEQ ID NO: 3125829 - DNA, 12 bp, Homo sapiens
gggtgctcagaa

SEQ ID NO: 3125830 - DNA, 21 bp, Homo sapiens
gggtgctcagaataaggcagg

SEQ ID NO: 3125831 - DNA, 17 bp, Homo sapiens
gggtgctggcccccagg

SEQ ID NO: 3125832 - DNA, 19 bp, Homo sapiens
gggtgctggctgcccagac

SEQ ID NO: 3125833 - DNA, 20 bp, Homo sapiens
gggtgcttttatagaggcta

SEQ ID NO: 3125834 - DNA, 18 bp, Homo sapiens
gggtggaaatcctgccct

SEQ ID NO: 3125835 - DNA, 17 bp, Homo sapiens
gggtggaagggctgggt

SEQ ID NO: 3125836 - DNA, 21 bp, Homo sapiens
gggtggacaaactggagtctg

SEQ ID NO: 3125837 - DNA, 22 bp, Homo sapiens
gggtggaggaaggtgctgagct

SEQ ID NO: 3125838 - DNA, 16 bp, Homo sapiens
gggtggaggcttcctg

SEQ ID NO: 3125839 - DNA, 13 bp, Homo sapiens
gggtggatgcctg

SEQ ID NO: 3125840 - DNA, 12 bp, Homo sapiens
gggtggcaggca

SEQ ID NO: 3125841 - DNA, 23 bp, Homo sapiens
gggtggcaggcacacagcagccc

SEQ ID NO: 3125842 - DNA, 12 bp, Homo sapiens
gggtggcctcaa

SEQ ID NO: 3125843 - DNA, 13 bp, Homo sapiens
gggtgggacagcc

SEQ ID NO: 3125844 - DNA, 14 bp, Homo sapiens
gggtgggacagcct

SEQ ID NO: 3125845 - DNA, 16 bp, Homo sapiens
gggtgggacagcctct

SEQ ID NO: 3125846 - DNA, 14 bp, Homo sapiens
gggtgggcccagaa

SEQ ID NO: 3125847 - DNA, 13 bp, Homo sapiens
gggtgggcctggc

SEQ ID NO: 3125848 - DNA, 15 bp, Homo sapiens
gggtgggcctggcct

SEQ ID NO: 3125849 - DNA, 23 bp, Homo sapiens
gggtgggcctggcctgagctggg

SEQ ID NO: 3125850 - DNA, 17 bp, Homo sapiens
gggtggggtagggctga

SEQ ID NO: 3125851 - DNA, 16 bp, Homo sapiens
gggtgggtgagagaga

SEQ ID NO: 3125852 - DNA, 13 bp, Homo sapiens
gggtggtcctgac

SEQ ID NO: 3125853 - DNA, 16 bp, Homo sapiens
gggtggtgggtgctgg

SEQ ID NO: 3125854 - DNA, 19 bp, Homo sapiens
gggtgtaggggccacctcc

SEQ ID NO: 3125855 - DNA, 20 bp, Homo sapiens
gggtgtctttttttggtgat

SEQ ID NO: 3125856 - DNA, 21 bp, Homo sapiens
gggtgtgcaatgtctgagtga

SEQ ID NO: 3125857 - DNA, 13 bp, Homo sapiens
gggtgtgcccttg

SEQ ID NO: 3125858 - DNA, 12 bp, Homo sapiens
gggtgtggcagt

SEQ ID NO: 3125859 - DNA, 13 bp, Homo sapiens
gggtgtggcctca

SEQ ID NO: 3125860 - DNA, 22 bp, Homo sapiens
gggtgtgggtggaagggctggg

SEQ ID NO: 3125861 - DNA, 22 bp, Homo sapiens
gggtgtgtttggcttggccttg

SEQ ID NO: 3125862 - DNA, 17 bp, Homo sapiens
gggttaacttggtcaga

SEQ ID NO: 3125863 - DNA, 16 bp, Homo sapiens
gggttaagaagacttt

SEQ ID NO: 3125864 - DNA, 21 bp, Homo sapiens
gggttaatcatatttgaaaac

SEQ ID NO: 3125865 - DNA, 22 bp, Homo sapiens
gggttcaagcgattcttctgct

SEQ ID NO: 3125866 - DNA, 23 bp, Homo sapiens
gggttcaagcgattcttctgctt

SEQ ID NO: 3125867 - DNA, 19 bp, Homo sapiens
gggttcataggtcactggc

SEQ ID NO: 3125868 - DNA, 20 bp, Homo sapiens
gggttcataggtcactggct

SEQ ID NO: 3125869 - DNA, 22 bp, Homo sapiens
gggttcataggtcactggctct

SEQ ID NO: 3125870 - DNA, 15 bp, Homo sapiens
gggttcatctgtcca

SEQ ID NO: 3125871 - DNA, 17 bp, Homo sapiens
gggttcattattggaat

SEQ ID NO: 3125872 - DNA, 21 bp, Homo sapiens
gggttccctttccttccatcc

SEQ ID NO: 3125873 - DNA, 23 bp, Homo sapiens
ggcctggcgggatgggccaccgc

SEQ ID NO: 3125874 - DNA, 14 bp, Homo sapiens
ggcctggctggtgg

SEQ ID NO: 3125875 - DNA, 17 bp, Homo sapiens
ggcctggcttgctccag

SEQ ID NO: 3125876 - DNA, 23 bp, Homo sapiens
ggcctgggagggttcccctggcc

SEQ ID NO: 3125877 - DNA, 12 bp, Homo sapiens
ggcctgggcctg

SEQ ID NO: 3125878 - DNA, 15 bp, Homo sapiens
ggcctggggaggccc

SEQ ID NO: 3125879 - DNA, 21 bp, Homo sapiens
ggcctggggccggtagaggct

SEQ ID NO: 3125880 - DNA, 14 bp, Homo sapiens
ggcctggggcctga

SEQ ID NO: 3125881 - DNA, 16 bp, Homo sapiens
ggcctggggcctgaga

SEQ ID NO: 3125882 - DNA, 20 bp, Homo sapiens
ggcctgggggcagtgactgg

SEQ ID NO: 3125883 - DNA, 20 bp, Homo sapiens
ggcctggggtgcatcctcct

SEQ ID NO: 3125884 - DNA, 21 bp, Homo sapiens
ggcctgggtgctggctgccca

SEQ ID NO: 3125885 - DNA, 15 bp, Homo sapiens
ggcctgtaatcagct

SEQ ID NO: 3125886 - DNA, 22 bp, Homo sapiens
ggcctgtaatcagctctcctgg

SEQ ID NO: 3125887 - DNA, 17 bp, Homo sapiens
ggcctgtctcatcccca

SEQ ID NO: 3125888 - DNA, 19 bp, Homo sapiens
ggcctgtgcagcagcccag

SEQ ID NO: 3125889 - DNA, 18 bp, Homo sapiens
ggcctgtggaatgagtgt

SEQ ID NO: 3125890 - DNA, 19 bp, Homo sapiens
ggcctgtggaatgagtgtg

SEQ ID NO: 3125891 - DNA, 18 bp, Homo sapiens
ggcctgtggcctgtgtcc

SEQ ID NO: 3125892 - DNA, 22 bp, Homo sapiens
ggcctgtgtccagcagctgcgg

SEQ ID NO: 3125893 - DNA, 15 bp, Homo sapiens
ggcctgttgctatag

SEQ ID NO: 3125894 - DNA, 15 bp, Homo sapiens
ggccttaaagaggga

SEQ ID NO: 3125895 - DNA, 16 bp, Homo sapiens
ggccttaaagagggac

SEQ ID NO: 3125896 - DNA, 16 bp, Homo sapiens
ggccttagtgggccag

SEQ ID NO: 3125897 - DNA, 13 bp, Homo sapiens
ggccttcctgccc

SEQ ID NO: 3125898 - DNA, 18 bp, Homo sapiens
ggccttcggcctccatcc

SEQ ID NO: 3125899 - DNA, 15 bp, Homo sapiens
ggccttctctgaagg

SEQ ID NO: 3125900 - DNA, 17 bp, Homo sapiens
ggccttctgctgcccag

SEQ ID NO: 3125901 - DNA, 19 bp, Homo sapiens
ggccttctgctgcccaggc

SEQ ID NO: 3125902 - DNA, 21 bp, Homo sapiens
ggccttctgctgcccaggcca

SEQ ID NO: 3125903 - DNA, 15 bp, Homo sapiens
ggccttgctgctgct

SEQ ID NO: 3125904 - DNA, 22 bp, Homo sapiens
ggccttggatcgctaagctggc

SEQ ID NO: 3125905 - DNA, 23 bp, Homo sapiens
ggcctttgagcccacaaagcctt

SEQ ID NO: 3125906 - DNA, 12 bp, Homo sapiens
ggccttttggat

SEQ ID NO: 3125907 - DNA, 15 bp, Homo sapiens
ggcctttttcattta

SEQ ID NO: 3125908 - DNA, 13 bp, Homo sapiens
ggcgaatctcaaa

SEQ ID NO: 3125909 - DNA, 17 bp, Homo sapiens
ggcgaatctcaaaatta

SEQ ID NO: 3125910 - DNA, 20 bp, Homo sapiens
ggcgacagagcgagactccg

SEQ ID NO: 3125911 - DNA, 23 bp, Homo sapiens
ggcgacagagcgagagtctgtct

SEQ ID NO: 3125912 - DNA, 18 bp, Homo sapiens
ggcgagagaggagccaga

SEQ ID NO: 3125913 - DNA, 23 bp, Homo sapiens
ggcgagttcctcgctctgggatg

SEQ ID NO: 3125914 - DNA, 18 bp, Homo sapiens
ggcgatccacctgtctca

SEQ ID NO: 3125915 - DNA, 14 bp, Homo sapiens
ggcgcagccaaggc

SEQ ID NO: 3125916 - DNA, 12 bp, Homo sapiens
ggcgcaggccca

SEQ ID NO: 3125917 - DNA, 14 bp, Homo sapiens
ggcgcaggcccagt

SEQ ID NO: 3125918 - DNA, 16 bp, Homo sapiens
ggcgcaggcccagtga

SEQ ID NO: 3125919 - DNA, 17 bp, Homo sapiens
ggcgcaggcccagtgac

SEQ ID NO: 3125920 - DNA, 22 bp, Homo sapiens
ggctctagatcataaggcttca

SEQ ID NO: 3125921 - DNA, 22 bp, Homo sapiens
ggctctagggttgctggagcct

SEQ ID NO: 3125922 - DNA, 14 bp, Homo sapiens
ggctctcagctcag

SEQ ID NO: 3125923 - DNA, 18 bp, Homo sapiens
ggctctccaaaggggctg

SEQ ID NO: 3125924 - DNA, 21 bp, Homo sapiens
ggctctccaaaggggctgctg

SEQ ID NO: 3125925 - DNA, 17 bp, Homo sapiens
ggctctccaagtgccag

SEQ ID NO: 3125926 - DNA, 13 bp, Homo sapiens
ggctctctccagg

SEQ ID NO: 3125927 - DNA, 17 bp, Homo sapiens
ggctctgaaataaaatg

SEQ ID NO: 3125928 - DNA, 22 bp, Homo sapiens
ggctctgagagtctagattctc

SEQ ID NO: 3125929 - DNA, 15 bp, Homo sapiens
ggctctgagcgcctc

SEQ ID NO: 3125930 - DNA, 20 bp, Homo sapiens
ggctctgaggtgcctgtccc

SEQ ID NO: 3125931 - DNA, 20 bp, Homo sapiens
ggctctgcacagacaagcag

SEQ ID NO: 3125932 - DNA, 16 bp, Homo sapiens
ggctctgcacccctct

SEQ ID NO: 3125933 - DNA, 17 bp, Homo sapiens
ggctctgcactaagaga

SEQ ID NO: 3125934 - DNA, 13 bp, Homo sapiens
ggctctgccagtg

SEQ ID NO: 3125935 - DNA, 20 bp, Homo sapiens
ggctctgccccagctctggc

SEQ ID NO: 3125936 - DNA, 16 bp, Homo sapiens
ggctctggactctaaa

SEQ ID NO: 3125937 - DNA, 16 bp, Homo sapiens
ggctctggagacagcc

SEQ ID NO: 3125938 - DNA, 19 bp, Homo sapiens
ggctctggagacagcccca

SEQ ID NO: 3125939 - DNA, 21 bp, Homo sapiens
ggctctggagacagccccaga

SEQ ID NO: 3125940 - DNA, 15 bp, Homo sapiens
ggctctggagagaaa

SEQ ID NO: 3125941 - DNA, 15 bp, Homo sapiens
ggctctgggaatggg

SEQ ID NO: 3125942 - DNA, 23 bp, Homo sapiens
ggctctgggatagctgacccagc

SEQ ID NO: 3125943 - DNA, 17 bp, Homo sapiens
ggctctgggctcagggc

SEQ ID NO: 3125944 - DNA, 15 bp, Homo sapiens
ggctctgtgcaggga

SEQ ID NO: 3125945 - DNA, 20 bp, Homo sapiens
ggctcttagcagcttccaga

SEQ ID NO: 3125946 - DNA, 19 bp, Homo sapiens
ggctcttatgtgtgccttt

SEQ ID NO: 3125947 - DNA, 16 bp, Homo sapiens
ggctcttatttctgaa

SEQ ID NO: 3125948 - DNA, 21 bp, Homo sapiens
ggctcttatttctgaattcaa

SEQ ID NO: 3125949 - DNA, 17 bp, Homo sapiens
ggctcttcctggacctg

SEQ ID NO: 3125950 - DNA, 20 bp, Homo sapiens
ggctcttgatacccccctct

SEQ ID NO: 3125951 - DNA, 16 bp, Homo sapiens
ggctctttccttgctc

SEQ ID NO: 3125952 - DNA, 13 bp, Homo sapiens
ggctgaaagacag

SEQ ID NO: 3125953 - DNA, 20 bp, Homo sapiens
ggctgaaagaggccaatgcc

SEQ ID NO: 3125954 - DNA, 17 bp, Homo sapiens
ggctgaaattctcctgg

SEQ ID NO: 3125955 - DNA, 19 bp, Homo sapiens
ggctgaaattctcctggag

SEQ ID NO: 3125956 - DNA, 17 bp, Homo sapiens
ggctgaaccctgtgctg

SEQ ID NO: 3125957 - DNA, 19 bp, Homo sapiens
ggctgaaccctgtgctggt

SEQ ID NO: 3125958 - DNA, 18 bp, Homo sapiens
ggctgaactttgtggtcg

SEQ ID NO: 3125959 - DNA, 16 bp, Homo sapiens
ggctgacacctaccat

SEQ ID NO: 3125960 - DNA, 22 bp, Homo sapiens
ggctgacacttcaaggtgacag

SEQ ID NO: 3125961 - DNA, 15 bp, Homo sapiens
ggctgacccagcatc

SEQ ID NO: 3125962 - DNA, 18 bp, Homo sapiens
ggctgacccagcatctcc

SEQ ID NO: 3125963 - DNA, 23 bp, Homo sapiens
ggctgacccagcatctcccagca

SEQ ID NO: 3125964 - DNA, 23 bp, Homo sapiens
ggctgacgtgtgagggaggacag

SEQ ID NO: 3125965 - DNA, 24 bp, Homo sapiens
ggctgactagaagggccagtcctg

SEQ ID NO: 3125966 - DNA, 15 bp, Homo sapiens
ggctgactggggctg

SEQ ID NO: 3125967 - DNA, 12 bp, Homo sapiens
ggctgagccctg

SEQ ID NO: 3125968 - DNA, 13 bp, Homo sapiens
ggctgagccctgg

SEQ ID NO: 3125969 - DNA, 16 bp, Homo sapiens
ggctgaggcaggagaa

SEQ ID NO: 3125970 - DNA, 23 bp, Homo sapiens
ggctgaggcaggagaatggtgtg

SEQ ID NO: 3125971 - DNA, 18 bp, Homo sapiens
ggctgaggttcctctgcc

SEQ ID NO: 3125972 - DNA, 20 bp, Homo sapiens
ggctgaggttcctctgcctg

SEQ ID NO: 3125973 - DNA, 23 bp, Homo sapiens
ggctgaggttcctctgcctgccc

SEQ ID NO: 3125974 - DNA, 18 bp, Homo sapiens
ggctgatggaggaaaaag

SEQ ID NO: 3125975 - DNA, 22 bp, Homo sapiens
ggctgatgtcaatttctgtgtt

SEQ ID NO: 3125976 - DNA, 16 bp, Homo sapiens
ggctgatttatttcta

SEQ ID NO: 3125977 - DNA, 18 bp, Homo sapiens
ggctgcaaagggtatcag

SEQ ID NO: 3125978 - DNA, 19 bp, Homo sapiens
ggctgcacagaagggctct

SEQ ID NO: 3125979 - DNA, 13 bp, Homo sapiens
ggctgcactgcag

SEQ ID NO: 3125980 - DNA, 18 bp, Homo sapiens
ggctgcagaggccagagg

SEQ ID NO: 3125981 - DNA, 21 bp, Homo sapiens
ggctgcagcatgttgctgagg

SEQ ID NO: 3125982 - DNA, 23 bp, Homo sapiens
ggctgcaggtgggactttgttgt

SEQ ID NO: 3125983 - DNA, 17 bp, Homo sapiens
ggctgccaaggccagag

SEQ ID NO: 3125984 - DNA, 13 bp, Homo sapiens
ggctgccaccaag

SEQ ID NO: 3125985 - DNA, 23 bp, Homo sapiens
ggctgccaggcgttggtgccact

SEQ ID NO: 3125986 - DNA, 22 bp, Homo sapiens
ggctgcccagccccgctcaggc

SEQ ID NO: 3125987 - DNA, 12 bp, Homo sapiens
ggctgcccagga

SEQ ID NO: 3125988 - DNA, 19 bp, Homo sapiens
ggctgcccccaacactcca

SEQ ID NO: 3125989 - DNA, 15 bp, Homo sapiens
ggctgcccctctcac

SEQ ID NO: 3125990 - DNA, 20 bp, Homo sapiens
ggctgcccctgcgtggcctg

SEQ ID NO: 3125991 - DNA, 23 bp, Homo sapiens
ggctgcccctgcgtggcctgagt

SEQ ID NO: 3125992 - DNA, 21 bp, Homo sapiens
ggctgccctgagaagctgctc

SEQ ID NO: 3125993 - DNA, 13 bp, Homo sapiens
ggctgccctgcca

SEQ ID NO: 3125994 - DNA, 12 bp, Homo sapiens
ggctgccctggc

SEQ ID NO: 3125995 - DNA, 12 bp, Homo sapiens
ggctgccctggt

SEQ ID NO: 3125996 - DNA, 13 bp, Homo sapiens
ggctgccctggtg

SEQ ID NO: 3125997 - DNA, 16 bp, Homo sapiens
ggctgccctggtgctg

SEQ ID NO: 3125998 - DNA, 19 bp, Homo sapiens
ggctgccctggtgctgcca

SEQ ID NO: 3125999 - DNA, 22 bp, Homo sapiens
ggctgccctggtgctgccacac

SEQ ID NO: 3126000 - DNA, 16 bp, Homo sapiens
ggctgccgtggggccg

SEQ ID NO: 3126001 - DNA, 11 bp, Homo sapiens
ggctgcctgcc

SEQ ID NO: 3126002 - DNA, 13 bp, Homo sapiens
ggctgcctgccgc

SEQ ID NO: 3126003 - DNA, 17 bp, Homo sapiens
ggctgcctgggctgttg

SEQ ID NO: 3126004 - DNA, 16 bp, Homo sapiens
ggctgccttctggcct

SEQ ID NO: 3126005 - DNA, 22 bp, Homo sapiens
ggctgcggaatgaaccacatct

SEQ ID NO: 3126006 - DNA, 17 bp, Homo sapiens
ggctgcgggaggccctg

SEQ ID NO: 3126007 - DNA, 18 bp, Homo sapiens
ggctttgggaaagcccag

SEQ ID NO: 3126008 - DNA, 19 bp, Homo sapiens
ggctttgggaaagcccaga

SEQ ID NO: 3126009 - DNA, 14 bp, Homo sapiens
ggcttttcactgct

SEQ ID NO: 3126010 - DNA, 17 bp, Homo sapiens
ggcttttcactgctggc

SEQ ID NO: 3126011 - DNA, 15 bp, Homo sapiens
ggcttttctggggcc

SEQ ID NO: 3126012 - DNA, 23 bp, Homo sapiens
ggctttttcctctgagcccagct

SEQ ID NO: 3126013 - DNA, 16 bp, Homo sapiens
ggctttttttttctct

SEQ ID NO: 3126014 - DNA, 23 bp, Homo sapiens
gggaaaaaaaatctctcagagcc

SEQ ID NO: 3126015 - DNA, 21 bp, Homo sapiens
gggaaaaaagttttgatgaaa

SEQ ID NO: 3126016 - DNA, 22 bp, Homo sapiens
gggaaaactgccaatatagaaa

SEQ ID NO: 3126017 - DNA, 20 bp, Homo sapiens
gggaaaagggagaaaaagaa

SEQ ID NO: 3126018 - DNA, 15 bp, Homo sapiens
gggaaagccacctct

SEQ ID NO: 3126019 - DNA, 23 bp, Homo sapiens
gggaaaggaggcatgcctctgat

SEQ ID NO: 3126020 - DNA, 13 bp, Homo sapiens
gggaacagaccag

SEQ ID NO: 3126021 - DNA, 14 bp, Homo sapiens
gggaacatgccccc

SEQ ID NO: 3126022 - DNA, 15 bp, Homo sapiens
gggaacatgccccct

SEQ ID NO: 3126023 - DNA, 22 bp, Homo sapiens
gggaacatttctgtaaatacca

SEQ ID NO: 3126024 - DNA, 15 bp, Homo sapiens
gggaaccactcccac

SEQ ID NO: 3126025 - DNA, 21 bp, Homo sapiens
gggaaccactcccaccacagg

SEQ ID NO: 3126026 - DNA, 18 bp, Homo sapiens
gggaaccatgaagacagg

SEQ ID NO: 3126027 - DNA, 17 bp, Homo sapiens
gggaacccccttccccg

SEQ ID NO: 3126028 - DNA, 14 bp, Homo sapiens
gggaacctcccaga

SEQ ID NO: 3126029 - DNA, 16 bp, Homo sapiens
gggaacctcccagagg

SEQ ID NO: 3126030 - DNA, 17 bp, Homo sapiens
gggaacctcccagaggt

SEQ ID NO: 3126031 - DNA, 14 bp, Homo sapiens
gggaactccactct

SEQ ID NO: 3126032 - DNA, 15 bp, Homo sapiens
gggaactccactctc

SEQ ID NO: 3126033 - DNA, 15 bp, Homo sapiens
gggaactcctgccac

SEQ ID NO: 3126034 - DNA, 21 bp, Homo sapiens
gggaactctgacaagggctga

SEQ ID NO: 3126035 - DNA, 15 bp, Homo sapiens
gggaagaaggggcca

SEQ ID NO: 3126036 - DNA, 17 bp, Homo sapiens
gggaagacgcctgagct

SEQ ID NO: 3126037 - DNA, 20 bp, Homo sapiens
gggaagagaagagggcccag

SEQ ID NO: 3126038 - DNA, 18 bp, Homo sapiens
gggaagagacagcccagg

SEQ ID NO: 3126039 - DNA, 12 bp, Homo sapiens
gggaagagggca

SEQ ID NO: 3126040 - DNA, 18 bp, Homo sapiens
gggaagatgaggttctga

SEQ ID NO: 3126041 - DNA, 22 bp, Homo sapiens
gggaagcagaatagcaaggtgc

SEQ ID NO: 3126042 - DNA, 23 bp, Homo sapiens
gggaagcatgtgacacccacaat

SEQ ID NO: 3126043 - DNA, 21 bp, Homo sapiens
gggaagctgaggcgggagaat

SEQ ID NO: 3126044 - DNA, 22 bp, Homo sapiens
gggaagctgcagcttgggagag

SEQ ID NO: 3126045 - DNA, 15 bp, Homo sapiens
gggaagctggcctga

SEQ ID NO: 3126046 - DNA, 18 bp, Homo sapiens
gggaagctgtactcagag

SEQ ID NO: 3126047 - DNA, 12 bp, Homo sapiens
gggaaggaaaaa

SEQ ID NO: 3126048 - DNA, 14 bp, Homo sapiens
gggaaggacagaaa

SEQ ID NO: 3126049 - DNA, 14 bp, Homo sapiens
gggaaggacaggac

SEQ ID NO: 3126050 - DNA, 23 bp, Homo sapiens
gggaaggacaggaccctcaggaa

SEQ ID NO: 3126051 - DNA, 18 bp, Homo sapiens
gggaaggacttggcgcgc

SEQ ID NO: 3126052 - DNA, 21 bp, Homo sapiens
gggaaggagggtacagctggg

SEQ ID NO: 3126053 - DNA, 22 bp, Homo sapiens
gggaagggccagtctgggctgc

SEQ ID NO: 3126054 - DNA, 17 bp, Homo sapiens
gggaagggtcatagaaa

SEQ ID NO: 3126055 - DNA, 12 bp, Homo sapiens
gggaaggtcacc

SEQ ID NO: 3126056 - DNA, 20 bp, Homo sapiens
gggaaggtggggccctgccc

SEQ ID NO: 3126057 - DNA, 22 bp, Homo sapiens
gggaaggtggggccctgcccct

SEQ ID NO: 3126058 - DNA, 21 bp, Homo sapiens
gggaaggtggggtcctggagc

SEQ ID NO: 3126059 - DNA, 20 bp, Homo sapiens
gggaagtcgggcatggtggc

SEQ ID NO: 3126060 - DNA, 14 bp, Homo sapiens
gggaataaccttcc

SEQ ID NO: 3126061 - DNA, 19 bp, Homo sapiens
gggaatccccgaaggtgct

SEQ ID NO: 3126062 - DNA, 22 bp, Homo sapiens
gggaatccccgaaggtgctgga

SEQ ID NO: 3126063 - DNA, 14 bp, Homo sapiens
gggaatgagcccag

SEQ ID NO: 3126064 - DNA, 18 bp, Homo sapiens
gggaatgagcccagagaa

SEQ ID NO: 3126065 - DNA, 22 bp, Homo sapiens
gggaatgatagcccagaacaaa

SEQ ID NO: 3126066 - DNA, 12 bp, Homo sapiens
gggaatgggaga

SEQ ID NO: 3126067 - DNA, 15 bp, Homo sapiens
gggaatgttccctgc

SEQ ID NO: 3126068 - DNA, 12 bp, Homo sapiens
gggaatttcctc

SEQ ID NO: 3126069 - DNA, 13 bp, Homo sapiens
gggaatttcctct

SEQ ID NO: 3126070 - DNA, 13 bp, Homo sapiens
gggacaagggatt

SEQ ID NO: 3126071 - DNA, 19 bp, Homo sapiens
gggacaagggattctggga

SEQ ID NO: 3126072 - DNA, 18 bp, Homo sapiens
gggacacaaaactccgcc

SEQ ID NO: 3126073 - DNA, 23 bp, Homo sapiens
gggacacaaaactccgcccccag

SEQ ID NO: 3126074 - DNA, 11 bp, Homo sapiens
gggacagagaa

SEQ ID NO: 3126075 - DNA, 22 bp, Homo sapiens
gggacagcatgccccttggctg

SEQ ID NO: 3126076 - DNA, 12 bp, Homo sapiens
gggacagcctct

SEQ ID NO: 3126077 - DNA, 21 bp, Homo sapiens
gggacagcctcttcagcccct

SEQ ID NO: 3126078 - DNA, 15 bp, Homo sapiens
gggacagctccttct

SEQ ID NO: 3126079 - DNA, 21 bp, Homo sapiens
gggacattgttctttccggcc

SEQ ID NO: 3126080 - DNA, 12 bp, Homo sapiens
gggaccaaggca

SEQ ID NO: 3126081 - DNA, 17 bp, Homo sapiens
gggaccaaggcaaggca

SEQ ID NO: 3126082 - DNA, 23 bp, Homo sapiens
gggaccaaggcaaggcaggtgcc

SEQ ID NO: 3126083 - DNA, 17 bp, Homo sapiens
gggaccactgggtgaga

SEQ ID NO: 3126084 - DNA, 12 bp, Homo sapiens
gggaccagagcc

SEQ ID NO: 3126085 - DNA, 13 bp, Homo sapiens
gggaccagagcca

SEQ ID NO: 3126086 - DNA, 15 bp, Homo sapiens
gggaccagagccaga

SEQ ID NO: 3126087 - DNA, 22 bp, Homo sapiens
gggaccagagccagatgcagga

SEQ ID NO: 3126088 - DNA, 14 bp, Homo sapiens
gggacccacggagc

SEQ ID NO: 3126089 - DNA, 14 bp, Homo sapiens
gggacccagctact

SEQ ID NO: 3126090 - DNA, 12 bp, Homo sapiens
gggacccaggct

SEQ ID NO: 3126091 - DNA, 19 bp, Homo sapiens
gggacccaggctccgccct

SEQ ID NO: 3126092 - DNA, 20 bp, Homo sapiens
gggacccctgctcccagcct

SEQ ID NO: 3126093 - DNA, 22 bp, Homo sapiens
gggacccctgctcccagcctgc

SEQ ID NO: 3126094 - DNA, 23 bp, Homo sapiens
gggacccctgctcccagcctgct

SEQ ID NO: 3126095 - DNA, 19 bp, Homo sapiens
gggaccggtgctgcaggag

SEQ ID NO: 3126096 - DNA, 19 bp, Homo sapiens
gggacctgccaggcagggg

SEQ ID NO: 3126097 - DNA, 20 bp, Homo sapiens
gggacgacgctgactgccct

SEQ ID NO: 3126098 - DNA, 16 bp, Homo sapiens
gggacgtccctgccca

SEQ ID NO: 3126099 - DNA, 14 bp, Homo sapiens
gggacgtttctcat

SEQ ID NO: 3126100 - DNA, 18 bp, Homo sapiens
gggactaggacctgagcc

SEQ ID NO: 3126101 - DNA, 23 bp, Homo sapiens
gggactcaatgcactgacattgt

SEQ ID NO: 3126102 - DNA, 14 bp, Homo sapiens
gggactcctggtgc

SEQ ID NO: 3126103 - DNA, 16 bp, Homo sapiens
gggactgcctctgcca

SEQ ID NO: 3126104 - DNA, 17 bp, Homo sapiens
gggactgcctctgccac

SEQ ID NO: 3126105 - DNA, 17 bp, Homo sapiens
gggactgggagtcagag

SEQ ID NO: 3126106 - DNA, 13 bp, Homo sapiens
gggactgtacaca

SEQ ID NO: 3126107 - DNA, 20 bp, Homo sapiens
gggacttccttgctctccct

SEQ ID NO: 3126108 - DNA, 18 bp, Homo sapiens
gggacttggaagctccgc

SEQ ID NO: 3126109 - DNA, 16 bp, Homo sapiens
gggacttgggagctgg

SEQ ID NO: 3126110 - DNA, 11 bp, Homo sapiens
gggagaaaaga

SEQ ID NO: 3126111 - DNA, 18 bp, Homo sapiens
gggagaaaatccaggtca

SEQ ID NO: 3126112 - DNA, 16 bp, Homo sapiens
gggagaaatcatcctg

SEQ ID NO: 3126113 - DNA, 14 bp, Homo sapiens
gggagaacctcagg

SEQ ID NO: 3126114 - DNA, 22 bp, Homo sapiens
gggagaagaaaggtgagtttga

SEQ ID NO: 3126115 - DNA, 12 bp, Homo sapiens
gggagaagagaa

SEQ ID NO: 3126116 - DNA, 19 bp, Homo sapiens
gggagaaggaagggcagag

SEQ ID NO: 3126117 - DNA, 19 bp, Homo sapiens
gggagacactggcccctca

SEQ ID NO: 3126118 - DNA, 18 bp, Homo sapiens
gggagacaggagcctagc

SEQ ID NO: 3126119 - DNA, 22 bp, Homo sapiens
gggagagacctcatcaggatga

SEQ ID NO: 3126120 - DNA, 14 bp, Homo sapiens
gggagagcaggctg

SEQ ID NO: 3126121 - DNA, 14 bp, Homo sapiens
gggagagccagctc

SEQ ID NO: 3126122 - DNA, 14 bp, Homo sapiens
gggagagcccctgg

SEQ ID NO: 3126123 - DNA, 12 bp, Homo sapiens
gggagagcctgc

SEQ ID NO: 3126124 - DNA, 13 bp, Homo sapiens
gggagaggaactc

SEQ ID NO: 3126125 - DNA, 21 bp, Homo sapiens
gggagaggatttttttctgag

SEQ ID NO: 3126126 - DNA, 17 bp, Homo sapiens
gggagagggaggtcact

SEQ ID NO: 3126127 - DNA, 11 bp, Homo sapiens
gggagcactgg

SEQ ID NO: 3126128 - DNA, 11 bp, Homo sapiens
gggagcagaaa

SEQ ID NO: 3126129 - DNA, 19 bp, Homo sapiens
gggagcagaaacagccatt

SEQ ID NO: 3126130 - DNA, 21 bp, Homo sapiens
gggagcaggagattgagaagg

SEQ ID NO: 3126131 - DNA, 19 bp, Homo sapiens
gggagcagttttcccctgg

SEQ ID NO: 3126132 - DNA, 20 bp, Homo sapiens
gggagcatagcagaggggcc

SEQ ID NO: 3126133 - DNA, 13 bp, Homo sapiens
gggagccagctgc

SEQ ID NO: 3126134 - DNA, 20 bp, Homo sapiens
gggagccagctgctttttgt

SEQ ID NO: 3126135 - DNA, 19 bp, Homo sapiens
gggagccatgcgccccctc

SEQ ID NO: 3126136 - DNA, 15 bp, Homo sapiens
gggagccatttgaga

SEQ ID NO: 3126137 - DNA, 13 bp, Homo sapiens
gggagcctccccc

SEQ ID NO: 3126138 - DNA, 23 bp, Homo sapiens
gggagctccactctgcttctctg

SEQ ID NO: 3126139 - DNA, 12 bp, Homo sapiens
gggagctcctgg

SEQ ID NO: 3126140 - DNA, 15 bp, Homo sapiens
gggagctgagctgga

SEQ ID NO: 3126141 - DNA, 13 bp, Homo sapiens
gggagctgcctgt

SEQ ID NO: 3126142 - DNA, 21 bp, Homo sapiens
gggagctgcctgttcagctcc

SEQ ID NO: 3126143 - DNA, 14 bp, Homo sapiens
gggaggaaaaaaga

SEQ ID NO: 3126144 - DNA, 16 bp, Homo sapiens
gggaggaaaaaagaac

SEQ ID NO: 3126145 - DNA, 11 bp, Homo sapiens
gggaggaaggg

SEQ ID NO: 3126146 - DNA, 23 bp, Homo sapiens
gggaggacaaaacttcttgtcag

SEQ ID NO: 3126147 - DNA, 19 bp, Homo sapiens
gggaggacctgaccctact

SEQ ID NO: 3126148 - DNA, 17 bp, Homo sapiens
gggaggacgctctctgg

SEQ ID NO: 3126149 - DNA, 20 bp, Homo sapiens
gggaggacgctctctggcct

SEQ ID NO: 3126150 - DNA, 23 bp, Homo sapiens
gggaggagcctgtgcgtcccagc

SEQ ID NO: 3126151 - DNA, 12 bp, Homo sapiens
gggaggcaccag

SEQ ID NO: 3126152 - DNA, 11 bp, Homo sapiens
gggaggcagcc

SEQ ID NO: 3126153 - DNA, 14 bp, Homo sapiens
gggaggccccagct

SEQ ID NO: 3126154 - DNA, 17 bp, Homo sapiens
gggaggccccagctctg

SEQ ID NO: 3126155 - DNA, 15 bp, Homo sapiens
gggaggccctggccc

SEQ ID NO: 3126156 - DNA, 16 bp, Homo sapiens
gggaggccgggcggtc

SEQ ID NO: 3126157 - DNA, 17 bp, Homo sapiens
gggaggctgaggcagga

SEQ ID NO: 3126158 - DNA, 18 bp, Homo sapiens
gggagggaagtgtgagcg

SEQ ID NO: 3126159 - DNA, 15 bp, Homo sapiens
gggagggagcaagcc

SEQ ID NO: 3126160 - DNA, 17 bp, Homo sapiens
gggaggggaaaggctgc

SEQ ID NO: 3126161 - DNA, 12 bp, Homo sapiens
gggaggggcagg

SEQ ID NO: 3126162 - DNA, 16 bp, Homo sapiens
gggaggggcaggctga

SEQ ID NO: 3126163 - DNA, 10 bp, Homo sapiens
gggaggggcg

SEQ ID NO: 3126164 - DNA, 16 bp, Homo sapiens
gggaggggcgctggcc

SEQ ID NO: 3126165 - DNA, 18 bp, Homo sapiens
gggaggggcgctggccca

SEQ ID NO: 3126166 - DNA, 15 bp, Homo sapiens
gggagggggatccga

SEQ ID NO: 3126167 - DNA, 17 bp, Homo sapiens
gggaggggggcacatgc

SEQ ID NO: 3126168 - DNA, 16 bp, Homo sapiens
gggagggttcccctgg

SEQ ID NO: 3126169 - DNA, 17 bp, Homo sapiens
gggagggttggggaggg

SEQ ID NO: 3126170 - DNA, 19 bp, Homo sapiens
gctaggacgttggcctcag

SEQ ID NO: 3126171 - DNA, 17 bp, Homo sapiens
gctaggactgaggagtg

SEQ ID NO: 3126172 - DNA, 22 bp, Homo sapiens
gctaggccccagaggccctgga

SEQ ID NO: 3126173 - DNA, 16 bp, Homo sapiens
gctaggcctggccaga

SEQ ID NO: 3126174 - DNA, 23 bp, Homo sapiens
gctaggcctggccagatgcacca

SEQ ID NO: 3126175 - DNA, 18 bp, Homo sapiens
gctaggcgctggggagac

SEQ ID NO: 3126176 - DNA, 17 bp, Homo sapiens
gctaggggacatcagag

SEQ ID NO: 3126177 - DNA, 14 bp, Homo sapiens
gctagggtggccct

SEQ ID NO: 3126178 - DNA, 20 bp, Homo sapiens
gctagtaccctatagagagg

SEQ ID NO: 3126179 - DNA, 17 bp, Homo sapiens
gctagtgatgtttttat

SEQ ID NO: 3126180 - DNA, 19 bp, Homo sapiens
gctagtgggccctctctct

SEQ ID NO: 3126181 - DNA, 22 bp, Homo sapiens
gctagtgtacctcctctcagtg

SEQ ID NO: 3126182 - DNA, 17 bp, Homo sapiens
gctagtgtgagtggcag

SEQ ID NO: 3126183 - DNA, 19 bp, Homo sapiens
gctagtgtgagtggcagcc

SEQ ID NO: 3126184 - DNA, 23 bp, Homo sapiens
gctagtgtgagtggcagccatgc

SEQ ID NO: 3126185 - DNA, 12 bp, Homo sapiens
gggcctggcctg

SEQ ID NO: 3126186 - DNA, 14 bp, Homo sapiens
gggcctggcctgag

SEQ ID NO: 3126187 - DNA, 16 bp, Homo sapiens
gggcctggcctgagct

SEQ ID NO: 3126188 - DNA, 18 bp, Homo sapiens
gggcctggcctgagctgg

SEQ ID NO: 3126189 - DNA, 16 bp, Homo sapiens
gggcctggcttgctcc

SEQ ID NO: 3126190 - DNA, 21 bp, Homo sapiens
gggcctggcttgctccagggt

SEQ ID NO: 3126191 - DNA, 22 bp, Homo sapiens
gggcctgggatgctagccccag

SEQ ID NO: 3126192 - DNA, 15 bp, Homo sapiens
gggcctgggcctgct

SEQ ID NO: 3126193 - DNA, 16 bp, Homo sapiens
gggcctggtccctggg

SEQ ID NO: 3126194 - DNA, 19 bp, Homo sapiens
gggcctggtccctgggagg

SEQ ID NO: 3126195 - DNA, 14 bp, Homo sapiens
gggcctgtgcagca

SEQ ID NO: 3126196 - DNA, 16 bp, Homo sapiens
gggcctgtgcagcagc

SEQ ID NO: 3126197 - DNA, 20 bp, Homo sapiens
gggcctgtgcagcagcccag

SEQ ID NO: 3126198 - DNA, 21 bp, Homo sapiens
gggcctgtgcagcagcccagc

SEQ ID NO: 3126199 - DNA, 16 bp, Homo sapiens
gggcctgtggaatgag

SEQ ID NO: 3126200 - DNA, 14 bp, Homo sapiens
gggcctgttgccct

SEQ ID NO: 3126201 - DNA, 17 bp, Homo sapiens
gggccttaacatccctc

SEQ ID NO: 3126202 - DNA, 21 bp, Homo sapiens
gggccttagggcactgggctg

SEQ ID NO: 3126203 - DNA, 20 bp, Homo sapiens
gggccttagtgggccagggc

SEQ ID NO: 3126204 - DNA, 21 bp, Homo sapiens
gggccttgctgctgctgcacc

SEQ ID NO: 3126205 - DNA, 23 bp, Homo sapiens
gggccttggatcgctaagctggc

SEQ ID NO: 3126206 - DNA, 15 bp, Homo sapiens
gggcctttgcaagat

SEQ ID NO: 3126207 - DNA, 20 bp, Homo sapiens
gggccttttagaaacctcat

SEQ ID NO: 3126208 - DNA, 16 bp, Homo sapiens
gtgtcctgcccatgcc

SEQ ID NO: 3126209 - DNA, 16 bp, Homo sapiens
gtgtccttagaacatt

SEQ ID NO: 3126210 - DNA, 19 bp, Homo sapiens
gtgtcctttcccctctctg

SEQ ID NO: 3126211 - DNA, 17 bp, Homo sapiens
gtgtctaagattctaga

SEQ ID NO: 3126212 - DNA, 19 bp, Homo sapiens
gtgtctaagattctagatc

SEQ ID NO: 3126213 - DNA, 20 bp, Homo sapiens
gtgtctaagattctagatca

SEQ ID NO: 3126214 - DNA, 18 bp, Homo sapiens
gtgtctcttttctctttc

SEQ ID NO: 3126215 - DNA, 19 bp, Homo sapiens
gtgtctcttttctctttct

SEQ ID NO: 3126216 - DNA, 22 bp, Homo sapiens
gtgtctcttttctctttctcct

SEQ ID NO: 3126217 - DNA, 13 bp, Homo sapiens
gtgtctgcacagg

SEQ ID NO: 3126218 - DNA, 21 bp, Homo sapiens
gtgtctgctttaaagggcctg

SEQ ID NO: 3126219 - DNA, 17 bp, Homo sapiens
gtgtctggagcggctgc

SEQ ID NO: 3126220 - DNA, 12 bp, Homo sapiens
gtgtctggcttt

SEQ ID NO: 3126221 - DNA, 13 bp, Homo sapiens
gtgtctgtacacg

SEQ ID NO: 3126222 - DNA, 21 bp, Homo sapiens
gtgtctgtgccctccaaagag

SEQ ID NO: 3126223 - DNA, 14 bp, Homo sapiens
gtgtcttaattatt

SEQ ID NO: 3126224 - DNA, 19 bp, Homo sapiens
gtgtcttaattattatttg

SEQ ID NO: 3126225 - DNA, 13 bp, Homo sapiens
gtgtcttccataa

SEQ ID NO: 3126226 - DNA, 17 bp, Homo sapiens
gtgtcttcctagaattc

SEQ ID NO: 3126227 - DNA, 19 bp, Homo sapiens
gtgtcttgcaatggcagcc

SEQ ID NO: 3126228 - DNA, 17 bp, Homo sapiens
gtgtcttgggcagagct

SEQ ID NO: 3126229 - DNA, 16 bp, Homo sapiens
gtgtctttctaagaaa

SEQ ID NO: 3126230 - DNA, 14 bp, Homo sapiens
gtgtgaaaaaagaa

SEQ ID NO: 3126231 - DNA, 17 bp, Homo sapiens
gtgtgaaaaaagaaaat

SEQ ID NO: 3126232 - DNA, 22 bp, Homo sapiens
gtgtgaactcaccctgggagcc

SEQ ID NO: 3126233 - DNA, 18 bp, Homo sapiens
gtgtgaactgctttcaag

SEQ ID NO: 3126234 - DNA, 19 bp, Homo sapiens
gtgtgaatgtgggcactgg

SEQ ID NO: 3126235 - DNA, 23 bp, Homo sapiens
gtgtgaatgtgggcactggccca

SEQ ID NO: 3126236 - DNA, 17 bp, Homo sapiens
gtgtgaattctgcaact

SEQ ID NO: 3126237 - DNA, 14 bp, Homo sapiens
gtgtgacagggcca

SEQ ID NO: 3126238 - DNA, 18 bp, Homo sapiens
gtgtgacagggccagtgg

SEQ ID NO: 3126239 - DNA, 15 bp, Homo sapiens
gtgtgaccaactgtg

SEQ ID NO: 3126240 - DNA, 14 bp, Homo sapiens
gtgtgaccccactg

SEQ ID NO: 3126241 - DNA, 14 bp, Homo sapiens
gtgtgagcagtgga

SEQ ID NO: 3126242 - DNA, 13 bp, Homo sapiens
gtgtgagcgcctt

SEQ ID NO: 3126243 - DNA, 13 bp, Homo sapiens
gtgtgagtcacca

SEQ ID NO: 3126244 - DNA, 21 bp, Homo sapiens
gtgtgagtggcagccatgcct

SEQ ID NO: 3126245 - DNA, 22 bp, Homo sapiens
gtgtgatgaactttctcttcat

SEQ ID NO: 3126246 - DNA, 19 bp, Homo sapiens
gtgtgattgcacagaattt

SEQ ID NO: 3126247 - DNA, 14 bp, Homo sapiens
gtgtgatttcctaa

SEQ ID NO: 3126248 - DNA, 20 bp, Homo sapiens
gtgtgatttcctaaacataa

SEQ ID NO: 3126249 - DNA, 21 bp, Homo sapiens
gtgtgccatagagtttaacac

SEQ ID NO: 3126250 - DNA, 14 bp, Homo sapiens
gtgtgcccttgggg

SEQ ID NO: 3126251 - DNA, 22 bp, Homo sapiens
gtgtgcctcagtatatttaaac

SEQ ID NO: 3126252 - DNA, 15 bp, Homo sapiens
gtgtgctaaaaatga

SEQ ID NO: 3126253 - DNA, 16 bp, Homo sapiens
gtgtgctgaggtgtta

SEQ ID NO: 3126254 - DNA, 22 bp, Homo sapiens
gtgtggaaaaatagctctgtgt

SEQ ID NO: 3126255 - DNA, 15 bp, Homo sapiens
gtgtggactgtgatg

SEQ ID NO: 3126256 - DNA, 23 bp, Homo sapiens
gtgtggatgtaattagctctggg

SEQ ID NO: 3126257 - DNA, 14 bp, Homo sapiens
gtgtgggctgtgtc

SEQ ID NO: 3126258 - DNA, 18 bp, Homo sapiens
gttaatgtatataaaaat

SEQ ID NO: 3126259 - DNA, 23 bp, Homo sapiens
gttaatgttatatcatatgtata

SEQ ID NO: 3126260 - DNA, 18 bp, Homo sapiens
gttaattcagcactgatt

SEQ ID NO: 3126261 - DNA, 17 bp, Homo sapiens
gttaatttatctaaatt

SEQ ID NO: 3126262 - DNA, 21 bp, Homo sapiens
gttaatttatctaaattaaag

SEQ ID NO: 3126263 - DNA, 16 bp, Homo sapiens
gttaatttatttagtt

SEQ ID NO: 3126264 - DNA, 18 bp, Homo sapiens
gttaattttcctcatttt

SEQ ID NO: 3126265 - DNA, 23 bp, Homo sapiens
gttaattttcctcattttgaatt

SEQ ID NO: 3126266 - DNA, 14 bp, Homo sapiens
gttaatttttccta

SEQ ID NO: 3126267 - DNA, 9 bp, Homo sapiens
gttacaaac

SEQ ID NO: 3126268 - DNA, 14 bp, Homo sapiens
gttacaaactgcaa

SEQ ID NO: 3126269 - DNA, 20 bp, Homo sapiens
gttacaagattgtaagtaaa

SEQ ID NO: 3126270 - DNA, 14 bp, Homo sapiens
gttacactgttaga

SEQ ID NO: 3126271 - DNA, 20 bp, Homo sapiens
gttacactgttagaacacta

SEQ ID NO: 3126272 - DNA, 22 bp, Homo sapiens
gttacagagacctatgtaagaa

SEQ ID NO: 3126273 - DNA, 18 bp, Homo sapiens
gttacagcctgttagtaa

SEQ ID NO: 3126274 - DNA, 17 bp, Homo sapiens
gttacagtgcagacagg

SEQ ID NO: 3126275 - DNA, 13 bp, Homo sapiens
gttacagttctgt

SEQ ID NO: 3126276 - DNA, 18 bp, Homo sapiens
gttacattaaaataaacc

SEQ ID NO: 3126277 - DNA, 23 bp, Homo sapiens
gttacattaaaataaaccaaata

SEQ ID NO: 3126278 - DNA, 13 bp, Homo sapiens
gttacattaatgt

SEQ ID NO: 3126279 - DNA, 19 bp, Homo sapiens
gttaccaaatacacatttc

SEQ ID NO: 3126280 - DNA, 15 bp, Homo sapiens
gttaccatgtcactg

SEQ ID NO: 3126281 - DNA, 13 bp, Homo sapiens
gttaccattcaca

SEQ ID NO: 3126282 - DNA, 23 bp, Homo sapiens
gttaccattttaacgctgcctaa

SEQ ID NO: 3126283 - DNA, 23 bp, Homo sapiens
gttaccattttggggtacccact

SEQ ID NO: 3126284 - DNA, 13 bp, Homo sapiens
gttacccagagaa

SEQ ID NO: 3126285 - DNA, 23 bp, Homo sapiens
gttacctccaacagaactaaatg

SEQ ID NO: 3126286 - DNA, 23 bp, Homo sapiens
gttacgcacacgtacttaaatga

SEQ ID NO: 3126287 - DNA, 17 bp, Homo sapiens
gttactcagatataaga

SEQ ID NO: 3126288 - DNA, 14 bp, Homo sapiens
gttactcagggctc

SEQ ID NO: 3126289 - DNA, 20 bp, Homo sapiens
gttactcagggttcatctgt

SEQ ID NO: 3126290 - DNA, 19 bp, Homo sapiens
gttactccctacactgatg

SEQ ID NO: 3126291 - DNA, 21 bp, Homo sapiens
gttactctcttccacatgtta

SEQ ID NO: 3126292 - DNA, 14 bp, Homo sapiens
gttactctggttct

SEQ ID NO: 3126293 - DNA, 13 bp, Homo sapiens
gttactgtaattc

SEQ ID NO: 3126294 - DNA, 13 bp, Homo sapiens
gttactgtgtaat

SEQ ID NO: 3126295 - DNA, 12 bp, Homo sapiens
gttactgttctt

SEQ ID NO: 3126296 - DNA, 16 bp, Homo sapiens
gttactgttcttgctg

SEQ ID NO: 3126297 - DNA, 24 bp, Homo sapiens
gttactgttcttgctgctagaact

SEQ ID NO: 3126298 - DNA, 13 bp, Homo sapiens
gttacttcctact

SEQ ID NO: 3126299 - DNA, 14 bp, Homo sapiens
gttacttctgaggt

SEQ ID NO: 3126300 - DNA, 10 bp, Homo sapiens
gttactttgt

SEQ ID NO: 3126301 - DNA, 20 bp, Homo sapiens
gttactttgtaatttttggg

SEQ ID NO: 3126302 - DNA, 21 bp, Homo sapiens
gttagaaaatgacttatttct

SEQ ID NO: 3126303 - DNA, 22 bp, Homo sapiens
gttagaaaatgacttatttctg

SEQ ID NO: 3126304 - DNA, 13 bp, Homo sapiens
gttagaacactat

SEQ ID NO: 3126305 - DNA, 14 bp, Homo sapiens
gttagaacactatt

SEQ ID NO: 3126306 - DNA, 21 bp, Homo sapiens
gttagaacactattttcagaa

SEQ ID NO: 3126307 - DNA, 22 bp, Homo sapiens
gttagaacactattttcagaat

SEQ ID NO: 3126308 - DNA, 23 bp, Homo sapiens
gttagactgacttgtttgtcttc

SEQ ID NO: 3126309 - DNA, 20 bp, Homo sapiens
gttagagaactaaactagtt

SEQ ID NO: 3126310 - DNA, 15 bp, Homo sapiens
gttagagagaaagag

SEQ ID NO: 3126311 - DNA, 11 bp, Homo sapiens
gttagcaaaga

SEQ ID NO: 3126312 - DNA, 16 bp, Homo sapiens
gttagcactgttgatg

SEQ ID NO: 3126313 - DNA, 21 bp, Homo sapiens
gttagcactgttgatgtatct

SEQ ID NO: 3126314 - DNA, 22 bp, Homo sapiens
gttagccccagggatcactggc

SEQ ID NO: 3126315 - DNA, 12 bp, Homo sapiens
gttagctcctgt

SEQ ID NO: 3126316 - DNA, 14 bp, Homo sapiens
gttagctcctgtgg

SEQ ID NO: 3126317 - DNA, 15 bp, Homo sapiens
gttagctcctgtggc

SEQ ID NO: 3126318 - DNA, 19 bp, Homo sapiens
gttagctttttaaaacatt

SEQ ID NO: 3126319 - DNA, 16 bp, Homo sapiens
gttaggaaataaaacc

SEQ ID NO: 3126320 - DNA, 13 bp, Homo sapiens
gttaggaggtcct

SEQ ID NO: 3126321 - DNA, 15 bp, Homo sapiens
gttaggagttcgaga

SEQ ID NO: 3126322 - DNA, 23 bp, Homo sapiens
gttaggatttaacagtcatttaa

SEQ ID NO: 3126323 - DNA, 18 bp, Homo sapiens
gttaggtagagggagttg

SEQ ID NO: 3126324 - DNA, 23 bp, Homo sapiens
gttagtaacatgaggggacattt

SEQ ID NO: 3126325 - DNA, 16 bp, Homo sapiens
gttagtatctaacatg

SEQ ID NO: 3126326 - DNA, 17 bp, Homo sapiens
gttagtatctaacatgt

SEQ ID NO: 3126327 - DNA, 14 bp, Homo sapiens
gttagtattttaat

SEQ ID NO: 3126328 - DNA, 16 bp, Homo sapiens
gttataaaaaatggtt

SEQ ID NO: 3126329 - DNA, 17 bp, Homo sapiens
gttataaatcaatgtca

SEQ ID NO: 3126330 - DNA, 18 bp, Homo sapiens
gttataaatcaatgtcac

SEQ ID NO: 3126331 - DNA, 20 bp, Homo sapiens
gttatacaataacccagtta

SEQ ID NO: 3126332 - DNA, 22 bp, Homo sapiens
gttatacagttataaaattaaa

SEQ ID NO: 3126333 - DNA, 19 bp, Homo sapiens
gttatactgtcggtttttt

SEQ ID NO: 3126334 - DNA, 23 bp, Homo sapiens
gttatagaatacttttttctagt

SEQ ID NO: 3126335 - DNA, 19 bp, Homo sapiens
gttatagtatatctggaca

SEQ ID NO: 3126336 - DNA, 17 bp, Homo sapiens
gttatatattttttgta

SEQ ID NO: 3126337 - DNA, 14 bp, Homo sapiens
gttatattcacagt

SEQ ID NO: 3126338 - DNA, 14 bp, Homo sapiens
gttatatttttgtg

SEQ ID NO: 3126339 - DNA, 20 bp, Homo sapiens
gttatatttttgtgttttct

SEQ ID NO: 3126340 - DNA, 16 bp, Homo sapiens
gttatcaccttccaaa

SEQ ID NO: 3126341 - DNA, 15 bp, Homo sapiens
gttatcagttaacat

SEQ ID NO: 3126342 - DNA, 19 bp, Homo sapiens
gttatcatgaattttaaag

SEQ ID NO: 3126343 - DNA, 22 bp, Homo sapiens
gttatcatgaattttaaagtat

SEQ ID NO: 3126344 - DNA, 21 bp, Homo sapiens
gttatcccttccttttagcct

SEQ ID NO: 3126345 - DNA, 16 bp, Homo sapiens
gttatcctttgtgagc

SEQ ID NO: 3126346 - DNA, 14 bp, Homo sapiens
gttatcgaaataac

SEQ ID NO: 3126347 - DNA, 23 bp, Homo sapiens
gttatcgaaataacaatgttaag

SEQ ID NO: 3126348 - DNA, 16 bp, Homo sapiens
gttatctaaaagaaat

SEQ ID NO: 3126349 - DNA, 20 bp, Homo sapiens
gttatctgcctggcctggct

SEQ ID NO: 3126350 - DNA, 22 bp, Homo sapiens
gttatctttttaaaaactcttc

SEQ ID NO: 3126351 - DNA, 21 bp, Homo sapiens
gttatgatattgtttaaaatt

SEQ ID NO: 3126352 - DNA, 17 bp, Homo sapiens
gttatgtaaaactcgct

SEQ ID NO: 3126353 - DNA, 11 bp, Homo sapiens
gttatgtatga

SEQ ID NO: 3126354 - DNA, 19 bp, Homo sapiens
gttatgtgtatgtgccatt

SEQ ID NO: 3126355 - DNA, 21 bp, Homo sapiens
gttattaactttaatgttttt

SEQ ID NO: 3126356 - DNA, 13 bp, Homo sapiens
gttattatgggat

SEQ ID NO: 3126357 - DNA, 13 bp, Homo sapiens
gttattcaaattt

SEQ ID NO: 3126358 - DNA, 14 bp, Homo sapiens
gttattcataaaga

SEQ ID NO: 3126359 - DNA, 18 bp, Homo sapiens
gttattcataaagagaaa

SEQ ID NO: 3126360 - DNA, 23 bp, Homo sapiens
gttattcattctgtgatcattta

SEQ ID NO: 3126361 - DNA, 18 bp, Homo sapiens
gttattccttgatcattt

SEQ ID NO: 3126362 - DNA, 18 bp, Homo sapiens
gttattgcaataaagtat

SEQ ID NO: 3126363 - DNA, 12 bp, Homo sapiens
gttattgtgaat

SEQ ID NO: 3126364 - DNA, 14 bp, Homo sapiens
gttattgtgaatga

SEQ ID NO: 3126365 - DNA, 15 bp, Homo sapiens
gttattgtgaatgat

SEQ ID NO: 3126366 - DNA, 13 bp, Homo sapiens
gttatttaaagaa

SEQ ID NO: 3126367 - DNA, 23 bp, Homo sapiens
gttatttaacagctgaattatct

SEQ ID NO: 3126368 - DNA, 23 bp, Homo sapiens
gttatttaatcacagtcatcttt

SEQ ID NO: 3126369 - DNA, 19 bp, Homo sapiens
gttatttatgctataaatt

SEQ ID NO: 3126370 - DNA, 12 bp, Homo sapiens
gttattttcagt

SEQ ID NO: 3126371 - DNA, 21 bp, Homo sapiens
gttattttgcatatatgttct

SEQ ID NO: 3126372 - DNA, 13 bp, Homo sapiens
gttattttgcttt

SEQ ID NO: 3126373 - DNA, 16 bp, Homo sapiens
gttattttgctttggt

SEQ ID NO: 3126374 - DNA, 13 bp, Homo sapiens
gttattttggata

SEQ ID NO: 3126375 - DNA, 14 bp, Homo sapiens
gttattttggatat

SEQ ID NO: 3126376 - DNA, 21 bp, Homo sapiens
gttattttggatatattattg

SEQ ID NO: 3126377 - DNA, 23 bp, Homo sapiens
gttatttttatttatttaaattt

SEQ ID NO: 3126378 - DNA, 14 bp, Homo sapiens
gttcaaaatgtctg

SEQ ID NO: 3126379 - DNA, 16 bp, Homo sapiens
gttcaaacaatatcat

SEQ ID NO: 3126380 - DNA, 14 bp, Homo sapiens
gttcaaactgcagc

SEQ ID NO: 3126381 - DNA, 20 bp, Homo sapiens
gttcaaattctcttcttttt

SEQ ID NO: 3126382 - DNA, 15 bp, Homo sapiens
gttcaacccacagct

SEQ ID NO: 3126383 - DNA, 20 bp, Homo sapiens
gttcaacctggtggcaccag

SEQ ID NO: 3126384 - DNA, 13 bp, Homo sapiens
gtatatattttgt

SEQ ID NO: 3126385 - DNA, 16 bp, Homo sapiens
gtatatcattctacag

SEQ ID NO: 3126386 - DNA, 16 bp, Homo sapiens
gtatatctcttggaaa

SEQ ID NO: 3126387 - DNA, 18 bp, Homo sapiens
gtatatctcttggaaaat

SEQ ID NO: 3126388 - DNA, 15 bp, Homo sapiens
gtatatgacatttaa

SEQ ID NO: 3126389 - DNA, 16 bp, Homo sapiens
gtatatggtatttatt

SEQ ID NO: 3126390 - DNA, 12 bp, Homo sapiens
gtatatgtattc

SEQ ID NO: 3126391 - DNA, 21 bp, Homo sapiens
gtatatgtctcaggtccctgc

SEQ ID NO: 3126392 - DNA, 15 bp, Homo sapiens
gtatatgtgaaaaaa

SEQ ID NO: 3126393 - DNA, 15 bp, Homo sapiens
gtatatgttgtaata

SEQ ID NO: 3126394 - DNA, 18 bp, Homo sapiens
gtatatgttgtaataaaa

SEQ ID NO: 3126395 - DNA, 16 bp, Homo sapiens
gtatatgtttatatac

SEQ ID NO: 3126396 - DNA, 15 bp, Homo sapiens
gtatattacctcaaa

SEQ ID NO: 3126397 - DNA, 14 bp, Homo sapiens
gtatattatttggc

SEQ ID NO: 3126398 - DNA, 20 bp, Homo sapiens
gtatattgtgtttgtgtatt

SEQ ID NO: 3126399 - DNA, 22 bp, Homo sapiens
gtatatttaaactcaagacaat

SEQ ID NO: 3126400 - DNA, 14 bp, Homo sapiens
gtatatttattcat

SEQ ID NO: 3126401 - DNA, 18 bp, Homo sapiens
gtatatttattcataatg

SEQ ID NO: 3126402 - DNA, 16 bp, Homo sapiens
gtatatttccgcactt

SEQ ID NO: 3126403 - DNA, 19 bp, Homo sapiens
gtatatttctcataatgtg

SEQ ID NO: 3126404 - DNA, 12 bp, Homo sapiens
gtatatttgaaa

SEQ ID NO: 3126405 - DNA, 11 bp, Homo sapiens
gtatatttggt

SEQ ID NO: 3126406 - DNA, 20 bp, Homo sapiens
gtatatttgtgatagcactt

SEQ ID NO: 3126407 - DNA, 13 bp, Homo sapiens
gtgctgcaggagt

SEQ ID NO: 3126408 - DNA, 18 bp, Homo sapiens
gtgctgcaggtggcagag

SEQ ID NO: 3126409 - DNA, 19 bp, Homo sapiens
gtgctgccatccaggttca

SEQ ID NO: 3126410 - DNA, 14 bp, Homo sapiens
gtgctgccatgcca

SEQ ID NO: 3126411 - DNA, 21 bp, Homo sapiens
gtgctgccatgccactgccag

SEQ ID NO: 3126412 - DNA, 22 bp, Homo sapiens
gtgctgccatgccactgccagg

SEQ ID NO: 3126413 - DNA, 12 bp, Homo sapiens
gtgctgccctgt

SEQ ID NO: 3126414 - DNA, 13 bp, Homo sapiens
gtgctgccctgtg

SEQ ID NO: 3126415 - DNA, 14 bp, Homo sapiens
gtgctgctgctgct

SEQ ID NO: 3126416 - DNA, 14 bp, Homo sapiens
gtgctgctgtaaat

SEQ ID NO: 3126417 - DNA, 19 bp, Homo sapiens
gtgctgcttttgagcctca

SEQ ID NO: 3126418 - DNA, 20 bp, Homo sapiens
gtgctgcttttgagcctcag

SEQ ID NO: 3126419 - DNA, 11 bp, Homo sapiens
gtgctggactg

SEQ ID NO: 3126420 - DNA, 19 bp, Homo sapiens
gtgctggaggtgggagcag

SEQ ID NO: 3126421 - DNA, 21 bp, Homo sapiens
gtgctggaggtgggagcagga

SEQ ID NO: 3126422 - DNA, 20 bp, Homo sapiens
gtgctggatggagcccaggc

SEQ ID NO: 3126423 - DNA, 22 bp, Homo sapiens
gtgctggctcacagtacagcat

SEQ ID NO: 3126424 - DNA, 18 bp, Homo sapiens
gtgctggctgcccagacc

SEQ ID NO: 3126425 - DNA, 12 bp, Homo sapiens
gtgctgggacca

SEQ ID NO: 3126426 - DNA, 14 bp, Homo sapiens
gtgctgggaccaga

SEQ ID NO: 3126427 - DNA, 16 bp, Homo sapiens
gtgctgggaccagagc

SEQ ID NO: 3126428 - DNA, 18 bp, Homo sapiens
gtgctgggaggagggaga

SEQ ID NO: 3126429 - DNA, 19 bp, Homo sapiens
gtgctgggaggagggagag

SEQ ID NO: 3126430 - DNA, 20 bp, Homo sapiens
gtgctggtcccggggccagc

SEQ ID NO: 3126431 - DNA, 14 bp, Homo sapiens
gtgctgtaaataag

SEQ ID NO: 3126432 - DNA, 21 bp, Homo sapiens
gtgctgtacccttccacctcc

SEQ ID NO: 3126433 - DNA, 15 bp, Homo sapiens
gtgctgtgaccattt

SEQ ID NO: 3126434 - DNA, 12 bp, Homo sapiens
gtgctgtgcctg

SEQ ID NO: 3126435 - DNA, 13 bp, Homo sapiens
gtgctgtgcctgc

SEQ ID NO: 3126436 - DNA, 15 bp, Homo sapiens
gtgctgtgcctgcta

SEQ ID NO: 3126437 - DNA, 16 bp, Homo sapiens
gtgctgtggcctgggc

SEQ ID NO: 3126438 - DNA, 17 bp, Homo sapiens
gtgctgtggcctgggca

SEQ ID NO: 3126439 - DNA, 15 bp, Homo sapiens
gtgctgtgggcagca

SEQ ID NO: 3126440 - DNA, 19 bp, Homo sapiens
gtgctgtgggcagcaccct

SEQ ID NO: 3126441 - DNA, 20 bp, Homo sapiens
gtgctgtgggcagcaccctc

SEQ ID NO: 3126442 - DNA, 14 bp, Homo sapiens
gtgctgtggggctg

SEQ ID NO: 3126443 - DNA, 19 bp, Homo sapiens
gtgctgtggggctggtagc

SEQ ID NO: 3126444 - DNA, 17 bp, Homo sapiens
gtgctgttggtggcagt

SEQ ID NO: 3126445 - DNA, 22 bp, Homo sapiens
gtgcttcacagtagagccagct

SEQ ID NO: 3126446 - DNA, 18 bp, Homo sapiens
gtgcttcagagtttgtgt

SEQ ID NO: 3126447 - DNA, 13 bp, Homo sapiens
gtgcttcagcctg

SEQ ID NO: 3126448 - DNA, 15 bp, Homo sapiens
gtgcttcagcctgag

SEQ ID NO: 3126449 - DNA, 18 bp, Homo sapiens
gtgcttcagcctgaggct

SEQ ID NO: 3126450 - DNA, 17 bp, Homo sapiens
gtgcttctccccagaat

SEQ ID NO: 3126451 - DNA, 12 bp, Homo sapiens
gtgcttgggctc

SEQ ID NO: 3126452 - DNA, 17 bp, Homo sapiens
gtgcttgggctccacgg

SEQ ID NO: 3126453 - DNA, 19 bp, Homo sapiens
gtgcttggggctatttgtg

SEQ ID NO: 3126454 - DNA, 13 bp, Homo sapiens
gtgcttgtgtcac

SEQ ID NO: 3126455 - DNA, 18 bp, Homo sapiens
gtgcttgttagagagaaa

SEQ ID NO: 3126456 - DNA, 20 bp, Homo sapiens
gtgcttgttagagagaaaga

SEQ ID NO: 3126457 - DNA, 22 bp, Homo sapiens
gtgcttgttagagagaaagaga

SEQ ID NO: 3126458 - DNA, 19 bp, Homo sapiens
gtgcttgtttacagcacta

SEQ ID NO: 3126459 - DNA, 15 bp, Homo sapiens
gtgctttgtaatatt

SEQ ID NO: 3126460 - DNA, 19 bp, Homo sapiens
gtgcttttatagaggctag

SEQ ID NO: 3126461 - DNA, 14 bp, Homo sapiens
gtggaaaaaagaga

SEQ ID NO: 3126462 - DNA, 19 bp, Homo sapiens
gtggaaaaaagagaaaaac

SEQ ID NO: 3126463 - DNA, 15 bp, Homo sapiens
gtggaaaaccaggaa

SEQ ID NO: 3126464 - DNA, 14 bp, Homo sapiens
gtggaaagcacttt

SEQ ID NO: 3126465 - DNA, 20 bp, Homo sapiens
gtggaaatcaaccctctcct

SEQ ID NO: 3126466 - DNA, 24 bp, Homo sapiens
gtggaaatcgcttatatgtccttg

SEQ ID NO: 3126467 - DNA, 21 bp, Homo sapiens
gtggaaccactgactactggc

SEQ ID NO: 3126468 - DNA, 20 bp, Homo sapiens
gttttcttgtaaatgtttct

SEQ ID NO: 3126469 - DNA, 17 bp, Homo sapiens
gttttctttctttaaat

SEQ ID NO: 3126470 - DNA, 14 bp, Homo sapiens
gttttctttgaatg

SEQ ID NO: 3126471 - DNA, 13 bp, Homo sapiens
gttttgaaaagct

SEQ ID NO: 3126472 - DNA, 14 bp, Homo sapiens
gttttgaaagaaaa

SEQ ID NO: 3126473 - DNA, 21 bp, Homo sapiens
gttttgaaggcaaaattgcaa

SEQ ID NO: 3126474 - DNA, 18 bp, Homo sapiens
gttttgaatattactcct

SEQ ID NO: 3126475 - DNA, 16 bp, Homo sapiens
gttttgacggatgatt

SEQ ID NO: 3126476 - DNA, 16 bp, Homo sapiens
gttttgagagtaatgc

SEQ ID NO: 3126477 - DNA, 22 bp, Homo sapiens
gttttgagtagatattacttta

SEQ ID NO: 3126478 - DNA, 14 bp, Homo sapiens
gttttgatatgagt

SEQ ID NO: 3126479 - DNA, 15 bp, Homo sapiens
gttttgatatgagta

SEQ ID NO: 3126480 - DNA, 22 bp, Homo sapiens
gttttgatgtttgtggcctcag

SEQ ID NO: 3126481 - DNA, 23 bp, Homo sapiens
gttttgatgtttgtggcctcaga

SEQ ID NO: 3126482 - DNA, 21 bp, Homo sapiens
gttttgattttggaaagatgt

SEQ ID NO: 3126483 - DNA, 13 bp, Homo sapiens
gttttgcaataac

SEQ ID NO: 3126484 - DNA, 15 bp, Homo sapiens
gttttgcacagccaa

SEQ ID NO: 3126485 - DNA, 16 bp, Homo sapiens
gttttgccatgttggc

SEQ ID NO: 3126486 - DNA, 21 bp, Homo sapiens
gttttgccatgttggccaggc

SEQ ID NO: 3126487 - DNA, 22 bp, Homo sapiens
gttttgcctgtgactgtaaaga

SEQ ID NO: 3126488 - DNA, 18 bp, Homo sapiens
taaaacatatttcatttt

SEQ ID NO: 3126489 - DNA, 13 bp, Homo sapiens
taaaacatgcacg

SEQ ID NO: 3126490 - DNA, 12 bp, Homo sapiens
taaaacattatg

SEQ ID NO: 3126491 - DNA, 14 bp, Homo sapiens
taaaacattcccct

SEQ ID NO: 3126492 - DNA, 19 bp, Homo sapiens
taaaaccccatctctacta

SEQ ID NO: 3126493 - DNA, 16 bp, Homo sapiens
taaaaccttgttctat

SEQ ID NO: 3126494 - DNA, 11 bp, Homo sapiens
taaaacctttc

SEQ ID NO: 3126495 - DNA, 14 bp, Homo sapiens
taaaactaagcaca

SEQ ID NO: 3126496 - DNA, 22 bp, Homo sapiens
taaaactaggtaatgttttgta

SEQ ID NO: 3126497 - DNA, 22 bp, Homo sapiens
taaaactcaacattactgttaa

SEQ ID NO: 3126498 - DNA, 16 bp, Homo sapiens
taaaactcactgtgat

SEQ ID NO: 3126499 - DNA, 17 bp, Homo sapiens
taaaactcactgtgatc

SEQ ID NO: 3126500 - DNA, 19 bp, Homo sapiens
taaaactcagaatataaca

SEQ ID NO: 3126501 - DNA, 22 bp, Homo sapiens
taaaactcagaatataacatgt

SEQ ID NO: 3126502 - DNA, 20 bp, Homo sapiens
taaaacttctcaagatactg

SEQ ID NO: 3126503 - DNA, 20 bp, Homo sapiens
taaaacttgatgtgttatct

SEQ ID NO: 3126504 - DNA, 17 bp, Homo sapiens
taaaactttatgtactg

SEQ ID NO: 3126505 - DNA, 15 bp, Homo sapiens
taaaactttcctcgc

SEQ ID NO: 3126506 - DNA, 17 bp, Homo sapiens
taaaactttcctcgcct

SEQ ID NO: 3126507 - DNA, 16 bp, Homo sapiens
taaaacttttctgctg

SEQ ID NO: 3126508 - DNA, 17 bp, Homo sapiens
taaaagaaaaaatgaca

SEQ ID NO: 3126509 - DNA, 20 bp, Homo sapiens
taaaagaaaatgtaaaaaac

SEQ ID NO: 3126510 - DNA, 19 bp, Homo sapiens
taaaagaacttactgatta

SEQ ID NO: 3126511 - DNA, 20 bp, Homo sapiens
taaaagacatttgatagaaa

SEQ ID NO: 3126512 - DNA, 17 bp, Homo sapiens
taaaagataagtttgtt

SEQ ID NO: 3126513 - DNA, 13 bp, Homo sapiens
taaaagatatata

SEQ ID NO: 3126514 - DNA, 18 bp, Homo sapiens
taaaagcaaatctacaga

SEQ ID NO: 3126515 - DNA, 17 bp, Homo sapiens
taaaagcataaatgcaa

SEQ ID NO: 3126516 - DNA, 11 bp, Homo sapiens
taaaagcattg

SEQ ID NO: 3126517 - DNA, 12 bp, Homo sapiens
taaaagcattgt

SEQ ID NO: 3126518 - DNA, 23 bp, Homo sapiens
taaaagccaaccttcaaagaaac

SEQ ID NO: 3126519 - DNA, 16 bp, Homo sapiens
taaaagccttattcta

SEQ ID NO: 3126520 - DNA, 15 bp, Homo sapiens
taaaagctttcatgt

SEQ ID NO: 3126521 - DNA, 16 bp, Homo sapiens
taaaagctttcatgtc

SEQ ID NO: 3126522 - DNA, 21 bp, Homo sapiens
taaaaggaaatctcaccccat

SEQ ID NO: 3126523 - DNA, 23 bp, Homo sapiens
taaaaggatagtatttttatcca

SEQ ID NO: 3126524 - DNA, 22 bp, Homo sapiens
taaaaggcccatagcagccagt

SEQ ID NO: 3126525 - DNA, 19 bp, Homo sapiens
taaaagggatacacaggac

SEQ ID NO: 3126526 - DNA, 23 bp, Homo sapiens
taaaagggatacacaggactgaa

SEQ ID NO: 3126527 - DNA, 13 bp, Homo sapiens
taaaaggggccca

SEQ ID NO: 3126528 - DNA, 20 bp, Homo sapiens
taaaaggggcccaagcccca

SEQ ID NO: 3126529 - DNA, 19 bp, Homo sapiens
taaaaggtagagtcttaca

SEQ ID NO: 3126530 - DNA, 21 bp, Homo sapiens
taaaaggtatgcaatcaaatc

SEQ ID NO: 3126531 - DNA, 22 bp, Homo sapiens
taaaaggtattaaattgatgtt

SEQ ID NO: 3126532 - DNA, 15 bp, Homo sapiens
taaaaggttcaggga

SEQ ID NO: 3126533 - DNA, 14 bp, Homo sapiens
taaaagtaaaatgt

SEQ ID NO: 3126534 - DNA, 12 bp, Homo sapiens
taaaagtaaaca

SEQ ID NO: 3126535 - DNA, 13 bp, Homo sapiens
taaaagtagtaaa

SEQ ID NO: 3126536 - DNA, 15 bp, Homo sapiens
taaaagtattcatac

SEQ ID NO: 3126537 - DNA, 23 bp, Homo sapiens
taaaagtcgcattccatatcttt

SEQ ID NO: 3126538 - DNA, 21 bp, Homo sapiens
taaaagttgtgattccagata

SEQ ID NO: 3126539 - DNA, 13 bp, Homo sapiens
taaaagtttcaat

SEQ ID NO: 3126540 - DNA, 15 bp, Homo sapiens
taaaagttttgttct

SEQ ID NO: 3126541 - DNA, 19 bp, Homo sapiens
taaaataaaaaccaaatta

SEQ ID NO: 3126542 - DNA, 21 bp, Homo sapiens
taaaataaaaattctgaatgt

SEQ ID NO: 3126543 - DNA, 15 bp, Homo sapiens
taaaataaaatgaaa

SEQ ID NO: 3126544 - DNA, 17 bp, Homo sapiens
taaaataaaatgaaaat

SEQ ID NO: 3126545 - DNA, 14 bp, Homo sapiens
taaaataaacagtt

SEQ ID NO: 3126546 - DNA, 15 bp, Homo sapiens
taaaataaacagttg

SEQ ID NO: 3126547 - DNA, 13 bp, Homo sapiens
taaaataaatggt

SEQ ID NO: 3126548 - DNA, 14 bp, Homo sapiens
taaaataaattagt

SEQ ID NO: 3126549 - DNA, 20 bp, Homo sapiens
taaaataagcactgtgctaa

SEQ ID NO: 3126550 - DNA, 16 bp, Homo sapiens
taaaataagcaggtgg

SEQ ID NO: 3126551 - DNA, 13 bp, Homo sapiens
taaaatacattta

SEQ ID NO: 3126552 - DNA, 14 bp, Homo sapiens
taaaatacttttac

SEQ ID NO: 3126553 - DNA, 19 bp, Homo sapiens
taaaatacttttactctgc

SEQ ID NO: 3126554 - DNA, 21 bp, Homo sapiens
taaaatagtttatttttcaca

SEQ ID NO: 3126555 - DNA, 17 bp, Homo sapiens
taaaatatatttcagat

SEQ ID NO: 3126556 - DNA, 13 bp, Homo sapiens
taaaatattcctg

SEQ ID NO: 3126557 - DNA, 23 bp, Homo sapiens
taaaatatttaaacctttttctt

SEQ ID NO: 3126558 - DNA, 13 bp, Homo sapiens
taaaatatttatt

SEQ ID NO: 3126559 - DNA, 12 bp, Homo sapiens
taaaatattttg

SEQ ID NO: 3126560 - DNA, 17 bp, Homo sapiens
taaaatatttttgaaag

SEQ ID NO: 3126561 - DNA, 15 bp, Homo sapiens
taaaatcatgttttt

SEQ ID NO: 3126562 - DNA, 15 bp, Homo sapiens
taaaatctattctgt

SEQ ID NO: 3126563 - DNA, 16 bp, Homo sapiens
taaaatctattctgtg

SEQ ID NO: 3126564 - DNA, 17 bp, Homo sapiens
taaaatctattctgtgt

SEQ ID NO: 3126565 - DNA, 14 bp, Homo sapiens
taaaatctgtgaat

SEQ ID NO: 3126566 - DNA, 17 bp, Homo sapiens
taaaatcttatagttct

SEQ ID NO: 3126567 - DNA, 19 bp, Homo sapiens
taaaatcttggcacagaaa

SEQ ID NO: 3126568 - DNA, 20 bp, Homo sapiens
taaaatgaggttcaactgtt

SEQ ID NO: 3126569 - DNA, 16 bp, Homo sapiens
taaaatgattgtaaaa

SEQ ID NO: 3126570 - DNA, 22 bp, Homo sapiens
taaaatgattgtaaaatagctt

SEQ ID NO: 3126571 - DNA, 15 bp, Homo sapiens
taaaatgattttatc

SEQ ID NO: 3126572 - DNA, 17 bp, Homo sapiens
taaaatgattttatctg

SEQ ID NO: 3126573 - DNA, 18 bp, Homo sapiens
taaaatgattttatctgt

SEQ ID NO: 3126574 - DNA, 16 bp, Homo sapiens
taaaatgcatgatttt

SEQ ID NO: 3126575 - DNA, 16 bp, Homo sapiens
taaaatgccatagttt

SEQ ID NO: 3126576 - DNA, 19 bp, Homo sapiens
taaaatgccatagtttgtg

SEQ ID NO: 3126577 - DNA, 18 bp, Homo sapiens
taaaatggacacaaattt

SEQ ID NO: 3126578 - DNA, 21 bp, Homo sapiens
taaaatggacacaaattttca

SEQ ID NO: 3126579 - DNA, 23 bp, Homo sapiens
taaaatggacacaaattttcaag

SEQ ID NO: 3126580 - DNA, 16 bp, Homo sapiens
taaaatggatttaatc

SEQ ID NO: 3126581 - DNA, 21 bp, Homo sapiens
taaaatggatttaatccattt

SEQ ID NO: 3126582 - DNA, 10 bp, Homo sapiens
taaaatgtaa

SEQ ID NO: 3126583 - DNA, 14 bp, Homo sapiens
taaaatgtaagatt

SEQ ID NO: 3126584 - DNA, 15 bp, Homo sapiens
taaaatgtaatttaa

SEQ ID NO: 3126585 - DNA, 17 bp, Homo sapiens
taaaatgtaatttaaat

SEQ ID NO: 3126586 - DNA, 19 bp, Homo sapiens
taaaatgtaatttaaatga

SEQ ID NO: 3126587 - DNA, 21 bp, Homo sapiens
taaaatgtaatttaaatgaaa

SEQ ID NO: 3126588 - DNA, 16 bp, Homo sapiens
taaaatgtctttccaa

SEQ ID NO: 3126589 - DNA, 14 bp, Homo sapiens
taaaatgtgtacag

SEQ ID NO: 3126590 - DNA, 14 bp, Homo sapiens
taaaatgttaaaac

SEQ ID NO: 3126591 - DNA, 13 bp, Homo sapiens
taaaatgttcagt

SEQ ID NO: 3126592 - DNA, 12 bp, Homo sapiens
taaaattaaatg

SEQ ID NO: 3126593 - DNA, 14 bp, Homo sapiens
taaaattaaatgcc

SEQ ID NO: 3126594 - DNA, 19 bp, Homo sapiens
taaaattaaatgccttgta

SEQ ID NO: 3126595 - DNA, 17 bp, Homo sapiens
taaaattacagatgtga

SEQ ID NO: 3126596 - DNA, 20 bp, Homo sapiens
taaaattacagatgtgaaaa

SEQ ID NO: 3126597 - DNA, 16 bp, Homo sapiens
taaaattacgtttgtt

SEQ ID NO: 3126598 - DNA, 19 bp, Homo sapiens
taaaattatcctctttgta

SEQ ID NO: 3126599 - DNA, 15 bp, Homo sapiens
taaaattatgagatt

SEQ ID NO: 3126600 - DNA, 22 bp, Homo sapiens
taaaattatgagattggttttc

SEQ ID NO: 3126601 - DNA, 13 bp, Homo sapiens
taaaattatttca

SEQ ID NO: 3126602 - DNA, 14 bp, Homo sapiens
taaaattattttgg

SEQ ID NO: 3126603 - DNA, 15 bp, Homo sapiens
taaaattattttgga

SEQ ID NO: 3126604 - DNA, 18 bp, Homo sapiens
taaaattcagtttttgta

SEQ ID NO: 3126605 - DNA, 20 bp, Homo sapiens
taaaattcagtttttgtatc

SEQ ID NO: 3126606 - DNA, 16 bp, Homo sapiens
taaaattgccatttta

SEQ ID NO: 3126607 - DNA, 14 bp, Homo sapiens
taaaattggcacca

SEQ ID NO: 3126608 - DNA, 23 bp, Homo sapiens
taaaattgggcttgtgatttcca

SEQ ID NO: 3126609 - DNA, 14 bp, Homo sapiens
taaaattgtatgaa

SEQ ID NO: 3126610 - DNA, 16 bp, Homo sapiens
taaaattgtatgaaaa

SEQ ID NO: 3126611 - DNA, 22 bp, Homo sapiens
taaaattgtcacctctgttaag

SEQ ID NO: 3126612 - DNA, 14 bp, Homo sapiens
taaaattgtgcata

SEQ ID NO: 3126613 - DNA, 15 bp, Homo sapiens
taaaatttatttcat

SEQ ID NO: 3126614 - DNA, 9 bp, Homo sapiens
taaaatttg

SEQ ID NO: 3126615 - DNA, 21 bp, Homo sapiens
taaaattttgcttttaattaa

SEQ ID NO: 3126616 - DNA, 16 bp, Homo sapiens
taaaattttgtatgtt

SEQ ID NO: 3126617 - DNA, 19 bp, Homo sapiens
taaaattttgtatgttaaa

SEQ ID NO: 3126618 - DNA, 13 bp, Homo sapiens
taaacaaacattg

SEQ ID NO: 3126619 - DNA, 15 bp, Homo sapiens
taaacaaacattgtg

SEQ ID NO: 3126620 - DNA, 13 bp, Homo sapiens
taaacaaactctt

SEQ ID NO: 3126621 - DNA, 18 bp, Homo sapiens
taaacaaagtgactgttt

SEQ ID NO: 3126622 - DNA, 15 bp, Homo sapiens
taaacaaagttacta

SEQ ID NO: 3126623 - DNA, 18 bp, Homo sapiens
taaacaaagtttcagagt

SEQ ID NO: 3126624 - DNA, 15 bp, Homo sapiens
taaacaacagctgaa

SEQ ID NO: 3126625 - DNA, 18 bp, Homo sapiens
taaacaacagctgaagca

SEQ ID NO: 3126626 - DNA, 18 bp, Homo sapiens
taaacaagaaccatttgc

SEQ ID NO: 3126627 - DNA, 19 bp, Homo sapiens
taaacaagaaccatttgca

SEQ ID NO: 3126628 - DNA, 19 bp, Homo sapiens
taaacaagtaagaaaaata

SEQ ID NO: 3126629 - DNA, 23 bp, Homo sapiens
taaacaatgatgccctgctccag

SEQ ID NO: 3126630 - DNA, 14 bp, Homo sapiens
taaacaatgtataa

SEQ ID NO: 3126631 - DNA, 22 bp, Homo sapiens
taaacaatgtataaagattgta

SEQ ID NO: 3126632 - DNA, 21 bp, Homo sapiens
taaacacagtcaaaataattc

SEQ ID NO: 3126633 - DNA, 16 bp, Homo sapiens
taaacactcaccttct

SEQ ID NO: 3126634 - DNA, 17 bp, Homo sapiens
taaacactcaccttcta

SEQ ID NO: 3126635 - DNA, 21 bp, Homo sapiens
taaacacttatcttctggatt

SEQ ID NO: 3126636 - DNA, 14 bp, Homo sapiens
taaacagaaatgga

SEQ ID NO: 3126637 - DNA, 24 bp, Homo sapiens
taaacagaactcccttcaaaagcc

SEQ ID NO: 3126638 - DNA, 13 bp, Homo sapiens
taaacagacaata

SEQ ID NO: 3126639 - DNA, 16 bp, Homo sapiens
taaacagatataaatg

SEQ ID NO: 3126640 - DNA, 16 bp, Homo sapiens
taaacagatgaataaa

SEQ ID NO: 3126641 - DNA, 17 bp, Homo sapiens
taaacagatgatgagaa

SEQ ID NO: 3126642 - DNA, 18 bp, Homo sapiens
taaacagatttttacaaa

SEQ ID NO: 3126643 - DNA, 15 bp, Homo sapiens
taaacaggcccagca

SEQ ID NO: 3126644 - DNA, 17 bp, Homo sapiens
taaacagtagttgtatt

SEQ ID NO: 3126645 - DNA, 23 bp, Homo sapiens
taaacagtgagcctgaattttgt

SEQ ID NO: 3126646 - DNA, 21 bp, Homo sapiens
taaacataacagcctctgtga

SEQ ID NO: 3126647 - DNA, 23 bp, Homo sapiens
taaacataattgtggattataaa

SEQ ID NO: 3126648 - DNA, 17 bp, Homo sapiens
taaacatccaatatttt

SEQ ID NO: 3126649 - DNA, 12 bp, Homo sapiens
taaacatgtgtt

SEQ ID NO: 3126650 - DNA, 15 bp, Homo sapiens
taaacattaaatgtc

SEQ ID NO: 3126651 - DNA, 22 bp, Homo sapiens
taaacattaatagcagcctttc

SEQ ID NO: 3126652 - DNA, 23 bp, Homo sapiens
taaacattaattttgtgcattct

SEQ ID NO: 3126653 - DNA, 18 bp, Homo sapiens
taaacattgaagtaatga

SEQ ID NO: 3126654 - DNA, 11 bp, Homo sapiens
taaacattttc

SEQ ID NO: 3126655 - DNA, 14 bp, Homo sapiens
taaaccaaaggaca

SEQ ID NO: 3126656 - DNA, 19 bp, Homo sapiens
taaaccaaaggacattatg

SEQ ID NO: 3126657 - DNA, 23 bp, Homo sapiens
taaaccaaaggacattatgtgtg

SEQ ID NO: 3126658 - DNA, 15 bp, Homo sapiens
taaaccaactctaat

SEQ ID NO: 3126659 - DNA, 21 bp, Homo sapiens
taaaccaggtttagacagtat

SEQ ID NO: 3126660 - DNA, 15 bp, Homo sapiens
taaacccctgtccca

SEQ ID NO: 3126661 - DNA, 17 bp, Homo sapiens
taaaccgtttttaacac

SEQ ID NO: 3126662 - DNA, 19 bp, Homo sapiens
taaacctagtaaaaccttg

SEQ ID NO: 3126663 - DNA, 19 bp, Homo sapiens
taaacctcaaaatgtctaa

SEQ ID NO: 3126664 - DNA, 15 bp, Homo sapiens
taaacctcagttatt

SEQ ID NO: 3126665 - DNA, 15 bp, Homo sapiens
taaacctccgccaat

SEQ ID NO: 3126666 - DNA, 14 bp, Homo sapiens
taaacctttttctt

SEQ ID NO: 3126667 - DNA, 21 bp, Homo sapiens
taaacctttttcttgatctta

SEQ ID NO: 3126668 - DNA, 19 bp, Homo sapiens
taaacgcaagctgagctgg

SEQ ID NO: 3126669 - DNA, 15 bp, Homo sapiens
taaacggattccaaa

SEQ ID NO: 3126670 - DNA, 21 bp, Homo sapiens
taaacggttcagtttcttctg

SEQ ID NO: 3126671 - DNA, 17 bp, Homo sapiens
taaacggttcctggtga

SEQ ID NO: 3126672 - DNA, 17 bp, Homo sapiens
taaacgtgcagactatg

SEQ ID NO: 3126673 - DNA, 18 bp, Homo sapiens
taaactagtttttcctat

SEQ ID NO: 3126674 - DNA, 13 bp, Homo sapiens
taaactatcagtt

SEQ ID NO: 3126675 - DNA, 17 bp, Homo sapiens
taaactatcagtttgtc

SEQ ID NO: 3126676 - DNA, 15 bp, Homo sapiens
taaactatctgtatt

SEQ ID NO: 3126677 - DNA, 17 bp, Homo sapiens
taaactatctgtattta

SEQ ID NO: 3126678 - DNA, 21 bp, Homo sapiens
taaactatcttggtgaatttt

SEQ ID NO: 3126679 - DNA, 17 bp, Homo sapiens
taaactattggaaagta

SEQ ID NO: 3126680 - DNA, 15 bp, Homo sapiens
taaactcaaaactta

SEQ ID NO: 3126681 - DNA, 16 bp, Homo sapiens
taaactcaaaatattt

SEQ ID NO: 3126682 - DNA, 11 bp, Homo sapiens
taaactcaggg

SEQ ID NO: 3126683 - DNA, 16 bp, Homo sapiens
taaactgactttatcc

SEQ ID NO: 3126684 - DNA, 21 bp, Homo sapiens
taaactgactttttcccccca

SEQ ID NO: 3126685 - DNA, 13 bp, Homo sapiens
taaactgccatat

SEQ ID NO: 3126686 - DNA, 22 bp, Homo sapiens
taaactggaattaaaaggatag

SEQ ID NO: 3126687 - DNA, 22 bp, Homo sapiens
taaactgtgtattccaagacat

SEQ ID NO: 3126688 - DNA, 20 bp, Homo sapiens
taaactgtgtggactgtgat

SEQ ID NO: 3126689 - DNA, 16 bp, Homo sapiens
taaactgttagcactg

SEQ ID NO: 3126690 - DNA, 18 bp, Homo sapiens
taaactgttagcactgtt

SEQ ID NO: 3126691 - DNA, 23 bp, Homo sapiens
taaactgttagcactgttgatgt

SEQ ID NO: 3126692 - DNA, 12 bp, Homo sapiens
taaactgtttat

SEQ ID NO: 3126693 - DNA, 14 bp, Homo sapiens
taaactgtttatat

SEQ ID NO: 3126694 - DNA, 19 bp, Homo sapiens
taaacttagaggaaaatga

SEQ ID NO: 3126695 - DNA, 21 bp, Homo sapiens
taaacttagaggaaaatgagt

SEQ ID NO: 3126696 - DNA, 22 bp, Homo sapiens
taaacttagtgcggacaagttt

SEQ ID NO: 3126697 - DNA, 18 bp, Homo sapiens
taaacttataaatcatat

SEQ ID NO: 3126698 - DNA, 13 bp, Homo sapiens
taaacttccaaag

SEQ ID NO: 3126699 - DNA, 18 bp, Homo sapiens
taaacttccccatcttct

SEQ ID NO: 3126700 - DNA, 20 bp, Homo sapiens
taaacttgtttgctgtgaac

SEQ ID NO: 3126701 - DNA, 18 bp, Homo sapiens
taaactttagagtagcat

SEQ ID NO: 3126702 - DNA, 15 bp, Homo sapiens
taaactttatttgta

SEQ ID NO: 3126703 - DNA, 17 bp, Homo sapiens
taaactttatttgtaaa

SEQ ID NO: 3126704 - DNA, 15 bp, Homo sapiens
taaacttttaattca

SEQ ID NO: 3126705 - DNA, 16 bp, Homo sapiens
taaacttttaattcat

SEQ ID NO: 3126706 - DNA, 18 bp, Homo sapiens
taaactttttttctgtac

SEQ ID NO: 3126707 - DNA, 20 bp, Homo sapiens
taaagaaaaatatcttggcc

SEQ ID NO: 3126708 - DNA, 13 bp, Homo sapiens
taaagaaaacttc

SEQ ID NO: 3126709 - DNA, 15 bp, Homo sapiens
taaagaaacagcttt

SEQ ID NO: 3126710 - DNA, 16 bp, Homo sapiens
taaagaaaggaaaaga

SEQ ID NO: 3126711 - DNA, 21 bp, Homo sapiens
taaagaaagtcgaattaatag

SEQ ID NO: 3126712 - DNA, 15 bp, Homo sapiens
taaagaaatttacta

SEQ ID NO: 3126713 - DNA, 16 bp, Homo sapiens
taaagaaatttactat

SEQ ID NO: 3126714 - DNA, 21 bp, Homo sapiens
taaagaactccttattttgta

SEQ ID NO: 3126715 - DNA, 23 bp, Homo sapiens
taaagaacttaaattatgtttta

SEQ ID NO: 3126716 - DNA, 20 bp, Homo sapiens
taaagaagggggctttcttt

SEQ ID NO: 3126717 - DNA, 15 bp, Homo sapiens
taaagaatttaagct

SEQ ID NO: 3126718 - DNA, 9 bp, Homo sapiens
taaagacag

SEQ ID NO: 3126719 - DNA, 15 bp, Homo sapiens
taaagacagaggcag

SEQ ID NO: 3126720 - DNA, 10 bp, Homo sapiens
taaagacagg

SEQ ID NO: 3126721 - DNA, 16 bp, Homo sapiens
taaagaccagaaattc

SEQ ID NO: 3126722 - DNA, 13 bp, Homo sapiens
taaagactgaaat

SEQ ID NO: 3126723 - DNA, 19 bp, Homo sapiens
taaagactggttttctgcc

SEQ ID NO: 3126724 - DNA, 12 bp, Homo sapiens
taaagagaaact

SEQ ID NO: 3126725 - DNA, 20 bp, Homo sapiens
taaagagaaactttgtgcta

SEQ ID NO: 3126726 - DNA, 12 bp, Homo sapiens
taaagagaagac

SEQ ID NO: 3126727 - DNA, 22 bp, Homo sapiens
taaagagacagtgatattggaa

SEQ ID NO: 3126728 - DNA, 19 bp, Homo sapiens
taaagagacctacctcagg

SEQ ID NO: 3126729 - DNA, 13 bp, Homo sapiens
taaagagaggtta

SEQ ID NO: 3126730 - DNA, 16 bp, Homo sapiens
taaagagcccttgcct

SEQ ID NO: 3126731 - DNA, 13 bp, Homo sapiens
gttcttttaaagg

SEQ ID NO: 3126732 - DNA, 17 bp, Homo sapiens
gttcttttatagactga

SEQ ID NO: 3126733 - DNA, 13 bp, Homo sapiens
gttgaaaaatcta

SEQ ID NO: 3126734 - DNA, 16 bp, Homo sapiens
gttgaaaaatctagtt

SEQ ID NO: 3126735 - DNA, 18 bp, Homo sapiens
gttgaaaattcaaaaagt

SEQ ID NO: 3126736 - DNA, 22 bp, Homo sapiens
gttgaaaattcaaaaagtgttt

SEQ ID NO: 3126737 - DNA, 18 bp, Homo sapiens
gttgaaccaaacctccct

SEQ ID NO: 3126738 - DNA, 18 bp, Homo sapiens
gttgaaccattatacttt

SEQ ID NO: 3126739 - DNA, 22 bp, Homo sapiens
gttgaagagacagagacaagta

SEQ ID NO: 3126740 - DNA, 22 bp, Homo sapiens
gttgaagggaggtggcaagagt

SEQ ID NO: 3126741 - DNA, 18 bp, Homo sapiens
gttgaatatagcctgcct

SEQ ID NO: 3126742 - DNA, 15 bp, Homo sapiens
gttgacaactgtgac

SEQ ID NO: 3126743 - DNA, 16 bp, Homo sapiens
gttgacaactgtgact

SEQ ID NO: 3126744 - DNA, 21 bp, Homo sapiens
gttgacaccattctcctgcct

SEQ ID NO: 3126745 - DNA, 18 bp, Homo sapiens
gttgacagttcatatgta

SEQ ID NO: 3126746 - DNA, 20 bp, Homo sapiens
gttgacttattttctctgtg

SEQ ID NO: 3126747 - DNA, 15 bp, Homo sapiens
gttgagccccaagtc

SEQ ID NO: 3126748 - DNA, 16 bp, Homo sapiens
gttgagccccaagtcc

SEQ ID NO: 3126749 - DNA, 20 bp, Homo sapiens
gttgagccccaagtcctgaa

SEQ ID NO: 3126750 - DNA, 13 bp, Homo sapiens
gttgagctgtttt

SEQ ID NO: 3126751 - DNA, 21 bp, Homo sapiens
gttgagcttcatataccagca

SEQ ID NO: 3126752 - DNA, 16 bp, Homo sapiens
gttgaggggcctggag

SEQ ID NO: 3126753 - DNA, 23 bp, Homo sapiens
gttgaggtggtctgaatgttctg

SEQ ID NO: 3126754 - DNA, 12 bp, Homo sapiens
gttgatagttta

SEQ ID NO: 3126755 - DNA, 13 bp, Homo sapiens
gttgatggaaaat

SEQ ID NO: 3126756 - DNA, 17 bp, Homo sapiens
gttgatgggttctaatt

SEQ ID NO: 3126757 - DNA, 16 bp, Homo sapiens
gttgcaatgtgaaaaa

SEQ ID NO: 3126758 - DNA, 16 bp, Homo sapiens
gttgcaccatctgctt

SEQ ID NO: 3126759 - DNA, 17 bp, Homo sapiens
gttgcaccatctgcttg

SEQ ID NO: 3126760 - DNA, 14 bp, Homo sapiens
gttgcactgatatt

SEQ ID NO: 3126761 - DNA, 22 bp, Homo sapiens
gttgcagagaagcatcctccac

SEQ ID NO: 3126762 - DNA, 23 bp, Homo sapiens
gttgcatagcagtatatgttaat

SEQ ID NO: 3126763 - DNA, 18 bp, Homo sapiens
gttgcattcctttgtctt

SEQ ID NO: 3126764 - DNA, 17 bp, Homo sapiens
gtttacaggtttgaatt

SEQ ID NO: 3126765 - DNA, 21 bp, Homo sapiens
gtttacatgtgtagcctatgt

SEQ ID NO: 3126766 - DNA, 18 bp, Homo sapiens
gtttaccagttgcctttt

SEQ ID NO: 3126767 - DNA, 13 bp, Homo sapiens
gtttaccatttgt

SEQ ID NO: 3126768 - DNA, 17 bp, Homo sapiens
gtttaccatttgtaata

SEQ ID NO: 3126769 - DNA, 13 bp, Homo sapiens
gtttacctagaag

SEQ ID NO: 3126770 - DNA, 13 bp, Homo sapiens
gtttacctttctc

SEQ ID NO: 3126771 - DNA, 19 bp, Homo sapiens
gtttactcattgcccccac

SEQ ID NO: 3126772 - DNA, 21 bp, Homo sapiens
gtttactcattgcccccacct

SEQ ID NO: 3126773 - DNA, 18 bp, Homo sapiens
gtttacttatcttatgcc

SEQ ID NO: 3126774 - DNA, 14 bp, Homo sapiens
gtttactttcaaaa

SEQ ID NO: 3126775 - DNA, 15 bp, Homo sapiens
gtttagaagctgaga

SEQ ID NO: 3126776 - DNA, 12 bp, Homo sapiens
gtttagaccaag

SEQ ID NO: 3126777 - DNA, 14 bp, Homo sapiens
gtttagatttcaag

SEQ ID NO: 3126778 - DNA, 19 bp, Homo sapiens
gtttagcagaactcattct

SEQ ID NO: 3126779 - DNA, 19 bp, Homo sapiens
gtttagtttctagaggcct

SEQ ID NO: 3126780 - DNA, 20 bp, Homo sapiens
gtttagtttctagaggcctc

SEQ ID NO: 3126781 - DNA, 18 bp, Homo sapiens
gtttataatctgaagata

SEQ ID NO: 3126782 - DNA, 19 bp, Homo sapiens
gtttataatctgaagatat

SEQ ID NO: 3126783 - DNA, 17 bp, Homo sapiens
gtttataattttctgaa

SEQ ID NO: 3126784 - DNA, 20 bp, Homo sapiens
gtttatactccagtgtacat

SEQ ID NO: 3126785 - DNA, 18 bp, Homo sapiens
gtttatcagatacatcac

SEQ ID NO: 3126786 - DNA, 15 bp, Homo sapiens
gtttatccaaatctt

SEQ ID NO: 3126787 - DNA, 13 bp, Homo sapiens
gtttatgagccag

SEQ ID NO: 3126788 - DNA, 16 bp, Homo sapiens
gtttatgatctatttg

SEQ ID NO: 3126789 - DNA, 16 bp, Homo sapiens
gtttatggcagaaggg

SEQ ID NO: 3126790 - DNA, 18 bp, Homo sapiens
gtttatggcctcagctgc

SEQ ID NO: 3126791 - DNA, 14 bp, Homo sapiens
gtttattaaatgct

SEQ ID NO: 3126792 - DNA, 15 bp, Homo sapiens
gtttattaaatgctt

SEQ ID NO: 3126793 - DNA, 23 bp, Homo sapiens
gtttattaacaaattatgttaca

SEQ ID NO: 3126794 - DNA, 14 bp, Homo sapiens
gtttattaatctta

SEQ ID NO: 3126795 - DNA, 22 bp, Homo sapiens
gtttattaatcttagtgtatga

SEQ ID NO: 3126796 - DNA, 22 bp, Homo sapiens
gtttattgagtttgtaggtaaa

SEQ ID NO: 3126797 - DNA, 14 bp, Homo sapiens
gtttatttatcagt

SEQ ID NO: 3126798 - DNA, 19 bp, Homo sapiens
gtttatttatcagtgacag

SEQ ID NO: 3126799 - DNA, 12 bp, Homo sapiens
gtttatttccaa

SEQ ID NO: 3126800 - DNA, 14 bp, Homo sapiens
gtttatttttcata

SEQ ID NO: 3126801 - DNA, 16 bp, Homo sapiens
gtttatttttcatatt

SEQ ID NO: 3126802 - DNA, 14 bp, Homo sapiens
gtttatttttgtaa

SEQ ID NO: 3126803 - DNA, 16 bp, Homo sapiens
gtttatttttgtaatg

SEQ ID NO: 3126804 - DNA, 17 bp, Homo sapiens
gtttatttttgtaatgt

SEQ ID NO: 3126805 - DNA, 19 bp, Homo sapiens
gtttcaaagatgctgtgag

SEQ ID NO: 3126806 - DNA, 19 bp, Homo sapiens
gtttcaaagtaaaggcctc

SEQ ID NO: 3126807 - DNA, 23 bp, Homo sapiens
gtttcaaagtaaaggcctcctcc

SEQ ID NO: 3126808 - DNA, 20 bp, Homo sapiens
gtttcaagaaaatctttgtt

SEQ ID NO: 3126809 - DNA, 19 bp, Homo sapiens
gtttcaaggcactctagat

SEQ ID NO: 3126810 - DNA, 22 bp, Homo sapiens
gtttcacaggtcaataaactta

SEQ ID NO: 3126811 - DNA, 13 bp, Homo sapiens
gtttcagacaggg

SEQ ID NO: 3126812 - DNA, 16 bp, Homo sapiens
gtttcagatatatatc

SEQ ID NO: 3126813 - DNA, 18 bp, Homo sapiens
gtttcagcgactccgttg

SEQ ID NO: 3126814 - DNA, 14 bp, Homo sapiens
gtttcaggtgacat

SEQ ID NO: 3126815 - DNA, 20 bp, Homo sapiens
gtttcaggtgacatgtgaaa

SEQ ID NO: 3126816 - DNA, 17 bp, Homo sapiens
gtttcagtaataaaaca

SEQ ID NO: 3126817 - DNA, 18 bp, Homo sapiens
gtttcagtaataaaacat

SEQ ID NO: 3126818 - DNA, 15 bp, Homo sapiens
gtttcagtttgttgg

SEQ ID NO: 3126819 - DNA, 15 bp, Homo sapiens
gtttcattctcctgc

SEQ ID NO: 3126820 - DNA, 16 bp, Homo sapiens
gtttccacagcctgca

SEQ ID NO: 3126821 - DNA, 14 bp, Homo sapiens
gtttccacatgctc

SEQ ID NO: 3126822 - DNA, 22 bp, Homo sapiens
gtttccacgatgaaaaacttcc

SEQ ID NO: 3126823 - DNA, 16 bp, Homo sapiens
gtttccatcatttctg

SEQ ID NO: 3126824 - DNA, 22 bp, Homo sapiens
gtttccccactaataaagtgcc

SEQ ID NO: 3126825 - DNA, 19 bp, Homo sapiens
gtttccccagggaaggaaa

SEQ ID NO: 3126826 - DNA, 13 bp, Homo sapiens
gtttccctgctga

SEQ ID NO: 3126827 - DNA, 14 bp, Homo sapiens
gtttccctgctgaa

SEQ ID NO: 3126828 - DNA, 21 bp, Homo sapiens
gtttcctaaatccaaccattt

SEQ ID NO: 3126829 - DNA, 12 bp, Homo sapiens
gtttcctctaaa

SEQ ID NO: 3126830 - DNA, 22 bp, Homo sapiens
gtttcctctagttctttgttca

SEQ ID NO: 3126831 - DNA, 17 bp, Homo sapiens
gtttcctgacattgtct

SEQ ID NO: 3126832 - DNA, 12 bp, Homo sapiens
gtttcctgcagg

SEQ ID NO: 3126833 - DNA, 17 bp, Homo sapiens
gtttcctggttccgttt

SEQ ID NO: 3126834 - DNA, 20 bp, Homo sapiens
gtttccttgttggtcagagg

SEQ ID NO: 3126835 - DNA, 17 bp, Homo sapiens
gtttcgactggtccagc

SEQ ID NO: 3126836 - DNA, 22 bp, Homo sapiens
gtttcgactggtccagctctga

SEQ ID NO: 3126837 - DNA, 15 bp, Homo sapiens
gtttcgtttctgtat

SEQ ID NO: 3126838 - DNA, 15 bp, Homo sapiens
gtttctaagattcta

SEQ ID NO: 3126839 - DNA, 19 bp, Homo sapiens
gtttctaagattctaaagg

SEQ ID NO: 3126840 - DNA, 23 bp, Homo sapiens
gtttctaccggagagagaatgta

SEQ ID NO: 3126841 - DNA, 16 bp, Homo sapiens
gtttctagaggcctca

SEQ ID NO: 3126842 - DNA, 17 bp, Homo sapiens
gtttctagaggcctcag

SEQ ID NO: 3126843 - DNA, 23 bp, Homo sapiens
gtttctatacaaatataaatctt

SEQ ID NO: 3126844 - DNA, 14 bp, Homo sapiens
gtttctattctgtc

SEQ ID NO: 3126845 - DNA, 15 bp, Homo sapiens
gtttctcatttgttt

SEQ ID NO: 3126846 - DNA, 18 bp, Homo sapiens
gtttctccaaactgaagc

SEQ ID NO: 3126847 - DNA, 16 bp, Homo sapiens
gtttctctctacagtg

SEQ ID NO: 3126848 - DNA, 20 bp, Homo sapiens
gtttctcttctagatgattt

SEQ ID NO: 3126849 - DNA, 17 bp, Homo sapiens
gtttctcttgagctggc

SEQ ID NO: 3126850 - DNA, 18 bp, Homo sapiens
gtttctcttgagctggcc

SEQ ID NO: 3126851 - DNA, 22 bp, Homo sapiens
gtttctgaaaatgtttaagtat

SEQ ID NO: 3126852 - DNA, 19 bp, Homo sapiens
gtttctgaagtacttaaac

SEQ ID NO: 3126853 - DNA, 19 bp, Homo sapiens
gtttctgacccactgatct

SEQ ID NO: 3126854 - DNA, 21 bp, Homo sapiens
gtttctgcccacattggaccc

SEQ ID NO: 3126855 - DNA, 18 bp, Homo sapiens
gtttctggtggtctgttg

SEQ ID NO: 3126856 - DNA, 12 bp, Homo sapiens
gtttctgttcca

SEQ ID NO: 3126857 - DNA, 12 bp, Homo sapiens
gtttcttaaata

SEQ ID NO: 3126858 - DNA, 19 bp, Homo sapiens
gtttcttaagggcacacac

SEQ ID NO: 3126859 - DNA, 16 bp, Homo sapiens
gtttcttagcttttta

SEQ ID NO: 3126860 - DNA, 18 bp, Homo sapiens
gtttcttcaagagctgag

SEQ ID NO: 3126861 - DNA, 11 bp, Homo sapiens
gtttcttccaa

SEQ ID NO: 3126862 - DNA, 21 bp, Homo sapiens
gtttcttcctgctccttttgt

SEQ ID NO: 3126863 - DNA, 19 bp, Homo sapiens
gtttcttctgtctttatgt

SEQ ID NO: 3126864 - DNA, 11 bp, Homo sapiens
gtttcttcttc

SEQ ID NO: 3126865 - DNA, 13 bp, Homo sapiens
gtttcttgtttat

SEQ ID NO: 3126866 - DNA, 17 bp, Homo sapiens
gtttctttaagaaagta

SEQ ID NO: 3126867 - DNA, 21 bp, Homo sapiens
gtttctttcctgccttcttct

SEQ ID NO: 3126868 - DNA, 14 bp, Homo sapiens
gtttcttttaaaga

SEQ ID NO: 3126869 - DNA, 21 bp, Homo sapiens
gtttctttttacagcattgtc

SEQ ID NO: 3126870 - DNA, 24 bp, Homo sapiens
gtttctttttacagcattgtcttt

SEQ ID NO: 3126871 - DNA, 17 bp, Homo sapiens
gtttgaaagattatgat

SEQ ID NO: 3126872 - DNA, 22 bp, Homo sapiens
gtttgaaatagttcaaactgca

SEQ ID NO: 3126873 - DNA, 12 bp, Homo sapiens
gtttgaacttca

SEQ ID NO: 3126874 - DNA, 14 bp, Homo sapiens
gtttgaattcagta

SEQ ID NO: 3126875 - DNA, 15 bp, Homo sapiens
gtttgaattcagtaa

SEQ ID NO: 3126876 - DNA, 17 bp, Homo sapiens
gtttgagacaagccctg

SEQ ID NO: 3126877 - DNA, 22 bp, Homo sapiens
gtttgagacaagccctggcaac

SEQ ID NO: 3126878 - DNA, 14 bp, Homo sapiens
gtttgagctgcctt

SEQ ID NO: 3126879 - DNA, 23 bp, Homo sapiens
gtttgaggatatattttcacttt

SEQ ID NO: 3126880 - DNA, 21 bp, Homo sapiens
gtttgaggcaaattaactgta

SEQ ID NO: 3126881 - DNA, 16 bp, Homo sapiens
gtttgaggctgcagcg

SEQ ID NO: 3126882 - DNA, 22 bp, Homo sapiens
gtttgatgcaggcacttattgt

SEQ ID NO: 3126883 - DNA, 19 bp, Homo sapiens
gtttgatgctatttatgca

SEQ ID NO: 3126884 - DNA, 15 bp, Homo sapiens
gtttgatgtatgtgt

SEQ ID NO: 3126885 - DNA, 19 bp, Homo sapiens
gtttgatgtatgtgtgaaa

SEQ ID NO: 3126886 - DNA, 20 bp, Homo sapiens
gtttgatgtcattaatgtgt

SEQ ID NO: 3126887 - DNA, 15 bp, Homo sapiens
gtttgattattatgt

SEQ ID NO: 3126888 - DNA, 18 bp, Homo sapiens
gtttgattgaggagctgc

SEQ ID NO: 3126889 - DNA, 11 bp, Homo sapiens
gtttgatttca

SEQ ID NO: 3126890 - DNA, 14 bp, Homo sapiens
gtttgatttttgtt

SEQ ID NO: 3126891 - DNA, 22 bp, Homo sapiens
gtttgcacaagttccctggaga

SEQ ID NO: 3126892 - DNA, 15 bp, Homo sapiens
gtttgcacctgtccc

SEQ ID NO: 3126893 - DNA, 15 bp, Homo sapiens
gtttgcaggggtgac

SEQ ID NO: 3126894 - DNA, 22 bp, Homo sapiens
gtttgccatactttgtctgaaa

SEQ ID NO: 3126895 - DNA, 15 bp, Homo sapiens
gtttgccggatacaa

SEQ ID NO: 3126896 - DNA, 22 bp, Homo sapiens
gtttgcctccgtcccctgccca

SEQ ID NO: 3126897 - DNA, 13 bp, Homo sapiens
gtttgcctctgcc

SEQ ID NO: 3126898 - DNA, 18 bp, Homo sapiens
gtttgctaagtaaattag

SEQ ID NO: 3126899 - DNA, 14 bp, Homo sapiens
gtttgcttaaacaa

SEQ ID NO: 3126900 - DNA, 13 bp, Homo sapiens
gtttgcttattgt

SEQ ID NO: 3126901 - DNA, 17 bp, Homo sapiens
gtttgcttcataaatga

SEQ ID NO: 3126902 - DNA, 20 bp, Homo sapiens
gtttgcttggaaattccttg

SEQ ID NO: 3126903 - DNA, 16 bp, Homo sapiens
gtttggaatattaaaa

SEQ ID NO: 3126904 - DNA, 15 bp, Homo sapiens
gtttggaccccagct

SEQ ID NO: 3126905 - DNA, 17 bp, Homo sapiens
gtttggaccccagctgg

SEQ ID NO: 3126906 - DNA, 19 bp, Homo sapiens
gtttggaccccagctggga

SEQ ID NO: 3126907 - DNA, 21 bp, Homo sapiens
gtttggagcactagtttgatt

SEQ ID NO: 3126908 - DNA, 16 bp, Homo sapiens
gtttggatgtaattta

SEQ ID NO: 3126909 - DNA, 14 bp, Homo sapiens
gtttggcacttgta

SEQ ID NO: 3126910 - DNA, 21 bp, Homo sapiens
gtttggcacttgtatttaatt

SEQ ID NO: 3126911 - DNA, 12 bp, Homo sapiens
gtttgggcagag

SEQ ID NO: 3126912 - DNA, 20 bp, Homo sapiens
gtttggggagcagagacact

SEQ ID NO: 3126913 - DNA, 19 bp, Homo sapiens
gtttgggtaaaatactttt

SEQ ID NO: 3126914 - DNA, 16 bp, Homo sapiens
gtttggtaaatgtttc

SEQ ID NO: 3126915 - DNA, 16 bp, Homo sapiens
gtttggtagttagcca

SEQ ID NO: 3126916 - DNA, 16 bp, Homo sapiens
gtttggtgcaaagtat

SEQ ID NO: 3126917 - DNA, 18 bp, Homo sapiens
gtttggttagaggaaggc

SEQ ID NO: 3126918 - DNA, 15 bp, Homo sapiens
gtttgtaaatgcctc

SEQ ID NO: 3126919 - DNA, 22 bp, Homo sapiens
gtttgtaccttccttaagccag

SEQ ID NO: 3126920 - DNA, 14 bp, Homo sapiens
gtttgtaggtaaaa

SEQ ID NO: 3126921 - DNA, 15 bp, Homo sapiens
gtttgtataacttct

SEQ ID NO: 3126922 - DNA, 20 bp, Homo sapiens
gtttgtattttttatttaca

SEQ ID NO: 3126923 - DNA, 21 bp, Homo sapiens
gtttgtattttttatttacat

SEQ ID NO: 3126924 - DNA, 18 bp, Homo sapiens
gtttgtcgctcatgtgtg

SEQ ID NO: 3126925 - DNA, 16 bp, Homo sapiens
gtttgtctattttaaa

SEQ ID NO: 3126926 - DNA, 15 bp, Homo sapiens
gtttgtctcgtggtt

SEQ ID NO: 3126927 - DNA, 15 bp, Homo sapiens
gtttgtctctccttt

SEQ ID NO: 3126928 - DNA, 16 bp, Homo sapiens
gtttgtctctcctttt

SEQ ID NO: 3126929 - DNA, 17 bp, Homo sapiens
gtttgtctctccttttc

SEQ ID NO: 3126930 - DNA, 21 bp, Homo sapiens
gtttgtcttccattccattgt

SEQ ID NO: 3126931 - DNA, 22 bp, Homo sapiens
gtttgtgagcatgggtgtgccc

SEQ ID NO: 3126932 - DNA, 13 bp, Homo sapiens
gtttgtggctggg

SEQ ID NO: 3126933 - DNA, 20 bp, Homo sapiens
gtttgtggctgggggcagga

SEQ ID NO: 3126934 - DNA, 13 bp, Homo sapiens
gtttgtgtgattt

SEQ ID NO: 3126935 - DNA, 16 bp, Homo sapiens
gtttgtgtgtatttgt

SEQ ID NO: 3126936 - DNA, 21 bp, Homo sapiens
gtttgtgtgtatttgtattaa

SEQ ID NO: 3126937 - DNA, 22 bp, Homo sapiens
gtttgtgtgtatttgtattaat

SEQ ID NO: 3126938 - DNA, 15 bp, Homo sapiens
gtttgtgtgttgtct

SEQ ID NO: 3126939 - DNA, 21 bp, Homo sapiens
gtttgtgtgttgtcttgaaag

SEQ ID NO: 3126940 - DNA, 20 bp, Homo sapiens
gtttgtgttctgtttgttaa

SEQ ID NO: 3126941 - DNA, 19 bp, Homo sapiens
gtttgttaaaaataaatcc

SEQ ID NO: 3126942 - DNA, 15 bp, Homo sapiens
gtttgttaaaactgg

SEQ ID NO: 3126943 - DNA, 13 bp, Homo sapiens
gtttgttggaaag

SEQ ID NO: 3126944 - DNA, 19 bp, Homo sapiens
gtttgttggatcttcaatg

SEQ ID NO: 3126945 - DNA, 23 bp, Homo sapiens
gtttgtttcatatatacaggcat

SEQ ID NO: 3126946 - DNA, 15 bp, Homo sapiens
gtttgttttgtgaat

SEQ ID NO: 3126947 - DNA, 16 bp, Homo sapiens
gttttaaaaagccagt

SEQ ID NO: 3126948 - DNA, 12 bp, Homo sapiens
gttttaaaagca

SEQ ID NO: 3126949 - DNA, 22 bp, Homo sapiens
gttttaaacacatgccttaaat

SEQ ID NO: 3126950 - DNA, 19 bp, Homo sapiens
gttttaaacatagaaagtt

SEQ ID NO: 3126951 - DNA, 12 bp, Homo sapiens
gttttaaattct

SEQ ID NO: 3126952 - DNA, 22 bp, Homo sapiens
gttttaacaatttcctttatat

SEQ ID NO: 3126953 - DNA, 20 bp, Homo sapiens
gttttaaccgcacatgcaca

SEQ ID NO: 3126954 - DNA, 14 bp, Homo sapiens
gttttaacttttat

SEQ ID NO: 3126955 - DNA, 12 bp, Homo sapiens
gttttaatgtat

SEQ ID NO: 3126956 - DNA, 17 bp, Homo sapiens
gttttacttacaaaaat

SEQ ID NO: 3126957 - DNA, 21 bp, Homo sapiens
gttttacttacaaaaatggga

SEQ ID NO: 3126958 - DNA, 13 bp, Homo sapiens
gttttagaaaaca

SEQ ID NO: 3126959 - DNA, 16 bp, Homo sapiens
gttttaggtagaaaaa

SEQ ID NO: 3126960 - DNA, 16 bp, Homo sapiens
gttttaggttctaaag

SEQ ID NO: 3126961 - DNA, 17 bp, Homo sapiens
gttttaggttctaaagt

SEQ ID NO: 3126962 - DNA, 21 bp, Homo sapiens
gttttagttgcagaaacattt

SEQ ID NO: 3126963 - DNA, 21 bp, Homo sapiens
gttttatactgaaggaaaaac

SEQ ID NO: 3126964 - DNA, 18 bp, Homo sapiens
gttttatactgtacttaa

SEQ ID NO: 3126965 - DNA, 23 bp, Homo sapiens
gttttatactgtacttaataaat

SEQ ID NO: 3126966 - DNA, 22 bp, Homo sapiens
gttttatatattatgtgaagaa

SEQ ID NO: 3126967 - DNA, 11 bp, Homo sapiens
gttttatcaag

SEQ ID NO: 3126968 - DNA, 22 bp, Homo sapiens
gttttatcatgacatgttatat

SEQ ID NO: 3126969 - DNA, 13 bp, Homo sapiens
gttttattgtgtt

SEQ ID NO: 3126970 - DNA, 19 bp, Homo sapiens
gttttatttacttctgtat

SEQ ID NO: 3126971 - DNA, 17 bp, Homo sapiens
gttttcaactcaggaac

SEQ ID NO: 3126972 - DNA, 13 bp, Homo sapiens
gttttcaagtcaa

SEQ ID NO: 3126973 - DNA, 17 bp, Homo sapiens
gttttcaagtcaaatta

SEQ ID NO: 3126974 - DNA, 22 bp, Homo sapiens
gttttcacttgtattgacttta

SEQ ID NO: 3126975 - DNA, 16 bp, Homo sapiens
gttttcagaagaaata

SEQ ID NO: 3126976 - DNA, 22 bp, Homo sapiens
gttttcagctgctcagaattca

SEQ ID NO: 3126977 - DNA, 17 bp, Homo sapiens
gttttcattatgttcat

SEQ ID NO: 3126978 - DNA, 22 bp, Homo sapiens
gttttcattcccccttcctagt

SEQ ID NO: 3126979 - DNA, 23 bp, Homo sapiens
gttttccacccataatcctttct

SEQ ID NO: 3126980 - DNA, 14 bp, Homo sapiens
gttttccaccctgg

SEQ ID NO: 3126981 - DNA, 15 bp, Homo sapiens
gttttccatgaaaac

SEQ ID NO: 3126982 - DNA, 22 bp, Homo sapiens
gttttcctataatataataaat

SEQ ID NO: 3126983 - DNA, 20 bp, Homo sapiens
gttttcctctatacatctct

SEQ ID NO: 3126984 - DNA, 22 bp, Homo sapiens
gttttcctctatacatctctcc

SEQ ID NO: 3126985 - DNA, 24 bp, Homo sapiens
gttttcctctatacatctctcccc

SEQ ID NO: 3126986 - DNA, 21 bp, Homo sapiens
gttttctcctcccaggaactg

SEQ ID NO: 3126987 - DNA, 16 bp, Homo sapiens
gttttctctaacttct

SEQ ID NO: 3126988 - DNA, 20 bp, Homo sapiens
gttttctctttgtggggctt

SEQ ID NO: 3126989 - DNA, 13 bp, Homo sapiens
gttttctgagccc

SEQ ID NO: 3126990 - DNA, 16 bp, Homo sapiens
gttttctgagggaaag

SEQ ID NO: 3126991 - DNA, 15 bp, Homo sapiens
gttttctgtagtcat

SEQ ID NO: 3126992 - DNA, 18 bp, Homo sapiens
gttttctgtagtcattta

SEQ ID NO: 3126993 - DNA, 23 bp, Homo sapiens
tacgatacgctactataaagaga

SEQ ID NO: 3126994 - DNA, 16 bp, Homo sapiens
tacgcagaggaatttt

SEQ ID NO: 3126995 - DNA, 14 bp, Homo sapiens
tacgctgtccagaa

SEQ ID NO: 3126996 - DNA, 15 bp, Homo sapiens
tacgctttgattcat

SEQ ID NO: 3126997 - DNA, 12 bp, Homo sapiens
tacgctttgtca

SEQ ID NO: 3126998 - DNA, 12 bp, Homo sapiens
tacgcttttctt

SEQ ID NO: 3126999 - DNA, 12 bp, Homo sapiens
tacggagaagaa

SEQ ID NO: 3127000 - DNA, 21 bp, Homo sapiens
tacgtagcctaaggctcctgt

SEQ ID NO: 3127001 - DNA, 13 bp, Homo sapiens
tacgtatgcaagt

SEQ ID NO: 3127002 - DNA, 18 bp, Homo sapiens
tacgtatgcaagtctgtg

SEQ ID NO: 3127003 - DNA, 20 bp, Homo sapiens
tacgtgcacagggtccccga

SEQ ID NO: 3127004 - DNA, 16 bp, Homo sapiens
tacgttattgttgact

SEQ ID NO: 3127005 - DNA, 14 bp, Homo sapiens
tacgtttgtatgtg

SEQ ID NO: 3127006 - DNA, 20 bp, Homo sapiens
tacgtttgtatgtgtgtaga

SEQ ID NO: 3127007 - DNA, 16 bp, Homo sapiens
tactaaaaaaaagatg

SEQ ID NO: 3127008 - DNA, 22 bp, Homo sapiens
tactaaaaagtaccagcatgtt

SEQ ID NO: 3127009 - DNA, 20 bp, Homo sapiens
tactaaaagttcttctccaa

SEQ ID NO: 3127010 - DNA, 16 bp, Homo sapiens
tactaaaccaactcta

SEQ ID NO: 3127011 - DNA, 20 bp, Homo sapiens
tactaaaccaactctaatat

SEQ ID NO: 3127012 - DNA, 15 bp, Homo sapiens
tactaaatttaaatt

SEQ ID NO: 3127013 - DNA, 15 bp, Homo sapiens
tactaagaaaagata

SEQ ID NO: 3127014 - DNA, 13 bp, Homo sapiens
tactaaggaaaat

SEQ ID NO: 3127015 - DNA, 17 bp, Homo sapiens
tactaaggaaaataata

SEQ ID NO: 3127016 - DNA, 16 bp, Homo sapiens
tactaaggacgttgtt

SEQ ID NO: 3127017 - DNA, 18 bp, Homo sapiens
tactaagggaacaatcca

SEQ ID NO: 3127018 - DNA, 19 bp, Homo sapiens
tactaagttattttatgac

SEQ ID NO: 3127019 - DNA, 22 bp, Homo sapiens
tactaagttcacattagaatta

SEQ ID NO: 3127020 - DNA, 20 bp, Homo sapiens
tactaatagaataaaggcag

SEQ ID NO: 3127021 - DNA, 15 bp, Homo sapiens
tactaatgatgtttt

SEQ ID NO: 3127022 - DNA, 16 bp, Homo sapiens
tactaatgatgttttc

SEQ ID NO: 3127023 - DNA, 15 bp, Homo sapiens
tactaattttacaca

SEQ ID NO: 3127024 - DNA, 17 bp, Homo sapiens
tactaattttacacatt

SEQ ID NO: 3127025 - DNA, 23 bp, Homo sapiens
tactacagttgttttttgaaaac

SEQ ID NO: 3127026 - DNA, 13 bp, Homo sapiens
tactacctcttaa

SEQ ID NO: 3127027 - DNA, 13 bp, Homo sapiens
tactaccttgaaa

SEQ ID NO: 3127028 - DNA, 16 bp, Homo sapiens
tactaccttgaaaata

SEQ ID NO: 3127029 - DNA, 20 bp, Homo sapiens
tactaccttgaaaataagaa

SEQ ID NO: 3127030 - DNA, 20 bp, Homo sapiens
tactactgaaacagatttca

SEQ ID NO: 3127031 - DNA, 21 bp, Homo sapiens
tactactgaaacagatttcat

SEQ ID NO: 3127032 - DNA, 17 bp, Homo sapiens
tactagaatttgtattt

SEQ ID NO: 3127033 - DNA, 18 bp, Homo sapiens
tactagaatttgtatttt

SEQ ID NO: 3127034 - DNA, 18 bp, Homo sapiens
tactagatgcatcactgg

SEQ ID NO: 3127035 - DNA, 22 bp, Homo sapiens
tactaggatacagaaatgcaaa

SEQ ID NO: 3127036 - DNA, 19 bp, Homo sapiens
tactagggagccatttgag

SEQ ID NO: 3127037 - DNA, 13 bp, Homo sapiens
tactataaagaga

SEQ ID NO: 3127038 - DNA, 14 bp, Homo sapiens
tactataaagagaa

SEQ ID NO: 3127039 - DNA, 13 bp, Homo sapiens
tactataacatat

SEQ ID NO: 3127040 - DNA, 14 bp, Homo sapiens
tactataatcaaat

SEQ ID NO: 3127041 - DNA, 16 bp, Homo sapiens
tactataatcaaatga

SEQ ID NO: 3127042 - DNA, 22 bp, Homo sapiens
tactataatcaaatgatttcat

SEQ ID NO: 3127043 - DNA, 13 bp, Homo sapiens
tactatatacata

SEQ ID NO: 3127044 - DNA, 17 bp, Homo sapiens
tactatccagttactgc

SEQ ID NO: 3127045 - DNA, 16 bp, Homo sapiens
tactatggctgattta

SEQ ID NO: 3127046 - DNA, 12 bp, Homo sapiens
tactatgtatca

SEQ ID NO: 3127047 - DNA, 14 bp, Homo sapiens
tactatgtatcaat

SEQ ID NO: 3127048 - DNA, 15 bp, Homo sapiens
tactatgtgctgggt

SEQ ID NO: 3127049 - DNA, 15 bp, Homo sapiens
tactattaaaatatt

SEQ ID NO: 3127050 - DNA, 20 bp, Homo sapiens
tactattaagcagtaaaaac

SEQ ID NO: 3127051 - DNA, 14 bp, Homo sapiens
tactattcatgttt

SEQ ID NO: 3127052 - DNA, 22 bp, Homo sapiens
tactattccctttgacttcagc

SEQ ID NO: 3127053 - DNA, 15 bp, Homo sapiens
tactattgttacatt

SEQ ID NO: 3127054 - DNA, 19 bp, Homo sapiens
tactattttctacaattaa

SEQ ID NO: 3127055 - DNA, 23 bp, Homo sapiens
tactcaaatgagtaacatttgct

SEQ ID NO: 3127056 - DNA, 13 bp, Homo sapiens
tactcaatactac

SEQ ID NO: 3127057 - DNA, 14 bp, Homo sapiens
tactcaatggattt

SEQ ID NO: 3127058 - DNA, 15 bp, Homo sapiens
tactcacagtctctt

SEQ ID NO: 3127059 - DNA, 16 bp, Homo sapiens
tactcagaagcctgag

SEQ ID NO: 3127060 - DNA, 21 bp, Homo sapiens
tactcagagcagagcaaatga

SEQ ID NO: 3127061 - DNA, 12 bp, Homo sapiens
tactcagcctgc

SEQ ID NO: 3127062 - DNA, 18 bp, Homo sapiens
tactcagggctcctccca

SEQ ID NO: 3127063 - DNA, 20 bp, Homo sapiens
tactcagggctcctcccagc

SEQ ID NO: 3127064 - DNA, 18 bp, Homo sapiens
tactcagggttcatctgt

SEQ ID NO: 3127065 - DNA, 20 bp, Homo sapiens
tactcagggttcatctgtcc

SEQ ID NO: 3127066 - DNA, 21 bp, Homo sapiens
tactcagggttcatctgtcca

SEQ ID NO: 3127067 - DNA, 12 bp, Homo sapiens
tactcaggtttg

SEQ ID NO: 3127068 - DNA, 13 bp, Homo sapiens
tactcattgaaat

SEQ ID NO: 3127069 - DNA, 15 bp, Homo sapiens
tactcattgccccca

SEQ ID NO: 3127070 - DNA, 11 bp, Homo sapiens
tactcatttct

SEQ ID NO: 3127071 - DNA, 18 bp, Homo sapiens
tactccctacactgatgc

SEQ ID NO: 3127072 - DNA, 16 bp, Homo sapiens
tactccctgcagatgc

SEQ ID NO: 3127073 - DNA, 16 bp, Homo sapiens
tactcccttcctggcc

SEQ ID NO: 3127074 - DNA, 17 bp, Homo sapiens
tactcccttcctggcct

SEQ ID NO: 3127075 - DNA, 21 bp, Homo sapiens
tactcctatttttgtaaactg

SEQ ID NO: 3127076 - DNA, 12 bp, Homo sapiens
tactcctctgca

SEQ ID NO: 3127077 - DNA, 22 bp, Homo sapiens
tactcctctgcagtgccttggg

SEQ ID NO: 3127078 - DNA, 17 bp, Homo sapiens
tactcctgcaaaatttt

SEQ ID NO: 3127079 - DNA, 22 bp, Homo sapiens
tactcgggaggctgaggcagga

SEQ ID NO: 3127080 - DNA, 12 bp, Homo sapiens
tactctaaacaa

SEQ ID NO: 3127081 - DNA, 20 bp, Homo sapiens
tactctaagatcttagattc

SEQ ID NO: 3127082 - DNA, 14 bp, Homo sapiens
tactctagatgaag

SEQ ID NO: 3127083 - DNA, 22 bp, Homo sapiens
tactctccccacgagggctggc

SEQ ID NO: 3127084 - DNA, 23 bp, Homo sapiens
tactctcctggaaatattaagaa

SEQ ID NO: 3127085 - DNA, 21 bp, Homo sapiens
tactctccttgagtgtatgag

SEQ ID NO: 3127086 - DNA, 12 bp, Homo sapiens
tactctctgcct

SEQ ID NO: 3127087 - DNA, 17 bp, Homo sapiens
tactctggggtgctgcc

SEQ ID NO: 3127088 - DNA, 21 bp, Homo sapiens
tactctggggtgctgcctgaa

SEQ ID NO: 3127089 - DNA, 23 bp, Homo sapiens
tactctggggtgctgcctgaatc

SEQ ID NO: 3127090 - DNA, 15 bp, Homo sapiens
tacttcttattgcaa

SEQ ID NO: 3127091 - DNA, 21 bp, Homo sapiens
tacttcttgaatataaaaaat

SEQ ID NO: 3127092 - DNA, 24 bp, Homo sapiens
tacttgaagaaacagagtggcctc

SEQ ID NO: 3127093 - DNA, 12 bp, Homo sapiens
tacttgactcta

SEQ ID NO: 3127094 - DNA, 15 bp, Homo sapiens
tacttgactctaata

SEQ ID NO: 3127095 - DNA, 16 bp, Homo sapiens
tacttgagcccaggag

SEQ ID NO: 3127096 - DNA, 22 bp, Homo sapiens
tacttgcagcattcatttgttt

SEQ ID NO: 3127097 - DNA, 14 bp, Homo sapiens
tacttgcagtacat

SEQ ID NO: 3127098 - DNA, 20 bp, Homo sapiens
tacttgctttcaattgacaa

SEQ ID NO: 3127099 - DNA, 15 bp, Homo sapiens
tacttggaagtgttt

SEQ ID NO: 3127100 - DNA, 21 bp, Homo sapiens
tacttgggagacctgtaatca

SEQ ID NO: 3127101 - DNA, 12 bp, Homo sapiens
tacttgggaggc

SEQ ID NO: 3127102 - DNA, 13 bp, Homo sapiens
tacttggtttgtg

SEQ ID NO: 3127103 - DNA, 21 bp, Homo sapiens
tacttgtgaaacacagctgtt

SEQ ID NO: 3127104 - DNA, 13 bp, Homo sapiens
tacttgtggacac

SEQ ID NO: 3127105 - DNA, 15 bp, Homo sapiens
tacttgtggacacag

SEQ ID NO: 3127106 - DNA, 18 bp, Homo sapiens
tacttgtggacacagctc

SEQ ID NO: 3127107 - DNA, 17 bp, Homo sapiens
tacttgtggttttcaaa

SEQ ID NO: 3127108 - DNA, 20 bp, Homo sapiens
tacttgtttctctgttgtaa

SEQ ID NO: 3127109 - DNA, 15 bp, Homo sapiens
tactttaaaaaggaa

SEQ ID NO: 3127110 - DNA, 23 bp, Homo sapiens
tactttaaaaaggaaatttgttt

SEQ ID NO: 3127111 - DNA, 19 bp, Homo sapiens
tactttataactaacatgt

SEQ ID NO: 3127112 - DNA, 23 bp, Homo sapiens
tactttataactaacatgtcctg

SEQ ID NO: 3127113 - DNA, 13 bp, Homo sapiens
tactttatatctg

SEQ ID NO: 3127114 - DNA, 20 bp, Homo sapiens
tactttatcactttttgaac

SEQ ID NO: 3127115 - DNA, 12 bp, Homo sapiens
tactttattctt

SEQ ID NO: 3127116 - DNA, 15 bp, Homo sapiens
tactttattcttgct

SEQ ID NO: 3127117 - DNA, 21 bp, Homo sapiens
tactttattgtacagactgtt

SEQ ID NO: 3127118 - DNA, 22 bp, Homo sapiens
tactttattgtacagactgttt

SEQ ID NO: 3127119 - DNA, 23 bp, Homo sapiens
tactttcaaaagagtagaaagct

SEQ ID NO: 3127120 - DNA, 18 bp, Homo sapiens
tactttcgaaatttcatt

SEQ ID NO: 3127121 - DNA, 16 bp, Homo sapiens
tactttcggagaaatt

SEQ ID NO: 3127122 - DNA, 15 bp, Homo sapiens
tactttcttataaat

SEQ ID NO: 3127123 - DNA, 19 bp, Homo sapiens
tactttgaaaccagaaaat

SEQ ID NO: 3127124 - DNA, 15 bp, Homo sapiens
tactttgacagtgtt

SEQ ID NO: 3127125 - DNA, 22 bp, Homo sapiens
tactttgcaatccaaataaaga

SEQ ID NO: 3127126 - DNA, 16 bp, Homo sapiens
tacatacataatgttt

SEQ ID NO: 3127127 - DNA, 22 bp, Homo sapiens
tacatacataatgtttttcctt

SEQ ID NO: 3127128 - DNA, 14 bp, Homo sapiens
tacatagatgctta

SEQ ID NO: 3127129 - DNA, 22 bp, Homo sapiens
tacatagatttatttttcagtt

SEQ ID NO: 3127130 - DNA, 19 bp, Homo sapiens
tacatagttttaaactcat

SEQ ID NO: 3127131 - DNA, 21 bp, Homo sapiens
tacatagttttaaactcattt

SEQ ID NO: 3127132 - DNA, 22 bp, Homo sapiens
tacatataaatgaatctggtgt

SEQ ID NO: 3127133 - DNA, 20 bp, Homo sapiens
tacatatcgctgacttcatg

SEQ ID NO: 3127134 - DNA, 20 bp, Homo sapiens
tacatatgtagaaacattta

SEQ ID NO: 3127135 - DNA, 21 bp, Homo sapiens
tacatatgtagaaacatttag

SEQ ID NO: 3127136 - DNA, 17 bp, Homo sapiens
tacatatgtagactata

SEQ ID NO: 3127137 - DNA, 19 bp, Homo sapiens
tacatatgtagactatata

SEQ ID NO: 3127138 - DNA, 23 bp, Homo sapiens
tacatattaggaaaatatgggtt

SEQ ID NO: 3127139 - DNA, 17 bp, Homo sapiens
tacatatttgagactag

SEQ ID NO: 3127140 - DNA, 16 bp, Homo sapiens
tacatatttgtggaat

SEQ ID NO: 3127141 - DNA, 15 bp, Homo sapiens
tacatcactgcttga

SEQ ID NO: 3127142 - DNA, 20 bp, Homo sapiens
tacatcagttattcattctg

SEQ ID NO: 3127143 - DNA, 23 bp, Homo sapiens
tacatcagttattcattctgtga

SEQ ID NO: 3127144 - DNA, 14 bp, Homo sapiens
tacatcctgggtaa

SEQ ID NO: 3127145 - DNA, 18 bp, Homo sapiens
tacatctattttggattg

SEQ ID NO: 3127146 - DNA, 23 bp, Homo sapiens
tacatctattttggattgtatat

SEQ ID NO: 3127147 - DNA, 20 bp, Homo sapiens
tacatctggcttattttaat

SEQ ID NO: 3127148 - DNA, 14 bp, Homo sapiens
tacatctgtgatga

SEQ ID NO: 3127149 - DNA, 17 bp, Homo sapiens
tacatcttctgtgaaat

SEQ ID NO: 3127150 - DNA, 20 bp, Homo sapiens
tacatcttctgtgaaatata

SEQ ID NO: 3127151 - DNA, 21 bp, Homo sapiens
tacatgaaaattttaaaaata

SEQ ID NO: 3127152 - DNA, 21 bp, Homo sapiens
tacatgaaacagaaacaaaaa

SEQ ID NO: 3127153 - DNA, 14 bp, Homo sapiens
tacatgactgggcc

SEQ ID NO: 3127154 - DNA, 15 bp, Homo sapiens
tacatgagaaagatg

SEQ ID NO: 3127155 - DNA, 16 bp, Homo sapiens
tacatgcaaaaagaaa

SEQ ID NO: 3127156 - DNA, 18 bp, Homo sapiens
tacatgcaaaaagaaatg

SEQ ID NO: 3127157 - DNA, 16 bp, Homo sapiens
tacatgcaatttatta

SEQ ID NO: 3127158 - DNA, 14 bp, Homo sapiens
tacatgcagcccat

SEQ ID NO: 3127159 - DNA, 17 bp, Homo sapiens
tacatgcagcccatgcc

SEQ ID NO: 3127160 - DNA, 14 bp, Homo sapiens
tacatgctcttttt

SEQ ID NO: 3127161 - DNA, 17 bp, Homo sapiens
tacatgctgaaaaatat

SEQ ID NO: 3127162 - DNA, 24 bp, Homo sapiens
tacatgctgctatacacaagcaat

SEQ ID NO: 3127163 - DNA, 14 bp, Homo sapiens
tacatgctggggtc

SEQ ID NO: 3127164 - DNA, 14 bp, Homo sapiens
tacatggaataaca

SEQ ID NO: 3127165 - DNA, 16 bp, Homo sapiens
tacatggcagagtttg

SEQ ID NO: 3127166 - DNA, 16 bp, Homo sapiens
tacatggttgtgacct

SEQ ID NO: 3127167 - DNA, 13 bp, Homo sapiens
tacatgtaatttg

SEQ ID NO: 3127168 - DNA, 17 bp, Homo sapiens
tacatgtagaaaaatac

SEQ ID NO: 3127169 - DNA, 13 bp, Homo sapiens
tacatgtagtagt

SEQ ID NO: 3127170 - DNA, 12 bp, Homo sapiens
tacatgtatggt

SEQ ID NO: 3127171 - DNA, 14 bp, Homo sapiens
tacatgtatggtta

SEQ ID NO: 3127172 - DNA, 15 bp, Homo sapiens
tacatgtattgcaca

SEQ ID NO: 3127173 - DNA, 16 bp, Homo sapiens
tacatgtgatacattt

SEQ ID NO: 3127174 - DNA, 18 bp, Homo sapiens
tacatgtgatacattttt

SEQ ID NO: 3127175 - DNA, 17 bp, Homo sapiens
tacatgtgccgaatgtg

SEQ ID NO: 3127176 - DNA, 19 bp, Homo sapiens
tacatgtgccgaatgtgca

SEQ ID NO: 3127177 - DNA, 16 bp, Homo sapiens
tacatgtgtgtatata

SEQ ID NO: 3127178 - DNA, 15 bp, Homo sapiens
tacatgtttccatca

SEQ ID NO: 3127179 - DNA, 12 bp, Homo sapiens
tacattaatgtt

SEQ ID NO: 3127180 - DNA, 20 bp, Homo sapiens
tacattaatgttaattcagc

SEQ ID NO: 3127181 - DNA, 19 bp, Homo sapiens
tacattagcagtttgcttt

SEQ ID NO: 3127182 - DNA, 14 bp, Homo sapiens
tacattcaactttt

SEQ ID NO: 3127183 - DNA, 23 bp, Homo sapiens
tacattcaacttttctaagaaaa

SEQ ID NO: 3127184 - DNA, 14 bp, Homo sapiens
tacattcatcaata

SEQ ID NO: 3127185 - DNA, 21 bp, Homo sapiens
tacattccctctcctgcccag

SEQ ID NO: 3127186 - DNA, 19 bp, Homo sapiens
tacattcctaactagaatt

SEQ ID NO: 3127187 - DNA, 17 bp, Homo sapiens
tacattgacacacagaa

SEQ ID NO: 3127188 - DNA, 23 bp, Homo sapiens
tacattgtgggatgttcagcact

SEQ ID NO: 3127189 - DNA, 13 bp, Homo sapiens
tacattgtgtgaa

SEQ ID NO: 3127190 - DNA, 20 bp, Homo sapiens
tacattgtgtgaaaaaagaa

SEQ ID NO: 3127191 - DNA, 14 bp, Homo sapiens
tacattgttcaatt

SEQ ID NO: 3127192 - DNA, 21 bp, Homo sapiens
tacatttaaaattgctatgtt

SEQ ID NO: 3127193 - DNA, 13 bp, Homo sapiens
tacatttaataca

SEQ ID NO: 3127194 - DNA, 12 bp, Homo sapiens
tacatttataat

SEQ ID NO: 3127195 - DNA, 19 bp, Homo sapiens
tacatttatctattaaaat

SEQ ID NO: 3127196 - DNA, 20 bp, Homo sapiens
tacatttatgatttaataaa

SEQ ID NO: 3127197 - DNA, 18 bp, Homo sapiens
tacatttcacattattct

SEQ ID NO: 3127198 - DNA, 21 bp, Homo sapiens
tacatttcacctactttgtaa

SEQ ID NO: 3127199 - DNA, 15 bp, Homo sapiens
tacatttcatacaac

SEQ ID NO: 3127200 - DNA, 16 bp, Homo sapiens
tacattttgttgtaaa

SEQ ID NO: 3127201 - DNA, 18 bp, Homo sapiens
tacattttgttgtaaaaa

SEQ ID NO: 3127202 - DNA, 14 bp, Homo sapiens
tacatttttacaat

SEQ ID NO: 3127203 - DNA, 15 bp, Homo sapiens
tacatttttacaata

SEQ ID NO: 3127204 - DNA, 17 bp, Homo sapiens
tacatttttacaataaa

SEQ ID NO: 3127205 - DNA, 15 bp, Homo sapiens
taccaaagttttatc

SEQ ID NO: 3127206 - DNA, 16 bp, Homo sapiens
taccaaatacacattt

SEQ ID NO: 3127207 - DNA, 22 bp, Homo sapiens
taccaaatacacatttcacatt

SEQ ID NO: 3127208 - DNA, 12 bp, Homo sapiens
taccaaatctga

SEQ ID NO: 3127209 - DNA, 17 bp, Homo sapiens
taccaaatctgacatat

SEQ ID NO: 3127210 - DNA, 20 bp, Homo sapiens
taccaaatctgacatattat

SEQ ID NO: 3127211 - DNA, 19 bp, Homo sapiens
taccaaattaaaaaaaaat

SEQ ID NO: 3127212 - DNA, 15 bp, Homo sapiens
taccaactttctgta

SEQ ID NO: 3127213 - DNA, 18 bp, Homo sapiens
taccaagacccccgtctc

SEQ ID NO: 3127214 - DNA, 16 bp, Homo sapiens
taccaagtgctgtctt

SEQ ID NO: 3127215 - DNA, 20 bp, Homo sapiens
taccaatcattttaattatt

SEQ ID NO: 3127216 - DNA, 22 bp, Homo sapiens
taccaatcattttaattattat

SEQ ID NO: 3127217 - DNA, 13 bp, Homo sapiens
taccaatctctgc

SEQ ID NO: 3127218 - DNA, 16 bp, Homo sapiens
taccaatctctgctct

SEQ ID NO: 3127219 - DNA, 17 bp, Homo sapiens
taccaatgctgttgtaa

SEQ ID NO: 3127220 - DNA, 13 bp, Homo sapiens
taccacaaggaaa

SEQ ID NO: 3127221 - DNA, 14 bp, Homo sapiens
taccacaaggaaaa

SEQ ID NO: 3127222 - DNA, 16 bp, Homo sapiens
taccacatctgctcta

SEQ ID NO: 3127223 - DNA, 16 bp, Homo sapiens
taccacctttactgtg

SEQ ID NO: 3127224 - DNA, 18 bp, Homo sapiens
taccactatttaagttat

SEQ ID NO: 3127225 - DNA, 16 bp, Homo sapiens
taccactcacatgaca

SEQ ID NO: 3127226 - DNA, 15 bp, Homo sapiens
taccacttacctcaa

SEQ ID NO: 3127227 - DNA, 18 bp, Homo sapiens
tacagtaagctgctctat

SEQ ID NO: 3127228 - DNA, 13 bp, Homo sapiens
tacagtacacatc

SEQ ID NO: 3127229 - DNA, 19 bp, Homo sapiens
tacagtacacatccccaga

SEQ ID NO: 3127230 - DNA, 13 bp, Homo sapiens
tacagtattctgt

SEQ ID NO: 3127231 - DNA, 20 bp, Homo sapiens
tacagtctctttcttccttt

SEQ ID NO: 3127232 - DNA, 15 bp, Homo sapiens
tacagtctgtcatga

SEQ ID NO: 3127233 - DNA, 21 bp, Homo sapiens
tacagtgaaaatgtaagctgt

SEQ ID NO: 3127234 - DNA, 17 bp, Homo sapiens
tacagtgaattgtcttt

SEQ ID NO: 3127235 - DNA, 16 bp, Homo sapiens
tacagtgaccttttct

SEQ ID NO: 3127236 - DNA, 16 bp, Homo sapiens
tacagtgcagacaggc

SEQ ID NO: 3127237 - DNA, 21 bp, Homo sapiens
tacagtggttttatactgaag

SEQ ID NO: 3127238 - DNA, 22 bp, Homo sapiens
tacagtggttttatactgaagg

SEQ ID NO: 3127239 - DNA, 23 bp, Homo sapiens
tacagtgtctgtgccatggattt

SEQ ID NO: 3127240 - DNA, 16 bp, Homo sapiens
tacagtgtttggacag

SEQ ID NO: 3127241 - DNA, 13 bp, Homo sapiens
tacagttataaaa

SEQ ID NO: 3127242 - DNA, 17 bp, Homo sapiens
tacagttataaaattaa

SEQ ID NO: 3127243 - DNA, 14 bp, Homo sapiens
tacagttctgtggt

SEQ ID NO: 3127244 - DNA, 21 bp, Homo sapiens
tacagttctgtggtttcatgt

SEQ ID NO: 3127245 - DNA, 16 bp, Homo sapiens
tacataaaattttcta

SEQ ID NO: 3127246 - DNA, 17 bp, Homo sapiens
tacataaactgacttta

SEQ ID NO: 3127247 - DNA, 16 bp, Homo sapiens
tacataaactgtcact

SEQ ID NO: 3127248 - DNA, 23 bp, Homo sapiens
tacataactctgtaaaaacactg

SEQ ID NO: 3127249 - DNA, 17 bp, Homo sapiens
tacataagataaatgtg

SEQ ID NO: 3127250 - DNA, 19 bp, Homo sapiens
tacataagtaattcaagaa

SEQ ID NO: 3127251 - DNA, 13 bp, Homo sapiens
tacataatgctta

SEQ ID NO: 3127252 - DNA, 22 bp, Homo sapiens
tacataatgcttaatttctaaa

SEQ ID NO: 3127253 - DNA, 20 bp, Homo sapiens
tacaataaatatttgaaccc

SEQ ID NO: 3127254 - DNA, 14 bp, Homo sapiens
tacaatatataaaa

SEQ ID NO: 3127255 - DNA, 16 bp, Homo sapiens
tacaatattttattct

SEQ ID NO: 3127256 - DNA, 15 bp, Homo sapiens
tacaatcaaatctcc

SEQ ID NO: 3127257 - DNA, 18 bp, Homo sapiens
tacaatcttagtgaatgg

SEQ ID NO: 3127258 - DNA, 22 bp, Homo sapiens
tacaatgactagtcacctgggg

SEQ ID NO: 3127259 - DNA, 14 bp, Homo sapiens
tacaatggaaacaa

SEQ ID NO: 3127260 - DNA, 16 bp, Homo sapiens
tacaatgtgaacttta

SEQ ID NO: 3127261 - DNA, 12 bp, Homo sapiens
tacaattaaagg

SEQ ID NO: 3127262 - DNA, 21 bp, Homo sapiens
tacaattaaaggtcctgccct

SEQ ID NO: 3127263 - DNA, 18 bp, Homo sapiens
tacaattactaaattgta

SEQ ID NO: 3127264 - DNA, 15 bp, Homo sapiens
tacaattgcactgct

SEQ ID NO: 3127265 - DNA, 17 bp, Homo sapiens
tacaattgcactgctgt

SEQ ID NO: 3127266 - DNA, 18 bp, Homo sapiens
tacaattgcactgctgtt

SEQ ID NO: 3127267 - DNA, 20 bp, Homo sapiens
tacacaattaattcatccct

SEQ ID NO: 3127268 - DNA, 18 bp, Homo sapiens
tacacaccctgcccctgc

SEQ ID NO: 3127269 - DNA, 23 bp, Homo sapiens
tacacagcacaccagccgctgca

SEQ ID NO: 3127270 - DNA, 14 bp, Homo sapiens
tacacagtacttta

SEQ ID NO: 3127271 - DNA, 23 bp, Homo sapiens
tacacagtactttattgtacaga

SEQ ID NO: 3127272 - DNA, 23 bp, Homo sapiens
tacacagtgggaactctgacaag

SEQ ID NO: 3127273 - DNA, 11 bp, Homo sapiens
tacacagttgc

SEQ ID NO: 3127274 - DNA, 22 bp, Homo sapiens
tacacataagaccgtgtcccaa

SEQ ID NO: 3127275 - DNA, 23 bp, Homo sapiens
tacacatagcaggggcaccttcc

SEQ ID NO: 3127276 - DNA, 20 bp, Homo sapiens
taaagcaattgcataataga

SEQ ID NO: 3127277 - DNA, 17 bp, Homo sapiens
taaagcagtttattata

SEQ ID NO: 3127278 - DNA, 21 bp, Homo sapiens
taaagcataagtatacagttc

SEQ ID NO: 3127279 - DNA, 21 bp, Homo sapiens
taaagcattgcttttattttg

SEQ ID NO: 3127280 - DNA, 14 bp, Homo sapiens
taaagccagcctga

SEQ ID NO: 3127281 - DNA, 23 bp, Homo sapiens
taaagcccgcctgacagaaacca

SEQ ID NO: 3127282 - DNA, 12 bp, Homo sapiens
taaagcctcctc

SEQ ID NO: 3127283 - DNA, 21 bp, Homo sapiens
taaagcctttagtatcagtgt

SEQ ID NO: 3127284 - DNA, 17 bp, Homo sapiens
taaagcgatatacagat

SEQ ID NO: 3127285 - DNA, 23 bp, Homo sapiens
taaagctaaaatgattttatctg

SEQ ID NO: 3127286 - DNA, 14 bp, Homo sapiens
taaagctatgttac

SEQ ID NO: 3127287 - DNA, 18 bp, Homo sapiens
taaagctcaaatgaaatg

SEQ ID NO: 3127288 - DNA, 20 bp, Homo sapiens
taaagctcaaatgaaatgta

SEQ ID NO: 3127289 - DNA, 17 bp, Homo sapiens
taaagctgcctgtagtt

SEQ ID NO: 3127290 - DNA, 10 bp, Homo sapiens
taaagctggc

SEQ ID NO: 3127291 - DNA, 17 bp, Homo sapiens
taaagctggccctgcct

SEQ ID NO: 3127292 - DNA, 18 bp, Homo sapiens
taaagctggccctgcctc

SEQ ID NO: 3127293 - DNA, 20 bp, Homo sapiens
taaagctggccctgcctcct

SEQ ID NO: 3127294 - DNA, 23 bp, Homo sapiens
taaagctggccctgcctcctggg

SEQ ID NO: 3127295 - DNA, 13 bp, Homo sapiens
taaagcttaaatt

SEQ ID NO: 3127296 - DNA, 19 bp, Homo sapiens
taaagcttgcaacaaaatt

SEQ ID NO: 3127297 - DNA, 17 bp, Homo sapiens
taaagcttgtggcccct

SEQ ID NO: 3127298 - DNA, 22 bp, Homo sapiens
taaagctttggacaagtccttg

SEQ ID NO: 3127299 - DNA, 17 bp, Homo sapiens
taaagcttttggaagcc

SEQ ID NO: 3127300 - DNA, 14 bp, Homo sapiens
taaaggaaggaaaa

SEQ ID NO: 3127301 - DNA, 16 bp, Homo sapiens
taaaggatgctgctgt

SEQ ID NO: 3127302 - DNA, 21 bp, Homo sapiens
taaaggattgatcactttgtt

SEQ ID NO: 3127303 - DNA, 19 bp, Homo sapiens
taaaggcaccatctaatag

SEQ ID NO: 3127304 - DNA, 17 bp, Homo sapiens
taaaggcagctgcctct

SEQ ID NO: 3127305 - DNA, 18 bp, Homo sapiens
taaaggcagctgcctctg

SEQ ID NO: 3127306 - DNA, 23 bp, Homo sapiens
taaaggcagctgcctctgctccc

SEQ ID NO: 3127307 - DNA, 11 bp, Homo sapiens
taaaggcctgg

SEQ ID NO: 3127308 - DNA, 14 bp, Homo sapiens
taaagggcctgcct

SEQ ID NO: 3127309 - DNA, 18 bp, Homo sapiens
taaaggggactagacagt

SEQ ID NO: 3127310 - DNA, 18 bp, Homo sapiens
taaaggggagaaactgaa

SEQ ID NO: 3127311 - DNA, 22 bp, Homo sapiens
taaaggggagaaactgaaagtg

SEQ ID NO: 3127312 - DNA, 14 bp, Homo sapiens
taaaggggggaggg

SEQ ID NO: 3127313 - DNA, 15 bp, Homo sapiens
taaaggggggagggg

SEQ ID NO: 3127314 - DNA, 22 bp, Homo sapiens
taaaggttacaagcctgcacaa

SEQ ID NO: 3127315 - DNA, 17 bp, Homo sapiens
taaagtaaagctaaaat

SEQ ID NO: 3127316 - DNA, 18 bp, Homo sapiens
taaagtaaatctcttttt

SEQ ID NO: 3127317 - DNA, 21 bp, Homo sapiens
taaagtaatttctaaagcagt

SEQ ID NO: 3127318 - DNA, 15 bp, Homo sapiens
taaagtacttgagtg

SEQ ID NO: 3127319 - DNA, 17 bp, Homo sapiens
taaagtactttcttata

SEQ ID NO: 3127320 - DNA, 19 bp, Homo sapiens
taaagtactttcttataaa

SEQ ID NO: 3127321 - DNA, 23 bp, Homo sapiens
taaagtactttcttataaatttg

SEQ ID NO: 3127322 - DNA, 18 bp, Homo sapiens
taaagtagaagagggttt

SEQ ID NO: 3127323 - DNA, 13 bp, Homo sapiens
taaagtattcttt

SEQ ID NO: 3127324 - DNA, 15 bp, Homo sapiens
taaagtcagaagttt

SEQ ID NO: 3127325 - DNA, 13 bp, Homo sapiens
taaagtcagatgg

SEQ ID NO: 3127326 - DNA, 15 bp, Homo sapiens
taaagtcagatggaa

SEQ ID NO: 3127327 - DNA, 18 bp, Homo sapiens
taaagtcaggtccaattt

SEQ ID NO: 3127328 - DNA, 11 bp, Homo sapiens
taaagtgatta

SEQ ID NO: 3127329 - DNA, 13 bp, Homo sapiens
taaagtgccttct

SEQ ID NO: 3127330 - DNA, 17 bp, Homo sapiens
taaagtgctaaggttct

SEQ ID NO: 3127331 - DNA, 16 bp, Homo sapiens
taaagtgtaataatat

SEQ ID NO: 3127332 - DNA, 17 bp, Homo sapiens
taaagtgtgttgttgct

SEQ ID NO: 3127333 - DNA, 18 bp, Homo sapiens
taaagtgtgttgttgctt

SEQ ID NO: 3127334 - DNA, 16 bp, Homo sapiens
taaagtgttggtcttt

SEQ ID NO: 3127335 - DNA, 18 bp, Homo sapiens
taaagtgtttctgttatt

SEQ ID NO: 3127336 - DNA, 15 bp, Homo sapiens
taaagtgttttcaga

SEQ ID NO: 3127337 - DNA, 14 bp, Homo sapiens
taaagttctaagat

SEQ ID NO: 3127338 - DNA, 22 bp, Homo sapiens
taaagttctaagattctgattt

SEQ ID NO: 3127339 - DNA, 17 bp, Homo sapiens
taaagttctgagtgttt

SEQ ID NO: 3127340 - DNA, 14 bp, Homo sapiens
taaagttggaattt

SEQ ID NO: 3127341 - DNA, 17 bp, Homo sapiens
taaagtttgcttagaaa

SEQ ID NO: 3127342 - DNA, 22 bp, Homo sapiens
taaagttttgtacaaagttttc

SEQ ID NO: 3127343 - DNA, 14 bp, Homo sapiens
taaataaaaatgga

SEQ ID NO: 3127344 - DNA, 13 bp, Homo sapiens
taaataaaagcac

SEQ ID NO: 3127345 - DNA, 14 bp, Homo sapiens
taaataaaagcagc

SEQ ID NO: 3127346 - DNA, 15 bp, Homo sapiens
taaataaaagcagca

SEQ ID NO: 3127347 - DNA, 17 bp, Homo sapiens
taaataaaatgtgtaca

SEQ ID NO: 3127348 - DNA, 17 bp, Homo sapiens
taaataaaattcatttc

SEQ ID NO: 3127349 - DNA, 13 bp, Homo sapiens
taaataaaccctt

SEQ ID NO: 3127350 - DNA, 20 bp, Homo sapiens
taaataaactgttgctcgtt

SEQ ID NO: 3127351 - DNA, 19 bp, Homo sapiens
taaataaactttttttcaa

SEQ ID NO: 3127352 - DNA, 20 bp, Homo sapiens
taaataaactttttttcaat

SEQ ID NO: 3127353 - DNA, 21 bp, Homo sapiens
taaataaactttttttcaatg

SEQ ID NO: 3127354 - DNA, 23 bp, Homo sapiens
taaataaactttttttcaatgtg

SEQ ID NO: 3127355 - DNA, 14 bp, Homo sapiens
taaataaatatttt

SEQ ID NO: 3127356 - DNA, 22 bp, Homo sapiens
taaataaatgtatcttattcac

SEQ ID NO: 3127357 - DNA, 12 bp, Homo sapiens
taaataacactt

SEQ ID NO: 3127358 - DNA, 14 bp, Homo sapiens
taaataacacttgt

SEQ ID NO: 3127359 - DNA, 18 bp, Homo sapiens
taaataaccccattcttt

SEQ ID NO: 3127360 - DNA, 18 bp, Homo sapiens
taaataacctctggccct

SEQ ID NO: 3127361 - DNA, 11 bp, Homo sapiens
taaataagaga

SEQ ID NO: 3127362 - DNA, 13 bp, Homo sapiens
taaataagagatt

SEQ ID NO: 3127363 - DNA, 14 bp, Homo sapiens
taaataagattcta

SEQ ID NO: 3127364 - DNA, 12 bp, Homo sapiens
taaataatgaaa

SEQ ID NO: 3127365 - DNA, 12 bp, Homo sapiens
taaataatgaat

SEQ ID NO: 3127366 - DNA, 17 bp, Homo sapiens
taaataatgcttcagat

SEQ ID NO: 3127367 - DNA, 14 bp, Homo sapiens
taaataatttctac

SEQ ID NO: 3127368 - DNA, 18 bp, Homo sapiens
taaatacaagactgttgt

SEQ ID NO: 3127369 - DNA, 17 bp, Homo sapiens
taaatacagacactaag

SEQ ID NO: 3127370 - DNA, 23 bp, Homo sapiens
taaatacagataattcatttgta

SEQ ID NO: 3127371 - DNA, 21 bp, Homo sapiens
taaatacataaatagtagaaa

SEQ ID NO: 3127372 - DNA, 17 bp, Homo sapiens
taaataccagacacgta

SEQ ID NO: 3127373 - DNA, 12 bp, Homo sapiens
taaataccagga

SEQ ID NO: 3127374 - DNA, 13 bp, Homo sapiens
taaatactgtgca

SEQ ID NO: 3127375 - DNA, 15 bp, Homo sapiens
taaatactgtgcaga

SEQ ID NO: 3127376 - DNA, 22 bp, Homo sapiens
taaatactgtgcagaataatgg

SEQ ID NO: 3127377 - DNA, 21 bp, Homo sapiens
taaatactgtgtggaactttt

SEQ ID NO: 3127378 - DNA, 18 bp, Homo sapiens
taaatagagtatatgcac

SEQ ID NO: 3127379 - DNA, 15 bp, Homo sapiens
taaatagctatatcc

SEQ ID NO: 3127380 - DNA, 16 bp, Homo sapiens
taaatagctatatcca

SEQ ID NO: 3127381 - DNA, 20 bp, Homo sapiens
taaatagctatatccatgta

SEQ ID NO: 3127382 - DNA, 23 bp, Homo sapiens
taaataggaatcattcagaaatg

SEQ ID NO: 3127383 - DNA, 12 bp, Homo sapiens
taaataggattt

SEQ ID NO: 3127384 - DNA, 18 bp, Homo sapiens
taaatagtatttgagagt

SEQ ID NO: 3127385 - DNA, 13 bp, Homo sapiens
taaatagttctat

SEQ ID NO: 3127386 - DNA, 14 bp, Homo sapiens
taaatataagcctt

SEQ ID NO: 3127387 - DNA, 19 bp, Homo sapiens
taaatataattctgtaaat

SEQ ID NO: 3127388 - DNA, 19 bp, Homo sapiens
taaatataccactctttac

SEQ ID NO: 3127389 - DNA, 16 bp, Homo sapiens
taaatatagttcctaa

SEQ ID NO: 3127390 - DNA, 23 bp, Homo sapiens
taaatatagttcctaagaagctt

SEQ ID NO: 3127391 - DNA, 11 bp, Homo sapiens
taaatatatat

SEQ ID NO: 3127392 - DNA, 14 bp, Homo sapiens
taaatatatataaa

SEQ ID NO: 3127393 - DNA, 15 bp, Homo sapiens
taaatatatataaag

SEQ ID NO: 3127394 - DNA, 20 bp, Homo sapiens
taaatatatataaagaatat

SEQ ID NO: 3127395 - DNA, 18 bp, Homo sapiens
taaatatatctaccccag

SEQ ID NO: 3127396 - DNA, 12 bp, Homo sapiens
taaatatccaaa

SEQ ID NO: 3127397 - DNA, 13 bp, Homo sapiens
taaatatccaaag

SEQ ID NO: 3127398 - DNA, 23 bp, Homo sapiens
taaatatccaaagactgtactgg

SEQ ID NO: 3127399 - DNA, 23 bp, Homo sapiens
taaatatgaatctgctcacttta

SEQ ID NO: 3127400 - DNA, 16 bp, Homo sapiens
taaatatgcagtgata

SEQ ID NO: 3127401 - DNA, 18 bp, Homo sapiens
taaatatgtacatttgtc

SEQ ID NO: 3127402 - DNA, 16 bp, Homo sapiens
taatttaaatgaaaga

SEQ ID NO: 3127403 - DNA, 16 bp, Homo sapiens
taatttaacccagctc

SEQ ID NO: 3127404 - DNA, 11 bp, Homo sapiens
taatttaactt

SEQ ID NO: 3127405 - DNA, 21 bp, Homo sapiens
taatttaagagctaaccagtt

SEQ ID NO: 3127406 - DNA, 22 bp, Homo sapiens
taatttacctaagattacaaat

SEQ ID NO: 3127407 - DNA, 20 bp, Homo sapiens
taatttacttgttttggatg

SEQ ID NO: 3127408 - DNA, 23 bp, Homo sapiens
taatttagaaactgatttcttca

SEQ ID NO: 3127409 - DNA, 18 bp, Homo sapiens
taatttagggtactaaat

SEQ ID NO: 3127410 - DNA, 19 bp, Homo sapiens
taatttagggtactaaatt

SEQ ID NO: 3127411 - DNA, 13 bp, Homo sapiens
taatttataaaaa

SEQ ID NO: 3127412 - DNA, 13 bp, Homo sapiens
taatttataaaat

SEQ ID NO: 3127413 - DNA, 18 bp, Homo sapiens
taatttatctaaattaaa

SEQ ID NO: 3127414 - DNA, 17 bp, Homo sapiens
taatttattattgaaat

SEQ ID NO: 3127415 - DNA, 18 bp, Homo sapiens
taatttatttattaagat

SEQ ID NO: 3127416 - DNA, 19 bp, Homo sapiens
taatttatttccactaaaa

SEQ ID NO: 3127417 - DNA, 13 bp, Homo sapiens
taatttatttgtt

SEQ ID NO: 3127418 - DNA, 16 bp, Homo sapiens
taatttatttgtttcc

SEQ ID NO: 3127419 - DNA, 18 bp, Homo sapiens
taatttcaaaaatataac

SEQ ID NO: 3127420 - DNA, 12 bp, Homo sapiens
taatttcaaaat

SEQ ID NO: 3127421 - DNA, 15 bp, Homo sapiens
taatttcagtgtaaa

SEQ ID NO: 3127422 - DNA, 15 bp, Homo sapiens
taccatttatacaaa

SEQ ID NO: 3127423 - DNA, 18 bp, Homo sapiens
taccatttatacaaatta

SEQ ID NO: 3127424 - DNA, 16 bp, Homo sapiens
taccatttcagagagg

SEQ ID NO: 3127425 - DNA, 15 bp, Homo sapiens
taccatttgcctccc

SEQ ID NO: 3127426 - DNA, 17 bp, Homo sapiens
taccatttgtaataaag

SEQ ID NO: 3127427 - DNA, 22 bp, Homo sapiens
taccatttgtaataaagtatat

SEQ ID NO: 3127428 - DNA, 23 bp, Homo sapiens
taccatttgtaataaagtatata

SEQ ID NO: 3127429 - DNA, 14 bp, Homo sapiens
taccatttttcatt

SEQ ID NO: 3127430 - DNA, 21 bp, Homo sapiens
taccattttttaaggaaacaa

SEQ ID NO: 3127431 - DNA, 20 bp, Homo sapiens
tacccaaaccctaggttccc

SEQ ID NO: 3127432 - DNA, 21 bp, Homo sapiens
tacccaaccactcaaattaat

SEQ ID NO: 3127433 - DNA, 13 bp, Homo sapiens
tacccaatttccc

SEQ ID NO: 3127434 - DNA, 21 bp, Homo sapiens
tacccaccgatggagccccca

SEQ ID NO: 3127435 - DNA, 20 bp, Homo sapiens
tacccacgttctcacaccca

SEQ ID NO: 3127436 - DNA, 14 bp, Homo sapiens
tacccactgctctg

SEQ ID NO: 3127437 - DNA, 22 bp, Homo sapiens
tacccactgtcaggcctctgag

SEQ ID NO: 3127438 - DNA, 16 bp, Homo sapiens
tacccagcgagccctg

SEQ ID NO: 3127439 - DNA, 13 bp, Homo sapiens
tacccagctcctt

SEQ ID NO: 3127440 - DNA, 20 bp, Homo sapiens
tacccaggctggagtgcagt

SEQ ID NO: 3127441 - DNA, 15 bp, Homo sapiens
tacccatagacatga

SEQ ID NO: 3127442 - DNA, 18 bp, Homo sapiens
tacccatagacatgaaag

SEQ ID NO: 3127443 - DNA, 18 bp, Homo sapiens
tacccatgactttatatg

SEQ ID NO: 3127444 - DNA, 15 bp, Homo sapiens
tacccatgagcctgc

SEQ ID NO: 3127445 - DNA, 21 bp, Homo sapiens
taccccactgggccagccctg

SEQ ID NO: 3127446 - DNA, 15 bp, Homo sapiens
tacccccctctgtct

SEQ ID NO: 3127447 - DNA, 23 bp, Homo sapiens
tacccccttctgggcatctgttc

SEQ ID NO: 3127448 - DNA, 22 bp, Homo sapiens
tacccctgctcccattcctccc

SEQ ID NO: 3127449 - DNA, 19 bp, Homo sapiens
taccccttagcctccctga

SEQ ID NO: 3127450 - DNA, 20 bp, Homo sapiens
taccccttctttgcagggct

SEQ ID NO: 3127451 - DNA, 22 bp, Homo sapiens
tacccgagaagcacttgagcat

SEQ ID NO: 3127452 - DNA, 14 bp, Homo sapiens
taccctaatgtctt

SEQ ID NO: 3127453 - DNA, 16 bp, Homo sapiens
taccctaatgtcttca

SEQ ID NO: 3127454 - DNA, 22 bp, Homo sapiens
taccctaatgtcttcataaagt

SEQ ID NO: 3127455 - DNA, 18 bp, Homo sapiens
taccctcctgcactgttt

SEQ ID NO: 3127456 - DNA, 20 bp, Homo sapiens
taccctccttccacatgtac

SEQ ID NO: 3127457 - DNA, 21 bp, Homo sapiens
taccctccttccacatgtaca

SEQ ID NO: 3127458 - DNA, 15 bp, Homo sapiens
taccctcgggcccac

SEQ ID NO: 3127459 - DNA, 17 bp, Homo sapiens
taccctcgggcccacct

SEQ ID NO: 3127460 - DNA, 18 bp, Homo sapiens
taccctcgggcccacctg

SEQ ID NO: 3127461 - DNA, 20 bp, Homo sapiens
taccctcgggcccacctggc

SEQ ID NO: 3127462 - DNA, 23 bp, Homo sapiens
taccctcgggcccacctggccac

SEQ ID NO: 3127463 - DNA, 16 bp, Homo sapiens
taccctctcagctcca

SEQ ID NO: 3127464 - DNA, 17 bp, Homo sapiens
taccctctcagctccag

SEQ ID NO: 3127465 - DNA, 20 bp, Homo sapiens
taccctctcagctccaggtg

SEQ ID NO: 3127466 - DNA, 14 bp, Homo sapiens
taccctctggaggg

SEQ ID NO: 3127467 - DNA, 22 bp, Homo sapiens
taccctctggaggggtgtggct

SEQ ID NO: 3127468 - DNA, 17 bp, Homo sapiens
taccctgagttcatcca

SEQ ID NO: 3127469 - DNA, 15 bp, Homo sapiens
taccctgctccctgc

SEQ ID NO: 3127470 - DNA, 20 bp, Homo sapiens
taccctggcactataatgta

SEQ ID NO: 3127471 - DNA, 22 bp, Homo sapiens
taccctggcactataatgtaag

SEQ ID NO: 3127472 - DNA, 18 bp, Homo sapiens
taccctggccgccccctg

SEQ ID NO: 3127473 - DNA, 22 bp, Homo sapiens
tacccttcccgcctccctctca

SEQ ID NO: 3127474 - DNA, 16 bp, Homo sapiens
tacccttccctgcact

SEQ ID NO: 3127475 - DNA, 17 bp, Homo sapiens
taccctttatagaacat

SEQ ID NO: 3127476 - DNA, 18 bp, Homo sapiens
taccctttgctggaagaa

SEQ ID NO: 3127477 - DNA, 21 bp, Homo sapiens
tacccttttcctttgtggttt

SEQ ID NO: 3127478 - DNA, 17 bp, Homo sapiens
taccctttttctccagc

SEQ ID NO: 3127479 - DNA, 18 bp, Homo sapiens
taccctttttctccagct

SEQ ID NO: 3127480 - DNA, 19 bp, Homo sapiens
taccctttttctccagctg

SEQ ID NO: 3127481 - DNA, 18 bp, Homo sapiens
taccgaaaccttgccttt

SEQ ID NO: 3127482 - DNA, 21 bp, Homo sapiens
taccgagtctcttctccactg

SEQ ID NO: 3127483 - DNA, 22 bp, Homo sapiens
taccgagtctcttctccactgg

SEQ ID NO: 3127484 - DNA, 19 bp, Homo sapiens
tacctaaaaggaaatctca

SEQ ID NO: 3127485 - DNA, 22 bp, Homo sapiens
tacctaaaaggaaatctcaccc

SEQ ID NO: 3127486 - DNA, 14 bp, Homo sapiens
tacctaaacagata

SEQ ID NO: 3127487 - DNA, 22 bp, Homo sapiens
tacctaaacagatataaatggc

SEQ ID NO: 3127488 - DNA, 16 bp, Homo sapiens
tacctaagtactgtaa

SEQ ID NO: 3127489 - DNA, 17 bp, Homo sapiens
tacctaagtactgtaat

SEQ ID NO: 3127490 - DNA, 20 bp, Homo sapiens
tacctaagtgacatttgtag

SEQ ID NO: 3127491 - DNA, 18 bp, Homo sapiens
tacctaatccaaatatca

SEQ ID NO: 3127492 - DNA, 22 bp, Homo sapiens
tacctacataggcaaattggaa

SEQ ID NO: 3127493 - DNA, 16 bp, Homo sapiens
tacctaccacagtgtc

SEQ ID NO: 3127494 - DNA, 16 bp, Homo sapiens
tacctagatttacagc

SEQ ID NO: 3127495 - DNA, 23 bp, Homo sapiens
tacctataatgtgtgtatgtgta

SEQ ID NO: 3127496 - DNA, 21 bp, Homo sapiens
tacctatggaagtggttctat

SEQ ID NO: 3127497 - DNA, 19 bp, Homo sapiens
tacctcaaatgaattcttt

SEQ ID NO: 3127498 - DNA, 21 bp, Homo sapiens
tacctcaagccccatttcctc

SEQ ID NO: 3127499 - DNA, 22 bp, Homo sapiens
tacctcaagccccatttcctca

SEQ ID NO: 3127500 - DNA, 19 bp, Homo sapiens
tacctcactactacatctg

SEQ ID NO: 3127501 - DNA, 11 bp, Homo sapiens
tacctcagcct

SEQ ID NO: 3127502 - DNA, 16 bp, Homo sapiens
tacctcagcctagacc

SEQ ID NO: 3127503 - DNA, 16 bp, Homo sapiens
tacctcaggcagctca

SEQ ID NO: 3127504 - DNA, 18 bp, Homo sapiens
tacctcaggcagctcaag

SEQ ID NO: 3127505 - DNA, 14 bp, Homo sapiens
tacctcaggcagga

SEQ ID NO: 3127506 - DNA, 21 bp, Homo sapiens
tacctcagtggatcttcagaa

SEQ ID NO: 3127507 - DNA, 19 bp, Homo sapiens
tacctcatgtttatgaaaa

SEQ ID NO: 3127508 - DNA, 15 bp, Homo sapiens
tacctccaagcaagt

SEQ ID NO: 3127509 - DNA, 21 bp, Homo sapiens
tacctccctccccgtctcatt

SEQ ID NO: 3127510 - DNA, 15 bp, Homo sapiens
tacctcctctcagtg

SEQ ID NO: 3127511 - DNA, 13 bp, Homo sapiens
tacctcgcagtgt

SEQ ID NO: 3127512 - DNA, 12 bp, Homo sapiens
tacctctctgtc

SEQ ID NO: 3127513 - DNA, 21 bp, Homo sapiens
tacctctctgtcccttgctgt

SEQ ID NO: 3127514 - DNA, 23 bp, Homo sapiens
tacctctcttatagaatatttat

SEQ ID NO: 3127515 - DNA, 17 bp, Homo sapiens
tacctctgagaagacac

SEQ ID NO: 3127516 - DNA, 15 bp, Homo sapiens
tacctctgatacctc

SEQ ID NO: 3127517 - DNA, 17 bp, Homo sapiens
tacctctgatacctcaa

SEQ ID NO: 3127518 - DNA, 16 bp, Homo sapiens
tacctctgctgggatg

SEQ ID NO: 3127519 - DNA, 14 bp, Homo sapiens
tacctctgtgtgct

SEQ ID NO: 3127520 - DNA, 13 bp, Homo sapiens
tactttgccattt

SEQ ID NO: 3127521 - DNA, 14 bp, Homo sapiens
tactttgccatttt

SEQ ID NO: 3127522 - DNA, 16 bp, Homo sapiens
tactttgccatttttc

SEQ ID NO: 3127523 - DNA, 17 bp, Homo sapiens
tactttggctacaaata

SEQ ID NO: 3127524 - DNA, 20 bp, Homo sapiens
tactttggtagctgggaaag

SEQ ID NO: 3127525 - DNA, 23 bp, Homo sapiens
tactttggtagctgggaaagcat

SEQ ID NO: 3127526 - DNA, 18 bp, Homo sapiens
tactttggtttctgtctg

SEQ ID NO: 3127527 - DNA, 11 bp, Homo sapiens
tactttgtaat

SEQ ID NO: 3127528 - DNA, 20 bp, Homo sapiens
tactttgtaatttttgggga

SEQ ID NO: 3127529 - DNA, 21 bp, Homo sapiens
tactttgtaatttttggggaa

SEQ ID NO: 3127530 - DNA, 16 bp, Homo sapiens
tactttgtattttgat

SEQ ID NO: 3127531 - DNA, 11 bp, Homo sapiens
tactttgtcag

SEQ ID NO: 3127532 - DNA, 14 bp, Homo sapiens
tactttgtctgaaa

SEQ ID NO: 3127533 - DNA, 21 bp, Homo sapiens
tacttttaaaaaatactctgc

SEQ ID NO: 3127534 - DNA, 15 bp, Homo sapiens
tacttttaaactgtg

SEQ ID NO: 3127535 - DNA, 12 bp, Homo sapiens
tacttttaaatt

SEQ ID NO: 3127536 - DNA, 17 bp, Homo sapiens
tacttttaccactattt

SEQ ID NO: 3127537 - DNA, 19 bp, Homo sapiens
tacttttatgatgtatatt

SEQ ID NO: 3127538 - DNA, 16 bp, Homo sapiens
tacttttcattctctt

SEQ ID NO: 3127539 - DNA, 16 bp, Homo sapiens
tacttttcccctgtta

SEQ ID NO: 3127540 - DNA, 17 bp, Homo sapiens
tacttttcccctgttaa

SEQ ID NO: 3127541 - DNA, 22 bp, Homo sapiens
tacttttcctgggtttcctgca

SEQ ID NO: 3127542 - DNA, 16 bp, Homo sapiens
tacttttgcaaactgt

SEQ ID NO: 3127543 - DNA, 19 bp, Homo sapiens
tacttttgcaaactgtcct

SEQ ID NO: 3127544 - DNA, 19 bp, Homo sapiens
tacttttgttgtatgggat

SEQ ID NO: 3127545 - DNA, 17 bp, Homo sapiens
tactttttcttgtattc

SEQ ID NO: 3127546 - DNA, 19 bp, Homo sapiens
tactttttgaggggttctt

SEQ ID NO: 3127547 - DNA, 19 bp, Homo sapiens
tacttttttacactgataa

SEQ ID NO: 3127548 - DNA, 13 bp, Homo sapiens
tagaaaactgaaa

SEQ ID NO: 3127549 - DNA, 16 bp, Homo sapiens
tagaaaactgaaaatc

SEQ ID NO: 3127550 - DNA, 22 bp, Homo sapiens
tagaaaactgaaaatctaatat

SEQ ID NO: 3127551 - DNA, 22 bp, Homo sapiens
tagaaaagcagtcccattcata

SEQ ID NO: 3127552 - DNA, 17 bp, Homo sapiens
tagaaaaggcgtgcagt

SEQ ID NO: 3127553 - DNA, 21 bp, Homo sapiens
tagaaaaggctaggtacacag

SEQ ID NO: 3127554 - DNA, 16 bp, Homo sapiens
tagaaaagtagacaat

SEQ ID NO: 3127555 - DNA, 17 bp, Homo sapiens
tagaaaagttgcagatg

SEQ ID NO: 3127556 - DNA, 21 bp, Homo sapiens
tagaaaagttgcagatgtatt

SEQ ID NO: 3127557 - DNA, 16 bp, Homo sapiens
tagaaaatattctcta

SEQ ID NO: 3127558 - DNA, 12 bp, Homo sapiens
tagaaaatggtc

SEQ ID NO: 3127559 - DNA, 23 bp, Homo sapiens
tagaaaatttagccctttaaaac

SEQ ID NO: 3127560 - DNA, 16 bp, Homo sapiens
tagaaaatttgcttta

SEQ ID NO: 3127561 - DNA, 17 bp, Homo sapiens
tagaaacaaacatctaa

SEQ ID NO: 3127562 - DNA, 14 bp, Homo sapiens
tagaaacatgacac

SEQ ID NO: 3127563 - DNA, 17 bp, Homo sapiens
tagaaacatgacactga

SEQ ID NO: 3127564 - DNA, 15 bp, Homo sapiens
tagaaacccaagctc

SEQ ID NO: 3127565 - DNA, 18 bp, Homo sapiens
tagaaacccaagctcctc

SEQ ID NO: 3127566 - DNA, 14 bp, Homo sapiens
tagaaaccttaata

SEQ ID NO: 3127567 - DNA, 16 bp, Homo sapiens
tagaaactgatttctt

SEQ ID NO: 3127568 - DNA, 19 bp, Homo sapiens
tagaaagaaaagaccctga

SEQ ID NO: 3127569 - DNA, 20 bp, Homo sapiens
tagaaagaaaagaccctgag

SEQ ID NO: 3127570 - DNA, 14 bp, Homo sapiens
tagaaagaagccca

SEQ ID NO: 3127571 - DNA, 16 bp, Homo sapiens
tagaaagagaaacagt

SEQ ID NO: 3127572 - DNA, 17 bp, Homo sapiens
tagaaagagatacagag

SEQ ID NO: 3127573 - DNA, 23 bp, Homo sapiens
tagaaagcctgttcccctcactg

SEQ ID NO: 3127574 - DNA, 20 bp, Homo sapiens
tagaaagctggcaacatgaa

SEQ ID NO: 3127575 - DNA, 18 bp, Homo sapiens
tagaaagcttgaaaagat

SEQ ID NO: 3127576 - DNA, 22 bp, Homo sapiens
tagaaagttctgtgtaaacaga

SEQ ID NO: 3127577 - DNA, 21 bp, Homo sapiens
tagaaataaaagtgaatgaaa

SEQ ID NO: 3127578 - DNA, 23 bp, Homo sapiens
tagaaataaaagtgaatgaaaga

SEQ ID NO: 3127579 - DNA, 23 bp, Homo sapiens
tagaaatacccaacgcacaaatg

SEQ ID NO: 3127580 - DNA, 18 bp, Homo sapiens
tagaaatgaccaatatta

SEQ ID NO: 3127581 - DNA, 20 bp, Homo sapiens
tagaaatgcggtctggtctc

SEQ ID NO: 3127582 - DNA, 15 bp, Homo sapiens
tagaaatgtaaactg

SEQ ID NO: 3127583 - DNA, 18 bp, Homo sapiens
tagaaatgtaaactgcca

SEQ ID NO: 3127584 - DNA, 15 bp, Homo sapiens
tagaaatgtgaatga

SEQ ID NO: 3127585 - DNA, 12 bp, Homo sapiens
tagaaatgttta

SEQ ID NO: 3127586 - DNA, 19 bp, Homo sapiens
tagaaattacacccaaaga

SEQ ID NO: 3127587 - DNA, 13 bp, Homo sapiens
tagaaattcttaa

SEQ ID NO: 3127588 - DNA, 13 bp, Homo sapiens
tagaaattcttca

SEQ ID NO: 3127589 - DNA, 19 bp, Homo sapiens
tagaaatttttcagatgct

SEQ ID NO: 3127590 - DNA, 15 bp, Homo sapiens
tagaacactaattca

SEQ ID NO: 3127591 - DNA, 17 bp, Homo sapiens
tagaacactattttcag

SEQ ID NO: 3127592 - DNA, 20 bp, Homo sapiens
tagaacactattttcagaat

SEQ ID NO: 3127593 - DNA, 21 bp, Homo sapiens
tagaacactattttcagaatc

SEQ ID NO: 3127594 - DNA, 20 bp, Homo sapiens
tagaacagtggaaactatgt

SEQ ID NO: 3127595 - DNA, 23 bp, Homo sapiens
tagaaccaccaaaattatagctt

SEQ ID NO: 3127596 - DNA, 15 bp, Homo sapiens
tagaacctgggctgt

SEQ ID NO: 3127597 - DNA, 18 bp, Homo sapiens
tagaactcactctgggct

SEQ ID NO: 3127598 - DNA, 20 bp, Homo sapiens
tagaactcactctgggctgt

SEQ ID NO: 3127599 - DNA, 19 bp, Homo sapiens
tagaactccaggccctcct

SEQ ID NO: 3127600 - DNA, 18 bp, Homo sapiens
tagaactgggtaaatgca

SEQ ID NO: 3127601 - DNA, 19 bp, Homo sapiens
tagaactgtatgtcagaca

SEQ ID NO: 3127602 - DNA, 20 bp, Homo sapiens
tagaactgtatgtcagacat

SEQ ID NO: 3127603 - DNA, 18 bp, Homo sapiens
tagaacttactattcatt

SEQ ID NO: 3127604 - DNA, 21 bp, Homo sapiens
tagaacttgcagctgatgttg

SEQ ID NO: 3127605 - DNA, 21 bp, Homo sapiens
tagattccattggtccaagat

SEQ ID NO: 3127606 - DNA, 22 bp, Homo sapiens
tagattcctcttgcctctctca

SEQ ID NO: 3127607 - DNA, 15 bp, Homo sapiens
tagattctaaagatt

SEQ ID NO: 3127608 - DNA, 18 bp, Homo sapiens
tagattctaaagattcta

SEQ ID NO: 3127609 - DNA, 23 bp, Homo sapiens
tagattctctggctgtaaggctc

SEQ ID NO: 3127610 - DNA, 20 bp, Homo sapiens
tagattctctgtgtctaaga

SEQ ID NO: 3127611 - DNA, 22 bp, Homo sapiens
tagattgactaactcaaataca

SEQ ID NO: 3127612 - DNA, 23 bp, Homo sapiens
tagattgcagaaaattctgtgcc

SEQ ID NO: 3127613 - DNA, 19 bp, Homo sapiens
tagatttaccctttataga

SEQ ID NO: 3127614 - DNA, 11 bp, Homo sapiens
tagatttatgg

SEQ ID NO: 3127615 - DNA, 21 bp, Homo sapiens
tagatttatttttcagttcca

SEQ ID NO: 3127616 - DNA, 20 bp, Homo sapiens
tagatttcatagttcagaat

SEQ ID NO: 3127617 - DNA, 23 bp, Homo sapiens
tagatttcatagttcagaattta

SEQ ID NO: 3127618 - DNA, 16 bp, Homo sapiens
tagatttggcatctcc

SEQ ID NO: 3127619 - DNA, 17 bp, Homo sapiens
tagatttgtccttttat

SEQ ID NO: 3127620 - DNA, 18 bp, Homo sapiens
tagattttaatttatttg

SEQ ID NO: 3127621 - DNA, 18 bp, Homo sapiens
tagattttagcatgatga

SEQ ID NO: 3127622 - DNA, 12 bp, Homo sapiens
tagattttccaa

SEQ ID NO: 3127623 - DNA, 13 bp, Homo sapiens
tagattttccaaa

SEQ ID NO: 3127624 - DNA, 21 bp, Homo sapiens
tagattttctggttctaacat

SEQ ID NO: 3127625 - DNA, 12 bp, Homo sapiens
tagcaaacagag

SEQ ID NO: 3127626 - DNA, 18 bp, Homo sapiens
tagcaacaacaattggta

SEQ ID NO: 3127627 - DNA, 19 bp, Homo sapiens
tagcaacaacaattggtaa

SEQ ID NO: 3127628 - DNA, 12 bp, Homo sapiens
tagcaacaggaa

SEQ ID NO: 3127629 - DNA, 17 bp, Homo sapiens
tagcaacttttgtgtaa

SEQ ID NO: 3127630 - DNA, 19 bp, Homo sapiens
tagcaaggtcatttcttca

SEQ ID NO: 3127631 - DNA, 23 bp, Homo sapiens
tagcaaggtttggtgcaaagtat

SEQ ID NO: 3127632 - DNA, 17 bp, Homo sapiens
tagcacacttttccaca

SEQ ID NO: 3127633 - DNA, 15 bp, Homo sapiens
tagcacagattttaa

SEQ ID NO: 3127634 - DNA, 16 bp, Homo sapiens
tagcacagattttaat

SEQ ID NO: 3127635 - DNA, 22 bp, Homo sapiens
tagcacagtggacagtctttga

SEQ ID NO: 3127636 - DNA, 16 bp, Homo sapiens
tagcacgtttaaagtt

SEQ ID NO: 3127637 - DNA, 11 bp, Homo sapiens
tagcactgttg

SEQ ID NO: 3127638 - DNA, 17 bp, Homo sapiens
tagcactgttgatgtat

SEQ ID NO: 3127639 - DNA, 18 bp, Homo sapiens
tagcactgttgatgtatc

SEQ ID NO: 3127640 - DNA, 20 bp, Homo sapiens
tagcactgttgatgtatctg

SEQ ID NO: 3127641 - DNA, 23 bp, Homo sapiens
tagcactgttgatgtatctgagt

SEQ ID NO: 3127642 - DNA, 17 bp, Homo sapiens
tagcacttatgttactg

SEQ ID NO: 3127643 - DNA, 23 bp, Homo sapiens
tagcactttcattgccagtgtct

SEQ ID NO: 3127644 - DNA, 19 bp, Homo sapiens
tagcactttgaaatacctc

SEQ ID NO: 3127645 - DNA, 20 bp, Homo sapiens
tagcactttgaaatacctca

SEQ ID NO: 3127646 - DNA, 19 bp, Homo sapiens
tagcagacagaaactggat

SEQ ID NO: 3127647 - DNA, 20 bp, Homo sapiens
tagcagacagaaactggatt

SEQ ID NO: 3127648 - DNA, 19 bp, Homo sapiens
tagcagaggggccaggccc

SEQ ID NO: 3127649 - DNA, 21 bp, Homo sapiens
tagcagaggggccaggcccag

SEQ ID NO: 3127650 - DNA, 22 bp, Homo sapiens
tagcagaggggccaggcccagg

SEQ ID NO: 3127651 - DNA, 23 bp, Homo sapiens
tagcagaggggccaggcccaggc

SEQ ID NO: 3127652 - DNA, 22 bp, Homo sapiens
tagcagaggggtaagagaggat

SEQ ID NO: 3127653 - DNA, 20 bp, Homo sapiens
tagcagcagcctttaatgca

SEQ ID NO: 3127654 - DNA, 22 bp, Homo sapiens
tagcagccccgggagggcggca

SEQ ID NO: 3127655 - DNA, 13 bp, Homo sapiens
tagcagcctttct

SEQ ID NO: 3127656 - DNA, 14 bp, Homo sapiens
tagcagcttccaga

SEQ ID NO: 3127657 - DNA, 19 bp, Homo sapiens
tagcagggaaggtgaagat

SEQ ID NO: 3127658 - DNA, 18 bp, Homo sapiens
tagcagtcgcgagcacat

SEQ ID NO: 3127659 - DNA, 20 bp, Homo sapiens
tagcagtgtctgtaaaagag

SEQ ID NO: 3127660 - DNA, 20 bp, Homo sapiens
tagcagttataacagatgtg

SEQ ID NO: 3127661 - DNA, 20 bp, Homo sapiens
tagcataaataaaactgaat

SEQ ID NO: 3127662 - DNA, 20 bp, Homo sapiens
tagcataattttgtgttgta

SEQ ID NO: 3127663 - DNA, 19 bp, Homo sapiens
tagcatagcttattattga

SEQ ID NO: 3127664 - DNA, 18 bp, Homo sapiens
tagcatgcacaaagtgta

SEQ ID NO: 3127665 - DNA, 19 bp, Homo sapiens
tagcatgcacaaagtgtat

SEQ ID NO: 3127666 - DNA, 16 bp, Homo sapiens
tagcatgtttgctgaa

SEQ ID NO: 3127667 - DNA, 22 bp, Homo sapiens
tagcattatgcaattaggtttt

SEQ ID NO: 3127668 - DNA, 17 bp, Homo sapiens
tagcattctttggagtt

SEQ ID NO: 3127669 - DNA, 17 bp, Homo sapiens
tagcattgataatcttc

SEQ ID NO: 3127670 - DNA, 16 bp, Homo sapiens
tagcattgccaatatc

SEQ ID NO: 3127671 - DNA, 24 bp, Homo sapiens
tagcattgtaaaattatttcatga

SEQ ID NO: 3127672 - DNA, 12 bp, Homo sapiens
tagcatttcttg

SEQ ID NO: 3127673 - DNA, 16 bp, Homo sapiens
tagcatttcttgatgt

SEQ ID NO: 3127674 - DNA, 14 bp, Homo sapiens
tagcatttttgatt

SEQ ID NO: 3127675 - DNA, 20 bp, Homo sapiens
tagccaaaaatgtctaaaag

SEQ ID NO: 3127676 - DNA, 16 bp, Homo sapiens
tagccaaacccttgtc

SEQ ID NO: 3127677 - DNA, 19 bp, Homo sapiens
tagccaactgtttccctgc

SEQ ID NO: 3127678 - DNA, 23 bp, Homo sapiens
tagccaactgtttccctgctgaa

SEQ ID NO: 3127679 - DNA, 21 bp, Homo sapiens
tagccacaaatgccttgaact

SEQ ID NO: 3127680 - DNA, 15 bp, Homo sapiens
tagacaactagattt

SEQ ID NO: 3127681 - DNA, 17 bp, Homo sapiens
tagacaactagatttgt

SEQ ID NO: 3127682 - DNA, 18 bp, Homo sapiens
tagacaactcttccattt

SEQ ID NO: 3127683 - DNA, 18 bp, Homo sapiens
tagacaccaaagttctaa

SEQ ID NO: 3127684 - DNA, 18 bp, Homo sapiens
tagacacccattttcaca

SEQ ID NO: 3127685 - DNA, 21 bp, Homo sapiens
tagacactccccgaagtcttt

SEQ ID NO: 3127686 - DNA, 21 bp, Homo sapiens
tagacagagtctcactgttgc

SEQ ID NO: 3127687 - DNA, 18 bp, Homo sapiens
tagacagtctcactttgt

SEQ ID NO: 3127688 - DNA, 17 bp, Homo sapiens
tagacatggaggttcta

SEQ ID NO: 3127689 - DNA, 19 bp, Homo sapiens
tagacatggaggttctaag

SEQ ID NO: 3127690 - DNA, 12 bp, Homo sapiens
tagacatgtcat

SEQ ID NO: 3127691 - DNA, 16 bp, Homo sapiens
tagacattctgtcgcc

SEQ ID NO: 3127692 - DNA, 14 bp, Homo sapiens
tagaccaaaataaa

SEQ ID NO: 3127693 - DNA, 13 bp, Homo sapiens
tagaccaaggaac

SEQ ID NO: 3127694 - DNA, 16 bp, Homo sapiens
tagaccaggatttcta

SEQ ID NO: 3127695 - DNA, 23 bp, Homo sapiens
tagaccatttatctgggattatg

SEQ ID NO: 3127696 - DNA, 19 bp, Homo sapiens
tagacccatgctggtcaga

SEQ ID NO: 3127697 - DNA, 16 bp, Homo sapiens
tagaccctcgggcccc

SEQ ID NO: 3127698 - DNA, 23 bp, Homo sapiens
tagaccgctctcttttctgtact

SEQ ID NO: 3127699 - DNA, 21 bp, Homo sapiens
tagacctataatccttgataa

SEQ ID NO: 3127700 - DNA, 19 bp, Homo sapiens
tagaccttgttacttctga

SEQ ID NO: 3127701 - DNA, 16 bp, Homo sapiens
tagacgccttccaggt

SEQ ID NO: 3127702 - DNA, 17 bp, Homo sapiens
tagactagtcctatgga

SEQ ID NO: 3127703 - DNA, 14 bp, Homo sapiens
tagactataaatgt

SEQ ID NO: 3127704 - DNA, 22 bp, Homo sapiens
tagactataaatgttgctatgt

SEQ ID NO: 3127705 - DNA, 13 bp, Homo sapiens
tagactatataca

SEQ ID NO: 3127706 - DNA, 17 bp, Homo sapiens
tagactctgtctacctg

SEQ ID NO: 3127707 - DNA, 16 bp, Homo sapiens
tagactcttcactgtt

SEQ ID NO: 3127708 - DNA, 21 bp, Homo sapiens
tagactgaggtataaagacaa

SEQ ID NO: 3127709 - DNA, 15 bp, Homo sapiens
tagactgatgtttta

SEQ ID NO: 3127710 - DNA, 20 bp, Homo sapiens
tagactgatgttttagcatt

SEQ ID NO: 3127711 - DNA, 17 bp, Homo sapiens
tagactgcctgggttcc

SEQ ID NO: 3127712 - DNA, 18 bp, Homo sapiens
tagacttcgactcaggat

SEQ ID NO: 3127713 - DNA, 22 bp, Homo sapiens
tagacttcgactcaggatccag

SEQ ID NO: 3127714 - DNA, 14 bp, Homo sapiens
tagacttctggttg

SEQ ID NO: 3127715 - DNA, 20 bp, Homo sapiens
tagacttgaaagttttccag

SEQ ID NO: 3127716 - DNA, 18 bp, Homo sapiens
tagacttgtgctgatcgt

SEQ ID NO: 3127717 - DNA, 13 bp, Homo sapiens
tagagaaaagtgt

SEQ ID NO: 3127718 - DNA, 15 bp, Homo sapiens
tagagaaaagtgtat

SEQ ID NO: 3127719 - DNA, 19 bp, Homo sapiens
tagagaaaccgtcctcttt

SEQ ID NO: 3127720 - DNA, 22 bp, Homo sapiens
tagagaaaccgtcctctttttc

SEQ ID NO: 3127721 - DNA, 14 bp, Homo sapiens
tagagaagctgaaa

SEQ ID NO: 3127722 - DNA, 22 bp, Homo sapiens
tagagaaggacccggaggggcc

SEQ ID NO: 3127723 - DNA, 15 bp, Homo sapiens
tagagacagaagcag

SEQ ID NO: 3127724 - DNA, 21 bp, Homo sapiens
tagagacagaagcaggctgga

SEQ ID NO: 3127725 - DNA, 15 bp, Homo sapiens
tagagacccccaggc

SEQ ID NO: 3127726 - DNA, 19 bp, Homo sapiens
tagagactgtagattgctt

SEQ ID NO: 3127727 - DNA, 22 bp, Homo sapiens
tagagaggacaatactggggtt

SEQ ID NO: 3127728 - DNA, 19 bp, Homo sapiens
tagagaggggactggggga

SEQ ID NO: 3127729 - DNA, 15 bp, Homo sapiens
tagagagggggctct

SEQ ID NO: 3127730 - DNA, 18 bp, Homo sapiens
tagagatctggttttgct

SEQ ID NO: 3127731 - DNA, 15 bp, Homo sapiens
tagagatttgtctaa

SEQ ID NO: 3127732 - DNA, 13 bp, Homo sapiens
tagagcatatttg

SEQ ID NO: 3127733 - DNA, 12 bp, Homo sapiens
tagaggaaaagg

SEQ ID NO: 3127734 - DNA, 21 bp, Homo sapiens
tagaggaaggctgaactcttc

SEQ ID NO: 3127735 - DNA, 19 bp, Homo sapiens
tagaggcagggaggggact

SEQ ID NO: 3127736 - DNA, 23 bp, Homo sapiens
tagaggcattacttgctttcaat

SEQ ID NO: 3127737 - DNA, 18 bp, Homo sapiens
tagaggccagccccaccc

SEQ ID NO: 3127738 - DNA, 14 bp, Homo sapiens
tagaggcctggggc

SEQ ID NO: 3127739 - DNA, 19 bp, Homo sapiens
tagaggctccccagggctc

SEQ ID NO: 3127740 - DNA, 23 bp, Homo sapiens
tagaggctccccagggctccctt

SEQ ID NO: 3127741 - DNA, 21 bp, Homo sapiens
tagaggcttctccgccagcct

SEQ ID NO: 3127742 - DNA, 22 bp, Homo sapiens
tagaggcttctccgccagcctc

SEQ ID NO: 3127743 - DNA, 17 bp, Homo sapiens
tagaggtcctctggagc

SEQ ID NO: 3127744 - DNA, 16 bp, Homo sapiens
tagaggttttgttgtt

SEQ ID NO: 3127745 - DNA, 17 bp, Homo sapiens
tagagtaaataaactgt

SEQ ID NO: 3127746 - DNA, 21 bp, Homo sapiens
tagagtcatctccatcagctg

SEQ ID NO: 3127747 - DNA, 22 bp, Homo sapiens
tagagtcatctccatcagctgt

SEQ ID NO: 3127748 - DNA, 23 bp, Homo sapiens
tagagtcatctccatcagctgta

SEQ ID NO: 3127749 - DNA, 13 bp, Homo sapiens
tagagtccaaggt

SEQ ID NO: 3127750 - DNA, 13 bp, Homo sapiens
tagagtcctcact

SEQ ID NO: 3127751 - DNA, 20 bp, Homo sapiens
tagagtcctcactcccagtc

SEQ ID NO: 3127752 - DNA, 22 bp, Homo sapiens
tagagtctcagaaactcccctg

SEQ ID NO: 3127753 - DNA, 17 bp, Homo sapiens
tagagtgtagactgtgg

SEQ ID NO: 3127754 - DNA, 11 bp, Homo sapiens
tagagtgtagc

SEQ ID NO: 3127755 - DNA, 23 bp, Homo sapiens
tagagtgtagcctaaagggcagg

SEQ ID NO: 3127756 - DNA, 20 bp, Homo sapiens
tagagtgtagctgtaagggc

SEQ ID NO: 3127757 - DNA, 22 bp, Homo sapiens
tagagtgtagctgtaagggcag

SEQ ID NO: 3127758 - DNA, 12 bp, Homo sapiens
tagagttaagaa

SEQ ID NO: 3127759 - DNA, 12 bp, Homo sapiens
tagctacatcag

SEQ ID NO: 3127760 - DNA, 23 bp, Homo sapiens
tagctacctacatgctgaaaaat

SEQ ID NO: 3127761 - DNA, 15 bp, Homo sapiens
tagctatcagaagac

SEQ ID NO: 3127762 - DNA, 21 bp, Homo sapiens
tagctatcagaagaccacaaa

SEQ ID NO: 3127763 - DNA, 17 bp, Homo sapiens
tagctattaagatactt

SEQ ID NO: 3127764 - DNA, 18 bp, Homo sapiens
tagctcaagtttaaaagc

SEQ ID NO: 3127765 - DNA, 20 bp, Homo sapiens
tagctcaagtttaaaagcca

SEQ ID NO: 3127766 - DNA, 12 bp, Homo sapiens
tagctcagttta

SEQ ID NO: 3127767 - DNA, 19 bp, Homo sapiens
tagctcctccccttcctct

SEQ ID NO: 3127768 - DNA, 13 bp, Homo sapiens
tagctcctgtggc

SEQ ID NO: 3127769 - DNA, 20 bp, Homo sapiens
tagctcctgtggccccaccc

SEQ ID NO: 3127770 - DNA, 22 bp, Homo sapiens
tagctcctgtggccccaccctg

SEQ ID NO: 3127771 - DNA, 13 bp, Homo sapiens
tagctctctaggc

SEQ ID NO: 3127772 - DNA, 14 bp, Homo sapiens
tagctctgcctccc

SEQ ID NO: 3127773 - DNA, 21 bp, Homo sapiens
tagctgaagaattgaaaagtt

SEQ ID NO: 3127774 - DNA, 23 bp, Homo sapiens
tagctgacccagccccttgagaa

SEQ ID NO: 3127775 - DNA, 21 bp, Homo sapiens
tagctgatgaacttattctgt

SEQ ID NO: 3127776 - DNA, 15 bp, Homo sapiens
tagctgcaaaaataa

SEQ ID NO: 3127777 - DNA, 22 bp, Homo sapiens
tagctgctctgagcatcaagaa

SEQ ID NO: 3127778 - DNA, 19 bp, Homo sapiens
tagctggatataatgtatt

SEQ ID NO: 3127779 - DNA, 16 bp, Homo sapiens
tagctgggaaagcata

SEQ ID NO: 3127780 - DNA, 21 bp, Homo sapiens
tagctgggactacagatgtgg

SEQ ID NO: 3127781 - DNA, 22 bp, Homo sapiens
tagctgggactacagatgtggg

SEQ ID NO: 3127782 - DNA, 17 bp, Homo sapiens
tagctggtggtttcacg

SEQ ID NO: 3127783 - DNA, 22 bp, Homo sapiens
tagctggttaaccttgaagtga

SEQ ID NO: 3127784 - DNA, 20 bp, Homo sapiens
tagctgtaagggcagtgccc

SEQ ID NO: 3127785 - DNA, 16 bp, Homo sapiens
tagctgtactataagt

SEQ ID NO: 3127786 - DNA, 23 bp, Homo sapiens
tagctgtactataagtagttggt

SEQ ID NO: 3127787 - DNA, 21 bp, Homo sapiens
tagctgtatgatttgttttga

SEQ ID NO: 3127788 - DNA, 14 bp, Homo sapiens
tagctgtgggggtg

SEQ ID NO: 3127789 - DNA, 16 bp, Homo sapiens
tagctgttgagctgtt

SEQ ID NO: 3127790 - DNA, 15 bp, Homo sapiens
tagcttagtttcaga

SEQ ID NO: 3127791 - DNA, 15 bp, Homo sapiens
tagcttatctttctt

SEQ ID NO: 3127792 - DNA, 17 bp, Homo sapiens
tagcttatctttctttc

SEQ ID NO: 3127793 - DNA, 15 bp, Homo sapiens
tagcttattattgaa

SEQ ID NO: 3127794 - DNA, 16 bp, Homo sapiens
tagcttccaataaagc

SEQ ID NO: 3127795 - DNA, 21 bp, Homo sapiens
tagcttctaccatgaacagaa

SEQ ID NO: 3127796 - DNA, 22 bp, Homo sapiens
tagcttctgcttttctgccctg

SEQ ID NO: 3127797 - DNA, 13 bp, Homo sapiens
tagctttattctt

SEQ ID NO: 3127798 - DNA, 15 bp, Homo sapiens
tagctttattcttca

SEQ ID NO: 3127799 - DNA, 19 bp, Homo sapiens
tagctttattttttaagta

SEQ ID NO: 3127800 - DNA, 18 bp, Homo sapiens
tagctttccacatttgtc

SEQ ID NO: 3127801 - DNA, 17 bp, Homo sapiens
tagctttccctgtgcca

SEQ ID NO: 3127802 - DNA, 15 bp, Homo sapiens
tagctttgctctttg

SEQ ID NO: 3127803 - DNA, 14 bp, Homo sapiens
tagcttttaggaaa

SEQ ID NO: 3127804 - DNA, 18 bp, Homo sapiens
tagcttttattgtataaa

SEQ ID NO: 3127805 - DNA, 14 bp, Homo sapiens
tagctttttaattg

SEQ ID NO: 3127806 - DNA, 15 bp, Homo sapiens
tagctttttaattgt

SEQ ID NO: 3127807 - DNA, 16 bp, Homo sapiens
tagctttttaattgtt

SEQ ID NO: 3127808 - DNA, 15 bp, Homo sapiens
taggaaaaaaactgg

SEQ ID NO: 3127809 - DNA, 23 bp, Homo sapiens
taggaaaaaaactgggataactg

SEQ ID NO: 3127810 - DNA, 18 bp, Homo sapiens
taggaacaatctttgctg

SEQ ID NO: 3127811 - DNA, 16 bp, Homo sapiens
taggaacatatgaaaa

SEQ ID NO: 3127812 - DNA, 21 bp, Homo sapiens
taggaagaacgcggtgtgtaa

SEQ ID NO: 3127813 - DNA, 18 bp, Homo sapiens
taggaagggaccaaggca

SEQ ID NO: 3127814 - DNA, 17 bp, Homo sapiens
taggaagtgtaacagct

SEQ ID NO: 3127815 - DNA, 20 bp, Homo sapiens
taggaagtgtaacagctgag

SEQ ID NO: 3127816 - DNA, 17 bp, Homo sapiens
taggaatcattcagaaa

SEQ ID NO: 3127817 - DNA, 22 bp, Homo sapiens
taggaatcattcagaaatgttg

SEQ ID NO: 3127818 - DNA, 21 bp, Homo sapiens
taggaatcccagaggtgggat

SEQ ID NO: 3127819 - DNA, 16 bp, Homo sapiens
taggaatgatcataaa

SEQ ID NO: 3127820 - DNA, 15 bp, Homo sapiens
taggaccactcagcc

SEQ ID NO: 3127821 - DNA, 21 bp, Homo sapiens
taggaccactcagcccctagg

SEQ ID NO: 3127822 - DNA, 19 bp, Homo sapiens
taggacctttccaccacag

SEQ ID NO: 3127823 - DNA, 22 bp, Homo sapiens
taggacctttccaccacagcca

SEQ ID NO: 3127824 - DNA, 16 bp, Homo sapiens
taggactctgaggctc

SEQ ID NO: 3127825 - DNA, 18 bp, Homo sapiens
taggactctgaggctctt

SEQ ID NO: 3127826 - DNA, 14 bp, Homo sapiens
taggagaaacacat

SEQ ID NO: 3127827 - DNA, 16 bp, Homo sapiens
taggagacgctgcact

SEQ ID NO: 3127828 - DNA, 16 bp, Homo sapiens
taggagagccaacctc

SEQ ID NO: 3127829 - DNA, 16 bp, Homo sapiens
taggagataccaggtt

SEQ ID NO: 3127830 - DNA, 23 bp, Homo sapiens
taggagctgccttggctcagaca

SEQ ID NO: 3127831 - DNA, 20 bp, Homo sapiens
taggaggaccagagctactg

SEQ ID NO: 3127832 - DNA, 18 bp, Homo sapiens
taggaggctgtgggtttt

SEQ ID NO: 3127833 - DNA, 16 bp, Homo sapiens
taggagggagttatct

SEQ ID NO: 3127834 - DNA, 18 bp, Homo sapiens
taggagggagttatctaa

SEQ ID NO: 3127835 - DNA, 20 bp, Homo sapiens
taggagtgtgtgacattcca

SEQ ID NO: 3127836 - DNA, 20 bp, Homo sapiens
taggatacagaaatgcaaaa

SEQ ID NO: 3127837 - DNA, 12 bp, Homo sapiens
taggatatttga

SEQ ID NO: 3127838 - DNA, 19 bp, Homo sapiens
taggatcagccctcatttt

SEQ ID NO: 3127839 - DNA, 18 bp, Homo sapiens
taggatctgcaaacaatg

SEQ ID NO: 3127840 - DNA, 16 bp, Homo sapiens
taggatggttctgtga

SEQ ID NO: 3127841 - DNA, 12 bp, Homo sapiens
taggattctaaa

SEQ ID NO: 3127842 - DNA, 22 bp, Homo sapiens
taggatttaacagtcatttaaa

SEQ ID NO: 3127843 - DNA, 13 bp, Homo sapiens
taggatttcttaa

SEQ ID NO: 3127844 - DNA, 24 bp, Homo sapiens
taggcaagcaggacctggcatcat

SEQ ID NO: 3127845 - DNA, 16 bp, Homo sapiens
taggcaagtttgttca

SEQ ID NO: 3127846 - DNA, 14 bp, Homo sapiens
taggcacaaggttg

SEQ ID NO: 3127847 - DNA, 19 bp, Homo sapiens
taggcactgtagttctaag

SEQ ID NO: 3127848 - DNA, 17 bp, Homo sapiens
taggcactgttcaatac

SEQ ID NO: 3127849 - DNA, 13 bp, Homo sapiens
taggcagaatgga

SEQ ID NO: 3127850 - DNA, 20 bp, Homo sapiens
taggcagattgaaaaggaca

SEQ ID NO: 3127851 - DNA, 22 bp, Homo sapiens
taggcaggaagcccaattgctg

SEQ ID NO: 3127852 - DNA, 17 bp, Homo sapiens
taggcatctctgtactt

SEQ ID NO: 3127853 - DNA, 23 bp, Homo sapiens
taggcatgaagagcaaaaatatc

SEQ ID NO: 3127854 - DNA, 21 bp, Homo sapiens
taggcatgagggatcacaggg

SEQ ID NO: 3127855 - DNA, 14 bp, Homo sapiens
taggcatgtaaaca

SEQ ID NO: 3127856 - DNA, 18 bp, Homo sapiens
taggcattaacacaaagg

SEQ ID NO: 3127857 - DNA, 19 bp, Homo sapiens
taggcattaatgtttctat

SEQ ID NO: 3127858 - DNA, 21 bp, Homo sapiens
taggccagggcatgtgtatgt

SEQ ID NO: 3127859 - DNA, 18 bp, Homo sapiens
taggccatgggacaggga

SEQ ID NO: 3127860 - DNA, 13 bp, Homo sapiens
taggccccagagg

SEQ ID NO: 3127861 - DNA, 22 bp, Homo sapiens
taggccccagaggccctggagg

SEQ ID NO: 3127862 - DNA, 21 bp, Homo sapiens
taggcccccacttgcctcttc

SEQ ID NO: 3127863 - DNA, 20 bp, Homo sapiens
taggcccttgtcctgccagc

SEQ ID NO: 3127864 - DNA, 22 bp, Homo sapiens
taggcctataaaattaaatgcc

SEQ ID NO: 3127865 - DNA, 23 bp, Homo sapiens
taggcctataaaattaaatgcct

SEQ ID NO: 3127866 - DNA, 13 bp, Homo sapiens
taggcctggccag

SEQ ID NO: 3127867 - DNA, 15 bp, Homo sapiens
taggcctggccagat

SEQ ID NO: 3127868 - DNA, 18 bp, Homo sapiens
taggcctggccagatgca

SEQ ID NO: 3127869 - DNA, 16 bp, Homo sapiens
taggctattaaaaaag

SEQ ID NO: 3127870 - DNA, 15 bp, Homo sapiens
taggctctgcacaga

SEQ ID NO: 3127871 - DNA, 21 bp, Homo sapiens
taggctctgcacagatggatt

SEQ ID NO: 3127872 - DNA, 16 bp, Homo sapiens
taggctcttaagcagc

SEQ ID NO: 3127873 - DNA, 20 bp, Homo sapiens
taggctcttatgtgtgcctt

SEQ ID NO: 3127874 - DNA, 17 bp, Homo sapiens
taggcttatcaaaatct

SEQ ID NO: 3127875 - DNA, 22 bp, Homo sapiens
taggctttcatgttgcaaagaa

SEQ ID NO: 3127876 - DNA, 19 bp, Homo sapiens
taggcttttaccattagca

SEQ ID NO: 3127877 - DNA, 14 bp, Homo sapiens
taggctttttaatc

SEQ ID NO: 3127878 - DNA, 17 bp, Homo sapiens
tagggaaaggttttgta

SEQ ID NO: 3127879 - DNA, 19 bp, Homo sapiens
tagggactacccatagaca

SEQ ID NO: 3127880 - DNA, 16 bp, Homo sapiens
tagggagacagggtag

SEQ ID NO: 3127881 - DNA, 23 bp, Homo sapiens
tagggagacagggtaggaaaggg

SEQ ID NO: 3127882 - DNA, 12 bp, Homo sapiens
tagggagagtca

SEQ ID NO: 3127883 - DNA, 17 bp, Homo sapiens
tagggagagtcatattt

SEQ ID NO: 3127884 - DNA, 17 bp, Homo sapiens
tagggaggcagcctcca

SEQ ID NO: 3127885 - DNA, 18 bp, Homo sapiens
tagggagggcggcagggg

SEQ ID NO: 3127886 - DNA, 18 bp, Homo sapiens
tagggagtacctgctgcc

SEQ ID NO: 3127887 - DNA, 20 bp, Homo sapiens
tatctaatatatatgaataa

SEQ ID NO: 3127888 - DNA, 21 bp, Homo sapiens
tatctaatatatatgaataaa

SEQ ID NO: 3127889 - DNA, 23 bp, Homo sapiens
tatctagtgcagctgattttaac

SEQ ID NO: 3127890 - DNA, 18 bp, Homo sapiens
tatctagttctaacagtg

SEQ ID NO: 3127891 - DNA, 18 bp, Homo sapiens
tatctatacatatcttta

SEQ ID NO: 3127892 - DNA, 20 bp, Homo sapiens
tatctatacatatctttatt

SEQ ID NO: 3127893 - DNA, 15 bp, Homo sapiens
tatctatataaaata

SEQ ID NO: 3127894 - DNA, 23 bp, Homo sapiens
tatctatcttccaaatgcaattt

SEQ ID NO: 3127895 - DNA, 12 bp, Homo sapiens
tatctattaata

SEQ ID NO: 3127896 - DNA, 13 bp, Homo sapiens
tatctattaatat

SEQ ID NO: 3127897 - DNA, 13 bp, Homo sapiens
tatctcagaaagt

SEQ ID NO: 3127898 - DNA, 20 bp, Homo sapiens
tatctcagaaagtgcctgac

SEQ ID NO: 3127899 - DNA, 16 bp, Homo sapiens
tatctcagatgttaaa

SEQ ID NO: 3127900 - DNA, 19 bp, Homo sapiens
tatctcaggaagtccagcc

SEQ ID NO: 3127901 - DNA, 13 bp, Homo sapiens
tatctcatactgt

SEQ ID NO: 3127902 - DNA, 17 bp, Homo sapiens
tatctcatactgtctgg

SEQ ID NO: 3127903 - DNA, 16 bp, Homo sapiens
tatctcctaattgtat

SEQ ID NO: 3127904 - DNA, 14 bp, Homo sapiens
tatctcctgacaga

SEQ ID NO: 3127905 - DNA, 17 bp, Homo sapiens
tatctctatttaatatt

SEQ ID NO: 3127906 - DNA, 16 bp, Homo sapiens
tatctctatttgagaa

SEQ ID NO: 3127907 - DNA, 15 bp, Homo sapiens
tatctctgaagcatg

SEQ ID NO: 3127908 - DNA, 14 bp, Homo sapiens
tatctctgaggcta

SEQ ID NO: 3127909 - DNA, 17 bp, Homo sapiens
tatctctgtgtgcacaa

SEQ ID NO: 3127910 - DNA, 16 bp, Homo sapiens
tatctcttgtgctttt

SEQ ID NO: 3127911 - DNA, 20 bp, Homo sapiens
tatctcttgtgcttttttga

SEQ ID NO: 3127912 - DNA, 21 bp, Homo sapiens
tatctcttttatatttgtagg

SEQ ID NO: 3127913 - DNA, 19 bp, Homo sapiens
tatctgaagagtatccttc

SEQ ID NO: 3127914 - DNA, 13 bp, Homo sapiens
tatctgaggtcac

SEQ ID NO: 3127915 - DNA, 17 bp, Homo sapiens
tatctgagttgccaaga

SEQ ID NO: 3127916 - DNA, 18 bp, Homo sapiens
tatctgagttgccaagac

SEQ ID NO: 3127917 - DNA, 19 bp, Homo sapiens
tatctgagttgccaagaca

SEQ ID NO: 3127918 - DNA, 16 bp, Homo sapiens
tatctgcctggcctgg

SEQ ID NO: 3127919 - DNA, 18 bp, Homo sapiens
tatctgcctggcctggct

SEQ ID NO: 3127920 - DNA, 21 bp, Homo sapiens
tatctgcctggcctggctccc

SEQ ID NO: 3127921 - DNA, 18 bp, Homo sapiens
tatctggacaagccaact

SEQ ID NO: 3127922 - DNA, 12 bp, Homo sapiens
tatctggcactg

SEQ ID NO: 3127923 - DNA, 18 bp, Homo sapiens
tatctggcctaaaatctt

SEQ ID NO: 3127924 - DNA, 19 bp, Homo sapiens
tatctggcctaaaatcttg

SEQ ID NO: 3127925 - DNA, 17 bp, Homo sapiens
tatctgggattattctt

SEQ ID NO: 3127926 - DNA, 16 bp, Homo sapiens
tatctgggcctgggct

SEQ ID NO: 3127927 - DNA, 17 bp, Homo sapiens
tatctggggagctcctg

SEQ ID NO: 3127928 - DNA, 22 bp, Homo sapiens
tatctgggtaagaagaaagcaa

SEQ ID NO: 3127929 - DNA, 15 bp, Homo sapiens
tatctggtgcctcct

SEQ ID NO: 3127930 - DNA, 21 bp, Homo sapiens
tatctgtcatctctctggggc

SEQ ID NO: 3127931 - DNA, 21 bp, Homo sapiens
tatctgtcatttgagcagggc

SEQ ID NO: 3127932 - DNA, 18 bp, Homo sapiens
tatctgtgcgtgaaacac

SEQ ID NO: 3127933 - DNA, 14 bp, Homo sapiens
tatctgttcacttt

SEQ ID NO: 3127934 - DNA, 22 bp, Homo sapiens
tatctgtttcctgacattgtct

SEQ ID NO: 3127935 - DNA, 20 bp, Homo sapiens
tatcttaaagaaacagcttt

SEQ ID NO: 3127936 - DNA, 14 bp, Homo sapiens
tatcttatgttaaa

SEQ ID NO: 3127937 - DNA, 16 bp, Homo sapiens
tatcttcaaactttca

SEQ ID NO: 3127938 - DNA, 20 bp, Homo sapiens
tatagcattgataatcttca

SEQ ID NO: 3127939 - DNA, 22 bp, Homo sapiens
tatagcattgataatcttcagg

SEQ ID NO: 3127940 - DNA, 22 bp, Homo sapiens
tatagccacaaatgccttgaac

SEQ ID NO: 3127941 - DNA, 20 bp, Homo sapiens
tatagcctgcctcagtggca

SEQ ID NO: 3127942 - DNA, 22 bp, Homo sapiens
tatagcctgcctcagtggcagc

SEQ ID NO: 3127943 - DNA, 16 bp, Homo sapiens
tatagctacaggaagc

SEQ ID NO: 3127944 - DNA, 22 bp, Homo sapiens
tatagctacaggaagcacccca

SEQ ID NO: 3127945 - DNA, 14 bp, Homo sapiens
tatagctattactg

SEQ ID NO: 3127946 - DNA, 16 bp, Homo sapiens
tatagcttgaaacata

SEQ ID NO: 3127947 - DNA, 12 bp, Homo sapiens
tataggaaaaaa

SEQ ID NO: 3127948 - DNA, 17 bp, Homo sapiens
tataggtagatccagat

SEQ ID NO: 3127949 - DNA, 22 bp, Homo sapiens
tataggtctcttctcccagaat

SEQ ID NO: 3127950 - DNA, 15 bp, Homo sapiens
tataggttgtgcaaa

SEQ ID NO: 3127951 - DNA, 14 bp, Homo sapiens
tatagtatgtgact

SEQ ID NO: 3127952 - DNA, 13 bp, Homo sapiens
tatagtcatttat

SEQ ID NO: 3127953 - DNA, 20 bp, Homo sapiens
tatagtcccagctactcaga

SEQ ID NO: 3127954 - DNA, 16 bp, Homo sapiens
tatagtctaagactat

SEQ ID NO: 3127955 - DNA, 18 bp, Homo sapiens
tatagtctaagactatat

SEQ ID NO: 3127956 - DNA, 19 bp, Homo sapiens
tatagtctaagactatata

SEQ ID NO: 3127957 - DNA, 20 bp, Homo sapiens
tatagtgctatatatataaa

SEQ ID NO: 3127958 - DNA, 20 bp, Homo sapiens
tatagttaatattttgttct

SEQ ID NO: 3127959 - DNA, 20 bp, Homo sapiens
tatagttactgtgtaattag

SEQ ID NO: 3127960 - DNA, 18 bp, Homo sapiens
tatagttaggatagcatt

SEQ ID NO: 3127961 - DNA, 17 bp, Homo sapiens
tatagttcctaagaagc

SEQ ID NO: 3127962 - DNA, 19 bp, Homo sapiens
tatagtttaaaacacattg

SEQ ID NO: 3127963 - DNA, 14 bp, Homo sapiens
tatagtttctgagg

SEQ ID NO: 3127964 - DNA, 20 bp, Homo sapiens
tatagtttgctttgcttttt

SEQ ID NO: 3127965 - DNA, 15 bp, Homo sapiens
tatagtttgtacatg

SEQ ID NO: 3127966 - DNA, 18 bp, Homo sapiens
tatataaaaagaaaagat

SEQ ID NO: 3127967 - DNA, 20 bp, Homo sapiens
tatataaaaagaaaagataa

SEQ ID NO: 3127968 - DNA, 21 bp, Homo sapiens
tatataaaaatatatatagtg

SEQ ID NO: 3127969 - DNA, 12 bp, Homo sapiens
tatataaaaatg

SEQ ID NO: 3127970 - DNA, 15 bp, Homo sapiens
tatataaaaatggct

SEQ ID NO: 3127971 - DNA, 14 bp, Homo sapiens
tatataaaatatct

SEQ ID NO: 3127972 - DNA, 19 bp, Homo sapiens
tatataaaatatctatatt

SEQ ID NO: 3127973 - DNA, 20 bp, Homo sapiens
tatataaaatatctatattc

SEQ ID NO: 3127974 - DNA, 18 bp, Homo sapiens
tatataaaatgtattcaa

SEQ ID NO: 3127975 - DNA, 21 bp, Homo sapiens
tatataaaatgtattcaagca

SEQ ID NO: 3127976 - DNA, 18 bp, Homo sapiens
tatataaagaatatatat

SEQ ID NO: 3127977 - DNA, 17 bp, Homo sapiens
tatataaagatatatag

SEQ ID NO: 3127978 - DNA, 14 bp, Homo sapiens
tatataaaggtttt

SEQ ID NO: 3127979 - DNA, 19 bp, Homo sapiens
tatataaagtattcttttt

SEQ ID NO: 3127980 - DNA, 18 bp, Homo sapiens
tatataaatgtaaaaata

SEQ ID NO: 3127981 - DNA, 18 bp, Homo sapiens
tatataacagatacattt

SEQ ID NO: 3127982 - DNA, 22 bp, Homo sapiens
tatataaccctaggaatttaga

SEQ ID NO: 3127983 - DNA, 18 bp, Homo sapiens
tatataagttgctgtgtg

SEQ ID NO: 3127984 - DNA, 21 bp, Homo sapiens
tatataattcactcaagcact

SEQ ID NO: 3127985 - DNA, 14 bp, Homo sapiens
tatataattctgta

SEQ ID NO: 3127986 - DNA, 22 bp, Homo sapiens
tatatacagtaactttatgtgt

SEQ ID NO: 3127987 - DNA, 23 bp, Homo sapiens
tatatacagtaactttatgtgta

SEQ ID NO: 3127988 - DNA, 11 bp, Homo sapiens
tatatacagtt

SEQ ID NO: 3127989 - DNA, 13 bp, Homo sapiens
tatatacatatgt

SEQ ID NO: 3127990 - DNA, 15 bp, Homo sapiens
tatatacatatgtag

SEQ ID NO: 3127991 - DNA, 17 bp, Homo sapiens
tatatacatatgtagac

SEQ ID NO: 3127992 - DNA, 15 bp, Homo sapiens
tatatacatgtgtgt

SEQ ID NO: 3127993 - DNA, 14 bp, Homo sapiens
tatatactgaagtg

SEQ ID NO: 3127994 - DNA, 16 bp, Homo sapiens
tatatagagatgtttt

SEQ ID NO: 3127995 - DNA, 16 bp, Homo sapiens
tatattagtgaagatg

SEQ ID NO: 3127996 - DNA, 14 bp, Homo sapiens
tatattataaatat

SEQ ID NO: 3127997 - DNA, 21 bp, Homo sapiens
tatattataaatatatataaa

SEQ ID NO: 3127998 - DNA, 16 bp, Homo sapiens
tatattattatatata

SEQ ID NO: 3127999 - DNA, 17 bp, Homo sapiens
tatattctaattaaaat

SEQ ID NO: 3128000 - DNA, 13 bp, Homo sapiens
tatattgtacaaa

SEQ ID NO: 3128001 - DNA, 17 bp, Homo sapiens
tatattgtacaaatgta

SEQ ID NO: 3128002 - DNA, 22 bp, Homo sapiens
tatattgtacaaatgtaagcaa

SEQ ID NO: 3128003 - DNA, 19 bp, Homo sapiens
tatattgtcagatattttt

SEQ ID NO: 3128004 - DNA, 19 bp, Homo sapiens
tatattgtgtttgtgtatt

SEQ ID NO: 3128005 - DNA, 20 bp, Homo sapiens
tatattgtttttgtatttat

SEQ ID NO: 3128006 - DNA, 16 bp, Homo sapiens
tatatttaaaaaatta

SEQ ID NO: 3128007 - DNA, 14 bp, Homo sapiens
tatatttaaactca

SEQ ID NO: 3128008 - DNA, 17 bp, Homo sapiens
tatatttacaaataaaa

SEQ ID NO: 3128009 - DNA, 16 bp, Homo sapiens
tatatttagttatagt

SEQ ID NO: 3128010 - DNA, 12 bp, Homo sapiens
tatatttataac

SEQ ID NO: 3128011 - DNA, 21 bp, Homo sapiens
tatatttataactcatcataa

SEQ ID NO: 3128012 - DNA, 23 bp, Homo sapiens
tatatttataactcatcataaaa

SEQ ID NO: 3128013 - DNA, 24 bp, Homo sapiens
tatatttataactcatcataaaat

SEQ ID NO: 3128014 - DNA, 22 bp, Homo sapiens
tatatttatttaaagcattgct

SEQ ID NO: 3128015 - DNA, 21 bp, Homo sapiens
tatatttcacttttgttctgc

SEQ ID NO: 3128016 - DNA, 13 bp, Homo sapiens
tatatttctatta

SEQ ID NO: 3128017 - DNA, 13 bp, Homo sapiens
tatatttctcata

SEQ ID NO: 3128018 - DNA, 15 bp, Homo sapiens
tatatttctcataat

SEQ ID NO: 3128019 - DNA, 22 bp, Homo sapiens
tatatttgcagataattctgga

SEQ ID NO: 3128020 - DNA, 14 bp, Homo sapiens
tatatttgcttttt

SEQ ID NO: 3128021 - DNA, 22 bp, Homo sapiens
tatatttgtgatagcactttct

SEQ ID NO: 3128022 - DNA, 12 bp, Homo sapiens
tatattttaata

SEQ ID NO: 3128023 - DNA, 16 bp, Homo sapiens
tatattttcgtatgaa

SEQ ID NO: 3128024 - DNA, 15 bp, Homo sapiens
tatattttgctgttt

SEQ ID NO: 3128025 - DNA, 21 bp, Homo sapiens
tatattttgtgttattcgtga

SEQ ID NO: 3128026 - DNA, 20 bp, Homo sapiens
tatatttttagcctaaatgt

SEQ ID NO: 3128027 - DNA, 20 bp, Homo sapiens
tatatttttatatttagtta

SEQ ID NO: 3128028 - DNA, 22 bp, Homo sapiens
tatatttttatctatataaaat

SEQ ID NO: 3128029 - DNA, 21 bp, Homo sapiens
tatatttttgatggtaagact

SEQ ID NO: 3128030 - DNA, 18 bp, Homo sapiens
tatatttttggttgtcaa

SEQ ID NO: 3128031 - DNA, 19 bp, Homo sapiens
tatatttttggttgtcaat

SEQ ID NO: 3128032 - DNA, 12 bp, Homo sapiens
tatatttttgta

SEQ ID NO: 3128033 - DNA, 17 bp, Homo sapiens
tatatttttgtacatat

SEQ ID NO: 3128034 - DNA, 20 bp, Homo sapiens
tatatttttgtacatattgt

SEQ ID NO: 3128035 - DNA, 21 bp, Homo sapiens
tatatttttgtacatattgtt

SEQ ID NO: 3128036 - DNA, 18 bp, Homo sapiens
tatatttttttaatttaa

SEQ ID NO: 3128037 - DNA, 19 bp, Homo sapiens
tatcaaaactttcttttct

SEQ ID NO: 3128038 - DNA, 19 bp, Homo sapiens
tatcaaaataggatttctt

SEQ ID NO: 3128039 - DNA, 22 bp, Homo sapiens
tatcaaaattgcctttttctct

SEQ ID NO: 3128040 - DNA, 20 bp, Homo sapiens
tatcaaacagccccagtctt

SEQ ID NO: 3128041 - DNA, 23 bp, Homo sapiens
tatcaaaccctagccttgcttgt

SEQ ID NO: 3128042 - DNA, 16 bp, Homo sapiens
tatcaagacatagcat

SEQ ID NO: 3128043 - DNA, 17 bp, Homo sapiens
tatcaagacgtttaact

SEQ ID NO: 3128044 - DNA, 20 bp, Homo sapiens
tatcaagacgtttaactgca

SEQ ID NO: 3128045 - DNA, 22 bp, Homo sapiens
tatcaaggaagaaatggttcag

SEQ ID NO: 3128046 - DNA, 22 bp, Homo sapiens
tatcaaggactctggtttctca

SEQ ID NO: 3128047 - DNA, 13 bp, Homo sapiens
tattgttccaaga

SEQ ID NO: 3128048 - DNA, 17 bp, Homo sapiens
tattgttccaagacatt

SEQ ID NO: 3128049 - DNA, 23 bp, Homo sapiens
tattgttccaagacattgtcaat

SEQ ID NO: 3128050 - DNA, 23 bp, Homo sapiens
tattgttccagcagttttcaagt

SEQ ID NO: 3128051 - DNA, 14 bp, Homo sapiens
tattgttgtataat

SEQ ID NO: 3128052 - DNA, 13 bp, Homo sapiens
tattgttgttact

SEQ ID NO: 3128053 - DNA, 11 bp, Homo sapiens
tattgtttaaa

SEQ ID NO: 3128054 - DNA, 12 bp, Homo sapiens
tattgtttaaaa

SEQ ID NO: 3128055 - DNA, 12 bp, Homo sapiens
tattgtttctgc

SEQ ID NO: 3128056 - DNA, 20 bp, Homo sapiens
tattgtttctttaagaaagt

SEQ ID NO: 3128057 - DNA, 16 bp, Homo sapiens
tattgtttggtaaatg

SEQ ID NO: 3128058 - DNA, 20 bp, Homo sapiens
tattgttttcagtgtacatg

SEQ ID NO: 3128059 - DNA, 16 bp, Homo sapiens
tattgtttttgtattt

SEQ ID NO: 3128060 - DNA, 18 bp, Homo sapiens
tatttaaaaaattatgga

SEQ ID NO: 3128061 - DNA, 15 bp, Homo sapiens
tatttaaaaatattt

SEQ ID NO: 3128062 - DNA, 16 bp, Homo sapiens
tatttaaaaatatttc

SEQ ID NO: 3128063 - DNA, 22 bp, Homo sapiens
tatttaaaaattgtttcttgac

SEQ ID NO: 3128064 - DNA, 12 bp, Homo sapiens
tatttaaactat

SEQ ID NO: 3128065 - DNA, 14 bp, Homo sapiens
tatttaaagacagg

SEQ ID NO: 3128066 - DNA, 13 bp, Homo sapiens
tatttaaagcatt

SEQ ID NO: 3128067 - DNA, 18 bp, Homo sapiens
tatttaaattacaatttt

SEQ ID NO: 3128068 - DNA, 21 bp, Homo sapiens
tatttaactgccttgtgtaca

SEQ ID NO: 3128069 - DNA, 15 bp, Homo sapiens
tatttaagaaaagca

SEQ ID NO: 3128070 - DNA, 18 bp, Homo sapiens
tatttaagaaaagcactt

SEQ ID NO: 3128071 - DNA, 13 bp, Homo sapiens
tatttaagaaaat

SEQ ID NO: 3128072 - DNA, 19 bp, Homo sapiens
tatttaagaaaatacaata

SEQ ID NO: 3128073 - DNA, 21 bp, Homo sapiens
tatttaagcctcatatttaaa

SEQ ID NO: 3128074 - DNA, 16 bp, Homo sapiens
tatttaagcttatgtc

SEQ ID NO: 3128075 - DNA, 13 bp, Homo sapiens
tatttaataacat

SEQ ID NO: 3128076 - DNA, 14 bp, Homo sapiens
tatttaataacatt

SEQ ID NO: 3128077 - DNA, 23 bp, Homo sapiens
tatttaatcacagtcatctttaa

SEQ ID NO: 3128078 - DNA, 13 bp, Homo sapiens
tatttaatgaaac

SEQ ID NO: 3128079 - DNA, 15 bp, Homo sapiens
tatttaatgaaagac

SEQ ID NO: 3128080 - DNA, 21 bp, Homo sapiens
tatttaatgaaagactgtaca

SEQ ID NO: 3128081 - DNA, 13 bp, Homo sapiens
tatttaattaaaa

SEQ ID NO: 3128082 - DNA, 14 bp, Homo sapiens
tatttaattattaa

SEQ ID NO: 3128083 - DNA, 14 bp, Homo sapiens
tatttaattgtaaa

SEQ ID NO: 3128084 - DNA, 15 bp, Homo sapiens
tatttaattgtaaac

SEQ ID NO: 3128085 - DNA, 16 bp, Homo sapiens
tatttaattgtaaact

SEQ ID NO: 3128086 - DNA, 17 bp, Homo sapiens
tatttaattgtaaactg

SEQ ID NO: 3128087 - DNA, 18 bp, Homo sapiens
tatttaattgtaaactgt

SEQ ID NO: 3128088 - DNA, 20 bp, Homo sapiens
tatttaattgtaaactgtac

SEQ ID NO: 3128089 - DNA, 23 bp, Homo sapiens
tatttaatttttttgagacagag

SEQ ID NO: 3128090 - DNA, 22 bp, Homo sapiens
tatttacagtgaaaatgtaagc

SEQ ID NO: 3128091 - DNA, 20 bp, Homo sapiens
tatttaccgttgcttgaaat

SEQ ID NO: 3128092 - DNA, 17 bp, Homo sapiens
tatttacctgcaggctg

SEQ ID NO: 3128093 - DNA, 22 bp, Homo sapiens
tatttaccttttaagacatttt

SEQ ID NO: 3128094 - DNA, 19 bp, Homo sapiens
tatttacgctttgattcat

SEQ ID NO: 3128095 - DNA, 16 bp, Homo sapiens
tatttactctttctaa

SEQ ID NO: 3128096 - DNA, 16 bp, Homo sapiens
tatttactctttgcaa

SEQ ID NO: 3128097 - DNA, 16 bp, Homo sapiens
tatttactgagcttct

SEQ ID NO: 3128098 - DNA, 23 bp, Homo sapiens
tatttactgagcttctctgtgaa

SEQ ID NO: 3128099 - DNA, 13 bp, Homo sapiens
tatttactgtact

SEQ ID NO: 3128100 - DNA, 15 bp, Homo sapiens
tatttacttctgtat

SEQ ID NO: 3128101 - DNA, 19 bp, Homo sapiens
tatttagacaagagatggg

SEQ ID NO: 3128102 - DNA, 14 bp, Homo sapiens
tatttagttggaat

SEQ ID NO: 3128103 - DNA, 14 bp, Homo sapiens
tatttataaaactt

SEQ ID NO: 3128104 - DNA, 20 bp, Homo sapiens
tatttataactcatcataaa

SEQ ID NO: 3128105 - DNA, 22 bp, Homo sapiens
tatttataatagcaacttttgt

SEQ ID NO: 3128106 - DNA, 17 bp, Homo sapiens
tatttatactataaaat

SEQ ID NO: 3128107 - DNA, 16 bp, Homo sapiens
tatttatatatgtatt

SEQ ID NO: 3128108 - DNA, 14 bp, Homo sapiens
tatttatatatttg

SEQ ID NO: 3128109 - DNA, 16 bp, Homo sapiens
tatttatatatttgaa

SEQ ID NO: 3128110 - DNA, 15 bp, Homo sapiens
tatttatatttcact

SEQ ID NO: 3128111 - DNA, 16 bp, Homo sapiens
tatttatatttggaaa

SEQ ID NO: 3128112 - DNA, 21 bp, Homo sapiens
tatttatatttggaaagagac

SEQ ID NO: 3128113 - DNA, 22 bp, Homo sapiens
tatttatctccgcaggctattt

SEQ ID NO: 3128114 - DNA, 15 bp, Homo sapiens
tatttatctgattaa

SEQ ID NO: 3128115 - DNA, 16 bp, Homo sapiens
tatttatctgattaag

SEQ ID NO: 3128116 - DNA, 21 bp, Homo sapiens
tatttatctgtagtaaactat

SEQ ID NO: 3128117 - DNA, 11 bp, Homo sapiens
tatttatgaaa

SEQ ID NO: 3128118 - DNA, 20 bp, Homo sapiens
tatttatgcctctgtattta

SEQ ID NO: 3128119 - DNA, 18 bp, Homo sapiens
tatttatgtaatgaagta

SEQ ID NO: 3128120 - DNA, 21 bp, Homo sapiens
tatttatgtgtatatttgtag

SEQ ID NO: 3128121 - DNA, 23 bp, Homo sapiens
tatttattaaacagatttttaca

SEQ ID NO: 3128122 - DNA, 13 bp, Homo sapiens
tatttattaacag

SEQ ID NO: 3128123 - DNA, 19 bp, Homo sapiens
tatttattaatatttaaca

SEQ ID NO: 3128124 - DNA, 14 bp, Homo sapiens
tatttattaatttg

SEQ ID NO: 3128125 - DNA, 13 bp, Homo sapiens
tatttattacata

SEQ ID NO: 3128126 - DNA, 20 bp, Homo sapiens
tatttattacataatttagt

SEQ ID NO: 3128127 - DNA, 14 bp, Homo sapiens
tatttattactatg

SEQ ID NO: 3128128 - DNA, 21 bp, Homo sapiens
tatttattctctatttattgg

SEQ ID NO: 3128129 - DNA, 14 bp, Homo sapiens
tatttattgcattg

SEQ ID NO: 3128130 - DNA, 22 bp, Homo sapiens
tatttattgcattgctggtaga

SEQ ID NO: 3128131 - DNA, 21 bp, Homo sapiens
tatttattgggatgtgagccc

SEQ ID NO: 3128132 - DNA, 10 bp, Homo sapiens
tatttattgt

SEQ ID NO: 3128133 - DNA, 13 bp, Homo sapiens
tatttatttaaat

SEQ ID NO: 3128134 - DNA, 12 bp, Homo sapiens
tatttatttaat

SEQ ID NO: 3128135 - DNA, 11 bp, Homo sapiens
tatttatttac

SEQ ID NO: 3128136 - DNA, 23 bp, Homo sapiens
tatttattttcagtatactgtgt

SEQ ID NO: 3128137 - DNA, 16 bp, Homo sapiens
tatttcaactgctgta

SEQ ID NO: 3128138 - DNA, 18 bp, Homo sapiens
tatttcactatcttcttc

SEQ ID NO: 3128139 - DNA, 20 bp, Homo sapiens
tatttcactatcttcttcaa

SEQ ID NO: 3128140 - DNA, 21 bp, Homo sapiens
tatttcactatcttcttcaaa

SEQ ID NO: 3128141 - DNA, 16 bp, Homo sapiens
tatttcacttgatgat

SEQ ID NO: 3128142 - DNA, 19 bp, Homo sapiens
tatttcacttttgttctgc

SEQ ID NO: 3128143 - DNA, 19 bp, Homo sapiens
tattccacagatatctttt

SEQ ID NO: 3128144 - DNA, 17 bp, Homo sapiens
tattccatatttattca

SEQ ID NO: 3128145 - DNA, 11 bp, Homo sapiens
tattccatcaa

SEQ ID NO: 3128146 - DNA, 12 bp, Homo sapiens
tattccatcaat

SEQ ID NO: 3128147 - DNA, 19 bp, Homo sapiens
tattccatcaataaatgct

SEQ ID NO: 3128148 - DNA, 16 bp, Homo sapiens
tattccatgaatgtat

SEQ ID NO: 3128149 - DNA, 22 bp, Homo sapiens
tattccatgaatgtatcaggaa

SEQ ID NO: 3128150 - DNA, 22 bp, Homo sapiens
tattcccaagcccatgagtcct

SEQ ID NO: 3128151 - DNA, 13 bp, Homo sapiens
tattcccaagccg

SEQ ID NO: 3128152 - DNA, 21 bp, Homo sapiens
tattccccatttcctgtacaa

SEQ ID NO: 3128153 - DNA, 13 bp, Homo sapiens
tattcccttgtat

SEQ ID NO: 3128154 - DNA, 18 bp, Homo sapiens
tattccctttgacttcag

SEQ ID NO: 3128155 - DNA, 19 bp, Homo sapiens
tattccgatacaaagtgtt

SEQ ID NO: 3128156 - DNA, 14 bp, Homo sapiens
tattcctacttgca

SEQ ID NO: 3128157 - DNA, 17 bp, Homo sapiens
tattcctccaaatctct

SEQ ID NO: 3128158 - DNA, 18 bp, Homo sapiens
tattcctcctgctcatat

SEQ ID NO: 3128159 - DNA, 20 bp, Homo sapiens
tattcctgaatgaaatatca

SEQ ID NO: 3128160 - DNA, 19 bp, Homo sapiens
tattcctgcatttgtgaaa

SEQ ID NO: 3128161 - DNA, 20 bp, Homo sapiens
tattcctgcatttgtgaaat

SEQ ID NO: 3128162 - DNA, 14 bp, Homo sapiens
tattccttctggcc

SEQ ID NO: 3128163 - DNA, 15 bp, Homo sapiens
tattccttctggcct

SEQ ID NO: 3128164 - DNA, 19 bp, Homo sapiens
tattccttctggcctttcc

SEQ ID NO: 3128165 - DNA, 16 bp, Homo sapiens
tattcctttctatcat

SEQ ID NO: 3128166 - DNA, 21 bp, Homo sapiens
tattcctttgggcctctgctt

SEQ ID NO: 3128167 - DNA, 23 bp, Homo sapiens
tattctaagacttactctaagat

SEQ ID NO: 3128168 - DNA, 15 bp, Homo sapiens
tattctaataaatat

SEQ ID NO: 3128169 - DNA, 13 bp, Homo sapiens
tattctaattaaa

SEQ ID NO: 3128170 - DNA, 16 bp, Homo sapiens
tattctaattaaaatt

SEQ ID NO: 3128171 - DNA, 21 bp, Homo sapiens
tattctatacacaccctgccc

SEQ ID NO: 3128172 - DNA, 15 bp, Homo sapiens
tattctatatgaatt

SEQ ID NO: 3128173 - DNA, 16 bp, Homo sapiens
tattctatgagaacaa

SEQ ID NO: 3128174 - DNA, 17 bp, Homo sapiens
tattctatgtatgttaa

SEQ ID NO: 3128175 - DNA, 13 bp, Homo sapiens
tattctattaact

SEQ ID NO: 3128176 - DNA, 19 bp, Homo sapiens
tattctattaactttaatt

SEQ ID NO: 3128177 - DNA, 12 bp, Homo sapiens
tattctattgca

SEQ ID NO: 3128178 - DNA, 16 bp, Homo sapiens
tattctattgtattat

SEQ ID NO: 3128179 - DNA, 16 bp, Homo sapiens
tattctcaaagcagga

SEQ ID NO: 3128180 - DNA, 16 bp, Homo sapiens
tattctcaaagttaaa

SEQ ID NO: 3128181 - DNA, 12 bp, Homo sapiens
tattctcagagc

SEQ ID NO: 3128182 - DNA, 17 bp, Homo sapiens
tattctcataatccttc

SEQ ID NO: 3128183 - DNA, 23 bp, Homo sapiens
tattctcataggagactgcgtca

SEQ ID NO: 3128184 - DNA, 15 bp, Homo sapiens
tattctcatgcctca

SEQ ID NO: 3128185 - DNA, 18 bp, Homo sapiens
tattctctatttattggg

SEQ ID NO: 3128186 - DNA, 12 bp, Homo sapiens
tattctgagcct

SEQ ID NO: 3128187 - DNA, 13 bp, Homo sapiens
tattctgagcctt

SEQ ID NO: 3128188 - DNA, 22 bp, Homo sapiens
tattctgtcagtgttaaagatt

SEQ ID NO: 3128189 - DNA, 14 bp, Homo sapiens
tattctgttccaca

SEQ ID NO: 3128190 - DNA, 22 bp, Homo sapiens
tattcttaagggaacttccaca

SEQ ID NO: 3128191 - DNA, 15 bp, Homo sapiens
tattcttattggaaa

SEQ ID NO: 3128192 - DNA, 19 bp, Homo sapiens
tattcttattggaaatgta

SEQ ID NO: 3128193 - DNA, 13 bp, Homo sapiens
tattcttctagag

SEQ ID NO: 3128194 - DNA, 18 bp, Homo sapiens
tattcttctagagttcag

SEQ ID NO: 3128195 - DNA, 21 bp, Homo sapiens
tattcttgctgggcatacttt

SEQ ID NO: 3128196 - DNA, 17 bp, Homo sapiens
tattcttgttttacatt

SEQ ID NO: 3128197 - DNA, 16 bp, Homo sapiens
tattgaaaaaaaaaat

SEQ ID NO: 3128198 - DNA, 20 bp, Homo sapiens
tattgaaaaaaaaaatgttg

SEQ ID NO: 3128199 - DNA, 19 bp, Homo sapiens
tattgaaaattgaaaagta

SEQ ID NO: 3128200 - DNA, 20 bp, Homo sapiens
tattgaaaattgaaaagtac

SEQ ID NO: 3128201 - DNA, 17 bp, Homo sapiens
tattgaagaaaagcact

SEQ ID NO: 3128202 - DNA, 18 bp, Homo sapiens
tattgaagaaaagcactt

SEQ ID NO: 3128203 - DNA, 13 bp, Homo sapiens
tattgaagaaaca

SEQ ID NO: 3128204 - DNA, 21 bp, Homo sapiens
tattgaaggaattagaaatga

SEQ ID NO: 3128205 - DNA, 14 bp, Homo sapiens
tattgaatcttaat

SEQ ID NO: 3128206 - DNA, 12 bp, Homo sapiens
tattgaatgttt

SEQ ID NO: 3128207 - DNA, 22 bp, Homo sapiens
tattgactgtaccacagacaca

SEQ ID NO: 3128208 - DNA, 19 bp, Homo sapiens
tattgacttcaatgatagt

SEQ ID NO: 3128209 - DNA, 14 bp, Homo sapiens
tattgacttgtata

SEQ ID NO: 3128210 - DNA, 15 bp, Homo sapiens
tattgacttgtatat

SEQ ID NO: 3128211 - DNA, 23 bp, Homo sapiens
tattgactttatgttgtatgatt

SEQ ID NO: 3128212 - DNA, 16 bp, Homo sapiens
tattgactttgacaat

SEQ ID NO: 3128213 - DNA, 19 bp, Homo sapiens
tattgagaacctggcctgt

SEQ ID NO: 3128214 - DNA, 20 bp, Homo sapiens
tattgagaatcccttaaaat

SEQ ID NO: 3128215 - DNA, 14 bp, Homo sapiens
tattgagtcaaatg

SEQ ID NO: 3128216 - DNA, 19 bp, Homo sapiens
tattgagtttgtaggtaaa

SEQ ID NO: 3128217 - DNA, 15 bp, Homo sapiens
tattgatagtactct

SEQ ID NO: 3128218 - DNA, 14 bp, Homo sapiens
tattgatatatatt

SEQ ID NO: 3128219 - DNA, 21 bp, Homo sapiens
tattgatatgcttatacactt

SEQ ID NO: 3128220 - DNA, 23 bp, Homo sapiens
tattgatgaaaagatttaagcac

SEQ ID NO: 3128221 - DNA, 21 bp, Homo sapiens
tattgatgtcagtatttcaac

SEQ ID NO: 3128222 - DNA, 15 bp, Homo sapiens
tattgatgttaacaa

SEQ ID NO: 3128223 - DNA, 21 bp, Homo sapiens
tattgattcctcacatcttta

SEQ ID NO: 3128224 - DNA, 19 bp, Homo sapiens
tattgattgggaaaacatt

SEQ ID NO: 3128225 - DNA, 22 bp, Homo sapiens
tattgattgggaaaacatttgc

SEQ ID NO: 3128226 - DNA, 13 bp, Homo sapiens
tattgatttcaaa

SEQ ID NO: 3128227 - DNA, 17 bp, Homo sapiens
tattgcacattgtaaaa

SEQ ID NO: 3128228 - DNA, 18 bp, Homo sapiens
tattgcactcagcttttt

SEQ ID NO: 3128229 - DNA, 16 bp, Homo sapiens
tattgcaggagacatt

SEQ ID NO: 3128230 - DNA, 15 bp, Homo sapiens
tattgcccacgctgg

SEQ ID NO: 3128231 - DNA, 17 bp, Homo sapiens
tattgctgagaagcaaa

SEQ ID NO: 3128232 - DNA, 19 bp, Homo sapiens
tattgctgtgtaacactgt

SEQ ID NO: 3128233 - DNA, 12 bp, Homo sapiens
tattgcttattt

SEQ ID NO: 3128234 - DNA, 15 bp, Homo sapiens
tattgcttattttat

SEQ ID NO: 3128235 - DNA, 21 bp, Homo sapiens
tatttcagatatcaaaattct

SEQ ID NO: 3128236 - DNA, 23 bp, Homo sapiens
tatttcagtgtagttaatttatc

SEQ ID NO: 3128237 - DNA, 20 bp, Homo sapiens
tatttcataaacaacttaat

SEQ ID NO: 3128238 - DNA, 12 bp, Homo sapiens
tatttcatgtgg

SEQ ID NO: 3128239 - DNA, 21 bp, Homo sapiens
tatttcatgtttttgatcaaa

SEQ ID NO: 3128240 - DNA, 22 bp, Homo sapiens
tatttccagtgttctatgaaca

SEQ ID NO: 3128241 - DNA, 21 bp, Homo sapiens
tatttccccttggacacttgg

SEQ ID NO: 3128242 - DNA, 15 bp, Homo sapiens
tatttccctaaaata

SEQ ID NO: 3128243 - DNA, 22 bp, Homo sapiens
tatttccctcacctttcccatc

SEQ ID NO: 3128244 - DNA, 21 bp, Homo sapiens
tatttcctgacttgagtgttc

SEQ ID NO: 3128245 - DNA, 15 bp, Homo sapiens
tatttccttaaactg

SEQ ID NO: 3128246 - DNA, 19 bp, Homo sapiens
tatttccttaaactgtgtg

SEQ ID NO: 3128247 - DNA, 14 bp, Homo sapiens
tatttctaagtatt

SEQ ID NO: 3128248 - DNA, 16 bp, Homo sapiens
tatttctaagtattta

SEQ ID NO: 3128249 - DNA, 17 bp, Homo sapiens
tatttctaagtatttaa

SEQ ID NO: 3128250 - DNA, 17 bp, Homo sapiens
tatttctactatataca

SEQ ID NO: 3128251 - DNA, 13 bp, Homo sapiens
tatttctagaagc

SEQ ID NO: 3128252 - DNA, 17 bp, Homo sapiens
tatttctagctttttaa

SEQ ID NO: 3128253 - DNA, 17 bp, Homo sapiens
tatttctagtccaaaat

SEQ ID NO: 3128254 - DNA, 21 bp, Homo sapiens
tatttctattattaattgcaa

SEQ ID NO: 3128255 - DNA, 11 bp, Homo sapiens
tatttctattg

SEQ ID NO: 3128256 - DNA, 21 bp, Homo sapiens
tatttctcaacaaagcacagt

SEQ ID NO: 3128257 - DNA, 15 bp, Homo sapiens
tatttctccatcttt

SEQ ID NO: 3128258 - DNA, 19 bp, Homo sapiens
tatttctcgggtgcatttg

SEQ ID NO: 3128259 - DNA, 21 bp, Homo sapiens
tatttctgaattcaaagcttg

SEQ ID NO: 3128260 - DNA, 22 bp, Homo sapiens
tatttctgaattcaaagcttgt

SEQ ID NO: 3128261 - DNA, 17 bp, Homo sapiens
tatttctgcatatgttg

SEQ ID NO: 3128262 - DNA, 15 bp, Homo sapiens
tatttctgctttctt

SEQ ID NO: 3128263 - DNA, 22 bp, Homo sapiens
tatttctgggtcttttgctact

SEQ ID NO: 3128264 - DNA, 20 bp, Homo sapiens
tatttctgtcattcaaatgg

SEQ ID NO: 3128265 - DNA, 18 bp, Homo sapiens
tatttcttaattattata

SEQ ID NO: 3128266 - DNA, 14 bp, Homo sapiens
tatttcttgtttgt

SEQ ID NO: 3128267 - DNA, 16 bp, Homo sapiens
tcaagttgtaaaaatg

SEQ ID NO: 3128268 - DNA, 13 bp, Homo sapiens
tcaagttgtgctt

SEQ ID NO: 3128269 - DNA, 17 bp, Homo sapiens
tcaagttgtgcttgttt

SEQ ID NO: 3128270 - DNA, 15 bp, Homo sapiens
tcaagtttacacttc

SEQ ID NO: 3128271 - DNA, 19 bp, Homo sapiens
tcaataaaatgtgattttt

SEQ ID NO: 3128272 - DNA, 13 bp, Homo sapiens
tcaataaacactt

SEQ ID NO: 3128273 - DNA, 12 bp, Homo sapiens
tcaataaacagc

SEQ ID NO: 3128274 - DNA, 23 bp, Homo sapiens
tcaataaacagcttcatgccttt

SEQ ID NO: 3128275 - DNA, 14 bp, Homo sapiens
tcaataaagaaaac

SEQ ID NO: 3128276 - DNA, 21 bp, Homo sapiens
tcaataaagaaaacttccata

SEQ ID NO: 3128277 - DNA, 15 bp, Homo sapiens
tcaataaagcattta

SEQ ID NO: 3128278 - DNA, 14 bp, Homo sapiens
tcaataaattgcaa

SEQ ID NO: 3128279 - DNA, 15 bp, Homo sapiens
tcaataaattgcaac

SEQ ID NO: 3128280 - DNA, 22 bp, Homo sapiens
tcaataagaaggtagaatgagt

SEQ ID NO: 3128281 - DNA, 12 bp, Homo sapiens
tcaataataaaa

SEQ ID NO: 3128282 - DNA, 14 bp, Homo sapiens
tcaatacagcttca

SEQ ID NO: 3128283 - DNA, 15 bp, Homo sapiens
tcaatacagcttcat

SEQ ID NO: 3128284 - DNA, 19 bp, Homo sapiens
tcaatacagtgaaggtctt

SEQ ID NO: 3128285 - DNA, 12 bp, Homo sapiens
tcaatactacct

SEQ ID NO: 3128286 - DNA, 13 bp, Homo sapiens
ttttaattgtcat

SEQ ID NO: 3128287 - DNA, 17 bp, Homo sapiens
ttttaatttaaagctta

SEQ ID NO: 3128288 - DNA, 17 bp, Homo sapiens
ttttaatttaacatgaa

SEQ ID NO: 3128289 - DNA, 23 bp, Homo sapiens
ttttaatttatgagtttttgata

SEQ ID NO: 3128290 - DNA, 19 bp, Homo sapiens
ttttaatttatttgtttcc

SEQ ID NO: 3128291 - DNA, 19 bp, Homo sapiens
ttttaatttgatgaaagct

SEQ ID NO: 3128292 - DNA, 20 bp, Homo sapiens
ttttaatttgatgaaagctg

SEQ ID NO: 3128293 - DNA, 19 bp, Homo sapiens
ttttaattttgtgttgcta

SEQ ID NO: 3128294 - DNA, 20 bp, Homo sapiens
ttttaattttgtgttgctaa

SEQ ID NO: 3128295 - DNA, 17 bp, Homo sapiens
ttttacaataaaatctt

SEQ ID NO: 3128296 - DNA, 19 bp, Homo sapiens
ttttacagtgaccttttct

SEQ ID NO: 3128297 - DNA, 22 bp, Homo sapiens
ttttacagttagggttttgcaa

SEQ ID NO: 3128298 - DNA, 23 bp, Homo sapiens
ttttacagttagggttttgcaat

SEQ ID NO: 3128299 - DNA, 16 bp, Homo sapiens
ttttacatttcataca

SEQ ID NO: 3128300 - DNA, 17 bp, Homo sapiens
ttttaccaaagcatcaa

SEQ ID NO: 3128301 - DNA, 22 bp, Homo sapiens
ttttaccctaatgtcttcataa

SEQ ID NO: 3128302 - DNA, 22 bp, Homo sapiens
ttttaccgttggggcccttaac

SEQ ID NO: 3128303 - DNA, 18 bp, Homo sapiens
ttttacctaccacagtgt

SEQ ID NO: 3128304 - DNA, 21 bp, Homo sapiens
ttttacctaccacagtgtctg

SEQ ID NO: 3128305 - DNA, 17 bp, Homo sapiens
ttttactattgttacat

SEQ ID NO: 3128306 - DNA, 12 bp, Homo sapiens
ttttactctttt

SEQ ID NO: 3128307 - DNA, 13 bp, Homo sapiens
ttttactgaacaa

SEQ ID NO: 3128308 - DNA, 11 bp, Homo sapiens
ttttacttaca

SEQ ID NO: 3128309 - DNA, 17 bp, Homo sapiens
ttttacttttaaactgt

SEQ ID NO: 3128310 - DNA, 20 bp, Homo sapiens
ttttacttttaaactgtgta

SEQ ID NO: 3128311 - DNA, 12 bp, Homo sapiens
ttttactttttt

SEQ ID NO: 3128312 - DNA, 16 bp, Homo sapiens
ttttactttttttagt

SEQ ID NO: 3128313 - DNA, 17 bp, Homo sapiens
ttttagaaatattcaca

SEQ ID NO: 3128314 - DNA, 17 bp, Homo sapiens
ttttagatgaccaaaac

SEQ ID NO: 3128315 - DNA, 22 bp, Homo sapiens
ttttagcatgatgaaactgtca

SEQ ID NO: 3128316 - DNA, 20 bp, Homo sapiens
ttttagctgatgaacttatt

SEQ ID NO: 3128317 - DNA, 20 bp, Homo sapiens
ttttaggagctaaggctcta

SEQ ID NO: 3128318 - DNA, 15 bp, Homo sapiens
ttttaggcactctta

SEQ ID NO: 3128319 - DNA, 18 bp, Homo sapiens
ttttaggctgttccttgt

SEQ ID NO: 3128320 - DNA, 23 bp, Homo sapiens
ttttaggctgttccttgtactct

SEQ ID NO: 3128321 - DNA, 12 bp, Homo sapiens
ttttaggttcta

SEQ ID NO: 3128322 - DNA, 14 bp, Homo sapiens
ttttaggttctaaa

SEQ ID NO: 3128323 - DNA, 15 bp, Homo sapiens
ttttagtaatctgta

SEQ ID NO: 3128324 - DNA, 13 bp, Homo sapiens
ttttagttcatat

SEQ ID NO: 3128325 - DNA, 17 bp, Homo sapiens
ttttagttcctttattt

SEQ ID NO: 3128326 - DNA, 16 bp, Homo sapiens
ttttataaaaataaat

SEQ ID NO: 3128327 - DNA, 23 bp, Homo sapiens
ttttataattggtgctatttgaa

SEQ ID NO: 3128328 - DNA, 15 bp, Homo sapiens
ttttatactgcacag

SEQ ID NO: 3128329 - DNA, 15 bp, Homo sapiens
ttttatactgtactt

SEQ ID NO: 3128330 - DNA, 22 bp, Homo sapiens
ttttatagcttaactaatttga

SEQ ID NO: 3128331 - DNA, 22 bp, Homo sapiens
ttttataggactgttctttgct

SEQ ID NO: 3128332 - DNA, 22 bp, Homo sapiens
ttttatatattatgtgaagaat

SEQ ID NO: 3128333 - DNA, 22 bp, Homo sapiens
ttttatatgaagataagtgtat

SEQ ID NO: 3128334 - DNA, 21 bp, Homo sapiens
ttttatattgccttatttccc

SEQ ID NO: 3128335 - DNA, 20 bp, Homo sapiens
ttttatatttattgttagaa

SEQ ID NO: 3128336 - DNA, 14 bp, Homo sapiens
ttttatatttgtag

SEQ ID NO: 3128337 - DNA, 15 bp, Homo sapiens
ttttatcatgacatg

SEQ ID NO: 3128338 - DNA, 19 bp, Homo sapiens
ttttatcatgacatgttat

SEQ ID NO: 3128339 - DNA, 15 bp, Homo sapiens
ttttatctgtttcct

SEQ ID NO: 3128340 - DNA, 21 bp, Homo sapiens
ttttatgaagtgcgtgaatgt

SEQ ID NO: 3128341 - DNA, 13 bp, Homo sapiens
ttttatgatcagt

SEQ ID NO: 3128342 - DNA, 24 bp, Homo sapiens
ttttatgcagaagcatattttgct

SEQ ID NO: 3128343 - DNA, 19 bp, Homo sapiens
ttttatgctcttttttact

SEQ ID NO: 3128344 - DNA, 16 bp, Homo sapiens
ttttatggatgattaa

SEQ ID NO: 3128345 - DNA, 17 bp, Homo sapiens
ttttatggatgattaaa

SEQ ID NO: 3128346 - DNA, 18 bp, Homo sapiens
ttttatggatgattaaat

SEQ ID NO: 3128347 - DNA, 18 bp, Homo sapiens
ttttatggttccaatgaa

SEQ ID NO: 3128348 - DNA, 18 bp, Homo sapiens
ttttatgtgagagaaagt

SEQ ID NO: 3128349 - DNA, 21 bp, Homo sapiens
ttttatgtgctctcatcagaa

SEQ ID NO: 3128350 - DNA, 18 bp, Homo sapiens
ttttattaaacattttca

SEQ ID NO: 3128351 - DNA, 12 bp, Homo sapiens
ttttattaaatt

SEQ ID NO: 3128352 - DNA, 15 bp, Homo sapiens
ttttattagaataat

SEQ ID NO: 3128353 - DNA, 17 bp, Homo sapiens
ttttattatttctatta

SEQ ID NO: 3128354 - DNA, 15 bp, Homo sapiens
ttttattcctgtatg

SEQ ID NO: 3128355 - DNA, 20 bp, Homo sapiens
ttttattgtattttgatgag

SEQ ID NO: 3128356 - DNA, 19 bp, Homo sapiens
ttttattgttgttgtttga

SEQ ID NO: 3128357 - DNA, 12 bp, Homo sapiens
ttttattgtttt

SEQ ID NO: 3128358 - DNA, 14 bp, Homo sapiens
ttttatttatatct

SEQ ID NO: 3128359 - DNA, 15 bp, Homo sapiens
ttttatttatatctt

SEQ ID NO: 3128360 - DNA, 13 bp, Homo sapiens
ttttatttctaag

SEQ ID NO: 3128361 - DNA, 14 bp, Homo sapiens
ttttatttgtaatt

SEQ ID NO: 3128362 - DNA, 14 bp, Homo sapiens
ttttattttcaaga

SEQ ID NO: 3128363 - DNA, 12 bp, Homo sapiens
ttttattttgaa

SEQ ID NO: 3128364 - DNA, 18 bp, Homo sapiens
ttttatttttagacagag

SEQ ID NO: 3128365 - DNA, 18 bp, Homo sapiens
ttttatttttctaaaaaa

SEQ ID NO: 3128366 - DNA, 22 bp, Homo sapiens
ttttatttttgaacccctgtgt

SEQ ID NO: 3128367 - DNA, 15 bp, Homo sapiens
ttttcaaaaatgctg

SEQ ID NO: 3128368 - DNA, 17 bp, Homo sapiens
ttttcaaaaggtattat

SEQ ID NO: 3128369 - DNA, 14 bp, Homo sapiens
ttttcaaaatggag

SEQ ID NO: 3128370 - DNA, 21 bp, Homo sapiens
ttttcaacgcagccctgcttt

SEQ ID NO: 3128371 - DNA, 15 bp, Homo sapiens
ttttcaactgctttg

SEQ ID NO: 3128372 - DNA, 14 bp, Homo sapiens
ttttcaagaaactg

SEQ ID NO: 3128373 - DNA, 15 bp, Homo sapiens
ttttcaagaaactga

SEQ ID NO: 3128374 - DNA, 16 bp, Homo sapiens
ttttcaagaataatca

SEQ ID NO: 3128375 - DNA, 22 bp, Homo sapiens
ttttcaagcagcatcttctggt

SEQ ID NO: 3128376 - DNA, 14 bp, Homo sapiens
ttttcaatatttat

SEQ ID NO: 3128377 - DNA, 19 bp, Homo sapiens
ttttcaccagatttgctaa

SEQ ID NO: 3128378 - DNA, 13 bp, Homo sapiens
ttttcactgcctg

SEQ ID NO: 3128379 - DNA, 19 bp, Homo sapiens
ttttcactgctggctgcct

SEQ ID NO: 3128380 - DNA, 20 bp, Homo sapiens
ttttcactgctggctgcctt

SEQ ID NO: 3128381 - DNA, 12 bp, Homo sapiens
ttttcacttgta

SEQ ID NO: 3128382 - DNA, 21 bp, Homo sapiens
ttttcagaaggttattttctt

SEQ ID NO: 3128383 - DNA, 20 bp, Homo sapiens
ttttcagaatctgaatgtaa

SEQ ID NO: 3128384 - DNA, 22 bp, Homo sapiens
ttttcagaatctgaatgtaatt

SEQ ID NO: 3128385 - DNA, 23 bp, Homo sapiens
ttttcagaatctgaatgtaattt

SEQ ID NO: 3128386 - DNA, 19 bp, Homo sapiens
ttttcagcaaactcttttc

SEQ ID NO: 3128387 - DNA, 20 bp, Homo sapiens
ttttcagcacccccacccac

SEQ ID NO: 3128388 - DNA, 14 bp, Homo sapiens
ttttcagctgagcc

SEQ ID NO: 3128389 - DNA, 20 bp, Homo sapiens
ttttcagctgctcagaattc

SEQ ID NO: 3128390 - DNA, 22 bp, Homo sapiens
ttttcaggtaggcccttgtcct

SEQ ID NO: 3128391 - DNA, 23 bp, Homo sapiens
ttttcagtcttgtagtgtgtgct

SEQ ID NO: 3128392 - DNA, 16 bp, Homo sapiens
ttttcagttccaagaa

SEQ ID NO: 3128393 - DNA, 18 bp, Homo sapiens
ttttcatacttttacctt

SEQ ID NO: 3128394 - DNA, 15 bp, Homo sapiens
ttttcatcactggga

SEQ ID NO: 3128395 - DNA, 14 bp, Homo sapiens
ttttcatgcttcca

SEQ ID NO: 3128396 - DNA, 16 bp, Homo sapiens
ttttcattaaacttga

SEQ ID NO: 3128397 - DNA, 19 bp, Homo sapiens
ttttcattacaatggaaac

SEQ ID NO: 3128398 - DNA, 17 bp, Homo sapiens
ttttcattcctaaagaa

SEQ ID NO: 3128399 - DNA, 13 bp, Homo sapiens
ttttcatttatct

SEQ ID NO: 3128400 - DNA, 15 bp, Homo sapiens
ttttcatttcttcct

SEQ ID NO: 3128401 - DNA, 13 bp, Homo sapiens
ttttcatttgcct

SEQ ID NO: 3128402 - DNA, 12 bp, Homo sapiens
ttttcatttgta

SEQ ID NO: 3128403 - DNA, 19 bp, Homo sapiens
ttttcatttgtacaaggta

SEQ ID NO: 3128404 - DNA, 22 bp, Homo sapiens
ttttcatttgttttgcttttgt

SEQ ID NO: 3128405 - DNA, 11 bp, Homo sapiens
ttttcattttg

SEQ ID NO: 3128406 - DNA, 19 bp, Homo sapiens
ttttccaaaacaaaaagat

SEQ ID NO: 3128407 - DNA, 13 bp, Homo sapiens
ttttccacattcc

SEQ ID NO: 3128408 - DNA, 12 bp, Homo sapiens
ttttccagcaag

SEQ ID NO: 3128409 - DNA, 19 bp, Homo sapiens
ttttccaggatcctgcagg

SEQ ID NO: 3128410 - DNA, 13 bp, Homo sapiens
ttttcccaataaa

SEQ ID NO: 3128411 - DNA, 17 bp, Homo sapiens
ttttcccatcatccttt

SEQ ID NO: 3128412 - DNA, 20 bp, Homo sapiens
ttttcccatcatcctttgtt

SEQ ID NO: 3128413 - DNA, 19 bp, Homo sapiens
ttttcccctgttaaacagt

SEQ ID NO: 3128414 - DNA, 17 bp, Homo sapiens
ttttcctactgtcctca

SEQ ID NO: 3128415 - DNA, 16 bp, Homo sapiens
tttgtggttgtagaag

SEQ ID NO: 3128416 - DNA, 16 bp, Homo sapiens
tttgtggtttggaata

SEQ ID NO: 3128417 - DNA, 16 bp, Homo sapiens
tttgtggttttatgga

SEQ ID NO: 3128418 - DNA, 14 bp, Homo sapiens
tttgtgtaacatat

SEQ ID NO: 3128419 - DNA, 15 bp, Homo sapiens
tttgtgtaataaagt

SEQ ID NO: 3128420 - DNA, 16 bp, Homo sapiens
tttgtgtaataaagtg

SEQ ID NO: 3128421 - DNA, 17 bp, Homo sapiens
tttgtgtaataaagtgt

SEQ ID NO: 3128422 - DNA, 14 bp, Homo sapiens
tttgtgtacagtgt

SEQ ID NO: 3128423 - DNA, 20 bp, Homo sapiens
tttgtgtgaccaactgtgtt

SEQ ID NO: 3128424 - DNA, 21 bp, Homo sapiens
tttgtgtgatgcgccttgctg

SEQ ID NO: 3128425 - DNA, 15 bp, Homo sapiens
tttgtgtgttgtctt

SEQ ID NO: 3128426 - DNA, 12 bp, Homo sapiens
tttgtgttgcta

SEQ ID NO: 3128427 - DNA, 14 bp, Homo sapiens
tttgtgttgtacaa

SEQ ID NO: 3128428 - DNA, 20 bp, Homo sapiens
tttgtgttgttggaaaaagt

SEQ ID NO: 3128429 - DNA, 21 bp, Homo sapiens
tttgtgttgttggaaaaagtc

SEQ ID NO: 3128430 - DNA, 14 bp, Homo sapiens
tttgttaaaaataa

SEQ ID NO: 3128431 - DNA, 22 bp, Homo sapiens
tttgttaaaattatcaatatct

SEQ ID NO: 3128432 - DNA, 9 bp, Homo sapiens
tttgttact

SEQ ID NO: 3128433 - DNA, 16 bp, Homo sapiens
tttgttactgttcttg

SEQ ID NO: 3128434 - DNA, 17 bp, Homo sapiens
tttgttaggattttcac

SEQ ID NO: 3128435 - DNA, 14 bp, Homo sapiens
tttgttattcctag

SEQ ID NO: 3128436 - DNA, 12 bp, Homo sapiens
tttgttattttg

SEQ ID NO: 3128437 - DNA, 17 bp, Homo sapiens
tttgttcaagttttggg

SEQ ID NO: 3128438 - DNA, 18 bp, Homo sapiens
tttgttcaatgttccatt

SEQ ID NO: 3128439 - DNA, 14 bp, Homo sapiens
tttgttcatgtttg

SEQ ID NO: 3128440 - DNA, 23 bp, Homo sapiens
tttgttcccaaggacttccacat

SEQ ID NO: 3128441 - DNA, 12 bp, Homo sapiens
tttgttccctgt

SEQ ID NO: 3128442 - DNA, 19 bp, Homo sapiens
tttgttctttatgtagaat

SEQ ID NO: 3128443 - DNA, 19 bp, Homo sapiens
tttgttgacaaaattttct

SEQ ID NO: 3128444 - DNA, 12 bp, Homo sapiens
tttgttgtaaaa

SEQ ID NO: 3128445 - DNA, 15 bp, Homo sapiens
tttgttgtagatgct

SEQ ID NO: 3128446 - DNA, 21 bp, Homo sapiens
tttgttgtggccaatgtcgaa

SEQ ID NO: 3128447 - DNA, 12 bp, Homo sapiens
tttgttgtttat

SEQ ID NO: 3128448 - DNA, 12 bp, Homo sapiens
tttgttgtttgg

SEQ ID NO: 3128449 - DNA, 14 bp, Homo sapiens
tttgtttcctttgt

SEQ ID NO: 3128450 - DNA, 17 bp, Homo sapiens
tttgtttctgagaaaag

SEQ ID NO: 3128451 - DNA, 11 bp, Homo sapiens
tttgtttgttt

SEQ ID NO: 3128452 - DNA, 15 bp, Homo sapiens
tttgtttgtttaatt

SEQ ID NO: 3128453 - DNA, 16 bp, Homo sapiens
tttgttttaataaaca

SEQ ID NO: 3128454 - DNA, 12 bp, Homo sapiens
tttgttttgctt

SEQ ID NO: 3128455 - DNA, 13 bp, Homo sapiens
tttgtttttaatt

SEQ ID NO: 3128456 - DNA, 18 bp, Homo sapiens
tttgtttttatttaaatt

SEQ ID NO: 3128457 - DNA, 16 bp, Homo sapiens
tttgttttttgtaact

SEQ ID NO: 3128458 - DNA, 20 bp, Homo sapiens
tttgttttttgtaactacaa

SEQ ID NO: 3128459 - DNA, 16 bp, Homo sapiens
tttgtttttttccaac

SEQ ID NO: 3128460 - DNA, 22 bp, Homo sapiens
tttgtttttttccaactgtgtt

SEQ ID NO: 3128461 - DNA, 19 bp, Homo sapiens
tttgttttttttgactaaa

SEQ ID NO: 3128462 - DNA, 21 bp, Homo sapiens
tttgtttttttttttttggta

SEQ ID NO: 3128463 - DNA, 15 bp, Homo sapiens
ttttaaaaaaagaaa

SEQ ID NO: 3128464 - DNA, 23 bp, Homo sapiens
ttttaaaaaatactctgctattt

SEQ ID NO: 3128465 - DNA, 18 bp, Homo sapiens
ttttaaaaaatattttct

SEQ ID NO: 3128466 - DNA, 22 bp, Homo sapiens
ttttaaaaaatctgttgttcca

SEQ ID NO: 3128467 - DNA, 22 bp, Homo sapiens
ttttaaaaaatgaaaataagtg

SEQ ID NO: 3128468 - DNA, 23 bp, Homo sapiens
ttttaaaaacactacttttgctt

SEQ ID NO: 3128469 - DNA, 13 bp, Homo sapiens
ttttaaaaaccta

SEQ ID NO: 3128470 - DNA, 14 bp, Homo sapiens
ttttaaaaactctt

SEQ ID NO: 3128471 - DNA, 13 bp, Homo sapiens
ttttaaaaatgta

SEQ ID NO: 3128472 - DNA, 19 bp, Homo sapiens
ttttaaaaatgtagaaatt

SEQ ID NO: 3128473 - DNA, 23 bp, Homo sapiens
ttttaaaaatgtcctgcctttta

SEQ ID NO: 3128474 - DNA, 16 bp, Homo sapiens
ttttaaaacacttcca

SEQ ID NO: 3128475 - DNA, 22 bp, Homo sapiens
ttttaaaacacttccataatct

SEQ ID NO: 3128476 - DNA, 22 bp, Homo sapiens
ttttaaaagcacaatcactaaa

SEQ ID NO: 3128477 - DNA, 22 bp, Homo sapiens
ttttaaaaggtagagtcttaca

SEQ ID NO: 3128478 - DNA, 24 bp, Homo sapiens
ttttaaaaggtagagtcttacaat

SEQ ID NO: 3128479 - DNA, 21 bp, Homo sapiens
ttttaaaaggtattttgaata

SEQ ID NO: 3128480 - DNA, 21 bp, Homo sapiens
ttttaaaagttgttaccaaat

SEQ ID NO: 3128481 - DNA, 22 bp, Homo sapiens
ttttaaaagtttcaatgtgatt

SEQ ID NO: 3128482 - DNA, 16 bp, Homo sapiens
ttttaaaatgcaatgt

SEQ ID NO: 3128483 - DNA, 15 bp, Homo sapiens
ttttaaaatttcata

SEQ ID NO: 3128484 - DNA, 16 bp, Homo sapiens
ttttaaacaaaataga

SEQ ID NO: 3128485 - DNA, 23 bp, Homo sapiens
ttttaaacattaatagcagcctt

SEQ ID NO: 3128486 - DNA, 23 bp, Homo sapiens
ttttaaagaatatgactttttat

SEQ ID NO: 3128487 - DNA, 11 bp, Homo sapiens
ttttaaagaca

SEQ ID NO: 3128488 - DNA, 15 bp, Homo sapiens
ttttaaagatctgta

SEQ ID NO: 3128489 - DNA, 14 bp, Homo sapiens
ttttaaagtacttt

SEQ ID NO: 3128490 - DNA, 23 bp, Homo sapiens
ttttaaagtactttcttataaat

SEQ ID NO: 3128491 - DNA, 14 bp, Homo sapiens
ttttaaagtgatta

SEQ ID NO: 3128492 - DNA, 19 bp, Homo sapiens
ttttaaagtgattaaacgt

SEQ ID NO: 3128493 - DNA, 15 bp, Homo sapiens
ttttaaataaacttt

SEQ ID NO: 3128494 - DNA, 21 bp, Homo sapiens
ttttaaataaactttttttca

SEQ ID NO: 3128495 - DNA, 22 bp, Homo sapiens
ttttaaataaactttttttcaa

SEQ ID NO: 3128496 - DNA, 23 bp, Homo sapiens
ttttaaataaactttttttcaat

SEQ ID NO: 3128497 - DNA, 13 bp, Homo sapiens
ttttaaataacct

SEQ ID NO: 3128498 - DNA, 18 bp, Homo sapiens
ttttaaatctaaatctat

SEQ ID NO: 3128499 - DNA, 14 bp, Homo sapiens
ttttaaatgacttg

SEQ ID NO: 3128500 - DNA, 20 bp, Homo sapiens
tttggggagggggaagagaa

SEQ ID NO: 3128501 - DNA, 22 bp, Homo sapiens
tttggggagggggaagagaaat

SEQ ID NO: 3128502 - DNA, 18 bp, Homo sapiens
tttggggcagaaaggact

SEQ ID NO: 3128503 - DNA, 21 bp, Homo sapiens
tttgggggcgccctctctgct

SEQ ID NO: 3128504 - DNA, 22 bp, Homo sapiens
tttgggggcgccctctctgctc

SEQ ID NO: 3128505 - DNA, 22 bp, Homo sapiens
tttggggtacccactgctctgg

SEQ ID NO: 3128506 - DNA, 18 bp, Homo sapiens
tttggggtgcccctctcc

SEQ ID NO: 3128507 - DNA, 16 bp, Homo sapiens
tttggtaaatgtttct

SEQ ID NO: 3128508 - DNA, 22 bp, Homo sapiens
tttggtattacactgtatttgt

SEQ ID NO: 3128509 - DNA, 14 bp, Homo sapiens
tttggtccaaaaaa

SEQ ID NO: 3128510 - DNA, 18 bp, Homo sapiens
tttggtcgaggagtaaca

SEQ ID NO: 3128511 - DNA, 21 bp, Homo sapiens
tttggtgagagtcaaagctga

SEQ ID NO: 3128512 - DNA, 22 bp, Homo sapiens
tttggtgcatagaactgggtaa

SEQ ID NO: 3128513 - DNA, 12 bp, Homo sapiens
tttggtgccttt

SEQ ID NO: 3128514 - DNA, 12 bp, Homo sapiens
tttggtgtgttc

SEQ ID NO: 3128515 - DNA, 18 bp, Homo sapiens
tttggtgttcctggaagc

SEQ ID NO: 3128516 - DNA, 19 bp, Homo sapiens
tttggtgttcctggaagca

SEQ ID NO: 3128517 - DNA, 16 bp, Homo sapiens
tttggtgtttgtctgt

SEQ ID NO: 3128518 - DNA, 15 bp, Homo sapiens
tttggttaagttggc

SEQ ID NO: 3128519 - DNA, 20 bp, Homo sapiens
tttggttcattaattctata

SEQ ID NO: 3128520 - DNA, 17 bp, Homo sapiens
tttggttcctctctggt

SEQ ID NO: 3128521 - DNA, 13 bp, Homo sapiens
tttggttctaata

SEQ ID NO: 3128522 - DNA, 14 bp, Homo sapiens
tttggtttattttt

SEQ ID NO: 3128523 - DNA, 16 bp, Homo sapiens
tttggttttaaaagca

SEQ ID NO: 3128524 - DNA, 21 bp, Homo sapiens
tttgtaaaaacagcattgctt

SEQ ID NO: 3128525 - DNA, 23 bp, Homo sapiens
tttgtaaaaatcttttgaagcat

SEQ ID NO: 3128526 - DNA, 13 bp, Homo sapiens
tttgtaaaccatt

SEQ ID NO: 3128527 - DNA, 16 bp, Homo sapiens
tttgtaaactcaaaat

SEQ ID NO: 3128528 - DNA, 16 bp, Homo sapiens
tttgtaaactggaatt

SEQ ID NO: 3128529 - DNA, 17 bp, Homo sapiens
tttgtaaactgtatcaa

SEQ ID NO: 3128530 - DNA, 13 bp, Homo sapiens
tttgtaaacttct

SEQ ID NO: 3128531 - DNA, 13 bp, Homo sapiens
tttgtaaagaaat

SEQ ID NO: 3128532 - DNA, 21 bp, Homo sapiens
tttgtaaagaaatttactata

SEQ ID NO: 3128533 - DNA, 15 bp, Homo sapiens
tttgtaaatactgct

SEQ ID NO: 3128534 - DNA, 20 bp, Homo sapiens
tttgtaaataggatttttag

SEQ ID NO: 3128535 - DNA, 15 bp, Homo sapiens
tttgtaaatctgcca

SEQ ID NO: 3128536 - DNA, 21 bp, Homo sapiens
tttgtaaatgcctcttaaatt

SEQ ID NO: 3128537 - DNA, 22 bp, Homo sapiens
tttgtaaattaaacataaaaca

SEQ ID NO: 3128538 - DNA, 18 bp, Homo sapiens
tttgtaaattatttatgt

SEQ ID NO: 3128539 - DNA, 17 bp, Homo sapiens
tttgtaagacatttgta

SEQ ID NO: 3128540 - DNA, 18 bp, Homo sapiens
tttgtaagacatttgtat

SEQ ID NO: 3128541 - DNA, 12 bp, Homo sapiens
tttgtaagagtg

SEQ ID NO: 3128542 - DNA, 21 bp, Homo sapiens
tttgtaagtttcaggtgacat

SEQ ID NO: 3128543 - DNA, 14 bp, Homo sapiens
tttgtaataaagta

SEQ ID NO: 3128544 - DNA, 17 bp, Homo sapiens
tttgtaatgcactgttt

SEQ ID NO: 3128545 - DNA, 15 bp, Homo sapiens
tttgtaatgtgaaaa

SEQ ID NO: 3128546 - DNA, 23 bp, Homo sapiens
tttgtaattacaggagggaacat

SEQ ID NO: 3128547 - DNA, 18 bp, Homo sapiens
tttgtaattgcttacatt

SEQ ID NO: 3128548 - DNA, 14 bp, Homo sapiens
tttgtaattgtgta

SEQ ID NO: 3128549 - DNA, 21 bp, Homo sapiens
tttgtaattttaaaagtctat

SEQ ID NO: 3128550 - DNA, 20 bp, Homo sapiens
tttgtacaaagttttccttt

SEQ ID NO: 3128551 - DNA, 21 bp, Homo sapiens
tttgtacaaagttttcctttg

SEQ ID NO: 3128552 - DNA, 12 bp, Homo sapiens
tttgtacagaat

SEQ ID NO: 3128553 - DNA, 16 bp, Homo sapiens
tttgtacatagattta

SEQ ID NO: 3128554 - DNA, 19 bp, Homo sapiens
tttgtacatagttatttat

SEQ ID NO: 3128555 - DNA, 14 bp, Homo sapiens
tttgtaccatggtg

SEQ ID NO: 3128556 - DNA, 17 bp, Homo sapiens
tttgtaccatggtgtga

SEQ ID NO: 3128557 - DNA, 14 bp, Homo sapiens
tttgtactgaatct

SEQ ID NO: 3128558 - DNA, 20 bp, Homo sapiens
tttgtacttccacctccacc

SEQ ID NO: 3128559 - DNA, 14 bp, Homo sapiens
tttgtacttttagt

SEQ ID NO: 3128560 - DNA, 13 bp, Homo sapiens
tttgtagagccag

SEQ ID NO: 3128561 - DNA, 22 bp, Homo sapiens
tttgtaggaaggtctcattctt

SEQ ID NO: 3128562 - DNA, 21 bp, Homo sapiens
tttgtaggagaaactcccatg

SEQ ID NO: 3128563 - DNA, 20 bp, Homo sapiens
tttgtaggtaaaatgtattt

SEQ ID NO: 3128564 - DNA, 18 bp, Homo sapiens
tttgtagttactcaagca

SEQ ID NO: 3128565 - DNA, 19 bp, Homo sapiens
tttgtagttactcaagcag

SEQ ID NO: 3128566 - DNA, 16 bp, Homo sapiens
tttgtataaactgtca

SEQ ID NO: 3128567 - DNA, 18 bp, Homo sapiens
tttgtataacttcttaaa

SEQ ID NO: 3128568 - DNA, 22 bp, Homo sapiens
tttgtatacaaatatattgtta

SEQ ID NO: 3128569 - DNA, 15 bp, Homo sapiens
tttgtatatacagtt

SEQ ID NO: 3128570 - DNA, 19 bp, Homo sapiens
tttgtatattacacatttg

SEQ ID NO: 3128571 - DNA, 21 bp, Homo sapiens
tttgtatctctgaagcatgtt

SEQ ID NO: 3128572 - DNA, 16 bp, Homo sapiens
tttgtatgagatggtt

SEQ ID NO: 3128573 - DNA, 21 bp, Homo sapiens
tttgtatgagatggttaaaaa

SEQ ID NO: 3128574 - DNA, 16 bp, Homo sapiens
tttgtatgcactttgt

SEQ ID NO: 3128575 - DNA, 23 bp, Homo sapiens
tttgtatgtgaacaaatcaaatt

SEQ ID NO: 3128576 - DNA, 13 bp, Homo sapiens
tttgtatgtgtgt

SEQ ID NO: 3128577 - DNA, 16 bp, Homo sapiens
tttgtatgttaaagag

SEQ ID NO: 3128578 - DNA, 17 bp, Homo sapiens
tttgtattacttaggtt

SEQ ID NO: 3128579 - DNA, 22 bp, Homo sapiens
tttgtattactttctctgtagt

SEQ ID NO: 3128580 - DNA, 12 bp, Homo sapiens
tttgtattgctt

SEQ ID NO: 3128581 - DNA, 18 bp, Homo sapiens
tttgtattgttaatatct

SEQ ID NO: 3128582 - DNA, 16 bp, Homo sapiens
tttgtatttattaatt

SEQ ID NO: 3128583 - DNA, 18 bp, Homo sapiens
tttgtatttattaatttg

SEQ ID NO: 3128584 - DNA, 13 bp, Homo sapiens
tttgtatttggaa

SEQ ID NO: 3128585 - DNA, 21 bp, Homo sapiens
tttgtatttggaatatttgaa

SEQ ID NO: 3128586 - DNA, 13 bp, Homo sapiens
tttgtattttcat

SEQ ID NO: 3128587 - DNA, 13 bp, Homo sapiens
tttgtattttgct

SEQ ID NO: 3128588 - DNA, 16 bp, Homo sapiens
tttgtattttgtgtga

SEQ ID NO: 3128589 - DNA, 23 bp, Homo sapiens
tttgtattttgtgtgaccaactg

SEQ ID NO: 3128590 - DNA, 22 bp, Homo sapiens
tttgtatttttgattgttatgt

SEQ ID NO: 3128591 - DNA, 17 bp, Homo sapiens
tttgtcacattatttat

SEQ ID NO: 3128592 - DNA, 21 bp, Homo sapiens
tttcatcttctggaatattgt

SEQ ID NO: 3128593 - DNA, 19 bp, Homo sapiens
tttcatgaaaataccattt

SEQ ID NO: 3128594 - DNA, 19 bp, Homo sapiens
tttcatgctatctctgtgt

SEQ ID NO: 3128595 - DNA, 13 bp, Homo sapiens
tttcatgcttcca

SEQ ID NO: 3128596 - DNA, 20 bp, Homo sapiens
tttcatggtgaaaatgtact

SEQ ID NO: 3128597 - DNA, 12 bp, Homo sapiens
tttcatgtacaa

SEQ ID NO: 3128598 - DNA, 21 bp, Homo sapiens
tttcatgtctttactggacct

SEQ ID NO: 3128599 - DNA, 17 bp, Homo sapiens
tttcatgtggctgtaga

SEQ ID NO: 3128600 - DNA, 17 bp, Homo sapiens
tttcatgttcactgtga

SEQ ID NO: 3128601 - DNA, 16 bp, Homo sapiens
tttcattacaatggaa

SEQ ID NO: 3128602 - DNA, 15 bp, Homo sapiens
tttcattacttttaa

SEQ ID NO: 3128603 - DNA, 21 bp, Homo sapiens
tttcattattagtactgctct

SEQ ID NO: 3128604 - DNA, 16 bp, Homo sapiens
tttcattattctcata

SEQ ID NO: 3128605 - DNA, 14 bp, Homo sapiens
tttcattcaaatca

SEQ ID NO: 3128606 - DNA, 23 bp, Homo sapiens
tttcattcagctaacaaactaga

SEQ ID NO: 3128607 - DNA, 21 bp, Homo sapiens
tttcattcccccttcctagtg

SEQ ID NO: 3128608 - DNA, 17 bp, Homo sapiens
tttcattgcctgtgtat

SEQ ID NO: 3128609 - DNA, 15 bp, Homo sapiens
tttcattgtatgatg

SEQ ID NO: 3128610 - DNA, 17 bp, Homo sapiens
tttcattgtatgatgtg

SEQ ID NO: 3128611 - DNA, 16 bp, Homo sapiens
tttcattttaaaaagt

SEQ ID NO: 3128612 - DNA, 20 bp, Homo sapiens
tttccaaaacaatttctttt

SEQ ID NO: 3128613 - DNA, 13 bp, Homo sapiens
tttccaaattatt

SEQ ID NO: 3128614 - DNA, 14 bp, Homo sapiens
tttccaaattattt

SEQ ID NO: 3128615 - DNA, 23 bp, Homo sapiens
tttccaacacacacaacgtaaaa

SEQ ID NO: 3128616 - DNA, 18 bp, Homo sapiens
tttccaacaccacagaca

SEQ ID NO: 3128617 - DNA, 20 bp, Homo sapiens
tttccaacaccacagacaca

SEQ ID NO: 3128618 - DNA, 23 bp, Homo sapiens
tttccaacaccacagacacacac

SEQ ID NO: 3128619 - DNA, 15 bp, Homo sapiens
tttccaagtaagagt

SEQ ID NO: 3128620 - DNA, 14 bp, Homo sapiens
tttccaagtaatat

SEQ ID NO: 3128621 - DNA, 23 bp, Homo sapiens
tttccaccacagccagcacctgg

SEQ ID NO: 3128622 - DNA, 12 bp, Homo sapiens
tttccactttgt

SEQ ID NO: 3128623 - DNA, 16 bp, Homo sapiens
tttccagcagaagaca

SEQ ID NO: 3128624 - DNA, 21 bp, Homo sapiens
tttccagcagaagacaaaaag

SEQ ID NO: 3128625 - DNA, 16 bp, Homo sapiens
tttccagctttctccc

SEQ ID NO: 3128626 - DNA, 18 bp, Homo sapiens
tttccaggatcctgcagg

SEQ ID NO: 3128627 - DNA, 19 bp, Homo sapiens
tttccaggcccctgaggac

SEQ ID NO: 3128628 - DNA, 15 bp, Homo sapiens
tttccagtattgaaa

SEQ ID NO: 3128629 - DNA, 19 bp, Homo sapiens
tttccagtattgaaaactt

SEQ ID NO: 3128630 - DNA, 23 bp, Homo sapiens
tttccagtattgaaaacttcaaa

SEQ ID NO: 3128631 - DNA, 22 bp, Homo sapiens
tttccatacagggtctcttcct

SEQ ID NO: 3128632 - DNA, 14 bp, Homo sapiens
tttccatcatttta

SEQ ID NO: 3128633 - DNA, 19 bp, Homo sapiens
tttccatcattttacagtg

SEQ ID NO: 3128634 - DNA, 15 bp, Homo sapiens
tttccatctctggta

SEQ ID NO: 3128635 - DNA, 18 bp, Homo sapiens
tttccatcttaatgttac

SEQ ID NO: 3128636 - DNA, 23 bp, Homo sapiens
tttccatgcaccctcatacacag

SEQ ID NO: 3128637 - DNA, 21 bp, Homo sapiens
tttccatgcagactcctcaga

SEQ ID NO: 3128638 - DNA, 19 bp, Homo sapiens
tttccatgcgtgtttctga

SEQ ID NO: 3128639 - DNA, 13 bp, Homo sapiens
tttccatttattt

SEQ ID NO: 3128640 - DNA, 19 bp, Homo sapiens
tttccatttatttatgaaa

SEQ ID NO: 3128641 - DNA, 18 bp, Homo sapiens
tttccatttggtattaca

SEQ ID NO: 3128642 - DNA, 18 bp, Homo sapiens
tttcccaagtcagacaga

SEQ ID NO: 3128643 - DNA, 21 bp, Homo sapiens
tttcccaccattcctgccttt

SEQ ID NO: 3128644 - DNA, 23 bp, Homo sapiens
tttcccactcattctgaattaat

SEQ ID NO: 3128645 - DNA, 12 bp, Homo sapiens
tttcccataatt

SEQ ID NO: 3128646 - DNA, 14 bp, Homo sapiens
tttcccataatttt

SEQ ID NO: 3128647 - DNA, 13 bp, Homo sapiens
tttcccatctgca

SEQ ID NO: 3128648 - DNA, 22 bp, Homo sapiens
tttcccatctgcaccccttctc

SEQ ID NO: 3128649 - DNA, 21 bp, Homo sapiens
tttcccatttgtgccagagga

SEQ ID NO: 3128650 - DNA, 21 bp, Homo sapiens
tttccccagggaaggaaaaat

SEQ ID NO: 3128651 - DNA, 23 bp, Homo sapiens
tttccccccactctccccacact

SEQ ID NO: 3128652 - DNA, 15 bp, Homo sapiens
tttcccccgagctct

SEQ ID NO: 3128653 - DNA, 21 bp, Homo sapiens
tttcccccgagctcttggcct

SEQ ID NO: 3128654 - DNA, 16 bp, Homo sapiens
tttcccccttctacat

SEQ ID NO: 3128655 - DNA, 13 bp, Homo sapiens
tttcccctctctg

SEQ ID NO: 3128656 - DNA, 14 bp, Homo sapiens
tttcccctgtcctg

SEQ ID NO: 3128657 - DNA, 15 bp, Homo sapiens
tttcccctgttaaac

SEQ ID NO: 3128658 - DNA, 12 bp, Homo sapiens
tttccccttccc

SEQ ID NO: 3128659 - DNA, 20 bp, Homo sapiens
tttccccttcccctcccctc

SEQ ID NO: 3128660 - DNA, 12 bp, Homo sapiens
tttccccttcct

SEQ ID NO: 3128661 - DNA, 20 bp, Homo sapiens
tttccctcctgacaaatatt

SEQ ID NO: 3128662 - DNA, 20 bp, Homo sapiens
tttccctcttcggtgttctt

SEQ ID NO: 3128663 - DNA, 16 bp, Homo sapiens
tttccctgcctctcat

SEQ ID NO: 3128664 - DNA, 16 bp, Homo sapiens
tttccctgctgaatgc

SEQ ID NO: 3128665 - DNA, 19 bp, Homo sapiens
tttcccttgccctttccat

SEQ ID NO: 3128666 - DNA, 20 bp, Homo sapiens
tttcccttgtgtcaagacat

SEQ ID NO: 3128667 - DNA, 22 bp, Homo sapiens
tttccgctgtcgccccaggccc

SEQ ID NO: 3128668 - DNA, 18 bp, Homo sapiens
tttcctaaacataattgt

SEQ ID NO: 3128669 - DNA, 13 bp, Homo sapiens
tttcctaaatgtt

SEQ ID NO: 3128670 - DNA, 14 bp, Homo sapiens
tttcctaaatgttt

SEQ ID NO: 3128671 - DNA, 12 bp, Homo sapiens
tttcctaatact

SEQ ID NO: 3128672 - DNA, 19 bp, Homo sapiens
tttcctactgtcctcagag

SEQ ID NO: 3128673 - DNA, 17 bp, Homo sapiens
tttcctagccctctcac

SEQ ID NO: 3128674 - DNA, 15 bp, Homo sapiens
tttcctatgggaaca

SEQ ID NO: 3128675 - DNA, 19 bp, Homo sapiens
tttcctcaagtatcttcta

SEQ ID NO: 3128676 - DNA, 11 bp, Homo sapiens
tttcctcagtg

SEQ ID NO: 3128677 - DNA, 14 bp, Homo sapiens
tttcctcatgtaac

SEQ ID NO: 3128678 - DNA, 15 bp, Homo sapiens
tttcctcatgtaaca

SEQ ID NO: 3128679 - DNA, 20 bp, Homo sapiens
tttcctcatgtaacattggt

SEQ ID NO: 3128680 - DNA, 16 bp, Homo sapiens
tttcctccccctgcaa

SEQ ID NO: 3128681 - DNA, 16 bp, Homo sapiens
tttcctcctacctttt

SEQ ID NO: 3128682 - DNA, 22 bp, Homo sapiens
tttcctcctaccttttgtctct

SEQ ID NO: 3128683 - DNA, 16 bp, Homo sapiens
tttcctcctttatcac

SEQ ID NO: 3128684 - DNA, 17 bp, Homo sapiens
tttcctcctttatcaca

SEQ ID NO: 3128685 - DNA, 11 bp, Homo sapiens
tttcctctaaa

SEQ ID NO: 3128686 - DNA, 19 bp, Homo sapiens
tttcctctctttgttctca

SEQ ID NO: 3128687 - DNA, 22 bp, Homo sapiens
tttcctctctttgttctcagct

SEQ ID NO: 3128688 - DNA, 16 bp, Homo sapiens
tttcctctgagcccag

SEQ ID NO: 3128689 - DNA, 19 bp, Homo sapiens
tttcctctgagcccagctg

SEQ ID NO: 3128690 - DNA, 22 bp, Homo sapiens
tttcctctgagcccagctgcct

SEQ ID NO: 3128691 - DNA, 23 bp, Homo sapiens
tttcctctgagcccagctgcctg

SEQ ID NO: 3128692 - DNA, 16 bp, Homo sapiens
tttcctctgttcacaa

SEQ ID NO: 3128693 - DNA, 22 bp, Homo sapiens
tttcctcttctattttgtaaac

SEQ ID NO: 3128694 - DNA, 12 bp, Homo sapiens
tttcctcttgtg

SEQ ID NO: 3128695 - DNA, 12 bp, Homo sapiens
tttcctgcaggc

SEQ ID NO: 3128696 - DNA, 17 bp, Homo sapiens
tttcctgccttcttctt

SEQ ID NO: 3128697 - DNA, 16 bp, Homo sapiens
tttcctggacactcag

SEQ ID NO: 3128698 - DNA, 20 bp, Homo sapiens
tttcctggacactcagacct

SEQ ID NO: 3128699 - DNA, 19 bp, Homo sapiens
tttcctggacttaaagaaa

SEQ ID NO: 3128700 - DNA, 16 bp, Homo sapiens
tttcctggtgccaatt

SEQ ID NO: 3128701 - DNA, 13 bp, Homo sapiens
tttcctgtacaat

SEQ ID NO: 3128702 - DNA, 21 bp, Homo sapiens
tttcctgtcagtgtttttgaa

SEQ ID NO: 3128703 - DNA, 23 bp, Homo sapiens
tttcctgtcagtgtttttgaaac

SEQ ID NO: 3128704 - DNA, 22 bp, Homo sapiens
tttcctgtggcataaattgcat

SEQ ID NO: 3128705 - DNA, 12 bp, Homo sapiens
tttcctgtgtct

SEQ ID NO: 3128706 - DNA, 16 bp, Homo sapiens
tttccttaaactgtgt

SEQ ID NO: 3128707 - DNA, 16 bp, Homo sapiens
tttccttaatccagct

SEQ ID NO: 3128708 - DNA, 22 bp, Homo sapiens
tttccttaccataccactttga

SEQ ID NO: 3128709 - DNA, 19 bp, Homo sapiens
tttccttcaagccagcaac

SEQ ID NO: 3128710 - DNA, 18 bp, Homo sapiens
tttccttgttggtcagag

SEQ ID NO: 3128711 - DNA, 21 bp, Homo sapiens
tttcctttaaaaaaatttaag

SEQ ID NO: 3128712 - DNA, 17 bp, Homo sapiens
tttcctttccccagccc

SEQ ID NO: 3128713 - DNA, 21 bp, Homo sapiens
tttgatctggacagaacattt

SEQ ID NO: 3128714 - DNA, 21 bp, Homo sapiens
tttgatgagatattaaattct

SEQ ID NO: 3128715 - DNA, 17 bp, Homo sapiens
tttgatgcatgtctttt

SEQ ID NO: 3128716 - DNA, 18 bp, Homo sapiens
tttgatgctatttatgca

SEQ ID NO: 3128717 - DNA, 15 bp, Homo sapiens
tttgatgctgtttga

SEQ ID NO: 3128718 - DNA, 20 bp, Homo sapiens
tttgatggtgccagagaggg

SEQ ID NO: 3128719 - DNA, 23 bp, Homo sapiens
tttgatgtatgtgtgaaacaatg

SEQ ID NO: 3128720 - DNA, 19 bp, Homo sapiens
tttgatgtttgtggcctca

SEQ ID NO: 3128721 - DNA, 16 bp, Homo sapiens
tttgattaacaaatat

SEQ ID NO: 3128722 - DNA, 20 bp, Homo sapiens
tttgattaatgtttcttaaa

SEQ ID NO: 3128723 - DNA, 18 bp, Homo sapiens
tttgattcgccctcctcc

SEQ ID NO: 3128724 - DNA, 19 bp, Homo sapiens
tttgattgttatgtaaaac

SEQ ID NO: 3128725 - DNA, 15 bp, Homo sapiens
tttgatttacagcaa

SEQ ID NO: 3128726 - DNA, 12 bp, Homo sapiens
tttgatttcaac

SEQ ID NO: 3128727 - DNA, 16 bp, Homo sapiens
tttgatttcaacatga

SEQ ID NO: 3128728 - DNA, 11 bp, Homo sapiens
tttgatttttg

SEQ ID NO: 3128729 - DNA, 19 bp, Homo sapiens
tttgcaaacccgaaaataa

SEQ ID NO: 3128730 - DNA, 12 bp, Homo sapiens
tttgcacagctc

SEQ ID NO: 3128731 - DNA, 16 bp, Homo sapiens
tttgcacagctctccg

SEQ ID NO: 3128732 - DNA, 19 bp, Homo sapiens
tttgcacagtgtgtgactt

SEQ ID NO: 3128733 - DNA, 13 bp, Homo sapiens
tttgcaccaaaga

SEQ ID NO: 3128734 - DNA, 15 bp, Homo sapiens
tttgcacctgtcccc

SEQ ID NO: 3128735 - DNA, 21 bp, Homo sapiens
tttgcactaaatcagagacaa

SEQ ID NO: 3128736 - DNA, 17 bp, Homo sapiens
tttgcactgagggccac

SEQ ID NO: 3128737 - DNA, 22 bp, Homo sapiens
tttgcactgagggccacactat

SEQ ID NO: 3128738 - DNA, 21 bp, Homo sapiens
tttgcacttgtgattatttat

SEQ ID NO: 3128739 - DNA, 18 bp, Homo sapiens
tttgcagataattctgga

SEQ ID NO: 3128740 - DNA, 12 bp, Homo sapiens
tttgcaggctct

SEQ ID NO: 3128741 - DNA, 14 bp, Homo sapiens
tttgcaggctctgg

SEQ ID NO: 3128742 - DNA, 9 bp, Homo sapiens
tttgcagta

SEQ ID NO: 3128743 - DNA, 21 bp, Homo sapiens
tttgcagtagagtcatctcca

SEQ ID NO: 3128744 - DNA, 22 bp, Homo sapiens
tttgcagttggactctcaggga

SEQ ID NO: 3128745 - DNA, 14 bp, Homo sapiens
tttgcataatgcaa

SEQ ID NO: 3128746 - DNA, 23 bp, Homo sapiens
tttgcatagtaccaatcatttta

SEQ ID NO: 3128747 - DNA, 21 bp, Homo sapiens
tttgcatatatgttcttcata

SEQ ID NO: 3128748 - DNA, 17 bp, Homo sapiens
tttgcatattctattgt

SEQ ID NO: 3128749 - DNA, 18 bp, Homo sapiens
tttgcatgatatcttcaa

SEQ ID NO: 3128750 - DNA, 19 bp, Homo sapiens
tttgcatgatatcttcaag

SEQ ID NO: 3128751 - DNA, 16 bp, Homo sapiens
tttgcatgtcgcacaa

SEQ ID NO: 3128752 - DNA, 17 bp, Homo sapiens
tttgcattaaattcaca

SEQ ID NO: 3128753 - DNA, 19 bp, Homo sapiens
tttgcattgaacacaaact

SEQ ID NO: 3128754 - DNA, 19 bp, Homo sapiens
tttgcatttaaaacagaca

SEQ ID NO: 3128755 - DNA, 23 bp, Homo sapiens
tttgcatttaaaacagacactgg

SEQ ID NO: 3128756 - DNA, 22 bp, Homo sapiens
tttgcattttgccgctgagata

SEQ ID NO: 3128757 - DNA, 23 bp, Homo sapiens
tttgccaagttgctgtcactgtt

SEQ ID NO: 3128758 - DNA, 12 bp, Homo sapiens
tttgccaataaa

SEQ ID NO: 3128759 - DNA, 13 bp, Homo sapiens
tttgccaataaag

SEQ ID NO: 3128760 - DNA, 15 bp, Homo sapiens
tttgccaataaagct

SEQ ID NO: 3128761 - DNA, 17 bp, Homo sapiens
tttgccaataaagcttt

SEQ ID NO: 3128762 - DNA, 15 bp, Homo sapiens
tttgccacagctttt

SEQ ID NO: 3128763 - DNA, 16 bp, Homo sapiens
tttgccacagcttttg

SEQ ID NO: 3128764 - DNA, 10 bp, Homo sapiens
tttgccagca

SEQ ID NO: 3128765 - DNA, 14 bp, Homo sapiens
tttgccatgggctt

SEQ ID NO: 3128766 - DNA, 11 bp, Homo sapiens
tttgccatttg

SEQ ID NO: 3128767 - DNA, 12 bp, Homo sapiens
tttgccatttga

SEQ ID NO: 3128768 - DNA, 18 bp, Homo sapiens
tttgccatttttctataa

SEQ ID NO: 3128769 - DNA, 18 bp, Homo sapiens
tttgcccagaaagaagat

SEQ ID NO: 3128770 - DNA, 15 bp, Homo sapiens
tttgcccatttacac

SEQ ID NO: 3128771 - DNA, 11 bp, Homo sapiens
tttgcctggct

SEQ ID NO: 3128772 - DNA, 12 bp, Homo sapiens
tttgccttctct

SEQ ID NO: 3128773 - DNA, 14 bp, Homo sapiens
tttgccttgcagaa

SEQ ID NO: 3128774 - DNA, 21 bp, Homo sapiens
tttgccttgggctgctcctca

SEQ ID NO: 3128775 - DNA, 12 bp, Homo sapiens
tttgcctttaaa

SEQ ID NO: 3128776 - DNA, 22 bp, Homo sapiens
tttgcctttctgggagcagaaa

SEQ ID NO: 3128777 - DNA, 19 bp, Homo sapiens
tttgcctttcttctgccct

SEQ ID NO: 3128778 - DNA, 20 bp, Homo sapiens
tttgctacaaatttatgcat

SEQ ID NO: 3128779 - DNA, 21 bp, Homo sapiens
tttgctacaaatttatgcatt

SEQ ID NO: 3128780 - DNA, 14 bp, Homo sapiens
tttgctataatcat

SEQ ID NO: 3128781 - DNA, 15 bp, Homo sapiens
tttgctataatcatt

SEQ ID NO: 3128782 - DNA, 16 bp, Homo sapiens
tttgctataatcatta

SEQ ID NO: 3128783 - DNA, 20 bp, Homo sapiens
tttgctataatcattagttt

SEQ ID NO: 3128784 - DNA, 20 bp, Homo sapiens
tttgctattgacaagtcatt

SEQ ID NO: 3128785 - DNA, 17 bp, Homo sapiens
tttgctccgctcccacc

SEQ ID NO: 3128786 - DNA, 20 bp, Homo sapiens
tttgctccgctcccaccgcc

SEQ ID NO: 3128787 - DNA, 15 bp, Homo sapiens
tttgctctatgggaa

SEQ ID NO: 3128788 - DNA, 12 bp, Homo sapiens
tttgctcttgcc

SEQ ID NO: 3128789 - DNA, 17 bp, Homo sapiens
tttgctcttgtcccacg

SEQ ID NO: 3128790 - DNA, 17 bp, Homo sapiens
tttgctcttgtttttat

SEQ ID NO: 3128791 - DNA, 22 bp, Homo sapiens
tttgctctttgacaactaaaat

SEQ ID NO: 3128792 - DNA, 19 bp, Homo sapiens
tttgctgagcatgtactga

SEQ ID NO: 3128793 - DNA, 21 bp, Homo sapiens
tttgctgatttcccctcttcc

SEQ ID NO: 3128794 - DNA, 12 bp, Homo sapiens
tttgctgcctta

SEQ ID NO: 3128795 - DNA, 18 bp, Homo sapiens
tttgctgcgcaccaatgc

SEQ ID NO: 3128796 - DNA, 22 bp, Homo sapiens
tttgctgctaccgccctgggct

SEQ ID NO: 3128797 - DNA, 17 bp, Homo sapiens
tttgctgctatgaaaat

SEQ ID NO: 3128798 - DNA, 14 bp, Homo sapiens
tttgctggaagaaa

SEQ ID NO: 3128799 - DNA, 20 bp, Homo sapiens
tttgctggttgtaaatactt

SEQ ID NO: 3128800 - DNA, 19 bp, Homo sapiens
tttgctgtactagagatct

SEQ ID NO: 3128801 - DNA, 18 bp, Homo sapiens
tttgctgtactcttgctg

SEQ ID NO: 3128802 - DNA, 21 bp, Homo sapiens
tttgctgtactcttgctgatg

SEQ ID NO: 3128803 - DNA, 14 bp, Homo sapiens
tttgctgtgaacaa

SEQ ID NO: 3128804 - DNA, 15 bp, Homo sapiens
tttgctgtgaacaat

SEQ ID NO: 3128805 - DNA, 19 bp, Homo sapiens
tttgctgtgaggctgtcct

SEQ ID NO: 3128806 - DNA, 21 bp, Homo sapiens
tttgctgttttaaacattaat

SEQ ID NO: 3128807 - DNA, 15 bp, Homo sapiens
tttgcttattgttcc

SEQ ID NO: 3128808 - DNA, 14 bp, Homo sapiens
tttgcttgaacaca

SEQ ID NO: 3128809 - DNA, 21 bp, Homo sapiens
tttgcttgctcatatgcatgt

SEQ ID NO: 3128810 - DNA, 19 bp, Homo sapiens
tttgcttggaaattccttg

SEQ ID NO: 3128811 - DNA, 18 bp, Homo sapiens
tttgcttgtactgggaca

SEQ ID NO: 3128812 - DNA, 17 bp, Homo sapiens
tttcggattttttccaa

SEQ ID NO: 3128813 - DNA, 14 bp, Homo sapiens
tttcgtatgaaaat

SEQ ID NO: 3128814 - DNA, 13 bp, Homo sapiens
tttcgtggggagg

SEQ ID NO: 3128815 - DNA, 21 bp, Homo sapiens
tttcgtgggtctgttttcctt

SEQ ID NO: 3128816 - DNA, 13 bp, Homo sapiens
tttcgttaacatt

SEQ ID NO: 3128817 - DNA, 13 bp, Homo sapiens
tttcgttccctga

SEQ ID NO: 3128818 - DNA, 14 bp, Homo sapiens
tttcgtttctgtat

SEQ ID NO: 3128819 - DNA, 12 bp, Homo sapiens
tttcgtttgttt

SEQ ID NO: 3128820 - DNA, 14 bp, Homo sapiens
tttcgtttgtttgt

SEQ ID NO: 3128821 - DNA, 17 bp, Homo sapiens
tttctaaagtgttggtc

SEQ ID NO: 3128822 - DNA, 21 bp, Homo sapiens
tttctaacaaaaaaatatatt

SEQ ID NO: 3128823 - DNA, 16 bp, Homo sapiens
tttctaactttcttta

SEQ ID NO: 3128824 - DNA, 19 bp, Homo sapiens
tttctaagaagttgtttga

SEQ ID NO: 3128825 - DNA, 11 bp, Homo sapiens
tttctaagaga

SEQ ID NO: 3128826 - DNA, 16 bp, Homo sapiens
tttctaagagaagtta

SEQ ID NO: 3128827 - DNA, 14 bp, Homo sapiens
tttctaagagagct

SEQ ID NO: 3128828 - DNA, 18 bp, Homo sapiens
tttctaaggaatgcacaa

SEQ ID NO: 3128829 - DNA, 23 bp, Homo sapiens
tttctacatgactgggcctccct

SEQ ID NO: 3128830 - DNA, 15 bp, Homo sapiens
tttctacattattgc

SEQ ID NO: 3128831 - DNA, 15 bp, Homo sapiens
tttctacccagcgag

SEQ ID NO: 3128832 - DNA, 18 bp, Homo sapiens
tttctacccagcgagccc

SEQ ID NO: 3128833 - DNA, 17 bp, Homo sapiens
tttctaccctagccatt

SEQ ID NO: 3128834 - DNA, 20 bp, Homo sapiens
tttctaccctagccattcct

SEQ ID NO: 3128835 - DNA, 16 bp, Homo sapiens
tttctactatatacat

SEQ ID NO: 3128836 - DNA, 21 bp, Homo sapiens
tttctagactataaatgttgc

SEQ ID NO: 3128837 - DNA, 20 bp, Homo sapiens
tttctagcaattttctttgt

SEQ ID NO: 3128838 - DNA, 18 bp, Homo sapiens
tttctagtggtctttgta

SEQ ID NO: 3128839 - DNA, 14 bp, Homo sapiens
tttctagttgagga

SEQ ID NO: 3128840 - DNA, 14 bp, Homo sapiens
tttctagtttcagt

SEQ ID NO: 3128841 - DNA, 18 bp, Homo sapiens
tttctagtttttaatttt

SEQ ID NO: 3128842 - DNA, 20 bp, Homo sapiens
tttctagttttttttctagt

SEQ ID NO: 3128843 - DNA, 14 bp, Homo sapiens
tttctataaatcag

SEQ ID NO: 3128844 - DNA, 15 bp, Homo sapiens
tttctataaatcagt

SEQ ID NO: 3128845 - DNA, 16 bp, Homo sapiens
tttctataaatcagta

SEQ ID NO: 3128846 - DNA, 14 bp, Homo sapiens
tttctatcacatat

SEQ ID NO: 3128847 - DNA, 20 bp, Homo sapiens
tttctattatggaaaactgt

SEQ ID NO: 3128848 - DNA, 14 bp, Homo sapiens
tttctattccttct

SEQ ID NO: 3128849 - DNA, 15 bp, Homo sapiens
tttctattttcacaa

SEQ ID NO: 3128850 - DNA, 14 bp, Homo sapiens
tttctcaaaagcat

SEQ ID NO: 3128851 - DNA, 16 bp, Homo sapiens
tttctcaaaagcattt

SEQ ID NO: 3128852 - DNA, 16 bp, Homo sapiens
tttctcaaagttttga

SEQ ID NO: 3128853 - DNA, 22 bp, Homo sapiens
tttctcaaagttttgaaaagct

SEQ ID NO: 3128854 - DNA, 17 bp, Homo sapiens
tttctcagtgttggtat

SEQ ID NO: 3128855 - DNA, 15 bp, Homo sapiens
tttctcatatttgag

SEQ ID NO: 3128856 - DNA, 21 bp, Homo sapiens
tttctccagctcagaacccag

SEQ ID NO: 3128857 - DNA, 12 bp, Homo sapiens
tttctccagctg

SEQ ID NO: 3128858 - DNA, 15 bp, Homo sapiens
tttctccagtgctgt

SEQ ID NO: 3128859 - DNA, 14 bp, Homo sapiens
tttctccatcttta

SEQ ID NO: 3128860 - DNA, 20 bp, Homo sapiens
tttctccccatccccttcct

SEQ ID NO: 3128861 - DNA, 21 bp, Homo sapiens
tttctcccccgacactgctgc

SEQ ID NO: 3128862 - DNA, 18 bp, Homo sapiens
tttctccggggtctgtgc

SEQ ID NO: 3128863 - DNA, 20 bp, Homo sapiens
tttctccggggtctgtgctg

SEQ ID NO: 3128864 - DNA, 12 bp, Homo sapiens
tttctcctgtga

SEQ ID NO: 3128865 - DNA, 19 bp, Homo sapiens
tttctccttagtcttctca

SEQ ID NO: 3128866 - DNA, 20 bp, Homo sapiens
tttctccttagtcttctcat

SEQ ID NO: 3128867 - DNA, 19 bp, Homo sapiens
tttctcctttgcaatagca

SEQ ID NO: 3128868 - DNA, 20 bp, Homo sapiens
tttctcctttgcaatagcag

SEQ ID NO: 3128869 - DNA, 17 bp, Homo sapiens
tttctcgattttatctt

SEQ ID NO: 3128870 - DNA, 23 bp, Homo sapiens
tttctcgggtgcatttgagagaa

SEQ ID NO: 3128871 - DNA, 15 bp, Homo sapiens
tttctctaatgcttg

SEQ ID NO: 3128872 - DNA, 15 bp, Homo sapiens
tttctctcagaaatg

SEQ ID NO: 3128873 - DNA, 16 bp, Homo sapiens
tttctctctacagtgc

SEQ ID NO: 3128874 - DNA, 14 bp, Homo sapiens
tttctctctcctct

SEQ ID NO: 3128875 - DNA, 11 bp, Homo sapiens
tttctctctgc

SEQ ID NO: 3128876 - DNA, 23 bp, Homo sapiens
tttctctgccgctacctccctcc

SEQ ID NO: 3128877 - DNA, 18 bp, Homo sapiens
tttctctgtagttcctaa

SEQ ID NO: 3128878 - DNA, 20 bp, Homo sapiens
tttctctgtgtggttcagct

SEQ ID NO: 3128879 - DNA, 17 bp, Homo sapiens
tttctctgtgtttgttc

SEQ ID NO: 3128880 - DNA, 17 bp, Homo sapiens
tttctcttaacttaatt

SEQ ID NO: 3128881 - DNA, 11 bp, Homo sapiens
tttctcttcat

SEQ ID NO: 3128882 - DNA, 14 bp, Homo sapiens
tttctcttctcagc

SEQ ID NO: 3128883 - DNA, 21 bp, Homo sapiens
tttctcttctcagctcttcca

SEQ ID NO: 3128884 - DNA, 16 bp, Homo sapiens
tttctctttctctcct

SEQ ID NO: 3128885 - DNA, 13 bp, Homo sapiens
tttctcttttgct

SEQ ID NO: 3128886 - DNA, 22 bp, Homo sapiens
tttctgaaaattccagaaagga

SEQ ID NO: 3128887 - DNA, 21 bp, Homo sapiens
tttctgaattatgcttccaca

SEQ ID NO: 3128888 - DNA, 19 bp, Homo sapiens
tttctgaattcaaagcttg

SEQ ID NO: 3128889 - DNA, 21 bp, Homo sapiens
tttctgaattcaaagcttgtg

SEQ ID NO: 3128890 - DNA, 17 bp, Homo sapiens
tttctgacgaaggtcct

SEQ ID NO: 3128891 - DNA, 12 bp, Homo sapiens
tttctgagaaaa

SEQ ID NO: 3128892 - DNA, 17 bp, Homo sapiens
tttctgaggctttatga

SEQ ID NO: 3128893 - DNA, 16 bp, Homo sapiens
tttctgatcagaggtg

SEQ ID NO: 3128894 - DNA, 23 bp, Homo sapiens
tttctgattaatatatttaatat

SEQ ID NO: 3128895 - DNA, 14 bp, Homo sapiens
tttctgcagaaatt

SEQ ID NO: 3128896 - DNA, 19 bp, Homo sapiens
tttctgcagaaatttgcaa

SEQ ID NO: 3128897 - DNA, 22 bp, Homo sapiens
tttctgcagaaatttgcaactc

SEQ ID NO: 3128898 - DNA, 21 bp, Homo sapiens
tttctgcagcccttgggcagt

SEQ ID NO: 3128899 - DNA, 16 bp, Homo sapiens
tttctgccagggagct

SEQ ID NO: 3128900 - DNA, 14 bp, Homo sapiens
tttctgcctggagt

SEQ ID NO: 3128901 - DNA, 13 bp, Homo sapiens
tttctgctgagga

SEQ ID NO: 3128902 - DNA, 22 bp, Homo sapiens
tttctgctttctttgattctcc

SEQ ID NO: 3128903 - DNA, 11 bp, Homo sapiens
tttctggactg

SEQ ID NO: 3128904 - DNA, 16 bp, Homo sapiens
tttctgggagcagaaa

SEQ ID NO: 3128905 - DNA, 14 bp, Homo sapiens
tttctggggcccag

SEQ ID NO: 3128906 - DNA, 17 bp, Homo sapiens
tttctggggcccaggaa

SEQ ID NO: 3128907 - DNA, 15 bp, Homo sapiens
tttctggtagataga

SEQ ID NO: 3128908 - DNA, 19 bp, Homo sapiens
tttctggtagatagaaata

SEQ ID NO: 3128909 - DNA, 17 bp, Homo sapiens
tttctggtggtctgttg

SEQ ID NO: 3128910 - DNA, 15 bp, Homo sapiens
tttctggttctaaca

SEQ ID NO: 3128911 - DNA, 21 bp, Homo sapiens
tttctggttgttatgtgatca

SEQ ID NO: 3128912 - DNA, 15 bp, Homo sapiens
tttctgtaaatacca

SEQ ID NO: 3128913 - DNA, 14 bp, Homo sapiens
tttctgtaccagtt

SEQ ID NO: 3128914 - DNA, 13 bp, Homo sapiens
tttctgtaccatt

SEQ ID NO: 3128915 - DNA, 15 bp, Homo sapiens
tttctgtcaagaaga

SEQ ID NO: 3128916 - DNA, 13 bp, Homo sapiens
tttctgtcattca

SEQ ID NO: 3128917 - DNA, 14 bp, Homo sapiens
tttctgtcttctct

SEQ ID NO: 3128918 - DNA, 20 bp, Homo sapiens
tttctgtgataactctgcaa

SEQ ID NO: 3128919 - DNA, 22 bp, Homo sapiens
tttctgtgtgcaccttaccaac

SEQ ID NO: 3128920 - DNA, 15 bp, Homo sapiens
tttctgttgtaactt

SEQ ID NO: 3128921 - DNA, 16 bp, Homo sapiens
tttctgttgtaactta

SEQ ID NO: 3128922 - DNA, 17 bp, Homo sapiens
tttctgttgtaacttat

SEQ ID NO: 3128923 - DNA, 19 bp, Homo sapiens
tttctgttgtaacttatgt

SEQ ID NO: 3128924 - DNA, 23 bp, Homo sapiens
tttctgttgtaacttatgtagat

SEQ ID NO: 3128925 - DNA, 20 bp, Homo sapiens
tttcttaaaagtactttaaa

SEQ ID NO: 3128926 - DNA, 22 bp, Homo sapiens
tttcttaaaagtactttaaaaa

SEQ ID NO: 3128927 - DNA, 22 bp, Homo sapiens
tttcttaaaccaacctttaaaa

SEQ ID NO: 3128928 - DNA, 23 bp, Homo sapiens
tttcttaaataatgcttcagata

SEQ ID NO: 3128929 - DNA, 13 bp, Homo sapiens
tttcttaaatatg

SEQ ID NO: 3128930 - DNA, 22 bp, Homo sapiens
tttcttaaatctttcttcaaat

SEQ ID NO: 3128931 - DNA, 17 bp, Homo sapiens
tttcttaacttcttgct

SEQ ID NO: 3128932 - DNA, 21 bp, Homo sapiens
tttcttaacttcttgcttctt

SEQ ID NO: 3128933 - DNA, 21 bp, Homo sapiens
tttcttaattattataaaaat

SEQ ID NO: 3128934 - DNA, 22 bp, Homo sapiens
tttcttacccatatatcttatg

SEQ ID NO: 3128935 - DNA, 12 bp, Homo sapiens
tttcttagcttt

SEQ ID NO: 3128936 - DNA, 13 bp, Homo sapiens
tttcttagctttt

SEQ ID NO: 3128937 - DNA, 15 bp, Homo sapiens
tttcttagtcattac

SEQ ID NO: 3128938 - DNA, 18 bp, Homo sapiens
tttcttagtcgaatgtta

SEQ ID NO: 3128939 - DNA, 23 bp, Homo sapiens
tttcttagtgcttcagagtttgt

SEQ ID NO: 3128940 - DNA, 23 bp, Homo sapiens
tttcttatgtgggtcttatgctt

SEQ ID NO: 3128941 - DNA, 21 bp, Homo sapiens
tttcttcaacatcaatgttca

SEQ ID NO: 3128942 - DNA, 15 bp, Homo sapiens
tttatttatatcttt

SEQ ID NO: 3128943 - DNA, 13 bp, Homo sapiens
tttatttctttta

SEQ ID NO: 3128944 - DNA, 17 bp, Homo sapiens
tttatttgtaaaccatt

SEQ ID NO: 3128945 - DNA, 15 bp, Homo sapiens
tttataaatgagcaa

SEQ ID NO: 3128946 - DNA, 17 bp, Homo sapiens
tttataacatctttatt

SEQ ID NO: 3128947 - DNA, 16 bp, Homo sapiens
tttataactcatcata

SEQ ID NO: 3128948 - DNA, 19 bp, Homo sapiens
tttataactcatcataaaa

SEQ ID NO: 3128949 - DNA, 16 bp, Homo sapiens
tttataagcaaatttc

SEQ ID NO: 3128950 - DNA, 17 bp, Homo sapiens
tttataagtcattgtat

SEQ ID NO: 3128951 - DNA, 19 bp, Homo sapiens
tttataagtcattgtatgt

SEQ ID NO: 3128952 - DNA, 14 bp, Homo sapiens
tttataatctgaag

SEQ ID NO: 3128953 - DNA, 15 bp, Homo sapiens
tttataatctgaaga

SEQ ID NO: 3128954 - DNA, 18 bp, Homo sapiens
tttataattggtgctatt

SEQ ID NO: 3128955 - DNA, 14 bp, Homo sapiens
tttatacagctgta

SEQ ID NO: 3128956 - DNA, 22 bp, Homo sapiens
ttgttgctccctgtgacaaaat

SEQ ID NO: 3128957 - DNA, 15 bp, Homo sapiens
ttgttggatcttcaa

SEQ ID NO: 3128958 - DNA, 20 bp, Homo sapiens
ttgttgggattcctgaccca

SEQ ID NO: 3128959 - DNA, 12 bp, Homo sapiens
ttgttgtgactt

SEQ ID NO: 3128960 - DNA, 15 bp, Homo sapiens
ttgttgtgtgtgcag

SEQ ID NO: 3128961 - DNA, 21 bp, Homo sapiens
ttgttgtttgccatactttgt

SEQ ID NO: 3128962 - DNA, 19 bp, Homo sapiens
ttgttgtttggattcctca

SEQ ID NO: 3128963 - DNA, 20 bp, Homo sapiens
ttgtttaaatataaatgttt

SEQ ID NO: 3128964 - DNA, 16 bp, Homo sapiens
ttgtttaatgtgaact

SEQ ID NO: 3128965 - DNA, 21 bp, Homo sapiens
ttgtttacagcactactctgt

SEQ ID NO: 3128966 - DNA, 19 bp, Homo sapiens
ttgtttatcagatacatca

SEQ ID NO: 3128967 - DNA, 21 bp, Homo sapiens
ttgtttatcagatacatcact

SEQ ID NO: 3128968 - DNA, 22 bp, Homo sapiens
ttgtttatcagatacatcactg

SEQ ID NO: 3128969 - DNA, 12 bp, Homo sapiens
ttgtttatgtaa

SEQ ID NO: 3128970 - DNA, 19 bp, Homo sapiens
ttgtttattgagtttgtag

SEQ ID NO: 3128971 - DNA, 24 bp, Homo sapiens
ttgtttattgagtttgtaggtaaa

SEQ ID NO: 3128972 - DNA, 16 bp, Homo sapiens
ttgtttcgtggggagg

SEQ ID NO: 3128973 - DNA, 21 bp, Homo sapiens
ttgtttctgacccactgatct

SEQ ID NO: 3128974 - DNA, 16 bp, Homo sapiens
ttgtttctgttccaaa

SEQ ID NO: 3128975 - DNA, 17 bp, Homo sapiens
ttgtttcttgacaagct

SEQ ID NO: 3128976 - DNA, 17 bp, Homo sapiens
ttgtttcttgtttattg

SEQ ID NO: 3128977 - DNA, 19 bp, Homo sapiens
ttgtttgaccccagtttct

SEQ ID NO: 3128978 - DNA, 14 bp, Homo sapiens
ttgtttgatttcaa

SEQ ID NO: 3128979 - DNA, 13 bp, Homo sapiens
ttgtttgccagga

SEQ ID NO: 3128980 - DNA, 12 bp, Homo sapiens
ttgtttgctgct

SEQ ID NO: 3128981 - DNA, 12 bp, Homo sapiens
ttgtttggagac

SEQ ID NO: 3128982 - DNA, 19 bp, Homo sapiens
ttgtttgggatcagcttct

SEQ ID NO: 3128983 - DNA, 19 bp, Homo sapiens
ttgtttggtaaatgtttct

SEQ ID NO: 3128984 - DNA, 19 bp, Homo sapiens
ttgtttgtctctccttttc

SEQ ID NO: 3128985 - DNA, 20 bp, Homo sapiens
ttgtttgtctctccttttct

SEQ ID NO: 3128986 - DNA, 12 bp, Homo sapiens
ttgttttacaat

SEQ ID NO: 3128987 - DNA, 20 bp, Homo sapiens
tttacattgtaaatagtatt

SEQ ID NO: 3128988 - DNA, 21 bp, Homo sapiens
tttaccaaagagatattgata

SEQ ID NO: 3128989 - DNA, 23 bp, Homo sapiens
tttaccaaaggtttttaaagtaa

SEQ ID NO: 3128990 - DNA, 18 bp, Homo sapiens
tttaccaagagtaacttt

SEQ ID NO: 3128991 - DNA, 18 bp, Homo sapiens
tttaccagggatgtagat

SEQ ID NO: 3128992 - DNA, 17 bp, Homo sapiens
tttaccagttgcctttt

SEQ ID NO: 3128993 - DNA, 22 bp, Homo sapiens
tttacccagaatgtcagattcc

SEQ ID NO: 3128994 - DNA, 17 bp, Homo sapiens
tttacccagtgggacag

SEQ ID NO: 3128995 - DNA, 16 bp, Homo sapiens
tttaccctaatgtctt

SEQ ID NO: 3128996 - DNA, 15 bp, Homo sapiens
tttacctaagattac

SEQ ID NO: 3128997 - DNA, 22 bp, Homo sapiens
tttacctagctggtagcataaa

SEQ ID NO: 3128998 - DNA, 21 bp, Homo sapiens
tttacctatggaagtggttct

SEQ ID NO: 3128999 - DNA, 16 bp, Homo sapiens
tttacctgagaccagt

SEQ ID NO: 3129000 - DNA, 16 bp, Homo sapiens
tttacctgcaaaaaat

SEQ ID NO: 3129001 - DNA, 16 bp, Homo sapiens
tttaccttcaaacttt

SEQ ID NO: 3129002 - DNA, 13 bp, Homo sapiens
tttacctttatct

SEQ ID NO: 3129003 - DNA, 17 bp, Homo sapiens
tttaccttttaagacat

SEQ ID NO: 3129004 - DNA, 17 bp, Homo sapiens
tttaccttttctgttgt

SEQ ID NO: 3129005 - DNA, 18 bp, Homo sapiens
tttacgctttgattcata

SEQ ID NO: 3129006 - DNA, 19 bp, Homo sapiens
tttacgtagtaaaagtcat

SEQ ID NO: 3129007 - DNA, 12 bp, Homo sapiens
tttacgttgtgt

SEQ ID NO: 3129008 - DNA, 21 bp, Homo sapiens
tttactaagccacaagaaatt

SEQ ID NO: 3129009 - DNA, 19 bp, Homo sapiens
tttactaattttctagatt

SEQ ID NO: 3129010 - DNA, 14 bp, Homo sapiens
tttactcacagcac

SEQ ID NO: 3129011 - DNA, 19 bp, Homo sapiens
tttactcacagcacttgtt

SEQ ID NO: 3129012 - DNA, 22 bp, Homo sapiens
tttactcacagcacttgttttc

SEQ ID NO: 3129013 - DNA, 13 bp, Homo sapiens
tttactcattgaa

SEQ ID NO: 3129014 - DNA, 14 bp, Homo sapiens
tttactcattgaaa

SEQ ID NO: 3129015 - DNA, 15 bp, Homo sapiens
tttactcattgaaat

SEQ ID NO: 3129016 - DNA, 16 bp, Homo sapiens
tttactcattgaaatg

SEQ ID NO: 3129017 - DNA, 19 bp, Homo sapiens
tttactcattgaaatgtca

SEQ ID NO: 3129018 - DNA, 22 bp, Homo sapiens
tttactccaggttattgcaata

SEQ ID NO: 3129019 - DNA, 19 bp, Homo sapiens
tttactcccttcctggcct

SEQ ID NO: 3129020 - DNA, 21 bp, Homo sapiens
tttactctatgccccaaatat

SEQ ID NO: 3129021 - DNA, 13 bp, Homo sapiens
tttactctgtgtt

SEQ ID NO: 3129022 - DNA, 15 bp, Homo sapiens
tttactctgtgttta

SEQ ID NO: 3129023 - DNA, 14 bp, Homo sapiens
tttactctttctaa

SEQ ID NO: 3129024 - DNA, 16 bp, Homo sapiens
tttactctttctaact

SEQ ID NO: 3129025 - DNA, 13 bp, Homo sapiens
tttactgaacaat

SEQ ID NO: 3129026 - DNA, 22 bp, Homo sapiens
tttactgccaaagggaaatatc

SEQ ID NO: 3129027 - DNA, 17 bp, Homo sapiens
tttactgtcagattaaa

SEQ ID NO: 3129028 - DNA, 20 bp, Homo sapiens
tttactgttttaattgtagt

SEQ ID NO: 3129029 - DNA, 23 bp, Homo sapiens
tttacttaacaaccaacttgttg

SEQ ID NO: 3129030 - DNA, 17 bp, Homo sapiens
tttacttatcttatgcc

SEQ ID NO: 3129031 - DNA, 15 bp, Homo sapiens
tttacttcttataca

SEQ ID NO: 3129032 - DNA, 15 bp, Homo sapiens
tttactttgtgttca

SEQ ID NO: 3129033 - DNA, 15 bp, Homo sapiens
tttacttttaaacag

SEQ ID NO: 3129034 - DNA, 18 bp, Homo sapiens
tttacttttaaacagtga

SEQ ID NO: 3129035 - DNA, 15 bp, Homo sapiens
tttacttttaaactg

SEQ ID NO: 3129036 - DNA, 23 bp, Homo sapiens
tttagaaaaaatggatgcccaga

SEQ ID NO: 3129037 - DNA, 14 bp, Homo sapiens
tttagaaattataa

SEQ ID NO: 3129038 - DNA, 13 bp, Homo sapiens
tttagaaccagcc

SEQ ID NO: 3129039 - DNA, 14 bp, Homo sapiens
tttagaagccaact

SEQ ID NO: 3129040 - DNA, 22 bp, Homo sapiens
tttagaagccaactatgattat

SEQ ID NO: 3129041 - DNA, 15 bp, Homo sapiens
tttagaagtgcattt

SEQ ID NO: 3129042 - DNA, 18 bp, Homo sapiens
tttagacaacctgaaatt

SEQ ID NO: 3129043 - DNA, 14 bp, Homo sapiens
tttagacaactaga

SEQ ID NO: 3129044 - DNA, 18 bp, Homo sapiens
tttagaccaaggaacaaa

SEQ ID NO: 3129045 - DNA, 22 bp, Homo sapiens
tttagactcatcaatcaaataa

SEQ ID NO: 3129046 - DNA, 19 bp, Homo sapiens
tttagagtaaataaactgt

SEQ ID NO: 3129047 - DNA, 15 bp, Homo sapiens
tttagataatttgaa

SEQ ID NO: 3129048 - DNA, 24 bp, Homo sapiens
tttagatcaaggcaaaaatatcag

SEQ ID NO: 3129049 - DNA, 12 bp, Homo sapiens
tttagatttcaa

SEQ ID NO: 3129050 - DNA, 19 bp, Homo sapiens
tttagcacgtttaaagttc

SEQ ID NO: 3129051 - DNA, 16 bp, Homo sapiens
tttagcataaaatttt

SEQ ID NO: 3129052 - DNA, 19 bp, Homo sapiens
tttagcattgtcttgttct

SEQ ID NO: 3129053 - DNA, 19 bp, Homo sapiens
tttagccataattttgcat

SEQ ID NO: 3129054 - DNA, 17 bp, Homo sapiens
tttagctagtatcttca

SEQ ID NO: 3129055 - DNA, 21 bp, Homo sapiens
tttagctgatgaacttattct

SEQ ID NO: 3129056 - DNA, 13 bp, Homo sapiens
tttaggaaaatca

SEQ ID NO: 3129057 - DNA, 24 bp, Homo sapiens
tttaggaagaagtggtactagtgt

SEQ ID NO: 3129058 - DNA, 11 bp, Homo sapiens
tttaggagaaa

SEQ ID NO: 3129059 - DNA, 23 bp, Homo sapiens
tttaggagctaaggctctatgag

SEQ ID NO: 3129060 - DNA, 20 bp, Homo sapiens
tttaggcactcttaaatgat

SEQ ID NO: 3129061 - DNA, 22 bp, Homo sapiens
tttaggcactcttaaatgatct

SEQ ID NO: 3129062 - DNA, 22 bp, Homo sapiens
tttagggtactaaatttaaatt

SEQ ID NO: 3129063 - DNA, 13 bp, Homo sapiens
tttaggttctaaa

SEQ ID NO: 3129064 - DNA, 18 bp, Homo sapiens
tttaggttctaaagttct

SEQ ID NO: 3129065 - DNA, 13 bp, Homo sapiens
tttagtacatttt

SEQ ID NO: 3129066 - DNA, 21 bp, Homo sapiens
tttagtacctgaaaagtaact

SEQ ID NO: 3129067 - DNA, 22 bp, Homo sapiens
tttagtactgaagccaaatgaa

SEQ ID NO: 3129068 - DNA, 23 bp, Homo sapiens
tttagtatagccacaaatgcctt

SEQ ID NO: 3129069 - DNA, 21 bp, Homo sapiens
tttagtatgacgctgatacat

SEQ ID NO: 3129070 - DNA, 17 bp, Homo sapiens
tttagtcaatcactgca

SEQ ID NO: 3129071 - DNA, 20 bp, Homo sapiens
tttagtcacgtgtattttca

SEQ ID NO: 3129072 - DNA, 21 bp, Homo sapiens
tttagtcacgtgtattttcat

SEQ ID NO: 3129073 - DNA, 15 bp, Homo sapiens
tttagtcatgtgacc

SEQ ID NO: 3129074 - DNA, 12 bp, Homo sapiens
tttagtgaaaaa

SEQ ID NO: 3129075 - DNA, 20 bp, Homo sapiens
tttagtgaaaaactgctgta

SEQ ID NO: 3129076 - DNA, 23 bp, Homo sapiens
tttagtgccctgccccctggctg

SEQ ID NO: 3129077 - DNA, 22 bp, Homo sapiens
tttagtgccggctgtggagcaa

SEQ ID NO: 3129078 - DNA, 19 bp, Homo sapiens
tttagtgtgtgtgcagagt

SEQ ID NO: 3129079 - DNA, 14 bp, Homo sapiens
tttagttatagttt

SEQ ID NO: 3129080 - DNA, 23 bp, Homo sapiens
tttagttcaatatttgttactgt

SEQ ID NO: 3129081 - DNA, 12 bp, Homo sapiens
tttagttcatat

SEQ ID NO: 3129082 - DNA, 15 bp, Homo sapiens
tttagttccacaaat

SEQ ID NO: 3129083 - DNA, 14 bp, Homo sapiens
tttagtttactcaa

SEQ ID NO: 3129084 - DNA, 15 bp, Homo sapiens
tttagttttctctta

SEQ ID NO: 3129085 - DNA, 11 bp, Homo sapiens
tttagtttttg

SEQ ID NO: 3129086 - DNA, 19 bp, Homo sapiens
tttataaaaataaatagaa

SEQ ID NO: 3129087 - DNA, 23 bp, Homo sapiens
tttataaaaataaatagaaaagt

SEQ ID NO: 3129088 - DNA, 16 bp, Homo sapiens
tttataaaatggctgt

SEQ ID NO: 3129089 - DNA, 16 bp, Homo sapiens
tttataaaattagaaa

SEQ ID NO: 3129090 - DNA, 15 bp, Homo sapiens
tttataaacagaaat

SEQ ID NO: 3129091 - DNA, 16 bp, Homo sapiens
tttataaacagaaatg

SEQ ID NO: 3129092 - DNA, 19 bp, Homo sapiens
tttataaactaggtaaaat

SEQ ID NO: 3129093 - DNA, 24 bp, Homo sapiens
tttataaagtacccatctagtact

SEQ ID NO: 3129094 - DNA, 20 bp, Homo sapiens
tttataaataaactgttgct

SEQ ID NO: 3129095 - DNA, 21 bp, Homo sapiens
tttataaatatattcaggagt

SEQ ID NO: 3129096 - DNA, 12 bp, Homo sapiens
tttataaatgag

SEQ ID NO: 3129097 - DNA, 17 bp, Homo sapiens
ttttcctagccctctca

SEQ ID NO: 3129098 - DNA, 13 bp, Homo sapiens
ttttcctatttgt

SEQ ID NO: 3129099 - DNA, 21 bp, Homo sapiens
ttttcctcccttgggttctga

SEQ ID NO: 3129100 - DNA, 18 bp, Homo sapiens
ttttcctggacttaaaga

SEQ ID NO: 3129101 - DNA, 13 bp, Homo sapiens
ttttcctgtcagt

SEQ ID NO: 3129102 - DNA, 15 bp, Homo sapiens
ttttcctttagatca

SEQ ID NO: 3129103 - DNA, 13 bp, Homo sapiens
ttttcctttgtgg

SEQ ID NO: 3129104 - DNA, 13 bp, Homo sapiens
ttttctaagaaaa

SEQ ID NO: 3129105 - DNA, 13 bp, Homo sapiens
ttttctaagagaa

SEQ ID NO: 3129106 - DNA, 21 bp, Homo sapiens
ttttctaagcaatttcttgct

SEQ ID NO: 3129107 - DNA, 13 bp, Homo sapiens
ttttctacagtgg

SEQ ID NO: 3129108 - DNA, 18 bp, Homo sapiens
ttttctacagtggtttta

SEQ ID NO: 3129109 - DNA, 17 bp, Homo sapiens
ttttctaccctagccat

SEQ ID NO: 3129110 - DNA, 22 bp, Homo sapiens
ttttctatcatggaatatttat

SEQ ID NO: 3129111 - DNA, 23 bp, Homo sapiens
ttttctattatggaaaactgtgt

SEQ ID NO: 3129112 - DNA, 19 bp, Homo sapiens
ttttctattatttttataa

SEQ ID NO: 3129113 - DNA, 23 bp, Homo sapiens
ttttctattgttactctggttct

SEQ ID NO: 3129114 - DNA, 11 bp, Homo sapiens
ttttctatttt

SEQ ID NO: 3129115 - DNA, 22 bp, Homo sapiens
ttttctattttgttttttaagt

SEQ ID NO: 3129116 - DNA, 15 bp, Homo sapiens
ttttctcaaagtttt

SEQ ID NO: 3129117 - DNA, 19 bp, Homo sapiens
ttttctcaaagttttgaaa

SEQ ID NO: 3129118 - DNA, 17 bp, Homo sapiens
ttttctcactccttttg

SEQ ID NO: 3129119 - DNA, 18 bp, Homo sapiens
ttttctcagtgtgccctt

SEQ ID NO: 3129120 - DNA, 14 bp, Homo sapiens
ttttctccaaataa

SEQ ID NO: 3129121 - DNA, 13 bp, Homo sapiens
ttttctccagctc

SEQ ID NO: 3129122 - DNA, 20 bp, Homo sapiens
ttttctctatacatagagct

SEQ ID NO: 3129123 - DNA, 14 bp, Homo sapiens
ttttctctgtactt

SEQ ID NO: 3129124 - DNA, 20 bp, Homo sapiens
ttttctctgtgtggttcagc

SEQ ID NO: 3129125 - DNA, 21 bp, Homo sapiens
ttttctcttagaacattgtat

SEQ ID NO: 3129126 - DNA, 14 bp, Homo sapiens
ttttctctttctcc

SEQ ID NO: 3129127 - DNA, 14 bp, Homo sapiens
ttttctgaattatg

SEQ ID NO: 3129128 - DNA, 20 bp, Homo sapiens
ttttctgacatgcattgttg

SEQ ID NO: 3129129 - DNA, 16 bp, Homo sapiens
ttttctgagcccgggc

SEQ ID NO: 3129130 - DNA, 16 bp, Homo sapiens
ttttctgccctggctg

SEQ ID NO: 3129131 - DNA, 19 bp, Homo sapiens
ttttctggtagatagaaat

SEQ ID NO: 3129132 - DNA, 14 bp, Homo sapiens
ttttctggttctaa

SEQ ID NO: 3129133 - DNA, 21 bp, Homo sapiens
ttttctgtaccagttaatttt

SEQ ID NO: 3129134 - DNA, 16 bp, Homo sapiens
ttttctgtagtcattt

SEQ ID NO: 3129135 - DNA, 18 bp, Homo sapiens
ttttctgtgcctgaatat

SEQ ID NO: 3129136 - DNA, 13 bp, Homo sapiens
ttttctgttgtaa

SEQ ID NO: 3129137 - DNA, 20 bp, Homo sapiens
ttttcttaaaccaaccttta

SEQ ID NO: 3129138 - DNA, 22 bp, Homo sapiens
ttttcttaccctagttctctta

SEQ ID NO: 3129139 - DNA, 22 bp, Homo sapiens
ttttcttcaacatcaatgttca

SEQ ID NO: 3129140 - DNA, 17 bp, Homo sapiens
ttttcttcactcaaatt

SEQ ID NO: 3129141 - DNA, 11 bp, Homo sapiens
ttttcttcctt

SEQ ID NO: 3129142 - DNA, 22 bp, Homo sapiens
ttttcttgctagtattcgctgt

SEQ ID NO: 3129143 - DNA, 24 bp, Homo sapiens
ttttcttggcaaaagccttgtgta

SEQ ID NO: 3129144 - DNA, 14 bp, Homo sapiens
ttttcttgtaaatg

SEQ ID NO: 3129145 - DNA, 19 bp, Homo sapiens
ttttcttgtaaatgtttct

SEQ ID NO: 3129146 - DNA, 18 bp, Homo sapiens
ttttcttgttgcatcttt

SEQ ID NO: 3129147 - DNA, 16 bp, Homo sapiens
ttttctttaatgcttt

SEQ ID NO: 3129148 - DNA, 19 bp, Homo sapiens
ttttctttgtgtagctttg

SEQ ID NO: 3129149 - DNA, 19 bp, Homo sapiens
ttttcttttgttactgttc

SEQ ID NO: 3129150 - DNA, 15 bp, Homo sapiens
ttttcttttttatta

SEQ ID NO: 3129151 - DNA, 16 bp, Homo sapiens
ttttgaaaagctatta

SEQ ID NO: 3129152 - DNA, 21 bp, Homo sapiens
ttttgaaaagcttcttaatta

SEQ ID NO: 3129153 - DNA, 13 bp, Homo sapiens
ttttgaaacaaac

SEQ ID NO: 3129154 - DNA, 20 bp, Homo sapiens
ttttgaaacccacagtttta

SEQ ID NO: 3129155 - DNA, 22 bp, Homo sapiens
ttttgaaatacctttgtagtta

SEQ ID NO: 3129156 - DNA, 12 bp, Homo sapiens
ttttgaaatgaa

SEQ ID NO: 3129157 - DNA, 20 bp, Homo sapiens
ttttgaactaataaaagcat

SEQ ID NO: 3129158 - DNA, 13 bp, Homo sapiens
ttttgaaggcaaa

SEQ ID NO: 3129159 - DNA, 13 bp, Homo sapiens
ttttgaagggagg

SEQ ID NO: 3129160 - DNA, 19 bp, Homo sapiens
ttttgaagtagtttgtata

SEQ ID NO: 3129161 - DNA, 14 bp, Homo sapiens
ttttgaatctataa

SEQ ID NO: 3129162 - DNA, 22 bp, Homo sapiens
ttttgaatgcttcctgacaatc

SEQ ID NO: 3129163 - DNA, 18 bp, Homo sapiens
ttttgaatggtgttgtat

SEQ ID NO: 3129164 - DNA, 17 bp, Homo sapiens
ttttgaatgtcacaaat

SEQ ID NO: 3129165 - DNA, 19 bp, Homo sapiens
ttttgacagtgttgaaaat

SEQ ID NO: 3129166 - DNA, 14 bp, Homo sapiens
ttttgacataagat

SEQ ID NO: 3129167 - DNA, 15 bp, Homo sapiens
ttttgacatggaaat

SEQ ID NO: 3129168 - DNA, 22 bp, Homo sapiens
ttgtgatgaatcaatgaaaaat

SEQ ID NO: 3129169 - DNA, 17 bp, Homo sapiens
ttgtgatgatgctgtga

SEQ ID NO: 3129170 - DNA, 17 bp, Homo sapiens
ttgtgattatttcactt

SEQ ID NO: 3129171 - DNA, 15 bp, Homo sapiens
ttgtgattggcctgt

SEQ ID NO: 3129172 - DNA, 16 bp, Homo sapiens
ttgtgattggcctgta

SEQ ID NO: 3129173 - DNA, 21 bp, Homo sapiens
ttgtgcaaaatatttgactat

SEQ ID NO: 3129174 - DNA, 11 bp, Homo sapiens
ttgtgcagaga

SEQ ID NO: 3129175 - DNA, 16 bp, Homo sapiens
ttgtgccaatatgtat

SEQ ID NO: 3129176 - DNA, 17 bp, Homo sapiens
ttgtgccaatatgtatt

SEQ ID NO: 3129177 - DNA, 22 bp, Homo sapiens
ttgtgccaatatgtattgtaaa

SEQ ID NO: 3129178 - DNA, 13 bp, Homo sapiens
ttgtgccagagga

SEQ ID NO: 3129179 - DNA, 22 bp, Homo sapiens
ttgtgccatagtcacatggcct

SEQ ID NO: 3129180 - DNA, 13 bp, Homo sapiens
ttgtgctgcttct

SEQ ID NO: 3129181 - DNA, 17 bp, Homo sapiens
ttgtgctgtgggcagca

SEQ ID NO: 3129182 - DNA, 19 bp, Homo sapiens
ttgtgctgtgggcagcacc

SEQ ID NO: 3129183 - DNA, 22 bp, Homo sapiens
ttgtgctgtgggcagcaccctc

SEQ ID NO: 3129184 - DNA, 14 bp, Homo sapiens
ttgtgcttgtttac

SEQ ID NO: 3129185 - DNA, 16 bp, Homo sapiens
ttgtgcttttcctatt

SEQ ID NO: 3129186 - DNA, 21 bp, Homo sapiens
ttgtggaattgggagcttggg

SEQ ID NO: 3129187 - DNA, 17 bp, Homo sapiens
ttgtggacacagctctt

SEQ ID NO: 3129188 - DNA, 18 bp, Homo sapiens
ttgtggattataaaaaat

SEQ ID NO: 3129189 - DNA, 21 bp, Homo sapiens
ttgtggattataaaaaatgta

SEQ ID NO: 3129190 - DNA, 19 bp, Homo sapiens
ttgtggccccttttacttt

SEQ ID NO: 3129191 - DNA, 20 bp, Homo sapiens
ttgtgggacttattacaatt

SEQ ID NO: 3129192 - DNA, 11 bp, Homo sapiens
ttgtgggctgg

SEQ ID NO: 3129193 - DNA, 21 bp, Homo sapiens
ttgtggggaagaggggctggg

SEQ ID NO: 3129194 - DNA, 15 bp, Homo sapiens
ttgtggggacccagg

SEQ ID NO: 3129195 - DNA, 22 bp, Homo sapiens
ttgtggtgtaaagctggccctg

SEQ ID NO: 3129196 - DNA, 13 bp, Homo sapiens
ttgtggttaatct

SEQ ID NO: 3129197 - DNA, 17 bp, Homo sapiens
ttgtggttccatgcagc

SEQ ID NO: 3129198 - DNA, 14 bp, Homo sapiens
ttgtggtttggaat

SEQ ID NO: 3129199 - DNA, 15 bp, Homo sapiens
ttgtgtaaaaaatgg

SEQ ID NO: 3129200 - DNA, 19 bp, Homo sapiens
ttgtgtaaaaaatggaaaa

SEQ ID NO: 3129201 - DNA, 21 bp, Homo sapiens
ttgtgtaaaaaatggaaaaaa

SEQ ID NO: 3129202 - DNA, 22 bp, Homo sapiens
ttgtgtaacaattttaatgcta

SEQ ID NO: 3129203 - DNA, 22 bp, Homo sapiens
ttgtgtaataaagtgttttcag

SEQ ID NO: 3129204 - DNA, 15 bp, Homo sapiens
ttgtgtacaagttgt

SEQ ID NO: 3129205 - DNA, 15 bp, Homo sapiens
ttgtgtacagttatt

SEQ ID NO: 3129206 - DNA, 13 bp, Homo sapiens
ttgtgtagccttt

SEQ ID NO: 3129207 - DNA, 14 bp, Homo sapiens
ttgtacaggactgt

SEQ ID NO: 3129208 - DNA, 18 bp, Homo sapiens
ttgtacagtgtctgtgcc

SEQ ID NO: 3129209 - DNA, 16 bp, Homo sapiens
ttgtacatagttattt

SEQ ID NO: 3129210 - DNA, 16 bp, Homo sapiens
ttgtacatctggctta

SEQ ID NO: 3129211 - DNA, 17 bp, Homo sapiens
ttgtacatctggcttat

SEQ ID NO: 3129212 - DNA, 20 bp, Homo sapiens
ttgtacatgtgtagcctgtg

SEQ ID NO: 3129213 - DNA, 17 bp, Homo sapiens
ttgtacatttatgattt

SEQ ID NO: 3129214 - DNA, 23 bp, Homo sapiens
ttgtacatttatgatttaataaa

SEQ ID NO: 3129215 - DNA, 15 bp, Homo sapiens
ttgtaccaaaatttt

SEQ ID NO: 3129216 - DNA, 21 bp, Homo sapiens
ttgtaccccccaacccctgag

SEQ ID NO: 3129217 - DNA, 15 bp, Homo sapiens
ttgtactgtaaagag

SEQ ID NO: 3129218 - DNA, 18 bp, Homo sapiens
ttgtacttctgtgttcat

SEQ ID NO: 3129219 - DNA, 13 bp, Homo sapiens
ttgtacttcttat

SEQ ID NO: 3129220 - DNA, 19 bp, Homo sapiens
ttgtacttgtgtttgctta

SEQ ID NO: 3129221 - DNA, 19 bp, Homo sapiens
ttgtagaactcactctggg

SEQ ID NO: 3129222 - DNA, 22 bp, Homo sapiens
ttgtagaactcactctgggctg

SEQ ID NO: 3129223 - DNA, 17 bp, Homo sapiens
ttgtagaaggagccttg

SEQ ID NO: 3129224 - DNA, 23 bp, Homo sapiens
ttgtagaaggagccttgttggtg

SEQ ID NO: 3129225 - DNA, 16 bp, Homo sapiens
ttgtagaattgttata

SEQ ID NO: 3129226 - DNA, 16 bp, Homo sapiens
ttgtagacacttactt

SEQ ID NO: 3129227 - DNA, 21 bp, Homo sapiens
ttgtagactgatgttttagca

SEQ ID NO: 3129228 - DNA, 19 bp, Homo sapiens
ttgtagcagattgtttcct

SEQ ID NO: 3129229 - DNA, 14 bp, Homo sapiens
ttgtagcataactg

SEQ ID NO: 3129230 - DNA, 16 bp, Homo sapiens
ttgtagcataactgta

SEQ ID NO: 3129231 - DNA, 13 bp, Homo sapiens
ttgtagctgtaaa

SEQ ID NO: 3129232 - DNA, 16 bp, Homo sapiens
ttgtagggatgccttt

SEQ ID NO: 3129233 - DNA, 20 bp, Homo sapiens
ttgtaggggtcaaagaaatg

SEQ ID NO: 3129234 - DNA, 15 bp, Homo sapiens
ttgtaggtaaaatgt

SEQ ID NO: 3129235 - DNA, 15 bp, Homo sapiens
ttgtagtagtctcat

SEQ ID NO: 3129236 - DNA, 17 bp, Homo sapiens
ttgtagtttacctcttt

SEQ ID NO: 3129237 - DNA, 12 bp, Homo sapiens
ttgtataaataa

SEQ ID NO: 3129238 - DNA, 19 bp, Homo sapiens
ttgtataaataataaagaa

SEQ ID NO: 3129239 - DNA, 22 bp, Homo sapiens
ttgtataaatgtatatacacat

SEQ ID NO: 3129240 - DNA, 21 bp, Homo sapiens
ttgtataattggatttcctaa

SEQ ID NO: 3129241 - DNA, 12 bp, Homo sapiens
ttgtataatttc

SEQ ID NO: 3129242 - DNA, 14 bp, Homo sapiens
ttgtatacaaatat

SEQ ID NO: 3129243 - DNA, 14 bp, Homo sapiens
ttgtatagtgtaaa

SEQ ID NO: 3129244 - DNA, 20 bp, Homo sapiens
ttgtatatacagttattttg

SEQ ID NO: 3129245 - DNA, 21 bp, Homo sapiens
ttgtatatacagttattttgg

SEQ ID NO: 3129246 - DNA, 19 bp, Homo sapiens
ttgtatatatctgcttcag

SEQ ID NO: 3129247 - DNA, 20 bp, Homo sapiens
ttgtatattacacatttgta

SEQ ID NO: 3129248 - DNA, 13 bp, Homo sapiens
ttgtatattgtgt

SEQ ID NO: 3129249 - DNA, 15 bp, Homo sapiens
ttgtatattgtgttt

SEQ ID NO: 3129250 - DNA, 22 bp, Homo sapiens
ttgtatcagaggcctataatga

SEQ ID NO: 3129251 - DNA, 19 bp, Homo sapiens
ttgtatcatttgaacaact

SEQ ID NO: 3129252 - DNA, 20 bp, Homo sapiens
ttgtatctagtgcagctgat

SEQ ID NO: 3129253 - DNA, 14 bp, Homo sapiens
ttgtatctcttaaa

SEQ ID NO: 3129254 - DNA, 18 bp, Homo sapiens
ttgggtagatgggtgggg

SEQ ID NO: 3129255 - DNA, 21 bp, Homo sapiens
ttgggtatcctgcccagtgtt

SEQ ID NO: 3129256 - DNA, 19 bp, Homo sapiens
ttgggtcacccctccagga

SEQ ID NO: 3129257 - DNA, 21 bp, Homo sapiens
ttgggtcattgacctctcagg

SEQ ID NO: 3129258 - DNA, 12 bp, Homo sapiens
ttgggtgaatct

SEQ ID NO: 3129259 - DNA, 17 bp, Homo sapiens
ttgggttccaaccaggc

SEQ ID NO: 3129260 - DNA, 12 bp, Homo sapiens
ttgggtttttat

SEQ ID NO: 3129261 - DNA, 14 bp, Homo sapiens
ttggtaaaaatgct

SEQ ID NO: 3129262 - DNA, 20 bp, Homo sapiens
ttggtaaaactcactgtgat

SEQ ID NO: 3129263 - DNA, 17 bp, Homo sapiens
ttggtaactaatgttat

SEQ ID NO: 3129264 - DNA, 12 bp, Homo sapiens
ttggtaactttt

SEQ ID NO: 3129265 - DNA, 15 bp, Homo sapiens
ttggtaacttttgtg

SEQ ID NO: 3129266 - DNA, 18 bp, Homo sapiens
ttggtaagagacagaatg

SEQ ID NO: 3129267 - DNA, 15 bp, Homo sapiens
ttggtaattattttg

SEQ ID NO: 3129268 - DNA, 15 bp, Homo sapiens
ttggtagattaaata

SEQ ID NO: 3129269 - DNA, 21 bp, Homo sapiens
ttggtaggcttatcaaaatct

SEQ ID NO: 3129270 - DNA, 20 bp, Homo sapiens
ttggtataatgtttaaatca

SEQ ID NO: 3129271 - DNA, 21 bp, Homo sapiens
ttggtataatgtttaaatcat

SEQ ID NO: 3129272 - DNA, 13 bp, Homo sapiens
ttggtcagaggag

SEQ ID NO: 3129273 - DNA, 15 bp, Homo sapiens
ttggtcagcttttgt

SEQ ID NO: 3129274 - DNA, 16 bp, Homo sapiens
ttggtccaaaaaaagg

SEQ ID NO: 3129275 - DNA, 22 bp, Homo sapiens
ttggtccaaaaaaaggaaaaat

SEQ ID NO: 3129276 - DNA, 12 bp, Homo sapiens
ttggtccagagc

SEQ ID NO: 3129277 - DNA, 13 bp, Homo sapiens
ttggtcctttctc

SEQ ID NO: 3129278 - DNA, 14 bp, Homo sapiens
ttggtcctttctcc

SEQ ID NO: 3129279 - DNA, 17 bp, Homo sapiens
ttggtctaatttattca

SEQ ID NO: 3129280 - DNA, 14 bp, Homo sapiens
ttggtctctatttc

SEQ ID NO: 3129281 - DNA, 15 bp, Homo sapiens
ttggtctgtgagatg

SEQ ID NO: 3129282 - DNA, 19 bp, Homo sapiens
ttggtgaaggatccaggaa

SEQ ID NO: 3129283 - DNA, 11 bp, Homo sapiens
ttggtgactca

SEQ ID NO: 3129284 - DNA, 13 bp, Homo sapiens
ttggtgactcact

SEQ ID NO: 3129285 - DNA, 14 bp, Homo sapiens
ttggtgactgtccc

SEQ ID NO: 3129286 - DNA, 14 bp, Homo sapiens
ttggtgataagtgg

SEQ ID NO: 3129287 - DNA, 18 bp, Homo sapiens
ttggtgataagtggaaaa

SEQ ID NO: 3129288 - DNA, 16 bp, Homo sapiens
ttggtgcaacccttac

SEQ ID NO: 3129289 - DNA, 21 bp, Homo sapiens
ttggtgcaacccttacccctt

SEQ ID NO: 3129290 - DNA, 18 bp, Homo sapiens
ttggtgcacagtgatttt

SEQ ID NO: 3129291 - DNA, 15 bp, Homo sapiens
ttggtgcatagaact

SEQ ID NO: 3129292 - DNA, 16 bp, Homo sapiens
ttggtgcatagaactg

SEQ ID NO: 3129293 - DNA, 21 bp, Homo sapiens
ttggtgcatagaactgggtaa

SEQ ID NO: 3129294 - DNA, 12 bp, Homo sapiens
ttggtgcctggc

SEQ ID NO: 3129295 - DNA, 13 bp, Homo sapiens
ttggtgcctggcc

SEQ ID NO: 3129296 - DNA, 20 bp, Homo sapiens
ttggtgcctggcctggcaca

SEQ ID NO: 3129297 - DNA, 21 bp, Homo sapiens
ttggtgcctttcctgttcagc

SEQ ID NO: 3129298 - DNA, 14 bp, Homo sapiens
ttggtgctgatgga

SEQ ID NO: 3129299 - DNA, 17 bp, Homo sapiens
ttggtgctttttataaa

SEQ ID NO: 3129300 - DNA, 21 bp, Homo sapiens
ttggtgctttttataaaaaga

SEQ ID NO: 3129301 - DNA, 19 bp, Homo sapiens
ttggtggagagtggaagga

SEQ ID NO: 3129302 - DNA, 16 bp, Homo sapiens
ttggtggatgtaaata

SEQ ID NO: 3129303 - DNA, 13 bp, Homo sapiens
ttggtggggccag

SEQ ID NO: 3129304 - DNA, 21 bp, Homo sapiens
ttggtggggctcgtggccttc

SEQ ID NO: 3129305 - DNA, 23 bp, Homo sapiens
ttggtgtgtttttgggatgtctt

SEQ ID NO: 3129306 - DNA, 22 bp, Homo sapiens
ttggtgttacacagcccaagag

SEQ ID NO: 3129307 - DNA, 15 bp, Homo sapiens
ttggtgttcctggaa

SEQ ID NO: 3129308 - DNA, 16 bp, Homo sapiens
ttggtgttcctggaag

SEQ ID NO: 3129309 - DNA, 19 bp, Homo sapiens
ttggacccaaggaaaactg

SEQ ID NO: 3129310 - DNA, 14 bp, Homo sapiens
ttggaccccagaga

SEQ ID NO: 3129311 - DNA, 13 bp, Homo sapiens
ttggaccccagct

SEQ ID NO: 3129312 - DNA, 19 bp, Homo sapiens
ttggaccccagctgggagg

SEQ ID NO: 3129313 - DNA, 20 bp, Homo sapiens
ttggaccccagctgggaggc

SEQ ID NO: 3129314 - DNA, 22 bp, Homo sapiens
ttggaccccagctgggaggcaa

SEQ ID NO: 3129315 - DNA, 11 bp, Homo sapiens
ttggacctgcc

SEQ ID NO: 3129316 - DNA, 12 bp, Homo sapiens
ttggactcagcc

SEQ ID NO: 3129317 - DNA, 14 bp, Homo sapiens
ttggactccatctc

SEQ ID NO: 3129318 - DNA, 18 bp, Homo sapiens
ttggactgagatttctta

SEQ ID NO: 3129319 - DNA, 20 bp, Homo sapiens
ttggactgagatttcttaaa

SEQ ID NO: 3129320 - DNA, 20 bp, Homo sapiens
ttggacttttcgttaacatt

SEQ ID NO: 3129321 - DNA, 22 bp, Homo sapiens
ttggacttttcgttaacattga

SEQ ID NO: 3129322 - DNA, 15 bp, Homo sapiens
ttggagaaattattt

SEQ ID NO: 3129323 - DNA, 22 bp, Homo sapiens
ttggagaccctgcaaacagaac

SEQ ID NO: 3129324 - DNA, 13 bp, Homo sapiens
ttggagactctgt

SEQ ID NO: 3129325 - DNA, 14 bp, Homo sapiens
ttggagagaatcat

SEQ ID NO: 3129326 - DNA, 17 bp, Homo sapiens
ttggagagtaaaaactg

SEQ ID NO: 3129327 - DNA, 18 bp, Homo sapiens
ttggagagtaaaaactga

SEQ ID NO: 3129328 - DNA, 20 bp, Homo sapiens
ttggagagtaaaaactgaat

SEQ ID NO: 3129329 - DNA, 20 bp, Homo sapiens
ttggagataatctagaacac

SEQ ID NO: 3129330 - DNA, 19 bp, Homo sapiens
ttggagcactagtttgatt

SEQ ID NO: 3129331 - DNA, 11 bp, Homo sapiens
ttggagccact

SEQ ID NO: 3129332 - DNA, 21 bp, Homo sapiens
ttggagcctcccttctgcctt

SEQ ID NO: 3129333 - DNA, 15 bp, Homo sapiens
ttggagcttacatag

SEQ ID NO: 3129334 - DNA, 20 bp, Homo sapiens
ttggagcttacatagtttta

SEQ ID NO: 3129335 - DNA, 21 bp, Homo sapiens
ttggagcttttttctttaaga

SEQ ID NO: 3129336 - DNA, 12 bp, Homo sapiens
ttggagggatgg

SEQ ID NO: 3129337 - DNA, 22 bp, Homo sapiens
ttggagggcccacttgtatcct

SEQ ID NO: 3129338 - DNA, 14 bp, Homo sapiens
ttggagtgtttcta

SEQ ID NO: 3129339 - DNA, 13 bp, Homo sapiens
ttggataaatcat

SEQ ID NO: 3129340 - DNA, 22 bp, Homo sapiens
ttggataagtagggctaagcca

SEQ ID NO: 3129341 - DNA, 15 bp, Homo sapiens
ttggataatattcat

SEQ ID NO: 3129342 - DNA, 16 bp, Homo sapiens
ttggatatattattgt

SEQ ID NO: 3129343 - DNA, 19 bp, Homo sapiens
ttggatatattattgtaag

SEQ ID NO: 3129344 - DNA, 13 bp, Homo sapiens
ttggatatttttg

SEQ ID NO: 3129345 - DNA, 19 bp, Homo sapiens
ttggatatttttgtacttg

SEQ ID NO: 3129346 - DNA, 16 bp, Homo sapiens
ttggatcttgaatgtg

SEQ ID NO: 3129347 - DNA, 21 bp, Homo sapiens
ttggatggagtccagggaaga

SEQ ID NO: 3129348 - DNA, 23 bp, Homo sapiens
ttggatgggagtgggcacctcag

SEQ ID NO: 3129349 - DNA, 13 bp, Homo sapiens
ttggattattcat

SEQ ID NO: 3129350 - DNA, 18 bp, Homo sapiens
ttggattattcatttaaa

SEQ ID NO: 3129351 - DNA, 20 bp, Homo sapiens
ttggattattcatttaaaat

SEQ ID NO: 3129352 - DNA, 19 bp, Homo sapiens
ttggattatttaataacat

SEQ ID NO: 3129353 - DNA, 18 bp, Homo sapiens
ttggattgtatattgtgt

SEQ ID NO: 3129354 - DNA, 15 bp, Homo sapiens
ttggcaagaacttgt

SEQ ID NO: 3129355 - DNA, 16 bp, Homo sapiens
ttggcaagaacttgtt

SEQ ID NO: 3129356 - DNA, 17 bp, Homo sapiens
ttggcaagatgaaataa

SEQ ID NO: 3129357 - DNA, 16 bp, Homo sapiens
ttggcaatttcctggc

SEQ ID NO: 3129358 - DNA, 15 bp, Homo sapiens
ttggcacagaaacac

SEQ ID NO: 3129359 - DNA, 11 bp, Homo sapiens
ttggcaccaaa

SEQ ID NO: 3129360 - DNA, 18 bp, Homo sapiens
ttggcaccaaagatgcag

SEQ ID NO: 3129361 - DNA, 14 bp, Homo sapiens
ttggcactcacaga

SEQ ID NO: 3129362 - DNA, 22 bp, Homo sapiens
ttggcactgagatatttattgt

SEQ ID NO: 3129363 - DNA, 20 bp, Homo sapiens
ttggcacttgccattccaaa

SEQ ID NO: 3129364 - DNA, 13 bp, Homo sapiens
ttggcacttgtat

SEQ ID NO: 3129365 - DNA, 23 bp, Homo sapiens
ttggcactttttcgtgtggatct

SEQ ID NO: 3129366 - DNA, 17 bp, Homo sapiens
ttggcagagaaggcctc

SEQ ID NO: 3129367 - DNA, 11 bp, Homo sapiens
ttggcagctct

SEQ ID NO: 3129368 - DNA, 13 bp, Homo sapiens
ttggcaggctggc

SEQ ID NO: 3129369 - DNA, 16 bp, Homo sapiens
ttggcaggtcctggcc

SEQ ID NO: 3129370 - DNA, 14 bp, Homo sapiens
ttggcagtctgaat

SEQ ID NO: 3129371 - DNA, 23 bp, Homo sapiens
ttgcagagaagcatcctccacat

SEQ ID NO: 3129372 - DNA, 17 bp, Homo sapiens
ttgcagataattctgga

SEQ ID NO: 3129373 - DNA, 13 bp, Homo sapiens
ttgcagatggaaa

SEQ ID NO: 3129374 - DNA, 14 bp, Homo sapiens
ttgcagatgtattg

SEQ ID NO: 3129375 - DNA, 12 bp, Homo sapiens
ttgcagcagtga

SEQ ID NO: 3129376 - DNA, 23 bp, Homo sapiens
ttgcagcagtgagtctcttcaga

SEQ ID NO: 3129377 - DNA, 18 bp, Homo sapiens
ttgcagccggcacagggt

SEQ ID NO: 3129378 - DNA, 22 bp, Homo sapiens
ttgcagcctgctctagtgggac

SEQ ID NO: 3129379 - DNA, 23 bp, Homo sapiens
ttgcagcctgctctagtgggaca

SEQ ID NO: 3129380 - DNA, 15 bp, Homo sapiens
ttgcaggagacattt

SEQ ID NO: 3129381 - DNA, 13 bp, Homo sapiens
ttgcaggctctgg

SEQ ID NO: 3129382 - DNA, 18 bp, Homo sapiens
ttgcagggagctcaagcc

SEQ ID NO: 3129383 - DNA, 21 bp, Homo sapiens
ttgcagggcagccccacaact

SEQ ID NO: 3129384 - DNA, 17 bp, Homo sapiens
ttgcagggtcctcttct

SEQ ID NO: 3129385 - DNA, 15 bp, Homo sapiens
ttgcagtaactgttt

SEQ ID NO: 3129386 - DNA, 15 bp, Homo sapiens
ttgcagtacatcaaa

SEQ ID NO: 3129387 - DNA, 20 bp, Homo sapiens
ttgcataataagctaaagag

SEQ ID NO: 3129388 - DNA, 16 bp, Homo sapiens
ttgcatactttgtatt

SEQ ID NO: 3129389 - DNA, 22 bp, Homo sapiens
ttgcatagtaccaatcatttta

SEQ ID NO: 3129390 - DNA, 23 bp, Homo sapiens
ttgcatagtaccaatcattttaa

SEQ ID NO: 3129391 - DNA, 16 bp, Homo sapiens
ttgcatatgagccgtg

SEQ ID NO: 3129392 - DNA, 20 bp, Homo sapiens
ttgcatcactgtatcatttt

SEQ ID NO: 3129393 - DNA, 21 bp, Homo sapiens
ttgcatccattgttgtgtctg

SEQ ID NO: 3129394 - DNA, 18 bp, Homo sapiens
ttgcatctaggtaatttt

SEQ ID NO: 3129395 - DNA, 21 bp, Homo sapiens
ttgcatgaagagaagcaattt

SEQ ID NO: 3129396 - DNA, 18 bp, Homo sapiens
ttgcatgaattactgtat

SEQ ID NO: 3129397 - DNA, 22 bp, Homo sapiens
ttgcatgaattactgtatataa

SEQ ID NO: 3129398 - DNA, 17 bp, Homo sapiens
ttgcatgcatgcaaatg

SEQ ID NO: 3129399 - DNA, 20 bp, Homo sapiens
ttgcatggctccagaaatgt

SEQ ID NO: 3129400 - DNA, 17 bp, Homo sapiens
ttgcatgtcgcacaatg

SEQ ID NO: 3129401 - DNA, 15 bp, Homo sapiens
ttgcatgtggatcaa

SEQ ID NO: 3129402 - DNA, 16 bp, Homo sapiens
ttgcattattcattta

SEQ ID NO: 3129403 - DNA, 23 bp, Homo sapiens
ttgcattgaacacaaactgtaaa

SEQ ID NO: 3129404 - DNA, 20 bp, Homo sapiens
ttgcatttacttttaataaa

SEQ ID NO: 3129405 - DNA, 15 bp, Homo sapiens
ttgcatttagaactt

SEQ ID NO: 3129406 - DNA, 12 bp, Homo sapiens
ttgccaaaaaaa

SEQ ID NO: 3129407 - DNA, 18 bp, Homo sapiens
ttgccaaaataccagagc

SEQ ID NO: 3129408 - DNA, 18 bp, Homo sapiens
ttgccaaatatgtcctgg

SEQ ID NO: 3129409 - DNA, 22 bp, Homo sapiens
ttgccaagacaaatcaacagaa

SEQ ID NO: 3129410 - DNA, 20 bp, Homo sapiens
ttgccaagccccccgagtga

SEQ ID NO: 3129411 - DNA, 22 bp, Homo sapiens
ttgccaagctccaagccccatc

SEQ ID NO: 3129412 - DNA, 17 bp, Homo sapiens
ttgccaaggcaaaaaac

SEQ ID NO: 3129413 - DNA, 18 bp, Homo sapiens
ttgccaaggcaaaaaact

SEQ ID NO: 3129414 - DNA, 12 bp, Homo sapiens
ttgccacagctt

SEQ ID NO: 3129415 - DNA, 13 bp, Homo sapiens
ttgccacagcttt

SEQ ID NO: 3129416 - DNA, 18 bp, Homo sapiens
ttgccacagcttttgcaa

SEQ ID NO: 3129417 - DNA, 15 bp, Homo sapiens
ttgccacaggcctcc

SEQ ID NO: 3129418 - DNA, 17 bp, Homo sapiens
ttgccacagtagaactg

SEQ ID NO: 3129419 - DNA, 20 bp, Homo sapiens
ttgccacagtagaactgtct

SEQ ID NO: 3129420 - DNA, 22 bp, Homo sapiens
ttgccacatttctgatcagagg

SEQ ID NO: 3129421 - DNA, 14 bp, Homo sapiens
ttgccaccaggaga

SEQ ID NO: 3129422 - DNA, 14 bp, Homo sapiens
ttgccaccccaacc

SEQ ID NO: 3129423 - DNA, 15 bp, Homo sapiens
ttgccagaaagcata

SEQ ID NO: 3129424 - DNA, 20 bp, Homo sapiens
ttgccagaaagcataaaatt

SEQ ID NO: 3129425 - DNA, 12 bp, Homo sapiens
ttgccagactct

SEQ ID NO: 3129426 - DNA, 21 bp, Homo sapiens
ttgccagcacaggggccccag

SEQ ID NO: 3129427 - DNA, 19 bp, Homo sapiens
ttgccagcttttcctccct

SEQ ID NO: 3129428 - DNA, 15 bp, Homo sapiens
ttgccaggacatgca

SEQ ID NO: 3129429 - DNA, 17 bp, Homo sapiens
ttgccagtgtctttctt

SEQ ID NO: 3129430 - DNA, 23 bp, Homo sapiens
ttgccatcccctatggaccagaa

SEQ ID NO: 3129431 - DNA, 17 bp, Homo sapiens
ttgccatgttggccagg

SEQ ID NO: 3129432 - DNA, 13 bp, Homo sapiens
ttgccatttgata

SEQ ID NO: 3129433 - DNA, 20 bp, Homo sapiens
ttgcccaacaccagcccctg

SEQ ID NO: 3129434 - DNA, 23 bp, Homo sapiens
ttgcccacgctggagtgcagtga

SEQ ID NO: 3129435 - DNA, 11 bp, Homo sapiens
ttgcccaggct

SEQ ID NO: 3129436 - DNA, 12 bp, Homo sapiens
ttgcccaggctg

SEQ ID NO: 3129437 - DNA, 14 bp, Homo sapiens
ttgcccatcctgac

SEQ ID NO: 3129438 - DNA, 16 bp, Homo sapiens
ttgcccatttacactt

SEQ ID NO: 3129439 - DNA, 17 bp, Homo sapiens
ttgcccatttatattca

SEQ ID NO: 3129440 - DNA, 13 bp, Homo sapiens
ttgccccacagtt

SEQ ID NO: 3129441 - DNA, 17 bp, Homo sapiens
ttgccccacagttgtgt

SEQ ID NO: 3129442 - DNA, 13 bp, Homo sapiens
ttgcccccacctc

SEQ ID NO: 3129443 - DNA, 14 bp, Homo sapiens
ttgcccccacctct

SEQ ID NO: 3129444 - DNA, 18 bp, Homo sapiens
ttgcccccacctctggtc

SEQ ID NO: 3129445 - DNA, 14 bp, Homo sapiens
ttgcccgcgctctt

SEQ ID NO: 3129446 - DNA, 16 bp, Homo sapiens
ttgccctagatagttt

SEQ ID NO: 3129447 - DNA, 18 bp, Homo sapiens
ttgccctccgcctgggat

SEQ ID NO: 3129448 - DNA, 14 bp, Homo sapiens
ttgcccttcacagt

SEQ ID NO: 3129449 - DNA, 14 bp, Homo sapiens
ttgcccttccctgt

SEQ ID NO: 3129450 - DNA, 17 bp, Homo sapiens
ttgcccttccctgtccc

SEQ ID NO: 3129451 - DNA, 19 bp, Homo sapiens
ttgcccttccctgtccctc

SEQ ID NO: 3129452 - DNA, 18 bp, Homo sapiens
ttgccctttccatattta

SEQ ID NO: 3129453 - DNA, 18 bp, Homo sapiens
ttgccctttctgtaccat

SEQ ID NO: 3129454 - DNA, 20 bp, Homo sapiens
ttgccctttctgtaccattt

SEQ ID NO: 3129455 - DNA, 22 bp, Homo sapiens
ttgccgtctaggattgggcctc

SEQ ID NO: 3129456 - DNA, 18 bp, Homo sapiens
ttgcctaactaactggca

SEQ ID NO: 3129457 - DNA, 16 bp, Homo sapiens
ttgcctaattggaaag

SEQ ID NO: 3129458 - DNA, 13 bp, Homo sapiens
ttgcctaccattt

SEQ ID NO: 3129459 - DNA, 23 bp, Homo sapiens
ttgcctaggcgattttgtctacc

SEQ ID NO: 3129460 - DNA, 24 bp, Homo sapiens
ttgcctattcccacacctccacag

SEQ ID NO: 3129461 - DNA, 20 bp, Homo sapiens
ttgcctccccatttcccatc

SEQ ID NO: 3129462 - DNA, 21 bp, Homo sapiens
ttgcctccccatttcccatct

SEQ ID NO: 3129463 - DNA, 22 bp, Homo sapiens
ttgcctccccatttcccatctg

SEQ ID NO: 3129464 - DNA, 19 bp, Homo sapiens
ttgcctcctgtgtactgtg

SEQ ID NO: 3129465 - DNA, 21 bp, Homo sapiens
ttgcctcctgtgtactgtgtc

SEQ ID NO: 3129466 - DNA, 14 bp, Homo sapiens
ttgcctctgcctct

SEQ ID NO: 3129467 - DNA, 16 bp, Homo sapiens
ttgcctctgcctctga

SEQ ID NO: 3129468 - DNA, 17 bp, Homo sapiens
ttgcctcttccagtctt

SEQ ID NO: 3129469 - DNA, 23 bp, Homo sapiens
ttgcctgatttgttttcattata

SEQ ID NO: 3129470 - DNA, 12 bp, Homo sapiens
ttgcctggcctt

SEQ ID NO: 3129471 - DNA, 12 bp, Homo sapiens
ttgcctggctgt

SEQ ID NO: 3129472 - DNA, 19 bp, Homo sapiens
ttgcctggctgtggaggcc

SEQ ID NO: 3129473 - DNA, 20 bp, Homo sapiens
ttgcctggctgtggaggcct

SEQ ID NO: 3129474 - DNA, 23 bp, Homo sapiens
ttgcctgggggcttttgccactc

SEQ ID NO: 3129475 - DNA, 16 bp, Homo sapiens
ttgcctggttttgtct

SEQ ID NO: 3129476 - DNA, 13 bp, Homo sapiens
ttgccttatttcc

SEQ ID NO: 3129477 - DNA, 20 bp, Homo sapiens
ttgccttcctttctccagga

SEQ ID NO: 3129478 - DNA, 19 bp, Homo sapiens
ttgccttcttcacccagct

SEQ ID NO: 3129479 - DNA, 15 bp, Homo sapiens
ttgccttgcagaact

SEQ ID NO: 3129480 - DNA, 17 bp, Homo sapiens
ttgccttgcagaactgc

SEQ ID NO: 3129481 - DNA, 16 bp, Homo sapiens
ttgccttgctgtttgt

SEQ ID NO: 3129482 - DNA, 18 bp, Homo sapiens
ttgcctttatctctgagg

SEQ ID NO: 3129483 - DNA, 21 bp, Homo sapiens
ttgcctttctgggagcagaaa

SEQ ID NO: 3129484 - DNA, 18 bp, Homo sapiens
ttgcctttgtggccttcc

SEQ ID NO: 3129485 - DNA, 17 bp, Homo sapiens
ttgcctttgttttgatg

SEQ ID NO: 3129486 - DNA, 15 bp, Homo sapiens
ttgccttttaatttt

SEQ ID NO: 3129487 - DNA, 15 bp, Homo sapiens
ttgcctttttctcta

SEQ ID NO: 3129488 - DNA, 19 bp, Homo sapiens
ttgcgaatccaagctccct

SEQ ID NO: 3129489 - DNA, 22 bp, Homo sapiens
ttgcgacggagagaaaaaagaa

SEQ ID NO: 3129490 - DNA, 12 bp, Homo sapiens
ttgcgccactgc

SEQ ID NO: 3129491 - DNA, 16 bp, Homo sapiens
ttgcggcaaaaggaaa

SEQ ID NO: 3129492 - DNA, 15 bp, Homo sapiens
ttgcggccccaggag

SEQ ID NO: 3129493 - DNA, 18 bp, Homo sapiens
ttgcgtatgtctgttacc

SEQ ID NO: 3129494 - DNA, 15 bp, Homo sapiens
ttgcgtcctgcagag

SEQ ID NO: 3129495 - DNA, 15 bp, Homo sapiens
ttgcgtggactctgc

SEQ ID NO: 3129496 - DNA, 18 bp, Homo sapiens
ttgcgtggactctgcaca

SEQ ID NO: 3129497 - DNA, 20 bp, Homo sapiens
ttgcgtgtcaatttccctca

SEQ ID NO: 3129498 - DNA, 22 bp, Homo sapiens
ttgctaataaacactggctctg

SEQ ID NO: 3129499 - DNA, 16 bp, Homo sapiens
ttgctaatcaaagcca

SEQ ID NO: 3129500 - DNA, 18 bp, Homo sapiens
ttgaggatatattttcac

SEQ ID NO: 3129501 - DNA, 17 bp, Homo sapiens
ttgaggattgtggaaaa

SEQ ID NO: 3129502 - DNA, 19 bp, Homo sapiens
ttgaggcggtttcctgaat

SEQ ID NO: 3129503 - DNA, 19 bp, Homo sapiens
ttgaggctgtcacagtcct

SEQ ID NO: 3129504 - DNA, 20 bp, Homo sapiens
ttgagggacgctttgtctgt

SEQ ID NO: 3129505 - DNA, 21 bp, Homo sapiens
ttgagggacgctttgtctgtc

SEQ ID NO: 3129506 - DNA, 18 bp, Homo sapiens
ttgagggactgcctctgc

SEQ ID NO: 3129507 - DNA, 16 bp, Homo sapiens
ttgagggcccagagca

SEQ ID NO: 3129508 - DNA, 21 bp, Homo sapiens
ttgagggcccagccaggagca

SEQ ID NO: 3129509 - DNA, 20 bp, Homo sapiens
ttgaggggattaatatgaaa

SEQ ID NO: 3129510 - DNA, 20 bp, Homo sapiens
ttgagggttcacctctgcct

SEQ ID NO: 3129511 - DNA, 13 bp, Homo sapiens
ttgagggttgggc

SEQ ID NO: 3129512 - DNA, 16 bp, Homo sapiens
ttgaggtaaagatatg

SEQ ID NO: 3129513 - DNA, 21 bp, Homo sapiens
ttgaggtaccagttgtattta

SEQ ID NO: 3129514 - DNA, 18 bp, Homo sapiens
ttgaggtcttttgacatg

SEQ ID NO: 3129515 - DNA, 19 bp, Homo sapiens
ttgaggtgtcagagaaaat

SEQ ID NO: 3129516 - DNA, 12 bp, Homo sapiens
ttgagtaatggt

SEQ ID NO: 3129517 - DNA, 20 bp, Homo sapiens
ttgagtagatattactttat

SEQ ID NO: 3129518 - DNA, 20 bp, Homo sapiens
ttgagtattgtttaaaatgt

SEQ ID NO: 3129519 - DNA, 15 bp, Homo sapiens
ttgagtcacttgtgt

SEQ ID NO: 3129520 - DNA, 14 bp, Homo sapiens
ttgagtgtcaagct

SEQ ID NO: 3129521 - DNA, 13 bp, Homo sapiens
ttgataaatatat

SEQ ID NO: 3129522 - DNA, 18 bp, Homo sapiens
ttgataaattccactgga

SEQ ID NO: 3129523 - DNA, 19 bp, Homo sapiens
ttgataaattccactggac

SEQ ID NO: 3129524 - DNA, 18 bp, Homo sapiens
ttgataaccttgaaaaaa

SEQ ID NO: 3129525 - DNA, 19 bp, Homo sapiens
ttgataataaattgaaatt

SEQ ID NO: 3129526 - DNA, 13 bp, Homo sapiens
ttgataatcttca

SEQ ID NO: 3129527 - DNA, 15 bp, Homo sapiens
ttgataatgctttca

SEQ ID NO: 3129528 - DNA, 23 bp, Homo sapiens
ttgataatgctttcacaacattt

SEQ ID NO: 3129529 - DNA, 15 bp, Homo sapiens
ttgataatgttaaat

SEQ ID NO: 3129530 - DNA, 18 bp, Homo sapiens
ttgataatgttaaatttg

SEQ ID NO: 3129531 - DNA, 19 bp, Homo sapiens
ttgataatgttaaatttgt

SEQ ID NO: 3129532 - DNA, 21 bp, Homo sapiens
ttgataatgttaaatttgtaa

SEQ ID NO: 3129533 - DNA, 15 bp, Homo sapiens
ttgatactgaatgca

SEQ ID NO: 3129534 - DNA, 17 bp, Homo sapiens
ttgatactgaatgcata

SEQ ID NO: 3129535 - DNA, 20 bp, Homo sapiens
ttgatactgaatgcataaat

SEQ ID NO: 3129536 - DNA, 16 bp, Homo sapiens
ttgatagaaaggaaca

SEQ ID NO: 3129537 - DNA, 19 bp, Homo sapiens
ttgatataccaaattaaaa

SEQ ID NO: 3129538 - DNA, 14 bp, Homo sapiens
ttgatatatattat

SEQ ID NO: 3129539 - DNA, 23 bp, Homo sapiens
ttgatatatattataaatatata

SEQ ID NO: 3129540 - DNA, 14 bp, Homo sapiens
ttgatcagtataat

SEQ ID NO: 3129541 - DNA, 13 bp, Homo sapiens
ttgatcatcatgt

SEQ ID NO: 3129542 - DNA, 16 bp, Homo sapiens
ttgatctgataagcaa

SEQ ID NO: 3129543 - DNA, 16 bp, Homo sapiens
ttgatctttttatcat

SEQ ID NO: 3129544 - DNA, 17 bp, Homo sapiens
ttgatctttttatcatg

SEQ ID NO: 3129545 - DNA, 18 bp, Homo sapiens
ttgatctttttatcatga

SEQ ID NO: 3129546 - DNA, 19 bp, Homo sapiens
ttgatgaaaagatttaagc

SEQ ID NO: 3129547 - DNA, 18 bp, Homo sapiens
ttgatgaaattcttgaag

SEQ ID NO: 3129548 - DNA, 18 bp, Homo sapiens
ttgatgaagcaaggaaga

SEQ ID NO: 3129549 - DNA, 18 bp, Homo sapiens
ttgatgagttaactgtga

SEQ ID NO: 3129550 - DNA, 12 bp, Homo sapiens
ttgatgcatgtg

SEQ ID NO: 3129551 - DNA, 15 bp, Homo sapiens
ttgatgccaggacac

SEQ ID NO: 3129552 - DNA, 17 bp, Homo sapiens
ttgatgctggagaggtt

SEQ ID NO: 3129553 - DNA, 13 bp, Homo sapiens
ttgatggaaaata

SEQ ID NO: 3129554 - DNA, 14 bp, Homo sapiens
ttgatggagatatt

SEQ ID NO: 3129555 - DNA, 19 bp, Homo sapiens
ttgatggtatttctttctc

SEQ ID NO: 3129556 - DNA, 20 bp, Homo sapiens
ttgatgtacagtctgtcatg

SEQ ID NO: 3129557 - DNA, 12 bp, Homo sapiens
ttgatgtatgtg

SEQ ID NO: 3129558 - DNA, 16 bp, Homo sapiens
ttgatgtatgtgtgaa

SEQ ID NO: 3129559 - DNA, 17 bp, Homo sapiens
ttgatgtatgtgtgaaa

SEQ ID NO: 3129560 - DNA, 20 bp, Homo sapiens
ttgatgtatgtgtgaaacaa

SEQ ID NO: 3129561 - DNA, 14 bp, Homo sapiens
ttgatgtcagtatt

SEQ ID NO: 3129562 - DNA, 17 bp, Homo sapiens
ttgatgtgaagataatt

SEQ ID NO: 3129563 - DNA, 14 bp, Homo sapiens
ttgatgtgacaata

SEQ ID NO: 3129564 - DNA, 14 bp, Homo sapiens
ttgatgtgactttt

SEQ ID NO: 3129565 - DNA, 11 bp, Homo sapiens
ttgatgtgttt

SEQ ID NO: 3129566 - DNA, 20 bp, Homo sapiens
ttgatgtgtttatttataga

SEQ ID NO: 3129567 - DNA, 13 bp, Homo sapiens
ttgatgttaacaa

SEQ ID NO: 3129568 - DNA, 14 bp, Homo sapiens
ttgatgttacagat

SEQ ID NO: 3129569 - DNA, 17 bp, Homo sapiens
ttgatgtttgtggcctc

SEQ ID NO: 3129570 - DNA, 22 bp, Homo sapiens
ttgatgtttgtggcctcagaat

SEQ ID NO: 3129571 - DNA, 18 bp, Homo sapiens
ttgattaagattttacaa

SEQ ID NO: 3129572 - DNA, 16 bp, Homo sapiens
ttgattaatgtttctt

SEQ ID NO: 3129573 - DNA, 14 bp, Homo sapiens
ttgattcagcaaaa

SEQ ID NO: 3129574 - DNA, 21 bp, Homo sapiens
ttgattccaatccaattatca

SEQ ID NO: 3129575 - DNA, 19 bp, Homo sapiens
ttgattgactgcccattca

SEQ ID NO: 3129576 - DNA, 14 bp, Homo sapiens
ttgattgatttgaa

SEQ ID NO: 3129577 - DNA, 17 bp, Homo sapiens
ttgattgggaaaacatt

SEQ ID NO: 3129578 - DNA, 14 bp, Homo sapiens
ttgatttccatctt

SEQ ID NO: 3129579 - DNA, 15 bp, Homo sapiens
ttgatttccatctta

SEQ ID NO: 3129580 - DNA, 14 bp, Homo sapiens
ttgatttgaagaac

SEQ ID NO: 3129581 - DNA, 11 bp, Homo sapiens
ttgatttgcat

SEQ ID NO: 3129582 - DNA, 19 bp, Homo sapiens
ttgatttgcattgaacaca

SEQ ID NO: 3129583 - DNA, 14 bp, Homo sapiens
ttgattttctgttg

SEQ ID NO: 3129584 - DNA, 15 bp, Homo sapiens
ttgattttgctgact

SEQ ID NO: 3129585 - DNA, 17 bp, Homo sapiens
ttgatttttctcttcat

SEQ ID NO: 3129586 - DNA, 20 bp, Homo sapiens
ttgatttttctcttcatttt

SEQ ID NO: 3129587 - DNA, 17 bp, Homo sapiens
ttgcaaaagactaattt

SEQ ID NO: 3129588 - DNA, 23 bp, Homo sapiens
ttgcaaaatttccagtacctttg

SEQ ID NO: 3129589 - DNA, 19 bp, Homo sapiens
ttgcaaagaactccagagt

SEQ ID NO: 3129590 - DNA, 19 bp, Homo sapiens
ttgcaaagacctacctcca

SEQ ID NO: 3129591 - DNA, 21 bp, Homo sapiens
ttgcaaagacctacctccaga

SEQ ID NO: 3129592 - DNA, 12 bp, Homo sapiens
ttgcaaatataa

SEQ ID NO: 3129593 - DNA, 15 bp, Homo sapiens
ttgcaaatcttgaaa

SEQ ID NO: 3129594 - DNA, 23 bp, Homo sapiens
ttgcaacaggggaggaaaaaaga

SEQ ID NO: 3129595 - DNA, 15 bp, Homo sapiens
ttgcaacttcagttt

SEQ ID NO: 3129596 - DNA, 18 bp, Homo sapiens
ttgcaagttatattagtg

SEQ ID NO: 3129597 - DNA, 18 bp, Homo sapiens
ttgcaataacttctatat

SEQ ID NO: 3129598 - DNA, 23 bp, Homo sapiens
ttgcaataacttctatattttaa

SEQ ID NO: 3129599 - DNA, 22 bp, Homo sapiens
ttgcaatagcagttataacaga

SEQ ID NO: 3129600 - DNA, 15 bp, Homo sapiens
ttgcaatatctgaag

SEQ ID NO: 3129601 - DNA, 14 bp, Homo sapiens
ttgcaatggcagcc

SEQ ID NO: 3129602 - DNA, 16 bp, Homo sapiens
ttgcaatggcagcctt

SEQ ID NO: 3129603 - DNA, 16 bp, Homo sapiens
ttgcaattagcattct

SEQ ID NO: 3129604 - DNA, 18 bp, Homo sapiens
ttgcacaagttccctgga

SEQ ID NO: 3129605 - DNA, 13 bp, Homo sapiens
ttgcacacttgtg

SEQ ID NO: 3129606 - DNA, 18 bp, Homo sapiens
ttgcacaggatgctggcc

SEQ ID NO: 3129607 - DNA, 13 bp, Homo sapiens
ttgcacagtgtgt

SEQ ID NO: 3129608 - DNA, 22 bp, Homo sapiens
ttgcaccactgcactccagcct

SEQ ID NO: 3129609 - DNA, 22 bp, Homo sapiens
ttgcacccctcactctggcctc

SEQ ID NO: 3129610 - DNA, 13 bp, Homo sapiens
ttgcacccctccc

SEQ ID NO: 3129611 - DNA, 15 bp, Homo sapiens
ttgcacccctcccat

SEQ ID NO: 3129612 - DNA, 22 bp, Homo sapiens
ttgcacgtttggtttgcgcagt

SEQ ID NO: 3129613 - DNA, 19 bp, Homo sapiens
ttgcactctaaaaggttca

SEQ ID NO: 3129614 - DNA, 13 bp, Homo sapiens
ttgcactgagggc

SEQ ID NO: 3129615 - DNA, 21 bp, Homo sapiens
ttgcactgagggccacactat

SEQ ID NO: 3129616 - DNA, 21 bp, Homo sapiens
ttgcactgatgtccggagaga

SEQ ID NO: 3129617 - DNA, 17 bp, Homo sapiens
ttgcactggagttctat

SEQ ID NO: 3129618 - DNA, 13 bp, Homo sapiens
ttgcacttatgta

SEQ ID NO: 3129619 - DNA, 15 bp, Homo sapiens
ttgcacttatgtact

SEQ ID NO: 3129620 - DNA, 16 bp, Homo sapiens
ttgcacttatgtactt

SEQ ID NO: 3129621 - DNA, 17 bp, Homo sapiens
ttgcacttatgtacttg

SEQ ID NO: 3129622 - DNA, 18 bp, Homo sapiens
ttgcacttattgtcccct

SEQ ID NO: 3129623 - DNA, 22 bp, Homo sapiens
ttgcacttgattaagcttttgt

SEQ ID NO: 3129624 - DNA, 15 bp, Homo sapiens
ttgcagaaacatttt

SEQ ID NO: 3129625 - DNA, 14 bp, Homo sapiens
ttgcagaactgcca

SEQ ID NO: 3129626 - DNA, 16 bp, Homo sapiens
ttgcagaagagggtgt

SEQ ID NO: 3129627 - DNA, 22 bp, Homo sapiens
ttgcagacaggcaagcacctcc

SEQ ID NO: 3129628 - DNA, 23 bp, Homo sapiens
ttgcagacaggcaagcacctcct

SEQ ID NO: 3129629 - DNA, 20 bp, Homo sapiens
ttgcagagaagcatcctcca

SEQ ID NO: 3129630 - DNA, 14 bp, Homo sapiens
ttgaaggcagtctg

SEQ ID NO: 3129631 - DNA, 16 bp, Homo sapiens
ttgaaggcagtctgaa

SEQ ID NO: 3129632 - DNA, 20 bp, Homo sapiens
ttgaagggaggggctgtgtt

SEQ ID NO: 3129633 - DNA, 22 bp, Homo sapiens
ttgaaggtgataagggaaaaga

SEQ ID NO: 3129634 - DNA, 17 bp, Homo sapiens
ttgaagtaatgaatttt

SEQ ID NO: 3129635 - DNA, 18 bp, Homo sapiens
ttgaagtgactgttgtac

SEQ ID NO: 3129636 - DNA, 22 bp, Homo sapiens
ttgaagttagtggaaatctgaa

SEQ ID NO: 3129637 - DNA, 19 bp, Homo sapiens
ttgaataaaaaatagacat

SEQ ID NO: 3129638 - DNA, 20 bp, Homo sapiens
ttgaataaaaatatgtacaa

SEQ ID NO: 3129639 - DNA, 17 bp, Homo sapiens
ttgaataggtagtatca

SEQ ID NO: 3129640 - DNA, 16 bp, Homo sapiens
ttgaatatagcctgcc

SEQ ID NO: 3129641 - DNA, 17 bp, Homo sapiens
ttgaatatagcctgcct

SEQ ID NO: 3129642 - DNA, 14 bp, Homo sapiens
ttgaatatcattaa

SEQ ID NO: 3129643 - DNA, 21 bp, Homo sapiens
ttgaatattactcctattttt

SEQ ID NO: 3129644 - DNA, 12 bp, Homo sapiens
ttgaatattgtg

SEQ ID NO: 3129645 - DNA, 17 bp, Homo sapiens
ttgaatcagtataaaca

SEQ ID NO: 3129646 - DNA, 19 bp, Homo sapiens
ttgaatctataaaagaatt

SEQ ID NO: 3129647 - DNA, 24 bp, Homo sapiens
ttgaatctgattggacattttctt

SEQ ID NO: 3129648 - DNA, 20 bp, Homo sapiens
ttgaatgaaaaatttaagca

SEQ ID NO: 3129649 - DNA, 23 bp, Homo sapiens
ttgaatgaaaaatttaagcattg

SEQ ID NO: 3129650 - DNA, 17 bp, Homo sapiens
ttgaatgacaacagaag

SEQ ID NO: 3129651 - DNA, 18 bp, Homo sapiens
ttgaatgacaacagaagc

SEQ ID NO: 3129652 - DNA, 16 bp, Homo sapiens
ttgaatgcttcctgac

SEQ ID NO: 3129653 - DNA, 15 bp, Homo sapiens
ttgaatgggtccatt

SEQ ID NO: 3129654 - DNA, 23 bp, Homo sapiens
ttgaatggtcagcgttgcatgtc

SEQ ID NO: 3129655 - DNA, 16 bp, Homo sapiens
ttgaatggtgttgtat

SEQ ID NO: 3129656 - DNA, 20 bp, Homo sapiens
ttgaatggtgttgtatgcct

SEQ ID NO: 3129657 - DNA, 23 bp, Homo sapiens
ttgaatgtcacaaattgatcaag

SEQ ID NO: 3129658 - DNA, 14 bp, Homo sapiens
ttgaatgttaaagg

SEQ ID NO: 3129659 - DNA, 16 bp, Homo sapiens
ttgaatgttaagaatt

SEQ ID NO: 3129660 - DNA, 17 bp, Homo sapiens
ttgaatgttaagaattg

SEQ ID NO: 3129661 - DNA, 23 bp, Homo sapiens
ttgaattaaattaggaataaata

SEQ ID NO: 3129662 - DNA, 16 bp, Homo sapiens
ttgaattaggctaaaa

SEQ ID NO: 3129663 - DNA, 13 bp, Homo sapiens
ttgaattatcttg

SEQ ID NO: 3129664 - DNA, 18 bp, Homo sapiens
ttgaattatcttggttga

SEQ ID NO: 3129665 - DNA, 20 bp, Homo sapiens
ttgaattatcttggttgaaa

SEQ ID NO: 3129666 - DNA, 15 bp, Homo sapiens
ttgaattttaaatct

SEQ ID NO: 3129667 - DNA, 22 bp, Homo sapiens
ttgaattttgtttttattttca

SEQ ID NO: 3129668 - DNA, 14 bp, Homo sapiens
ttgaatttttctct

SEQ ID NO: 3129669 - DNA, 17 bp, Homo sapiens
ttgacaaaattttctca

SEQ ID NO: 3129670 - DNA, 18 bp, Homo sapiens
ttgacaaaattttctcat

SEQ ID NO: 3129671 - DNA, 13 bp, Homo sapiens
ttgacaaatctgt

SEQ ID NO: 3129672 - DNA, 23 bp, Homo sapiens
ttgacaaatctgtgtatattatt

SEQ ID NO: 3129673 - DNA, 16 bp, Homo sapiens
ttgacaaccatgagac

SEQ ID NO: 3129674 - DNA, 17 bp, Homo sapiens
ttgacaactaaaattag

SEQ ID NO: 3129675 - DNA, 16 bp, Homo sapiens
ttgacaactgtgactg

SEQ ID NO: 3129676 - DNA, 18 bp, Homo sapiens
ttgacaattactcaggtt

SEQ ID NO: 3129677 - DNA, 14 bp, Homo sapiens
ttgacacaagtgga

SEQ ID NO: 3129678 - DNA, 18 bp, Homo sapiens
ttgacacaagtggacctt

SEQ ID NO: 3129679 - DNA, 16 bp, Homo sapiens
ttgacacacagaaatg

SEQ ID NO: 3129680 - DNA, 14 bp, Homo sapiens
ttgacacagtcagc

SEQ ID NO: 3129681 - DNA, 21 bp, Homo sapiens
ttgacacatccgccttttgta

SEQ ID NO: 3129682 - DNA, 17 bp, Homo sapiens
ttgacactctgcagact

SEQ ID NO: 3129683 - DNA, 15 bp, Homo sapiens
ttgacactgctctaa

SEQ ID NO: 3129684 - DNA, 19 bp, Homo sapiens
ttgacaggattattggaaa

SEQ ID NO: 3129685 - DNA, 10 bp, Homo sapiens
ttgacagggc

SEQ ID NO: 3129686 - DNA, 19 bp, Homo sapiens
ttgacagtgttgaaaatgt

SEQ ID NO: 3129687 - DNA, 15 bp, Homo sapiens
ttgacagttctgaag

SEQ ID NO: 3129688 - DNA, 17 bp, Homo sapiens
ttgacatccaaatctag

SEQ ID NO: 3129689 - DNA, 16 bp, Homo sapiens
ttgacatggaaatgaa

SEQ ID NO: 3129690 - DNA, 15 bp, Homo sapiens
ttgaccaagaactgc

SEQ ID NO: 3129691 - DNA, 17 bp, Homo sapiens
ttgaccaagaactgcat

SEQ ID NO: 3129692 - DNA, 18 bp, Homo sapiens
ttgaccaagaactgcatg

SEQ ID NO: 3129693 - DNA, 21 bp, Homo sapiens
ttgaccaagaactgcatggac

SEQ ID NO: 3129694 - DNA, 16 bp, Homo sapiens
ttgaccactgtctttt

SEQ ID NO: 3129695 - DNA, 17 bp, Homo sapiens
ttgaccatctgctttta

SEQ ID NO: 3129696 - DNA, 15 bp, Homo sapiens
ttgaccccagtttct

SEQ ID NO: 3129697 - DNA, 19 bp, Homo sapiens
ttgaccccagtttcttctt

SEQ ID NO: 3129698 - DNA, 23 bp, Homo sapiens
ttgacctcacagtgacccttccc

SEQ ID NO: 3129699 - DNA, 21 bp, Homo sapiens
ttgacctcaggtgatccaccc

SEQ ID NO: 3129700 - DNA, 17 bp, Homo sapiens
ttgacctctcagggcct

SEQ ID NO: 3129701 - DNA, 18 bp, Homo sapiens
ttgacctctcagggcctg

SEQ ID NO: 3129702 - DNA, 19 bp, Homo sapiens
ttgacctctcagggcctgg

SEQ ID NO: 3129703 - DNA, 18 bp, Homo sapiens
ttgacctgaggagacatc

SEQ ID NO: 3129704 - DNA, 16 bp, Homo sapiens
ttgacctgctccgctg

SEQ ID NO: 3129705 - DNA, 21 bp, Homo sapiens
ttgacctgctccgctgctcct

SEQ ID NO: 3129706 - DNA, 19 bp, Homo sapiens
ttgacctgtttctctttgt

SEQ ID NO: 3129707 - DNA, 23 bp, Homo sapiens
ttgacgaagtctcttttctttag

SEQ ID NO: 3129708 - DNA, 14 bp, Homo sapiens
ttgactaattttac

SEQ ID NO: 3129709 - DNA, 22 bp, Homo sapiens
ttgactcagaggctgggagcat

SEQ ID NO: 3129710 - DNA, 12 bp, Homo sapiens
ttgactcctttt

SEQ ID NO: 3129711 - DNA, 18 bp, Homo sapiens
ttgactccttttggaacc

SEQ ID NO: 3129712 - DNA, 21 bp, Homo sapiens
ttgactgatgctgagattctt

SEQ ID NO: 3129713 - DNA, 21 bp, Homo sapiens
ttgacttaatgtgattactgc

SEQ ID NO: 3129714 - DNA, 16 bp, Homo sapiens
ttgacttattttctct

SEQ ID NO: 3129715 - DNA, 23 bp, Homo sapiens
ttgacttcagctgcctgaaacag

SEQ ID NO: 3129716 - DNA, 23 bp, Homo sapiens
ttgacttcattttatatttaaaa

SEQ ID NO: 3129717 - DNA, 21 bp, Homo sapiens
ttgacttcttgcttcagtcat

SEQ ID NO: 3129718 - DNA, 13 bp, Homo sapiens
ttgactttataaa

SEQ ID NO: 3129719 - DNA, 16 bp, Homo sapiens
ttgactttcaaaatat

SEQ ID NO: 3129720 - DNA, 15 bp, Homo sapiens
ttgagaaatgaataa

SEQ ID NO: 3129721 - DNA, 23 bp, Homo sapiens
ttgagaaccagtctcctcactct

SEQ ID NO: 3129722 - DNA, 15 bp, Homo sapiens
ttgagaagcgttttt

SEQ ID NO: 3129723 - DNA, 16 bp, Homo sapiens
ttgagaaggagagaaa

SEQ ID NO: 3129724 - DNA, 17 bp, Homo sapiens
ttgagaaggagagaaag

SEQ ID NO: 3129725 - DNA, 14 bp, Homo sapiens
ttgagacaagccct

SEQ ID NO: 3129726 - DNA, 15 bp, Homo sapiens
ttgagacaagccctg

SEQ ID NO: 3129727 - DNA, 13 bp, Homo sapiens
ttgagacagtttc

SEQ ID NO: 3129728 - DNA, 17 bp, Homo sapiens
ttgagacagtttcttag

SEQ ID NO: 3129729 - DNA, 14 bp, Homo sapiens
ttgagactagtttt

SEQ ID NO: 3129730 - DNA, 12 bp, Homo sapiens
ttgagacttttt

SEQ ID NO: 3129731 - DNA, 19 bp, Homo sapiens
ttgagaggccctggggttc

SEQ ID NO: 3129732 - DNA, 14 bp, Homo sapiens
ttgagagttctaaa

SEQ ID NO: 3129733 - DNA, 18 bp, Homo sapiens
ttgagagttttgtcttga

SEQ ID NO: 3129734 - DNA, 23 bp, Homo sapiens
ttgagatgtgttcctcctgctgt

SEQ ID NO: 3129735 - DNA, 17 bp, Homo sapiens
ttgagattgccccaggt

SEQ ID NO: 3129736 - DNA, 19 bp, Homo sapiens
ttgagcagtggctggtcca

SEQ ID NO: 3129737 - DNA, 17 bp, Homo sapiens
ttgagcatttttaaggg

SEQ ID NO: 3129738 - DNA, 13 bp, Homo sapiens
ttgagccaggcct

SEQ ID NO: 3129739 - DNA, 22 bp, Homo sapiens
ttgagccaggcctgggtctgtg

SEQ ID NO: 3129740 - DNA, 23 bp, Homo sapiens
ttgagccagtaatctttatactg

SEQ ID NO: 3129741 - DNA, 14 bp, Homo sapiens
ttgagccccaagtc

SEQ ID NO: 3129742 - DNA, 19 bp, Homo sapiens
ttgagccccaagtcctgaa

SEQ ID NO: 3129743 - DNA, 13 bp, Homo sapiens
ttgagccctggct

SEQ ID NO: 3129744 - DNA, 14 bp, Homo sapiens
ttgagccctggctg

SEQ ID NO: 3129745 - DNA, 20 bp, Homo sapiens
ttgagccgggcccctgggct

SEQ ID NO: 3129746 - DNA, 18 bp, Homo sapiens
ttgagcctcccccaaagc

SEQ ID NO: 3129747 - DNA, 20 bp, Homo sapiens
ttgagctactggattcttat

SEQ ID NO: 3129748 - DNA, 15 bp, Homo sapiens
ttgagctattgctgt

SEQ ID NO: 3129749 - DNA, 11 bp, Homo sapiens
ttgagctggcc

SEQ ID NO: 3129750 - DNA, 12 bp, Homo sapiens
ttgagctgtttt

SEQ ID NO: 3129751 - DNA, 15 bp, Homo sapiens
ttgaggaaatattaa

SEQ ID NO: 3129752 - DNA, 14 bp, Homo sapiens
ttgaggaactgtac

SEQ ID NO: 3129753 - DNA, 15 bp, Homo sapiens
ttgaggaactgtaca

SEQ ID NO: 3129754 - DNA, 20 bp, Homo sapiens
ttgaggaagtggctgtccct

SEQ ID NO: 3129755 - DNA, 20 bp, Homo sapiens
ttgaggaataaatgccttta

SEQ ID NO: 3129756 - DNA, 15 bp, Homo sapiens
ttgaggagcatgttt

SEQ ID NO: 3129757 - DNA, 16 bp, Homo sapiens
ttgaggagcatgtttt

SEQ ID NO: 3129758 - DNA, 21 bp, Homo sapiens
ttgaggagcatgttttgtata

SEQ ID NO: 3129759 - DNA, 20 bp, Homo sapiens
ttcttgctgctagaactttt

SEQ ID NO: 3129760 - DNA, 14 bp, Homo sapiens
ttcttgctggttgt

SEQ ID NO: 3129761 - DNA, 23 bp, Homo sapiens
ttcttgctggttgtcatttttgc

SEQ ID NO: 3129762 - DNA, 19 bp, Homo sapiens
ttcttgcttctttctagaa

SEQ ID NO: 3129763 - DNA, 15 bp, Homo sapiens
ttcttgctttcaatt

SEQ ID NO: 3129764 - DNA, 22 bp, Homo sapiens
ttcttggcttaatcattttcat

SEQ ID NO: 3129765 - DNA, 18 bp, Homo sapiens
ttcttggggtactcttga

SEQ ID NO: 3129766 - DNA, 15 bp, Homo sapiens
ttcttggtagagatt

SEQ ID NO: 3129767 - DNA, 18 bp, Homo sapiens
ttcttggtgactgtccca

SEQ ID NO: 3129768 - DNA, 13 bp, Homo sapiens
ttcttgtaaatgt

SEQ ID NO: 3129769 - DNA, 14 bp, Homo sapiens
ttcttgtaaatgtt

SEQ ID NO: 3129770 - DNA, 15 bp, Homo sapiens
ttcttgtaaatgttt

SEQ ID NO: 3129771 - DNA, 16 bp, Homo sapiens
ttcttgtaaatgtttc

SEQ ID NO: 3129772 - DNA, 21 bp, Homo sapiens
ttcttgtaatttaaacaggcc

SEQ ID NO: 3129773 - DNA, 23 bp, Homo sapiens
ttcttgtaatttaaacaggccca

SEQ ID NO: 3129774 - DNA, 13 bp, Homo sapiens
ttcttgtagtagt

SEQ ID NO: 3129775 - DNA, 20 bp, Homo sapiens
ttcttgtcagacataaagcc

SEQ ID NO: 3129776 - DNA, 14 bp, Homo sapiens
ttcttgtctttatt

SEQ ID NO: 3129777 - DNA, 20 bp, Homo sapiens
ttcttgtggtgtaaagctgg

SEQ ID NO: 3129778 - DNA, 15 bp, Homo sapiens
ttcttgttttatata

SEQ ID NO: 3129779 - DNA, 13 bp, Homo sapiens
ttctttaaaagaa

SEQ ID NO: 3129780 - DNA, 17 bp, Homo sapiens
ttctttaaaagaatgac

SEQ ID NO: 3129781 - DNA, 18 bp, Homo sapiens
ttctttaaaagaatgact

SEQ ID NO: 3129782 - DNA, 14 bp, Homo sapiens
ttctttaaagaagt

SEQ ID NO: 3129783 - DNA, 13 bp, Homo sapiens
ttctttaaagatg

SEQ ID NO: 3129784 - DNA, 13 bp, Homo sapiens
ttctttaaatgtt

SEQ ID NO: 3129785 - DNA, 14 bp, Homo sapiens
ttctttaaatgttt

SEQ ID NO: 3129786 - DNA, 18 bp, Homo sapiens
ttctttaatgcttttata

SEQ ID NO: 3129787 - DNA, 16 bp, Homo sapiens
ttctttactaaagata

SEQ ID NO: 3129788 - DNA, 22 bp, Homo sapiens
ttctttaggagattttaggtgt

SEQ ID NO: 3129789 - DNA, 14 bp, Homo sapiens
ttctttagtatagc

SEQ ID NO: 3129790 - DNA, 18 bp, Homo sapiens
ttctttataattctactt

SEQ ID NO: 3129791 - DNA, 19 bp, Homo sapiens
ttctttcagttctttggat

SEQ ID NO: 3129792 - DNA, 17 bp, Homo sapiens
ttctttccattatgatt

SEQ ID NO: 3129793 - DNA, 20 bp, Homo sapiens
ttctttccattatgattctt

SEQ ID NO: 3129794 - DNA, 19 bp, Homo sapiens
ttctttcctccccctgcaa

SEQ ID NO: 3129795 - DNA, 21 bp, Homo sapiens
ttctttcctccccctgcaact

SEQ ID NO: 3129796 - DNA, 13 bp, Homo sapiens
ttctttctagaaa

SEQ ID NO: 3129797 - DNA, 22 bp, Homo sapiens
ttctttctagtggtctttgtaa

SEQ ID NO: 3129798 - DNA, 13 bp, Homo sapiens
ttctttctctcag

SEQ ID NO: 3129799 - DNA, 13 bp, Homo sapiens
ttctttctggact

SEQ ID NO: 3129800 - DNA, 14 bp, Homo sapiens
ttctttctggactg

SEQ ID NO: 3129801 - DNA, 15 bp, Homo sapiens
ttctttctggactgg

SEQ ID NO: 3129802 - DNA, 15 bp, Homo sapiens
ttctttcttcctctg

SEQ ID NO: 3129803 - DNA, 14 bp, Homo sapiens
ttctttcttgctgg

SEQ ID NO: 3129804 - DNA, 17 bp, Homo sapiens
ttctttgagactgggtc

SEQ ID NO: 3129805 - DNA, 21 bp, Homo sapiens
ttctttgagggactgcctctg

SEQ ID NO: 3129806 - DNA, 16 bp, Homo sapiens
ttctttgcaccaaaga

SEQ ID NO: 3129807 - DNA, 16 bp, Homo sapiens
ttctttgcacttaaaa

SEQ ID NO: 3129808 - DNA, 12 bp, Homo sapiens
ttctttgctgtt

SEQ ID NO: 3129809 - DNA, 16 bp, Homo sapiens
ttctttggaaagtaca

SEQ ID NO: 3129810 - DNA, 16 bp, Homo sapiens
ttctttggtaattttt

SEQ ID NO: 3129811 - DNA, 15 bp, Homo sapiens
ttctttggtgccttt

SEQ ID NO: 3129812 - DNA, 15 bp, Homo sapiens
ttctttgtttcctgg

SEQ ID NO: 3129813 - DNA, 13 bp, Homo sapiens
ttctttgtttctt

SEQ ID NO: 3129814 - DNA, 14 bp, Homo sapiens
ttctttgtttcttt

SEQ ID NO: 3129815 - DNA, 22 bp, Homo sapiens
ttcttttataataatgaatgtg

SEQ ID NO: 3129816 - DNA, 22 bp, Homo sapiens
ttcttttcccttaaatacagat

SEQ ID NO: 3129817 - DNA, 12 bp, Homo sapiens
ttcttttgcatt

SEQ ID NO: 3129818 - DNA, 13 bp, Homo sapiens
ttcttttgcattt

SEQ ID NO: 3129819 - DNA, 21 bp, Homo sapiens
ttcttttgcccttcacagtgt

SEQ ID NO: 3129820 - DNA, 22 bp, Homo sapiens
ttcttttgcccttcacagtgtt

SEQ ID NO: 3129821 - DNA, 17 bp, Homo sapiens
ttcttttgttactgttc

SEQ ID NO: 3129822 - DNA, 20 bp, Homo sapiens
ttctttttaattattttaaa

SEQ ID NO: 3129823 - DNA, 18 bp, Homo sapiens
ttctttttacagcattgt

SEQ ID NO: 3129824 - DNA, 21 bp, Homo sapiens
ttctttttacagcattgtctt

SEQ ID NO: 3129825 - DNA, 23 bp, Homo sapiens
ttctttttgctgttgtttctaaa

SEQ ID NO: 3129826 - DNA, 15 bp, Homo sapiens
ttctttttgtacact

SEQ ID NO: 3129827 - DNA, 17 bp, Homo sapiens
ttcttttttaaaatcaa

SEQ ID NO: 3129828 - DNA, 18 bp, Homo sapiens
ttctttttttccttttta

SEQ ID NO: 3129829 - DNA, 19 bp, Homo sapiens
ttctttttttcctttttaa

SEQ ID NO: 3129830 - DNA, 14 bp, Homo sapiens
ttctttttttgtga

SEQ ID NO: 3129831 - DNA, 18 bp, Homo sapiens
ttcttttttttttctgtt

SEQ ID NO: 3129832 - DNA, 20 bp, Homo sapiens
ttcttttttttttctgttga

SEQ ID NO: 3129833 - DNA, 18 bp, Homo sapiens
ttgaaaaaaaaaatgttg

SEQ ID NO: 3129834 - DNA, 13 bp, Homo sapiens
ttgaaaaatataa

SEQ ID NO: 3129835 - DNA, 17 bp, Homo sapiens
ttgaaaaccatatttta

SEQ ID NO: 3129836 - DNA, 17 bp, Homo sapiens
ttgaaaagcttcttaat

SEQ ID NO: 3129837 - DNA, 16 bp, Homo sapiens
ttgaaaaggtgacctt

SEQ ID NO: 3129838 - DNA, 15 bp, Homo sapiens
ttgaaaatcttgtgt

SEQ ID NO: 3129839 - DNA, 22 bp, Homo sapiens
ttgaaaatggtttcaagttatt

SEQ ID NO: 3129840 - DNA, 15 bp, Homo sapiens
ttgaaaatgtgtttg

SEQ ID NO: 3129841 - DNA, 15 bp, Homo sapiens
ttgaaaattatttta

SEQ ID NO: 3129842 - DNA, 19 bp, Homo sapiens
ttgaaaattattttaaaca

SEQ ID NO: 3129843 - DNA, 22 bp, Homo sapiens
ttgaaaattattttaaacaaaa

SEQ ID NO: 3129844 - DNA, 17 bp, Homo sapiens
ttgaaacacaataccta

SEQ ID NO: 3129845 - DNA, 17 bp, Homo sapiens
ttgaaacccacagtttt

SEQ ID NO: 3129846 - DNA, 18 bp, Homo sapiens
ttgaaacccacagtttta

SEQ ID NO: 3129847 - DNA, 18 bp, Homo sapiens
ttgaaacgttatgatgac

SEQ ID NO: 3129848 - DNA, 22 bp, Homo sapiens
ttgaaactttgggaaaacatgt

SEQ ID NO: 3129849 - DNA, 13 bp, Homo sapiens
ttgaaagaccttc

SEQ ID NO: 3129850 - DNA, 20 bp, Homo sapiens
ttgaaagagaaccagtttca

SEQ ID NO: 3129851 - DNA, 14 bp, Homo sapiens
ttgaaagagttaag

SEQ ID NO: 3129852 - DNA, 19 bp, Homo sapiens
ttgaaagagttaagaatgt

SEQ ID NO: 3129853 - DNA, 12 bp, Homo sapiens
ttgaaagctgtg

SEQ ID NO: 3129854 - DNA, 22 bp, Homo sapiens
ttgaaagctgtggccagcttgt

SEQ ID NO: 3129855 - DNA, 21 bp, Homo sapiens
ttgaaaggttttttttcagtt

SEQ ID NO: 3129856 - DNA, 21 bp, Homo sapiens
ttgaaataactggaacaaatt

SEQ ID NO: 3129857 - DNA, 20 bp, Homo sapiens
ttgaaatacctcatgtttat

SEQ ID NO: 3129858 - DNA, 18 bp, Homo sapiens
ttgaaatactaaaagcaa

SEQ ID NO: 3129859 - DNA, 19 bp, Homo sapiens
ttgaaatactaaaagcaaa

SEQ ID NO: 3129860 - DNA, 13 bp, Homo sapiens
ttgaaatgaaatt

SEQ ID NO: 3129861 - DNA, 20 bp, Homo sapiens
ttgaaatgaaatttaaacat

SEQ ID NO: 3129862 - DNA, 21 bp, Homo sapiens
ttgaaatgaaatttaaacatt

SEQ ID NO: 3129863 - DNA, 17 bp, Homo sapiens
ttgaaattactgtgtaa

SEQ ID NO: 3129864 - DNA, 11 bp, Homo sapiens
ttgaaattata

SEQ ID NO: 3129865 - DNA, 23 bp, Homo sapiens
ttgaaattatgtatgtttacata

SEQ ID NO: 3129866 - DNA, 13 bp, Homo sapiens
ttgaaattgtgaa

SEQ ID NO: 3129867 - DNA, 19 bp, Homo sapiens
ttgaaattgtttaagtgtt

SEQ ID NO: 3129868 - DNA, 12 bp, Homo sapiens
ttgaaattttaa

SEQ ID NO: 3129869 - DNA, 17 bp, Homo sapiens
ttgaaattttgcaaata

SEQ ID NO: 3129870 - DNA, 22 bp, Homo sapiens
ttgaaattttgcaaatataaac

SEQ ID NO: 3129871 - DNA, 18 bp, Homo sapiens
ttgaacacagtattttcc

SEQ ID NO: 3129872 - DNA, 20 bp, Homo sapiens
ttgaacacagtattttccca

SEQ ID NO: 3129873 - DNA, 19 bp, Homo sapiens
ttgaacatgtgccttttct

SEQ ID NO: 3129874 - DNA, 14 bp, Homo sapiens
ttgaacccctgtgt

SEQ ID NO: 3129875 - DNA, 20 bp, Homo sapiens
ttgaacctggatccagcact

SEQ ID NO: 3129876 - DNA, 18 bp, Homo sapiens
ttgaacctttttttttga

SEQ ID NO: 3129877 - DNA, 14 bp, Homo sapiens
ttgaactaagaaac

SEQ ID NO: 3129878 - DNA, 16 bp, Homo sapiens
ttgaactaagaaactt

SEQ ID NO: 3129879 - DNA, 22 bp, Homo sapiens
ttgaactaagaaacttttgtaa

SEQ ID NO: 3129880 - DNA, 19 bp, Homo sapiens
ttgaactgttagatgctga

SEQ ID NO: 3129881 - DNA, 18 bp, Homo sapiens
ttgaagaaggaaagaacc

SEQ ID NO: 3129882 - DNA, 17 bp, Homo sapiens
ttgaagaatatttaaga

SEQ ID NO: 3129883 - DNA, 14 bp, Homo sapiens
ttgaagagacagag

SEQ ID NO: 3129884 - DNA, 17 bp, Homo sapiens
ttgaagccactgaagct

SEQ ID NO: 3129885 - DNA, 21 bp, Homo sapiens
ttgaagccactgaagctggga

SEQ ID NO: 3129886 - DNA, 19 bp, Homo sapiens
ttgaaggaagccaaattta

SEQ ID NO: 3129887 - DNA, 15 bp, Homo sapiens
ttgaaggcaaaattg

SEQ ID NO: 3129888 - DNA, 20 bp, Homo sapiens
ttctggggcccaggaagccc

SEQ ID NO: 3129889 - DNA, 21 bp, Homo sapiens
ttctggggcccaggaagccca

SEQ ID NO: 3129890 - DNA, 17 bp, Homo sapiens
ttctgggtcttttgcta

SEQ ID NO: 3129891 - DNA, 18 bp, Homo sapiens
ttctggtactctcctaga

SEQ ID NO: 3129892 - DNA, 15 bp, Homo sapiens
ttctggtactttctg

SEQ ID NO: 3129893 - DNA, 13 bp, Homo sapiens
ttctggtctgtgt

SEQ ID NO: 3129894 - DNA, 17 bp, Homo sapiens
ttctggttccagggtcc

SEQ ID NO: 3129895 - DNA, 14 bp, Homo sapiens
ttctggttccattt

SEQ ID NO: 3129896 - DNA, 13 bp, Homo sapiens
ttctgtaattgtg

SEQ ID NO: 3129897 - DNA, 15 bp, Homo sapiens
ttctgtacatagcct

SEQ ID NO: 3129898 - DNA, 14 bp, Homo sapiens
ttctgtaccagtta

SEQ ID NO: 3129899 - DNA, 21 bp, Homo sapiens
ttctgtaccagttaatttttc

SEQ ID NO: 3129900 - DNA, 21 bp, Homo sapiens
ttctgtacttccaatttataa

SEQ ID NO: 3129901 - DNA, 13 bp, Homo sapiens
ttctgtacttcct

SEQ ID NO: 3129902 - DNA, 15 bp, Homo sapiens
ttctgtacttcctga

SEQ ID NO: 3129903 - DNA, 20 bp, Homo sapiens
ttctgtagtactccttaaga

SEQ ID NO: 3129904 - DNA, 15 bp, Homo sapiens
ttctgtagtcattta

SEQ ID NO: 3129905 - DNA, 22 bp, Homo sapiens
ttctgtagtcatttactaaaca

SEQ ID NO: 3129906 - DNA, 21 bp, Homo sapiens
ttctgtatacaaccctggcat

SEQ ID NO: 3129907 - DNA, 23 bp, Homo sapiens
ttctgtatacaaccctggcatta

SEQ ID NO: 3129908 - DNA, 15 bp, Homo sapiens
ttctgtatatacttt

SEQ ID NO: 3129909 - DNA, 14 bp, Homo sapiens
ttctgtatttctag

SEQ ID NO: 3129910 - DNA, 11 bp, Homo sapiens
ttctgtatttt

SEQ ID NO: 3129911 - DNA, 20 bp, Homo sapiens
ttctgtatttttttttctaa

SEQ ID NO: 3129912 - DNA, 22 bp, Homo sapiens
ttctgtcagatgagaacaaagc

SEQ ID NO: 3129913 - DNA, 24 bp, Homo sapiens
ttctgtcagatgagaacaaagctg

SEQ ID NO: 3129914 - DNA, 16 bp, Homo sapiens
ttctgtcagtgttaaa

SEQ ID NO: 3129915 - DNA, 13 bp, Homo sapiens
ttctgtccccagc

SEQ ID NO: 3129916 - DNA, 18 bp, Homo sapiens
ttctgtcgccttagcatg

SEQ ID NO: 3129917 - DNA, 21 bp, Homo sapiens
ttctgtcgccttagcatgttt

SEQ ID NO: 3129918 - DNA, 16 bp, Homo sapiens
ttctgtgacccatctg

SEQ ID NO: 3129919 - DNA, 17 bp, Homo sapiens
ttctgtgacccatctgt

SEQ ID NO: 3129920 - DNA, 18 bp, Homo sapiens
ttctgtgatgagctgatc

SEQ ID NO: 3129921 - DNA, 16 bp, Homo sapiens
ttctgtgcctgaatat

SEQ ID NO: 3129922 - DNA, 20 bp, Homo sapiens
ttctgtggttcctctgctca

SEQ ID NO: 3129923 - DNA, 21 bp, Homo sapiens
ttctgtggttcctctgctcac

SEQ ID NO: 3129924 - DNA, 18 bp, Homo sapiens
ttctgtggtttcatgtta

SEQ ID NO: 3129925 - DNA, 14 bp, Homo sapiens
ttctgtgtacattt

SEQ ID NO: 3129926 - DNA, 21 bp, Homo sapiens
ttctgtgtatctctttcacat

SEQ ID NO: 3129927 - DNA, 13 bp, Homo sapiens
ttctgtgtattta

SEQ ID NO: 3129928 - DNA, 20 bp, Homo sapiens
ttctgtgtatttaattgtaa

SEQ ID NO: 3129929 - DNA, 21 bp, Homo sapiens
ttctgtgtatttaattgtaaa

SEQ ID NO: 3129930 - DNA, 22 bp, Homo sapiens
ttctgtgtatttaattgtaaac

SEQ ID NO: 3129931 - DNA, 23 bp, Homo sapiens
ttctgtgtatttaattgtaaact

SEQ ID NO: 3129932 - DNA, 23 bp, Homo sapiens
ttctgtgtctttcacagctcctc

SEQ ID NO: 3129933 - DNA, 17 bp, Homo sapiens
ttctgttccagtcacat

SEQ ID NO: 3129934 - DNA, 23 bp, Homo sapiens
ttctgttcctctcttttcctgtt

SEQ ID NO: 3129935 - DNA, 15 bp, Homo sapiens
ttctgttctgctggg

SEQ ID NO: 3129936 - DNA, 12 bp, Homo sapiens
ttctgttctggg

SEQ ID NO: 3129937 - DNA, 13 bp, Homo sapiens
ttctgttctgggg

SEQ ID NO: 3129938 - DNA, 12 bp, Homo sapiens
ttctgttgtaac

SEQ ID NO: 3129939 - DNA, 13 bp, Homo sapiens
ttctgttgtaact

SEQ ID NO: 3129940 - DNA, 13 bp, Homo sapiens
ttctgtttaggaa

SEQ ID NO: 3129941 - DNA, 14 bp, Homo sapiens
ttctgtttaggaag

SEQ ID NO: 3129942 - DNA, 16 bp, Homo sapiens
ttctgtttaggaagaa

SEQ ID NO: 3129943 - DNA, 12 bp, Homo sapiens
ttctgtttcaag

SEQ ID NO: 3129944 - DNA, 14 bp, Homo sapiens
ttctgtttctagtt

SEQ ID NO: 3129945 - DNA, 12 bp, Homo sapiens
ttctgtttctca

SEQ ID NO: 3129946 - DNA, 13 bp, Homo sapiens
ttctgtttgctgt

SEQ ID NO: 3129947 - DNA, 12 bp, Homo sapiens
ttctgtttgtta

SEQ ID NO: 3129948 - DNA, 12 bp, Homo sapiens
ttctgttttctg

SEQ ID NO: 3129949 - DNA, 23 bp, Homo sapiens
ttctgttttgtttggcaaggaaa

SEQ ID NO: 3129950 - DNA, 23 bp, Homo sapiens
ttcttaaaagtactttaaaaagg

SEQ ID NO: 3129951 - DNA, 23 bp, Homo sapiens
ttcttaaaccaacctttaaaatt

SEQ ID NO: 3129952 - DNA, 12 bp, Homo sapiens
ttcttaaatata

SEQ ID NO: 3129953 - DNA, 19 bp, Homo sapiens
ttcttaaatctttcttcaa

SEQ ID NO: 3129954 - DNA, 21 bp, Homo sapiens
ttcttaaatctttcttcaaat

SEQ ID NO: 3129955 - DNA, 13 bp, Homo sapiens
ttcttaaatggaa

SEQ ID NO: 3129956 - DNA, 14 bp, Homo sapiens
ttcttaaatggaat

SEQ ID NO: 3129957 - DNA, 20 bp, Homo sapiens
ttcttaaatggaattatttt

SEQ ID NO: 3129958 - DNA, 13 bp, Homo sapiens
ttcttaaatgttt

SEQ ID NO: 3129959 - DNA, 20 bp, Homo sapiens
ttcttaagccgatggtcact

SEQ ID NO: 3129960 - DNA, 20 bp, Homo sapiens
ttcttaattattataaaaat

SEQ ID NO: 3129961 - DNA, 12 bp, Homo sapiens
ttcttacacata

SEQ ID NO: 3129962 - DNA, 18 bp, Homo sapiens
ttcttacactgcctgtat

SEQ ID NO: 3129963 - DNA, 13 bp, Homo sapiens
ttcttacataatt

SEQ ID NO: 3129964 - DNA, 14 bp, Homo sapiens
ttcttacccaaagc

SEQ ID NO: 3129965 - DNA, 18 bp, Homo sapiens
ttcttacccaaagcacat

SEQ ID NO: 3129966 - DNA, 21 bp, Homo sapiens
ttcttactcattactgcaaat

SEQ ID NO: 3129967 - DNA, 16 bp, Homo sapiens
ttcttactgataattt

SEQ ID NO: 3129968 - DNA, 21 bp, Homo sapiens
ttcttagactacatttagaga

SEQ ID NO: 3129969 - DNA, 20 bp, Homo sapiens
ttcttagtgtggtatttgct

SEQ ID NO: 3129970 - DNA, 12 bp, Homo sapiens
ttcttataatac

SEQ ID NO: 3129971 - DNA, 21 bp, Homo sapiens
ttcttatacatttgataaagt

SEQ ID NO: 3129972 - DNA, 16 bp, Homo sapiens
ttcttatacgcttttc

SEQ ID NO: 3129973 - DNA, 20 bp, Homo sapiens
ttcttatacgcttttctttg

SEQ ID NO: 3129974 - DNA, 22 bp, Homo sapiens
ttcttatggaattgatttgcat

SEQ ID NO: 3129975 - DNA, 17 bp, Homo sapiens
ttcttattactattatt

SEQ ID NO: 3129976 - DNA, 15 bp, Homo sapiens
ttcttattgctttta

SEQ ID NO: 3129977 - DNA, 21 bp, Homo sapiens
ttcttatttaatcttttctta

SEQ ID NO: 3129978 - DNA, 22 bp, Homo sapiens
ttcttatttttcctaacaaaag

SEQ ID NO: 3129979 - DNA, 20 bp, Homo sapiens
ttcttcaaaatcgatatggt

SEQ ID NO: 3129980 - DNA, 20 bp, Homo sapiens
ttcttcaaaatgtatatatt

SEQ ID NO: 3129981 - DNA, 16 bp, Homo sapiens
ttcttcaaatacaaag

SEQ ID NO: 3129982 - DNA, 17 bp, Homo sapiens
ttcttcaaatacaaagt

SEQ ID NO: 3129983 - DNA, 21 bp, Homo sapiens
ttcttcaaatacaaagtaaat

SEQ ID NO: 3129984 - DNA, 19 bp, Homo sapiens
ttcttcaaatccttccaaa

SEQ ID NO: 3129985 - DNA, 17 bp, Homo sapiens
ttcttcaacatcaatgt

SEQ ID NO: 3129986 - DNA, 13 bp, Homo sapiens
ttcttcacctcta

SEQ ID NO: 3129987 - DNA, 16 bp, Homo sapiens
ttcttcacctttgtaa

SEQ ID NO: 3129988 - DNA, 14 bp, Homo sapiens
ttcttcagaagaca

SEQ ID NO: 3129989 - DNA, 13 bp, Homo sapiens
ttcttcagttggt

SEQ ID NO: 3129990 - DNA, 20 bp, Homo sapiens
ttcttcatattctaaaacca

SEQ ID NO: 3129991 - DNA, 14 bp, Homo sapiens
ttcttcatgcaatg

SEQ ID NO: 3129992 - DNA, 15 bp, Homo sapiens
ttcttcatgcaatga

SEQ ID NO: 3129993 - DNA, 13 bp, Homo sapiens
ttcttccatccca

SEQ ID NO: 3129994 - DNA, 16 bp, Homo sapiens
ttcttccatcccagga

SEQ ID NO: 3129995 - DNA, 21 bp, Homo sapiens
ttcttccccaggtccttcctt

SEQ ID NO: 3129996 - DNA, 12 bp, Homo sapiens
ttcttcctcacc

SEQ ID NO: 3129997 - DNA, 16 bp, Homo sapiens
ttcttcctccagctgc

SEQ ID NO: 3129998 - DNA, 13 bp, Homo sapiens
ttcttcctctgct

SEQ ID NO: 3129999 - DNA, 15 bp, Homo sapiens
ttcttcctgccagca

SEQ ID NO: 3130000 - DNA, 13 bp, Homo sapiens
ttcttcctgctgg

SEQ ID NO: 3130001 - DNA, 11 bp, Homo sapiens
ttcttccttcc

SEQ ID NO: 3130002 - DNA, 14 bp, Homo sapiens
ttcttcgctgctct

SEQ ID NO: 3130003 - DNA, 17 bp, Homo sapiens
ttcttctaaaattgaag

SEQ ID NO: 3130004 - DNA, 15 bp, Homo sapiens
ttcttctagagttca

SEQ ID NO: 3130005 - DNA, 15 bp, Homo sapiens
ttcttctgcttcagc

SEQ ID NO: 3130006 - DNA, 14 bp, Homo sapiens
ttcttctggtgcta

SEQ ID NO: 3130007 - DNA, 13 bp, Homo sapiens
ttcttctgtattt

SEQ ID NO: 3130008 - DNA, 15 bp, Homo sapiens
ttcttcttcagaaga

SEQ ID NO: 3130009 - DNA, 22 bp, Homo sapiens
ttcttgacaagctgacttggca

SEQ ID NO: 3130010 - DNA, 22 bp, Homo sapiens
ttcttgcataggctcttaagca

SEQ ID NO: 3130011 - DNA, 16 bp, Homo sapiens
ttcttgccaatgaggt

SEQ ID NO: 3130012 - DNA, 15 bp, Homo sapiens
ttcttgcctctgtgc

SEQ ID NO: 3130013 - DNA, 22 bp, Homo sapiens
ttcttgcctctgtgctgtgtgt

SEQ ID NO: 3130014 - DNA, 17 bp, Homo sapiens
ttcttgctcccttcagc

SEQ ID NO: 3130015 - DNA, 22 bp, Homo sapiens
ttcttgctcccttcagccccca

SEQ ID NO: 3130016 - DNA, 20 bp, Homo sapiens
ttcttgctctatctctcaaa

SEQ ID NO: 3130017 - DNA, 15 bp, Homo sapiens
ttcttgctgctagaa

SEQ ID NO: 3130018 - DNA, 23 bp, Homo sapiens
ttctctgcaatgcttctgtagct

SEQ ID NO: 3130019 - DNA, 10 bp, Homo sapiens
ttctctgcca

SEQ ID NO: 3130020 - DNA, 21 bp, Homo sapiens
ttctctgcctttgacatttaa

SEQ ID NO: 3130021 - DNA, 14 bp, Homo sapiens
ttctctgctccacc

SEQ ID NO: 3130022 - DNA, 14 bp, Homo sapiens
ttctctgtactttt

SEQ ID NO: 3130023 - DNA, 17 bp, Homo sapiens
ttctctgtagggaactc

SEQ ID NO: 3130024 - DNA, 21 bp, Homo sapiens
ttctctgtagttcctaatgga

SEQ ID NO: 3130025 - DNA, 21 bp, Homo sapiens
ttctctgtcctacttctgact

SEQ ID NO: 3130026 - DNA, 21 bp, Homo sapiens
ttctctgtgtctaagattcta

SEQ ID NO: 3130027 - DNA, 22 bp, Homo sapiens
ttctctgtgtctaagattctag

SEQ ID NO: 3130028 - DNA, 12 bp, Homo sapiens
ttctctgtgtgg

SEQ ID NO: 3130029 - DNA, 21 bp, Homo sapiens
ttctctgtgtggttcagctac

SEQ ID NO: 3130030 - DNA, 19 bp, Homo sapiens
ttctctgtgtttgttccta

SEQ ID NO: 3130031 - DNA, 20 bp, Homo sapiens
ttctctgttgtcgtaaagat

SEQ ID NO: 3130032 - DNA, 12 bp, Homo sapiens
ttctcttctagg

SEQ ID NO: 3130033 - DNA, 13 bp, Homo sapiens
ttctcttctctgc

SEQ ID NO: 3130034 - DNA, 15 bp, Homo sapiens
ttctcttctctgcaa

SEQ ID NO: 3130035 - DNA, 17 bp, Homo sapiens
ttctcttctctgcaatg

SEQ ID NO: 3130036 - DNA, 14 bp, Homo sapiens
ttctcttgagctgg

SEQ ID NO: 3130037 - DNA, 16 bp, Homo sapiens
ttctcttgagctggcc

SEQ ID NO: 3130038 - DNA, 22 bp, Homo sapiens
ttctcttgagctggcctctcta

SEQ ID NO: 3130039 - DNA, 15 bp, Homo sapiens
ttctcttgtaaaaag

SEQ ID NO: 3130040 - DNA, 13 bp, Homo sapiens
ttctctttcaaag

SEQ ID NO: 3130041 - DNA, 11 bp, Homo sapiens
ttctctttctc

SEQ ID NO: 3130042 - DNA, 17 bp, Homo sapiens
ttctgaaaccacagttt

SEQ ID NO: 3130043 - DNA, 22 bp, Homo sapiens
ttctgaaaggaaatacacttct

SEQ ID NO: 3130044 - DNA, 23 bp, Homo sapiens
ttctgaaaggaaatacacttctt

SEQ ID NO: 3130045 - DNA, 21 bp, Homo sapiens
ttctgaaatttttttcctaag

SEQ ID NO: 3130046 - DNA, 15 bp, Homo sapiens
ttctgaactgttaca

SEQ ID NO: 3130047 - DNA, 23 bp, Homo sapiens
ttctgaagatcagaacattcagc

SEQ ID NO: 3130048 - DNA, 16 bp, Homo sapiens
ttctgaaggaagagaa

SEQ ID NO: 3130049 - DNA, 16 bp, Homo sapiens
ttctgaatgctgctac

SEQ ID NO: 3130050 - DNA, 11 bp, Homo sapiens
ttctgaatgta

SEQ ID NO: 3130051 - DNA, 19 bp, Homo sapiens
ttctgaatgtgctgatcat

SEQ ID NO: 3130052 - DNA, 22 bp, Homo sapiens
ttctgaattcaaagcttgtgaa

SEQ ID NO: 3130053 - DNA, 19 bp, Homo sapiens
ttctgacaaaaagtttcca

SEQ ID NO: 3130054 - DNA, 22 bp, Homo sapiens
ttctgacaaaaagtttccatat

SEQ ID NO: 3130055 - DNA, 15 bp, Homo sapiens
ttctgacaaactgtg

SEQ ID NO: 3130056 - DNA, 18 bp, Homo sapiens
ttctgacagtttttctgt

SEQ ID NO: 3130057 - DNA, 14 bp, Homo sapiens
ttctgacattaaca

SEQ ID NO: 3130058 - DNA, 22 bp, Homo sapiens
ttctgacattaacagttttcca

SEQ ID NO: 3130059 - DNA, 23 bp, Homo sapiens
ttctgacattaacagttttccat

SEQ ID NO: 3130060 - DNA, 19 bp, Homo sapiens
ttctgacatttatatttgt

SEQ ID NO: 3130061 - DNA, 14 bp, Homo sapiens
ttctgaccatttca

SEQ ID NO: 3130062 - DNA, 18 bp, Homo sapiens
ttctgaccctgcttcaaa

SEQ ID NO: 3130063 - DNA, 13 bp, Homo sapiens
ttctgacggccct

SEQ ID NO: 3130064 - DNA, 18 bp, Homo sapiens
ttctgactcggtttctcc

SEQ ID NO: 3130065 - DNA, 15 bp, Homo sapiens
ttctgactctgagct

SEQ ID NO: 3130066 - DNA, 15 bp, Homo sapiens
ttctgactttacttg

SEQ ID NO: 3130067 - DNA, 19 bp, Homo sapiens
ttctgagaactgactttct

SEQ ID NO: 3130068 - DNA, 13 bp, Homo sapiens
ttctgagaccagt

SEQ ID NO: 3130069 - DNA, 13 bp, Homo sapiens
ttctgagccttga

SEQ ID NO: 3130070 - DNA, 20 bp, Homo sapiens
ttctgagcttttcatggaag

SEQ ID NO: 3130071 - DNA, 23 bp, Homo sapiens
ttctgaggaccgctgataagcat

SEQ ID NO: 3130072 - DNA, 19 bp, Homo sapiens
ttctgagtttcattctcct

SEQ ID NO: 3130073 - DNA, 14 bp, Homo sapiens
ttctgatcagaggt

SEQ ID NO: 3130074 - DNA, 18 bp, Homo sapiens
ttctgatgggtcccaaaa

SEQ ID NO: 3130075 - DNA, 20 bp, Homo sapiens
ttctgattaatatatttaat

SEQ ID NO: 3130076 - DNA, 12 bp, Homo sapiens
ttctgattccac

SEQ ID NO: 3130077 - DNA, 20 bp, Homo sapiens
ttctgattcccctccaccaa

SEQ ID NO: 3130078 - DNA, 23 bp, Homo sapiens
ttctgattctggctttaagcctt

SEQ ID NO: 3130079 - DNA, 17 bp, Homo sapiens
ttctgatttcagttttt

SEQ ID NO: 3130080 - DNA, 13 bp, Homo sapiens
ttctgcaaagtgt

SEQ ID NO: 3130081 - DNA, 17 bp, Homo sapiens
ttctgcaacaagcatgc

SEQ ID NO: 3130082 - DNA, 17 bp, Homo sapiens
ttctgcaactagccaag

SEQ ID NO: 3130083 - DNA, 21 bp, Homo sapiens
ttctgcaagcacatctgcatt

SEQ ID NO: 3130084 - DNA, 22 bp, Homo sapiens
ttctgcaagcacatctgcattt

SEQ ID NO: 3130085 - DNA, 20 bp, Homo sapiens
ttctgcagatcttccgtggt

SEQ ID NO: 3130086 - DNA, 19 bp, Homo sapiens
ttctgcagcccttgggcag

SEQ ID NO: 3130087 - DNA, 15 bp, Homo sapiens
ttctgcagtaaatct

SEQ ID NO: 3130088 - DNA, 21 bp, Homo sapiens
ttctgcatatgttgaatactt

SEQ ID NO: 3130089 - DNA, 20 bp, Homo sapiens
ttctgcatcatctgtagata

SEQ ID NO: 3130090 - DNA, 19 bp, Homo sapiens
ttctgcattcatttttata

SEQ ID NO: 3130091 - DNA, 21 bp, Homo sapiens
ttctgcattcatttttatagc

SEQ ID NO: 3130092 - DNA, 22 bp, Homo sapiens
ttctgcccacaccgcagggaca

SEQ ID NO: 3130093 - DNA, 19 bp, Homo sapiens
ttctgcccacattggaccc

SEQ ID NO: 3130094 - DNA, 16 bp, Homo sapiens
ttctgcccccagccca

SEQ ID NO: 3130095 - DNA, 13 bp, Homo sapiens
ttctgccctggct

SEQ ID NO: 3130096 - DNA, 16 bp, Homo sapiens
ttctgccctggctgct

SEQ ID NO: 3130097 - DNA, 22 bp, Homo sapiens
ttctgccctttcctaggcccag

SEQ ID NO: 3130098 - DNA, 22 bp, Homo sapiens
ttctgcctagagtgtagcctaa

SEQ ID NO: 3130099 - DNA, 18 bp, Homo sapiens
ttctgcctctctaggacc

SEQ ID NO: 3130100 - DNA, 16 bp, Homo sapiens
ttctgcctgcccaggc

SEQ ID NO: 3130101 - DNA, 14 bp, Homo sapiens
ttctgcctggagac

SEQ ID NO: 3130102 - DNA, 15 bp, Homo sapiens
ttctgcctgttataa

SEQ ID NO: 3130103 - DNA, 16 bp, Homo sapiens
ttctgccttctcatga

SEQ ID NO: 3130104 - DNA, 15 bp, Homo sapiens
ttctgccttggcctc

SEQ ID NO: 3130105 - DNA, 10 bp, Homo sapiens
ttctgccttt

SEQ ID NO: 3130106 - DNA, 16 bp, Homo sapiens
ttctgcctttgatgtt

SEQ ID NO: 3130107 - DNA, 18 bp, Homo sapiens
ttctgcgccacttccttt

SEQ ID NO: 3130108 - DNA, 15 bp, Homo sapiens
ttctgctacttcact

SEQ ID NO: 3130109 - DNA, 22 bp, Homo sapiens
ttctgctacttcactgtcatct

SEQ ID NO: 3130110 - DNA, 9 bp, Homo sapiens
ttctgctcc

SEQ ID NO: 3130111 - DNA, 16 bp, Homo sapiens
ttctgctccacccttg

SEQ ID NO: 3130112 - DNA, 13 bp, Homo sapiens
ttctgctcctctc

SEQ ID NO: 3130113 - DNA, 16 bp, Homo sapiens
ttctgctcctctccag

SEQ ID NO: 3130114 - DNA, 13 bp, Homo sapiens
ttctgctctggaa

SEQ ID NO: 3130115 - DNA, 17 bp, Homo sapiens
ttctgctctggaataaa

SEQ ID NO: 3130116 - DNA, 21 bp, Homo sapiens
ttctgctctggttgtttctgt

SEQ ID NO: 3130117 - DNA, 22 bp, Homo sapiens
ttctgctctggttgtttctgtt

SEQ ID NO: 3130118 - DNA, 13 bp, Homo sapiens
ttctgctgcccag

SEQ ID NO: 3130119 - DNA, 15 bp, Homo sapiens
ttctgctgcccaggc

SEQ ID NO: 3130120 - DNA, 21 bp, Homo sapiens
ttctgctggataaaatgaggt

SEQ ID NO: 3130121 - DNA, 17 bp, Homo sapiens
ttctgctggcatcaaga

SEQ ID NO: 3130122 - DNA, 14 bp, Homo sapiens
ttctgctggcctgg

SEQ ID NO: 3130123 - DNA, 15 bp, Homo sapiens
ttctgctggcctgga

SEQ ID NO: 3130124 - DNA, 14 bp, Homo sapiens
ttctgcttaggaga

SEQ ID NO: 3130125 - DNA, 19 bp, Homo sapiens
ttctgcttcaataaatctt

SEQ ID NO: 3130126 - DNA, 14 bp, Homo sapiens
ttctgcttcagcct

SEQ ID NO: 3130127 - DNA, 17 bp, Homo sapiens
ttctgcttttctgccct

SEQ ID NO: 3130128 - DNA, 15 bp, Homo sapiens
ttctggaatgtaatc

SEQ ID NO: 3130129 - DNA, 22 bp, Homo sapiens
ttctggaatgtaatcaatgttt

SEQ ID NO: 3130130 - DNA, 20 bp, Homo sapiens
ttctggaatttgttcaagtt

SEQ ID NO: 3130131 - DNA, 22 bp, Homo sapiens
ttctggaatttgttcaagtttt

SEQ ID NO: 3130132 - DNA, 19 bp, Homo sapiens
ttctggattagaatgccgg

SEQ ID NO: 3130133 - DNA, 17 bp, Homo sapiens
ttctggccttgtaagac

SEQ ID NO: 3130134 - DNA, 21 bp, Homo sapiens
ttctggcctttcctctctcct

SEQ ID NO: 3130135 - DNA, 15 bp, Homo sapiens
ttctggctgaaaaag

SEQ ID NO: 3130136 - DNA, 20 bp, Homo sapiens
ttctgggaagcttgagcctc

SEQ ID NO: 3130137 - DNA, 10 bp, Homo sapiens
ttctgggaca

SEQ ID NO: 3130138 - DNA, 23 bp, Homo sapiens
ttctgggcacagtggactcagca

SEQ ID NO: 3130139 - DNA, 19 bp, Homo sapiens
ttctgggcatctgttctgg

SEQ ID NO: 3130140 - DNA, 12 bp, Homo sapiens
ttctgggctctt

SEQ ID NO: 3130141 - DNA, 13 bp, Homo sapiens
ttctgggctcttt

SEQ ID NO: 3130142 - DNA, 16 bp, Homo sapiens
ttctgggcttcatctg

SEQ ID NO: 3130143 - DNA, 19 bp, Homo sapiens
ttctgggcttggggtgtgg

SEQ ID NO: 3130144 - DNA, 17 bp, Homo sapiens
ttctggggcaggctggg

SEQ ID NO: 3130145 - DNA, 18 bp, Homo sapiens
ttctggggcaggctgggc

SEQ ID NO: 3130146 - DNA, 19 bp, Homo sapiens
ttctggggcaggctgggcc

SEQ ID NO: 3130147 - DNA, 13 bp, Homo sapiens
ttcagcattctta

SEQ ID NO: 3130148 - DNA, 11 bp, Homo sapiens
ttcagcccctt

SEQ ID NO: 3130149 - DNA, 14 bp, Homo sapiens
ttcagccccttctc

SEQ ID NO: 3130150 - DNA, 23 bp, Homo sapiens
ttcagcgaagtctcatgggaagc

SEQ ID NO: 3130151 - DNA, 20 bp, Homo sapiens
ttcagctagcttttaggaaa

SEQ ID NO: 3130152 - DNA, 12 bp, Homo sapiens
ttcagctccagc

SEQ ID NO: 3130153 - DNA, 23 bp, Homo sapiens
ttcagctccagctcaccagcccc

SEQ ID NO: 3130154 - DNA, 17 bp, Homo sapiens
ttcagctctctgtataa

SEQ ID NO: 3130155 - DNA, 12 bp, Homo sapiens
ttcagctctgga

SEQ ID NO: 3130156 - DNA, 13 bp, Homo sapiens
ttcagctcttttt

SEQ ID NO: 3130157 - DNA, 18 bp, Homo sapiens
ttcagctgagccctgggg

SEQ ID NO: 3130158 - DNA, 19 bp, Homo sapiens
ttcagctgcctgaaacagc

SEQ ID NO: 3130159 - DNA, 15 bp, Homo sapiens
ttcagctgtcctccc

SEQ ID NO: 3130160 - DNA, 19 bp, Homo sapiens
ttcagctgtcctccctcca

SEQ ID NO: 3130161 - DNA, 16 bp, Homo sapiens
ttcagcttaaaataaa

SEQ ID NO: 3130162 - DNA, 22 bp, Homo sapiens
ttcaggaaatctacttcctaca

SEQ ID NO: 3130163 - DNA, 22 bp, Homo sapiens
ttcaggaactggggctttgcct

SEQ ID NO: 3130164 - DNA, 20 bp, Homo sapiens
ttcaggaagataaaaatcag

SEQ ID NO: 3130165 - DNA, 16 bp, Homo sapiens
ttcaggatacatgtgc

SEQ ID NO: 3130166 - DNA, 13 bp, Homo sapiens
ttcaatactgtat

SEQ ID NO: 3130167 - DNA, 11 bp, Homo sapiens
ttcaatattta

SEQ ID NO: 3130168 - DNA, 18 bp, Homo sapiens
ttcaatcaactttactgt

SEQ ID NO: 3130169 - DNA, 14 bp, Homo sapiens
ttcaatctgtaaac

SEQ ID NO: 3130170 - DNA, 20 bp, Homo sapiens
ttcaatctgtaaactgtgta

SEQ ID NO: 3130171 - DNA, 21 bp, Homo sapiens
ttcaatgcgttttgttgtaga

SEQ ID NO: 3130172 - DNA, 16 bp, Homo sapiens
ttcaatggttctgaaa

SEQ ID NO: 3130173 - DNA, 21 bp, Homo sapiens
ttcaattcagattgtcttgca

SEQ ID NO: 3130174 - DNA, 16 bp, Homo sapiens
ttcaattcctctggga

SEQ ID NO: 3130175 - DNA, 13 bp, Homo sapiens
ttcaattctcaaa

SEQ ID NO: 3130176 - DNA, 15 bp, Homo sapiens
ttcacaaacttttat

SEQ ID NO: 3130177 - DNA, 16 bp, Homo sapiens
ttcacaaacttttata

SEQ ID NO: 3130178 - DNA, 22 bp, Homo sapiens
ttcacaaacttttatactcttt

SEQ ID NO: 3130179 - DNA, 21 bp, Homo sapiens
ttcacaaccttctgtggctca

SEQ ID NO: 3130180 - DNA, 13 bp, Homo sapiens
ttcacaatagaaa

SEQ ID NO: 3130181 - DNA, 13 bp, Homo sapiens
ttcacaatgttaa

SEQ ID NO: 3130182 - DNA, 11 bp, Homo sapiens
ttcacaccctg

SEQ ID NO: 3130183 - DNA, 15 bp, Homo sapiens
ttcacaccctgcaag

SEQ ID NO: 3130184 - DNA, 17 bp, Homo sapiens
ttcacactcagaaagag

SEQ ID NO: 3130185 - DNA, 17 bp, Homo sapiens
ttcacagctcctcccac

SEQ ID NO: 3130186 - DNA, 15 bp, Homo sapiens
ttcacagctctgtgt

SEQ ID NO: 3130187 - DNA, 23 bp, Homo sapiens
ttcacagctctgtgttgccatgt

SEQ ID NO: 3130188 - DNA, 13 bp, Homo sapiens
ttcacaggaggcc

SEQ ID NO: 3130189 - DNA, 15 bp, Homo sapiens
ttcacaggaggccag

SEQ ID NO: 3130190 - DNA, 16 bp, Homo sapiens
ttcacaggcagtgcat

SEQ ID NO: 3130191 - DNA, 20 bp, Homo sapiens
ttcacaggctgtaaattgaa

SEQ ID NO: 3130192 - DNA, 18 bp, Homo sapiens
ttcacaggtgtggtgtaa

SEQ ID NO: 3130193 - DNA, 20 bp, Homo sapiens
ttcacaggtgtggtgtaatt

SEQ ID NO: 3130194 - DNA, 19 bp, Homo sapiens
ttcacagtacccaaactgc

SEQ ID NO: 3130195 - DNA, 23 bp, Homo sapiens
ttcacagtacccaaactgctttt

SEQ ID NO: 3130196 - DNA, 16 bp, Homo sapiens
ttcacagtcactgatg

SEQ ID NO: 3130197 - DNA, 15 bp, Homo sapiens
ttcacagtgctcttt

SEQ ID NO: 3130198 - DNA, 22 bp, Homo sapiens
ttcacagtgtttcgacagctga

SEQ ID NO: 3130199 - DNA, 23 bp, Homo sapiens
ttcacagttggctggatgaaatt

SEQ ID NO: 3130200 - DNA, 15 bp, Homo sapiens
ttcacataccctccc

SEQ ID NO: 3130201 - DNA, 18 bp, Homo sapiens
ttcacatagctgtctaga

SEQ ID NO: 3130202 - DNA, 18 bp, Homo sapiens
ttcacattaaaaaatgaa

SEQ ID NO: 3130203 - DNA, 14 bp, Homo sapiens
ttcacattattctg

SEQ ID NO: 3130204 - DNA, 14 bp, Homo sapiens
ttcacatttagaaa

SEQ ID NO: 3130205 - DNA, 14 bp, Homo sapiens
ttcaccaaaaccaa

SEQ ID NO: 3130206 - DNA, 22 bp, Homo sapiens
ttcaccaccaaatgccaagaaa

SEQ ID NO: 3130207 - DNA, 16 bp, Homo sapiens
ttcaccacttcactga

SEQ ID NO: 3130208 - DNA, 14 bp, Homo sapiens
ttcaccagaagtta

SEQ ID NO: 3130209 - DNA, 15 bp, Homo sapiens
ttcaccagtctgtct

SEQ ID NO: 3130210 - DNA, 22 bp, Homo sapiens
ttcaccccggcaggccctgcag

SEQ ID NO: 3130211 - DNA, 22 bp, Homo sapiens
ttcaccctcaccccctcctggc

SEQ ID NO: 3130212 - DNA, 16 bp, Homo sapiens
ttcaccctccacttcc

SEQ ID NO: 3130213 - DNA, 18 bp, Homo sapiens
ttcacccttaacccaagg

SEQ ID NO: 3130214 - DNA, 13 bp, Homo sapiens
ttcacctatgtta

SEQ ID NO: 3130215 - DNA, 12 bp, Homo sapiens
ttcacctctatc

SEQ ID NO: 3130216 - DNA, 15 bp, Homo sapiens
ttcacctgttatgta

SEQ ID NO: 3130217 - DNA, 14 bp, Homo sapiens
ttcaccttgaagaa

SEQ ID NO: 3130218 - DNA, 17 bp, Homo sapiens
ttcaccttttcttcaaa

SEQ ID NO: 3130219 - DNA, 13 bp, Homo sapiens
ttcactaaagcag

SEQ ID NO: 3130220 - DNA, 23 bp, Homo sapiens
ttcactagtgaccccttccctgt

SEQ ID NO: 3130221 - DNA, 21 bp, Homo sapiens
ttcactctgggcacactctgc

SEQ ID NO: 3130222 - DNA, 22 bp, Homo sapiens
ttcactgaagaaaccttcagat

SEQ ID NO: 3130223 - DNA, 13 bp, Homo sapiens
ttcactgaagacg

SEQ ID NO: 3130224 - DNA, 19 bp, Homo sapiens
ttcactgaagttctcctga

SEQ ID NO: 3130225 - DNA, 16 bp, Homo sapiens
ttcactgagctcccca

SEQ ID NO: 3130226 - DNA, 13 bp, Homo sapiens
ttcactgcaattt

SEQ ID NO: 3130227 - DNA, 15 bp, Homo sapiens
ttcactgcaattttg

SEQ ID NO: 3130228 - DNA, 20 bp, Homo sapiens
ttcactgcatggctcccaca

SEQ ID NO: 3130229 - DNA, 17 bp, Homo sapiens
ttcactgcctgtagaga

SEQ ID NO: 3130230 - DNA, 13 bp, Homo sapiens
ttcactgctggct

SEQ ID NO: 3130231 - DNA, 17 bp, Homo sapiens
ttcactgctggctgcct

SEQ ID NO: 3130232 - DNA, 13 bp, Homo sapiens
ttcactggcccaa

SEQ ID NO: 3130233 - DNA, 20 bp, Homo sapiens
ttcactgtaagactcattcc

SEQ ID NO: 3130234 - DNA, 22 bp, Homo sapiens
ttcactgtagaatgatttcatg

SEQ ID NO: 3130235 - DNA, 16 bp, Homo sapiens
ttcactgtataaatag

SEQ ID NO: 3130236 - DNA, 19 bp, Homo sapiens
ttcactgtataaataggag

SEQ ID NO: 3130237 - DNA, 22 bp, Homo sapiens
ttcactgtataaataggagagg

SEQ ID NO: 3130238 - DNA, 16 bp, Homo sapiens
ttcactgtctttaatt

SEQ ID NO: 3130239 - DNA, 19 bp, Homo sapiens
ttcactgtctttaattctg

SEQ ID NO: 3130240 - DNA, 16 bp, Homo sapiens
ttcactgttagctttt

SEQ ID NO: 3130241 - DNA, 13 bp, Homo sapiens
ttcacttctgcat

SEQ ID NO: 3130242 - DNA, 20 bp, Homo sapiens
ttcacttttagggagagtca

SEQ ID NO: 3130243 - DNA, 23 bp, Homo sapiens
ttcagaaaacccttttctacagt

SEQ ID NO: 3130244 - DNA, 20 bp, Homo sapiens
ttcagaaaatattatgtgtt

SEQ ID NO: 3130245 - DNA, 12 bp, Homo sapiens
ttcagaaatgtt

SEQ ID NO: 3130246 - DNA, 20 bp, Homo sapiens
ttcagaaattggaacagaat

SEQ ID NO: 3130247 - DNA, 12 bp, Homo sapiens
ttcagaacctct

SEQ ID NO: 3130248 - DNA, 16 bp, Homo sapiens
ttcagaagacactgca

SEQ ID NO: 3130249 - DNA, 23 bp, Homo sapiens
ttcagaaggttattttctttatc

SEQ ID NO: 3130250 - DNA, 17 bp, Homo sapiens
ttcagaatcctatggaa

SEQ ID NO: 3130251 - DNA, 13 bp, Homo sapiens
ttcagaatctgaa

SEQ ID NO: 3130252 - DNA, 17 bp, Homo sapiens
ttcagaatctgaatgta

SEQ ID NO: 3130253 - DNA, 23 bp, Homo sapiens
ttcagaatctgaatgtaatttgt

SEQ ID NO: 3130254 - DNA, 13 bp, Homo sapiens
ttcagaatttagt

SEQ ID NO: 3130255 - DNA, 20 bp, Homo sapiens
ttcagacaagcaacaggttt

SEQ ID NO: 3130256 - DNA, 21 bp, Homo sapiens
ttcagacaagcaacaggtttt

SEQ ID NO: 3130257 - DNA, 17 bp, Homo sapiens
ttcagacagggtctgaa

SEQ ID NO: 3130258 - DNA, 18 bp, Homo sapiens
ttcagacccctgcctgga

SEQ ID NO: 3130259 - DNA, 19 bp, Homo sapiens
ttcagactttgcttcccat

SEQ ID NO: 3130260 - DNA, 18 bp, Homo sapiens
ttcagacttttatcaaaa

SEQ ID NO: 3130261 - DNA, 23 bp, Homo sapiens
ttcagagatttatataaatgtaa

SEQ ID NO: 3130262 - DNA, 13 bp, Homo sapiens
ttcagagccagtg

SEQ ID NO: 3130263 - DNA, 18 bp, Homo sapiens
ttcagagttgtacactgt

SEQ ID NO: 3130264 - DNA, 14 bp, Homo sapiens
ttcagagtttgtgt

SEQ ID NO: 3130265 - DNA, 17 bp, Homo sapiens
ttcagatacaaactgca

SEQ ID NO: 3130266 - DNA, 15 bp, Homo sapiens
ttcagatatatatca

SEQ ID NO: 3130267 - DNA, 18 bp, Homo sapiens
ttcagatcaaaatgcctt

SEQ ID NO: 3130268 - DNA, 16 bp, Homo sapiens
ttcagatcactgaatt

SEQ ID NO: 3130269 - DNA, 18 bp, Homo sapiens
ttcagatcactgaattta

SEQ ID NO: 3130270 - DNA, 21 bp, Homo sapiens
ttcagatcactgaatttataa

SEQ ID NO: 3130271 - DNA, 17 bp, Homo sapiens
ttcagatgaccttttgg

SEQ ID NO: 3130272 - DNA, 19 bp, Homo sapiens
ttcagatgcttctgggaga

SEQ ID NO: 3130273 - DNA, 21 bp, Homo sapiens
ttcagatgggaggaaagagag

SEQ ID NO: 3130274 - DNA, 23 bp, Homo sapiens
ttcagatgtcttctgcctgttat

SEQ ID NO: 3130275 - DNA, 14 bp, Homo sapiens
ttcagattcccaga

SEQ ID NO: 3130276 - DNA, 22 bp, Homo sapiens
ttcagattcccagagcaaaata

SEQ ID NO: 3130277 - DNA, 20 bp, Homo sapiens
ttcagcaaactcttttccca

SEQ ID NO: 3130278 - DNA, 14 bp, Homo sapiens
ttcagcacccccac

SEQ ID NO: 3130279 - DNA, 15 bp, Homo sapiens
ttcagcacccccacc

SEQ ID NO: 3130280 - DNA, 19 bp, Homo sapiens
ttcagcacccccacccacc

SEQ ID NO: 3130281 - DNA, 20 bp, Homo sapiens
ttcagcacccccacccacct

SEQ ID NO: 3130282 - DNA, 17 bp, Homo sapiens
ttcagcaccctgggtgc

SEQ ID NO: 3130283 - DNA, 22 bp, Homo sapiens
ttcagcaccctgggtgccattc

SEQ ID NO: 3130284 - DNA, 15 bp, Homo sapiens
ttcagcactcagaaa

SEQ ID NO: 3130285 - DNA, 14 bp, Homo sapiens
ttcagcactgtccc

SEQ ID NO: 3130286 - DNA, 15 bp, Homo sapiens
ttcagcactgtccct

SEQ ID NO: 3130287 - DNA, 20 bp, Homo sapiens
ttcagcactgtcccttgcct

SEQ ID NO: 3130288 - DNA, 21 bp, Homo sapiens
ttcagcactgtcccttgcctc

SEQ ID NO: 3130289 - DNA, 19 bp, Homo sapiens
ttcagcagcaaattttcag

SEQ ID NO: 3130290 - DNA, 22 bp, Homo sapiens
ttcagcatctaaagcagcaggt

SEQ ID NO: 3130291 - DNA, 13 bp, Homo sapiens
ttcagcatgtcca

SEQ ID NO: 3130292 - DNA, 17 bp, Homo sapiens
ttcagcattaagctgtt

SEQ ID NO: 3130293 - DNA, 22 bp, Homo sapiens
ttcagcattaagctgttcctgt

SEQ ID NO: 3130294 - DNA, 16 bp, Homo sapiens
ttcagcattaggcttt

SEQ ID NO: 3130295 - DNA, 15 bp, Homo sapiens
ttatggaaaaataaa

SEQ ID NO: 3130296 - DNA, 13 bp, Homo sapiens
ttatggaaaactg

SEQ ID NO: 3130297 - DNA, 19 bp, Homo sapiens
ttatggaagattttaaatt

SEQ ID NO: 3130298 - DNA, 13 bp, Homo sapiens
ttatggaccactt

SEQ ID NO: 3130299 - DNA, 14 bp, Homo sapiens
ttatggagacctct

SEQ ID NO: 3130300 - DNA, 21 bp, Homo sapiens
ttatggagacctctccttcct

SEQ ID NO: 3130301 - DNA, 21 bp, Homo sapiens
ttatggatacgtgttttgaat

SEQ ID NO: 3130302 - DNA, 12 bp, Homo sapiens
ttatggcctcag

SEQ ID NO: 3130303 - DNA, 13 bp, Homo sapiens
ttatggcctcagc

SEQ ID NO: 3130304 - DNA, 14 bp, Homo sapiens
ttatggcttgtgaa

SEQ ID NO: 3130305 - DNA, 15 bp, Homo sapiens
ttatgggatgtaaac

SEQ ID NO: 3130306 - DNA, 16 bp, Homo sapiens
ttatgggatgtaaaca

SEQ ID NO: 3130307 - DNA, 23 bp, Homo sapiens
ttatggtaactgctttctgttcc

SEQ ID NO: 3130308 - DNA, 17 bp, Homo sapiens
ttatggttttgtgatgt

SEQ ID NO: 3130309 - DNA, 18 bp, Homo sapiens
ttatgtaaaactcgcttt

SEQ ID NO: 3130310 - DNA, 16 bp, Homo sapiens
ttatgtaatatattgt

SEQ ID NO: 3130311 - DNA, 15 bp, Homo sapiens
ttatgtactgtacta

SEQ ID NO: 3130312 - DNA, 15 bp, Homo sapiens
ttatgtagatatttg

SEQ ID NO: 3130313 - DNA, 18 bp, Homo sapiens
ttatgtagatatttggct

SEQ ID NO: 3130314 - DNA, 17 bp, Homo sapiens
ttatgtccactgtgtat

SEQ ID NO: 3130315 - DNA, 19 bp, Homo sapiens
ttatgtctcaaaataagtt

SEQ ID NO: 3130316 - DNA, 15 bp, Homo sapiens
ttatgtcttcttttg

SEQ ID NO: 3130317 - DNA, 21 bp, Homo sapiens
ttatgtcttttatatttgtat

SEQ ID NO: 3130318 - DNA, 13 bp, Homo sapiens
ttatgtgaagaat

SEQ ID NO: 3130319 - DNA, 18 bp, Homo sapiens
ttatgtgaagaatttaga

SEQ ID NO: 3130320 - DNA, 19 bp, Homo sapiens
ttatgtgaagaatttagat

SEQ ID NO: 3130321 - DNA, 18 bp, Homo sapiens
ttatgtgccgtgttattg

SEQ ID NO: 3130322 - DNA, 18 bp, Homo sapiens
ttatgtggttttagattt

SEQ ID NO: 3130323 - DNA, 14 bp, Homo sapiens
ttatgtgtatattt

SEQ ID NO: 3130324 - DNA, 16 bp, Homo sapiens
ttatgtgtatatttgt

SEQ ID NO: 3130325 - DNA, 19 bp, Homo sapiens
ttatgtgtatgtgccattt

SEQ ID NO: 3130326 - DNA, 19 bp, Homo sapiens
ttatgtgtgaggagctgct

SEQ ID NO: 3130327 - DNA, 23 bp, Homo sapiens
ttatgttaactagaatgcttttg

SEQ ID NO: 3130328 - DNA, 19 bp, Homo sapiens
ttatgttatcaccttccaa

SEQ ID NO: 3130329 - DNA, 17 bp, Homo sapiens
ttatgttcatttttcaa

SEQ ID NO: 3130330 - DNA, 14 bp, Homo sapiens
ttattttgcactgt

SEQ ID NO: 3130331 - DNA, 21 bp, Homo sapiens
ttattttgcatatatgttctt

SEQ ID NO: 3130332 - DNA, 15 bp, Homo sapiens
ttattttgctgagtt

SEQ ID NO: 3130333 - DNA, 14 bp, Homo sapiens
ttattttggatata

SEQ ID NO: 3130334 - DNA, 20 bp, Homo sapiens
ttattttggcttcatttcaa

SEQ ID NO: 3130335 - DNA, 23 bp, Homo sapiens
ttattttggcttcatttcaatca

SEQ ID NO: 3130336 - DNA, 13 bp, Homo sapiens
ttattttggtact

SEQ ID NO: 3130337 - DNA, 18 bp, Homo sapiens
ttattttggtacttttat

SEQ ID NO: 3130338 - DNA, 18 bp, Homo sapiens
ttattttgtattacatct

SEQ ID NO: 3130339 - DNA, 19 bp, Homo sapiens
ttattttgttacactaaag

SEQ ID NO: 3130340 - DNA, 14 bp, Homo sapiens
ttatttttaaaata

SEQ ID NO: 3130341 - DNA, 14 bp, Homo sapiens
ttatttttaaagat

SEQ ID NO: 3130342 - DNA, 14 bp, Homo sapiens
ttatttttataatt

SEQ ID NO: 3130343 - DNA, 16 bp, Homo sapiens
ttatttttataattgt

SEQ ID NO: 3130344 - DNA, 20 bp, Homo sapiens
ttatttttatatcagcctga

SEQ ID NO: 3130345 - DNA, 14 bp, Homo sapiens
ttatttttcaagga

SEQ ID NO: 3130346 - DNA, 23 bp, Homo sapiens
ttatttttggcgtggctgactta

SEQ ID NO: 3130347 - DNA, 14 bp, Homo sapiens
ttattttttaatta

SEQ ID NO: 3130348 - DNA, 16 bp, Homo sapiens
ttattttttaattatt

SEQ ID NO: 3130349 - DNA, 14 bp, Homo sapiens
ttcaaaaaaacact

SEQ ID NO: 3130350 - DNA, 18 bp, Homo sapiens
ttcaaaaactaaaatcat

SEQ ID NO: 3130351 - DNA, 13 bp, Homo sapiens
ttcaaaaagtgtt

SEQ ID NO: 3130352 - DNA, 12 bp, Homo sapiens
ttcaaaaatgct

SEQ ID NO: 3130353 - DNA, 14 bp, Homo sapiens
ttcaaaaatgctgt

SEQ ID NO: 3130354 - DNA, 21 bp, Homo sapiens
ttcaaaagaatcagaaacagg

SEQ ID NO: 3130355 - DNA, 19 bp, Homo sapiens
ttcaaaagccataacttga

SEQ ID NO: 3130356 - DNA, 21 bp, Homo sapiens
ttcaaaaggtattatacatgt

SEQ ID NO: 3130357 - DNA, 14 bp, Homo sapiens
ttcaaaagttccaa

SEQ ID NO: 3130358 - DNA, 16 bp, Homo sapiens
ttcaaaatatattttg

SEQ ID NO: 3130359 - DNA, 13 bp, Homo sapiens
ttcaaaatccttc

SEQ ID NO: 3130360 - DNA, 17 bp, Homo sapiens
ttcaaaatccttccaaa

SEQ ID NO: 3130361 - DNA, 17 bp, Homo sapiens
ttcaaaatgctttttat

SEQ ID NO: 3130362 - DNA, 14 bp, Homo sapiens
ttcaaaatgtatat

SEQ ID NO: 3130363 - DNA, 14 bp, Homo sapiens
ttcaaaatgtctgt

SEQ ID NO: 3130364 - DNA, 13 bp, Homo sapiens
ttcaaacaagaat

SEQ ID NO: 3130365 - DNA, 20 bp, Homo sapiens
ttcaaaccaatttcttcctt

SEQ ID NO: 3130366 - DNA, 21 bp, Homo sapiens
ttcaaactggggcctccagaa

SEQ ID NO: 3130367 - DNA, 12 bp, Homo sapiens
ttcaaactgtga

SEQ ID NO: 3130368 - DNA, 19 bp, Homo sapiens
ttcaaactgtgaagcattt

SEQ ID NO: 3130369 - DNA, 17 bp, Homo sapiens
ttcaaacttactatttt

SEQ ID NO: 3130370 - DNA, 23 bp, Homo sapiens
ttcaaagcatggacatttagaag

SEQ ID NO: 3130371 - DNA, 12 bp, Homo sapiens
ttcaaagccttc

SEQ ID NO: 3130372 - DNA, 17 bp, Homo sapiens
ttcaaagccttctccct

SEQ ID NO: 3130373 - DNA, 19 bp, Homo sapiens
ttcaaagctaaaatatata

SEQ ID NO: 3130374 - DNA, 18 bp, Homo sapiens
ttcaaagctgaatatttt

SEQ ID NO: 3130375 - DNA, 13 bp, Homo sapiens
ttcaaagcttgtg

SEQ ID NO: 3130376 - DNA, 22 bp, Homo sapiens
ttcaaagctttttccagaggct

SEQ ID NO: 3130377 - DNA, 20 bp, Homo sapiens
ttcaaaggccacatacctct

SEQ ID NO: 3130378 - DNA, 16 bp, Homo sapiens
ttcaaatacaaagtaa

SEQ ID NO: 3130379 - DNA, 18 bp, Homo sapiens
ttcaaatagggtctaact

SEQ ID NO: 3130380 - DNA, 19 bp, Homo sapiens
ttcaaatagggtctaactc

SEQ ID NO: 3130381 - DNA, 14 bp, Homo sapiens
ttcaaatcagtgat

SEQ ID NO: 3130382 - DNA, 15 bp, Homo sapiens
ttcaaatcagtgatc

SEQ ID NO: 3130383 - DNA, 22 bp, Homo sapiens
ttcaaatcagtgatctatgttt

SEQ ID NO: 3130384 - DNA, 15 bp, Homo sapiens
ttcaaatccttccaa

SEQ ID NO: 3130385 - DNA, 16 bp, Homo sapiens
ttcaaatgggttttcc

SEQ ID NO: 3130386 - DNA, 22 bp, Homo sapiens
ttcaaatgttagatattgctac

SEQ ID NO: 3130387 - DNA, 12 bp, Homo sapiens
ttcaaattctct

SEQ ID NO: 3130388 - DNA, 18 bp, Homo sapiens
ttcaaattgctgcttgga

SEQ ID NO: 3130389 - DNA, 14 bp, Homo sapiens
ttcaaatttgtaca

SEQ ID NO: 3130390 - DNA, 21 bp, Homo sapiens
ttcaacaaagaaacaaagatg

SEQ ID NO: 3130391 - DNA, 19 bp, Homo sapiens
ttcaacaaatatcttgtgt

SEQ ID NO: 3130392 - DNA, 20 bp, Homo sapiens
ttcaacaaatatcttgtgtt

SEQ ID NO: 3130393 - DNA, 17 bp, Homo sapiens
ttcaacaatttcaataa

SEQ ID NO: 3130394 - DNA, 17 bp, Homo sapiens
ttcaacatcctgccagc

SEQ ID NO: 3130395 - DNA, 21 bp, Homo sapiens
ttcaacatcctgccagcccca

SEQ ID NO: 3130396 - DNA, 19 bp, Homo sapiens
ttcaaccactgtaaaatga

SEQ ID NO: 3130397 - DNA, 15 bp, Homo sapiens
ttcaaccattcccca

SEQ ID NO: 3130398 - DNA, 16 bp, Homo sapiens
ttcaacgcagccctgc

SEQ ID NO: 3130399 - DNA, 19 bp, Homo sapiens
ttcaacgcagccctgcttt

SEQ ID NO: 3130400 - DNA, 17 bp, Homo sapiens
ttcaactattttattat

SEQ ID NO: 3130401 - DNA, 14 bp, Homo sapiens
ttcaactgaaaaga

SEQ ID NO: 3130402 - DNA, 16 bp, Homo sapiens
ttcaacttttctaaga

SEQ ID NO: 3130403 - DNA, 21 bp, Homo sapiens
ttcaagaaaaaataaatggaa

SEQ ID NO: 3130404 - DNA, 14 bp, Homo sapiens
ttcaagaaaatctt

SEQ ID NO: 3130405 - DNA, 20 bp, Homo sapiens
ttcaagaaaatctttgttga

SEQ ID NO: 3130406 - DNA, 22 bp, Homo sapiens
ttcaagaaaatctttgttgaag

SEQ ID NO: 3130407 - DNA, 18 bp, Homo sapiens
ttcaagagggcaagtgga

SEQ ID NO: 3130408 - DNA, 17 bp, Homo sapiens
ttcaagcagtcgtgcct

SEQ ID NO: 3130409 - DNA, 23 bp, Homo sapiens
ttcaagcagtcgtgcctgtgtcc

SEQ ID NO: 3130410 - DNA, 20 bp, Homo sapiens
ttcaagcctgtgggagtaga

SEQ ID NO: 3130411 - DNA, 16 bp, Homo sapiens
ttcaaggaaaaatgct

SEQ ID NO: 3130412 - DNA, 17 bp, Homo sapiens
ttcaaggaatttcttaa

SEQ ID NO: 3130413 - DNA, 16 bp, Homo sapiens
ttcaaggagaatatga

SEQ ID NO: 3130414 - DNA, 22 bp, Homo sapiens
ttcaaggcactctagattccat

SEQ ID NO: 3130415 - DNA, 16 bp, Homo sapiens
ttcaagggaagaaaca

SEQ ID NO: 3130416 - DNA, 15 bp, Homo sapiens
ttcaagtgcctagac

SEQ ID NO: 3130417 - DNA, 23 bp, Homo sapiens
ttcaagtgcctagactgttactt

SEQ ID NO: 3130418 - DNA, 21 bp, Homo sapiens
ttcaagtgcctttctgcagtt

SEQ ID NO: 3130419 - DNA, 23 bp, Homo sapiens
ttcaagtgcctttctgcagtttt

SEQ ID NO: 3130420 - DNA, 21 bp, Homo sapiens
ttcaagtgttgctcttggaaa

SEQ ID NO: 3130421 - DNA, 17 bp, Homo sapiens
ttcaagttagctcagga

SEQ ID NO: 3130422 - DNA, 14 bp, Homo sapiens
ttcaagttattcaa

SEQ ID NO: 3130423 - DNA, 20 bp, Homo sapiens
ttcaagttattcaaatttgt

SEQ ID NO: 3130424 - DNA, 19 bp, Homo sapiens
ttcaagttgtaaaaatgaa

SEQ ID NO: 3130425 - DNA, 19 bp, Homo sapiens
ttcaagttgtgtctgaaaa

SEQ ID NO: 3130426 - DNA, 15 bp, Homo sapiens
ttcaagtttacactt

SEQ ID NO: 3130427 - DNA, 16 bp, Homo sapiens
ttcaataaagcattta

SEQ ID NO: 3130428 - DNA, 18 bp, Homo sapiens
ttcaataaatgtctgttg

SEQ ID NO: 3130429 - DNA, 21 bp, Homo sapiens
ttatatacctggcttttactt

SEQ ID NO: 3130430 - DNA, 19 bp, Homo sapiens
ttatatatatagtttattt

SEQ ID NO: 3130431 - DNA, 17 bp, Homo sapiens
ttatatattatgtgaag

SEQ ID NO: 3130432 - DNA, 19 bp, Homo sapiens
ttatatattatgtgaagaa

SEQ ID NO: 3130433 - DNA, 12 bp, Homo sapiens
ttatatatttct

SEQ ID NO: 3130434 - DNA, 12 bp, Homo sapiens
ttatatcaaagt

SEQ ID NO: 3130435 - DNA, 15 bp, Homo sapiens
ttatatcagcctgag

SEQ ID NO: 3130436 - DNA, 14 bp, Homo sapiens
ttatatcatgcaaa

SEQ ID NO: 3130437 - DNA, 20 bp, Homo sapiens
ttatatcatgcaaaatatgt

SEQ ID NO: 3130438 - DNA, 20 bp, Homo sapiens
ttatatctgtaatgatactg

SEQ ID NO: 3130439 - DNA, 14 bp, Homo sapiens
ttatatcttttggt

SEQ ID NO: 3130440 - DNA, 13 bp, Homo sapiens
ttatatgaacata

SEQ ID NO: 3130441 - DNA, 22 bp, Homo sapiens
ttatatgaccatatttactctt

SEQ ID NO: 3130442 - DNA, 20 bp, Homo sapiens
ttatatgccaagctaattta

SEQ ID NO: 3130443 - DNA, 19 bp, Homo sapiens
ttatatgcttactgatata

SEQ ID NO: 3130444 - DNA, 17 bp, Homo sapiens
ttatatggcccagcctt

SEQ ID NO: 3130445 - DNA, 18 bp, Homo sapiens
ttatatggcgttttgtct

SEQ ID NO: 3130446 - DNA, 23 bp, Homo sapiens
ttatatggcgttttgtctgtgtt

SEQ ID NO: 3130447 - DNA, 12 bp, Homo sapiens
ttatatgtcctt

SEQ ID NO: 3130448 - DNA, 15 bp, Homo sapiens
ttatattaaaatatg

SEQ ID NO: 3130449 - DNA, 14 bp, Homo sapiens
ttatattctaatta

SEQ ID NO: 3130450 - DNA, 21 bp, Homo sapiens
ttatattggtttgcacaagtt

SEQ ID NO: 3130451 - DNA, 22 bp, Homo sapiens
ttatatttccctaaaatacatt

SEQ ID NO: 3130452 - DNA, 14 bp, Homo sapiens
ttatatttggaaag

SEQ ID NO: 3130453 - DNA, 17 bp, Homo sapiens
ttatatttggaaagaga

SEQ ID NO: 3130454 - DNA, 19 bp, Homo sapiens
ttatatttggaaagagacc

SEQ ID NO: 3130455 - DNA, 13 bp, Homo sapiens
ttatatttgtatc

SEQ ID NO: 3130456 - DNA, 15 bp, Homo sapiens
ttatattttcgtatg

SEQ ID NO: 3130457 - DNA, 17 bp, Homo sapiens
ttatattttgaaagaag

SEQ ID NO: 3130458 - DNA, 18 bp, Homo sapiens
ttatattttgaaagaagc

SEQ ID NO: 3130459 - DNA, 17 bp, Homo sapiens
ttatattttgctgttta

SEQ ID NO: 3130460 - DNA, 19 bp, Homo sapiens
ttatatttttaataaaagt

SEQ ID NO: 3130461 - DNA, 22 bp, Homo sapiens
ttatatttttgtacatattgtt

SEQ ID NO: 3130462 - DNA, 16 bp, Homo sapiens
ttatcaaaactttctt

SEQ ID NO: 3130463 - DNA, 19 bp, Homo sapiens
ttatcaaaccctagccttg

SEQ ID NO: 3130464 - DNA, 16 bp, Homo sapiens
ttatcaagcaaaatgt

SEQ ID NO: 3130465 - DNA, 11 bp, Homo sapiens
ttatcaagtgt

SEQ ID NO: 3130466 - DNA, 14 bp, Homo sapiens
ttatcaagtgtctt

SEQ ID NO: 3130467 - DNA, 22 bp, Homo sapiens
ttatcaatatctaatatatatg

SEQ ID NO: 3130468 - DNA, 22 bp, Homo sapiens
ttatcactgtctgttctgcaca

SEQ ID NO: 3130469 - DNA, 22 bp, Homo sapiens
ttatcactttttgaactaagaa

SEQ ID NO: 3130470 - DNA, 19 bp, Homo sapiens
ttacatgctgtgctctttg

SEQ ID NO: 3130471 - DNA, 13 bp, Homo sapiens
ttacatgtatggt

SEQ ID NO: 3130472 - DNA, 18 bp, Homo sapiens
ttacatgtgtagcctatg

SEQ ID NO: 3130473 - DNA, 16 bp, Homo sapiens
ttacatgtttataaat

SEQ ID NO: 3130474 - DNA, 16 bp, Homo sapiens
ttacatgttttaaaga

SEQ ID NO: 3130475 - DNA, 18 bp, Homo sapiens
ttacattcctaactagaa

SEQ ID NO: 3130476 - DNA, 19 bp, Homo sapiens
ttacattcctaactagaat

SEQ ID NO: 3130477 - DNA, 20 bp, Homo sapiens
ttacattcctaactagaatt

SEQ ID NO: 3130478 - DNA, 21 bp, Homo sapiens
ttacatttggattagaaattt

SEQ ID NO: 3130479 - DNA, 12 bp, Homo sapiens
ttacattttata

SEQ ID NO: 3130480 - DNA, 20 bp, Homo sapiens
ttacattttattaagctttt

SEQ ID NO: 3130481 - DNA, 18 bp, Homo sapiens
ttacatttttacaataaa

SEQ ID NO: 3130482 - DNA, 20 bp, Homo sapiens
ttaccaaagcatcaatacaa

SEQ ID NO: 3130483 - DNA, 16 bp, Homo sapiens
ttaccaaatacacatt

SEQ ID NO: 3130484 - DNA, 21 bp, Homo sapiens
ttaccaaatacacatttcaca

SEQ ID NO: 3130485 - DNA, 22 bp, Homo sapiens
ttaccaaatacacatttcacat

SEQ ID NO: 3130486 - DNA, 20 bp, Homo sapiens
ttaccaacctgttacctact

SEQ ID NO: 3130487 - DNA, 16 bp, Homo sapiens
ttaccaactttctgta

SEQ ID NO: 3130488 - DNA, 14 bp, Homo sapiens
ttaccaagagtaac

SEQ ID NO: 3130489 - DNA, 17 bp, Homo sapiens
ttaccaagagtaacttt

SEQ ID NO: 3130490 - DNA, 19 bp, Homo sapiens
ttaccaataggcaaattaa

SEQ ID NO: 3130491 - DNA, 20 bp, Homo sapiens
ttaccaataggcaaattaat

SEQ ID NO: 3130492 - DNA, 15 bp, Homo sapiens
ttaccacacatctat

SEQ ID NO: 3130493 - DNA, 20 bp, Homo sapiens
ttaccacacatctatgatat

SEQ ID NO: 3130494 - DNA, 13 bp, Homo sapiens
ttaccagatgcta

SEQ ID NO: 3130495 - DNA, 12 bp, Homo sapiens
ttaccagcaaga

SEQ ID NO: 3130496 - DNA, 19 bp, Homo sapiens
ttaccagcaagaataaaaa

SEQ ID NO: 3130497 - DNA, 23 bp, Homo sapiens
ttaccagtctttaaaggcccagc

SEQ ID NO: 3130498 - DNA, 18 bp, Homo sapiens
ttaccagttaattactca

SEQ ID NO: 3130499 - DNA, 11 bp, Homo sapiens
ttaccatgaga

SEQ ID NO: 3130500 - DNA, 21 bp, Homo sapiens
ttaccatgagtgaatttatat

SEQ ID NO: 3130501 - DNA, 21 bp, Homo sapiens
ttaccattaattacatacaga

SEQ ID NO: 3130502 - DNA, 17 bp, Homo sapiens
ttaccattcacaataaa

SEQ ID NO: 3130503 - DNA, 21 bp, Homo sapiens
ttaccattcagttaattcaat

SEQ ID NO: 3130504 - DNA, 21 bp, Homo sapiens
ttaccatttgctactgtacat

SEQ ID NO: 3130505 - DNA, 16 bp, Homo sapiens
ttaccattttaacgct

SEQ ID NO: 3130506 - DNA, 23 bp, Homo sapiens
ttaccattttggggtacccactg

SEQ ID NO: 3130507 - DNA, 14 bp, Homo sapiens
ttacccaatttccc

SEQ ID NO: 3130508 - DNA, 15 bp, Homo sapiens
ttacccacctagaac

SEQ ID NO: 3130509 - DNA, 16 bp, Homo sapiens
ttacccagaatgtcag

SEQ ID NO: 3130510 - DNA, 21 bp, Homo sapiens
ttacccagtgggacagaggag

SEQ ID NO: 3130511 - DNA, 12 bp, Homo sapiens
ttaccctaatgt

SEQ ID NO: 3130512 - DNA, 18 bp, Homo sapiens
ttaccctaatgtcttcat

SEQ ID NO: 3130513 - DNA, 13 bp, Homo sapiens
ttaccctttagac

SEQ ID NO: 3130514 - DNA, 16 bp, Homo sapiens
ttaccctttagactgt

SEQ ID NO: 3130515 - DNA, 15 bp, Homo sapiens
ttaccgtagcctccg

SEQ ID NO: 3130516 - DNA, 16 bp, Homo sapiens
ttacctaaacagatat

SEQ ID NO: 3130517 - DNA, 17 bp, Homo sapiens
ttacctaaacagatata

SEQ ID NO: 3130518 - DNA, 20 bp, Homo sapiens
ttacctaaacagatataaat

SEQ ID NO: 3130519 - DNA, 18 bp, Homo sapiens
ttacctaagattacaaat

SEQ ID NO: 3130520 - DNA, 18 bp, Homo sapiens
ttacctaagtgacatttg

SEQ ID NO: 3130521 - DNA, 21 bp, Homo sapiens
ttacctaagtgacatttgtag

SEQ ID NO: 3130522 - DNA, 16 bp, Homo sapiens
ttacctaccacagtgt

SEQ ID NO: 3130523 - DNA, 23 bp, Homo sapiens
ttacctactttgactttttgcat

SEQ ID NO: 3130524 - DNA, 23 bp, Homo sapiens
ttacctccaacagaactaaatgt

SEQ ID NO: 3130525 - DNA, 11 bp, Homo sapiens
ttacctctgat

SEQ ID NO: 3130526 - DNA, 21 bp, Homo sapiens
ttacctctgatacctcaaccc

SEQ ID NO: 3130527 - DNA, 13 bp, Homo sapiens
ttacctgacacaa

SEQ ID NO: 3130528 - DNA, 23 bp, Homo sapiens
ttacctgacctcttgctgtctct

SEQ ID NO: 3130529 - DNA, 15 bp, Homo sapiens
ttagtttgtgtgttg

SEQ ID NO: 3130530 - DNA, 16 bp, Homo sapiens
ttagtttgtgtgttgt

SEQ ID NO: 3130531 - DNA, 20 bp, Homo sapiens
ttagttttagaggcattgtt

SEQ ID NO: 3130532 - DNA, 14 bp, Homo sapiens
ttagttttatacta

SEQ ID NO: 3130533 - DNA, 23 bp, Homo sapiens
ttagtttttggttgggaatgagg

SEQ ID NO: 3130534 - DNA, 18 bp, Homo sapiens
ttataaaaaatgtaacat

SEQ ID NO: 3130535 - DNA, 18 bp, Homo sapiens
ttataaaaataaagggaa

SEQ ID NO: 3130536 - DNA, 21 bp, Homo sapiens
ttataaaaataaatagaaaag

SEQ ID NO: 3130537 - DNA, 13 bp, Homo sapiens
ttataaaaatatt

SEQ ID NO: 3130538 - DNA, 12 bp, Homo sapiens
ttataaaagtgt

SEQ ID NO: 3130539 - DNA, 21 bp, Homo sapiens
ttataaaatgggaagactgag

SEQ ID NO: 3130540 - DNA, 18 bp, Homo sapiens
ttataaaattttgctttt

SEQ ID NO: 3130541 - DNA, 12 bp, Homo sapiens
ttataaacacat

SEQ ID NO: 3130542 - DNA, 14 bp, Homo sapiens
ttataaaccaatct

SEQ ID NO: 3130543 - DNA, 17 bp, Homo sapiens
ttataaaccaatcttaa

SEQ ID NO: 3130544 - DNA, 11 bp, Homo sapiens
ttataaacttt

SEQ ID NO: 3130545 - DNA, 19 bp, Homo sapiens
ttataaagaatgtttctta

SEQ ID NO: 3130546 - DNA, 16 bp, Homo sapiens
ttataaatatatataa

SEQ ID NO: 3130547 - DNA, 17 bp, Homo sapiens
ttataaatatatataaa

SEQ ID NO: 3130548 - DNA, 19 bp, Homo sapiens
ttataaatcatattgatga

SEQ ID NO: 3130549 - DNA, 21 bp, Homo sapiens
ttataaatcatattgatgaaa

SEQ ID NO: 3130550 - DNA, 17 bp, Homo sapiens
ttataacagatgtgaaa

SEQ ID NO: 3130551 - DNA, 19 bp, Homo sapiens
ttataacagatgtgaaaat

SEQ ID NO: 3130552 - DNA, 18 bp, Homo sapiens
ttataactcatcataaaa

SEQ ID NO: 3130553 - DNA, 17 bp, Homo sapiens
ttataactgtaaagatg

SEQ ID NO: 3130554 - DNA, 15 bp, Homo sapiens
ttataacttaaaaaa

SEQ ID NO: 3130555 - DNA, 16 bp, Homo sapiens
ttataacttattagca

SEQ ID NO: 3130556 - DNA, 21 bp, Homo sapiens
ttataagaagaagttcatgtc

SEQ ID NO: 3130557 - DNA, 23 bp, Homo sapiens
ttataagcaaatttcaaaagaca

SEQ ID NO: 3130558 - DNA, 15 bp, Homo sapiens
ttataagcattgaaa

SEQ ID NO: 3130559 - DNA, 17 bp, Homo sapiens
ttataagcattgaaatt

SEQ ID NO: 3130560 - DNA, 18 bp, Homo sapiens
ttataagcattgaaatta

SEQ ID NO: 3130561 - DNA, 21 bp, Homo sapiens
ttataagggagagctgagcca

SEQ ID NO: 3130562 - DNA, 18 bp, Homo sapiens
ttataagtagcaggccaa

SEQ ID NO: 3130563 - DNA, 16 bp, Homo sapiens
ttataagtcacaaaga

SEQ ID NO: 3130564 - DNA, 15 bp, Homo sapiens
ttataataatgttaa

SEQ ID NO: 3130565 - DNA, 18 bp, Homo sapiens
ttataataatgttaacat

SEQ ID NO: 3130566 - DNA, 14 bp, Homo sapiens
ttataatactctgt

SEQ ID NO: 3130567 - DNA, 16 bp, Homo sapiens
ttataatctgaagata

SEQ ID NO: 3130568 - DNA, 20 bp, Homo sapiens
ttataatcttccatacttct

SEQ ID NO: 3130569 - DNA, 21 bp, Homo sapiens
ttataattggtgctatttgaa

SEQ ID NO: 3130570 - DNA, 19 bp, Homo sapiens
ttataattttagtttatat

SEQ ID NO: 3130571 - DNA, 12 bp, Homo sapiens
ttataattttct

SEQ ID NO: 3130572 - DNA, 21 bp, Homo sapiens
ttataatttttttattactga

SEQ ID NO: 3130573 - DNA, 16 bp, Homo sapiens
ttataatttttttcaa

SEQ ID NO: 3130574 - DNA, 19 bp, Homo sapiens
ttatacaaattaaaaagat

SEQ ID NO: 3130575 - DNA, 21 bp, Homo sapiens
ttatacaacagcaaaccctga

SEQ ID NO: 3130576 - DNA, 21 bp, Homo sapiens
ttatacaataacccagttact

SEQ ID NO: 3130577 - DNA, 15 bp, Homo sapiens
ttatacaatatcatc

SEQ ID NO: 3130578 - DNA, 16 bp, Homo sapiens
ttatacagattttcta

SEQ ID NO: 3130579 - DNA, 13 bp, Homo sapiens
ttatacagctgta

SEQ ID NO: 3130580 - DNA, 15 bp, Homo sapiens
ttatacagctgtatt

SEQ ID NO: 3130581 - DNA, 23 bp, Homo sapiens
ttatacatcaatttaaaaagcaa

SEQ ID NO: 3130582 - DNA, 15 bp, Homo sapiens
ttatacgtgtagcta

SEQ ID NO: 3130583 - DNA, 21 bp, Homo sapiens
ttatacgtgtagctatatcta

SEQ ID NO: 3130584 - DNA, 18 bp, Homo sapiens
ttatactaacttatttat

SEQ ID NO: 3130585 - DNA, 12 bp, Homo sapiens
ttatactaagaa

SEQ ID NO: 3130586 - DNA, 16 bp, Homo sapiens
ttatactaagaaaaga

SEQ ID NO: 3130587 - DNA, 15 bp, Homo sapiens
ttatactatatttgt

SEQ ID NO: 3130588 - DNA, 18 bp, Homo sapiens
ttatactgggtttcaaga

SEQ ID NO: 3130589 - DNA, 16 bp, Homo sapiens
ttatactttatatctg

SEQ ID NO: 3130590 - DNA, 18 bp, Homo sapiens
ttatagaaggaatttgta

SEQ ID NO: 3130591 - DNA, 22 bp, Homo sapiens
ttatagaaggaatttgtacttc

SEQ ID NO: 3130592 - DNA, 22 bp, Homo sapiens
ttatagaataaaagctataaag

SEQ ID NO: 3130593 - DNA, 15 bp, Homo sapiens
ttatagaatactttt

SEQ ID NO: 3130594 - DNA, 15 bp, Homo sapiens
ttatagaatatttat

SEQ ID NO: 3130595 - DNA, 12 bp, Homo sapiens
ttatagattcta

SEQ ID NO: 3130596 - DNA, 17 bp, Homo sapiens
ttatagcaaacttggaa

SEQ ID NO: 3130597 - DNA, 18 bp, Homo sapiens
ttatagcaacaacaattg

SEQ ID NO: 3130598 - DNA, 18 bp, Homo sapiens
ttatagcaagatattgat

SEQ ID NO: 3130599 - DNA, 14 bp, Homo sapiens
ttatagcactttga

SEQ ID NO: 3130600 - DNA, 22 bp, Homo sapiens
ttatagcactttgaaatacctc

SEQ ID NO: 3130601 - DNA, 14 bp, Homo sapiens
ttataggagagatt

SEQ ID NO: 3130602 - DNA, 16 bp, Homo sapiens
ttataggatcatttgt

SEQ ID NO: 3130603 - DNA, 23 bp, Homo sapiens
ttataggccagggcatgtgtatg

SEQ ID NO: 3130604 - DNA, 14 bp, Homo sapiens
ttataggtgagaaa

SEQ ID NO: 3130605 - DNA, 15 bp, Homo sapiens
ttatagtatatctgg

SEQ ID NO: 3130606 - DNA, 14 bp, Homo sapiens
ttatagttactgtg

SEQ ID NO: 3130607 - DNA, 15 bp, Homo sapiens
ttatagtttctgagg

SEQ ID NO: 3130608 - DNA, 23 bp, Homo sapiens
ttatataaatgtaaaaataataa

SEQ ID NO: 3130609 - DNA, 22 bp, Homo sapiens
ttatataattcactcaagcact

SEQ ID NO: 3130610 - DNA, 23 bp, Homo sapiens
ttatatacagtacacagatacct

SEQ ID NO: 3130611 - DNA, 19 bp, Homo sapiens
ttaatcttagtgtatgatt

SEQ ID NO: 3130612 - DNA, 14 bp, Homo sapiens
ttaatctttcctga

SEQ ID NO: 3130613 - DNA, 17 bp, Homo sapiens
ttaatctttctttacct

SEQ ID NO: 3130614 - DNA, 22 bp, Homo sapiens
ttaatgaatattgatgttaaca

SEQ ID NO: 3130615 - DNA, 20 bp, Homo sapiens
ttaatgacaacacttaatag

SEQ ID NO: 3130616 - DNA, 17 bp, Homo sapiens
ttaatgataagtaaatg

SEQ ID NO: 3130617 - DNA, 19 bp, Homo sapiens
ttaatgatatactgatctt

SEQ ID NO: 3130618 - DNA, 23 bp, Homo sapiens
ttaatgatcaacaatttaatgta

SEQ ID NO: 3130619 - DNA, 18 bp, Homo sapiens
ttaatgatgatcttcaga

SEQ ID NO: 3130620 - DNA, 18 bp, Homo sapiens
ttaatgcattaaacctgt

SEQ ID NO: 3130621 - DNA, 23 bp, Homo sapiens
ttaatgccgatatactctagatg

SEQ ID NO: 3130622 - DNA, 14 bp, Homo sapiens
ttaatgctacatgt

SEQ ID NO: 3130623 - DNA, 20 bp, Homo sapiens
ttaatgctctatgtttgtat

SEQ ID NO: 3130624 - DNA, 18 bp, Homo sapiens
ttaatgcttttatatttt

SEQ ID NO: 3130625 - DNA, 19 bp, Homo sapiens
ttaatggacatgagataat

SEQ ID NO: 3130626 - DNA, 22 bp, Homo sapiens
ttaatggacatgagataatgtt

SEQ ID NO: 3130627 - DNA, 14 bp, Homo sapiens
ttaatggcactgat

SEQ ID NO: 3130628 - DNA, 22 bp, Homo sapiens
ttaatggtatcctactgagcat

SEQ ID NO: 3130629 - DNA, 15 bp, Homo sapiens
ttaatggtctaaaaa

SEQ ID NO: 3130630 - DNA, 12 bp, Homo sapiens
ttaatggttttt

SEQ ID NO: 3130631 - DNA, 17 bp, Homo sapiens
ttaatgtatgttaccaa

SEQ ID NO: 3130632 - DNA, 13 bp, Homo sapiens
ttaatgtgatgat

SEQ ID NO: 3130633 - DNA, 20 bp, Homo sapiens
ttaatgtgatgatgtaattg

SEQ ID NO: 3130634 - DNA, 22 bp, Homo sapiens
ttaatgtgatggatggcacaat

SEQ ID NO: 3130635 - DNA, 19 bp, Homo sapiens
ttaatgtgtatttactgta

SEQ ID NO: 3130636 - DNA, 13 bp, Homo sapiens
ttaatgttactca

SEQ ID NO: 3130637 - DNA, 15 bp, Homo sapiens
ttaatgtttattcct

SEQ ID NO: 3130638 - DNA, 14 bp, Homo sapiens
ttaatgtttcttaa

SEQ ID NO: 3130639 - DNA, 16 bp, Homo sapiens
ttaatgttttcaaaag

SEQ ID NO: 3130640 - DNA, 21 bp, Homo sapiens
ttaatgttttcattatgttca

SEQ ID NO: 3130641 - DNA, 21 bp, Homo sapiens
ttaattaatttgattaacaaa

SEQ ID NO: 3130642 - DNA, 15 bp, Homo sapiens
ttaattacatacaga

SEQ ID NO: 3130643 - DNA, 17 bp, Homo sapiens
ttaattacatacagatt

SEQ ID NO: 3130644 - DNA, 16 bp, Homo sapiens
ttaattaccaacctgt

SEQ ID NO: 3130645 - DNA, 23 bp, Homo sapiens
ttaattataggagccttaatttt

SEQ ID NO: 3130646 - DNA, 14 bp, Homo sapiens
ttaattattattct

SEQ ID NO: 3130647 - DNA, 14 bp, Homo sapiens
ttaattattattta

SEQ ID NO: 3130648 - DNA, 16 bp, Homo sapiens
ttaattcaccaaagta

SEQ ID NO: 3130649 - DNA, 21 bp, Homo sapiens
ttaattcttcacctgttatgt

SEQ ID NO: 3130650 - DNA, 21 bp, Homo sapiens
ttaattcttcacctttgtaag

SEQ ID NO: 3130651 - DNA, 14 bp, Homo sapiens
ttaattctttctat

SEQ ID NO: 3130652 - DNA, 15 bp, Homo sapiens
ttaattctttgttct

SEQ ID NO: 3130653 - DNA, 17 bp, Homo sapiens
ttaattctttgttctgt

SEQ ID NO: 3130654 - DNA, 19 bp, Homo sapiens
ttaattgtagttctgtgta

SEQ ID NO: 3130655 - DNA, 16 bp, Homo sapiens
ttaattgttgtttctt

SEQ ID NO: 3130656 - DNA, 20 bp, Homo sapiens
ttaattgttgtttctttcta

SEQ ID NO: 3130657 - DNA, 22 bp, Homo sapiens
ttaattgttgtttctttctagt

SEQ ID NO: 3130658 - DNA, 21 bp, Homo sapiens
ttaatttaaagcttactctgt

SEQ ID NO: 3130659 - DNA, 12 bp, Homo sapiens
ttaatttaacaa

SEQ ID NO: 3130660 - DNA, 20 bp, Homo sapiens
ttaatttatgagtttttgat

SEQ ID NO: 3130661 - DNA, 14 bp, Homo sapiens
ttaatttatttaat

SEQ ID NO: 3130662 - DNA, 13 bp, Homo sapiens
ttaatttatttca

SEQ ID NO: 3130663 - DNA, 23 bp, Homo sapiens
ttaatttcttcaaaatgtatata

SEQ ID NO: 3130664 - DNA, 14 bp, Homo sapiens
ttaatttgcacagt

SEQ ID NO: 3130665 - DNA, 12 bp, Homo sapiens
ttaatttgtaaa

SEQ ID NO: 3130666 - DNA, 14 bp, Homo sapiens
ttaatttgtaaact

SEQ ID NO: 3130667 - DNA, 18 bp, Homo sapiens
ttaatttgtaaacttctg

SEQ ID NO: 3130668 - DNA, 17 bp, Homo sapiens
ttaattttactccataa

SEQ ID NO: 3130669 - DNA, 13 bp, Homo sapiens
ttaattttcagta

SEQ ID NO: 3130670 - DNA, 17 bp, Homo sapiens
ttaattttgtgttgcta

SEQ ID NO: 3130671 - DNA, 17 bp, Homo sapiens
ttaatttttaatgatga

SEQ ID NO: 3130672 - DNA, 18 bp, Homo sapiens
ttaatttttatttcttcc

SEQ ID NO: 3130673 - DNA, 22 bp, Homo sapiens
ttaatttttgcttttagaaaag

SEQ ID NO: 3130674 - DNA, 18 bp, Homo sapiens
ttacaaaagatgtatcct

SEQ ID NO: 3130675 - DNA, 16 bp, Homo sapiens
ttacaaatcagaagtc

SEQ ID NO: 3130676 - DNA, 17 bp, Homo sapiens
ttacaaatcagaagtca

SEQ ID NO: 3130677 - DNA, 16 bp, Homo sapiens
tgttttcacttgtatt

SEQ ID NO: 3130678 - DNA, 17 bp, Homo sapiens
tgttttcagtgtacatg

SEQ ID NO: 3130679 - DNA, 15 bp, Homo sapiens
tgttttcataataaa

SEQ ID NO: 3130680 - DNA, 19 bp, Homo sapiens
tgttttcattatgttcatg

SEQ ID NO: 3130681 - DNA, 20 bp, Homo sapiens
tgttttcattcccccttcct

SEQ ID NO: 3130682 - DNA, 21 bp, Homo sapiens
tgttttcattcccccttccta

SEQ ID NO: 3130683 - DNA, 12 bp, Homo sapiens
tgttttcttcaa

SEQ ID NO: 3130684 - DNA, 17 bp, Homo sapiens
tgttttcttgtaaatgt

SEQ ID NO: 3130685 - DNA, 22 bp, Homo sapiens
tgttttcttgtaaatgtttctt

SEQ ID NO: 3130686 - DNA, 22 bp, Homo sapiens
tgttttctttctttaaatgttt

SEQ ID NO: 3130687 - DNA, 17 bp, Homo sapiens
tgttttgaaactcagta

SEQ ID NO: 3130688 - DNA, 19 bp, Homo sapiens
tgttttgaatggtgttgta

SEQ ID NO: 3130689 - DNA, 14 bp, Homo sapiens
tgttttgaattttg

SEQ ID NO: 3130690 - DNA, 16 bp, Homo sapiens
tgttttgagagtaatg

SEQ ID NO: 3130691 - DNA, 13 bp, Homo sapiens
tgttttgcacttt

SEQ ID NO: 3130692 - DNA, 19 bp, Homo sapiens
tgttttggacagtttacca

SEQ ID NO: 3130693 - DNA, 17 bp, Homo sapiens
tgttttggatggcttgt

SEQ ID NO: 3130694 - DNA, 18 bp, Homo sapiens
tgttttggctgaaattct

SEQ ID NO: 3130695 - DNA, 23 bp, Homo sapiens
tgttttgggtgaatcttgaggaa

SEQ ID NO: 3130696 - DNA, 15 bp, Homo sapiens
tgttttgtacaatta

SEQ ID NO: 3130697 - DNA, 16 bp, Homo sapiens
tgttttgttgtttgat

SEQ ID NO: 3130698 - DNA, 19 bp, Homo sapiens
tgtttttaaaagtttcaat

SEQ ID NO: 3130699 - DNA, 14 bp, Homo sapiens
tgtttttaagctgt

SEQ ID NO: 3130700 - DNA, 20 bp, Homo sapiens
tgtttttaagctgtttccat

SEQ ID NO: 3130701 - DNA, 14 bp, Homo sapiens
tgtttttctccagt

SEQ ID NO: 3130702 - DNA, 18 bp, Homo sapiens
tgtttttgggatgtctta

SEQ ID NO: 3130703 - DNA, 16 bp, Homo sapiens
tgtttttgtatcttta

SEQ ID NO: 3130704 - DNA, 19 bp, Homo sapiens
tgtttttgtatttttaatg

SEQ ID NO: 3130705 - DNA, 13 bp, Homo sapiens
tgtttttgttgtg

SEQ ID NO: 3130706 - DNA, 15 bp, Homo sapiens
tgtttttgttgtgtg

SEQ ID NO: 3130707 - DNA, 14 bp, Homo sapiens
tgttttttaaagca

SEQ ID NO: 3130708 - DNA, 19 bp, Homo sapiens
tgttttttgaaaacatggt

SEQ ID NO: 3130709 - DNA, 19 bp, Homo sapiens
tgttttttgccacagcttt

SEQ ID NO: 3130710 - DNA, 21 bp, Homo sapiens
tgtttttttcctcatgtaaca

SEQ ID NO: 3130711 - DNA, 21 bp, Homo sapiens
tgttttttttgactaaagcta

SEQ ID NO: 3130712 - DNA, 18 bp, Homo sapiens
tgttttttttttccactt

SEQ ID NO: 3130713 - DNA, 22 bp, Homo sapiens
ttaaaaaaaaaaaaaaaagact

SEQ ID NO: 3130714 - DNA, 16 bp, Homo sapiens
ttaaaaaaaaaagtca

SEQ ID NO: 3130715 - DNA, 20 bp, Homo sapiens
ttaaaaaaacaaataaataa

SEQ ID NO: 3130716 - DNA, 13 bp, Homo sapiens
ttaaaaaaagaaa

SEQ ID NO: 3130717 - DNA, 17 bp, Homo sapiens
ttaaaaaaatcacaaaa

SEQ ID NO: 3130718 - DNA, 23 bp, Homo sapiens
ttaaaaaaatcacaaaaatttga

SEQ ID NO: 3130719 - DNA, 11 bp, Homo sapiens
ttaaaaaacaa

SEQ ID NO: 3130720 - DNA, 13 bp, Homo sapiens
ttaaaaaacttgt

SEQ ID NO: 3130721 - DNA, 19 bp, Homo sapiens
ttaaaaaagactgaacatg

SEQ ID NO: 3130722 - DNA, 20 bp, Homo sapiens
ttaaaaaagactgaacatgt

SEQ ID NO: 3130723 - DNA, 14 bp, Homo sapiens
ttaaaaaataaata

SEQ ID NO: 3130724 - DNA, 15 bp, Homo sapiens
ttaaaaaatatttat

SEQ ID NO: 3130725 - DNA, 20 bp, Homo sapiens
ttaaaaaatattttctctgt

SEQ ID NO: 3130726 - DNA, 12 bp, Homo sapiens
ttaaaaaatgtc

SEQ ID NO: 3130727 - DNA, 16 bp, Homo sapiens
ttaaaaaatgtccatg

SEQ ID NO: 3130728 - DNA, 16 bp, Homo sapiens
ttaaaaaatttttgaa

SEQ ID NO: 3130729 - DNA, 12 bp, Homo sapiens
ttaaaaactctt

SEQ ID NO: 3130730 - DNA, 18 bp, Homo sapiens
ttaaaaagattctttttc

SEQ ID NO: 3130731 - DNA, 13 bp, Homo sapiens
ttaaaaagccagt

SEQ ID NO: 3130732 - DNA, 20 bp, Homo sapiens
ttaaaaagctcactgctgat

SEQ ID NO: 3130733 - DNA, 12 bp, Homo sapiens
ttaaaaaggaac

SEQ ID NO: 3130734 - DNA, 16 bp, Homo sapiens
ttaaaaataaatccca

SEQ ID NO: 3130735 - DNA, 20 bp, Homo sapiens
ttaaaaatggctcaagtaga

SEQ ID NO: 3130736 - DNA, 23 bp, Homo sapiens
ttaaaaatggtatcaaaattaca

SEQ ID NO: 3130737 - DNA, 19 bp, Homo sapiens
ttaaaaatgtagaaattct

SEQ ID NO: 3130738 - DNA, 14 bp, Homo sapiens
ttaaaaatgttagt

SEQ ID NO: 3130739 - DNA, 13 bp, Homo sapiens
ttaaaacaatttt

SEQ ID NO: 3130740 - DNA, 18 bp, Homo sapiens
ttaaaacatatttcattt

SEQ ID NO: 3130741 - DNA, 15 bp, Homo sapiens
ttaaaacgtcttaga

SEQ ID NO: 3130742 - DNA, 16 bp, Homo sapiens
ttaaaactaaatttca

SEQ ID NO: 3130743 - DNA, 18 bp, Homo sapiens
ttaaaactcgaaaataag

SEQ ID NO: 3130744 - DNA, 22 bp, Homo sapiens
ttaaaactgcttttttttttcc

SEQ ID NO: 3130745 - DNA, 9 bp, Homo sapiens
ttaaaagaa

SEQ ID NO: 3130746 - DNA, 14 bp, Homo sapiens
ttaaaagaaaaaat

SEQ ID NO: 3130747 - DNA, 18 bp, Homo sapiens
ttaaaagaaaaaatgaca

SEQ ID NO: 3130748 - DNA, 12 bp, Homo sapiens
ttaaaagaaatt

SEQ ID NO: 3130749 - DNA, 14 bp, Homo sapiens
ttaaaagaagactg

SEQ ID NO: 3130750 - DNA, 12 bp, Homo sapiens
ttaaaagagacc

SEQ ID NO: 3130751 - DNA, 11 bp, Homo sapiens
ttaaaagagag

SEQ ID NO: 3130752 - DNA, 15 bp, Homo sapiens
ttaaaagcacaatca

SEQ ID NO: 3130753 - DNA, 17 bp, Homo sapiens
ttaaaagccacatagag

SEQ ID NO: 3130754 - DNA, 15 bp, Homo sapiens
ttaaaagccatgtat

SEQ ID NO: 3130755 - DNA, 17 bp, Homo sapiens
ttaaaagccatgtataa

SEQ ID NO: 3130756 - DNA, 21 bp, Homo sapiens
ttaaaagtactttaaaaagga

SEQ ID NO: 3130757 - DNA, 15 bp, Homo sapiens
ttaaaagtattcata

SEQ ID NO: 3130758 - DNA, 17 bp, Homo sapiens
ttaaaagtctattttat

SEQ ID NO: 3130759 - DNA, 16 bp, Homo sapiens
ttaaaagtttcaatgt

SEQ ID NO: 3130760 - DNA, 19 bp, Homo sapiens
ttaaaagtttcaatgtgat

SEQ ID NO: 3130761 - DNA, 22 bp, Homo sapiens
ttaaaagtttcaatgtgattct

SEQ ID NO: 3130762 - DNA, 16 bp, Homo sapiens
ttaaaataaaaattct

SEQ ID NO: 3130763 - DNA, 14 bp, Homo sapiens
ttaaaataaatggt

SEQ ID NO: 3130764 - DNA, 13 bp, Homo sapiens
ttaaaataaattc

SEQ ID NO: 3130765 - DNA, 18 bp, Homo sapiens
ttaaaataggggatattt

SEQ ID NO: 3130766 - DNA, 23 bp, Homo sapiens
ttaaaataggggatatttaaggt

SEQ ID NO: 3130767 - DNA, 12 bp, Homo sapiens
ttaaaatcacta

SEQ ID NO: 3130768 - DNA, 19 bp, Homo sapiens
ttaaaatcactaacattat

SEQ ID NO: 3130769 - DNA, 21 bp, Homo sapiens
ttaaaatcactaacattatat

SEQ ID NO: 3130770 - DNA, 17 bp, Homo sapiens
ttaaaatctattctgtg

SEQ ID NO: 3130771 - DNA, 18 bp, Homo sapiens
ttaaaatctattctgtgt

SEQ ID NO: 3130772 - DNA, 19 bp, Homo sapiens
ttaaaatctattctgtgtt

SEQ ID NO: 3130773 - DNA, 23 bp, Homo sapiens
ttaaaatctattctgtgttgcat

SEQ ID NO: 3130774 - DNA, 18 bp, Homo sapiens
ttaaaatgcattgaaaga

SEQ ID NO: 3130775 - DNA, 20 bp, Homo sapiens
ttaaaatggatttaatccat

SEQ ID NO: 3130776 - DNA, 17 bp, Homo sapiens
ttaaaatgtaatttaaa

SEQ ID NO: 3130777 - DNA, 16 bp, Homo sapiens
ttaaaattaagtagaa

SEQ ID NO: 3130778 - DNA, 19 bp, Homo sapiens
ttaaaattaagtagaacaa

SEQ ID NO: 3130779 - DNA, 18 bp, Homo sapiens
ttaaaattacagatgtga

SEQ ID NO: 3130780 - DNA, 23 bp, Homo sapiens
ttaaaattgatttttctcttcat

SEQ ID NO: 3130781 - DNA, 20 bp, Homo sapiens
ttaaaattttgtatgttaaa

SEQ ID NO: 3130782 - DNA, 14 bp, Homo sapiens
ttaaacaaagtgac

SEQ ID NO: 3130783 - DNA, 20 bp, Homo sapiens
ttaaacaatgtataaagatt

SEQ ID NO: 3130784 - DNA, 14 bp, Homo sapiens
ttaaacacaaagtg

SEQ ID NO: 3130785 - DNA, 19 bp, Homo sapiens
ttaaacacatgccttaaat

SEQ ID NO: 3130786 - DNA, 13 bp, Homo sapiens
ttaaacacctcct

SEQ ID NO: 3130787 - DNA, 11 bp, Homo sapiens
ttaaacagatg

SEQ ID NO: 3130788 - DNA, 16 bp, Homo sapiens
ttaaacagatttttac

SEQ ID NO: 3130789 - DNA, 16 bp, Homo sapiens
ttaaacagtatttcat

SEQ ID NO: 3130790 - DNA, 12 bp, Homo sapiens
ttaaacataata

SEQ ID NO: 3130791 - DNA, 13 bp, Homo sapiens
ttaaacataataa

SEQ ID NO: 3130792 - DNA, 23 bp, Homo sapiens
ttaaaccaacctttaaaattgtc

SEQ ID NO: 3130793 - DNA, 20 bp, Homo sapiens
ttaaaccctggatcagtcct

SEQ ID NO: 3130794 - DNA, 13 bp, Homo sapiens
ttaaaccttttat

SEQ ID NO: 3130795 - DNA, 19 bp, Homo sapiens
ttaaacgaagagttccctt

SEQ ID NO: 3130796 - DNA, 23 bp, Homo sapiens
ttaaacgctctaggtacgatgac

SEQ ID NO: 3130797 - DNA, 14 bp, Homo sapiens
ttaaactatcttgt

SEQ ID NO: 3130798 - DNA, 13 bp, Homo sapiens
ttaaactcaggga

SEQ ID NO: 3130799 - DNA, 16 bp, Homo sapiens
ttaaactcagggacag

SEQ ID NO: 3130800 - DNA, 20 bp, Homo sapiens
ttaaactcagggacagagcc

SEQ ID NO: 3130801 - DNA, 19 bp, Homo sapiens
ttaaactcttcacaaaatc

SEQ ID NO: 3130802 - DNA, 18 bp, Homo sapiens
ttaaactgttagcactgt

SEQ ID NO: 3130803 - DNA, 19 bp, Homo sapiens
ttaaactgttagcactgtt

SEQ ID NO: 3130804 - DNA, 16 bp, Homo sapiens
ttaaacttataaatca

SEQ ID NO: 3130805 - DNA, 15 bp, Homo sapiens
ttaaacttgtgaatg

SEQ ID NO: 3130806 - DNA, 17 bp, Homo sapiens
ttaaacttgtgaatgct

SEQ ID NO: 3130807 - DNA, 20 bp, Homo sapiens
tgttccttgtactcttagga

SEQ ID NO: 3130808 - DNA, 20 bp, Homo sapiens
tgttcgcatggtcacacact

SEQ ID NO: 3130809 - DNA, 22 bp, Homo sapiens
tgttcgcatggtcacacactga

SEQ ID NO: 3130810 - DNA, 22 bp, Homo sapiens
tgttcgtctttagttttgattt

SEQ ID NO: 3130811 - DNA, 18 bp, Homo sapiens
tgttctaaagctctgaca

SEQ ID NO: 3130812 - DNA, 16 bp, Homo sapiens
tgttctaagatgtgat

SEQ ID NO: 3130813 - DNA, 10 bp, Homo sapiens
tgttctaagg

SEQ ID NO: 3130814 - DNA, 14 bp, Homo sapiens
tgttctaaggctct

SEQ ID NO: 3130815 - DNA, 23 bp, Homo sapiens
tgttctaaggctctgagagtcta

SEQ ID NO: 3130816 - DNA, 11 bp, Homo sapiens
tgttctaaggg

SEQ ID NO: 3130817 - DNA, 19 bp, Homo sapiens
tgttctaatactttgttta

SEQ ID NO: 3130818 - DNA, 21 bp, Homo sapiens
tgttctagttttttacttttg

SEQ ID NO: 3130819 - DNA, 13 bp, Homo sapiens
tgttctatccaaa

SEQ ID NO: 3130820 - DNA, 18 bp, Homo sapiens
tgttctatccaaacatgt

SEQ ID NO: 3130821 - DNA, 17 bp, Homo sapiens
tgttctatggttatgaa

SEQ ID NO: 3130822 - DNA, 22 bp, Homo sapiens
tgttctcacactggtctgctgt

SEQ ID NO: 3130823 - DNA, 23 bp, Homo sapiens
tgttctcacactggtctgctgtc

SEQ ID NO: 3130824 - DNA, 23 bp, Homo sapiens
tgttctccgggtgtggcctcagc

SEQ ID NO: 3130825 - DNA, 21 bp, Homo sapiens
tgttctccttttcctctctcc

SEQ ID NO: 3130826 - DNA, 16 bp, Homo sapiens
tgttctctgaggacac

SEQ ID NO: 3130827 - DNA, 14 bp, Homo sapiens
tgttctcttcttca

SEQ ID NO: 3130828 - DNA, 16 bp, Homo sapiens
tgttctctttaaaata

SEQ ID NO: 3130829 - DNA, 13 bp, Homo sapiens
tgttctgacatta

SEQ ID NO: 3130830 - DNA, 16 bp, Homo sapiens
tgttctgacattaaca

SEQ ID NO: 3130831 - DNA, 14 bp, Homo sapiens
tgttctgattagaa

SEQ ID NO: 3130832 - DNA, 22 bp, Homo sapiens
tgttctgattagaaatgaccaa

SEQ ID NO: 3130833 - DNA, 16 bp, Homo sapiens
tgttctgcccccagcc

SEQ ID NO: 3130834 - DNA, 12 bp, Homo sapiens
tgttctgctggg

SEQ ID NO: 3130835 - DNA, 22 bp, Homo sapiens
tgttctgctttatcttttcata

SEQ ID NO: 3130836 - DNA, 14 bp, Homo sapiens
tgttctgggacaca

SEQ ID NO: 3130837 - DNA, 15 bp, Homo sapiens
tgttctgggacacag

SEQ ID NO: 3130838 - DNA, 13 bp, Homo sapiens
tgttctgggctca

SEQ ID NO: 3130839 - DNA, 15 bp, Homo sapiens
tgttctgggctcttt

SEQ ID NO: 3130840 - DNA, 12 bp, Homo sapiens
tgttctgtattt

SEQ ID NO: 3130841 - DNA, 13 bp, Homo sapiens
tgttctgtccctt

SEQ ID NO: 3130842 - DNA, 14 bp, Homo sapiens
tgttctgtcccttc

SEQ ID NO: 3130843 - DNA, 12 bp, Homo sapiens
tgttctgtgtcc

SEQ ID NO: 3130844 - DNA, 13 bp, Homo sapiens
tgttctgtgtctt

SEQ ID NO: 3130845 - DNA, 14 bp, Homo sapiens
tgttctgtgtcttt

SEQ ID NO: 3130846 - DNA, 21 bp, Homo sapiens
tgttctgtttgttaaaactgg

SEQ ID NO: 3130847 - DNA, 16 bp, Homo sapiens
tgttcttacacataca

SEQ ID NO: 3130848 - DNA, 14 bp, Homo sapiens
tgttcttagagtgt

SEQ ID NO: 3130849 - DNA, 18 bp, Homo sapiens
tgttcttcaagccagctc

SEQ ID NO: 3130850 - DNA, 20 bp, Homo sapiens
tgttcttcaagccagctcta

SEQ ID NO: 3130851 - DNA, 19 bp, Homo sapiens
tgttcttgccactgcactc

SEQ ID NO: 3130852 - DNA, 12 bp, Homo sapiens
tgttcttgctgc

SEQ ID NO: 3130853 - DNA, 13 bp, Homo sapiens
tgttcttgctgct

SEQ ID NO: 3130854 - DNA, 20 bp, Homo sapiens
tgttcttgctgctagaactt

SEQ ID NO: 3130855 - DNA, 16 bp, Homo sapiens
tgttctttctggagtc

SEQ ID NO: 3130856 - DNA, 23 bp, Homo sapiens
tgttgaaaaaaaagtttcagaga

SEQ ID NO: 3130857 - DNA, 23 bp, Homo sapiens
tgttgaaaatatttctctagtgt

SEQ ID NO: 3130858 - DNA, 20 bp, Homo sapiens
tgttgaaaatggtttcaagt

SEQ ID NO: 3130859 - DNA, 14 bp, Homo sapiens
tgttgaaacagaaa

SEQ ID NO: 3130860 - DNA, 24 bp, Homo sapiens
tgttgaaaggtaatttgagagaaa

SEQ ID NO: 3130861 - DNA, 23 bp, Homo sapiens
tgttgaaaggttttttttcagtt

SEQ ID NO: 3130862 - DNA, 15 bp, Homo sapiens
tgttgaaattatgta

SEQ ID NO: 3130863 - DNA, 22 bp, Homo sapiens
tgttgaaattatgtatgtttac

SEQ ID NO: 3130864 - DNA, 21 bp, Homo sapiens
tgttgaaattttgcaaatata

SEQ ID NO: 3130865 - DNA, 15 bp, Homo sapiens
tgttgaacatacttc

SEQ ID NO: 3130866 - DNA, 20 bp, Homo sapiens
tgttgaagaaaaaagcttat

SEQ ID NO: 3130867 - DNA, 17 bp, Homo sapiens
tgttgaagggaggtggc

SEQ ID NO: 3130868 - DNA, 13 bp, Homo sapiens
tgttgaatacttt

SEQ ID NO: 3130869 - DNA, 18 bp, Homo sapiens
tgttgaatactttttaca

SEQ ID NO: 3130870 - DNA, 15 bp, Homo sapiens
tgttgacaactgtga

SEQ ID NO: 3130871 - DNA, 21 bp, Homo sapiens
tgttgacagcaaaatgttgaa

SEQ ID NO: 3130872 - DNA, 16 bp, Homo sapiens
tgttgacagttctgaa

SEQ ID NO: 3130873 - DNA, 20 bp, Homo sapiens
tgttgacttattttctctgt

SEQ ID NO: 3130874 - DNA, 22 bp, Homo sapiens
tgttgagaatcccaaatttgat

SEQ ID NO: 3130875 - DNA, 13 bp, Homo sapiens
tgttgagctgttt

SEQ ID NO: 3130876 - DNA, 20 bp, Homo sapiens
tgttgaggtggtctgaatgt

SEQ ID NO: 3130877 - DNA, 23 bp, Homo sapiens
tgttgaggtggtctgaatgttct

SEQ ID NO: 3130878 - DNA, 18 bp, Homo sapiens
tgttgagtgttcatttta

SEQ ID NO: 3130879 - DNA, 19 bp, Homo sapiens
tgttgatcatgtacttttt

SEQ ID NO: 3130880 - DNA, 13 bp, Homo sapiens
tgttgatgtatct

SEQ ID NO: 3130881 - DNA, 19 bp, Homo sapiens
tgttgatgtatctgagttg

SEQ ID NO: 3130882 - DNA, 11 bp, Homo sapiens
tgttgattatt

SEQ ID NO: 3130883 - DNA, 18 bp, Homo sapiens
tgttgattttctgttgta

SEQ ID NO: 3130884 - DNA, 20 bp, Homo sapiens
tgttgcaattaggattttga

SEQ ID NO: 3130885 - DNA, 18 bp, Homo sapiens
tgttgccaagctccaagc

SEQ ID NO: 3130886 - DNA, 13 bp, Homo sapiens
tgttgcccaggca

SEQ ID NO: 3130887 - DNA, 16 bp, Homo sapiens
tgttgcccaggcaggt

SEQ ID NO: 3130888 - DNA, 18 bp, Homo sapiens
tgttgcccaggcaggtct

SEQ ID NO: 3130889 - DNA, 13 bp, Homo sapiens
tgttgcccaggct

SEQ ID NO: 3130890 - DNA, 17 bp, Homo sapiens
tgttgcctaattggaaa

SEQ ID NO: 3130891 - DNA, 16 bp, Homo sapiens
tgttgctaaaaaaagt

SEQ ID NO: 3130892 - DNA, 16 bp, Homo sapiens
tgttgctataataaag

SEQ ID NO: 3130893 - DNA, 15 bp, Homo sapiens
tgttgctctaggaag

SEQ ID NO: 3130894 - DNA, 15 bp, Homo sapiens
tgttgctcttggaaa

SEQ ID NO: 3130895 - DNA, 21 bp, Homo sapiens
tgttgcttttgtgaacttttt

SEQ ID NO: 3130896 - DNA, 21 bp, Homo sapiens
tgttggaaaagaatacagaaa

SEQ ID NO: 3130897 - DNA, 13 bp, Homo sapiens
tgttggaaagtaa

SEQ ID NO: 3130898 - DNA, 14 bp, Homo sapiens
tgttggagcaaacc

SEQ ID NO: 3130899 - DNA, 17 bp, Homo sapiens
tgttggagcaaaccatt

SEQ ID NO: 3130900 - DNA, 21 bp, Homo sapiens
tgttggcactcacagacctgg

SEQ ID NO: 3130901 - DNA, 22 bp, Homo sapiens
tgttggcactcacagacctgga

SEQ ID NO: 3130902 - DNA, 16 bp, Homo sapiens
tgttgtgtacagactt

SEQ ID NO: 3130903 - DNA, 13 bp, Homo sapiens
tgttgtgtgtgca

SEQ ID NO: 3130904 - DNA, 22 bp, Homo sapiens
tgttgttccattttatgcagaa

SEQ ID NO: 3130905 - DNA, 19 bp, Homo sapiens
tgttgttgaaaggtttttt

SEQ ID NO: 3130906 - DNA, 13 bp, Homo sapiens
tgttgtttctttc

SEQ ID NO: 3130907 - DNA, 15 bp, Homo sapiens
tgttgtttctttcta

SEQ ID NO: 3130908 - DNA, 11 bp, Homo sapiens
tgttgttttgt

SEQ ID NO: 3130909 - DNA, 19 bp, Homo sapiens
tgtttaaaaagtaagttaa

SEQ ID NO: 3130910 - DNA, 14 bp, Homo sapiens
tgtttaaaatgtaa

SEQ ID NO: 3130911 - DNA, 23 bp, Homo sapiens
tgtttaaacacttatcttctgga

SEQ ID NO: 3130912 - DNA, 24 bp, Homo sapiens
tgtttaaacacttatcttctggat

SEQ ID NO: 3130913 - DNA, 18 bp, Homo sapiens
tgtttaaatcatgtatgt

SEQ ID NO: 3130914 - DNA, 22 bp, Homo sapiens
tgtttaacaaatctaatctctt

SEQ ID NO: 3130915 - DNA, 15 bp, Homo sapiens
tgtttaatatttaaa

SEQ ID NO: 3130916 - DNA, 17 bp, Homo sapiens
tgtttaatatttaaaca

SEQ ID NO: 3130917 - DNA, 19 bp, Homo sapiens
tgtttaatgtgaacttgta

SEQ ID NO: 3130918 - DNA, 16 bp, Homo sapiens
tgtttacactctttgt

SEQ ID NO: 3130919 - DNA, 20 bp, Homo sapiens
tgtttacagcactactctgt

SEQ ID NO: 3130920 - DNA, 23 bp, Homo sapiens
tgtttacagcactactctgtgcc

SEQ ID NO: 3130921 - DNA, 23 bp, Homo sapiens
tgtttacagggagcctcctgccc

SEQ ID NO: 3130922 - DNA, 18 bp, Homo sapiens
tgtttacaggtttgaatt

SEQ ID NO: 3130923 - DNA, 22 bp, Homo sapiens
tgtttacatttgatgcatgtct

SEQ ID NO: 3130924 - DNA, 20 bp, Homo sapiens
tgtttagagtaaataaactg

SEQ ID NO: 3130925 - DNA, 23 bp, Homo sapiens
tgtttagagtaaataaactgttt

SEQ ID NO: 3130926 - DNA, 13 bp, Homo sapiens
tgtttaggaagaa

SEQ ID NO: 3130927 - DNA, 24 bp, Homo sapiens
tgtttaggaagaagtggtactagt

SEQ ID NO: 3130928 - DNA, 16 bp, Homo sapiens
tgtttataatctgaag

SEQ ID NO: 3130929 - DNA, 22 bp, Homo sapiens
tgtttatactgtatttctaaga

SEQ ID NO: 3130930 - DNA, 12 bp, Homo sapiens
tgtttatataaa

SEQ ID NO: 3130931 - DNA, 21 bp, Homo sapiens
tgtttatatacagtacacaga

SEQ ID NO: 3130932 - DNA, 18 bp, Homo sapiens
tgtttatcagatacatca

SEQ ID NO: 3130933 - DNA, 22 bp, Homo sapiens
tgtttatcagatacatcactgc

SEQ ID NO: 3130934 - DNA, 14 bp, Homo sapiens
tgtttatgaaaata

SEQ ID NO: 3130935 - DNA, 18 bp, Homo sapiens
tgtttatgaaaataaata

SEQ ID NO: 3130936 - DNA, 21 bp, Homo sapiens
tgtttatgaaaataaatagct

SEQ ID NO: 3130937 - DNA, 22 bp, Homo sapiens
tgtttatgatctatttgtagat

SEQ ID NO: 3130938 - DNA, 15 bp, Homo sapiens
tgtttatggcctcag

SEQ ID NO: 3130939 - DNA, 14 bp, Homo sapiens
tgtttatgttttta

SEQ ID NO: 3130940 - DNA, 14 bp, Homo sapiens
tgtttattaatctt

SEQ ID NO: 3130941 - DNA, 17 bp, Homo sapiens
tgtttattaatcttagt

SEQ ID NO: 3130942 - DNA, 13 bp, Homo sapiens
tgtttattacaat

SEQ ID NO: 3130943 - DNA, 22 bp, Homo sapiens
tgtttatttataagcagattta

SEQ ID NO: 3130944 - DNA, 14 bp, Homo sapiens
tgtttatttataga

SEQ ID NO: 3130945 - DNA, 15 bp, Homo sapiens
tgtttatttatcagt

SEQ ID NO: 3130946 - DNA, 13 bp, Homo sapiens
tgtttatttcagg

SEQ ID NO: 3130947 - DNA, 14 bp, Homo sapiens
tgtttatttctgtt

SEQ ID NO: 3130948 - DNA, 17 bp, Homo sapiens
tgtttatttctgtttct

SEQ ID NO: 3130949 - DNA, 14 bp, Homo sapiens
tgtttatttttata

SEQ ID NO: 3130950 - DNA, 15 bp, Homo sapiens
tgtttatttttcata

SEQ ID NO: 3130951 - DNA, 19 bp, Homo sapiens
tgtttatttttcatattgt

SEQ ID NO: 3130952 - DNA, 23 bp, Homo sapiens
tgtttatttttcttgtctttatt

SEQ ID NO: 3130953 - DNA, 19 bp, Homo sapiens
tgtttcaaaaaattatatg

SEQ ID NO: 3130954 - DNA, 19 bp, Homo sapiens
tgtttcaaggcactctaga

SEQ ID NO: 3130955 - DNA, 21 bp, Homo sapiens
tgtttcaaggcactctagatt

SEQ ID NO: 3130956 - DNA, 17 bp, Homo sapiens
tgtttcaagtggggctc

SEQ ID NO: 3130957 - DNA, 14 bp, Homo sapiens
tgtttcaatcactg

SEQ ID NO: 3130958 - DNA, 22 bp, Homo sapiens
tgtttcactgaaatgtttggat

SEQ ID NO: 3130959 - DNA, 19 bp, Homo sapiens
tgtttcagcttctctgcta

SEQ ID NO: 3130960 - DNA, 16 bp, Homo sapiens
tgtttcaggtttccat

SEQ ID NO: 3130961 - DNA, 14 bp, Homo sapiens
tgtttcatgttttg

SEQ ID NO: 3130962 - DNA, 22 bp, Homo sapiens
tgtttcatgttttgtgactata

SEQ ID NO: 3130963 - DNA, 22 bp, Homo sapiens
tgtttccaacttgtctgggaat

SEQ ID NO: 3130964 - DNA, 20 bp, Homo sapiens
tgtttccagacttccttgag

SEQ ID NO: 3130965 - DNA, 20 bp, Homo sapiens
tgtttccattttaaggatat

SEQ ID NO: 3130966 - DNA, 23 bp, Homo sapiens
tgtttcccttgctttgttttaat

SEQ ID NO: 3130967 - DNA, 14 bp, Homo sapiens
tgtttcctctagtt

SEQ ID NO: 3130968 - DNA, 21 bp, Homo sapiens
tgtttcctgacattgtctcct

SEQ ID NO: 3130969 - DNA, 14 bp, Homo sapiens
tgtttcctggcaat

SEQ ID NO: 3130970 - DNA, 22 bp, Homo sapiens
tgtttctagttgaggagtttcc

SEQ ID NO: 3130971 - DNA, 16 bp, Homo sapiens
tgtttctccccctggg

SEQ ID NO: 3130972 - DNA, 13 bp, Homo sapiens
tgtttctctgctg

SEQ ID NO: 3130973 - DNA, 16 bp, Homo sapiens
tgtttctgacccactg

SEQ ID NO: 3130974 - DNA, 22 bp, Homo sapiens
tgtttctgcagcccttgggcag

SEQ ID NO: 3130975 - DNA, 23 bp, Homo sapiens
tgtttctgcagcccttgggcagt

SEQ ID NO: 3130976 - DNA, 12 bp, Homo sapiens
tgtttctgttat

SEQ ID NO: 3130977 - DNA, 13 bp, Homo sapiens
tgtttctgttatt

SEQ ID NO: 3130978 - DNA, 19 bp, Homo sapiens
tgtttctgttattaacaaa

SEQ ID NO: 3130979 - DNA, 16 bp, Homo sapiens
tgtttctgttccaaat

SEQ ID NO: 3130980 - DNA, 15 bp, Homo sapiens
tgtttcttctgtctt

SEQ ID NO: 3130981 - DNA, 14 bp, Homo sapiens
tgtttcttgtttat

SEQ ID NO: 3130982 - DNA, 16 bp, Homo sapiens
tgtttctttatatttt

SEQ ID NO: 3130983 - DNA, 17 bp, Homo sapiens
tgtttctttttacagca

SEQ ID NO: 3130984 - DNA, 23 bp, Homo sapiens
tgtttcttttttttttttttaca

SEQ ID NO: 3130985 - DNA, 22 bp, Homo sapiens
tgtttgacaaagttactgattc

SEQ ID NO: 3130986 - DNA, 22 bp, Homo sapiens
tgtttgaggatatattttcact

SEQ ID NO: 3130987 - DNA, 12 bp, Homo sapiens
tgtttgatgcag

SEQ ID NO: 3130988 - DNA, 14 bp, Homo sapiens
tgtttgatgtatgt

SEQ ID NO: 3130989 - DNA, 19 bp, Homo sapiens
tgtttgatgtatgtgtgaa

SEQ ID NO: 3130990 - DNA, 13 bp, Homo sapiens
tgtttgatttcaa

SEQ ID NO: 3130991 - DNA, 19 bp, Homo sapiens
tgtgagtcaccaagcccag

SEQ ID NO: 3130992 - DNA, 18 bp, Homo sapiens
tgtgagtctttggttcta

SEQ ID NO: 3130993 - DNA, 20 bp, Homo sapiens
tgtgagtctttggttctaag

SEQ ID NO: 3130994 - DNA, 16 bp, Homo sapiens
tgtgagtgccttttgc

SEQ ID NO: 3130995 - DNA, 19 bp, Homo sapiens
tgtgagtgccttttgcaga

SEQ ID NO: 3130996 - DNA, 17 bp, Homo sapiens
tgtgagtgcgtctgagg

SEQ ID NO: 3130997 - DNA, 20 bp, Homo sapiens
tgtgagtggcagccatgcct

SEQ ID NO: 3130998 - DNA, 11 bp, Homo sapiens
tgtgagtgtga

SEQ ID NO: 3130999 - DNA, 12 bp, Homo sapiens
tgtgagtgtgac

SEQ ID NO: 3131000 - DNA, 22 bp, Homo sapiens
tgtgagtgtgtgtttgtgctga

SEQ ID NO: 3131001 - DNA, 16 bp, Homo sapiens
tgtgagtttaaagcaa

SEQ ID NO: 3131002 - DNA, 16 bp, Homo sapiens
tgtgataactctgcaa

SEQ ID NO: 3131003 - DNA, 21 bp, Homo sapiens
tgtgataactctgcaaaggcc

SEQ ID NO: 3131004 - DNA, 14 bp, Homo sapiens
tgtgatatataagt

SEQ ID NO: 3131005 - DNA, 15 bp, Homo sapiens
tgtgatatataagtg

SEQ ID NO: 3131006 - DNA, 19 bp, Homo sapiens
tgtgatattctaagactta

SEQ ID NO: 3131007 - DNA, 17 bp, Homo sapiens
tgtgatcactgagacag

SEQ ID NO: 3131008 - DNA, 20 bp, Homo sapiens
tgtgatcaggctatgtatgg

SEQ ID NO: 3131009 - DNA, 18 bp, Homo sapiens
tgtgatcccaagtgccag

SEQ ID NO: 3131010 - DNA, 23 bp, Homo sapiens
tgtgatcccaagtgccagtcttg

SEQ ID NO: 3131011 - DNA, 18 bp, Homo sapiens
tgtgatcttgcattcatt

SEQ ID NO: 3131012 - DNA, 15 bp, Homo sapiens
tgtgatgaactttct

SEQ ID NO: 3131013 - DNA, 17 bp, Homo sapiens
tgtgatgaataaaataa

SEQ ID NO: 3131014 - DNA, 19 bp, Homo sapiens
tgtgatgactggttgttca

SEQ ID NO: 3131015 - DNA, 16 bp, Homo sapiens
tgtgatgatgtaattg

SEQ ID NO: 3131016 - DNA, 16 bp, Homo sapiens
tgtgatggatggcaca

SEQ ID NO: 3131017 - DNA, 16 bp, Homo sapiens
tgtgatgtattctagc

SEQ ID NO: 3131018 - DNA, 14 bp, Homo sapiens
tgtgatgttctaag

SEQ ID NO: 3131019 - DNA, 15 bp, Homo sapiens
tgtgattaatgtttt

SEQ ID NO: 3131020 - DNA, 15 bp, Homo sapiens
tgtgattcaaaagat

SEQ ID NO: 3131021 - DNA, 20 bp, Homo sapiens
tgtgattcagaaaatgttct

SEQ ID NO: 3131022 - DNA, 14 bp, Homo sapiens
tgtgattctaatgt

SEQ ID NO: 3131023 - DNA, 17 bp, Homo sapiens
tgtgattctaatgtctt

SEQ ID NO: 3131024 - DNA, 13 bp, Homo sapiens
tgtgattgctgcc

SEQ ID NO: 3131025 - DNA, 17 bp, Homo sapiens
tgtgatttagaactgta

SEQ ID NO: 3131026 - DNA, 18 bp, Homo sapiens
tgtgatttagaactgtat

SEQ ID NO: 3131027 - DNA, 13 bp, Homo sapiens
tgtgatttccatt

SEQ ID NO: 3131028 - DNA, 17 bp, Homo sapiens
tgtgatttccatttctg

SEQ ID NO: 3131029 - DNA, 15 bp, Homo sapiens
tgtgatttctttctt

SEQ ID NO: 3131030 - DNA, 23 bp, Homo sapiens
tgtgcaagcgacgacagatgcta

SEQ ID NO: 3131031 - DNA, 20 bp, Homo sapiens
tgtgcacacacacacacatg

SEQ ID NO: 3131032 - DNA, 13 bp, Homo sapiens
tgtgcacatcttc

SEQ ID NO: 3131033 - DNA, 22 bp, Homo sapiens
tgtgcacatgcacgtgtgtgca

SEQ ID NO: 3131034 - DNA, 22 bp, Homo sapiens
tgtgcaccttaccaactttctg

SEQ ID NO: 3131035 - DNA, 14 bp, Homo sapiens
tgtgcactgtcact

SEQ ID NO: 3131036 - DNA, 22 bp, Homo sapiens
tgtgcagaataatggaaacatt

SEQ ID NO: 3131037 - DNA, 13 bp, Homo sapiens
tgtgcagcagccc

SEQ ID NO: 3131038 - DNA, 15 bp, Homo sapiens
tgtgcagcgcagctg

SEQ ID NO: 3131039 - DNA, 17 bp, Homo sapiens
tgtgcagggagggcagt

SEQ ID NO: 3131040 - DNA, 14 bp, Homo sapiens
tgtgcagtgtagcc

SEQ ID NO: 3131041 - DNA, 15 bp, Homo sapiens
tgtgcataatgcttt

SEQ ID NO: 3131042 - DNA, 15 bp, Homo sapiens
tgtgcatagtgctgg

SEQ ID NO: 3131043 - DNA, 15 bp, Homo sapiens
tgtgcatcctgtgaa

SEQ ID NO: 3131044 - DNA, 16 bp, Homo sapiens
tgtgcatggaggccct

SEQ ID NO: 3131045 - DNA, 19 bp, Homo sapiens
tgtgcatggaggccctcct

SEQ ID NO: 3131046 - DNA, 22 bp, Homo sapiens
tgtgcatggaggccctcctgtg

SEQ ID NO: 3131047 - DNA, 17 bp, Homo sapiens
tgtgcatgtgtgtataa

SEQ ID NO: 3131048 - DNA, 15 bp, Homo sapiens
tgtgcattctggatt

SEQ ID NO: 3131049 - DNA, 14 bp, Homo sapiens
tgtgcattctttgg

SEQ ID NO: 3131050 - DNA, 21 bp, Homo sapiens
tgtgcatttttgtgaaatgaa

SEQ ID NO: 3131051 - DNA, 16 bp, Homo sapiens
tgtgccacccaccagg

SEQ ID NO: 3131052 - DNA, 21 bp, Homo sapiens
tgtgccagaggaaggaaaagg

SEQ ID NO: 3131053 - DNA, 20 bp, Homo sapiens
tgtgccagaggaatcctggc

SEQ ID NO: 3131054 - DNA, 20 bp, Homo sapiens
tgtgccaggtttttggtctg

SEQ ID NO: 3131055 - DNA, 18 bp, Homo sapiens
tgtgccatagagtttaac

SEQ ID NO: 3131056 - DNA, 22 bp, Homo sapiens
tgtgccatagagtttaacacaa

SEQ ID NO: 3131057 - DNA, 10 bp, Homo sapiens
tgtgccatca

SEQ ID NO: 3131058 - DNA, 23 bp, Homo sapiens
tgtgccatctgtacatattactg

SEQ ID NO: 3131059 - DNA, 14 bp, Homo sapiens
tgtgccatgctggg

SEQ ID NO: 3131060 - DNA, 21 bp, Homo sapiens
tgtgcccacatcccaggcttc

SEQ ID NO: 3131061 - DNA, 15 bp, Homo sapiens
tgtgcccctggccca

SEQ ID NO: 3131062 - DNA, 23 bp, Homo sapiens
tgtgcccctggcccatctcagcc

SEQ ID NO: 3131063 - DNA, 16 bp, Homo sapiens
tgtgccctccaaagag

SEQ ID NO: 3131064 - DNA, 14 bp, Homo sapiens
tgtgccctggtgga

SEQ ID NO: 3131065 - DNA, 15 bp, Homo sapiens
tgtgcccttctctta

SEQ ID NO: 3131066 - DNA, 16 bp, Homo sapiens
tgtgccgaatgtgcag

SEQ ID NO: 3131067 - DNA, 16 bp, Homo sapiens
tgtgcctaacaccagc

SEQ ID NO: 3131068 - DNA, 12 bp, Homo sapiens
tgtgcctcctca

SEQ ID NO: 3131069 - DNA, 13 bp, Homo sapiens
tgtgcctctgcct

SEQ ID NO: 3131070 - DNA, 15 bp, Homo sapiens
tgtgcctctgcctgt

SEQ ID NO: 3131071 - DNA, 19 bp, Homo sapiens
tgtgcctgcaccaggagac

SEQ ID NO: 3131072 - DNA, 11 bp, Homo sapiens
tgtgcctgcca

SEQ ID NO: 3131073 - DNA, 15 bp, Homo sapiens
tgtgcctgccatggg

SEQ ID NO: 3131074 - DNA, 19 bp, Homo sapiens
tgtgcctgccatgggccag

SEQ ID NO: 3131075 - DNA, 22 bp, Homo sapiens
tgtgcctgccatgggccagcct

SEQ ID NO: 3131076 - DNA, 20 bp, Homo sapiens
tgtgcctgctagagcaaccc

SEQ ID NO: 3131077 - DNA, 13 bp, Homo sapiens
tgtgcctggggga

SEQ ID NO: 3131078 - DNA, 14 bp, Homo sapiens
tgtgccttcgtctt

SEQ ID NO: 3131079 - DNA, 23 bp, Homo sapiens
tgtgccttcgtctttcccatggg

SEQ ID NO: 3131080 - DNA, 18 bp, Homo sapiens
tgtgccttgttttttgtt

SEQ ID NO: 3131081 - DNA, 18 bp, Homo sapiens
tgtgcctttgcaaatcag

SEQ ID NO: 3131082 - DNA, 15 bp, Homo sapiens
tgtgccttttcccca

SEQ ID NO: 3131083 - DNA, 17 bp, Homo sapiens
tgtgcgtcccagctgaa

SEQ ID NO: 3131084 - DNA, 14 bp, Homo sapiens
tgtgcgtgaaacac

SEQ ID NO: 3131085 - DNA, 22 bp, Homo sapiens
tgtgcgtgaaacacaccaggct

SEQ ID NO: 3131086 - DNA, 16 bp, Homo sapiens
tgtgcgtgcgtgtgtg

SEQ ID NO: 3131087 - DNA, 18 bp, Homo sapiens
tgtgctaagtctttccca

SEQ ID NO: 3131088 - DNA, 17 bp, Homo sapiens
tgtgctactgattgttt

SEQ ID NO: 3131089 - DNA, 21 bp, Homo sapiens
tgtgctactgtctttggaaaa

SEQ ID NO: 3131090 - DNA, 18 bp, Homo sapiens
tgtgctatactgcatact

SEQ ID NO: 3131091 - DNA, 14 bp, Homo sapiens
tgtgctcacgctcc

SEQ ID NO: 3131092 - DNA, 22 bp, Homo sapiens
tgtgctcagagacctgaagtgt

SEQ ID NO: 3131093 - DNA, 15 bp, Homo sapiens
tgtgctcatttaagt

SEQ ID NO: 3131094 - DNA, 16 bp, Homo sapiens
tgtgctcctccttggt

SEQ ID NO: 3131095 - DNA, 16 bp, Homo sapiens
tgtgctctcaccagct

SEQ ID NO: 3131096 - DNA, 19 bp, Homo sapiens
tgtgctctggacaggcatg

SEQ ID NO: 3131097 - DNA, 13 bp, Homo sapiens
tgtgctctggagg

SEQ ID NO: 3131098 - DNA, 15 bp, Homo sapiens
tgtgctgacttttta

SEQ ID NO: 3131099 - DNA, 13 bp, Homo sapiens
tgtgctgcttctc

SEQ ID NO: 3131100 - DNA, 18 bp, Homo sapiens
tgtgctggaattctaaca

SEQ ID NO: 3131101 - DNA, 17 bp, Homo sapiens
tgtgctgggagctccac

SEQ ID NO: 3131102 - DNA, 17 bp, Homo sapiens
tgtgctgggttattcag

SEQ ID NO: 3131103 - DNA, 23 bp, Homo sapiens
tgtgctggtgtcctgaccaccct

SEQ ID NO: 3131104 - DNA, 21 bp, Homo sapiens
tgtgctgtgcctgctagagca

SEQ ID NO: 3131105 - DNA, 15 bp, Homo sapiens
tgtgctgtggagaga

SEQ ID NO: 3131106 - DNA, 20 bp, Homo sapiens
tgtgctgtggggctggtagc

SEQ ID NO: 3131107 - DNA, 13 bp, Homo sapiens
tgtgcttatgttt

SEQ ID NO: 3131108 - DNA, 13 bp, Homo sapiens
tgtgcttattttt

SEQ ID NO: 3131109 - DNA, 12 bp, Homo sapiens
tgtgcttctccc

SEQ ID NO: 3131110 - DNA, 19 bp, Homo sapiens
tgtgcttgttttataaaat

SEQ ID NO: 3131111 - DNA, 16 bp, Homo sapiens
tgtgctttgctcttgt

SEQ ID NO: 3131112 - DNA, 14 bp, Homo sapiens
tgtgcttttcctat

SEQ ID NO: 3131113 - DNA, 16 bp, Homo sapiens
tgtgcttttcctattt

SEQ ID NO: 3131114 - DNA, 18 bp, Homo sapiens
tgtggaaaaccaggaaaa

SEQ ID NO: 3131115 - DNA, 17 bp, Homo sapiens
tgtggaaagcacttttt

SEQ ID NO: 3131116 - DNA, 14 bp, Homo sapiens
tgtggaaagcctct

SEQ ID NO: 3131117 - DNA, 15 bp, Homo sapiens
tgtggaaagcctctg

SEQ ID NO: 3131118 - DNA, 16 bp, Homo sapiens
tgtggaaagtgaattt

SEQ ID NO: 3131119 - DNA, 19 bp, Homo sapiens
tgtggaaagtgaatttgaa

SEQ ID NO: 3131120 - DNA, 22 bp, Homo sapiens
tgtggaaagtgaatttgaatga

SEQ ID NO: 3131121 - DNA, 19 bp, Homo sapiens
tgtcttcatttcattgtat

SEQ ID NO: 3131122 - DNA, 16 bp, Homo sapiens
tgtcttccaaggagac

SEQ ID NO: 3131123 - DNA, 24 bp, Homo sapiens
tgtcttccaaggagaccaagtcct

SEQ ID NO: 3131124 - DNA, 15 bp, Homo sapiens
tgtcttccactttgc

SEQ ID NO: 3131125 - DNA, 13 bp, Homo sapiens
tgtcttccataat

SEQ ID NO: 3131126 - DNA, 18 bp, Homo sapiens
tgtcttccatgtgaacag

SEQ ID NO: 3131127 - DNA, 18 bp, Homo sapiens
tgtcttccattccattgt

SEQ ID NO: 3131128 - DNA, 15 bp, Homo sapiens
tgtcttcctagaatt

SEQ ID NO: 3131129 - DNA, 20 bp, Homo sapiens
tgtcttcgctggctcctacc

SEQ ID NO: 3131130 - DNA, 16 bp, Homo sapiens
tgtcttctaactttat

SEQ ID NO: 3131131 - DNA, 23 bp, Homo sapiens
tgtcttctaactttattctttgt

SEQ ID NO: 3131132 - DNA, 20 bp, Homo sapiens
tgtcttctctaacaccttgt

SEQ ID NO: 3131133 - DNA, 22 bp, Homo sapiens
tgtcttctctgtctcagacttt

SEQ ID NO: 3131134 - DNA, 13 bp, Homo sapiens
tgtcttctgcctg

SEQ ID NO: 3131135 - DNA, 13 bp, Homo sapiens
tgtcttctggtct

SEQ ID NO: 3131136 - DNA, 17 bp, Homo sapiens
tgtcttctggtctgtgt

SEQ ID NO: 3131137 - DNA, 16 bp, Homo sapiens
tgtcttcttttgtggt

SEQ ID NO: 3131138 - DNA, 17 bp, Homo sapiens
tgtcttgaatgtctttt

SEQ ID NO: 3131139 - DNA, 15 bp, Homo sapiens
tgtcttgcaacttca

SEQ ID NO: 3131140 - DNA, 19 bp, Homo sapiens
tgtcttgcaacttcagttt

SEQ ID NO: 3131141 - DNA, 15 bp, Homo sapiens
tgtcttgcaatggca

SEQ ID NO: 3131142 - DNA, 13 bp, Homo sapiens
tgtcttggaacat

SEQ ID NO: 3131143 - DNA, 12 bp, Homo sapiens
tgtcttgggcag

SEQ ID NO: 3131144 - DNA, 22 bp, Homo sapiens
tgtcttgggcagagctggctct

SEQ ID NO: 3131145 - DNA, 13 bp, Homo sapiens
tgtcttgtacatg

SEQ ID NO: 3131146 - DNA, 18 bp, Homo sapiens
tgtcttgtacttctgtgt

SEQ ID NO: 3131147 - DNA, 13 bp, Homo sapiens
tgtcttgttctgt

SEQ ID NO: 3131148 - DNA, 15 bp, Homo sapiens
tgtcttgttctgtcc

SEQ ID NO: 3131149 - DNA, 17 bp, Homo sapiens
tgtcttgttctgtccct

SEQ ID NO: 3131150 - DNA, 21 bp, Homo sapiens
tgtcttgttctgtcccttcca

SEQ ID NO: 3131151 - DNA, 22 bp, Homo sapiens
tgtctttaaaaactgttttaga

SEQ ID NO: 3131152 - DNA, 22 bp, Homo sapiens
tgtctttaatttctgtcagaat

SEQ ID NO: 3131153 - DNA, 22 bp, Homo sapiens
tgtctttactggacctgaaatt

SEQ ID NO: 3131154 - DNA, 16 bp, Homo sapiens
tgtctttatagatgta

SEQ ID NO: 3131155 - DNA, 13 bp, Homo sapiens
tgtctttattctt

SEQ ID NO: 3131156 - DNA, 15 bp, Homo sapiens
tgtctttcagataca

SEQ ID NO: 3131157 - DNA, 20 bp, Homo sapiens
tgtctttcagatacatggtt

SEQ ID NO: 3131158 - DNA, 19 bp, Homo sapiens
tgtctttcagcattaggct

SEQ ID NO: 3131159 - DNA, 22 bp, Homo sapiens
tgtctttctttggtgcctttcc

SEQ ID NO: 3131160 - DNA, 15 bp, Homo sapiens
tgtcttttaaaatgc

SEQ ID NO: 3131161 - DNA, 15 bp, Homo sapiens
tgtcttttatatttg

SEQ ID NO: 3131162 - DNA, 23 bp, Homo sapiens
tgtcttttcttggcaaaagcctt

SEQ ID NO: 3131163 - DNA, 23 bp, Homo sapiens
tgtctttttctggactgaagcct

SEQ ID NO: 3131164 - DNA, 15 bp, Homo sapiens
tgtctttttgttgta

SEQ ID NO: 3131165 - DNA, 15 bp, Homo sapiens
tgtgaaaaaataaag

SEQ ID NO: 3131166 - DNA, 21 bp, Homo sapiens
tgtgaaaataaagcagaagca

SEQ ID NO: 3131167 - DNA, 22 bp, Homo sapiens
tgtgaaaataaagcagaagcaa

SEQ ID NO: 3131168 - DNA, 23 bp, Homo sapiens
tgtgaaacaatgttgtccaacaa

SEQ ID NO: 3131169 - DNA, 22 bp, Homo sapiens
tgtgaaaccttttttaagattt

SEQ ID NO: 3131170 - DNA, 14 bp, Homo sapiens
tgtgaaactttcat

SEQ ID NO: 3131171 - DNA, 21 bp, Homo sapiens
tgtgaaagtcagatgcccaga

SEQ ID NO: 3131172 - DNA, 18 bp, Homo sapiens
tgtgaaataaaacaggac

SEQ ID NO: 3131173 - DNA, 13 bp, Homo sapiens
tgtgaaataccac

SEQ ID NO: 3131174 - DNA, 23 bp, Homo sapiens
tgtgaaataccacaagcctgaga

SEQ ID NO: 3131175 - DNA, 12 bp, Homo sapiens
tgtgaaatataa

SEQ ID NO: 3131176 - DNA, 21 bp, Homo sapiens
tgtgaaatcatcaaaaagaaa

SEQ ID NO: 3131177 - DNA, 22 bp, Homo sapiens
tgtgaaatctcagaatttatct

SEQ ID NO: 3131178 - DNA, 19 bp, Homo sapiens
tgtgaaccaccacacccag

SEQ ID NO: 3131179 - DNA, 20 bp, Homo sapiens
tgtgaaccaccacacccagc

SEQ ID NO: 3131180 - DNA, 22 bp, Homo sapiens
tgtgaaccaccacacccagccc

SEQ ID NO: 3131181 - DNA, 20 bp, Homo sapiens
tgtgaactagggaagctcag

SEQ ID NO: 3131182 - DNA, 17 bp, Homo sapiens
tgtgaactgctttcaag

SEQ ID NO: 3131183 - DNA, 19 bp, Homo sapiens
tgtgaactggaagaaagca

SEQ ID NO: 3131184 - DNA, 12 bp, Homo sapiens
tgtgaacttgta

SEQ ID NO: 3131185 - DNA, 15 bp, Homo sapiens
tgtgaacttgtagct

SEQ ID NO: 3131186 - DNA, 10 bp, Homo sapiens
tgtgaagaat

SEQ ID NO: 3131187 - DNA, 19 bp, Homo sapiens
tgtgaagacattttttgct

SEQ ID NO: 3131188 - DNA, 21 bp, Homo sapiens
tgtgaagacattttttgctat

SEQ ID NO: 3131189 - DNA, 22 bp, Homo sapiens
tgtgaagatgatatactatttt

SEQ ID NO: 3131190 - DNA, 13 bp, Homo sapiens
tgtgaagcatgct

SEQ ID NO: 3131191 - DNA, 19 bp, Homo sapiens
tgtgaagcatgctttgctg

SEQ ID NO: 3131192 - DNA, 15 bp, Homo sapiens
tgtgaagcatttaca

SEQ ID NO: 3131193 - DNA, 12 bp, Homo sapiens
tgtgaaggccca

SEQ ID NO: 3131194 - DNA, 15 bp, Homo sapiens
tgtgaagtattcaca

SEQ ID NO: 3131195 - DNA, 12 bp, Homo sapiens
tgtgaatacaat

SEQ ID NO: 3131196 - DNA, 15 bp, Homo sapiens
tgtgaatacaattaa

SEQ ID NO: 3131197 - DNA, 15 bp, Homo sapiens
tgtgaatagatttta

SEQ ID NO: 3131198 - DNA, 19 bp, Homo sapiens
tgtgaatgattcatgttat

SEQ ID NO: 3131199 - DNA, 13 bp, Homo sapiens
tgtgaatggaggc

SEQ ID NO: 3131200 - DNA, 14 bp, Homo sapiens
tgtgaatggaggca

SEQ ID NO: 3131201 - DNA, 13 bp, Homo sapiens
tgtgaatggattg

SEQ ID NO: 3131202 - DNA, 12 bp, Homo sapiens
tgtgaatgtggg

SEQ ID NO: 3131203 - DNA, 15 bp, Homo sapiens
tgtgaatgtgggcac

SEQ ID NO: 3131204 - DNA, 18 bp, Homo sapiens
tgtgaatgtgggcactgg

SEQ ID NO: 3131205 - DNA, 24 bp, Homo sapiens
tgtgaattaggctgtaactacttt

SEQ ID NO: 3131206 - DNA, 18 bp, Homo sapiens
tgtgaattgcatgacttg

SEQ ID NO: 3131207 - DNA, 13 bp, Homo sapiens
tgtgacaaaggat

SEQ ID NO: 3131208 - DNA, 21 bp, Homo sapiens
tgtgacaattctgtttttaat

SEQ ID NO: 3131209 - DNA, 19 bp, Homo sapiens
tgtgacaattttgtacaaa

SEQ ID NO: 3131210 - DNA, 23 bp, Homo sapiens
tgtgacacccacaatcccaccta

SEQ ID NO: 3131211 - DNA, 16 bp, Homo sapiens
tgtgacacctaactct

SEQ ID NO: 3131212 - DNA, 23 bp, Homo sapiens
tgtgacaggaaagccctccccct

SEQ ID NO: 3131213 - DNA, 14 bp, Homo sapiens
tgtgacagggccag

SEQ ID NO: 3131214 - DNA, 18 bp, Homo sapiens
tgtgacatttatatattg

SEQ ID NO: 3131215 - DNA, 15 bp, Homo sapiens
tgtgaccaaaatacc

SEQ ID NO: 3131216 - DNA, 13 bp, Homo sapiens
tgtgaccaactgt

SEQ ID NO: 3131217 - DNA, 17 bp, Homo sapiens
tgtgaccaactgtgttg

SEQ ID NO: 3131218 - DNA, 21 bp, Homo sapiens
tgtgaccatcatttcccaggc

SEQ ID NO: 3131219 - DNA, 16 bp, Homo sapiens
tgtgaccatgttcatt

SEQ ID NO: 3131220 - DNA, 18 bp, Homo sapiens
tgtgacccaccagtgcct

SEQ ID NO: 3131221 - DNA, 19 bp, Homo sapiens
tgtgacccaccagtgcctt

SEQ ID NO: 3131222 - DNA, 12 bp, Homo sapiens
tgtgactagaaa

SEQ ID NO: 3131223 - DNA, 22 bp, Homo sapiens
tgtgactatatagagatgtttt

SEQ ID NO: 3131224 - DNA, 20 bp, Homo sapiens
tgtgactgaaggggcacacc

SEQ ID NO: 3131225 - DNA, 23 bp, Homo sapiens
tgtgactggcaagaggcctcatg

SEQ ID NO: 3131226 - DNA, 19 bp, Homo sapiens
tgtgacttcagctctgttt

SEQ ID NO: 3131227 - DNA, 15 bp, Homo sapiens
tgtgacttttctgat

SEQ ID NO: 3131228 - DNA, 12 bp, Homo sapiens
tgtgactttttt

SEQ ID NO: 3131229 - DNA, 17 bp, Homo sapiens
tgtgagaagtgccttct

SEQ ID NO: 3131230 - DNA, 14 bp, Homo sapiens
tgtgagaatcaaaa

SEQ ID NO: 3131231 - DNA, 18 bp, Homo sapiens
tgtgagacccccacacct

SEQ ID NO: 3131232 - DNA, 16 bp, Homo sapiens
tgtgagaggtttgact

SEQ ID NO: 3131233 - DNA, 22 bp, Homo sapiens
tgtgagatccttcacaggcagt

SEQ ID NO: 3131234 - DNA, 22 bp, Homo sapiens
tgtgagatgctagaactccctt

SEQ ID NO: 3131235 - DNA, 12 bp, Homo sapiens
tgtgagcagtgg

SEQ ID NO: 3131236 - DNA, 20 bp, Homo sapiens
tgtgagcagtggacacgtga

SEQ ID NO: 3131237 - DNA, 16 bp, Homo sapiens
tgtgagccaccgctgc

SEQ ID NO: 3131238 - DNA, 14 bp, Homo sapiens
tgtgagcctatgat

SEQ ID NO: 3131239 - DNA, 14 bp, Homo sapiens
tgtgagccttggct

SEQ ID NO: 3131240 - DNA, 15 bp, Homo sapiens
tgtgagcgccttggt

SEQ ID NO: 3131241 - DNA, 17 bp, Homo sapiens
tgtgagcgccttggtat

SEQ ID NO: 3131242 - DNA, 16 bp, Homo sapiens
tgtgagctatgcaaac

SEQ ID NO: 3131243 - DNA, 15 bp, Homo sapiens
tgtgagctcttccta

SEQ ID NO: 3131244 - DNA, 18 bp, Homo sapiens
tgtgagctttttttaaat

SEQ ID NO: 3131245 - DNA, 19 bp, Homo sapiens
tgtgaggaagtgtggaaaa

SEQ ID NO: 3131246 - DNA, 13 bp, Homo sapiens
tgtgaggagctgc

SEQ ID NO: 3131247 - DNA, 17 bp, Homo sapiens
tgtgaggaggaaaagga

SEQ ID NO: 3131248 - DNA, 15 bp, Homo sapiens
tgtgagggtgctgac

SEQ ID NO: 3131249 - DNA, 19 bp, Homo sapiens
tgtcagagaaaatgaattt

SEQ ID NO: 3131250 - DNA, 21 bp, Homo sapiens
tgtcagatattttttcagaaa

SEQ ID NO: 3131251 - DNA, 20 bp, Homo sapiens
tgtcagatgagaacaaagct

SEQ ID NO: 3131252 - DNA, 21 bp, Homo sapiens
tgtcagatgcgtgcccagctc

SEQ ID NO: 3131253 - DNA, 14 bp, Homo sapiens
tgtcagattaaatt

SEQ ID NO: 3131254 - DNA, 16 bp, Homo sapiens
tgtcagattaaattac

SEQ ID NO: 3131255 - DNA, 19 bp, Homo sapiens
tgtcagattaaattacagc

SEQ ID NO: 3131256 - DNA, 17 bp, Homo sapiens
tgtcagattcctttccc

SEQ ID NO: 3131257 - DNA, 11 bp, Homo sapiens
tgtcagccagc

SEQ ID NO: 3131258 - DNA, 15 bp, Homo sapiens
tgtcagccagccgcc

SEQ ID NO: 3131259 - DNA, 17 bp, Homo sapiens
tgtcagccagccgccct

SEQ ID NO: 3131260 - DNA, 22 bp, Homo sapiens
tgtcagccgagccgggcctggg

SEQ ID NO: 3131261 - DNA, 13 bp, Homo sapiens
tgtcctccctcca

SEQ ID NO: 3131262 - DNA, 22 bp, Homo sapiens
tgtcctctcccctccagccttt

SEQ ID NO: 3131263 - DNA, 18 bp, Homo sapiens
tgtcctctccctgccaag

SEQ ID NO: 3131264 - DNA, 13 bp, Homo sapiens
tgtcctcttccct

SEQ ID NO: 3131265 - DNA, 16 bp, Homo sapiens
tgtcctcttccctctc

SEQ ID NO: 3131266 - DNA, 22 bp, Homo sapiens
tgtcctctttactcccttcctg

SEQ ID NO: 3131267 - DNA, 15 bp, Homo sapiens
tgtcctgaccaccct

SEQ ID NO: 3131268 - DNA, 16 bp, Homo sapiens
tgtcctgaccaccctc

SEQ ID NO: 3131269 - DNA, 19 bp, Homo sapiens
tgtcctgaccaccctcccc

SEQ ID NO: 3131270 - DNA, 22 bp, Homo sapiens
tgtcctgaccaccctcccctct

SEQ ID NO: 3131271 - DNA, 23 bp, Homo sapiens
tgtcctgaccaccctcccctctc

SEQ ID NO: 3131272 - DNA, 20 bp, Homo sapiens
tgtcctgatggtcagctccc

SEQ ID NO: 3131273 - DNA, 15 bp, Homo sapiens
tgtcctgatttctac

SEQ ID NO: 3131274 - DNA, 18 bp, Homo sapiens
tgtcctgcagcaaacact

SEQ ID NO: 3131275 - DNA, 13 bp, Homo sapiens
tgtcctgccagct

SEQ ID NO: 3131276 - DNA, 22 bp, Homo sapiens
tgtcctgccagctgccttcctc

SEQ ID NO: 3131277 - DNA, 22 bp, Homo sapiens
tgtcctgcctgcaatatttgaa

SEQ ID NO: 3131278 - DNA, 16 bp, Homo sapiens
tgtcctgctggcttcc

SEQ ID NO: 3131279 - DNA, 19 bp, Homo sapiens
tgtcctgctggcttccagc

SEQ ID NO: 3131280 - DNA, 12 bp, Homo sapiens
tgtcctgggagt

SEQ ID NO: 3131281 - DNA, 19 bp, Homo sapiens
tgtcctgggagtgagctgg

SEQ ID NO: 3131282 - DNA, 15 bp, Homo sapiens
tgtcctgtaaaggtt

SEQ ID NO: 3131283 - DNA, 18 bp, Homo sapiens
tgtccttagaacatttta

SEQ ID NO: 3131284 - DNA, 16 bp, Homo sapiens
tgtccttccctgcatt

SEQ ID NO: 3131285 - DNA, 22 bp, Homo sapiens
tgtccttccctgcatttctgag

SEQ ID NO: 3131286 - DNA, 15 bp, Homo sapiens
tgtccttgtgtgttt

SEQ ID NO: 3131287 - DNA, 16 bp, Homo sapiens
tgtcctttaaaaaaga

SEQ ID NO: 3131288 - DNA, 14 bp, Homo sapiens
tgtcctttcccctc

SEQ ID NO: 3131289 - DNA, 17 bp, Homo sapiens
tgtcctttcccctctct

SEQ ID NO: 3131290 - DNA, 22 bp, Homo sapiens
tgtcctttcccctctctgcccc

SEQ ID NO: 3131291 - DNA, 20 bp, Homo sapiens
tgtccttttatttctccatc

SEQ ID NO: 3131292 - DNA, 20 bp, Homo sapiens
tgtcgaaaagagtcttccaa

SEQ ID NO: 3131293 - DNA, 22 bp, Homo sapiens
tgtcgattaaaatcactctcag

SEQ ID NO: 3131294 - DNA, 13 bp, Homo sapiens
tgtcgcctctgca

SEQ ID NO: 3131295 - DNA, 15 bp, Homo sapiens
tgtcgctcatgtgtg

SEQ ID NO: 3131296 - DNA, 14 bp, Homo sapiens
tgtcggagaggctg

SEQ ID NO: 3131297 - DNA, 16 bp, Homo sapiens
tgtcgtaggtaaacta

SEQ ID NO: 3131298 - DNA, 14 bp, Homo sapiens
tgtcgtctgtgaat

SEQ ID NO: 3131299 - DNA, 15 bp, Homo sapiens
tgtcgtttttattcc

SEQ ID NO: 3131300 - DNA, 20 bp, Homo sapiens
tgtctaaacaatgctgattt

SEQ ID NO: 3131301 - DNA, 22 bp, Homo sapiens
tgtctaaacaatgctgatttgg

SEQ ID NO: 3131302 - DNA, 14 bp, Homo sapiens
tgtctaagatagta

SEQ ID NO: 3131303 - DNA, 15 bp, Homo sapiens
tgtctaagattctag

SEQ ID NO: 3131304 - DNA, 18 bp, Homo sapiens
tgtctaagattctagatc

SEQ ID NO: 3131305 - DNA, 15 bp, Homo sapiens
tgtctacaaatataa

SEQ ID NO: 3131306 - DNA, 21 bp, Homo sapiens
tgtctacaaatataagatttt

SEQ ID NO: 3131307 - DNA, 16 bp, Homo sapiens
tgtctactgtggtgat

SEQ ID NO: 3131308 - DNA, 19 bp, Homo sapiens
tgtctaggtctcctcaggg

SEQ ID NO: 3131309 - DNA, 20 bp, Homo sapiens
tgtctaggtctcctcagggt

SEQ ID NO: 3131310 - DNA, 19 bp, Homo sapiens
tgtctagtttcccacattc

SEQ ID NO: 3131311 - DNA, 16 bp, Homo sapiens
tgtctatgggactcaa

SEQ ID NO: 3131312 - DNA, 19 bp, Homo sapiens
tgtctattcaaaatatcaa

SEQ ID NO: 3131313 - DNA, 14 bp, Homo sapiens
tgtctattcagctt

SEQ ID NO: 3131314 - DNA, 19 bp, Homo sapiens
tgtctattctgagccttga

SEQ ID NO: 3131315 - DNA, 11 bp, Homo sapiens
tgtctatttta

SEQ ID NO: 3131316 - DNA, 15 bp, Homo sapiens
tgtctattttaaaat

SEQ ID NO: 3131317 - DNA, 16 bp, Homo sapiens
tgtctattttaaaata

SEQ ID NO: 3131318 - DNA, 22 bp, Homo sapiens
tgtctattttaaaataaattag

SEQ ID NO: 3131319 - DNA, 20 bp, Homo sapiens
tgtctatttttaatgtttgt

SEQ ID NO: 3131320 - DNA, 23 bp, Homo sapiens
tgtctcaagagggcactggtggc

SEQ ID NO: 3131321 - DNA, 17 bp, Homo sapiens
tgtctcactgaaacatt

SEQ ID NO: 3131322 - DNA, 17 bp, Homo sapiens
tgtctcactgttctgca

SEQ ID NO: 3131323 - DNA, 14 bp, Homo sapiens
tgtctcagactttt

SEQ ID NO: 3131324 - DNA, 16 bp, Homo sapiens
tgtctcagttggaaat

SEQ ID NO: 3131325 - DNA, 13 bp, Homo sapiens
tgtctcatcccca

SEQ ID NO: 3131326 - DNA, 23 bp, Homo sapiens
tgtctcatccccaggggtcccag

SEQ ID NO: 3131327 - DNA, 13 bp, Homo sapiens
tgtctccactgtg

SEQ ID NO: 3131328 - DNA, 14 bp, Homo sapiens
tgtctccactgtgc

SEQ ID NO: 3131329 - DNA, 16 bp, Homo sapiens
tgtctcctactcctga

SEQ ID NO: 3131330 - DNA, 17 bp, Homo sapiens
tgtctccttaagctgca

SEQ ID NO: 3131331 - DNA, 21 bp, Homo sapiens
tgtctccttaagctgcagaga

SEQ ID NO: 3131332 - DNA, 13 bp, Homo sapiens
tgtctcctttgct

SEQ ID NO: 3131333 - DNA, 15 bp, Homo sapiens
tgtctctaacttatt

SEQ ID NO: 3131334 - DNA, 19 bp, Homo sapiens
tgtctctacaaaaaataaa

SEQ ID NO: 3131335 - DNA, 15 bp, Homo sapiens
tgtctctcccacccc

SEQ ID NO: 3131336 - DNA, 15 bp, Homo sapiens
tgtctctccttttct

SEQ ID NO: 3131337 - DNA, 21 bp, Homo sapiens
tgtctctcttcagactctcag

SEQ ID NO: 3131338 - DNA, 13 bp, Homo sapiens
tgtctctgaggac

SEQ ID NO: 3131339 - DNA, 13 bp, Homo sapiens
tgtctctggggca

SEQ ID NO: 3131340 - DNA, 20 bp, Homo sapiens
tgtctcttaaaaaaataaaa

SEQ ID NO: 3131341 - DNA, 17 bp, Homo sapiens
tgtctcttgagtttgtc

SEQ ID NO: 3131342 - DNA, 14 bp, Homo sapiens
tgtctcttgtagaa

SEQ ID NO: 3131343 - DNA, 15 bp, Homo sapiens
tgtctcttgtagaag

SEQ ID NO: 3131344 - DNA, 22 bp, Homo sapiens
tgtctctttaagggcatgcctt

SEQ ID NO: 3131345 - DNA, 16 bp, Homo sapiens
tgtctcttttctcttt

SEQ ID NO: 3131346 - DNA, 12 bp, Homo sapiens
tgtctgaaaaat

SEQ ID NO: 3131347 - DNA, 18 bp, Homo sapiens
tgtctgaagtcactgcac

SEQ ID NO: 3131348 - DNA, 22 bp, Homo sapiens
tgtctgactcaggcgcctggca

SEQ ID NO: 3131349 - DNA, 13 bp, Homo sapiens
tgtctgaggcctc

SEQ ID NO: 3131350 - DNA, 16 bp, Homo sapiens
tgtctgattggcttgt

SEQ ID NO: 3131351 - DNA, 15 bp, Homo sapiens
tgtctgcattgttat

SEQ ID NO: 3131352 - DNA, 15 bp, Homo sapiens
tgtctgccctctggg

SEQ ID NO: 3131353 - DNA, 23 bp, Homo sapiens
tgtctgccctctgggtccctcct

SEQ ID NO: 3131354 - DNA, 21 bp, Homo sapiens
tgtctgctaggcgctggggag

SEQ ID NO: 3131355 - DNA, 14 bp, Homo sapiens
tgtctgctctcatc

SEQ ID NO: 3131356 - DNA, 21 bp, Homo sapiens
tgtctgctttaaagggcctgc

SEQ ID NO: 3131357 - DNA, 23 bp, Homo sapiens
tgtctggaaacctgtcattgtat

SEQ ID NO: 3131358 - DNA, 15 bp, Homo sapiens
tgtctggccaggcct

SEQ ID NO: 3131359 - DNA, 23 bp, Homo sapiens
tgtctggctgaggatttcaagcc

SEQ ID NO: 3131360 - DNA, 14 bp, Homo sapiens
tgtctggtggcccc

SEQ ID NO: 3131361 - DNA, 16 bp, Homo sapiens
tgtctggttttaacaa

SEQ ID NO: 3131362 - DNA, 21 bp, Homo sapiens
tgtctgtacacgtgtcctgta

SEQ ID NO: 3131363 - DNA, 11 bp, Homo sapiens
tgtctgtcacc

SEQ ID NO: 3131364 - DNA, 16 bp, Homo sapiens
tgtctgtcccggggtc

SEQ ID NO: 3131365 - DNA, 17 bp, Homo sapiens
tgtctgtctacatttct

SEQ ID NO: 3131366 - DNA, 14 bp, Homo sapiens
tgtctgtctggcac

SEQ ID NO: 3131367 - DNA, 14 bp, Homo sapiens
tgtctgtgttgctg

SEQ ID NO: 3131368 - DNA, 23 bp, Homo sapiens
tgtctgttaccatgtcactgtgg

SEQ ID NO: 3131369 - DNA, 20 bp, Homo sapiens
tgtctgttctgcacaataaa

SEQ ID NO: 3131370 - DNA, 15 bp, Homo sapiens
tgtctgtttttgtat

SEQ ID NO: 3131371 - DNA, 13 bp, Homo sapiens
tgtcttatatata

SEQ ID NO: 3131372 - DNA, 16 bp, Homo sapiens
tgtcttatctggccct

SEQ ID NO: 3131373 - DNA, 14 bp, Homo sapiens
tgtcttattcttaa

SEQ ID NO: 3131374 - DNA, 15 bp, Homo sapiens
tgtcttattgaaaaa

SEQ ID NO: 3131375 - DNA, 15 bp, Homo sapiens
tgtcttatttttaga

SEQ ID NO: 3131376 - DNA, 16 bp, Homo sapiens
tgtcttatttttagat

SEQ ID NO: 3131377 - DNA, 17 bp, Homo sapiens
tgtcttatttttagatg

SEQ ID NO: 3131378 - DNA, 16 bp, Homo sapiens
tgtcttcaaactgtga

SEQ ID NO: 3131379 - DNA, 15 bp, Homo sapiens
tgtcttcacctgcca

SEQ ID NO: 3131380 - DNA, 16 bp, Homo sapiens
tgtcttcacctgccac

SEQ ID NO: 3131381 - DNA, 18 bp, Homo sapiens
tgtcttcacctgccacca

SEQ ID NO: 3131382 - DNA, 22 bp, Homo sapiens
tgtcttcagcagtcaatacaaa

SEQ ID NO: 3131383 - DNA, 17 bp, Homo sapiens
tgtcttcataaagtact

SEQ ID NO: 3131384 - DNA, 16 bp, Homo sapiens
tggtggggatattttt

SEQ ID NO: 3131385 - DNA, 14 bp, Homo sapiens
tggtggggccaggc

SEQ ID NO: 3131386 - DNA, 24 bp, Homo sapiens
tggtggggccaggccaggaccaca

SEQ ID NO: 3131387 - DNA, 19 bp, Homo sapiens
tggtgggttcaggggactc

SEQ ID NO: 3131388 - DNA, 22 bp, Homo sapiens
tggtgggttgaatatagcctgc

SEQ ID NO: 3131389 - DNA, 23 bp, Homo sapiens
tggtgggttgaatatagcctgcc

SEQ ID NO: 3131390 - DNA, 18 bp, Homo sapiens
tggtggtactttattctt

SEQ ID NO: 3131391 - DNA, 15 bp, Homo sapiens
tggtggtcagatgca

SEQ ID NO: 3131392 - DNA, 12 bp, Homo sapiens
tggtggtgggga

SEQ ID NO: 3131393 - DNA, 21 bp, Homo sapiens
tggtggttcctttgcaccctg

SEQ ID NO: 3131394 - DNA, 16 bp, Homo sapiens
tggtggtttttgctct

SEQ ID NO: 3131395 - DNA, 16 bp, Homo sapiens
tggtgtaaagctggcc

SEQ ID NO: 3131396 - DNA, 19 bp, Homo sapiens
tggtgtaaagctggccctg

SEQ ID NO: 3131397 - DNA, 20 bp, Homo sapiens
tggtgtaaagctggccctgc

SEQ ID NO: 3131398 - DNA, 15 bp, Homo sapiens
tggtgtagaacacta

SEQ ID NO: 3131399 - DNA, 21 bp, Homo sapiens
tggtgtatttttcaggtaggc

SEQ ID NO: 3131400 - DNA, 20 bp, Homo sapiens
tggtgtcacttactgtttct

SEQ ID NO: 3131401 - DNA, 19 bp, Homo sapiens
tggtgtcctgaccaccctc

SEQ ID NO: 3131402 - DNA, 16 bp, Homo sapiens
tggtgtgaacccggga

SEQ ID NO: 3131403 - DNA, 17 bp, Homo sapiens
tggtgtgaacccgggag

SEQ ID NO: 3131404 - DNA, 19 bp, Homo sapiens
tggtgtgaccatgttcatt

SEQ ID NO: 3131405 - DNA, 22 bp, Homo sapiens
tggtgtgtcccattggtgttgt

SEQ ID NO: 3131406 - DNA, 15 bp, Homo sapiens
tggtgtgtccctgga

SEQ ID NO: 3131407 - DNA, 21 bp, Homo sapiens
tggtgttacacagcccaagag

SEQ ID NO: 3131408 - DNA, 13 bp, Homo sapiens
tggtgttcctgga

SEQ ID NO: 3131409 - DNA, 17 bp, Homo sapiens
tggtgttcctggaagca

SEQ ID NO: 3131410 - DNA, 20 bp, Homo sapiens
tggtgttcctggaagcaggt

SEQ ID NO: 3131411 - DNA, 15 bp, Homo sapiens
tggtgtttgtctgtg

SEQ ID NO: 3131412 - DNA, 13 bp, Homo sapiens
tggttaagagtcc

SEQ ID NO: 3131413 - DNA, 14 bp, Homo sapiens
tggttaagagtcca

SEQ ID NO: 3131414 - DNA, 15 bp, Homo sapiens
tggttaataaaactg

SEQ ID NO: 3131415 - DNA, 17 bp, Homo sapiens
tggttaatctttcctga

SEQ ID NO: 3131416 - DNA, 14 bp, Homo sapiens
tggttacactgtta

SEQ ID NO: 3131417 - DNA, 21 bp, Homo sapiens
tggttacactgttagaacact

SEQ ID NO: 3131418 - DNA, 14 bp, Homo sapiens
tggttactcagggt

SEQ ID NO: 3131419 - DNA, 22 bp, Homo sapiens
tggttactcagggttcatctgt

SEQ ID NO: 3131420 - DNA, 14 bp, Homo sapiens
tggttagaaatgca

SEQ ID NO: 3131421 - DNA, 14 bp, Homo sapiens
tgtagtaattgaca

SEQ ID NO: 3131422 - DNA, 15 bp, Homo sapiens
tgtagtaattgacat

SEQ ID NO: 3131423 - DNA, 18 bp, Homo sapiens
tgtagtaattgacatgtg

SEQ ID NO: 3131424 - DNA, 18 bp, Homo sapiens
tgtagtagccctttctgt

SEQ ID NO: 3131425 - DNA, 18 bp, Homo sapiens
tgtagtattttttgtata

SEQ ID NO: 3131426 - DNA, 15 bp, Homo sapiens
tgtagtcaataaaac

SEQ ID NO: 3131427 - DNA, 14 bp, Homo sapiens
tgtagtcatttact

SEQ ID NO: 3131428 - DNA, 15 bp, Homo sapiens
tgtagtcatttacta

SEQ ID NO: 3131429 - DNA, 19 bp, Homo sapiens
tgtagtcatttactaaaca

SEQ ID NO: 3131430 - DNA, 17 bp, Homo sapiens
tgtagtcctcataaaaa

SEQ ID NO: 3131431 - DNA, 17 bp, Homo sapiens
tgtagtcctttctgcct

SEQ ID NO: 3131432 - DNA, 14 bp, Homo sapiens
tgtagttaatttat

SEQ ID NO: 3131433 - DNA, 17 bp, Homo sapiens
tgtagttaatttatcta

SEQ ID NO: 3131434 - DNA, 18 bp, Homo sapiens
tgtagttacctactgagt

SEQ ID NO: 3131435 - DNA, 13 bp, Homo sapiens
tgtagttaggaaa

SEQ ID NO: 3131436 - DNA, 14 bp, Homo sapiens
tgtagttaggaaat

SEQ ID NO: 3131437 - DNA, 23 bp, Homo sapiens
tgtagttaggaaataaaaccttt

SEQ ID NO: 3131438 - DNA, 13 bp, Homo sapiens
tgtagttctaaga

SEQ ID NO: 3131439 - DNA, 15 bp, Homo sapiens
tgtagttctaagact

SEQ ID NO: 3131440 - DNA, 15 bp, Homo sapiens
tgtagttctgccagg

SEQ ID NO: 3131441 - DNA, 15 bp, Homo sapiens
tgtagttgacataaa

SEQ ID NO: 3131442 - DNA, 22 bp, Homo sapiens
tgtagttgtcacactaaaattt

SEQ ID NO: 3131443 - DNA, 19 bp, Homo sapiens
tgtagtttacctctttaaa

SEQ ID NO: 3131444 - DNA, 20 bp, Homo sapiens
tgtagtttttatatgttgta

SEQ ID NO: 3131445 - DNA, 15 bp, Homo sapiens
tgtataaaaacatga

SEQ ID NO: 3131446 - DNA, 18 bp, Homo sapiens
tgtataaaagtgtgaaat

SEQ ID NO: 3131447 - DNA, 13 bp, Homo sapiens
tgtataaaataga

SEQ ID NO: 3131448 - DNA, 20 bp, Homo sapiens
tgtataaacattaaatgtct

SEQ ID NO: 3131449 - DNA, 13 bp, Homo sapiens
tgtataaagaaca

SEQ ID NO: 3131450 - DNA, 12 bp, Homo sapiens
tgtataaagatt

SEQ ID NO: 3131451 - DNA, 14 bp, Homo sapiens
tgtataaagattgt

SEQ ID NO: 3131452 - DNA, 21 bp, Homo sapiens
tgtataaatctttcttttgat

SEQ ID NO: 3131453 - DNA, 11 bp, Homo sapiens
tgtataaatgt

SEQ ID NO: 3131454 - DNA, 16 bp, Homo sapiens
tgtataaatgtatata

SEQ ID NO: 3131455 - DNA, 15 bp, Homo sapiens
tgtataaattgtctt

SEQ ID NO: 3131456 - DNA, 18 bp, Homo sapiens
tgtataaccaagtgtgct

SEQ ID NO: 3131457 - DNA, 20 bp, Homo sapiens
tgtataaccaagtgtgctct

SEQ ID NO: 3131458 - DNA, 16 bp, Homo sapiens
tgtataagtcaagcac

SEQ ID NO: 3131459 - DNA, 17 bp, Homo sapiens
tgtataagtcaagcaca

SEQ ID NO: 3131460 - DNA, 16 bp, Homo sapiens
tgtataagtgcacaca

SEQ ID NO: 3131461 - DNA, 18 bp, Homo sapiens
tgtataagtgcacacaga

SEQ ID NO: 3131462 - DNA, 23 bp, Homo sapiens
tgtataagtgcacacagaaatat

SEQ ID NO: 3131463 - DNA, 20 bp, Homo sapiens
tgtataagtggaggcacttt

SEQ ID NO: 3131464 - DNA, 23 bp, Homo sapiens
tgtataagttatttttgtacatg

SEQ ID NO: 3131465 - DNA, 22 bp, Homo sapiens
tgtataatattgaaaattgaaa

SEQ ID NO: 3131466 - DNA, 20 bp, Homo sapiens
tgtataatcccacccacctc

SEQ ID NO: 3131467 - DNA, 21 bp, Homo sapiens
tgtataattggatttcctaat

SEQ ID NO: 3131468 - DNA, 12 bp, Homo sapiens
tgtataatttcg

SEQ ID NO: 3131469 - DNA, 16 bp, Homo sapiens
tgtatacaaatatatt

SEQ ID NO: 3131470 - DNA, 16 bp, Homo sapiens
tgtatacattttgtta

SEQ ID NO: 3131471 - DNA, 17 bp, Homo sapiens
tgtatacattttgttat

SEQ ID NO: 3131472 - DNA, 18 bp, Homo sapiens
tgtatacattttgttata

SEQ ID NO: 3131473 - DNA, 22 bp, Homo sapiens
tgtatacattttgttatagaat

SEQ ID NO: 3131474 - DNA, 11 bp, Homo sapiens
tgtatacttta

SEQ ID NO: 3131475 - DNA, 18 bp, Homo sapiens
tgtataggtagatccaga

SEQ ID NO: 3131476 - DNA, 19 bp, Homo sapiens
tgtatagtgcctaaaattg

SEQ ID NO: 3131477 - DNA, 17 bp, Homo sapiens
tgtatataagttgctgt

SEQ ID NO: 3131478 - DNA, 13 bp, Homo sapiens
tgtatatacacat

SEQ ID NO: 3131479 - DNA, 18 bp, Homo sapiens
tgtatatacacatatacc

SEQ ID NO: 3131480 - DNA, 13 bp, Homo sapiens
tgtatatacagtt

SEQ ID NO: 3131481 - DNA, 17 bp, Homo sapiens
tgtatatacagttattt

SEQ ID NO: 3131482 - DNA, 15 bp, Homo sapiens
tgtatatacatatat

SEQ ID NO: 3131483 - DNA, 17 bp, Homo sapiens
tgtatatacgcatctat

SEQ ID NO: 3131484 - DNA, 21 bp, Homo sapiens
tgtatatacgcatctataaat

SEQ ID NO: 3131485 - DNA, 12 bp, Homo sapiens
tgtatatacttt

SEQ ID NO: 3131486 - DNA, 20 bp, Homo sapiens
tgtatatattttgtgtgaaa

SEQ ID NO: 3131487 - DNA, 22 bp, Homo sapiens
tgtatatccttccaaaaaatta

SEQ ID NO: 3131488 - DNA, 18 bp, Homo sapiens
tgtatatcctttctaaca

SEQ ID NO: 3131489 - DNA, 21 bp, Homo sapiens
tgtatatctcttggaaaataa

SEQ ID NO: 3131490 - DNA, 14 bp, Homo sapiens
tgtatatgaaaaca

SEQ ID NO: 3131491 - DNA, 15 bp, Homo sapiens
tgtatatgaaaacaa

SEQ ID NO: 3131492 - DNA, 23 bp, Homo sapiens
tgtatatgaaaacaagttccaaa

SEQ ID NO: 3131493 - DNA, 13 bp, Homo sapiens
tgtatatgtttat

SEQ ID NO: 3131494 - DNA, 24 bp, Homo sapiens
tgtatattatttggcagtttggta

SEQ ID NO: 3131495 - DNA, 21 bp, Homo sapiens
tgtatattgtggatgtgttca

SEQ ID NO: 3131496 - DNA, 20 bp, Homo sapiens
tgtatatttattcataatga

SEQ ID NO: 3131497 - DNA, 14 bp, Homo sapiens
tgtatatttgtaca

SEQ ID NO: 3131498 - DNA, 21 bp, Homo sapiens
tgtatatttgtgatagcactt

SEQ ID NO: 3131499 - DNA, 19 bp, Homo sapiens
tgtatatttttatattgtt

SEQ ID NO: 3131500 - DNA, 22 bp, Homo sapiens
tgtatatttttatctatataaa

SEQ ID NO: 3131501 - DNA, 17 bp, Homo sapiens
tgtatcaaacccacgat

SEQ ID NO: 3131502 - DNA, 19 bp, Homo sapiens
tgtatcagaagagagggga

SEQ ID NO: 3131503 - DNA, 14 bp, Homo sapiens
tgtatcaggtcagg

SEQ ID NO: 3131504 - DNA, 17 bp, Homo sapiens
tgtatcaggtcagggac

SEQ ID NO: 3131505 - DNA, 15 bp, Homo sapiens
tgtatcatagaaatg

SEQ ID NO: 3131506 - DNA, 17 bp, Homo sapiens
tgtatcatagaaatgta

SEQ ID NO: 3131507 - DNA, 16 bp, Homo sapiens
tgtatcccatgagcct

SEQ ID NO: 3131508 - DNA, 20 bp, Homo sapiens
tgtatcccttctcacagcac

SEQ ID NO: 3131509 - DNA, 19 bp, Homo sapiens
tgtatccgactctaagctg

SEQ ID NO: 3131510 - DNA, 21 bp, Homo sapiens
tgtatccgactctaagctgtg

SEQ ID NO: 3131511 - DNA, 22 bp, Homo sapiens
tgtatccgactctaagctgtgt

SEQ ID NO: 3131512 - DNA, 24 bp, Homo sapiens
tgtatccgactctaagctgtgtgc

SEQ ID NO: 3131513 - DNA, 19 bp, Homo sapiens
tgtatcgatgttttattat

SEQ ID NO: 3131514 - DNA, 16 bp, Homo sapiens
tgtatcgcatattagt

SEQ ID NO: 3131515 - DNA, 15 bp, Homo sapiens
tgtatctaagaataa

SEQ ID NO: 3131516 - DNA, 20 bp, Homo sapiens
tgtatctaagaataataaaa

SEQ ID NO: 3131517 - DNA, 21 bp, Homo sapiens
tgtatctagtgcagctgattt

SEQ ID NO: 3131518 - DNA, 21 bp, Homo sapiens
tgtatctctgaagcatgtttc

SEQ ID NO: 3131519 - DNA, 14 bp, Homo sapiens
tgtatctcttaaag

SEQ ID NO: 3131520 - DNA, 16 bp, Homo sapiens
tgtatctgagttgcca

SEQ ID NO: 3131521 - DNA, 19 bp, Homo sapiens
tgtatctgagttgccaaga

SEQ ID NO: 3131522 - DNA, 14 bp, Homo sapiens
tgtatctgctggat

SEQ ID NO: 3131523 - DNA, 16 bp, Homo sapiens
tgtatcttcctttctt

SEQ ID NO: 3131524 - DNA, 19 bp, Homo sapiens
tgtatcttcctttcttgtc

SEQ ID NO: 3131525 - DNA, 21 bp, Homo sapiens
tgtatcttggggcaagactgc

SEQ ID NO: 3131526 - DNA, 21 bp, Homo sapiens
tgtatgaaaaattggggagga

SEQ ID NO: 3131527 - DNA, 20 bp, Homo sapiens
tgtatgaactttatctaaag

SEQ ID NO: 3131528 - DNA, 20 bp, Homo sapiens
tggccacctgaggtgggccc

SEQ ID NO: 3131529 - DNA, 17 bp, Homo sapiens
tggccactccagacccc

SEQ ID NO: 3131530 - DNA, 20 bp, Homo sapiens
tggccactgcacagagctct

SEQ ID NO: 3131531 - DNA, 21 bp, Homo sapiens
tggccacttgggtcttccctg

SEQ ID NO: 3131532 - DNA, 12 bp, Homo sapiens
tggccagagctg

SEQ ID NO: 3131533 - DNA, 14 bp, Homo sapiens
tggccagagctgga

SEQ ID NO: 3131534 - DNA, 22 bp, Homo sapiens
tggccagagctggaaggcaggg

SEQ ID NO: 3131535 - DNA, 23 bp, Homo sapiens
tggccagagctggaaggcagggc

SEQ ID NO: 3131536 - DNA, 15 bp, Homo sapiens
tggccagagctggga

SEQ ID NO: 3131537 - DNA, 17 bp, Homo sapiens
tggccagagctgggagg

SEQ ID NO: 3131538 - DNA, 17 bp, Homo sapiens
tggccagatgcaccagc

SEQ ID NO: 3131539 - DNA, 20 bp, Homo sapiens
tggccagatgcaccagccct

SEQ ID NO: 3131540 - DNA, 17 bp, Homo sapiens
tggccagatggcccgga

SEQ ID NO: 3131541 - DNA, 19 bp, Homo sapiens
tggccagcaaggcaggttg

SEQ ID NO: 3131542 - DNA, 12 bp, Homo sapiens
tggccagcaccc

SEQ ID NO: 3131543 - DNA, 14 bp, Homo sapiens
tggccagcaccctc

SEQ ID NO: 3131544 - DNA, 20 bp, Homo sapiens
tggccagcaccctctcctgg

SEQ ID NO: 3131545 - DNA, 21 bp, Homo sapiens
tggccagccaacttttgcatg

SEQ ID NO: 3131546 - DNA, 16 bp, Homo sapiens
tggccagccagtgcca

SEQ ID NO: 3131547 - DNA, 12 bp, Homo sapiens
tggccagcccgg

SEQ ID NO: 3131548 - DNA, 15 bp, Homo sapiens
tggccagcccttcct

SEQ ID NO: 3131549 - DNA, 24 bp, Homo sapiens
tggccagcccttcctctcactcct

SEQ ID NO: 3131550 - DNA, 14 bp, Homo sapiens
tggccagcctggat

SEQ ID NO: 3131551 - DNA, 21 bp, Homo sapiens
tggccagcctggggcctggca

SEQ ID NO: 3131552 - DNA, 16 bp, Homo sapiens
tggccagctcataaaa

SEQ ID NO: 3131553 - DNA, 11 bp, Homo sapiens
tggccaggagc

SEQ ID NO: 3131554 - DNA, 15 bp, Homo sapiens
tggccaggagctctt

SEQ ID NO: 3131555 - DNA, 20 bp, Homo sapiens
tggccaggagctcttcaggc

SEQ ID NO: 3131556 - DNA, 22 bp, Homo sapiens
tggccaggaggttggtgactga

SEQ ID NO: 3131557 - DNA, 12 bp, Homo sapiens
tggccaggatgg

SEQ ID NO: 3131558 - DNA, 16 bp, Homo sapiens
tggccaggcactgcct

SEQ ID NO: 3131559 - DNA, 17 bp, Homo sapiens
tggccaggcagatctgt

SEQ ID NO: 3131560 - DNA, 14 bp, Homo sapiens
tggccagggcaggg

SEQ ID NO: 3131561 - DNA, 22 bp, Homo sapiens
tggccagggccacgctccagct

SEQ ID NO: 3131562 - DNA, 11 bp, Homo sapiens
tggccaggtgg

SEQ ID NO: 3131563 - DNA, 16 bp, Homo sapiens
tggccagttatccctt

SEQ ID NO: 3131564 - DNA, 18 bp, Homo sapiens
tggccagttgcccagagc

SEQ ID NO: 3131565 - DNA, 16 bp, Homo sapiens
tggccatccctgggcc

SEQ ID NO: 3131566 - DNA, 17 bp, Homo sapiens
tggccatccctgggccc

SEQ ID NO: 3131567 - DNA, 15 bp, Homo sapiens
tggccatccctgtga

SEQ ID NO: 3131568 - DNA, 17 bp, Homo sapiens
tggccatccctgtgagg

SEQ ID NO: 3131569 - DNA, 16 bp, Homo sapiens
tggccatctccctccc

SEQ ID NO: 3131570 - DNA, 15 bp, Homo sapiens
tggccatttgctttt

SEQ ID NO: 3131571 - DNA, 10 bp, Homo sapiens
tggcccagcc

SEQ ID NO: 3131572 - DNA, 13 bp, Homo sapiens
tggcccagtgtca

SEQ ID NO: 3131573 - DNA, 20 bp, Homo sapiens
tggcccatagaaacatgaca

SEQ ID NO: 3131574 - DNA, 23 bp, Homo sapiens
tggcccatagaaacatgacactg

SEQ ID NO: 3131575 - DNA, 18 bp, Homo sapiens
tggcccatctcagcctcc

SEQ ID NO: 3131576 - DNA, 19 bp, Homo sapiens
tggcccatgggagccaggc

SEQ ID NO: 3131577 - DNA, 18 bp, Homo sapiens
tggccccaccctgggccc

SEQ ID NO: 3131578 - DNA, 14 bp, Homo sapiens
tggccccagcacag

SEQ ID NO: 3131579 - DNA, 19 bp, Homo sapiens
tggccccagcacagcttga

SEQ ID NO: 3131580 - DNA, 16 bp, Homo sapiens
tggccccagccctgct

SEQ ID NO: 3131581 - DNA, 15 bp, Homo sapiens
tggcccccaataaag

SEQ ID NO: 3131582 - DNA, 22 bp, Homo sapiens
tggcccccaataaaggcagctg

SEQ ID NO: 3131583 - DNA, 17 bp, Homo sapiens
tggcccctcgcctgtgg

SEQ ID NO: 3131584 - DNA, 10 bp, Homo sapiens
tggcccctct

SEQ ID NO: 3131585 - DNA, 16 bp, Homo sapiens
tggcccctctgacctg

SEQ ID NO: 3131586 - DNA, 20 bp, Homo sapiens
tggcccctgaacaagaattg

SEQ ID NO: 3131587 - DNA, 16 bp, Homo sapiens
tggcccgacagcctgg

SEQ ID NO: 3131588 - DNA, 22 bp, Homo sapiens
tggcccgcgtctagcttagttt

SEQ ID NO: 3131589 - DNA, 17 bp, Homo sapiens
tggcccggatgctgctt

SEQ ID NO: 3131590 - DNA, 22 bp, Homo sapiens
tggccctcggtggctgcacaga

SEQ ID NO: 3131591 - DNA, 18 bp, Homo sapiens
tggccctgccctctcctt

SEQ ID NO: 3131592 - DNA, 12 bp, Homo sapiens
tggccctgcctc

SEQ ID NO: 3131593 - DNA, 15 bp, Homo sapiens
tggccctgcctcctg

SEQ ID NO: 3131594 - DNA, 21 bp, Homo sapiens
tggccctgcctcctgggaaga

SEQ ID NO: 3131595 - DNA, 17 bp, Homo sapiens
tggccctggctctgctg

SEQ ID NO: 3131596 - DNA, 19 bp, Homo sapiens
tggccctggctctgctgtc

SEQ ID NO: 3131597 - DNA, 13 bp, Homo sapiens
tggccctggggtc

SEQ ID NO: 3131598 - DNA, 19 bp, Homo sapiens
tggccctggggtcccacga

SEQ ID NO: 3131599 - DNA, 19 bp, Homo sapiens
tggccctgtccctcccacc

SEQ ID NO: 3131600 - DNA, 21 bp, Homo sapiens
tggccctgtccctcccacctc

SEQ ID NO: 3131601 - DNA, 13 bp, Homo sapiens
tggccctgtgcta

SEQ ID NO: 3131602 - DNA, 13 bp, Homo sapiens
tggccctgtgtag

SEQ ID NO: 3131603 - DNA, 22 bp, Homo sapiens
tggcccttgcagttcagcacca

SEQ ID NO: 3131604 - DNA, 21 bp, Homo sapiens
tggcccttgcctttgtggcct

SEQ ID NO: 3131605 - DNA, 14 bp, Homo sapiens
tggccctttcccct

SEQ ID NO: 3131606 - DNA, 16 bp, Homo sapiens
tggccctttccccttc

SEQ ID NO: 3131607 - DNA, 19 bp, Homo sapiens
tggccctttccccttcccc

SEQ ID NO: 3131608 - DNA, 13 bp, Homo sapiens
tggccctttcctt

SEQ ID NO: 3131609 - DNA, 14 bp, Homo sapiens
tggccgccaccccc

SEQ ID NO: 3131610 - DNA, 18 bp, Homo sapiens
tggccgccacccccatct

SEQ ID NO: 3131611 - DNA, 19 bp, Homo sapiens
tggccgccacccccatctt

SEQ ID NO: 3131612 - DNA, 21 bp, Homo sapiens
tggccgccccctgccccccag

SEQ ID NO: 3131613 - DNA, 23 bp, Homo sapiens
tggccgccccctgccccccagcc

SEQ ID NO: 3131614 - DNA, 15 bp, Homo sapiens
tggccggctgtgctc

SEQ ID NO: 3131615 - DNA, 14 bp, Homo sapiens
tggccgtctcctcc

SEQ ID NO: 3131616 - DNA, 17 bp, Homo sapiens
tggccgtctcctccctc

SEQ ID NO: 3131617 - DNA, 21 bp, Homo sapiens
tggcctaaacctcagttatta

SEQ ID NO: 3131618 - DNA, 18 bp, Homo sapiens
tggcctagcccaccctgc

SEQ ID NO: 3131619 - DNA, 13 bp, Homo sapiens
tggcctatgcaca

SEQ ID NO: 3131620 - DNA, 14 bp, Homo sapiens
tggcctatgcacat

SEQ ID NO: 3131621 - DNA, 19 bp, Homo sapiens
tggattattcatttaaaat

SEQ ID NO: 3131622 - DNA, 20 bp, Homo sapiens
tggattattcatttaaaatg

SEQ ID NO: 3131623 - DNA, 16 bp, Homo sapiens
tggattatttaataac

SEQ ID NO: 3131624 - DNA, 20 bp, Homo sapiens
tggattcaattacggactct

SEQ ID NO: 3131625 - DNA, 21 bp, Homo sapiens
tggattcccccccctttccta

SEQ ID NO: 3131626 - DNA, 20 bp, Homo sapiens
tggattcctcacagccttgg

SEQ ID NO: 3131627 - DNA, 13 bp, Homo sapiens
tggattctcagat

SEQ ID NO: 3131628 - DNA, 16 bp, Homo sapiens
tggattctcagatatt

SEQ ID NO: 3131629 - DNA, 22 bp, Homo sapiens
tggattctcttagctactgtat

SEQ ID NO: 3131630 - DNA, 22 bp, Homo sapiens
tggattctgggaggcaagaaaa

SEQ ID NO: 3131631 - DNA, 23 bp, Homo sapiens
tggattctgggaggcaagaaaag

SEQ ID NO: 3131632 - DNA, 16 bp, Homo sapiens
tggattgcctctgaaa

SEQ ID NO: 3131633 - DNA, 16 bp, Homo sapiens
tggattggattattta

SEQ ID NO: 3131634 - DNA, 21 bp, Homo sapiens
tggattgtggttccatgcagc

SEQ ID NO: 3131635 - DNA, 20 bp, Homo sapiens
tggatttaaaagcctgctca

SEQ ID NO: 3131636 - DNA, 21 bp, Homo sapiens
tggatttgatgagttaactgt

SEQ ID NO: 3131637 - DNA, 15 bp, Homo sapiens
tggatttgcatattt

SEQ ID NO: 3131638 - DNA, 20 bp, Homo sapiens
tggattttctattgttactc

SEQ ID NO: 3131639 - DNA, 15 bp, Homo sapiens
tggatttttaaatta

SEQ ID NO: 3131640 - DNA, 16 bp, Homo sapiens
tggatttttaaattat

SEQ ID NO: 3131641 - DNA, 16 bp, Homo sapiens
tggatttttacaagat

SEQ ID NO: 3131642 - DNA, 20 bp, Homo sapiens
tggatttttgactctggcaa

SEQ ID NO: 3131643 - DNA, 17 bp, Homo sapiens
tggcaaaaatggctaga

SEQ ID NO: 3131644 - DNA, 20 bp, Homo sapiens
tggcaaaactctacttaatc

SEQ ID NO: 3131645 - DNA, 17 bp, Homo sapiens
tggcaaaagccttgtgt

SEQ ID NO: 3131646 - DNA, 17 bp, Homo sapiens
tggggggccgggcaggt

SEQ ID NO: 3131647 - DNA, 14 bp, Homo sapiens
tgggggggtggccg

SEQ ID NO: 3131648 - DNA, 20 bp, Homo sapiens
tggggggtgcaggtgggcac

SEQ ID NO: 3131649 - DNA, 20 bp, Homo sapiens
tggggggtgttttgtggggc

SEQ ID NO: 3131650 - DNA, 16 bp, Homo sapiens
tgggggtagcagctgg

SEQ ID NO: 3131651 - DNA, 18 bp, Homo sapiens
tgggggtagcagctggac

SEQ ID NO: 3131652 - DNA, 19 bp, Homo sapiens
tgggggtgctggatggaca

SEQ ID NO: 3131653 - DNA, 15 bp, Homo sapiens
tgggggtggcaggca

SEQ ID NO: 3131654 - DNA, 21 bp, Homo sapiens
tgggggtggccatccctgggc

SEQ ID NO: 3131655 - DNA, 18 bp, Homo sapiens
tgggggtggctgggactc

SEQ ID NO: 3131656 - DNA, 22 bp, Homo sapiens
tgggggttctttcttcctctgc

SEQ ID NO: 3131657 - DNA, 12 bp, Homo sapiens
tgggggttttta

SEQ ID NO: 3131658 - DNA, 15 bp, Homo sapiens
tggggtaagccagag

SEQ ID NO: 3131659 - DNA, 14 bp, Homo sapiens
tggggtacccactg

SEQ ID NO: 3131660 - DNA, 18 bp, Homo sapiens
tggggtacccactgctct

SEQ ID NO: 3131661 - DNA, 19 bp, Homo sapiens
tggggtacccactgctctg

SEQ ID NO: 3131662 - DNA, 20 bp, Homo sapiens
tggggtacccactgctctgg

SEQ ID NO: 3131663 - DNA, 21 bp, Homo sapiens
tggggtactcttgatgtgaag

SEQ ID NO: 3131664 - DNA, 16 bp, Homo sapiens
tggggtagaaacattg

SEQ ID NO: 3131665 - DNA, 13 bp, Homo sapiens
tggggtcaggaac

SEQ ID NO: 3131666 - DNA, 19 bp, Homo sapiens
tggggtccctccaccccac

SEQ ID NO: 3131667 - DNA, 20 bp, Homo sapiens
tggggtcctggagcagacca

SEQ ID NO: 3131668 - DNA, 22 bp, Homo sapiens
tggggtccttttttatacagga

SEQ ID NO: 3131669 - DNA, 15 bp, Homo sapiens
tggggtgaatactta

SEQ ID NO: 3131670 - DNA, 12 bp, Homo sapiens
tggggtgacagt

SEQ ID NO: 3131671 - DNA, 15 bp, Homo sapiens
tggggtgacagtcat

SEQ ID NO: 3131672 - DNA, 16 bp, Homo sapiens
tggggtgacagtcatc

SEQ ID NO: 3131673 - DNA, 17 bp, Homo sapiens
tggggtgacagtcatca

SEQ ID NO: 3131674 - DNA, 22 bp, Homo sapiens
tggggtggggggatggtaagag

SEQ ID NO: 3131675 - DNA, 21 bp, Homo sapiens
tggggtgtgttccaactgccc

SEQ ID NO: 3131676 - DNA, 17 bp, Homo sapiens
tggggttggcaacagga

SEQ ID NO: 3131677 - DNA, 19 bp, Homo sapiens
tggggttggcaacaggaca

SEQ ID NO: 3131678 - DNA, 16 bp, Homo sapiens
tgggtaaaatactttt

SEQ ID NO: 3131679 - DNA, 17 bp, Homo sapiens
tgggtacttgtggacac

SEQ ID NO: 3131680 - DNA, 19 bp, Homo sapiens
tgggtagatgggtgggggc

SEQ ID NO: 3131681 - DNA, 18 bp, Homo sapiens
tgggtagggtaaatcagt

SEQ ID NO: 3131682 - DNA, 21 bp, Homo sapiens
tgggtagtgagcagtgagcag

SEQ ID NO: 3131683 - DNA, 18 bp, Homo sapiens
tgggtataagcagagagg

SEQ ID NO: 3131684 - DNA, 19 bp, Homo sapiens
tgggtatcctgcccagtgt

SEQ ID NO: 3131685 - DNA, 16 bp, Homo sapiens
tgggtcagaacatgtt

SEQ ID NO: 3131686 - DNA, 23 bp, Homo sapiens
tgggtcagggccagactggaaga

SEQ ID NO: 3131687 - DNA, 22 bp, Homo sapiens
tgggtcattgacctctcagggc

SEQ ID NO: 3131688 - DNA, 14 bp, Homo sapiens
tgggtccaaataaa

SEQ ID NO: 3131689 - DNA, 20 bp, Homo sapiens
tgggtccaggaaggcagctg

SEQ ID NO: 3131690 - DNA, 23 bp, Homo sapiens
tgggtccaggaaggcagctgctc

SEQ ID NO: 3131691 - DNA, 16 bp, Homo sapiens
tgggtccgataatatc

SEQ ID NO: 3131692 - DNA, 19 bp, Homo sapiens
tggcaaaagccttgtgtat

SEQ ID NO: 3131693 - DNA, 17 bp, Homo sapiens
tggcaaacgctaaagag

SEQ ID NO: 3131694 - DNA, 16 bp, Homo sapiens
tggcaaagcttttaga

SEQ ID NO: 3131695 - DNA, 18 bp, Homo sapiens
tggcaaagcttttagaaa

SEQ ID NO: 3131696 - DNA, 14 bp, Homo sapiens
tggcaaatataaaa

SEQ ID NO: 3131697 - DNA, 13 bp, Homo sapiens
tggcaaattaaac

SEQ ID NO: 3131698 - DNA, 17 bp, Homo sapiens
tggcaaattaacttgag

SEQ ID NO: 3131699 - DNA, 15 bp, Homo sapiens
tggcaagaaagctgg

SEQ ID NO: 3131700 - DNA, 19 bp, Homo sapiens
tggcaagagtgtggaggct

SEQ ID NO: 3131701 - DNA, 16 bp, Homo sapiens
tggcaaggaaaaacag

SEQ ID NO: 3131702 - DNA, 22 bp, Homo sapiens
tggcaagttttgatatgagtat

SEQ ID NO: 3131703 - DNA, 19 bp, Homo sapiens
tggcaatagggtagaatga

SEQ ID NO: 3131704 - DNA, 15 bp, Homo sapiens
tggcaatagtgtgtt

SEQ ID NO: 3131705 - DNA, 18 bp, Homo sapiens
tggcaatagtgtgttctg

SEQ ID NO: 3131706 - DNA, 20 bp, Homo sapiens
tggcaatcaatacagcttca

SEQ ID NO: 3131707 - DNA, 19 bp, Homo sapiens
tggcaatgcttaaactaaa

SEQ ID NO: 3131708 - DNA, 18 bp, Homo sapiens
tggcaatttcctggccct

SEQ ID NO: 3131709 - DNA, 19 bp, Homo sapiens
tggcaatttcctggccctc

SEQ ID NO: 3131710 - DNA, 22 bp, Homo sapiens
tggcaatttcctggccctccac

SEQ ID NO: 3131711 - DNA, 19 bp, Homo sapiens
tggcaattttgtaaattga

SEQ ID NO: 3131712 - DNA, 22 bp, Homo sapiens
tggcacagacttctggaaggct

SEQ ID NO: 3131713 - DNA, 23 bp, Homo sapiens
tggcacagacttctggaaggctg

SEQ ID NO: 3131714 - DNA, 16 bp, Homo sapiens
tggcacagggcagtgg

SEQ ID NO: 3131715 - DNA, 18 bp, Homo sapiens
tggcacagggcagtggga

SEQ ID NO: 3131716 - DNA, 11 bp, Homo sapiens
tggcaccaaag

SEQ ID NO: 3131717 - DNA, 13 bp, Homo sapiens
tggcaccactctc

SEQ ID NO: 3131718 - DNA, 20 bp, Homo sapiens
tggcaccagatgcaacctca

SEQ ID NO: 3131719 - DNA, 16 bp, Homo sapiens
tggcaccagccccctg

SEQ ID NO: 3131720 - DNA, 17 bp, Homo sapiens
tggcaccagccccctgg

SEQ ID NO: 3131721 - DNA, 20 bp, Homo sapiens
tggcacccaccgtggaggag

SEQ ID NO: 3131722 - DNA, 21 bp, Homo sapiens
tggcacccaccgtggaggagg

SEQ ID NO: 3131723 - DNA, 21 bp, Homo sapiens
tggcaccccagctaccccttc

SEQ ID NO: 3131724 - DNA, 16 bp, Homo sapiens
tggcacccggcccctg

SEQ ID NO: 3131725 - DNA, 14 bp, Homo sapiens
tggcacctcctgag

SEQ ID NO: 3131726 - DNA, 18 bp, Homo sapiens
tggcacctcctgagaagg

SEQ ID NO: 3131727 - DNA, 15 bp, Homo sapiens
tggcactataatgta

SEQ ID NO: 3131728 - DNA, 22 bp, Homo sapiens
tggcactataatgtaagctcta

SEQ ID NO: 3131729 - DNA, 17 bp, Homo sapiens
tggcactcacagacctg

SEQ ID NO: 3131730 - DNA, 22 bp, Homo sapiens
tggcactcacagacctggagcc

SEQ ID NO: 3131731 - DNA, 13 bp, Homo sapiens
tggcactgagccc

SEQ ID NO: 3131732 - DNA, 14 bp, Homo sapiens
tggcactgagcccc

SEQ ID NO: 3131733 - DNA, 16 bp, Homo sapiens
tggcactgagcccccc

SEQ ID NO: 3131734 - DNA, 10 bp, Homo sapiens
tggcactgat

SEQ ID NO: 3131735 - DNA, 15 bp, Homo sapiens
tggcactggatgcag

SEQ ID NO: 3131736 - DNA, 13 bp, Homo sapiens
tggcactggccac

SEQ ID NO: 3131737 - DNA, 20 bp, Homo sapiens
tggcactgttaatacacagt

SEQ ID NO: 3131738 - DNA, 13 bp, Homo sapiens
tggcacttaagtg

SEQ ID NO: 3131739 - DNA, 20 bp, Homo sapiens
tggcacttaagtgcactttt

SEQ ID NO: 3131740 - DNA, 22 bp, Homo sapiens
tggcacttgccattccaaaata

SEQ ID NO: 3131741 - DNA, 16 bp, Homo sapiens
tggcacttgctaacaa

SEQ ID NO: 3131742 - DNA, 23 bp, Homo sapiens
tggcagaaaagaggagaccctgg

SEQ ID NO: 3131743 - DNA, 20 bp, Homo sapiens
tggcagaagacaccagagca

SEQ ID NO: 3131744 - DNA, 19 bp, Homo sapiens
tggcagaagggaattgctc

SEQ ID NO: 3131745 - DNA, 11 bp, Homo sapiens
tggcagactct

SEQ ID NO: 3131746 - DNA, 17 bp, Homo sapiens
tggcagagaaggcctct

SEQ ID NO: 3131747 - DNA, 20 bp, Homo sapiens
tggcagatactccttttgcc

SEQ ID NO: 3131748 - DNA, 21 bp, Homo sapiens
tggcagatcgctcactgttgt

SEQ ID NO: 3131749 - DNA, 20 bp, Homo sapiens
tggcagattttacaaaagat

SEQ ID NO: 3131750 - DNA, 16 bp, Homo sapiens
tggcagcacagcccag

SEQ ID NO: 3131751 - DNA, 18 bp, Homo sapiens
tggcagcacagcccaggg

SEQ ID NO: 3131752 - DNA, 21 bp, Homo sapiens
tggcagcacagcccagggcct

SEQ ID NO: 3131753 - DNA, 18 bp, Homo sapiens
tggcagccatgcctcatg

SEQ ID NO: 3131754 - DNA, 17 bp, Homo sapiens
tggcagctagactggag

SEQ ID NO: 3131755 - DNA, 22 bp, Homo sapiens
tggcagctagactggagtgagg

SEQ ID NO: 3131756 - DNA, 17 bp, Homo sapiens
tggcagctcctctcctt

SEQ ID NO: 3131757 - DNA, 12 bp, Homo sapiens
tggcagctctcc

SEQ ID NO: 3131758 - DNA, 13 bp, Homo sapiens
tggcagctctcca

SEQ ID NO: 3131759 - DNA, 14 bp, Homo sapiens
tggcagctctccag

SEQ ID NO: 3131760 - DNA, 15 bp, Homo sapiens
tggcagctctccagt

SEQ ID NO: 3131761 - DNA, 17 bp, Homo sapiens
tggcagctctccagtca

SEQ ID NO: 3131762 - DNA, 18 bp, Homo sapiens
tggcagctgagagccctg

SEQ ID NO: 3131763 - DNA, 19 bp, Homo sapiens
tggcagctgagagccctgc

SEQ ID NO: 3131764 - DNA, 23 bp, Homo sapiens
tggcagctgagagccctgctgtg

SEQ ID NO: 3131765 - DNA, 19 bp, Homo sapiens
tggcagctgcggtccaccc

SEQ ID NO: 3131766 - DNA, 12 bp, Homo sapiens
tggcaggacaca

SEQ ID NO: 3131767 - DNA, 19 bp, Homo sapiens
tggcaggacacatcccggc

SEQ ID NO: 3131768 - DNA, 19 bp, Homo sapiens
tggcaggcagcgccaagca

SEQ ID NO: 3131769 - DNA, 12 bp, Homo sapiens
tggcaggctggc

SEQ ID NO: 3131770 - DNA, 14 bp, Homo sapiens
tggcaggctggcca

SEQ ID NO: 3131771 - DNA, 18 bp, Homo sapiens
tggcaggctggccagtcc

SEQ ID NO: 3131772 - DNA, 19 bp, Homo sapiens
tggcagggaggtcaggccc

SEQ ID NO: 3131773 - DNA, 14 bp, Homo sapiens
tggcagggctcagg

SEQ ID NO: 3131774 - DNA, 15 bp, Homo sapiens
tggcagggctcagga

SEQ ID NO: 3131775 - DNA, 15 bp, Homo sapiens
tggcaggggacagga

SEQ ID NO: 3131776 - DNA, 13 bp, Homo sapiens
tggcaggggagca

SEQ ID NO: 3131777 - DNA, 18 bp, Homo sapiens
tggcagggggccccgcca

SEQ ID NO: 3131778 - DNA, 21 bp, Homo sapiens
tggcagggggccccgccaggg

SEQ ID NO: 3131779 - DNA, 20 bp, Homo sapiens
tggcaggtgcagatgggctg

SEQ ID NO: 3131780 - DNA, 15 bp, Homo sapiens
tggcaggtgtcatat

SEQ ID NO: 3131781 - DNA, 16 bp, Homo sapiens
tggcagtctgaatttt

SEQ ID NO: 3131782 - DNA, 20 bp, Homo sapiens
tggcagtgactttgtataga

SEQ ID NO: 3131783 - DNA, 17 bp, Homo sapiens
tggcagtgagtgagcct

SEQ ID NO: 3131784 - DNA, 14 bp, Homo sapiens
tggcagtggcagag

SEQ ID NO: 3131785 - DNA, 13 bp, Homo sapiens
tggcagtgggagc

SEQ ID NO: 3131786 - DNA, 14 bp, Homo sapiens
tggcagtgggagct

SEQ ID NO: 3131787 - DNA, 15 bp, Homo sapiens
tggcagtgggagctg

SEQ ID NO: 3131788 - DNA, 12 bp, Homo sapiens
tggcagtggttt

SEQ ID NO: 3131789 - DNA, 16 bp, Homo sapiens
tggagccactcctgtc

SEQ ID NO: 3131790 - DNA, 18 bp, Homo sapiens
tggagccactcctgtccc

SEQ ID NO: 3131791 - DNA, 23 bp, Homo sapiens
tggagccagggagcggccgcctg

SEQ ID NO: 3131792 - DNA, 16 bp, Homo sapiens
tggagcccaggcggga

SEQ ID NO: 3131793 - DNA, 12 bp, Homo sapiens
tggagcccctgg

SEQ ID NO: 3131794 - DNA, 13 bp, Homo sapiens
tggagcccctggg

SEQ ID NO: 3131795 - DNA, 13 bp, Homo sapiens
tggagcccgtgca

SEQ ID NO: 3131796 - DNA, 22 bp, Homo sapiens
tggagcccgtgcagtacaggca

SEQ ID NO: 3131797 - DNA, 19 bp, Homo sapiens
tggagcctttgaataaaaa

SEQ ID NO: 3131798 - DNA, 22 bp, Homo sapiens
tggagcgcacctgccccctggt

SEQ ID NO: 3131799 - DNA, 18 bp, Homo sapiens
tggagcggggtatgaaga

SEQ ID NO: 3131800 - DNA, 14 bp, Homo sapiens
tggagctgccacag

SEQ ID NO: 3131801 - DNA, 16 bp, Homo sapiens
tggagctgccacagag

SEQ ID NO: 3131802 - DNA, 16 bp, Homo sapiens
tggaggaaaaaggtca

SEQ ID NO: 3131803 - DNA, 16 bp, Homo sapiens
tggaggaaagggagga

SEQ ID NO: 3131804 - DNA, 17 bp, Homo sapiens
tggaggaaggtgctgag

SEQ ID NO: 3131805 - DNA, 20 bp, Homo sapiens
tggaggaaggtgctgagctt

SEQ ID NO: 3131806 - DNA, 14 bp, Homo sapiens
tggaggagaaggac

SEQ ID NO: 3131807 - DNA, 13 bp, Homo sapiens
tggaggagagaga

SEQ ID NO: 3131808 - DNA, 21 bp, Homo sapiens
tggaggagcagcttccttctg

SEQ ID NO: 3131809 - DNA, 17 bp, Homo sapiens
tggaggatcagtttttt

SEQ ID NO: 3131810 - DNA, 14 bp, Homo sapiens
tggacagtcctggg

SEQ ID NO: 3131811 - DNA, 22 bp, Homo sapiens
tggacagttcacaccctgcaag

SEQ ID NO: 3131812 - DNA, 19 bp, Homo sapiens
tggacatagatattttcac

SEQ ID NO: 3131813 - DNA, 22 bp, Homo sapiens
tggacatagatattttcacaat

SEQ ID NO: 3131814 - DNA, 17 bp, Homo sapiens
tggacatcaccagtcct

SEQ ID NO: 3131815 - DNA, 20 bp, Homo sapiens
tggacatcaccagtcctagc

SEQ ID NO: 3131816 - DNA, 23 bp, Homo sapiens
tggacatcctcctcccacccggc

SEQ ID NO: 3131817 - DNA, 21 bp, Homo sapiens
tggacatttaacttttctacc

SEQ ID NO: 3131818 - DNA, 17 bp, Homo sapiens
tggacatttagaagaaa

SEQ ID NO: 3131819 - DNA, 19 bp, Homo sapiens
tggacatttagaagaaaga

SEQ ID NO: 3131820 - DNA, 18 bp, Homo sapiens
tggaccaaggtgaagcaa

SEQ ID NO: 3131821 - DNA, 20 bp, Homo sapiens
tggaccaatagggctgagct

SEQ ID NO: 3131822 - DNA, 21 bp, Homo sapiens
tggaccaatagggctgagctc

SEQ ID NO: 3131823 - DNA, 14 bp, Homo sapiens
tggaccagagactt

SEQ ID NO: 3131824 - DNA, 19 bp, Homo sapiens
tggaccagtggtttccagt

SEQ ID NO: 3131825 - DNA, 14 bp, Homo sapiens
tggacccaaggaaa

SEQ ID NO: 3131826 - DNA, 13 bp, Homo sapiens
tggaccccagaga

SEQ ID NO: 3131827 - DNA, 18 bp, Homo sapiens
tgcttggttggctggcag

SEQ ID NO: 3131828 - DNA, 14 bp, Homo sapiens
tgcttggttttctt

SEQ ID NO: 3131829 - DNA, 23 bp, Homo sapiens
tgcttgtaacaagaaaacataag

SEQ ID NO: 3131830 - DNA, 22 bp, Homo sapiens
tgcttgtcttctggtactttct

SEQ ID NO: 3131831 - DNA, 23 bp, Homo sapiens
tgcttgttgggattcctgaccca

SEQ ID NO: 3131832 - DNA, 14 bp, Homo sapiens
tgcttgtttatgat

SEQ ID NO: 3131833 - DNA, 12 bp, Homo sapiens
tgcttgttttat

SEQ ID NO: 3131834 - DNA, 23 bp, Homo sapiens
tgctttaaagtgtaataatatga

SEQ ID NO: 3131835 - DNA, 23 bp, Homo sapiens
tgctttaattaattaagtatctg

SEQ ID NO: 3131836 - DNA, 20 bp, Homo sapiens
tgctttacatgctgtgctct

SEQ ID NO: 3131837 - DNA, 17 bp, Homo sapiens
tgctttaggctcacggc

SEQ ID NO: 3131838 - DNA, 16 bp, Homo sapiens
tgctttattgcttttt

SEQ ID NO: 3131839 - DNA, 13 bp, Homo sapiens
tgctttcccctgt

SEQ ID NO: 3131840 - DNA, 16 bp, Homo sapiens
tgctttcctgggcctt

SEQ ID NO: 3131841 - DNA, 17 bp, Homo sapiens
tgctttctgttccaaat

SEQ ID NO: 3131842 - DNA, 16 bp, Homo sapiens
tgctttctgtttctta

SEQ ID NO: 3131843 - DNA, 20 bp, Homo sapiens
tgctttcttttttaaaatca

SEQ ID NO: 3131844 - DNA, 14 bp, Homo sapiens
tgctttgaagcagt

SEQ ID NO: 3131845 - DNA, 20 bp, Homo sapiens
tgctttgaagtagctctttt

SEQ ID NO: 3131846 - DNA, 18 bp, Homo sapiens
tgctttgatttacagcaa

SEQ ID NO: 3131847 - DNA, 17 bp, Homo sapiens
tgctttgccaaaatacc

SEQ ID NO: 3131848 - DNA, 20 bp, Homo sapiens
tgctttgccaaaataccaga

SEQ ID NO: 3131849 - DNA, 21 bp, Homo sapiens
tgctttgccaagttgctgtca

SEQ ID NO: 3131850 - DNA, 23 bp, Homo sapiens
tgctttgccaagttgctgtcact

SEQ ID NO: 3131851 - DNA, 15 bp, Homo sapiens
tgctttgctgctatg

SEQ ID NO: 3131852 - DNA, 16 bp, Homo sapiens
tgctttggctgagggg

SEQ ID NO: 3131853 - DNA, 20 bp, Homo sapiens
tgctttgggaggccaaggca

SEQ ID NO: 3131854 - DNA, 21 bp, Homo sapiens
tgctttgggctttgcaggctc

SEQ ID NO: 3131855 - DNA, 22 bp, Homo sapiens
tgctttgggctttgcaggctct

SEQ ID NO: 3131856 - DNA, 19 bp, Homo sapiens
tgctttgtaagatccaccc

SEQ ID NO: 3131857 - DNA, 21 bp, Homo sapiens
tgctttgtaatattctcccca

SEQ ID NO: 3131858 - DNA, 16 bp, Homo sapiens
tgctttgtgtgattga

SEQ ID NO: 3131859 - DNA, 14 bp, Homo sapiens
tgctttgtttggat

SEQ ID NO: 3131860 - DNA, 16 bp, Homo sapiens
tgcttttaattaaata

SEQ ID NO: 3131861 - DNA, 19 bp, Homo sapiens
tgcttttagtgtgtgcata

SEQ ID NO: 3131862 - DNA, 21 bp, Homo sapiens
tgcttttatatggcccagcct

SEQ ID NO: 3131863 - DNA, 23 bp, Homo sapiens
tgcttttatatggcccagccttg

SEQ ID NO: 3131864 - DNA, 14 bp, Homo sapiens
tgcttttattttga

SEQ ID NO: 3131865 - DNA, 17 bp, Homo sapiens
tgcttttcctcaagcaa

SEQ ID NO: 3131866 - DNA, 18 bp, Homo sapiens
tgcttttctgccctggct

SEQ ID NO: 3131867 - DNA, 14 bp, Homo sapiens
tgcttttgagcctc

SEQ ID NO: 3131868 - DNA, 18 bp, Homo sapiens
tgcttttgcataatgcaa

SEQ ID NO: 3131869 - DNA, 19 bp, Homo sapiens
tgcttttggcaaaactcta

SEQ ID NO: 3131870 - DNA, 18 bp, Homo sapiens
tgcttttggtctgtgtga

SEQ ID NO: 3131871 - DNA, 19 bp, Homo sapiens
tgcttttgtatatcctata

SEQ ID NO: 3131872 - DNA, 10 bp, Homo sapiens
tgcttttgtt

SEQ ID NO: 3131873 - DNA, 13 bp, Homo sapiens
tgcttttgttttt

SEQ ID NO: 3131874 - DNA, 15 bp, Homo sapiens
tgctttttatttctg

SEQ ID NO: 3131875 - DNA, 21 bp, Homo sapiens
tgctttttccaactcagaaat

SEQ ID NO: 3131876 - DNA, 17 bp, Homo sapiens
tgctttttgaaatgaaa

SEQ ID NO: 3131877 - DNA, 13 bp, Homo sapiens
tgctttttggaaa

SEQ ID NO: 3131878 - DNA, 15 bp, Homo sapiens
tgctttttggcacag

SEQ ID NO: 3131879 - DNA, 19 bp, Homo sapiens
tgcttttttccaaaacaaa

SEQ ID NO: 3131880 - DNA, 19 bp, Homo sapiens
tgcttttttgattttgctg

SEQ ID NO: 3131881 - DNA, 17 bp, Homo sapiens
tgcttttttgttttggc

SEQ ID NO: 3131882 - DNA, 16 bp, Homo sapiens
tgctttttttcttaaa

SEQ ID NO: 3131883 - DNA, 18 bp, Homo sapiens
tgctttttttcttaaaag

SEQ ID NO: 3131884 - DNA, 14 bp, Homo sapiens
tggaaaaaaacata

SEQ ID NO: 3131885 - DNA, 21 bp, Homo sapiens
tggaaaaaagattctgtctta

SEQ ID NO: 3131886 - DNA, 18 bp, Homo sapiens
tggaaaaatccagaaaga

SEQ ID NO: 3131887 - DNA, 15 bp, Homo sapiens
tggaaaaatccttga

SEQ ID NO: 3131888 - DNA, 11 bp, Homo sapiens
tggaaaaatgg

SEQ ID NO: 3131889 - DNA, 19 bp, Homo sapiens
tggaaaaatgggtctttta

SEQ ID NO: 3131890 - DNA, 22 bp, Homo sapiens
tggaaaaatgggtcttttatag

SEQ ID NO: 3131891 - DNA, 19 bp, Homo sapiens
tggaaaaatggttgatgga

SEQ ID NO: 3131892 - DNA, 23 bp, Homo sapiens
tggaaaaatggttgatggaaaat

SEQ ID NO: 3131893 - DNA, 16 bp, Homo sapiens
tggaaaaatgtatcca

SEQ ID NO: 3131894 - DNA, 21 bp, Homo sapiens
tggaaaacaaagccaaacaaa

SEQ ID NO: 3131895 - DNA, 23 bp, Homo sapiens
tggaaaacaaagccaaacaaaac

SEQ ID NO: 3131896 - DNA, 13 bp, Homo sapiens
tggaaaaccagga

SEQ ID NO: 3131897 - DNA, 15 bp, Homo sapiens
tggaaaactgtgttg

SEQ ID NO: 3131898 - DNA, 15 bp, Homo sapiens
tggaaaagaactgtt

SEQ ID NO: 3131899 - DNA, 14 bp, Homo sapiens
tggaaaagaataca

SEQ ID NO: 3131900 - DNA, 13 bp, Homo sapiens
tggaaaataaaca

SEQ ID NO: 3131901 - DNA, 14 bp, Homo sapiens
tggaaaataaacat

SEQ ID NO: 3131902 - DNA, 15 bp, Homo sapiens
tggaaaataaattat

SEQ ID NO: 3131903 - DNA, 16 bp, Homo sapiens
tggaaaataaattatt

SEQ ID NO: 3131904 - DNA, 23 bp, Homo sapiens
tggaaaataagacaatagtattt

SEQ ID NO: 3131905 - DNA, 22 bp, Homo sapiens
tggaaaatacctaattgtggat

SEQ ID NO: 3131906 - DNA, 14 bp, Homo sapiens
tggaaacaggacca

SEQ ID NO: 3131907 - DNA, 17 bp, Homo sapiens
tggaaacattacagttc

SEQ ID NO: 3131908 - DNA, 12 bp, Homo sapiens
tggaaaccacag

SEQ ID NO: 3131909 - DNA, 17 bp, Homo sapiens
tggaaaccctgagagtc

SEQ ID NO: 3131910 - DNA, 17 bp, Homo sapiens
tggaaacctgtcattgt

SEQ ID NO: 3131911 - DNA, 19 bp, Homo sapiens
tggaaactgctaaattcta

SEQ ID NO: 3131912 - DNA, 21 bp, Homo sapiens
tggaaactgctaaattctatg

SEQ ID NO: 3131913 - DNA, 10 bp, Homo sapiens
tggaaagaga

SEQ ID NO: 3131914 - DNA, 20 bp, Homo sapiens
tggaaagatgttaagcattt

SEQ ID NO: 3131915 - DNA, 16 bp, Homo sapiens
tggaaagcatcacctc

SEQ ID NO: 3131916 - DNA, 15 bp, Homo sapiens
tggaaagcctctgct

SEQ ID NO: 3131917 - DNA, 16 bp, Homo sapiens
tggaaagcctctgctg

SEQ ID NO: 3131918 - DNA, 18 bp, Homo sapiens
tggaaagcctctgctgcc

SEQ ID NO: 3131919 - DNA, 20 bp, Homo sapiens
tggaaaggctcagtctcagg

SEQ ID NO: 3131920 - DNA, 13 bp, Homo sapiens
tggaaaggggaga

SEQ ID NO: 3131921 - DNA, 14 bp, Homo sapiens
tggaaaggggagag

SEQ ID NO: 3131922 - DNA, 19 bp, Homo sapiens
tggaaaggggagagcctgc

SEQ ID NO: 3131923 - DNA, 22 bp, Homo sapiens
tggaaaggggagagcctgctgg

SEQ ID NO: 3131924 - DNA, 23 bp, Homo sapiens
tggaaaggggagagcctgctggc

SEQ ID NO: 3131925 - DNA, 19 bp, Homo sapiens
tggaaagtacactctgctg

SEQ ID NO: 3131926 - DNA, 15 bp, Homo sapiens
tggaaagtgaatttg

SEQ ID NO: 3131927 - DNA, 22 bp, Homo sapiens
tggaaagtgccagcattccaga

SEQ ID NO: 3131928 - DNA, 16 bp, Homo sapiens
tggaaataaactgtgc

SEQ ID NO: 3131929 - DNA, 15 bp, Homo sapiens
tggaaatacacagtg

SEQ ID NO: 3131930 - DNA, 17 bp, Homo sapiens
tggaaatattttgataa

SEQ ID NO: 3131931 - DNA, 18 bp, Homo sapiens
tggaaatcatcgaaaatt

SEQ ID NO: 3131932 - DNA, 22 bp, Homo sapiens
tggaaatcctagtttcctctcc

SEQ ID NO: 3131933 - DNA, 22 bp, Homo sapiens
tggaaatcgcttatatgtcctt

SEQ ID NO: 3131934 - DNA, 22 bp, Homo sapiens
tggaaattccttgccccacagt

SEQ ID NO: 3131935 - DNA, 16 bp, Homo sapiens
tggaaattggaagagc

SEQ ID NO: 3131936 - DNA, 21 bp, Homo sapiens
tggaaatttgttataatgaat

SEQ ID NO: 3131937 - DNA, 23 bp, Homo sapiens
tggaaatttgttataatgaatga

SEQ ID NO: 3131938 - DNA, 14 bp, Homo sapiens
tggaacaccttggg

SEQ ID NO: 3131939 - DNA, 12 bp, Homo sapiens
tggaacatttct

SEQ ID NO: 3131940 - DNA, 17 bp, Homo sapiens
tggaaccagggaggaga

SEQ ID NO: 3131941 - DNA, 19 bp, Homo sapiens
tggaaccagggaggagagg

SEQ ID NO: 3131942 - DNA, 21 bp, Homo sapiens
tggaacccagcagttctgtta

SEQ ID NO: 3131943 - DNA, 13 bp, Homo sapiens
tggaacctctgtc

SEQ ID NO: 3131944 - DNA, 20 bp, Homo sapiens
tggaacctctgtctcatcct

SEQ ID NO: 3131945 - DNA, 14 bp, Homo sapiens
tggaaccttccctc

SEQ ID NO: 3131946 - DNA, 13 bp, Homo sapiens
tggaaccttgctg

SEQ ID NO: 3131947 - DNA, 18 bp, Homo sapiens
tggaaccttgctgtcctg

SEQ ID NO: 3131948 - DNA, 13 bp, Homo sapiens
tggaaccttgttt

SEQ ID NO: 3131949 - DNA, 17 bp, Homo sapiens
tggaactaataaataca

SEQ ID NO: 3131950 - DNA, 17 bp, Homo sapiens
tggaactacattactgt

SEQ ID NO: 3131951 - DNA, 20 bp, Homo sapiens
tggaactctatctgggcctg

SEQ ID NO: 3131952 - DNA, 21 bp, Homo sapiens
tggaactctatctgggcctgg

SEQ ID NO: 3131953 - DNA, 22 bp, Homo sapiens
tggaactctatctgggcctggg

SEQ ID NO: 3131954 - DNA, 13 bp, Homo sapiens
tggaactgacccc

SEQ ID NO: 3131955 - DNA, 14 bp, Homo sapiens
tggaacttctaata

SEQ ID NO: 3131956 - DNA, 13 bp, Homo sapiens
tgctgagctgggc

SEQ ID NO: 3131957 - DNA, 14 bp, Homo sapiens
tgcatctcaaaatt

SEQ ID NO: 3131958 - DNA, 21 bp, Homo sapiens
tgcatctcactggatgcaaag

SEQ ID NO: 3131959 - DNA, 14 bp, Homo sapiens
tgcatctcagccca

SEQ ID NO: 3131960 - DNA, 15 bp, Homo sapiens
tgcatctcagcccac

SEQ ID NO: 3131961 - DNA, 18 bp, Homo sapiens
tgcatcttatagcacttt

SEQ ID NO: 3131962 - DNA, 10 bp, Homo sapiens
tgcatgaaat

SEQ ID NO: 3131963 - DNA, 22 bp, Homo sapiens
tgcatgaagagaagcaattttg

SEQ ID NO: 3131964 - DNA, 20 bp, Homo sapiens
tgcatgaattactgtatata

SEQ ID NO: 3131965 - DNA, 20 bp, Homo sapiens
tgcatgacctaccaggacag

SEQ ID NO: 3131966 - DNA, 15 bp, Homo sapiens
tgcatgagcttttat

SEQ ID NO: 3131967 - DNA, 14 bp, Homo sapiens
tgcatgattttgta

SEQ ID NO: 3131968 - DNA, 22 bp, Homo sapiens
tgcatgcaaatgagctctgaaa

SEQ ID NO: 3131969 - DNA, 18 bp, Homo sapiens
tgcatggacctaacattc

SEQ ID NO: 3131970 - DNA, 13 bp, Homo sapiens
tgcatggaggccc

SEQ ID NO: 3131971 - DNA, 21 bp, Homo sapiens
tgcatggattcagcatgtcca

SEQ ID NO: 3131972 - DNA, 18 bp, Homo sapiens
tgcatggctccagaaatg

SEQ ID NO: 3131973 - DNA, 16 bp, Homo sapiens
tgcatgggggcaccgg

SEQ ID NO: 3131974 - DNA, 22 bp, Homo sapiens
tgcatgggggcaccgggctcca

SEQ ID NO: 3131975 - DNA, 23 bp, Homo sapiens
tgcatggggtggggtagggctga

SEQ ID NO: 3131976 - DNA, 17 bp, Homo sapiens
tgcatgggtgaagggag

SEQ ID NO: 3131977 - DNA, 14 bp, Homo sapiens
tgcatgtatgtctt

SEQ ID NO: 3131978 - DNA, 21 bp, Homo sapiens
tgcatgtcgtgaccaactaga

SEQ ID NO: 3131979 - DNA, 14 bp, Homo sapiens
tgcatgtcttttaa

SEQ ID NO: 3131980 - DNA, 24 bp, Homo sapiens
tgcatgtggtttggttcctctctg

SEQ ID NO: 3131981 - DNA, 15 bp, Homo sapiens
tgcatgtgtgtataa

SEQ ID NO: 3131982 - DNA, 14 bp, Homo sapiens
tgcatgttaccatc

SEQ ID NO: 3131983 - DNA, 16 bp, Homo sapiens
tgcattaaacctgtct

SEQ ID NO: 3131984 - DNA, 21 bp, Homo sapiens
tgcattaaacctgtctccact

SEQ ID NO: 3131985 - DNA, 15 bp, Homo sapiens
tgcattaaattcaca

SEQ ID NO: 3131986 - DNA, 16 bp, Homo sapiens
tgcattaaattcacaa

SEQ ID NO: 3131987 - DNA, 20 bp, Homo sapiens
tgcattaaattcacaaactt

SEQ ID NO: 3131988 - DNA, 21 bp, Homo sapiens
tgcattaaattcacaaacttt

SEQ ID NO: 3131989 - DNA, 16 bp, Homo sapiens
tgcattacagagagga

SEQ ID NO: 3131990 - DNA, 18 bp, Homo sapiens
tgcattacagagaggaga

SEQ ID NO: 3131991 - DNA, 23 bp, Homo sapiens
tgcattacagagaggagaaacac

SEQ ID NO: 3131992 - DNA, 19 bp, Homo sapiens
tgcattagaaatagacagt

SEQ ID NO: 3131993 - DNA, 23 bp, Homo sapiens
tgcattagaaattagctgtgtga

SEQ ID NO: 3131994 - DNA, 21 bp, Homo sapiens
tgcattagagcccatttcaat

SEQ ID NO: 3131995 - DNA, 16 bp, Homo sapiens
tgcattagcacagatt

SEQ ID NO: 3131996 - DNA, 14 bp, Homo sapiens
tgcattattaaatt

SEQ ID NO: 3131997 - DNA, 17 bp, Homo sapiens
tgcattattaaattgta

SEQ ID NO: 3131998 - DNA, 12 bp, Homo sapiens
tgcattcatttt

SEQ ID NO: 3131999 - DNA, 16 bp, Homo sapiens
tgcattcctgtaactt

SEQ ID NO: 3132000 - DNA, 20 bp, Homo sapiens
tgcattcctttgtcttcaaa

SEQ ID NO: 3132001 - DNA, 15 bp, Homo sapiens
tgcattctctcccat

SEQ ID NO: 3132002 - DNA, 20 bp, Homo sapiens
tgccgtctaggattgggcct

SEQ ID NO: 3132003 - DNA, 18 bp, Homo sapiens
tgccgtctcatcttctct

SEQ ID NO: 3132004 - DNA, 20 bp, Homo sapiens
tgccgtggattgcacgtggc

SEQ ID NO: 3132005 - DNA, 23 bp, Homo sapiens
tgccgtggggccgccgcctcttt

SEQ ID NO: 3132006 - DNA, 23 bp, Homo sapiens
tgccgtgtgagtgtgacagggcc

SEQ ID NO: 3132007 - DNA, 14 bp, Homo sapiens
tgcctaacaccagc

SEQ ID NO: 3132008 - DNA, 20 bp, Homo sapiens
tgcctaaccaggcccagcca

SEQ ID NO: 3132009 - DNA, 18 bp, Homo sapiens
tgcctaagcattgcctgg

SEQ ID NO: 3132010 - DNA, 15 bp, Homo sapiens
tgcctaatggagaag

SEQ ID NO: 3132011 - DNA, 16 bp, Homo sapiens
tgcctaattggaaagt

SEQ ID NO: 3132012 - DNA, 23 bp, Homo sapiens
tgcctaattggaaagtgccagca

SEQ ID NO: 3132013 - DNA, 16 bp, Homo sapiens
tgcctacaaccatccc

SEQ ID NO: 3132014 - DNA, 12 bp, Homo sapiens
tgcctaccattt

SEQ ID NO: 3132015 - DNA, 17 bp, Homo sapiens
tgcctagcaagctggcc

SEQ ID NO: 3132016 - DNA, 17 bp, Homo sapiens
tgcctaggaattcccag

SEQ ID NO: 3132017 - DNA, 17 bp, Homo sapiens
tgcctaggcgattttgt

SEQ ID NO: 3132018 - DNA, 13 bp, Homo sapiens
tgcctagttttta

SEQ ID NO: 3132019 - DNA, 20 bp, Homo sapiens
tgcctataatcttatacaac

SEQ ID NO: 3132020 - DNA, 18 bp, Homo sapiens
tgcctatagtcccagcta

SEQ ID NO: 3132021 - DNA, 13 bp, Homo sapiens
tgcctcaatgcca

SEQ ID NO: 3132022 - DNA, 16 bp, Homo sapiens
tgcctcaatgccagta

SEQ ID NO: 3132023 - DNA, 17 bp, Homo sapiens
tgcctcaccctcccaag

SEQ ID NO: 3132024 - DNA, 18 bp, Homo sapiens
tgcctcaccctcccaagt

SEQ ID NO: 3132025 - DNA, 16 bp, Homo sapiens
tgcctcaccgcttccc

SEQ ID NO: 3132026 - DNA, 22 bp, Homo sapiens
tgcctcactaatttttgtatta

SEQ ID NO: 3132027 - DNA, 15 bp, Homo sapiens
tgcctcactgggggc

SEQ ID NO: 3132028 - DNA, 12 bp, Homo sapiens
tgcctcagcctc

SEQ ID NO: 3132029 - DNA, 12 bp, Homo sapiens
tgcctcaggttc

SEQ ID NO: 3132030 - DNA, 14 bp, Homo sapiens
tgcctcagtggcag

SEQ ID NO: 3132031 - DNA, 20 bp, Homo sapiens
tgcctcagtggcagcatcct

SEQ ID NO: 3132032 - DNA, 16 bp, Homo sapiens
tgcctccaccaccact

SEQ ID NO: 3132033 - DNA, 17 bp, Homo sapiens
tgcctccaccaccactg

SEQ ID NO: 3132034 - DNA, 20 bp, Homo sapiens
tgcctccaccaccactggcc

SEQ ID NO: 3132035 - DNA, 21 bp, Homo sapiens
tgcctccaccaccactggcca

SEQ ID NO: 3132036 - DNA, 13 bp, Homo sapiens
tgcctccaggtgt

SEQ ID NO: 3132037 - DNA, 15 bp, Homo sapiens
tgcctccaggtgtgc

SEQ ID NO: 3132038 - DNA, 19 bp, Homo sapiens
tgcctcccaaggtcctctc

SEQ ID NO: 3132039 - DNA, 22 bp, Homo sapiens
tgcctcccacacttgctggggc

SEQ ID NO: 3132040 - DNA, 15 bp, Homo sapiens
tgcctcccatgcctg

SEQ ID NO: 3132041 - DNA, 22 bp, Homo sapiens
tgcctccccatttcccatctgc

SEQ ID NO: 3132042 - DNA, 17 bp, Homo sapiens
tgcctcccctctccttc

SEQ ID NO: 3132043 - DNA, 15 bp, Homo sapiens
tgcctccgctggctt

SEQ ID NO: 3132044 - DNA, 19 bp, Homo sapiens
tgcctccgctggctttggg

SEQ ID NO: 3132045 - DNA, 19 bp, Homo sapiens
tgcctccgtcccctgccca

SEQ ID NO: 3132046 - DNA, 22 bp, Homo sapiens
tgcctcctcaaacccagtctca

SEQ ID NO: 3132047 - DNA, 20 bp, Homo sapiens
tgcctcctcgttcctttctc

SEQ ID NO: 3132048 - DNA, 13 bp, Homo sapiens
tgcctcctgggaa

SEQ ID NO: 3132049 - DNA, 14 bp, Homo sapiens
tgcctcctgggaag

SEQ ID NO: 3132050 - DNA, 20 bp, Homo sapiens
tgcctcctgggaagatgagg

SEQ ID NO: 3132051 - DNA, 14 bp, Homo sapiens
tgcctcctgtgggg

SEQ ID NO: 3132052 - DNA, 20 bp, Homo sapiens
tgcctcctgtgtactgtgtc

SEQ ID NO: 3132053 - DNA, 13 bp, Homo sapiens
tgcctcgaaacac

SEQ ID NO: 3132054 - DNA, 18 bp, Homo sapiens
tgcctcgaactggctgca

SEQ ID NO: 3132055 - DNA, 20 bp, Homo sapiens
tgcctcgaactggctgcaaa

SEQ ID NO: 3132056 - DNA, 12 bp, Homo sapiens
tgcctctcacac

SEQ ID NO: 3132057 - DNA, 18 bp, Homo sapiens
tgcctctcatcaactgaa

SEQ ID NO: 3132058 - DNA, 21 bp, Homo sapiens
tgcctctcatcaactgaatga

SEQ ID NO: 3132059 - DNA, 20 bp, Homo sapiens
tgcctctcgctcctcaaccc

SEQ ID NO: 3132060 - DNA, 18 bp, Homo sapiens
tgcctctgatatgggact

SEQ ID NO: 3132061 - DNA, 21 bp, Homo sapiens
tgcctctgatatgggactgag

SEQ ID NO: 3132062 - DNA, 11 bp, Homo sapiens
tgcctctgcca

SEQ ID NO: 3132063 - DNA, 14 bp, Homo sapiens
tgcctctgcctctg

SEQ ID NO: 3132064 - DNA, 13 bp, Homo sapiens
tgcctctgcctgt

SEQ ID NO: 3132065 - DNA, 18 bp, Homo sapiens
tgcctctgcctgtctccc

SEQ ID NO: 3132066 - DNA, 14 bp, Homo sapiens
tgcctctgccttag

SEQ ID NO: 3132067 - DNA, 19 bp, Homo sapiens
tgcctctgcggggcagggc

SEQ ID NO: 3132068 - DNA, 17 bp, Homo sapiens
tgcctctgctccctctg

SEQ ID NO: 3132069 - DNA, 19 bp, Homo sapiens
tgcctctggaggcctctgg

SEQ ID NO: 3132070 - DNA, 16 bp, Homo sapiens
tgcctctgtgctgtgt

SEQ ID NO: 3132071 - DNA, 11 bp, Homo sapiens
tgcctctttcc

SEQ ID NO: 3132072 - DNA, 18 bp, Homo sapiens
tgcctctttcctgttgtt

SEQ ID NO: 3132073 - DNA, 19 bp, Homo sapiens
tgcctcttttcacattttt

SEQ ID NO: 3132074 - DNA, 14 bp, Homo sapiens
tgcctgaaacagcc

SEQ ID NO: 3132075 - DNA, 22 bp, Homo sapiens
tgcctgaaacagccatgtccaa

SEQ ID NO: 3132076 - DNA, 17 bp, Homo sapiens
tgcctgaagtcacacag

SEQ ID NO: 3132077 - DNA, 19 bp, Homo sapiens
tgcctgacactgagcccca

SEQ ID NO: 3132078 - DNA, 17 bp, Homo sapiens
tgcctgaccccttgctc

SEQ ID NO: 3132079 - DNA, 20 bp, Homo sapiens
tgcctgactaatttttgtat

SEQ ID NO: 3132080 - DNA, 21 bp, Homo sapiens
tgcctgactgcccgctcctcg

SEQ ID NO: 3132081 - DNA, 18 bp, Homo sapiens
tgcctgagaggcaggcat

SEQ ID NO: 3132082 - DNA, 19 bp, Homo sapiens
tgcctgagtcacccatgaa

SEQ ID NO: 3132083 - DNA, 22 bp, Homo sapiens
tgcctgcagccccgcgcctcct

SEQ ID NO: 3132084 - DNA, 14 bp, Homo sapiens
tgcctgccatgggc

SEQ ID NO: 3132085 - DNA, 18 bp, Homo sapiens
tgcctgccatgggccagc

SEQ ID NO: 3132086 - DNA, 21 bp, Homo sapiens
tgcctgccatgggccagccta

SEQ ID NO: 3132087 - DNA, 18 bp, Homo sapiens
tgcctgcccaggcccctg

SEQ ID NO: 3132088 - DNA, 18 bp, Homo sapiens
tgcctgccccaaacaaat

SEQ ID NO: 3132089 - DNA, 15 bp, Homo sapiens
tgcctgccccacacg

SEQ ID NO: 3132090 - DNA, 21 bp, Homo sapiens
tgcctgcccctaccctggact

SEQ ID NO: 3132091 - DNA, 22 bp, Homo sapiens
tgcctgcccctaccctggactt

SEQ ID NO: 3132092 - DNA, 18 bp, Homo sapiens
tgcctgcccgcacagcag

SEQ ID NO: 3132093 - DNA, 19 bp, Homo sapiens
tgcctgcccgcacagcagc

SEQ ID NO: 3132094 - DNA, 15 bp, Homo sapiens
tgcctgctgagagag

SEQ ID NO: 3132095 - DNA, 17 bp, Homo sapiens
tgcctgctttttggaaa

SEQ ID NO: 3132096 - DNA, 23 bp, Homo sapiens
tgcctggaagagccgagcacctg

SEQ ID NO: 3132097 - DNA, 21 bp, Homo sapiens
tgcctggacatttgccttgct

SEQ ID NO: 3132098 - DNA, 15 bp, Homo sapiens
tgcctggagacagat

SEQ ID NO: 3132099 - DNA, 22 bp, Homo sapiens
tgcctggagacgtggaacctct

SEQ ID NO: 3132100 - DNA, 16 bp, Homo sapiens
tgcctggagagggtct

SEQ ID NO: 3132101 - DNA, 21 bp, Homo sapiens
tgcctggagtgcccaccctgg

SEQ ID NO: 3132102 - DNA, 23 bp, Homo sapiens
tgcctggatgagaaacagctcag

SEQ ID NO: 3132103 - DNA, 23 bp, Homo sapiens
tgcctggcaggctgtctggccag

SEQ ID NO: 3132104 - DNA, 22 bp, Homo sapiens
tgcctggcctggcacacatcag

SEQ ID NO: 3132105 - DNA, 13 bp, Homo sapiens
tgcctggctgtgg

SEQ ID NO: 3132106 - DNA, 14 bp, Homo sapiens
tgcctggctgtgga

SEQ ID NO: 3132107 - DNA, 16 bp, Homo sapiens
tgcctgggaatgtatt

SEQ ID NO: 3132108 - DNA, 17 bp, Homo sapiens
tgcctggtgaatggcct

SEQ ID NO: 3132109 - DNA, 19 bp, Homo sapiens
tgcctggtgcactgtgtct

SEQ ID NO: 3132110 - DNA, 16 bp, Homo sapiens
tgcctggtggcagctg

SEQ ID NO: 3132111 - DNA, 18 bp, Homo sapiens
tgcctggtggtcagatgc

SEQ ID NO: 3132112 - DNA, 20 bp, Homo sapiens
tgcctgtagctttcctggtc

SEQ ID NO: 3132113 - DNA, 22 bp, Homo sapiens
tgcctgtagctttcctggtccc

SEQ ID NO: 3132114 - DNA, 15 bp, Homo sapiens
tgcctgtagttagga

SEQ ID NO: 3132115 - DNA, 18 bp, Homo sapiens
tgcctgtagttaggaaat

SEQ ID NO: 3132116 - DNA, 19 bp, Homo sapiens
tgcctgtagttaggaaata

SEQ ID NO: 3132117 - DNA, 23 bp, Homo sapiens
tgcctgtagttaggaaataaaac

SEQ ID NO: 3132118 - DNA, 21 bp, Homo sapiens
tgcctgtcaggctctggccct

SEQ ID NO: 3132119 - DNA, 22 bp, Homo sapiens
tgcctgtcaggctctggccctt

SEQ ID NO: 3132120 - DNA, 16 bp, Homo sapiens
tgcctgtccagcctgg

SEQ ID NO: 3132121 - DNA, 18 bp, Homo sapiens
tgcctgtccagcctgggc

SEQ ID NO: 3132122 - DNA, 12 bp, Homo sapiens
tgcctgtgccaa

SEQ ID NO: 3132123 - DNA, 14 bp, Homo sapiens
tgcctgtgccaata

SEQ ID NO: 3132124 - DNA, 16 bp, Homo sapiens
tgcctgtgccaataaa

SEQ ID NO: 3132125 - DNA, 14 bp, Homo sapiens
tgcctgtgccaccc

SEQ ID NO: 3132126 - DNA, 23 bp, Homo sapiens
tgcctgtgcctgccatgggccag

SEQ ID NO: 3132127 - DNA, 21 bp, Homo sapiens
tgcctgtggcgccgtctccag

SEQ ID NO: 3132128 - DNA, 18 bp, Homo sapiens
tgcctgttataactctgc

SEQ ID NO: 3132129 - DNA, 18 bp, Homo sapiens
tgcctgttcagctccagc

SEQ ID NO: 3132130 - DNA, 20 bp, Homo sapiens
tgccttaaaaccaaagaggg

SEQ ID NO: 3132131 - DNA, 19 bp, Homo sapiens
tgccttaaacactcacctt

SEQ ID NO: 3132132 - DNA, 15 bp, Homo sapiens
tgccttaaagaaagt

SEQ ID NO: 3132133 - DNA, 18 bp, Homo sapiens
tgccttactcttcttgaa

SEQ ID NO: 3132134 - DNA, 22 bp, Homo sapiens
tgccttagaaatgtaaactgcc

SEQ ID NO: 3132135 - DNA, 23 bp, Homo sapiens
tgccttagaaatgtaaactgcca

SEQ ID NO: 3132136 - DNA, 21 bp, Homo sapiens
tgccttagaacctttcttaca

SEQ ID NO: 3132137 - DNA, 16 bp, Homo sapiens
tgccttagaggagccc

SEQ ID NO: 3132138 - DNA, 15 bp, Homo sapiens
tgccttagtctcagt

SEQ ID NO: 3132139 - DNA, 16 bp, Homo sapiens
tgccttagtctcagtt

SEQ ID NO: 3132140 - DNA, 13 bp, Homo sapiens
tgccttcagctct

SEQ ID NO: 3132141 - DNA, 18 bp, Homo sapiens
tgccttcagctctacagc

SEQ ID NO: 3132142 - DNA, 17 bp, Homo sapiens
tgccttcaggcttctgt

SEQ ID NO: 3132143 - DNA, 18 bp, Homo sapiens
tgccttcatcttcactgc

SEQ ID NO: 3132144 - DNA, 14 bp, Homo sapiens
tgccttccataatt

SEQ ID NO: 3132145 - DNA, 17 bp, Homo sapiens
tgccttccataattatg

SEQ ID NO: 3132146 - DNA, 13 bp, Homo sapiens
tgccttcccctgt

SEQ ID NO: 3132147 - DNA, 16 bp, Homo sapiens
tgccttcctttctcca

SEQ ID NO: 3132148 - DNA, 21 bp, Homo sapiens
tgccttcctttctccaggacc

SEQ ID NO: 3132149 - DNA, 23 bp, Homo sapiens
tgccttcctttctccaggaccaa

SEQ ID NO: 3132150 - DNA, 17 bp, Homo sapiens
tgccttcgcttcttgcc

SEQ ID NO: 3132151 - DNA, 22 bp, Homo sapiens
tgccttcgcttcttgcctctgt

SEQ ID NO: 3132152 - DNA, 20 bp, Homo sapiens
tgccttcgttaactgtgtat

SEQ ID NO: 3132153 - DNA, 21 bp, Homo sapiens
tgccttctcctctctgggcct

SEQ ID NO: 3132154 - DNA, 17 bp, Homo sapiens
tgccttctccttcccca

SEQ ID NO: 3132155 - DNA, 19 bp, Homo sapiens
tgccttctgacggccctgc

SEQ ID NO: 3132156 - DNA, 17 bp, Homo sapiens
tgccttctgggcttttt

SEQ ID NO: 3132157 - DNA, 17 bp, Homo sapiens
tgccttctgtcctggtg

SEQ ID NO: 3132158 - DNA, 13 bp, Homo sapiens
tgccttcttcacc

SEQ ID NO: 3132159 - DNA, 22 bp, Homo sapiens
tgccttcttctttttgctgttg

SEQ ID NO: 3132160 - DNA, 13 bp, Homo sapiens
tgccttcttttgt

SEQ ID NO: 3132161 - DNA, 14 bp, Homo sapiens
tgccttcttttgta

SEQ ID NO: 3132162 - DNA, 18 bp, Homo sapiens
tgccttgaactgttgtct

SEQ ID NO: 3132163 - DNA, 13 bp, Homo sapiens
tgccttgctgttt

SEQ ID NO: 3132164 - DNA, 12 bp, Homo sapiens
tgccttggcctc

SEQ ID NO: 3132165 - DNA, 15 bp, Homo sapiens
tgccttggcctcggc

SEQ ID NO: 3132166 - DNA, 16 bp, Homo sapiens
tgccttgggccttgct

SEQ ID NO: 3132167 - DNA, 17 bp, Homo sapiens
tgccttgggccttgctg

SEQ ID NO: 3132168 - DNA, 11 bp, Homo sapiens
tgccttgggct

SEQ ID NO: 3132169 - DNA, 13 bp, Homo sapiens
tgccttgtataaa

SEQ ID NO: 3132170 - DNA, 22 bp, Homo sapiens
tgcctttaacagaaactttcaa

SEQ ID NO: 3132171 - DNA, 17 bp, Homo sapiens
tgcctttatatttcaca

SEQ ID NO: 3132172 - DNA, 10 bp, Homo sapiens
tgcctttcct

SEQ ID NO: 3132173 - DNA, 13 bp, Homo sapiens
tgcctttcctgtt

SEQ ID NO: 3132174 - DNA, 16 bp, Homo sapiens
tgcctttcctgttcag

SEQ ID NO: 3132175 - DNA, 15 bp, Homo sapiens
tgcctttctgggagc

SEQ ID NO: 3132176 - DNA, 18 bp, Homo sapiens
tgcctttctgggagcaga

SEQ ID NO: 3132177 - DNA, 21 bp, Homo sapiens
tgcctttctgggagcagaaac

SEQ ID NO: 3132178 - DNA, 17 bp, Homo sapiens
tgcctttcttctgccct

SEQ ID NO: 3132179 - DNA, 20 bp, Homo sapiens
tgcctttgagacagtttctt

SEQ ID NO: 3132180 - DNA, 23 bp, Homo sapiens
tgcctttgagacagtttcttagc

SEQ ID NO: 3132181 - DNA, 12 bp, Homo sapiens
tgcctttgtaag

SEQ ID NO: 3132182 - DNA, 15 bp, Homo sapiens
tgcctttgtaagtta

SEQ ID NO: 3132183 - DNA, 22 bp, Homo sapiens
tgccttttatagctattactgt

SEQ ID NO: 3132184 - DNA, 14 bp, Homo sapiens
tgccttttatccca

SEQ ID NO: 3132185 - DNA, 14 bp, Homo sapiens
tgccttttgcaccc

SEQ ID NO: 3132186 - DNA, 22 bp, Homo sapiens
tgccttttgcacccctcccatt

SEQ ID NO: 3132187 - DNA, 15 bp, Homo sapiens
tgccttttgctgcgc

SEQ ID NO: 3132188 - DNA, 19 bp, Homo sapiens
tgccttttttgtagttttt

SEQ ID NO: 3132189 - DNA, 19 bp, Homo sapiens
tgcgacggagagaaaaaag

SEQ ID NO: 3132190 - DNA, 17 bp, Homo sapiens
tgcgactttctgcctgg

SEQ ID NO: 3132191 - DNA, 18 bp, Homo sapiens
tgcgactttctgcctgga

SEQ ID NO: 3132192 - DNA, 19 bp, Homo sapiens
tgcgatctgggttcactgc

SEQ ID NO: 3132193 - DNA, 21 bp, Homo sapiens
tgcgatctgggttcactgcaa

SEQ ID NO: 3132194 - DNA, 15 bp, Homo sapiens
tgcgcaccaatgccc

SEQ ID NO: 3132195 - DNA, 17 bp, Homo sapiens
tgcgcaccaatgcccag

SEQ ID NO: 3132196 - DNA, 18 bp, Homo sapiens
tgcgcaccaatgcccagc

SEQ ID NO: 3132197 - DNA, 21 bp, Homo sapiens
tgcgcaccaatgcccagcagg

SEQ ID NO: 3132198 - DNA, 21 bp, Homo sapiens
tgcgccacttcctttgtgttt

SEQ ID NO: 3132199 - DNA, 23 bp, Homo sapiens
tgcgccccctccgccctgccact

SEQ ID NO: 3132200 - DNA, 17 bp, Homo sapiens
tgcgccccgcccacacc

SEQ ID NO: 3132201 - DNA, 16 bp, Homo sapiens
tgcgcctacaggagtg

SEQ ID NO: 3132202 - DNA, 22 bp, Homo sapiens
tgcgcctacaggagtgagcact

SEQ ID NO: 3132203 - DNA, 14 bp, Homo sapiens
tgcgcctgtgacca

SEQ ID NO: 3132204 - DNA, 14 bp, Homo sapiens
tgcgctcggcagga

SEQ ID NO: 3132205 - DNA, 18 bp, Homo sapiens
tgcgctcggcaggaagga

SEQ ID NO: 3132206 - DNA, 19 bp, Homo sapiens
tgcgctcggcaggaaggag

SEQ ID NO: 3132207 - DNA, 18 bp, Homo sapiens
tgcggacagccacggcca

SEQ ID NO: 3132208 - DNA, 23 bp, Homo sapiens
tgcggacagccacggccaggcca

SEQ ID NO: 3132209 - DNA, 17 bp, Homo sapiens
tgcggaccaagggactc

SEQ ID NO: 3132210 - DNA, 16 bp, Homo sapiens
tgcggagtgaagaggg

SEQ ID NO: 3132211 - DNA, 15 bp, Homo sapiens
tgcggccccaggagg

SEQ ID NO: 3132212 - DNA, 23 bp, Homo sapiens
tgcggccccctctcggccaggca

SEQ ID NO: 3132213 - DNA, 19 bp, Homo sapiens
tgcggcgtggagactggca

SEQ ID NO: 3132214 - DNA, 22 bp, Homo sapiens
tgcggcgtggagactggcaggc

SEQ ID NO: 3132215 - DNA, 17 bp, Homo sapiens
tgcgggagctctgtatg

SEQ ID NO: 3132216 - DNA, 17 bp, Homo sapiens
tgcgggaggccctggcc

SEQ ID NO: 3132217 - DNA, 18 bp, Homo sapiens
tgcgggatggtcctgggg

SEQ ID NO: 3132218 - DNA, 19 bp, Homo sapiens
tgcgggatggtcctggggc

SEQ ID NO: 3132219 - DNA, 22 bp, Homo sapiens
tgcgtctggaggggcccctgct

SEQ ID NO: 3132220 - DNA, 14 bp, Homo sapiens
tgcgtgaaacacac

SEQ ID NO: 3132221 - DNA, 17 bp, Homo sapiens
tgcgtgccgcctgctcc

SEQ ID NO: 3132222 - DNA, 23 bp, Homo sapiens
tgcgtgccgcctgctcctcactg

SEQ ID NO: 3132223 - DNA, 16 bp, Homo sapiens
tgcgtggctgtggcac

SEQ ID NO: 3132224 - DNA, 12 bp, Homo sapiens
tgcgtgtgtaga

SEQ ID NO: 3132225 - DNA, 21 bp, Homo sapiens
tgcgtgtgtagagttaagaag

SEQ ID NO: 3132226 - DNA, 16 bp, Homo sapiens
tgcgttctgcaagcat

SEQ ID NO: 3132227 - DNA, 13 bp, Homo sapiens
tgcgttggagcca

SEQ ID NO: 3132228 - DNA, 16 bp, Homo sapiens
tgcgttggagccactc

SEQ ID NO: 3132229 - DNA, 13 bp, Homo sapiens
tgcgtttttacag

SEQ ID NO: 3132230 - DNA, 15 bp, Homo sapiens
tgctaaaaaaagtgc

SEQ ID NO: 3132231 - DNA, 23 bp, Homo sapiens
tgctaaacaagtaagaaaaataa

SEQ ID NO: 3132232 - DNA, 22 bp, Homo sapiens
tgctaaagcactttgcacttaa

SEQ ID NO: 3132233 - DNA, 13 bp, Homo sapiens
tgctaaagccagg

SEQ ID NO: 3132234 - DNA, 14 bp, Homo sapiens
tgctaaagccagga

SEQ ID NO: 3132235 - DNA, 12 bp, Homo sapiens
tgctaaatctcc

SEQ ID NO: 3132236 - DNA, 16 bp, Homo sapiens
tgctaaatctcctatt

SEQ ID NO: 3132237 - DNA, 17 bp, Homo sapiens
tgctaaatctcctattt

SEQ ID NO: 3132238 - DNA, 18 bp, Homo sapiens
tgctaaattctatgttaa

SEQ ID NO: 3132239 - DNA, 20 bp, Homo sapiens
tgctaaattctatgttaaat

SEQ ID NO: 3132240 - DNA, 19 bp, Homo sapiens
tgctaaatttttaactgcc

SEQ ID NO: 3132241 - DNA, 23 bp, Homo sapiens
tgctaaccacgtctgtcttcaca

SEQ ID NO: 3132242 - DNA, 15 bp, Homo sapiens
tgctaacctaaaaga

SEQ ID NO: 3132243 - DNA, 16 bp, Homo sapiens
tgctaaccttgtagca

SEQ ID NO: 3132244 - DNA, 22 bp, Homo sapiens
tgctaagaagcgagcactgacc

SEQ ID NO: 3132245 - DNA, 19 bp, Homo sapiens
tgctaagaatgcattattg

SEQ ID NO: 3132246 - DNA, 16 bp, Homo sapiens
tgctaaggctcctcct

SEQ ID NO: 3132247 - DNA, 12 bp, Homo sapiens
tgctaaggttct

SEQ ID NO: 3132248 - DNA, 13 bp, Homo sapiens
tgctaaggttcta

SEQ ID NO: 3132249 - DNA, 15 bp, Homo sapiens
tgctaagtctttccc

SEQ ID NO: 3132250 - DNA, 21 bp, Homo sapiens
tgctaataaacactggctctg

SEQ ID NO: 3132251 - DNA, 22 bp, Homo sapiens
tgctaataaacactggctctgg

SEQ ID NO: 3132252 - DNA, 21 bp, Homo sapiens
tgctaatcaaagccagggtct

SEQ ID NO: 3132253 - DNA, 22 bp, Homo sapiens
tgctaatcagggaggtcatttt

SEQ ID NO: 3132254 - DNA, 23 bp, Homo sapiens
tgctaatcagggaggtcattttg

SEQ ID NO: 3132255 - DNA, 13 bp, Homo sapiens
tgctaatcagtgt

SEQ ID NO: 3132256 - DNA, 14 bp, Homo sapiens
tgctaatcagtgtc

SEQ ID NO: 3132257 - DNA, 19 bp, Homo sapiens
tgctaatcagtgtctcaca

SEQ ID NO: 3132258 - DNA, 13 bp, Homo sapiens
tgctaatcttgtc

SEQ ID NO: 3132259 - DNA, 16 bp, Homo sapiens
tgctaatcttgtccct

SEQ ID NO: 3132260 - DNA, 15 bp, Homo sapiens
tgctaatgcaaatta

SEQ ID NO: 3132261 - DNA, 18 bp, Homo sapiens
tgctaatgcaaattaaaa

SEQ ID NO: 3132262 - DNA, 14 bp, Homo sapiens
tgctaatgtaaact

SEQ ID NO: 3132263 - DNA, 16 bp, Homo sapiens
tgctaatttaaagaga

SEQ ID NO: 3132264 - DNA, 17 bp, Homo sapiens
tgctaatttaaagagac

SEQ ID NO: 3132265 - DNA, 13 bp, Homo sapiens
tgctaatttgttt

SEQ ID NO: 3132266 - DNA, 21 bp, Homo sapiens
tgctacaaatttatgcatttc

SEQ ID NO: 3132267 - DNA, 19 bp, Homo sapiens
tgctacagaggaaacaata

SEQ ID NO: 3132268 - DNA, 18 bp, Homo sapiens
tgctacaggaggggtctc

SEQ ID NO: 3132269 - DNA, 13 bp, Homo sapiens
tgctaccagcgcc

SEQ ID NO: 3132270 - DNA, 15 bp, Homo sapiens
tgctaccagtattta

SEQ ID NO: 3132271 - DNA, 23 bp, Homo sapiens
tgctacccatgactttatatgga

SEQ ID NO: 3132272 - DNA, 16 bp, Homo sapiens
tgctaccgccctgggc

SEQ ID NO: 3132273 - DNA, 20 bp, Homo sapiens
tgctaccgccctgggctgga

SEQ ID NO: 3132274 - DNA, 21 bp, Homo sapiens
tgctaccgccctgggctggac

SEQ ID NO: 3132275 - DNA, 16 bp, Homo sapiens
tgctacctctgagaag

SEQ ID NO: 3132276 - DNA, 20 bp, Homo sapiens
tgctacctctgagaagacac

SEQ ID NO: 3132277 - DNA, 14 bp, Homo sapiens
tgctactataatca

SEQ ID NO: 3132278 - DNA, 14 bp, Homo sapiens
tgctactccatgca

SEQ ID NO: 3132279 - DNA, 18 bp, Homo sapiens
tgctactccatgcagggg

SEQ ID NO: 3132280 - DNA, 12 bp, Homo sapiens
tgctactcctgt

SEQ ID NO: 3132281 - DNA, 16 bp, Homo sapiens
tgctactcctgtgctc

SEQ ID NO: 3132282 - DNA, 20 bp, Homo sapiens
tgctactgattgtttcattg

SEQ ID NO: 3132283 - DNA, 20 bp, Homo sapiens
tgctactgttgtaagaattc

SEQ ID NO: 3132284 - DNA, 21 bp, Homo sapiens
tgctactgttgtaagaattct

SEQ ID NO: 3132285 - DNA, 23 bp, Homo sapiens
tgctactgttgtaagaattctga

SEQ ID NO: 3132286 - DNA, 16 bp, Homo sapiens
tgctagaaaatttagc

SEQ ID NO: 3132287 - DNA, 13 bp, Homo sapiens
tgctagaactccc

SEQ ID NO: 3132288 - DNA, 15 bp, Homo sapiens
tgctagaactccctt

SEQ ID NO: 3132289 - DNA, 12 bp, Homo sapiens
tgctagaacttt

SEQ ID NO: 3132290 - DNA, 14 bp, Homo sapiens
tgctagaacttttt

SEQ ID NO: 3132291 - DNA, 16 bp, Homo sapiens
tgctagaactttttta

SEQ ID NO: 3132292 - DNA, 22 bp, Homo sapiens
tgctagaacttttttaaataaa

SEQ ID NO: 3132293 - DNA, 23 bp, Homo sapiens
tgctagaacttttttaaataaac

SEQ ID NO: 3132294 - DNA, 16 bp, Homo sapiens
tgctagaatacttttt

SEQ ID NO: 3132295 - DNA, 14 bp, Homo sapiens
tgctagagcaaccc

SEQ ID NO: 3132296 - DNA, 20 bp, Homo sapiens
tgctagatgtgcaaatgcaa

SEQ ID NO: 3132297 - DNA, 17 bp, Homo sapiens
tgctagattttaattta

SEQ ID NO: 3132298 - DNA, 22 bp, Homo sapiens
tgctagattttaatttatttgt

SEQ ID NO: 3132299 - DNA, 23 bp, Homo sapiens
tgctagattttaatttatttgtt

SEQ ID NO: 3132300 - DNA, 23 bp, Homo sapiens
tgctagccccagagatgccagcc

SEQ ID NO: 3132301 - DNA, 17 bp, Homo sapiens
tgctagctatgtgacct

SEQ ID NO: 3132302 - DNA, 16 bp, Homo sapiens
tgctagcttgacacag

SEQ ID NO: 3132303 - DNA, 22 bp, Homo sapiens
tgctagcttgacacagtcagca

SEQ ID NO: 3132304 - DNA, 20 bp, Homo sapiens
tgctagggttaggaggtcct

SEQ ID NO: 3132305 - DNA, 19 bp, Homo sapiens
tgctagtgagctgggcatg

SEQ ID NO: 3132306 - DNA, 16 bp, Homo sapiens
tgctagttagcgcccc

SEQ ID NO: 3132307 - DNA, 20 bp, Homo sapiens
tgctataaattttttgaaac

SEQ ID NO: 3132308 - DNA, 13 bp, Homo sapiens
tgctataatctgt

SEQ ID NO: 3132309 - DNA, 17 bp, Homo sapiens
tgctataatctgttttt

SEQ ID NO: 3132310 - DNA, 21 bp, Homo sapiens
tgctatacacaagcaatgcaa

SEQ ID NO: 3132311 - DNA, 22 bp, Homo sapiens
tgctatacacaagcaatgcaag

SEQ ID NO: 3132312 - DNA, 14 bp, Homo sapiens
tgctatacacacac

SEQ ID NO: 3132313 - DNA, 15 bp, Homo sapiens
tgctatatatataaa

SEQ ID NO: 3132314 - DNA, 17 bp, Homo sapiens
tgctatatatataaata

SEQ ID NO: 3132315 - DNA, 19 bp, Homo sapiens
tgctatccccatctccctg

SEQ ID NO: 3132316 - DNA, 22 bp, Homo sapiens
tgctatccccatctccctgcct

SEQ ID NO: 3132317 - DNA, 20 bp, Homo sapiens
tgctatcctgccaaaatcat

SEQ ID NO: 3132318 - DNA, 20 bp, Homo sapiens
tgctatctctgtgtgcacaa

SEQ ID NO: 3132319 - DNA, 17 bp, Homo sapiens
tgctatgaaaatgagca

SEQ ID NO: 3132320 - DNA, 22 bp, Homo sapiens
tgctatgaaaatgagcatcaga

SEQ ID NO: 3132321 - DNA, 15 bp, Homo sapiens
tgctcaaaaagaaat

SEQ ID NO: 3132322 - DNA, 19 bp, Homo sapiens
tgctcaaaataaaaagcct

SEQ ID NO: 3132323 - DNA, 15 bp, Homo sapiens
tgctcaagaagacat

SEQ ID NO: 3132324 - DNA, 18 bp, Homo sapiens
tgctcaataaacacttgt

SEQ ID NO: 3132325 - DNA, 14 bp, Homo sapiens
tgctcacaccccat

SEQ ID NO: 3132326 - DNA, 15 bp, Homo sapiens
tgctcacagtaaccc

SEQ ID NO: 3132327 - DNA, 23 bp, Homo sapiens
tgctcaccgcccatcagggttct

SEQ ID NO: 3132328 - DNA, 12 bp, Homo sapiens
tgctcacctcta

SEQ ID NO: 3132329 - DNA, 13 bp, Homo sapiens
tgctcacctctag

SEQ ID NO: 3132330 - DNA, 14 bp, Homo sapiens
tgctcacctctgcc

SEQ ID NO: 3132331 - DNA, 14 bp, Homo sapiens
tgctcagagaagga

SEQ ID NO: 3132332 - DNA, 19 bp, Homo sapiens
tgctcaggcttgaaatgca

SEQ ID NO: 3132333 - DNA, 16 bp, Homo sapiens
tgctcagtctcccttt

SEQ ID NO: 3132334 - DNA, 15 bp, Homo sapiens
tgctcagtgcttggg

SEQ ID NO: 3132335 - DNA, 19 bp, Homo sapiens
tgctcagtgcttgggctcc

SEQ ID NO: 3132336 - DNA, 21 bp, Homo sapiens
tgctcagtgcttgggctccac

SEQ ID NO: 3132337 - DNA, 23 bp, Homo sapiens
tgctcagtgcttgggctccacgg

SEQ ID NO: 3132338 - DNA, 22 bp, Homo sapiens
tgctcatattgtgattctgcct

SEQ ID NO: 3132339 - DNA, 19 bp, Homo sapiens
tgcaggtaagtctggtttt

SEQ ID NO: 3132340 - DNA, 22 bp, Homo sapiens
tgcaggtacttcctcctgatgg

SEQ ID NO: 3132341 - DNA, 13 bp, Homo sapiens
tgcaggtggcaga

SEQ ID NO: 3132342 - DNA, 20 bp, Homo sapiens
tgcaggttggaccccagaga

SEQ ID NO: 3132343 - DNA, 16 bp, Homo sapiens
tgcaggtttgttacat

SEQ ID NO: 3132344 - DNA, 15 bp, Homo sapiens
tgcagtaaaacacat

SEQ ID NO: 3132345 - DNA, 17 bp, Homo sapiens
tgcagtaacattctact

SEQ ID NO: 3132346 - DNA, 14 bp, Homo sapiens
tgcagtacaggcaa

SEQ ID NO: 3132347 - DNA, 13 bp, Homo sapiens
tgcagtacatcaa

SEQ ID NO: 3132348 - DNA, 17 bp, Homo sapiens
tgcagtactttgtgcat

SEQ ID NO: 3132349 - DNA, 18 bp, Homo sapiens
tgcagtactttgtgcatt

SEQ ID NO: 3132350 - DNA, 22 bp, Homo sapiens
tgcagtagagtcatctccatca

SEQ ID NO: 3132351 - DNA, 16 bp, Homo sapiens
tgcagtaggggaggag

SEQ ID NO: 3132352 - DNA, 14 bp, Homo sapiens
tgcagtcactggag

SEQ ID NO: 3132353 - DNA, 15 bp, Homo sapiens
tgcagtcctgaggag

SEQ ID NO: 3132354 - DNA, 22 bp, Homo sapiens
tgcagtcgtgtaattggcccaa

SEQ ID NO: 3132355 - DNA, 14 bp, Homo sapiens
tgcagtcttctggg

SEQ ID NO: 3132356 - DNA, 17 bp, Homo sapiens
tgcagtcttctgggctg

SEQ ID NO: 3132357 - DNA, 23 bp, Homo sapiens
tgcagtgacacaatctcggctca

SEQ ID NO: 3132358 - DNA, 19 bp, Homo sapiens
tgcagtgacgtgcacctgt

SEQ ID NO: 3132359 - DNA, 14 bp, Homo sapiens
tgcagtgagccatg

SEQ ID NO: 3132360 - DNA, 17 bp, Homo sapiens
tgcagtgatatggcaga

SEQ ID NO: 3132361 - DNA, 22 bp, Homo sapiens
tgcagtgatatggcagaagaca

SEQ ID NO: 3132362 - DNA, 23 bp, Homo sapiens
tgcagtgatggcgcgggaggcac

SEQ ID NO: 3132363 - DNA, 18 bp, Homo sapiens
tgcagtggcgcattctag

SEQ ID NO: 3132364 - DNA, 17 bp, Homo sapiens
tgcagtggcttttcatg

SEQ ID NO: 3132365 - DNA, 21 bp, Homo sapiens
tgcagtggtgcgatctgggtt

SEQ ID NO: 3132366 - DNA, 17 bp, Homo sapiens
tgcagtgttcgcttggc

SEQ ID NO: 3132367 - DNA, 18 bp, Homo sapiens
tgcagtgttcgcttggct

SEQ ID NO: 3132368 - DNA, 14 bp, Homo sapiens
tgcagttaacagga

SEQ ID NO: 3132369 - DNA, 21 bp, Homo sapiens
tgcagttcccccaacctcaga

SEQ ID NO: 3132370 - DNA, 13 bp, Homo sapiens
tgcagttcctggc

SEQ ID NO: 3132371 - DNA, 20 bp, Homo sapiens
tgcagttggactctcaggga

SEQ ID NO: 3132372 - DNA, 18 bp, Homo sapiens
tgcagtttaagagcagaa

SEQ ID NO: 3132373 - DNA, 13 bp, Homo sapiens
tgcataaatatgc

SEQ ID NO: 3132374 - DNA, 14 bp, Homo sapiens
tgcataaatatgca

SEQ ID NO: 3132375 - DNA, 19 bp, Homo sapiens
tgcataaatatgcagtgat

SEQ ID NO: 3132376 - DNA, 12 bp, Homo sapiens
tgcataagatta

SEQ ID NO: 3132377 - DNA, 22 bp, Homo sapiens
tgcataataagctaaagaggct

SEQ ID NO: 3132378 - DNA, 12 bp, Homo sapiens
tgcataatgcaa

SEQ ID NO: 3132379 - DNA, 13 bp, Homo sapiens
tgcataatgcaat

SEQ ID NO: 3132380 - DNA, 17 bp, Homo sapiens
tgcataatgctttggaa

SEQ ID NO: 3132381 - DNA, 19 bp, Homo sapiens
tgcataatgctttggaaaa

SEQ ID NO: 3132382 - DNA, 21 bp, Homo sapiens
tgcataatgctttggaaaaat

SEQ ID NO: 3132383 - DNA, 15 bp, Homo sapiens
tgcatacagaaatat

SEQ ID NO: 3132384 - DNA, 17 bp, Homo sapiens
tgcatactgaaaatcca

SEQ ID NO: 3132385 - DNA, 12 bp, Homo sapiens
tgcatactttat

SEQ ID NO: 3132386 - DNA, 18 bp, Homo sapiens
tgcatactttttaaatgt

SEQ ID NO: 3132387 - DNA, 22 bp, Homo sapiens
tgcatactttttaaatgtaaag

SEQ ID NO: 3132388 - DNA, 23 bp, Homo sapiens
tgcatactttttaaatgtaaaga

SEQ ID NO: 3132389 - DNA, 16 bp, Homo sapiens
tgcatagaactgggta

SEQ ID NO: 3132390 - DNA, 22 bp, Homo sapiens
tgcatagaactgggtaaatgca

SEQ ID NO: 3132391 - DNA, 16 bp, Homo sapiens
tgcatagagccctggc

SEQ ID NO: 3132392 - DNA, 20 bp, Homo sapiens
tgcatagagccctggccagc

SEQ ID NO: 3132393 - DNA, 15 bp, Homo sapiens
tgcatagcagtatat

SEQ ID NO: 3132394 - DNA, 15 bp, Homo sapiens
tgcatagctctattt

SEQ ID NO: 3132395 - DNA, 19 bp, Homo sapiens
tgcataggctcttaagcag

SEQ ID NO: 3132396 - DNA, 20 bp, Homo sapiens
tgcatagtaccaatcatttt

SEQ ID NO: 3132397 - DNA, 20 bp, Homo sapiens
tgcatagtcccagctaccca

SEQ ID NO: 3132398 - DNA, 13 bp, Homo sapiens
tgcatagtgctgg

SEQ ID NO: 3132399 - DNA, 15 bp, Homo sapiens
tgcatataaatatat

SEQ ID NO: 3132400 - DNA, 13 bp, Homo sapiens
tgcatatcctgag

SEQ ID NO: 3132401 - DNA, 15 bp, Homo sapiens
tgcatatgacagaat

SEQ ID NO: 3132402 - DNA, 17 bp, Homo sapiens
tgcatatgttgaatact

SEQ ID NO: 3132403 - DNA, 22 bp, Homo sapiens
tgcatatttattgcattgctgg

SEQ ID NO: 3132404 - DNA, 21 bp, Homo sapiens
tgcatcacgtaccccactggg

SEQ ID NO: 3132405 - DNA, 12 bp, Homo sapiens
tgcatcactggg

SEQ ID NO: 3132406 - DNA, 15 bp, Homo sapiens
tgcatcattactgtt

SEQ ID NO: 3132407 - DNA, 13 bp, Homo sapiens
tgcatccaactcc

SEQ ID NO: 3132408 - DNA, 17 bp, Homo sapiens
tgcatccaactccagga

SEQ ID NO: 3132409 - DNA, 14 bp, Homo sapiens
tgcatcccagcacc

SEQ ID NO: 3132410 - DNA, 16 bp, Homo sapiens
tgcatccccttggctg

SEQ ID NO: 3132411 - DNA, 12 bp, Homo sapiens
tgcatcctcctc

SEQ ID NO: 3132412 - DNA, 13 bp, Homo sapiens
tgcatcctcctca

SEQ ID NO: 3132413 - DNA, 15 bp, Homo sapiens
tgcatcctcctcagc

SEQ ID NO: 3132414 - DNA, 19 bp, Homo sapiens
tgcatcctcctcagccccc

SEQ ID NO: 3132415 - DNA, 13 bp, Homo sapiens
tgcatccttccta

SEQ ID NO: 3132416 - DNA, 15 bp, Homo sapiens
tgcatccttcctata

SEQ ID NO: 3132417 - DNA, 15 bp, Homo sapiens
tgcatcgggaaagaa

SEQ ID NO: 3132418 - DNA, 18 bp, Homo sapiens
tgcatcgggaaagaagaa

SEQ ID NO: 3132419 - DNA, 23 bp, Homo sapiens
tgcactgaagtttttgaaatacc

SEQ ID NO: 3132420 - DNA, 15 bp, Homo sapiens
tgcactgacccttcc

SEQ ID NO: 3132421 - DNA, 17 bp, Homo sapiens
tgcactgacccttccag

SEQ ID NO: 3132422 - DNA, 14 bp, Homo sapiens
tgcactgagggcca

SEQ ID NO: 3132423 - DNA, 15 bp, Homo sapiens
tgcactgcatgcaaa

SEQ ID NO: 3132424 - DNA, 16 bp, Homo sapiens
tgcactgcatgcaaac

SEQ ID NO: 3132425 - DNA, 12 bp, Homo sapiens
tgcactgccctg

SEQ ID NO: 3132426 - DNA, 19 bp, Homo sapiens
tgcactgtcactttgctct

SEQ ID NO: 3132427 - DNA, 21 bp, Homo sapiens
tgcactgtcactttgctctgg

SEQ ID NO: 3132428 - DNA, 14 bp, Homo sapiens
tgcactgtttttaa

SEQ ID NO: 3132429 - DNA, 16 bp, Homo sapiens
tgcacttaaggcactc

SEQ ID NO: 3132430 - DNA, 16 bp, Homo sapiens
tgcacttacttgctta

SEQ ID NO: 3132431 - DNA, 21 bp, Homo sapiens
tgcacttatatagcacctttc

SEQ ID NO: 3132432 - DNA, 17 bp, Homo sapiens
tgcacttatgtacttga

SEQ ID NO: 3132433 - DNA, 21 bp, Homo sapiens
tgcacttatgtacttgatact

SEQ ID NO: 3132434 - DNA, 19 bp, Homo sapiens
tgcacttattgaccatttt

SEQ ID NO: 3132435 - DNA, 21 bp, Homo sapiens
tgcacttattgtccccttttt

SEQ ID NO: 3132436 - DNA, 21 bp, Homo sapiens
tgcacttgattaagcttttgt

SEQ ID NO: 3132437 - DNA, 16 bp, Homo sapiens
tgcacttggcctcagc

SEQ ID NO: 3132438 - DNA, 16 bp, Homo sapiens
tgcacttttttatgaa

SEQ ID NO: 3132439 - DNA, 18 bp, Homo sapiens
tgcagaaaattctgtgcc

SEQ ID NO: 3132440 - DNA, 15 bp, Homo sapiens
tgcagaaaggagaga

SEQ ID NO: 3132441 - DNA, 20 bp, Homo sapiens
tgcagaaatagacaaaaagt

SEQ ID NO: 3132442 - DNA, 15 bp, Homo sapiens
tgcagaaatgaaata

SEQ ID NO: 3132443 - DNA, 16 bp, Homo sapiens
tgcagaacagtgaaag

SEQ ID NO: 3132444 - DNA, 18 bp, Homo sapiens
tgcagaacagtgaaaggt

SEQ ID NO: 3132445 - DNA, 12 bp, Homo sapiens
tgcagaactgcc

SEQ ID NO: 3132446 - DNA, 15 bp, Homo sapiens
tgcagaactgtagct

SEQ ID NO: 3132447 - DNA, 13 bp, Homo sapiens
tgcagaagaagct

SEQ ID NO: 3132448 - DNA, 15 bp, Homo sapiens
tgcagaaggaaagaa

SEQ ID NO: 3132449 - DNA, 21 bp, Homo sapiens
tgcagaatacagtaagctgct

SEQ ID NO: 3132450 - DNA, 24 bp, Homo sapiens
tgcagaatctctgcctagaatctt

SEQ ID NO: 3132451 - DNA, 17 bp, Homo sapiens
tgcagaatgactccacc

SEQ ID NO: 3132452 - DNA, 18 bp, Homo sapiens
tgcagacacctggactga

SEQ ID NO: 3132453 - DNA, 19 bp, Homo sapiens
tgcagacagaagtctcctc

SEQ ID NO: 3132454 - DNA, 23 bp, Homo sapiens
tgcagaccacgcccgtcctgcct

SEQ ID NO: 3132455 - DNA, 15 bp, Homo sapiens
tgcagactcagtttg

SEQ ID NO: 3132456 - DNA, 22 bp, Homo sapiens
tgcagactctacagaggccatg

SEQ ID NO: 3132457 - DNA, 12 bp, Homo sapiens
tgcagactgcta

SEQ ID NO: 3132458 - DNA, 15 bp, Homo sapiens
tgcagacttcccagc

SEQ ID NO: 3132459 - DNA, 16 bp, Homo sapiens
tgcagacttcccagct

SEQ ID NO: 3132460 - DNA, 22 bp, Homo sapiens
tgcagacttcccagctaggaag

SEQ ID NO: 3132461 - DNA, 18 bp, Homo sapiens
tgcagagagccattttgt

SEQ ID NO: 3132462 - DNA, 20 bp, Homo sapiens
tgcagagatttctcattgac

SEQ ID NO: 3132463 - DNA, 14 bp, Homo sapiens
tgcagagcacaaac

SEQ ID NO: 3132464 - DNA, 12 bp, Homo sapiens
tgcagagctgca

SEQ ID NO: 3132465 - DNA, 14 bp, Homo sapiens
tgcagagctgcact

SEQ ID NO: 3132466 - DNA, 20 bp, Homo sapiens
tgcagagctgcacttggcct

SEQ ID NO: 3132467 - DNA, 15 bp, Homo sapiens
tgcagaggaccacag

SEQ ID NO: 3132468 - DNA, 14 bp, Homo sapiens
tgcagaggaggtga

SEQ ID NO: 3132469 - DNA, 21 bp, Homo sapiens
tgcagaggaggtgagagtggg

SEQ ID NO: 3132470 - DNA, 13 bp, Homo sapiens
tgcagaggggaaa

SEQ ID NO: 3132471 - DNA, 20 bp, Homo sapiens
tgcagagtccatttcccaca

SEQ ID NO: 3132472 - DNA, 15 bp, Homo sapiens
tgcagattcctgggc

SEQ ID NO: 3132473 - DNA, 20 bp, Homo sapiens
tgcagattcctgggcctgtc

SEQ ID NO: 3132474 - DNA, 16 bp, Homo sapiens
tgcagatttgatattt

SEQ ID NO: 3132475 - DNA, 19 bp, Homo sapiens
tgcagcaaggccctgctgc

SEQ ID NO: 3132476 - DNA, 12 bp, Homo sapiens
tgcagcacctcc

SEQ ID NO: 3132477 - DNA, 18 bp, Homo sapiens
tgcagcacggacaataaa

SEQ ID NO: 3132478 - DNA, 20 bp, Homo sapiens
tgcagcacggacaataaacc

SEQ ID NO: 3132479 - DNA, 22 bp, Homo sapiens
tgcagcacggacaataaacctc

SEQ ID NO: 3132480 - DNA, 13 bp, Homo sapiens
tgcagcagaggac

SEQ ID NO: 3132481 - DNA, 14 bp, Homo sapiens
tgcagcagaggaca

SEQ ID NO: 3132482 - DNA, 23 bp, Homo sapiens
tgcagcagaggacagtctggaga

SEQ ID NO: 3132483 - DNA, 19 bp, Homo sapiens
tgcagcagataactttttt

SEQ ID NO: 3132484 - DNA, 14 bp, Homo sapiens
tgcagcagcccagc

SEQ ID NO: 3132485 - DNA, 16 bp, Homo sapiens
tgcagcagcccagctt

SEQ ID NO: 3132486 - DNA, 23 bp, Homo sapiens
tgcagcaggagtggtgcagacag

SEQ ID NO: 3132487 - DNA, 18 bp, Homo sapiens
tgcagcagtgagtctctt

SEQ ID NO: 3132488 - DNA, 16 bp, Homo sapiens
tgcagcatggtccctg

SEQ ID NO: 3132489 - DNA, 18 bp, Homo sapiens
tgcagcatgttgctgagg

SEQ ID NO: 3132490 - DNA, 22 bp, Homo sapiens
tgcagccacatggccccatccc

SEQ ID NO: 3132491 - DNA, 13 bp, Homo sapiens
tgcagcccatgcc

SEQ ID NO: 3132492 - DNA, 21 bp, Homo sapiens
tgcagcccatgcccacctgcc

SEQ ID NO: 3132493 - DNA, 23 bp, Homo sapiens
tgcagcccatgcccacctgccca

SEQ ID NO: 3132494 - DNA, 22 bp, Homo sapiens
tgatttgcatggattttggata

SEQ ID NO: 3132495 - DNA, 22 bp, Homo sapiens
tgatttggtcagattgggataa

SEQ ID NO: 3132496 - DNA, 13 bp, Homo sapiens
tgatttggtgacc

SEQ ID NO: 3132497 - DNA, 20 bp, Homo sapiens
tgatttggtgaccaactgtc

SEQ ID NO: 3132498 - DNA, 15 bp, Homo sapiens
tgatttgttcttaca

SEQ ID NO: 3132499 - DNA, 15 bp, Homo sapiens
tgatttgttttgaat

SEQ ID NO: 3132500 - DNA, 22 bp, Homo sapiens
tgattttaaaggcagagaagtt

SEQ ID NO: 3132501 - DNA, 12 bp, Homo sapiens
tgattttctgtt

SEQ ID NO: 3132502 - DNA, 13 bp, Homo sapiens
tgattttctgttg

SEQ ID NO: 3132503 - DNA, 16 bp, Homo sapiens
tgattttgaaaagtat

SEQ ID NO: 3132504 - DNA, 20 bp, Homo sapiens
tgattttgtagttaatttat

SEQ ID NO: 3132505 - DNA, 13 bp, Homo sapiens
tgattttgtatat

SEQ ID NO: 3132506 - DNA, 15 bp, Homo sapiens
tgatttttctcttca

SEQ ID NO: 3132507 - DNA, 17 bp, Homo sapiens
tgattttttaaaagaaa

SEQ ID NO: 3132508 - DNA, 17 bp, Homo sapiens
tgattttttttaattac

SEQ ID NO: 3132509 - DNA, 22 bp, Homo sapiens
tgatttttttttcatacactta

SEQ ID NO: 3132510 - DNA, 20 bp, Homo sapiens
tgatttttttttttttttcc

SEQ ID NO: 3132511 - DNA, 21 bp, Homo sapiens
tgatttttttttttttttcct

SEQ ID NO: 3132512 - DNA, 17 bp, Homo sapiens
tgcaaaaagaggatccg

SEQ ID NO: 3132513 - DNA, 22 bp, Homo sapiens
tgcaaaaatatttataaaactt

SEQ ID NO: 3132514 - DNA, 22 bp, Homo sapiens
tgcaaaattgttttcacttgta

SEQ ID NO: 3132515 - DNA, 15 bp, Homo sapiens
tgcaaaatttccagt

SEQ ID NO: 3132516 - DNA, 23 bp, Homo sapiens
tgcaaacaagaaacgtgtcacac

SEQ ID NO: 3132517 - DNA, 12 bp, Homo sapiens
tgcaaacaatga

SEQ ID NO: 3132518 - DNA, 23 bp, Homo sapiens
tgcaaacacacaaaggtataatt

SEQ ID NO: 3132519 - DNA, 22 bp, Homo sapiens
tgcaaacctgacccctgctcag

SEQ ID NO: 3132520 - DNA, 16 bp, Homo sapiens
tgcaaaccttcctggg

SEQ ID NO: 3132521 - DNA, 17 bp, Homo sapiens
tgcaaaccttcctggga

SEQ ID NO: 3132522 - DNA, 12 bp, Homo sapiens
tgcaaagaaaat

SEQ ID NO: 3132523 - DNA, 21 bp, Homo sapiens
tgcaaagacagtatttattgg

SEQ ID NO: 3132524 - DNA, 16 bp, Homo sapiens
tgcaaagacctacctc

SEQ ID NO: 3132525 - DNA, 13 bp, Homo sapiens
tgcaaagctgaag

SEQ ID NO: 3132526 - DNA, 15 bp, Homo sapiens
tgcaaagtacaatgt

SEQ ID NO: 3132527 - DNA, 23 bp, Homo sapiens
tgcaaagtacaatgtgtttttct

SEQ ID NO: 3132528 - DNA, 15 bp, Homo sapiens
tgcaaagtattgtaa

SEQ ID NO: 3132529 - DNA, 20 bp, Homo sapiens
tgcaaagtgattcactgtgc

SEQ ID NO: 3132530 - DNA, 22 bp, Homo sapiens
tgcaaagtgttttctcagaaca

SEQ ID NO: 3132531 - DNA, 14 bp, Homo sapiens
tgcaaagttctgtg

SEQ ID NO: 3132532 - DNA, 20 bp, Homo sapiens
tgcaaagttctgtgtttaat

SEQ ID NO: 3132533 - DNA, 14 bp, Homo sapiens
tgcaaattaacagt

SEQ ID NO: 3132534 - DNA, 14 bp, Homo sapiens
tgcaaattgattgt

SEQ ID NO: 3132535 - DNA, 12 bp, Homo sapiens
tgcaaattgtat

SEQ ID NO: 3132536 - DNA, 14 bp, Homo sapiens
tgcaacagcactgg

SEQ ID NO: 3132537 - DNA, 13 bp, Homo sapiens
tgcaacaggctgg

SEQ ID NO: 3132538 - DNA, 14 bp, Homo sapiens
tgcaacaggctggg

SEQ ID NO: 3132539 - DNA, 18 bp, Homo sapiens
tgcaacaggggaggaaaa

SEQ ID NO: 3132540 - DNA, 24 bp, Homo sapiens
tgcaacagggtatggactatctgt

SEQ ID NO: 3132541 - DNA, 23 bp, Homo sapiens
tgcaacatttacagtccttcaaa

SEQ ID NO: 3132542 - DNA, 14 bp, Homo sapiens
tgcaacctccgcct

SEQ ID NO: 3132543 - DNA, 20 bp, Homo sapiens
tgcaacctccgcctcttggg

SEQ ID NO: 3132544 - DNA, 16 bp, Homo sapiens
tgcaacggcttagact

SEQ ID NO: 3132545 - DNA, 13 bp, Homo sapiens
tgcaactagccaa

SEQ ID NO: 3132546 - DNA, 17 bp, Homo sapiens
tgcaactagccaaggct

SEQ ID NO: 3132547 - DNA, 16 bp, Homo sapiens
tgcaactcaaggactt

SEQ ID NO: 3132548 - DNA, 15 bp, Homo sapiens
tgcaacttcatgtca

SEQ ID NO: 3132549 - DNA, 20 bp, Homo sapiens
tgcaactttaagcagctctt

SEQ ID NO: 3132550 - DNA, 17 bp, Homo sapiens
tgcaagatttaacacta

SEQ ID NO: 3132551 - DNA, 23 bp, Homo sapiens
tgcaagattttaaaagttttgtt

SEQ ID NO: 3132552 - DNA, 13 bp, Homo sapiens
tgcaagccccagg

SEQ ID NO: 3132553 - DNA, 16 bp, Homo sapiens
tgcaagccccagggcc

SEQ ID NO: 3132554 - DNA, 18 bp, Homo sapiens
tgcaagccccagggcctg

SEQ ID NO: 3132555 - DNA, 12 bp, Homo sapiens
tgcaaggcccac

SEQ ID NO: 3132556 - DNA, 16 bp, Homo sapiens
tgcaagtcagaggatg

SEQ ID NO: 3132557 - DNA, 23 bp, Homo sapiens
tgcaagtcagtccaggatgctaa

SEQ ID NO: 3132558 - DNA, 14 bp, Homo sapiens
tgcaagtctgtgag

SEQ ID NO: 3132559 - DNA, 24 bp, Homo sapiens
tgcaagtctgtgagtgcgtctgag

SEQ ID NO: 3132560 - DNA, 19 bp, Homo sapiens
tgcaagtgtctggagcggc

SEQ ID NO: 3132561 - DNA, 16 bp, Homo sapiens
tgcaataaaatttaaa

SEQ ID NO: 3132562 - DNA, 14 bp, Homo sapiens
tgcaataacttcta

SEQ ID NO: 3132563 - DNA, 17 bp, Homo sapiens
tgcaataacttctgacc

SEQ ID NO: 3132564 - DNA, 19 bp, Homo sapiens
tgcaatagagactgtagat

SEQ ID NO: 3132565 - DNA, 13 bp, Homo sapiens
tgcaatagcagtt

SEQ ID NO: 3132566 - DNA, 16 bp, Homo sapiens
tgcaatagcagttata

SEQ ID NO: 3132567 - DNA, 13 bp, Homo sapiens
tgcaatatggatt

SEQ ID NO: 3132568 - DNA, 14 bp, Homo sapiens
tgcaatattccttt

SEQ ID NO: 3132569 - DNA, 19 bp, Homo sapiens
tgcaatcctgtctttctga

SEQ ID NO: 3132570 - DNA, 21 bp, Homo sapiens
tgcaatgccagtcctgcagga

SEQ ID NO: 3132571 - DNA, 15 bp, Homo sapiens
tgcaatgcttctgta

SEQ ID NO: 3132572 - DNA, 22 bp, Homo sapiens
tgcaatgcttctgtagcttcta

SEQ ID NO: 3132573 - DNA, 13 bp, Homo sapiens
tgcaatggcagcc

SEQ ID NO: 3132574 - DNA, 15 bp, Homo sapiens
tgcaatgggcactgg

SEQ ID NO: 3132575 - DNA, 17 bp, Homo sapiens
tgcaatggttaacatct

SEQ ID NO: 3132576 - DNA, 21 bp, Homo sapiens
tgcaatgtcacaacctctctg

SEQ ID NO: 3132577 - DNA, 16 bp, Homo sapiens
tgcaatgtgctactga

SEQ ID NO: 3132578 - DNA, 19 bp, Homo sapiens
tgcaattaaacttccaaag

SEQ ID NO: 3132579 - DNA, 14 bp, Homo sapiens
tgcaattcaaaagt

SEQ ID NO: 3132580 - DNA, 21 bp, Homo sapiens
tgcaattcaaaagttccaaga

SEQ ID NO: 3132581 - DNA, 22 bp, Homo sapiens
tgcaattgtaggggtgtgtgtg

SEQ ID NO: 3132582 - DNA, 14 bp, Homo sapiens
tgcaatttattaaa

SEQ ID NO: 3132583 - DNA, 13 bp, Homo sapiens
tgcaatttcaagg

SEQ ID NO: 3132584 - DNA, 17 bp, Homo sapiens
tgcaatttcaaggttct

SEQ ID NO: 3132585 - DNA, 20 bp, Homo sapiens
tgcaatttcatatgctgtat

SEQ ID NO: 3132586 - DNA, 20 bp, Homo sapiens
tgcaattttaattgattatt

SEQ ID NO: 3132587 - DNA, 23 bp, Homo sapiens
tgcaattttctaagcaatttctt

SEQ ID NO: 3132588 - DNA, 15 bp, Homo sapiens
tgcacaaagcccttc

SEQ ID NO: 3132589 - DNA, 17 bp, Homo sapiens
tgcacaaggattgaaaa

SEQ ID NO: 3132590 - DNA, 18 bp, Homo sapiens
tgcacaaggattgaaaat

SEQ ID NO: 3132591 - DNA, 15 bp, Homo sapiens
tgcacaagttccctg

SEQ ID NO: 3132592 - DNA, 18 bp, Homo sapiens
tgcacaagttccctggag

SEQ ID NO: 3132593 - DNA, 19 bp, Homo sapiens
tgcacaagttccctggaga

SEQ ID NO: 3132594 - DNA, 15 bp, Homo sapiens
tgcacaataaaaatg

SEQ ID NO: 3132595 - DNA, 15 bp, Homo sapiens
tgcacacacagctcc

SEQ ID NO: 3132596 - DNA, 17 bp, Homo sapiens
tgcacacaccagagccc

SEQ ID NO: 3132597 - DNA, 21 bp, Homo sapiens
tgcacacaccagagcccacct

SEQ ID NO: 3132598 - DNA, 18 bp, Homo sapiens
tgcacacagaaatatata

SEQ ID NO: 3132599 - DNA, 23 bp, Homo sapiens
tgcacacagaaatatatatacat

SEQ ID NO: 3132600 - DNA, 21 bp, Homo sapiens
tgcacacagatgtgaaatgaa

SEQ ID NO: 3132601 - DNA, 17 bp, Homo sapiens
tgcacaccaccctcccg

SEQ ID NO: 3132602 - DNA, 23 bp, Homo sapiens
tgcacacttgtgtgtgggctgtg

SEQ ID NO: 3132603 - DNA, 16 bp, Homo sapiens
tgcacagaagggctct

SEQ ID NO: 3132604 - DNA, 12 bp, Homo sapiens
tgcacagagccc

SEQ ID NO: 3132605 - DNA, 19 bp, Homo sapiens
tgcacagagcccaatgcat

SEQ ID NO: 3132606 - DNA, 14 bp, Homo sapiens
tgcacagagctctc

SEQ ID NO: 3132607 - DNA, 19 bp, Homo sapiens
tgcacagatatactttgtg

SEQ ID NO: 3132608 - DNA, 23 bp, Homo sapiens
tgcacagatggatttgcctgtgc

SEQ ID NO: 3132609 - DNA, 18 bp, Homo sapiens
tgcacagcggcccctgca

SEQ ID NO: 3132610 - DNA, 16 bp, Homo sapiens
tgcacagtgcatctca

SEQ ID NO: 3132611 - DNA, 20 bp, Homo sapiens
tgcacagtgcatctcagccc

SEQ ID NO: 3132612 - DNA, 16 bp, Homo sapiens
tgcacagtgtgtgact

SEQ ID NO: 3132613 - DNA, 18 bp, Homo sapiens
tgcacagttgccacattt

SEQ ID NO: 3132614 - DNA, 14 bp, Homo sapiens
tgcacatatggact

SEQ ID NO: 3132615 - DNA, 13 bp, Homo sapiens
tgcacatccattc

SEQ ID NO: 3132616 - DNA, 22 bp, Homo sapiens
tgcacatgtcttgtacatgtgt

SEQ ID NO: 3132617 - DNA, 23 bp, Homo sapiens
tgcacatgtcttgtacatgtgta

SEQ ID NO: 3132618 - DNA, 21 bp, Homo sapiens
tgcacatttctggattgtggt

SEQ ID NO: 3132619 - DNA, 15 bp, Homo sapiens
tgcacattttgattt

SEQ ID NO: 3132620 - DNA, 11 bp, Homo sapiens
tgcaccaaaga

SEQ ID NO: 3132621 - DNA, 18 bp, Homo sapiens
tgcaccaccaagccaagg

SEQ ID NO: 3132622 - DNA, 22 bp, Homo sapiens
tgcaccacggcgtttttttaca

SEQ ID NO: 3132623 - DNA, 16 bp, Homo sapiens
tgatgtatatgtttat

SEQ ID NO: 3132624 - DNA, 12 bp, Homo sapiens
tgatgtatattt

SEQ ID NO: 3132625 - DNA, 11 bp, Homo sapiens
tgatgtatgtg

SEQ ID NO: 3132626 - DNA, 14 bp, Homo sapiens
tgatgtatgtgtga

SEQ ID NO: 3132627 - DNA, 17 bp, Homo sapiens
tgatgtatgtgtgaaac

SEQ ID NO: 3132628 - DNA, 19 bp, Homo sapiens
tgatgtatgtgtgaaacaa

SEQ ID NO: 3132629 - DNA, 13 bp, Homo sapiens
tgatgtattctag

SEQ ID NO: 3132630 - DNA, 17 bp, Homo sapiens
tgatgtcaatttctgtg

SEQ ID NO: 3132631 - DNA, 17 bp, Homo sapiens
tgatgtcattaatgtgt

SEQ ID NO: 3132632 - DNA, 12 bp, Homo sapiens
tgatgtccagaa

SEQ ID NO: 3132633 - DNA, 13 bp, Homo sapiens
tgatgtccagaag

SEQ ID NO: 3132634 - DNA, 15 bp, Homo sapiens
tgatgtccagaagaa

SEQ ID NO: 3132635 - DNA, 16 bp, Homo sapiens
tgatgtctcttgtaga

SEQ ID NO: 3132636 - DNA, 18 bp, Homo sapiens
tgatgtctcttgtagaag

SEQ ID NO: 3132637 - DNA, 20 bp, Homo sapiens
tgatgtgaagataatttgca

SEQ ID NO: 3132638 - DNA, 22 bp, Homo sapiens
tgatgtgaagataatttgcata

SEQ ID NO: 3132639 - DNA, 16 bp, Homo sapiens
tgatgtgacaataata

SEQ ID NO: 3132640 - DNA, 13 bp, Homo sapiens
tgatgtgactttt

SEQ ID NO: 3132641 - DNA, 14 bp, Homo sapiens
tgatgtgacttttt

SEQ ID NO: 3132642 - DNA, 14 bp, Homo sapiens
tgatgtgtttattt

SEQ ID NO: 3132643 - DNA, 10 bp, Homo sapiens
tgatgttaac

SEQ ID NO: 3132644 - DNA, 14 bp, Homo sapiens
tgatgttctaaggc

SEQ ID NO: 3132645 - DNA, 22 bp, Homo sapiens
tgatgttctaaggctctgagag

SEQ ID NO: 3132646 - DNA, 20 bp, Homo sapiens
tgatgtttgtggcctcagaa

SEQ ID NO: 3132647 - DNA, 20 bp, Homo sapiens
tgattaaacgtgcagactat

SEQ ID NO: 3132648 - DNA, 17 bp, Homo sapiens
tgattaaataagattct

SEQ ID NO: 3132649 - DNA, 18 bp, Homo sapiens
tgattaaataagattcta

SEQ ID NO: 3132650 - DNA, 14 bp, Homo sapiens
tgattaaattttag

SEQ ID NO: 3132651 - DNA, 14 bp, Homo sapiens
tgattaacagagag

SEQ ID NO: 3132652 - DNA, 17 bp, Homo sapiens
tgattaagattttacaa

SEQ ID NO: 3132653 - DNA, 16 bp, Homo sapiens
tgattaatgttttcat

SEQ ID NO: 3132654 - DNA, 17 bp, Homo sapiens
tgattaatgttttcatt

SEQ ID NO: 3132655 - DNA, 13 bp, Homo sapiens
tgattacacagtt

SEQ ID NO: 3132656 - DNA, 21 bp, Homo sapiens
tgattactggcctttttcatt

SEQ ID NO: 3132657 - DNA, 13 bp, Homo sapiens
tgattactgtcaa

SEQ ID NO: 3132658 - DNA, 14 bp, Homo sapiens
tgattactgtcaat

SEQ ID NO: 3132659 - DNA, 18 bp, Homo sapiens
tgattactgtcaataaac

SEQ ID NO: 3132660 - DNA, 23 bp, Homo sapiens
tgattagaaattacctgtggata

SEQ ID NO: 3132661 - DNA, 11 bp, Homo sapiens
tgattagatga

SEQ ID NO: 3132662 - DNA, 18 bp, Homo sapiens
tgattattgtatttattc

SEQ ID NO: 3132663 - DNA, 10 bp, Homo sapiens
tgattattta

SEQ ID NO: 3132664 - DNA, 16 bp, Homo sapiens
tgattatttcacttta

SEQ ID NO: 3132665 - DNA, 23 bp, Homo sapiens
tgattatttcactttagatgctg

SEQ ID NO: 3132666 - DNA, 13 bp, Homo sapiens
tgattatttgtat

SEQ ID NO: 3132667 - DNA, 20 bp, Homo sapiens
tgattattttcattacaatg

SEQ ID NO: 3132668 - DNA, 13 bp, Homo sapiens
tgattattttctt

SEQ ID NO: 3132669 - DNA, 18 bp, Homo sapiens
tgattcaaattgctgctt

SEQ ID NO: 3132670 - DNA, 19 bp, Homo sapiens
tgattcaaattgctgcttg

SEQ ID NO: 3132671 - DNA, 22 bp, Homo sapiens
tgattcacatgctaaagccagg

SEQ ID NO: 3132672 - DNA, 16 bp, Homo sapiens
tgattcactatttaaa

SEQ ID NO: 3132673 - DNA, 20 bp, Homo sapiens
tgattcagaaaatgttctgt

SEQ ID NO: 3132674 - DNA, 22 bp, Homo sapiens
tgattcagaaaatgttctgttt

SEQ ID NO: 3132675 - DNA, 15 bp, Homo sapiens
tgattcataacaatg

SEQ ID NO: 3132676 - DNA, 19 bp, Homo sapiens
tgattcatgccaattagca

SEQ ID NO: 3132677 - DNA, 19 bp, Homo sapiens
tgattccaatctctgttct

SEQ ID NO: 3132678 - DNA, 23 bp, Homo sapiens
tgattccactacacctggctgag

SEQ ID NO: 3132679 - DNA, 16 bp, Homo sapiens
tgattccatccacctt

SEQ ID NO: 3132680 - DNA, 18 bp, Homo sapiens
tgattccatccacctttc

SEQ ID NO: 3132681 - DNA, 16 bp, Homo sapiens
tgattcccaagctctg

SEQ ID NO: 3132682 - DNA, 14 bp, Homo sapiens
tgattcccgggctt

SEQ ID NO: 3132683 - DNA, 23 bp, Homo sapiens
tgattcctaagccacttgaaatg

SEQ ID NO: 3132684 - DNA, 24 bp, Homo sapiens
tgattcctggacatcaccagtcct

SEQ ID NO: 3132685 - DNA, 22 bp, Homo sapiens
tgattccttgatggagatattt

SEQ ID NO: 3132686 - DNA, 17 bp, Homo sapiens
tgattcgtatgatcagt

SEQ ID NO: 3132687 - DNA, 19 bp, Homo sapiens
tgattctaatcatctgcag

SEQ ID NO: 3132688 - DNA, 21 bp, Homo sapiens
tgattctatttatatgtacat

SEQ ID NO: 3132689 - DNA, 22 bp, Homo sapiens
tgattctatttatatgtacatg

SEQ ID NO: 3132690 - DNA, 13 bp, Homo sapiens
tgattctcctgcc

SEQ ID NO: 3132691 - DNA, 15 bp, Homo sapiens
tgattctcctgcctc

SEQ ID NO: 3132692 - DNA, 16 bp, Homo sapiens
tgattctgaaattttt

SEQ ID NO: 3132693 - DNA, 20 bp, Homo sapiens
tgattctgaaatttttttcc

SEQ ID NO: 3132694 - DNA, 22 bp, Homo sapiens
tgattctgaaatttttttccta

SEQ ID NO: 3132695 - DNA, 23 bp, Homo sapiens
tgattctgaaatttttttcctaa

SEQ ID NO: 3132696 - DNA, 11 bp, Homo sapiens
tgattctgatt

SEQ ID NO: 3132697 - DNA, 13 bp, Homo sapiens
tgattctgatttc

SEQ ID NO: 3132698 - DNA, 14 bp, Homo sapiens
tgattctgatttca

SEQ ID NO: 3132699 - DNA, 18 bp, Homo sapiens
tgattctgatttcagttt

SEQ ID NO: 3132700 - DNA, 18 bp, Homo sapiens
tgattctggctttaagcc

SEQ ID NO: 3132701 - DNA, 13 bp, Homo sapiens
tgattctgtgtgt

SEQ ID NO: 3132702 - DNA, 19 bp, Homo sapiens
tgattctttgttacaggca

SEQ ID NO: 3132703 - DNA, 18 bp, Homo sapiens
tgattctttttaaagtgt

SEQ ID NO: 3132704 - DNA, 20 bp, Homo sapiens
tgattgaaccagctcatctc

SEQ ID NO: 3132705 - DNA, 22 bp, Homo sapiens
tgattgaatctgattggacatt

SEQ ID NO: 3132706 - DNA, 15 bp, Homo sapiens
tgattgacctgctcc

SEQ ID NO: 3132707 - DNA, 12 bp, Homo sapiens
tgattgatttga

SEQ ID NO: 3132708 - DNA, 14 bp, Homo sapiens
tgattgatttgaag

SEQ ID NO: 3132709 - DNA, 17 bp, Homo sapiens
tgattgcacagaatttg

SEQ ID NO: 3132710 - DNA, 15 bp, Homo sapiens
tgattgcagaaagga

SEQ ID NO: 3132711 - DNA, 18 bp, Homo sapiens
tgattgcagaaaggagag

SEQ ID NO: 3132712 - DNA, 16 bp, Homo sapiens
tgattggaccaggcca

SEQ ID NO: 3132713 - DNA, 16 bp, Homo sapiens
tgattggattattcat

SEQ ID NO: 3132714 - DNA, 23 bp, Homo sapiens
tgattggcttgtagaattgttat

SEQ ID NO: 3132715 - DNA, 15 bp, Homo sapiens
tgattgggaaaacat

SEQ ID NO: 3132716 - DNA, 23 bp, Homo sapiens
tgattgtaaaatagcttgtatag

SEQ ID NO: 3132717 - DNA, 14 bp, Homo sapiens
tgattgttatgtaa

SEQ ID NO: 3132718 - DNA, 17 bp, Homo sapiens
tgattgttatgtaaaac

SEQ ID NO: 3132719 - DNA, 15 bp, Homo sapiens
tgatttaaacacaca

SEQ ID NO: 3132720 - DNA, 23 bp, Homo sapiens
tgatttaataaaataattctaaa

SEQ ID NO: 3132721 - DNA, 20 bp, Homo sapiens
tgatttacagcaagtagata

SEQ ID NO: 3132722 - DNA, 19 bp, Homo sapiens
tgatttacatgtatggtta

SEQ ID NO: 3132723 - DNA, 17 bp, Homo sapiens
tgatttagattgagtaa

SEQ ID NO: 3132724 - DNA, 22 bp, Homo sapiens
tgatttaggtagccttgtgttc

SEQ ID NO: 3132725 - DNA, 20 bp, Homo sapiens
tgatttatcctcacataaaa

SEQ ID NO: 3132726 - DNA, 13 bp, Homo sapiens
tgatttatggttt

SEQ ID NO: 3132727 - DNA, 21 bp, Homo sapiens
tgatttcaaagttttgttgta

SEQ ID NO: 3132728 - DNA, 19 bp, Homo sapiens
tgatttcacaacagatcaa

SEQ ID NO: 3132729 - DNA, 14 bp, Homo sapiens
tgatttcagtaagt

SEQ ID NO: 3132730 - DNA, 19 bp, Homo sapiens
tgatttcagtaagtctcat

SEQ ID NO: 3132731 - DNA, 14 bp, Homo sapiens
tgatttcatattga

SEQ ID NO: 3132732 - DNA, 18 bp, Homo sapiens
tgatttcatcttctggaa

SEQ ID NO: 3132733 - DNA, 19 bp, Homo sapiens
tgatttcatcttctggaat

SEQ ID NO: 3132734 - DNA, 17 bp, Homo sapiens
tgatttcatttcaactg

SEQ ID NO: 3132735 - DNA, 13 bp, Homo sapiens
tgatttccaggcc

SEQ ID NO: 3132736 - DNA, 19 bp, Homo sapiens
tgatttccagtgagtgtaa

SEQ ID NO: 3132737 - DNA, 16 bp, Homo sapiens
tgatttccatctctgg

SEQ ID NO: 3132738 - DNA, 19 bp, Homo sapiens
tgatttccatctctggtaa

SEQ ID NO: 3132739 - DNA, 17 bp, Homo sapiens
tgatttccatttctgat

SEQ ID NO: 3132740 - DNA, 16 bp, Homo sapiens
tgatttcctaaacata

SEQ ID NO: 3132741 - DNA, 22 bp, Homo sapiens
tgatttcctaaacataattgtg

SEQ ID NO: 3132742 - DNA, 17 bp, Homo sapiens
tgatttctagaaagcct

SEQ ID NO: 3132743 - DNA, 16 bp, Homo sapiens
tgatttctatggcttt

SEQ ID NO: 3132744 - DNA, 20 bp, Homo sapiens
tgatttctatggctttcaaa

SEQ ID NO: 3132745 - DNA, 21 bp, Homo sapiens
tgatttctatggctttcaaag

SEQ ID NO: 3132746 - DNA, 22 bp, Homo sapiens
tgatttctatggctttcaaagc

SEQ ID NO: 3132747 - DNA, 22 bp, Homo sapiens
tgatttcttaggggaaggagaa

SEQ ID NO: 3132748 - DNA, 12 bp, Homo sapiens
tgatttcttcta

SEQ ID NO: 3132749 - DNA, 16 bp, Homo sapiens
tgatttgcatggattt

SEQ ID NO: 3132750 - DNA, 17 bp, Homo sapiens
tgatttgcatggatttt

SEQ ID NO: 3132751 - DNA, 21 bp, Homo sapiens
tgatttgcatggattttggat

SEQ ID NO: 3132752 - DNA, 16 bp, Homo sapiens
tgatcactcccagcac

SEQ ID NO: 3132753 - DNA, 18 bp, Homo sapiens
tgatcactcccagcactc

SEQ ID NO: 3132754 - DNA, 22 bp, Homo sapiens
tgatcactttgttaaaaatatt

SEQ ID NO: 3132755 - DNA, 23 bp, Homo sapiens
tgatcagaagactttaattatat

SEQ ID NO: 3132756 - DNA, 18 bp, Homo sapiens
tgatcagaccataatgtt

SEQ ID NO: 3132757 - DNA, 19 bp, Homo sapiens
tgatcagaggtgtacacta

SEQ ID NO: 3132758 - DNA, 23 bp, Homo sapiens
tgatcagaggtgtacactaacat

SEQ ID NO: 3132759 - DNA, 21 bp, Homo sapiens
tgatcagtactgactttctga

SEQ ID NO: 3132760 - DNA, 11 bp, Homo sapiens
tgatcagtgtt

SEQ ID NO: 3132761 - DNA, 12 bp, Homo sapiens
tgatcagtgttg

SEQ ID NO: 3132762 - DNA, 16 bp, Homo sapiens
tgatcatcatgtagaa

SEQ ID NO: 3132763 - DNA, 17 bp, Homo sapiens
tgatcatccctttctcc

SEQ ID NO: 3132764 - DNA, 15 bp, Homo sapiens
tgatcatgcattgtt

SEQ ID NO: 3132765 - DNA, 23 bp, Homo sapiens
tgatcatgcattgttgaggtggt

SEQ ID NO: 3132766 - DNA, 19 bp, Homo sapiens
tgatcatgtactttttagt

SEQ ID NO: 3132767 - DNA, 16 bp, Homo sapiens
tgatcatgttgttaaa

SEQ ID NO: 3132768 - DNA, 13 bp, Homo sapiens
tgatcatttattt

SEQ ID NO: 3132769 - DNA, 21 bp, Homo sapiens
tgatcattttccccccactct

SEQ ID NO: 3132770 - DNA, 13 bp, Homo sapiens
tgatccaactaat

SEQ ID NO: 3132771 - DNA, 13 bp, Homo sapiens
tgatccaagctgg

SEQ ID NO: 3132772 - DNA, 14 bp, Homo sapiens
tgatccaagctggt

SEQ ID NO: 3132773 - DNA, 21 bp, Homo sapiens
tgatccaagctggtcccactc

SEQ ID NO: 3132774 - DNA, 16 bp, Homo sapiens
tgatccacccaaccct

SEQ ID NO: 3132775 - DNA, 15 bp, Homo sapiens
tgatccacccacctc

SEQ ID NO: 3132776 - DNA, 22 bp, Homo sapiens
tgatccacccacctcagcctcc

SEQ ID NO: 3132777 - DNA, 18 bp, Homo sapiens
tgatccatccatctccag

SEQ ID NO: 3132778 - DNA, 15 bp, Homo sapiens
tgatcccatattctt

SEQ ID NO: 3132779 - DNA, 15 bp, Homo sapiens
tgatcccattttcct

SEQ ID NO: 3132780 - DNA, 20 bp, Homo sapiens
tgatccccaagtggtgaatg

SEQ ID NO: 3132781 - DNA, 19 bp, Homo sapiens
tgatccctgtgttgtctct

SEQ ID NO: 3132782 - DNA, 19 bp, Homo sapiens
tgatccgcctacctcagcc

SEQ ID NO: 3132783 - DNA, 23 bp, Homo sapiens
tgatccgcctgcctctgcctccc

SEQ ID NO: 3132784 - DNA, 20 bp, Homo sapiens
tgatcctcccacctcagcct

SEQ ID NO: 3132785 - DNA, 21 bp, Homo sapiens
tgatcctcccacctcagcctc

SEQ ID NO: 3132786 - DNA, 22 bp, Homo sapiens
tgatccttttttgtcattttat

SEQ ID NO: 3132787 - DNA, 15 bp, Homo sapiens
tgatcgaaaaaataa

SEQ ID NO: 3132788 - DNA, 16 bp, Homo sapiens
tgatcgaaaaaataat

SEQ ID NO: 3132789 - DNA, 16 bp, Homo sapiens
tgatcgagccactgca

SEQ ID NO: 3132790 - DNA, 22 bp, Homo sapiens
tgatctacttcatagctccttg

SEQ ID NO: 3132791 - DNA, 18 bp, Homo sapiens
tgatctacttctgtaatt

SEQ ID NO: 3132792 - DNA, 21 bp, Homo sapiens
tgatctacttctgtaattgtg

SEQ ID NO: 3132793 - DNA, 20 bp, Homo sapiens
tgatctattgctcatcagct

SEQ ID NO: 3132794 - DNA, 22 bp, Homo sapiens
tgatctatttgtagattaggat

SEQ ID NO: 3132795 - DNA, 17 bp, Homo sapiens
tgatctcggatgaccaa

SEQ ID NO: 3132796 - DNA, 18 bp, Homo sapiens
tgatctcggatgaccaaa

SEQ ID NO: 3132797 - DNA, 12 bp, Homo sapiens
tgatctcttcct

SEQ ID NO: 3132798 - DNA, 22 bp, Homo sapiens
tgatctgtatttaatggttttt

SEQ ID NO: 3132799 - DNA, 21 bp, Homo sapiens
tgatctgtgatagttcacccc

SEQ ID NO: 3132800 - DNA, 15 bp, Homo sapiens
tgatctgtttttcac

SEQ ID NO: 3132801 - DNA, 13 bp, Homo sapiens
tgatcttaaagat

SEQ ID NO: 3132802 - DNA, 18 bp, Homo sapiens
tgatcttaaagatcgtgt

SEQ ID NO: 3132803 - DNA, 19 bp, Homo sapiens
tgatcttctgggagcagga

SEQ ID NO: 3132804 - DNA, 20 bp, Homo sapiens
tgatcttctgggagcaggaa

SEQ ID NO: 3132805 - DNA, 20 bp, Homo sapiens
tgatctttgcagacaggcaa

SEQ ID NO: 3132806 - DNA, 17 bp, Homo sapiens
tgatgaaattcttgaag

SEQ ID NO: 3132807 - DNA, 18 bp, Homo sapiens
tgatgaactcttaatcaa

SEQ ID NO: 3132808 - DNA, 15 bp, Homo sapiens
tgatgaagcaaggaa

SEQ ID NO: 3132809 - DNA, 16 bp, Homo sapiens
tgatgaagcaaggaag

SEQ ID NO: 3132810 - DNA, 24 bp, Homo sapiens
tgatgaagcaaggaagatatacat

SEQ ID NO: 3132811 - DNA, 19 bp, Homo sapiens
tgatgaatcaatgaaaaat

SEQ ID NO: 3132812 - DNA, 22 bp, Homo sapiens
tgatgaatcaatgaaaaatgta

SEQ ID NO: 3132813 - DNA, 14 bp, Homo sapiens
tgatgaatcactgt

SEQ ID NO: 3132814 - DNA, 18 bp, Homo sapiens
tgatgacaaaaaatgttt

SEQ ID NO: 3132815 - DNA, 20 bp, Homo sapiens
tgatgacaaaaaatgtttta

SEQ ID NO: 3132816 - DNA, 18 bp, Homo sapiens
tgatgacattccctgcta

SEQ ID NO: 3132817 - DNA, 16 bp, Homo sapiens
tgatgactggttgttc

SEQ ID NO: 3132818 - DNA, 15 bp, Homo sapiens
tgatgagaatttcta

SEQ ID NO: 3132819 - DNA, 23 bp, Homo sapiens
tgatgagaatttctaaaaagatt

SEQ ID NO: 3132820 - DNA, 20 bp, Homo sapiens
tgatgagatattaaattctc

SEQ ID NO: 3132821 - DNA, 14 bp, Homo sapiens
tgatgagattttta

SEQ ID NO: 3132822 - DNA, 14 bp, Homo sapiens
tgatgaggggaggg

SEQ ID NO: 3132823 - DNA, 22 bp, Homo sapiens
tgatgaggtattttttcctttt

SEQ ID NO: 3132824 - DNA, 18 bp, Homo sapiens
tgatgagttaactgtgaa

SEQ ID NO: 3132825 - DNA, 19 bp, Homo sapiens
tgatgagttaactgtgaaa

SEQ ID NO: 3132826 - DNA, 20 bp, Homo sapiens
tgatgagttaactgtgaaat

SEQ ID NO: 3132827 - DNA, 14 bp, Homo sapiens
tgatgataatgatg

SEQ ID NO: 3132828 - DNA, 15 bp, Homo sapiens
tgatgatacaagatt

SEQ ID NO: 3132829 - DNA, 13 bp, Homo sapiens
tgatgatcaaaac

SEQ ID NO: 3132830 - DNA, 22 bp, Homo sapiens
tgatgatctttgcagacaggca

SEQ ID NO: 3132831 - DNA, 15 bp, Homo sapiens
tgatgatgatgaaaa

SEQ ID NO: 3132832 - DNA, 16 bp, Homo sapiens
tgatgatgatgaaaac

SEQ ID NO: 3132833 - DNA, 14 bp, Homo sapiens
tgatgatgtaattg

SEQ ID NO: 3132834 - DNA, 14 bp, Homo sapiens
tgatgatgtctctt

SEQ ID NO: 3132835 - DNA, 15 bp, Homo sapiens
tgatgatgtctcttg

SEQ ID NO: 3132836 - DNA, 21 bp, Homo sapiens
tgatgatgtctcttgtagaag

SEQ ID NO: 3132837 - DNA, 14 bp, Homo sapiens
tgatgatttggggg

SEQ ID NO: 3132838 - DNA, 15 bp, Homo sapiens
tgatgatttggggga

SEQ ID NO: 3132839 - DNA, 16 bp, Homo sapiens
tgatgcaaggattaca

SEQ ID NO: 3132840 - DNA, 18 bp, Homo sapiens
tgatgcaaggattacaga

SEQ ID NO: 3132841 - DNA, 20 bp, Homo sapiens
tgatgcaaggattacagaaa

SEQ ID NO: 3132842 - DNA, 22 bp, Homo sapiens
tgatgcaaggattacagaaact

SEQ ID NO: 3132843 - DNA, 20 bp, Homo sapiens
tgatgcatacagttttctag

SEQ ID NO: 3132844 - DNA, 22 bp, Homo sapiens
tgatgcatgctattcacaatta

SEQ ID NO: 3132845 - DNA, 16 bp, Homo sapiens
tgatgcatgtctttta

SEQ ID NO: 3132846 - DNA, 14 bp, Homo sapiens
tgatgcatgttact

SEQ ID NO: 3132847 - DNA, 18 bp, Homo sapiens
tgatgccacacagagtgg

SEQ ID NO: 3132848 - DNA, 16 bp, Homo sapiens
tgatgctaaataggag

SEQ ID NO: 3132849 - DNA, 16 bp, Homo sapiens
tgatgctccctcccct

SEQ ID NO: 3132850 - DNA, 21 bp, Homo sapiens
tgatgctgagattcttcaggc

SEQ ID NO: 3132851 - DNA, 13 bp, Homo sapiens
tgatgctgccccg

SEQ ID NO: 3132852 - DNA, 14 bp, Homo sapiens
tgatgctgtgacaa

SEQ ID NO: 3132853 - DNA, 20 bp, Homo sapiens
tgatgctgtgctatgaattt

SEQ ID NO: 3132854 - DNA, 18 bp, Homo sapiens
tgatgctgttctcttctt

SEQ ID NO: 3132855 - DNA, 23 bp, Homo sapiens
tgatgcttgtaacaagaaaacat

SEQ ID NO: 3132856 - DNA, 22 bp, Homo sapiens
tgatggaagtaaagcctcaacc

SEQ ID NO: 3132857 - DNA, 23 bp, Homo sapiens
tgatggaccagtggtttccagtc

SEQ ID NO: 3132858 - DNA, 19 bp, Homo sapiens
tgatggaccgggtgggcct

SEQ ID NO: 3132859 - DNA, 20 bp, Homo sapiens
tgatggaccgggtgggcctg

SEQ ID NO: 3132860 - DNA, 22 bp, Homo sapiens
tgatggaccgggtgggcctggc

SEQ ID NO: 3132861 - DNA, 12 bp, Homo sapiens
tgatggagagga

SEQ ID NO: 3132862 - DNA, 17 bp, Homo sapiens
tgatggaggtatttgaa

SEQ ID NO: 3132863 - DNA, 15 bp, Homo sapiens
tgatggagtgtgagc

SEQ ID NO: 3132864 - DNA, 22 bp, Homo sapiens
tgatggcacttagctatcagaa

SEQ ID NO: 3132865 - DNA, 14 bp, Homo sapiens
tgatggccaagggg

SEQ ID NO: 3132866 - DNA, 18 bp, Homo sapiens
tgatggccttacactgaa

SEQ ID NO: 3132867 - DNA, 21 bp, Homo sapiens
tgatggcgcgggaggcaccag

SEQ ID NO: 3132868 - DNA, 23 bp, Homo sapiens
tgatggcgcgggaggcaccagct

SEQ ID NO: 3132869 - DNA, 12 bp, Homo sapiens
tgatggcttgac

SEQ ID NO: 3132870 - DNA, 19 bp, Homo sapiens
tgatgggagagtagatggt

SEQ ID NO: 3132871 - DNA, 21 bp, Homo sapiens
tgatgggcaacccccagcctg

SEQ ID NO: 3132872 - DNA, 14 bp, Homo sapiens
tgatggtgagctgg

SEQ ID NO: 3132873 - DNA, 14 bp, Homo sapiens
tgatggttcccctg

SEQ ID NO: 3132874 - DNA, 19 bp, Homo sapiens
tgatggttcttcacctcct

SEQ ID NO: 3132875 - DNA, 17 bp, Homo sapiens
tgatgtacagattcttt

SEQ ID NO: 3132876 - DNA, 15 bp, Homo sapiens
tgatgtacagatttt

SEQ ID NO: 3132877 - DNA, 16 bp, Homo sapiens
tgatgtacagatttta

SEQ ID NO: 3132878 - DNA, 18 bp, Homo sapiens
tgatgtacagtctgtcat

SEQ ID NO: 3132879 - DNA, 13 bp, Homo sapiens
tgatgtatatgtt

SEQ ID NO: 3132880 - DNA, 21 bp, Homo sapiens
tgagagaagccacgctgtcct

SEQ ID NO: 3132881 - DNA, 22 bp, Homo sapiens
tgagagaagccacgctgtcctc

SEQ ID NO: 3132882 - DNA, 14 bp, Homo sapiens
tgagagaattggct

SEQ ID NO: 3132883 - DNA, 18 bp, Homo sapiens
tgagagaattgtatcatt

SEQ ID NO: 3132884 - DNA, 19 bp, Homo sapiens
tgagagaattgtatcattt

SEQ ID NO: 3132885 - DNA, 10 bp, Homo sapiens
tgagagagac

SEQ ID NO: 3132886 - DNA, 15 bp, Homo sapiens
tgagagagacaagaa

SEQ ID NO: 3132887 - DNA, 15 bp, Homo sapiens
tgagagagagactgt

SEQ ID NO: 3132888 - DNA, 17 bp, Homo sapiens
tgagagagagactgtgt

SEQ ID NO: 3132889 - DNA, 19 bp, Homo sapiens
tgagagagagactgtgtgt

SEQ ID NO: 3132890 - DNA, 15 bp, Homo sapiens
tgagagcccagaggt

SEQ ID NO: 3132891 - DNA, 20 bp, Homo sapiens
tgagagcccagaggtaacag

SEQ ID NO: 3132892 - DNA, 23 bp, Homo sapiens
tgagagcccattcccaccattct

SEQ ID NO: 3132893 - DNA, 20 bp, Homo sapiens
tgagagccctgaggcctaga

SEQ ID NO: 3132894 - DNA, 17 bp, Homo sapiens
tgagagccctgctgtgg

SEQ ID NO: 3132895 - DNA, 19 bp, Homo sapiens
tgagagccctgctgtggga

SEQ ID NO: 3132896 - DNA, 16 bp, Homo sapiens
tgagagcgagatggga

SEQ ID NO: 3132897 - DNA, 23 bp, Homo sapiens
tgagaggacttttctttgtggct

SEQ ID NO: 3132898 - DNA, 23 bp, Homo sapiens
tgagaggatgaatgtatgtgcac

SEQ ID NO: 3132899 - DNA, 14 bp, Homo sapiens
tgagaggcaggcat

SEQ ID NO: 3132900 - DNA, 14 bp, Homo sapiens
tgagaggcctggag

SEQ ID NO: 3132901 - DNA, 16 bp, Homo sapiens
tgagaggcctggagcc

SEQ ID NO: 3132902 - DNA, 21 bp, Homo sapiens
tgagaggtggcttttgcggcc

SEQ ID NO: 3132903 - DNA, 16 bp, Homo sapiens
tgagagtcaaagctga

SEQ ID NO: 3132904 - DNA, 13 bp, Homo sapiens
tgagagtctagat

SEQ ID NO: 3132905 - DNA, 14 bp, Homo sapiens
tgagagtctagatt

SEQ ID NO: 3132906 - DNA, 21 bp, Homo sapiens
tgagagttttgtcttgaatgt

SEQ ID NO: 3132907 - DNA, 13 bp, Homo sapiens
tgagatacactga

SEQ ID NO: 3132908 - DNA, 19 bp, Homo sapiens
tgagatagtagcatacatt

SEQ ID NO: 3132909 - DNA, 23 bp, Homo sapiens
tgagatagtagcatacatttata

SEQ ID NO: 3132910 - DNA, 15 bp, Homo sapiens
tgagatattaaattc

SEQ ID NO: 3132911 - DNA, 17 bp, Homo sapiens
tgagatcacagcctcca

SEQ ID NO: 3132912 - DNA, 22 bp, Homo sapiens
tgagatcacagcctccagggcc

SEQ ID NO: 3132913 - DNA, 12 bp, Homo sapiens
tgagatcccctg

SEQ ID NO: 3132914 - DNA, 22 bp, Homo sapiens
tgagatctaagcctttccataa

SEQ ID NO: 3132915 - DNA, 16 bp, Homo sapiens
tgagatgctggagaag

SEQ ID NO: 3132916 - DNA, 21 bp, Homo sapiens
tgagatggaaaagtgtccttc

SEQ ID NO: 3132917 - DNA, 13 bp, Homo sapiens
tgagatggtaaca

SEQ ID NO: 3132918 - DNA, 21 bp, Homo sapiens
tgagatggtaacagatttgct

SEQ ID NO: 3132919 - DNA, 19 bp, Homo sapiens
tgagatgtgttcctcctgc

SEQ ID NO: 3132920 - DNA, 15 bp, Homo sapiens
tgagattacagagga

SEQ ID NO: 3132921 - DNA, 20 bp, Homo sapiens
tgagattcctctgtattgtg

SEQ ID NO: 3132922 - DNA, 17 bp, Homo sapiens
tgagattgaatttcact

SEQ ID NO: 3132923 - DNA, 15 bp, Homo sapiens
tgagattggttttcc

SEQ ID NO: 3132924 - DNA, 22 bp, Homo sapiens
tgagattggttttcctgtggca

SEQ ID NO: 3132925 - DNA, 23 bp, Homo sapiens
tgagatttaccagggatgtagat

SEQ ID NO: 3132926 - DNA, 17 bp, Homo sapiens
tgagatttcttaaataa

SEQ ID NO: 3132927 - DNA, 17 bp, Homo sapiens
tgagatttcttaaatct

SEQ ID NO: 3132928 - DNA, 14 bp, Homo sapiens
tgagatttgccagc

SEQ ID NO: 3132929 - DNA, 20 bp, Homo sapiens
tgagatttgccagcacaggg

SEQ ID NO: 3132930 - DNA, 19 bp, Homo sapiens
tgagatttttttgtgtatg

SEQ ID NO: 3132931 - DNA, 18 bp, Homo sapiens
tgagcaaactaacttgac

SEQ ID NO: 3132932 - DNA, 18 bp, Homo sapiens
tgagcaaatgtggctcct

SEQ ID NO: 3132933 - DNA, 19 bp, Homo sapiens
tgagcaagaccctgtctct

SEQ ID NO: 3132934 - DNA, 23 bp, Homo sapiens
tgagcaaggagcacaagccacaa

SEQ ID NO: 3132935 - DNA, 16 bp, Homo sapiens
tgagcaagggggccca

SEQ ID NO: 3132936 - DNA, 17 bp, Homo sapiens
tgagcaccgtcatggct

SEQ ID NO: 3132937 - DNA, 22 bp, Homo sapiens
tgagcactaaggtgtgctctga

SEQ ID NO: 3132938 - DNA, 15 bp, Homo sapiens
tgagcacttagcagg

SEQ ID NO: 3132939 - DNA, 23 bp, Homo sapiens
tgagcagccgccagctgggagca

SEQ ID NO: 3132940 - DNA, 17 bp, Homo sapiens
tgagcaggaaggcctgg

SEQ ID NO: 3132941 - DNA, 18 bp, Homo sapiens
tgagcaggaaggcctggg

SEQ ID NO: 3132942 - DNA, 15 bp, Homo sapiens
tgagcagggctcagc

SEQ ID NO: 3132943 - DNA, 23 bp, Homo sapiens
tgagcagggctcagcggggacag

SEQ ID NO: 3132944 - DNA, 21 bp, Homo sapiens
tgagcagggtcagtggaagcc

SEQ ID NO: 3132945 - DNA, 14 bp, Homo sapiens
tgagcagtggctgg

SEQ ID NO: 3132946 - DNA, 17 bp, Homo sapiens
tgagcatacctgtctca

SEQ ID NO: 3132947 - DNA, 22 bp, Homo sapiens
tgagcatacctgtctcagctgt

SEQ ID NO: 3132948 - DNA, 14 bp, Homo sapiens
tgagcatgatggga

SEQ ID NO: 3132949 - DNA, 17 bp, Homo sapiens
tgagcatggcagctggt

SEQ ID NO: 3132950 - DNA, 21 bp, Homo sapiens
tgagcattttatatccacatc

SEQ ID NO: 3132951 - DNA, 12 bp, Homo sapiens
tgagccaccacg

SEQ ID NO: 3132952 - DNA, 23 bp, Homo sapiens
tgagccaccgctgccagcacaga

SEQ ID NO: 3132953 - DNA, 20 bp, Homo sapiens
tgagccagacaaatggagga

SEQ ID NO: 3132954 - DNA, 18 bp, Homo sapiens
tgaggaaatccattgttt

SEQ ID NO: 3132955 - DNA, 20 bp, Homo sapiens
tgaggaaatccattgtttaa

SEQ ID NO: 3132956 - DNA, 17 bp, Homo sapiens
tgaggaactgtacagaa

SEQ ID NO: 3132957 - DNA, 19 bp, Homo sapiens
tgaggaactgtacagaaaa

SEQ ID NO: 3132958 - DNA, 14 bp, Homo sapiens
tgaggaagagtctt

SEQ ID NO: 3132959 - DNA, 18 bp, Homo sapiens
tgaggaagtgtggaaaaa

SEQ ID NO: 3132960 - DNA, 22 bp, Homo sapiens
tgaggaataaatgcctttatat

SEQ ID NO: 3132961 - DNA, 20 bp, Homo sapiens
tgaggaatagttgagcccca

SEQ ID NO: 3132962 - DNA, 21 bp, Homo sapiens
tgaggaatccagacccggctg

SEQ ID NO: 3132963 - DNA, 22 bp, Homo sapiens
tgaggaatttcacctgtaaacc

SEQ ID NO: 3132964 - DNA, 18 bp, Homo sapiens
tgaggaattttctttgtg

SEQ ID NO: 3132965 - DNA, 20 bp, Homo sapiens
tgaggacacaccccacaccc

SEQ ID NO: 3132966 - DNA, 21 bp, Homo sapiens
tgaggacaccagtgaaagaag

SEQ ID NO: 3132967 - DNA, 21 bp, Homo sapiens
tgaggacacgtggcctgcacc

SEQ ID NO: 3132968 - DNA, 22 bp, Homo sapiens
tgaggaccgctgataagcattg

SEQ ID NO: 3132969 - DNA, 15 bp, Homo sapiens
tgaggacgcaccgcc

SEQ ID NO: 3132970 - DNA, 23 bp, Homo sapiens
tgaggagcatgttttgtatacaa

SEQ ID NO: 3132971 - DNA, 22 bp, Homo sapiens
tgaggagcccatactcagcctg

SEQ ID NO: 3132972 - DNA, 23 bp, Homo sapiens
tgaggagcccatactcagcctgc

SEQ ID NO: 3132973 - DNA, 11 bp, Homo sapiens
tgaggagcccc

SEQ ID NO: 3132974 - DNA, 11 bp, Homo sapiens
tgaggagctgc

SEQ ID NO: 3132975 - DNA, 15 bp, Homo sapiens
tgaggagctgctggc

SEQ ID NO: 3132976 - DNA, 16 bp, Homo sapiens
tgaggagctgctggct

SEQ ID NO: 3132977 - DNA, 13 bp, Homo sapiens
tgaggaggaaaag

SEQ ID NO: 3132978 - DNA, 18 bp, Homo sapiens
tgaggaggaaaaggaaaa

SEQ ID NO: 3132979 - DNA, 22 bp, Homo sapiens
tgaggaggatgtccctgggcca

SEQ ID NO: 3132980 - DNA, 19 bp, Homo sapiens
tgaggaggttcactgagct

SEQ ID NO: 3132981 - DNA, 21 bp, Homo sapiens
tgaggagtttcctaaaagttc

SEQ ID NO: 3132982 - DNA, 22 bp, Homo sapiens
tgaggattgtggaaaaccagga

SEQ ID NO: 3132983 - DNA, 13 bp, Homo sapiens
tgaggatttcaag

SEQ ID NO: 3132984 - DNA, 16 bp, Homo sapiens
tgaggatttcaagcct

SEQ ID NO: 3132985 - DNA, 16 bp, Homo sapiens
tgaggcacttctgtca

SEQ ID NO: 3132986 - DNA, 18 bp, Homo sapiens
tgaggcagcagaattgct

SEQ ID NO: 3132987 - DNA, 22 bp, Homo sapiens
tgaggccatctcaggagatgga

SEQ ID NO: 3132988 - DNA, 18 bp, Homo sapiens
tgaggcctcatccctcgg

SEQ ID NO: 3132989 - DNA, 16 bp, Homo sapiens
tgaggcctgaggcctg

SEQ ID NO: 3132990 - DNA, 17 bp, Homo sapiens
tgaggcctgaggcctgt

SEQ ID NO: 3132991 - DNA, 11 bp, Homo sapiens
tgaggcctgga

SEQ ID NO: 3132992 - DNA, 13 bp, Homo sapiens
tgaggcctgggcc

SEQ ID NO: 3132993 - DNA, 15 bp, Homo sapiens
tgaggcctgtgcctg

SEQ ID NO: 3132994 - DNA, 16 bp, Homo sapiens
tgaggctctttctggg

SEQ ID NO: 3132995 - DNA, 18 bp, Homo sapiens
tgaggctctttctgggcc

SEQ ID NO: 3132996 - DNA, 13 bp, Homo sapiens
tgaggctgagact

SEQ ID NO: 3132997 - DNA, 13 bp, Homo sapiens
tgaggctgcagcg

SEQ ID NO: 3132998 - DNA, 12 bp, Homo sapiens
tgaggctgggaa

SEQ ID NO: 3132999 - DNA, 17 bp, Homo sapiens
tgaggcttctccttctc

SEQ ID NO: 3133000 - DNA, 19 bp, Homo sapiens
tgaggcttctccttctcct

SEQ ID NO: 3133001 - DNA, 13 bp, Homo sapiens
tgagggacatgct

SEQ ID NO: 3133002 - DNA, 16 bp, Homo sapiens
tgagggactgcctctg

SEQ ID NO: 3133003 - DNA, 14 bp, Homo sapiens
tgagggagcttagc

SEQ ID NO: 3133004 - DNA, 23 bp, Homo sapiens
tgagggaggaggccacctctcca

SEQ ID NO: 3133005 - DNA, 21 bp, Homo sapiens
tgagggagggggcgctcagga

SEQ ID NO: 3133006 - DNA, 18 bp, Homo sapiens
tgagggatcacagggccc

SEQ ID NO: 3133007 - DNA, 18 bp, Homo sapiens
tgagggccaagaaagagt

SEQ ID NO: 3133008 - DNA, 18 bp, Homo sapiens
tgagggcccagagcagga

SEQ ID NO: 3133009 - DNA, 19 bp, Homo sapiens
tgagggcccagagcaggaa

SEQ ID NO: 3133010 - DNA, 13 bp, Homo sapiens
tgagggcccagcc

SEQ ID NO: 3133011 - DNA, 17 bp, Homo sapiens
tgagggcccagccagga

SEQ ID NO: 3133012 - DNA, 21 bp, Homo sapiens
tgaggggaggatcactggagc

SEQ ID NO: 3133013 - DNA, 15 bp, Homo sapiens
tgaggggaggggggc

SEQ ID NO: 3133014 - DNA, 22 bp, Homo sapiens
tgaggggcatctgcccctcccc

SEQ ID NO: 3133015 - DNA, 14 bp, Homo sapiens
tgaggggctcctgg

SEQ ID NO: 3133016 - DNA, 11 bp, Homo sapiens
tgaggggtctc

SEQ ID NO: 3133017 - DNA, 15 bp, Homo sapiens
tgaggggtctcggat

SEQ ID NO: 3133018 - DNA, 16 bp, Homo sapiens
tgaggggtctcggatg

SEQ ID NO: 3133019 - DNA, 15 bp, Homo sapiens
tgagggtccccacct

SEQ ID NO: 3133020 - DNA, 19 bp, Homo sapiens
tgagggtcttcttacatgc

SEQ ID NO: 3133021 - DNA, 14 bp, Homo sapiens
tgagggtgtttctt

SEQ ID NO: 3133022 - DNA, 22 bp, Homo sapiens
tgaggtagaccaggatttctaa

SEQ ID NO: 3133023 - DNA, 16 bp, Homo sapiens
tgaggtcagagcctgc

SEQ ID NO: 3133024 - DNA, 16 bp, Homo sapiens
aaaatattgtttctgc

SEQ ID NO: 3133025 - DNA, 23 bp, Homo sapiens
aaaatatttattaaataaaatca

SEQ ID NO: 3133026 - DNA, 13 bp, Homo sapiens
aaaatatttcaga

SEQ ID NO: 3133027 - DNA, 17 bp, Homo sapiens
aaaatatttcagatatc

SEQ ID NO: 3133028 - DNA, 21 bp, Homo sapiens
aaaatatttgactattctgta

SEQ ID NO: 3133029 - DNA, 15 bp, Homo sapiens
aaaatcaacttgtgt

SEQ ID NO: 3133030 - DNA, 16 bp, Homo sapiens
aaaatcactaacatta

SEQ ID NO: 3133031 - DNA, 15 bp, Homo sapiens
aaaatcactttcata

SEQ ID NO: 3133032 - DNA, 16 bp, Homo sapiens
aaaatcagtttttcat

SEQ ID NO: 3133033 - DNA, 20 bp, Homo sapiens
aaaatccaataatcagaaaa

SEQ ID NO: 3133034 - DNA, 15 bp, Homo sapiens
aaaatccatccaaat

SEQ ID NO: 3133035 - DNA, 16 bp, Homo sapiens
aaaatcctaagacaca

SEQ ID NO: 3133036 - DNA, 13 bp, Homo sapiens
aaaatccttgctt

SEQ ID NO: 3133037 - DNA, 16 bp, Homo sapiens
aaaatctaaaacaaaa

SEQ ID NO: 3133038 - DNA, 23 bp, Homo sapiens
aaaatctaatattaaaaatatgg

SEQ ID NO: 3133039 - DNA, 19 bp, Homo sapiens
aaaatctcccattttggaa

SEQ ID NO: 3133040 - DNA, 12 bp, Homo sapiens
aaaatctgtcca

SEQ ID NO: 3133041 - DNA, 14 bp, Homo sapiens
aaaatcttggaagt

SEQ ID NO: 3133042 - DNA, 12 bp, Homo sapiens
aaaatctttcag

SEQ ID NO: 3133043 - DNA, 18 bp, Homo sapiens
aaaatctttgtataaata

SEQ ID NO: 3133044 - DNA, 16 bp, Homo sapiens
aaaatcttttgaagca

SEQ ID NO: 3133045 - DNA, 19 bp, Homo sapiens
aaaatgaaagcatgtctca

SEQ ID NO: 3133046 - DNA, 22 bp, Homo sapiens
aaaatgaaagcatgtctcaata

SEQ ID NO: 3133047 - DNA, 14 bp, Homo sapiens
aaaatgaaagctac

SEQ ID NO: 3133048 - DNA, 15 bp, Homo sapiens
aaaatgaaagtgact

SEQ ID NO: 3133049 - DNA, 18 bp, Homo sapiens
aaaatgaagaaggaagct

SEQ ID NO: 3133050 - DNA, 13 bp, Homo sapiens
aaaatgaagggat

SEQ ID NO: 3133051 - DNA, 18 bp, Homo sapiens
aaaatgaatatctattaa

SEQ ID NO: 3133052 - DNA, 16 bp, Homo sapiens
aaaatgaattttttcc

SEQ ID NO: 3133053 - DNA, 19 bp, Homo sapiens
aaaatgacaacagaaaaac

SEQ ID NO: 3133054 - DNA, 13 bp, Homo sapiens
aaaatgacaatga

SEQ ID NO: 3133055 - DNA, 21 bp, Homo sapiens
aaaatgactaaaaatattata

SEQ ID NO: 3133056 - DNA, 16 bp, Homo sapiens
aaaatgagcttgatta

SEQ ID NO: 3133057 - DNA, 20 bp, Homo sapiens
aaaatgagttgtgaaagttt

SEQ ID NO: 3133058 - DNA, 16 bp, Homo sapiens
aaaatgagttgtgatg

SEQ ID NO: 3133059 - DNA, 12 bp, Homo sapiens
aaaatgcaaagc

SEQ ID NO: 3133060 - DNA, 22 bp, Homo sapiens
aaaatgcattgaaagaattaga

SEQ ID NO: 3133061 - DNA, 17 bp, Homo sapiens
aaaatgccatagtttgt

SEQ ID NO: 3133062 - DNA, 21 bp, Homo sapiens
aaaatgccatttagcaataaa

SEQ ID NO: 3133063 - DNA, 19 bp, Homo sapiens
aaaatgcctcaattcacat

SEQ ID NO: 3133064 - DNA, 12 bp, Homo sapiens
aaaatgcctttg

SEQ ID NO: 3133065 - DNA, 14 bp, Homo sapiens
aaaatgcctttgag

SEQ ID NO: 3133066 - DNA, 17 bp, Homo sapiens
aaaatgcctttgagaca

SEQ ID NO: 3133067 - DNA, 23 bp, Homo sapiens
aaaatgcctttgagacagtttct

SEQ ID NO: 3133068 - DNA, 18 bp, Homo sapiens
aaaatgctccccacagcg

SEQ ID NO: 3133069 - DNA, 13 bp, Homo sapiens
aaaatggaaagaa

SEQ ID NO: 3133070 - DNA, 14 bp, Homo sapiens
aaaatggaactgtg

SEQ ID NO: 3133071 - DNA, 14 bp, Homo sapiens
aaaatggaataaaa

SEQ ID NO: 3133072 - DNA, 19 bp, Homo sapiens
aaaatggacacaaattttc

SEQ ID NO: 3133073 - DNA, 20 bp, Homo sapiens
aaaatggatattattagaaa

SEQ ID NO: 3133074 - DNA, 14 bp, Homo sapiens
aaaatggatttaat

SEQ ID NO: 3133075 - DNA, 19 bp, Homo sapiens
aaaatggatttaatccatt

SEQ ID NO: 3133076 - DNA, 21 bp, Homo sapiens
aaaatggatttaatccatttt

SEQ ID NO: 3133077 - DNA, 19 bp, Homo sapiens
aaaatgggaagactgagct

SEQ ID NO: 3133078 - DNA, 13 bp, Homo sapiens
aaaatggtatcaa

SEQ ID NO: 3133079 - DNA, 16 bp, Homo sapiens
aaaatggttgatggaa

SEQ ID NO: 3133080 - DNA, 17 bp, Homo sapiens
aaaatggttgatggaaa

SEQ ID NO: 3133081 - DNA, 14 bp, Homo sapiens
aaaatggtttattt

SEQ ID NO: 3133082 - DNA, 11 bp, Homo sapiens
aaaatgtaaat

SEQ ID NO: 3133083 - DNA, 12 bp, Homo sapiens
aaaatgtaaatt

SEQ ID NO: 3133084 - DNA, 12 bp, Homo sapiens
aaaatgtaacat

SEQ ID NO: 3133085 - DNA, 19 bp, Homo sapiens
aaaatgtaacatcataatt

SEQ ID NO: 3133086 - DNA, 14 bp, Homo sapiens
aaaatgtaatttaa

SEQ ID NO: 3133087 - DNA, 19 bp, Homo sapiens
aaaatgtaatttaaatgaa

SEQ ID NO: 3133088 - DNA, 15 bp, Homo sapiens
aaaatgtacatttat

SEQ ID NO: 3133089 - DNA, 18 bp, Homo sapiens
aaaatgtactgagatttt

SEQ ID NO: 3133090 - DNA, 12 bp, Homo sapiens
aaaatgtatata

SEQ ID NO: 3133091 - DNA, 12 bp, Homo sapiens
aaaatgtatttt

SEQ ID NO: 3133092 - DNA, 17 bp, Homo sapiens
aaaatgtcctgcctttt

SEQ ID NO: 3133093 - DNA, 18 bp, Homo sapiens
aaaatgtctgttaactta

SEQ ID NO: 3133094 - DNA, 21 bp, Homo sapiens
aaaatgtctttccaaattatt

SEQ ID NO: 3133095 - DNA, 19 bp, Homo sapiens
aaaatgtgaaaaaaattat

SEQ ID NO: 3133096 - DNA, 20 bp, Homo sapiens
aaaatgtgaaaaaaattatt

SEQ ID NO: 3133097 - DNA, 23 bp, Homo sapiens
aaaatgtgaattgcatgacttgt

SEQ ID NO: 3133098 - DNA, 15 bp, Homo sapiens
aaaatgtgaggaaga

SEQ ID NO: 3133099 - DNA, 19 bp, Homo sapiens
aaaatgtgatgttctaagg

SEQ ID NO: 3133100 - DNA, 12 bp, Homo sapiens
aaaatgtgattt

SEQ ID NO: 3133101 - DNA, 18 bp, Homo sapiens
aaaatgtgatttttctga

SEQ ID NO: 3133102 - DNA, 12 bp, Homo sapiens
aaaatgtgtaca

SEQ ID NO: 3133103 - DNA, 18 bp, Homo sapiens
aaaatgttatcttctcaa

SEQ ID NO: 3133104 - DNA, 16 bp, Homo sapiens
aaaatgttatttaaca

SEQ ID NO: 3133105 - DNA, 12 bp, Homo sapiens
aaaatgttcatc

SEQ ID NO: 3133106 - DNA, 16 bp, Homo sapiens
aaaatgttctcaaata

SEQ ID NO: 3133107 - DNA, 14 bp, Homo sapiens
aaaattaaatgcct

SEQ ID NO: 3133108 - DNA, 19 bp, Homo sapiens
aaaattaaatgccttgtat

SEQ ID NO: 3133109 - DNA, 22 bp, Homo sapiens
aaaattaaatgccttgtataaa

SEQ ID NO: 3133110 - DNA, 13 bp, Homo sapiens
aaaattaactggt

SEQ ID NO: 3133111 - DNA, 14 bp, Homo sapiens
aaaattaagtagaa

SEQ ID NO: 3133112 - DNA, 17 bp, Homo sapiens
aaaattaagtagaacaa

SEQ ID NO: 3133113 - DNA, 21 bp, Homo sapiens
aaaattaatatgattattaat

SEQ ID NO: 3133114 - DNA, 17 bp, Homo sapiens
aaaattacagatgtgaa

SEQ ID NO: 3133115 - DNA, 17 bp, Homo sapiens
aaaattacgtttgttat

SEQ ID NO: 3133116 - DNA, 12 bp, Homo sapiens
aaaattactaat

SEQ ID NO: 3133117 - DNA, 14 bp, Homo sapiens
aaaattacttttct

SEQ ID NO: 3133118 - DNA, 14 bp, Homo sapiens
aaaattataaactt

SEQ ID NO: 3133119 - DNA, 21 bp, Homo sapiens
aaaattatactaacttattta

SEQ ID NO: 3133120 - DNA, 13 bp, Homo sapiens
aaaattatgaatc

SEQ ID NO: 3133121 - DNA, 13 bp, Homo sapiens
aaaattatggaat

SEQ ID NO: 3133122 - DNA, 22 bp, Homo sapiens
aaaattatggaatatcatctgt

SEQ ID NO: 3133123 - DNA, 24 bp, Homo sapiens
aaaattatggaatatcatctgtca

SEQ ID NO: 3133124 - DNA, 13 bp, Homo sapiens
aaaattatttgta

SEQ ID NO: 3133125 - DNA, 18 bp, Homo sapiens
aaaattattttaaacaaa

SEQ ID NO: 3133126 - DNA, 19 bp, Homo sapiens
aaaattattttaaacaaaa

SEQ ID NO: 3133127 - DNA, 16 bp, Homo sapiens
aaaattcaaaaagtgt

SEQ ID NO: 3133128 - DNA, 18 bp, Homo sapiens
aaaattcaaaaagtgttt

SEQ ID NO: 3133129 - DNA, 21 bp, Homo sapiens
aaaattcaaagcatggacatt

SEQ ID NO: 3133130 - DNA, 16 bp, Homo sapiens
aaaattcagcaaacca

SEQ ID NO: 3133131 - DNA, 18 bp, Homo sapiens
aaaattcagcaaaccatt

SEQ ID NO: 3133132 - DNA, 21 bp, Homo sapiens
aaaattcagtttttgtatctt

SEQ ID NO: 3133133 - DNA, 14 bp, Homo sapiens
aaaattcatttcac

SEQ ID NO: 3133134 - DNA, 16 bp, Homo sapiens
aaaattcatttcacat

SEQ ID NO: 3133135 - DNA, 13 bp, Homo sapiens
aaaattcatttct

SEQ ID NO: 3133136 - DNA, 14 bp, Homo sapiens
aaaattcatttcta

SEQ ID NO: 3133137 - DNA, 15 bp, Homo sapiens
aaaattcatttctaa

SEQ ID NO: 3133138 - DNA, 13 bp, Homo sapiens
aaaattcattttt

SEQ ID NO: 3133139 - DNA, 20 bp, Homo sapiens
aaaattccagaaaggatatt

SEQ ID NO: 3133140 - DNA, 21 bp, Homo sapiens
aaaattccatcccatcatctt

SEQ ID NO: 3133141 - DNA, 20 bp, Homo sapiens
aaaattcgcccgagctgttt

SEQ ID NO: 3133142 - DNA, 13 bp, Homo sapiens
aaaattctcctga

SEQ ID NO: 3133143 - DNA, 16 bp, Homo sapiens
aaaattgaaaatatgt

SEQ ID NO: 3133144 - DNA, 21 bp, Homo sapiens
aaaattgatgtgtttatttat

SEQ ID NO: 3133145 - DNA, 19 bp, Homo sapiens
aaaattgatttttctcttc

SEQ ID NO: 3133146 - DNA, 15 bp, Homo sapiens
aaaattgcactaaat

SEQ ID NO: 3133147 - DNA, 16 bp, Homo sapiens
aaaattgccattttat

SEQ ID NO: 3133148 - DNA, 20 bp, Homo sapiens
aaaattgctatgttactatt

SEQ ID NO: 3133149 - DNA, 22 bp, Homo sapiens
aaaattgctatgttactatttt

SEQ ID NO: 3133150 - DNA, 22 bp, Homo sapiens
aaaattgctctgtgtatatctc

SEQ ID NO: 3133151 - DNA, 14 bp, Homo sapiens
aaacttactatttt

SEQ ID NO: 3133152 - DNA, 15 bp, Homo sapiens
aaacttactattttg

SEQ ID NO: 3133153 - DNA, 13 bp, Homo sapiens
aaacttagaggaa

SEQ ID NO: 3133154 - DNA, 15 bp, Homo sapiens
aaacttagaggaaaa

SEQ ID NO: 3133155 - DNA, 16 bp, Homo sapiens
aaacttagaggaaaat

SEQ ID NO: 3133156 - DNA, 17 bp, Homo sapiens
aaacttagtgacaaaat

SEQ ID NO: 3133157 - DNA, 13 bp, Homo sapiens
aaacttcaaagct

SEQ ID NO: 3133158 - DNA, 16 bp, Homo sapiens
aaacttcaaagctgaa

SEQ ID NO: 3133159 - DNA, 20 bp, Homo sapiens
aaacttcagatgggaggaaa

SEQ ID NO: 3133160 - DNA, 20 bp, Homo sapiens
aaacttcatgtaattttatt

SEQ ID NO: 3133161 - DNA, 21 bp, Homo sapiens
aaacttcatgtaattttattt

SEQ ID NO: 3133162 - DNA, 18 bp, Homo sapiens
aaacttccaaagaaagtt

SEQ ID NO: 3133163 - DNA, 23 bp, Homo sapiens
aaacttccatgaggccaaacgtt

SEQ ID NO: 3133164 - DNA, 11 bp, Homo sapiens
aaacttctgaa

SEQ ID NO: 3133165 - DNA, 17 bp, Homo sapiens
aaacttcttgtcagaca

SEQ ID NO: 3133166 - DNA, 13 bp, Homo sapiens
aaacttgaaaata

SEQ ID NO: 3133167 - DNA, 15 bp, Homo sapiens
aaacttggattctct

SEQ ID NO: 3133168 - DNA, 14 bp, Homo sapiens
aaacttgttattgt

SEQ ID NO: 3133169 - DNA, 16 bp, Homo sapiens
aaacttgttattgtga

SEQ ID NO: 3133170 - DNA, 19 bp, Homo sapiens
aaacttgttattgtgaatg

SEQ ID NO: 3133171 - DNA, 15 bp, Homo sapiens
aaacttgttcattta

SEQ ID NO: 3133172 - DNA, 16 bp, Homo sapiens
aaactttaaaaaatat

SEQ ID NO: 3133173 - DNA, 22 bp, Homo sapiens
aaactttaaaaaatatttatta

SEQ ID NO: 3133174 - DNA, 20 bp, Homo sapiens
aaactttacccaaaaactaa

SEQ ID NO: 3133175 - DNA, 20 bp, Homo sapiens
aaactttcattccttcagat

SEQ ID NO: 3133176 - DNA, 20 bp, Homo sapiens
aaactttgggaaaacatgtt

SEQ ID NO: 3133177 - DNA, 24 bp, Homo sapiens
aaacttttgtaaagaaatttacta

SEQ ID NO: 3133178 - DNA, 16 bp, Homo sapiens
aaactttttttcaatg

SEQ ID NO: 3133179 - DNA, 22 bp, Homo sapiens
aaactttttttctgtaccagtt

SEQ ID NO: 3133180 - DNA, 22 bp, Homo sapiens
aaagaaaaaaaaaaaagccagc

SEQ ID NO: 3133181 - DNA, 18 bp, Homo sapiens
aaagaaaaaaaagaaagc

SEQ ID NO: 3133182 - DNA, 9 bp, Homo sapiens
aaagaaaag

SEQ ID NO: 3133183 - DNA, 23 bp, Homo sapiens
aaagaaaagataaagatgatcta

SEQ ID NO: 3133184 - DNA, 22 bp, Homo sapiens
aaagaaaataggggatggtcca

SEQ ID NO: 3133185 - DNA, 12 bp, Homo sapiens
aaagaaacacaa

SEQ ID NO: 3133186 - DNA, 12 bp, Homo sapiens
aaagaaagtgta

SEQ ID NO: 3133187 - DNA, 13 bp, Homo sapiens
aaagaaagtgtat

SEQ ID NO: 3133188 - DNA, 16 bp, Homo sapiens
aaagaaagtgtatttg

SEQ ID NO: 3133189 - DNA, 14 bp, Homo sapiens
aaagaaataccttg

SEQ ID NO: 3133190 - DNA, 20 bp, Homo sapiens
aaagaaatcttgtcttacca

SEQ ID NO: 3133191 - DNA, 13 bp, Homo sapiens
aaagaaatgaaca

SEQ ID NO: 3133192 - DNA, 15 bp, Homo sapiens
aaagaaatgaacatt

SEQ ID NO: 3133193 - DNA, 13 bp, Homo sapiens
aaagaaattacag

SEQ ID NO: 3133194 - DNA, 14 bp, Homo sapiens
aaagaacaaacaaa

SEQ ID NO: 3133195 - DNA, 15 bp, Homo sapiens
aaagaacagtaaaca

SEQ ID NO: 3133196 - DNA, 18 bp, Homo sapiens
aaagaacatggacttgta

SEQ ID NO: 3133197 - DNA, 21 bp, Homo sapiens
aaagaacatggacttgtatat

SEQ ID NO: 3133198 - DNA, 22 bp, Homo sapiens
aaagaacatggacttgtatatt

SEQ ID NO: 3133199 - DNA, 21 bp, Homo sapiens
aaagaaccatgcaggaaggaa

SEQ ID NO: 3133200 - DNA, 16 bp, Homo sapiens
aaagaactccttattt

SEQ ID NO: 3133201 - DNA, 20 bp, Homo sapiens
aaagaactccttattttgta

SEQ ID NO: 3133202 - DNA, 18 bp, Homo sapiens
aaagaacttaaattatgt

SEQ ID NO: 3133203 - DNA, 12 bp, Homo sapiens
aaagaacttact

SEQ ID NO: 3133204 - DNA, 18 bp, Homo sapiens
aaagaacttgatttgcat

SEQ ID NO: 3133205 - DNA, 16 bp, Homo sapiens
aaagaagaaagactct

SEQ ID NO: 3133206 - DNA, 14 bp, Homo sapiens
aaagaagactggaa

SEQ ID NO: 3133207 - DNA, 15 bp, Homo sapiens
aaagaagatgttgaa

SEQ ID NO: 3133208 - DNA, 12 bp, Homo sapiens
aaagaagcaaga

SEQ ID NO: 3133209 - DNA, 20 bp, Homo sapiens
aaagaagcccaatattataa

SEQ ID NO: 3133210 - DNA, 19 bp, Homo sapiens
aaagaagctcgccccacct

SEQ ID NO: 3133211 - DNA, 17 bp, Homo sapiens
aaagaaggaaagatggt

SEQ ID NO: 3133212 - DNA, 16 bp, Homo sapiens
aaagaagttactttgt

SEQ ID NO: 3133213 - DNA, 18 bp, Homo sapiens
aaagaagttactttgtaa

SEQ ID NO: 3133214 - DNA, 15 bp, Homo sapiens
aaagaatacagaaag

SEQ ID NO: 3133215 - DNA, 17 bp, Homo sapiens
aaagaatacagaaagat

SEQ ID NO: 3133216 - DNA, 17 bp, Homo sapiens
aaagaatatatttattt

SEQ ID NO: 3133217 - DNA, 13 bp, Homo sapiens
aaagaatattcag

SEQ ID NO: 3133218 - DNA, 22 bp, Homo sapiens
aaagaatgagaaggagtcagaa

SEQ ID NO: 3133219 - DNA, 19 bp, Homo sapiens
aaagaattcttatacacat

SEQ ID NO: 3133220 - DNA, 19 bp, Homo sapiens
aaagaatttaagctgtaaa

SEQ ID NO: 3133221 - DNA, 22 bp, Homo sapiens
aaagacaagtatgaatattact

SEQ ID NO: 3133222 - DNA, 19 bp, Homo sapiens
aaagacacctactgagtgg

SEQ ID NO: 3133223 - DNA, 21 bp, Homo sapiens
aaagacatcagtctccaacat

SEQ ID NO: 3133224 - DNA, 20 bp, Homo sapiens
aaagacattgattcagcctg

SEQ ID NO: 3133225 - DNA, 13 bp, Homo sapiens
aaagaccaaactt

SEQ ID NO: 3133226 - DNA, 22 bp, Homo sapiens
aaagaccaaacttcactctggg

SEQ ID NO: 3133227 - DNA, 18 bp, Homo sapiens
aaagacgtaataaaatta

SEQ ID NO: 3133228 - DNA, 20 bp, Homo sapiens
aaagacgtaataaaattaac

SEQ ID NO: 3133229 - DNA, 23 bp, Homo sapiens
aaagactaatttaaaaaataact

SEQ ID NO: 3133230 - DNA, 14 bp, Homo sapiens
aaagactcctctgg

SEQ ID NO: 3133231 - DNA, 15 bp, Homo sapiens
aaagactggttttct

SEQ ID NO: 3133232 - DNA, 15 bp, Homo sapiens
aaagactgtacaaag

SEQ ID NO: 3133233 - DNA, 12 bp, Homo sapiens
aaagactgtact

SEQ ID NO: 3133234 - DNA, 19 bp, Homo sapiens
aaagagaaacagttggtaa

SEQ ID NO: 3133235 - DNA, 12 bp, Homo sapiens
aaagagaatgag

SEQ ID NO: 3133236 - DNA, 14 bp, Homo sapiens
aaagagaatgagtc

SEQ ID NO: 3133237 - DNA, 20 bp, Homo sapiens
aaagagaatgccattctctt

SEQ ID NO: 3133238 - DNA, 20 bp, Homo sapiens
aaagagacctacctcaggtt

SEQ ID NO: 3133239 - DNA, 14 bp, Homo sapiens
aaagagagaagcca

SEQ ID NO: 3133240 - DNA, 11 bp, Homo sapiens
aaagagagaga

SEQ ID NO: 3133241 - DNA, 24 bp, Homo sapiens
aaagagatccaggaagcatgagtg

SEQ ID NO: 3133242 - DNA, 15 bp, Homo sapiens
aaagagcatggatgc

SEQ ID NO: 3133243 - DNA, 22 bp, Homo sapiens
aaagagcatggatgcatttcaa

SEQ ID NO: 3133244 - DNA, 12 bp, Homo sapiens
aaagaggctgag

SEQ ID NO: 3133245 - DNA, 20 bp, Homo sapiens
aaagaggctgcccctctcac

SEQ ID NO: 3133246 - DNA, 22 bp, Homo sapiens
aaagaggctgcccctctcacca

SEQ ID NO: 3133247 - DNA, 23 bp, Homo sapiens
aaagaggctgcccctctcaccaa

SEQ ID NO: 3133248 - DNA, 12 bp, Homo sapiens
aaagagggacag

SEQ ID NO: 3133249 - DNA, 19 bp, Homo sapiens
aaagaggtctccccatccc

SEQ ID NO: 3133250 - DNA, 21 bp, Homo sapiens
aaagaggtctccccatcccca

SEQ ID NO: 3133251 - DNA, 15 bp, Homo sapiens
aaagaggtgaaaatg

SEQ ID NO: 3133252 - DNA, 19 bp, Homo sapiens
aaagaggtgaaaatgaaga

SEQ ID NO: 3133253 - DNA, 21 bp, Homo sapiens
aaagaggtgaaaatgaagaag

SEQ ID NO: 3133254 - DNA, 21 bp, Homo sapiens
aaagagtctagattcaaaggt

SEQ ID NO: 3133255 - DNA, 12 bp, Homo sapiens
aaagagttagaa

SEQ ID NO: 3133256 - DNA, 19 bp, Homo sapiens
aaagataatctcagtgctt

SEQ ID NO: 3133257 - DNA, 14 bp, Homo sapiens
aaagatatggagaa

SEQ ID NO: 3133258 - DNA, 15 bp, Homo sapiens
aaagatattgttcaa

SEQ ID NO: 3133259 - DNA, 20 bp, Homo sapiens
aaagatcaaaataaaaagtg

SEQ ID NO: 3133260 - DNA, 21 bp, Homo sapiens
aaagatctgttttgaaggcaa

SEQ ID NO: 3133261 - DNA, 21 bp, Homo sapiens
aaagatgccaattattgttac

SEQ ID NO: 3133262 - DNA, 17 bp, Homo sapiens
aaagatgctcttctgtg

SEQ ID NO: 3133263 - DNA, 17 bp, Homo sapiens
aaagatggagtttctaa

SEQ ID NO: 3133264 - DNA, 18 bp, Homo sapiens
aaagatggagtttctaag

SEQ ID NO: 3133265 - DNA, 23 bp, Homo sapiens
aaagatggctgtgcctctgcctg

SEQ ID NO: 3133266 - DNA, 20 bp, Homo sapiens
aaagatggtaaaccagatct

SEQ ID NO: 3133267 - DNA, 20 bp, Homo sapiens
aaagatggttaaacattttc

SEQ ID NO: 3133268 - DNA, 22 bp, Homo sapiens
aaagatgtaatgtccctttcag

SEQ ID NO: 3133269 - DNA, 23 bp, Homo sapiens
aaagattatgatgcatacagttt

SEQ ID NO: 3133270 - DNA, 14 bp, Homo sapiens
aaagattcacctga

SEQ ID NO: 3133271 - DNA, 18 bp, Homo sapiens
aaagattccacagagatg

SEQ ID NO: 3133272 - DNA, 12 bp, Homo sapiens
aaagattctata

SEQ ID NO: 3133273 - DNA, 18 bp, Homo sapiens
aaagattctatagttcta

SEQ ID NO: 3133274 - DNA, 19 bp, Homo sapiens
aaagattctatagttctag

SEQ ID NO: 3133275 - DNA, 20 bp, Homo sapiens
aaagattctatagttctaga

SEQ ID NO: 3133276 - DNA, 12 bp, Homo sapiens
aaagattctttt

SEQ ID NO: 3133277 - DNA, 21 bp, Homo sapiens
aaatacaatttttatttcttt

SEQ ID NO: 3133278 - DNA, 17 bp, Homo sapiens
aaatacacaagtaaaca

SEQ ID NO: 3133279 - DNA, 13 bp, Homo sapiens
aaatacacatttg

SEQ ID NO: 3133280 - DNA, 14 bp, Homo sapiens
aaatacacatttgc

SEQ ID NO: 3133281 - DNA, 15 bp, Homo sapiens
aaatacacatttgct

SEQ ID NO: 3133282 - DNA, 13 bp, Homo sapiens
aaatacacttttt

SEQ ID NO: 3133283 - DNA, 16 bp, Homo sapiens
aaatacagacactaag

SEQ ID NO: 3133284 - DNA, 17 bp, Homo sapiens
aaatacagacactaagt

SEQ ID NO: 3133285 - DNA, 22 bp, Homo sapiens
aaatacagttattaaaatgtta

SEQ ID NO: 3133286 - DNA, 16 bp, Homo sapiens
aaatacatacggtcag

SEQ ID NO: 3133287 - DNA, 14 bp, Homo sapiens
aaatacatgcatct

SEQ ID NO: 3133288 - DNA, 14 bp, Homo sapiens
aaataccacaagcc

SEQ ID NO: 3133289 - DNA, 22 bp, Homo sapiens
aaataccatttagtaagaatac

SEQ ID NO: 3133290 - DNA, 21 bp, Homo sapiens
aaatacccgttaccatattta

SEQ ID NO: 3133291 - DNA, 16 bp, Homo sapiens
aaatacctcatgttta

SEQ ID NO: 3133292 - DNA, 22 bp, Homo sapiens
aaatacctttgtagttactcaa

SEQ ID NO: 3133293 - DNA, 16 bp, Homo sapiens
aaatacgtattacaaa

SEQ ID NO: 3133294 - DNA, 18 bp, Homo sapiens
aaatacgtattacaaaca

SEQ ID NO: 3133295 - DNA, 12 bp, Homo sapiens
aaatactaaaag

SEQ ID NO: 3133296 - DNA, 13 bp, Homo sapiens
aaatactctgcta

SEQ ID NO: 3133297 - DNA, 13 bp, Homo sapiens
aaatactgtgcag

SEQ ID NO: 3133298 - DNA, 14 bp, Homo sapiens
aaatactgtgtgga

SEQ ID NO: 3133299 - DNA, 19 bp, Homo sapiens
aaatacttaaatttggttt

SEQ ID NO: 3133300 - DNA, 14 bp, Homo sapiens
aaatacttaataaa

SEQ ID NO: 3133301 - DNA, 18 bp, Homo sapiens
aaatacttgtttcagctt

SEQ ID NO: 3133302 - DNA, 19 bp, Homo sapiens
aaatacttgtttcagcttc

SEQ ID NO: 3133303 - DNA, 12 bp, Homo sapiens
aaatactttgtc

SEQ ID NO: 3133304 - DNA, 15 bp, Homo sapiens
aaatagaaaatggtc

SEQ ID NO: 3133305 - DNA, 14 bp, Homo sapiens
aaatagaaataagt

SEQ ID NO: 3133306 - DNA, 19 bp, Homo sapiens
aaatagacagtatatttat

SEQ ID NO: 3133307 - DNA, 13 bp, Homo sapiens
aaatagcatttgt

SEQ ID NO: 3133308 - DNA, 12 bp, Homo sapiens
aaatagctatat

SEQ ID NO: 3133309 - DNA, 15 bp, Homo sapiens
aaatagcttgtatag

SEQ ID NO: 3133310 - DNA, 16 bp, Homo sapiens
aaatagcttgtatagt

SEQ ID NO: 3133311 - DNA, 19 bp, Homo sapiens
aaataggaatcattcagaa

SEQ ID NO: 3133312 - DNA, 15 bp, Homo sapiens
aaataggatttctta

SEQ ID NO: 3133313 - DNA, 18 bp, Homo sapiens
aaataggatttcttaaat

SEQ ID NO: 3133314 - DNA, 14 bp, Homo sapiens
aaataggcagaatg

SEQ ID NO: 3133315 - DNA, 16 bp, Homo sapiens
aaataggcagaatgga

SEQ ID NO: 3133316 - DNA, 14 bp, Homo sapiens
aaataggcaggaag

SEQ ID NO: 3133317 - DNA, 17 bp, Homo sapiens
aaataggggatatttaa

SEQ ID NO: 3133318 - DNA, 20 bp, Homo sapiens
aaatagtgcagaatctcata

SEQ ID NO: 3133319 - DNA, 21 bp, Homo sapiens
aaatagtgcagaatctcatag

SEQ ID NO: 3133320 - DNA, 13 bp, Homo sapiens
aaatagtgtgaaa

SEQ ID NO: 3133321 - DNA, 17 bp, Homo sapiens
aaatagttaagacatga

SEQ ID NO: 3133322 - DNA, 13 bp, Homo sapiens
aaatagttccctt

SEQ ID NO: 3133323 - DNA, 20 bp, Homo sapiens
aaatagttgcatagcagtat

SEQ ID NO: 3133324 - DNA, 23 bp, Homo sapiens
aaatagttgcatagcagtatatg

SEQ ID NO: 3133325 - DNA, 18 bp, Homo sapiens
aaatagtttaggagaaac

SEQ ID NO: 3133326 - DNA, 11 bp, Homo sapiens
aaatataaaac

SEQ ID NO: 3133327 - DNA, 12 bp, Homo sapiens
aaatataaacat

SEQ ID NO: 3133328 - DNA, 13 bp, Homo sapiens
aaatataaatctt

SEQ ID NO: 3133329 - DNA, 14 bp, Homo sapiens
aaatataacacatt

SEQ ID NO: 3133330 - DNA, 18 bp, Homo sapiens
aaatataacaggtgcttc

SEQ ID NO: 3133331 - DNA, 12 bp, Homo sapiens
aaatataattct

SEQ ID NO: 3133332 - DNA, 13 bp, Homo sapiens
aaatataattctg

SEQ ID NO: 3133333 - DNA, 17 bp, Homo sapiens
aaatataattctgtaaa

SEQ ID NO: 3133334 - DNA, 18 bp, Homo sapiens
aaatataattctgtaaat

SEQ ID NO: 3133335 - DNA, 14 bp, Homo sapiens
aaatataattgaca

SEQ ID NO: 3133336 - DNA, 14 bp, Homo sapiens
aaatatacatttgt

SEQ ID NO: 3133337 - DNA, 20 bp, Homo sapiens
aaatatacatttgttggtaa

SEQ ID NO: 3133338 - DNA, 20 bp, Homo sapiens
aaatataccactctttacct

SEQ ID NO: 3133339 - DNA, 21 bp, Homo sapiens
aaatatactcaagtttcaggt

SEQ ID NO: 3133340 - DNA, 24 bp, Homo sapiens
aaatatagaaagttgatattcaac

SEQ ID NO: 3133341 - DNA, 17 bp, Homo sapiens
aaatatagattagaaaa

SEQ ID NO: 3133342 - DNA, 21 bp, Homo sapiens
aaatatagtttgattcttcat

SEQ ID NO: 3133343 - DNA, 13 bp, Homo sapiens
aaatatatatagt

SEQ ID NO: 3133344 - DNA, 20 bp, Homo sapiens
aaatatatatgatcattgaa

SEQ ID NO: 3133345 - DNA, 18 bp, Homo sapiens
aaatatattacttaactg

SEQ ID NO: 3133346 - DNA, 12 bp, Homo sapiens
aaatatatttaa

SEQ ID NO: 3133347 - DNA, 22 bp, Homo sapiens
aaatatatttaagataattata

SEQ ID NO: 3133348 - DNA, 18 bp, Homo sapiens
aaatatctatattctata

SEQ ID NO: 3133349 - DNA, 17 bp, Homo sapiens
aaatatctgaaaatgta

SEQ ID NO: 3133350 - DNA, 19 bp, Homo sapiens
aaatatgaaccctttgttt

SEQ ID NO: 3133351 - DNA, 20 bp, Homo sapiens
aaatatgaacctattttcat

SEQ ID NO: 3133352 - DNA, 17 bp, Homo sapiens
aaatatgaagaactgag

SEQ ID NO: 3133353 - DNA, 22 bp, Homo sapiens
aaatatgatactctcagatttt

SEQ ID NO: 3133354 - DNA, 18 bp, Homo sapiens
aaatatgcagtgatatgg

SEQ ID NO: 3133355 - DNA, 18 bp, Homo sapiens
aaatatgcatctggccca

SEQ ID NO: 3133356 - DNA, 15 bp, Homo sapiens
aaatatgctaatttg

SEQ ID NO: 3133357 - DNA, 19 bp, Homo sapiens
aaatatgctaatttgggga

SEQ ID NO: 3133358 - DNA, 13 bp, Homo sapiens
aaatatggaactt

SEQ ID NO: 3133359 - DNA, 16 bp, Homo sapiens
aaatatggaacttaca

SEQ ID NO: 3133360 - DNA, 16 bp, Homo sapiens
aaatatggaacttcta

SEQ ID NO: 3133361 - DNA, 20 bp, Homo sapiens
aaatatggaacttctaatat

SEQ ID NO: 3133362 - DNA, 15 bp, Homo sapiens
aaatatggacactta

SEQ ID NO: 3133363 - DNA, 20 bp, Homo sapiens
aaatatggacacttaatact

SEQ ID NO: 3133364 - DNA, 17 bp, Homo sapiens
aaatatggctagttttc

SEQ ID NO: 3133365 - DNA, 19 bp, Homo sapiens
aaatatggctataaatata

SEQ ID NO: 3133366 - DNA, 15 bp, Homo sapiens
aaatatgttaaagtt

SEQ ID NO: 3133367 - DNA, 13 bp, Homo sapiens
aaatattaaagat

SEQ ID NO: 3133368 - DNA, 23 bp, Homo sapiens
aaatattattgtggaaatgaata

SEQ ID NO: 3133369 - DNA, 13 bp, Homo sapiens
aaatattatttgt

SEQ ID NO: 3133370 - DNA, 16 bp, Homo sapiens
aaatattcctccaaat

SEQ ID NO: 3133371 - DNA, 18 bp, Homo sapiens
aaatattctatatgaatt

SEQ ID NO: 3133372 - DNA, 22 bp, Homo sapiens
aaatattgccaactcttctatt

SEQ ID NO: 3133373 - DNA, 17 bp, Homo sapiens
aaatattgtcatgttta

SEQ ID NO: 3133374 - DNA, 17 bp, Homo sapiens
aaatattgttgacaact

SEQ ID NO: 3133375 - DNA, 14 bp, Homo sapiens
aaatatttaaacct

SEQ ID NO: 3133376 - DNA, 15 bp, Homo sapiens
aaatatttactcttt

SEQ ID NO: 3133377 - DNA, 19 bp, Homo sapiens
aaatatttactctttgcaa

SEQ ID NO: 3133378 - DNA, 20 bp, Homo sapiens
aaatatttactctttgcaaa

SEQ ID NO: 3133379 - DNA, 15 bp, Homo sapiens
aaatatttatattgt

SEQ ID NO: 3133380 - DNA, 22 bp, Homo sapiens
aaatatttattaaataaaatca

SEQ ID NO: 3133381 - DNA, 15 bp, Homo sapiens
aaatatttcagatat

SEQ ID NO: 3133382 - DNA, 16 bp, Homo sapiens
aaatatttcagatatc

SEQ ID NO: 3133383 - DNA, 21 bp, Homo sapiens
aaatatttcctgacttgagtg

SEQ ID NO: 3133384 - DNA, 17 bp, Homo sapiens
aaatatttgactattct

SEQ ID NO: 3133385 - DNA, 22 bp, Homo sapiens
aaatatttgtacatagttattt

SEQ ID NO: 3133386 - DNA, 19 bp, Homo sapiens
aaatatttgtctttaaaca

SEQ ID NO: 3133387 - DNA, 15 bp, Homo sapiens
aaatattttcaaaga

SEQ ID NO: 3133388 - DNA, 20 bp, Homo sapiens
aaatattttcaaagagatgg

SEQ ID NO: 3133389 - DNA, 12 bp, Homo sapiens
aaatattttcca

SEQ ID NO: 3133390 - DNA, 17 bp, Homo sapiens
aaatattttctatttta

SEQ ID NO: 3133391 - DNA, 21 bp, Homo sapiens
aaatattttctctgtactttt

SEQ ID NO: 3133392 - DNA, 16 bp, Homo sapiens
aaatattttctgggtt

SEQ ID NO: 3133393 - DNA, 22 bp, Homo sapiens
aaatattttttatatatacagt

SEQ ID NO: 3133394 - DNA, 15 bp, Homo sapiens
aaatattttttgcaa

SEQ ID NO: 3133395 - DNA, 18 bp, Homo sapiens
aaatcaacagaagcattt

SEQ ID NO: 3133396 - DNA, 22 bp, Homo sapiens
aaatcaacagaagcatttgtat

SEQ ID NO: 3133397 - DNA, 19 bp, Homo sapiens
aaatcaacttgtgtactga

SEQ ID NO: 3133398 - DNA, 13 bp, Homo sapiens
aaatcaataagaa

SEQ ID NO: 3133399 - DNA, 15 bp, Homo sapiens
aaatcaatacactag

SEQ ID NO: 3133400 - DNA, 17 bp, Homo sapiens
aaatcaatacactagtt

SEQ ID NO: 3133401 - DNA, 19 bp, Homo sapiens
aaatcaattactggtccaa

SEQ ID NO: 3133402 - DNA, 14 bp, Homo sapiens
aaatcaatttttag

SEQ ID NO: 3133403 - DNA, 15 bp, Homo sapiens
aaatcactgtattta

SEQ ID NO: 3133404 - DNA, 11 bp, Homo sapiens
aacactttgta

SEQ ID NO: 3133405 - DNA, 15 bp, Homo sapiens
aacactttgtattac

SEQ ID NO: 3133406 - DNA, 16 bp, Homo sapiens
aacactttgtattact

SEQ ID NO: 3133407 - DNA, 15 bp, Homo sapiens
aacagaaaaataagt

SEQ ID NO: 3133408 - DNA, 19 bp, Homo sapiens
aacagaaaaataagtcaaa

SEQ ID NO: 3133409 - DNA, 14 bp, Homo sapiens
aacagaaaacattc

SEQ ID NO: 3133410 - DNA, 19 bp, Homo sapiens
aacagaaaacattctgatt

SEQ ID NO: 3133411 - DNA, 22 bp, Homo sapiens
aacagaaagcctgggtgacatt

SEQ ID NO: 3133412 - DNA, 18 bp, Homo sapiens
aacagaaagtttgtaaaa

SEQ ID NO: 3133413 - DNA, 23 bp, Homo sapiens
aacagaaataaaatacacaacac

SEQ ID NO: 3133414 - DNA, 11 bp, Homo sapiens
aacagaacagg

SEQ ID NO: 3133415 - DNA, 14 bp, Homo sapiens
aacagaacagggtc

SEQ ID NO: 3133416 - DNA, 14 bp, Homo sapiens
aacagaactaaatg

SEQ ID NO: 3133417 - DNA, 17 bp, Homo sapiens
aacagaactaaatgttc

SEQ ID NO: 3133418 - DNA, 21 bp, Homo sapiens
aacagaactaaatgttctatg

SEQ ID NO: 3133419 - DNA, 17 bp, Homo sapiens
aacagaagcatttgtat

SEQ ID NO: 3133420 - DNA, 16 bp, Homo sapiens
aacagaataaagcagc

SEQ ID NO: 3133421 - DNA, 20 bp, Homo sapiens
aacagaataaagcagcctga

SEQ ID NO: 3133422 - DNA, 21 bp, Homo sapiens
aacagaataaagcagcctgat

SEQ ID NO: 3133423 - DNA, 17 bp, Homo sapiens
aacagaataatgcatga

SEQ ID NO: 3133424 - DNA, 13 bp, Homo sapiens
aacagaattttaa

SEQ ID NO: 3133425 - DNA, 14 bp, Homo sapiens
aacagaatttttcc

SEQ ID NO: 3133426 - DNA, 15 bp, Homo sapiens
aacagagcctgccta

SEQ ID NO: 3133427 - DNA, 19 bp, Homo sapiens
aacagagcctgcctaacca

SEQ ID NO: 3133428 - DNA, 19 bp, Homo sapiens
aacagagtgagaccctgtc

SEQ ID NO: 3133429 - DNA, 21 bp, Homo sapiens
aacagagtggcctccctgctg

SEQ ID NO: 3133430 - DNA, 18 bp, Homo sapiens
aacagataagcaagagag

SEQ ID NO: 3133431 - DNA, 22 bp, Homo sapiens
aacagataccatactcatttct

SEQ ID NO: 3133432 - DNA, 23 bp, Homo sapiens
aacagatactggaagttttgcat

SEQ ID NO: 3133433 - DNA, 14 bp, Homo sapiens
aacagatcttttac

SEQ ID NO: 3133434 - DNA, 18 bp, Homo sapiens
aacagatgaccataattt

SEQ ID NO: 3133435 - DNA, 22 bp, Homo sapiens
aacagatgcaatgtgctactga

SEQ ID NO: 3133436 - DNA, 23 bp, Homo sapiens
aacagatgcaatgtgctactgat

SEQ ID NO: 3133437 - DNA, 13 bp, Homo sapiens
aacagatgtgaaa

SEQ ID NO: 3133438 - DNA, 20 bp, Homo sapiens
aacagattcaggccagccca

SEQ ID NO: 3133439 - DNA, 17 bp, Homo sapiens
aacagatttttacaaat

SEQ ID NO: 3133440 - DNA, 14 bp, Homo sapiens
aacagcactggctc

SEQ ID NO: 3133441 - DNA, 16 bp, Homo sapiens
aacagcagaggttctt

SEQ ID NO: 3133442 - DNA, 21 bp, Homo sapiens
aacagcagaggttcttttaaa

SEQ ID NO: 3133443 - DNA, 23 bp, Homo sapiens
aacagcagtctccttcagcacgg

SEQ ID NO: 3133444 - DNA, 12 bp, Homo sapiens
aacagcattgct

SEQ ID NO: 3133445 - DNA, 18 bp, Homo sapiens
aacagccaagattttcct

SEQ ID NO: 3133446 - DNA, 17 bp, Homo sapiens
aacagccatgtccaagt

SEQ ID NO: 3133447 - DNA, 22 bp, Homo sapiens
aacagccattgcggccccagga

SEQ ID NO: 3133448 - DNA, 23 bp, Homo sapiens
aacagccattgcggccccaggag

SEQ ID NO: 3133449 - DNA, 24 bp, Homo sapiens
aacagccattgcggccccaggagg

SEQ ID NO: 3133450 - DNA, 13 bp, Homo sapiens
aacagcccaggca

SEQ ID NO: 3133451 - DNA, 17 bp, Homo sapiens
aacagccctcctctgca

SEQ ID NO: 3133452 - DNA, 11 bp, Homo sapiens
aacagccttag

SEQ ID NO: 3133453 - DNA, 12 bp, Homo sapiens
aacagccttagc

SEQ ID NO: 3133454 - DNA, 17 bp, Homo sapiens
aacagccttagctgcca

SEQ ID NO: 3133455 - DNA, 16 bp, Homo sapiens
aacagctaaatttgga

SEQ ID NO: 3133456 - DNA, 17 bp, Homo sapiens
aacagctatttaagggg

SEQ ID NO: 3133457 - DNA, 18 bp, Homo sapiens
aacagctatttaaggggg

SEQ ID NO: 3133458 - DNA, 11 bp, Homo sapiens
aacagctcagc

SEQ ID NO: 3133459 - DNA, 14 bp, Homo sapiens
aacagctcagccag

SEQ ID NO: 3133460 - DNA, 19 bp, Homo sapiens
aacagctctgagatcctgg

SEQ ID NO: 3133461 - DNA, 20 bp, Homo sapiens
aacagctctgcaggcttaat

SEQ ID NO: 3133462 - DNA, 16 bp, Homo sapiens
aacagcttcaggttat

SEQ ID NO: 3133463 - DNA, 22 bp, Homo sapiens
aacagctttggggtgtcttttt

SEQ ID NO: 3133464 - DNA, 20 bp, Homo sapiens
aacaggaattttattttgct

SEQ ID NO: 3133465 - DNA, 21 bp, Homo sapiens
aacaggaattttattttgctg

SEQ ID NO: 3133466 - DNA, 20 bp, Homo sapiens
aacaggaggtgtgaatgcac

SEQ ID NO: 3133467 - DNA, 11 bp, Homo sapiens
aacaggcccag

SEQ ID NO: 3133468 - DNA, 12 bp, Homo sapiens
aacaggcccagc

SEQ ID NO: 3133469 - DNA, 13 bp, Homo sapiens
aacaggcccagca

SEQ ID NO: 3133470 - DNA, 20 bp, Homo sapiens
aacaggctcaatattcctga

SEQ ID NO: 3133471 - DNA, 22 bp, Homo sapiens
aacaggctgggcttcagtggca

SEQ ID NO: 3133472 - DNA, 23 bp, Homo sapiens
aacaggctgggcttcagtggcag

SEQ ID NO: 3133473 - DNA, 21 bp, Homo sapiens
aacaggctgttctgcactgaa

SEQ ID NO: 3133474 - DNA, 20 bp, Homo sapiens
aacagggccacatagatgct

SEQ ID NO: 3133475 - DNA, 21 bp, Homo sapiens
aacagggctgccttctggcct

SEQ ID NO: 3133476 - DNA, 18 bp, Homo sapiens
aacaggggaggaaaaaag

SEQ ID NO: 3133477 - DNA, 20 bp, Homo sapiens
aacaggggaggaaaaaagaa

SEQ ID NO: 3133478 - DNA, 18 bp, Homo sapiens
aacaggtaatataaaaag

SEQ ID NO: 3133479 - DNA, 17 bp, Homo sapiens
aacaggtatatactttg

SEQ ID NO: 3133480 - DNA, 18 bp, Homo sapiens
aacaggtatatactttga

SEQ ID NO: 3133481 - DNA, 19 bp, Homo sapiens
aacaggttataacagtgtt

SEQ ID NO: 3133482 - DNA, 22 bp, Homo sapiens
aacaggttcttaaaaaggaaca

SEQ ID NO: 3133483 - DNA, 14 bp, Homo sapiens
aacagtaaatgtgc

SEQ ID NO: 3133484 - DNA, 14 bp, Homo sapiens
aacagtcatttaaa

SEQ ID NO: 3133485 - DNA, 22 bp, Homo sapiens
aacagtcgtaaccgtggctggt

SEQ ID NO: 3133486 - DNA, 20 bp, Homo sapiens
aacagtgaagttttactgtc

SEQ ID NO: 3133487 - DNA, 18 bp, Homo sapiens
aacagtgccattgtcttt

SEQ ID NO: 3133488 - DNA, 19 bp, Homo sapiens
aacagtgccattgtcttta

SEQ ID NO: 3133489 - DNA, 17 bp, Homo sapiens
aacagtgctttgtaaat

SEQ ID NO: 3133490 - DNA, 11 bp, Homo sapiens
aacagtggctg

SEQ ID NO: 3133491 - DNA, 14 bp, Homo sapiens
aacagtggctgggt

SEQ ID NO: 3133492 - DNA, 16 bp, Homo sapiens
aacagtggctgggtgg

SEQ ID NO: 3133493 - DNA, 19 bp, Homo sapiens
aacagtgggagccctgacc

SEQ ID NO: 3133494 - DNA, 20 bp, Homo sapiens
aacagtgggagccctgacct

SEQ ID NO: 3133495 - DNA, 15 bp, Homo sapiens
aacagtgtttcccat

SEQ ID NO: 3133496 - DNA, 16 bp, Homo sapiens
aacagttagctggagc

SEQ ID NO: 3133497 - DNA, 23 bp, Homo sapiens
aacagttcatgtttgcttcataa

SEQ ID NO: 3133498 - DNA, 16 bp, Homo sapiens
aacagtttcttgcttg

SEQ ID NO: 3133499 - DNA, 14 bp, Homo sapiens
aacagttttccatg

SEQ ID NO: 3133500 - DNA, 15 bp, Homo sapiens
aacagttttccatga

SEQ ID NO: 3133501 - DNA, 21 bp, Homo sapiens
aacagttttttatgctaatca

SEQ ID NO: 3133502 - DNA, 16 bp, Homo sapiens
aacataaaatctgtga

SEQ ID NO: 3133503 - DNA, 20 bp, Homo sapiens
aacataacccacttgtcact

SEQ ID NO: 3133504 - DNA, 13 bp, Homo sapiens
aacataataaatc

SEQ ID NO: 3133505 - DNA, 12 bp, Homo sapiens
aacataattaaa

SEQ ID NO: 3133506 - DNA, 18 bp, Homo sapiens
aacataattcttgtatat

SEQ ID NO: 3133507 - DNA, 19 bp, Homo sapiens
aacataattgtggattata

SEQ ID NO: 3133508 - DNA, 20 bp, Homo sapiens
aacatacttcaaaaataatg

SEQ ID NO: 3133509 - DNA, 13 bp, Homo sapiens
aacatagaaaaat

SEQ ID NO: 3133510 - DNA, 22 bp, Homo sapiens
aacatagtaattcttaagtctt

SEQ ID NO: 3133511 - DNA, 21 bp, Homo sapiens
aacatagtgagacccctgtct

SEQ ID NO: 3133512 - DNA, 14 bp, Homo sapiens
aacatatcaaaata

SEQ ID NO: 3133513 - DNA, 17 bp, Homo sapiens
aacatatgaaaatacaa

SEQ ID NO: 3133514 - DNA, 16 bp, Homo sapiens
aacatattcaaagcag

SEQ ID NO: 3133515 - DNA, 19 bp, Homo sapiens
aacatattctgtatgaact

SEQ ID NO: 3133516 - DNA, 22 bp, Homo sapiens
aacatatttcattttaacatga

SEQ ID NO: 3133517 - DNA, 12 bp, Homo sapiens
aacatcaatgtt

SEQ ID NO: 3133518 - DNA, 14 bp, Homo sapiens
aacatcataattac

SEQ ID NO: 3133519 - DNA, 16 bp, Homo sapiens
aacatccaaccttccc

SEQ ID NO: 3133520 - DNA, 22 bp, Homo sapiens
aacatccaaggagaaacagaga

SEQ ID NO: 3133521 - DNA, 17 bp, Homo sapiens
aacatccatgtcctatg

SEQ ID NO: 3133522 - DNA, 22 bp, Homo sapiens
aacatcctatcaacaacaaggt

SEQ ID NO: 3133523 - DNA, 17 bp, Homo sapiens
aacatcgatatgtatat

SEQ ID NO: 3133524 - DNA, 18 bp, Homo sapiens
aacatcgcaatagttttt

SEQ ID NO: 3133525 - DNA, 21 bp, Homo sapiens
aacatcgtgggtcactacagg

SEQ ID NO: 3133526 - DNA, 20 bp, Homo sapiens
aacatctattataaaaccat

SEQ ID NO: 3133527 - DNA, 21 bp, Homo sapiens
aacatctattataaaaccatg

SEQ ID NO: 3133528 - DNA, 18 bp, Homo sapiens
aacatctttccagtcctt

SEQ ID NO: 3133529 - DNA, 16 bp, Homo sapiens
aactcgcgctcagtaa

SEQ ID NO: 3133530 - DNA, 16 bp, Homo sapiens
aactctaatattgctt

SEQ ID NO: 3133531 - DNA, 17 bp, Homo sapiens
aactctaatattgcttc

SEQ ID NO: 3133532 - DNA, 21 bp, Homo sapiens
aactctaattcccattttgca

SEQ ID NO: 3133533 - DNA, 17 bp, Homo sapiens
aactctacccctgctcc

SEQ ID NO: 3133534 - DNA, 22 bp, Homo sapiens
aactctggacccctgggcctca

SEQ ID NO: 3133535 - DNA, 12 bp, Homo sapiens
aactctggtggc

SEQ ID NO: 3133536 - DNA, 16 bp, Homo sapiens
aactctgtataataga

SEQ ID NO: 3133537 - DNA, 23 bp, Homo sapiens
aactctgtataatagagataagt

SEQ ID NO: 3133538 - DNA, 17 bp, Homo sapiens
aactcttaatctgtgtg

SEQ ID NO: 3133539 - DNA, 23 bp, Homo sapiens
aactcttcagaacacacagactt

SEQ ID NO: 3133540 - DNA, 20 bp, Homo sapiens
aactcttccatttattgcac

SEQ ID NO: 3133541 - DNA, 17 bp, Homo sapiens
aactcttgattatccat

SEQ ID NO: 3133542 - DNA, 16 bp, Homo sapiens
aactcttttctatttt

SEQ ID NO: 3133543 - DNA, 12 bp, Homo sapiens
aactgaaaatgt

SEQ ID NO: 3133544 - DNA, 14 bp, Homo sapiens
aactgaaaatgtaa

SEQ ID NO: 3133545 - DNA, 17 bp, Homo sapiens
aactgaaaatgtaaatt

SEQ ID NO: 3133546 - DNA, 14 bp, Homo sapiens
aactgaaagtgttt

SEQ ID NO: 3133547 - DNA, 22 bp, Homo sapiens
aactgaaatgagcatgcatttt

SEQ ID NO: 3133548 - DNA, 23 bp, Homo sapiens
aactgaacaccattgaaggctta

SEQ ID NO: 3133549 - DNA, 11 bp, Homo sapiens
aactgaaccaa

SEQ ID NO: 3133550 - DNA, 17 bp, Homo sapiens
aactgaaccaaattgca

SEQ ID NO: 3133551 - DNA, 18 bp, Homo sapiens
aactgaaccaaattgcac

SEQ ID NO: 3133552 - DNA, 16 bp, Homo sapiens
aactgaaccacaaaaa

SEQ ID NO: 3133553 - DNA, 13 bp, Homo sapiens
aactgaagagaca

SEQ ID NO: 3133554 - DNA, 17 bp, Homo sapiens
aactgaatattttggaa

SEQ ID NO: 3133555 - DNA, 20 bp, Homo sapiens
aactgaatgtttattccttg

SEQ ID NO: 3133556 - DNA, 14 bp, Homo sapiens
aactgaatttggag

SEQ ID NO: 3133557 - DNA, 11 bp, Homo sapiens
aactgacacag

SEQ ID NO: 3133558 - DNA, 13 bp, Homo sapiens
aactgacacagga

SEQ ID NO: 3133559 - DNA, 19 bp, Homo sapiens
aactgactgaaggaaaagc

SEQ ID NO: 3133560 - DNA, 19 bp, Homo sapiens
aactgactttttcccccca

SEQ ID NO: 3133561 - DNA, 13 bp, Homo sapiens
aactgaggaattt

SEQ ID NO: 3133562 - DNA, 16 bp, Homo sapiens
aactgaggaattttct

SEQ ID NO: 3133563 - DNA, 20 bp, Homo sapiens
aactgaggaattttctttgt

SEQ ID NO: 3133564 - DNA, 19 bp, Homo sapiens
aactgaggagatgaccagg

SEQ ID NO: 3133565 - DNA, 21 bp, Homo sapiens
aactgatccagtataagacta

SEQ ID NO: 3133566 - DNA, 19 bp, Homo sapiens
aactgatgttactagcctc

SEQ ID NO: 3133567 - DNA, 14 bp, Homo sapiens
aactgatttctatg

SEQ ID NO: 3133568 - DNA, 13 bp, Homo sapiens
aactgatttcttc

SEQ ID NO: 3133569 - DNA, 16 bp, Homo sapiens
aactgatttcttcaga

SEQ ID NO: 3133570 - DNA, 17 bp, Homo sapiens
aactgcaaaaaaagcct

SEQ ID NO: 3133571 - DNA, 18 bp, Homo sapiens
aactgcaaaaaaagcctc

SEQ ID NO: 3133572 - DNA, 18 bp, Homo sapiens
aactgcaaccttgtttat

SEQ ID NO: 3133573 - DNA, 21 bp, Homo sapiens
aactgcaataacttctgacct

SEQ ID NO: 3133574 - DNA, 17 bp, Homo sapiens
aactgcacacacagctc

SEQ ID NO: 3133575 - DNA, 15 bp, Homo sapiens
aactgcacagtgctg

SEQ ID NO: 3133576 - DNA, 16 bp, Homo sapiens
aactgcacagtgctgt

SEQ ID NO: 3133577 - DNA, 22 bp, Homo sapiens
aactgcagaccatgaagtaaat

SEQ ID NO: 3133578 - DNA, 14 bp, Homo sapiens
aactgcaggccctg

SEQ ID NO: 3133579 - DNA, 19 bp, Homo sapiens
aactgcaggccctggcctc

SEQ ID NO: 3133580 - DNA, 21 bp, Homo sapiens
aactgcaggccctggcctccc

SEQ ID NO: 3133581 - DNA, 12 bp, Homo sapiens
aactgccattat

SEQ ID NO: 3133582 - DNA, 18 bp, Homo sapiens
aactgccattattttctg

SEQ ID NO: 3133583 - DNA, 21 bp, Homo sapiens
aactgccattattttctgtca

SEQ ID NO: 3133584 - DNA, 14 bp, Homo sapiens
aactgcccccactg

SEQ ID NO: 3133585 - DNA, 17 bp, Homo sapiens
aactgccgtaatttaac

SEQ ID NO: 3133586 - DNA, 18 bp, Homo sapiens
aactgccgtaatttaact

SEQ ID NO: 3133587 - DNA, 16 bp, Homo sapiens
aactgctaatgcaaat

SEQ ID NO: 3133588 - DNA, 14 bp, Homo sapiens
aactgctgcttttt

SEQ ID NO: 3133589 - DNA, 14 bp, Homo sapiens
aactgctgtaaaca

SEQ ID NO: 3133590 - DNA, 18 bp, Homo sapiens
aactgcttcatgtgaaca

SEQ ID NO: 3133591 - DNA, 22 bp, Homo sapiens
aactgcttcccttactttgctg

SEQ ID NO: 3133592 - DNA, 23 bp, Homo sapiens
aactgcttcccttactttgctga

SEQ ID NO: 3133593 - DNA, 17 bp, Homo sapiens
aactgctttcaagtctg

SEQ ID NO: 3133594 - DNA, 20 bp, Homo sapiens
aactgctttctgttccaaat

SEQ ID NO: 3133595 - DNA, 16 bp, Homo sapiens
aactgcttttcctcaa

SEQ ID NO: 3133596 - DNA, 20 bp, Homo sapiens
aactgcttttcctcaagcaa

SEQ ID NO: 3133597 - DNA, 22 bp, Homo sapiens
aactgcttttcctcaagcaata

SEQ ID NO: 3133598 - DNA, 20 bp, Homo sapiens
aactggaattaaaaggatag

SEQ ID NO: 3133599 - DNA, 14 bp, Homo sapiens
aactggagtctgga

SEQ ID NO: 3133600 - DNA, 20 bp, Homo sapiens
aactggagtctggagtgggc

SEQ ID NO: 3133601 - DNA, 14 bp, Homo sapiens
aactggattaaaac

SEQ ID NO: 3133602 - DNA, 18 bp, Homo sapiens
aactggtatgaataattg

SEQ ID NO: 3133603 - DNA, 21 bp, Homo sapiens
aactggtttgttgcagccaaa

SEQ ID NO: 3133604 - DNA, 17 bp, Homo sapiens
aactgtaacgttttctt

SEQ ID NO: 3133605 - DNA, 23 bp, Homo sapiens
aactgtactagtctgtgtgggac

SEQ ID NO: 3133606 - DNA, 14 bp, Homo sapiens
aactgtagaaatga

SEQ ID NO: 3133607 - DNA, 23 bp, Homo sapiens
aactgtagctcaagtttaaaagc

SEQ ID NO: 3133608 - DNA, 15 bp, Homo sapiens
aactgtagtctctga

SEQ ID NO: 3133609 - DNA, 20 bp, Homo sapiens
aactgtcactctaggaagaa

SEQ ID NO: 3133610 - DNA, 22 bp, Homo sapiens
aactgtcagtgtacacgtctgg

SEQ ID NO: 3133611 - DNA, 21 bp, Homo sapiens
aactgtccgtaagcagtatat

SEQ ID NO: 3133612 - DNA, 18 bp, Homo sapiens
aactgtctttaaaagaga

SEQ ID NO: 3133613 - DNA, 19 bp, Homo sapiens
aactgtgaaataccacaag

SEQ ID NO: 3133614 - DNA, 22 bp, Homo sapiens
aactgtgaaataccacaagcct

SEQ ID NO: 3133615 - DNA, 13 bp, Homo sapiens
aactgtgccttcg

SEQ ID NO: 3133616 - DNA, 18 bp, Homo sapiens
aactgtgcgttaaataag

SEQ ID NO: 3133617 - DNA, 11 bp, Homo sapiens
aactgtggccg

SEQ ID NO: 3133618 - DNA, 20 bp, Homo sapiens
aactgtgtacataactgaaa

SEQ ID NO: 3133619 - DNA, 23 bp, Homo sapiens
aactgtgtacataactgaaaatg

SEQ ID NO: 3133620 - DNA, 17 bp, Homo sapiens
aactgtgtatgtacata

SEQ ID NO: 3133621 - DNA, 18 bp, Homo sapiens
aactgtgtggactgtgat

SEQ ID NO: 3133622 - DNA, 17 bp, Homo sapiens
aactgtgttcattagaa

SEQ ID NO: 3133623 - DNA, 20 bp, Homo sapiens
aactgtgttgtattaacaaa

SEQ ID NO: 3133624 - DNA, 23 bp, Homo sapiens
aactgttacaacttgtatttcca

SEQ ID NO: 3133625 - DNA, 14 bp, Homo sapiens
aactgttagatgct

SEQ ID NO: 3133626 - DNA, 16 bp, Homo sapiens
aactgttagatgctga

SEQ ID NO: 3133627 - DNA, 15 bp, Homo sapiens
aactgttagcactgt

SEQ ID NO: 3133628 - DNA, 14 bp, Homo sapiens
aactgttgattgca

SEQ ID NO: 3133629 - DNA, 22 bp, Homo sapiens
aactgttgtgggcgctgcttcc

SEQ ID NO: 3133630 - DNA, 12 bp, Homo sapiens
aactgtttatat

SEQ ID NO: 3133631 - DNA, 15 bp, Homo sapiens
aactgtttccctgct

SEQ ID NO: 3133632 - DNA, 18 bp, Homo sapiens
aactgtttccctgctgaa

SEQ ID NO: 3133633 - DNA, 19 bp, Homo sapiens
aactgtttccctgctgaat

SEQ ID NO: 3133634 - DNA, 13 bp, Homo sapiens
aacttaaaaatgt

SEQ ID NO: 3133635 - DNA, 17 bp, Homo sapiens
aacttaaaaatgtaaat

SEQ ID NO: 3133636 - DNA, 21 bp, Homo sapiens
aacttaaaaatgtaaatattc

SEQ ID NO: 3133637 - DNA, 13 bp, Homo sapiens
aacttaaaatatt

SEQ ID NO: 3133638 - DNA, 14 bp, Homo sapiens
aacttaaataataa

SEQ ID NO: 3133639 - DNA, 14 bp, Homo sapiens
aacttaaattatgt

SEQ ID NO: 3133640 - DNA, 21 bp, Homo sapiens
aacttaacattctgtaaaatg

SEQ ID NO: 3133641 - DNA, 17 bp, Homo sapiens
aacttaagatgaataca

SEQ ID NO: 3133642 - DNA, 20 bp, Homo sapiens
aacttaatgttctgaataat

SEQ ID NO: 3133643 - DNA, 20 bp, Homo sapiens
aacttacattgttcaattag

SEQ ID NO: 3133644 - DNA, 15 bp, Homo sapiens
aacttactgattatt

SEQ ID NO: 3133645 - DNA, 12 bp, Homo sapiens
aacttactgtat

SEQ ID NO: 3133646 - DNA, 15 bp, Homo sapiens
aacttagaggaaaat

SEQ ID NO: 3133647 - DNA, 15 bp, Homo sapiens
aacttagccagagtt

SEQ ID NO: 3133648 - DNA, 20 bp, Homo sapiens
aacttagtgacaaaatagac

SEQ ID NO: 3133649 - DNA, 23 bp, Homo sapiens
aacttagtgcggacaagttttaa

SEQ ID NO: 3133650 - DNA, 14 bp, Homo sapiens
aacttataaatcat

SEQ ID NO: 3133651 - DNA, 23 bp, Homo sapiens
aacttatattaaataaatgtgca

SEQ ID NO: 3133652 - DNA, 19 bp, Homo sapiens
aacttatcctaaaacaaat

SEQ ID NO: 3133653 - DNA, 21 bp, Homo sapiens
aacttatctagaaagaaaaga

SEQ ID NO: 3133654 - DNA, 21 bp, Homo sapiens
aacttatgacctcttccttta

SEQ ID NO: 3133655 - DNA, 19 bp, Homo sapiens
aagataatttgcatattct

SEQ ID NO: 3133656 - DNA, 18 bp, Homo sapiens
aagatacaaattaatttt

SEQ ID NO: 3133657 - DNA, 20 bp, Homo sapiens
aagatacaagtttcagacag

SEQ ID NO: 3133658 - DNA, 22 bp, Homo sapiens
aagataccggtgcttctggaaa

SEQ ID NO: 3133659 - DNA, 15 bp, Homo sapiens
aagatacgactttat

SEQ ID NO: 3133660 - DNA, 18 bp, Homo sapiens
aagatacgactttatttt

SEQ ID NO: 3133661 - DNA, 14 bp, Homo sapiens
aagataggctctgc

SEQ ID NO: 3133662 - DNA, 18 bp, Homo sapiens
aagataggctctgcacag

SEQ ID NO: 3133663 - DNA, 16 bp, Homo sapiens
aagatagtcttggaag

SEQ ID NO: 3133664 - DNA, 18 bp, Homo sapiens
aagatatcagagctctta

SEQ ID NO: 3133665 - DNA, 13 bp, Homo sapiens
aagatatggagaa

SEQ ID NO: 3133666 - DNA, 17 bp, Homo sapiens
aagatatggagaattgc

SEQ ID NO: 3133667 - DNA, 20 bp, Homo sapiens
aagatattgatcaaatatag

SEQ ID NO: 3133668 - DNA, 14 bp, Homo sapiens
aagatattgttcaa

SEQ ID NO: 3133669 - DNA, 15 bp, Homo sapiens
aagatattgttcaaa

SEQ ID NO: 3133670 - DNA, 19 bp, Homo sapiens
aagatatttgcagtttttc

SEQ ID NO: 3133671 - DNA, 17 bp, Homo sapiens
aagatatttttatcttt

SEQ ID NO: 3133672 - DNA, 16 bp, Homo sapiens
aagatcacgctccccg

SEQ ID NO: 3133673 - DNA, 13 bp, Homo sapiens
aagatccaccccc

SEQ ID NO: 3133674 - DNA, 19 bp, Homo sapiens
aagatccatttgcctttct

SEQ ID NO: 3133675 - DNA, 11 bp, Homo sapiens
aagatctacag

SEQ ID NO: 3133676 - DNA, 17 bp, Homo sapiens
aagatcttagattctct

SEQ ID NO: 3133677 - DNA, 13 bp, Homo sapiens
aagatgaggttct

SEQ ID NO: 3133678 - DNA, 15 bp, Homo sapiens
aagatgcaaggacca

SEQ ID NO: 3133679 - DNA, 17 bp, Homo sapiens
aagatgctcttctgtgg

SEQ ID NO: 3133680 - DNA, 10 bp, Homo sapiens
aagatgctgg

SEQ ID NO: 3133681 - DNA, 14 bp, Homo sapiens
aagatgctgggttg

SEQ ID NO: 3133682 - DNA, 16 bp, Homo sapiens
aagatgctgggttggt

SEQ ID NO: 3133683 - DNA, 15 bp, Homo sapiens
aagatggaaaggatt

SEQ ID NO: 3133684 - DNA, 22 bp, Homo sapiens
aagatggactctgaaaaacatt

SEQ ID NO: 3133685 - DNA, 20 bp, Homo sapiens
aagatggagtttctaaggtc

SEQ ID NO: 3133686 - DNA, 21 bp, Homo sapiens
aagatggataaactgagcctc

SEQ ID NO: 3133687 - DNA, 18 bp, Homo sapiens
aagatggctgtgcctctg

SEQ ID NO: 3133688 - DNA, 18 bp, Homo sapiens
aagatgggcagctagttc

SEQ ID NO: 3133689 - DNA, 16 bp, Homo sapiens
aagatgtcagactggc

SEQ ID NO: 3133690 - DNA, 17 bp, Homo sapiens
aagatgtctatgtagct

SEQ ID NO: 3133691 - DNA, 17 bp, Homo sapiens
aagatgtgttcttattt

SEQ ID NO: 3133692 - DNA, 16 bp, Homo sapiens
aagatgtttgtcagat

SEQ ID NO: 3133693 - DNA, 13 bp, Homo sapiens
aagattaaaggaa

SEQ ID NO: 3133694 - DNA, 19 bp, Homo sapiens
aagattaaaggaaggaaaa

SEQ ID NO: 3133695 - DNA, 16 bp, Homo sapiens
aagattaacactaatt

SEQ ID NO: 3133696 - DNA, 21 bp, Homo sapiens
aagattacaaatcagaagtca

SEQ ID NO: 3133697 - DNA, 16 bp, Homo sapiens
aagattatagattcta

SEQ ID NO: 3133698 - DNA, 19 bp, Homo sapiens
aagattcacacctgactct

SEQ ID NO: 3133699 - DNA, 15 bp, Homo sapiens
aagattcaggtatgt

SEQ ID NO: 3133700 - DNA, 21 bp, Homo sapiens
aagattctactcttgtcattt

SEQ ID NO: 3133701 - DNA, 20 bp, Homo sapiens
aagattctagatcagatgct

SEQ ID NO: 3133702 - DNA, 14 bp, Homo sapiens
aagattctagatga

SEQ ID NO: 3133703 - DNA, 12 bp, Homo sapiens
aagattctgctg

SEQ ID NO: 3133704 - DNA, 14 bp, Homo sapiens
aagattcttttaaa

SEQ ID NO: 3133705 - DNA, 16 bp, Homo sapiens
aagattcttttaaatt

SEQ ID NO: 3133706 - DNA, 17 bp, Homo sapiens
aagattcttttaaatta

SEQ ID NO: 3133707 - DNA, 16 bp, Homo sapiens
aagattctttttctga

SEQ ID NO: 3133708 - DNA, 23 bp, Homo sapiens
aagattggtctcccatatgcaga

SEQ ID NO: 3133709 - DNA, 13 bp, Homo sapiens
aagattgtactta

SEQ ID NO: 3133710 - DNA, 20 bp, Homo sapiens
aagattgtgggggaaaaata

SEQ ID NO: 3133711 - DNA, 21 bp, Homo sapiens
aagatttaagcacaaacttta

SEQ ID NO: 3133712 - DNA, 22 bp, Homo sapiens
aagatttaccttttctgttgta

SEQ ID NO: 3133713 - DNA, 22 bp, Homo sapiens
aagatttgatgctggagaggtt

SEQ ID NO: 3133714 - DNA, 21 bp, Homo sapiens
aagatttgcccatttacactt

SEQ ID NO: 3133715 - DNA, 17 bp, Homo sapiens
aagatttggaataaagt

SEQ ID NO: 3133716 - DNA, 20 bp, Homo sapiens
aagatttgtgaactggaaga

SEQ ID NO: 3133717 - DNA, 19 bp, Homo sapiens
aagattttgaaatttttat

SEQ ID NO: 3133718 - DNA, 21 bp, Homo sapiens
aagattttgaatgcttcctga

SEQ ID NO: 3133719 - DNA, 13 bp, Homo sapiens
aagatttttcttt

SEQ ID NO: 3133720 - DNA, 13 bp, Homo sapiens
aagcaaaagaaaa

SEQ ID NO: 3133721 - DNA, 15 bp, Homo sapiens
aagcaaaagaaaaag

SEQ ID NO: 3133722 - DNA, 16 bp, Homo sapiens
aagcaaaagcaaggga

SEQ ID NO: 3133723 - DNA, 14 bp, Homo sapiens
aagcaaaaggctga

SEQ ID NO: 3133724 - DNA, 21 bp, Homo sapiens
aagcaaaaggctgagaaggaa

SEQ ID NO: 3133725 - DNA, 16 bp, Homo sapiens
aagcaaacatcaaata

SEQ ID NO: 3133726 - DNA, 18 bp, Homo sapiens
aagcaaacatcaaataaa

SEQ ID NO: 3133727 - DNA, 17 bp, Homo sapiens
aagcaaaggtgaagaga

SEQ ID NO: 3133728 - DNA, 14 bp, Homo sapiens
aagcaaatctacag

SEQ ID NO: 3133729 - DNA, 20 bp, Homo sapiens
aagcaaatttcaaaagacat

SEQ ID NO: 3133730 - DNA, 21 bp, Homo sapiens
aagcaacaaagattgagaagc

SEQ ID NO: 3133731 - DNA, 20 bp, Homo sapiens
aagcaacctgggtccaaata

SEQ ID NO: 3133732 - DNA, 21 bp, Homo sapiens
aagcaacctgggtccaaataa

SEQ ID NO: 3133733 - DNA, 23 bp, Homo sapiens
aagcaacctgggtccaaataaaa

SEQ ID NO: 3133734 - DNA, 18 bp, Homo sapiens
aagcaagagagatgtttt

SEQ ID NO: 3133735 - DNA, 16 bp, Homo sapiens
aagcaagctctcttgc

SEQ ID NO: 3133736 - DNA, 20 bp, Homo sapiens
aagcaagggctccagcatcc

SEQ ID NO: 3133737 - DNA, 19 bp, Homo sapiens
aagcaagtagctttccaca

SEQ ID NO: 3133738 - DNA, 16 bp, Homo sapiens
aagcaataaatgaatg

SEQ ID NO: 3133739 - DNA, 15 bp, Homo sapiens
aagcaattgccctgt

SEQ ID NO: 3133740 - DNA, 23 bp, Homo sapiens
aagcaattgctcatgttggccaa

SEQ ID NO: 3133741 - DNA, 15 bp, Homo sapiens
aagcaatttcttgct

SEQ ID NO: 3133742 - DNA, 15 bp, Homo sapiens
aagcacaactccctt

SEQ ID NO: 3133743 - DNA, 15 bp, Homo sapiens
aagcacaagtacttt

SEQ ID NO: 3133744 - DNA, 13 bp, Homo sapiens
aagcacagccctt

SEQ ID NO: 3133745 - DNA, 15 bp, Homo sapiens
aagcacagtttgaac

SEQ ID NO: 3133746 - DNA, 16 bp, Homo sapiens
aagcacagtttgaaca

SEQ ID NO: 3133747 - DNA, 17 bp, Homo sapiens
aagcacagtttgaacaa

SEQ ID NO: 3133748 - DNA, 12 bp, Homo sapiens
aagcacatacat

SEQ ID NO: 3133749 - DNA, 13 bp, Homo sapiens
aagcacatacatt

SEQ ID NO: 3133750 - DNA, 14 bp, Homo sapiens
aagcacatacatta

SEQ ID NO: 3133751 - DNA, 12 bp, Homo sapiens
aagcacatttta

SEQ ID NO: 3133752 - DNA, 14 bp, Homo sapiens
aagcaccccatgcc

SEQ ID NO: 3133753 - DNA, 19 bp, Homo sapiens
aagcacctactatgtgctg

SEQ ID NO: 3133754 - DNA, 16 bp, Homo sapiens
aagcaccttagctggc

SEQ ID NO: 3133755 - DNA, 19 bp, Homo sapiens
aagcaccttagctggcatt

SEQ ID NO: 3133756 - DNA, 15 bp, Homo sapiens
aagcacgaaatgtta

SEQ ID NO: 3133757 - DNA, 23 bp, Homo sapiens
aagcactacataaactgacttta

SEQ ID NO: 3133758 - DNA, 20 bp, Homo sapiens
aagcactagagaatgcacag

SEQ ID NO: 3133759 - DNA, 17 bp, Homo sapiens
aagcactcttaaagcaa

SEQ ID NO: 3133760 - DNA, 11 bp, Homo sapiens
aagcactgata

SEQ ID NO: 3133761 - DNA, 14 bp, Homo sapiens
aagcactttaagct

SEQ ID NO: 3133762 - DNA, 18 bp, Homo sapiens
aagcactttgggattctt

SEQ ID NO: 3133763 - DNA, 13 bp, Homo sapiens
aagcacttttgtt

SEQ ID NO: 3133764 - DNA, 20 bp, Homo sapiens
aagcacttttgttattccat

SEQ ID NO: 3133765 - DNA, 17 bp, Homo sapiens
aagcagaatcctcagtt

SEQ ID NO: 3133766 - DNA, 21 bp, Homo sapiens
aagcagacgtccatagctcct

SEQ ID NO: 3133767 - DNA, 20 bp, Homo sapiens
aagcagagtgcacagctgtc

SEQ ID NO: 3133768 - DNA, 17 bp, Homo sapiens
aagcagagtggactgca

SEQ ID NO: 3133769 - DNA, 14 bp, Homo sapiens
aagcagcatggaaa

SEQ ID NO: 3133770 - DNA, 11 bp, Homo sapiens
aagcagccagc

SEQ ID NO: 3133771 - DNA, 22 bp, Homo sapiens
aagcagccagccagtcttgcct

SEQ ID NO: 3133772 - DNA, 21 bp, Homo sapiens
aagcagccagctccccacacc

SEQ ID NO: 3133773 - DNA, 13 bp, Homo sapiens
aagcagcctcatt

SEQ ID NO: 3133774 - DNA, 20 bp, Homo sapiens
aagcagctaacaatgtctgg

SEQ ID NO: 3133775 - DNA, 17 bp, Homo sapiens
aagcagctcttgctaat

SEQ ID NO: 3133776 - DNA, 16 bp, Homo sapiens
aagcagctgaagaaaa

SEQ ID NO: 3133777 - DNA, 17 bp, Homo sapiens
aagcagctttaaacaaa

SEQ ID NO: 3133778 - DNA, 15 bp, Homo sapiens
aagcaggaattatgt

SEQ ID NO: 3133779 - DNA, 13 bp, Homo sapiens
aagcaggacctgg

SEQ ID NO: 3133780 - DNA, 15 bp, Homo sapiens
aagcaggacctggca

SEQ ID NO: 3133781 - DNA, 18 bp, Homo sapiens
aagcaggagacgacaggc

SEQ ID NO: 3133782 - DNA, 22 bp, Homo sapiens
aaggccggcagcgggcggaggg

SEQ ID NO: 3133783 - DNA, 15 bp, Homo sapiens
aaggcctaggattct

SEQ ID NO: 3133784 - DNA, 18 bp, Homo sapiens
aaggcctaggattctaaa

SEQ ID NO: 3133785 - DNA, 14 bp, Homo sapiens
aaggcctcctcccc

SEQ ID NO: 3133786 - DNA, 20 bp, Homo sapiens
aaggcctcttgtaaagactg

SEQ ID NO: 3133787 - DNA, 16 bp, Homo sapiens
aaggcctcttgtgctc

SEQ ID NO: 3133788 - DNA, 19 bp, Homo sapiens
aaggcctggaaccagggag

SEQ ID NO: 3133789 - DNA, 15 bp, Homo sapiens
aaggcctggctggaa

SEQ ID NO: 3133790 - DNA, 20 bp, Homo sapiens
aaggccttcatggccccagc

SEQ ID NO: 3133791 - DNA, 16 bp, Homo sapiens
aaggcgaggagagtgg

SEQ ID NO: 3133792 - DNA, 16 bp, Homo sapiens
aaggctaaaacttaac

SEQ ID NO: 3133793 - DNA, 18 bp, Homo sapiens
aaggctaacatcccactt

SEQ ID NO: 3133794 - DNA, 21 bp, Homo sapiens
aaggctagtttattttgttac

SEQ ID NO: 3133795 - DNA, 15 bp, Homo sapiens
aaggctatgtgatta

SEQ ID NO: 3133796 - DNA, 16 bp, Homo sapiens
aaggctcagtctcagg

SEQ ID NO: 3133797 - DNA, 11 bp, Homo sapiens
aaggctctaga

SEQ ID NO: 3133798 - DNA, 12 bp, Homo sapiens
aaggctctagat

SEQ ID NO: 3133799 - DNA, 20 bp, Homo sapiens
aaggctctatgagtctagat

SEQ ID NO: 3133800 - DNA, 21 bp, Homo sapiens
aaggctctatgagtctagatg

SEQ ID NO: 3133801 - DNA, 13 bp, Homo sapiens
aaggctctcaccc

SEQ ID NO: 3133802 - DNA, 13 bp, Homo sapiens
aaggctctgagag

SEQ ID NO: 3133803 - DNA, 20 bp, Homo sapiens
aaggctctgagagtctagat

SEQ ID NO: 3133804 - DNA, 21 bp, Homo sapiens
aaggctctgagagtctagatt

SEQ ID NO: 3133805 - DNA, 17 bp, Homo sapiens
aaggctgaactcttcag

SEQ ID NO: 3133806 - DNA, 22 bp, Homo sapiens
aaggctgagacagtgaatttgg

SEQ ID NO: 3133807 - DNA, 16 bp, Homo sapiens
aaggctgcgtctggag

SEQ ID NO: 3133808 - DNA, 19 bp, Homo sapiens
aaggctgcgtctggagggg

SEQ ID NO: 3133809 - DNA, 12 bp, Homo sapiens
aaggctggctga

SEQ ID NO: 3133810 - DNA, 16 bp, Homo sapiens
aaggcttaagaactgc

SEQ ID NO: 3133811 - DNA, 13 bp, Homo sapiens
aaggcttgaagct

SEQ ID NO: 3133812 - DNA, 13 bp, Homo sapiens
aagggaaatatca

SEQ ID NO: 3133813 - DNA, 14 bp, Homo sapiens
aagggaaatatcat

SEQ ID NO: 3133814 - DNA, 15 bp, Homo sapiens
aagggaacctgtgtc

SEQ ID NO: 3133815 - DNA, 20 bp, Homo sapiens
aagggaagaaggaggaatgc

SEQ ID NO: 3133816 - DNA, 17 bp, Homo sapiens
aagggaagtaagcaaac

SEQ ID NO: 3133817 - DNA, 17 bp, Homo sapiens
aagggaagttgtgcctt

SEQ ID NO: 3133818 - DNA, 14 bp, Homo sapiens
aagggaattgctca

SEQ ID NO: 3133819 - DNA, 15 bp, Homo sapiens
aagggaccctttgcc

SEQ ID NO: 3133820 - DNA, 16 bp, Homo sapiens
aagggagaagaaaggt

SEQ ID NO: 3133821 - DNA, 21 bp, Homo sapiens
aagggagaaggaagggcagag

SEQ ID NO: 3133822 - DNA, 17 bp, Homo sapiens
aagggagagctgagcca

SEQ ID NO: 3133823 - DNA, 13 bp, Homo sapiens
aagggaggaagat

SEQ ID NO: 3133824 - DNA, 17 bp, Homo sapiens
aagggagggagcaagcc

SEQ ID NO: 3133825 - DNA, 15 bp, Homo sapiens
aagggagtttaaaaa

SEQ ID NO: 3133826 - DNA, 18 bp, Homo sapiens
aagggagtttaaaaatgg

SEQ ID NO: 3133827 - DNA, 12 bp, Homo sapiens
aagggatatttt

SEQ ID NO: 3133828 - DNA, 14 bp, Homo sapiens
aagggatctgctta

SEQ ID NO: 3133829 - DNA, 14 bp, Homo sapiens
aagggattctggga

SEQ ID NO: 3133830 - DNA, 15 bp, Homo sapiens
aagggattctgggaa

SEQ ID NO: 3133831 - DNA, 21 bp, Homo sapiens
aagggcacagacactacatat

SEQ ID NO: 3133832 - DNA, 19 bp, Homo sapiens
aagggcacttaatttgtaa

SEQ ID NO: 3133833 - DNA, 11 bp, Homo sapiens
aagggcagagt

SEQ ID NO: 3133834 - DNA, 23 bp, Homo sapiens
aagggcaggtcttcatatttttg

SEQ ID NO: 3133835 - DNA, 14 bp, Homo sapiens
aagggcagtgccca

SEQ ID NO: 3133836 - DNA, 22 bp, Homo sapiens
aagggcagtgcccatgtgtaca

SEQ ID NO: 3133837 - DNA, 15 bp, Homo sapiens
aagggcatgccttgt

SEQ ID NO: 3133838 - DNA, 19 bp, Homo sapiens
aagggcatgccttgtgctg

SEQ ID NO: 3133839 - DNA, 16 bp, Homo sapiens
aagggccagtcctgcc

SEQ ID NO: 3133840 - DNA, 15 bp, Homo sapiens
aagggcccagagagg

SEQ ID NO: 3133841 - DNA, 12 bp, Homo sapiens
aagggccctggc

SEQ ID NO: 3133842 - DNA, 16 bp, Homo sapiens
aagggccctggcaccc

SEQ ID NO: 3133843 - DNA, 13 bp, Homo sapiens
aagggctccagca

SEQ ID NO: 3133844 - DNA, 18 bp, Homo sapiens
aagggctgacctgcctct

SEQ ID NO: 3133845 - DNA, 12 bp, Homo sapiens
aagggctgggtg

SEQ ID NO: 3133846 - DNA, 23 bp, Homo sapiens
aagggcttctgcaccctccaccc

SEQ ID NO: 3133847 - DNA, 12 bp, Homo sapiens
aaggggagagcc

SEQ ID NO: 3133848 - DNA, 14 bp, Homo sapiens
aaggggagagcctg

SEQ ID NO: 3133849 - DNA, 19 bp, Homo sapiens
aaggggagagcctgctggc

SEQ ID NO: 3133850 - DNA, 16 bp, Homo sapiens
aaggggaggcagccgg

SEQ ID NO: 3133851 - DNA, 22 bp, Homo sapiens
aaggggcccaaattctttcagt

SEQ ID NO: 3133852 - DNA, 18 bp, Homo sapiens
aaggggccccggggctgg

SEQ ID NO: 3133853 - DNA, 21 bp, Homo sapiens
aaggggccctggtccttccag

SEQ ID NO: 3133854 - DNA, 13 bp, Homo sapiens
aaggggccttgct

SEQ ID NO: 3133855 - DNA, 20 bp, Homo sapiens
aaggggcggtgcccacaccg

SEQ ID NO: 3133856 - DNA, 21 bp, Homo sapiens
aaggggctgagtgagttcaac

SEQ ID NO: 3133857 - DNA, 13 bp, Homo sapiens
aaggggggagggg

SEQ ID NO: 3133858 - DNA, 18 bp, Homo sapiens
aaggggtcccatcagtga

SEQ ID NO: 3133859 - DNA, 17 bp, Homo sapiens
aaggggtgcttttatag

SEQ ID NO: 3133860 - DNA, 22 bp, Homo sapiens
aaggggttggggtgacagtcat

SEQ ID NO: 3133861 - DNA, 16 bp, Homo sapiens
aagggtatcaggtgct

SEQ ID NO: 3133862 - DNA, 21 bp, Homo sapiens
aagggttaatcatatttgaaa

SEQ ID NO: 3133863 - DNA, 15 bp, Homo sapiens
aagggttgaaggcag

SEQ ID NO: 3133864 - DNA, 20 bp, Homo sapiens
aagggtttcgactggtccag

SEQ ID NO: 3133865 - DNA, 20 bp, Homo sapiens
aagggtttgtggctgggggc

SEQ ID NO: 3133866 - DNA, 21 bp, Homo sapiens
aagggttttccaccctggaat

SEQ ID NO: 3133867 - DNA, 20 bp, Homo sapiens
aaggtatatgttttataatt

SEQ ID NO: 3133868 - DNA, 22 bp, Homo sapiens
aaggtattaaattgatgttgct

SEQ ID NO: 3133869 - DNA, 22 bp, Homo sapiens
aaggtattccttttgtgtacag

SEQ ID NO: 3133870 - DNA, 19 bp, Homo sapiens
aaggtattttgaataccat

SEQ ID NO: 3133871 - DNA, 14 bp, Homo sapiens
aaggtcatttcttc

SEQ ID NO: 3133872 - DNA, 17 bp, Homo sapiens
aaggtcctaagggagtg

SEQ ID NO: 3133873 - DNA, 19 bp, Homo sapiens
aaggtctccttactctgag

SEQ ID NO: 3133874 - DNA, 20 bp, Homo sapiens
aaggtctccttactctgagc

SEQ ID NO: 3133875 - DNA, 23 bp, Homo sapiens
aaggtctccttactctgagccca

SEQ ID NO: 3133876 - DNA, 19 bp, Homo sapiens
aaggtctttcagtactttt

SEQ ID NO: 3133877 - DNA, 21 bp, Homo sapiens
aaggtgaagatgaagaagcct

SEQ ID NO: 3133878 - DNA, 17 bp, Homo sapiens
aaggtgagcataaatca

SEQ ID NO: 3133879 - DNA, 17 bp, Homo sapiens
aaggtgatatatttaaa

SEQ ID NO: 3133880 - DNA, 13 bp, Homo sapiens
aaggtgatgttgt

SEQ ID NO: 3133881 - DNA, 14 bp, Homo sapiens
aaggtgatttcaga

SEQ ID NO: 3133882 - DNA, 14 bp, Homo sapiens
aaggtgcagttccc

SEQ ID NO: 3133883 - DNA, 12 bp, Homo sapiens
aaggtgcatctg

SEQ ID NO: 3133884 - DNA, 21 bp, Homo sapiens
aaggtgccaccaccctgcccc

SEQ ID NO: 3133885 - DNA, 15 bp, Homo sapiens
aaggtgctggaggtg

SEQ ID NO: 3133886 - DNA, 15 bp, Homo sapiens
aaggtggaaaatgga

SEQ ID NO: 3133887 - DNA, 16 bp, Homo sapiens
aaggtgggctgagccc

SEQ ID NO: 3133888 - DNA, 15 bp, Homo sapiens
aaggtgggtccagga

SEQ ID NO: 3133889 - DNA, 17 bp, Homo sapiens
aaggtgtaactctaatt

SEQ ID NO: 3133890 - DNA, 22 bp, Homo sapiens
aaggtgttcattcacttgcatt

SEQ ID NO: 3133891 - DNA, 18 bp, Homo sapiens
aaggttaggatttaacag

SEQ ID NO: 3133892 - DNA, 19 bp, Homo sapiens
aaggttatgttcatttttc

SEQ ID NO: 3133893 - DNA, 18 bp, Homo sapiens
aaggttccaactgtatat

SEQ ID NO: 3133894 - DNA, 22 bp, Homo sapiens
aaggttccaatcagatctttat

SEQ ID NO: 3133895 - DNA, 13 bp, Homo sapiens
aaggttctaaggc

SEQ ID NO: 3133896 - DNA, 21 bp, Homo sapiens
aaggttctcaggtgttgccaa

SEQ ID NO: 3133897 - DNA, 20 bp, Homo sapiens
aaggttcttcatccctttcc

SEQ ID NO: 3133898 - DNA, 22 bp, Homo sapiens
aaggttgacaataaatgtgctt

SEQ ID NO: 3133899 - DNA, 21 bp, Homo sapiens
aaggttgcatactgagccaag

SEQ ID NO: 3133900 - DNA, 16 bp, Homo sapiens
aaggttgggcagggtg

SEQ ID NO: 3133901 - DNA, 16 bp, Homo sapiens
aaggttggttgctaag

SEQ ID NO: 3133902 - DNA, 16 bp, Homo sapiens
aaggtttcgtttctgt

SEQ ID NO: 3133903 - DNA, 22 bp, Homo sapiens
aaggtttcgtttctgtatacaa

SEQ ID NO: 3133904 - DNA, 20 bp, Homo sapiens
aaggttttataaggctgatg

SEQ ID NO: 3133905 - DNA, 12 bp, Homo sapiens
aaggttttgtat

SEQ ID NO: 3133906 - DNA, 20 bp, Homo sapiens
aaggttttgtattttttaaa

SEQ ID NO: 3133907 - DNA, 23 bp, Homo sapiens
aaggttttgtattttttaaaaca

SEQ ID NO: 3133908 - DNA, 14 bp, Homo sapiens
aatacctctgtgtg

SEQ ID NO: 3133909 - DNA, 12 bp, Homo sapiens
aatacctgctca

SEQ ID NO: 3133910 - DNA, 13 bp, Homo sapiens
aatacctttgtag

SEQ ID NO: 3133911 - DNA, 14 bp, Homo sapiens
aatacctttgtagt

SEQ ID NO: 3133912 - DNA, 18 bp, Homo sapiens
aatacctttgtagttact

SEQ ID NO: 3133913 - DNA, 22 bp, Homo sapiens
aatacctttgtagttactcaag

SEQ ID NO: 3133914 - DNA, 16 bp, Homo sapiens
aatacgcactacatgt

SEQ ID NO: 3133915 - DNA, 15 bp, Homo sapiens
aatactaaaatatgt

SEQ ID NO: 3133916 - DNA, 22 bp, Homo sapiens
aatactacctctgaatgttaca

SEQ ID NO: 3133917 - DNA, 13 bp, Homo sapiens
aatactcatcaga

SEQ ID NO: 3133918 - DNA, 12 bp, Homo sapiens
aatactctattt

SEQ ID NO: 3133919 - DNA, 23 bp, Homo sapiens
aatactctgctatttctcttgct

SEQ ID NO: 3133920 - DNA, 19 bp, Homo sapiens
aatactgtatgccttctgt

SEQ ID NO: 3133921 - DNA, 19 bp, Homo sapiens
aatactgtgcagaataatg

SEQ ID NO: 3133922 - DNA, 15 bp, Homo sapiens
aatactgtgtggaac

SEQ ID NO: 3133923 - DNA, 19 bp, Homo sapiens
aatacttactataatttga

SEQ ID NO: 3133924 - DNA, 15 bp, Homo sapiens
aatacttattttcag

SEQ ID NO: 3133925 - DNA, 20 bp, Homo sapiens
aatacttcatttggtgctgg

SEQ ID NO: 3133926 - DNA, 15 bp, Homo sapiens
aatacttttactctg

SEQ ID NO: 3133927 - DNA, 18 bp, Homo sapiens
aatacttttactctgcct

SEQ ID NO: 3133928 - DNA, 15 bp, Homo sapiens
aatactttttacaat

SEQ ID NO: 3133929 - DNA, 15 bp, Homo sapiens
aatacttttttctag

SEQ ID NO: 3133930 - DNA, 14 bp, Homo sapiens
aatagaaaatggtc

SEQ ID NO: 3133931 - DNA, 22 bp, Homo sapiens
aatagaaataaaggatgtgatt

SEQ ID NO: 3133932 - DNA, 20 bp, Homo sapiens
aatagaaataaattcctaaa

SEQ ID NO: 3133933 - DNA, 15 bp, Homo sapiens
aatagaagaacatcc

SEQ ID NO: 3133934 - DNA, 14 bp, Homo sapiens
aatagaaggtgatg

SEQ ID NO: 3133935 - DNA, 16 bp, Homo sapiens
aatagaataaaggcag

SEQ ID NO: 3133936 - DNA, 16 bp, Homo sapiens
aatagaattataactg

SEQ ID NO: 3133937 - DNA, 17 bp, Homo sapiens
aatagacaaaaagtata

SEQ ID NO: 3133938 - DNA, 14 bp, Homo sapiens
aatagacaaataga

SEQ ID NO: 3133939 - DNA, 22 bp, Homo sapiens
aatagacaaatagaaaatggtc

SEQ ID NO: 3133940 - DNA, 15 bp, Homo sapiens
aatagacatgtagtt

SEQ ID NO: 3133941 - DNA, 16 bp, Homo sapiens
aatagacttaaatctc

SEQ ID NO: 3133942 - DNA, 15 bp, Homo sapiens
aatagagactgtaga

SEQ ID NO: 3133943 - DNA, 15 bp, Homo sapiens
aatagaggaagaaat

SEQ ID NO: 3133944 - DNA, 15 bp, Homo sapiens
aatagagtatatgca

SEQ ID NO: 3133945 - DNA, 19 bp, Homo sapiens
aatagagttgggacaattg

SEQ ID NO: 3133946 - DNA, 19 bp, Homo sapiens
aatagatatgaaagctgat

SEQ ID NO: 3133947 - DNA, 16 bp, Homo sapiens
aatagatgctgactgt

SEQ ID NO: 3133948 - DNA, 22 bp, Homo sapiens
aatagatttaccctttatagaa

SEQ ID NO: 3133949 - DNA, 13 bp, Homo sapiens
aatagcaactttt

SEQ ID NO: 3133950 - DNA, 15 bp, Homo sapiens
aatagcaacttttgt

SEQ ID NO: 3133951 - DNA, 19 bp, Homo sapiens
aatagcaacttttgtgtaa

SEQ ID NO: 3133952 - DNA, 19 bp, Homo sapiens
aatagcactttcattgcca

SEQ ID NO: 3133953 - DNA, 15 bp, Homo sapiens
aatagcagttataac

SEQ ID NO: 3133954 - DNA, 20 bp, Homo sapiens
aatagcagttataacagatg

SEQ ID NO: 3133955 - DNA, 23 bp, Homo sapiens
aatagcagttataacagatgtga

SEQ ID NO: 3133956 - DNA, 20 bp, Homo sapiens
aatagccacatttggaatac

SEQ ID NO: 3133957 - DNA, 18 bp, Homo sapiens
aatagctatatccatgta

SEQ ID NO: 3133958 - DNA, 21 bp, Homo sapiens
aatagctatatccatgtactg

SEQ ID NO: 3133959 - DNA, 22 bp, Homo sapiens
aatagctatatccatgtactgt

SEQ ID NO: 3133960 - DNA, 13 bp, Homo sapiens
aatagctgggact

SEQ ID NO: 3133961 - DNA, 14 bp, Homo sapiens
aatagcttgtatag

SEQ ID NO: 3133962 - DNA, 23 bp, Homo sapiens
aataggaatcattcagaaatgtt

SEQ ID NO: 3133963 - DNA, 22 bp, Homo sapiens
aatagggaaaatacctatttta

SEQ ID NO: 3133964 - DNA, 16 bp, Homo sapiens
aatagggtagaatgat

SEQ ID NO: 3133965 - DNA, 19 bp, Homo sapiens
aataggtagggggctttca

SEQ ID NO: 3133966 - DNA, 15 bp, Homo sapiens
aataggtagtttgga

SEQ ID NO: 3133967 - DNA, 21 bp, Homo sapiens
aataggtagtttggatatttt

SEQ ID NO: 3133968 - DNA, 14 bp, Homo sapiens
aatagtagaaaaat

SEQ ID NO: 3133969 - DNA, 22 bp, Homo sapiens
aatagtatttctcctttgcaat

SEQ ID NO: 3133970 - DNA, 23 bp, Homo sapiens
aatagtatttgagagttctaaat

SEQ ID NO: 3133971 - DNA, 13 bp, Homo sapiens
aatagtctgtgtg

SEQ ID NO: 3133972 - DNA, 15 bp, Homo sapiens
aatagtctgtgtgaa

SEQ ID NO: 3133973 - DNA, 19 bp, Homo sapiens
aatagtgcagaatctcata

SEQ ID NO: 3133974 - DNA, 17 bp, Homo sapiens
aatagtgtgaaatatat

SEQ ID NO: 3133975 - DNA, 15 bp, Homo sapiens
aatagtgtgttctga

SEQ ID NO: 3133976 - DNA, 22 bp, Homo sapiens
aatagtgtgttctgattagaaa

SEQ ID NO: 3133977 - DNA, 19 bp, Homo sapiens
aatagtttacatgtagtag

SEQ ID NO: 3133978 - DNA, 12 bp, Homo sapiens
aatataaaaaat

SEQ ID NO: 3133979 - DNA, 16 bp, Homo sapiens
aatataaaaaatcatg

SEQ ID NO: 3133980 - DNA, 20 bp, Homo sapiens
aatataaaaaatcatgccag

SEQ ID NO: 3133981 - DNA, 19 bp, Homo sapiens
aatataaaagatatatata

SEQ ID NO: 3133982 - DNA, 22 bp, Homo sapiens
aatataaaaggcaaatgtgtac

SEQ ID NO: 3133983 - DNA, 18 bp, Homo sapiens
aatataactatgtggctg

SEQ ID NO: 3133984 - DNA, 22 bp, Homo sapiens
aatataactatgtggctgaaaa

SEQ ID NO: 3133985 - DNA, 21 bp, Homo sapiens
aatataacttaaaaatgtaaa

SEQ ID NO: 3133986 - DNA, 13 bp, Homo sapiens
aatataagatttt

SEQ ID NO: 3133987 - DNA, 19 bp, Homo sapiens
aatataaggaaagcaataa

SEQ ID NO: 3133988 - DNA, 14 bp, Homo sapiens
aatataataatgat

SEQ ID NO: 3133989 - DNA, 23 bp, Homo sapiens
aatataatggaagagaaatctca

SEQ ID NO: 3133990 - DNA, 11 bp, Homo sapiens
aatataattat

SEQ ID NO: 3133991 - DNA, 22 bp, Homo sapiens
aatatagaaagttgatattcaa

SEQ ID NO: 3133992 - DNA, 21 bp, Homo sapiens
aatatagatcagttataagta

SEQ ID NO: 3133993 - DNA, 13 bp, Homo sapiens
aatatagcctgcc

SEQ ID NO: 3133994 - DNA, 23 bp, Homo sapiens
aatataggtctcttctcccagaa

SEQ ID NO: 3133995 - DNA, 18 bp, Homo sapiens
aatatagttcctaagaag

SEQ ID NO: 3133996 - DNA, 14 bp, Homo sapiens
aatatagttctgat

SEQ ID NO: 3133997 - DNA, 18 bp, Homo sapiens
aatatataaaaagaaaag

SEQ ID NO: 3133998 - DNA, 19 bp, Homo sapiens
aatatataaaaatatatat

SEQ ID NO: 3133999 - DNA, 12 bp, Homo sapiens
aatatataatat

SEQ ID NO: 3134000 - DNA, 14 bp, Homo sapiens
aatatataatttat

SEQ ID NO: 3134001 - DNA, 13 bp, Homo sapiens
aatatatagaatt

SEQ ID NO: 3134002 - DNA, 15 bp, Homo sapiens
aatatatagaattca

SEQ ID NO: 3134003 - DNA, 13 bp, Homo sapiens
aatatatataaag

SEQ ID NO: 3134004 - DNA, 14 bp, Homo sapiens
aatatatatacata

SEQ ID NO: 3134005 - DNA, 22 bp, Homo sapiens
aatatatatagtgctatatata

SEQ ID NO: 3134006 - DNA, 15 bp, Homo sapiens
aatatatatgatcat

SEQ ID NO: 3134007 - DNA, 16 bp, Homo sapiens
aatatatcccagaaat

SEQ ID NO: 3134008 - DNA, 20 bp, Homo sapiens
aatatatccccactactcaa

SEQ ID NO: 3134009 - DNA, 20 bp, Homo sapiens
aatatatctaccccagacta

SEQ ID NO: 3134010 - DNA, 14 bp, Homo sapiens
aatatatctctatt

SEQ ID NO: 3134011 - DNA, 20 bp, Homo sapiens
aatatatgccttgtataata

SEQ ID NO: 3134012 - DNA, 14 bp, Homo sapiens
aatatatgtattat

SEQ ID NO: 3134013 - DNA, 14 bp, Homo sapiens
aatatatgtctgat

SEQ ID NO: 3134014 - DNA, 23 bp, Homo sapiens
aatatattaccagcaagaataaa

SEQ ID NO: 3134015 - DNA, 13 bp, Homo sapiens
aatatattgaata

SEQ ID NO: 3134016 - DNA, 16 bp, Homo sapiens
aatatattgtacaaat

SEQ ID NO: 3134017 - DNA, 20 bp, Homo sapiens
aatatattgtacaaatgtaa

SEQ ID NO: 3134018 - DNA, 20 bp, Homo sapiens
aatatatttatttaaagcat

SEQ ID NO: 3134019 - DNA, 15 bp, Homo sapiens
aatatatttttatat

SEQ ID NO: 3134020 - DNA, 20 bp, Homo sapiens
aatatatttttatatttagt

SEQ ID NO: 3134021 - DNA, 15 bp, Homo sapiens
aatatcagacaagca

SEQ ID NO: 3134022 - DNA, 22 bp, Homo sapiens
aatatcatatcatcacattgag

SEQ ID NO: 3134023 - DNA, 16 bp, Homo sapiens
aatatccaaagactgt

SEQ ID NO: 3134024 - DNA, 19 bp, Homo sapiens
aatatccaaagactgtact

SEQ ID NO: 3134025 - DNA, 16 bp, Homo sapiens
aatatccctacatgta

SEQ ID NO: 3134026 - DNA, 17 bp, Homo sapiens
aatatccctacatgtat

SEQ ID NO: 3134027 - DNA, 17 bp, Homo sapiens
aatatccctcttgtaag

SEQ ID NO: 3134028 - DNA, 20 bp, Homo sapiens
aatatctaatatatatgaat

SEQ ID NO: 3134029 - DNA, 21 bp, Homo sapiens
aatatctaatatatatgaata

SEQ ID NO: 3134030 - DNA, 17 bp, Homo sapiens
aatatctgaaaatgtat

SEQ ID NO: 3134031 - DNA, 12 bp, Homo sapiens
aatatctgaagc

SEQ ID NO: 3134032 - DNA, 14 bp, Homo sapiens
aatatctggcactg

SEQ ID NO: 3134033 - DNA, 13 bp, Homo sapiens
aatatctgggatt

SEQ ID NO: 3134034 - DNA, 19 bp, Homo sapiens
aatgatctcggatgaccaa

SEQ ID NO: 3134035 - DNA, 22 bp, Homo sapiens
aatgatctctctgaatcctaag

SEQ ID NO: 3134036 - DNA, 19 bp, Homo sapiens
aatgatgacaaaaaatgtt

SEQ ID NO: 3134037 - DNA, 15 bp, Homo sapiens
aatgatgagtattag

SEQ ID NO: 3134038 - DNA, 13 bp, Homo sapiens
aatgatgatcttc

SEQ ID NO: 3134039 - DNA, 17 bp, Homo sapiens
aatgatgatgataatga

SEQ ID NO: 3134040 - DNA, 14 bp, Homo sapiens
aatgatggcaattt

SEQ ID NO: 3134041 - DNA, 14 bp, Homo sapiens
aatgatgtccagaa

SEQ ID NO: 3134042 - DNA, 14 bp, Homo sapiens
aatgattataatca

SEQ ID NO: 3134043 - DNA, 16 bp, Homo sapiens
aatgattataatcata

SEQ ID NO: 3134044 - DNA, 14 bp, Homo sapiens
aatgattattttca

SEQ ID NO: 3134045 - DNA, 19 bp, Homo sapiens
aatgattcaaattgctgct

SEQ ID NO: 3134046 - DNA, 22 bp, Homo sapiens
aatgattcaaattgctgcttgg

SEQ ID NO: 3134047 - DNA, 14 bp, Homo sapiens
aatgattgtaaaat

SEQ ID NO: 3134048 - DNA, 20 bp, Homo sapiens
aatgatttcatattgatctt

SEQ ID NO: 3134049 - DNA, 14 bp, Homo sapiens
aatgcaaaaccttt

SEQ ID NO: 3134050 - DNA, 20 bp, Homo sapiens
aatgcaaacacacaaaggta

SEQ ID NO: 3134051 - DNA, 15 bp, Homo sapiens
aatgcaaagctgaag

SEQ ID NO: 3134052 - DNA, 16 bp, Homo sapiens
aatgcaaagttctgtg

SEQ ID NO: 3134053 - DNA, 21 bp, Homo sapiens
aatgcacaaattgaaaacaca

SEQ ID NO: 3134054 - DNA, 17 bp, Homo sapiens
aatgcacagatatactt

SEQ ID NO: 3134055 - DNA, 18 bp, Homo sapiens
aatgcacagatatacttt

SEQ ID NO: 3134056 - DNA, 16 bp, Homo sapiens
aatgcacatccattcc

SEQ ID NO: 3134057 - DNA, 13 bp, Homo sapiens
aatgcacggcctc

SEQ ID NO: 3134058 - DNA, 17 bp, Homo sapiens
aatgcagtgaattgtga

SEQ ID NO: 3134059 - DNA, 16 bp, Homo sapiens
aatgcagtgacacaat

SEQ ID NO: 3134060 - DNA, 20 bp, Homo sapiens
aatgcagtgacacaatctcg

SEQ ID NO: 3134061 - DNA, 14 bp, Homo sapiens
aatgcataaatgca

SEQ ID NO: 3134062 - DNA, 18 bp, Homo sapiens
aatgcatcaatatgtatt

SEQ ID NO: 3134063 - DNA, 22 bp, Homo sapiens
aatgcatcacgtaccccactgg

SEQ ID NO: 3134064 - DNA, 19 bp, Homo sapiens
aatgcatctagattatgga

SEQ ID NO: 3134065 - DNA, 16 bp, Homo sapiens
aatgcatgattttgta

SEQ ID NO: 3134066 - DNA, 17 bp, Homo sapiens
aatgcatgattttgtaa

SEQ ID NO: 3134067 - DNA, 19 bp, Homo sapiens
aatgcatgattttgtaacc

SEQ ID NO: 3134068 - DNA, 18 bp, Homo sapiens
aatgcattaaacctgtct

SEQ ID NO: 3134069 - DNA, 23 bp, Homo sapiens
aatgcattataggatcatttgtt

SEQ ID NO: 3134070 - DNA, 19 bp, Homo sapiens
aatgcattcaaaatataac

SEQ ID NO: 3134071 - DNA, 14 bp, Homo sapiens
aatgcattcttctc

SEQ ID NO: 3134072 - DNA, 17 bp, Homo sapiens
aatgcattgtcttgtgg

SEQ ID NO: 3134073 - DNA, 11 bp, Homo sapiens
aatgccctctt

SEQ ID NO: 3134074 - DNA, 16 bp, Homo sapiens
aatgcccttaaatcat

SEQ ID NO: 3134075 - DNA, 15 bp, Homo sapiens
aatgcctcctgtggg

SEQ ID NO: 3134076 - DNA, 20 bp, Homo sapiens
aatgcctcttaaattatata

SEQ ID NO: 3134077 - DNA, 19 bp, Homo sapiens
aatgcctgctttttggaaa

SEQ ID NO: 3134078 - DNA, 20 bp, Homo sapiens
aatgcctgctttttggaaag

SEQ ID NO: 3134079 - DNA, 18 bp, Homo sapiens
aatgcctggagacagata

SEQ ID NO: 3134080 - DNA, 13 bp, Homo sapiens
aatgcctgtgcca

SEQ ID NO: 3134081 - DNA, 14 bp, Homo sapiens
aatgcctgtgccaa

SEQ ID NO: 3134082 - DNA, 19 bp, Homo sapiens
aatgcctgtgccaataaaa

SEQ ID NO: 3134083 - DNA, 22 bp, Homo sapiens
aatgccttagaaatgtaaactg

SEQ ID NO: 3134084 - DNA, 23 bp, Homo sapiens
aatgcctttatatttcacaggct

SEQ ID NO: 3134085 - DNA, 12 bp, Homo sapiens
aatgcctttgag

SEQ ID NO: 3134086 - DNA, 21 bp, Homo sapiens
aatgcggttataaaaaatggt

SEQ ID NO: 3134087 - DNA, 15 bp, Homo sapiens
aatgctacatgtgag

SEQ ID NO: 3134088 - DNA, 19 bp, Homo sapiens
aatgctaggttaattccaa

SEQ ID NO: 3134089 - DNA, 21 bp, Homo sapiens
aatgctaggttaattccaatt

SEQ ID NO: 3134090 - DNA, 15 bp, Homo sapiens
aatgctattgaaaat

SEQ ID NO: 3134091 - DNA, 21 bp, Homo sapiens
aatgctattgttgtgggcttt

SEQ ID NO: 3134092 - DNA, 12 bp, Homo sapiens
aatgctcccagc

SEQ ID NO: 3134093 - DNA, 20 bp, Homo sapiens
aatgctctggggtcttttta

SEQ ID NO: 3134094 - DNA, 15 bp, Homo sapiens
aatgctgaggttatg

SEQ ID NO: 3134095 - DNA, 12 bp, Homo sapiens
aatgctgcactt

SEQ ID NO: 3134096 - DNA, 13 bp, Homo sapiens
aatgctgcacttc

SEQ ID NO: 3134097 - DNA, 18 bp, Homo sapiens
aatgctgctccaccctcc

SEQ ID NO: 3134098 - DNA, 16 bp, Homo sapiens
aatgctgcttctcctc

SEQ ID NO: 3134099 - DNA, 17 bp, Homo sapiens
aatgctggactggaggc

SEQ ID NO: 3134100 - DNA, 12 bp, Homo sapiens
aatgctgtacat

SEQ ID NO: 3134101 - DNA, 17 bp, Homo sapiens
aatgctgtcaactatga

SEQ ID NO: 3134102 - DNA, 20 bp, Homo sapiens
aatgcttaaactaaataatg

SEQ ID NO: 3134103 - DNA, 16 bp, Homo sapiens
aatgcttcagatatta

SEQ ID NO: 3134104 - DNA, 21 bp, Homo sapiens
aatgcttcctgacaatcaact

SEQ ID NO: 3134105 - DNA, 12 bp, Homo sapiens
aatgcttctgta

SEQ ID NO: 3134106 - DNA, 15 bp, Homo sapiens
aatgcttctgtagct

SEQ ID NO: 3134107 - DNA, 22 bp, Homo sapiens
aatgcttgacaaatattttcat

SEQ ID NO: 3134108 - DNA, 13 bp, Homo sapiens
aatgctttggaaa

SEQ ID NO: 3134109 - DNA, 21 bp, Homo sapiens
aatgcttttagtgtgtgcata

SEQ ID NO: 3134110 - DNA, 19 bp, Homo sapiens
aatgcttttatatggccca

SEQ ID NO: 3134111 - DNA, 20 bp, Homo sapiens
aatgctttttatttctgcat

SEQ ID NO: 3134112 - DNA, 18 bp, Homo sapiens
aatggaaaaatccttgaa

SEQ ID NO: 3134113 - DNA, 20 bp, Homo sapiens
aatggaaaatgccatgaatt

SEQ ID NO: 3134114 - DNA, 13 bp, Homo sapiens
aatggaaacatta

SEQ ID NO: 3134115 - DNA, 17 bp, Homo sapiens
aatggaaaccacaactt

SEQ ID NO: 3134116 - DNA, 19 bp, Homo sapiens
aatggaaaccacaactttt

SEQ ID NO: 3134117 - DNA, 17 bp, Homo sapiens
aatggaaattttgctat

SEQ ID NO: 3134118 - DNA, 17 bp, Homo sapiens
aatggaactactgtact

SEQ ID NO: 3134119 - DNA, 13 bp, Homo sapiens
aatggaagcaaag

SEQ ID NO: 3134120 - DNA, 23 bp, Homo sapiens
aatggaagcaattgctcatgttg

SEQ ID NO: 3134121 - DNA, 18 bp, Homo sapiens
aatggaaggtttgtatat

SEQ ID NO: 3134122 - DNA, 19 bp, Homo sapiens
aatggaatcttctccagta

SEQ ID NO: 3134123 - DNA, 18 bp, Homo sapiens
aatggacaaaatccatga

SEQ ID NO: 3134124 - DNA, 14 bp, Homo sapiens
aatggacacaaatt

SEQ ID NO: 3134125 - DNA, 13 bp, Homo sapiens
aatggaggcagag

SEQ ID NO: 3134126 - DNA, 17 bp, Homo sapiens
aatggaggccattgtgt

SEQ ID NO: 3134127 - DNA, 18 bp, Homo sapiens
aatggatttttctttaac

SEQ ID NO: 3134128 - DNA, 21 bp, Homo sapiens
aatggcaatagggtagaatga

SEQ ID NO: 3134129 - DNA, 13 bp, Homo sapiens
aatggcagctaga

SEQ ID NO: 3134130 - DNA, 19 bp, Homo sapiens
aatggcagctagactggag

SEQ ID NO: 3134131 - DNA, 13 bp, Homo sapiens
aatggcagctagt

SEQ ID NO: 3134132 - DNA, 17 bp, Homo sapiens
aatggccatttgctttt

SEQ ID NO: 3134133 - DNA, 20 bp, Homo sapiens
aatggcctcatgtggctgga

SEQ ID NO: 3134134 - DNA, 18 bp, Homo sapiens
aatggctaataaactgta

SEQ ID NO: 3134135 - DNA, 20 bp, Homo sapiens
aatggctaataaactgtatt

SEQ ID NO: 3134136 - DNA, 16 bp, Homo sapiens
aatggctcaagtagaa

SEQ ID NO: 3134137 - DNA, 21 bp, Homo sapiens
aatggctgggtcagggccaga

SEQ ID NO: 3134138 - DNA, 20 bp, Homo sapiens
aatgggctcttccaacaagg

SEQ ID NO: 3134139 - DNA, 14 bp, Homo sapiens
aatggtaataagca

SEQ ID NO: 3134140 - DNA, 18 bp, Homo sapiens
aatggtaggcatttccta

SEQ ID NO: 3134141 - DNA, 16 bp, Homo sapiens
aatggtataaatttca

SEQ ID NO: 3134142 - DNA, 16 bp, Homo sapiens
aatggtatcaaaatta

SEQ ID NO: 3134143 - DNA, 15 bp, Homo sapiens
aatggtcctgacttt

SEQ ID NO: 3134144 - DNA, 15 bp, Homo sapiens
aatggtgaacatttt

SEQ ID NO: 3134145 - DNA, 15 bp, Homo sapiens
aatggtgaatgttca

SEQ ID NO: 3134146 - DNA, 17 bp, Homo sapiens
aatggtgatcctctatt

SEQ ID NO: 3134147 - DNA, 20 bp, Homo sapiens
aatggtgatcctctattttg

SEQ ID NO: 3134148 - DNA, 23 bp, Homo sapiens
aatggtgatcctctattttgtga

SEQ ID NO: 3134149 - DNA, 19 bp, Homo sapiens
aatggtgcattgtatagat

SEQ ID NO: 3134150 - DNA, 14 bp, Homo sapiens
aatggttccatgcc

SEQ ID NO: 3134151 - DNA, 19 bp, Homo sapiens
aatggttccatgcctgagg

SEQ ID NO: 3134152 - DNA, 15 bp, Homo sapiens
aatggttctgaaata

SEQ ID NO: 3134153 - DNA, 19 bp, Homo sapiens
aatggttgatggaaaataa

SEQ ID NO: 3134154 - DNA, 18 bp, Homo sapiens
aatggttgccttaaagaa

SEQ ID NO: 3134155 - DNA, 21 bp, Homo sapiens
aatggtttattttgtattgtg

SEQ ID NO: 3134156 - DNA, 23 bp, Homo sapiens
aatggtttggtgctttttataaa

SEQ ID NO: 3134157 - DNA, 14 bp, Homo sapiens
aatggttttcaaaa

SEQ ID NO: 3134158 - DNA, 17 bp, Homo sapiens
aatgtaaaaaagaaaaa

SEQ ID NO: 3134159 - DNA, 19 bp, Homo sapiens
aatgtaaaagaaaattttt

SEQ ID NO: 3134160 - DNA, 18 bp, Homo sapiens
aattgctttgccaaaata

SEQ ID NO: 3134161 - DNA, 23 bp, Homo sapiens
aattgctttgccaaaataccaga

SEQ ID NO: 3134162 - DNA, 17 bp, Homo sapiens
aattgcttttgttgtga

SEQ ID NO: 3134163 - DNA, 22 bp, Homo sapiens
aattgcttttgttgtgactttt

SEQ ID NO: 3134164 - DNA, 23 bp, Homo sapiens
aattggggctgtcgggggctgtg

SEQ ID NO: 3134165 - DNA, 21 bp, Homo sapiens
aattggtaaaactcactgtga

SEQ ID NO: 3134166 - DNA, 18 bp, Homo sapiens
aattggtatcaagaaagt

SEQ ID NO: 3134167 - DNA, 18 bp, Homo sapiens
aattggtgctatttgaag

SEQ ID NO: 3134168 - DNA, 21 bp, Homo sapiens
aattggttggagaatttaggt

SEQ ID NO: 3134169 - DNA, 15 bp, Homo sapiens
aattgtaaactgtac

SEQ ID NO: 3134170 - DNA, 13 bp, Homo sapiens
aattgtaatctga

SEQ ID NO: 3134171 - DNA, 20 bp, Homo sapiens
aattgtacaaaattaagcaa

SEQ ID NO: 3134172 - DNA, 23 bp, Homo sapiens
aattgtagttctgtgtacttttt

SEQ ID NO: 3134173 - DNA, 14 bp, Homo sapiens
aattgtataagtca

SEQ ID NO: 3134174 - DNA, 16 bp, Homo sapiens
aattgtataagtcaag

SEQ ID NO: 3134175 - DNA, 18 bp, Homo sapiens
aattgtataagtcaagca

SEQ ID NO: 3134176 - DNA, 19 bp, Homo sapiens
aattgtataagtcaagcac

SEQ ID NO: 3134177 - DNA, 21 bp, Homo sapiens
aattgtataagtcaagcacat

SEQ ID NO: 3134178 - DNA, 22 bp, Homo sapiens
aattgtatacattttgttatag

SEQ ID NO: 3134179 - DNA, 22 bp, Homo sapiens
aattgtatcagaggcctataat

SEQ ID NO: 3134180 - DNA, 18 bp, Homo sapiens
aattgtatcatttgaaca

SEQ ID NO: 3134181 - DNA, 23 bp, Homo sapiens
aattgtatctagtgcagctgatt

SEQ ID NO: 3134182 - DNA, 19 bp, Homo sapiens
aattgtatcttattataaa

SEQ ID NO: 3134183 - DNA, 20 bp, Homo sapiens
aattgtatcttattataaaa

SEQ ID NO: 3134184 - DNA, 23 bp, Homo sapiens
aattgtcacctctgttaaggttg

SEQ ID NO: 3134185 - DNA, 20 bp, Homo sapiens
aattgtcattatttttgtta

SEQ ID NO: 3134186 - DNA, 18 bp, Homo sapiens
aattgtcgaaaagagtct

SEQ ID NO: 3134187 - DNA, 19 bp, Homo sapiens
aattgtctaaaatgtcagt

SEQ ID NO: 3134188 - DNA, 18 bp, Homo sapiens
aattgtctttaatttctg

SEQ ID NO: 3134189 - DNA, 12 bp, Homo sapiens
aattgtgaaaaa

SEQ ID NO: 3134190 - DNA, 21 bp, Homo sapiens
aattgtgcttctccccagaat

SEQ ID NO: 3134191 - DNA, 20 bp, Homo sapiens
aattgtgggcataaactgtt

SEQ ID NO: 3134192 - DNA, 23 bp, Homo sapiens
aattgtgggcataaactgtttca

SEQ ID NO: 3134193 - DNA, 17 bp, Homo sapiens
aattgtgtagccttttt

SEQ ID NO: 3134194 - DNA, 19 bp, Homo sapiens
aattgtgtggattctttaa

SEQ ID NO: 3134195 - DNA, 19 bp, Homo sapiens
aattgtgttgtcttcagca

SEQ ID NO: 3134196 - DNA, 20 bp, Homo sapiens
aattgtgttttaattgtaaa

SEQ ID NO: 3134197 - DNA, 18 bp, Homo sapiens
aattgttgaaattttgca

SEQ ID NO: 3134198 - DNA, 23 bp, Homo sapiens
aattgttgctaatcttcttatgc

SEQ ID NO: 3134199 - DNA, 21 bp, Homo sapiens
aattgtttcagagtcacagtt

SEQ ID NO: 3134200 - DNA, 12 bp, Homo sapiens
aattgtttccaa

SEQ ID NO: 3134201 - DNA, 16 bp, Homo sapiens
aattgtttccaacttg

SEQ ID NO: 3134202 - DNA, 22 bp, Homo sapiens
aattgtttggggatgagaaagg

SEQ ID NO: 3134203 - DNA, 19 bp, Homo sapiens
aattgttttaatctgaaat

SEQ ID NO: 3134204 - DNA, 17 bp, Homo sapiens
aattgttttcacttgta

SEQ ID NO: 3134205 - DNA, 18 bp, Homo sapiens
aattgttttcacttgtat

SEQ ID NO: 3134206 - DNA, 15 bp, Homo sapiens
aattgttttctttaa

SEQ ID NO: 3134207 - DNA, 19 bp, Homo sapiens
aattgttttttaaagcaag

SEQ ID NO: 3134208 - DNA, 17 bp, Homo sapiens
aatttaaaaaaatacag

SEQ ID NO: 3134209 - DNA, 15 bp, Homo sapiens
aatttaaaagtaaaa

SEQ ID NO: 3134210 - DNA, 16 bp, Homo sapiens
aatttaaaagtaaaat

SEQ ID NO: 3134211 - DNA, 16 bp, Homo sapiens
aatttaaaattaagta

SEQ ID NO: 3134212 - DNA, 18 bp, Homo sapiens
aatttaaaattaagtaga

SEQ ID NO: 3134213 - DNA, 11 bp, Homo sapiens
aatttaaacag

SEQ ID NO: 3134214 - DNA, 18 bp, Homo sapiens
aatttaaacaggcccagc

SEQ ID NO: 3134215 - DNA, 22 bp, Homo sapiens
aatttaaacattaaaaatggaa

SEQ ID NO: 3134216 - DNA, 17 bp, Homo sapiens
aatttaaagatattgtt

SEQ ID NO: 3134217 - DNA, 21 bp, Homo sapiens
aatttaaagggtgtacttata

SEQ ID NO: 3134218 - DNA, 16 bp, Homo sapiens
aatttaaatataattc

SEQ ID NO: 3134219 - DNA, 22 bp, Homo sapiens
aatttaaatgaaagaaaattga

SEQ ID NO: 3134220 - DNA, 11 bp, Homo sapiens
aatttaaattt

SEQ ID NO: 3134221 - DNA, 19 bp, Homo sapiens
aatttaacatagtaattct

SEQ ID NO: 3134222 - DNA, 11 bp, Homo sapiens
aatttaagcat

SEQ ID NO: 3134223 - DNA, 12 bp, Homo sapiens
aatttaagcatt

SEQ ID NO: 3134224 - DNA, 15 bp, Homo sapiens
aatttaagcattgtt

SEQ ID NO: 3134225 - DNA, 23 bp, Homo sapiens
aatttaagcattgtttgcttatt

SEQ ID NO: 3134226 - DNA, 17 bp, Homo sapiens
aatttaaggaacacaga

SEQ ID NO: 3134227 - DNA, 19 bp, Homo sapiens
aatttaagtcattttcatg

SEQ ID NO: 3134228 - DNA, 16 bp, Homo sapiens
aatttaagtgcgtgtg

SEQ ID NO: 3134229 - DNA, 12 bp, Homo sapiens
aatttaatgaaa

SEQ ID NO: 3134230 - DNA, 14 bp, Homo sapiens
aatttaatgctgcc

SEQ ID NO: 3134231 - DNA, 21 bp, Homo sapiens
aatttaattaggggttgctaa

SEQ ID NO: 3134232 - DNA, 19 bp, Homo sapiens
aatttaatttcttttttcc

SEQ ID NO: 3134233 - DNA, 23 bp, Homo sapiens
aatttacagtctagtacttatta

SEQ ID NO: 3134234 - DNA, 14 bp, Homo sapiens
aatttacatttatc

SEQ ID NO: 3134235 - DNA, 13 bp, Homo sapiens
aatttacctaaga

SEQ ID NO: 3134236 - DNA, 17 bp, Homo sapiens
aatttacctaagattac

SEQ ID NO: 3134237 - DNA, 16 bp, Homo sapiens
aatttactatatatat

SEQ ID NO: 3134238 - DNA, 16 bp, Homo sapiens
aatttactcacagcac

SEQ ID NO: 3134239 - DNA, 18 bp, Homo sapiens
aatttactcacagcactt

SEQ ID NO: 3134240 - DNA, 22 bp, Homo sapiens
aatttactcacagcacttgttt

SEQ ID NO: 3134241 - DNA, 13 bp, Homo sapiens
aatttacttgttt

SEQ ID NO: 3134242 - DNA, 18 bp, Homo sapiens
aatttagaaactgatttc

SEQ ID NO: 3134243 - DNA, 19 bp, Homo sapiens
aatttagaaactgatttct

SEQ ID NO: 3134244 - DNA, 14 bp, Homo sapiens
aatttagatcttat

SEQ ID NO: 3134245 - DNA, 19 bp, Homo sapiens
aatttagccctttaaaacg

SEQ ID NO: 3134246 - DNA, 17 bp, Homo sapiens
aatttagtgtatccata

SEQ ID NO: 3134247 - DNA, 13 bp, Homo sapiens
aatttagttgttt

SEQ ID NO: 3134248 - DNA, 20 bp, Homo sapiens
aatttagtttttgttcttaa

SEQ ID NO: 3134249 - DNA, 23 bp, Homo sapiens
aatttataatgaatactttctta

SEQ ID NO: 3134250 - DNA, 22 bp, Homo sapiens
aatttatccctttacaatgtga

SEQ ID NO: 3134251 - DNA, 18 bp, Homo sapiens
aatttatcctgaaatttc

SEQ ID NO: 3134252 - DNA, 23 bp, Homo sapiens
aatttatcctgaaatttcagatt

SEQ ID NO: 3134253 - DNA, 18 bp, Homo sapiens
aatttatcttgtctctgg

SEQ ID NO: 3134254 - DNA, 19 bp, Homo sapiens
aatttatcttgtctctggg

SEQ ID NO: 3134255 - DNA, 16 bp, Homo sapiens
aatttatgagtttttg

SEQ ID NO: 3134256 - DNA, 14 bp, Homo sapiens
aatttatgggagaa

SEQ ID NO: 3134257 - DNA, 16 bp, Homo sapiens
aatttattaatctaaa

SEQ ID NO: 3134258 - DNA, 18 bp, Homo sapiens
aatttattattgaaattg

SEQ ID NO: 3134259 - DNA, 16 bp, Homo sapiens
aatttattcacatata

SEQ ID NO: 3134260 - DNA, 17 bp, Homo sapiens
aatttattgtctgtcta

SEQ ID NO: 3134261 - DNA, 20 bp, Homo sapiens
aatttattgtctgtctacat

SEQ ID NO: 3134262 - DNA, 12 bp, Homo sapiens
aatttatttaat

SEQ ID NO: 3134263 - DNA, 17 bp, Homo sapiens
aatttatttagttttta

SEQ ID NO: 3134264 - DNA, 16 bp, Homo sapiens
aatttatttcatccag

SEQ ID NO: 3134265 - DNA, 18 bp, Homo sapiens
aatttatttcttaacctt

SEQ ID NO: 3134266 - DNA, 20 bp, Homo sapiens
aatttatttcttaacctttg

SEQ ID NO: 3134267 - DNA, 18 bp, Homo sapiens
aatttcaaggttctaacc

SEQ ID NO: 3134268 - DNA, 21 bp, Homo sapiens
aatttcaataaaagataaatt

SEQ ID NO: 3134269 - DNA, 19 bp, Homo sapiens
aatttcacctgtaaacctg

SEQ ID NO: 3134270 - DNA, 23 bp, Homo sapiens
aatttcactgtctttaattctgt

SEQ ID NO: 3134271 - DNA, 19 bp, Homo sapiens
aatttcagtgtaaagtgtg

SEQ ID NO: 3134272 - DNA, 21 bp, Homo sapiens
aatttcatagctgtacttctt

SEQ ID NO: 3134273 - DNA, 16 bp, Homo sapiens
aatttcatatgctgta

SEQ ID NO: 3134274 - DNA, 16 bp, Homo sapiens
aatttccctcaggttc

SEQ ID NO: 3134275 - DNA, 17 bp, Homo sapiens
aatttcggattttttcc

SEQ ID NO: 3134276 - DNA, 16 bp, Homo sapiens
aatttctaaagataat

SEQ ID NO: 3134277 - DNA, 16 bp, Homo sapiens
aatttctaccatttca

SEQ ID NO: 3134278 - DNA, 19 bp, Homo sapiens
aatttctgaaagatgagta

SEQ ID NO: 3134279 - DNA, 17 bp, Homo sapiens
aatttctgggatattta

SEQ ID NO: 3134280 - DNA, 21 bp, Homo sapiens
aatttctgtgttgccaagctc

SEQ ID NO: 3134281 - DNA, 20 bp, Homo sapiens
aatttcttactaaacatttt

SEQ ID NO: 3134282 - DNA, 14 bp, Homo sapiens
aatttcttcaaaat

SEQ ID NO: 3134283 - DNA, 15 bp, Homo sapiens
aatttgaaaaagttc

SEQ ID NO: 3134284 - DNA, 22 bp, Homo sapiens
aatttgaattatcagcaaagaa

SEQ ID NO: 3134285 - DNA, 18 bp, Homo sapiens
acacaatatgtatgcttt

SEQ ID NO: 3134286 - DNA, 12 bp, Homo sapiens
acacaatgttat

SEQ ID NO: 3134287 - DNA, 13 bp, Homo sapiens
acacaatgttatt

SEQ ID NO: 3134288 - DNA, 16 bp, Homo sapiens
acacaatgttattcgt

SEQ ID NO: 3134289 - DNA, 21 bp, Homo sapiens
acacaatttaattcctctttt

SEQ ID NO: 3134290 - DNA, 18 bp, Homo sapiens
acacacaacgtaaaaata

SEQ ID NO: 3134291 - DNA, 12 bp, Homo sapiens
acacacacacac

SEQ ID NO: 3134292 - DNA, 15 bp, Homo sapiens
acacacacacacaaa

SEQ ID NO: 3134293 - DNA, 14 bp, Homo sapiens
acacacacacgatg

SEQ ID NO: 3134294 - DNA, 16 bp, Homo sapiens
acacacacacgatgca

SEQ ID NO: 3134295 - DNA, 13 bp, Homo sapiens
acacacacacgca

SEQ ID NO: 3134296 - DNA, 13 bp, Homo sapiens
acacacacagctg

SEQ ID NO: 3134297 - DNA, 13 bp, Homo sapiens
acacacacataca

SEQ ID NO: 3134298 - DNA, 14 bp, Homo sapiens
acacacacatgcac

SEQ ID NO: 3134299 - DNA, 15 bp, Homo sapiens
acacacacatgcaca

SEQ ID NO: 3134300 - DNA, 14 bp, Homo sapiens
acacacacgcacgc

SEQ ID NO: 3134301 - DNA, 22 bp, Homo sapiens
acacacacgcgtgcacacacca

SEQ ID NO: 3134302 - DNA, 11 bp, Homo sapiens
acacacagctc

SEQ ID NO: 3134303 - DNA, 12 bp, Homo sapiens
acacacagctct

SEQ ID NO: 3134304 - DNA, 14 bp, Homo sapiens
acacacagctctgt

SEQ ID NO: 3134305 - DNA, 17 bp, Homo sapiens
acacacatgcacacaca

SEQ ID NO: 3134306 - DNA, 17 bp, Homo sapiens
acacaccaggcgctaat

SEQ ID NO: 3134307 - DNA, 12 bp, Homo sapiens
acacaccaggct

SEQ ID NO: 3134308 - DNA, 16 bp, Homo sapiens
acacaccaggctgtgg

SEQ ID NO: 3134309 - DNA, 20 bp, Homo sapiens
acacaccccacaccccagcc

SEQ ID NO: 3134310 - DNA, 23 bp, Homo sapiens
acacaccccacaccccagcccac

SEQ ID NO: 3134311 - DNA, 21 bp, Homo sapiens
acacacctccgagacagtcca

SEQ ID NO: 3134312 - DNA, 11 bp, Homo sapiens
acacacgatgc

SEQ ID NO: 3134313 - DNA, 14 bp, Homo sapiens
acacacgatgcatt

SEQ ID NO: 3134314 - DNA, 18 bp, Homo sapiens
acacacgatgcatttaat

SEQ ID NO: 3134315 - DNA, 19 bp, Homo sapiens
acacacgatgcatttaata

SEQ ID NO: 3134316 - DNA, 22 bp, Homo sapiens
acacacgatgcatttaataaag

SEQ ID NO: 3134317 - DNA, 14 bp, Homo sapiens
acacacgcacgcac

SEQ ID NO: 3134318 - DNA, 22 bp, Homo sapiens
acacacgcacggcttcctataa

SEQ ID NO: 3134319 - DNA, 13 bp, Homo sapiens
acacactaatcga

SEQ ID NO: 3134320 - DNA, 20 bp, Homo sapiens
acacactcaaaagacaaaca

SEQ ID NO: 3134321 - DNA, 14 bp, Homo sapiens
acacactcagtgca

SEQ ID NO: 3134322 - DNA, 14 bp, Homo sapiens
acacactgaaagct

SEQ ID NO: 3134323 - DNA, 17 bp, Homo sapiens
acacactgatgcttaga

SEQ ID NO: 3134324 - DNA, 14 bp, Homo sapiens
acacactttttaag

SEQ ID NO: 3134325 - DNA, 14 bp, Homo sapiens
acacagaaatgtgt

SEQ ID NO: 3134326 - DNA, 11 bp, Homo sapiens
acacagaccac

SEQ ID NO: 3134327 - DNA, 12 bp, Homo sapiens
acacagaccacc

SEQ ID NO: 3134328 - DNA, 20 bp, Homo sapiens
acacagactggcaataaact

SEQ ID NO: 3134329 - DNA, 15 bp, Homo sapiens
acacagactttctgt

SEQ ID NO: 3134330 - DNA, 18 bp, Homo sapiens
acacagactttctgtgac

SEQ ID NO: 3134331 - DNA, 13 bp, Homo sapiens
acacagaggaaga

SEQ ID NO: 3134332 - DNA, 16 bp, Homo sapiens
acacagatacacacac

SEQ ID NO: 3134333 - DNA, 17 bp, Homo sapiens
acacagatacacacaca

SEQ ID NO: 3134334 - DNA, 22 bp, Homo sapiens
acacagcacaccagccgctgca

SEQ ID NO: 3134335 - DNA, 22 bp, Homo sapiens
acacagcagcttcaccagagca

SEQ ID NO: 3134336 - DNA, 14 bp, Homo sapiens
acacagcatgtgta

SEQ ID NO: 3134337 - DNA, 21 bp, Homo sapiens
acacagcgtccctagcagtga

SEQ ID NO: 3134338 - DNA, 14 bp, Homo sapiens
acacagctctgtcc

SEQ ID NO: 3134339 - DNA, 18 bp, Homo sapiens
acacagctcttcattcca

SEQ ID NO: 3134340 - DNA, 19 bp, Homo sapiens
acacagctcttctccaggc

SEQ ID NO: 3134341 - DNA, 20 bp, Homo sapiens
acacagctcttctccaggct

SEQ ID NO: 3134342 - DNA, 13 bp, Homo sapiens
acacagctgggca

SEQ ID NO: 3134343 - DNA, 14 bp, Homo sapiens
acacagctgggcaa

SEQ ID NO: 3134344 - DNA, 18 bp, Homo sapiens
acacagctgggcaaagcc

SEQ ID NO: 3134345 - DNA, 11 bp, Homo sapiens
acacagctgtt

SEQ ID NO: 3134346 - DNA, 21 bp, Homo sapiens
acacaggactgaaaagggaat

SEQ ID NO: 3134347 - DNA, 11 bp, Homo sapiens
acacaggcagc

SEQ ID NO: 3134348 - DNA, 19 bp, Homo sapiens
acacaggcccggctccagg

SEQ ID NO: 3134349 - DNA, 16 bp, Homo sapiens
acacagggctctttga

SEQ ID NO: 3134350 - DNA, 22 bp, Homo sapiens
acacaggggtggagtttctgac

SEQ ID NO: 3134351 - DNA, 19 bp, Homo sapiens
acacagtattacttctgct

SEQ ID NO: 3134352 - DNA, 13 bp, Homo sapiens
acacagtattttc

SEQ ID NO: 3134353 - DNA, 18 bp, Homo sapiens
acacagtcaaaataattc

SEQ ID NO: 3134354 - DNA, 16 bp, Homo sapiens
acacagtcagcatgct

SEQ ID NO: 3134355 - DNA, 18 bp, Homo sapiens
acacagttcctgggaaca

SEQ ID NO: 3134356 - DNA, 13 bp, Homo sapiens
acacatacagttt

SEQ ID NO: 3134357 - DNA, 18 bp, Homo sapiens
acacatacgtgcacaggg

SEQ ID NO: 3134358 - DNA, 18 bp, Homo sapiens
acacatagattaatggca

SEQ ID NO: 3134359 - DNA, 21 bp, Homo sapiens
acacatagattaatggcactg

SEQ ID NO: 3134360 - DNA, 13 bp, Homo sapiens
acacatctttcct

SEQ ID NO: 3134361 - DNA, 14 bp, Homo sapiens
acacatgccctcct

SEQ ID NO: 3134362 - DNA, 23 bp, Homo sapiens
acacattatattctcttatgata

SEQ ID NO: 3134363 - DNA, 21 bp, Homo sapiens
acacattgaatgcgctttatt

SEQ ID NO: 3134364 - DNA, 12 bp, Homo sapiens
acacatttgtac

SEQ ID NO: 3134365 - DNA, 18 bp, Homo sapiens
acaccaaagataaggact

SEQ ID NO: 3134366 - DNA, 15 bp, Homo sapiens
acaccaaagttctaa

SEQ ID NO: 3134367 - DNA, 20 bp, Homo sapiens
acaccaatcccagggctggc

SEQ ID NO: 3134368 - DNA, 23 bp, Homo sapiens
acaccaatcccagggctggctct

SEQ ID NO: 3134369 - DNA, 13 bp, Homo sapiens
acaccacacccag

SEQ ID NO: 3134370 - DNA, 18 bp, Homo sapiens
acaccacacccagcctca

SEQ ID NO: 3134371 - DNA, 13 bp, Homo sapiens
acaccacagacac

SEQ ID NO: 3134372 - DNA, 14 bp, Homo sapiens
acaccacagacaca

SEQ ID NO: 3134373 - DNA, 16 bp, Homo sapiens
acaccacagacacaca

SEQ ID NO: 3134374 - DNA, 18 bp, Homo sapiens
acaccacagacacacaca

SEQ ID NO: 3134375 - DNA, 15 bp, Homo sapiens
acaccactgccctgc

SEQ ID NO: 3134376 - DNA, 13 bp, Homo sapiens
acaccactgtact

SEQ ID NO: 3134377 - DNA, 12 bp, Homo sapiens
acaccaggctgt

SEQ ID NO: 3134378 - DNA, 18 bp, Homo sapiens
acaccaggctgtgggcct

SEQ ID NO: 3134379 - DNA, 23 bp, Homo sapiens
acaccagtggcagctgccccagg

SEQ ID NO: 3134380 - DNA, 20 bp, Homo sapiens
acaccagtttgactgtgcta

SEQ ID NO: 3134381 - DNA, 16 bp, Homo sapiens
acaccattaccaaaat

SEQ ID NO: 3134382 - DNA, 17 bp, Homo sapiens
acaccattgaaggctta

SEQ ID NO: 3134383 - DNA, 20 bp, Homo sapiens
acacccaaagcatggactaa

SEQ ID NO: 3134384 - DNA, 22 bp, Homo sapiens
acacccaaagcatggactaacc

SEQ ID NO: 3134385 - DNA, 15 bp, Homo sapiens
acacccaatgctgct

SEQ ID NO: 3134386 - DNA, 16 bp, Homo sapiens
acacccaccctgtgcc

SEQ ID NO: 3134387 - DNA, 20 bp, Homo sapiens
acacccagatggcctgaagc

SEQ ID NO: 3134388 - DNA, 21 bp, Homo sapiens
acacccagcccacttctgcca

SEQ ID NO: 3134389 - DNA, 14 bp, Homo sapiens
acacccagcctcag

SEQ ID NO: 3134390 - DNA, 16 bp, Homo sapiens
acacccagcggccccc

SEQ ID NO: 3134391 - DNA, 18 bp, Homo sapiens
acacccagcggccccccg

SEQ ID NO: 3134392 - DNA, 18 bp, Homo sapiens
acaccccacaccccagcc

SEQ ID NO: 3134393 - DNA, 19 bp, Homo sapiens
acaccccacaccccagccc

SEQ ID NO: 3134394 - DNA, 12 bp, Homo sapiens
acaccccagccc

SEQ ID NO: 3134395 - DNA, 23 bp, Homo sapiens
acacccctgctctacccatgagc

SEQ ID NO: 3134396 - DNA, 17 bp, Homo sapiens
acaccctcaacctcttc

SEQ ID NO: 3134397 - DNA, 18 bp, Homo sapiens
acaccctcaacctcttct

SEQ ID NO: 3134398 - DNA, 19 bp, Homo sapiens
acaccctcccccgccactc

SEQ ID NO: 3134399 - DNA, 22 bp, Homo sapiens
acaccctcgaagcgcgccactc

SEQ ID NO: 3134400 - DNA, 11 bp, Homo sapiens
acaccctgcaa

SEQ ID NO: 3134401 - DNA, 20 bp, Homo sapiens
acaccctgcaaggcccacag

SEQ ID NO: 3134402 - DNA, 14 bp, Homo sapiens
acaccctgcccctg

SEQ ID NO: 3134403 - DNA, 15 bp, Homo sapiens
acaccctgcccctgc

SEQ ID NO: 3134404 - DNA, 17 bp, Homo sapiens
acaccctgcccctggtg

SEQ ID NO: 3134405 - DNA, 22 bp, Homo sapiens
acaccctgtactgttctgtgtc

SEQ ID NO: 3134406 - DNA, 22 bp, Homo sapiens
acaccctttcatctcagagtcc

SEQ ID NO: 3134407 - DNA, 16 bp, Homo sapiens
acaccgggcctggaga

SEQ ID NO: 3134408 - DNA, 18 bp, Homo sapiens
acaccgtacatctgcaat

SEQ ID NO: 3134409 - DNA, 15 bp, Homo sapiens
acacctaccatgctg

SEQ ID NO: 3134410 - DNA, 20 bp, Homo sapiens
acacctcccaccccctgtat

SEQ ID NO: 3134411 - DNA, 14 bp, Homo sapiens
acacctccctactc

SEQ ID NO: 3134412 - DNA, 20 bp, Homo sapiens
acaggagggaacatttccga

SEQ ID NO: 3134413 - DNA, 23 bp, Homo sapiens
acaggagggtatggtgctgctct

SEQ ID NO: 3134414 - DNA, 19 bp, Homo sapiens
acaggagtcagtctctttc

SEQ ID NO: 3134415 - DNA, 23 bp, Homo sapiens
acaggagtcagtctctttctgta

SEQ ID NO: 3134416 - DNA, 16 bp, Homo sapiens
acaggagtgagcacta

SEQ ID NO: 3134417 - DNA, 17 bp, Homo sapiens
acaggagtgtcctcttc

SEQ ID NO: 3134418 - DNA, 14 bp, Homo sapiens
acaggatcagtctg

SEQ ID NO: 3134419 - DNA, 15 bp, Homo sapiens
acaggatcagtctga

SEQ ID NO: 3134420 - DNA, 21 bp, Homo sapiens
acaggatgaggtggtggagtg

SEQ ID NO: 3134421 - DNA, 19 bp, Homo sapiens
acaggatgggggctggcct

SEQ ID NO: 3134422 - DNA, 12 bp, Homo sapiens
acaggcaagcac

SEQ ID NO: 3134423 - DNA, 16 bp, Homo sapiens
acaggcaagcacctcc

SEQ ID NO: 3134424 - DNA, 20 bp, Homo sapiens
acaggcaagcacctcctgcc

SEQ ID NO: 3134425 - DNA, 15 bp, Homo sapiens
acaggcaatgctggc

SEQ ID NO: 3134426 - DNA, 16 bp, Homo sapiens
acaggcaatgctggct

SEQ ID NO: 3134427 - DNA, 17 bp, Homo sapiens
acaggcaatgctggctg

SEQ ID NO: 3134428 - DNA, 19 bp, Homo sapiens
acaggcaatgctggctgtt

SEQ ID NO: 3134429 - DNA, 23 bp, Homo sapiens
acaggcaatgctggctgttggct

SEQ ID NO: 3134430 - DNA, 12 bp, Homo sapiens
acaggcaattcc

SEQ ID NO: 3134431 - DNA, 15 bp, Homo sapiens
acaggcactttgaga

SEQ ID NO: 3134432 - DNA, 15 bp, Homo sapiens
acaggcagatacagg

SEQ ID NO: 3134433 - DNA, 18 bp, Homo sapiens
acaggcagctttctagaa

SEQ ID NO: 3134434 - DNA, 13 bp, Homo sapiens
acaggcaggtcca

SEQ ID NO: 3134435 - DNA, 16 bp, Homo sapiens
acaggcaggtccaggg

SEQ ID NO: 3134436 - DNA, 16 bp, Homo sapiens
acaggcagtgcatgtg

SEQ ID NO: 3134437 - DNA, 22 bp, Homo sapiens
acaggcatgaggaatctgggag

SEQ ID NO: 3134438 - DNA, 20 bp, Homo sapiens
acaggcatgttctctgagga

SEQ ID NO: 3134439 - DNA, 17 bp, Homo sapiens
acaggccatgtgagcca

SEQ ID NO: 3134440 - DNA, 13 bp, Homo sapiens
acaggcccagcat

SEQ ID NO: 3134441 - DNA, 15 bp, Homo sapiens
acaggcccagcattg

SEQ ID NO: 3134442 - DNA, 20 bp, Homo sapiens
acaggcccagcattgctggt

SEQ ID NO: 3134443 - DNA, 13 bp, Homo sapiens
acaggcccagcgc

SEQ ID NO: 3134444 - DNA, 21 bp, Homo sapiens
acaggcccccttgagtggggt

SEQ ID NO: 3134445 - DNA, 16 bp, Homo sapiens
acaggcccggctccag

SEQ ID NO: 3134446 - DNA, 17 bp, Homo sapiens
acaggcccggctccagg

SEQ ID NO: 3134447 - DNA, 21 bp, Homo sapiens
acaggcccggctccaggctcc

SEQ ID NO: 3134448 - DNA, 22 bp, Homo sapiens
acaggcccggctccaggctcct

SEQ ID NO: 3134449 - DNA, 14 bp, Homo sapiens
acaggccctgctcc

SEQ ID NO: 3134450 - DNA, 17 bp, Homo sapiens
acaggccctgctcctgc

SEQ ID NO: 3134451 - DNA, 15 bp, Homo sapiens
acaggcccttcctct

SEQ ID NO: 3134452 - DNA, 22 bp, Homo sapiens
acaggcccttcctctccactgc

SEQ ID NO: 3134453 - DNA, 13 bp, Homo sapiens
acaggcctcacct

SEQ ID NO: 3134454 - DNA, 19 bp, Homo sapiens
acaggcctcacctctaccc

SEQ ID NO: 3134455 - DNA, 15 bp, Homo sapiens
acaggcctgaagata

SEQ ID NO: 3134456 - DNA, 14 bp, Homo sapiens
acaggcgagagagg

SEQ ID NO: 3134457 - DNA, 21 bp, Homo sapiens
acaggctgaagagagggacag

SEQ ID NO: 3134458 - DNA, 14 bp, Homo sapiens
acaggctgggcttc

SEQ ID NO: 3134459 - DNA, 22 bp, Homo sapiens
acaggctgtaaattgaacttcc

SEQ ID NO: 3134460 - DNA, 20 bp, Homo sapiens
acaggctgttctgcactgaa

SEQ ID NO: 3134461 - DNA, 22 bp, Homo sapiens
acaggctgttctgcactgaaaa

SEQ ID NO: 3134462 - DNA, 15 bp, Homo sapiens
acagggaagagcaga

SEQ ID NO: 3134463 - DNA, 16 bp, Homo sapiens
acagggagcctcctgc

SEQ ID NO: 3134464 - DNA, 16 bp, Homo sapiens
acagggagctgggaca

SEQ ID NO: 3134465 - DNA, 19 bp, Homo sapiens
acagggatctgtttgaaca

SEQ ID NO: 3134466 - DNA, 23 bp, Homo sapiens
acagggatctgtttgaacactta

SEQ ID NO: 3134467 - DNA, 12 bp, Homo sapiens
acagggcacacc

SEQ ID NO: 3134468 - DNA, 13 bp, Homo sapiens
acagggcaccaga

SEQ ID NO: 3134469 - DNA, 17 bp, Homo sapiens
acagggcaccagaggcc

SEQ ID NO: 3134470 - DNA, 13 bp, Homo sapiens
acagggccagagg

SEQ ID NO: 3134471 - DNA, 17 bp, Homo sapiens
acagggccagagggagc

SEQ ID NO: 3134472 - DNA, 23 bp, Homo sapiens
acagggccagtggggcctgtgga

SEQ ID NO: 3134473 - DNA, 18 bp, Homo sapiens
acagggcccgcagtgctg

SEQ ID NO: 3134474 - DNA, 19 bp, Homo sapiens
acagggcccgcagtgctgg

SEQ ID NO: 3134475 - DNA, 23 bp, Homo sapiens
acagggcggtaccttgtgcccag

SEQ ID NO: 3134476 - DNA, 19 bp, Homo sapiens
acaggggaggaaaaaagaa

SEQ ID NO: 3134477 - DNA, 17 bp, Homo sapiens
acaggggcaggcctggg

SEQ ID NO: 3134478 - DNA, 23 bp, Homo sapiens
acaggggccccagatctgcctgg

SEQ ID NO: 3134479 - DNA, 20 bp, Homo sapiens
acaggggtggagtttctgac

SEQ ID NO: 3134480 - DNA, 14 bp, Homo sapiens
acagggtctgctct

SEQ ID NO: 3134481 - DNA, 13 bp, Homo sapiens
acagggttttgta

SEQ ID NO: 3134482 - DNA, 18 bp, Homo sapiens
acaggtaaactatcttgg

SEQ ID NO: 3134483 - DNA, 15 bp, Homo sapiens
acaggtaatataaaa

SEQ ID NO: 3134484 - DNA, 22 bp, Homo sapiens
acaggtagaattatctaattta

SEQ ID NO: 3134485 - DNA, 16 bp, Homo sapiens
acaggtatatactttg

SEQ ID NO: 3134486 - DNA, 19 bp, Homo sapiens
acaggtcccacctccagcc

SEQ ID NO: 3134487 - DNA, 21 bp, Homo sapiens
acaggtcccacctccagcccg

SEQ ID NO: 3134488 - DNA, 13 bp, Homo sapiens
acaggtctagact

SEQ ID NO: 3134489 - DNA, 20 bp, Homo sapiens
acaggtgtgaaccaccacac

SEQ ID NO: 3134490 - DNA, 22 bp, Homo sapiens
acaggtgtgagtcaccaagccc

SEQ ID NO: 3134491 - DNA, 21 bp, Homo sapiens
acaggtgtggtgtaatttata

SEQ ID NO: 3134492 - DNA, 14 bp, Homo sapiens
acagtaaaaataaa

SEQ ID NO: 3134493 - DNA, 16 bp, Homo sapiens
acagtaaaaataaaat

SEQ ID NO: 3134494 - DNA, 12 bp, Homo sapiens
acagtaaacatt

SEQ ID NO: 3134495 - DNA, 22 bp, Homo sapiens
acagtaacaaataaagtgcagt

SEQ ID NO: 3134496 - DNA, 16 bp, Homo sapiens
acagtaactttatgtg

SEQ ID NO: 3134497 - DNA, 18 bp, Homo sapiens
acagtaactttatgtgta

SEQ ID NO: 3134498 - DNA, 21 bp, Homo sapiens
acagtaactttatgtgtaaat

SEQ ID NO: 3134499 - DNA, 17 bp, Homo sapiens
acagtaagaacatcata

SEQ ID NO: 3134500 - DNA, 21 bp, Homo sapiens
acagtaagaacatcataaaat

SEQ ID NO: 3134501 - DNA, 15 bp, Homo sapiens
acagtaagatatctc

SEQ ID NO: 3134502 - DNA, 15 bp, Homo sapiens
acagtacagcatgtg

SEQ ID NO: 3134503 - DNA, 18 bp, Homo sapiens
acagtacctgattgtatt

SEQ ID NO: 3134504 - DNA, 19 bp, Homo sapiens
acagtacctgattgtattt

SEQ ID NO: 3134505 - DNA, 18 bp, Homo sapiens
acagtactttattgtaca

SEQ ID NO: 3134506 - DNA, 13 bp, Homo sapiens
acagtagagccag

SEQ ID NO: 3134507 - DNA, 14 bp, Homo sapiens
acagtagtcttgat

SEQ ID NO: 3134508 - DNA, 22 bp, Homo sapiens
acagtatatcccaagtgcactt

SEQ ID NO: 3134509 - DNA, 18 bp, Homo sapiens
acagtatattctttggtt

SEQ ID NO: 3134510 - DNA, 14 bp, Homo sapiens
acagtatttattgg

SEQ ID NO: 3134511 - DNA, 15 bp, Homo sapiens
acagtatttattggt

SEQ ID NO: 3134512 - DNA, 14 bp, Homo sapiens
acagtcaaaataat

SEQ ID NO: 3134513 - DNA, 16 bp, Homo sapiens
acagtcaagatagaaa

SEQ ID NO: 3134514 - DNA, 12 bp, Homo sapiens
acagtcacattc

SEQ ID NO: 3134515 - DNA, 22 bp, Homo sapiens
acagtcactgccactttgcaca

SEQ ID NO: 3134516 - DNA, 23 bp, Homo sapiens
acagtcactgccactttgcacat

SEQ ID NO: 3134517 - DNA, 19 bp, Homo sapiens
acagtcatcatcagggcct

SEQ ID NO: 3134518 - DNA, 20 bp, Homo sapiens
acagtcatcatcagggcctg

SEQ ID NO: 3134519 - DNA, 17 bp, Homo sapiens
acagtcatcgctcgtgt

SEQ ID NO: 3134520 - DNA, 12 bp, Homo sapiens
acagtcctggga

SEQ ID NO: 3134521 - DNA, 18 bp, Homo sapiens
acagtccttaaaaatcac

SEQ ID NO: 3134522 - DNA, 22 bp, Homo sapiens
acagtcctttcccaccattcct

SEQ ID NO: 3134523 - DNA, 14 bp, Homo sapiens
acagtcggaaaagc

SEQ ID NO: 3134524 - DNA, 14 bp, Homo sapiens
acagtctctttaat

SEQ ID NO: 3134525 - DNA, 20 bp, Homo sapiens
acagtctctttaatcttcag

SEQ ID NO: 3134526 - DNA, 18 bp, Homo sapiens
acagtgaaaatgtaagct

SEQ ID NO: 3134527 - DNA, 21 bp, Homo sapiens
acagtgaaaatgtaagctgtt

SEQ ID NO: 3134528 - DNA, 17 bp, Homo sapiens
acagtgaatattgcttt

SEQ ID NO: 3134529 - DNA, 14 bp, Homo sapiens
acagtgacccttcc

SEQ ID NO: 3134530 - DNA, 18 bp, Homo sapiens
acagtgaccttttcttca

SEQ ID NO: 3134531 - DNA, 22 bp, Homo sapiens
acagtgaccttttcttcatttt

SEQ ID NO: 3134532 - DNA, 21 bp, Homo sapiens
acagtgagacagtctggaaag

SEQ ID NO: 3134533 - DNA, 22 bp, Homo sapiens
acagtgagacagtctggaaagt

SEQ ID NO: 3134534 - DNA, 12 bp, Homo sapiens
acagtgagcctg

SEQ ID NO: 3134535 - DNA, 14 bp, Homo sapiens
acagtgagcctgaa

SEQ ID NO: 3134536 - DNA, 13 bp, Homo sapiens
acagtgagctcta

SEQ ID NO: 3134537 - DNA, 22 bp, Homo sapiens
acagtgagtcgaggacagggag

SEQ ID NO: 3134538 - DNA, 19 bp, Homo sapiens
acatttctgatcagaggtg

SEQ ID NO: 3134539 - DNA, 21 bp, Homo sapiens
acatttctttcttgctggctc

SEQ ID NO: 3134540 - DNA, 20 bp, Homo sapiens
acatttgatagaaaggaaca

SEQ ID NO: 3134541 - DNA, 13 bp, Homo sapiens
acatttgatattt

SEQ ID NO: 3134542 - DNA, 14 bp, Homo sapiens
acatttgatatttt

SEQ ID NO: 3134543 - DNA, 14 bp, Homo sapiens
acatttgccttgca

SEQ ID NO: 3134544 - DNA, 17 bp, Homo sapiens
acatttgccttgcagaa

SEQ ID NO: 3134545 - DNA, 15 bp, Homo sapiens
acatttgccttgctg

SEQ ID NO: 3134546 - DNA, 23 bp, Homo sapiens
acatttgctgttttaaacattaa

SEQ ID NO: 3134547 - DNA, 21 bp, Homo sapiens
acatttgctttgttttctaaa

SEQ ID NO: 3134548 - DNA, 15 bp, Homo sapiens
acatttggaatactt

SEQ ID NO: 3134549 - DNA, 18 bp, Homo sapiens
acatttggaatacttttt

SEQ ID NO: 3134550 - DNA, 17 bp, Homo sapiens
acatttggattagaaat

SEQ ID NO: 3134551 - DNA, 12 bp, Homo sapiens
acatttgtatat

SEQ ID NO: 3134552 - DNA, 14 bp, Homo sapiens
acatttgtcagtat

SEQ ID NO: 3134553 - DNA, 22 bp, Homo sapiens
acatttgtgctccattttttct

SEQ ID NO: 3134554 - DNA, 18 bp, Homo sapiens
acattttaaaaacataga

SEQ ID NO: 3134555 - DNA, 23 bp, Homo sapiens
acattttaaaaacatagaaaaat

SEQ ID NO: 3134556 - DNA, 15 bp, Homo sapiens
acattttaaaggata

SEQ ID NO: 3134557 - DNA, 10 bp, Homo sapiens
acattttata

SEQ ID NO: 3134558 - DNA, 21 bp, Homo sapiens
acattttatatttttgtacat

SEQ ID NO: 3134559 - DNA, 18 bp, Homo sapiens
acattttcatgcacagta

SEQ ID NO: 3134560 - DNA, 12 bp, Homo sapiens
acattttccttt

SEQ ID NO: 3134561 - DNA, 16 bp, Homo sapiens
acattttctcagtgtg

SEQ ID NO: 3134562 - DNA, 16 bp, Homo sapiens
acattttctggattct

SEQ ID NO: 3134563 - DNA, 19 bp, Homo sapiens
acattttgttatagaatac

SEQ ID NO: 3134564 - DNA, 14 bp, Homo sapiens
acattttgttgtaa

SEQ ID NO: 3134565 - DNA, 16 bp, Homo sapiens
acattttgttgtaaaa

SEQ ID NO: 3134566 - DNA, 14 bp, Homo sapiens
acatttttacaata

SEQ ID NO: 3134567 - DNA, 21 bp, Homo sapiens
acatttttccgtttgcttttg

SEQ ID NO: 3134568 - DNA, 18 bp, Homo sapiens
acatttttgcacagatta

SEQ ID NO: 3134569 - DNA, 13 bp, Homo sapiens
acatttttttcta

SEQ ID NO: 3134570 - DNA, 20 bp, Homo sapiens
acatttttttctacctataa

SEQ ID NO: 3134571 - DNA, 18 bp, Homo sapiens
acatttttttgcatgcat

SEQ ID NO: 3134572 - DNA, 16 bp, Homo sapiens
accaaaacagttaatc

SEQ ID NO: 3134573 - DNA, 14 bp, Homo sapiens
accaaaacttccaa

SEQ ID NO: 3134574 - DNA, 12 bp, Homo sapiens
accaaaatgaca

SEQ ID NO: 3134575 - DNA, 16 bp, Homo sapiens
accaaaattatagctt

SEQ ID NO: 3134576 - DNA, 14 bp, Homo sapiens
accaaaattttaaa

SEQ ID NO: 3134577 - DNA, 13 bp, Homo sapiens
accaaacaattat

SEQ ID NO: 3134578 - DNA, 14 bp, Homo sapiens
accaaacaattatt

SEQ ID NO: 3134579 - DNA, 13 bp, Homo sapiens
accaaagatgcag

SEQ ID NO: 3134580 - DNA, 12 bp, Homo sapiens
accaaagccacc

SEQ ID NO: 3134581 - DNA, 13 bp, Homo sapiens
accaaagctgccc

SEQ ID NO: 3134582 - DNA, 14 bp, Homo sapiens
accaaagctgccca

SEQ ID NO: 3134583 - DNA, 18 bp, Homo sapiens
accaaagctgcccactgt

SEQ ID NO: 3134584 - DNA, 15 bp, Homo sapiens
accaaaggtttttaa

SEQ ID NO: 3134585 - DNA, 21 bp, Homo sapiens
accaaagtcctttttttccat

SEQ ID NO: 3134586 - DNA, 15 bp, Homo sapiens
accaaagttctaata

SEQ ID NO: 3134587 - DNA, 19 bp, Homo sapiens
accaaataatttcatattc

SEQ ID NO: 3134588 - DNA, 19 bp, Homo sapiens
accaaatatgttaaagttt

SEQ ID NO: 3134589 - DNA, 13 bp, Homo sapiens
accaaatctggaa

SEQ ID NO: 3134590 - DNA, 15 bp, Homo sapiens
accaaatgatgccac

SEQ ID NO: 3134591 - DNA, 16 bp, Homo sapiens
accaaattagcaggtg

SEQ ID NO: 3134592 - DNA, 23 bp, Homo sapiens
accaaattcagcctactgcctcg

SEQ ID NO: 3134593 - DNA, 22 bp, Homo sapiens
accaacatctttgcgaaaagat

SEQ ID NO: 3134594 - DNA, 13 bp, Homo sapiens
accaaccagacag

SEQ ID NO: 3134595 - DNA, 15 bp, Homo sapiens
accaacctttaaaat

SEQ ID NO: 3134596 - DNA, 15 bp, Homo sapiens
accaactgtgttgta

SEQ ID NO: 3134597 - DNA, 22 bp, Homo sapiens
accaacttggttctgcttcaat

SEQ ID NO: 3134598 - DNA, 19 bp, Homo sapiens
accaacttgttgtggctct

SEQ ID NO: 3134599 - DNA, 14 bp, Homo sapiens
accaactttctgta

SEQ ID NO: 3134600 - DNA, 15 bp, Homo sapiens
accaagaactgcatg

SEQ ID NO: 3134601 - DNA, 13 bp, Homo sapiens
accaagagagaaa

SEQ ID NO: 3134602 - DNA, 12 bp, Homo sapiens
accaagcccagt

SEQ ID NO: 3134603 - DNA, 18 bp, Homo sapiens
accaagccgtggcttccc

SEQ ID NO: 3134604 - DNA, 19 bp, Homo sapiens
accaagctgagtttcctat

SEQ ID NO: 3134605 - DNA, 21 bp, Homo sapiens
accaaggaaacgctacctctc

SEQ ID NO: 3134606 - DNA, 12 bp, Homo sapiens
accaaggcagcc

SEQ ID NO: 3134607 - DNA, 18 bp, Homo sapiens
accaaggcagcctccaga

SEQ ID NO: 3134608 - DNA, 24 bp, Homo sapiens
accaaggcagcctccagagccagc

SEQ ID NO: 3134609 - DNA, 24 bp, Homo sapiens
accaagtaaaacaaaaccactggg

SEQ ID NO: 3134610 - DNA, 15 bp, Homo sapiens
accaagtcctggcta

SEQ ID NO: 3134611 - DNA, 20 bp, Homo sapiens
accaagtcctggctacatcc

SEQ ID NO: 3134612 - DNA, 14 bp, Homo sapiens
accaagtgtgctct

SEQ ID NO: 3134613 - DNA, 23 bp, Homo sapiens
accaagtgtgctctttttttaaa

SEQ ID NO: 3134614 - DNA, 16 bp, Homo sapiens
accaatagcccacagc

SEQ ID NO: 3134615 - DNA, 22 bp, Homo sapiens
accaatcccagggctggctctg

SEQ ID NO: 3134616 - DNA, 23 bp, Homo sapiens
accaatcccagggctggctctgc

SEQ ID NO: 3134617 - DNA, 20 bp, Homo sapiens
accaatcttaaacataataa

SEQ ID NO: 3134618 - DNA, 22 bp, Homo sapiens
accaatgccaagataattcact

SEQ ID NO: 3134619 - DNA, 18 bp, Homo sapiens
accaatgctgttgtaaac

SEQ ID NO: 3134620 - DNA, 22 bp, Homo sapiens
accaattataacttattagcag

SEQ ID NO: 3134621 - DNA, 16 bp, Homo sapiens
accaattggttaatct

SEQ ID NO: 3134622 - DNA, 21 bp, Homo sapiens
accaatttggtaaaaatgctg

SEQ ID NO: 3134623 - DNA, 23 bp, Homo sapiens
accaatttggtaaaaatgctgct

SEQ ID NO: 3134624 - DNA, 14 bp, Homo sapiens
accacaaaatatac

SEQ ID NO: 3134625 - DNA, 14 bp, Homo sapiens
accacaaaggccaa

SEQ ID NO: 3134626 - DNA, 18 bp, Homo sapiens
accacaaaggccaaactg

SEQ ID NO: 3134627 - DNA, 19 bp, Homo sapiens
accacaactgacacaggaa

SEQ ID NO: 3134628 - DNA, 11 bp, Homo sapiens
accacacaaag

SEQ ID NO: 3134629 - DNA, 17 bp, Homo sapiens
accacacagaggctgcc

SEQ ID NO: 3134630 - DNA, 16 bp, Homo sapiens
accacacagtccccag

SEQ ID NO: 3134631 - DNA, 18 bp, Homo sapiens
accacacagtccccagac

SEQ ID NO: 3134632 - DNA, 20 bp, Homo sapiens
accacacccagcccacttct

SEQ ID NO: 3134633 - DNA, 23 bp, Homo sapiens
accacacccagcccacttctgcc

SEQ ID NO: 3134634 - DNA, 17 bp, Homo sapiens
accacaccctgtactgt

SEQ ID NO: 3134635 - DNA, 15 bp, Homo sapiens
accacacctccctga

SEQ ID NO: 3134636 - DNA, 22 bp, Homo sapiens
accacacctccctgaaccatcc

SEQ ID NO: 3134637 - DNA, 13 bp, Homo sapiens
accacactgagtt

SEQ ID NO: 3134638 - DNA, 13 bp, Homo sapiens
accacacttgaaa

SEQ ID NO: 3134639 - DNA, 17 bp, Homo sapiens
accacacttgaaacctt

SEQ ID NO: 3134640 - DNA, 13 bp, Homo sapiens
accacagacacac

SEQ ID NO: 3134641 - DNA, 18 bp, Homo sapiens
accacagacacacacacg

SEQ ID NO: 3134642 - DNA, 16 bp, Homo sapiens
accacagccagcacct

SEQ ID NO: 3134643 - DNA, 16 bp, Homo sapiens
accacagggccagagg

SEQ ID NO: 3134644 - DNA, 18 bp, Homo sapiens
accacagggccagaggga

SEQ ID NO: 3134645 - DNA, 20 bp, Homo sapiens
accacaggttttagcattgt

SEQ ID NO: 3134646 - DNA, 19 bp, Homo sapiens
accacagtgggtggcacct

SEQ ID NO: 3134647 - DNA, 21 bp, Homo sapiens
accacatcctccgtccagccg

SEQ ID NO: 3134648 - DNA, 14 bp, Homo sapiens
accacatctgctct

SEQ ID NO: 3134649 - DNA, 14 bp, Homo sapiens
accacatcttgctc

SEQ ID NO: 3134650 - DNA, 18 bp, Homo sapiens
accacatcttgctctgct

SEQ ID NO: 3134651 - DNA, 15 bp, Homo sapiens
accacattaattaat

SEQ ID NO: 3134652 - DNA, 20 bp, Homo sapiens
accaccacacccagcccact

SEQ ID NO: 3134653 - DNA, 14 bp, Homo sapiens
accaccactggcca

SEQ ID NO: 3134654 - DNA, 15 bp, Homo sapiens
accaccactggccac

SEQ ID NO: 3134655 - DNA, 20 bp, Homo sapiens
accaccactggccaccaggc

SEQ ID NO: 3134656 - DNA, 22 bp, Homo sapiens
accaccactggccaccaggctg

SEQ ID NO: 3134657 - DNA, 23 bp, Homo sapiens
accaccactggccaccaggctgg

SEQ ID NO: 3134658 - DNA, 24 bp, Homo sapiens
accaccactggccaccaggctggc

SEQ ID NO: 3134659 - DNA, 17 bp, Homo sapiens
accaccatccaccgctg

SEQ ID NO: 3134660 - DNA, 18 bp, Homo sapiens
accaccccgcctgccctc

SEQ ID NO: 3134661 - DNA, 11 bp, Homo sapiens
accaccctccc

SEQ ID NO: 3134662 - DNA, 21 bp, Homo sapiens
accaccctcccctctcttgca

SEQ ID NO: 3134663 - DNA, 23 bp, Homo sapiens
accaccgcctctggccgccaccc

SEQ ID NO: 3134664 - DNA, 17 bp, Homo sapiens
acccctaagtgcccaaa

SEQ ID NO: 3134665 - DNA, 21 bp, Homo sapiens
acccctagttccctctgctca

SEQ ID NO: 3134666 - DNA, 15 bp, Homo sapiens
acccctcactctggc

SEQ ID NO: 3134667 - DNA, 17 bp, Homo sapiens
acccctcactctggcct

SEQ ID NO: 3134668 - DNA, 18 bp, Homo sapiens
acccctcactctggcctc

SEQ ID NO: 3134669 - DNA, 12 bp, Homo sapiens
acccctccagga

SEQ ID NO: 3134670 - DNA, 16 bp, Homo sapiens
acccctccatgtgggc

SEQ ID NO: 3134671 - DNA, 19 bp, Homo sapiens
acccctccatgtgggctag

SEQ ID NO: 3134672 - DNA, 11 bp, Homo sapiens
acccctcccat

SEQ ID NO: 3134673 - DNA, 19 bp, Homo sapiens
acccctcccattaggacaa

SEQ ID NO: 3134674 - DNA, 14 bp, Homo sapiens
acccctcccctcca

SEQ ID NO: 3134675 - DNA, 17 bp, Homo sapiens
acccctcctcactggcc

SEQ ID NO: 3134676 - DNA, 19 bp, Homo sapiens
acccctcctcactggccat

SEQ ID NO: 3134677 - DNA, 12 bp, Homo sapiens
acccctgcactt

SEQ ID NO: 3134678 - DNA, 11 bp, Homo sapiens
acccctgctcc

SEQ ID NO: 3134679 - DNA, 19 bp, Homo sapiens
acccctgctcccagcctgc

SEQ ID NO: 3134680 - DNA, 20 bp, Homo sapiens
acccctgctcccagcctgct

SEQ ID NO: 3134681 - DNA, 23 bp, Homo sapiens
acccctgctcccagcctgctgag

SEQ ID NO: 3134682 - DNA, 11 bp, Homo sapiens
acccctgggca

SEQ ID NO: 3134683 - DNA, 12 bp, Homo sapiens
acccctgggcag

SEQ ID NO: 3134684 - DNA, 13 bp, Homo sapiens
acccctgggcagg

SEQ ID NO: 3134685 - DNA, 12 bp, Homo sapiens
acccctgtaccc

SEQ ID NO: 3134686 - DNA, 18 bp, Homo sapiens
acccctgtacccagctcc

SEQ ID NO: 3134687 - DNA, 21 bp, Homo sapiens
acccctgtcccatgcaggccc

SEQ ID NO: 3134688 - DNA, 16 bp, Homo sapiens
acccctgtcctcactg

SEQ ID NO: 3134689 - DNA, 21 bp, Homo sapiens
acccctgtgctccgtgcctcc

SEQ ID NO: 3134690 - DNA, 16 bp, Homo sapiens
accccttagcctccct

SEQ ID NO: 3134691 - DNA, 18 bp, Homo sapiens
accccttccatgtggaga

SEQ ID NO: 3134692 - DNA, 13 bp, Homo sapiens
accccttccccag

SEQ ID NO: 3134693 - DNA, 19 bp, Homo sapiens
accccttccccaggcccac

SEQ ID NO: 3134694 - DNA, 20 bp, Homo sapiens
accccttccccaggcccacc

SEQ ID NO: 3134695 - DNA, 21 bp, Homo sapiens
accccttccccaggcccacca

SEQ ID NO: 3134696 - DNA, 15 bp, Homo sapiens
accccttcgctcctg

SEQ ID NO: 3134697 - DNA, 19 bp, Homo sapiens
accccttcgctcctgtgtc

SEQ ID NO: 3134698 - DNA, 17 bp, Homo sapiens
accccttctttgcaggg

SEQ ID NO: 3134699 - DNA, 12 bp, Homo sapiens
acccctttctag

SEQ ID NO: 3134700 - DNA, 11 bp, Homo sapiens
acccctttctt

SEQ ID NO: 3134701 - DNA, 13 bp, Homo sapiens
acccctttcttct

SEQ ID NO: 3134702 - DNA, 13 bp, Homo sapiens
acccgaaatgcca

SEQ ID NO: 3134703 - DNA, 14 bp, Homo sapiens
acccgaaatgccac

SEQ ID NO: 3134704 - DNA, 22 bp, Homo sapiens
acccgatgctgctttcccctgt

SEQ ID NO: 3134705 - DNA, 21 bp, Homo sapiens
acccgccgcctcccacggcac

SEQ ID NO: 3134706 - DNA, 18 bp, Homo sapiens
acccgctcatcactggat

SEQ ID NO: 3134707 - DNA, 21 bp, Homo sapiens
acccggaggggcctggcagcc

SEQ ID NO: 3134708 - DNA, 13 bp, Homo sapiens
acccggctaattt

SEQ ID NO: 3134709 - DNA, 22 bp, Homo sapiens
acccggctcgtgtatttattac

SEQ ID NO: 3134710 - DNA, 22 bp, Homo sapiens
acccggctgggtcggccctgcc

SEQ ID NO: 3134711 - DNA, 14 bp, Homo sapiens
acccggcttcctgt

SEQ ID NO: 3134712 - DNA, 21 bp, Homo sapiens
acccgggaccaaactcacgga

SEQ ID NO: 3134713 - DNA, 20 bp, Homo sapiens
acccggggacccccaactcc

SEQ ID NO: 3134714 - DNA, 13 bp, Homo sapiens
acccgggggagcc

SEQ ID NO: 3134715 - DNA, 18 bp, Homo sapiens
acccgggggagcccagtg

SEQ ID NO: 3134716 - DNA, 20 bp, Homo sapiens
acccgggggagcccagtgaa

SEQ ID NO: 3134717 - DNA, 16 bp, Homo sapiens
acccggtttcttttta

SEQ ID NO: 3134718 - DNA, 17 bp, Homo sapiens
acccgtgagcgcctgtg

SEQ ID NO: 3134719 - DNA, 18 bp, Homo sapiens
acccgttctgctggcctg

SEQ ID NO: 3134720 - DNA, 23 bp, Homo sapiens
acccgttctgctggcctggatct

SEQ ID NO: 3134721 - DNA, 13 bp, Homo sapiens
accctaatgtctt

SEQ ID NO: 3134722 - DNA, 23 bp, Homo sapiens
accctaatgtcttcataaagtac

SEQ ID NO: 3134723 - DNA, 16 bp, Homo sapiens
accctacctgtgcctg

SEQ ID NO: 3134724 - DNA, 14 bp, Homo sapiens
accctactctggat

SEQ ID NO: 3134725 - DNA, 17 bp, Homo sapiens
accctactctggatggt

SEQ ID NO: 3134726 - DNA, 19 bp, Homo sapiens
accctactttgcttccgcc

SEQ ID NO: 3134727 - DNA, 17 bp, Homo sapiens
accctagccattcctgg

SEQ ID NO: 3134728 - DNA, 19 bp, Homo sapiens
accctagccattcctggta

SEQ ID NO: 3134729 - DNA, 12 bp, Homo sapiens
accctagccttg

SEQ ID NO: 3134730 - DNA, 22 bp, Homo sapiens
accctaggttcccggtcccgag

SEQ ID NO: 3134731 - DNA, 23 bp, Homo sapiens
accctaggttccctgttcttcct

SEQ ID NO: 3134732 - DNA, 15 bp, Homo sapiens
accctagttctacct

SEQ ID NO: 3134733 - DNA, 23 bp, Homo sapiens
accctatattttgcatagtacca

SEQ ID NO: 3134734 - DNA, 15 bp, Homo sapiens
accctatctcctgac

SEQ ID NO: 3134735 - DNA, 18 bp, Homo sapiens
accctatctcctgacaga

SEQ ID NO: 3134736 - DNA, 19 bp, Homo sapiens
accctcacacacacagctg

SEQ ID NO: 3134737 - DNA, 21 bp, Homo sapiens
accctcactctgccagggcag

SEQ ID NO: 3134738 - DNA, 11 bp, Homo sapiens
accctcagagc

SEQ ID NO: 3134739 - DNA, 16 bp, Homo sapiens
accctcagcacccctt

SEQ ID NO: 3134740 - DNA, 19 bp, Homo sapiens
accctcagcaccccttcca

SEQ ID NO: 3134741 - DNA, 22 bp, Homo sapiens
accctcagcaccccttccatgt

SEQ ID NO: 3134742 - DNA, 11 bp, Homo sapiens
accctcaggaa

SEQ ID NO: 3134743 - DNA, 19 bp, Homo sapiens
accctcaggcataggcctg

SEQ ID NO: 3134744 - DNA, 22 bp, Homo sapiens
accctcaggcataggcctgggt

SEQ ID NO: 3134745 - DNA, 23 bp, Homo sapiens
accctcatggcccccaggggcag

SEQ ID NO: 3134746 - DNA, 22 bp, Homo sapiens
accctccaagtctgtacctcaa

SEQ ID NO: 3134747 - DNA, 16 bp, Homo sapiens
accctccaccctgtcc

SEQ ID NO: 3134748 - DNA, 15 bp, Homo sapiens
accctccacttcccg

SEQ ID NO: 3134749 - DNA, 13 bp, Homo sapiens
accctccatgctc

SEQ ID NO: 3134750 - DNA, 16 bp, Homo sapiens
accctccatgctcctc

SEQ ID NO: 3134751 - DNA, 14 bp, Homo sapiens
accctcccaccccc

SEQ ID NO: 3134752 - DNA, 23 bp, Homo sapiens
accctcccacccccttctctgct

SEQ ID NO: 3134753 - DNA, 17 bp, Homo sapiens
accctcccatggcacct

SEQ ID NO: 3134754 - DNA, 15 bp, Homo sapiens
accctcccccgcagc

SEQ ID NO: 3134755 - DNA, 18 bp, Homo sapiens
accctcccctctcttgca

SEQ ID NO: 3134756 - DNA, 11 bp, Homo sapiens
accctcctctt

SEQ ID NO: 3134757 - DNA, 14 bp, Homo sapiens
accctcctcttgga

SEQ ID NO: 3134758 - DNA, 13 bp, Homo sapiens
accctcctggctc

SEQ ID NO: 3134759 - DNA, 20 bp, Homo sapiens
accctcgaagcgcgccactc

SEQ ID NO: 3134760 - DNA, 14 bp, Homo sapiens
accctcgggcccac

SEQ ID NO: 3134761 - DNA, 15 bp, Homo sapiens
accctcgggcccacc

SEQ ID NO: 3134762 - DNA, 18 bp, Homo sapiens
accctcgggcccacctgg

SEQ ID NO: 3134763 - DNA, 21 bp, Homo sapiens
accctcgggcccacctggcca

SEQ ID NO: 3134764 - DNA, 19 bp, Homo sapiens
accctcgggccccatcctc

SEQ ID NO: 3134765 - DNA, 21 bp, Homo sapiens
accctcggggggtcacaggcc

SEQ ID NO: 3134766 - DNA, 16 bp, Homo sapiens
accctctcagctccag

SEQ ID NO: 3134767 - DNA, 21 bp, Homo sapiens
accctctcctgggggtggcag

SEQ ID NO: 3134768 - DNA, 23 bp, Homo sapiens
accctctcctgggggtggcaggc

SEQ ID NO: 3134769 - DNA, 21 bp, Homo sapiens
accctctgcagaacagtgaaa

SEQ ID NO: 3134770 - DNA, 13 bp, Homo sapiens
accctctgccacc

SEQ ID NO: 3134771 - DNA, 23 bp, Homo sapiens
accctctggaggggtgtggctcc

SEQ ID NO: 3134772 - DNA, 11 bp, Homo sapiens
accctctggcc

SEQ ID NO: 3134773 - DNA, 13 bp, Homo sapiens
accctctgggaac

SEQ ID NO: 3134774 - DNA, 15 bp, Homo sapiens
accctctgggaacct

SEQ ID NO: 3134775 - DNA, 20 bp, Homo sapiens
accctctgggaacctcccag

SEQ ID NO: 3134776 - DNA, 15 bp, Homo sapiens
accctcttcctgtga

SEQ ID NO: 3134777 - DNA, 17 bp, Homo sapiens
accctcttcctgtgatc

SEQ ID NO: 3134778 - DNA, 19 bp, Homo sapiens
accctcttcctgtgatcca

SEQ ID NO: 3134779 - DNA, 22 bp, Homo sapiens
accctgaatggttccatgcctg

SEQ ID NO: 3134780 - DNA, 15 bp, Homo sapiens
accctgagactccag

SEQ ID NO: 3134781 - DNA, 16 bp, Homo sapiens
accctgagttcatcca

SEQ ID NO: 3134782 - DNA, 14 bp, Homo sapiens
accctgatgaaaac

SEQ ID NO: 3134783 - DNA, 17 bp, Homo sapiens
accctgatttcttgctt

SEQ ID NO: 3134784 - DNA, 19 bp, Homo sapiens
accctgcaaacagaacagg

SEQ ID NO: 3134785 - DNA, 23 bp, Homo sapiens
accctgcaaacagaacagggtca

SEQ ID NO: 3134786 - DNA, 18 bp, Homo sapiens
accctgcaaggcccacag

SEQ ID NO: 3134787 - DNA, 14 bp, Homo sapiens
accctgcacctgct

SEQ ID NO: 3134788 - DNA, 23 bp, Homo sapiens
accctgcacctgctgcgtcccca

SEQ ID NO: 3134789 - DNA, 23 bp, Homo sapiens
accctgcccctgcaaagacagta

SEQ ID NO: 3134790 - DNA, 19 bp, Homo sapiens
accttaccaactttctgta

SEQ ID NO: 3134791 - DNA, 21 bp, Homo sapiens
accttactgtggaggaaggat

SEQ ID NO: 3134792 - DNA, 17 bp, Homo sapiens
accttaggccttcctct

SEQ ID NO: 3134793 - DNA, 20 bp, Homo sapiens
accttaggccttcctctctc

SEQ ID NO: 3134794 - DNA, 22 bp, Homo sapiens
accttatagttactgtgtaatt

SEQ ID NO: 3134795 - DNA, 11 bp, Homo sapiens
accttatctgt

SEQ ID NO: 3134796 - DNA, 14 bp, Homo sapiens
accttattgtacct

SEQ ID NO: 3134797 - DNA, 20 bp, Homo sapiens
accttattgtacctctctta

SEQ ID NO: 3134798 - DNA, 18 bp, Homo sapiens
accttcaattcctgggcc

SEQ ID NO: 3134799 - DNA, 18 bp, Homo sapiens
accttcacctcggaggga

SEQ ID NO: 3134800 - DNA, 15 bp, Homo sapiens
accttcatccagatt

SEQ ID NO: 3134801 - DNA, 21 bp, Homo sapiens
accttcatttcaggagggatt

SEQ ID NO: 3134802 - DNA, 11 bp, Homo sapiens
accttccaaac

SEQ ID NO: 3134803 - DNA, 14 bp, Homo sapiens
accttccagctcct

SEQ ID NO: 3134804 - DNA, 14 bp, Homo sapiens
accttccaggaccc

SEQ ID NO: 3134805 - DNA, 15 bp, Homo sapiens
accttccaggacccc

SEQ ID NO: 3134806 - DNA, 16 bp, Homo sapiens
accttccattcacacc

SEQ ID NO: 3134807 - DNA, 21 bp, Homo sapiens
accttcccaaacgcctcccct

SEQ ID NO: 3134808 - DNA, 16 bp, Homo sapiens
accttcctcacttcca

SEQ ID NO: 3134809 - DNA, 17 bp, Homo sapiens
accttcctcacttccat

SEQ ID NO: 3134810 - DNA, 15 bp, Homo sapiens
accttcctcctgcag

SEQ ID NO: 3134811 - DNA, 18 bp, Homo sapiens
accttcctcctgcagaca

SEQ ID NO: 3134812 - DNA, 15 bp, Homo sapiens
accttcctctggggc

SEQ ID NO: 3134813 - DNA, 16 bp, Homo sapiens
accttccttcctgctt

SEQ ID NO: 3134814 - DNA, 15 bp, Homo sapiens
accttccttcctgtt

SEQ ID NO: 3134815 - DNA, 15 bp, Homo sapiens
accttcgagtagaga

SEQ ID NO: 3134816 - DNA, 16 bp, Homo sapiens
accttcgggctgtgcc

SEQ ID NO: 3134817 - DNA, 17 bp, Homo sapiens
accttcgggctgtgccc

SEQ ID NO: 3134818 - DNA, 15 bp, Homo sapiens
accttctagaattat

SEQ ID NO: 3134819 - DNA, 17 bp, Homo sapiens
accttctagaattataa

SEQ ID NO: 3134820 - DNA, 15 bp, Homo sapiens
accttctgagtacag

SEQ ID NO: 3134821 - DNA, 15 bp, Homo sapiens
accttctgagtattc

SEQ ID NO: 3134822 - DNA, 12 bp, Homo sapiens
accttctgcctt

SEQ ID NO: 3134823 - DNA, 17 bp, Homo sapiens
accttctggtatcttgt

SEQ ID NO: 3134824 - DNA, 21 bp, Homo sapiens
accttctgtccccagccctgt

SEQ ID NO: 3134825 - DNA, 12 bp, Homo sapiens
accttctgtggc

SEQ ID NO: 3134826 - DNA, 17 bp, Homo sapiens
accttctttctggactg

SEQ ID NO: 3134827 - DNA, 22 bp, Homo sapiens
accttctttgtaatcccttcac

SEQ ID NO: 3134828 - DNA, 20 bp, Homo sapiens
accttgaaaataagaataga

SEQ ID NO: 3134829 - DNA, 21 bp, Homo sapiens
accttgaagtgactgttgtac

SEQ ID NO: 3134830 - DNA, 22 bp, Homo sapiens
accttgaccaaaatcagctttg

SEQ ID NO: 3134831 - DNA, 17 bp, Homo sapiens
accttgacttgattagt

SEQ ID NO: 3134832 - DNA, 22 bp, Homo sapiens
accttgaggtcttttgacatgt

SEQ ID NO: 3134833 - DNA, 20 bp, Homo sapiens
accttgctaattttctcaaa

SEQ ID NO: 3134834 - DNA, 19 bp, Homo sapiens
accttgctgtcctgatctg

SEQ ID NO: 3134835 - DNA, 18 bp, Homo sapiens
accttggacatcctcctc

SEQ ID NO: 3134836 - DNA, 17 bp, Homo sapiens
accttggagagacacag

SEQ ID NO: 3134837 - DNA, 17 bp, Homo sapiens
accttggctctgccagt

SEQ ID NO: 3134838 - DNA, 18 bp, Homo sapiens
accttggctgcagggagt

SEQ ID NO: 3134839 - DNA, 14 bp, Homo sapiens
accttgtaaaaaaa

SEQ ID NO: 3134840 - DNA, 17 bp, Homo sapiens
accttgtaaaaaaagca

SEQ ID NO: 3134841 - DNA, 21 bp, Homo sapiens
accttgtaaaaaaagcaaaaa

SEQ ID NO: 3134842 - DNA, 18 bp, Homo sapiens
accttgtaaccagtgcag

SEQ ID NO: 3134843 - DNA, 23 bp, Homo sapiens
accttgtgcccagggttttgccc

SEQ ID NO: 3134844 - DNA, 15 bp, Homo sapiens
accttgttacttctg

SEQ ID NO: 3134845 - DNA, 17 bp, Homo sapiens
accttgttacttctgag

SEQ ID NO: 3134846 - DNA, 20 bp, Homo sapiens
accttgtttattaaattgca

SEQ ID NO: 3134847 - DNA, 16 bp, Homo sapiens
acctttaaaattgtca

SEQ ID NO: 3134848 - DNA, 22 bp, Homo sapiens
acctttaagaattttaaatatt

SEQ ID NO: 3134849 - DNA, 15 bp, Homo sapiens
acctttactgtgctt

SEQ ID NO: 3134850 - DNA, 21 bp, Homo sapiens
acctttagggcagcttgcccc

SEQ ID NO: 3134851 - DNA, 15 bp, Homo sapiens
acctttatggtttct

SEQ ID NO: 3134852 - DNA, 17 bp, Homo sapiens
acctttcaaatttcaca

SEQ ID NO: 3134853 - DNA, 19 bp, Homo sapiens
acctttcaccctcatgaaa

SEQ ID NO: 3134854 - DNA, 18 bp, Homo sapiens
acctttcacctttgtgta

SEQ ID NO: 3134855 - DNA, 21 bp, Homo sapiens
acctttcacctttgtgtattt

SEQ ID NO: 3134856 - DNA, 11 bp, Homo sapiens
acctttcatac

SEQ ID NO: 3134857 - DNA, 18 bp, Homo sapiens
acctttccaccacagcca

SEQ ID NO: 3134858 - DNA, 19 bp, Homo sapiens
acctttccgctgtcgcccc

SEQ ID NO: 3134859 - DNA, 13 bp, Homo sapiens
acctttctctctc

SEQ ID NO: 3134860 - DNA, 18 bp, Homo sapiens
acctttgctatgtaaggg

SEQ ID NO: 3134861 - DNA, 21 bp, Homo sapiens
acctttgtaagacatttgtat

SEQ ID NO: 3134862 - DNA, 15 bp, Homo sapiens
acctttgtagttact

SEQ ID NO: 3134863 - DNA, 16 bp, Homo sapiens
acctttgttttttgtt

SEQ ID NO: 3134864 - DNA, 15 bp, Homo sapiens
accttttatgtagca

SEQ ID NO: 3134865 - DNA, 15 bp, Homo sapiens
accttttatgtagta

SEQ ID NO: 3134866 - DNA, 20 bp, Homo sapiens
accttttattgacacagaaa

SEQ ID NO: 3134867 - DNA, 11 bp, Homo sapiens
accttttcagg

SEQ ID NO: 3134868 - DNA, 16 bp, Homo sapiens
accttttcaggaaaat

SEQ ID NO: 3134869 - DNA, 23 bp, Homo sapiens
accttttccccaaccacagagaa

SEQ ID NO: 3134870 - DNA, 12 bp, Homo sapiens
accttttcttca

SEQ ID NO: 3134871 - DNA, 21 bp, Homo sapiens
accttttgaggagccccagct

SEQ ID NO: 3134872 - DNA, 13 bp, Homo sapiens
accttttgtctct

SEQ ID NO: 3134873 - DNA, 17 bp, Homo sapiens
acctttttcttgatctt

SEQ ID NO: 3134874 - DNA, 23 bp, Homo sapiens
acctttttgcatgatatcttcaa

SEQ ID NO: 3134875 - DNA, 13 bp, Homo sapiens
acctttttgtaaa

SEQ ID NO: 3134876 - DNA, 16 bp, Homo sapiens
accttttttaagattt

SEQ ID NO: 3134877 - DNA, 20 bp, Homo sapiens
accttttttaagatttttct

SEQ ID NO: 3134878 - DNA, 22 bp, Homo sapiens
accttttttaagatttttctca

SEQ ID NO: 3134879 - DNA, 19 bp, Homo sapiens
acgaaacttgttattgtga

SEQ ID NO: 3134880 - DNA, 12 bp, Homo sapiens
acgaaatgttat

SEQ ID NO: 3134881 - DNA, 11 bp, Homo sapiens
acgaagaaaaa

SEQ ID NO: 3134882 - DNA, 23 bp, Homo sapiens
acgaagccttaagccataggccc

SEQ ID NO: 3134883 - DNA, 21 bp, Homo sapiens
acgaatgaaaataactgaatt

SEQ ID NO: 3134884 - DNA, 12 bp, Homo sapiens
acgacaaagctg

SEQ ID NO: 3134885 - DNA, 16 bp, Homo sapiens
acgaccggggccagca

SEQ ID NO: 3134886 - DNA, 14 bp, Homo sapiens
acgactaatcacct

SEQ ID NO: 3134887 - DNA, 14 bp, Homo sapiens
acgacttcagggca

SEQ ID NO: 3134888 - DNA, 19 bp, Homo sapiens
acgagaccctacaggagag

SEQ ID NO: 3134889 - DNA, 15 bp, Homo sapiens
acgagcactggccag

SEQ ID NO: 3134890 - DNA, 22 bp, Homo sapiens
acgaggaatctgtgggtctggg

SEQ ID NO: 3134891 - DNA, 19 bp, Homo sapiens
acgagggaggaacacctga

SEQ ID NO: 3134892 - DNA, 14 bp, Homo sapiens
acgagggctggctg

SEQ ID NO: 3134893 - DNA, 16 bp, Homo sapiens
acgagggctggctggc

SEQ ID NO: 3134894 - DNA, 20 bp, Homo sapiens
acgagggctggctggcctca

SEQ ID NO: 3134895 - DNA, 18 bp, Homo sapiens
acgaggggtgtcttgggc

SEQ ID NO: 3134896 - DNA, 18 bp, Homo sapiens
acgagtcacctgcaagcc

SEQ ID NO: 3134897 - DNA, 17 bp, Homo sapiens
acgagtgggaaggactt

SEQ ID NO: 3134898 - DNA, 13 bp, Homo sapiens
acgatcccctccc

SEQ ID NO: 3134899 - DNA, 14 bp, Homo sapiens
acgatgcatttaat

SEQ ID NO: 3134900 - DNA, 13 bp, Homo sapiens
acgattccttctc

SEQ ID NO: 3134901 - DNA, 16 bp, Homo sapiens
acgattccttctctga

SEQ ID NO: 3134902 - DNA, 18 bp, Homo sapiens
acgattttctccagctca

SEQ ID NO: 3134903 - DNA, 18 bp, Homo sapiens
acgcaaaaccactttcct

SEQ ID NO: 3134904 - DNA, 21 bp, Homo sapiens
acgcaagggcatcaggcactg

SEQ ID NO: 3134905 - DNA, 21 bp, Homo sapiens
acgcaataaatttatatactt

SEQ ID NO: 3134906 - DNA, 23 bp, Homo sapiens
acgcaatgaaaagtcgttttcca

SEQ ID NO: 3134907 - DNA, 13 bp, Homo sapiens
acgcacacacaca

SEQ ID NO: 3134908 - DNA, 16 bp, Homo sapiens
acgcacacagctgagc

SEQ ID NO: 3134909 - DNA, 11 bp, Homo sapiens
acgcacgcaca

SEQ ID NO: 3134910 - DNA, 14 bp, Homo sapiens
acgcacgcacacac

SEQ ID NO: 3134911 - DNA, 16 bp, Homo sapiens
acgcacgctcgctgcc

SEQ ID NO: 3134912 - DNA, 20 bp, Homo sapiens
acgcactgggccacggagga

SEQ ID NO: 3134913 - DNA, 19 bp, Homo sapiens
acgcagaagaaagggtgga

SEQ ID NO: 3134914 - DNA, 15 bp, Homo sapiens
acgcagaggaatttt

SEQ ID NO: 3134915 - DNA, 15 bp, Homo sapiens
acgcagatgatccat

SEQ ID NO: 3134916 - DNA, 15 bp, Homo sapiens
actactgtgttcctg

SEQ ID NO: 3134917 - DNA, 21 bp, Homo sapiens
actactgtgttcctggcaata

SEQ ID NO: 3134918 - DNA, 20 bp, Homo sapiens
actactttaataaagaatta

SEQ ID NO: 3134919 - DNA, 13 bp, Homo sapiens
actactttctctt

SEQ ID NO: 3134920 - DNA, 15 bp, Homo sapiens
actactttctctttt

SEQ ID NO: 3134921 - DNA, 13 bp, Homo sapiens
actagaaattctt

SEQ ID NO: 3134922 - DNA, 14 bp, Homo sapiens
actagaagaaaagc

SEQ ID NO: 3134923 - DNA, 23 bp, Homo sapiens
actagaagggccagtcctgcctg

SEQ ID NO: 3134924 - DNA, 23 bp, Homo sapiens
actagaattcaggtgctttgcta

SEQ ID NO: 3134925 - DNA, 20 bp, Homo sapiens
actagacaccaaagttctaa

SEQ ID NO: 3134926 - DNA, 20 bp, Homo sapiens
actagacattctgtcgcctt

SEQ ID NO: 3134927 - DNA, 15 bp, Homo sapiens
actagactactcaat

SEQ ID NO: 3134928 - DNA, 19 bp, Homo sapiens
actagactcttcactgtta

SEQ ID NO: 3134929 - DNA, 11 bp, Homo sapiens
actagagaaac

SEQ ID NO: 3134930 - DNA, 13 bp, Homo sapiens
actagagacaaat

SEQ ID NO: 3134931 - DNA, 21 bp, Homo sapiens
actagaggaaaccagtttggt

SEQ ID NO: 3134932 - DNA, 20 bp, Homo sapiens
actagagtctgaacagctgt

SEQ ID NO: 3134933 - DNA, 21 bp, Homo sapiens
actagagtctgaacagctgta

SEQ ID NO: 3134934 - DNA, 17 bp, Homo sapiens
actagatactactttct

SEQ ID NO: 3134935 - DNA, 12 bp, Homo sapiens
actagatgtagt

SEQ ID NO: 3134936 - DNA, 13 bp, Homo sapiens
actagatgtagta

SEQ ID NO: 3134937 - DNA, 17 bp, Homo sapiens
actagatgtagtatttt

SEQ ID NO: 3134938 - DNA, 16 bp, Homo sapiens
actagatttgtccttt

SEQ ID NO: 3134939 - DNA, 19 bp, Homo sapiens
actagatttgtccttttat

SEQ ID NO: 3134940 - DNA, 21 bp, Homo sapiens
actagcaggctactgggacct

SEQ ID NO: 3134941 - DNA, 15 bp, Homo sapiens
actagcctctccagg

SEQ ID NO: 3134942 - DNA, 22 bp, Homo sapiens
actagcctttggctctggagac

SEQ ID NO: 3134943 - DNA, 19 bp, Homo sapiens
actagctatctaggtggag

SEQ ID NO: 3134944 - DNA, 12 bp, Homo sapiens
actaggaaaatc

SEQ ID NO: 3134945 - DNA, 17 bp, Homo sapiens
actaggactctgaggct

SEQ ID NO: 3134946 - DNA, 17 bp, Homo sapiens
actagggattcaggctg

SEQ ID NO: 3134947 - DNA, 14 bp, Homo sapiens
actaggtaatgttt

SEQ ID NO: 3134948 - DNA, 15 bp, Homo sapiens
actaggtaatgtttt

SEQ ID NO: 3134949 - DNA, 18 bp, Homo sapiens
actaggttggacagcccc

SEQ ID NO: 3134950 - DNA, 19 bp, Homo sapiens
actagtaagtaattatgca

SEQ ID NO: 3134951 - DNA, 13 bp, Homo sapiens
actagtcacctgg

SEQ ID NO: 3134952 - DNA, 14 bp, Homo sapiens
actagtcacctggg

SEQ ID NO: 3134953 - DNA, 15 bp, Homo sapiens
actagtgacagcttg

SEQ ID NO: 3134954 - DNA, 16 bp, Homo sapiens
actagtgacagcttgt

SEQ ID NO: 3134955 - DNA, 17 bp, Homo sapiens
actagtgtggtgtgttt

SEQ ID NO: 3134956 - DNA, 13 bp, Homo sapiens
actagttacacat

SEQ ID NO: 3134957 - DNA, 18 bp, Homo sapiens
actagttacacatcttca

SEQ ID NO: 3134958 - DNA, 17 bp, Homo sapiens
actagtttgattattat

SEQ ID NO: 3134959 - DNA, 19 bp, Homo sapiens
actagtttgattattatgt

SEQ ID NO: 3134960 - DNA, 20 bp, Homo sapiens
actagtttgattattatgtt

SEQ ID NO: 3134961 - DNA, 17 bp, Homo sapiens
actagttttgtgccagc

SEQ ID NO: 3134962 - DNA, 20 bp, Homo sapiens
actataaagaagtaacaaaa

SEQ ID NO: 3134963 - DNA, 22 bp, Homo sapiens
actataacatatgtacataaat

SEQ ID NO: 3134964 - DNA, 18 bp, Homo sapiens
actataatcaaatgattt

SEQ ID NO: 3134965 - DNA, 20 bp, Homo sapiens
actatagcctaggtgacaga

SEQ ID NO: 3134966 - DNA, 20 bp, Homo sapiens
actatataaccctaggaatt

SEQ ID NO: 3134967 - DNA, 13 bp, Homo sapiens
actatatacatgt

SEQ ID NO: 3134968 - DNA, 16 bp, Homo sapiens
actatatatataaatg

SEQ ID NO: 3134969 - DNA, 22 bp, Homo sapiens
actatatatataaatgtataaa

SEQ ID NO: 3134970 - DNA, 19 bp, Homo sapiens
actatatatatatgccttt

SEQ ID NO: 3134971 - DNA, 18 bp, Homo sapiens
actatatgtacagctctc

SEQ ID NO: 3134972 - DNA, 19 bp, Homo sapiens
actatattcatttccactc

SEQ ID NO: 3134973 - DNA, 16 bp, Homo sapiens
actatcagttccctct

SEQ ID NO: 3134974 - DNA, 13 bp, Homo sapiens
actatcattctca

SEQ ID NO: 3134975 - DNA, 21 bp, Homo sapiens
actatcccaatcaaagaatta

SEQ ID NO: 3134976 - DNA, 15 bp, Homo sapiens
actatcctgacttct

SEQ ID NO: 3134977 - DNA, 21 bp, Homo sapiens
actatctaaatgttgaaagat

SEQ ID NO: 3134978 - DNA, 14 bp, Homo sapiens
actatctgtctggt

SEQ ID NO: 3134979 - DNA, 22 bp, Homo sapiens
actatgaactacaggtgtttga

SEQ ID NO: 3134980 - DNA, 18 bp, Homo sapiens
actatgacagatatattt

SEQ ID NO: 3134981 - DNA, 16 bp, Homo sapiens
actatgataaattatg

SEQ ID NO: 3134982 - DNA, 20 bp, Homo sapiens
actatggaaaatcagctgct

SEQ ID NO: 3134983 - DNA, 18 bp, Homo sapiens
actatggtatgctggcca

SEQ ID NO: 3134984 - DNA, 20 bp, Homo sapiens
actatggtatgctggccagc

SEQ ID NO: 3134985 - DNA, 21 bp, Homo sapiens
actatggtatgctggccagca

SEQ ID NO: 3134986 - DNA, 15 bp, Homo sapiens
actatgtatatacat

SEQ ID NO: 3134987 - DNA, 12 bp, Homo sapiens
actatgtatcaa

SEQ ID NO: 3134988 - DNA, 23 bp, Homo sapiens
actatgtgtgagctttttttaaa

SEQ ID NO: 3134989 - DNA, 22 bp, Homo sapiens
actattcaggagagtagaacag

SEQ ID NO: 3134990 - DNA, 14 bp, Homo sapiens
actattccctttga

SEQ ID NO: 3134991 - DNA, 20 bp, Homo sapiens
actattccctttgacttcag

SEQ ID NO: 3134992 - DNA, 22 bp, Homo sapiens
actattccctttgacttcagct

SEQ ID NO: 3134993 - DNA, 23 bp, Homo sapiens
actattccctttgacttcagctg

SEQ ID NO: 3134994 - DNA, 22 bp, Homo sapiens
actattctcggggccctgtgta

SEQ ID NO: 3134995 - DNA, 16 bp, Homo sapiens
actattggaaagtact

SEQ ID NO: 3134996 - DNA, 19 bp, Homo sapiens
actattggagggtgggaga

SEQ ID NO: 3134997 - DNA, 14 bp, Homo sapiens
actattgttacatt

SEQ ID NO: 3134998 - DNA, 18 bp, Homo sapiens
actatttaaacttataaa

SEQ ID NO: 3134999 - DNA, 11 bp, Homo sapiens
actatttaaag

SEQ ID NO: 3135000 - DNA, 15 bp, Homo sapiens
actatttatctgtgt

SEQ ID NO: 3135001 - DNA, 22 bp, Homo sapiens
actatttctacacagtgggaac

SEQ ID NO: 3135002 - DNA, 16 bp, Homo sapiens
actatttctgttccag

SEQ ID NO: 3135003 - DNA, 13 bp, Homo sapiens
actattttatatg

SEQ ID NO: 3135004 - DNA, 14 bp, Homo sapiens
actattttcagaat

SEQ ID NO: 3135005 - DNA, 18 bp, Homo sapiens
actatttttatttatatt

SEQ ID NO: 3135006 - DNA, 13 bp, Homo sapiens
actatttttgtaa

SEQ ID NO: 3135007 - DNA, 20 bp, Homo sapiens
actatttttgtaaaagacat

SEQ ID NO: 3135008 - DNA, 14 bp, Homo sapiens
actcaaaaataagt

SEQ ID NO: 3135009 - DNA, 16 bp, Homo sapiens
actcaaaaccatctct

SEQ ID NO: 3135010 - DNA, 19 bp, Homo sapiens
actcaaaaccatctctctt

SEQ ID NO: 3135011 - DNA, 19 bp, Homo sapiens
actcaaaagacaaacatgc

SEQ ID NO: 3135012 - DNA, 19 bp, Homo sapiens
actcaaaatatttgtacat

SEQ ID NO: 3135013 - DNA, 14 bp, Homo sapiens
actcaaactgagga

SEQ ID NO: 3135014 - DNA, 14 bp, Homo sapiens
actcaaatgagtaa

SEQ ID NO: 3135015 - DNA, 17 bp, Homo sapiens
actcaaatgagtaacat

SEQ ID NO: 3135016 - DNA, 20 bp, Homo sapiens
actcaaatgtgagtgttttt

SEQ ID NO: 3135017 - DNA, 16 bp, Homo sapiens
actcaaatgttctaag

SEQ ID NO: 3135018 - DNA, 17 bp, Homo sapiens
actcaaatgttctaagt

SEQ ID NO: 3135019 - DNA, 18 bp, Homo sapiens
actcaaatgttctaagtt

SEQ ID NO: 3135020 - DNA, 22 bp, Homo sapiens
actcaaatgttctaagtttcta

SEQ ID NO: 3135021 - DNA, 14 bp, Homo sapiens
actcaaattttggc

SEQ ID NO: 3135022 - DNA, 23 bp, Homo sapiens
actcaaattttggcgaatctcaa

SEQ ID NO: 3135023 - DNA, 21 bp, Homo sapiens
actcaacatgttactgaccag

SEQ ID NO: 3135024 - DNA, 23 bp, Homo sapiens
actcaacatgttactgaccagca

SEQ ID NO: 3135025 - DNA, 17 bp, Homo sapiens
actcaacattactgtta

SEQ ID NO: 3135026 - DNA, 23 bp, Homo sapiens
actcaaccttaagacctactgtt

SEQ ID NO: 3135027 - DNA, 15 bp, Homo sapiens
actcaagcactgata

SEQ ID NO: 3135028 - DNA, 23 bp, Homo sapiens
actcaagtaccaccaagggatct

SEQ ID NO: 3135029 - DNA, 13 bp, Homo sapiens
actcacaaatgat

SEQ ID NO: 3135030 - DNA, 15 bp, Homo sapiens
actcacaggaaggag

SEQ ID NO: 3135031 - DNA, 13 bp, Homo sapiens
actcacatgacac

SEQ ID NO: 3135032 - DNA, 19 bp, Homo sapiens
actcacatttattctgctc

SEQ ID NO: 3135033 - DNA, 21 bp, Homo sapiens
actcacatttattctgctcac

SEQ ID NO: 3135034 - DNA, 15 bp, Homo sapiens
actcacattttctca

SEQ ID NO: 3135035 - DNA, 20 bp, Homo sapiens
actcaccagccccactgcca

SEQ ID NO: 3135036 - DNA, 23 bp, Homo sapiens
actcaccagggtccgcaccagct

SEQ ID NO: 3135037 - DNA, 23 bp, Homo sapiens
actcaccagtgtcccctccactg

SEQ ID NO: 3135038 - DNA, 18 bp, Homo sapiens
actcaccatgaagcgaaa

SEQ ID NO: 3135039 - DNA, 15 bp, Homo sapiens
actcaccctgggagc

SEQ ID NO: 3135040 - DNA, 16 bp, Homo sapiens
actcacctaatgttta

SEQ ID NO: 3135041 - DNA, 22 bp, Homo sapiens
actgatttctatggctttcaaa

SEQ ID NO: 3135042 - DNA, 12 bp, Homo sapiens
actgatttcttc

SEQ ID NO: 3135043 - DNA, 15 bp, Homo sapiens
actgattttgaaaag

SEQ ID NO: 3135044 - DNA, 18 bp, Homo sapiens
actgattttgtaaagttg

SEQ ID NO: 3135045 - DNA, 16 bp, Homo sapiens
actgatttttaagtca

SEQ ID NO: 3135046 - DNA, 16 bp, Homo sapiens
actgcaaaaaaagcct

SEQ ID NO: 3135047 - DNA, 18 bp, Homo sapiens
actgcaaaaaaagcctcc

SEQ ID NO: 3135048 - DNA, 13 bp, Homo sapiens
actgcaacctccg

SEQ ID NO: 3135049 - DNA, 17 bp, Homo sapiens
actgcaacctccgcctc

SEQ ID NO: 3135050 - DNA, 22 bp, Homo sapiens
actgcaacctccgcctcttggg

SEQ ID NO: 3135051 - DNA, 16 bp, Homo sapiens
actgcaacctctgcct

SEQ ID NO: 3135052 - DNA, 17 bp, Homo sapiens
actgcaacctctgcctc

SEQ ID NO: 3135053 - DNA, 20 bp, Homo sapiens
actgcaaccttgtttattaa

SEQ ID NO: 3135054 - DNA, 16 bp, Homo sapiens
actgcaataacttctg

SEQ ID NO: 3135055 - DNA, 20 bp, Homo sapiens
actgcaatcctgtctttctg

SEQ ID NO: 3135056 - DNA, 12 bp, Homo sapiens
actgcacagagc

SEQ ID NO: 3135057 - DNA, 20 bp, Homo sapiens
actgcacagcggcccctgca

SEQ ID NO: 3135058 - DNA, 15 bp, Homo sapiens
actgcacagtgctgt

SEQ ID NO: 3135059 - DNA, 13 bp, Homo sapiens
actgcacccagct

SEQ ID NO: 3135060 - DNA, 22 bp, Homo sapiens
actgcacccagctccaggggcc

SEQ ID NO: 3135061 - DNA, 21 bp, Homo sapiens
actgcactatagcctaggtga

SEQ ID NO: 3135062 - DNA, 17 bp, Homo sapiens
actgcactccagcctgg

SEQ ID NO: 3135063 - DNA, 13 bp, Homo sapiens
actgcacttttag

SEQ ID NO: 3135064 - DNA, 13 bp, Homo sapiens
actgcagaagcaa

SEQ ID NO: 3135065 - DNA, 19 bp, Homo sapiens
actgcagaggggaaagact

SEQ ID NO: 3135066 - DNA, 14 bp, Homo sapiens
actgcagcacctcc

SEQ ID NO: 3135067 - DNA, 21 bp, Homo sapiens
actgcagcacctccaggcctg

SEQ ID NO: 3135068 - DNA, 22 bp, Homo sapiens
actgcagcacctccaggcctgt

SEQ ID NO: 3135069 - DNA, 22 bp, Homo sapiens
actgcagcagaaaggctctgaa

SEQ ID NO: 3135070 - DNA, 20 bp, Homo sapiens
actgcagcttgagtttttag

SEQ ID NO: 3135071 - DNA, 15 bp, Homo sapiens
actgcagctttacat

SEQ ID NO: 3135072 - DNA, 13 bp, Homo sapiens
actgcaggccctg

SEQ ID NO: 3135073 - DNA, 16 bp, Homo sapiens
actgcagggactgcca

SEQ ID NO: 3135074 - DNA, 13 bp, Homo sapiens
actgcagggccag

SEQ ID NO: 3135075 - DNA, 16 bp, Homo sapiens
actgcagggccaggac

SEQ ID NO: 3135076 - DNA, 17 bp, Homo sapiens
actgcagggccaggact

SEQ ID NO: 3135077 - DNA, 22 bp, Homo sapiens
actgcagggcctatatgccagc

SEQ ID NO: 3135078 - DNA, 17 bp, Homo sapiens
actgcaggttggacccc

SEQ ID NO: 3135079 - DNA, 17 bp, Homo sapiens
actgcagtgaccactta

SEQ ID NO: 3135080 - DNA, 23 bp, Homo sapiens
actgcatactttttaaatgtaaa

SEQ ID NO: 3135081 - DNA, 14 bp, Homo sapiens
actgcatggaccta

SEQ ID NO: 3135082 - DNA, 21 bp, Homo sapiens
actgcatgtaccatttgcatg

SEQ ID NO: 3135083 - DNA, 16 bp, Homo sapiens
actgcattctctccca

SEQ ID NO: 3135084 - DNA, 22 bp, Homo sapiens
actgcatttaaatttgatttcc

SEQ ID NO: 3135085 - DNA, 16 bp, Homo sapiens
actgccaaataaacag

SEQ ID NO: 3135086 - DNA, 22 bp, Homo sapiens
actgccaaataaacagctattt

SEQ ID NO: 3135087 - DNA, 15 bp, Homo sapiens
actgccaagccagat

SEQ ID NO: 3135088 - DNA, 18 bp, Homo sapiens
actgccaagccagattct

SEQ ID NO: 3135089 - DNA, 21 bp, Homo sapiens
actgccacactctccatcacc

SEQ ID NO: 3135090 - DNA, 23 bp, Homo sapiens
actgccaccttgtggccgcctga

SEQ ID NO: 3135091 - DNA, 17 bp, Homo sapiens
actgccactttgcacat

SEQ ID NO: 3135092 - DNA, 18 bp, Homo sapiens
actgccactttgcacatt

SEQ ID NO: 3135093 - DNA, 17 bp, Homo sapiens
actgccaggcacctggc

SEQ ID NO: 3135094 - DNA, 16 bp, Homo sapiens
actgccaggccagcct

SEQ ID NO: 3135095 - DNA, 23 bp, Homo sapiens
actgccaggccagcctccgagag

SEQ ID NO: 3135096 - DNA, 17 bp, Homo sapiens
actgccattattttctg

SEQ ID NO: 3135097 - DNA, 18 bp, Homo sapiens
actgccattattttctgt

SEQ ID NO: 3135098 - DNA, 19 bp, Homo sapiens
actgcccaggcctgcctgt

SEQ ID NO: 3135099 - DNA, 13 bp, Homo sapiens
actgccccccgag

SEQ ID NO: 3135100 - DNA, 15 bp, Homo sapiens
actgcccctgctgtg

SEQ ID NO: 3135101 - DNA, 14 bp, Homo sapiens
actgcccgagctgg

SEQ ID NO: 3135102 - DNA, 16 bp, Homo sapiens
actgcccgagctggtg

SEQ ID NO: 3135103 - DNA, 19 bp, Homo sapiens
actgcccgagctggtgcat

SEQ ID NO: 3135104 - DNA, 15 bp, Homo sapiens
actgccctgcctgcc

SEQ ID NO: 3135105 - DNA, 17 bp, Homo sapiens
actgccctgcctgccca

SEQ ID NO: 3135106 - DNA, 18 bp, Homo sapiens
actgcccttgctgcccgc

SEQ ID NO: 3135107 - DNA, 16 bp, Homo sapiens
actgcctataatctta

SEQ ID NO: 3135108 - DNA, 12 bp, Homo sapiens
actgcctcaggt

SEQ ID NO: 3135109 - DNA, 13 bp, Homo sapiens
actgcctctgcca

SEQ ID NO: 3135110 - DNA, 14 bp, Homo sapiens
actgcctcttcctc

SEQ ID NO: 3135111 - DNA, 15 bp, Homo sapiens
actgcctgtatactt

SEQ ID NO: 3135112 - DNA, 16 bp, Homo sapiens
actgcctgtatacttt

SEQ ID NO: 3135113 - DNA, 17 bp, Homo sapiens
actgcctgtatacttta

SEQ ID NO: 3135114 - DNA, 19 bp, Homo sapiens
actgcctgtatactttagt

SEQ ID NO: 3135115 - DNA, 15 bp, Homo sapiens
actgccttcctcctt

SEQ ID NO: 3135116 - DNA, 21 bp, Homo sapiens
actgccttctcctctctgggc

SEQ ID NO: 3135117 - DNA, 23 bp, Homo sapiens
actgcgactttctgcctggagtg

SEQ ID NO: 3135118 - DNA, 20 bp, Homo sapiens
actgcggaaaaggaaggaaa

SEQ ID NO: 3135119 - DNA, 15 bp, Homo sapiens
actgctaaattctat

SEQ ID NO: 3135120 - DNA, 16 bp, Homo sapiens
actgctaaattctatg

SEQ ID NO: 3135121 - DNA, 15 bp, Homo sapiens
actgctacctctgag

SEQ ID NO: 3135122 - DNA, 17 bp, Homo sapiens
actgctagtgttctgtc

SEQ ID NO: 3135123 - DNA, 19 bp, Homo sapiens
actgctagtgttctgtcta

SEQ ID NO: 3135124 - DNA, 16 bp, Homo sapiens
actgctccctgaagcc

SEQ ID NO: 3135125 - DNA, 20 bp, Homo sapiens
actgctccctgaagccagcc

SEQ ID NO: 3135126 - DNA, 22 bp, Homo sapiens
actgctccctgaagccagcctt

SEQ ID NO: 3135127 - DNA, 12 bp, Homo sapiens
actgctgagcca

SEQ ID NO: 3135128 - DNA, 18 bp, Homo sapiens
actgctgatcgtagaaaa

SEQ ID NO: 3135129 - DNA, 21 bp, Homo sapiens
actgctgcccagcctccaagc

SEQ ID NO: 3135130 - DNA, 21 bp, Homo sapiens
actgctgctttttgaggtggc

SEQ ID NO: 3135131 - DNA, 19 bp, Homo sapiens
actgctggagtctggcttt

SEQ ID NO: 3135132 - DNA, 15 bp, Homo sapiens
actgctgtaaaatta

SEQ ID NO: 3135133 - DNA, 22 bp, Homo sapiens
actgctgtaaaattataaactt

SEQ ID NO: 3135134 - DNA, 18 bp, Homo sapiens
actgctgtacccagatgc

SEQ ID NO: 3135135 - DNA, 21 bp, Homo sapiens
actgcttacctactttcttca

SEQ ID NO: 3135136 - DNA, 16 bp, Homo sapiens
actgcttcccatccta

SEQ ID NO: 3135137 - DNA, 17 bp, Homo sapiens
actgcttcccatcctac

SEQ ID NO: 3135138 - DNA, 21 bp, Homo sapiens
actgcttcccttactttgctg

SEQ ID NO: 3135139 - DNA, 21 bp, Homo sapiens
actgcttgaccgtactctcac

SEQ ID NO: 3135140 - DNA, 16 bp, Homo sapiens
actgcttgatgaagca

SEQ ID NO: 3135141 - DNA, 18 bp, Homo sapiens
actgcttgatgaagcaag

SEQ ID NO: 3135142 - DNA, 20 bp, Homo sapiens
actgcttgatgaagcaagga

SEQ ID NO: 3135143 - DNA, 17 bp, Homo sapiens
actgctttccagcctgg

SEQ ID NO: 3135144 - DNA, 20 bp, Homo sapiens
actgcttttttgattctgaa

SEQ ID NO: 3135145 - DNA, 20 bp, Homo sapiens
actggaaaggggagagcctg

SEQ ID NO: 3135146 - DNA, 13 bp, Homo sapiens
actggaagaaagc

SEQ ID NO: 3135147 - DNA, 15 bp, Homo sapiens
actggaagaaagcaa

SEQ ID NO: 3135148 - DNA, 19 bp, Homo sapiens
actggaagacacttcagat

SEQ ID NO: 3135149 - DNA, 21 bp, Homo sapiens
actggaagacacttcagatct

SEQ ID NO: 3135150 - DNA, 15 bp, Homo sapiens
actggaagcacagct

SEQ ID NO: 3135151 - DNA, 16 bp, Homo sapiens
actggaagcacagctt

SEQ ID NO: 3135152 - DNA, 16 bp, Homo sapiens
actggaagctaatttg

SEQ ID NO: 3135153 - DNA, 18 bp, Homo sapiens
actggaaggggaagggac

SEQ ID NO: 3135154 - DNA, 16 bp, Homo sapiens
actggaagttttgcat

SEQ ID NO: 3135155 - DNA, 17 bp, Homo sapiens
actggaagttttgcatt

SEQ ID NO: 3135156 - DNA, 12 bp, Homo sapiens
actggacagacc

SEQ ID NO: 3135157 - DNA, 21 bp, Homo sapiens
actggacagacccaggtcttc

SEQ ID NO: 3135158 - DNA, 16 bp, Homo sapiens
actggaccactgggca

SEQ ID NO: 3135159 - DNA, 23 bp, Homo sapiens
actggagaccgcttcacccctgc

SEQ ID NO: 3135160 - DNA, 13 bp, Homo sapiens
actggagcccagg

SEQ ID NO: 3135161 - DNA, 15 bp, Homo sapiens
actggagctcatctg

SEQ ID NO: 3135162 - DNA, 14 bp, Homo sapiens
actggaggagcagc

SEQ ID NO: 3135163 - DNA, 16 bp, Homo sapiens
actggaggagcagctt

SEQ ID NO: 3135164 - DNA, 23 bp, Homo sapiens
actggaggtgggcatgccaccct

SEQ ID NO: 3135165 - DNA, 19 bp, Homo sapiens
actggaggttgaagccaag

SEQ ID NO: 3135166 - DNA, 13 bp, Homo sapiens
actggagtctgga

SEQ ID NO: 3135167 - DNA, 19 bp, Homo sapiens
acttctgcaacaagcatgc

SEQ ID NO: 3135168 - DNA, 20 bp, Homo sapiens
acttctgccatattctgttg

SEQ ID NO: 3135169 - DNA, 13 bp, Homo sapiens
acttctgcctgga

SEQ ID NO: 3135170 - DNA, 16 bp, Homo sapiens
acttctgcctggagac

SEQ ID NO: 3135171 - DNA, 16 bp, Homo sapiens
acttctggaaggctgg

SEQ ID NO: 3135172 - DNA, 17 bp, Homo sapiens
acttctggaaggctggc

SEQ ID NO: 3135173 - DNA, 16 bp, Homo sapiens
acttctggctcctcaa

SEQ ID NO: 3135174 - DNA, 19 bp, Homo sapiens
acttctgggcttcatctgg

SEQ ID NO: 3135175 - DNA, 22 bp, Homo sapiens
acttctgggcttcatctggcaa

SEQ ID NO: 3135176 - DNA, 15 bp, Homo sapiens
acttctgtaattgtg

SEQ ID NO: 3135177 - DNA, 11 bp, Homo sapiens
acttctgtggg

SEQ ID NO: 3135178 - DNA, 21 bp, Homo sapiens
acttctgtgggcccctcaaca

SEQ ID NO: 3135179 - DNA, 17 bp, Homo sapiens
acttctgtgttcatttt

SEQ ID NO: 3135180 - DNA, 17 bp, Homo sapiens
acttcttaaaggcctgg

SEQ ID NO: 3135181 - DNA, 18 bp, Homo sapiens
acttcttaaaggcctgga

SEQ ID NO: 3135182 - DNA, 20 bp, Homo sapiens
acttcttaaaggcctggaac

SEQ ID NO: 3135183 - DNA, 17 bp, Homo sapiens
acttcttatggaattga

SEQ ID NO: 3135184 - DNA, 20 bp, Homo sapiens
acttcttgtcagacataaag

SEQ ID NO: 3135185 - DNA, 20 bp, Homo sapiens
acttctttctgttgagagaa

SEQ ID NO: 3135186 - DNA, 15 bp, Homo sapiens
acttcttttgaacat

SEQ ID NO: 3135187 - DNA, 18 bp, Homo sapiens
acttgaaaattttttaac

SEQ ID NO: 3135188 - DNA, 23 bp, Homo sapiens
acttgaaagttttccagtattga

SEQ ID NO: 3135189 - DNA, 13 bp, Homo sapiens
acttgaagcagtc

SEQ ID NO: 3135190 - DNA, 22 bp, Homo sapiens
acttgaagtctaaaagcagaaa

SEQ ID NO: 3135191 - DNA, 21 bp, Homo sapiens
acttgacaccaaccagacagc

SEQ ID NO: 3135192 - DNA, 19 bp, Homo sapiens
acttgacccccttgagggt

SEQ ID NO: 3135193 - DNA, 18 bp, Homo sapiens
acttgactccatttcatc

SEQ ID NO: 3135194 - DNA, 21 bp, Homo sapiens
acttgactccatttcatcatt

SEQ ID NO: 3135195 - DNA, 19 bp, Homo sapiens
acttgactctaatatgatt

SEQ ID NO: 3135196 - DNA, 21 bp, Homo sapiens
acttgagaaccagtctcctca

SEQ ID NO: 3135197 - DNA, 12 bp, Homo sapiens
acttgagaggat

SEQ ID NO: 3135198 - DNA, 20 bp, Homo sapiens
acttgagcaccgtcatggct

SEQ ID NO: 3135199 - DNA, 15 bp, Homo sapiens
acttgagggcccaga

SEQ ID NO: 3135200 - DNA, 16 bp, Homo sapiens
acttgagggcccagag

SEQ ID NO: 3135201 - DNA, 20 bp, Homo sapiens
acttgagtgttcctttttaa

SEQ ID NO: 3135202 - DNA, 22 bp, Homo sapiens
acttgagtgttcctttttaaat

SEQ ID NO: 3135203 - DNA, 21 bp, Homo sapiens
acttgagttttatttatttta

SEQ ID NO: 3135204 - DNA, 15 bp, Homo sapiens
acttgataatattag

SEQ ID NO: 3135205 - DNA, 15 bp, Homo sapiens
acttgatactgaatg

SEQ ID NO: 3135206 - DNA, 19 bp, Homo sapiens
acttgatagcaaacactgg

SEQ ID NO: 3135207 - DNA, 20 bp, Homo sapiens
acttgatagcaaacactggg

SEQ ID NO: 3135208 - DNA, 17 bp, Homo sapiens
acttgatgatttttaac

SEQ ID NO: 3135209 - DNA, 14 bp, Homo sapiens
acttgatgcatgtg

SEQ ID NO: 3135210 - DNA, 14 bp, Homo sapiens
acttgatttcttct

SEQ ID NO: 3135211 - DNA, 18 bp, Homo sapiens
acttgatttgatgtgact

SEQ ID NO: 3135212 - DNA, 15 bp, Homo sapiens
acttgatttgcatgg

SEQ ID NO: 3135213 - DNA, 20 bp, Homo sapiens
acttgcaaagacctacctcc

SEQ ID NO: 3135214 - DNA, 22 bp, Homo sapiens
acttgcagactctacagaggcc

SEQ ID NO: 3135215 - DNA, 20 bp, Homo sapiens
acttgcagctgatgttggaa

SEQ ID NO: 3135216 - DNA, 19 bp, Homo sapiens
acttgcaggggtccctgct

SEQ ID NO: 3135217 - DNA, 21 bp, Homo sapiens
acttgcaggggtccctgctag

SEQ ID NO: 3135218 - DNA, 17 bp, Homo sapiens
acttgcatgaatgattt

SEQ ID NO: 3135219 - DNA, 20 bp, Homo sapiens
acttgcatgaattactgtat

SEQ ID NO: 3135220 - DNA, 22 bp, Homo sapiens
acttgcatgaattactgtatat

SEQ ID NO: 3135221 - DNA, 11 bp, Homo sapiens
acttgcatttc

SEQ ID NO: 3135222 - DNA, 13 bp, Homo sapiens
acttgcctctgca

SEQ ID NO: 3135223 - DNA, 17 bp, Homo sapiens
acttgcctggggtctga

SEQ ID NO: 3135224 - DNA, 20 bp, Homo sapiens
acttgccttcttcacccagc

SEQ ID NO: 3135225 - DNA, 22 bp, Homo sapiens
acttgcgagaaattcgtgtgtt

SEQ ID NO: 3135226 - DNA, 14 bp, Homo sapiens
acttgcgtcctgca

SEQ ID NO: 3135227 - DNA, 15 bp, Homo sapiens
acttgcgtcctgcag

SEQ ID NO: 3135228 - DNA, 14 bp, Homo sapiens
acttgctaaagcac

SEQ ID NO: 3135229 - DNA, 17 bp, Homo sapiens
acttgctaaagcacttt

SEQ ID NO: 3135230 - DNA, 14 bp, Homo sapiens
acttgcttattaca

SEQ ID NO: 3135231 - DNA, 20 bp, Homo sapiens
acttgcttattacatttaaa

SEQ ID NO: 3135232 - DNA, 16 bp, Homo sapiens
acttgcttatttgaca

SEQ ID NO: 3135233 - DNA, 18 bp, Homo sapiens
acttggaatttgtaacct

SEQ ID NO: 3135234 - DNA, 21 bp, Homo sapiens
acttggaatttgtaacctcag

SEQ ID NO: 3135235 - DNA, 15 bp, Homo sapiens
acttggactcttgct

SEQ ID NO: 3135236 - DNA, 12 bp, Homo sapiens
acttggagcccg

SEQ ID NO: 3135237 - DNA, 14 bp, Homo sapiens
acttggagcccgtg

SEQ ID NO: 3135238 - DNA, 15 bp, Homo sapiens
acttggagcccgtgc

SEQ ID NO: 3135239 - DNA, 13 bp, Homo sapiens
acttggattctct

SEQ ID NO: 3135240 - DNA, 16 bp, Homo sapiens
acttggcacttaagtg

SEQ ID NO: 3135241 - DNA, 14 bp, Homo sapiens
acttggcatttcta

SEQ ID NO: 3135242 - DNA, 15 bp, Homo sapiens
acttggcatttctat

SEQ ID NO: 3135243 - DNA, 21 bp, Homo sapiens
acttggcctcagctggctgta

SEQ ID NO: 3135244 - DNA, 22 bp, Homo sapiens
acttggcctcagctggctgtat

SEQ ID NO: 3135245 - DNA, 19 bp, Homo sapiens
acttggctcgaatctctgt

SEQ ID NO: 3135246 - DNA, 20 bp, Homo sapiens
acttgggagacctgtaatca

SEQ ID NO: 3135247 - DNA, 22 bp, Homo sapiens
acttgggaggctgaggcaggag

SEQ ID NO: 3135248 - DNA, 14 bp, Homo sapiens
acttggggaggcaa

SEQ ID NO: 3135249 - DNA, 21 bp, Homo sapiens
acttggtctgtgagatgctag

SEQ ID NO: 3135250 - DNA, 15 bp, Homo sapiens
acttggttctgcttc

SEQ ID NO: 3135251 - DNA, 21 bp, Homo sapiens
acttggtttttttttttctta

SEQ ID NO: 3135252 - DNA, 20 bp, Homo sapiens
acttgtacaaaataaacaaa

SEQ ID NO: 3135253 - DNA, 16 bp, Homo sapiens
acttgtagctgtaaaa

SEQ ID NO: 3135254 - DNA, 23 bp, Homo sapiens
acttgtaggataagtgaaatgga

SEQ ID NO: 3135255 - DNA, 17 bp, Homo sapiens
acttgtagggatgcctt

SEQ ID NO: 3135256 - DNA, 14 bp, Homo sapiens
acttgtataaatgt

SEQ ID NO: 3135257 - DNA, 14 bp, Homo sapiens
acttgtatatttgt

SEQ ID NO: 3135258 - DNA, 18 bp, Homo sapiens
acttgtattaaagacaga

SEQ ID NO: 3135259 - DNA, 16 bp, Homo sapiens
acttgtattgacttta

SEQ ID NO: 3135260 - DNA, 18 bp, Homo sapiens
acttgtattgactttatg

SEQ ID NO: 3135261 - DNA, 22 bp, Homo sapiens
acttgtattgactttatgttgt

SEQ ID NO: 3135262 - DNA, 14 bp, Homo sapiens
acttgtatttccaa

SEQ ID NO: 3135263 - DNA, 16 bp, Homo sapiens
acttgtcaggcatggc

SEQ ID NO: 3135264 - DNA, 14 bp, Homo sapiens
acttgtctgaggcc

SEQ ID NO: 3135265 - DNA, 10 bp, Homo sapiens
acttgtgaat

SEQ ID NO: 3135266 - DNA, 18 bp, Homo sapiens
acttgtgaatgcttctca

SEQ ID NO: 3135267 - DNA, 17 bp, Homo sapiens
acttgtgattatttatt

SEQ ID NO: 3135268 - DNA, 16 bp, Homo sapiens
acttgtggacacagct

SEQ ID NO: 3135269 - DNA, 15 bp, Homo sapiens
acttgtggtgtgacc

SEQ ID NO: 3135270 - DNA, 17 bp, Homo sapiens
acttgtggtgtgaccat

SEQ ID NO: 3135271 - DNA, 16 bp, Homo sapiens
acttgtggttttcaaa

SEQ ID NO: 3135272 - DNA, 17 bp, Homo sapiens
acttgtggttttcaaat

SEQ ID NO: 3135273 - DNA, 13 bp, Homo sapiens
acttgtgtatatt

SEQ ID NO: 3135274 - DNA, 23 bp, Homo sapiens
acttgtgtatattttaatgaata

SEQ ID NO: 3135275 - DNA, 21 bp, Homo sapiens
acttgtgtctctgtgctttta

SEQ ID NO: 3135276 - DNA, 23 bp, Homo sapiens
acttgtgtgtgggctgtgagtgt

SEQ ID NO: 3135277 - DNA, 16 bp, Homo sapiens
acttgttattgtgaat

SEQ ID NO: 3135278 - DNA, 19 bp, Homo sapiens
acttgttattgtgaatgat

SEQ ID NO: 3135279 - DNA, 15 bp, Homo sapiens
acttgttccagctct

SEQ ID NO: 3135280 - DNA, 16 bp, Homo sapiens
acttgttgtggctctt

SEQ ID NO: 3135281 - DNA, 17 bp, Homo sapiens
acttgtttgtcttccat

SEQ ID NO: 3135282 - DNA, 18 bp, Homo sapiens
acttgttttggatggctt

SEQ ID NO: 3135283 - DNA, 20 bp, Homo sapiens
acttgttttggatggcttgt

SEQ ID NO: 3135284 - DNA, 21 bp, Homo sapiens
actttaaaaaatatttattaa

SEQ ID NO: 3135285 - DNA, 13 bp, Homo sapiens
actttaaaaagga

SEQ ID NO: 3135286 - DNA, 16 bp, Homo sapiens
actttaaaaaggaaat

SEQ ID NO: 3135287 - DNA, 16 bp, Homo sapiens
actttaaaaggagcca

SEQ ID NO: 3135288 - DNA, 16 bp, Homo sapiens
actttaaaaggattaa

SEQ ID NO: 3135289 - DNA, 15 bp, Homo sapiens
actttaaaataaaat

SEQ ID NO: 3135290 - DNA, 15 bp, Homo sapiens
actttaagagagaaa

SEQ ID NO: 3135291 - DNA, 13 bp, Homo sapiens
actttacaggaaa

SEQ ID NO: 3135292 - DNA, 22 bp, Homo sapiens
actttacataagaaatgtattc

SEQ ID NO: 3135293 - DNA, 15 bp, Homo sapiens
agacaagccctggca

SEQ ID NO: 3135294 - DNA, 15 bp, Homo sapiens
agacaagtaatttca

SEQ ID NO: 3135295 - DNA, 18 bp, Homo sapiens
agacaagtaatttcagtg

SEQ ID NO: 3135296 - DNA, 22 bp, Homo sapiens
agacaagttccatgggatacaa

SEQ ID NO: 3135297 - DNA, 14 bp, Homo sapiens
agacaatacagtaa

SEQ ID NO: 3135298 - DNA, 15 bp, Homo sapiens
agacaatatacaagc

SEQ ID NO: 3135299 - DNA, 18 bp, Homo sapiens
agacaatatgtgagtgcc

SEQ ID NO: 3135300 - DNA, 21 bp, Homo sapiens
agacaatatgtgagtgccttt

SEQ ID NO: 3135301 - DNA, 16 bp, Homo sapiens
agacaatcattgtttt

SEQ ID NO: 3135302 - DNA, 20 bp, Homo sapiens
agacaatgcacctagctgtg

SEQ ID NO: 3135303 - DNA, 13 bp, Homo sapiens
agacaatttgcac

SEQ ID NO: 3135304 - DNA, 19 bp, Homo sapiens
agacacaatatgtatgctt

SEQ ID NO: 3135305 - DNA, 10 bp, Homo sapiens
agacacacac

SEQ ID NO: 3135306 - DNA, 21 bp, Homo sapiens
agacacacacacgcacgcaca

SEQ ID NO: 3135307 - DNA, 13 bp, Homo sapiens
agacacaggcccg

SEQ ID NO: 3135308 - DNA, 12 bp, Homo sapiens
agacaccaaagt

SEQ ID NO: 3135309 - DNA, 17 bp, Homo sapiens
agacacctggactgagc

SEQ ID NO: 3135310 - DNA, 20 bp, Homo sapiens
agacacctggactgagccaa

SEQ ID NO: 3135311 - DNA, 19 bp, Homo sapiens
agacacctgttcacagaaa

SEQ ID NO: 3135312 - DNA, 21 bp, Homo sapiens
agacaccttcattttgagggg

SEQ ID NO: 3135313 - DNA, 17 bp, Homo sapiens
agacaccttgacagggc

SEQ ID NO: 3135314 - DNA, 23 bp, Homo sapiens
agacactccccgaagtcttttgt

SEQ ID NO: 3135315 - DNA, 18 bp, Homo sapiens
agacactgaaaaatctaa

SEQ ID NO: 3135316 - DNA, 19 bp, Homo sapiens
agacactgaccatccactc

SEQ ID NO: 3135317 - DNA, 18 bp, Homo sapiens
agacactgatctggctgc

SEQ ID NO: 3135318 - DNA, 13 bp, Homo sapiens
agacacttgcctt

SEQ ID NO: 3135319 - DNA, 14 bp, Homo sapiens
agacacttgctccc

SEQ ID NO: 3135320 - DNA, 23 bp, Homo sapiens
agacactttggaagtttgtgttc

SEQ ID NO: 3135321 - DNA, 11 bp, Homo sapiens
agacagaaact

SEQ ID NO: 3135322 - DNA, 13 bp, Homo sapiens
agacagaaactgg

SEQ ID NO: 3135323 - DNA, 17 bp, Homo sapiens
agacagaacccctacat

SEQ ID NO: 3135324 - DNA, 12 bp, Homo sapiens
agacagaatctc

SEQ ID NO: 3135325 - DNA, 17 bp, Homo sapiens
agacagaatgtatctgt

SEQ ID NO: 3135326 - DNA, 19 bp, Homo sapiens
agacagaatgtatctgtga

SEQ ID NO: 3135327 - DNA, 20 bp, Homo sapiens
agacagaatgtatctgtgaa

SEQ ID NO: 3135328 - DNA, 21 bp, Homo sapiens
agacagaatgtatctgtgaag

SEQ ID NO: 3135329 - DNA, 15 bp, Homo sapiens
agacagacttgagaa

SEQ ID NO: 3135330 - DNA, 19 bp, Homo sapiens
agacagagaccctctgcca

SEQ ID NO: 3135331 - DNA, 15 bp, Homo sapiens
agacagagaggactg

SEQ ID NO: 3135332 - DNA, 20 bp, Homo sapiens
agacagagtctcactgttgc

SEQ ID NO: 3135333 - DNA, 21 bp, Homo sapiens
agacagagtctcactgttgcc

SEQ ID NO: 3135334 - DNA, 16 bp, Homo sapiens
agacagcacagggcag

SEQ ID NO: 3135335 - DNA, 18 bp, Homo sapiens
agacagcaggcagcgcca

SEQ ID NO: 3135336 - DNA, 12 bp, Homo sapiens
agacagccccag

SEQ ID NO: 3135337 - DNA, 17 bp, Homo sapiens
agacagccccagagcag

SEQ ID NO: 3135338 - DNA, 14 bp, Homo sapiens
agacagcttctctg

SEQ ID NO: 3135339 - DNA, 15 bp, Homo sapiens
agacaggctcttagc

SEQ ID NO: 3135340 - DNA, 20 bp, Homo sapiens
agacaggctcttagcagctt

SEQ ID NO: 3135341 - DNA, 19 bp, Homo sapiens
agacagggtaggaaagggc

SEQ ID NO: 3135342 - DNA, 19 bp, Homo sapiens
agacagggtctgaaggact

SEQ ID NO: 3135343 - DNA, 22 bp, Homo sapiens
agacaggtccctccccttctct

SEQ ID NO: 3135344 - DNA, 18 bp, Homo sapiens
agacagtatatttatagt

SEQ ID NO: 3135345 - DNA, 21 bp, Homo sapiens
agacagtatttattggtgggt

SEQ ID NO: 3135346 - DNA, 15 bp, Homo sapiens
agacagtcctttccc

SEQ ID NO: 3135347 - DNA, 15 bp, Homo sapiens
agacagtctggaaag

SEQ ID NO: 3135348 - DNA, 17 bp, Homo sapiens
agacagtctggaaagtg

SEQ ID NO: 3135349 - DNA, 14 bp, Homo sapiens
agacagtgaatttg

SEQ ID NO: 3135350 - DNA, 19 bp, Homo sapiens
agacagtgagacagtctgg

SEQ ID NO: 3135351 - DNA, 21 bp, Homo sapiens
agacagtgatctccatatgtt

SEQ ID NO: 3135352 - DNA, 13 bp, Homo sapiens
agacagtgtacaa

SEQ ID NO: 3135353 - DNA, 15 bp, Homo sapiens
agacagttcaagaaa

SEQ ID NO: 3135354 - DNA, 14 bp, Homo sapiens
agacagtttcttag

SEQ ID NO: 3135355 - DNA, 15 bp, Homo sapiens
agacagtttcttagc

SEQ ID NO: 3135356 - DNA, 17 bp, Homo sapiens
agacataacgtttttcc

SEQ ID NO: 3135357 - DNA, 23 bp, Homo sapiens
agacatcagtctccaacatgttt

SEQ ID NO: 3135358 - DNA, 12 bp, Homo sapiens
agacatgaaata

SEQ ID NO: 3135359 - DNA, 16 bp, Homo sapiens
agacatgaaataaaga

SEQ ID NO: 3135360 - DNA, 13 bp, Homo sapiens
agacatggagact

SEQ ID NO: 3135361 - DNA, 16 bp, Homo sapiens
agacatggaggttcta

SEQ ID NO: 3135362 - DNA, 19 bp, Homo sapiens
agacatggaggttctaagg

SEQ ID NO: 3135363 - DNA, 20 bp, Homo sapiens
agacatggatgcgaggacca

SEQ ID NO: 3135364 - DNA, 16 bp, Homo sapiens
agacatgtgacattta

SEQ ID NO: 3135365 - DNA, 17 bp, Homo sapiens
agacatgtgaggaggaa

SEQ ID NO: 3135366 - DNA, 20 bp, Homo sapiens
agacatgtgaggaggaaaag

SEQ ID NO: 3135367 - DNA, 21 bp, Homo sapiens
agacatgtgaggaggaaaagg

SEQ ID NO: 3135368 - DNA, 19 bp, Homo sapiens
agacattcttccaaaaaga

SEQ ID NO: 3135369 - DNA, 21 bp, Homo sapiens
agacatttgatagaaaggaac

SEQ ID NO: 3135370 - DNA, 12 bp, Homo sapiens
agacatttgtat

SEQ ID NO: 3135371 - DNA, 11 bp, Homo sapiens
agacattttca

SEQ ID NO: 3135372 - DNA, 23 bp, Homo sapiens
agacattttttgctataatcatt

SEQ ID NO: 3135373 - DNA, 24 bp, Homo sapiens
agaccaaacttcactctgggcaca

SEQ ID NO: 3135374 - DNA, 22 bp, Homo sapiens
agaccaacgttactcagggctc

SEQ ID NO: 3135375 - DNA, 16 bp, Homo sapiens
agaccaagtcctggct

SEQ ID NO: 3135376 - DNA, 16 bp, Homo sapiens
agaccacaaaaattga

SEQ ID NO: 3135377 - DNA, 23 bp, Homo sapiens
agaccacactttgggacttggga

SEQ ID NO: 3135378 - DNA, 16 bp, Homo sapiens
agaccacagaggctca

SEQ ID NO: 3135379 - DNA, 22 bp, Homo sapiens
agaccaccagccgccccagccc

SEQ ID NO: 3135380 - DNA, 23 bp, Homo sapiens
agaccaccagccgccccagcccc

SEQ ID NO: 3135381 - DNA, 20 bp, Homo sapiens
agaccacgcccgtcctgcct

SEQ ID NO: 3135382 - DNA, 23 bp, Homo sapiens
agaccacgcccgtcctgcctgtg

SEQ ID NO: 3135383 - DNA, 18 bp, Homo sapiens
agaccagagctgtctgaa

SEQ ID NO: 3135384 - DNA, 14 bp, Homo sapiens
agaccagcctcgcc

SEQ ID NO: 3135385 - DNA, 15 bp, Homo sapiens
agaccagcctggcca

SEQ ID NO: 3135386 - DNA, 18 bp, Homo sapiens
agaccagcctgggcaaca

SEQ ID NO: 3135387 - DNA, 15 bp, Homo sapiens
agaccagggagcctt

SEQ ID NO: 3135388 - DNA, 18 bp, Homo sapiens
agaccagtgaccccagaa

SEQ ID NO: 3135389 - DNA, 18 bp, Homo sapiens
agaccagttgggagcact

SEQ ID NO: 3135390 - DNA, 13 bp, Homo sapiens
agaccataatgtt

SEQ ID NO: 3135391 - DNA, 14 bp, Homo sapiens
agaccatcctggct

SEQ ID NO: 3135392 - DNA, 15 bp, Homo sapiens
agaccatcctggcta

SEQ ID NO: 3135393 - DNA, 16 bp, Homo sapiens
agaccatgcagagcgc

SEQ ID NO: 3135394 - DNA, 17 bp, Homo sapiens
agaccatgcagagcgcc

SEQ ID NO: 3135395 - DNA, 13 bp, Homo sapiens
agaccattctgtg

SEQ ID NO: 3135396 - DNA, 15 bp, Homo sapiens
agaccatttaacatg

SEQ ID NO: 3135397 - DNA, 19 bp, Homo sapiens
agacccaccccacctgcag

SEQ ID NO: 3135398 - DNA, 20 bp, Homo sapiens
agacccaccccacctgcagg

SEQ ID NO: 3135399 - DNA, 18 bp, Homo sapiens
agacccaggagagacaga

SEQ ID NO: 3135400 - DNA, 19 bp, Homo sapiens
agacccaggtcttccagac

SEQ ID NO: 3135401 - DNA, 23 bp, Homo sapiens
agacccaggtcttccagacctgc

SEQ ID NO: 3135402 - DNA, 13 bp, Homo sapiens
agacccaggtgga

SEQ ID NO: 3135403 - DNA, 11 bp, Homo sapiens
agacccatgct

SEQ ID NO: 3135404 - DNA, 13 bp, Homo sapiens
agaccccaggctg

SEQ ID NO: 3135405 - DNA, 15 bp, Homo sapiens
agaccccagggcagg

SEQ ID NO: 3135406 - DNA, 19 bp, Homo sapiens
agaccccaggtcagcatct

SEQ ID NO: 3135407 - DNA, 14 bp, Homo sapiens
agacccccacacct

SEQ ID NO: 3135408 - DNA, 18 bp, Homo sapiens
agaccccgcacccggctc

SEQ ID NO: 3135409 - DNA, 21 bp, Homo sapiens
agacccctctggccaggatgg

SEQ ID NO: 3135410 - DNA, 22 bp, Homo sapiens
agacccctctggccaggatgga

SEQ ID NO: 3135411 - DNA, 11 bp, Homo sapiens
agacccctgcc

SEQ ID NO: 3135412 - DNA, 13 bp, Homo sapiens
agacccctgcctg

SEQ ID NO: 3135413 - DNA, 15 bp, Homo sapiens
agacccctggctttt

SEQ ID NO: 3135414 - DNA, 21 bp, Homo sapiens
agacccctggcttttcactgc

SEQ ID NO: 3135415 - DNA, 19 bp, Homo sapiens
agaccctcgcccaactcca

SEQ ID NO: 3135416 - DNA, 13 bp, Homo sapiens
agaccctcgggcc

SEQ ID NO: 3135417 - DNA, 17 bp, Homo sapiens
agaccctctgccaccag

SEQ ID NO: 3135418 - DNA, 18 bp, Homo sapiens
agaccctcttgcccatcc

SEQ ID NO: 3135419 - DNA, 18 bp, Homo sapiens
agagagttgttgtgtaca

SEQ ID NO: 3135420 - DNA, 19 bp, Homo sapiens
agagataccaagatgccat

SEQ ID NO: 3135421 - DNA, 14 bp, Homo sapiens
agagatcaaagatg

SEQ ID NO: 3135422 - DNA, 15 bp, Homo sapiens
agagatcaaagatga

SEQ ID NO: 3135423 - DNA, 15 bp, Homo sapiens
agagatgagaaatga

SEQ ID NO: 3135424 - DNA, 14 bp, Homo sapiens
agagatgccagccc

SEQ ID NO: 3135425 - DNA, 16 bp, Homo sapiens
agagatgccagccctt

SEQ ID NO: 3135426 - DNA, 17 bp, Homo sapiens
agagatgccagcccttc

SEQ ID NO: 3135427 - DNA, 20 bp, Homo sapiens
agagatgtttttaaaagttt

SEQ ID NO: 3135428 - DNA, 22 bp, Homo sapiens
agagatgtttttaaaagtttca

SEQ ID NO: 3135429 - DNA, 12 bp, Homo sapiens
agagattagaac

SEQ ID NO: 3135430 - DNA, 15 bp, Homo sapiens
agagattgcttctca

SEQ ID NO: 3135431 - DNA, 14 bp, Homo sapiens
agagattgggagaa

SEQ ID NO: 3135432 - DNA, 20 bp, Homo sapiens
agagattgggagaaatcatc

SEQ ID NO: 3135433 - DNA, 13 bp, Homo sapiens
agagatttatctt

SEQ ID NO: 3135434 - DNA, 20 bp, Homo sapiens
agagcaaaattgatgtgttt

SEQ ID NO: 3135435 - DNA, 22 bp, Homo sapiens
agagcaacccctgtacccagct

SEQ ID NO: 3135436 - DNA, 15 bp, Homo sapiens
agagcacaaacttca

SEQ ID NO: 3135437 - DNA, 12 bp, Homo sapiens
agagcacacaga

SEQ ID NO: 3135438 - DNA, 23 bp, Homo sapiens
agagcacccccaagcctgggctt

SEQ ID NO: 3135439 - DNA, 22 bp, Homo sapiens
agagcaccccctgctccaccag

SEQ ID NO: 3135440 - DNA, 20 bp, Homo sapiens
agagcaccttcctcacttcc

SEQ ID NO: 3135441 - DNA, 20 bp, Homo sapiens
agagcagaacggagccccag

SEQ ID NO: 3135442 - DNA, 18 bp, Homo sapiens
agagcagagtctgggcct

SEQ ID NO: 3135443 - DNA, 18 bp, Homo sapiens
agagcagatgcagagagc

SEQ ID NO: 3135444 - DNA, 12 bp, Homo sapiens
agagcagcagca

SEQ ID NO: 3135445 - DNA, 16 bp, Homo sapiens
agagcagcagcaccaa

SEQ ID NO: 3135446 - DNA, 18 bp, Homo sapiens
agagcagcctgatggcca

SEQ ID NO: 3135447 - DNA, 21 bp, Homo sapiens
agagcagctttaaactcaggg

SEQ ID NO: 3135448 - DNA, 23 bp, Homo sapiens
agagcaggaagcattcagagagc

SEQ ID NO: 3135449 - DNA, 13 bp, Homo sapiens
agagcaggactcc

SEQ ID NO: 3135450 - DNA, 13 bp, Homo sapiens
agagcaggcacat

SEQ ID NO: 3135451 - DNA, 20 bp, Homo sapiens
agagcaggcacatggaggag

SEQ ID NO: 3135452 - DNA, 13 bp, Homo sapiens
agagcaggctggc

SEQ ID NO: 3135453 - DNA, 22 bp, Homo sapiens
agagcaggctggcagctctcca

SEQ ID NO: 3135454 - DNA, 15 bp, Homo sapiens
agagcaggggctcca

SEQ ID NO: 3135455 - DNA, 17 bp, Homo sapiens
agagcaggggctccagc

SEQ ID NO: 3135456 - DNA, 18 bp, Homo sapiens
agagcaggggctccagca

SEQ ID NO: 3135457 - DNA, 19 bp, Homo sapiens
agagcagtctaaacagagt

SEQ ID NO: 3135458 - DNA, 20 bp, Homo sapiens
agagcagtgaagactagaaa

SEQ ID NO: 3135459 - DNA, 22 bp, Homo sapiens
agagcatatttgccaataaagc

SEQ ID NO: 3135460 - DNA, 21 bp, Homo sapiens
agagcatcgtgacccttcagg

SEQ ID NO: 3135461 - DNA, 15 bp, Homo sapiens
agagcatggatgcat

SEQ ID NO: 3135462 - DNA, 16 bp, Homo sapiens
agagcatgtgtcagag

SEQ ID NO: 3135463 - DNA, 15 bp, Homo sapiens
agagcattagctggc

SEQ ID NO: 3135464 - DNA, 17 bp, Homo sapiens
agagcattagctggcgc

SEQ ID NO: 3135465 - DNA, 18 bp, Homo sapiens
agagcatttaaggaaact

SEQ ID NO: 3135466 - DNA, 13 bp, Homo sapiens
agagccacctgga

SEQ ID NO: 3135467 - DNA, 13 bp, Homo sapiens
agagccagcctgg

SEQ ID NO: 3135468 - DNA, 12 bp, Homo sapiens
agagccagcttg

SEQ ID NO: 3135469 - DNA, 20 bp, Homo sapiens
agagccatataagtttgaag

SEQ ID NO: 3135470 - DNA, 13 bp, Homo sapiens
agagccatgaagc

SEQ ID NO: 3135471 - DNA, 14 bp, Homo sapiens
agagccatgaagca

SEQ ID NO: 3135472 - DNA, 16 bp, Homo sapiens
agagccatgggcctgg

SEQ ID NO: 3135473 - DNA, 17 bp, Homo sapiens
agagccatgggcctggg

SEQ ID NO: 3135474 - DNA, 23 bp, Homo sapiens
agagccatgggcctgggcctgct

SEQ ID NO: 3135475 - DNA, 22 bp, Homo sapiens
agagcccagaggtaacagaaca

SEQ ID NO: 3135476 - DNA, 24 bp, Homo sapiens
agagcccagaggtaacagaacagc

SEQ ID NO: 3135477 - DNA, 21 bp, Homo sapiens
agagcccagcagggcctcaaa

SEQ ID NO: 3135478 - DNA, 13 bp, Homo sapiens
agagcccccagcc

SEQ ID NO: 3135479 - DNA, 15 bp, Homo sapiens
agagcccccagccct

SEQ ID NO: 3135480 - DNA, 16 bp, Homo sapiens
agagcccccagccctg

SEQ ID NO: 3135481 - DNA, 22 bp, Homo sapiens
agagcccccagccctgggaacc

SEQ ID NO: 3135482 - DNA, 19 bp, Homo sapiens
agagcccctcctccagccc

SEQ ID NO: 3135483 - DNA, 20 bp, Homo sapiens
agagcccctcctccagcccc

SEQ ID NO: 3135484 - DNA, 22 bp, Homo sapiens
agagcccctcctccagcccctg

SEQ ID NO: 3135485 - DNA, 16 bp, Homo sapiens
agagcccgcttttgtt

SEQ ID NO: 3135486 - DNA, 16 bp, Homo sapiens
agagccctgccctgca

SEQ ID NO: 3135487 - DNA, 18 bp, Homo sapiens
agagccctggacacccct

SEQ ID NO: 3135488 - DNA, 14 bp, Homo sapiens
agagccctggccag

SEQ ID NO: 3135489 - DNA, 18 bp, Homo sapiens
agagccctggccagccct

SEQ ID NO: 3135490 - DNA, 22 bp, Homo sapiens
agagccctggccagcccttcct

SEQ ID NO: 3135491 - DNA, 15 bp, Homo sapiens
agagccctggctggg

SEQ ID NO: 3135492 - DNA, 12 bp, Homo sapiens
agagccctgtgg

SEQ ID NO: 3135493 - DNA, 18 bp, Homo sapiens
agagccctgtggccgcca

SEQ ID NO: 3135494 - DNA, 18 bp, Homo sapiens
agagcccttcactgccat

SEQ ID NO: 3135495 - DNA, 20 bp, Homo sapiens
agagcccttcactgccatga

SEQ ID NO: 3135496 - DNA, 21 bp, Homo sapiens
agagcctcggccctagcattg

SEQ ID NO: 3135497 - DNA, 14 bp, Homo sapiens
agagcctgatctct

SEQ ID NO: 3135498 - DNA, 12 bp, Homo sapiens
agagcctgctgg

SEQ ID NO: 3135499 - DNA, 18 bp, Homo sapiens
agagcctggtgctgctgc

SEQ ID NO: 3135500 - DNA, 19 bp, Homo sapiens
agagccttcaagtgccaaa

SEQ ID NO: 3135501 - DNA, 23 bp, Homo sapiens
agagccttcagaatgctcctgag

SEQ ID NO: 3135502 - DNA, 21 bp, Homo sapiens
agagccttttatctgcagaac

SEQ ID NO: 3135503 - DNA, 16 bp, Homo sapiens
agagcgaggaaaggat

SEQ ID NO: 3135504 - DNA, 14 bp, Homo sapiens
agagcgcacaggga

SEQ ID NO: 3135505 - DNA, 14 bp, Homo sapiens
agagcgcccctccc

SEQ ID NO: 3135506 - DNA, 18 bp, Homo sapiens
agagcgccgtgagttctc

SEQ ID NO: 3135507 - DNA, 14 bp, Homo sapiens
agagcggtctcagg

SEQ ID NO: 3135508 - DNA, 17 bp, Homo sapiens
agagctaagggtgggtg

SEQ ID NO: 3135509 - DNA, 14 bp, Homo sapiens
agagctaataaatc

SEQ ID NO: 3135510 - DNA, 23 bp, Homo sapiens
agagctcctctgtcctgcttctg

SEQ ID NO: 3135511 - DNA, 19 bp, Homo sapiens
agagctgacgggaggcccc

SEQ ID NO: 3135512 - DNA, 22 bp, Homo sapiens
agagctgattgcagaaaggaga

SEQ ID NO: 3135513 - DNA, 21 bp, Homo sapiens
agagctgcacttggcctcagc

SEQ ID NO: 3135514 - DNA, 11 bp, Homo sapiens
agagctgcctg

SEQ ID NO: 3135515 - DNA, 13 bp, Homo sapiens
agagctgcctgga

SEQ ID NO: 3135516 - DNA, 14 bp, Homo sapiens
agagctgcctggat

SEQ ID NO: 3135517 - DNA, 14 bp, Homo sapiens
agagctggaaggca

SEQ ID NO: 3135518 - DNA, 16 bp, Homo sapiens
agagctggaaggcagg

SEQ ID NO: 3135519 - DNA, 19 bp, Homo sapiens
agagctggaaggcagggca

SEQ ID NO: 3135520 - DNA, 22 bp, Homo sapiens
agagctggaaggcagggcagag

SEQ ID NO: 3135521 - DNA, 16 bp, Homo sapiens
agagctggctctgagc

SEQ ID NO: 3135522 - DNA, 12 bp, Homo sapiens
agagctgggagg

SEQ ID NO: 3135523 - DNA, 23 bp, Homo sapiens
agagctgggaggcatggccctgg

SEQ ID NO: 3135524 - DNA, 23 bp, Homo sapiens
agagctggtagttagtagcatgt

SEQ ID NO: 3135525 - DNA, 16 bp, Homo sapiens
agagctggtgcccgga

SEQ ID NO: 3135526 - DNA, 16 bp, Homo sapiens
agagctgtctgaactc

SEQ ID NO: 3135527 - DNA, 10 bp, Homo sapiens
agagctgtgc

SEQ ID NO: 3135528 - DNA, 11 bp, Homo sapiens
agagctgtgcc

SEQ ID NO: 3135529 - DNA, 12 bp, Homo sapiens
agagctgtgcca

SEQ ID NO: 3135530 - DNA, 15 bp, Homo sapiens
agagcttagcctgga

SEQ ID NO: 3135531 - DNA, 14 bp, Homo sapiens
agagcttgaagatt

SEQ ID NO: 3135532 - DNA, 17 bp, Homo sapiens
agagcttgaggtgggag

SEQ ID NO: 3135533 - DNA, 20 bp, Homo sapiens
agagcttgtaataaatactg

SEQ ID NO: 3135534 - DNA, 15 bp, Homo sapiens
agagcttttaaaaat

SEQ ID NO: 3135535 - DNA, 17 bp, Homo sapiens
agaggaaaaaaatgact

SEQ ID NO: 3135536 - DNA, 18 bp, Homo sapiens
agaggaaaagtaaggtgc

SEQ ID NO: 3135537 - DNA, 13 bp, Homo sapiens
agaggaaaatgag

SEQ ID NO: 3135538 - DNA, 21 bp, Homo sapiens
agaggaacagcactggggagt

SEQ ID NO: 3135539 - DNA, 17 bp, Homo sapiens
agaggaactccttggcc

SEQ ID NO: 3135540 - DNA, 19 bp, Homo sapiens
agaggaactccttggccta

SEQ ID NO: 3135541 - DNA, 22 bp, Homo sapiens
agaggaagaatttgttatcagt

SEQ ID NO: 3135542 - DNA, 15 bp, Homo sapiens
agaggaaggaaaagg

SEQ ID NO: 3135543 - DNA, 10 bp, Homo sapiens
agaggaaggc

SEQ ID NO: 3135544 - DNA, 14 bp, Homo sapiens
agaggaataagaat

SEQ ID NO: 3135545 - DNA, 20 bp, Homo sapiens
agcaaatcagaaacttgtga

SEQ ID NO: 3135546 - DNA, 19 bp, Homo sapiens
agcaaatctacagatcctt

SEQ ID NO: 3135547 - DNA, 18 bp, Homo sapiens
agcaaatttcaaaagaca

SEQ ID NO: 3135548 - DNA, 23 bp, Homo sapiens
agcaacaacaattggtaaaactc

SEQ ID NO: 3135549 - DNA, 15 bp, Homo sapiens
agcaacaatttatga

SEQ ID NO: 3135550 - DNA, 21 bp, Homo sapiens
agcaacaatttatgaattgaa

SEQ ID NO: 3135551 - DNA, 13 bp, Homo sapiens
agcaacacaatgt

SEQ ID NO: 3135552 - DNA, 21 bp, Homo sapiens
agcaacacaatgttattcgtt

SEQ ID NO: 3135553 - DNA, 22 bp, Homo sapiens
agcaacagagtgagaccctgtc

SEQ ID NO: 3135554 - DNA, 12 bp, Homo sapiens
agcaacatggct

SEQ ID NO: 3135555 - DNA, 20 bp, Homo sapiens
agcaacccctgtacccagct

SEQ ID NO: 3135556 - DNA, 21 bp, Homo sapiens
agcaacccctgtacccagctc

SEQ ID NO: 3135557 - DNA, 23 bp, Homo sapiens
agcaacccctgtacccagctcct

SEQ ID NO: 3135558 - DNA, 19 bp, Homo sapiens
agcaacctgggtccaaata

SEQ ID NO: 3135559 - DNA, 21 bp, Homo sapiens
agcaacctgggtccaaataaa

SEQ ID NO: 3135560 - DNA, 20 bp, Homo sapiens
agcaacgtagcttctaccat

SEQ ID NO: 3135561 - DNA, 14 bp, Homo sapiens
agcaactcttgatt

SEQ ID NO: 3135562 - DNA, 17 bp, Homo sapiens
agcaactgttatgaaat

SEQ ID NO: 3135563 - DNA, 18 bp, Homo sapiens
agcaacttcttctccatc

SEQ ID NO: 3135564 - DNA, 15 bp, Homo sapiens
agcaacttgtctttt

SEQ ID NO: 3135565 - DNA, 23 bp, Homo sapiens
agcaacttgtctttttctggact

SEQ ID NO: 3135566 - DNA, 15 bp, Homo sapiens
agcaacttttgtgta

SEQ ID NO: 3135567 - DNA, 16 bp, Homo sapiens
agcaagaaacagtttc

SEQ ID NO: 3135568 - DNA, 17 bp, Homo sapiens
agcaagacacgtggcct

SEQ ID NO: 3135569 - DNA, 19 bp, Homo sapiens
agcaagacctcatctgtgg

SEQ ID NO: 3135570 - DNA, 16 bp, Homo sapiens
agcaagactgttgctc

SEQ ID NO: 3135571 - DNA, 20 bp, Homo sapiens
agcaagatattgatcaaata

SEQ ID NO: 3135572 - DNA, 13 bp, Homo sapiens
agcaagctggcct

SEQ ID NO: 3135573 - DNA, 14 bp, Homo sapiens
agcaagctggcctc

SEQ ID NO: 3135574 - DNA, 15 bp, Homo sapiens
agcaagctggcctct

SEQ ID NO: 3135575 - DNA, 16 bp, Homo sapiens
agcaagctggcctcta

SEQ ID NO: 3135576 - DNA, 21 bp, Homo sapiens
agcaaggaagatatacatgaa

SEQ ID NO: 3135577 - DNA, 12 bp, Homo sapiens
agcaaggccctg

SEQ ID NO: 3135578 - DNA, 15 bp, Homo sapiens
agcaagggagaaaag

SEQ ID NO: 3135579 - DNA, 16 bp, Homo sapiens
agcaagggctccagca

SEQ ID NO: 3135580 - DNA, 18 bp, Homo sapiens
agcaagggctccagcatc

SEQ ID NO: 3135581 - DNA, 15 bp, Homo sapiens
agcaaggggctctgc

SEQ ID NO: 3135582 - DNA, 23 bp, Homo sapiens
agcaaggtgctcacaccccattg

SEQ ID NO: 3135583 - DNA, 14 bp, Homo sapiens
agcaagtcacctta

SEQ ID NO: 3135584 - DNA, 16 bp, Homo sapiens
agcaagtcttaacaaa

SEQ ID NO: 3135585 - DNA, 19 bp, Homo sapiens
agcaagtgtgcactccagc

SEQ ID NO: 3135586 - DNA, 18 bp, Homo sapiens
agcaagttcgtctgttgt

SEQ ID NO: 3135587 - DNA, 15 bp, Homo sapiens
agcaagttttcttcc

SEQ ID NO: 3135588 - DNA, 19 bp, Homo sapiens
agcaataaataacacttgt

SEQ ID NO: 3135589 - DNA, 15 bp, Homo sapiens
agcaataaatgaatg

SEQ ID NO: 3135590 - DNA, 20 bp, Homo sapiens
agcaataatggtcccatcca

SEQ ID NO: 3135591 - DNA, 15 bp, Homo sapiens
agcaataattgtttc

SEQ ID NO: 3135592 - DNA, 16 bp, Homo sapiens
agcaatactcatcaga

SEQ ID NO: 3135593 - DNA, 19 bp, Homo sapiens
agcaatactcatcagagca

SEQ ID NO: 3135594 - DNA, 18 bp, Homo sapiens
agcaatactgtttccatt

SEQ ID NO: 3135595 - DNA, 16 bp, Homo sapiens
agcaatatattaccag

SEQ ID NO: 3135596 - DNA, 21 bp, Homo sapiens
agcaatattgtatatttttat

SEQ ID NO: 3135597 - DNA, 14 bp, Homo sapiens
agcaatatttaaca

SEQ ID NO: 3135598 - DNA, 22 bp, Homo sapiens
agcaatatttatggatgcaaca

SEQ ID NO: 3135599 - DNA, 17 bp, Homo sapiens
agcaatccatgttagtt

SEQ ID NO: 3135600 - DNA, 20 bp, Homo sapiens
agcaatccatgttagttttt

SEQ ID NO: 3135601 - DNA, 19 bp, Homo sapiens
agcaatctccttactgtgt

SEQ ID NO: 3135602 - DNA, 19 bp, Homo sapiens
agcaatctgcattttaaca

SEQ ID NO: 3135603 - DNA, 20 bp, Homo sapiens
agcaatctgcattttaacaa

SEQ ID NO: 3135604 - DNA, 21 bp, Homo sapiens
agcaatctgcattttaacaag

SEQ ID NO: 3135605 - DNA, 18 bp, Homo sapiens
agcaatgatgtccagaag

SEQ ID NO: 3135606 - DNA, 23 bp, Homo sapiens
agcaatgatgtccagaagaatat

SEQ ID NO: 3135607 - DNA, 12 bp, Homo sapiens
agcaatgcaaga

SEQ ID NO: 3135608 - DNA, 15 bp, Homo sapiens
agcaatgcaagaaaa

SEQ ID NO: 3135609 - DNA, 21 bp, Homo sapiens
agcaatgctgatgaatcactg

SEQ ID NO: 3135610 - DNA, 16 bp, Homo sapiens
agcaattctcctgcct

SEQ ID NO: 3135611 - DNA, 16 bp, Homo sapiens
agcaatttcccccctc

SEQ ID NO: 3135612 - DNA, 21 bp, Homo sapiens
agcaatttcttgctctatctc

SEQ ID NO: 3135613 - DNA, 20 bp, Homo sapiens
agcaattttctttgtttctt

SEQ ID NO: 3135614 - DNA, 22 bp, Homo sapiens
agcaattttctttgtttctttt

SEQ ID NO: 3135615 - DNA, 14 bp, Homo sapiens
agcacaaaattcaa

SEQ ID NO: 3135616 - DNA, 20 bp, Homo sapiens
agcacaaaattcaaagcatg

SEQ ID NO: 3135617 - DNA, 14 bp, Homo sapiens
agcacaaacatttt

SEQ ID NO: 3135618 - DNA, 15 bp, Homo sapiens
agcacaaactttagg

SEQ ID NO: 3135619 - DNA, 23 bp, Homo sapiens
agcacaagcagagtgcacagctg

SEQ ID NO: 3135620 - DNA, 19 bp, Homo sapiens
agcacaatcactaaacttt

SEQ ID NO: 3135621 - DNA, 22 bp, Homo sapiens
agcacaatcactaaactttatt

SEQ ID NO: 3135622 - DNA, 18 bp, Homo sapiens
agcacaccagccgctgca

SEQ ID NO: 3135623 - DNA, 16 bp, Homo sapiens
agcacagattttaatt

SEQ ID NO: 3135624 - DNA, 17 bp, Homo sapiens
agcacagattttaattg

SEQ ID NO: 3135625 - DNA, 21 bp, Homo sapiens
agcacagattttaattgtcat

SEQ ID NO: 3135626 - DNA, 16 bp, Homo sapiens
agcacagccctgggag

SEQ ID NO: 3135627 - DNA, 17 bp, Homo sapiens
agcacagccctgggagg

SEQ ID NO: 3135628 - DNA, 12 bp, Homo sapiens
agcacagccctt

SEQ ID NO: 3135629 - DNA, 21 bp, Homo sapiens
agcacagctcaggaactagac

SEQ ID NO: 3135630 - DNA, 15 bp, Homo sapiens
agcacagctccctgc

SEQ ID NO: 3135631 - DNA, 18 bp, Homo sapiens
agcacagctccctgccaa

SEQ ID NO: 3135632 - DNA, 21 bp, Homo sapiens
agcacagcttcatttcctgtg

SEQ ID NO: 3135633 - DNA, 14 bp, Homo sapiens
agcacagcttgacc

SEQ ID NO: 3135634 - DNA, 13 bp, Homo sapiens
agcacaggcagct

SEQ ID NO: 3135635 - DNA, 13 bp, Homo sapiens
agcacagggcagg

SEQ ID NO: 3135636 - DNA, 19 bp, Homo sapiens
agcacagggcaggggtggt

SEQ ID NO: 3135637 - DNA, 21 bp, Homo sapiens
agcacaggggccccagatctg

SEQ ID NO: 3135638 - DNA, 16 bp, Homo sapiens
agcacaggtcccacct

SEQ ID NO: 3135639 - DNA, 21 bp, Homo sapiens
agcacaggtcccacctccagc

SEQ ID NO: 3135640 - DNA, 14 bp, Homo sapiens
agcacagtttgaac

SEQ ID NO: 3135641 - DNA, 17 bp, Homo sapiens
agcacagtttgaacaaa

SEQ ID NO: 3135642 - DNA, 16 bp, Homo sapiens
agcacatacattaaaa

SEQ ID NO: 3135643 - DNA, 17 bp, Homo sapiens
agcacatacattaaaac

SEQ ID NO: 3135644 - DNA, 21 bp, Homo sapiens
agcacatacattaaaactagg

SEQ ID NO: 3135645 - DNA, 19 bp, Homo sapiens
agcacatgatcatgggaat

SEQ ID NO: 3135646 - DNA, 20 bp, Homo sapiens
agcacatgctggccagcctg

SEQ ID NO: 3135647 - DNA, 18 bp, Homo sapiens
agcacatgtgtatttata

SEQ ID NO: 3135648 - DNA, 17 bp, Homo sapiens
agcacatttgtcagtat

SEQ ID NO: 3135649 - DNA, 15 bp, Homo sapiens
agcaccaaccacagc

SEQ ID NO: 3135650 - DNA, 12 bp, Homo sapiens
agcaccacccta

SEQ ID NO: 3135651 - DNA, 14 bp, Homo sapiens
agcaccccaaggct

SEQ ID NO: 3135652 - DNA, 15 bp, Homo sapiens
agcacccccaagcct

SEQ ID NO: 3135653 - DNA, 12 bp, Homo sapiens
agcacccccacc

SEQ ID NO: 3135654 - DNA, 17 bp, Homo sapiens
agcacccccacccacct

SEQ ID NO: 3135655 - DNA, 14 bp, Homo sapiens
agcaccccctgctc

SEQ ID NO: 3135656 - DNA, 22 bp, Homo sapiens
agcaccccctgctccaccagca

SEQ ID NO: 3135657 - DNA, 13 bp, Homo sapiens
agcaccccttcca

SEQ ID NO: 3135658 - DNA, 14 bp, Homo sapiens
agcaccctcccccg

SEQ ID NO: 3135659 - DNA, 18 bp, Homo sapiens
agcaccctcccccgcagc

SEQ ID NO: 3135660 - DNA, 13 bp, Homo sapiens
agcaccctctcct

SEQ ID NO: 3135661 - DNA, 21 bp, Homo sapiens
agcaccgcttttgttctcgca

SEQ ID NO: 3135662 - DNA, 23 bp, Homo sapiens
agcaccgtgatggagaggacaga

SEQ ID NO: 3135663 - DNA, 22 bp, Homo sapiens
agcacctccaaccaaataagac

SEQ ID NO: 3135664 - DNA, 21 bp, Homo sapiens
agcacctccattaaagtctga

SEQ ID NO: 3135665 - DNA, 16 bp, Homo sapiens
agcacctcctgcctcg

SEQ ID NO: 3135666 - DNA, 23 bp, Homo sapiens
agcacctgaaccccatgggcttg

SEQ ID NO: 3135667 - DNA, 16 bp, Homo sapiens
agcaccttctttctgg

SEQ ID NO: 3135668 - DNA, 17 bp, Homo sapiens
agcaccttctttctgga

SEQ ID NO: 3135669 - DNA, 20 bp, Homo sapiens
agcaccttctttctggactg

SEQ ID NO: 3135670 - DNA, 15 bp, Homo sapiens
agccccacccaggag

SEQ ID NO: 3135671 - DNA, 19 bp, Homo sapiens
agccccacccccagccagg

SEQ ID NO: 3135672 - DNA, 22 bp, Homo sapiens
agccccacccctaagtgcccaa

SEQ ID NO: 3135673 - DNA, 15 bp, Homo sapiens
agccccacctctcca

SEQ ID NO: 3135674 - DNA, 15 bp, Homo sapiens
agccccactgccagc

SEQ ID NO: 3135675 - DNA, 20 bp, Homo sapiens
agccccactgccagcagcag

SEQ ID NO: 3135676 - DNA, 19 bp, Homo sapiens
agccccagacaacagccca

SEQ ID NO: 3135677 - DNA, 14 bp, Homo sapiens
agccccagagatgc

SEQ ID NO: 3135678 - DNA, 19 bp, Homo sapiens
agccccagagatgccagcc

SEQ ID NO: 3135679 - DNA, 22 bp, Homo sapiens
agccccagagatgccagccctt

SEQ ID NO: 3135680 - DNA, 16 bp, Homo sapiens
agccccagagcagggt

SEQ ID NO: 3135681 - DNA, 15 bp, Homo sapiens
agccccagcagccct

SEQ ID NO: 3135682 - DNA, 16 bp, Homo sapiens
agccccaggcctctgt

SEQ ID NO: 3135683 - DNA, 18 bp, Homo sapiens
agccccaggcctctgtgt

SEQ ID NO: 3135684 - DNA, 10 bp, Homo sapiens
agccccaggg

SEQ ID NO: 3135685 - DNA, 18 bp, Homo sapiens
agccccagggatcactgg

SEQ ID NO: 3135686 - DNA, 17 bp, Homo sapiens
agccccagggcctgggg

SEQ ID NO: 3135687 - DNA, 16 bp, Homo sapiens
agccccaggggacaag

SEQ ID NO: 3135688 - DNA, 20 bp, Homo sapiens
agccccaggggggcctcctc

SEQ ID NO: 3135689 - DNA, 15 bp, Homo sapiens
agccccagtcttcct

SEQ ID NO: 3135690 - DNA, 23 bp, Homo sapiens
agccccataattttttttttcct

SEQ ID NO: 3135691 - DNA, 13 bp, Homo sapiens
agccccattctgc

SEQ ID NO: 3135692 - DNA, 16 bp, Homo sapiens
agccccattctgcctg

SEQ ID NO: 3135693 - DNA, 19 bp, Homo sapiens
agccccattctgcctgccc

SEQ ID NO: 3135694 - DNA, 23 bp, Homo sapiens
agccccattctgcctgcccaggc

SEQ ID NO: 3135695 - DNA, 18 bp, Homo sapiens
agcccccaccacaaactt

SEQ ID NO: 3135696 - DNA, 19 bp, Homo sapiens
agcccccaccttgatccca

SEQ ID NO: 3135697 - DNA, 21 bp, Homo sapiens
agcccccagatagagctgggt

SEQ ID NO: 3135698 - DNA, 22 bp, Homo sapiens
agcccccagatagagctgggtg

SEQ ID NO: 3135699 - DNA, 18 bp, Homo sapiens
agcccccagcccctcccc

SEQ ID NO: 3135700 - DNA, 22 bp, Homo sapiens
agcccccagccctgggaaccac

SEQ ID NO: 3135701 - DNA, 15 bp, Homo sapiens
agcccccaggaagac

SEQ ID NO: 3135702 - DNA, 11 bp, Homo sapiens
agcccccaggc

SEQ ID NO: 3135703 - DNA, 18 bp, Homo sapiens
agcccccccaacactgtg

SEQ ID NO: 3135704 - DNA, 21 bp, Homo sapiens
agcccccccaacactgtgccc

SEQ ID NO: 3135705 - DNA, 22 bp, Homo sapiens
agcccccccaacactgtgccct

SEQ ID NO: 3135706 - DNA, 13 bp, Homo sapiens
agccccctccaca

SEQ ID NO: 3135707 - DNA, 22 bp, Homo sapiens
agccccctccacaccagtggcc

SEQ ID NO: 3135708 - DNA, 17 bp, Homo sapiens
agccccctggcctctgt

SEQ ID NO: 3135709 - DNA, 15 bp, Homo sapiens
agccccgccctcttc

SEQ ID NO: 3135710 - DNA, 22 bp, Homo sapiens
agccccgccctcttcctgacga

SEQ ID NO: 3135711 - DNA, 19 bp, Homo sapiens
agccccggtggctgggcag

SEQ ID NO: 3135712 - DNA, 12 bp, Homo sapiens
agcccctagaaa

SEQ ID NO: 3135713 - DNA, 18 bp, Homo sapiens
agcccctagaaacccaag

SEQ ID NO: 3135714 - DNA, 15 bp, Homo sapiens
agcccctagcccagg

SEQ ID NO: 3135715 - DNA, 23 bp, Homo sapiens
agcccctagcccaggagagagaa

SEQ ID NO: 3135716 - DNA, 15 bp, Homo sapiens
agcccctcagccctt

SEQ ID NO: 3135717 - DNA, 17 bp, Homo sapiens
agcccctcagcccttgc

SEQ ID NO: 3135718 - DNA, 15 bp, Homo sapiens
agcccctccacgtga

SEQ ID NO: 3135719 - DNA, 12 bp, Homo sapiens
agcccctctggt

SEQ ID NO: 3135720 - DNA, 20 bp, Homo sapiens
agcccctctggtcgctcctg

SEQ ID NO: 3135721 - DNA, 12 bp, Homo sapiens
agcccctcttcc

SEQ ID NO: 3135722 - DNA, 14 bp, Homo sapiens
agcccctgggccca

SEQ ID NO: 3135723 - DNA, 16 bp, Homo sapiens
agcccctgggcccagt

SEQ ID NO: 3135724 - DNA, 13 bp, Homo sapiens
agcccctggggcc

SEQ ID NO: 3135725 - DNA, 22 bp, Homo sapiens
agcccctggggtggccaccagt

SEQ ID NO: 3135726 - DNA, 12 bp, Homo sapiens
agcccctgtccc

SEQ ID NO: 3135727 - DNA, 15 bp, Homo sapiens
agccccttcctgggt

SEQ ID NO: 3135728 - DNA, 18 bp, Homo sapiens
agccccttctcccagcac

SEQ ID NO: 3135729 - DNA, 17 bp, Homo sapiens
agccccttgagaaacct

SEQ ID NO: 3135730 - DNA, 20 bp, Homo sapiens
agccccttgctctcccctgc

SEQ ID NO: 3135731 - DNA, 13 bp, Homo sapiens
agcccgacagtgc

SEQ ID NO: 3135732 - DNA, 17 bp, Homo sapiens
agcccgacagtgccatc

SEQ ID NO: 3135733 - DNA, 20 bp, Homo sapiens
agcccgacagtgccatcccc

SEQ ID NO: 3135734 - DNA, 21 bp, Homo sapiens
agcccgacagtgccatcccca

SEQ ID NO: 3135735 - DNA, 19 bp, Homo sapiens
agcccgcaactctccagcc

SEQ ID NO: 3135736 - DNA, 15 bp, Homo sapiens
agcccgcacacctgc

SEQ ID NO: 3135737 - DNA, 14 bp, Homo sapiens
agcccgcttttgtt

SEQ ID NO: 3135738 - DNA, 22 bp, Homo sapiens
agcccgcttttgttcttcccca

SEQ ID NO: 3135739 - DNA, 14 bp, Homo sapiens
agcccggatgcttc

SEQ ID NO: 3135740 - DNA, 11 bp, Homo sapiens
agcccggcctg

SEQ ID NO: 3135741 - DNA, 15 bp, Homo sapiens
agcccggctggtttt

SEQ ID NO: 3135742 - DNA, 14 bp, Homo sapiens
agcccgggctgcct

SEQ ID NO: 3135743 - DNA, 15 bp, Homo sapiens
agcccgggctgcctg

SEQ ID NO: 3135744 - DNA, 17 bp, Homo sapiens
agcccgggctgcctggg

SEQ ID NO: 3135745 - DNA, 21 bp, Homo sapiens
agcccgggctgcctgggctgt

SEQ ID NO: 3135746 - DNA, 13 bp, Homo sapiens
agccctactccct

SEQ ID NO: 3135747 - DNA, 16 bp, Homo sapiens
agccctactccctgca

SEQ ID NO: 3135748 - DNA, 23 bp, Homo sapiens
agccctactcggatggggcacgg

SEQ ID NO: 3135749 - DNA, 12 bp, Homo sapiens
agccctatggat

SEQ ID NO: 3135750 - DNA, 17 bp, Homo sapiens
agccctcaacaggccca

SEQ ID NO: 3135751 - DNA, 22 bp, Homo sapiens
agccctcaactattctgttcca

SEQ ID NO: 3135752 - DNA, 23 bp, Homo sapiens
agccctcagtcagttcccggagc

SEQ ID NO: 3135753 - DNA, 23 bp, Homo sapiens
agccctcatcttgaagggcccag

SEQ ID NO: 3135754 - DNA, 12 bp, Homo sapiens
agccctccccat

SEQ ID NO: 3135755 - DNA, 12 bp, Homo sapiens
agccctccccct

SEQ ID NO: 3135756 - DNA, 16 bp, Homo sapiens
agccctccccctcaac

SEQ ID NO: 3135757 - DNA, 14 bp, Homo sapiens
agccctccctatgt

SEQ ID NO: 3135758 - DNA, 13 bp, Homo sapiens
agccctccctgcc

SEQ ID NO: 3135759 - DNA, 17 bp, Homo sapiens
agccctccctgcccctc

SEQ ID NO: 3135760 - DNA, 19 bp, Homo sapiens
agccctccctgcccctccc

SEQ ID NO: 3135761 - DNA, 19 bp, Homo sapiens
agccctcgaaccaaggcag

SEQ ID NO: 3135762 - DNA, 20 bp, Homo sapiens
agccctcgaaccaaggcagc

SEQ ID NO: 3135763 - DNA, 12 bp, Homo sapiens
agccctgacctt

SEQ ID NO: 3135764 - DNA, 21 bp, Homo sapiens
agccctgaggtgaaagggagc

SEQ ID NO: 3135765 - DNA, 15 bp, Homo sapiens
agccctgcagagcac

SEQ ID NO: 3135766 - DNA, 15 bp, Homo sapiens
agccctgccctgcac

SEQ ID NO: 3135767 - DNA, 19 bp, Homo sapiens
agccctgctggggatcccc

SEQ ID NO: 3135768 - DNA, 17 bp, Homo sapiens
agccctgctttgggctg

SEQ ID NO: 3135769 - DNA, 19 bp, Homo sapiens
agccctgctttgggctgcc

SEQ ID NO: 3135770 - DNA, 22 bp, Homo sapiens
agccctgcttttgcataatgca

SEQ ID NO: 3135771 - DNA, 19 bp, Homo sapiens
agccctggacacccctgct

SEQ ID NO: 3135772 - DNA, 20 bp, Homo sapiens
agccctggacacccctgctc

SEQ ID NO: 3135773 - DNA, 17 bp, Homo sapiens
agccctggcaggatgac

SEQ ID NO: 3135774 - DNA, 13 bp, Homo sapiens
agccctggccagc

SEQ ID NO: 3135775 - DNA, 16 bp, Homo sapiens
agccctggccagccct

SEQ ID NO: 3135776 - DNA, 17 bp, Homo sapiens
agccctggccagccctt

SEQ ID NO: 3135777 - DNA, 20 bp, Homo sapiens
agccctggccagcccttcct

SEQ ID NO: 3135778 - DNA, 21 bp, Homo sapiens
agccctggccagcccttcctc

SEQ ID NO: 3135779 - DNA, 19 bp, Homo sapiens
agccctggggactgttcca

SEQ ID NO: 3135780 - DNA, 21 bp, Homo sapiens
agccctggggactgttccaaa

SEQ ID NO: 3135781 - DNA, 14 bp, Homo sapiens
agccctggggctgg

SEQ ID NO: 3135782 - DNA, 22 bp, Homo sapiens
agccctggtgctacttgcttga

SEQ ID NO: 3135783 - DNA, 14 bp, Homo sapiens
agccctggtggcag

SEQ ID NO: 3135784 - DNA, 13 bp, Homo sapiens
agccctgtcctgg

SEQ ID NO: 3135785 - DNA, 14 bp, Homo sapiens
agccctgtcctggt

SEQ ID NO: 3135786 - DNA, 19 bp, Homo sapiens
agccctgtcctggttcctt

SEQ ID NO: 3135787 - DNA, 21 bp, Homo sapiens
agccctgtcgagacacttgcc

SEQ ID NO: 3135788 - DNA, 23 bp, Homo sapiens
agccctgtcgagacacttgcctt

SEQ ID NO: 3135789 - DNA, 16 bp, Homo sapiens
agcccttagcagggaa

SEQ ID NO: 3135790 - DNA, 21 bp, Homo sapiens
agcccttagcagggaaacagc

SEQ ID NO: 3135791 - DNA, 22 bp, Homo sapiens
agcccttatgcggttaattttg

SEQ ID NO: 3135792 - DNA, 17 bp, Homo sapiens
agcccttcactgccatg

SEQ ID NO: 3135793 - DNA, 15 bp, Homo sapiens
agcccttcctctcac

SEQ ID NO: 3135794 - DNA, 20 bp, Homo sapiens
agcccttcctctcactcctg

SEQ ID NO: 3135795 - DNA, 22 bp, Homo sapiens
agcccttcctctcactcctgcc

SEQ ID NO: 3135796 - DNA, 21 bp, Homo sapiens
aggcccctgccaccctgggga

SEQ ID NO: 3135797 - DNA, 19 bp, Homo sapiens
aggccccttctctccctgc

SEQ ID NO: 3135798 - DNA, 22 bp, Homo sapiens
aggcccgcaccccggcctcagg

SEQ ID NO: 3135799 - DNA, 16 bp, Homo sapiens
aggccctccatgggct

SEQ ID NO: 3135800 - DNA, 17 bp, Homo sapiens
aggccctccatgggcta

SEQ ID NO: 3135801 - DNA, 21 bp, Homo sapiens
aggccctcctctcccatcctt

SEQ ID NO: 3135802 - DNA, 15 bp, Homo sapiens
aggccctgagacagg

SEQ ID NO: 3135803 - DNA, 15 bp, Homo sapiens
aggccctgccccctc

SEQ ID NO: 3135804 - DNA, 19 bp, Homo sapiens
aggccctgccccctcccac

SEQ ID NO: 3135805 - DNA, 21 bp, Homo sapiens
aggccctgctcctgcagcatg

SEQ ID NO: 3135806 - DNA, 18 bp, Homo sapiens
aggccctgctttttttct

SEQ ID NO: 3135807 - DNA, 21 bp, Homo sapiens
aggccctgctttttttcttaa

SEQ ID NO: 3135808 - DNA, 21 bp, Homo sapiens
aggccctggaggtctccaggg

SEQ ID NO: 3135809 - DNA, 20 bp, Homo sapiens
aggccctgtggtccccgaga

SEQ ID NO: 3135810 - DNA, 16 bp, Homo sapiens
aggcccttattttcaa

SEQ ID NO: 3135811 - DNA, 14 bp, Homo sapiens
aggcccttgtcctg

SEQ ID NO: 3135812 - DNA, 18 bp, Homo sapiens
aggcccttgtcctgccag

SEQ ID NO: 3135813 - DNA, 20 bp, Homo sapiens
aggcccttgtcctgccagct

SEQ ID NO: 3135814 - DNA, 24 bp, Homo sapiens
aggccctttgaagcctcagctacc

SEQ ID NO: 3135815 - DNA, 14 bp, Homo sapiens
aggccgaagctctg

SEQ ID NO: 3135816 - DNA, 18 bp, Homo sapiens
aggccgaaggtgcctcag

SEQ ID NO: 3135817 - DNA, 12 bp, Homo sapiens
aggccgcagctc

SEQ ID NO: 3135818 - DNA, 15 bp, Homo sapiens
aggccgccgtgacct

SEQ ID NO: 3135819 - DNA, 15 bp, Homo sapiens
aggccggaaccacag

SEQ ID NO: 3135820 - DNA, 17 bp, Homo sapiens
aggccggaaccacaggg

SEQ ID NO: 3135821 - DNA, 18 bp, Homo sapiens
aggccggaaccacagggc

SEQ ID NO: 3135822 - DNA, 20 bp, Homo sapiens
aggccggaaccacagggcca

SEQ ID NO: 3135823 - DNA, 16 bp, Homo sapiens
aggccggccagcctca

SEQ ID NO: 3135824 - DNA, 16 bp, Homo sapiens
aggccgtgtctctgag

SEQ ID NO: 3135825 - DNA, 18 bp, Homo sapiens
aggccgtgtctctgagga

SEQ ID NO: 3135826 - DNA, 18 bp, Homo sapiens
aggctcttaagcagcatg

SEQ ID NO: 3135827 - DNA, 19 bp, Homo sapiens
aggctcttagcagcttcca

SEQ ID NO: 3135828 - DNA, 17 bp, Homo sapiens
aggctcttcctggacct

SEQ ID NO: 3135829 - DNA, 20 bp, Homo sapiens
aggctcttcctggacctgag

SEQ ID NO: 3135830 - DNA, 14 bp, Homo sapiens
aggctcttctcctt

SEQ ID NO: 3135831 - DNA, 18 bp, Homo sapiens
aggctctttctgggccaa

SEQ ID NO: 3135832 - DNA, 14 bp, Homo sapiens
aggctgaagagagg

SEQ ID NO: 3135833 - DNA, 14 bp, Homo sapiens
aggctgaccaagag

SEQ ID NO: 3135834 - DNA, 22 bp, Homo sapiens
aggctgaccaagagagaaagaa

SEQ ID NO: 3135835 - DNA, 18 bp, Homo sapiens
aggctgagacagtgaatt

SEQ ID NO: 3135836 - DNA, 14 bp, Homo sapiens
aggctgaggcagga

SEQ ID NO: 3135837 - DNA, 13 bp, Homo sapiens
aggctgaggcctg

SEQ ID NO: 3135838 - DNA, 16 bp, Homo sapiens
aggctgaggcctggac

SEQ ID NO: 3135839 - DNA, 15 bp, Homo sapiens
aggctgcactgcagt

SEQ ID NO: 3135840 - DNA, 18 bp, Homo sapiens
aggctgcagagctgaccc

SEQ ID NO: 3135841 - DNA, 19 bp, Homo sapiens
aggctgcagaggcacctca

SEQ ID NO: 3135842 - DNA, 15 bp, Homo sapiens
aggctgcagcgagct

SEQ ID NO: 3135843 - DNA, 22 bp, Homo sapiens
aggctgcccccaacactccagg

SEQ ID NO: 3135844 - DNA, 16 bp, Homo sapiens
aggctgcgtctggagg

SEQ ID NO: 3135845 - DNA, 10 bp, Homo sapiens
aggctgctag

SEQ ID NO: 3135846 - DNA, 16 bp, Homo sapiens
aggctgctgctgtgac

SEQ ID NO: 3135847 - DNA, 22 bp, Homo sapiens
aggctgctggggcctcagacga

SEQ ID NO: 3135848 - DNA, 18 bp, Homo sapiens
aggctggacatgctgact

SEQ ID NO: 3135849 - DNA, 20 bp, Homo sapiens
aggctggagtgcagtggcgt

SEQ ID NO: 3135850 - DNA, 18 bp, Homo sapiens
aggctggcagctctccag

SEQ ID NO: 3135851 - DNA, 17 bp, Homo sapiens
aggctggccagtccagg

SEQ ID NO: 3135852 - DNA, 19 bp, Homo sapiens
aggctggccagtccaggct

SEQ ID NO: 3135853 - DNA, 14 bp, Homo sapiens
aggctggcgcagcc

SEQ ID NO: 3135854 - DNA, 15 bp, Homo sapiens
aggctggcgcagcca

SEQ ID NO: 3135855 - DNA, 19 bp, Homo sapiens
aggctggcttgcccgcgct

SEQ ID NO: 3135856 - DNA, 17 bp, Homo sapiens
aggctgggagcatagca

SEQ ID NO: 3135857 - DNA, 13 bp, Homo sapiens
aggctgggcacag

SEQ ID NO: 3135858 - DNA, 17 bp, Homo sapiens
aggctgggcagccccag

SEQ ID NO: 3135859 - DNA, 18 bp, Homo sapiens
aggctgggcagccccaga

SEQ ID NO: 3135860 - DNA, 19 bp, Homo sapiens
aggctgggcagccccagag

SEQ ID NO: 3135861 - DNA, 20 bp, Homo sapiens
aggctgggccatgtccaaag

SEQ ID NO: 3135862 - DNA, 21 bp, Homo sapiens
aggctgggccatgtccaaaga

SEQ ID NO: 3135863 - DNA, 18 bp, Homo sapiens
aggctgggctgggtggca

SEQ ID NO: 3135864 - DNA, 22 bp, Homo sapiens
aggctgggcttcagtggcagct

SEQ ID NO: 3135865 - DNA, 16 bp, Homo sapiens
aggctggggcggggcc

SEQ ID NO: 3135866 - DNA, 22 bp, Homo sapiens
aggctggggcggggcccaggag

SEQ ID NO: 3135867 - DNA, 20 bp, Homo sapiens
aggctgggtaatgtgaaggc

SEQ ID NO: 3135868 - DNA, 17 bp, Homo sapiens
aggctggtctaaaactc

SEQ ID NO: 3135869 - DNA, 17 bp, Homo sapiens
aggctggtgggaggggc

SEQ ID NO: 3135870 - DNA, 12 bp, Homo sapiens
aggctgtaacta

SEQ ID NO: 3135871 - DNA, 13 bp, Homo sapiens
aggctgtatccca

SEQ ID NO: 3135872 - DNA, 21 bp, Homo sapiens
aggctgtatcccatgagcctc

SEQ ID NO: 3135873 - DNA, 16 bp, Homo sapiens
aggctgtggtcacagc

SEQ ID NO: 3135874 - DNA, 16 bp, Homo sapiens
aggctgtgtgaatttt

SEQ ID NO: 3135875 - DNA, 21 bp, Homo sapiens
aggctgtgtgaatttttctaa

SEQ ID NO: 3135876 - DNA, 15 bp, Homo sapiens
aggctgttaccattt

SEQ ID NO: 3135877 - DNA, 14 bp, Homo sapiens
aggctgttccttgt

SEQ ID NO: 3135878 - DNA, 21 bp, Homo sapiens
aggctgttctgcactgaaaag

SEQ ID NO: 3135879 - DNA, 17 bp, Homo sapiens
aggcttaagaactgctt

SEQ ID NO: 3135880 - DNA, 20 bp, Homo sapiens
aggcttaataaaaatgacag

SEQ ID NO: 3135881 - DNA, 15 bp, Homo sapiens
aggcttatcaaaatc

SEQ ID NO: 3135882 - DNA, 16 bp, Homo sapiens
aggcttatcaaaatct

SEQ ID NO: 3135883 - DNA, 17 bp, Homo sapiens
aggcttatcaaaatctt

SEQ ID NO: 3135884 - DNA, 20 bp, Homo sapiens
aggcttcagcatatttatag

SEQ ID NO: 3135885 - DNA, 15 bp, Homo sapiens
aggcttccaggctct

SEQ ID NO: 3135886 - DNA, 21 bp, Homo sapiens
aggcttccctgacttgcttta

SEQ ID NO: 3135887 - DNA, 13 bp, Homo sapiens
aggcttccttggc

SEQ ID NO: 3135888 - DNA, 22 bp, Homo sapiens
aggcttctccaattctgcccaa

SEQ ID NO: 3135889 - DNA, 15 bp, Homo sapiens
aggcttctccgccag

SEQ ID NO: 3135890 - DNA, 12 bp, Homo sapiens
aggcttctcctt

SEQ ID NO: 3135891 - DNA, 20 bp, Homo sapiens
aggcttctgttcctctcttt

SEQ ID NO: 3135892 - DNA, 20 bp, Homo sapiens
aggcttcttccttcttgtca

SEQ ID NO: 3135893 - DNA, 13 bp, Homo sapiens
aggcttgaagctg

SEQ ID NO: 3135894 - DNA, 21 bp, Homo sapiens
aggcttgtttacctttctctc

SEQ ID NO: 3135895 - DNA, 18 bp, Homo sapiens
aggctttagtgtatttat

SEQ ID NO: 3135896 - DNA, 19 bp, Homo sapiens
aggctttggatttgacatt

SEQ ID NO: 3135897 - DNA, 15 bp, Homo sapiens
agggaaactaagatt

SEQ ID NO: 3135898 - DNA, 19 bp, Homo sapiens
agggaaactaagattcttt

SEQ ID NO: 3135899 - DNA, 16 bp, Homo sapiens
agggaaactattgtcc

SEQ ID NO: 3135900 - DNA, 15 bp, Homo sapiens
agggaaaggttttgt

SEQ ID NO: 3135901 - DNA, 18 bp, Homo sapiens
agggaaaggttttgtatt

SEQ ID NO: 3135902 - DNA, 15 bp, Homo sapiens
agggaaagttttttt

SEQ ID NO: 3135903 - DNA, 21 bp, Homo sapiens
agggaacatttccgaataaag

SEQ ID NO: 3135904 - DNA, 23 bp, Homo sapiens
agggaacatttccgaataaagta

SEQ ID NO: 3135905 - DNA, 19 bp, Homo sapiens
agggaaccgttattataat

SEQ ID NO: 3135906 - DNA, 13 bp, Homo sapiens
agggaactgggga

SEQ ID NO: 3135907 - DNA, 15 bp, Homo sapiens
agggaagaaggagga

SEQ ID NO: 3135908 - DNA, 15 bp, Homo sapiens
agggaagagtagctg

SEQ ID NO: 3135909 - DNA, 12 bp, Homo sapiens
agggaaggcctg

SEQ ID NO: 3135910 - DNA, 13 bp, Homo sapiens
agggaaggcctga

SEQ ID NO: 3135911 - DNA, 23 bp, Homo sapiens
agggaaggtggggccctgcccct

SEQ ID NO: 3135912 - DNA, 23 bp, Homo sapiens
agggaataaaatcctaagacaca

SEQ ID NO: 3135913 - DNA, 15 bp, Homo sapiens
agggaatccagctcc

SEQ ID NO: 3135914 - DNA, 18 bp, Homo sapiens
agggaatccccgaaggtg

SEQ ID NO: 3135915 - DNA, 23 bp, Homo sapiens
agggaatccccgaaggtgctgga

SEQ ID NO: 3135916 - DNA, 18 bp, Homo sapiens
agggaatcctcctccagg

SEQ ID NO: 3135917 - DNA, 18 bp, Homo sapiens
agggaatgttccctgcac

SEQ ID NO: 3135918 - DNA, 22 bp, Homo sapiens
agggaatgttccctgcaccctg

SEQ ID NO: 3135919 - DNA, 13 bp, Homo sapiens
agggaattgctca

SEQ ID NO: 3135920 - DNA, 16 bp, Homo sapiens
agggaatttctatcta

SEQ ID NO: 3135921 - DNA, 15 bp, Homo sapiens
agggacaagccctgg

SEQ ID NO: 3135922 - DNA, 13 bp, Homo sapiens
agggacaagggat

SEQ ID NO: 3135923 - DNA, 15 bp, Homo sapiens
agggacaagggattc

SEQ ID NO: 3135924 - DNA, 21 bp, Homo sapiens
agggacaagggattctgggaa

SEQ ID NO: 3135925 - DNA, 17 bp, Homo sapiens
agggacacatttctctg

SEQ ID NO: 3135926 - DNA, 14 bp, Homo sapiens
agggacagagccat

SEQ ID NO: 3135927 - DNA, 13 bp, Homo sapiens
agggacaggctga

SEQ ID NO: 3135928 - DNA, 18 bp, Homo sapiens
agggacatgctcacctct

SEQ ID NO: 3135929 - DNA, 19 bp, Homo sapiens
agggaccaactgggcccaa

SEQ ID NO: 3135930 - DNA, 12 bp, Homo sapiens
agggaccaaggc

SEQ ID NO: 3135931 - DNA, 17 bp, Homo sapiens
agggaccaaggcaaggc

SEQ ID NO: 3135932 - DNA, 13 bp, Homo sapiens
agggaccagcttt

SEQ ID NO: 3135933 - DNA, 18 bp, Homo sapiens
agggaccggtgctgcagg

SEQ ID NO: 3135934 - DNA, 23 bp, Homo sapiens
agggaccttcatgcccttctgat

SEQ ID NO: 3135935 - DNA, 14 bp, Homo sapiens
agggacgctttgtc

SEQ ID NO: 3135936 - DNA, 19 bp, Homo sapiens
agggactacccatagacat

SEQ ID NO: 3135937 - DNA, 18 bp, Homo sapiens
agggacttggacaggagt

SEQ ID NO: 3135938 - DNA, 12 bp, Homo sapiens
agggagaaaaga

SEQ ID NO: 3135939 - DNA, 13 bp, Homo sapiens
agggagaaatgtt

SEQ ID NO: 3135940 - DNA, 14 bp, Homo sapiens
agggagaacttatg

SEQ ID NO: 3135941 - DNA, 16 bp, Homo sapiens
agggagaagaaaggtg

SEQ ID NO: 3135942 - DNA, 16 bp, Homo sapiens
agggagaagacactgc

SEQ ID NO: 3135943 - DNA, 13 bp, Homo sapiens
agggagaagagaa

SEQ ID NO: 3135944 - DNA, 11 bp, Homo sapiens
agggagaagga

SEQ ID NO: 3135945 - DNA, 19 bp, Homo sapiens
agggagaaggaagggcaga

SEQ ID NO: 3135946 - DNA, 16 bp, Homo sapiens
agggagacagggtagg

SEQ ID NO: 3135947 - DNA, 22 bp, Homo sapiens
agggagagagagagagagagga

SEQ ID NO: 3135948 - DNA, 15 bp, Homo sapiens
agggagcaagacaga

SEQ ID NO: 3135949 - DNA, 17 bp, Homo sapiens
agggagcaagacagaga

SEQ ID NO: 3135950 - DNA, 13 bp, Homo sapiens
agggagcaagccc

SEQ ID NO: 3135951 - DNA, 16 bp, Homo sapiens
agggagcaagccctac

SEQ ID NO: 3135952 - DNA, 18 bp, Homo sapiens
agggagcaagccctactc

SEQ ID NO: 3135953 - DNA, 18 bp, Homo sapiens
aggggtggtcctgactca

SEQ ID NO: 3135954 - DNA, 14 bp, Homo sapiens
aggggtgtcttggg

SEQ ID NO: 3135955 - DNA, 22 bp, Homo sapiens
aggggtgtcttgggcagagctg

SEQ ID NO: 3135956 - DNA, 18 bp, Homo sapiens
aggggttgcagtgagcgg

SEQ ID NO: 3135957 - DNA, 16 bp, Homo sapiens
aggggttgccacaggc

SEQ ID NO: 3135958 - DNA, 20 bp, Homo sapiens
aggggttgccacaggcctcc

SEQ ID NO: 3135959 - DNA, 21 bp, Homo sapiens
aggggttgccacaggcctccc

SEQ ID NO: 3135960 - DNA, 18 bp, Homo sapiens
aggggttggggtgacagt

SEQ ID NO: 3135961 - DNA, 14 bp, Homo sapiens
aggggttgttttgg

SEQ ID NO: 3135962 - DNA, 21 bp, Homo sapiens
aggggtttgccatttgatacc

SEQ ID NO: 3135963 - DNA, 21 bp, Homo sapiens
agggtaatttcctttgcttca

SEQ ID NO: 3135964 - DNA, 13 bp, Homo sapiens
agggtacatttat

SEQ ID NO: 3135965 - DNA, 18 bp, Homo sapiens
agggtacatttataattg

SEQ ID NO: 3135966 - DNA, 13 bp, Homo sapiens
agggtactaaatt

SEQ ID NO: 3135967 - DNA, 15 bp, Homo sapiens
agggtactaaattta

SEQ ID NO: 3135968 - DNA, 17 bp, Homo sapiens
agggtactaaatttaaa

SEQ ID NO: 3135969 - DNA, 14 bp, Homo sapiens
agggtagctgggcg

SEQ ID NO: 3135970 - DNA, 21 bp, Homo sapiens
agggtatggactatctgtctg

SEQ ID NO: 3135971 - DNA, 14 bp, Homo sapiens
agggtatttgaccc

SEQ ID NO: 3135972 - DNA, 20 bp, Homo sapiens
agggtcaacatcttttacat

SEQ ID NO: 3135973 - DNA, 15 bp, Homo sapiens
agggtcagtggaagc

SEQ ID NO: 3135974 - DNA, 14 bp, Homo sapiens
agggtccagactgt

SEQ ID NO: 3135975 - DNA, 18 bp, Homo sapiens
agggtccccacctgggac

SEQ ID NO: 3135976 - DNA, 18 bp, Homo sapiens
agggtccctctgtgtatt

SEQ ID NO: 3135977 - DNA, 15 bp, Homo sapiens
agggtccgcaccagc

SEQ ID NO: 3135978 - DNA, 16 bp, Homo sapiens
agggtccgcaccagct

SEQ ID NO: 3135979 - DNA, 18 bp, Homo sapiens
agggtccgcaccagctgc

SEQ ID NO: 3135980 - DNA, 22 bp, Homo sapiens
agggtccgcaccagctgctctg

SEQ ID NO: 3135981 - DNA, 14 bp, Homo sapiens
agggtcctggctcc

SEQ ID NO: 3135982 - DNA, 20 bp, Homo sapiens
agggtcctggctcctgaggg

SEQ ID NO: 3135983 - DNA, 18 bp, Homo sapiens
agggtcctttagtacctg

SEQ ID NO: 3135984 - DNA, 21 bp, Homo sapiens
agggtctcactctgtcgccca

SEQ ID NO: 3135985 - DNA, 14 bp, Homo sapiens
agggtctcactgct

SEQ ID NO: 3135986 - DNA, 17 bp, Homo sapiens
agggtctcgctgtcact

SEQ ID NO: 3135987 - DNA, 21 bp, Homo sapiens
agggtctcgctgtcactggct

SEQ ID NO: 3135988 - DNA, 16 bp, Homo sapiens
agggtctctccctcag

SEQ ID NO: 3135989 - DNA, 14 bp, Homo sapiens
agggtctgctcttt

SEQ ID NO: 3135990 - DNA, 15 bp, Homo sapiens
agggtcttccctacc

SEQ ID NO: 3135991 - DNA, 17 bp, Homo sapiens
agggtcttgggctactg

SEQ ID NO: 3135992 - DNA, 22 bp, Homo sapiens
agggtcttgggctactggcagc

SEQ ID NO: 3135993 - DNA, 15 bp, Homo sapiens
agggtgaaaggcagg

SEQ ID NO: 3135994 - DNA, 16 bp, Homo sapiens
agggtgcccgagtgcg

SEQ ID NO: 3135995 - DNA, 21 bp, Homo sapiens
agggtgccctttggggtcccg

SEQ ID NO: 3135996 - DNA, 16 bp, Homo sapiens
agggtggacttagaaa

SEQ ID NO: 3135997 - DNA, 20 bp, Homo sapiens
agggtggacttagaaagcag

SEQ ID NO: 3135998 - DNA, 22 bp, Homo sapiens
agggtggacttagaaagcaggg

SEQ ID NO: 3135999 - DNA, 23 bp, Homo sapiens
agggtggacttagaaagcagggg

SEQ ID NO: 3136000 - DNA, 18 bp, Homo sapiens
agggtggaggaaggtgct

SEQ ID NO: 3136001 - DNA, 21 bp, Homo sapiens
agggtggaggaaggtgctgag

SEQ ID NO: 3136002 - DNA, 18 bp, Homo sapiens
agggtggcccttgcagtt

SEQ ID NO: 3136003 - DNA, 20 bp, Homo sapiens
agggtggctttaattgtata

SEQ ID NO: 3136004 - DNA, 18 bp, Homo sapiens
agggtgggaagaaagaat

SEQ ID NO: 3136005 - DNA, 16 bp, Homo sapiens
agggtgggcaaactct

SEQ ID NO: 3136006 - DNA, 14 bp, Homo sapiens
agggtgggcagcct

SEQ ID NO: 3136007 - DNA, 23 bp, Homo sapiens
agggtggggggatttgtagcata

SEQ ID NO: 3136008 - DNA, 18 bp, Homo sapiens
agggtggtgacctctgcc

SEQ ID NO: 3136009 - DNA, 19 bp, Homo sapiens
agggtggtgacctctgcct

SEQ ID NO: 3136010 - DNA, 15 bp, Homo sapiens
agggtgtaggggcca

SEQ ID NO: 3136011 - DNA, 18 bp, Homo sapiens
agggtgtaggggccacct

SEQ ID NO: 3136012 - DNA, 20 bp, Homo sapiens
agggtgtaggggccacctcc

SEQ ID NO: 3136013 - DNA, 21 bp, Homo sapiens
agggtgtaggggccacctcct

SEQ ID NO: 3136014 - DNA, 15 bp, Homo sapiens
agggtgtttcctcta

SEQ ID NO: 3136015 - DNA, 17 bp, Homo sapiens
agggtgtttcctctaaa

SEQ ID NO: 3136016 - DNA, 18 bp, Homo sapiens
agggttaatcatatttga

SEQ ID NO: 3136017 - DNA, 18 bp, Homo sapiens
agggttcaaaatgtctgt

SEQ ID NO: 3136018 - DNA, 22 bp, Homo sapiens
agggttcaaaatgtctgtagct

SEQ ID NO: 3136019 - DNA, 13 bp, Homo sapiens
agggttcatctgt

SEQ ID NO: 3136020 - DNA, 15 bp, Homo sapiens
agggttcccctggcc

SEQ ID NO: 3136021 - DNA, 15 bp, Homo sapiens
agggttgctggagcc

SEQ ID NO: 3136022 - DNA, 17 bp, Homo sapiens
agggttgggctggtgtc

SEQ ID NO: 3136023 - DNA, 21 bp, Homo sapiens
agggttgttaatggtgcaaat

SEQ ID NO: 3136024 - DNA, 15 bp, Homo sapiens
agggtttcgactggt

SEQ ID NO: 3136025 - DNA, 19 bp, Homo sapiens
agggtttcgactggtccag

SEQ ID NO: 3136026 - DNA, 17 bp, Homo sapiens
agggtttcttaaatata

SEQ ID NO: 3136027 - DNA, 19 bp, Homo sapiens
agggttttccaccctggaa

SEQ ID NO: 3136028 - DNA, 22 bp, Homo sapiens
agggttttgccatgttggccag

SEQ ID NO: 3136029 - DNA, 14 bp, Homo sapiens
aggtaaaatgtatt

SEQ ID NO: 3136030 - DNA, 16 bp, Homo sapiens
aggtaaaatgtatttt

SEQ ID NO: 3136031 - DNA, 18 bp, Homo sapiens
aggtaaagggcaaataat

SEQ ID NO: 3136032 - DNA, 19 bp, Homo sapiens
aggtaaagggcaaataatg

SEQ ID NO: 3136033 - DNA, 14 bp, Homo sapiens
aggtaacagaacag

SEQ ID NO: 3136034 - DNA, 22 bp, Homo sapiens
aggtaacagaacagcttcaggt

SEQ ID NO: 3136035 - DNA, 16 bp, Homo sapiens
aggtaacaggcagata

SEQ ID NO: 3136036 - DNA, 19 bp, Homo sapiens
aggtaacttattagaaacc

SEQ ID NO: 3136037 - DNA, 20 bp, Homo sapiens
aggtaatgttttgtatatac

SEQ ID NO: 3136038 - DNA, 15 bp, Homo sapiens
aggtaattaaagtag

SEQ ID NO: 3136039 - DNA, 21 bp, Homo sapiens
aggtaattgttttttaaagca

SEQ ID NO: 3136040 - DNA, 18 bp, Homo sapiens
aggtacaggagaggcagc

SEQ ID NO: 3136041 - DNA, 15 bp, Homo sapiens
aggtacggagaagaa

SEQ ID NO: 3136042 - DNA, 17 bp, Homo sapiens
aggtacggagaagaata

SEQ ID NO: 3136043 - DNA, 20 bp, Homo sapiens
aggtagaccaggatttctaa

SEQ ID NO: 3136044 - DNA, 21 bp, Homo sapiens
aggtagccgagtcacacccgg

SEQ ID NO: 3136045 - DNA, 19 bp, Homo sapiens
aggtagccttgtgttctga

SEQ ID NO: 3136046 - DNA, 13 bp, Homo sapiens
aggtaggcccttg

SEQ ID NO: 3136047 - DNA, 17 bp, Homo sapiens
aggtaggcccttgtcct

SEQ ID NO: 3136048 - DNA, 19 bp, Homo sapiens
aggtaggcccttgtcctgc

SEQ ID NO: 3136049 - DNA, 21 bp, Homo sapiens
aggtaggcccttgtcctgcca

SEQ ID NO: 3136050 - DNA, 19 bp, Homo sapiens
aggtagtttcaaaggccac

SEQ ID NO: 3136051 - DNA, 21 bp, Homo sapiens
aggtagtttggatatttttgt

SEQ ID NO: 3136052 - DNA, 17 bp, Homo sapiens
aggtatactttagtaga

SEQ ID NO: 3136053 - DNA, 21 bp, Homo sapiens
aggtatactttagtagacatt

SEQ ID NO: 3136054 - DNA, 14 bp, Homo sapiens
aggtatatactttg

SEQ ID NO: 3136055 - DNA, 19 bp, Homo sapiens
aggtatatgttttataatt

SEQ ID NO: 3136056 - DNA, 17 bp, Homo sapiens
aggtatattggaagagg

SEQ ID NO: 3136057 - DNA, 18 bp, Homo sapiens
aggtatcttttttaaatg

SEQ ID NO: 3136058 - DNA, 17 bp, Homo sapiens
aggtatgcaatcaaatc

SEQ ID NO: 3136059 - DNA, 13 bp, Homo sapiens
aggtatggctctg

SEQ ID NO: 3136060 - DNA, 19 bp, Homo sapiens
aggtattaaaactaaattt

SEQ ID NO: 3136061 - DNA, 22 bp, Homo sapiens
aggtattccttttgtgtacagt

SEQ ID NO: 3136062 - DNA, 14 bp, Homo sapiens
aggtattgcactac

SEQ ID NO: 3136063 - DNA, 15 bp, Homo sapiens
aggtcaaactcccta

SEQ ID NO: 3136064 - DNA, 17 bp, Homo sapiens
aggtcaataaggtcaag

SEQ ID NO: 3136065 - DNA, 22 bp, Homo sapiens
aggtcaataaggtcaagggaaa

SEQ ID NO: 3136066 - DNA, 18 bp, Homo sapiens
aggtcaccaggggaggag

SEQ ID NO: 3136067 - DNA, 21 bp, Homo sapiens
aggtcactggaaaggggagag

SEQ ID NO: 3136068 - DNA, 14 bp, Homo sapiens
aggtcactggctct

SEQ ID NO: 3136069 - DNA, 15 bp, Homo sapiens
aggtcactggctctc

SEQ ID NO: 3136070 - DNA, 19 bp, Homo sapiens
aggtcactggctctccaag

SEQ ID NO: 3136071 - DNA, 20 bp, Homo sapiens
aggtcactggctctccaagt

SEQ ID NO: 3136072 - DNA, 17 bp, Homo sapiens
aggtcagagcctgcagt

SEQ ID NO: 3136073 - DNA, 12 bp, Homo sapiens
aggtcaggaaac

SEQ ID NO: 3136074 - DNA, 21 bp, Homo sapiens
aggtcaggaagcaggggtggg

SEQ ID NO: 3136075 - DNA, 14 bp, Homo sapiens
aggtcaggccctgg

SEQ ID NO: 3136076 - DNA, 15 bp, Homo sapiens
aggtcaggccctgga

SEQ ID NO: 3136077 - DNA, 18 bp, Homo sapiens
aggtcatttctttgctta

SEQ ID NO: 3136078 - DNA, 16 bp, Homo sapiens
agtaagttaataatgt

SEQ ID NO: 3136079 - DNA, 22 bp, Homo sapiens
agtaagttaataatgtattgta

SEQ ID NO: 3136080 - DNA, 15 bp, Homo sapiens
agtaagtttcttcct

SEQ ID NO: 3136081 - DNA, 16 bp, Homo sapiens
agtaagtttcttcctg

SEQ ID NO: 3136082 - DNA, 15 bp, Homo sapiens
agtaataaaacatct

SEQ ID NO: 3136083 - DNA, 17 bp, Homo sapiens
agtaataaaacatcttt

SEQ ID NO: 3136084 - DNA, 19 bp, Homo sapiens
agtaataggagcttccagc

SEQ ID NO: 3136085 - DNA, 11 bp, Homo sapiens
agtaatataat

SEQ ID NO: 3136086 - DNA, 20 bp, Homo sapiens
agtaatataatggaagagaa

SEQ ID NO: 3136087 - DNA, 18 bp, Homo sapiens
agtaatatttatatattt

SEQ ID NO: 3136088 - DNA, 14 bp, Homo sapiens
agtaatcaataaag

SEQ ID NO: 3136089 - DNA, 14 bp, Homo sapiens
agtaatctgtacat

SEQ ID NO: 3136090 - DNA, 21 bp, Homo sapiens
agtaatctgtacattttgttg

SEQ ID NO: 3136091 - DNA, 18 bp, Homo sapiens
agtaatgcatacagaaat

SEQ ID NO: 3136092 - DNA, 14 bp, Homo sapiens
agtaatggcagagc

SEQ ID NO: 3136093 - DNA, 15 bp, Homo sapiens
agtaatggtgtagaa

SEQ ID NO: 3136094 - DNA, 18 bp, Homo sapiens
agtaatggtgtagaacac

SEQ ID NO: 3136095 - DNA, 23 bp, Homo sapiens
agtaatggtgtagaacactaatt

SEQ ID NO: 3136096 - DNA, 14 bp, Homo sapiens
agtaatgtattagt

SEQ ID NO: 3136097 - DNA, 18 bp, Homo sapiens
agtaatgtggaagaaaat

SEQ ID NO: 3136098 - DNA, 21 bp, Homo sapiens
agtaatgtggaagaaaatggt

SEQ ID NO: 3136099 - DNA, 15 bp, Homo sapiens
agtaattatgcacta

SEQ ID NO: 3136100 - DNA, 19 bp, Homo sapiens
agtaattatgcactaaata

SEQ ID NO: 3136101 - DNA, 20 bp, Homo sapiens
agtaattgacatgtgccagg

SEQ ID NO: 3136102 - DNA, 22 bp, Homo sapiens
agtaattggtccgatctttgac

SEQ ID NO: 3136103 - DNA, 16 bp, Homo sapiens
agtaattgtgaaaaag

SEQ ID NO: 3136104 - DNA, 22 bp, Homo sapiens
agtaattgttatttattcttta

SEQ ID NO: 3136105 - DNA, 19 bp, Homo sapiens
agtaatttattgtctgtct

SEQ ID NO: 3136106 - DNA, 22 bp, Homo sapiens
agtaatttcagtgtaaagtgtg

SEQ ID NO: 3136107 - DNA, 14 bp, Homo sapiens
agtaatttcttttt

SEQ ID NO: 3136108 - DNA, 14 bp, Homo sapiens
agtaattttgtcac

SEQ ID NO: 3136109 - DNA, 18 bp, Homo sapiens
agtacaatgaactgcttt

SEQ ID NO: 3136110 - DNA, 13 bp, Homo sapiens
agtacaatgtgtt

SEQ ID NO: 3136111 - DNA, 17 bp, Homo sapiens
agtacaatgtgtttttc

SEQ ID NO: 3136112 - DNA, 20 bp, Homo sapiens
agtacaatgtgtttttctcc

SEQ ID NO: 3136113 - DNA, 12 bp, Homo sapiens
agtacagaattt

SEQ ID NO: 3136114 - DNA, 15 bp, Homo sapiens
agtacagcatgtgcc

SEQ ID NO: 3136115 - DNA, 20 bp, Homo sapiens
agtacagtgaggagggtgga

SEQ ID NO: 3136116 - DNA, 15 bp, Homo sapiens
agtacatttaaattt

SEQ ID NO: 3136117 - DNA, 16 bp, Homo sapiens
agtacatttaaatttt

SEQ ID NO: 3136118 - DNA, 21 bp, Homo sapiens
agtacatttaaattttttggc

SEQ ID NO: 3136119 - DNA, 19 bp, Homo sapiens
agtacatttggagacacaa

SEQ ID NO: 3136120 - DNA, 14 bp, Homo sapiens
agtaccaatgctgt

SEQ ID NO: 3136121 - DNA, 16 bp, Homo sapiens
agtaccaatgctgttg

SEQ ID NO: 3136122 - DNA, 17 bp, Homo sapiens
agtaccacactgagttc

SEQ ID NO: 3136123 - DNA, 14 bp, Homo sapiens
agtaccagcatgtt

SEQ ID NO: 3136124 - DNA, 23 bp, Homo sapiens
agtaccaggggctgggctccctg

SEQ ID NO: 3136125 - DNA, 13 bp, Homo sapiens
agtacccctggta

SEQ ID NO: 3136126 - DNA, 18 bp, Homo sapiens
agtaccctctcagctcca

SEQ ID NO: 3136127 - DNA, 21 bp, Homo sapiens
agtacctataaagtaaagcta

SEQ ID NO: 3136128 - DNA, 23 bp, Homo sapiens
agtacctataaagtaaagctaaa

SEQ ID NO: 3136129 - DNA, 19 bp, Homo sapiens
agtacctctgtatagaaat

SEQ ID NO: 3136130 - DNA, 22 bp, Homo sapiens
agtacctctgtatagaaatcta

SEQ ID NO: 3136131 - DNA, 12 bp, Homo sapiens
agtacctgctgc

SEQ ID NO: 3136132 - DNA, 17 bp, Homo sapiens
agtacctgctgccccag

SEQ ID NO: 3136133 - DNA, 19 bp, Homo sapiens
agtacctgctgccccagct

SEQ ID NO: 3136134 - DNA, 14 bp, Homo sapiens
agtacctttgtcac

SEQ ID NO: 3136135 - DNA, 18 bp, Homo sapiens
agtacgaacctacagttt

SEQ ID NO: 3136136 - DNA, 13 bp, Homo sapiens
agtacgttattgt

SEQ ID NO: 3136137 - DNA, 15 bp, Homo sapiens
agtacgttattgttg

SEQ ID NO: 3136138 - DNA, 17 bp, Homo sapiens
agtactagaatttgtat

SEQ ID NO: 3136139 - DNA, 12 bp, Homo sapiens
agtactatgtat

SEQ ID NO: 3136140 - DNA, 17 bp, Homo sapiens
agtactcaaattcaatg

SEQ ID NO: 3136141 - DNA, 17 bp, Homo sapiens
agtactccttaagaaca

SEQ ID NO: 3136142 - DNA, 13 bp, Homo sapiens
agtactctctgct

SEQ ID NO: 3136143 - DNA, 15 bp, Homo sapiens
agtactctctgctct

SEQ ID NO: 3136144 - DNA, 19 bp, Homo sapiens
agtactgaagccaaatgaa

SEQ ID NO: 3136145 - DNA, 20 bp, Homo sapiens
agtactgaagccaaatgaaa

SEQ ID NO: 3136146 - DNA, 16 bp, Homo sapiens
agtacttccctcaggc

SEQ ID NO: 3136147 - DNA, 19 bp, Homo sapiens
agtacttgaaatctaggat

SEQ ID NO: 3136148 - DNA, 21 bp, Homo sapiens
agtacttgtgaaacacagctg

SEQ ID NO: 3136149 - DNA, 22 bp, Homo sapiens
agtacttgtgaaacacagctgt

SEQ ID NO: 3136150 - DNA, 23 bp, Homo sapiens
agtacttgtgaaacacagctgtt

SEQ ID NO: 3136151 - DNA, 24 bp, Homo sapiens
agtacttgtgaaacacagctgttc

SEQ ID NO: 3136152 - DNA, 16 bp, Homo sapiens
agtactttaaaaagga

SEQ ID NO: 3136153 - DNA, 17 bp, Homo sapiens
agtactttattgtacag

SEQ ID NO: 3136154 - DNA, 22 bp, Homo sapiens
agtactttattgtacagactgt

SEQ ID NO: 3136155 - DNA, 17 bp, Homo sapiens
agtacttttgttgtatg

SEQ ID NO: 3136156 - DNA, 23 bp, Homo sapiens
agtacttttttaaatattttcta

SEQ ID NO: 3136157 - DNA, 11 bp, Homo sapiens
agtagaaaaat

SEQ ID NO: 3136158 - DNA, 22 bp, Homo sapiens
agtagaaaagcagtcccattca

SEQ ID NO: 3136159 - DNA, 17 bp, Homo sapiens
agtagaaaagttgcaga

SEQ ID NO: 3136160 - DNA, 19 bp, Homo sapiens
agtagaaataatatgcatt

SEQ ID NO: 3136161 - DNA, 17 bp, Homo sapiens
agtagaaattttacaat

SEQ ID NO: 3136162 - DNA, 13 bp, Homo sapiens
agtagaacagata

SEQ ID NO: 3136163 - DNA, 14 bp, Homo sapiens
agtagagaggcccg

SEQ ID NO: 3136164 - DNA, 13 bp, Homo sapiens
agtagagccagct

SEQ ID NO: 3136165 - DNA, 18 bp, Homo sapiens
agtagagcttgtaataaa

SEQ ID NO: 3136166 - DNA, 23 bp, Homo sapiens
agtagagtcatctccatcagctg

SEQ ID NO: 3136167 - DNA, 15 bp, Homo sapiens
agtagatattacttt

SEQ ID NO: 3136168 - DNA, 16 bp, Homo sapiens
agtagatattacttta

SEQ ID NO: 3136169 - DNA, 16 bp, Homo sapiens
agtagatccatttcca

SEQ ID NO: 3136170 - DNA, 15 bp, Homo sapiens
agtagatggtgaaat

SEQ ID NO: 3136171 - DNA, 17 bp, Homo sapiens
agtagatggtgaaattt

SEQ ID NO: 3136172 - DNA, 22 bp, Homo sapiens
agtagattatggcctttttaag

SEQ ID NO: 3136173 - DNA, 23 bp, Homo sapiens
agtagattatggcctttttaagt

SEQ ID NO: 3136174 - DNA, 15 bp, Homo sapiens
agtagatttctatga

SEQ ID NO: 3136175 - DNA, 17 bp, Homo sapiens
agtagcactgactattt

SEQ ID NO: 3136176 - DNA, 13 bp, Homo sapiens
agtagcatttcat

SEQ ID NO: 3136177 - DNA, 14 bp, Homo sapiens
agtagcatttcatt

SEQ ID NO: 3136178 - DNA, 17 bp, Homo sapiens
agtagccctttctgtgt

SEQ ID NO: 3136179 - DNA, 19 bp, Homo sapiens
agtagccctttctgtgtgc

SEQ ID NO: 3136180 - DNA, 20 bp, Homo sapiens
agtagccctttctgtgtgca

SEQ ID NO: 3136181 - DNA, 13 bp, Homo sapiens
agtagctgggact

SEQ ID NO: 3136182 - DNA, 13 bp, Homo sapiens
agtagctgggatg

SEQ ID NO: 3136183 - DNA, 21 bp, Homo sapiens
agtagctgggatgacaggcgc

SEQ ID NO: 3136184 - DNA, 19 bp, Homo sapiens
agtagcttgctccctgtgt

SEQ ID NO: 3136185 - DNA, 21 bp, Homo sapiens
agtaggcggcgatttttgtat

SEQ ID NO: 3136186 - DNA, 19 bp, Homo sapiens
agtagggatgcggatcctg

SEQ ID NO: 3136187 - DNA, 21 bp, Homo sapiens
agtagggatgcggatcctgct

SEQ ID NO: 3136188 - DNA, 13 bp, Homo sapiens
agtaggtccaagg

SEQ ID NO: 3136189 - DNA, 13 bp, Homo sapiens
agtagtcctgtga

SEQ ID NO: 3136190 - DNA, 14 bp, Homo sapiens
agtagtcctgtgaa

SEQ ID NO: 3136191 - DNA, 22 bp, Homo sapiens
agtagtgaggattttgttgata

SEQ ID NO: 3136192 - DNA, 14 bp, Homo sapiens
agtagttcctgcta

SEQ ID NO: 3136193 - DNA, 13 bp, Homo sapiens
agtagttggtttg

SEQ ID NO: 3136194 - DNA, 15 bp, Homo sapiens
agtagttggtttgta

SEQ ID NO: 3136195 - DNA, 19 bp, Homo sapiens
agtagttggtttgtatgag

SEQ ID NO: 3136196 - DNA, 15 bp, Homo sapiens
agtagtttggtttga

SEQ ID NO: 3136197 - DNA, 21 bp, Homo sapiens
agtagtttttacagctgtgtt

SEQ ID NO: 3136198 - DNA, 13 bp, Homo sapiens
agtataaacaaag

SEQ ID NO: 3136199 - DNA, 16 bp, Homo sapiens
agtataaacaaagtta

SEQ ID NO: 3136200 - DNA, 17 bp, Homo sapiens
agtataaacaaagttac

SEQ ID NO: 3136201 - DNA, 10 bp, Homo sapiens
agtataattg

SEQ ID NO: 3136202 - DNA, 12 bp, Homo sapiens
agtatacctcat

SEQ ID NO: 3136203 - DNA, 14 bp, Homo sapiens
agtatacctcattt

SEQ ID NO: 3136204 - DNA, 23 bp, Homo sapiens
agtatactagggagccatttgag

SEQ ID NO: 3136205 - DNA, 12 bp, Homo sapiens
agtatactgtgt

SEQ ID NO: 3136206 - DNA, 14 bp, Homo sapiens
agtatactgtgtgg

SEQ ID NO: 3136207 - DNA, 22 bp, Homo sapiens
agtatacttttcccctgttaaa

SEQ ID NO: 3136208 - DNA, 23 bp, Homo sapiens
agtatacttttcccctgttaaac

SEQ ID NO: 3136209 - DNA, 16 bp, Homo sapiens
agtatagagagaagtt

SEQ ID NO: 3136210 - DNA, 19 bp, Homo sapiens
agtatagccacaaatgcct

SEQ ID NO: 3136211 - DNA, 16 bp, Homo sapiens
agtatatacttttaaa

SEQ ID NO: 3136212 - DNA, 17 bp, Homo sapiens
agtatatacttttaaat

SEQ ID NO: 3136213 - DNA, 21 bp, Homo sapiens
agtatatacttttaaattatg

SEQ ID NO: 3136214 - DNA, 20 bp, Homo sapiens
agtatatcccaagtgcactt

SEQ ID NO: 3136215 - DNA, 12 bp, Homo sapiens
agtatatgtgag

SEQ ID NO: 3136216 - DNA, 15 bp, Homo sapiens
agtatatgttccctc

SEQ ID NO: 3136217 - DNA, 20 bp, Homo sapiens
agtatattgttgaagagaca

SEQ ID NO: 3136218 - DNA, 22 bp, Homo sapiens
agtatattgttgaagagacaga

SEQ ID NO: 3136219 - DNA, 13 bp, Homo sapiens
agtatatttggtt

SEQ ID NO: 3136220 - DNA, 18 bp, Homo sapiens
agtatattttcttttcct

SEQ ID NO: 3136221 - DNA, 16 bp, Homo sapiens
agtatcaggggaaaaa

SEQ ID NO: 3136222 - DNA, 20 bp, Homo sapiens
agtatcagtgttttaaattc

SEQ ID NO: 3136223 - DNA, 21 bp, Homo sapiens
agtatcagtgttttaaattct

SEQ ID NO: 3136224 - DNA, 11 bp, Homo sapiens
agtatccaggc

SEQ ID NO: 3136225 - DNA, 15 bp, Homo sapiens
agtatccttccttca

SEQ ID NO: 3136226 - DNA, 18 bp, Homo sapiens
agtatctatatatgtgta

SEQ ID NO: 3136227 - DNA, 19 bp, Homo sapiens
agtatctgggattattctt

SEQ ID NO: 3136228 - DNA, 12 bp, Homo sapiens
agtatctgtata

SEQ ID NO: 3136229 - DNA, 24 bp, Homo sapiens
agtatcttcaaactttcactttga

SEQ ID NO: 3136230 - DNA, 17 bp, Homo sapiens
agtatcttttttcaaaa

SEQ ID NO: 3136231 - DNA, 20 bp, Homo sapiens
agtatgaatattactctcaa

SEQ ID NO: 3136232 - DNA, 22 bp, Homo sapiens
agtatgacgctgatacataact

SEQ ID NO: 3136233 - DNA, 14 bp, Homo sapiens
agtatgagccctaa

SEQ ID NO: 3136234 - DNA, 16 bp, Homo sapiens
agtatgcattattaaa

SEQ ID NO: 3136235 - DNA, 19 bp, Homo sapiens
agtatgcattattaaattg

SEQ ID NO: 3136236 - DNA, 16 bp, Homo sapiens
agtatggtggctgggt

SEQ ID NO: 3136237 - DNA, 17 bp, Homo sapiens
agtatggtggctgggtt

SEQ ID NO: 3136238 - DNA, 18 bp, Homo sapiens
agtatggttcaagattgt

SEQ ID NO: 3136239 - DNA, 13 bp, Homo sapiens
agtatgtctgttt

SEQ ID NO: 3136240 - DNA, 22 bp, Homo sapiens
agtatgtctgtttttgtatctt

SEQ ID NO: 3136241 - DNA, 19 bp, Homo sapiens
agtatgtgacttttctgat

SEQ ID NO: 3136242 - DNA, 18 bp, Homo sapiens
agtattacttctgctaca

SEQ ID NO: 3136243 - DNA, 15 bp, Homo sapiens
agtattagacttcta

SEQ ID NO: 3136244 - DNA, 18 bp, Homo sapiens
agtattatgcatatataa

SEQ ID NO: 3136245 - DNA, 18 bp, Homo sapiens
agtattcttgtcaaaaaa

SEQ ID NO: 3136246 - DNA, 12 bp, Homo sapiens
agtattcttttt

SEQ ID NO: 3136247 - DNA, 21 bp, Homo sapiens
agtattgaaaaattatcagtt

SEQ ID NO: 3136248 - DNA, 21 bp, Homo sapiens
agtattgaaaacttcaaagct

SEQ ID NO: 3136249 - DNA, 22 bp, Homo sapiens
agtattgcagtctaaaacttca

SEQ ID NO: 3136250 - DNA, 12 bp, Homo sapiens
agtattgctaat

SEQ ID NO: 3136251 - DNA, 19 bp, Homo sapiens
agtattgtttaaaatgtaa

SEQ ID NO: 3136252 - DNA, 15 bp, Homo sapiens
agtatttagaagcca

SEQ ID NO: 3136253 - DNA, 19 bp, Homo sapiens
agtatttagaagccaacta

SEQ ID NO: 3136254 - DNA, 15 bp, Homo sapiens
agtatttatatattt

SEQ ID NO: 3136255 - DNA, 19 bp, Homo sapiens
agtatttatatatttataa

SEQ ID NO: 3136256 - DNA, 23 bp, Homo sapiens
agtatttatatatttataactca

SEQ ID NO: 3136257 - DNA, 15 bp, Homo sapiens
agtatttatttaatg

SEQ ID NO: 3136258 - DNA, 20 bp, Homo sapiens
agtatttatttaatgttatg

SEQ ID NO: 3136259 - DNA, 18 bp, Homo sapiens
agtatttcaactgctgta

SEQ ID NO: 3136260 - DNA, 23 bp, Homo sapiens
agtatttcaactgctgtaaaatt

SEQ ID NO: 3136261 - DNA, 20 bp, Homo sapiens
agtatttcagtgtagttaat

SEQ ID NO: 3136262 - DNA, 16 bp, Homo sapiens
agtatttcatgctggg

SEQ ID NO: 3136263 - DNA, 19 bp, Homo sapiens
agtatttcattgcctgtgt

SEQ ID NO: 3136264 - DNA, 22 bp, Homo sapiens
agtatttggtccaaaaaaagga

SEQ ID NO: 3136265 - DNA, 17 bp, Homo sapiens
agtattttgctggaata

SEQ ID NO: 3136266 - DNA, 17 bp, Homo sapiens
agtattttggttcttag

SEQ ID NO: 3136267 - DNA, 22 bp, Homo sapiens
agtatttttataaatataagcc

SEQ ID NO: 3136268 - DNA, 19 bp, Homo sapiens
agtattttttgtataattg

SEQ ID NO: 3136269 - DNA, 20 bp, Homo sapiens
agtattttttgtataattgg

SEQ ID NO: 3136270 - DNA, 19 bp, Homo sapiens
agtatttttttaagttaga

SEQ ID NO: 3136271 - DNA, 23 bp, Homo sapiens
agtatttttttaagttagagaat

SEQ ID NO: 3136272 - DNA, 20 bp, Homo sapiens
agtatttttttatcttggga

SEQ ID NO: 3136273 - DNA, 16 bp, Homo sapiens
agtatttttttttaat

SEQ ID NO: 3136274 - DNA, 20 bp, Homo sapiens
agtatttttttttaattttg

SEQ ID NO: 3136275 - DNA, 21 bp, Homo sapiens
agtcaaaacagagatgtgata

SEQ ID NO: 3136276 - DNA, 12 bp, Homo sapiens
agtcaaaaggaa

SEQ ID NO: 3136277 - DNA, 21 bp, Homo sapiens
agtcaaatttacatttatcta

SEQ ID NO: 3136278 - DNA, 18 bp, Homo sapiens
agtcaacaggtcacttga

SEQ ID NO: 3136279 - DNA, 15 bp, Homo sapiens
agtcaagaagaaaaa

SEQ ID NO: 3136280 - DNA, 16 bp, Homo sapiens
agtcacaagagcccag

SEQ ID NO: 3136281 - DNA, 17 bp, Homo sapiens
agtcacacagtgttgga

SEQ ID NO: 3136282 - DNA, 12 bp, Homo sapiens
agtcacagctgc

SEQ ID NO: 3136283 - DNA, 23 bp, Homo sapiens
agtcacagctgcagctgggcccc

SEQ ID NO: 3136284 - DNA, 19 bp, Homo sapiens
agtcacattgccatcactc

SEQ ID NO: 3136285 - DNA, 21 bp, Homo sapiens
agtcaccaaatagtgtgaaat

SEQ ID NO: 3136286 - DNA, 14 bp, Homo sapiens
agtcaccaagccca

SEQ ID NO: 3136287 - DNA, 17 bp, Homo sapiens
agtcaccaggacttggg

SEQ ID NO: 3136288 - DNA, 22 bp, Homo sapiens
agtcacctgcaagccccagggc

SEQ ID NO: 3136289 - DNA, 23 bp, Homo sapiens
agtcacctgcaagccccagggcc

SEQ ID NO: 3136290 - DNA, 16 bp, Homo sapiens
agtcacgctggggctc

SEQ ID NO: 3136291 - DNA, 20 bp, Homo sapiens
agtcacgctggggctctctg

SEQ ID NO: 3136292 - DNA, 23 bp, Homo sapiens
agtcacgctggggctctctgaga

SEQ ID NO: 3136293 - DNA, 19 bp, Homo sapiens
agtcactaggatgcagatg

SEQ ID NO: 3136294 - DNA, 19 bp, Homo sapiens
agtcactccctctgccttc

SEQ ID NO: 3136295 - DNA, 13 bp, Homo sapiens
agtcactgcacag

SEQ ID NO: 3136296 - DNA, 17 bp, Homo sapiens
agtcactgccactttgc

SEQ ID NO: 3136297 - DNA, 21 bp, Homo sapiens
agtcactgccactttgcacat

SEQ ID NO: 3136298 - DNA, 21 bp, Homo sapiens
agtcactggaggttgaagcca

SEQ ID NO: 3136299 - DNA, 23 bp, Homo sapiens
agtcactggaggttgaagccaag

SEQ ID NO: 3136300 - DNA, 24 bp, Homo sapiens
agtcagaaaattggcagtggcaga

SEQ ID NO: 3136301 - DNA, 11 bp, Homo sapiens
agtcagagccc

SEQ ID NO: 3136302 - DNA, 16 bp, Homo sapiens
agtcagagccctggct

SEQ ID NO: 3136303 - DNA, 19 bp, Homo sapiens
agtcagagccctggctggg

SEQ ID NO: 3136304 - DNA, 16 bp, Homo sapiens
agtcagaggagaagag

SEQ ID NO: 3136305 - DNA, 18 bp, Homo sapiens
agtcagaggatggccagt

SEQ ID NO: 3136306 - DNA, 22 bp, Homo sapiens
agtcagaggatggccagtgtct

SEQ ID NO: 3136307 - DNA, 23 bp, Homo sapiens
agtcagatggaaaattcattttt

SEQ ID NO: 3136308 - DNA, 21 bp, Homo sapiens
agtcagatttttaaagttttg

SEQ ID NO: 3136309 - DNA, 17 bp, Homo sapiens
agtcagcatgcttccca

SEQ ID NO: 3136310 - DNA, 21 bp, Homo sapiens
agtcagcatgcttcccagagg

SEQ ID NO: 3136311 - DNA, 23 bp, Homo sapiens
agtcagcatgcttcccagaggga

SEQ ID NO: 3136312 - DNA, 18 bp, Homo sapiens
agtcagccaggagctgtc

SEQ ID NO: 3136313 - DNA, 22 bp, Homo sapiens
agtcagccttccccctcccagg

SEQ ID NO: 3136314 - DNA, 20 bp, Homo sapiens
agtcagggcccagaggctga

SEQ ID NO: 3136315 - DNA, 22 bp, Homo sapiens
agtcagggtgggaagaaagaat

SEQ ID NO: 3136316 - DNA, 21 bp, Homo sapiens
agtcagtaggtccaagggcca

SEQ ID NO: 3136317 - DNA, 15 bp, Homo sapiens
agtcagtgtctggct

SEQ ID NO: 3136318 - DNA, 20 bp, Homo sapiens
agtcagttcccggagcacag

SEQ ID NO: 3136319 - DNA, 22 bp, Homo sapiens
agtcagttcccggagcacagcc

SEQ ID NO: 3136320 - DNA, 23 bp, Homo sapiens
agtcagttgctcaaaaagaaatc

SEQ ID NO: 3136321 - DNA, 22 bp, Homo sapiens
agtcataggttaatatttaaga

SEQ ID NO: 3136322 - DNA, 13 bp, Homo sapiens
agtcatcatcagg

SEQ ID NO: 3136323 - DNA, 16 bp, Homo sapiens
agtcatcatcagggcc

SEQ ID NO: 3136324 - DNA, 22 bp, Homo sapiens
agtcatctcctaatttgtttct

SEQ ID NO: 3136325 - DNA, 11 bp, Homo sapiens
agtcatcttgc

SEQ ID NO: 3136326 - DNA, 13 bp, Homo sapiens
agtcatcttgcta

SEQ ID NO: 3136327 - DNA, 16 bp, Homo sapiens
agtcatgcataaatat

SEQ ID NO: 3136328 - DNA, 13 bp, Homo sapiens
agtgagaccttgt

SEQ ID NO: 3136329 - DNA, 14 bp, Homo sapiens
agtgagagggcatg

SEQ ID NO: 3136330 - DNA, 22 bp, Homo sapiens
agtgagcaaaatatgccccttc

SEQ ID NO: 3136331 - DNA, 14 bp, Homo sapiens
agtgagcaaggggg

SEQ ID NO: 3136332 - DNA, 18 bp, Homo sapiens
agtgagcaagggggccca

SEQ ID NO: 3136333 - DNA, 14 bp, Homo sapiens
agtgagctacagag

SEQ ID NO: 3136334 - DNA, 13 bp, Homo sapiens
agtgagctgggca

SEQ ID NO: 3136335 - DNA, 23 bp, Homo sapiens
agtgagctggtttttagcggaga

SEQ ID NO: 3136336 - DNA, 20 bp, Homo sapiens
agtgaggaatagttgagccc

SEQ ID NO: 3136337 - DNA, 14 bp, Homo sapiens
agtgaggagaatga

SEQ ID NO: 3136338 - DNA, 12 bp, Homo sapiens
agtgaggagggt

SEQ ID NO: 3136339 - DNA, 18 bp, Homo sapiens
agtgaggcttccaggctc

SEQ ID NO: 3136340 - DNA, 15 bp, Homo sapiens
agtgagtctgtcagc

SEQ ID NO: 3136341 - DNA, 15 bp, Homo sapiens
agtgagtgtaaataa

SEQ ID NO: 3136342 - DNA, 16 bp, Homo sapiens
agtgagtgtaaataat

SEQ ID NO: 3136343 - DNA, 21 bp, Homo sapiens
agtgagtgtgctgacttttta

SEQ ID NO: 3136344 - DNA, 22 bp, Homo sapiens
agtgagtgtgctgactttttaa

SEQ ID NO: 3136345 - DNA, 23 bp, Homo sapiens
agtgagttcaactacatgttctg

SEQ ID NO: 3136346 - DNA, 15 bp, Homo sapiens
agtgatagtcttttg

SEQ ID NO: 3136347 - DNA, 17 bp, Homo sapiens
agtgatagtcttttgct

SEQ ID NO: 3136348 - DNA, 20 bp, Homo sapiens
agtgatagtcttttgctttt

SEQ ID NO: 3136349 - DNA, 19 bp, Homo sapiens
agtgatatgatccagagca

SEQ ID NO: 3136350 - DNA, 24 bp, Homo sapiens
agtgatatggcagaagacaccaga

SEQ ID NO: 3136351 - DNA, 14 bp, Homo sapiens
agtgatcatttaaa

SEQ ID NO: 3136352 - DNA, 15 bp, Homo sapiens
agtgatcatttaaaa

SEQ ID NO: 3136353 - DNA, 21 bp, Homo sapiens
agtgatcatttaaaaagctca

SEQ ID NO: 3136354 - DNA, 13 bp, Homo sapiens
agtgatcctccca

SEQ ID NO: 3136355 - DNA, 22 bp, Homo sapiens
agtgatctatgtttgtgtgatt

SEQ ID NO: 3136356 - DNA, 12 bp, Homo sapiens
agtgatgatttg

SEQ ID NO: 3136357 - DNA, 17 bp, Homo sapiens
agtgatgatttggggga

SEQ ID NO: 3136358 - DNA, 20 bp, Homo sapiens
agtgatggcgcgggaggcac

SEQ ID NO: 3136359 - DNA, 14 bp, Homo sapiens
agtgatgtttttat

SEQ ID NO: 3136360 - DNA, 23 bp, Homo sapiens
agtgatgtttttatgatatccct

SEQ ID NO: 3136361 - DNA, 14 bp, Homo sapiens
agtgattactgtca

SEQ ID NO: 3136362 - DNA, 12 bp, Homo sapiens
agtgattctgat

SEQ ID NO: 3136363 - DNA, 16 bp, Homo sapiens
agtgattctgatttca

SEQ ID NO: 3136364 - DNA, 20 bp, Homo sapiens
agtgattctgatttcagttt

SEQ ID NO: 3136365 - DNA, 18 bp, Homo sapiens
agtgattgaaccagctca

SEQ ID NO: 3136366 - DNA, 19 bp, Homo sapiens
agtgatttccatctctggt

SEQ ID NO: 3136367 - DNA, 19 bp, Homo sapiens
agtgcaaattgtatcttat

SEQ ID NO: 3136368 - DNA, 16 bp, Homo sapiens
agtgcacacagaaata

SEQ ID NO: 3136369 - DNA, 14 bp, Homo sapiens
agtgcactttctaa

SEQ ID NO: 3136370 - DNA, 13 bp, Homo sapiens
agtgcagaaatga

SEQ ID NO: 3136371 - DNA, 12 bp, Homo sapiens
agtgcagacagg

SEQ ID NO: 3136372 - DNA, 15 bp, Homo sapiens
agtgcagcagaggac

SEQ ID NO: 3136373 - DNA, 20 bp, Homo sapiens
agtgcagctgattttaacaa

SEQ ID NO: 3136374 - DNA, 19 bp, Homo sapiens
agtgcagtggcacaatctt

SEQ ID NO: 3136375 - DNA, 21 bp, Homo sapiens
agtgcagtggcacaatcttgg

SEQ ID NO: 3136376 - DNA, 22 bp, Homo sapiens
agtgcatagttgtagacaaagt

SEQ ID NO: 3136377 - DNA, 20 bp, Homo sapiens
agtgcatattcctttctatc

SEQ ID NO: 3136378 - DNA, 16 bp, Homo sapiens
agtgcatatttatcca

SEQ ID NO: 3136379 - DNA, 14 bp, Homo sapiens
agtgcatcattact

SEQ ID NO: 3136380 - DNA, 15 bp, Homo sapiens
agtgcatctcagccc

SEQ ID NO: 3136381 - DNA, 19 bp, Homo sapiens
agtgcatgatggtgagagc

SEQ ID NO: 3136382 - DNA, 20 bp, Homo sapiens
agtgcatgtgaagcatgctt

SEQ ID NO: 3136383 - DNA, 15 bp, Homo sapiens
agtgcattttcccag

SEQ ID NO: 3136384 - DNA, 17 bp, Homo sapiens
agtgcattttcccagat

SEQ ID NO: 3136385 - DNA, 12 bp, Homo sapiens
agtgccaaggac

SEQ ID NO: 3136386 - DNA, 20 bp, Homo sapiens
agtgccacccacctttgcca

SEQ ID NO: 3136387 - DNA, 21 bp, Homo sapiens
agtgccacccacctttgccac

SEQ ID NO: 3136388 - DNA, 13 bp, Homo sapiens
agtgccacccgca

SEQ ID NO: 3136389 - DNA, 19 bp, Homo sapiens
agtgccactcattcctgta

SEQ ID NO: 3136390 - DNA, 21 bp, Homo sapiens
agtgccactgcccgagctggt

SEQ ID NO: 3136391 - DNA, 17 bp, Homo sapiens
agtgccacttaatgtat

SEQ ID NO: 3136392 - DNA, 21 bp, Homo sapiens
agtgccacttaatgtatgtta

SEQ ID NO: 3136393 - DNA, 18 bp, Homo sapiens
agtgccagaggtgggcag

SEQ ID NO: 3136394 - DNA, 22 bp, Homo sapiens
agtgccagaggtgggcaggtgg

SEQ ID NO: 3136395 - DNA, 18 bp, Homo sapiens
agtgccagcacctgccca

SEQ ID NO: 3136396 - DNA, 12 bp, Homo sapiens
agtgccagcatt

SEQ ID NO: 3136397 - DNA, 13 bp, Homo sapiens
agtgccagcattc

SEQ ID NO: 3136398 - DNA, 22 bp, Homo sapiens
agtgccattccactccactcag

SEQ ID NO: 3136399 - DNA, 17 bp, Homo sapiens
agtgccattgtctttat

SEQ ID NO: 3136400 - DNA, 23 bp, Homo sapiens
agtgcccaccctgggagacagac

SEQ ID NO: 3136401 - DNA, 17 bp, Homo sapiens
agtgccctccacagccg

SEQ ID NO: 3136402 - DNA, 16 bp, Homo sapiens
agtgccctgccccctg

SEQ ID NO: 3136403 - DNA, 18 bp, Homo sapiens
agtgccctgccccctggc

SEQ ID NO: 3136404 - DNA, 21 bp, Homo sapiens
agtgccctgccccctggctga

SEQ ID NO: 3136405 - DNA, 19 bp, Homo sapiens
agtgccggctgtggagcaa

SEQ ID NO: 3136406 - DNA, 15 bp, Homo sapiens
agtgcctagactgtt

SEQ ID NO: 3136407 - DNA, 15 bp, Homo sapiens
agtgcctcgaggcac

SEQ ID NO: 3136408 - DNA, 22 bp, Homo sapiens
agtgcctggatcccctctgtct

SEQ ID NO: 3136409 - DNA, 23 bp, Homo sapiens
agtgcctggatcccctctgtcta

SEQ ID NO: 3136410 - DNA, 20 bp, Homo sapiens
agtgccttctccttccccag

SEQ ID NO: 3136411 - DNA, 21 bp, Homo sapiens
agtgccttctccttccccagg

SEQ ID NO: 3136412 - DNA, 12 bp, Homo sapiens
agtgccttctct

SEQ ID NO: 3136413 - DNA, 19 bp, Homo sapiens
agtgccttttgcagaagag

SEQ ID NO: 3136414 - DNA, 21 bp, Homo sapiens
agtgccttttgctgcgcacca

SEQ ID NO: 3136415 - DNA, 18 bp, Homo sapiens
agtgcgctcttggtccct

SEQ ID NO: 3136416 - DNA, 21 bp, Homo sapiens
agtgcgctcttggtccctggt

SEQ ID NO: 3136417 - DNA, 15 bp, Homo sapiens
agtgcggcgtggaga

SEQ ID NO: 3136418 - DNA, 17 bp, Homo sapiens
agtgcgtctgaggggac

SEQ ID NO: 3136419 - DNA, 16 bp, Homo sapiens
agtgcgtgccgtgtga

SEQ ID NO: 3136420 - DNA, 22 bp, Homo sapiens
agtgctaaacaagtaagaaaaa

SEQ ID NO: 3136421 - DNA, 20 bp, Homo sapiens
agtgctaagattacaggcgt

SEQ ID NO: 3136422 - DNA, 13 bp, Homo sapiens
agtgctaaggttc

SEQ ID NO: 3136423 - DNA, 15 bp, Homo sapiens
agtgctaaggttcta

SEQ ID NO: 3136424 - DNA, 16 bp, Homo sapiens
agtgctaaggttctaa

SEQ ID NO: 3136425 - DNA, 17 bp, Homo sapiens
agtgctaaggttctaag

SEQ ID NO: 3136426 - DNA, 21 bp, Homo sapiens
agtgctagtgagctgggcatg

SEQ ID NO: 3136427 - DNA, 14 bp, Homo sapiens
agtgctatatatat

SEQ ID NO: 3136428 - DNA, 22 bp, Homo sapiens
agtgctatatatataaatattt

SEQ ID NO: 3136429 - DNA, 14 bp, Homo sapiens
agtgctattgcaga

SEQ ID NO: 3136430 - DNA, 14 bp, Homo sapiens
agtgctcctgaaag

SEQ ID NO: 3136431 - DNA, 15 bp, Homo sapiens
agtgctgaacagtgg

SEQ ID NO: 3136432 - DNA, 12 bp, Homo sapiens
agtgctgccatg

SEQ ID NO: 3136433 - DNA, 14 bp, Homo sapiens
agtgctgccatgcc

SEQ ID NO: 3136434 - DNA, 22 bp, Homo sapiens
agtgctgccatgccactgccag

SEQ ID NO: 3136435 - DNA, 23 bp, Homo sapiens
agtgctgccatgccactgccagg

SEQ ID NO: 3136436 - DNA, 24 bp, Homo sapiens
agtgctgccatgccactgccaggc

SEQ ID NO: 3136437 - DNA, 13 bp, Homo sapiens
agtgctgctgtaa

SEQ ID NO: 3136438 - DNA, 12 bp, Homo sapiens
agtgctggactg

SEQ ID NO: 3136439 - DNA, 13 bp, Homo sapiens
agtgctggactgt

SEQ ID NO: 3136440 - DNA, 19 bp, Homo sapiens
agtgctggattgtccttgg

SEQ ID NO: 3136441 - DNA, 13 bp, Homo sapiens
agtgctggctcac

SEQ ID NO: 3136442 - DNA, 17 bp, Homo sapiens
agtgctggctcacagta

SEQ ID NO: 3136443 - DNA, 17 bp, Homo sapiens
agtgctgggaccagagc

SEQ ID NO: 3136444 - DNA, 20 bp, Homo sapiens
agtgctgggaccagagccag

SEQ ID NO: 3136445 - DNA, 20 bp, Homo sapiens
agtgctgggattacaggcat

SEQ ID NO: 3136446 - DNA, 20 bp, Homo sapiens
agtgctgggattacaggcgt

SEQ ID NO: 3136447 - DNA, 19 bp, Homo sapiens
agtgctgggattacaggtg

SEQ ID NO: 3136448 - DNA, 22 bp, Homo sapiens
agtgctgtacccttccacctcc

SEQ ID NO: 3136449 - DNA, 20 bp, Homo sapiens
agtgctgtccatgcttctca

SEQ ID NO: 3136450 - DNA, 17 bp, Homo sapiens
agtgctgtggcctgggc

SEQ ID NO: 3136451 - DNA, 20 bp, Homo sapiens
agtgctgtggcctgggcaag

SEQ ID NO: 3136452 - DNA, 16 bp, Homo sapiens
agtgcttaaaaatcat

SEQ ID NO: 3136453 - DNA, 19 bp, Homo sapiens
agtgcttaaaaatcattga

SEQ ID NO: 3136454 - DNA, 12 bp, Homo sapiens
agttcaaaaaca

SEQ ID NO: 3136455 - DNA, 15 bp, Homo sapiens
agttcaaactgcagc

SEQ ID NO: 3136456 - DNA, 13 bp, Homo sapiens
agttcaaagtgta

SEQ ID NO: 3136457 - DNA, 15 bp, Homo sapiens
agttcaaagtgtata

SEQ ID NO: 3136458 - DNA, 22 bp, Homo sapiens
agttcaaagtgtatatttattc

SEQ ID NO: 3136459 - DNA, 18 bp, Homo sapiens
agttcaaattcttctgaa

SEQ ID NO: 3136460 - DNA, 20 bp, Homo sapiens
agttcaacctggtggcacca

SEQ ID NO: 3136461 - DNA, 15 bp, Homo sapiens
agttcaagcctgtgg

SEQ ID NO: 3136462 - DNA, 18 bp, Homo sapiens
agttcaataaatgtctgt

SEQ ID NO: 3136463 - DNA, 19 bp, Homo sapiens
agttcaataaatgtctgtt

SEQ ID NO: 3136464 - DNA, 21 bp, Homo sapiens
agttcaataaatgtctgttga

SEQ ID NO: 3136465 - DNA, 10 bp, Homo sapiens
agttcaatgc

SEQ ID NO: 3136466 - DNA, 16 bp, Homo sapiens
agttcaattctcattt

SEQ ID NO: 3136467 - DNA, 15 bp, Homo sapiens
agttcacaccctgca

SEQ ID NO: 3136468 - DNA, 16 bp, Homo sapiens
agttcacaccctgcaa

SEQ ID NO: 3136469 - DNA, 23 bp, Homo sapiens
agttcacaccctgcaaggcccac

SEQ ID NO: 3136470 - DNA, 15 bp, Homo sapiens
agttcaccatctctt

SEQ ID NO: 3136471 - DNA, 15 bp, Homo sapiens
agttcagcaccaccc

SEQ ID NO: 3136472 - DNA, 17 bp, Homo sapiens
agttcagcaccacccta

SEQ ID NO: 3136473 - DNA, 16 bp, Homo sapiens
agttcagtagaattac

SEQ ID NO: 3136474 - DNA, 17 bp, Homo sapiens
agttcagtagaattacc

SEQ ID NO: 3136475 - DNA, 11 bp, Homo sapiens
agttcagtggc

SEQ ID NO: 3136476 - DNA, 23 bp, Homo sapiens
agttcagtggcagggctcaggat

SEQ ID NO: 3136477 - DNA, 16 bp, Homo sapiens
agttcataacagtgcc

SEQ ID NO: 3136478 - DNA, 17 bp, Homo sapiens
agttcataacagtgcca

SEQ ID NO: 3136479 - DNA, 21 bp, Homo sapiens
agttcatacctaagtactgta

SEQ ID NO: 3136480 - DNA, 22 bp, Homo sapiens
agttcatatgtaccatgtacat

SEQ ID NO: 3136481 - DNA, 19 bp, Homo sapiens
agttcatattccatattta

SEQ ID NO: 3136482 - DNA, 18 bp, Homo sapiens
agttcatccaatcctcac

SEQ ID NO: 3136483 - DNA, 18 bp, Homo sapiens
agttcatcccagccccaa

SEQ ID NO: 3136484 - DNA, 20 bp, Homo sapiens
agttcatcccagccccaatt

SEQ ID NO: 3136485 - DNA, 17 bp, Homo sapiens
agttcatggtgatcagt

SEQ ID NO: 3136486 - DNA, 17 bp, Homo sapiens
agttcattattttgtgg

SEQ ID NO: 3136487 - DNA, 13 bp, Homo sapiens
agttccaagagtc

SEQ ID NO: 3136488 - DNA, 19 bp, Homo sapiens
agttccaagttgaagggaa

SEQ ID NO: 3136489 - DNA, 18 bp, Homo sapiens
agttccacagattgtttc

SEQ ID NO: 3136490 - DNA, 21 bp, Homo sapiens
agttcccagctccccccgccc

SEQ ID NO: 3136491 - DNA, 23 bp, Homo sapiens
agttcccagctccccccgcccac

SEQ ID NO: 3136492 - DNA, 22 bp, Homo sapiens
agttcccccaaccatcttcact

SEQ ID NO: 3136493 - DNA, 23 bp, Homo sapiens
agttcccccaaccatcttcactg

SEQ ID NO: 3136494 - DNA, 18 bp, Homo sapiens
agttcccccaacctcaga

SEQ ID NO: 3136495 - DNA, 22 bp, Homo sapiens
agttcccccagtacctccaagc

SEQ ID NO: 3136496 - DNA, 22 bp, Homo sapiens
agttcccggagcacagccctgg

SEQ ID NO: 3136497 - DNA, 17 bp, Homo sapiens
agttccctacttcctgt

SEQ ID NO: 3136498 - DNA, 19 bp, Homo sapiens
agttccctctgctcagcca

SEQ ID NO: 3136499 - DNA, 14 bp, Homo sapiens
agttccctggagaa

SEQ ID NO: 3136500 - DNA, 23 bp, Homo sapiens
agttccctggagaaaaaaattgc

SEQ ID NO: 3136501 - DNA, 20 bp, Homo sapiens
agttccctgtctcttgaaaa

SEQ ID NO: 3136502 - DNA, 22 bp, Homo sapiens
agttcccttgaaactttgggaa

SEQ ID NO: 3136503 - DNA, 18 bp, Homo sapiens
agttcccttggcctcaga

SEQ ID NO: 3136504 - DNA, 18 bp, Homo sapiens
agttcctaacaggatgaa

SEQ ID NO: 3136505 - DNA, 13 bp, Homo sapiens
agttcctaagaag

SEQ ID NO: 3136506 - DNA, 15 bp, Homo sapiens
agttcctaagaagct

SEQ ID NO: 3136507 - DNA, 16 bp, Homo sapiens
agttcctaagaagctt

SEQ ID NO: 3136508 - DNA, 20 bp, Homo sapiens
agttcctgcggagtgaagag

SEQ ID NO: 3136509 - DNA, 21 bp, Homo sapiens
agttcctgcggagtgaagagg

SEQ ID NO: 3136510 - DNA, 23 bp, Homo sapiens
agttcctgctacaacttcagcag

SEQ ID NO: 3136511 - DNA, 21 bp, Homo sapiens
agttcctggcccatcaactgt

SEQ ID NO: 3136512 - DNA, 13 bp, Homo sapiens
agttcctgggaac

SEQ ID NO: 3136513 - DNA, 19 bp, Homo sapiens
agttcgaacatgtttcact

SEQ ID NO: 3136514 - DNA, 13 bp, Homo sapiens
agttcgtctgttg

SEQ ID NO: 3136515 - DNA, 15 bp, Homo sapiens
agttctaaattttgt

SEQ ID NO: 3136516 - DNA, 19 bp, Homo sapiens
agttctaacagtgaagttt

SEQ ID NO: 3136517 - DNA, 23 bp, Homo sapiens
agttctaagactcaaatgttcta

SEQ ID NO: 3136518 - DNA, 18 bp, Homo sapiens
agttctaataatttctaa

SEQ ID NO: 3136519 - DNA, 19 bp, Homo sapiens
agttctaataatttctaat

SEQ ID NO: 3136520 - DNA, 22 bp, Homo sapiens
agttctactatggctgagttct

SEQ ID NO: 3136521 - DNA, 22 bp, Homo sapiens
agttctagacatggaggttcta

SEQ ID NO: 3136522 - DNA, 19 bp, Homo sapiens
agttctatcagttatcctt

SEQ ID NO: 3136523 - DNA, 12 bp, Homo sapiens
agttctcactgt

SEQ ID NO: 3136524 - DNA, 18 bp, Homo sapiens
agttctcagggctcctgc

SEQ ID NO: 3136525 - DNA, 16 bp, Homo sapiens
agttctctcccttcct

SEQ ID NO: 3136526 - DNA, 22 bp, Homo sapiens
agttctctcccttcctctctcc

SEQ ID NO: 3136527 - DNA, 16 bp, Homo sapiens
agttctgccaggcaac

SEQ ID NO: 3136528 - DNA, 14 bp, Homo sapiens
agttctgctcctct

SEQ ID NO: 3136529 - DNA, 19 bp, Homo sapiens
agttctgtggtttcatgtt

SEQ ID NO: 3136530 - DNA, 13 bp, Homo sapiens
agttctgtgtaca

SEQ ID NO: 3136531 - DNA, 15 bp, Homo sapiens
agttctgtgtacatt

SEQ ID NO: 3136532 - DNA, 15 bp, Homo sapiens
agttctgtgtacttt

SEQ ID NO: 3136533 - DNA, 22 bp, Homo sapiens
agttcttaaggattgtgatatt

SEQ ID NO: 3136534 - DNA, 14 bp, Homo sapiens
agttcttcacctct

SEQ ID NO: 3136535 - DNA, 19 bp, Homo sapiens
agttcttggtgactgtccc

SEQ ID NO: 3136536 - DNA, 20 bp, Homo sapiens
agttcttggtgactgtccca

SEQ ID NO: 3136537 - DNA, 21 bp, Homo sapiens
agttcttggtgactgtcccac

SEQ ID NO: 3136538 - DNA, 16 bp, Homo sapiens
agttcttggtgctctg

SEQ ID NO: 3136539 - DNA, 19 bp, Homo sapiens
agttctttccataataaaa

SEQ ID NO: 3136540 - DNA, 12 bp, Homo sapiens
agttctttcctc

SEQ ID NO: 3136541 - DNA, 19 bp, Homo sapiens
agttctttcctccccctgc

SEQ ID NO: 3136542 - DNA, 20 bp, Homo sapiens
agttctttcctccccctgca

SEQ ID NO: 3136543 - DNA, 21 bp, Homo sapiens
agttctttcctccccctgcaa

SEQ ID NO: 3136544 - DNA, 22 bp, Homo sapiens
agttctttcctccccctgcaac

SEQ ID NO: 3136545 - DNA, 20 bp, Homo sapiens
agttctttttgtacacttaa

SEQ ID NO: 3136546 - DNA, 16 bp, Homo sapiens
agttgaaaaatctagt

SEQ ID NO: 3136547 - DNA, 15 bp, Homo sapiens
agttgaaccattata

SEQ ID NO: 3136548 - DNA, 16 bp, Homo sapiens
agttgaagctaagatt

SEQ ID NO: 3136549 - DNA, 13 bp, Homo sapiens
agttgaagggaaa

SEQ ID NO: 3136550 - DNA, 22 bp, Homo sapiens
agttgaatgttgcaatgtgaaa

SEQ ID NO: 3136551 - DNA, 16 bp, Homo sapiens
agttgactcacaggcc

SEQ ID NO: 3136552 - DNA, 12 bp, Homo sapiens
agttgagcccca

SEQ ID NO: 3136553 - DNA, 17 bp, Homo sapiens
agttgaggagtttccta

SEQ ID NO: 3136554 - DNA, 12 bp, Homo sapiens
agttgatcttct

SEQ ID NO: 3136555 - DNA, 16 bp, Homo sapiens
agttgatgttgcattt

SEQ ID NO: 3136556 - DNA, 11 bp, Homo sapiens
agttgcagaaa

SEQ ID NO: 3136557 - DNA, 23 bp, Homo sapiens
agttgcagactcagtttgtcaga

SEQ ID NO: 3136558 - DNA, 21 bp, Homo sapiens
agttgcagatgtattgactgt

SEQ ID NO: 3136559 - DNA, 17 bp, Homo sapiens
agttgcatagcagtata

SEQ ID NO: 3136560 - DNA, 13 bp, Homo sapiens
agttgccaagaca

SEQ ID NO: 3136561 - DNA, 18 bp, Homo sapiens
agttgccaagacaaatca

SEQ ID NO: 3136562 - DNA, 14 bp, Homo sapiens
agttgccaccacct

SEQ ID NO: 3136563 - DNA, 20 bp, Homo sapiens
agttgccaccacctctgtgg

SEQ ID NO: 3136564 - DNA, 13 bp, Homo sapiens
agttgcccagagc

SEQ ID NO: 3136565 - DNA, 14 bp, Homo sapiens
agttgcccagagca

SEQ ID NO: 3136566 - DNA, 14 bp, Homo sapiens
agttgcctttattt

SEQ ID NO: 3136567 - DNA, 21 bp, Homo sapiens
agttgcgacggagagaaaaaa

SEQ ID NO: 3136568 - DNA, 16 bp, Homo sapiens
agttgctgcaaacctg

SEQ ID NO: 3136569 - DNA, 16 bp, Homo sapiens
agttgctgtcactgtt

SEQ ID NO: 3136570 - DNA, 13 bp, Homo sapiens
agttgctgtttat

SEQ ID NO: 3136571 - DNA, 19 bp, Homo sapiens
agttgcttgtcttctggta

SEQ ID NO: 3136572 - DNA, 19 bp, Homo sapiens
agttggcagagaaggcctc

SEQ ID NO: 3136573 - DNA, 20 bp, Homo sapiens
agttggcagagaaggcctct

SEQ ID NO: 3136574 - DNA, 16 bp, Homo sapiens
agttggctaggacccc

SEQ ID NO: 3136575 - DNA, 15 bp, Homo sapiens
agttgggactcagga

SEQ ID NO: 3136576 - DNA, 19 bp, Homo sapiens
agttgggactcaggatatt

SEQ ID NO: 3136577 - DNA, 13 bp, Homo sapiens
agttgggagcact

SEQ ID NO: 3136578 - DNA, 13 bp, Homo sapiens
agttgggcttcct

SEQ ID NO: 3136579 - DNA, 19 bp, Homo sapiens
agttggggaagccaggtga

SEQ ID NO: 3136580 - DNA, 17 bp, Homo sapiens
agttggggacagaactc

SEQ ID NO: 3136581 - DNA, 19 bp, Homo sapiens
agttgggtagatgggtggg

SEQ ID NO: 3136582 - DNA, 17 bp, Homo sapiens
agttgggtggatgcctg

SEQ ID NO: 3136583 - DNA, 15 bp, Homo sapiens
agttgggtgtctcct

SEQ ID NO: 3136584 - DNA, 16 bp, Homo sapiens
agttgggtgtctcctt

SEQ ID NO: 3136585 - DNA, 13 bp, Homo sapiens
agttggtaacttt

SEQ ID NO: 3136586 - DNA, 19 bp, Homo sapiens
agttggtattaataaaaag

SEQ ID NO: 3136587 - DNA, 20 bp, Homo sapiens
agttggtggggccaggccag

SEQ ID NO: 3136588 - DNA, 16 bp, Homo sapiens
agttggtttgtatgag

SEQ ID NO: 3136589 - DNA, 14 bp, Homo sapiens
agttgtacaaatgt

SEQ ID NO: 3136590 - DNA, 16 bp, Homo sapiens
agttgtacaaatgtat

SEQ ID NO: 3136591 - DNA, 18 bp, Homo sapiens
agttgtagacaaagtaca

SEQ ID NO: 3136592 - DNA, 16 bp, Homo sapiens
agttgtagcagattgt

SEQ ID NO: 3136593 - DNA, 19 bp, Homo sapiens
agttgtattcttctgtatt

SEQ ID NO: 3136594 - DNA, 18 bp, Homo sapiens
agttgtcctatggacaac

SEQ ID NO: 3136595 - DNA, 21 bp, Homo sapiens
agttgtctctcttcagactct

SEQ ID NO: 3136596 - DNA, 19 bp, Homo sapiens
agttgtgccttttatagct

SEQ ID NO: 3136597 - DNA, 19 bp, Homo sapiens
agttgtgcttgtttacagc

SEQ ID NO: 3136598 - DNA, 21 bp, Homo sapiens
agttgtggaaagcctctgctg

SEQ ID NO: 3136599 - DNA, 17 bp, Homo sapiens
agttgtgttttttaaga

SEQ ID NO: 3136600 - DNA, 19 bp, Homo sapiens
agttgtgttttttaagatg

SEQ ID NO: 3136601 - DNA, 20 bp, Homo sapiens
agttgttcaactattttatt

SEQ ID NO: 3136602 - DNA, 23 bp, Homo sapiens
agttgtttctagactataaatgt

SEQ ID NO: 3136603 - DNA, 12 bp, Homo sapiens
agtttaaaaaaa

SEQ ID NO: 3136604 - DNA, 15 bp, Homo sapiens
agtttaaaacacatt

SEQ ID NO: 3136605 - DNA, 18 bp, Homo sapiens
agtttaaaagccatgtat

SEQ ID NO: 3136606 - DNA, 12 bp, Homo sapiens
agtttaaagcaa

SEQ ID NO: 3136607 - DNA, 23 bp, Homo sapiens
agtttaagtgtgcagccatagtt

SEQ ID NO: 3136608 - DNA, 15 bp, Homo sapiens
agtttacaagtgtat

SEQ ID NO: 3136609 - DNA, 16 bp, Homo sapiens
agtttacaagtgtata

SEQ ID NO: 3136610 - DNA, 19 bp, Homo sapiens
agtttacaagtgtatatca

SEQ ID NO: 3136611 - DNA, 18 bp, Homo sapiens
agtttacagaaaaatctt

SEQ ID NO: 3136612 - DNA, 19 bp, Homo sapiens
agtttacagaaaaatcttg

SEQ ID NO: 3136613 - DNA, 13 bp, Homo sapiens
agtttacattgta

SEQ ID NO: 3136614 - DNA, 17 bp, Homo sapiens
agtttaccatttgtaat

SEQ ID NO: 3136615 - DNA, 19 bp, Homo sapiens
agtttaccatttgtaataa

SEQ ID NO: 3136616 - DNA, 18 bp, Homo sapiens
agtttacctggcttattt

SEQ ID NO: 3136617 - DNA, 15 bp, Homo sapiens
agtttactgatgaaa

SEQ ID NO: 3136618 - DNA, 14 bp, Homo sapiens
agtttagaggaaaa

SEQ ID NO: 3136619 - DNA, 21 bp, Homo sapiens
agtttagaggaaaaaaatgac

SEQ ID NO: 3136620 - DNA, 13 bp, Homo sapiens
agtttaggagaaa

SEQ ID NO: 3136621 - DNA, 14 bp, Homo sapiens
agtttaggagaaac

SEQ ID NO: 3136622 - DNA, 13 bp, Homo sapiens
agtttatccaaat

SEQ ID NO: 3136623 - DNA, 16 bp, Homo sapiens
agtttattataatggt

SEQ ID NO: 3136624 - DNA, 15 bp, Homo sapiens
agtttattggaagtg

SEQ ID NO: 3136625 - DNA, 20 bp, Homo sapiens
agtttatttttaaagataga

SEQ ID NO: 3136626 - DNA, 16 bp, Homo sapiens
agtttatttttcacac

SEQ ID NO: 3136627 - DNA, 21 bp, Homo sapiens
agtttcaaacttactattttg

SEQ ID NO: 3136628 - DNA, 20 bp, Homo sapiens
agtttcaagttttaaagttc

SEQ ID NO: 3136629 - DNA, 22 bp, Homo sapiens
agtttcaagttttaaagttcat

SEQ ID NO: 3136630 - DNA, 19 bp, Homo sapiens
agtttcaatgtagtctgta

SEQ ID NO: 3136631 - DNA, 16 bp, Homo sapiens
agtttcaatgtgattc

SEQ ID NO: 3136632 - DNA, 23 bp, Homo sapiens
agtttcacaggtcaataaactta

SEQ ID NO: 3136633 - DNA, 14 bp, Homo sapiens
agtttcagacaggg

SEQ ID NO: 3136634 - DNA, 17 bp, Homo sapiens
agtttcagatatatatc

SEQ ID NO: 3136635 - DNA, 17 bp, Homo sapiens
agtttcagcttaaaata

SEQ ID NO: 3136636 - DNA, 22 bp, Homo sapiens
agtttcagcttaaaataaacag

SEQ ID NO: 3136637 - DNA, 20 bp, Homo sapiens
agtttcaggatacatgtgcc

SEQ ID NO: 3136638 - DNA, 15 bp, Homo sapiens
agtttcaggtgacat

SEQ ID NO: 3136639 - DNA, 17 bp, Homo sapiens
agtttcaggtgacatgt

SEQ ID NO: 3136640 - DNA, 19 bp, Homo sapiens
agtttcagtttgttggaaa

SEQ ID NO: 3136641 - DNA, 15 bp, Homo sapiens
agtttcatgtacaag

SEQ ID NO: 3136642 - DNA, 18 bp, Homo sapiens
agtttcatgtacaagatg

SEQ ID NO: 3136643 - DNA, 20 bp, Homo sapiens
agtttcattctcctgcctgt

SEQ ID NO: 3136644 - DNA, 17 bp, Homo sapiens
agtttccagtctcaaaa

SEQ ID NO: 3136645 - DNA, 16 bp, Homo sapiens
agtttcccttcctcca

SEQ ID NO: 3136646 - DNA, 20 bp, Homo sapiens
agtttcccttcctccatcct

SEQ ID NO: 3136647 - DNA, 23 bp, Homo sapiens
agtttccgtttccaggtgtttat

SEQ ID NO: 3136648 - DNA, 17 bp, Homo sapiens
agtttcctaaaagttca

SEQ ID NO: 3136649 - DNA, 16 bp, Homo sapiens
agtttcctaatcagaa

SEQ ID NO: 3136650 - DNA, 17 bp, Homo sapiens
agtttctagaggcctca

SEQ ID NO: 3136651 - DNA, 16 bp, Homo sapiens
agtttctagctagaaa

SEQ ID NO: 3136652 - DNA, 15 bp, Homo sapiens
agtttcttagctttt

SEQ ID NO: 3136653 - DNA, 15 bp, Homo sapiens
agtttcttcttacac

SEQ ID NO: 3136654 - DNA, 20 bp, Homo sapiens
agtttcttcttacacttctt

SEQ ID NO: 3136655 - DNA, 15 bp, Homo sapiens
agtttgaacttcata

SEQ ID NO: 3136656 - DNA, 20 bp, Homo sapiens
agtttgaagcacaactccct

SEQ ID NO: 3136657 - DNA, 21 bp, Homo sapiens
agtttgaagcacaactccctt

SEQ ID NO: 3136658 - DNA, 18 bp, Homo sapiens
agtttgaaggaaacagtt

SEQ ID NO: 3136659 - DNA, 21 bp, Homo sapiens
agtttgagacaagccctggca

SEQ ID NO: 3136660 - DNA, 21 bp, Homo sapiens
agtttgcaaataggcagaatg

SEQ ID NO: 3136661 - DNA, 20 bp, Homo sapiens
agtttgcactgtatgctgga

SEQ ID NO: 3136662 - DNA, 11 bp, Homo sapiens
agtttgctgta

SEQ ID NO: 3136663 - DNA, 14 bp, Homo sapiens
agtttgcttagaaa

SEQ ID NO: 3136664 - DNA, 15 bp, Homo sapiens
agtttggaatgaaga

SEQ ID NO: 3136665 - DNA, 20 bp, Homo sapiens
agtttggagcactagtttga

SEQ ID NO: 3136666 - DNA, 22 bp, Homo sapiens
agtttggagcactagtttgatt

SEQ ID NO: 3136667 - DNA, 21 bp, Homo sapiens
agtttggatatttttgtactt

SEQ ID NO: 3136668 - DNA, 20 bp, Homo sapiens
agtttgggtaaaatactttt

SEQ ID NO: 3136669 - DNA, 21 bp, Homo sapiens
agtttggtttatattcttatg

SEQ ID NO: 3136670 - DNA, 15 bp, Homo sapiens
agtttgtaaaaatat

SEQ ID NO: 3136671 - DNA, 15 bp, Homo sapiens
agtttgtagccaggt

SEQ ID NO: 3136672 - DNA, 20 bp, Homo sapiens
agtttgtaggtaaaatgtat

SEQ ID NO: 3136673 - DNA, 17 bp, Homo sapiens
agtttgtataacttctt

SEQ ID NO: 3136674 - DNA, 14 bp, Homo sapiens
agtttgtcattata

SEQ ID NO: 3136675 - DNA, 14 bp, Homo sapiens
agtttgtctatttt

SEQ ID NO: 3136676 - DNA, 15 bp, Homo sapiens
agtttgtctatttta

SEQ ID NO: 3136677 - DNA, 16 bp, Homo sapiens
agtttgtctattttaa

SEQ ID NO: 3136678 - DNA, 19 bp, Homo sapiens
agtttgtctattttaaaat

SEQ ID NO: 3136679 - DNA, 19 bp, Homo sapiens
agtttgtgtgtatttgtat

SEQ ID NO: 3136680 - DNA, 21 bp, Homo sapiens
agtttgtgtgtatttgtatta

SEQ ID NO: 3136681 - DNA, 22 bp, Homo sapiens
agtttgtgtgtatttgtattaa

SEQ ID NO: 3136682 - DNA, 16 bp, Homo sapiens
agtttgtgtgtcttaa

SEQ ID NO: 3136683 - DNA, 18 bp, Homo sapiens
agtttgtgtgttgtcttg

SEQ ID NO: 3136684 - DNA, 20 bp, Homo sapiens
agtttgtgtgttgtcttgaa

SEQ ID NO: 3136685 - DNA, 15 bp, Homo sapiens
agtttgttctccggg

SEQ ID NO: 3136686 - DNA, 20 bp, Homo sapiens
agttttacttttaaactgtg

SEQ ID NO: 3136687 - DNA, 15 bp, Homo sapiens
agttttatatgcttt

SEQ ID NO: 3136688 - DNA, 15 bp, Homo sapiens
agttttatgctcttt

SEQ ID NO: 3136689 - DNA, 24 bp, Homo sapiens
agttttatgctcttttttactcat

SEQ ID NO: 3136690 - DNA, 22 bp, Homo sapiens
agttttcaagtcaaattaataa

SEQ ID NO: 3136691 - DNA, 16 bp, Homo sapiens
agttttcagaacctct

SEQ ID NO: 3136692 - DNA, 22 bp, Homo sapiens
agttttcagaacctcttcccca

SEQ ID NO: 3136693 - DNA, 13 bp, Homo sapiens
agttttcagcctt

SEQ ID NO: 3136694 - DNA, 16 bp, Homo sapiens
agttttcagccttggg

SEQ ID NO: 3136695 - DNA, 23 bp, Homo sapiens
agttttcagctgctcagaattca

SEQ ID NO: 3136696 - DNA, 13 bp, Homo sapiens
agttttccagtat

SEQ ID NO: 3136697 - DNA, 16 bp, Homo sapiens
agttttccatgaaaac

SEQ ID NO: 3136698 - DNA, 12 bp, Homo sapiens
agttttctctta

SEQ ID NO: 3136699 - DNA, 15 bp, Homo sapiens
agttttgaaaagcta

SEQ ID NO: 3136700 - DNA, 17 bp, Homo sapiens
agttttgaaagaaaaat

SEQ ID NO: 3136701 - DNA, 13 bp, Homo sapiens
agttttgaatgtt

SEQ ID NO: 3136702 - DNA, 18 bp, Homo sapiens
agttttgagtagatatta

SEQ ID NO: 3136703 - DNA, 20 bp, Homo sapiens
agttttgagtagatattact

SEQ ID NO: 3136704 - DNA, 14 bp, Homo sapiens
agttttgattttgg

SEQ ID NO: 3136705 - DNA, 19 bp, Homo sapiens
agttttgattttggaaaga

SEQ ID NO: 3136706 - DNA, 16 bp, Homo sapiens
ataactcatcataaaa

SEQ ID NO: 3136707 - DNA, 17 bp, Homo sapiens
ataactcatcataaaat

SEQ ID NO: 3136708 - DNA, 18 bp, Homo sapiens
ataactcatcataaaata

SEQ ID NO: 3136709 - DNA, 12 bp, Homo sapiens
ataactctgtaa

SEQ ID NO: 3136710 - DNA, 21 bp, Homo sapiens
ataactctgtaaaaacactga

SEQ ID NO: 3136711 - DNA, 20 bp, Homo sapiens
ataactctgtataatagaga

SEQ ID NO: 3136712 - DNA, 19 bp, Homo sapiens
ataactgaaccaaattgca

SEQ ID NO: 3136713 - DNA, 14 bp, Homo sapiens
ataactgtagctca

SEQ ID NO: 3136714 - DNA, 12 bp, Homo sapiens
ataacttaaaaa

SEQ ID NO: 3136715 - DNA, 14 bp, Homo sapiens
ataacttactgtat

SEQ ID NO: 3136716 - DNA, 17 bp, Homo sapiens
ataacttactgtatatg

SEQ ID NO: 3136717 - DNA, 19 bp, Homo sapiens
ataacttactgtatatgta

SEQ ID NO: 3136718 - DNA, 14 bp, Homo sapiens
ataacttattagca

SEQ ID NO: 3136719 - DNA, 15 bp, Homo sapiens
ataacttattagcag

SEQ ID NO: 3136720 - DNA, 13 bp, Homo sapiens
ataacttcagtcc

SEQ ID NO: 3136721 - DNA, 20 bp, Homo sapiens
ataacttcagtcctgctcca

SEQ ID NO: 3136722 - DNA, 13 bp, Homo sapiens
ataacttctatat

SEQ ID NO: 3136723 - DNA, 14 bp, Homo sapiens
ataacttctgacct

SEQ ID NO: 3136724 - DNA, 16 bp, Homo sapiens
ataacttcttaaaagt

SEQ ID NO: 3136725 - DNA, 19 bp, Homo sapiens
ataacttcttaaaagttgt

SEQ ID NO: 3136726 - DNA, 14 bp, Homo sapiens
ataacttcttcctg

SEQ ID NO: 3136727 - DNA, 15 bp, Homo sapiens
ataacttcttcctgc

SEQ ID NO: 3136728 - DNA, 18 bp, Homo sapiens
ataacttcttcctgctgg

SEQ ID NO: 3136729 - DNA, 24 bp, Homo sapiens
ataacttcttcctgctggacagag

SEQ ID NO: 3136730 - DNA, 17 bp, Homo sapiens
ataacttggggaggcaa

SEQ ID NO: 3136731 - DNA, 20 bp, Homo sapiens
ataacttttttgagtcattg

SEQ ID NO: 3136732 - DNA, 23 bp, Homo sapiens
ataagaaatgtattcctgaaaag

SEQ ID NO: 3136733 - DNA, 23 bp, Homo sapiens
ataagaagaagttcatgtccaaa

SEQ ID NO: 3136734 - DNA, 18 bp, Homo sapiens
ataagaatggagcagtac

SEQ ID NO: 3136735 - DNA, 22 bp, Homo sapiens
ataagactgtttttaagtaact

SEQ ID NO: 3136736 - DNA, 14 bp, Homo sapiens
ataagagaaagaaa

SEQ ID NO: 3136737 - DNA, 19 bp, Homo sapiens
ataagagagccttggttca

SEQ ID NO: 3136738 - DNA, 12 bp, Homo sapiens
ataagcaagaga

SEQ ID NO: 3136739 - DNA, 13 bp, Homo sapiens
ataagcactgtaa

SEQ ID NO: 3136740 - DNA, 17 bp, Homo sapiens
ataagcactgtgctaat

SEQ ID NO: 3136741 - DNA, 18 bp, Homo sapiens
ataagcactgtgctaata

SEQ ID NO: 3136742 - DNA, 16 bp, Homo sapiens
ataagcaggtggatct

SEQ ID NO: 3136743 - DNA, 22 bp, Homo sapiens
ataagcccagtgctgctgtaaa

SEQ ID NO: 3136744 - DNA, 21 bp, Homo sapiens
ataagcctccatttagttctt

SEQ ID NO: 3136745 - DNA, 12 bp, Homo sapiens
ataagcctgagc

SEQ ID NO: 3136746 - DNA, 15 bp, Homo sapiens
ataagcctgagcctt

SEQ ID NO: 3136747 - DNA, 18 bp, Homo sapiens
ataagcggcgtaagttta

SEQ ID NO: 3136748 - DNA, 16 bp, Homo sapiens
ataagctaaagaggct

SEQ ID NO: 3136749 - DNA, 17 bp, Homo sapiens
ataagctaaagaggctg

SEQ ID NO: 3136750 - DNA, 17 bp, Homo sapiens
ataagctcgagtgaatt

SEQ ID NO: 3136751 - DNA, 22 bp, Homo sapiens
ataagctgggaaaaaagttttg

SEQ ID NO: 3136752 - DNA, 18 bp, Homo sapiens
ataaggaaagcaataaat

SEQ ID NO: 3136753 - DNA, 14 bp, Homo sapiens
ataaggaagagggc

SEQ ID NO: 3136754 - DNA, 16 bp, Homo sapiens
ataaggccttaatatg

SEQ ID NO: 3136755 - DNA, 13 bp, Homo sapiens
ataagggaaaaga

SEQ ID NO: 3136756 - DNA, 12 bp, Homo sapiens
ataagggagagc

SEQ ID NO: 3136757 - DNA, 18 bp, Homo sapiens
ataagggagagctgagcc

SEQ ID NO: 3136758 - DNA, 23 bp, Homo sapiens
ataaggtttcgtttctgtataca

SEQ ID NO: 3136759 - DNA, 19 bp, Homo sapiens
ataagtagttggtttgtat

SEQ ID NO: 3136760 - DNA, 22 bp, Homo sapiens
ataagtagttggtttgtatgag

SEQ ID NO: 3136761 - DNA, 18 bp, Homo sapiens
ataagtcaagcacatgta

SEQ ID NO: 3136762 - DNA, 20 bp, Homo sapiens
ataagtgcacacagaaatat

SEQ ID NO: 3136763 - DNA, 21 bp, Homo sapiens
ataagtgctattgcagagccg

SEQ ID NO: 3136764 - DNA, 13 bp, Homo sapiens
ataagtggaaaaa

SEQ ID NO: 3136765 - DNA, 17 bp, Homo sapiens
ataagtggaaaaaagag

SEQ ID NO: 3136766 - DNA, 19 bp, Homo sapiens
ataagtggaggcactttag

SEQ ID NO: 3136767 - DNA, 20 bp, Homo sapiens
ataagtggaggcactttagg

SEQ ID NO: 3136768 - DNA, 14 bp, Homo sapiens
ataagtgtattttt

SEQ ID NO: 3136769 - DNA, 16 bp, Homo sapiens
ataagtgtatttttca

SEQ ID NO: 3136770 - DNA, 21 bp, Homo sapiens
ataagtgtgtggtcccaagtt

SEQ ID NO: 3136771 - DNA, 12 bp, Homo sapiens
ataagttatttt

SEQ ID NO: 3136772 - DNA, 20 bp, Homo sapiens
ataagttatttttgtacatg

SEQ ID NO: 3136773 - DNA, 20 bp, Homo sapiens
ataagttcaaattcttctga

SEQ ID NO: 3136774 - DNA, 17 bp, Homo sapiens
ataagttccatgttaaa

SEQ ID NO: 3136775 - DNA, 21 bp, Homo sapiens
ataagtttctattctgtcagt

SEQ ID NO: 3136776 - DNA, 20 bp, Homo sapiens
ataagtttgaaggaaacagt

SEQ ID NO: 3136777 - DNA, 21 bp, Homo sapiens
ataagtttgaaggaaacagtt

SEQ ID NO: 3136778 - DNA, 13 bp, Homo sapiens
ataataaaatcac

SEQ ID NO: 3136779 - DNA, 21 bp, Homo sapiens
ataataaagaactccttattt

SEQ ID NO: 3136780 - DNA, 15 bp, Homo sapiens
ataataaatgtacat

SEQ ID NO: 3136781 - DNA, 18 bp, Homo sapiens
ataataatattgtttttc

SEQ ID NO: 3136782 - DNA, 14 bp, Homo sapiens
ataataatttttat

SEQ ID NO: 3136783 - DNA, 22 bp, Homo sapiens
ataataatttttatatttaatt

SEQ ID NO: 3136784 - DNA, 21 bp, Homo sapiens
ataatacactaattcctttct

SEQ ID NO: 3136785 - DNA, 19 bp, Homo sapiens
ataatacctcaatgtttga

SEQ ID NO: 3136786 - DNA, 13 bp, Homo sapiens
ataatagattctc

SEQ ID NO: 3136787 - DNA, 23 bp, Homo sapiens
ataataggtagggggctttcact

SEQ ID NO: 3136788 - DNA, 23 bp, Homo sapiens
ataatatattctatttttatact

SEQ ID NO: 3136789 - DNA, 12 bp, Homo sapiens
ataatatatttg

SEQ ID NO: 3136790 - DNA, 14 bp, Homo sapiens
ataatattagtgat

SEQ ID NO: 3136791 - DNA, 15 bp, Homo sapiens
ataatattagtgatt

SEQ ID NO: 3136792 - DNA, 19 bp, Homo sapiens
ataatattgttgtataatt

SEQ ID NO: 3136793 - DNA, 14 bp, Homo sapiens
ataatattgtttgg

SEQ ID NO: 3136794 - DNA, 21 bp, Homo sapiens
ataatattgtttggtaaatgt

SEQ ID NO: 3136795 - DNA, 20 bp, Homo sapiens
ataatatttcaagtgcctag

SEQ ID NO: 3136796 - DNA, 12 bp, Homo sapiens
ataatcaaatga

SEQ ID NO: 3136797 - DNA, 13 bp, Homo sapiens
ataatcaaatgat

SEQ ID NO: 3136798 - DNA, 16 bp, Homo sapiens
ataatcaaatgatttc

SEQ ID NO: 3136799 - DNA, 16 bp, Homo sapiens
ataatcacgctttcct

SEQ ID NO: 3136800 - DNA, 18 bp, Homo sapiens
ataatcacgctttcctga

SEQ ID NO: 3136801 - DNA, 20 bp, Homo sapiens
ataatcagaaaagtaatttt

SEQ ID NO: 3136802 - DNA, 14 bp, Homo sapiens
ataatcagcctctt

SEQ ID NO: 3136803 - DNA, 14 bp, Homo sapiens
ataatcccaccacc

SEQ ID NO: 3136804 - DNA, 15 bp, Homo sapiens
ataatcccagcactt

SEQ ID NO: 3136805 - DNA, 15 bp, Homo sapiens
ataatctagaacaca

SEQ ID NO: 3136806 - DNA, 14 bp, Homo sapiens
ataatctagtttac

SEQ ID NO: 3136807 - DNA, 15 bp, Homo sapiens
ataatctatgatgaa

SEQ ID NO: 3136808 - DNA, 13 bp, Homo sapiens
ataatctcaaagg

SEQ ID NO: 3136809 - DNA, 20 bp, Homo sapiens
ataatctcaaaggagaaaaa

SEQ ID NO: 3136810 - DNA, 17 bp, Homo sapiens
ataatctgaagatatat

SEQ ID NO: 3136811 - DNA, 18 bp, Homo sapiens
ataatctggactcctctg

SEQ ID NO: 3136812 - DNA, 22 bp, Homo sapiens
ataatctggactcctctgtcca

SEQ ID NO: 3136813 - DNA, 20 bp, Homo sapiens
ataatctgtcaaaacactgt

SEQ ID NO: 3136814 - DNA, 14 bp, Homo sapiens
ataatcttagagac

SEQ ID NO: 3136815 - DNA, 14 bp, Homo sapiens
ataatcttatacaa

SEQ ID NO: 3136816 - DNA, 23 bp, Homo sapiens
ataatcttattagggagaaaatt

SEQ ID NO: 3136817 - DNA, 12 bp, Homo sapiens
ataatcttcagg

SEQ ID NO: 3136818 - DNA, 12 bp, Homo sapiens
ataatctttcta

SEQ ID NO: 3136819 - DNA, 14 bp, Homo sapiens
ataatctttctata

SEQ ID NO: 3136820 - DNA, 14 bp, Homo sapiens
ataatgaagcttta

SEQ ID NO: 3136821 - DNA, 18 bp, Homo sapiens
ataatgaataaactgaat

SEQ ID NO: 3136822 - DNA, 17 bp, Homo sapiens
ataatgaattataacag

SEQ ID NO: 3136823 - DNA, 12 bp, Homo sapiens
ataatgacagat

SEQ ID NO: 3136824 - DNA, 19 bp, Homo sapiens
ataatgatcgaaaaaataa

SEQ ID NO: 3136825 - DNA, 16 bp, Homo sapiens
ataatgatttgctctt

SEQ ID NO: 3136826 - DNA, 21 bp, Homo sapiens
ataatgctaatttaaagagac

SEQ ID NO: 3136827 - DNA, 15 bp, Homo sapiens
ataatgctacaattt

SEQ ID NO: 3136828 - DNA, 14 bp, Homo sapiens
ataatgcttcagat

SEQ ID NO: 3136829 - DNA, 15 bp, Homo sapiens
ataatgctttggaaa

SEQ ID NO: 3136830 - DNA, 12 bp, Homo sapiens
ataatggaaaca

SEQ ID NO: 3136831 - DNA, 17 bp, Homo sapiens
ataatggaagagaaatc

SEQ ID NO: 3136832 - DNA, 22 bp, Homo sapiens
ataatggtcccatccaggcagt

SEQ ID NO: 3136833 - DNA, 14 bp, Homo sapiens
ataatgtaagctct

SEQ ID NO: 3136834 - DNA, 22 bp, Homo sapiens
ataatgtataaagaacaaggta

SEQ ID NO: 3136835 - DNA, 14 bp, Homo sapiens
ataatgtattgtaa

SEQ ID NO: 3136836 - DNA, 18 bp, Homo sapiens
ataatgtcattaatatat

SEQ ID NO: 3136837 - DNA, 18 bp, Homo sapiens
ataatgtgtgtatgtgta

SEQ ID NO: 3136838 - DNA, 19 bp, Homo sapiens
ataatgtgtgtatgtgtat

SEQ ID NO: 3136839 - DNA, 10 bp, Homo sapiens
ataatgttaa

SEQ ID NO: 3136840 - DNA, 11 bp, Homo sapiens
ataatgttaaa

SEQ ID NO: 3136841 - DNA, 18 bp, Homo sapiens
ataatgttaaatttgtaa

SEQ ID NO: 3136842 - DNA, 22 bp, Homo sapiens
ataatgttaaatttgtaagttt

SEQ ID NO: 3136843 - DNA, 22 bp, Homo sapiens
ataatgtttaatattgagaaag

SEQ ID NO: 3136844 - DNA, 15 bp, Homo sapiens
ataattaaaaaccac

SEQ ID NO: 3136845 - DNA, 21 bp, Homo sapiens
ataattaaacttcttttctct

SEQ ID NO: 3136846 - DNA, 20 bp, Homo sapiens
ataattaaattttgagttct

SEQ ID NO: 3136847 - DNA, 14 bp, Homo sapiens
ataattaattgtca

SEQ ID NO: 3136848 - DNA, 14 bp, Homo sapiens
ataattacattcct

SEQ ID NO: 3136849 - DNA, 21 bp, Homo sapiens
ataattagatgattatatatt

SEQ ID NO: 3136850 - DNA, 16 bp, Homo sapiens
ataattaggttaacat

SEQ ID NO: 3136851 - DNA, 16 bp, Homo sapiens
ataattataatatact

SEQ ID NO: 3136852 - DNA, 17 bp, Homo sapiens
ataattatccagagttt

SEQ ID NO: 3136853 - DNA, 19 bp, Homo sapiens
ataattatgacagttatac

SEQ ID NO: 3136854 - DNA, 16 bp, Homo sapiens
ataattatttatttaa

SEQ ID NO: 3136855 - DNA, 21 bp, Homo sapiens
ataattatttatttaataaca

SEQ ID NO: 3136856 - DNA, 13 bp, Homo sapiens
ataattcactcaa

SEQ ID NO: 3136857 - DNA, 23 bp, Homo sapiens
ataattcagggtggtaaagtatg

SEQ ID NO: 3136858 - DNA, 19 bp, Homo sapiens
ataattccctatcttttag

SEQ ID NO: 3136859 - DNA, 22 bp, Homo sapiens
ataattcctatatcctgtgact

SEQ ID NO: 3136860 - DNA, 12 bp, Homo sapiens
ataattctaaag

SEQ ID NO: 3136861 - DNA, 11 bp, Homo sapiens
ataattctgta

SEQ ID NO: 3136862 - DNA, 12 bp, Homo sapiens
ataattctgtaa

SEQ ID NO: 3136863 - DNA, 14 bp, Homo sapiens
ataattctgtaaat

SEQ ID NO: 3136864 - DNA, 22 bp, Homo sapiens
ataattctgtacatagcctata

SEQ ID NO: 3136865 - DNA, 19 bp, Homo sapiens
ataattcttgtatattatg

SEQ ID NO: 3136866 - DNA, 14 bp, Homo sapiens
ataattgatcaaat

SEQ ID NO: 3136867 - DNA, 19 bp, Homo sapiens
ataattgcatctaggtaat

SEQ ID NO: 3136868 - DNA, 19 bp, Homo sapiens
ataattgctcataagcaat

SEQ ID NO: 3136869 - DNA, 23 bp, Homo sapiens
ataattgctttgccaaaatacca

SEQ ID NO: 3136870 - DNA, 12 bp, Homo sapiens
ataattggaata

SEQ ID NO: 3136871 - DNA, 20 bp, Homo sapiens
ataattggatttcctaatac

SEQ ID NO: 3136872 - DNA, 22 bp, Homo sapiens
ataattggtgctatttgaagaa

SEQ ID NO: 3136873 - DNA, 23 bp, Homo sapiens
ataattgtatcagaggcctataa

SEQ ID NO: 3136874 - DNA, 13 bp, Homo sapiens
ataattgtggatt

SEQ ID NO: 3136875 - DNA, 15 bp, Homo sapiens
ataattgttgaaatt

SEQ ID NO: 3136876 - DNA, 19 bp, Homo sapiens
ataattgttgaaattttgc

SEQ ID NO: 3136877 - DNA, 20 bp, Homo sapiens
ataattgttgaaattttgca

SEQ ID NO: 3136878 - DNA, 13 bp, Homo sapiens
ataattgtttcca

SEQ ID NO: 3136879 - DNA, 21 bp, Homo sapiens
ataattgtttccaacttgtct

SEQ ID NO: 3136880 - DNA, 23 bp, Homo sapiens
ataatttacctaagattacaaat

SEQ ID NO: 3136881 - DNA, 20 bp, Homo sapiens
ataatttagttgtttctaga

SEQ ID NO: 3136882 - DNA, 14 bp, Homo sapiens
ataatttcatattc

SEQ ID NO: 3136883 - DNA, 12 bp, Homo sapiens
ataatttctaat

SEQ ID NO: 3136884 - DNA, 15 bp, Homo sapiens
ataatttgaaaaagt

SEQ ID NO: 3136885 - DNA, 21 bp, Homo sapiens
ataatttgaaaaagttccata

SEQ ID NO: 3136886 - DNA, 12 bp, Homo sapiens
ataatttgcata

SEQ ID NO: 3136887 - DNA, 16 bp, Homo sapiens
ataattttaaagtaat

SEQ ID NO: 3136888 - DNA, 16 bp, Homo sapiens
ataattttaaataacc

SEQ ID NO: 3136889 - DNA, 22 bp, Homo sapiens
ataattttagtttatattaatt

SEQ ID NO: 3136890 - DNA, 19 bp, Homo sapiens
ataattttatgaatgtctt

SEQ ID NO: 3136891 - DNA, 13 bp, Homo sapiens
ataattttattag

SEQ ID NO: 3136892 - DNA, 22 bp, Homo sapiens
ataattttcttcatgcaatgac

SEQ ID NO: 3136893 - DNA, 23 bp, Homo sapiens
ataattttcttcatgcaatgaca

SEQ ID NO: 3136894 - DNA, 21 bp, Homo sapiens
ataattttgcatactgaaaat

SEQ ID NO: 3136895 - DNA, 12 bp, Homo sapiens
ataattttgcct

SEQ ID NO: 3136896 - DNA, 22 bp, Homo sapiens
ataattttgctggaattcctaa

SEQ ID NO: 3136897 - DNA, 17 bp, Homo sapiens
ataattttgtgttgtac

SEQ ID NO: 3136898 - DNA, 21 bp, Homo sapiens
ataattttgtgttgtacaatt

SEQ ID NO: 3136899 - DNA, 21 bp, Homo sapiens
ataatttttaaagtatatatt

SEQ ID NO: 3136900 - DNA, 15 bp, Homo sapiens
ataattttttattca

SEQ ID NO: 3136901 - DNA, 16 bp, Homo sapiens
ataattttttattcaa

SEQ ID NO: 3136902 - DNA, 15 bp, Homo sapiens
atacaaagtaaatac

SEQ ID NO: 3136903 - DNA, 16 bp, Homo sapiens
atacaaattaaaaaga

SEQ ID NO: 3136904 - DNA, 17 bp, Homo sapiens
atacaaattaaaaagat

SEQ ID NO: 3136905 - DNA, 18 bp, Homo sapiens
atacaaattaattttact

SEQ ID NO: 3136906 - DNA, 14 bp, Homo sapiens
atacaaattagaaa

SEQ ID NO: 3136907 - DNA, 17 bp, Homo sapiens
atacaaattagaaaatg

SEQ ID NO: 3136908 - DNA, 20 bp, Homo sapiens
atacaacatgtagctgagtt

SEQ ID NO: 3136909 - DNA, 12 bp, Homo sapiens
atacaagtttca

SEQ ID NO: 3136910 - DNA, 17 bp, Homo sapiens
atacaagtttcagacag

SEQ ID NO: 3136911 - DNA, 19 bp, Homo sapiens
atacaagtttcagacaggg

SEQ ID NO: 3136912 - DNA, 15 bp, Homo sapiens
atacaataacccagt

SEQ ID NO: 3136913 - DNA, 21 bp, Homo sapiens
atacaataacccagttacttt

SEQ ID NO: 3136914 - DNA, 15 bp, Homo sapiens
atacaatatataaaa

SEQ ID NO: 3136915 - DNA, 16 bp, Homo sapiens
atacaatcctgtttat

SEQ ID NO: 3136916 - DNA, 23 bp, Homo sapiens
atacaatcctgtttataatctga

SEQ ID NO: 3136917 - DNA, 15 bp, Homo sapiens
atacaattaaaggtc

SEQ ID NO: 3136918 - DNA, 15 bp, Homo sapiens
atacacaagtaaaca

SEQ ID NO: 3136919 - DNA, 20 bp, Homo sapiens
atacacacatgccctcctgg

SEQ ID NO: 3136920 - DNA, 14 bp, Homo sapiens
atacacaccctgcc

SEQ ID NO: 3136921 - DNA, 15 bp, Homo sapiens
atacacaccctgccc

SEQ ID NO: 3136922 - DNA, 16 bp, Homo sapiens
atacacagatgattaa

SEQ ID NO: 3136923 - DNA, 21 bp, Homo sapiens
atacacagtactttattgtac

SEQ ID NO: 3136924 - DNA, 23 bp, Homo sapiens
atacacatatacctataatgtgt

SEQ ID NO: 3136925 - DNA, 22 bp, Homo sapiens
atacacatttgctactgttgta

SEQ ID NO: 3136926 - DNA, 20 bp, Homo sapiens
atacaccacctcactcctgt

SEQ ID NO: 3136927 - DNA, 21 bp, Homo sapiens
atacaccacctcactcctgtt

SEQ ID NO: 3136928 - DNA, 18 bp, Homo sapiens
atacaccttccccaccct

SEQ ID NO: 3136929 - DNA, 19 bp, Homo sapiens
atacactaattcctttcta

SEQ ID NO: 3136930 - DNA, 21 bp, Homo sapiens
atacactgaagttaacagaga

SEQ ID NO: 3136931 - DNA, 12 bp, Homo sapiens
atacactgagat

SEQ ID NO: 3136932 - DNA, 22 bp, Homo sapiens
atacacttacactttatgcaca

SEQ ID NO: 3136933 - DNA, 17 bp, Homo sapiens
atacacttgtataaatg

SEQ ID NO: 3136934 - DNA, 18 bp, Homo sapiens
atacacttgtataaatgt

SEQ ID NO: 3136935 - DNA, 23 bp, Homo sapiens
atacagaaagatggatgtgcttt

SEQ ID NO: 3136936 - DNA, 19 bp, Homo sapiens
atacagacactaagttata

SEQ ID NO: 3136937 - DNA, 23 bp, Homo sapiens
atacagacactaagttatagtat

SEQ ID NO: 3136938 - DNA, 20 bp, Homo sapiens
atacagataattcatttgta

SEQ ID NO: 3136939 - DNA, 23 bp, Homo sapiens
atacagatagatatatgctctgc

SEQ ID NO: 3136940 - DNA, 14 bp, Homo sapiens
atacagatgaaaat

SEQ ID NO: 3136941 - DNA, 12 bp, Homo sapiens
atacagctgtat

SEQ ID NO: 3136942 - DNA, 17 bp, Homo sapiens
atacaggaaaaacaaaa

SEQ ID NO: 3136943 - DNA, 19 bp, Homo sapiens
atacagtaactttatgtgt

SEQ ID NO: 3136944 - DNA, 20 bp, Homo sapiens
atacagtaactttatgtgta

SEQ ID NO: 3136945 - DNA, 17 bp, Homo sapiens
atacagtccctaaagaa

SEQ ID NO: 3136946 - DNA, 19 bp, Homo sapiens
atacagtgagctctagcaa

SEQ ID NO: 3136947 - DNA, 15 bp, Homo sapiens
atacagtgccttgct

SEQ ID NO: 3136948 - DNA, 23 bp, Homo sapiens
atacagtgttattttctttgaaa

SEQ ID NO: 3136949 - DNA, 17 bp, Homo sapiens
atacagttataaaatta

SEQ ID NO: 3136950 - DNA, 18 bp, Homo sapiens
atacagttataaaattaa

SEQ ID NO: 3136951 - DNA, 15 bp, Homo sapiens
atacagttcaataaa

SEQ ID NO: 3136952 - DNA, 21 bp, Homo sapiens
atacagttctgctctggttgt

SEQ ID NO: 3136953 - DNA, 12 bp, Homo sapiens
atacagttttat

SEQ ID NO: 3136954 - DNA, 13 bp, Homo sapiens
atacagttttatg

SEQ ID NO: 3136955 - DNA, 18 bp, Homo sapiens
atacagttttatgctctt

SEQ ID NO: 3136956 - DNA, 20 bp, Homo sapiens
atacagttttatgctctttt

SEQ ID NO: 3136957 - DNA, 21 bp, Homo sapiens
atacagttttatgctcttttt

SEQ ID NO: 3136958 - DNA, 23 bp, Homo sapiens
ataggatcatttgttggaatgaa

SEQ ID NO: 3136959 - DNA, 21 bp, Homo sapiens
ataggccagggcatgtgtatg

SEQ ID NO: 3136960 - DNA, 23 bp, Homo sapiens
ataggccagggcatgtgtatgtg

SEQ ID NO: 3136961 - DNA, 20 bp, Homo sapiens
ataggcccaaggtcccctcc

SEQ ID NO: 3136962 - DNA, 21 bp, Homo sapiens
ataggcccaaggtcccctcca

SEQ ID NO: 3136963 - DNA, 21 bp, Homo sapiens
ataggctcttaagcagcatgg

SEQ ID NO: 3136964 - DNA, 16 bp, Homo sapiens
ataggcttttgttctt

SEQ ID NO: 3136965 - DNA, 16 bp, Homo sapiens
atagggaaaattctaa

SEQ ID NO: 3136966 - DNA, 22 bp, Homo sapiens
atagggaaaattctaacccagg

SEQ ID NO: 3136967 - DNA, 19 bp, Homo sapiens
atagggaaaggttttgtat

SEQ ID NO: 3136968 - DNA, 15 bp, Homo sapiens
atagggagaaaccaa

SEQ ID NO: 3136969 - DNA, 14 bp, Homo sapiens
atagggtctaactc

SEQ ID NO: 3136970 - DNA, 20 bp, Homo sapiens
ataggtaatcaatgaatatt

SEQ ID NO: 3136971 - DNA, 15 bp, Homo sapiens
ataggtcactggctc

SEQ ID NO: 3136972 - DNA, 16 bp, Homo sapiens
ataggtcactggctct

SEQ ID NO: 3136973 - DNA, 20 bp, Homo sapiens
ataggtcactggctctccaa

SEQ ID NO: 3136974 - DNA, 18 bp, Homo sapiens
ataggtctcatctcttca

SEQ ID NO: 3136975 - DNA, 18 bp, Homo sapiens
ataggtctcttctcccag

SEQ ID NO: 3136976 - DNA, 19 bp, Homo sapiens
ataggtctcttctcccaga

SEQ ID NO: 3136977 - DNA, 16 bp, Homo sapiens
ataggtctttctctca

SEQ ID NO: 3136978 - DNA, 17 bp, Homo sapiens
ataggtctttctctcag

SEQ ID NO: 3136979 - DNA, 19 bp, Homo sapiens
ataggtgatgtttgctctt

SEQ ID NO: 3136980 - DNA, 22 bp, Homo sapiens
ataggtttttctcatgtatctt

SEQ ID NO: 3136981 - DNA, 17 bp, Homo sapiens
atagtaaaacacttatt

SEQ ID NO: 3136982 - DNA, 16 bp, Homo sapiens
atagtaactgacatga

SEQ ID NO: 3136983 - DNA, 19 bp, Homo sapiens
atagtaacttcttatggaa

SEQ ID NO: 3136984 - DNA, 19 bp, Homo sapiens
atagtaagacccccatctc

SEQ ID NO: 3136985 - DNA, 21 bp, Homo sapiens
atagtaccatttatacaaatt

SEQ ID NO: 3136986 - DNA, 18 bp, Homo sapiens
atagtaccttcaatactt

SEQ ID NO: 3136987 - DNA, 16 bp, Homo sapiens
atagtatatctggaca

SEQ ID NO: 3136988 - DNA, 22 bp, Homo sapiens
atagtatctgtatataagttgc

SEQ ID NO: 3136989 - DNA, 15 bp, Homo sapiens
atagtatgtgacttt

SEQ ID NO: 3136990 - DNA, 21 bp, Homo sapiens
atagtatttctcctttgcaat

SEQ ID NO: 3136991 - DNA, 16 bp, Homo sapiens
atagtatttttatcca

SEQ ID NO: 3136992 - DNA, 14 bp, Homo sapiens
atagtcacaagagc

SEQ ID NO: 3136993 - DNA, 20 bp, Homo sapiens
atagtcagcagcagctctga

SEQ ID NO: 3136994 - DNA, 12 bp, Homo sapiens
atagtcatctcc

SEQ ID NO: 3136995 - DNA, 18 bp, Homo sapiens
atagtctaagactatata

SEQ ID NO: 3136996 - DNA, 13 bp, Homo sapiens
atagtctgtgtga

SEQ ID NO: 3136997 - DNA, 22 bp, Homo sapiens
atagtcttggaagctgtttgga

SEQ ID NO: 3136998 - DNA, 13 bp, Homo sapiens
atagtctttcagt

SEQ ID NO: 3136999 - DNA, 14 bp, Homo sapiens
atagtcttttgctt

SEQ ID NO: 3137000 - DNA, 13 bp, Homo sapiens
atagtgaatactg

SEQ ID NO: 3137001 - DNA, 20 bp, Homo sapiens
atagtgacaagtgaagaaca

SEQ ID NO: 3137002 - DNA, 15 bp, Homo sapiens
atagtgcaactatga

SEQ ID NO: 3137003 - DNA, 20 bp, Homo sapiens
atagtgcaactatgaatgta

SEQ ID NO: 3137004 - DNA, 15 bp, Homo sapiens
atagtgctatatata

SEQ ID NO: 3137005 - DNA, 16 bp, Homo sapiens
atagtgctatatatat

SEQ ID NO: 3137006 - DNA, 19 bp, Homo sapiens
atagtgctatatatataaa

SEQ ID NO: 3137007 - DNA, 22 bp, Homo sapiens
atagtgctgggatggaggggag

SEQ ID NO: 3137008 - DNA, 17 bp, Homo sapiens
atagtggaaatcgctta

SEQ ID NO: 3137009 - DNA, 22 bp, Homo sapiens
atagtgggccctccgacagccc

SEQ ID NO: 3137010 - DNA, 15 bp, Homo sapiens
atagtgtgttctgat

SEQ ID NO: 3137011 - DNA, 23 bp, Homo sapiens
atagtgtgttctgattagaaatg

SEQ ID NO: 3137012 - DNA, 22 bp, Homo sapiens
atagttaagcgtgcataagtta

SEQ ID NO: 3137013 - DNA, 15 bp, Homo sapiens
atagttaatattttg

SEQ ID NO: 3137014 - DNA, 16 bp, Homo sapiens
atagttaatattttgt

SEQ ID NO: 3137015 - DNA, 13 bp, Homo sapiens
atagttacataat

SEQ ID NO: 3137016 - DNA, 17 bp, Homo sapiens
atagttactgtgtaatt

SEQ ID NO: 3137017 - DNA, 21 bp, Homo sapiens
atagttcagtagaattaccat

SEQ ID NO: 3137018 - DNA, 16 bp, Homo sapiens
atagttcctaagaagc

SEQ ID NO: 3137019 - DNA, 13 bp, Homo sapiens
atagttctagaca

SEQ ID NO: 3137020 - DNA, 21 bp, Homo sapiens
atagttctccagttgtatgga

SEQ ID NO: 3137021 - DNA, 12 bp, Homo sapiens
atagttgaatta

SEQ ID NO: 3137022 - DNA, 21 bp, Homo sapiens
atagttgaattagtgagtata

SEQ ID NO: 3137023 - DNA, 13 bp, Homo sapiens
atagttgagcccc

SEQ ID NO: 3137024 - DNA, 19 bp, Homo sapiens
atagttgtagacaaagtac

SEQ ID NO: 3137025 - DNA, 19 bp, Homo sapiens
atagttgtccatattttca

SEQ ID NO: 3137026 - DNA, 18 bp, Homo sapiens
atagttgtgggtgggaga

SEQ ID NO: 3137027 - DNA, 22 bp, Homo sapiens
atagtttgctttgctttttaat

SEQ ID NO: 3137028 - DNA, 16 bp, Homo sapiens
atagtttgtctatttt

SEQ ID NO: 3137029 - DNA, 18 bp, Homo sapiens
atataaaaagaaaagata

SEQ ID NO: 3137030 - DNA, 17 bp, Homo sapiens
atataaaaatatatata

SEQ ID NO: 3137031 - DNA, 15 bp, Homo sapiens
atataaaatgtattc

SEQ ID NO: 3137032 - DNA, 19 bp, Homo sapiens
atataaaatgtattcaagc

SEQ ID NO: 3137033 - DNA, 20 bp, Homo sapiens
atataaaatgtattcaagca

SEQ ID NO: 3137034 - DNA, 12 bp, Homo sapiens
atataaacatct

SEQ ID NO: 3137035 - DNA, 14 bp, Homo sapiens
atataaagaatata

SEQ ID NO: 3137036 - DNA, 18 bp, Homo sapiens
atataaagacctataaat

SEQ ID NO: 3137037 - DNA, 22 bp, Homo sapiens
atataaatatttggtaattctg

SEQ ID NO: 3137038 - DNA, 15 bp, Homo sapiens
atataaatggctggt

SEQ ID NO: 3137039 - DNA, 18 bp, Homo sapiens
atataaatgtataaatat

SEQ ID NO: 3137040 - DNA, 14 bp, Homo sapiens
atataacacatttt

SEQ ID NO: 3137041 - DNA, 23 bp, Homo sapiens
atataaccacaaagcacagtttg

SEQ ID NO: 3137042 - DNA, 18 bp, Homo sapiens
atataaccctaggaattt

SEQ ID NO: 3137043 - DNA, 16 bp, Homo sapiens
atataagaaaatgctt

SEQ ID NO: 3137044 - DNA, 21 bp, Homo sapiens
atataagagaagtctcattcg

SEQ ID NO: 3137045 - DNA, 14 bp, Homo sapiens
atataagattttct

SEQ ID NO: 3137046 - DNA, 23 bp, Homo sapiens
atataaggaaagcaataaatgaa

SEQ ID NO: 3137047 - DNA, 14 bp, Homo sapiens
atataagtttgaag

SEQ ID NO: 3137048 - DNA, 17 bp, Homo sapiens
atataagtttgaaggaa

SEQ ID NO: 3137049 - DNA, 21 bp, Homo sapiens
atataataaatgtacattaat

SEQ ID NO: 3137050 - DNA, 13 bp, Homo sapiens
atataatgaattc

SEQ ID NO: 3137051 - DNA, 19 bp, Homo sapiens
atataatggaagagaaatc

SEQ ID NO: 3137052 - DNA, 13 bp, Homo sapiens
atataatgtattt

SEQ ID NO: 3137053 - DNA, 16 bp, Homo sapiens
atataattctgtaaat

SEQ ID NO: 3137054 - DNA, 22 bp, Homo sapiens
atataatttatttccactaaaa

SEQ ID NO: 3137055 - DNA, 18 bp, Homo sapiens
atatacagatgaaaattt

SEQ ID NO: 3137056 - DNA, 14 bp, Homo sapiens
atatacagtaactt

SEQ ID NO: 3137057 - DNA, 17 bp, Homo sapiens
atatacagtatagattt

SEQ ID NO: 3137058 - DNA, 11 bp, Homo sapiens
atatacagtta

SEQ ID NO: 3137059 - DNA, 12 bp, Homo sapiens
atatacagttat

SEQ ID NO: 3137060 - DNA, 12 bp, Homo sapiens
atatacatacac

SEQ ID NO: 3137061 - DNA, 21 bp, Homo sapiens
atatacatacacttgtataaa

SEQ ID NO: 3137062 - DNA, 13 bp, Homo sapiens
atatacatatata

SEQ ID NO: 3137063 - DNA, 14 bp, Homo sapiens
atatacatgtgtgt

SEQ ID NO: 3137064 - DNA, 17 bp, Homo sapiens
atatacatgtgtgtata

SEQ ID NO: 3137065 - DNA, 18 bp, Homo sapiens
atatacatgtgtgtatat

SEQ ID NO: 3137066 - DNA, 22 bp, Homo sapiens
atatacatgtgtgtatatatgt

SEQ ID NO: 3137067 - DNA, 14 bp, Homo sapiens
atatacattgtgtg

SEQ ID NO: 3137068 - DNA, 23 bp, Homo sapiens
atatacattgtgtgaaaaaagaa

SEQ ID NO: 3137069 - DNA, 11 bp, Homo sapiens
atatacatttg

SEQ ID NO: 3137070 - DNA, 18 bp, Homo sapiens
atatacatttgttggtaa

SEQ ID NO: 3137071 - DNA, 22 bp, Homo sapiens
atataccactctttacctttat

SEQ ID NO: 3137072 - DNA, 21 bp, Homo sapiens
atatacctataatgtgtgtat

SEQ ID NO: 3137073 - DNA, 18 bp, Homo sapiens
atatacctggcttttact

SEQ ID NO: 3137074 - DNA, 21 bp, Homo sapiens
atatactaaaccaactctaat

SEQ ID NO: 3137075 - DNA, 18 bp, Homo sapiens
atatactgggttcttgtt

SEQ ID NO: 3137076 - DNA, 22 bp, Homo sapiens
atatactgggttcttgttttat

SEQ ID NO: 3137077 - DNA, 13 bp, Homo sapiens
atatactgtgtgc

SEQ ID NO: 3137078 - DNA, 16 bp, Homo sapiens
atatacttgactctaa

SEQ ID NO: 3137079 - DNA, 16 bp, Homo sapiens
atatacttttaaatta

SEQ ID NO: 3137080 - DNA, 22 bp, Homo sapiens
atatagaattgtagactgatgt

SEQ ID NO: 3137081 - DNA, 14 bp, Homo sapiens
atatagagaataag

SEQ ID NO: 3137082 - DNA, 16 bp, Homo sapiens
atatagagatgcattc

SEQ ID NO: 3137083 - DNA, 19 bp, Homo sapiens
atattccccatttcctgta

SEQ ID NO: 3137084 - DNA, 21 bp, Homo sapiens
atattcctacttgcagtacat

SEQ ID NO: 3137085 - DNA, 13 bp, Homo sapiens
atattcctccaaa

SEQ ID NO: 3137086 - DNA, 18 bp, Homo sapiens
atattcctgaatgaaata

SEQ ID NO: 3137087 - DNA, 16 bp, Homo sapiens
atattcctttctatca

SEQ ID NO: 3137088 - DNA, 20 bp, Homo sapiens
atattctatatgaatttaaa

SEQ ID NO: 3137089 - DNA, 15 bp, Homo sapiens
atattctatttttat

SEQ ID NO: 3137090 - DNA, 15 bp, Homo sapiens
atattctccccaccc

SEQ ID NO: 3137091 - DNA, 23 bp, Homo sapiens
atattctctccgccattgagaat

SEQ ID NO: 3137092 - DNA, 15 bp, Homo sapiens
atattcttattggaa

SEQ ID NO: 3137093 - DNA, 21 bp, Homo sapiens
atattcttctcttgctttata

SEQ ID NO: 3137094 - DNA, 15 bp, Homo sapiens
atattcttgtgcttt

SEQ ID NO: 3137095 - DNA, 14 bp, Homo sapiens
atattgaaaattga

SEQ ID NO: 3137096 - DNA, 12 bp, Homo sapiens
atattgaataaa

SEQ ID NO: 3137097 - DNA, 23 bp, Homo sapiens
atattgaataaaaaatagacatg

SEQ ID NO: 3137098 - DNA, 12 bp, Homo sapiens
atattgaatgtt

SEQ ID NO: 3137099 - DNA, 13 bp, Homo sapiens
atattgaatgtta

SEQ ID NO: 3137100 - DNA, 18 bp, Homo sapiens
atattgaatgtttccaac

SEQ ID NO: 3137101 - DNA, 15 bp, Homo sapiens
atattgatgttaaca

SEQ ID NO: 3137102 - DNA, 16 bp, Homo sapiens
atattgatgttaacaa

SEQ ID NO: 3137103 - DNA, 12 bp, Homo sapiens
atattgcaatga

SEQ ID NO: 3137104 - DNA, 18 bp, Homo sapiens
atattgcaggagacattt

SEQ ID NO: 3137105 - DNA, 16 bp, Homo sapiens
atattgccgcactagg

SEQ ID NO: 3137106 - DNA, 12 bp, Homo sapiens
atattgccttat

SEQ ID NO: 3137107 - DNA, 18 bp, Homo sapiens
atattgctactataatca

SEQ ID NO: 3137108 - DNA, 12 bp, Homo sapiens
atattgcttctt

SEQ ID NO: 3137109 - DNA, 17 bp, Homo sapiens
atattggcatggatttc

SEQ ID NO: 3137110 - DNA, 15 bp, Homo sapiens
atattggtttgcaca

SEQ ID NO: 3137111 - DNA, 22 bp, Homo sapiens
atattggtttgcacaagttccc

SEQ ID NO: 3137112 - DNA, 17 bp, Homo sapiens
atattgtaaaacaggta

SEQ ID NO: 3137113 - DNA, 15 bp, Homo sapiens
atattgtacaaatgt

SEQ ID NO: 3137114 - DNA, 17 bp, Homo sapiens
atattgtcagatatttt

SEQ ID NO: 3137115 - DNA, 13 bp, Homo sapiens
atattgtgaagta

SEQ ID NO: 3137116 - DNA, 12 bp, Homo sapiens
atattgtgccaa

SEQ ID NO: 3137117 - DNA, 18 bp, Homo sapiens
atattgtgccaatatgta

SEQ ID NO: 3137118 - DNA, 20 bp, Homo sapiens
atattgtgttgactttataa

SEQ ID NO: 3137119 - DNA, 13 bp, Homo sapiens
atattgtgtttgt

SEQ ID NO: 3137120 - DNA, 21 bp, Homo sapiens
atattgtgtttgtgtatttac

SEQ ID NO: 3137121 - DNA, 14 bp, Homo sapiens
atattgttaatctc

SEQ ID NO: 3137122 - DNA, 20 bp, Homo sapiens
atattgttcaaacaatatca

SEQ ID NO: 3137123 - DNA, 21 bp, Homo sapiens
atattgttcaaacaatatcat

SEQ ID NO: 3137124 - DNA, 13 bp, Homo sapiens
atattgttgacaa

SEQ ID NO: 3137125 - DNA, 16 bp, Homo sapiens
atattgttgtataatt

SEQ ID NO: 3137126 - DNA, 13 bp, Homo sapiens
atattgtttaaaa

SEQ ID NO: 3137127 - DNA, 19 bp, Homo sapiens
atattgtttaaaattcagt

SEQ ID NO: 3137128 - DNA, 16 bp, Homo sapiens
atattgtttggtaaat

SEQ ID NO: 3137129 - DNA, 17 bp, Homo sapiens
atattgtttttctttct

SEQ ID NO: 3137130 - DNA, 19 bp, Homo sapiens
atatttaaaaattgtttct

SEQ ID NO: 3137131 - DNA, 21 bp, Homo sapiens
atatttaaacctttttcttga

SEQ ID NO: 3137132 - DNA, 15 bp, Homo sapiens
atatttaaactcaag

SEQ ID NO: 3137133 - DNA, 14 bp, Homo sapiens
atatttaaagacag

SEQ ID NO: 3137134 - DNA, 22 bp, Homo sapiens
atatttaacaatttattctgat

SEQ ID NO: 3137135 - DNA, 19 bp, Homo sapiens
atatttaacctatttccac

SEQ ID NO: 3137136 - DNA, 14 bp, Homo sapiens
atatttaagaaaag

SEQ ID NO: 3137137 - DNA, 15 bp, Homo sapiens
atatttaagaaaagc

SEQ ID NO: 3137138 - DNA, 16 bp, Homo sapiens
atatttaagaaaagca

SEQ ID NO: 3137139 - DNA, 18 bp, Homo sapiens
atatttaagaaaagcact

SEQ ID NO: 3137140 - DNA, 20 bp, Homo sapiens
atatttaagaaaagcacttt

SEQ ID NO: 3137141 - DNA, 20 bp, Homo sapiens
atatttaagaaaatacaata

SEQ ID NO: 3137142 - DNA, 22 bp, Homo sapiens
atatttaagaaaatacaataaa

SEQ ID NO: 3137143 - DNA, 23 bp, Homo sapiens
atatttaagaaaatacaataaac

SEQ ID NO: 3137144 - DNA, 12 bp, Homo sapiens
atatttaatgat

SEQ ID NO: 3137145 - DNA, 23 bp, Homo sapiens
atatttaatgataagtaaatgct

SEQ ID NO: 3137146 - DNA, 22 bp, Homo sapiens
atatttaatgcattaaacctgt

SEQ ID NO: 3137147 - DNA, 17 bp, Homo sapiens
atatttaattattaact

SEQ ID NO: 3137148 - DNA, 21 bp, Homo sapiens
atatttacatgaattgcattt

SEQ ID NO: 3137149 - DNA, 14 bp, Homo sapiens
atatttataaaact

SEQ ID NO: 3137150 - DNA, 16 bp, Homo sapiens
atatttataacagcat

SEQ ID NO: 3137151 - DNA, 21 bp, Homo sapiens
atatttataactcatcataaa

SEQ ID NO: 3137152 - DNA, 15 bp, Homo sapiens
atatttatactttgc

SEQ ID NO: 3137153 - DNA, 15 bp, Homo sapiens
atatttatatttcac

SEQ ID NO: 3137154 - DNA, 16 bp, Homo sapiens
atatttattaaataaa

SEQ ID NO: 3137155 - DNA, 16 bp, Homo sapiens
atatttattgttagaa

SEQ ID NO: 3137156 - DNA, 23 bp, Homo sapiens
atatttattgtttatttatcagt

SEQ ID NO: 3137157 - DNA, 17 bp, Homo sapiens
atatttatttatttatt

SEQ ID NO: 3137158 - DNA, 20 bp, Homo sapiens
atatttattttcagtatact

SEQ ID NO: 3137159 - DNA, 19 bp, Homo sapiens
atatttattttttttaagt

SEQ ID NO: 3137160 - DNA, 19 bp, Homo sapiens
atatttcacaggctgtaaa

SEQ ID NO: 3137161 - DNA, 20 bp, Homo sapiens
atatttcacaggctgtaaat

SEQ ID NO: 3137162 - DNA, 18 bp, Homo sapiens
atatttcacttttgttct

SEQ ID NO: 3137163 - DNA, 21 bp, Homo sapiens
atatttcacttttgttctgct

SEQ ID NO: 3137164 - DNA, 23 bp, Homo sapiens
atatttcattttaacatgatttc

SEQ ID NO: 3137165 - DNA, 13 bp, Homo sapiens
atatttcctgact

SEQ ID NO: 3137166 - DNA, 14 bp, Homo sapiens
atatttctaactat

SEQ ID NO: 3137167 - DNA, 21 bp, Homo sapiens
atatttctcataatgtgaaat

SEQ ID NO: 3137168 - DNA, 15 bp, Homo sapiens
atatttctgatataa

SEQ ID NO: 3137169 - DNA, 20 bp, Homo sapiens
atatttcttgctttcaatta

SEQ ID NO: 3137170 - DNA, 12 bp, Homo sapiens
atatttgaatga

SEQ ID NO: 3137171 - DNA, 20 bp, Homo sapiens
atatttgaattttaaatcta

SEQ ID NO: 3137172 - DNA, 15 bp, Homo sapiens
atatttgacttgcat

SEQ ID NO: 3137173 - DNA, 16 bp, Homo sapiens
atatttgacttgcatg

SEQ ID NO: 3137174 - DNA, 17 bp, Homo sapiens
atatttgaggagtgtta

SEQ ID NO: 3137175 - DNA, 22 bp, Homo sapiens
atatttgcacttatgtacttga

SEQ ID NO: 3137176 - DNA, 13 bp, Homo sapiens
atatttggaaaga

SEQ ID NO: 3137177 - DNA, 18 bp, Homo sapiens
atatttggcttaaatata

SEQ ID NO: 3137178 - DNA, 23 bp, Homo sapiens
atatttggggtccttttttatac

SEQ ID NO: 3137179 - DNA, 13 bp, Homo sapiens
atatttgtacaaa

SEQ ID NO: 3137180 - DNA, 12 bp, Homo sapiens
atatttgtacat

SEQ ID NO: 3137181 - DNA, 22 bp, Homo sapiens
atatttgtgatagcactttcta

SEQ ID NO: 3137182 - DNA, 21 bp, Homo sapiens
atatttgtgtattttcctgga

SEQ ID NO: 3137183 - DNA, 17 bp, Homo sapiens
atattttaactccactg

SEQ ID NO: 3137184 - DNA, 17 bp, Homo sapiens
atattttaatagaaata

SEQ ID NO: 3137185 - DNA, 19 bp, Homo sapiens
atattttaatgcagttgct

SEQ ID NO: 3137186 - DNA, 17 bp, Homo sapiens
atattttacctcttatt

SEQ ID NO: 3137187 - DNA, 17 bp, Homo sapiens
atattttattgtatttt

SEQ ID NO: 3137188 - DNA, 17 bp, Homo sapiens
atattttcacaatgtca

SEQ ID NO: 3137189 - DNA, 13 bp, Homo sapiens
atattttcagtac

SEQ ID NO: 3137190 - DNA, 13 bp, Homo sapiens
atattttctattt

SEQ ID NO: 3137191 - DNA, 12 bp, Homo sapiens
atattttctcta

SEQ ID NO: 3137192 - DNA, 19 bp, Homo sapiens
atattttgattattgtatt

SEQ ID NO: 3137193 - DNA, 12 bp, Homo sapiens
atattttgctgg

SEQ ID NO: 3137194 - DNA, 17 bp, Homo sapiens
atattttggaaactgct

SEQ ID NO: 3137195 - DNA, 21 bp, Homo sapiens
atattttgttgccttcatctt

SEQ ID NO: 3137196 - DNA, 15 bp, Homo sapiens
atatttttaaagatc

SEQ ID NO: 3137197 - DNA, 22 bp, Homo sapiens
atatttttatctatataaaata

SEQ ID NO: 3137198 - DNA, 10 bp, Homo sapiens
atatttttgt

SEQ ID NO: 3137199 - DNA, 13 bp, Homo sapiens
atatttttgtaca

SEQ ID NO: 3137200 - DNA, 14 bp, Homo sapiens
atatttttgtacat

SEQ ID NO: 3137201 - DNA, 16 bp, Homo sapiens
atatttttgtacatat

SEQ ID NO: 3137202 - DNA, 13 bp, Homo sapiens
atatttttgtact

SEQ ID NO: 3137203 - DNA, 15 bp, Homo sapiens
atatttttgtacttg

SEQ ID NO: 3137204 - DNA, 17 bp, Homo sapiens
atattttttaatttaaa

SEQ ID NO: 3137205 - DNA, 21 bp, Homo sapiens
atattttttaatttaaagctt

SEQ ID NO: 3137206 - DNA, 19 bp, Homo sapiens
atattttttatttctaagt

SEQ ID NO: 3137207 - DNA, 16 bp, Homo sapiens
atatttttttaattta

SEQ ID NO: 3137208 - DNA, 13 bp, Homo sapiens
atcaaaaagaaaa

SEQ ID NO: 3137209 - DNA, 21 bp, Homo sapiens
atcaaaactttcttttctgga

SEQ ID NO: 3137210 - DNA, 21 bp, Homo sapiens
atcagacctgtcttccaagga

SEQ ID NO: 3137211 - DNA, 22 bp, Homo sapiens
atcagactagtgacaagctcct

SEQ ID NO: 3137212 - DNA, 13 bp, Homo sapiens
atcagagctcctc

SEQ ID NO: 3137213 - DNA, 14 bp, Homo sapiens
atcagagctcttaa

SEQ ID NO: 3137214 - DNA, 17 bp, Homo sapiens
atcagaggcctataatg

SEQ ID NO: 3137215 - DNA, 14 bp, Homo sapiens
atcagaggtgtaca

SEQ ID NO: 3137216 - DNA, 15 bp, Homo sapiens
atcagagtagaaata

SEQ ID NO: 3137217 - DNA, 15 bp, Homo sapiens
atcagatacatcact

SEQ ID NO: 3137218 - DNA, 16 bp, Homo sapiens
atcagatacatcactg

SEQ ID NO: 3137219 - DNA, 22 bp, Homo sapiens
atcagatgctccaagattctag

SEQ ID NO: 3137220 - DNA, 21 bp, Homo sapiens
atcagcaaaccggggcctact

SEQ ID NO: 3137221 - DNA, 13 bp, Homo sapiens
atcagcaaagaaa

SEQ ID NO: 3137222 - DNA, 23 bp, Homo sapiens
atcagcaaagaaaaaaaaaaaag

SEQ ID NO: 3137223 - DNA, 13 bp, Homo sapiens
atcagcactgaaa

SEQ ID NO: 3137224 - DNA, 23 bp, Homo sapiens
atcagccagcccatggcccccaa

SEQ ID NO: 3137225 - DNA, 11 bp, Homo sapiens
atcagcctctt

SEQ ID NO: 3137226 - DNA, 13 bp, Homo sapiens
atcagcctcttaa

SEQ ID NO: 3137227 - DNA, 18 bp, Homo sapiens
atcagcctgagtctcctg

SEQ ID NO: 3137228 - DNA, 22 bp, Homo sapiens
atcagcctgagtctcctgtgcc

SEQ ID NO: 3137229 - DNA, 15 bp, Homo sapiens
atcagctccttttcc

SEQ ID NO: 3137230 - DNA, 15 bp, Homo sapiens
atcagctctcctggc

SEQ ID NO: 3137231 - DNA, 18 bp, Homo sapiens
atcagctctcctggctcc

SEQ ID NO: 3137232 - DNA, 12 bp, Homo sapiens
atcagctgctac

SEQ ID NO: 3137233 - DNA, 19 bp, Homo sapiens
atcaggaatattttccaaa

SEQ ID NO: 3137234 - DNA, 17 bp, Homo sapiens
atcaggcactggtggca

SEQ ID NO: 3137235 - DNA, 18 bp, Homo sapiens
atcagggaggtcattttg

SEQ ID NO: 3137236 - DNA, 17 bp, Homo sapiens
atcagggcctggggcct

SEQ ID NO: 3137237 - DNA, 22 bp, Homo sapiens
atcagggcctggggcctgagag

SEQ ID NO: 3137238 - DNA, 14 bp, Homo sapiens
atcaggtgctgcca

SEQ ID NO: 3137239 - DNA, 15 bp, Homo sapiens
atcaggtgctgccat

SEQ ID NO: 3137240 - DNA, 15 bp, Homo sapiens
atcagtaaccccctt

SEQ ID NO: 3137241 - DNA, 23 bp, Homo sapiens
atcagtaacccccttaaatttaa

SEQ ID NO: 3137242 - DNA, 16 bp, Homo sapiens
atcagtatatttggtt

SEQ ID NO: 3137243 - DNA, 22 bp, Homo sapiens
atcagtattaatactaaaatat

SEQ ID NO: 3137244 - DNA, 13 bp, Homo sapiens
atcagtcaatatt

SEQ ID NO: 3137245 - DNA, 19 bp, Homo sapiens
atcagtcataactaaataa

SEQ ID NO: 3137246 - DNA, 21 bp, Homo sapiens
atcagtccctatgtatttgca

SEQ ID NO: 3137247 - DNA, 19 bp, Homo sapiens
atcagtctatccacagaga

SEQ ID NO: 3137248 - DNA, 20 bp, Homo sapiens
atcagtctatccacagagag

SEQ ID NO: 3137249 - DNA, 13 bp, Homo sapiens
atcagtgactgaa

SEQ ID NO: 3137250 - DNA, 14 bp, Homo sapiens
atcagtgactgaaa

SEQ ID NO: 3137251 - DNA, 15 bp, Homo sapiens
atcagtgatctatgt

SEQ ID NO: 3137252 - DNA, 17 bp, Homo sapiens
atcagtgcctctttgaa

SEQ ID NO: 3137253 - DNA, 20 bp, Homo sapiens
atcagtgcctctttgaaggt

SEQ ID NO: 3137254 - DNA, 18 bp, Homo sapiens
atcagtgggcaggataaa

SEQ ID NO: 3137255 - DNA, 19 bp, Homo sapiens
atcagtgtaccatttgcct

SEQ ID NO: 3137256 - DNA, 23 bp, Homo sapiens
atcagtgtagttaaggagcctaa

SEQ ID NO: 3137257 - DNA, 19 bp, Homo sapiens
atcagtgtgtctaaatttg

SEQ ID NO: 3137258 - DNA, 23 bp, Homo sapiens
atcagtgtgtctaaatttgaatg

SEQ ID NO: 3137259 - DNA, 13 bp, Homo sapiens
atcagtgttactg

SEQ ID NO: 3137260 - DNA, 17 bp, Homo sapiens
atcagtgttttaaattc

SEQ ID NO: 3137261 - DNA, 18 bp, Homo sapiens
atcagtgttttaaattct

SEQ ID NO: 3137262 - DNA, 21 bp, Homo sapiens
atcagttatattttgctgttt

SEQ ID NO: 3137263 - DNA, 22 bp, Homo sapiens
atcagttgaggccaggagttta

SEQ ID NO: 3137264 - DNA, 20 bp, Homo sapiens
atcagttttgtataacttaa

SEQ ID NO: 3137265 - DNA, 13 bp, Homo sapiens
atcataaagtcag

SEQ ID NO: 3137266 - DNA, 15 bp, Homo sapiens
atcataagtgaattt

SEQ ID NO: 3137267 - DNA, 17 bp, Homo sapiens
atcataagtgaatttat

SEQ ID NO: 3137268 - DNA, 21 bp, Homo sapiens
atcataccctttattctcact

SEQ ID NO: 3137269 - DNA, 21 bp, Homo sapiens
atcatattaaaattacagatg

SEQ ID NO: 3137270 - DNA, 18 bp, Homo sapiens
atcatattgatgaaaaga

SEQ ID NO: 3137271 - DNA, 15 bp, Homo sapiens
atcatatttgaaaac

SEQ ID NO: 3137272 - DNA, 13 bp, Homo sapiens
atcatcaaaaagt

SEQ ID NO: 3137273 - DNA, 20 bp, Homo sapiens
atcatcaacaagatttcctt

SEQ ID NO: 3137274 - DNA, 23 bp, Homo sapiens
atcatcaagcaggaattatgtcg

SEQ ID NO: 3137275 - DNA, 21 bp, Homo sapiens
atcatccactgtgccatgtgc

SEQ ID NO: 3137276 - DNA, 15 bp, Homo sapiens
atcatccctttccct

SEQ ID NO: 3137277 - DNA, 19 bp, Homo sapiens
atcatccctttcccttggt

SEQ ID NO: 3137278 - DNA, 14 bp, Homo sapiens
atcatccctttctc

SEQ ID NO: 3137279 - DNA, 15 bp, Homo sapiens
atcatcctaagctat

SEQ ID NO: 3137280 - DNA, 21 bp, Homo sapiens
atcatcctgttttctctgtga

SEQ ID NO: 3137281 - DNA, 16 bp, Homo sapiens
atcatcctttgttctg

SEQ ID NO: 3137282 - DNA, 17 bp, Homo sapiens
atcatcctttgttctga

SEQ ID NO: 3137283 - DNA, 19 bp, Homo sapiens
atcatcctttgttctgagc

SEQ ID NO: 3137284 - DNA, 20 bp, Homo sapiens
atcatcgaaaattcatttca

SEQ ID NO: 3137285 - DNA, 13 bp, Homo sapiens
atcatcgccagag

SEQ ID NO: 3137286 - DNA, 15 bp, Homo sapiens
atcatcgccagaggt

SEQ ID NO: 3137287 - DNA, 22 bp, Homo sapiens
atcatcgccagaggtgcttcac

SEQ ID NO: 3137288 - DNA, 17 bp, Homo sapiens
atcatctgcattcctga

SEQ ID NO: 3137289 - DNA, 15 bp, Homo sapiens
atcatctgtcattat

SEQ ID NO: 3137290 - DNA, 17 bp, Homo sapiens
atcatctgtcattatat

SEQ ID NO: 3137291 - DNA, 20 bp, Homo sapiens
atcatctgtcattatattct

SEQ ID NO: 3137292 - DNA, 23 bp, Homo sapiens
atcatctgtcattatattctaat

SEQ ID NO: 3137293 - DNA, 16 bp, Homo sapiens
atcatctgtgtgaaaa

SEQ ID NO: 3137294 - DNA, 18 bp, Homo sapiens
atcatgaaatatgcatct

SEQ ID NO: 3137295 - DNA, 14 bp, Homo sapiens
atcatgaattttaa

SEQ ID NO: 3137296 - DNA, 13 bp, Homo sapiens
atcatgacatgtt

SEQ ID NO: 3137297 - DNA, 21 bp, Homo sapiens
atcatgcatgtcctgtaaagg

SEQ ID NO: 3137298 - DNA, 12 bp, Homo sapiens
atcatgcattgt

SEQ ID NO: 3137299 - DNA, 14 bp, Homo sapiens
atcatgcattgttg

SEQ ID NO: 3137300 - DNA, 22 bp, Homo sapiens
atcatgcattgttgaggtggtc

SEQ ID NO: 3137301 - DNA, 14 bp, Homo sapiens
atcatgccctgcct

SEQ ID NO: 3137302 - DNA, 17 bp, Homo sapiens
atcatgctgcagtgggt

SEQ ID NO: 3137303 - DNA, 14 bp, Homo sapiens
atcatgctttaaag

SEQ ID NO: 3137304 - DNA, 22 bp, Homo sapiens
atcatgctttaaagtgtaataa

SEQ ID NO: 3137305 - DNA, 14 bp, Homo sapiens
atcatgggccagag

SEQ ID NO: 3137306 - DNA, 20 bp, Homo sapiens
atcatggtgtaataagacat

SEQ ID NO: 3137307 - DNA, 23 bp, Homo sapiens
atcatggtgtaataagacataac

SEQ ID NO: 3137308 - DNA, 15 bp, Homo sapiens
atcatgtccatccct

SEQ ID NO: 3137309 - DNA, 17 bp, Homo sapiens
atcatgtccatcccttt

SEQ ID NO: 3137310 - DNA, 17 bp, Homo sapiens
atcatgtcgtaggtaaa

SEQ ID NO: 3137311 - DNA, 21 bp, Homo sapiens
atcatgtcgtaggtaaactaa

SEQ ID NO: 3137312 - DNA, 21 bp, Homo sapiens
atcatgtgaacccgggacgca

SEQ ID NO: 3137313 - DNA, 21 bp, Homo sapiens
atcatgttatgatttgtaaca

SEQ ID NO: 3137314 - DNA, 14 bp, Homo sapiens
atcatgttatttta

SEQ ID NO: 3137315 - DNA, 19 bp, Homo sapiens
atcatgttgatcatgtact

SEQ ID NO: 3137316 - DNA, 11 bp, Homo sapiens
atcatgttgtt

SEQ ID NO: 3137317 - DNA, 15 bp, Homo sapiens
atcattaagacaact

SEQ ID NO: 3137318 - DNA, 20 bp, Homo sapiens
atcattactgttccagattc

SEQ ID NO: 3137319 - DNA, 13 bp, Homo sapiens
atcattcagaaat

SEQ ID NO: 3137320 - DNA, 16 bp, Homo sapiens
atcattcagaaatgtt

SEQ ID NO: 3137321 - DNA, 11 bp, Homo sapiens
atcattccagt

SEQ ID NO: 3137322 - DNA, 11 bp, Homo sapiens
atcattctcag

SEQ ID NO: 3137323 - DNA, 13 bp, Homo sapiens
atcattcttttat

SEQ ID NO: 3137324 - DNA, 20 bp, Homo sapiens
atcattggaacaactgatac

SEQ ID NO: 3137325 - DNA, 20 bp, Homo sapiens
atcatttccgttttgcctgt

SEQ ID NO: 3137326 - DNA, 21 bp, Homo sapiens
atcatttccgttttgcctgtg

SEQ ID NO: 3137327 - DNA, 17 bp, Homo sapiens
atcatttgaacaactag

SEQ ID NO: 3137328 - DNA, 18 bp, Homo sapiens
atcatttgcccttaagga

SEQ ID NO: 3137329 - DNA, 13 bp, Homo sapiens
atcatttgctttt

SEQ ID NO: 3137330 - DNA, 13 bp, Homo sapiens
atcattttaaaaa

SEQ ID NO: 3137331 - DNA, 14 bp, Homo sapiens
atcattttaaaaac

SEQ ID NO: 3137332 - DNA, 13 bp, Homo sapiens
atcattttacagt

SEQ ID NO: 3137333 - DNA, 14 bp, Homo sapiens
atcattttcccccc

SEQ ID NO: 3137334 - DNA, 14 bp, Homo sapiens
atcatttttgtaca

SEQ ID NO: 3137335 - DNA, 18 bp, Homo sapiens
atccaaaacaaacatgca

SEQ ID NO: 3137336 - DNA, 16 bp, Homo sapiens
atcgactcaaaaataa

SEQ ID NO: 3137337 - DNA, 14 bp, Homo sapiens
atcgatatgtatat

SEQ ID NO: 3137338 - DNA, 16 bp, Homo sapiens
atcgatgttttattat

SEQ ID NO: 3137339 - DNA, 11 bp, Homo sapiens
atcgattggct

SEQ ID NO: 3137340 - DNA, 18 bp, Homo sapiens
atcgatttctttcctcca

SEQ ID NO: 3137341 - DNA, 18 bp, Homo sapiens
atcgcaccattctgactc

SEQ ID NO: 3137342 - DNA, 19 bp, Homo sapiens
atcgccaaggactgactga

SEQ ID NO: 3137343 - DNA, 19 bp, Homo sapiens
atcgccagaggtgcttcac

SEQ ID NO: 3137344 - DNA, 14 bp, Homo sapiens
atcgctcactgttg

SEQ ID NO: 3137345 - DNA, 21 bp, Homo sapiens
atcgctcgtgtgttctatcca

SEQ ID NO: 3137346 - DNA, 17 bp, Homo sapiens
atcgcttatatgtcctt

SEQ ID NO: 3137347 - DNA, 14 bp, Homo sapiens
atcggaagcagtgc

SEQ ID NO: 3137348 - DNA, 18 bp, Homo sapiens
atcggaagcagtgccttc

SEQ ID NO: 3137349 - DNA, 16 bp, Homo sapiens
atcggagcctcctctc

SEQ ID NO: 3137350 - DNA, 18 bp, Homo sapiens
atcggagtcagccaggag

SEQ ID NO: 3137351 - DNA, 14 bp, Homo sapiens
atcggccacagggc

SEQ ID NO: 3137352 - DNA, 16 bp, Homo sapiens
atcggccacagggcgg

SEQ ID NO: 3137353 - DNA, 20 bp, Homo sapiens
atcggctggggactgctacc

SEQ ID NO: 3137354 - DNA, 18 bp, Homo sapiens
atcgggaaagaagaaact

SEQ ID NO: 3137355 - DNA, 21 bp, Homo sapiens
atcgggaacagtgtttcccat

SEQ ID NO: 3137356 - DNA, 19 bp, Homo sapiens
atcgggagcacccagagca

SEQ ID NO: 3137357 - DNA, 21 bp, Homo sapiens
atcgggagcagtgtcttccat

SEQ ID NO: 3137358 - DNA, 18 bp, Homo sapiens
atcggtgaaactaacaga

SEQ ID NO: 3137359 - DNA, 13 bp, Homo sapiens
atcgtccttcctc

SEQ ID NO: 3137360 - DNA, 14 bp, Homo sapiens
atcgtctaaacttt

SEQ ID NO: 3137361 - DNA, 12 bp, Homo sapiens
atcgtgaaaccc

SEQ ID NO: 3137362 - DNA, 20 bp, Homo sapiens
atcgtgaaaccctgtctcta

SEQ ID NO: 3137363 - DNA, 15 bp, Homo sapiens
atcgtgacaacactt

SEQ ID NO: 3137364 - DNA, 18 bp, Homo sapiens
atcgtgacccttcagggc

SEQ ID NO: 3137365 - DNA, 19 bp, Homo sapiens
atcgtgacccttcagggcc

SEQ ID NO: 3137366 - DNA, 22 bp, Homo sapiens
atcgtgacccttcagggccaga

SEQ ID NO: 3137367 - DNA, 17 bp, Homo sapiens
atcgtgctaaattttca

SEQ ID NO: 3137368 - DNA, 23 bp, Homo sapiens
atctaaaaatagacttaaatctc

SEQ ID NO: 3137369 - DNA, 21 bp, Homo sapiens
atctaaagcagcaggtctaga

SEQ ID NO: 3137370 - DNA, 15 bp, Homo sapiens
atctaaatctattta

SEQ ID NO: 3137371 - DNA, 16 bp, Homo sapiens
atctaaatctatttat

SEQ ID NO: 3137372 - DNA, 19 bp, Homo sapiens
atctaaatttcttttgcta

SEQ ID NO: 3137373 - DNA, 23 bp, Homo sapiens
atctaaccattaagtcatgtgtg

SEQ ID NO: 3137374 - DNA, 22 bp, Homo sapiens
atctaaccctcccatggcacct

SEQ ID NO: 3137375 - DNA, 16 bp, Homo sapiens
atctaagcctttccat

SEQ ID NO: 3137376 - DNA, 17 bp, Homo sapiens
atctaagcctttccata

SEQ ID NO: 3137377 - DNA, 11 bp, Homo sapiens
atctaaggata

SEQ ID NO: 3137378 - DNA, 13 bp, Homo sapiens
atctaagtgatat

SEQ ID NO: 3137379 - DNA, 17 bp, Homo sapiens
atctaagtgatataaat

SEQ ID NO: 3137380 - DNA, 13 bp, Homo sapiens
atctaagttataa

SEQ ID NO: 3137381 - DNA, 15 bp, Homo sapiens
atctaatatatatga

SEQ ID NO: 3137382 - DNA, 20 bp, Homo sapiens
atctaatatatatgaataaa

SEQ ID NO: 3137383 - DNA, 20 bp, Homo sapiens
atctaatatgtaacaagcca

SEQ ID NO: 3137384 - DNA, 14 bp, Homo sapiens
atctaatattaaaa

SEQ ID NO: 3137385 - DNA, 21 bp, Homo sapiens
atctaatctcttattctaata

SEQ ID NO: 3137386 - DNA, 23 bp, Homo sapiens
atctaatgcttgtttatgatatt

SEQ ID NO: 3137387 - DNA, 22 bp, Homo sapiens
atctaatgtaagaaaatttgaa

SEQ ID NO: 3137388 - DNA, 23 bp, Homo sapiens
atctaattatttccacttgccct

SEQ ID NO: 3137389 - DNA, 16 bp, Homo sapiens
atctaattattttgca

SEQ ID NO: 3137390 - DNA, 19 bp, Homo sapiens
atctaatttataaaaaggt

SEQ ID NO: 3137391 - DNA, 14 bp, Homo sapiens
atctacaatctctt

SEQ ID NO: 3137392 - DNA, 17 bp, Homo sapiens
atctacagatccttttt

SEQ ID NO: 3137393 - DNA, 21 bp, Homo sapiens
atctacagatcctttttccat

SEQ ID NO: 3137394 - DNA, 22 bp, Homo sapiens
atctacaggacaaagggaggga

SEQ ID NO: 3137395 - DNA, 20 bp, Homo sapiens
atctaccccagactagatgt

SEQ ID NO: 3137396 - DNA, 16 bp, Homo sapiens
atctactcagaaattt

SEQ ID NO: 3137397 - DNA, 18 bp, Homo sapiens
atctacttcatagctcct

SEQ ID NO: 3137398 - DNA, 20 bp, Homo sapiens
atctacttctgtaattgtgt

SEQ ID NO: 3137399 - DNA, 12 bp, Homo sapiens
atctagccagcc

SEQ ID NO: 3137400 - DNA, 19 bp, Homo sapiens
atctagccagcccctcttc

SEQ ID NO: 3137401 - DNA, 14 bp, Homo sapiens
atctaggcatgaag

SEQ ID NO: 3137402 - DNA, 21 bp, Homo sapiens
atctaggtggagttgaaagag

SEQ ID NO: 3137403 - DNA, 18 bp, Homo sapiens
atctagtgcagctgattt

SEQ ID NO: 3137404 - DNA, 19 bp, Homo sapiens
atctagtgcagctgatttt

SEQ ID NO: 3137405 - DNA, 12 bp, Homo sapiens
atctataaagcg

SEQ ID NO: 3137406 - DNA, 23 bp, Homo sapiens
atctataatttacctaagattac

SEQ ID NO: 3137407 - DNA, 11 bp, Homo sapiens
atctatataaa

SEQ ID NO: 3137408 - DNA, 13 bp, Homo sapiens
atctatataaaat

SEQ ID NO: 3137409 - DNA, 16 bp, Homo sapiens
atctatataaaataac

SEQ ID NO: 3137410 - DNA, 15 bp, Homo sapiens
atctatatataattc

SEQ ID NO: 3137411 - DNA, 19 bp, Homo sapiens
atctatatataattctgta

SEQ ID NO: 3137412 - DNA, 20 bp, Homo sapiens
atctatatataattctgtac

SEQ ID NO: 3137413 - DNA, 12 bp, Homo sapiens
atctatattaga

SEQ ID NO: 3137414 - DNA, 18 bp, Homo sapiens
atctatattctatacaca

SEQ ID NO: 3137415 - DNA, 15 bp, Homo sapiens
atctatatttaacaa

SEQ ID NO: 3137416 - DNA, 18 bp, Homo sapiens
atctatgagggtgtttcc

SEQ ID NO: 3137417 - DNA, 13 bp, Homo sapiens
atctatgatataa

SEQ ID NO: 3137418 - DNA, 17 bp, Homo sapiens
atctatgtttgtgtgat

SEQ ID NO: 3137419 - DNA, 21 bp, Homo sapiens
atctatgtttgtgtgatttcc

SEQ ID NO: 3137420 - DNA, 17 bp, Homo sapiens
atctattataaaaccat

SEQ ID NO: 3137421 - DNA, 15 bp, Homo sapiens
atctattcagacaag

SEQ ID NO: 3137422 - DNA, 13 bp, Homo sapiens
atctatttattaa

SEQ ID NO: 3137423 - DNA, 15 bp, Homo sapiens
atctatttattaata

SEQ ID NO: 3137424 - DNA, 19 bp, Homo sapiens
atctatttattaatattta

SEQ ID NO: 3137425 - DNA, 23 bp, Homo sapiens
atctatttgtagattaggattaa

SEQ ID NO: 3137426 - DNA, 22 bp, Homo sapiens
atctattttggattgtatattg

SEQ ID NO: 3137427 - DNA, 12 bp, Homo sapiens
atctcaaaatta

SEQ ID NO: 3137428 - DNA, 17 bp, Homo sapiens
atctcaaaggagaaaaa

SEQ ID NO: 3137429 - DNA, 13 bp, Homo sapiens
atctcaaatttat

SEQ ID NO: 3137430 - DNA, 13 bp, Homo sapiens
atctcaccccatc

SEQ ID NO: 3137431 - DNA, 23 bp, Homo sapiens
atctcaccccatcccacaccctg

SEQ ID NO: 3137432 - DNA, 20 bp, Homo sapiens
atctcagaattccttttcta

SEQ ID NO: 3137433 - DNA, 20 bp, Homo sapiens
atctcagatcagtgtaccat

SEQ ID NO: 3137434 - DNA, 21 bp, Homo sapiens
atctcagcctcctgagcctgt

SEQ ID NO: 3137435 - DNA, 24 bp, Homo sapiens
atctcagcctcctgagcctgtggg

SEQ ID NO: 3137436 - DNA, 22 bp, Homo sapiens
atctcagctttgagaagccttc

SEQ ID NO: 3137437 - DNA, 17 bp, Homo sapiens
atctcaggggccagagg

SEQ ID NO: 3137438 - DNA, 17 bp, Homo sapiens
atctcaggggctgtttg

SEQ ID NO: 3137439 - DNA, 14 bp, Homo sapiens
atctcaggtgccac

SEQ ID NO: 3137440 - DNA, 17 bp, Homo sapiens
atctcaggtgccactcc

SEQ ID NO: 3137441 - DNA, 16 bp, Homo sapiens
atctcagtcatgcata

SEQ ID NO: 3137442 - DNA, 21 bp, Homo sapiens
atctcagtcatgcataaatat

SEQ ID NO: 3137443 - DNA, 14 bp, Homo sapiens
atctcagtgctttc

SEQ ID NO: 3137444 - DNA, 22 bp, Homo sapiens
atctcatacacaactgttcccg

SEQ ID NO: 3137445 - DNA, 18 bp, Homo sapiens
atctcatacctctgacca

SEQ ID NO: 3137446 - DNA, 16 bp, Homo sapiens
atctcatactgtctgg

SEQ ID NO: 3137447 - DNA, 19 bp, Homo sapiens
atctcataggttgccaata

SEQ ID NO: 3137448 - DNA, 15 bp, Homo sapiens
atctcatcctggcac

SEQ ID NO: 3137449 - DNA, 17 bp, Homo sapiens
atctcattgcttacaag

SEQ ID NO: 3137450 - DNA, 15 bp, Homo sapiens
atctccagtattctt

SEQ ID NO: 3137451 - DNA, 20 bp, Homo sapiens
atctccatcatatgcctgac

SEQ ID NO: 3137452 - DNA, 15 bp, Homo sapiens
atctccatctgtcaa

SEQ ID NO: 3137453 - DNA, 15 bp, Homo sapiens
atctcccacaagtat

SEQ ID NO: 3137454 - DNA, 21 bp, Homo sapiens
atctccccaggcctccagcct

SEQ ID NO: 3137455 - DNA, 15 bp, Homo sapiens
atctcccccaaccca

SEQ ID NO: 3137456 - DNA, 17 bp, Homo sapiens
atctcccccaacccacc

SEQ ID NO: 3137457 - DNA, 21 bp, Homo sapiens
atctcccccaacccacctctg

SEQ ID NO: 3137458 - DNA, 23 bp, Homo sapiens
atctccccttgcactaaagtatg

SEQ ID NO: 3137459 - DNA, 20 bp, Homo sapiens
atctccctccccagaaacag

SEQ ID NO: 3137460 - DNA, 13 bp, Homo sapiens
atctccctgcctg

SEQ ID NO: 3137461 - DNA, 15 bp, Homo sapiens
atctccctgcctggc

SEQ ID NO: 3137462 - DNA, 12 bp, Homo sapiens
atctttccagtt

SEQ ID NO: 3137463 - DNA, 13 bp, Homo sapiens
atctttccctctt

SEQ ID NO: 3137464 - DNA, 23 bp, Homo sapiens
atctttccctcttcggtgttctt

SEQ ID NO: 3137465 - DNA, 13 bp, Homo sapiens
atctttcctcaag

SEQ ID NO: 3137466 - DNA, 16 bp, Homo sapiens
atctttcctcaagtat

SEQ ID NO: 3137467 - DNA, 12 bp, Homo sapiens
atctttcctgtc

SEQ ID NO: 3137468 - DNA, 18 bp, Homo sapiens
atctttctatataaaatg

SEQ ID NO: 3137469 - DNA, 22 bp, Homo sapiens
atctttctatataaaatgtatt

SEQ ID NO: 3137470 - DNA, 23 bp, Homo sapiens
atctttctatataaaatgtattc

SEQ ID NO: 3137471 - DNA, 14 bp, Homo sapiens
atctttctgcacac

SEQ ID NO: 3137472 - DNA, 17 bp, Homo sapiens
atctttctttacctgag

SEQ ID NO: 3137473 - DNA, 22 bp, Homo sapiens
atctttctttacctgagaccag

SEQ ID NO: 3137474 - DNA, 15 bp, Homo sapiens
atctttctttccaaa

SEQ ID NO: 3137475 - DNA, 14 bp, Homo sapiens
atctttctttccat

SEQ ID NO: 3137476 - DNA, 22 bp, Homo sapiens
atctttgccttgggctgctcct

SEQ ID NO: 3137477 - DNA, 17 bp, Homo sapiens
atctttgcgaaaagata

SEQ ID NO: 3137478 - DNA, 20 bp, Homo sapiens
atctttgcgaaaagataaac

SEQ ID NO: 3137479 - DNA, 23 bp, Homo sapiens
atctttgcgaaaagataaacctg

SEQ ID NO: 3137480 - DNA, 17 bp, Homo sapiens
atctttgtaccaaaatt

SEQ ID NO: 3137481 - DNA, 17 bp, Homo sapiens
atctttgtgataattta

SEQ ID NO: 3137482 - DNA, 22 bp, Homo sapiens
atcttttcataaagggttgaaa

SEQ ID NO: 3137483 - DNA, 14 bp, Homo sapiens
atcttttggttatt

SEQ ID NO: 3137484 - DNA, 11 bp, Homo sapiens
atctttttaaa

SEQ ID NO: 3137485 - DNA, 13 bp, Homo sapiens
atctttttaaaaa

SEQ ID NO: 3137486 - DNA, 23 bp, Homo sapiens
atctttttaaaaactcttcagtg

SEQ ID NO: 3137487 - DNA, 18 bp, Homo sapiens
atctttttacctttcata

SEQ ID NO: 3137488 - DNA, 19 bp, Homo sapiens
atctttttacctttcatac

SEQ ID NO: 3137489 - DNA, 16 bp, Homo sapiens
atctttttctttttaa

SEQ ID NO: 3137490 - DNA, 18 bp, Homo sapiens
atcttttttagcataaaa

SEQ ID NO: 3137491 - DNA, 14 bp, Homo sapiens
atcttttttcaaaa

SEQ ID NO: 3137492 - DNA, 20 bp, Homo sapiens
atgaaaaacaaaaataacat

SEQ ID NO: 3137493 - DNA, 13 bp, Homo sapiens
atgaaaaacaacc

SEQ ID NO: 3137494 - DNA, 22 bp, Homo sapiens
atgaaaaatttaagcattgttt

SEQ ID NO: 3137495 - DNA, 16 bp, Homo sapiens
atgaaaactctttgct

SEQ ID NO: 3137496 - DNA, 16 bp, Homo sapiens
atgaaaagctgctggt

SEQ ID NO: 3137497 - DNA, 19 bp, Homo sapiens
atgaaaagttatttatgct

SEQ ID NO: 3137498 - DNA, 22 bp, Homo sapiens
atgaaaagttatttatgctata

SEQ ID NO: 3137499 - DNA, 22 bp, Homo sapiens
atgaaaataactgaatttggag

SEQ ID NO: 3137500 - DNA, 13 bp, Homo sapiens
atgaaaatacaac

SEQ ID NO: 3137501 - DNA, 12 bp, Homo sapiens
atgaaaatcctt

SEQ ID NO: 3137502 - DNA, 16 bp, Homo sapiens
atgaaaatccttttaa

SEQ ID NO: 3137503 - DNA, 18 bp, Homo sapiens
atgaaaatccttttaacc

SEQ ID NO: 3137504 - DNA, 16 bp, Homo sapiens
atgaaaatgagcatca

SEQ ID NO: 3137505 - DNA, 12 bp, Homo sapiens
atgaaaatgtca

SEQ ID NO: 3137506 - DNA, 13 bp, Homo sapiens
atgaaaatgtcag

SEQ ID NO: 3137507 - DNA, 15 bp, Homo sapiens
atgaaaatgtcagaa

SEQ ID NO: 3137508 - DNA, 14 bp, Homo sapiens
atgaaaattgtatt

SEQ ID NO: 3137509 - DNA, 16 bp, Homo sapiens
atgaaacaaataatca

SEQ ID NO: 3137510 - DNA, 16 bp, Homo sapiens
atgaaactcacaaatg

SEQ ID NO: 3137511 - DNA, 19 bp, Homo sapiens
atgaaactcctgattttgt

SEQ ID NO: 3137512 - DNA, 18 bp, Homo sapiens
atgaaagaatatatttat

SEQ ID NO: 3137513 - DNA, 16 bp, Homo sapiens
atgaaagactgtacaa

SEQ ID NO: 3137514 - DNA, 16 bp, Homo sapiens
atgaaagattccacag

SEQ ID NO: 3137515 - DNA, 23 bp, Homo sapiens
atgaaagctgattactgtcaata

SEQ ID NO: 3137516 - DNA, 18 bp, Homo sapiens
atgaaagggcccagagag

SEQ ID NO: 3137517 - DNA, 21 bp, Homo sapiens
atgaaaggtttacattgtcaa

SEQ ID NO: 3137518 - DNA, 15 bp, Homo sapiens
atgaaagtgacttta

SEQ ID NO: 3137519 - DNA, 22 bp, Homo sapiens
atgaaataactccttcttgtag

SEQ ID NO: 3137520 - DNA, 20 bp, Homo sapiens
atgaaatacacaagtaaaca

SEQ ID NO: 3137521 - DNA, 14 bp, Homo sapiens
atgaaatgaggtca

SEQ ID NO: 3137522 - DNA, 22 bp, Homo sapiens
atgaaatgccctcctaaatgtc

SEQ ID NO: 3137523 - DNA, 16 bp, Homo sapiens
atgaaatggttaagaa

SEQ ID NO: 3137524 - DNA, 22 bp, Homo sapiens
atgaaatgtcccctcaaactca

SEQ ID NO: 3137525 - DNA, 18 bp, Homo sapiens
atgaaattcttgaagttc

SEQ ID NO: 3137526 - DNA, 23 bp, Homo sapiens
atgaaattgtctagcagagcagg

SEQ ID NO: 3137527 - DNA, 14 bp, Homo sapiens
atgaaattttgcct

SEQ ID NO: 3137528 - DNA, 16 bp, Homo sapiens
atgaaattttgcctgc

SEQ ID NO: 3137529 - DNA, 14 bp, Homo sapiens
atgaacaaaattat

SEQ ID NO: 3137530 - DNA, 17 bp, Homo sapiens
atgaacacccttagaaa

SEQ ID NO: 3137531 - DNA, 17 bp, Homo sapiens
atgaacagctctgagat

SEQ ID NO: 3137532 - DNA, 21 bp, Homo sapiens
atgaacatagactagagaaac

SEQ ID NO: 3137533 - DNA, 17 bp, Homo sapiens
atgaacatatatttttt

SEQ ID NO: 3137534 - DNA, 14 bp, Homo sapiens
atgaacatcccttt

SEQ ID NO: 3137535 - DNA, 10 bp, Homo sapiens
atgaacattc

SEQ ID NO: 3137536 - DNA, 13 bp, Homo sapiens
atgaacattccaa

SEQ ID NO: 3137537 - DNA, 15 bp, Homo sapiens
atgaacctattttca

SEQ ID NO: 3137538 - DNA, 20 bp, Homo sapiens
atgaacctattttcatttgt

SEQ ID NO: 3137539 - DNA, 22 bp, Homo sapiens
atgaacctattttcatttgtac

SEQ ID NO: 3137540 - DNA, 23 bp, Homo sapiens
atgaacctattttcatttgtaca

SEQ ID NO: 3137541 - DNA, 14 bp, Homo sapiens
atgaactgaagttt

SEQ ID NO: 3137542 - DNA, 15 bp, Homo sapiens
atgaactgaagtttc

SEQ ID NO: 3137543 - DNA, 19 bp, Homo sapiens
atgaactgaagtttcacat

SEQ ID NO: 3137544 - DNA, 18 bp, Homo sapiens
atgaactgcttttcctca

SEQ ID NO: 3137545 - DNA, 18 bp, Homo sapiens
atgaacttattctgtaga

SEQ ID NO: 3137546 - DNA, 14 bp, Homo sapiens
atgaacttgttact

SEQ ID NO: 3137547 - DNA, 17 bp, Homo sapiens
atgaagaaaaagtacaa

SEQ ID NO: 3137548 - DNA, 19 bp, Homo sapiens
atgaagaaaatcacttagg

SEQ ID NO: 3137549 - DNA, 18 bp, Homo sapiens
atgaagaacacagcatgt

SEQ ID NO: 3137550 - DNA, 15 bp, Homo sapiens
atgaagaactgagga

SEQ ID NO: 3137551 - DNA, 14 bp, Homo sapiens
atgaagaaggaagc

SEQ ID NO: 3137552 - DNA, 17 bp, Homo sapiens
atgaagaaggaagctgt

SEQ ID NO: 3137553 - DNA, 23 bp, Homo sapiens
atgaagaaggaagctgtgttgaa

SEQ ID NO: 3137554 - DNA, 15 bp, Homo sapiens
atgaagaattatgta

SEQ ID NO: 3137555 - DNA, 17 bp, Homo sapiens
atgaagaattatgtaat

SEQ ID NO: 3137556 - DNA, 15 bp, Homo sapiens
atgaagagaagcaat

SEQ ID NO: 3137557 - DNA, 18 bp, Homo sapiens
atgaagagtgagagggca

SEQ ID NO: 3137558 - DNA, 19 bp, Homo sapiens
atgaagagtgagagggcat

SEQ ID NO: 3137559 - DNA, 16 bp, Homo sapiens
atgaagcaaggaagat

SEQ ID NO: 3137560 - DNA, 13 bp, Homo sapiens
atgaagcagcttt

SEQ ID NO: 3137561 - DNA, 16 bp, Homo sapiens
atgaagcccaataaac

SEQ ID NO: 3137562 - DNA, 14 bp, Homo sapiens
atgaagctacctca

SEQ ID NO: 3137563 - DNA, 15 bp, Homo sapiens
atgaagctacctcaa

SEQ ID NO: 3137564 - DNA, 14 bp, Homo sapiens
atgaagctgtataa

SEQ ID NO: 3137565 - DNA, 22 bp, Homo sapiens
atgaagctgtataattaattgt

SEQ ID NO: 3137566 - DNA, 13 bp, Homo sapiens
atgaagctgttgt

SEQ ID NO: 3137567 - DNA, 23 bp, Homo sapiens
atgaagctttatacgtgtagcta

SEQ ID NO: 3137568 - DNA, 22 bp, Homo sapiens
atgaaggcagaaaaatgtcatt

SEQ ID NO: 3137569 - DNA, 17 bp, Homo sapiens
atgaagggaaaggatat

SEQ ID NO: 3137570 - DNA, 17 bp, Homo sapiens
atgaagggcgagtgaat

SEQ ID NO: 3137571 - DNA, 12 bp, Homo sapiens
atgaagtaaatt

SEQ ID NO: 3137572 - DNA, 19 bp, Homo sapiens
atgaagttgctgtttattt

SEQ ID NO: 3137573 - DNA, 22 bp, Homo sapiens
atgaagttgctgtttatttttt

SEQ ID NO: 3137574 - DNA, 16 bp, Homo sapiens
atgaagttttacattg

SEQ ID NO: 3137575 - DNA, 17 bp, Homo sapiens
atgaataaaacactcat

SEQ ID NO: 3137576 - DNA, 14 bp, Homo sapiens
atgaataaaataat

SEQ ID NO: 3137577 - DNA, 14 bp, Homo sapiens
atgaataaactgaa

SEQ ID NO: 3137578 - DNA, 21 bp, Homo sapiens
atgaataagctttctctcaga

SEQ ID NO: 3137579 - DNA, 22 bp, Homo sapiens
atgaataagctttctctcagaa

SEQ ID NO: 3137580 - DNA, 14 bp, Homo sapiens
atgaataatggaaa

SEQ ID NO: 3137581 - DNA, 15 bp, Homo sapiens
atgaataatttccca

SEQ ID NO: 3137582 - DNA, 15 bp, Homo sapiens
atgaatacaaatttt

SEQ ID NO: 3137583 - DNA, 17 bp, Homo sapiens
atgaatatctattaata

SEQ ID NO: 3137584 - DNA, 18 bp, Homo sapiens
atgaatatctattaatat

SEQ ID NO: 3137585 - DNA, 20 bp, Homo sapiens
atgaatatctattaatatat

SEQ ID NO: 3137586 - DNA, 22 bp, Homo sapiens
atgaatatctattaatatatgt

SEQ ID NO: 3137587 - DNA, 19 bp, Homo sapiens
atgaatattttgataataa

SEQ ID NO: 3137588 - DNA, 23 bp, Homo sapiens
atgccccttcttgggccccagac

SEQ ID NO: 3137589 - DNA, 16 bp, Homo sapiens
atgccccttggctgga

SEQ ID NO: 3137590 - DNA, 17 bp, Homo sapiens
atgcccggcgccgggca

SEQ ID NO: 3137591 - DNA, 17 bp, Homo sapiens
atgccctcctaaatgtc

SEQ ID NO: 3137592 - DNA, 21 bp, Homo sapiens
atgccctgccttgtccctctc

SEQ ID NO: 3137593 - DNA, 15 bp, Homo sapiens
atgcccttaaatcat

SEQ ID NO: 3137594 - DNA, 19 bp, Homo sapiens
atgccctttggaaagccat

SEQ ID NO: 3137595 - DNA, 16 bp, Homo sapiens
atgccgagacctcaag

SEQ ID NO: 3137596 - DNA, 19 bp, Homo sapiens
atgccgatatactctagat

SEQ ID NO: 3137597 - DNA, 20 bp, Homo sapiens
atgccggttaaattccatat

SEQ ID NO: 3137598 - DNA, 19 bp, Homo sapiens
atgccgtcctgcagtcctt

SEQ ID NO: 3137599 - DNA, 18 bp, Homo sapiens
atgcctacaaccatccct

SEQ ID NO: 3137600 - DNA, 21 bp, Homo sapiens
atgcctacaaccatccctgcc

SEQ ID NO: 3137601 - DNA, 16 bp, Homo sapiens
atgcctcaattcacat

SEQ ID NO: 3137602 - DNA, 15 bp, Homo sapiens
atgcctcactaattt

SEQ ID NO: 3137603 - DNA, 21 bp, Homo sapiens
atgcctcactaatttttgtat

SEQ ID NO: 3137604 - DNA, 19 bp, Homo sapiens
atgcctccaagccattcac

SEQ ID NO: 3137605 - DNA, 14 bp, Homo sapiens
atgcctcctgccct

SEQ ID NO: 3137606 - DNA, 21 bp, Homo sapiens
atgcctctgatatgggactga

SEQ ID NO: 3137607 - DNA, 22 bp, Homo sapiens
atgcctctgatatgggactgag

SEQ ID NO: 3137608 - DNA, 11 bp, Homo sapiens
atgcctctgga

SEQ ID NO: 3137609 - DNA, 20 bp, Homo sapiens
atgcctgaccccttgctccc

SEQ ID NO: 3137610 - DNA, 20 bp, Homo sapiens
atgcctgactaatttttgta

SEQ ID NO: 3137611 - DNA, 15 bp, Homo sapiens
atgcctgagggtgga

SEQ ID NO: 3137612 - DNA, 18 bp, Homo sapiens
atgcctgctttttggaaa

SEQ ID NO: 3137613 - DNA, 15 bp, Homo sapiens
atgcctggtcccaag

SEQ ID NO: 3137614 - DNA, 13 bp, Homo sapiens
atgcctggtggca

SEQ ID NO: 3137615 - DNA, 17 bp, Homo sapiens
atgcctggtggcagctg

SEQ ID NO: 3137616 - DNA, 18 bp, Homo sapiens
atgcctggtggcagctgc

SEQ ID NO: 3137617 - DNA, 16 bp, Homo sapiens
atgcctgtccagcctg

SEQ ID NO: 3137618 - DNA, 12 bp, Homo sapiens
atgcctgtgcca

SEQ ID NO: 3137619 - DNA, 13 bp, Homo sapiens
atgcctgtgccaa

SEQ ID NO: 3137620 - DNA, 22 bp, Homo sapiens
atgcctgtggaagagtgtgtgt

SEQ ID NO: 3137621 - DNA, 22 bp, Homo sapiens
atgccttcatgggggtgacccc

SEQ ID NO: 3137622 - DNA, 18 bp, Homo sapiens
atgccttgataaatatat

SEQ ID NO: 3137623 - DNA, 12 bp, Homo sapiens
atgccttgtata

SEQ ID NO: 3137624 - DNA, 13 bp, Homo sapiens
atgccttgtataa

SEQ ID NO: 3137625 - DNA, 14 bp, Homo sapiens
atgccttgtataaa

SEQ ID NO: 3137626 - DNA, 21 bp, Homo sapiens
atgcctttaaatctgtgatga

SEQ ID NO: 3137627 - DNA, 13 bp, Homo sapiens
atgcctttctagt

SEQ ID NO: 3137628 - DNA, 22 bp, Homo sapiens
atgcctttctagtcctattcta

SEQ ID NO: 3137629 - DNA, 14 bp, Homo sapiens
atgcctttctctcc

SEQ ID NO: 3137630 - DNA, 19 bp, Homo sapiens
atgcctttgagacagtttc

SEQ ID NO: 3137631 - DNA, 16 bp, Homo sapiens
atgcctttgtaagtta

SEQ ID NO: 3137632 - DNA, 16 bp, Homo sapiens
atgccttttttgtagt

SEQ ID NO: 3137633 - DNA, 13 bp, Homo sapiens
atgcgaggaccac

SEQ ID NO: 3137634 - DNA, 22 bp, Homo sapiens
atgcgccccctccgccctgcca

SEQ ID NO: 3137635 - DNA, 20 bp, Homo sapiens
atgcgccttgctgatggctt

SEQ ID NO: 3137636 - DNA, 14 bp, Homo sapiens
atgcggatcctgct

SEQ ID NO: 3137637 - DNA, 17 bp, Homo sapiens
atgcggatcctgctggg

SEQ ID NO: 3137638 - DNA, 24 bp, Homo sapiens
atgcgtgccgcctgctcctcactg

SEQ ID NO: 3137639 - DNA, 16 bp, Homo sapiens
atgcgtgtttctgact

SEQ ID NO: 3137640 - DNA, 14 bp, Homo sapiens
atgcgtttcatgta

SEQ ID NO: 3137641 - DNA, 23 bp, Homo sapiens
atgctaacaaagacaaaagtctg

SEQ ID NO: 3137642 - DNA, 17 bp, Homo sapiens
atgctaagtccatcacc

SEQ ID NO: 3137643 - DNA, 23 bp, Homo sapiens
atgctaagtccatcaccctttcc

SEQ ID NO: 3137644 - DNA, 18 bp, Homo sapiens
atgctaatttaaagagac

SEQ ID NO: 3137645 - DNA, 22 bp, Homo sapiens
atgctagaactccctttcaaca

SEQ ID NO: 3137646 - DNA, 15 bp, Homo sapiens
atgctagccccagag

SEQ ID NO: 3137647 - DNA, 16 bp, Homo sapiens
atgctagccccagaga

SEQ ID NO: 3137648 - DNA, 18 bp, Homo sapiens
atgctaggttaattccaa

SEQ ID NO: 3137649 - DNA, 12 bp, Homo sapiens
atgctagtttat

SEQ ID NO: 3137650 - DNA, 20 bp, Homo sapiens
atgctataaattttttgaaa

SEQ ID NO: 3137651 - DNA, 19 bp, Homo sapiens
atgctattgttgtgggctt

SEQ ID NO: 3137652 - DNA, 13 bp, Homo sapiens
atgctatttgaac

SEQ ID NO: 3137653 - DNA, 20 bp, Homo sapiens
atgctccaagattctagatg

SEQ ID NO: 3137654 - DNA, 20 bp, Homo sapiens
atgctcccagctgtgctgtg

SEQ ID NO: 3137655 - DNA, 14 bp, Homo sapiens
atgctccccacagc

SEQ ID NO: 3137656 - DNA, 22 bp, Homo sapiens
atgctccccacagcgtccctgg

SEQ ID NO: 3137657 - DNA, 18 bp, Homo sapiens
atgctccctcccctgccc

SEQ ID NO: 3137658 - DNA, 13 bp, Homo sapiens
atgctcctcacct

SEQ ID NO: 3137659 - DNA, 20 bp, Homo sapiens
atgctcctcacctgtctagg

SEQ ID NO: 3137660 - DNA, 21 bp, Homo sapiens
atgctctcatatatattttaa

SEQ ID NO: 3137661 - DNA, 13 bp, Homo sapiens
atgctctgcccca

SEQ ID NO: 3137662 - DNA, 14 bp, Homo sapiens
atgctctgctttta

SEQ ID NO: 3137663 - DNA, 13 bp, Homo sapiens
atgctctgtgcca

SEQ ID NO: 3137664 - DNA, 14 bp, Homo sapiens
atgctctgtgccag

SEQ ID NO: 3137665 - DNA, 23 bp, Homo sapiens
atgctctgtgcgagggttactat

SEQ ID NO: 3137666 - DNA, 15 bp, Homo sapiens
atgctcttctgtgga

SEQ ID NO: 3137667 - DNA, 12 bp, Homo sapiens
atgctctttccc

SEQ ID NO: 3137668 - DNA, 23 bp, Homo sapiens
atgctctttcccttttctgttta

SEQ ID NO: 3137669 - DNA, 15 bp, Homo sapiens
atgctcttttttact

SEQ ID NO: 3137670 - DNA, 21 bp, Homo sapiens
atgctcttttttactcattga

SEQ ID NO: 3137671 - DNA, 23 bp, Homo sapiens
atgctcttttttactcattgaaa

SEQ ID NO: 3137672 - DNA, 14 bp, Homo sapiens
atgctgaacgcaga

SEQ ID NO: 3137673 - DNA, 18 bp, Homo sapiens
atgctgaatatatagaat

SEQ ID NO: 3137674 - DNA, 13 bp, Homo sapiens
atgctgacagctc

SEQ ID NO: 3137675 - DNA, 21 bp, Homo sapiens
atgctgactgtactcctccca

SEQ ID NO: 3137676 - DNA, 22 bp, Homo sapiens
atgctgaggcctgggccgctgc

SEQ ID NO: 3137677 - DNA, 13 bp, Homo sapiens
atgctgagggtgt

SEQ ID NO: 3137678 - DNA, 20 bp, Homo sapiens
atgctgagggtgtttcttcc

SEQ ID NO: 3137679 - DNA, 22 bp, Homo sapiens
atgctgagtatgttaagctctt

SEQ ID NO: 3137680 - DNA, 17 bp, Homo sapiens
atgctgatgaatcactg

SEQ ID NO: 3137681 - DNA, 15 bp, Homo sapiens
atgctgatgatcaaa

SEQ ID NO: 3137682 - DNA, 22 bp, Homo sapiens
atgctgatgatcaaaacctgtg

SEQ ID NO: 3137683 - DNA, 14 bp, Homo sapiens
atgctgcagcagag

SEQ ID NO: 3137684 - DNA, 19 bp, Homo sapiens
atgctgcaggacttgagaa

SEQ ID NO: 3137685 - DNA, 24 bp, Homo sapiens
atgctgccccgttccctgtcagag

SEQ ID NO: 3137686 - DNA, 17 bp, Homo sapiens
atgctgcgcttcgcttg

SEQ ID NO: 3137687 - DNA, 15 bp, Homo sapiens
atgctgctatacaca

SEQ ID NO: 3137688 - DNA, 19 bp, Homo sapiens
atgctgctccgcccgctcc

SEQ ID NO: 3137689 - DNA, 22 bp, Homo sapiens
atgctgctgttgaagctttgaa

SEQ ID NO: 3137690 - DNA, 23 bp, Homo sapiens
atgctgctttcccctgtggggat

SEQ ID NO: 3137691 - DNA, 21 bp, Homo sapiens
atgctggacggcattcctgct

SEQ ID NO: 3137692 - DNA, 22 bp, Homo sapiens
atgctggactggaggcccctgg

SEQ ID NO: 3137693 - DNA, 12 bp, Homo sapiens
atgctggagaag

SEQ ID NO: 3137694 - DNA, 9 bp, Homo sapiens
atgctggga

SEQ ID NO: 3137695 - DNA, 16 bp, Homo sapiens
atgctgggacccttag

SEQ ID NO: 3137696 - DNA, 14 bp, Homo sapiens
atgctgggccactg

SEQ ID NO: 3137697 - DNA, 18 bp, Homo sapiens
atgctgggctgggccctc

SEQ ID NO: 3137698 - DNA, 22 bp, Homo sapiens
atgctggggcaagtccctgact

SEQ ID NO: 3137699 - DNA, 11 bp, Homo sapiens
atgctgggttg

SEQ ID NO: 3137700 - DNA, 19 bp, Homo sapiens
atgctgggttggtgcacag

SEQ ID NO: 3137701 - DNA, 23 bp, Homo sapiens
atgctgggttggtgcacagtgat

SEQ ID NO: 3137702 - DNA, 21 bp, Homo sapiens
atgctggtactattgtgacca

SEQ ID NO: 3137703 - DNA, 23 bp, Homo sapiens
atgctgtacatctattttggatt

SEQ ID NO: 3137704 - DNA, 13 bp, Homo sapiens
atgctgtagtaac

SEQ ID NO: 3137705 - DNA, 18 bp, Homo sapiens
atgctgtagtaactgcct

SEQ ID NO: 3137706 - DNA, 23 bp, Homo sapiens
atgctgtcatggtcctttctgga

SEQ ID NO: 3137707 - DNA, 11 bp, Homo sapiens
atgctgtgaca

SEQ ID NO: 3137708 - DNA, 21 bp, Homo sapiens
atgctgtgagtctttggttct

SEQ ID NO: 3137709 - DNA, 18 bp, Homo sapiens
atgctgtgctctttgaag

SEQ ID NO: 3137710 - DNA, 19 bp, Homo sapiens
atgctgttctcttcttcat

SEQ ID NO: 3137711 - DNA, 21 bp, Homo sapiens
atgctgttgcatttagaactt

SEQ ID NO: 3137712 - DNA, 17 bp, Homo sapiens
atgcttaaactaaataa

SEQ ID NO: 3137713 - DNA, 21 bp, Homo sapiens
atggtatctgggtaagaagaa

SEQ ID NO: 3137714 - DNA, 15 bp, Homo sapiens
atggtatgctggcca

SEQ ID NO: 3137715 - DNA, 20 bp, Homo sapiens
atggtcaacacttaagggtt

SEQ ID NO: 3137716 - DNA, 14 bp, Homo sapiens
atggtcacacactg

SEQ ID NO: 3137717 - DNA, 15 bp, Homo sapiens
atggtcacacactga

SEQ ID NO: 3137718 - DNA, 18 bp, Homo sapiens
atggtcacacactgatgc

SEQ ID NO: 3137719 - DNA, 19 bp, Homo sapiens
atggtcaccaaatcagctg

SEQ ID NO: 3137720 - DNA, 16 bp, Homo sapiens
atggtcagcgttgcat

SEQ ID NO: 3137721 - DNA, 18 bp, Homo sapiens
atggtcagcgttgcatgt

SEQ ID NO: 3137722 - DNA, 22 bp, Homo sapiens
atggtcatcttggagggaccaa

SEQ ID NO: 3137723 - DNA, 17 bp, Homo sapiens
atggtcattgcagttta

SEQ ID NO: 3137724 - DNA, 15 bp, Homo sapiens
atggtcccatccagg

SEQ ID NO: 3137725 - DNA, 17 bp, Homo sapiens
atggtcccatccaggca

SEQ ID NO: 3137726 - DNA, 18 bp, Homo sapiens
atggtcccatccaggcag

SEQ ID NO: 3137727 - DNA, 12 bp, Homo sapiens
atggtcctgggg

SEQ ID NO: 3137728 - DNA, 17 bp, Homo sapiens
atggtcctggggctctg

SEQ ID NO: 3137729 - DNA, 14 bp, Homo sapiens
atggtctaaaaata

SEQ ID NO: 3137730 - DNA, 18 bp, Homo sapiens
atggtctcgatctcctga

SEQ ID NO: 3137731 - DNA, 19 bp, Homo sapiens
atggtctcgatctcctgac

SEQ ID NO: 3137732 - DNA, 23 bp, Homo sapiens
atggtcttgagccagtaatcttt

SEQ ID NO: 3137733 - DNA, 17 bp, Homo sapiens
atggtgaaaatgtactg

SEQ ID NO: 3137734 - DNA, 18 bp, Homo sapiens
atggtgaacattttaatg

SEQ ID NO: 3137735 - DNA, 18 bp, Homo sapiens
atggtgaagtaacatgca

SEQ ID NO: 3137736 - DNA, 14 bp, Homo sapiens
atggtgagctggga

SEQ ID NO: 3137737 - DNA, 18 bp, Homo sapiens
atggtgagtgatttttat

SEQ ID NO: 3137738 - DNA, 17 bp, Homo sapiens
atggtgatcctctattt

SEQ ID NO: 3137739 - DNA, 23 bp, Homo sapiens
atggtgatcctctattttgtgat

SEQ ID NO: 3137740 - DNA, 20 bp, Homo sapiens
atggtgcagagaagctggac

SEQ ID NO: 3137741 - DNA, 16 bp, Homo sapiens
atggtgcctgagaggc

SEQ ID NO: 3137742 - DNA, 15 bp, Homo sapiens
atggtgctcaccatg

SEQ ID NO: 3137743 - DNA, 17 bp, Homo sapiens
atggtgcttaagttcca

SEQ ID NO: 3137744 - DNA, 19 bp, Homo sapiens
atggtgcttaagttccagc

SEQ ID NO: 3137745 - DNA, 16 bp, Homo sapiens
atggtggacccagcgg

SEQ ID NO: 3137746 - DNA, 13 bp, Homo sapiens
atggtggctgggt

SEQ ID NO: 3137747 - DNA, 17 bp, Homo sapiens
atggtggctgggttgga

SEQ ID NO: 3137748 - DNA, 22 bp, Homo sapiens
atggtgtaataagacataacgt

SEQ ID NO: 3137749 - DNA, 18 bp, Homo sapiens
atggtgtacataatgtat

SEQ ID NO: 3137750 - DNA, 16 bp, Homo sapiens
atggtgtagaacacta

SEQ ID NO: 3137751 - DNA, 19 bp, Homo sapiens
atggtgtagaacactaatt

SEQ ID NO: 3137752 - DNA, 18 bp, Homo sapiens
atggttaagagtccaaga

SEQ ID NO: 3137753 - DNA, 18 bp, Homo sapiens
atggttaataaaactgca

SEQ ID NO: 3137754 - DNA, 19 bp, Homo sapiens
atggttaataaaactgcac

SEQ ID NO: 3137755 - DNA, 17 bp, Homo sapiens
atggttacaaactacag

SEQ ID NO: 3137756 - DNA, 15 bp, Homo sapiens
atggttacactgtta

SEQ ID NO: 3137757 - DNA, 13 bp, Homo sapiens
atggttactaaaa

SEQ ID NO: 3137758 - DNA, 16 bp, Homo sapiens
atggttatgaaagaat

SEQ ID NO: 3137759 - DNA, 16 bp, Homo sapiens
atggttcaagattgtt

SEQ ID NO: 3137760 - DNA, 21 bp, Homo sapiens
atggttcagaattaaactttt

SEQ ID NO: 3137761 - DNA, 15 bp, Homo sapiens
atggttccaatgaaa

SEQ ID NO: 3137762 - DNA, 16 bp, Homo sapiens
atggttccaatgaaat

SEQ ID NO: 3137763 - DNA, 18 bp, Homo sapiens
atggttccatgcctgagg

SEQ ID NO: 3137764 - DNA, 20 bp, Homo sapiens
atggttcccctgttcactct

SEQ ID NO: 3137765 - DNA, 20 bp, Homo sapiens
atggttcctctcttggcaat

SEQ ID NO: 3137766 - DNA, 20 bp, Homo sapiens
atggttccttccctgggaag

SEQ ID NO: 3137767 - DNA, 19 bp, Homo sapiens
atggttgaccaaggtgctt

SEQ ID NO: 3137768 - DNA, 15 bp, Homo sapiens
atggttgagttacat

SEQ ID NO: 3137769 - DNA, 13 bp, Homo sapiens
atggttgatggaa

SEQ ID NO: 3137770 - DNA, 14 bp, Homo sapiens
atggttgatggaaa

SEQ ID NO: 3137771 - DNA, 15 bp, Homo sapiens
atggttgatggaaaa

SEQ ID NO: 3137772 - DNA, 14 bp, Homo sapiens
atggttgccacccc

SEQ ID NO: 3137773 - DNA, 20 bp, Homo sapiens
atggttgccaccccaaccca

SEQ ID NO: 3137774 - DNA, 15 bp, Homo sapiens
atggttgccttaaag

SEQ ID NO: 3137775 - DNA, 18 bp, Homo sapiens
atggttgccttaaagaaa

SEQ ID NO: 3137776 - DNA, 18 bp, Homo sapiens
atggttgcgtcctttgaa

SEQ ID NO: 3137777 - DNA, 14 bp, Homo sapiens
atggtttaaaagaa

SEQ ID NO: 3137778 - DNA, 22 bp, Homo sapiens
atggtttggtgctttttataaa

SEQ ID NO: 3137779 - DNA, 23 bp, Homo sapiens
atggtttttgcaagatttaacac

SEQ ID NO: 3137780 - DNA, 11 bp, Homo sapiens
atgtaaaaaac

SEQ ID NO: 3137781 - DNA, 19 bp, Homo sapiens
atgtaaaaaagaaaaacac

SEQ ID NO: 3137782 - DNA, 19 bp, Homo sapiens
atgtaaaagaacttactga

SEQ ID NO: 3137783 - DNA, 23 bp, Homo sapiens
atgtaaaagaacttactgattat

SEQ ID NO: 3137784 - DNA, 21 bp, Homo sapiens
atgtaaaagagtcatctggta

SEQ ID NO: 3137785 - DNA, 18 bp, Homo sapiens
atgtaaacaatgtaaagt

SEQ ID NO: 3137786 - DNA, 13 bp, Homo sapiens
atgtaaactgcca

SEQ ID NO: 3137787 - DNA, 14 bp, Homo sapiens
atgtaaactgccat

SEQ ID NO: 3137788 - DNA, 23 bp, Homo sapiens
atgtaaagccaaaaccatcttct

SEQ ID NO: 3137789 - DNA, 14 bp, Homo sapiens
atgtaaaggaggga

SEQ ID NO: 3137790 - DNA, 16 bp, Homo sapiens
atgtaaagtaagacat

SEQ ID NO: 3137791 - DNA, 23 bp, Homo sapiens
atgtaaataaccccattctttgc

SEQ ID NO: 3137792 - DNA, 12 bp, Homo sapiens
atgtaaatattc

SEQ ID NO: 3137793 - DNA, 14 bp, Homo sapiens
atgtaaatccccac

SEQ ID NO: 3137794 - DNA, 14 bp, Homo sapiens
atgtaacatcataa

SEQ ID NO: 3137795 - DNA, 16 bp, Homo sapiens
atgtaacatcataatt

SEQ ID NO: 3137796 - DNA, 19 bp, Homo sapiens
atgtaacatcataattaca

SEQ ID NO: 3137797 - DNA, 14 bp, Homo sapiens
atgtaacattggtg

SEQ ID NO: 3137798 - DNA, 16 bp, Homo sapiens
atgtaactccagatag

SEQ ID NO: 3137799 - DNA, 21 bp, Homo sapiens
atgtaactccagatagagaaa

SEQ ID NO: 3137800 - DNA, 17 bp, Homo sapiens
atgtaagattatagatt

SEQ ID NO: 3137801 - DNA, 19 bp, Homo sapiens
atgtaagattatagattct

SEQ ID NO: 3137802 - DNA, 24 bp, Homo sapiens
atgtaagattatagattctaaaga

SEQ ID NO: 3137803 - DNA, 12 bp, Homo sapiens
atgtaagcaaag

SEQ ID NO: 3137804 - DNA, 21 bp, Homo sapiens
atgtaagcaaaggctctgaaa

SEQ ID NO: 3137805 - DNA, 17 bp, Homo sapiens
atgtaagctctactgag

SEQ ID NO: 3137806 - DNA, 14 bp, Homo sapiens
atgtaagctgttta

SEQ ID NO: 3137807 - DNA, 17 bp, Homo sapiens
atgtaagggtctttggt

SEQ ID NO: 3137808 - DNA, 14 bp, Homo sapiens
atgtaataaacttt

SEQ ID NO: 3137809 - DNA, 17 bp, Homo sapiens
atgtaataaattcaaaa

SEQ ID NO: 3137810 - DNA, 17 bp, Homo sapiens
atgtaataactgtgaag

SEQ ID NO: 3137811 - DNA, 16 bp, Homo sapiens
atgtaatatattgtac

SEQ ID NO: 3137812 - DNA, 23 bp, Homo sapiens
atgtaatatattgtacaaatgta

SEQ ID NO: 3137813 - DNA, 19 bp, Homo sapiens
atgtaatcggcttgaattt

SEQ ID NO: 3137814 - DNA, 22 bp, Homo sapiens
atgtaatgatgctgaggatata

SEQ ID NO: 3137815 - DNA, 16 bp, Homo sapiens
atgtaatgcactttgg

SEQ ID NO: 3137816 - DNA, 14 bp, Homo sapiens
atgtaatgtccctt

SEQ ID NO: 3137817 - DNA, 16 bp, Homo sapiens
atgtaattagctctgg

SEQ ID NO: 3137818 - DNA, 17 bp, Homo sapiens
atgtaattagctctggg

SEQ ID NO: 3137819 - DNA, 19 bp, Homo sapiens
atgtaattagctctggggg

SEQ ID NO: 3137820 - DNA, 21 bp, Homo sapiens
atgtaattagctctggggggc

SEQ ID NO: 3137821 - DNA, 15 bp, Homo sapiens
atgtaattgaataaa

SEQ ID NO: 3137822 - DNA, 22 bp, Homo sapiens
atgtaatttagggtactaaatt

SEQ ID NO: 3137823 - DNA, 18 bp, Homo sapiens
atgtaatttgtgtaataa

SEQ ID NO: 3137824 - DNA, 20 bp, Homo sapiens
atgtaattttattttaaaat

SEQ ID NO: 3137825 - DNA, 15 bp, Homo sapiens
atgtacagattcttt

SEQ ID NO: 3137826 - DNA, 21 bp, Homo sapiens
atgtacagattttatttgtaa

SEQ ID NO: 3137827 - DNA, 16 bp, Homo sapiens
atgtacagtctgtcat

SEQ ID NO: 3137828 - DNA, 17 bp, Homo sapiens
atgtacagtctgtcatg

SEQ ID NO: 3137829 - DNA, 14 bp, Homo sapiens
atgtacattaatta

SEQ ID NO: 3137830 - DNA, 15 bp, Homo sapiens
atgtaccatttgcat

SEQ ID NO: 3137831 - DNA, 14 bp, Homo sapiens
atgtacgtttgtat

SEQ ID NO: 3137832 - DNA, 21 bp, Homo sapiens
atgtactagttttagttttct

SEQ ID NO: 3137833 - DNA, 14 bp, Homo sapiens
atgtactgagattt

SEQ ID NO: 3137834 - DNA, 19 bp, Homo sapiens
atgtactgatttcagtaag

SEQ ID NO: 3137835 - DNA, 12 bp, Homo sapiens
atgtactgtact

SEQ ID NO: 3137836 - DNA, 14 bp, Homo sapiens
atgtactgtactaa

SEQ ID NO: 3137837 - DNA, 20 bp, Homo sapiens
atgtacttagctgtactata

SEQ ID NO: 3137838 - DNA, 21 bp, Homo sapiens
atgtacttagctgtactataa

SEQ ID NO: 3137839 - DNA, 13 bp, Homo sapiens
atgtttctatctg

SEQ ID NO: 3137840 - DNA, 12 bp, Homo sapiens
atgtttctggat

SEQ ID NO: 3137841 - DNA, 15 bp, Homo sapiens
atgtttcttctaggt

SEQ ID NO: 3137842 - DNA, 20 bp, Homo sapiens
atgtttcttttcccttaaat

SEQ ID NO: 3137843 - DNA, 16 bp, Homo sapiens
atgtttcttttgtttg

SEQ ID NO: 3137844 - DNA, 18 bp, Homo sapiens
atgtttgaatttttctct

SEQ ID NO: 3137845 - DNA, 18 bp, Homo sapiens
atgtttgaggagcatgtt

SEQ ID NO: 3137846 - DNA, 15 bp, Homo sapiens
atgtttgcctctgcc

SEQ ID NO: 3137847 - DNA, 17 bp, Homo sapiens
atgtttgcctctgcctc

SEQ ID NO: 3137848 - DNA, 18 bp, Homo sapiens
atgtttgcctctgcctct

SEQ ID NO: 3137849 - DNA, 20 bp, Homo sapiens
atgtttggtgcatagaactg

SEQ ID NO: 3137850 - DNA, 22 bp, Homo sapiens
atgtttgtctcacttttcatct

SEQ ID NO: 3137851 - DNA, 10 bp, Homo sapiens
atgtttgtgg

SEQ ID NO: 3137852 - DNA, 17 bp, Homo sapiens
atgtttgtggcctcaga

SEQ ID NO: 3137853 - DNA, 18 bp, Homo sapiens
atgtttgtggcctcagaa

SEQ ID NO: 3137854 - DNA, 15 bp, Homo sapiens
atgtttgtgtgattt

SEQ ID NO: 3137855 - DNA, 17 bp, Homo sapiens
atgtttgtgtgatttcc

SEQ ID NO: 3137856 - DNA, 18 bp, Homo sapiens
atgtttgtgtgatttcct

SEQ ID NO: 3137857 - DNA, 21 bp, Homo sapiens
atgttttaaacatagaaagtt

SEQ ID NO: 3137858 - DNA, 12 bp, Homo sapiens
atgttttaaaga

SEQ ID NO: 3137859 - DNA, 18 bp, Homo sapiens
atgttttaagaggcaggg

SEQ ID NO: 3137860 - DNA, 14 bp, Homo sapiens
atgttttagcattt

SEQ ID NO: 3137861 - DNA, 16 bp, Homo sapiens
atgttttataagttca

SEQ ID NO: 3137862 - DNA, 22 bp, Homo sapiens
atgttttcaaaaggtattatac

SEQ ID NO: 3137863 - DNA, 15 bp, Homo sapiens
atgttttcattatgt

SEQ ID NO: 3137864 - DNA, 18 bp, Homo sapiens
atgttttctttgtttcct

SEQ ID NO: 3137865 - DNA, 21 bp, Homo sapiens
atgttttgagacataaatgtt

SEQ ID NO: 3137866 - DNA, 15 bp, Homo sapiens
atgttttgtatacaa

SEQ ID NO: 3137867 - DNA, 16 bp, Homo sapiens
atgttttgtatacaaa

SEQ ID NO: 3137868 - DNA, 14 bp, Homo sapiens
atgttttgtgacta

SEQ ID NO: 3137869 - DNA, 19 bp, Homo sapiens
atgttttgtttctgaaaat

SEQ ID NO: 3137870 - DNA, 20 bp, Homo sapiens
atgttttgtttctgaaaatt

SEQ ID NO: 3137871 - DNA, 18 bp, Homo sapiens
atgtttttaaaagtttca

SEQ ID NO: 3137872 - DNA, 20 bp, Homo sapiens
atgtttttatgatatccctg

SEQ ID NO: 3137873 - DNA, 12 bp, Homo sapiens
atgtttttcctt

SEQ ID NO: 3137874 - DNA, 14 bp, Homo sapiens
atgtttttcctttc

SEQ ID NO: 3137875 - DNA, 22 bp, Homo sapiens
atgtttttctgccagggagctt

SEQ ID NO: 3137876 - DNA, 22 bp, Homo sapiens
atgttttttaaaatatttatct

SEQ ID NO: 3137877 - DNA, 12 bp, Homo sapiens
atgttttttgcc

SEQ ID NO: 3137878 - DNA, 16 bp, Homo sapiens
atgttttttgtaagat

SEQ ID NO: 3137879 - DNA, 20 bp, Homo sapiens
atgttttttgtaagataaac

SEQ ID NO: 3137880 - DNA, 20 bp, Homo sapiens
attaaaaaaaaagatctgtt

SEQ ID NO: 3137881 - DNA, 19 bp, Homo sapiens
attaaaaaagcatacttct

SEQ ID NO: 3137882 - DNA, 13 bp, Homo sapiens
attaaaaaccact

SEQ ID NO: 3137883 - DNA, 20 bp, Homo sapiens
attaaaaaccactgaacatt

SEQ ID NO: 3137884 - DNA, 16 bp, Homo sapiens
attaaaaagattcttt

SEQ ID NO: 3137885 - DNA, 17 bp, Homo sapiens
attaaaaagattctttt

SEQ ID NO: 3137886 - DNA, 14 bp, Homo sapiens
attaaaaatatgga

SEQ ID NO: 3137887 - DNA, 21 bp, Homo sapiens
attaaaaatatggaacttcta

SEQ ID NO: 3137888 - DNA, 22 bp, Homo sapiens
attaaaacagctgcattagaaa

SEQ ID NO: 3137889 - DNA, 18 bp, Homo sapiens
attaaaacatatttcatt

SEQ ID NO: 3137890 - DNA, 17 bp, Homo sapiens
attaaaactaaatttca

SEQ ID NO: 3137891 - DNA, 19 bp, Homo sapiens
attaaaactcaacattact

SEQ ID NO: 3137892 - DNA, 12 bp, Homo sapiens
attaaaactgct

SEQ ID NO: 3137893 - DNA, 18 bp, Homo sapiens
attaaaagaagactggaa

SEQ ID NO: 3137894 - DNA, 17 bp, Homo sapiens
attaaaataaaccaaat

SEQ ID NO: 3137895 - DNA, 15 bp, Homo sapiens
attaaaatattttgg

SEQ ID NO: 3137896 - DNA, 16 bp, Homo sapiens
attaaaatattttgga

SEQ ID NO: 3137897 - DNA, 19 bp, Homo sapiens
attaaaatgattgtaaaat

SEQ ID NO: 3137898 - DNA, 23 bp, Homo sapiens
attaaaatggatttaatccattt

SEQ ID NO: 3137899 - DNA, 23 bp, Homo sapiens
attaaaatgtcggatttatcttt

SEQ ID NO: 3137900 - DNA, 13 bp, Homo sapiens
attaaaattacag

SEQ ID NO: 3137901 - DNA, 15 bp, Homo sapiens
attaaaattacagat

SEQ ID NO: 3137902 - DNA, 21 bp, Homo sapiens
attaaaattacagatgtgaaa

SEQ ID NO: 3137903 - DNA, 22 bp, Homo sapiens
attaaaattacagatgtgaaaa

SEQ ID NO: 3137904 - DNA, 16 bp, Homo sapiens
attaaaattgccattt

SEQ ID NO: 3137905 - DNA, 17 bp, Homo sapiens
attaaaattgtgcataa

SEQ ID NO: 3137906 - DNA, 14 bp, Homo sapiens
attaaacagatgat

SEQ ID NO: 3137907 - DNA, 19 bp, Homo sapiens
attaaacagatgatgagaa

SEQ ID NO: 3137908 - DNA, 15 bp, Homo sapiens
attaaacataaaaca

SEQ ID NO: 3137909 - DNA, 16 bp, Homo sapiens
attaaacataaaacaa

SEQ ID NO: 3137910 - DNA, 12 bp, Homo sapiens
attaaacatttt

SEQ ID NO: 3137911 - DNA, 13 bp, Homo sapiens
attaaacattttc

SEQ ID NO: 3137912 - DNA, 12 bp, Homo sapiens
attaaacctgtc

SEQ ID NO: 3137913 - DNA, 24 bp, Homo sapiens
attaaacttcttttctcttctaca

SEQ ID NO: 3137914 - DNA, 18 bp, Homo sapiens
attaaacttttaattcat

SEQ ID NO: 3137915 - DNA, 17 bp, Homo sapiens
attaaagattctcttta

SEQ ID NO: 3137916 - DNA, 16 bp, Homo sapiens
attaaagcctttagta

SEQ ID NO: 3137917 - DNA, 12 bp, Homo sapiens
attaaaggaagg

SEQ ID NO: 3137918 - DNA, 11 bp, Homo sapiens
attaaagtcag

SEQ ID NO: 3137919 - DNA, 16 bp, Homo sapiens
attaaagtcagaagtt

SEQ ID NO: 3137920 - DNA, 19 bp, Homo sapiens
attaaagtcagaagtttta

SEQ ID NO: 3137921 - DNA, 14 bp, Homo sapiens
attaaagtctgaat

SEQ ID NO: 3137922 - DNA, 17 bp, Homo sapiens
attaaataagattctaa

SEQ ID NO: 3137923 - DNA, 19 bp, Homo sapiens
attaaatacaaaacttcca

SEQ ID NO: 3137924 - DNA, 17 bp, Homo sapiens
attaaatagttatataa

SEQ ID NO: 3137925 - DNA, 22 bp, Homo sapiens
attaaatatagattagaaaaat

SEQ ID NO: 3137926 - DNA, 16 bp, Homo sapiens
attaaatcttaaacaa

SEQ ID NO: 3137927 - DNA, 22 bp, Homo sapiens
attaaatcttaaacaatgtata

SEQ ID NO: 3137928 - DNA, 23 bp, Homo sapiens
attaaatcttaaacaatgtataa

SEQ ID NO: 3137929 - DNA, 22 bp, Homo sapiens
attaaatgaatattttgataat

SEQ ID NO: 3137930 - DNA, 17 bp, Homo sapiens
attaaatgccttgtata

SEQ ID NO: 3137931 - DNA, 18 bp, Homo sapiens
attaaatgccttgtataa

SEQ ID NO: 3137932 - DNA, 19 bp, Homo sapiens
attaaatgccttgtataaa

SEQ ID NO: 3137933 - DNA, 14 bp, Homo sapiens
attaaatgtcttat

SEQ ID NO: 3137934 - DNA, 13 bp, Homo sapiens
attaaatgtttga

SEQ ID NO: 3137935 - DNA, 13 bp, Homo sapiens
attaaattaagac

SEQ ID NO: 3137936 - DNA, 15 bp, Homo sapiens
attaaattacagctt

SEQ ID NO: 3137937 - DNA, 16 bp, Homo sapiens
attaaattacagcttt

SEQ ID NO: 3137938 - DNA, 18 bp, Homo sapiens
attaaattaggaataaat

SEQ ID NO: 3137939 - DNA, 18 bp, Homo sapiens
attaaattagtttgtgaa

SEQ ID NO: 3137940 - DNA, 14 bp, Homo sapiens
attaaattcacaaa

SEQ ID NO: 3137941 - DNA, 17 bp, Homo sapiens
attaaattctcaaagtt

SEQ ID NO: 3137942 - DNA, 17 bp, Homo sapiens
attaaattggaattttc

SEQ ID NO: 3137943 - DNA, 12 bp, Homo sapiens
attaaattgtgt

SEQ ID NO: 3137944 - DNA, 13 bp, Homo sapiens
attaaatttaact

SEQ ID NO: 3137945 - DNA, 17 bp, Homo sapiens
attaaatttgcaacaat

SEQ ID NO: 3137946 - DNA, 21 bp, Homo sapiens
attaaatttgttgacaaaatt

SEQ ID NO: 3137947 - DNA, 19 bp, Homo sapiens
attaaattttagtacattt

SEQ ID NO: 3137948 - DNA, 18 bp, Homo sapiens
attaaattttgagttcta

SEQ ID NO: 3137949 - DNA, 13 bp, Homo sapiens
attaacaaatatg

SEQ ID NO: 3137950 - DNA, 15 bp, Homo sapiens
attaacaaatatgct

SEQ ID NO: 3137951 - DNA, 17 bp, Homo sapiens
attaacaaatatgctaa

SEQ ID NO: 3137952 - DNA, 13 bp, Homo sapiens
attaacaaatgct

SEQ ID NO: 3137953 - DNA, 19 bp, Homo sapiens
attaacagttttccatgaa

SEQ ID NO: 3137954 - DNA, 22 bp, Homo sapiens
attaacagttttccatgaaaac

SEQ ID NO: 3137955 - DNA, 20 bp, Homo sapiens
attaaccttgccttagaaac

SEQ ID NO: 3137956 - DNA, 21 bp, Homo sapiens
attaaccttttttgtcttatt

SEQ ID NO: 3137957 - DNA, 17 bp, Homo sapiens
attaactaatctattgg

SEQ ID NO: 3137958 - DNA, 14 bp, Homo sapiens
attaactacattta

SEQ ID NO: 3137959 - DNA, 17 bp, Homo sapiens
attaactacatttatga

SEQ ID NO: 3137960 - DNA, 21 bp, Homo sapiens
attaactacatttatgagtaa

SEQ ID NO: 3137961 - DNA, 17 bp, Homo sapiens
attaacttatttagaga

SEQ ID NO: 3137962 - DNA, 18 bp, Homo sapiens
attaacttctctggaaag

SEQ ID NO: 3137963 - DNA, 13 bp, Homo sapiens
attaagaaagact

SEQ ID NO: 3137964 - DNA, 14 bp, Homo sapiens
attaagaaagacta

SEQ ID NO: 3137965 - DNA, 12 bp, Homo sapiens
attaagaatctc

SEQ ID NO: 3137966 - DNA, 14 bp, Homo sapiens
attatgttcatgta

SEQ ID NO: 3137967 - DNA, 20 bp, Homo sapiens
attatgttcatgtaagaagc

SEQ ID NO: 3137968 - DNA, 15 bp, Homo sapiens
attatgtttattaca

SEQ ID NO: 3137969 - DNA, 16 bp, Homo sapiens
attatgtttattacaa

SEQ ID NO: 3137970 - DNA, 18 bp, Homo sapiens
attatgtttattacaatt

SEQ ID NO: 3137971 - DNA, 20 bp, Homo sapiens
attattaactacatttatga

SEQ ID NO: 3137972 - DNA, 15 bp, Homo sapiens
attattagtactgct

SEQ ID NO: 3137973 - DNA, 15 bp, Homo sapiens
attattataggtaat

SEQ ID NO: 3137974 - DNA, 14 bp, Homo sapiens
attattatatatat

SEQ ID NO: 3137975 - DNA, 12 bp, Homo sapiens
attattatcatt

SEQ ID NO: 3137976 - DNA, 12 bp, Homo sapiens
attattatgttt

SEQ ID NO: 3137977 - DNA, 15 bp, Homo sapiens
attattatgtttatt

SEQ ID NO: 3137978 - DNA, 22 bp, Homo sapiens
attattatgtttattacaattt

SEQ ID NO: 3137979 - DNA, 17 bp, Homo sapiens
attattattaaaaatat

SEQ ID NO: 3137980 - DNA, 16 bp, Homo sapiens
attattattcttcata

SEQ ID NO: 3137981 - DNA, 16 bp, Homo sapiens
attattattgctgaag

SEQ ID NO: 3137982 - DNA, 18 bp, Homo sapiens
attattcatttaaaatga

SEQ ID NO: 3137983 - DNA, 13 bp, Homo sapiens
attattctgtttt

SEQ ID NO: 3137984 - DNA, 12 bp, Homo sapiens
attattcttgta

SEQ ID NO: 3137985 - DNA, 19 bp, Homo sapiens
attattctttgaaaacaga

SEQ ID NO: 3137986 - DNA, 12 bp, Homo sapiens
attattgaaatt

SEQ ID NO: 3137987 - DNA, 15 bp, Homo sapiens
attattgcttattgc

SEQ ID NO: 3137988 - DNA, 14 bp, Homo sapiens
attattggaattaa

SEQ ID NO: 3137989 - DNA, 16 bp, Homo sapiens
attattgtatttattc

SEQ ID NO: 3137990 - DNA, 12 bp, Homo sapiens
attatttaaata

SEQ ID NO: 3137991 - DNA, 16 bp, Homo sapiens
attatttaaataaaat

SEQ ID NO: 3137992 - DNA, 18 bp, Homo sapiens
attatttaaataaaatca

SEQ ID NO: 3137993 - DNA, 20 bp, Homo sapiens
attatttaaataaaatcacc

SEQ ID NO: 3137994 - DNA, 21 bp, Homo sapiens
attatttaataaaaaaacaat

SEQ ID NO: 3137995 - DNA, 18 bp, Homo sapiens
attatttaataacattac

SEQ ID NO: 3137996 - DNA, 22 bp, Homo sapiens
attatttaataacattacctta

SEQ ID NO: 3137997 - DNA, 13 bp, Homo sapiens
attatttatatgg

SEQ ID NO: 3137998 - DNA, 20 bp, Homo sapiens
attatttattaaaaatgttc

SEQ ID NO: 3137999 - DNA, 14 bp, Homo sapiens
attatttatttaat

SEQ ID NO: 3138000 - DNA, 18 bp, Homo sapiens
attatttcactttagatg

SEQ ID NO: 3138001 - DNA, 20 bp, Homo sapiens
attatttgcttttcatgtag

SEQ ID NO: 3138002 - DNA, 18 bp, Homo sapiens
attatttggcagtttggt

SEQ ID NO: 3138003 - DNA, 17 bp, Homo sapiens
attatttgtgtaataga

SEQ ID NO: 3138004 - DNA, 18 bp, Homo sapiens
attatttgtgtaatagaa

SEQ ID NO: 3138005 - DNA, 23 bp, Homo sapiens
attatttgtgtaatagaaaactg

SEQ ID NO: 3138006 - DNA, 15 bp, Homo sapiens
attatttgtgtttta

SEQ ID NO: 3138007 - DNA, 14 bp, Homo sapiens
attattttaaacaa

SEQ ID NO: 3138008 - DNA, 21 bp, Homo sapiens
attattttaaacaaaatagaa

SEQ ID NO: 3138009 - DNA, 21 bp, Homo sapiens
attattttcttcatccaactt

SEQ ID NO: 3138010 - DNA, 16 bp, Homo sapiens
attattttgaatgtca

SEQ ID NO: 3138011 - DNA, 21 bp, Homo sapiens
attattttgaatgtcacaaat

SEQ ID NO: 3138012 - DNA, 17 bp, Homo sapiens
attattttggggtctct

SEQ ID NO: 3138013 - DNA, 21 bp, Homo sapiens
attattttggggtctcttttg

SEQ ID NO: 3138014 - DNA, 22 bp, Homo sapiens
attattttggggtctcttttgt

SEQ ID NO: 3138015 - DNA, 14 bp, Homo sapiens
attatttttataat

SEQ ID NO: 3138016 - DNA, 14 bp, Homo sapiens
attcaaaaagtgtt

SEQ ID NO: 3138017 - DNA, 21 bp, Homo sapiens
attcaaaagttccaagagtct

SEQ ID NO: 3138018 - DNA, 22 bp, Homo sapiens
attcaaaccaatttcttccttc

SEQ ID NO: 3138019 - DNA, 17 bp, Homo sapiens
attcaaactggggcctc

SEQ ID NO: 3138020 - DNA, 19 bp, Homo sapiens
attcaaactggggcctcca

SEQ ID NO: 3138021 - DNA, 15 bp, Homo sapiens
attcaaaggttctag

SEQ ID NO: 3138022 - DNA, 16 bp, Homo sapiens
attcaaaggttctagg

SEQ ID NO: 3138023 - DNA, 18 bp, Homo sapiens
attcaaaggttctaggtt

SEQ ID NO: 3138024 - DNA, 14 bp, Homo sapiens
attcaaatcagtga

SEQ ID NO: 3138025 - DNA, 19 bp, Homo sapiens
attcaaatcagtgatctat

SEQ ID NO: 3138026 - DNA, 20 bp, Homo sapiens
attcaaatgggtgatatcct

SEQ ID NO: 3138027 - DNA, 21 bp, Homo sapiens
attcaaattgctgcttggatt

SEQ ID NO: 3138028 - DNA, 14 bp, Homo sapiens
attcaaatttgtac

SEQ ID NO: 3138029 - DNA, 16 bp, Homo sapiens
attcaacaatttcaat

SEQ ID NO: 3138030 - DNA, 16 bp, Homo sapiens
attcaaccactgtaaa

SEQ ID NO: 3138031 - DNA, 15 bp, Homo sapiens
attcaactttgtaaa

SEQ ID NO: 3138032 - DNA, 14 bp, Homo sapiens
attcaacttttcta

SEQ ID NO: 3138033 - DNA, 19 bp, Homo sapiens
attcaacttttctaagaaa

SEQ ID NO: 3138034 - DNA, 13 bp, Homo sapiens
attcaagcaaaca

SEQ ID NO: 3138035 - DNA, 22 bp, Homo sapiens
attcaagcaaacatcaaataaa

SEQ ID NO: 3138036 - DNA, 21 bp, Homo sapiens
attcaagctatttaatatctg

SEQ ID NO: 3138037 - DNA, 16 bp, Homo sapiens
attcaaggccttccaa

SEQ ID NO: 3138038 - DNA, 14 bp, Homo sapiens
attcaagttattgt

SEQ ID NO: 3138039 - DNA, 15 bp, Homo sapiens
attcaagttattgta

SEQ ID NO: 3138040 - DNA, 14 bp, Homo sapiens
attcaatctgtaaa

SEQ ID NO: 3138041 - DNA, 17 bp, Homo sapiens
attcaatctgtaaactg

SEQ ID NO: 3138042 - DNA, 21 bp, Homo sapiens
attcaattacggactctggat

SEQ ID NO: 3138043 - DNA, 17 bp, Homo sapiens
attcaattcctctggga

SEQ ID NO: 3138044 - DNA, 14 bp, Homo sapiens
attcaattgtaaat

SEQ ID NO: 3138045 - DNA, 13 bp, Homo sapiens
attcacaaacttt

SEQ ID NO: 3138046 - DNA, 14 bp, Homo sapiens
attcacaaactttt

SEQ ID NO: 3138047 - DNA, 17 bp, Homo sapiens
attcacaaacttttata

SEQ ID NO: 3138048 - DNA, 15 bp, Homo sapiens
attcacaagcctcct

SEQ ID NO: 3138049 - DNA, 17 bp, Homo sapiens
attcacaagcctcctgt

SEQ ID NO: 3138050 - DNA, 21 bp, Homo sapiens
attcacaagcctcctgtacct

SEQ ID NO: 3138051 - DNA, 22 bp, Homo sapiens
attcacaagcctcctgtacctc

SEQ ID NO: 3138052 - DNA, 16 bp, Homo sapiens
attcacaataaaagct

SEQ ID NO: 3138053 - DNA, 18 bp, Homo sapiens
attcacacagggctcttt

SEQ ID NO: 3138054 - DNA, 22 bp, Homo sapiens
attcacagaacctactgttcct

SEQ ID NO: 3138055 - DNA, 12 bp, Homo sapiens
attcacagtttt

SEQ ID NO: 3138056 - DNA, 16 bp, Homo sapiens
attcaccaaaattatc

SEQ ID NO: 3138057 - DNA, 16 bp, Homo sapiens
attcaccccctttcct

SEQ ID NO: 3138058 - DNA, 18 bp, Homo sapiens
attcaccttttcttcaaa

SEQ ID NO: 3138059 - DNA, 13 bp, Homo sapiens
attcactgtgctt

SEQ ID NO: 3138060 - DNA, 14 bp, Homo sapiens
attcagagaatatc

SEQ ID NO: 3138061 - DNA, 13 bp, Homo sapiens
attcagagtcctt

SEQ ID NO: 3138062 - DNA, 21 bp, Homo sapiens
attcagatatatttttcacag

SEQ ID NO: 3138063 - DNA, 19 bp, Homo sapiens
attcagatcaaaatgcctt

SEQ ID NO: 3138064 - DNA, 16 bp, Homo sapiens
attcagatcactgaat

SEQ ID NO: 3138065 - DNA, 19 bp, Homo sapiens
attcagatcactgaattta

SEQ ID NO: 3138066 - DNA, 15 bp, Homo sapiens
attcagattgtcttg

SEQ ID NO: 3138067 - DNA, 17 bp, Homo sapiens
attcagattgttatcta

SEQ ID NO: 3138068 - DNA, 14 bp, Homo sapiens
attcagattttaaa

SEQ ID NO: 3138069 - DNA, 15 bp, Homo sapiens
attcagcaaaccatt

SEQ ID NO: 3138070 - DNA, 16 bp, Homo sapiens
attcagcaccctgggt

SEQ ID NO: 3138071 - DNA, 17 bp, Homo sapiens
attcagcaccctgggtg

SEQ ID NO: 3138072 - DNA, 20 bp, Homo sapiens
attcagcaccctgggtgcca

SEQ ID NO: 3138073 - DNA, 21 bp, Homo sapiens
attcagcaccctgggtgccat

SEQ ID NO: 3138074 - DNA, 17 bp, Homo sapiens
attcagcactgatttca

SEQ ID NO: 3138075 - DNA, 21 bp, Homo sapiens
attcagcactgatttcacaac

SEQ ID NO: 3138076 - DNA, 18 bp, Homo sapiens
attcagcagcaaattttc

SEQ ID NO: 3138077 - DNA, 20 bp, Homo sapiens
attcagcagcaaattttcag

SEQ ID NO: 3138078 - DNA, 21 bp, Homo sapiens
attcagctctggagaacagtg

SEQ ID NO: 3138079 - DNA, 21 bp, Homo sapiens
attcaggacttaacggctcca

SEQ ID NO: 3138080 - DNA, 18 bp, Homo sapiens
attcaggacttgaaagaa

SEQ ID NO: 3138081 - DNA, 19 bp, Homo sapiens
attcaggacttgaaagaaa

SEQ ID NO: 3138082 - DNA, 18 bp, Homo sapiens
attcaggccagcccagcc

SEQ ID NO: 3138083 - DNA, 21 bp, Homo sapiens
attcaggccagcccagccagg

SEQ ID NO: 3138084 - DNA, 19 bp, Homo sapiens
attcaggggctgacacttc

SEQ ID NO: 3138085 - DNA, 14 bp, Homo sapiens
attcaggtaacact

SEQ ID NO: 3138086 - DNA, 17 bp, Homo sapiens
attcaggtatgttgcct

SEQ ID NO: 3138087 - DNA, 18 bp, Homo sapiens
attcaggtatgttgcctt

SEQ ID NO: 3138088 - DNA, 23 bp, Homo sapiens
attcaggtatgttgcctttatgg

SEQ ID NO: 3138089 - DNA, 17 bp, Homo sapiens
attcagtcctgggcaaa

SEQ ID NO: 3138090 - DNA, 16 bp, Homo sapiens
attcagtgccttcaac

SEQ ID NO: 3138091 - DNA, 17 bp, Homo sapiens
attcagtgctgtggcct

SEQ ID NO: 3138092 - DNA, 13 bp, Homo sapiens
attggaccaggcc

SEQ ID NO: 3138093 - DNA, 15 bp, Homo sapiens
attggaccaggccat

SEQ ID NO: 3138094 - DNA, 16 bp, Homo sapiens
attggacctgcccaca

SEQ ID NO: 3138095 - DNA, 23 bp, Homo sapiens
attggagggtgggagagcccagc

SEQ ID NO: 3138096 - DNA, 19 bp, Homo sapiens
attggaggtgagatcacag

SEQ ID NO: 3138097 - DNA, 21 bp, Homo sapiens
attggatatttgatatttggt

SEQ ID NO: 3138098 - DNA, 19 bp, Homo sapiens
attggattattcatttaaa

SEQ ID NO: 3138099 - DNA, 21 bp, Homo sapiens
attggattattcatttaaaat

SEQ ID NO: 3138100 - DNA, 22 bp, Homo sapiens
attggattattcatttaaaatg

SEQ ID NO: 3138101 - DNA, 19 bp, Homo sapiens
attggattatttaataaca

SEQ ID NO: 3138102 - DNA, 23 bp, Homo sapiens
attggatttcctaatactgtcat

SEQ ID NO: 3138103 - DNA, 16 bp, Homo sapiens
attggatttttgttaa

SEQ ID NO: 3138104 - DNA, 17 bp, Homo sapiens
attggcagtggcagaga

SEQ ID NO: 3138105 - DNA, 23 bp, Homo sapiens
attggcctggcaaaataaaacat

SEQ ID NO: 3138106 - DNA, 22 bp, Homo sapiens
attggcctgtagagttgctgag

SEQ ID NO: 3138107 - DNA, 17 bp, Homo sapiens
attggcttgtagaattg

SEQ ID NO: 3138108 - DNA, 23 bp, Homo sapiens
attggctttaaacacccttcaca

SEQ ID NO: 3138109 - DNA, 17 bp, Homo sapiens
attgggatgtgagcccc

SEQ ID NO: 3138110 - DNA, 18 bp, Homo sapiens
attgggcaagtgattgaa

SEQ ID NO: 3138111 - DNA, 21 bp, Homo sapiens
attgggtatcaagacatagca

SEQ ID NO: 3138112 - DNA, 18 bp, Homo sapiens
attggtatcaagaaagtc

SEQ ID NO: 3138113 - DNA, 14 bp, Homo sapiens
attggtctaattta

SEQ ID NO: 3138114 - DNA, 12 bp, Homo sapiens
attggtgactca

SEQ ID NO: 3138115 - DNA, 16 bp, Homo sapiens
attggtgataagtgga

SEQ ID NO: 3138116 - DNA, 18 bp, Homo sapiens
attggtgataagtggaaa

SEQ ID NO: 3138117 - DNA, 16 bp, Homo sapiens
attggtggctttcctt

SEQ ID NO: 3138118 - DNA, 18 bp, Homo sapiens
attggtttaaagaaagtg

SEQ ID NO: 3138119 - DNA, 21 bp, Homo sapiens
attgtaaaaaaaaatgccttt

SEQ ID NO: 3138120 - DNA, 20 bp, Homo sapiens
attgtaaaacctgtcaatga

SEQ ID NO: 3138121 - DNA, 21 bp, Homo sapiens
attgtaaaacctgtcaatgat

SEQ ID NO: 3138122 - DNA, 17 bp, Homo sapiens
attgtaaactgtactag

SEQ ID NO: 3138123 - DNA, 17 bp, Homo sapiens
attgtaaattgaatcag

SEQ ID NO: 3138124 - DNA, 23 bp, Homo sapiens
attgtaaattgaatcagtataaa

SEQ ID NO: 3138125 - DNA, 13 bp, Homo sapiens
attgtaatctttc

SEQ ID NO: 3138126 - DNA, 13 bp, Homo sapiens
attgtaatgttac

SEQ ID NO: 3138127 - DNA, 15 bp, Homo sapiens
attgtaatgttactg

SEQ ID NO: 3138128 - DNA, 15 bp, Homo sapiens
attgtacatatttgt

SEQ ID NO: 3138129 - DNA, 12 bp, Homo sapiens
attgtacctctc

SEQ ID NO: 3138130 - DNA, 18 bp, Homo sapiens
attgtacctctcttatag

SEQ ID NO: 3138131 - DNA, 18 bp, Homo sapiens
attgtactacctgtgtat

SEQ ID NO: 3138132 - DNA, 18 bp, Homo sapiens
attgtactcaatggattt

SEQ ID NO: 3138133 - DNA, 22 bp, Homo sapiens
attgtacttagccagttcaaag

SEQ ID NO: 3138134 - DNA, 18 bp, Homo sapiens
attgtagactgatgtttt

SEQ ID NO: 3138135 - DNA, 16 bp, Homo sapiens
attgtagcatttcttg

SEQ ID NO: 3138136 - DNA, 15 bp, Homo sapiens
attgtaggtgcaagc

SEQ ID NO: 3138137 - DNA, 14 bp, Homo sapiens
attgtagttaatga

SEQ ID NO: 3138138 - DNA, 21 bp, Homo sapiens
attgtataaactatcagtttg

SEQ ID NO: 3138139 - DNA, 15 bp, Homo sapiens
attgtatacattttg

SEQ ID NO: 3138140 - DNA, 21 bp, Homo sapiens
attgtatctagtgcagctgat

SEQ ID NO: 3138141 - DNA, 21 bp, Homo sapiens
attgtatgatgtgttgtgata

SEQ ID NO: 3138142 - DNA, 16 bp, Homo sapiens
attgtattactttaat

SEQ ID NO: 3138143 - DNA, 23 bp, Homo sapiens
attgtattaggtgtcatttccat

SEQ ID NO: 3138144 - DNA, 15 bp, Homo sapiens
attgtatttatgtgt

SEQ ID NO: 3138145 - DNA, 16 bp, Homo sapiens
attgtattttgatgag

SEQ ID NO: 3138146 - DNA, 19 bp, Homo sapiens
attgtcagagttctgctct

SEQ ID NO: 3138147 - DNA, 12 bp, Homo sapiens
attgtcagccat

SEQ ID NO: 3138148 - DNA, 22 bp, Homo sapiens
attgtcagccatcgtcctggga

SEQ ID NO: 3138149 - DNA, 19 bp, Homo sapiens
attgtcagctactaatgat

SEQ ID NO: 3138150 - DNA, 16 bp, Homo sapiens
attgtcagtgattttg

SEQ ID NO: 3138151 - DNA, 20 bp, Homo sapiens
attgtcatgtttattctaat

SEQ ID NO: 3138152 - DNA, 19 bp, Homo sapiens
attgtccaggtgaggccca

SEQ ID NO: 3138153 - DNA, 20 bp, Homo sapiens
attgtccaggtgaggcccaa

SEQ ID NO: 3138154 - DNA, 17 bp, Homo sapiens
attgtccttcagagctc

SEQ ID NO: 3138155 - DNA, 22 bp, Homo sapiens
attgtcgaaaagagtcttccaa

SEQ ID NO: 3138156 - DNA, 13 bp, Homo sapiens
attgtctatttat

SEQ ID NO: 3138157 - DNA, 14 bp, Homo sapiens
attgtctatttatc

SEQ ID NO: 3138158 - DNA, 16 bp, Homo sapiens
attgtctgaacttgca

SEQ ID NO: 3138159 - DNA, 19 bp, Homo sapiens
attgtctgtctacatttct

SEQ ID NO: 3138160 - DNA, 18 bp, Homo sapiens
attgtcttgttctgtccc

SEQ ID NO: 3138161 - DNA, 12 bp, Homo sapiens
attgtctttgct

SEQ ID NO: 3138162 - DNA, 13 bp, Homo sapiens
attgtctttgctg

SEQ ID NO: 3138163 - DNA, 19 bp, Homo sapiens
attgtctttgctgtactct

SEQ ID NO: 3138164 - DNA, 15 bp, Homo sapiens
attgtgattggcctg

SEQ ID NO: 3138165 - DNA, 20 bp, Homo sapiens
attgtgcagtactttgtgca

SEQ ID NO: 3138166 - DNA, 16 bp, Homo sapiens
attgtgccaatatgta

SEQ ID NO: 3138167 - DNA, 12 bp, Homo sapiens
attgtgcttctc

SEQ ID NO: 3138168 - DNA, 14 bp, Homo sapiens
attgtgcttctccc

SEQ ID NO: 3138169 - DNA, 20 bp, Homo sapiens
attgtggaaaaccaggaaaa

SEQ ID NO: 3138170 - DNA, 16 bp, Homo sapiens
attgtggattataaaa

SEQ ID NO: 3138171 - DNA, 18 bp, Homo sapiens
attgtggattataaaaaa

SEQ ID NO: 3138172 - DNA, 22 bp, Homo sapiens
attgtggattataaaaaatgta

SEQ ID NO: 3138173 - DNA, 16 bp, Homo sapiens
attgtgggcataaact

SEQ ID NO: 3138174 - DNA, 18 bp, Homo sapiens
attgtggtaggcctttta

SEQ ID NO: 3138175 - DNA, 19 bp, Homo sapiens
attgtgtaaaaaatggaaa

SEQ ID NO: 3138176 - DNA, 23 bp, Homo sapiens
attgtgtaacaattttaatgcta

SEQ ID NO: 3138177 - DNA, 14 bp, Homo sapiens
attgtgtagccttt

SEQ ID NO: 3138178 - DNA, 22 bp, Homo sapiens
attgtgtagcctttttgtataa

SEQ ID NO: 3138179 - DNA, 18 bp, Homo sapiens
attgtgtataactggatt

SEQ ID NO: 3138180 - DNA, 22 bp, Homo sapiens
attgtgtcagaaacatgaaatg

SEQ ID NO: 3138181 - DNA, 14 bp, Homo sapiens
attgtgtctgcatt

SEQ ID NO: 3138182 - DNA, 20 bp, Homo sapiens
attgtgtgaaaaaagaaaat

SEQ ID NO: 3138183 - DNA, 14 bp, Homo sapiens
attgtgtgaatact

SEQ ID NO: 3138184 - DNA, 15 bp, Homo sapiens
attgtgtgtctggta

SEQ ID NO: 3138185 - DNA, 15 bp, Homo sapiens
attgtgttcccattt

SEQ ID NO: 3138186 - DNA, 13 bp, Homo sapiens
attgtgttgacat

SEQ ID NO: 3138187 - DNA, 20 bp, Homo sapiens
attgtgttgacattaagaat

SEQ ID NO: 3138188 - DNA, 14 bp, Homo sapiens
attgtgttgtgaat

SEQ ID NO: 3138189 - DNA, 13 bp, Homo sapiens
attgtgtttgtgt

SEQ ID NO: 3138190 - DNA, 17 bp, Homo sapiens
attgttaatctctgtta

SEQ ID NO: 3138191 - DNA, 21 bp, Homo sapiens
attgttacattatgtggaaaa

SEQ ID NO: 3138192 - DNA, 19 bp, Homo sapiens
attgttacgtagcctaagg

SEQ ID NO: 3138193 - DNA, 21 bp, Homo sapiens
attgttagaaaatgacttatt

SEQ ID NO: 3138194 - DNA, 22 bp, Homo sapiens
attgttattgtggaagatttac

SEQ ID NO: 3138195 - DNA, 13 bp, Homo sapiens
attgttatttata

SEQ ID NO: 3138196 - DNA, 15 bp, Homo sapiens
attgttcaaacaata

SEQ ID NO: 3138197 - DNA, 24 bp, Homo sapiens
attgttcaaacaatatcatatcat

SEQ ID NO: 3138198 - DNA, 18 bp, Homo sapiens
attgttccaagacattgt

SEQ ID NO: 3138199 - DNA, 24 bp, Homo sapiens
attgttccagcagttttcaagtca

SEQ ID NO: 3138200 - DNA, 16 bp, Homo sapiens
attgttccctatgaaa

SEQ ID NO: 3138201 - DNA, 18 bp, Homo sapiens
attgttcttattctggca

SEQ ID NO: 3138202 - DNA, 20 bp, Homo sapiens
attgttgacaactgtgactg

SEQ ID NO: 3138203 - DNA, 22 bp, Homo sapiens
attgttgaggtggtctgaatgt

SEQ ID NO: 3138204 - DNA, 14 bp, Homo sapiens
attgttgcattgct

SEQ ID NO: 3138205 - DNA, 16 bp, Homo sapiens
attgttgcattgcttt

SEQ ID NO: 3138206 - DNA, 16 bp, Homo sapiens
attgttggctatttga

SEQ ID NO: 3138207 - DNA, 17 bp, Homo sapiens
attgttggctatttgaa

SEQ ID NO: 3138208 - DNA, 15 bp, Homo sapiens
attgttgtataattt

SEQ ID NO: 3138209 - DNA, 13 bp, Homo sapiens
attgttgtgtctg

SEQ ID NO: 3138210 - DNA, 15 bp, Homo sapiens
attgttgtgtctgtg

SEQ ID NO: 3138211 - DNA, 12 bp, Homo sapiens
attgttgtttct

SEQ ID NO: 3138212 - DNA, 19 bp, Homo sapiens
attgttgtttctttctagt

SEQ ID NO: 3138213 - DNA, 12 bp, Homo sapiens
attgtttatgta

SEQ ID NO: 3138214 - DNA, 19 bp, Homo sapiens
attgtttccaacttgtctg

SEQ ID NO: 3138215 - DNA, 17 bp, Homo sapiens
attgtttctgcattcat

SEQ ID NO: 3138216 - DNA, 19 bp, Homo sapiens
attgtttcttcttcatgct

SEQ ID NO: 3138217 - DNA, 23 bp, Homo sapiens
atttcagagtgactacacacagt

SEQ ID NO: 3138218 - DNA, 18 bp, Homo sapiens
atttcagattcccagagc

SEQ ID NO: 3138219 - DNA, 13 bp, Homo sapiens
atttcaggaattt

SEQ ID NO: 3138220 - DNA, 22 bp, Homo sapiens
atttcaggatactctgtcagat

SEQ ID NO: 3138221 - DNA, 23 bp, Homo sapiens
atttcagggagaaactccaaagt

SEQ ID NO: 3138222 - DNA, 19 bp, Homo sapiens
atttcaggggtcgtcacca

SEQ ID NO: 3138223 - DNA, 22 bp, Homo sapiens
atttcaggggtcgtcaccacct

SEQ ID NO: 3138224 - DNA, 14 bp, Homo sapiens
atttcagtaagtct

SEQ ID NO: 3138225 - DNA, 21 bp, Homo sapiens
atttcagtgtagttaatttat

SEQ ID NO: 3138226 - DNA, 14 bp, Homo sapiens
atttcagtttttca

SEQ ID NO: 3138227 - DNA, 18 bp, Homo sapiens
atttcagtttttcatttg

SEQ ID NO: 3138228 - DNA, 19 bp, Homo sapiens
atttcagtttttcatttgt

SEQ ID NO: 3138229 - DNA, 18 bp, Homo sapiens
atttcatatctacagata

SEQ ID NO: 3138230 - DNA, 22 bp, Homo sapiens
atttcatatctacagatagaga

SEQ ID NO: 3138231 - DNA, 18 bp, Homo sapiens
atttcatcattgtttctg

SEQ ID NO: 3138232 - DNA, 23 bp, Homo sapiens
atttcatccagtttgttctccgg

SEQ ID NO: 3138233 - DNA, 14 bp, Homo sapiens
atttcatctatttt

SEQ ID NO: 3138234 - DNA, 16 bp, Homo sapiens
atttcatcttctggaa

SEQ ID NO: 3138235 - DNA, 20 bp, Homo sapiens
atttcatcttctggaatatt

SEQ ID NO: 3138236 - DNA, 15 bp, Homo sapiens
atttcatgatttcat

SEQ ID NO: 3138237 - DNA, 18 bp, Homo sapiens
atttcatgctatctctgt

SEQ ID NO: 3138238 - DNA, 14 bp, Homo sapiens
atttcattcttctc

SEQ ID NO: 3138239 - DNA, 14 bp, Homo sapiens
atttcattgcctgt

SEQ ID NO: 3138240 - DNA, 12 bp, Homo sapiens
atttcattgtat

SEQ ID NO: 3138241 - DNA, 23 bp, Homo sapiens
atttcatttccaactcaggttaa

SEQ ID NO: 3138242 - DNA, 22 bp, Homo sapiens
atttcattttttgcatcagtat

SEQ ID NO: 3138243 - DNA, 15 bp, Homo sapiens
atttccaaataaaat

SEQ ID NO: 3138244 - DNA, 17 bp, Homo sapiens
atttccaaataaaatga

SEQ ID NO: 3138245 - DNA, 18 bp, Homo sapiens
atttccaaataaaatgag

SEQ ID NO: 3138246 - DNA, 22 bp, Homo sapiens
atttccaacaccacagacacac

SEQ ID NO: 3138247 - DNA, 14 bp, Homo sapiens
atttccacaccaag

SEQ ID NO: 3138248 - DNA, 22 bp, Homo sapiens
atttccagaaccacacttgaaa

SEQ ID NO: 3138249 - DNA, 21 bp, Homo sapiens
atttccagctttctccccgct

SEQ ID NO: 3138250 - DNA, 15 bp, Homo sapiens
atttccaggcccctg

SEQ ID NO: 3138251 - DNA, 22 bp, Homo sapiens
atttccaggcccctgaggactg

SEQ ID NO: 3138252 - DNA, 20 bp, Homo sapiens
atttccagtacctttgtcac

SEQ ID NO: 3138253 - DNA, 22 bp, Homo sapiens
atttccagtgttctatgaacaa

SEQ ID NO: 3138254 - DNA, 20 bp, Homo sapiens
atttccatcttaatgttact

SEQ ID NO: 3138255 - DNA, 15 bp, Homo sapiens
atttccattccagaa

SEQ ID NO: 3138256 - DNA, 16 bp, Homo sapiens
atttccattccagaat

SEQ ID NO: 3138257 - DNA, 15 bp, Homo sapiens
atttccatttctgat

SEQ ID NO: 3138258 - DNA, 17 bp, Homo sapiens
atttccccaccccagct

SEQ ID NO: 3138259 - DNA, 20 bp, Homo sapiens
atttccccatctgccacagg

SEQ ID NO: 3138260 - DNA, 14 bp, Homo sapiens
atttccccctcctc

SEQ ID NO: 3138261 - DNA, 17 bp, Homo sapiens
atttccccctcctcaga

SEQ ID NO: 3138262 - DNA, 19 bp, Homo sapiens
atttccccgatgtcccctg

SEQ ID NO: 3138263 - DNA, 16 bp, Homo sapiens
atttcccttcttgcat

SEQ ID NO: 3138264 - DNA, 14 bp, Homo sapiens
atttccgaataaag

SEQ ID NO: 3138265 - DNA, 21 bp, Homo sapiens
atttcctaatactgtcatcct

SEQ ID NO: 3138266 - DNA, 24 bp, Homo sapiens
atttcctcaacgttgctccccatc

SEQ ID NO: 3138267 - DNA, 19 bp, Homo sapiens
atttcctctattgatgtac

SEQ ID NO: 3138268 - DNA, 18 bp, Homo sapiens
atttcctgtacaatcatg

SEQ ID NO: 3138269 - DNA, 21 bp, Homo sapiens
atttcctgtacaatcatgaac

SEQ ID NO: 3138270 - DNA, 14 bp, Homo sapiens
atttccttgaatgt

SEQ ID NO: 3138271 - DNA, 19 bp, Homo sapiens
atttccttttttgttatta

SEQ ID NO: 3138272 - DNA, 22 bp, Homo sapiens
atttcgtgggtctgttttcctt

SEQ ID NO: 3138273 - DNA, 12 bp, Homo sapiens
atttcgttccct

SEQ ID NO: 3138274 - DNA, 14 bp, Homo sapiens
atttcgttccctga

SEQ ID NO: 3138275 - DNA, 14 bp, Homo sapiens
atttctaagaagtt

SEQ ID NO: 3138276 - DNA, 14 bp, Homo sapiens
atttctaagtattt

SEQ ID NO: 3138277 - DNA, 19 bp, Homo sapiens
atttctacaactggagttt

SEQ ID NO: 3138278 - DNA, 19 bp, Homo sapiens
atttctacacagtgggaac

SEQ ID NO: 3138279 - DNA, 15 bp, Homo sapiens
atttctacctcagca

SEQ ID NO: 3138280 - DNA, 17 bp, Homo sapiens
atttctactatatacat

SEQ ID NO: 3138281 - DNA, 18 bp, Homo sapiens
atttctactatatacata

SEQ ID NO: 3138282 - DNA, 20 bp, Homo sapiens
atttctagaagcacatgtgt

SEQ ID NO: 3138283 - DNA, 20 bp, Homo sapiens
atttctagtccaaaattaca

SEQ ID NO: 3138284 - DNA, 21 bp, Homo sapiens
atttctagttctttcctcccc

SEQ ID NO: 3138285 - DNA, 20 bp, Homo sapiens
atttctatactttacaggaa

SEQ ID NO: 3138286 - DNA, 16 bp, Homo sapiens
atttctatggctttca

SEQ ID NO: 3138287 - DNA, 17 bp, Homo sapiens
atttctatggctttcaa

SEQ ID NO: 3138288 - DNA, 18 bp, Homo sapiens
atttctatggctttcaaa

SEQ ID NO: 3138289 - DNA, 23 bp, Homo sapiens
atttctattcaaggtggccaaat

SEQ ID NO: 3138290 - DNA, 12 bp, Homo sapiens
atttctatttat

SEQ ID NO: 3138291 - DNA, 17 bp, Homo sapiens
atttctatttatttact

SEQ ID NO: 3138292 - DNA, 20 bp, Homo sapiens
atttctcaacaaagcacagt

SEQ ID NO: 3138293 - DNA, 22 bp, Homo sapiens
atttctcaacaaagcacagtgt

SEQ ID NO: 3138294 - DNA, 14 bp, Homo sapiens
atttctcactgaga

SEQ ID NO: 3138295 - DNA, 20 bp, Homo sapiens
atttctcatacttagaaaca

SEQ ID NO: 3138296 - DNA, 17 bp, Homo sapiens
atttctcattgactttt

SEQ ID NO: 3138297 - DNA, 22 bp, Homo sapiens
atttctcattgacttttataaa

SEQ ID NO: 3138298 - DNA, 20 bp, Homo sapiens
atttctccagttgggactca

SEQ ID NO: 3138299 - DNA, 19 bp, Homo sapiens
atttctccatctttataga

SEQ ID NO: 3138300 - DNA, 12 bp, Homo sapiens
atttctcctccc

SEQ ID NO: 3138301 - DNA, 14 bp, Homo sapiens
atttctcctccctt

SEQ ID NO: 3138302 - DNA, 19 bp, Homo sapiens
atttctcctcccttccttt

SEQ ID NO: 3138303 - DNA, 15 bp, Homo sapiens
atttctcctttgcaa

SEQ ID NO: 3138304 - DNA, 17 bp, Homo sapiens
atttctcctttgcaata

SEQ ID NO: 3138305 - DNA, 22 bp, Homo sapiens
atttctcttctcagctcttcca

SEQ ID NO: 3138306 - DNA, 23 bp, Homo sapiens
atttctcttctcagctcttccat

SEQ ID NO: 3138307 - DNA, 12 bp, Homo sapiens
atttctcttgct

SEQ ID NO: 3138308 - DNA, 21 bp, Homo sapiens
atttctgaaaacctaccagcc

SEQ ID NO: 3138309 - DNA, 16 bp, Homo sapiens
atttctgaactgttac

SEQ ID NO: 3138310 - DNA, 21 bp, Homo sapiens
atttctgaattcaaagcttgt

SEQ ID NO: 3138311 - DNA, 22 bp, Homo sapiens
atttctgatcagaggtgtacac

SEQ ID NO: 3138312 - DNA, 24 bp, Homo sapiens
atttctgatcagaggtgtacacta

SEQ ID NO: 3138313 - DNA, 14 bp, Homo sapiens
atttctgatgtctc

SEQ ID NO: 3138314 - DNA, 23 bp, Homo sapiens
atttctgcatatgttgaatactt

SEQ ID NO: 3138315 - DNA, 21 bp, Homo sapiens
atttctgctctggaataaagt

SEQ ID NO: 3138316 - DNA, 20 bp, Homo sapiens
atttctgtcacagtaaaaat

SEQ ID NO: 3138317 - DNA, 21 bp, Homo sapiens
atttctgtcacagtaaaaata

SEQ ID NO: 3138318 - DNA, 13 bp, Homo sapiens
atttctgtcagaa

SEQ ID NO: 3138319 - DNA, 17 bp, Homo sapiens
atttctgtctttaagaa

SEQ ID NO: 3138320 - DNA, 23 bp, Homo sapiens
atttcttaaatctttcttcaaat

SEQ ID NO: 3138321 - DNA, 17 bp, Homo sapiens
atttcttaacctttgct

SEQ ID NO: 3138322 - DNA, 14 bp, Homo sapiens
atttcttaacttct

SEQ ID NO: 3138323 - DNA, 17 bp, Homo sapiens
atttcttaacttcttgc

SEQ ID NO: 3138324 - DNA, 18 bp, Homo sapiens
atttcttaattattataa

SEQ ID NO: 3138325 - DNA, 19 bp, Homo sapiens
atttcttaattattataaa

SEQ ID NO: 3138326 - DNA, 22 bp, Homo sapiens
atttcttaattattataaaaat

SEQ ID NO: 3138327 - DNA, 23 bp, Homo sapiens
atttcttagtgcttcagagtttg

SEQ ID NO: 3138328 - DNA, 22 bp, Homo sapiens
atttcttatacgcttttctttg

SEQ ID NO: 3138329 - DNA, 22 bp, Homo sapiens
atttcttcaaaatgtatatatt

SEQ ID NO: 3138330 - DNA, 17 bp, Homo sapiens
atttcttcagtcagaaa

SEQ ID NO: 3138331 - DNA, 20 bp, Homo sapiens
atttcttcagtcagaaaact

SEQ ID NO: 3138332 - DNA, 23 bp, Homo sapiens
atttcttcagtcagaaaacttta

SEQ ID NO: 3138333 - DNA, 19 bp, Homo sapiens
atttcttcctaccaagtca

SEQ ID NO: 3138334 - DNA, 20 bp, Homo sapiens
atttcttcctaccaagtcaa

SEQ ID NO: 3138335 - DNA, 14 bp, Homo sapiens
atttcttcctcagc

SEQ ID NO: 3138336 - DNA, 21 bp, Homo sapiens
atttcttcgctgctctagctg

SEQ ID NO: 3138337 - DNA, 23 bp, Homo sapiens
atttcttcgctgctctagctggc

SEQ ID NO: 3138338 - DNA, 19 bp, Homo sapiens
atttcttctctttagtata

SEQ ID NO: 3138339 - DNA, 22 bp, Homo sapiens
atttcttctctttagtataatt

SEQ ID NO: 3138340 - DNA, 21 bp, Homo sapiens
atttctttaaaagaatgacta

SEQ ID NO: 3138341 - DNA, 15 bp, Homo sapiens
atttttcagttccaa

SEQ ID NO: 3138342 - DNA, 16 bp, Homo sapiens
atttttcagttccaag

SEQ ID NO: 3138343 - DNA, 11 bp, Homo sapiens
atttttcatac

SEQ ID NO: 3138344 - DNA, 13 bp, Homo sapiens
atttttcatattg

SEQ ID NO: 3138345 - DNA, 19 bp, Homo sapiens
atttttcatattgtgccaa

SEQ ID NO: 3138346 - DNA, 20 bp, Homo sapiens
atttttccatttatttatga

SEQ ID NO: 3138347 - DNA, 22 bp, Homo sapiens
atttttcggaggccccactgat

SEQ ID NO: 3138348 - DNA, 18 bp, Homo sapiens
atttttctataaatcagt

SEQ ID NO: 3138349 - DNA, 19 bp, Homo sapiens
atttttctataaatcagta

SEQ ID NO: 3138350 - DNA, 12 bp, Homo sapiens
atttttctcttc

SEQ ID NO: 3138351 - DNA, 15 bp, Homo sapiens
atttttctttaactg

SEQ ID NO: 3138352 - DNA, 21 bp, Homo sapiens
atttttgataaagcctcaagg

SEQ ID NO: 3138353 - DNA, 12 bp, Homo sapiens
atttttgcctct

SEQ ID NO: 3138354 - DNA, 19 bp, Homo sapiens
atttttggcagtctgaatt

SEQ ID NO: 3138355 - DNA, 14 bp, Homo sapiens
atttttggggaaaa

SEQ ID NO: 3138356 - DNA, 24 bp, Homo sapiens
atttttggggcatcctggatgatt

SEQ ID NO: 3138357 - DNA, 19 bp, Homo sapiens
atttttggtgggaatccaa

SEQ ID NO: 3138358 - DNA, 18 bp, Homo sapiens
atttttgtaatgtgaaaa

SEQ ID NO: 3138359 - DNA, 11 bp, Homo sapiens
atttttgtaca

SEQ ID NO: 3138360 - DNA, 14 bp, Homo sapiens
atttttgtacatat

SEQ ID NO: 3138361 - DNA, 13 bp, Homo sapiens
atttttgtacatg

SEQ ID NO: 3138362 - DNA, 18 bp, Homo sapiens
atttttgtacttgatttg

SEQ ID NO: 3138363 - DNA, 19 bp, Homo sapiens
atttttgtagagccagggt

SEQ ID NO: 3138364 - DNA, 20 bp, Homo sapiens
atttttgtgaagtattcaca

SEQ ID NO: 3138365 - DNA, 18 bp, Homo sapiens
atttttgtgttttcttgt

SEQ ID NO: 3138366 - DNA, 19 bp, Homo sapiens
atttttgtgttttcttgta

SEQ ID NO: 3138367 - DNA, 20 bp, Homo sapiens
atttttgttactctcttcca

SEQ ID NO: 3138368 - DNA, 17 bp, Homo sapiens
atttttgttagcaaaga

SEQ ID NO: 3138369 - DNA, 17 bp, Homo sapiens
atttttgtttcttccaa

SEQ ID NO: 3138370 - DNA, 16 bp, Homo sapiens
attttttaaaacacta

SEQ ID NO: 3138371 - DNA, 12 bp, Homo sapiens
attttttaaagt

SEQ ID NO: 3138372 - DNA, 12 bp, Homo sapiens
attttttaagct

SEQ ID NO: 3138373 - DNA, 11 bp, Homo sapiens
attttttaagt

SEQ ID NO: 3138374 - DNA, 20 bp, Homo sapiens
attttttaagtatttatata

SEQ ID NO: 3138375 - DNA, 20 bp, Homo sapiens
attttttaattattatttat

SEQ ID NO: 3138376 - DNA, 13 bp, Homo sapiens
attttttatatat

SEQ ID NO: 3138377 - DNA, 14 bp, Homo sapiens
attttttccaaaat

SEQ ID NO: 3138378 - DNA, 21 bp, Homo sapiens
attttttcgtgcactctgcta

SEQ ID NO: 3138379 - DNA, 12 bp, Homo sapiens
attttttcttcc

SEQ ID NO: 3138380 - DNA, 20 bp, Homo sapiens
attttttgctataatcatta

SEQ ID NO: 3138381 - DNA, 23 bp, Homo sapiens
attttttgtaatgtgtgaaaaag

SEQ ID NO: 3138382 - DNA, 15 bp, Homo sapiens
attttttgtataatt

SEQ ID NO: 3138383 - DNA, 16 bp, Homo sapiens
attttttgtataattg

SEQ ID NO: 3138384 - DNA, 22 bp, Homo sapiens
atttttttaaaatcactaacat

SEQ ID NO: 3138385 - DNA, 15 bp, Homo sapiens
atttttttaaaattt

SEQ ID NO: 3138386 - DNA, 16 bp, Homo sapiens
atttttttaaatttgc

SEQ ID NO: 3138387 - DNA, 16 bp, Homo sapiens
atttttttaactgaaa

SEQ ID NO: 3138388 - DNA, 18 bp, Homo sapiens
atttttttaagaaaaaag

SEQ ID NO: 3138389 - DNA, 12 bp, Homo sapiens
atttttttaagc

SEQ ID NO: 3138390 - DNA, 18 bp, Homo sapiens
atttttttaatagtgctt

SEQ ID NO: 3138391 - DNA, 21 bp, Homo sapiens
atttttttatcttgggactgg

SEQ ID NO: 3138392 - DNA, 13 bp, Homo sapiens
atttttttcctaa

SEQ ID NO: 3138393 - DNA, 13 bp, Homo sapiens
atttttttctatt

SEQ ID NO: 3138394 - DNA, 15 bp, Homo sapiens
atttttttgtgtatg

SEQ ID NO: 3138395 - DNA, 18 bp, Homo sapiens
attttttttaagtattta

SEQ ID NO: 3138396 - DNA, 17 bp, Homo sapiens
attttttttatatttat

SEQ ID NO: 3138397 - DNA, 20 bp, Homo sapiens
attttttttcaaaaatgctg

SEQ ID NO: 3138398 - DNA, 14 bp, Homo sapiens
attttttttggcct

SEQ ID NO: 3138399 - DNA, 18 bp, Homo sapiens
attttttttggcctgttt

SEQ ID NO: 3138400 - DNA, 22 bp, Homo sapiens
attttttttggcctgtttgatg

SEQ ID NO: 3138401 - DNA, 23 bp, Homo sapiens
attttttttggcctgtttgatgt

SEQ ID NO: 3138402 - DNA, 21 bp, Homo sapiens
atttttttttaattttgatat

SEQ ID NO: 3138403 - DNA, 16 bp, Homo sapiens
atttttttttcataca

SEQ ID NO: 3138404 - DNA, 23 bp, Homo sapiens
atttttttttcatagagatttgt

SEQ ID NO: 3138405 - DNA, 15 bp, Homo sapiens
atttttttttctaag

SEQ ID NO: 3138406 - DNA, 19 bp, Homo sapiens
attttttttttaaattatt

SEQ ID NO: 3138407 - DNA, 23 bp, Homo sapiens
atttttttttttgtttctgagaa

SEQ ID NO: 3138408 - DNA, 19 bp, Homo sapiens
atttttttttttttttcct

SEQ ID NO: 3138409 - DNA, 23 bp, Homo sapiens
atttttttttttttttttttaag

SEQ ID NO: 3138410 - DNA, 20 bp, Homo sapiens
caaaaaaaaaaaaagaagac

SEQ ID NO: 3138411 - DNA, 19 bp, Homo sapiens
caaaaaaaaaaaaatgcac

SEQ ID NO: 3138412 - DNA, 13 bp, Homo sapiens
caaaaaaaaaaga

SEQ ID NO: 3138413 - DNA, 20 bp, Homo sapiens
caaaaaaaaaagaagttact

SEQ ID NO: 3138414 - DNA, 14 bp, Homo sapiens
caaaaaaaaaggct

SEQ ID NO: 3138415 - DNA, 16 bp, Homo sapiens
caaaaaaaaagtttta

SEQ ID NO: 3138416 - DNA, 19 bp, Homo sapiens
caaaaaaaaagttttattt

SEQ ID NO: 3138417 - DNA, 17 bp, Homo sapiens
caaaaaaaatttaaaaa

SEQ ID NO: 3138418 - DNA, 18 bp, Homo sapiens
caaaaaaacaagtttaga

SEQ ID NO: 3138419 - DNA, 13 bp, Homo sapiens
caaaaaaacacta

SEQ ID NO: 3138420 - DNA, 13 bp, Homo sapiens
caaaaaaaccaca

SEQ ID NO: 3138421 - DNA, 13 bp, Homo sapiens
caaaaaaagcctc

SEQ ID NO: 3138422 - DNA, 12 bp, Homo sapiens
caaaaaaaggaa

SEQ ID NO: 3138423 - DNA, 14 bp, Homo sapiens
caaaaaaaggaaaa

SEQ ID NO: 3138424 - DNA, 15 bp, Homo sapiens
caaaaaaaggaaaaa

SEQ ID NO: 3138425 - DNA, 16 bp, Homo sapiens
caaaaaaaggaaaaat

SEQ ID NO: 3138426 - DNA, 20 bp, Homo sapiens
caaaaaaaggaaaaataatc

SEQ ID NO: 3138427 - DNA, 18 bp, Homo sapiens
caaaaaaatatatttaat

SEQ ID NO: 3138428 - DNA, 14 bp, Homo sapiens
caaaaaaattaaat

SEQ ID NO: 3138429 - DNA, 19 bp, Homo sapiens
caaaaaaggaaaagttaaa

SEQ ID NO: 3138430 - DNA, 17 bp, Homo sapiens
caaaaaagggacagcat

SEQ ID NO: 3138431 - DNA, 15 bp, Homo sapiens
caaaaaagtattttt

SEQ ID NO: 3138432 - DNA, 16 bp, Homo sapiens
caaaaaatgttttaaa

SEQ ID NO: 3138433 - DNA, 16 bp, Homo sapiens
caaaaaattagccggg

SEQ ID NO: 3138434 - DNA, 14 bp, Homo sapiens
caaaaacaaaaaag

SEQ ID NO: 3138435 - DNA, 22 bp, Homo sapiens
caaaaacaggtatatactttga

SEQ ID NO: 3138436 - DNA, 15 bp, Homo sapiens
caaaaacatgtatgt

SEQ ID NO: 3138437 - DNA, 18 bp, Homo sapiens
caaaaaccacagtcctca

SEQ ID NO: 3138438 - DNA, 14 bp, Homo sapiens
caaaaaccagcagg

SEQ ID NO: 3138439 - DNA, 15 bp, Homo sapiens
caaaaaccagcaggt

SEQ ID NO: 3138440 - DNA, 14 bp, Homo sapiens
caaaaactaaaatc

SEQ ID NO: 3138441 - DNA, 16 bp, Homo sapiens
caaaaactatttggga

SEQ ID NO: 3138442 - DNA, 22 bp, Homo sapiens
caaaaactgtctttaaaagaga

SEQ ID NO: 3138443 - DNA, 16 bp, Homo sapiens
caaaaagaaaaatcaa

SEQ ID NO: 3138444 - DNA, 14 bp, Homo sapiens
caaaaagcaaggga

SEQ ID NO: 3138445 - DNA, 21 bp, Homo sapiens
caaaaagcaagggagaaaaga

SEQ ID NO: 3138446 - DNA, 16 bp, Homo sapiens
caaaaaggtataaata

SEQ ID NO: 3138447 - DNA, 14 bp, Homo sapiens
caaaaagtatatta

SEQ ID NO: 3138448 - DNA, 17 bp, Homo sapiens
caaaaagtgtttatttt

SEQ ID NO: 3138449 - DNA, 15 bp, Homo sapiens
caaaaagtttccata

SEQ ID NO: 3138450 - DNA, 15 bp, Homo sapiens
caaaaatataactta

SEQ ID NO: 3138451 - DNA, 22 bp, Homo sapiens
caaaaatatttataaaacttct

SEQ ID NO: 3138452 - DNA, 20 bp, Homo sapiens
caaaaatctcccagtgacaa

SEQ ID NO: 3138453 - DNA, 19 bp, Homo sapiens
caaaaatgaaagcatgtct

SEQ ID NO: 3138454 - DNA, 20 bp, Homo sapiens
caaaaatgacaacagaaaaa

SEQ ID NO: 3138455 - DNA, 23 bp, Homo sapiens
caaaaatgggaaaaataaaagaa

SEQ ID NO: 3138456 - DNA, 13 bp, Homo sapiens
caaaaatgttgaa

SEQ ID NO: 3138457 - DNA, 15 bp, Homo sapiens
caaaaattagccggg

SEQ ID NO: 3138458 - DNA, 11 bp, Homo sapiens
caaaacaaaaa

SEQ ID NO: 3138459 - DNA, 20 bp, Homo sapiens
caaaacaagtttttctgtca

SEQ ID NO: 3138460 - DNA, 12 bp, Homo sapiens
caaaacacacta

SEQ ID NO: 3138461 - DNA, 19 bp, Homo sapiens
caaaacagagatgtgataa

SEQ ID NO: 3138462 - DNA, 22 bp, Homo sapiens
caaaacccaggacatctcctgg

SEQ ID NO: 3138463 - DNA, 14 bp, Homo sapiens
caaaacccatgtgg

SEQ ID NO: 3138464 - DNA, 23 bp, Homo sapiens
caaaacccctaagagactgcgtt

SEQ ID NO: 3138465 - DNA, 21 bp, Homo sapiens
caaaacctgatgttaaaattc

SEQ ID NO: 3138466 - DNA, 16 bp, Homo sapiens
caaaacctgtgccagg

SEQ ID NO: 3138467 - DNA, 20 bp, Homo sapiens
caaaacctgtgccaggctga

SEQ ID NO: 3138468 - DNA, 13 bp, Homo sapiens
caaagtgctggga

SEQ ID NO: 3138469 - DNA, 14 bp, Homo sapiens
caaagtggggaggg

SEQ ID NO: 3138470 - DNA, 15 bp, Homo sapiens
caaagtggggaggga

SEQ ID NO: 3138471 - DNA, 14 bp, Homo sapiens
caaagtgtatattt

SEQ ID NO: 3138472 - DNA, 15 bp, Homo sapiens
caaagtgtatattta

SEQ ID NO: 3138473 - DNA, 15 bp, Homo sapiens
caaagttaacagatt

SEQ ID NO: 3138474 - DNA, 17 bp, Homo sapiens
caaagttagagaactaa

SEQ ID NO: 3138475 - DNA, 24 bp, Homo sapiens
caaagttagagaactaaactagtt

SEQ ID NO: 3138476 - DNA, 19 bp, Homo sapiens
caaagttcccactccttca

SEQ ID NO: 3138477 - DNA, 21 bp, Homo sapiens
caaagttccctacttcctgtg

SEQ ID NO: 3138478 - DNA, 21 bp, Homo sapiens
caaagttctaataatttctaa

SEQ ID NO: 3138479 - DNA, 15 bp, Homo sapiens
caaagttctgtgttt

SEQ ID NO: 3138480 - DNA, 20 bp, Homo sapiens
caaagttctgtgtttaattt

SEQ ID NO: 3138481 - DNA, 15 bp, Homo sapiens
caaagttgttgtaac

SEQ ID NO: 3138482 - DNA, 15 bp, Homo sapiens
caaagttttcctttg

SEQ ID NO: 3138483 - DNA, 14 bp, Homo sapiens
caaagttttgaaaa

SEQ ID NO: 3138484 - DNA, 18 bp, Homo sapiens
caaagttttgaaaagcta

SEQ ID NO: 3138485 - DNA, 17 bp, Homo sapiens
caaataaaaactaaatt

SEQ ID NO: 3138486 - DNA, 22 bp, Homo sapiens
caaataaaaactaaattgtaaa

SEQ ID NO: 3138487 - DNA, 16 bp, Homo sapiens
caaataaaaatattgt

SEQ ID NO: 3138488 - DNA, 12 bp, Homo sapiens
caaataaacagc

SEQ ID NO: 3138489 - DNA, 18 bp, Homo sapiens
caaataaactctaaacat

SEQ ID NO: 3138490 - DNA, 20 bp, Homo sapiens
caaataaactgactttttcc

SEQ ID NO: 3138491 - DNA, 23 bp, Homo sapiens
caaataaagccttttaaatcatc

SEQ ID NO: 3138492 - DNA, 15 bp, Homo sapiens
caaataaatttctgg

SEQ ID NO: 3138493 - DNA, 17 bp, Homo sapiens
caaataacttcagtcct

SEQ ID NO: 3138494 - DNA, 13 bp, Homo sapiens
caaataatcacat

SEQ ID NO: 3138495 - DNA, 19 bp, Homo sapiens
caaatacaaagtaaataca

SEQ ID NO: 3138496 - DNA, 22 bp, Homo sapiens
caaatacaaagtaaatacaaga

SEQ ID NO: 3138497 - DNA, 13 bp, Homo sapiens
caaatacacattt

SEQ ID NO: 3138498 - DNA, 18 bp, Homo sapiens
caaatactgtatattcag

SEQ ID NO: 3138499 - DNA, 19 bp, Homo sapiens
caaatagatttttgttttt

SEQ ID NO: 3138500 - DNA, 17 bp, Homo sapiens
caaataggctattaaaa

SEQ ID NO: 3138501 - DNA, 23 bp, Homo sapiens
caaataggctattaaaaaagtct

SEQ ID NO: 3138502 - DNA, 15 bp, Homo sapiens
caaatagtgtgaaat

SEQ ID NO: 3138503 - DNA, 19 bp, Homo sapiens
caaatagttgcatagcagt

SEQ ID NO: 3138504 - DNA, 13 bp, Homo sapiens
caaatataaacat

SEQ ID NO: 3138505 - DNA, 12 bp, Homo sapiens
caaatatagaaa

SEQ ID NO: 3138506 - DNA, 14 bp, Homo sapiens
caaatatagaaagt

SEQ ID NO: 3138507 - DNA, 11 bp, Homo sapiens
caaatatattg

SEQ ID NO: 3138508 - DNA, 14 bp, Homo sapiens
caaatatattgtta

SEQ ID NO: 3138509 - DNA, 15 bp, Homo sapiens
caaatatattgttaa

SEQ ID NO: 3138510 - DNA, 13 bp, Homo sapiens
caaatatgtcctg

SEQ ID NO: 3138511 - DNA, 15 bp, Homo sapiens
caaatatgtcctggg

SEQ ID NO: 3138512 - DNA, 12 bp, Homo sapiens
caaatattaaag

SEQ ID NO: 3138513 - DNA, 22 bp, Homo sapiens
caaatattaaagattctcttta

SEQ ID NO: 3138514 - DNA, 18 bp, Homo sapiens
caaatattcactggcccc

SEQ ID NO: 3138515 - DNA, 13 bp, Homo sapiens
caaatattgccaa

SEQ ID NO: 3138516 - DNA, 14 bp, Homo sapiens
caaatatttatttt

SEQ ID NO: 3138517 - DNA, 20 bp, Homo sapiens
caaatatttattttctttct

SEQ ID NO: 3138518 - DNA, 23 bp, Homo sapiens
caaatattttagaagctaatgta

SEQ ID NO: 3138519 - DNA, 22 bp, Homo sapiens
caaatcaaagcaagggctccag

SEQ ID NO: 3138520 - DNA, 15 bp, Homo sapiens
caaatcaatacacta

SEQ ID NO: 3138521 - DNA, 14 bp, Homo sapiens
caaatcagaagtca

SEQ ID NO: 3138522 - DNA, 15 bp, Homo sapiens
caaatcagaagtcat

SEQ ID NO: 3138523 - DNA, 13 bp, Homo sapiens
caaatcagctgct

SEQ ID NO: 3138524 - DNA, 19 bp, Homo sapiens
caaatccttccaaaaatta

SEQ ID NO: 3138525 - DNA, 20 bp, Homo sapiens
caaatccttccaaaaattat

SEQ ID NO: 3138526 - DNA, 22 bp, Homo sapiens
caaatctaaagttgctccatac

SEQ ID NO: 3138527 - DNA, 18 bp, Homo sapiens
caaatctaatctcttatt

SEQ ID NO: 3138528 - DNA, 21 bp, Homo sapiens
caaatctacagatcctttttc

SEQ ID NO: 3138529 - DNA, 24 bp, Homo sapiens
caaatctattacttttgcaaactg

SEQ ID NO: 3138530 - DNA, 13 bp, Homo sapiens
caaatctattcag

SEQ ID NO: 3138531 - DNA, 20 bp, Homo sapiens
caaatctcatacacaactgt

SEQ ID NO: 3138532 - DNA, 17 bp, Homo sapiens
caaatctcttgcttgtc

SEQ ID NO: 3138533 - DNA, 21 bp, Homo sapiens
caaatctcttgcttgtcattg

SEQ ID NO: 3138534 - DNA, 14 bp, Homo sapiens
caaatctgaagatt

SEQ ID NO: 3138535 - DNA, 12 bp, Homo sapiens
caaatctgtgta

SEQ ID NO: 3138536 - DNA, 16 bp, Homo sapiens
caaatctgtgtatatt

SEQ ID NO: 3138537 - DNA, 17 bp, Homo sapiens
caaatctgtgtatatta

SEQ ID NO: 3138538 - DNA, 14 bp, Homo sapiens
caaatcttgggtgg

SEQ ID NO: 3138539 - DNA, 22 bp, Homo sapiens
caaatcttgggtgggtgaaggc

SEQ ID NO: 3138540 - DNA, 15 bp, Homo sapiens
caaatctttaagaat

SEQ ID NO: 3138541 - DNA, 19 bp, Homo sapiens
caaatgagtaacatttgct

SEQ ID NO: 3138542 - DNA, 21 bp, Homo sapiens
caaatgagtaacatttgctgt

SEQ ID NO: 3138543 - DNA, 11 bp, Homo sapiens
caaatgatttc

SEQ ID NO: 3138544 - DNA, 14 bp, Homo sapiens
caaatgatttcata

SEQ ID NO: 3138545 - DNA, 16 bp, Homo sapiens
caaatgcacaagctca

SEQ ID NO: 3138546 - DNA, 18 bp, Homo sapiens
caaatgcacaagctcaga

SEQ ID NO: 3138547 - DNA, 22 bp, Homo sapiens
caaatgcagggaggggaggcag

SEQ ID NO: 3138548 - DNA, 17 bp, Homo sapiens
caaatgcgcgtgtgcac

SEQ ID NO: 3138549 - DNA, 22 bp, Homo sapiens
caaatgctctgtcttcaatgat

SEQ ID NO: 3138550 - DNA, 22 bp, Homo sapiens
caaatggaaagtaactcatttg

SEQ ID NO: 3138551 - DNA, 22 bp, Homo sapiens
caaatggattttgggagtgact

SEQ ID NO: 3138552 - DNA, 15 bp, Homo sapiens
caaatggctgagatg

SEQ ID NO: 3138553 - DNA, 14 bp, Homo sapiens
caaatgtattaatg

SEQ ID NO: 3138554 - DNA, 16 bp, Homo sapiens
caaatgtgatcaactg

SEQ ID NO: 3138555 - DNA, 20 bp, Homo sapiens
caaatgtgatcaactgttca

SEQ ID NO: 3138556 - DNA, 14 bp, Homo sapiens
caaatgtgattttt

SEQ ID NO: 3138557 - DNA, 15 bp, Homo sapiens
caaatgttcatcctc

SEQ ID NO: 3138558 - DNA, 15 bp, Homo sapiens
caaatgttctaagtt

SEQ ID NO: 3138559 - DNA, 20 bp, Homo sapiens
caaatgtttacagggagcct

SEQ ID NO: 3138560 - DNA, 13 bp, Homo sapiens
caaattaaaaaaa

SEQ ID NO: 3138561 - DNA, 13 bp, Homo sapiens
caaattaaaacat

SEQ ID NO: 3138562 - DNA, 13 bp, Homo sapiens
caaattaatttta

SEQ ID NO: 3138563 - DNA, 12 bp, Homo sapiens
caaattagaaaa

SEQ ID NO: 3138564 - DNA, 22 bp, Homo sapiens
caaattagaaaatgttatttaa

SEQ ID NO: 3138565 - DNA, 21 bp, Homo sapiens
caaattagggcaattggaaca

SEQ ID NO: 3138566 - DNA, 18 bp, Homo sapiens
caaattcaaggccttcca

SEQ ID NO: 3138567 - DNA, 17 bp, Homo sapiens
caaattcaatgattctt

SEQ ID NO: 3138568 - DNA, 12 bp, Homo sapiens
caaattcagttt

SEQ ID NO: 3138569 - DNA, 16 bp, Homo sapiens
caaattcagtttcata

SEQ ID NO: 3138570 - DNA, 18 bp, Homo sapiens
caaattcagtttcataaa

SEQ ID NO: 3138571 - DNA, 15 bp, Homo sapiens
caaattctcaccaaa

SEQ ID NO: 3138572 - DNA, 14 bp, Homo sapiens
caaattcttctgaa

SEQ ID NO: 3138573 - DNA, 15 bp, Homo sapiens
caaattgcactgaag

SEQ ID NO: 3138574 - DNA, 13 bp, Homo sapiens
caaattgctgctt

SEQ ID NO: 3138575 - DNA, 17 bp, Homo sapiens
caaattgcttaaaaaag

SEQ ID NO: 3138576 - DNA, 19 bp, Homo sapiens
caaattggactttcaaaat

SEQ ID NO: 3138577 - DNA, 16 bp, Homo sapiens
caaattgtcgttttta

SEQ ID NO: 3138578 - DNA, 17 bp, Homo sapiens
caaattgtcgtttttat

SEQ ID NO: 3138579 - DNA, 19 bp, Homo sapiens
caaattgtctggtactatt

SEQ ID NO: 3138580 - DNA, 14 bp, Homo sapiens
caaattgtgcttct

SEQ ID NO: 3138581 - DNA, 18 bp, Homo sapiens
caaattgtgcttctcccc

SEQ ID NO: 3138582 - DNA, 19 bp, Homo sapiens
caaattgtgcttctcccca

SEQ ID NO: 3138583 - DNA, 16 bp, Homo sapiens
caaatttacatttatc

SEQ ID NO: 3138584 - DNA, 20 bp, Homo sapiens
caaatttacatttatctatt

SEQ ID NO: 3138585 - DNA, 19 bp, Homo sapiens
caaatttatcaaagcatag

SEQ ID NO: 3138586 - DNA, 13 bp, Homo sapiens
caaatttatgcat

SEQ ID NO: 3138587 - DNA, 22 bp, Homo sapiens
caaatttatgcatttcattcaa

SEQ ID NO: 3138588 - DNA, 11 bp, Homo sapiens
caaatttattt

SEQ ID NO: 3138589 - DNA, 21 bp, Homo sapiens
caaatttattttaatgtaaag

SEQ ID NO: 3138590 - DNA, 19 bp, Homo sapiens
caaatttgaaaataattgt

SEQ ID NO: 3138591 - DNA, 17 bp, Homo sapiens
caaatttgattgatttg

SEQ ID NO: 3138592 - DNA, 21 bp, Homo sapiens
caaatttggctcacttgcctt

SEQ ID NO: 3138593 - DNA, 17 bp, Homo sapiens
caaattttcaaataata

SEQ ID NO: 3138594 - DNA, 13 bp, Homo sapiens
caaattttcaagt

SEQ ID NO: 3138595 - DNA, 17 bp, Homo sapiens
caagactgttgctcaaa

SEQ ID NO: 3138596 - DNA, 15 bp, Homo sapiens
caagacttggcaaca

SEQ ID NO: 3138597 - DNA, 20 bp, Homo sapiens
caagacttggcaacagaagc

SEQ ID NO: 3138598 - DNA, 21 bp, Homo sapiens
caagagaaaggcctgcacaca

SEQ ID NO: 3138599 - DNA, 15 bp, Homo sapiens
caagagagatgtttt

SEQ ID NO: 3138600 - DNA, 21 bp, Homo sapiens
caagagatctttctttccaaa

SEQ ID NO: 3138601 - DNA, 16 bp, Homo sapiens
caagagatgggaatga

SEQ ID NO: 3138602 - DNA, 13 bp, Homo sapiens
caagagcacacag

SEQ ID NO: 3138603 - DNA, 14 bp, Homo sapiens
caagagcagagtct

SEQ ID NO: 3138604 - DNA, 22 bp, Homo sapiens
caagagcatcgtgacccttcag

SEQ ID NO: 3138605 - DNA, 17 bp, Homo sapiens
caagagcccctgcccct

SEQ ID NO: 3138606 - DNA, 12 bp, Homo sapiens
caagagccctgt

SEQ ID NO: 3138607 - DNA, 17 bp, Homo sapiens
caagagccctgtggccg

SEQ ID NO: 3138608 - DNA, 12 bp, Homo sapiens
caagagcctgat

SEQ ID NO: 3138609 - DNA, 16 bp, Homo sapiens
caagagcctgatctct

SEQ ID NO: 3138610 - DNA, 22 bp, Homo sapiens
caagagcctgatctcttcctgt

SEQ ID NO: 3138611 - DNA, 22 bp, Homo sapiens
caagaggaaaagctgtaagaaa

SEQ ID NO: 3138612 - DNA, 22 bp, Homo sapiens
caagaggaataagaatggagca

SEQ ID NO: 3138613 - DNA, 15 bp, Homo sapiens
caagaggcaagctga

SEQ ID NO: 3138614 - DNA, 23 bp, Homo sapiens
caagaggcagagttctgtgaaga

SEQ ID NO: 3138615 - DNA, 19 bp, Homo sapiens
caagaggcctcatgcctgc

SEQ ID NO: 3138616 - DNA, 17 bp, Homo sapiens
caagagggaacaaaact

SEQ ID NO: 3138617 - DNA, 20 bp, Homo sapiens
caagagggaacaaaactgtt

SEQ ID NO: 3138618 - DNA, 20 bp, Homo sapiens
caagagggcactggtggccc

SEQ ID NO: 3138619 - DNA, 15 bp, Homo sapiens
caagagggggtggag

SEQ ID NO: 3138620 - DNA, 17 bp, Homo sapiens
caagagggggtggaggg

SEQ ID NO: 3138621 - DNA, 23 bp, Homo sapiens
caagaggggtggagactgcttcc

SEQ ID NO: 3138622 - DNA, 16 bp, Homo sapiens
caagagggtctgagga

SEQ ID NO: 3138623 - DNA, 15 bp, Homo sapiens
caagaggtctgagcc

SEQ ID NO: 3138624 - DNA, 16 bp, Homo sapiens
caagaggtctgagccc

SEQ ID NO: 3138625 - DNA, 20 bp, Homo sapiens
caagaggtctgagccctggt

SEQ ID NO: 3138626 - DNA, 22 bp, Homo sapiens
caagagtttgttctgttctggg

SEQ ID NO: 3138627 - DNA, 14 bp, Homo sapiens
caagataaaagaat

SEQ ID NO: 3138628 - DNA, 17 bp, Homo sapiens
caagataaaagaatggc

SEQ ID NO: 3138629 - DNA, 14 bp, Homo sapiens
caagataagcctga

SEQ ID NO: 3138630 - DNA, 16 bp, Homo sapiens
caagataagcctgagc

SEQ ID NO: 3138631 - DNA, 21 bp, Homo sapiens
caagatacatatgaggacaag

SEQ ID NO: 3138632 - DNA, 12 bp, Homo sapiens
caagatagaaag

SEQ ID NO: 3138633 - DNA, 19 bp, Homo sapiens
caagatattgatcaaatat

SEQ ID NO: 3138634 - DNA, 15 bp, Homo sapiens
caagatccatttgcc

SEQ ID NO: 3138635 - DNA, 19 bp, Homo sapiens
caagatccatttgcctttc

SEQ ID NO: 3138636 - DNA, 15 bp, Homo sapiens
caagatctacaggac

SEQ ID NO: 3138637 - DNA, 12 bp, Homo sapiens
caagatctttca

SEQ ID NO: 3138638 - DNA, 13 bp, Homo sapiens
caagatctttcag

SEQ ID NO: 3138639 - DNA, 15 bp, Homo sapiens
caagatctttcagga

SEQ ID NO: 3138640 - DNA, 15 bp, Homo sapiens
caagatgaaataatt

SEQ ID NO: 3138641 - DNA, 13 bp, Homo sapiens
caagatgcttggt

SEQ ID NO: 3138642 - DNA, 14 bp, Homo sapiens
caagattaaatgta

SEQ ID NO: 3138643 - DNA, 17 bp, Homo sapiens
caagattcacacctgac

SEQ ID NO: 3138644 - DNA, 22 bp, Homo sapiens
caagattccggatcctaagcat

SEQ ID NO: 3138645 - DNA, 18 bp, Homo sapiens
caagattctagatgatta

SEQ ID NO: 3138646 - DNA, 12 bp, Homo sapiens
caagattgaaaa

SEQ ID NO: 3138647 - DNA, 14 bp, Homo sapiens
caagatttagaaaa

SEQ ID NO: 3138648 - DNA, 17 bp, Homo sapiens
caagatttcctactttc

SEQ ID NO: 3138649 - DNA, 19 bp, Homo sapiens
caagattttcctcttgtga

SEQ ID NO: 3138650 - DNA, 23 bp, Homo sapiens
caagcaaacatcaaataaatttc

SEQ ID NO: 3138651 - DNA, 22 bp, Homo sapiens
caagcaacctgggtccaaataa

SEQ ID NO: 3138652 - DNA, 15 bp, Homo sapiens
caagcaagctctctt

SEQ ID NO: 3138653 - DNA, 16 bp, Homo sapiens
caagcaataattgttt

SEQ ID NO: 3138654 - DNA, 16 bp, Homo sapiens
caagcaatgcaagaaa

SEQ ID NO: 3138655 - DNA, 14 bp, Homo sapiens
caagcacagccctt

SEQ ID NO: 3138656 - DNA, 13 bp, Homo sapiens
caagcacctcctg

SEQ ID NO: 3138657 - DNA, 16 bp, Homo sapiens
caagcacctcctgcct

SEQ ID NO: 3138658 - DNA, 14 bp, Homo sapiens
caagcactatttta

SEQ ID NO: 3138659 - DNA, 19 bp, Homo sapiens
caagcagagtgcacagctg

SEQ ID NO: 3138660 - DNA, 17 bp, Homo sapiens
caagcagcatcttctgg

SEQ ID NO: 3138661 - DNA, 15 bp, Homo sapiens
caagcagccagccag

SEQ ID NO: 3138662 - DNA, 16 bp, Homo sapiens
caagcagccagccagt

SEQ ID NO: 3138663 - DNA, 15 bp, Homo sapiens
caagcagcccttgct

SEQ ID NO: 3138664 - DNA, 16 bp, Homo sapiens
caagcagctgaagaaa

SEQ ID NO: 3138665 - DNA, 17 bp, Homo sapiens
caagcagctttttattc

SEQ ID NO: 3138666 - DNA, 17 bp, Homo sapiens
caagcaggaattatgtc

SEQ ID NO: 3138667 - DNA, 19 bp, Homo sapiens
caagcagggaaagctccac

SEQ ID NO: 3138668 - DNA, 21 bp, Homo sapiens
caagcagggaaagctccacgg

SEQ ID NO: 3138669 - DNA, 18 bp, Homo sapiens
caagcagtcgtgcctgtg

SEQ ID NO: 3138670 - DNA, 20 bp, Homo sapiens
caagcagtcgtgcctgtgtc

SEQ ID NO: 3138671 - DNA, 24 bp, Homo sapiens
caagcagttactccctacactgat

SEQ ID NO: 3138672 - DNA, 21 bp, Homo sapiens
caagcatcttgggggggtggc

SEQ ID NO: 3138673 - DNA, 19 bp, Homo sapiens
caagcatgacaacttttaa

SEQ ID NO: 3138674 - DNA, 18 bp, Homo sapiens
caagccaagggaacctgt

SEQ ID NO: 3138675 - DNA, 14 bp, Homo sapiens
caagccaatcccct

SEQ ID NO: 3138676 - DNA, 17 bp, Homo sapiens
caagccaatcccctcct

SEQ ID NO: 3138677 - DNA, 13 bp, Homo sapiens
caagccagaggct

SEQ ID NO: 3138678 - DNA, 18 bp, Homo sapiens
caagccagattctcttga

SEQ ID NO: 3138679 - DNA, 22 bp, Homo sapiens
caagccagcaacacagagcact

SEQ ID NO: 3138680 - DNA, 18 bp, Homo sapiens
caagcccaaatttaattt

SEQ ID NO: 3138681 - DNA, 13 bp, Homo sapiens
caagccccagcag

SEQ ID NO: 3138682 - DNA, 17 bp, Homo sapiens
caagccccagcagccct

SEQ ID NO: 3138683 - DNA, 14 bp, Homo sapiens
caagccccagggcc

SEQ ID NO: 3138684 - DNA, 19 bp, Homo sapiens
caagccccagggcctgggg

SEQ ID NO: 3138685 - DNA, 21 bp, Homo sapiens
caagccccagggcctgggggc

SEQ ID NO: 3138686 - DNA, 20 bp, Homo sapiens
caagccccatctcatcctgg

SEQ ID NO: 3138687 - DNA, 14 bp, Homo sapiens
caagccccatttcc

SEQ ID NO: 3138688 - DNA, 20 bp, Homo sapiens
caagcccctcagcccttgcc

SEQ ID NO: 3138689 - DNA, 21 bp, Homo sapiens
caagccctccccatcccatgt

SEQ ID NO: 3138690 - DNA, 21 bp, Homo sapiens
caagccctggagccaactgct

SEQ ID NO: 3138691 - DNA, 12 bp, Homo sapiens
caagccctggca

SEQ ID NO: 3138692 - DNA, 15 bp, Homo sapiens
caagccctggcaaca

SEQ ID NO: 3138693 - DNA, 19 bp, Homo sapiens
caagcccttcggtcacctg

SEQ ID NO: 3138694 - DNA, 16 bp, Homo sapiens
caagccgaccttccct

SEQ ID NO: 3138695 - DNA, 17 bp, Homo sapiens
caagccgtggcttcccg

SEQ ID NO: 3138696 - DNA, 15 bp, Homo sapiens
caagcctccacagcg

SEQ ID NO: 3138697 - DNA, 16 bp, Homo sapiens
caagcctccacagcga

SEQ ID NO: 3138698 - DNA, 14 bp, Homo sapiens
caagcctgctggct

SEQ ID NO: 3138699 - DNA, 13 bp, Homo sapiens
caagcctgtggga

SEQ ID NO: 3138700 - DNA, 14 bp, Homo sapiens
caagcctgtgggag

SEQ ID NO: 3138701 - DNA, 15 bp, Homo sapiens
caagcgattcttctg

SEQ ID NO: 3138702 - DNA, 20 bp, Homo sapiens
caagcgattcttctgcttca

SEQ ID NO: 3138703 - DNA, 16 bp, Homo sapiens
caagcgcatccaatct

SEQ ID NO: 3138704 - DNA, 18 bp, Homo sapiens
caagcgctcccagcctgc

SEQ ID NO: 3138705 - DNA, 24 bp, Homo sapiens
caagcgctcccagcctgccctcca

SEQ ID NO: 3138706 - DNA, 14 bp, Homo sapiens
caagctaagcactg

SEQ ID NO: 3138707 - DNA, 16 bp, Homo sapiens
caagctaagcactgcc

SEQ ID NO: 3138708 - DNA, 15 bp, Homo sapiens
caagctagccagagg

SEQ ID NO: 3138709 - DNA, 17 bp, Homo sapiens
caagctaggccccagag

SEQ ID NO: 3138710 - DNA, 20 bp, Homo sapiens
caagctaggccccagaggcc

SEQ ID NO: 3138711 - DNA, 22 bp, Homo sapiens
caagctaggccccagaggccct

SEQ ID NO: 3138712 - DNA, 21 bp, Homo sapiens
caagctatctaaagtttgtta

SEQ ID NO: 3138713 - DNA, 15 bp, Homo sapiens
caagctatttaatat

SEQ ID NO: 3138714 - DNA, 23 bp, Homo sapiens
caagctatttaatatctggcact

SEQ ID NO: 3138715 - DNA, 17 bp, Homo sapiens
caagctccctggagccc

SEQ ID NO: 3138716 - DNA, 20 bp, Homo sapiens
caagctccgcctcccgggtt

SEQ ID NO: 3138717 - DNA, 14 bp, Homo sapiens
caagctcctcctcg

SEQ ID NO: 3138718 - DNA, 16 bp, Homo sapiens
caagctcctcctcgga

SEQ ID NO: 3138719 - DNA, 17 bp, Homo sapiens
caagctctagtgggaag

SEQ ID NO: 3138720 - DNA, 15 bp, Homo sapiens
caagctgacttggca

SEQ ID NO: 3138721 - DNA, 15 bp, Homo sapiens
caatgattcataaca

SEQ ID NO: 3138722 - DNA, 15 bp, Homo sapiens
caatgattgttaatt

SEQ ID NO: 3138723 - DNA, 15 bp, Homo sapiens
caatgcaacttttaa

SEQ ID NO: 3138724 - DNA, 13 bp, Homo sapiens
caatgcacatcca

SEQ ID NO: 3138725 - DNA, 16 bp, Homo sapiens
caatgcatagagccct

SEQ ID NO: 3138726 - DNA, 19 bp, Homo sapiens
caatgcatagagccctggc

SEQ ID NO: 3138727 - DNA, 21 bp, Homo sapiens
caatgcatagagccctggcca

SEQ ID NO: 3138728 - DNA, 19 bp, Homo sapiens
caatgccaagtcactcttt

SEQ ID NO: 3138729 - DNA, 18 bp, Homo sapiens
caatgccatttcagtggc

SEQ ID NO: 3138730 - DNA, 15 bp, Homo sapiens
caatgcccagcaggg

SEQ ID NO: 3138731 - DNA, 21 bp, Homo sapiens
caatgctgatttggtgaccaa

SEQ ID NO: 3138732 - DNA, 12 bp, Homo sapiens
caatgctggctg

SEQ ID NO: 3138733 - DNA, 13 bp, Homo sapiens
caatgctgtactt

SEQ ID NO: 3138734 - DNA, 16 bp, Homo sapiens
caatgcttaaactaaa

SEQ ID NO: 3138735 - DNA, 20 bp, Homo sapiens
caatgcttaaactaaataat

SEQ ID NO: 3138736 - DNA, 15 bp, Homo sapiens
caatggaaacctcac

SEQ ID NO: 3138737 - DNA, 13 bp, Homo sapiens
caatggatttgat

SEQ ID NO: 3138738 - DNA, 17 bp, Homo sapiens
caatggatttgatgctg

SEQ ID NO: 3138739 - DNA, 14 bp, Homo sapiens
caatggcagctaga

SEQ ID NO: 3138740 - DNA, 18 bp, Homo sapiens
caatggcagctagactgg

SEQ ID NO: 3138741 - DNA, 19 bp, Homo sapiens
caatggcagctagactgga

SEQ ID NO: 3138742 - DNA, 15 bp, Homo sapiens
caatgggcaatgaca

SEQ ID NO: 3138743 - DNA, 15 bp, Homo sapiens
caatgggcactggga

SEQ ID NO: 3138744 - DNA, 23 bp, Homo sapiens
caatgggtttttccctgtacagt

SEQ ID NO: 3138745 - DNA, 20 bp, Homo sapiens
caatggtgatcctctatttt

SEQ ID NO: 3138746 - DNA, 21 bp, Homo sapiens
caatggtgtcagtatccaggc

SEQ ID NO: 3138747 - DNA, 15 bp, Homo sapiens
caatgtataaagatt

SEQ ID NO: 3138748 - DNA, 19 bp, Homo sapiens
caatgtataaagattgtac

SEQ ID NO: 3138749 - DNA, 21 bp, Homo sapiens
caatgtataaagattgtactt

SEQ ID NO: 3138750 - DNA, 23 bp, Homo sapiens
caatgtatgtgaaagtgtaaaat

SEQ ID NO: 3138751 - DNA, 11 bp, Homo sapiens
caatgtgttca

SEQ ID NO: 3138752 - DNA, 23 bp, Homo sapiens
caatgtgttttttcggacatgct

SEQ ID NO: 3138753 - DNA, 11 bp, Homo sapiens
caatgttaagg

SEQ ID NO: 3138754 - DNA, 16 bp, Homo sapiens
caatgttaaggaaact

SEQ ID NO: 3138755 - DNA, 20 bp, Homo sapiens
caatgttaaggaaactctta

SEQ ID NO: 3138756 - DNA, 24 bp, Homo sapiens
caatgttaaggaaactcttatctc

SEQ ID NO: 3138757 - DNA, 13 bp, Homo sapiens
caatgttcattgt

SEQ ID NO: 3138758 - DNA, 15 bp, Homo sapiens
caatgttcattgtaa

SEQ ID NO: 3138759 - DNA, 16 bp, Homo sapiens
caatgttgtccaacaa

SEQ ID NO: 3138760 - DNA, 17 bp, Homo sapiens
caatgttgtccaacaat

SEQ ID NO: 3138761 - DNA, 18 bp, Homo sapiens
caatgttgtccaacaata

SEQ ID NO: 3138762 - DNA, 17 bp, Homo sapiens
caatgtttcttctaggt

SEQ ID NO: 3138763 - DNA, 15 bp, Homo sapiens
caatgtttgatgtcc

SEQ ID NO: 3138764 - DNA, 22 bp, Homo sapiens
caatgtttgatgtccccaaagt

SEQ ID NO: 3138765 - DNA, 23 bp, Homo sapiens
caatgtttgatgtccccaaagta

SEQ ID NO: 3138766 - DNA, 19 bp, Homo sapiens
caattaaacttccaaagaa

SEQ ID NO: 3138767 - DNA, 13 bp, Homo sapiens
caattaaaggtcc

SEQ ID NO: 3138768 - DNA, 20 bp, Homo sapiens
caattaaaggtcctgccctc

SEQ ID NO: 3138769 - DNA, 14 bp, Homo sapiens
caattaaatgtagg

SEQ ID NO: 3138770 - DNA, 15 bp, Homo sapiens
caattaaatttattt

SEQ ID NO: 3138771 - DNA, 17 bp, Homo sapiens
caattaaatttatttta

SEQ ID NO: 3138772 - DNA, 14 bp, Homo sapiens
caattaagcagctt

SEQ ID NO: 3138773 - DNA, 15 bp, Homo sapiens
caattaataaaaaat

SEQ ID NO: 3138774 - DNA, 13 bp, Homo sapiens
caattaatgcttt

SEQ ID NO: 3138775 - DNA, 17 bp, Homo sapiens
caattaattcatccctt

SEQ ID NO: 3138776 - DNA, 17 bp, Homo sapiens
caattacagggtgactc

SEQ ID NO: 3138777 - DNA, 22 bp, Homo sapiens
caattacagggtgactcacagc

SEQ ID NO: 3138778 - DNA, 13 bp, Homo sapiens
caattacatctct

SEQ ID NO: 3138779 - DNA, 21 bp, Homo sapiens
caattagcaattgactgtcac

SEQ ID NO: 3138780 - DNA, 14 bp, Homo sapiens
caattagcattctg

SEQ ID NO: 3138781 - DNA, 14 bp, Homo sapiens
caattagtttcctt

SEQ ID NO: 3138782 - DNA, 18 bp, Homo sapiens
caattagtttccttttta

SEQ ID NO: 3138783 - DNA, 15 bp, Homo sapiens
caattataacttatt

SEQ ID NO: 3138784 - DNA, 21 bp, Homo sapiens
caattataacttattagcagt

SEQ ID NO: 3138785 - DNA, 14 bp, Homo sapiens
caattatagtttct

SEQ ID NO: 3138786 - DNA, 22 bp, Homo sapiens
caattattgatatatattataa

SEQ ID NO: 3138787 - DNA, 15 bp, Homo sapiens
caattcaaaagttcc

SEQ ID NO: 3138788 - DNA, 19 bp, Homo sapiens
caattcagattgtcttgca

SEQ ID NO: 3138789 - DNA, 21 bp, Homo sapiens
caattccaatatttctgcttt

SEQ ID NO: 3138790 - DNA, 14 bp, Homo sapiens
caattccatcaccc

SEQ ID NO: 3138791 - DNA, 17 bp, Homo sapiens
caattcccctctgctgc

SEQ ID NO: 3138792 - DNA, 18 bp, Homo sapiens
caattcctagataaaaag

SEQ ID NO: 3138793 - DNA, 22 bp, Homo sapiens
caattcctagataaaaagatgg

SEQ ID NO: 3138794 - DNA, 13 bp, Homo sapiens
caattcctctggg

SEQ ID NO: 3138795 - DNA, 14 bp, Homo sapiens
caattcctctggga

SEQ ID NO: 3138796 - DNA, 14 bp, Homo sapiens
caattcctcttcat

SEQ ID NO: 3138797 - DNA, 12 bp, Homo sapiens
caattcctgggc

SEQ ID NO: 3138798 - DNA, 21 bp, Homo sapiens
caattctcctgcctcagcctc

SEQ ID NO: 3138799 - DNA, 21 bp, Homo sapiens
caattgaagtaaactttttgt

SEQ ID NO: 3138800 - DNA, 14 bp, Homo sapiens
caattgacaaatga

SEQ ID NO: 3138801 - DNA, 13 bp, Homo sapiens
caattgcactgct

SEQ ID NO: 3138802 - DNA, 17 bp, Homo sapiens
caattggcagtgacttt

SEQ ID NO: 3138803 - DNA, 17 bp, Homo sapiens
caattgggagctgccaa

SEQ ID NO: 3138804 - DNA, 20 bp, Homo sapiens
caattgggagctgccaagag

SEQ ID NO: 3138805 - DNA, 14 bp, Homo sapiens
caattgtaaattga

SEQ ID NO: 3138806 - DNA, 14 bp, Homo sapiens
caattgtcatttat

SEQ ID NO: 3138807 - DNA, 16 bp, Homo sapiens
caattgtcatttataa

SEQ ID NO: 3138808 - DNA, 17 bp, Homo sapiens
caattgtgtagcctttt

SEQ ID NO: 3138809 - DNA, 18 bp, Homo sapiens
caattgtgtagccttttt

SEQ ID NO: 3138810 - DNA, 23 bp, Homo sapiens
caattgttgacagttctgaagaa

SEQ ID NO: 3138811 - DNA, 22 bp, Homo sapiens
caattgtttgggtgattcctaa

SEQ ID NO: 3138812 - DNA, 12 bp, Homo sapiens
caatttaaggaa

SEQ ID NO: 3138813 - DNA, 22 bp, Homo sapiens
caatttaaggaacacagagcag

SEQ ID NO: 3138814 - DNA, 20 bp, Homo sapiens
caatttaatggatatttctc

SEQ ID NO: 3138815 - DNA, 14 bp, Homo sapiens
caatttatgaattg

SEQ ID NO: 3138816 - DNA, 22 bp, Homo sapiens
caatttattaaaatgattgtaa

SEQ ID NO: 3138817 - DNA, 15 bp, Homo sapiens
caatttcaaggttct

SEQ ID NO: 3138818 - DNA, 17 bp, Homo sapiens
caatttcccccctcgtg

SEQ ID NO: 3138819 - DNA, 16 bp, Homo sapiens
caatttcctttatatt

SEQ ID NO: 3138820 - DNA, 23 bp, Homo sapiens
caatttgcacatcttggctatgt

SEQ ID NO: 3138821 - DNA, 23 bp, Homo sapiens
caatttgtaattgcttacatttt

SEQ ID NO: 3138822 - DNA, 18 bp, Homo sapiens
caatttgttaattcctat

SEQ ID NO: 3138823 - DNA, 22 bp, Homo sapiens
caatttgttcatcctattgttg

SEQ ID NO: 3138824 - DNA, 17 bp, Homo sapiens
caattttaatgctattt

SEQ ID NO: 3138825 - DNA, 21 bp, Homo sapiens
caattttatccctcacctgta

SEQ ID NO: 3138826 - DNA, 22 bp, Homo sapiens
caattttctaagcaatttcttg

SEQ ID NO: 3138827 - DNA, 19 bp, Homo sapiens
caattttctggaatacatg

SEQ ID NO: 3138828 - DNA, 17 bp, Homo sapiens
caattttctttgtttct

SEQ ID NO: 3138829 - DNA, 23 bp, Homo sapiens
cacaaaaaaatatcagacaagca

SEQ ID NO: 3138830 - DNA, 12 bp, Homo sapiens
cacaaaaatgaa

SEQ ID NO: 3138831 - DNA, 20 bp, Homo sapiens
cacaaaaatttgaacactgg

SEQ ID NO: 3138832 - DNA, 21 bp, Homo sapiens
cacaaaactccgcccccagcc

SEQ ID NO: 3138833 - DNA, 23 bp, Homo sapiens
cacaaaactccgcccccagccta

SEQ ID NO: 3138834 - DNA, 16 bp, Homo sapiens
cacaaaagtttctctt

SEQ ID NO: 3138835 - DNA, 17 bp, Homo sapiens
cacaaactacctctgga

SEQ ID NO: 3138836 - DNA, 13 bp, Homo sapiens
cacaaactgtaaa

SEQ ID NO: 3138837 - DNA, 23 bp, Homo sapiens
cacaaactgtaaataaaaagaaa

SEQ ID NO: 3138838 - DNA, 19 bp, Homo sapiens
cacaaacttttatactctt

SEQ ID NO: 3138839 - DNA, 18 bp, Homo sapiens
cacaaagcccttccatgt

SEQ ID NO: 3138840 - DNA, 17 bp, Homo sapiens
cacaaaggccaaactgc

SEQ ID NO: 3138841 - DNA, 19 bp, Homo sapiens
cacaaaggccaaactgctg

SEQ ID NO: 3138842 - DNA, 17 bp, Homo sapiens
cacaaaggtggaataaa

SEQ ID NO: 3138843 - DNA, 13 bp, Homo sapiens
cacaaatatttat

SEQ ID NO: 3138844 - DNA, 21 bp, Homo sapiens
cacaaatatttattttctttc

SEQ ID NO: 3138845 - DNA, 14 bp, Homo sapiens
cacaacagaataaa

SEQ ID NO: 3138846 - DNA, 17 bp, Homo sapiens
cacaacagaataaagca

SEQ ID NO: 3138847 - DNA, 18 bp, Homo sapiens
cacatcaaataagaaata

SEQ ID NO: 3138848 - DNA, 13 bp, Homo sapiens
cacatcaagcttt

SEQ ID NO: 3138849 - DNA, 12 bp, Homo sapiens
cacatccaactc

SEQ ID NO: 3138850 - DNA, 16 bp, Homo sapiens
cacatccaactccagc

SEQ ID NO: 3138851 - DNA, 18 bp, Homo sapiens
cacatccaactccagcaa

SEQ ID NO: 3138852 - DNA, 19 bp, Homo sapiens
cacatccaactccagcaac

SEQ ID NO: 3138853 - DNA, 21 bp, Homo sapiens
cacatccattcccaagaaatg

SEQ ID NO: 3138854 - DNA, 22 bp, Homo sapiens
cacatccattcccaagaaatgc

SEQ ID NO: 3138855 - DNA, 18 bp, Homo sapiens
cacatcccagcagcccaa

SEQ ID NO: 3138856 - DNA, 22 bp, Homo sapiens
cacatcccagcagcccaagctt

SEQ ID NO: 3138857 - DNA, 12 bp, Homo sapiens
cacatcccaggc

SEQ ID NO: 3138858 - DNA, 22 bp, Homo sapiens
cacatcccaggcttcaccctga

SEQ ID NO: 3138859 - DNA, 16 bp, Homo sapiens
cacatcccggcctctt

SEQ ID NO: 3138860 - DNA, 18 bp, Homo sapiens
cacatcctccgtccagcc

SEQ ID NO: 3138861 - DNA, 13 bp, Homo sapiens
cacatcctgtgtc

SEQ ID NO: 3138862 - DNA, 13 bp, Homo sapiens
cacatctgcattt

SEQ ID NO: 3138863 - DNA, 13 bp, Homo sapiens
cacatctgcctta

SEQ ID NO: 3138864 - DNA, 12 bp, Homo sapiens
cacatcttccct

SEQ ID NO: 3138865 - DNA, 15 bp, Homo sapiens
cacatcttgctctgc

SEQ ID NO: 3138866 - DNA, 18 bp, Homo sapiens
cacatcttgctctgctga

SEQ ID NO: 3138867 - DNA, 20 bp, Homo sapiens
cacatcttgctctgctgaca

SEQ ID NO: 3138868 - DNA, 15 bp, Homo sapiens
cacatctttcctgtc

SEQ ID NO: 3138869 - DNA, 21 bp, Homo sapiens
cacatgaaacctacacactgt

SEQ ID NO: 3138870 - DNA, 15 bp, Homo sapiens
cacatgaggccatct

SEQ ID NO: 3138871 - DNA, 12 bp, Homo sapiens
cacatgatcatg

SEQ ID NO: 3138872 - DNA, 12 bp, Homo sapiens
cacatgcacaca

SEQ ID NO: 3138873 - DNA, 18 bp, Homo sapiens
cacatgcacgtgtgtgca

SEQ ID NO: 3138874 - DNA, 20 bp, Homo sapiens
cacatgccccccagattgct

SEQ ID NO: 3138875 - DNA, 13 bp, Homo sapiens
cacatgccctcct

SEQ ID NO: 3138876 - DNA, 17 bp, Homo sapiens
cacatgccctcctggac

SEQ ID NO: 3138877 - DNA, 13 bp, Homo sapiens
cacatgcgcactc

SEQ ID NO: 3138878 - DNA, 22 bp, Homo sapiens
cacatgctgagtctcccaaggc

SEQ ID NO: 3138879 - DNA, 13 bp, Homo sapiens
cacatgctggcca

SEQ ID NO: 3138880 - DNA, 15 bp, Homo sapiens
cacatgctggccagc

SEQ ID NO: 3138881 - DNA, 17 bp, Homo sapiens
cacatgctggccagcct

SEQ ID NO: 3138882 - DNA, 18 bp, Homo sapiens
cacatgctggccagcctg

SEQ ID NO: 3138883 - DNA, 21 bp, Homo sapiens
cacatggacccaagataaaag

SEQ ID NO: 3138884 - DNA, 17 bp, Homo sapiens
cacatggccccatccca

SEQ ID NO: 3138885 - DNA, 23 bp, Homo sapiens
cacatggcccctccccctgccag

SEQ ID NO: 3138886 - DNA, 21 bp, Homo sapiens
cacatgtacataaactgtcac

SEQ ID NO: 3138887 - DNA, 23 bp, Homo sapiens
cacatgtacataaactgtcactc

SEQ ID NO: 3138888 - DNA, 14 bp, Homo sapiens
cacatgtgcacatg

SEQ ID NO: 3138889 - DNA, 15 bp, Homo sapiens
cacatgtgcacatgc

SEQ ID NO: 3138890 - DNA, 19 bp, Homo sapiens
cacatgtgccacacagtga

SEQ ID NO: 3138891 - DNA, 19 bp, Homo sapiens
cacatgtggcaaaatatgg

SEQ ID NO: 3138892 - DNA, 12 bp, Homo sapiens
cacatgtgtggt

SEQ ID NO: 3138893 - DNA, 13 bp, Homo sapiens
cacattaaaaaat

SEQ ID NO: 3138894 - DNA, 22 bp, Homo sapiens
cacattaaaaaatgaaatattt

SEQ ID NO: 3138895 - DNA, 22 bp, Homo sapiens
cacattaagtaatcaataaaga

SEQ ID NO: 3138896 - DNA, 18 bp, Homo sapiens
cacattaattaattaaag

SEQ ID NO: 3138897 - DNA, 15 bp, Homo sapiens
cacattagaattagt

SEQ ID NO: 3138898 - DNA, 21 bp, Homo sapiens
cacattagattttattttact

SEQ ID NO: 3138899 - DNA, 20 bp, Homo sapiens
cacattatcgggagcagtgt

SEQ ID NO: 3138900 - DNA, 14 bp, Homo sapiens
cacattatttgcat

SEQ ID NO: 3138901 - DNA, 23 bp, Homo sapiens
cacattcagggctattttttccc

SEQ ID NO: 3138902 - DNA, 22 bp, Homo sapiens
cacattcttggcttaatcattt

SEQ ID NO: 3138903 - DNA, 14 bp, Homo sapiens
cacattgaatcatg

SEQ ID NO: 3138904 - DNA, 23 bp, Homo sapiens
cacattgtgtgaatactggaagc

SEQ ID NO: 3138905 - DNA, 18 bp, Homo sapiens
cacattgtttgctgctat

SEQ ID NO: 3138906 - DNA, 19 bp, Homo sapiens
cacatttcagggagaaact

SEQ ID NO: 3138907 - DNA, 17 bp, Homo sapiens
cacatttctgatcagag

SEQ ID NO: 3138908 - DNA, 21 bp, Homo sapiens
cacatttgctactgttgtaag

SEQ ID NO: 3138909 - DNA, 20 bp, Homo sapiens
cacatttgggatgttccttt

SEQ ID NO: 3138910 - DNA, 22 bp, Homo sapiens
cacatttggttctaagaaaccc

SEQ ID NO: 3138911 - DNA, 12 bp, Homo sapiens
cacatttgtaca

SEQ ID NO: 3138912 - DNA, 19 bp, Homo sapiens
cacatttgtcagtattttt

SEQ ID NO: 3138913 - DNA, 18 bp, Homo sapiens
caccaaaattatagcttt

SEQ ID NO: 3138914 - DNA, 16 bp, Homo sapiens
caccaaactgcacaca

SEQ ID NO: 3138915 - DNA, 14 bp, Homo sapiens
caccaaagatgcag

SEQ ID NO: 3138916 - DNA, 13 bp, Homo sapiens
caccaaagctgcc

SEQ ID NO: 3138917 - DNA, 13 bp, Homo sapiens
caccaaagttcta

SEQ ID NO: 3138918 - DNA, 22 bp, Homo sapiens
caccaaccacagcatcgggagc

SEQ ID NO: 3138919 - DNA, 14 bp, Homo sapiens
caccaaccagacag

SEQ ID NO: 3138920 - DNA, 14 bp, Homo sapiens
caccaagccaaggg

SEQ ID NO: 3138921 - DNA, 13 bp, Homo sapiens
caccaagcccagt

SEQ ID NO: 3138922 - DNA, 12 bp, Homo sapiens
caccaaggaaac

SEQ ID NO: 3138923 - DNA, 22 bp, Homo sapiens
caccaagttggaacatccttgg

SEQ ID NO: 3138924 - DNA, 24 bp, Homo sapiens
caccaattggttaatctttcctga

SEQ ID NO: 3138925 - DNA, 17 bp, Homo sapiens
caccacacccagcccac

SEQ ID NO: 3138926 - DNA, 18 bp, Homo sapiens
caccacactttcaaagac

SEQ ID NO: 3138927 - DNA, 14 bp, Homo sapiens
caccacagacacac

SEQ ID NO: 3138928 - DNA, 13 bp, Homo sapiens
caccacagccagc

SEQ ID NO: 3138929 - DNA, 19 bp, Homo sapiens
caccacagccagcacctgg

SEQ ID NO: 3138930 - DNA, 16 bp, Homo sapiens
caccaccccaacaaac

SEQ ID NO: 3138931 - DNA, 14 bp, Homo sapiens
caccaccccctcaa

SEQ ID NO: 3138932 - DNA, 20 bp, Homo sapiens
caccaccccctcaagcccca

SEQ ID NO: 3138933 - DNA, 23 bp, Homo sapiens
caccaccccctcaagccccagca

SEQ ID NO: 3138934 - DNA, 18 bp, Homo sapiens
caccaccctttgctgact

SEQ ID NO: 3138935 - DNA, 16 bp, Homo sapiens
caccacctcactcctg

SEQ ID NO: 3138936 - DNA, 13 bp, Homo sapiens
caccacctccctc

SEQ ID NO: 3138937 - DNA, 13 bp, Homo sapiens
caccacctctgtg

SEQ ID NO: 3138938 - DNA, 14 bp, Homo sapiens
caccacctctgtgg

SEQ ID NO: 3138939 - DNA, 20 bp, Homo sapiens
caccacggcgtttttttaca

SEQ ID NO: 3138940 - DNA, 15 bp, Homo sapiens
caccacgtccagctg

SEQ ID NO: 3138941 - DNA, 15 bp, Homo sapiens
caccacgtctgccag

SEQ ID NO: 3138942 - DNA, 20 bp, Homo sapiens
caccacgtctgccaggccca

SEQ ID NO: 3138943 - DNA, 20 bp, Homo sapiens
caccactaggactctgaggc

SEQ ID NO: 3138944 - DNA, 14 bp, Homo sapiens
caccactccactcc

SEQ ID NO: 3138945 - DNA, 14 bp, Homo sapiens
caccactccattcc

SEQ ID NO: 3138946 - DNA, 15 bp, Homo sapiens
caccactccattccc

SEQ ID NO: 3138947 - DNA, 16 bp, Homo sapiens
caccactccattccca

SEQ ID NO: 3138948 - DNA, 20 bp, Homo sapiens
caccactgcactccagcctg

SEQ ID NO: 3138949 - DNA, 16 bp, Homo sapiens
caccactgccctgcct

SEQ ID NO: 3138950 - DNA, 20 bp, Homo sapiens
caccactgccctgcctgccc

SEQ ID NO: 3138951 - DNA, 21 bp, Homo sapiens
caccactgccctgcctgccca

SEQ ID NO: 3138952 - DNA, 22 bp, Homo sapiens
caccactgccctgcctgcccac

SEQ ID NO: 3138953 - DNA, 18 bp, Homo sapiens
caccactggccaccaggc

SEQ ID NO: 3138954 - DNA, 21 bp, Homo sapiens
caccactggccaccaggctgg

SEQ ID NO: 3138955 - DNA, 16 bp, Homo sapiens
caccactgttgccttt

SEQ ID NO: 3138956 - DNA, 20 bp, Homo sapiens
caccacttcaggggatgggt

SEQ ID NO: 3138957 - DNA, 13 bp, Homo sapiens
caccagaagttac

SEQ ID NO: 3138958 - DNA, 11 bp, Homo sapiens
caccagagacc

SEQ ID NO: 3138959 - DNA, 20 bp, Homo sapiens
caccagagcaacctctcact

SEQ ID NO: 3138960 - DNA, 22 bp, Homo sapiens
caccagagcaacctctcactcc

SEQ ID NO: 3138961 - DNA, 20 bp, Homo sapiens
caccagagcagatgcagaga

SEQ ID NO: 3138962 - DNA, 13 bp, Homo sapiens
caccagaggccga

SEQ ID NO: 3138963 - DNA, 21 bp, Homo sapiens
caccagcatccaccttggctc

SEQ ID NO: 3138964 - DNA, 22 bp, Homo sapiens
caccagcatccaccttggctct

SEQ ID NO: 3138965 - DNA, 20 bp, Homo sapiens
caccagccccactgccagca

SEQ ID NO: 3138966 - DNA, 21 bp, Homo sapiens
caccagccccagtgcccacag

SEQ ID NO: 3138967 - DNA, 22 bp, Homo sapiens
caccagccccctggatgggcat

SEQ ID NO: 3138968 - DNA, 16 bp, Homo sapiens
caccagcccctgcccc

SEQ ID NO: 3138969 - DNA, 12 bp, Homo sapiens
caccagcccgca

SEQ ID NO: 3138970 - DNA, 22 bp, Homo sapiens
caccagcccgcaactctccagc

SEQ ID NO: 3138971 - DNA, 15 bp, Homo sapiens
caccagcccggcctg

SEQ ID NO: 3138972 - DNA, 16 bp, Homo sapiens
caccagcccggcctgc

SEQ ID NO: 3138973 - DNA, 12 bp, Homo sapiens
cacctcagggca

SEQ ID NO: 3138974 - DNA, 11 bp, Homo sapiens
cacctcagttc

SEQ ID NO: 3138975 - DNA, 22 bp, Homo sapiens
cacctcagttcccttggcctca

SEQ ID NO: 3138976 - DNA, 12 bp, Homo sapiens
cacctcatgccc

SEQ ID NO: 3138977 - DNA, 14 bp, Homo sapiens
cacctcatgcccac

SEQ ID NO: 3138978 - DNA, 20 bp, Homo sapiens
cacctcatgcccaccccctg

SEQ ID NO: 3138979 - DNA, 21 bp, Homo sapiens
cacctcatgcccaccccctgc

SEQ ID NO: 3138980 - DNA, 18 bp, Homo sapiens
cacctccacagttcagtg

SEQ ID NO: 3138981 - DNA, 20 bp, Homo sapiens
cacctccaccacatctgcca

SEQ ID NO: 3138982 - DNA, 11 bp, Homo sapiens
cacctccaccc

SEQ ID NO: 3138983 - DNA, 16 bp, Homo sapiens
cacctccacccagccc

SEQ ID NO: 3138984 - DNA, 19 bp, Homo sapiens
cacctccacccagcccctg

SEQ ID NO: 3138985 - DNA, 17 bp, Homo sapiens
cacctccacctgtgaga

SEQ ID NO: 3138986 - DNA, 16 bp, Homo sapiens
cacctccagcccggga

SEQ ID NO: 3138987 - DNA, 20 bp, Homo sapiens
cacctccagcccgggagcct

SEQ ID NO: 3138988 - DNA, 21 bp, Homo sapiens
cacctccagcccgggagccta

SEQ ID NO: 3138989 - DNA, 22 bp, Homo sapiens
cacctccagcccgggagcctag

SEQ ID NO: 3138990 - DNA, 13 bp, Homo sapiens
cacctccaggcct

SEQ ID NO: 3138991 - DNA, 11 bp, Homo sapiens
cacctcccagg

SEQ ID NO: 3138992 - DNA, 12 bp, Homo sapiens
cacctcccagga

SEQ ID NO: 3138993 - DNA, 9 bp, Homo sapiens
cacctcccc

SEQ ID NO: 3138994 - DNA, 19 bp, Homo sapiens
cacctccccacgccctccc

SEQ ID NO: 3138995 - DNA, 17 bp, Homo sapiens
cacctcccgaagccacc

SEQ ID NO: 3138996 - DNA, 12 bp, Homo sapiens
cacctccctccc

SEQ ID NO: 3138997 - DNA, 19 bp, Homo sapiens
cacctccctgaaccatccc

SEQ ID NO: 3138998 - DNA, 23 bp, Homo sapiens
cacctccctgcccaggccggcca

SEQ ID NO: 3138999 - DNA, 23 bp, Homo sapiens
cacctccctgctcagtgcttggg

SEQ ID NO: 3139000 - DNA, 21 bp, Homo sapiens
cacctccgagacagtccagtg

SEQ ID NO: 3139001 - DNA, 21 bp, Homo sapiens
cacctcctagaggtgggcagc

SEQ ID NO: 3139002 - DNA, 22 bp, Homo sapiens
cacctcctagaggtgggcagct

SEQ ID NO: 3139003 - DNA, 23 bp, Homo sapiens
cacctcctagaggtgggcagctg

SEQ ID NO: 3139004 - DNA, 17 bp, Homo sapiens
cacctcctctgtgattt

SEQ ID NO: 3139005 - DNA, 11 bp, Homo sapiens
cacctcctgcc

SEQ ID NO: 3139006 - DNA, 13 bp, Homo sapiens
cacctcctgcctc

SEQ ID NO: 3139007 - DNA, 14 bp, Homo sapiens
cacctcctgcctcg

SEQ ID NO: 3139008 - DNA, 22 bp, Homo sapiens
cacctccttgtcactttattac

SEQ ID NO: 3139009 - DNA, 14 bp, Homo sapiens
cacctcggagcatg

SEQ ID NO: 3139010 - DNA, 17 bp, Homo sapiens
cacctcggagcatggtg

SEQ ID NO: 3139011 - DNA, 15 bp, Homo sapiens
cacctcggggacacc

SEQ ID NO: 3139012 - DNA, 21 bp, Homo sapiens
cacctctacccaaaccctagg

SEQ ID NO: 3139013 - DNA, 18 bp, Homo sapiens
cacctctccaagtctctc

SEQ ID NO: 3139014 - DNA, 14 bp, Homo sapiens
cacctctccctcaa

SEQ ID NO: 3139015 - DNA, 23 bp, Homo sapiens
cacctctccctcaacaagggaga

SEQ ID NO: 3139016 - DNA, 12 bp, Homo sapiens
cacctctgcgga

SEQ ID NO: 3139017 - DNA, 22 bp, Homo sapiens
cacctctgcggaccccagctgt

SEQ ID NO: 3139018 - DNA, 17 bp, Homo sapiens
cacctctggactggcta

SEQ ID NO: 3139019 - DNA, 17 bp, Homo sapiens
cacctctggccctgtgt

SEQ ID NO: 3139020 - DNA, 12 bp, Homo sapiens
cacctctggtcc

SEQ ID NO: 3139021 - DNA, 20 bp, Homo sapiens
cacctctggtccacactaga

SEQ ID NO: 3139022 - DNA, 17 bp, Homo sapiens
cacctctgtgacctcag

SEQ ID NO: 3139023 - DNA, 18 bp, Homo sapiens
cacctctgtgacctcagg

SEQ ID NO: 3139024 - DNA, 20 bp, Homo sapiens
cacctctgtgacctcaggca

SEQ ID NO: 3139025 - DNA, 23 bp, Homo sapiens
cacctctgttaaggttgaacttt

SEQ ID NO: 3139026 - DNA, 18 bp, Homo sapiens
cacctcttatgcacacct

SEQ ID NO: 3139027 - DNA, 12 bp, Homo sapiens
cacctcttccga

SEQ ID NO: 3139028 - DNA, 17 bp, Homo sapiens
cacctgacaatggcagc

SEQ ID NO: 3139029 - DNA, 18 bp, Homo sapiens
cacctgacaatggcagct

SEQ ID NO: 3139030 - DNA, 20 bp, Homo sapiens
cacctgacacaccaggcgct

SEQ ID NO: 3139031 - DNA, 23 bp, Homo sapiens
cacctgacactaaccagagtcag

SEQ ID NO: 3139032 - DNA, 21 bp, Homo sapiens
cacctgagcccggatgcttct

SEQ ID NO: 3139033 - DNA, 15 bp, Homo sapiens
cacctgaggtgggcc

SEQ ID NO: 3139034 - DNA, 17 bp, Homo sapiens
cacctgaggtgggccca

SEQ ID NO: 3139035 - DNA, 20 bp, Homo sapiens
cacctgaggtgggcccagga

SEQ ID NO: 3139036 - DNA, 21 bp, Homo sapiens
cacctgaggtgggcccaggac

SEQ ID NO: 3139037 - DNA, 24 bp, Homo sapiens
cacctgaggtgggcccaggaccag

SEQ ID NO: 3139038 - DNA, 21 bp, Homo sapiens
cacctgaggtgggctggggct

SEQ ID NO: 3139039 - DNA, 20 bp, Homo sapiens
cacctgcaagccccagggcc

SEQ ID NO: 3139040 - DNA, 22 bp, Homo sapiens
cacctgcaagccccagggcctg

SEQ ID NO: 3139041 - DNA, 14 bp, Homo sapiens
cacctgcaatccca

SEQ ID NO: 3139042 - DNA, 16 bp, Homo sapiens
cacctgcaatcccagc

SEQ ID NO: 3139043 - DNA, 16 bp, Homo sapiens
cacctgcacccaggtg

SEQ ID NO: 3139044 - DNA, 21 bp, Homo sapiens
cacctgcactaacagagtggc

SEQ ID NO: 3139045 - DNA, 16 bp, Homo sapiens
cacctgcatctggggc

SEQ ID NO: 3139046 - DNA, 17 bp, Homo sapiens
cacctgcatctggggcc

SEQ ID NO: 3139047 - DNA, 16 bp, Homo sapiens
cacctgccaccacaca

SEQ ID NO: 3139048 - DNA, 15 bp, Homo sapiens
cacctgccagcctgg

SEQ ID NO: 3139049 - DNA, 18 bp, Homo sapiens
cacctgcccaacctgctc

SEQ ID NO: 3139050 - DNA, 18 bp, Homo sapiens
cacctgcccatcacaggg

SEQ ID NO: 3139051 - DNA, 15 bp, Homo sapiens
cacctgccccctggt

SEQ ID NO: 3139052 - DNA, 14 bp, Homo sapiens
cacctgccctgccc

SEQ ID NO: 3139053 - DNA, 17 bp, Homo sapiens
cacctgcctgccccaca

SEQ ID NO: 3139054 - DNA, 19 bp, Homo sapiens
cacctgcctgccccacacg

SEQ ID NO: 3139055 - DNA, 14 bp, Homo sapiens
cacctgctcttcta

SEQ ID NO: 3139056 - DNA, 16 bp, Homo sapiens
cacctgctgcgtcccc

SEQ ID NO: 3139057 - DNA, 22 bp, Homo sapiens
cacctgctgcgtccccactccc

SEQ ID NO: 3139058 - DNA, 22 bp, Homo sapiens
cacctggactgagccaaggagg

SEQ ID NO: 3139059 - DNA, 23 bp, Homo sapiens
cacctggactgagccaaggaggc

SEQ ID NO: 3139060 - DNA, 12 bp, Homo sapiens
cacctggccacc

SEQ ID NO: 3139061 - DNA, 20 bp, Homo sapiens
cacctggccacctgaggtgg

SEQ ID NO: 3139062 - DNA, 12 bp, Homo sapiens
cacctggcctgc

SEQ ID NO: 3139063 - DNA, 21 bp, Homo sapiens
cacctggctgaggttcctctg

SEQ ID NO: 3139064 - DNA, 22 bp, Homo sapiens
cacctgtactcaggaggctgag

SEQ ID NO: 3139065 - DNA, 18 bp, Homo sapiens
cacctgtagcacttactg

SEQ ID NO: 3139066 - DNA, 22 bp, Homo sapiens
cacctgtagcacttactggtag

SEQ ID NO: 3139067 - DNA, 15 bp, Homo sapiens
cacctgtagcagcca

SEQ ID NO: 3139068 - DNA, 17 bp, Homo sapiens
cacctgtagccatctgc

SEQ ID NO: 3139069 - DNA, 16 bp, Homo sapiens
cacctgtagtcccagc

SEQ ID NO: 3139070 - DNA, 21 bp, Homo sapiens
cacctgtccccaccctccact

SEQ ID NO: 3139071 - DNA, 22 bp, Homo sapiens
cacctgtccccaccctccactc

SEQ ID NO: 3139072 - DNA, 20 bp, Homo sapiens
cacctgtgggtgtagccagg

SEQ ID NO: 3139073 - DNA, 23 bp, Homo sapiens
cacctgttaaggtggaaaatgga

SEQ ID NO: 3139074 - DNA, 23 bp, Homo sapiens
cacctgttcacagaaaaagcatg

SEQ ID NO: 3139075 - DNA, 22 bp, Homo sapiens
cacctgttggctacacagaccc

SEQ ID NO: 3139076 - DNA, 19 bp, Homo sapiens
cacctgtttttaagctgtt

SEQ ID NO: 3139077 - DNA, 18 bp, Homo sapiens
caccttcaattcctgggc

SEQ ID NO: 3139078 - DNA, 16 bp, Homo sapiens
caccttcattttgagg

SEQ ID NO: 3139079 - DNA, 15 bp, Homo sapiens
caccttccaaacaaa

SEQ ID NO: 3139080 - DNA, 16 bp, Homo sapiens
caccttccagctcctg

SEQ ID NO: 3139081 - DNA, 18 bp, Homo sapiens
caccttccagctcctgta

SEQ ID NO: 3139082 - DNA, 13 bp, Homo sapiens
caccttcctcact

SEQ ID NO: 3139083 - DNA, 15 bp, Homo sapiens
caccttcctcctgca

SEQ ID NO: 3139084 - DNA, 20 bp, Homo sapiens
caccttctgtccccagccct

SEQ ID NO: 3139085 - DNA, 18 bp, Homo sapiens
caccttctttctggactg

SEQ ID NO: 3139086 - DNA, 13 bp, Homo sapiens
caccttgacaggg

SEQ ID NO: 3139087 - DNA, 19 bp, Homo sapiens
caccttgacagggcacacc

SEQ ID NO: 3139088 - DNA, 21 bp, Homo sapiens
caccttgctaacctaaaagac

SEQ ID NO: 3139089 - DNA, 14 bp, Homo sapiens
caccttggctcaag

SEQ ID NO: 3139090 - DNA, 16 bp, Homo sapiens
caccttggctctgcca

SEQ ID NO: 3139091 - DNA, 21 bp, Homo sapiens
caccttgtaaccagtgcagaa

SEQ ID NO: 3139092 - DNA, 22 bp, Homo sapiens
cacctttactgtgcttattttt

SEQ ID NO: 3139093 - DNA, 12 bp, Homo sapiens
cacctttcaacc

SEQ ID NO: 3139094 - DNA, 14 bp, Homo sapiens
cacctttgccacaa

SEQ ID NO: 3139095 - DNA, 20 bp, Homo sapiens
cacctttgtaagacatttgt

SEQ ID NO: 3139096 - DNA, 23 bp, Homo sapiens
cacctttgtggggtttttggaga

SEQ ID NO: 3139097 - DNA, 18 bp, Homo sapiens
caccttttaactcacctc

SEQ ID NO: 3139098 - DNA, 21 bp, Homo sapiens
cactgacccttccagacatac

SEQ ID NO: 3139099 - DNA, 22 bp, Homo sapiens
cactgacctgtcatgcccccct

SEQ ID NO: 3139100 - DNA, 23 bp, Homo sapiens
cactgacctgtcatgcccccctc

SEQ ID NO: 3139101 - DNA, 22 bp, Homo sapiens
cactgaccttggagagacacag

SEQ ID NO: 3139102 - DNA, 19 bp, Homo sapiens
cactgactactggctctca

SEQ ID NO: 3139103 - DNA, 14 bp, Homo sapiens
cactgactcctgtg

SEQ ID NO: 3139104 - DNA, 17 bp, Homo sapiens
cactgagaagattgtga

SEQ ID NO: 3139105 - DNA, 19 bp, Homo sapiens
cactgagaagattgtgaat

SEQ ID NO: 3139106 - DNA, 14 bp, Homo sapiens
cactgagagcgaga

SEQ ID NO: 3139107 - DNA, 13 bp, Homo sapiens
cactgagcctggc

SEQ ID NO: 3139108 - DNA, 15 bp, Homo sapiens
cactgagcctggccc

SEQ ID NO: 3139109 - DNA, 19 bp, Homo sapiens
cactgagctccccagatct

SEQ ID NO: 3139110 - DNA, 14 bp, Homo sapiens
cactgagggccaca

SEQ ID NO: 3139111 - DNA, 17 bp, Homo sapiens
cactgagtaccaggggc

SEQ ID NO: 3139112 - DNA, 15 bp, Homo sapiens
cactgagttctatca

SEQ ID NO: 3139113 - DNA, 21 bp, Homo sapiens
cactgagttgggcaaaaccca

SEQ ID NO: 3139114 - DNA, 18 bp, Homo sapiens
cactgataaaagttttga

SEQ ID NO: 3139115 - DNA, 13 bp, Homo sapiens
cactgatcaccca

SEQ ID NO: 3139116 - DNA, 24 bp, Homo sapiens
cactgatctctactaccacaagga

SEQ ID NO: 3139117 - DNA, 24 bp, Homo sapiens
cactgatgggcaacccccagcctg

SEQ ID NO: 3139118 - DNA, 16 bp, Homo sapiens
cactgcaaataaagcc

SEQ ID NO: 3139119 - DNA, 17 bp, Homo sapiens
cactgcaaataaagcct

SEQ ID NO: 3139120 - DNA, 19 bp, Homo sapiens
cactgcaaataaagccttt

SEQ ID NO: 3139121 - DNA, 14 bp, Homo sapiens
cactgcaacctccg

SEQ ID NO: 3139122 - DNA, 23 bp, Homo sapiens
cactgcaacctccgcctcttggg

SEQ ID NO: 3139123 - DNA, 14 bp, Homo sapiens
cactgcaacctctg

SEQ ID NO: 3139124 - DNA, 19 bp, Homo sapiens
cactgcacagagctctcca

SEQ ID NO: 3139125 - DNA, 21 bp, Homo sapiens
cactgcacagagctctccagc

SEQ ID NO: 3139126 - DNA, 18 bp, Homo sapiens
cactgcacagtgcatctc

SEQ ID NO: 3139127 - DNA, 15 bp, Homo sapiens
cactgcaccgggcca

SEQ ID NO: 3139128 - DNA, 18 bp, Homo sapiens
cactgcaccgggccacag

SEQ ID NO: 3139129 - DNA, 17 bp, Homo sapiens
cactgcactcaacctta

SEQ ID NO: 3139130 - DNA, 20 bp, Homo sapiens
cactgcactccagcctgggc

SEQ ID NO: 3139131 - DNA, 17 bp, Homo sapiens
cactgcagcagaaaggc

SEQ ID NO: 3139132 - DNA, 15 bp, Homo sapiens
cactgcagcccagga

SEQ ID NO: 3139133 - DNA, 13 bp, Homo sapiens
cactgcagcctca

SEQ ID NO: 3139134 - DNA, 20 bp, Homo sapiens
cactgcagcctcaacctcct

SEQ ID NO: 3139135 - DNA, 23 bp, Homo sapiens
cactgcagcctcaacctcctggg

SEQ ID NO: 3139136 - DNA, 18 bp, Homo sapiens
cactgcagtcttatttcc

SEQ ID NO: 3139137 - DNA, 18 bp, Homo sapiens
cactgcatgagcttttat

SEQ ID NO: 3139138 - DNA, 16 bp, Homo sapiens
cactgccaaataaaca

SEQ ID NO: 3139139 - DNA, 18 bp, Homo sapiens
cactgccaaataaacagc

SEQ ID NO: 3139140 - DNA, 20 bp, Homo sapiens
cactgccaaataaacagcta

SEQ ID NO: 3139141 - DNA, 12 bp, Homo sapiens
cactgccactgg

SEQ ID NO: 3139142 - DNA, 19 bp, Homo sapiens
cactgccactttgcacatt

SEQ ID NO: 3139143 - DNA, 19 bp, Homo sapiens
cactgccagcagcagcagg

SEQ ID NO: 3139144 - DNA, 20 bp, Homo sapiens
cactgccagcagcagcaggt

SEQ ID NO: 3139145 - DNA, 11 bp, Homo sapiens
cactgccaggc

SEQ ID NO: 3139146 - DNA, 16 bp, Homo sapiens
cactgccaggcacctg

SEQ ID NO: 3139147 - DNA, 17 bp, Homo sapiens
cactgccaggcacctgg

SEQ ID NO: 3139148 - DNA, 19 bp, Homo sapiens
cactgccaggcacctggcc

SEQ ID NO: 3139149 - DNA, 18 bp, Homo sapiens
cactgccaggccagcctc

SEQ ID NO: 3139150 - DNA, 20 bp, Homo sapiens
cactgccaggccagcctccg

SEQ ID NO: 3139151 - DNA, 21 bp, Homo sapiens
cactgccaggccagcctccga

SEQ ID NO: 3139152 - DNA, 17 bp, Homo sapiens
cactgccatctgatgcc

SEQ ID NO: 3139153 - DNA, 21 bp, Homo sapiens
cactgccatgatagctggggc

SEQ ID NO: 3139154 - DNA, 15 bp, Homo sapiens
cactgcccaccccct

SEQ ID NO: 3139155 - DNA, 17 bp, Homo sapiens
cactgcccaccccctca

SEQ ID NO: 3139156 - DNA, 20 bp, Homo sapiens
cactgccccccgaggctgct

SEQ ID NO: 3139157 - DNA, 16 bp, Homo sapiens
cactgcccgagctggt

SEQ ID NO: 3139158 - DNA, 21 bp, Homo sapiens
cactgcccgagctggtgcatt

SEQ ID NO: 3139159 - DNA, 15 bp, Homo sapiens
cactgcccgcacacc

SEQ ID NO: 3139160 - DNA, 19 bp, Homo sapiens
cactgcccgcacaccctca

SEQ ID NO: 3139161 - DNA, 18 bp, Homo sapiens
cactgccctgcctgccca

SEQ ID NO: 3139162 - DNA, 20 bp, Homo sapiens
cactgccctgcctgcccact

SEQ ID NO: 3139163 - DNA, 13 bp, Homo sapiens
cactgccctggca

SEQ ID NO: 3139164 - DNA, 19 bp, Homo sapiens
cactgccctggcagcagca

SEQ ID NO: 3139165 - DNA, 17 bp, Homo sapiens
cactgcctcaggttcct

SEQ ID NO: 3139166 - DNA, 15 bp, Homo sapiens
cactgcctctggaat

SEQ ID NO: 3139167 - DNA, 15 bp, Homo sapiens
cactgcctgtatact

SEQ ID NO: 3139168 - DNA, 18 bp, Homo sapiens
cactgccttcgcttcttg

SEQ ID NO: 3139169 - DNA, 21 bp, Homo sapiens
cactgccttcgcttcttgcct

SEQ ID NO: 3139170 - DNA, 22 bp, Homo sapiens
cactgccttctcctctctgggc

SEQ ID NO: 3139171 - DNA, 23 bp, Homo sapiens
cactgccttctcctctctgggcc

SEQ ID NO: 3139172 - DNA, 22 bp, Homo sapiens
cactgcgaagaccctcttgccc

SEQ ID NO: 3139173 - DNA, 16 bp, Homo sapiens
cactgcggctgtctcc

SEQ ID NO: 3139174 - DNA, 22 bp, Homo sapiens
cactgcggctgtctccttgaag

SEQ ID NO: 3139175 - DNA, 18 bp, Homo sapiens
cactgcgggagctctgta

SEQ ID NO: 3139176 - DNA, 14 bp, Homo sapiens
cactgctccctgaa

SEQ ID NO: 3139177 - DNA, 21 bp, Homo sapiens
cactgctccctgaagccagcc

SEQ ID NO: 3139178 - DNA, 15 bp, Homo sapiens
cactgctctaacagc

SEQ ID NO: 3139179 - DNA, 18 bp, Homo sapiens
cactgctgatcgtagaaa

SEQ ID NO: 3139180 - DNA, 15 bp, Homo sapiens
cactgctgcaccaga

SEQ ID NO: 3139181 - DNA, 13 bp, Homo sapiens
cactgctgcagta

SEQ ID NO: 3139182 - DNA, 15 bp, Homo sapiens
cactgctgcccagcc

SEQ ID NO: 3139183 - DNA, 17 bp, Homo sapiens
cactgctgtacccagat

SEQ ID NO: 3139184 - DNA, 18 bp, Homo sapiens
cactgctgtacccagatg

SEQ ID NO: 3139185 - DNA, 20 bp, Homo sapiens
cactgcttgaactaggctga

SEQ ID NO: 3139186 - DNA, 18 bp, Homo sapiens
cactgcttgatgaagcaa

SEQ ID NO: 3139187 - DNA, 19 bp, Homo sapiens
cactgcttgatgaagcaag

SEQ ID NO: 3139188 - DNA, 21 bp, Homo sapiens
cactgcttttggtctgtgtga

SEQ ID NO: 3139189 - DNA, 12 bp, Homo sapiens
cactggaaaggg

SEQ ID NO: 3139190 - DNA, 15 bp, Homo sapiens
cactggaaaggggag

SEQ ID NO: 3139191 - DNA, 16 bp, Homo sapiens
cactggaaaggggaga

SEQ ID NO: 3139192 - DNA, 18 bp, Homo sapiens
cactggaaaggggagagc

SEQ ID NO: 3139193 - DNA, 19 bp, Homo sapiens
cactggaaaggggagagcc

SEQ ID NO: 3139194 - DNA, 22 bp, Homo sapiens
cactggaaaggggagagcctgc

SEQ ID NO: 3139195 - DNA, 17 bp, Homo sapiens
cactggacagacccagg

SEQ ID NO: 3139196 - DNA, 18 bp, Homo sapiens
cactggacagacccaggt

SEQ ID NO: 3139197 - DNA, 12 bp, Homo sapiens
cactggagcatg

SEQ ID NO: 3139198 - DNA, 16 bp, Homo sapiens
cactggagcatgcaga

SEQ ID NO: 3139199 - DNA, 12 bp, Homo sapiens
cactggagccca

SEQ ID NO: 3139200 - DNA, 18 bp, Homo sapiens
cactggaggagcagcttc

SEQ ID NO: 3139201 - DNA, 21 bp, Homo sapiens
cactggaggttgaagccaagt

SEQ ID NO: 3139202 - DNA, 16 bp, Homo sapiens
cactggagtgcaggga

SEQ ID NO: 3139203 - DNA, 17 bp, Homo sapiens
cactggagtgcagggag

SEQ ID NO: 3139204 - DNA, 23 bp, Homo sapiens
cactggatgcaaagaaaatcaga

SEQ ID NO: 3139205 - DNA, 14 bp, Homo sapiens
cactggcattgtcc

SEQ ID NO: 3139206 - DNA, 18 bp, Homo sapiens
cactggcattgtccctgt

SEQ ID NO: 3139207 - DNA, 14 bp, Homo sapiens
cactggccaccagg

SEQ ID NO: 3139208 - DNA, 22 bp, Homo sapiens
cactggccaccaggctggcgca

SEQ ID NO: 3139209 - DNA, 17 bp, Homo sapiens
cactggccagagagggc

SEQ ID NO: 3139210 - DNA, 23 bp, Homo sapiens
cactggcgtagaagtttttgtac

SEQ ID NO: 3139211 - DNA, 18 bp, Homo sapiens
cactggctccatgattct

SEQ ID NO: 3139212 - DNA, 11 bp, Homo sapiens
cactggctctc

SEQ ID NO: 3139213 - DNA, 15 bp, Homo sapiens
cactggctctccaag

SEQ ID NO: 3139214 - DNA, 22 bp, Homo sapiens
cactggctctccaagtgccaga

SEQ ID NO: 3139215 - DNA, 15 bp, Homo sapiens
cactggctctctcca

SEQ ID NO: 3139216 - DNA, 13 bp, Homo sapiens
cactggctctggg

SEQ ID NO: 3139217 - DNA, 19 bp, Homo sapiens
cactggctggctcctaggg

SEQ ID NO: 3139218 - DNA, 14 bp, Homo sapiens
cactggctggggca

SEQ ID NO: 3139219 - DNA, 16 bp, Homo sapiens
cactggctggggcaga

SEQ ID NO: 3139220 - DNA, 20 bp, Homo sapiens
cactggctggggcagagggg

SEQ ID NO: 3139221 - DNA, 23 bp, Homo sapiens
cactggctggggcagaggggcag

SEQ ID NO: 3139222 - DNA, 15 bp, Homo sapiens
cactggcttccatca

SEQ ID NO: 3139223 - DNA, 14 bp, Homo sapiens
cagaagcatttgta

SEQ ID NO: 3139224 - DNA, 19 bp, Homo sapiens
cagaagcatttgtattttg

SEQ ID NO: 3139225 - DNA, 21 bp, Homo sapiens
cagaagcatttgtattttgtg

SEQ ID NO: 3139226 - DNA, 22 bp, Homo sapiens
cagaagcctccaagcctgcctc

SEQ ID NO: 3139227 - DNA, 13 bp, Homo sapiens
cagaagcctctgg

SEQ ID NO: 3139228 - DNA, 15 bp, Homo sapiens
cagaagcctgtttca

SEQ ID NO: 3139229 - DNA, 18 bp, Homo sapiens
cagaaggattttttaaag

SEQ ID NO: 3139230 - DNA, 15 bp, Homo sapiens
cagaagggaattgct

SEQ ID NO: 3139231 - DNA, 19 bp, Homo sapiens
cagaagggtagctgggcgg

SEQ ID NO: 3139232 - DNA, 15 bp, Homo sapiens
cagaaggtattcctt

SEQ ID NO: 3139233 - DNA, 14 bp, Homo sapiens
cagaagtcatcttg

SEQ ID NO: 3139234 - DNA, 17 bp, Homo sapiens
cagaagtcatcttgcta

SEQ ID NO: 3139235 - DNA, 20 bp, Homo sapiens
cagaagtcatcttgctacca

SEQ ID NO: 3139236 - DNA, 14 bp, Homo sapiens
cagaagtctcctca

SEQ ID NO: 3139237 - DNA, 15 bp, Homo sapiens
cagaagtctcctcaa

SEQ ID NO: 3139238 - DNA, 13 bp, Homo sapiens
cagaagtgaaaat

SEQ ID NO: 3139239 - DNA, 19 bp, Homo sapiens
cagaagtttctcagctccc

SEQ ID NO: 3139240 - DNA, 16 bp, Homo sapiens
cagaagtttggcaata

SEQ ID NO: 3139241 - DNA, 19 bp, Homo sapiens
cagaagttttaacttccag

SEQ ID NO: 3139242 - DNA, 14 bp, Homo sapiens
cagaataaagcagc

SEQ ID NO: 3139243 - DNA, 20 bp, Homo sapiens
cagaataaagcagcctgatt

SEQ ID NO: 3139244 - DNA, 18 bp, Homo sapiens
cagaataaggcaggcatt

SEQ ID NO: 3139245 - DNA, 20 bp, Homo sapiens
cagaataaggcaggcattga

SEQ ID NO: 3139246 - DNA, 14 bp, Homo sapiens
cagaataatccagt

SEQ ID NO: 3139247 - DNA, 23 bp, Homo sapiens
cagaataatggaaacattacagt

SEQ ID NO: 3139248 - DNA, 17 bp, Homo sapiens
cagaatatttctattga

SEQ ID NO: 3139249 - DNA, 19 bp, Homo sapiens
cagaatccataaatgtgtt

SEQ ID NO: 3139250 - DNA, 20 bp, Homo sapiens
cagaatccataaatgtgttc

SEQ ID NO: 3139251 - DNA, 13 bp, Homo sapiens
cagaatcccagcc

SEQ ID NO: 3139252 - DNA, 14 bp, Homo sapiens
cagaatcccagccg

SEQ ID NO: 3139253 - DNA, 14 bp, Homo sapiens
cagaatcctcagtt

SEQ ID NO: 3139254 - DNA, 22 bp, Homo sapiens
cagaatctaaacgtggtcacct

SEQ ID NO: 3139255 - DNA, 14 bp, Homo sapiens
cagaatctgaatgt

SEQ ID NO: 3139256 - DNA, 15 bp, Homo sapiens
cagaatctgaatgta

SEQ ID NO: 3139257 - DNA, 18 bp, Homo sapiens
cagaatctgaatgtaatt

SEQ ID NO: 3139258 - DNA, 20 bp, Homo sapiens
cagaatctgctgttgccata

SEQ ID NO: 3139259 - DNA, 23 bp, Homo sapiens
cagaatctgctgttgccatagcc

SEQ ID NO: 3139260 - DNA, 22 bp, Homo sapiens
cagaatctgttgagttgctgcc

SEQ ID NO: 3139261 - DNA, 13 bp, Homo sapiens
cagaatcttgttt

SEQ ID NO: 3139262 - DNA, 21 bp, Homo sapiens
cagaatgctgtacatctattt

SEQ ID NO: 3139263 - DNA, 20 bp, Homo sapiens
cagaatggctatcaaaagaa

SEQ ID NO: 3139264 - DNA, 22 bp, Homo sapiens
cagaatggctatcaaaagaaat

SEQ ID NO: 3139265 - DNA, 12 bp, Homo sapiens
cagaatgtcaga

SEQ ID NO: 3139266 - DNA, 14 bp, Homo sapiens
cagaattaaacttt

SEQ ID NO: 3139267 - DNA, 13 bp, Homo sapiens
cagaattattttt

SEQ ID NO: 3139268 - DNA, 21 bp, Homo sapiens
cagaattatttttaaaaagaa

SEQ ID NO: 3139269 - DNA, 15 bp, Homo sapiens
cagaattccttttct

SEQ ID NO: 3139270 - DNA, 14 bp, Homo sapiens
cagaattgtcctca

SEQ ID NO: 3139271 - DNA, 16 bp, Homo sapiens
cagaatttggaaatcc

SEQ ID NO: 3139272 - DNA, 13 bp, Homo sapiens
cagaattttaatg

SEQ ID NO: 3139273 - DNA, 23 bp, Homo sapiens
cagaattttaggaacttcagaga

SEQ ID NO: 3139274 - DNA, 12 bp, Homo sapiens
cagaatttttcc

SEQ ID NO: 3139275 - DNA, 16 bp, Homo sapiens
cagacaacaccttcct

SEQ ID NO: 3139276 - DNA, 17 bp, Homo sapiens
cagacaacaccttcctc

SEQ ID NO: 3139277 - DNA, 19 bp, Homo sapiens
cagacaagcaacaggtttt

SEQ ID NO: 3139278 - DNA, 13 bp, Homo sapiens
cagacaagcacta

SEQ ID NO: 3139279 - DNA, 15 bp, Homo sapiens
cagacaagcactatt

SEQ ID NO: 3139280 - DNA, 14 bp, Homo sapiens
cagacaagcagccc

SEQ ID NO: 3139281 - DNA, 17 bp, Homo sapiens
cagacaaggaaataccc

SEQ ID NO: 3139282 - DNA, 17 bp, Homo sapiens
cagacaatatgtgagtg

SEQ ID NO: 3139283 - DNA, 22 bp, Homo sapiens
cagacaatatgtgagtgccttt

SEQ ID NO: 3139284 - DNA, 15 bp, Homo sapiens
cagacaattccattc

SEQ ID NO: 3139285 - DNA, 17 bp, Homo sapiens
cagacacaatatgtatg

SEQ ID NO: 3139286 - DNA, 18 bp, Homo sapiens
cagacacaatatgtatgc

SEQ ID NO: 3139287 - DNA, 19 bp, Homo sapiens
cagacacaatatgtatgct

SEQ ID NO: 3139288 - DNA, 13 bp, Homo sapiens
cagacacacacac

SEQ ID NO: 3139289 - DNA, 14 bp, Homo sapiens
cagacacacacacg

SEQ ID NO: 3139290 - DNA, 21 bp, Homo sapiens
cagacacagactggcaataaa

SEQ ID NO: 3139291 - DNA, 13 bp, Homo sapiens
cagacacaggccc

SEQ ID NO: 3139292 - DNA, 14 bp, Homo sapiens
cagacacaggcccg

SEQ ID NO: 3139293 - DNA, 18 bp, Homo sapiens
cagacacaggcccggctc

SEQ ID NO: 3139294 - DNA, 23 bp, Homo sapiens
cagacacaggcccggctccaggc

SEQ ID NO: 3139295 - DNA, 15 bp, Homo sapiens
cagacaccctcaacc

SEQ ID NO: 3139296 - DNA, 19 bp, Homo sapiens
cagacaccttgacagggca

SEQ ID NO: 3139297 - DNA, 20 bp, Homo sapiens
cagacacgctcgcgggcagc

SEQ ID NO: 3139298 - DNA, 17 bp, Homo sapiens
cagacactaaatgcaga

SEQ ID NO: 3139299 - DNA, 19 bp, Homo sapiens
cagacactaaatgcagaca

SEQ ID NO: 3139300 - DNA, 22 bp, Homo sapiens
cagacactgccgacatcagcat

SEQ ID NO: 3139301 - DNA, 16 bp, Homo sapiens
cagacacttatttatt

SEQ ID NO: 3139302 - DNA, 14 bp, Homo sapiens
cagacactttggaa

SEQ ID NO: 3139303 - DNA, 15 bp, Homo sapiens
cagacagaacttgaa

SEQ ID NO: 3139304 - DNA, 20 bp, Homo sapiens
cagacagaacttgaatgtgt

SEQ ID NO: 3139305 - DNA, 23 bp, Homo sapiens
cagacagaagtcactcaattgtt

SEQ ID NO: 3139306 - DNA, 17 bp, Homo sapiens
cagacagaagtctcctc

SEQ ID NO: 3139307 - DNA, 20 bp, Homo sapiens
cagacagatgtcagcttccc

SEQ ID NO: 3139308 - DNA, 13 bp, Homo sapiens
cagacagcaagga

SEQ ID NO: 3139309 - DNA, 18 bp, Homo sapiens
cagacagcacagggcagg

SEQ ID NO: 3139310 - DNA, 15 bp, Homo sapiens
cagacagcaggcagc

SEQ ID NO: 3139311 - DNA, 12 bp, Homo sapiens
cagacaggagga

SEQ ID NO: 3139312 - DNA, 11 bp, Homo sapiens
cagacaggcaa

SEQ ID NO: 3139313 - DNA, 13 bp, Homo sapiens
cagacaggcaagc

SEQ ID NO: 3139314 - DNA, 14 bp, Homo sapiens
cagacaggctctta

SEQ ID NO: 3139315 - DNA, 18 bp, Homo sapiens
cagacaggctcttagcag

SEQ ID NO: 3139316 - DNA, 12 bp, Homo sapiens
cagacataaagc

SEQ ID NO: 3139317 - DNA, 17 bp, Homo sapiens
cagacatacgaaacaca

SEQ ID NO: 3139318 - DNA, 23 bp, Homo sapiens
cagacatccatgtttgtaaaact

SEQ ID NO: 3139319 - DNA, 22 bp, Homo sapiens
cagacatgttttccgtgaaaac

SEQ ID NO: 3139320 - DNA, 16 bp, Homo sapiens
cagacattatgtaaaa

SEQ ID NO: 3139321 - DNA, 20 bp, Homo sapiens
cagaccacatctttatctgt

SEQ ID NO: 3139322 - DNA, 19 bp, Homo sapiens
cagaccaccagccgcccca

SEQ ID NO: 3139323 - DNA, 22 bp, Homo sapiens
cagaccacgcccgtcctgcctg

SEQ ID NO: 3139324 - DNA, 16 bp, Homo sapiens
cagaccagagctgtct

SEQ ID NO: 3139325 - DNA, 16 bp, Homo sapiens
cagaccataatgttac

SEQ ID NO: 3139326 - DNA, 13 bp, Homo sapiens
cagacccaggtct

SEQ ID NO: 3139327 - DNA, 16 bp, Homo sapiens
cagacccaggtcttcc

SEQ ID NO: 3139328 - DNA, 16 bp, Homo sapiens
cagaccccaggtcagc

SEQ ID NO: 3139329 - DNA, 21 bp, Homo sapiens
cagacccctctggccaggatg

SEQ ID NO: 3139330 - DNA, 14 bp, Homo sapiens
cagacccctgcctg

SEQ ID NO: 3139331 - DNA, 19 bp, Homo sapiens
cagacccctgcctggactt

SEQ ID NO: 3139332 - DNA, 14 bp, Homo sapiens
cagacccctggctt

SEQ ID NO: 3139333 - DNA, 18 bp, Homo sapiens
cagacccctggcttttca

SEQ ID NO: 3139334 - DNA, 23 bp, Homo sapiens
cagacccctggcttttcactgct

SEQ ID NO: 3139335 - DNA, 12 bp, Homo sapiens
cagacccctggg

SEQ ID NO: 3139336 - DNA, 17 bp, Homo sapiens
cagacccctgggagctt

SEQ ID NO: 3139337 - DNA, 12 bp, Homo sapiens
cagacccggctg

SEQ ID NO: 3139338 - DNA, 22 bp, Homo sapiens
cagacctaggatttcatgattt

SEQ ID NO: 3139339 - DNA, 14 bp, Homo sapiens
cagacctccccagc

SEQ ID NO: 3139340 - DNA, 23 bp, Homo sapiens
cagacctccccagcccctagccc

SEQ ID NO: 3139341 - DNA, 19 bp, Homo sapiens
cagacctgcttcctgaaat

SEQ ID NO: 3139342 - DNA, 22 bp, Homo sapiens
cagacctgcttcctgaaataaa

SEQ ID NO: 3139343 - DNA, 23 bp, Homo sapiens
cagacctgcttcctgaaataaac

SEQ ID NO: 3139344 - DNA, 20 bp, Homo sapiens
cagacctggagcccctgggt

SEQ ID NO: 3139345 - DNA, 14 bp, Homo sapiens
cagacctgtcttcc

SEQ ID NO: 3139346 - DNA, 16 bp, Homo sapiens
cagacctgtcttccaa

SEQ ID NO: 3139347 - DNA, 23 bp, Homo sapiens
cagacctgtcttccaaggagacc

SEQ ID NO: 3139348 - DNA, 15 bp, Homo sapiens
cagacgccttactgg

SEQ ID NO: 3139349 - DNA, 13 bp, Homo sapiens
cagatttaataca

SEQ ID NO: 3139350 - DNA, 20 bp, Homo sapiens
cagatttgctaatttatcct

SEQ ID NO: 3139351 - DNA, 22 bp, Homo sapiens
cagatttggggtataggtctca

SEQ ID NO: 3139352 - DNA, 14 bp, Homo sapiens
cagatttgtctttt

SEQ ID NO: 3139353 - DNA, 16 bp, Homo sapiens
cagattttacaaaaga

SEQ ID NO: 3139354 - DNA, 18 bp, Homo sapiens
cagattttacaaaagatg

SEQ ID NO: 3139355 - DNA, 13 bp, Homo sapiens
cagattttcagca

SEQ ID NO: 3139356 - DNA, 15 bp, Homo sapiens
cagattttcagcaaa

SEQ ID NO: 3139357 - DNA, 19 bp, Homo sapiens
cagattttgctgtatattt

SEQ ID NO: 3139358 - DNA, 20 bp, Homo sapiens
cagattttggggttgtgttg

SEQ ID NO: 3139359 - DNA, 17 bp, Homo sapiens
cagatttttaaagtttt

SEQ ID NO: 3139360 - DNA, 14 bp, Homo sapiens
cagatttttacaaa

SEQ ID NO: 3139361 - DNA, 22 bp, Homo sapiens
cagattttttacagctgcctgc

SEQ ID NO: 3139362 - DNA, 15 bp, Homo sapiens
cagcaaaaatataaa

SEQ ID NO: 3139363 - DNA, 14 bp, Homo sapiens
cagcaaacaggtgc

SEQ ID NO: 3139364 - DNA, 24 bp, Homo sapiens
cagcaaaccatttttaaagtagaa

SEQ ID NO: 3139365 - DNA, 20 bp, Homo sapiens
cagcaaactcttttcccact

SEQ ID NO: 3139366 - DNA, 20 bp, Homo sapiens
cagcaaagaggactcgcttg

SEQ ID NO: 3139367 - DNA, 14 bp, Homo sapiens
cagcaacacaatgt

SEQ ID NO: 3139368 - DNA, 18 bp, Homo sapiens
cagcaacagcaagaaata

SEQ ID NO: 3139369 - DNA, 17 bp, Homo sapiens
cagcaacgcttgtagaa

SEQ ID NO: 3139370 - DNA, 18 bp, Homo sapiens
cagcaacttgtctttttc

SEQ ID NO: 3139371 - DNA, 19 bp, Homo sapiens
cagcaacttgtctttttct

SEQ ID NO: 3139372 - DNA, 14 bp, Homo sapiens
cagcaagaataaaa

SEQ ID NO: 3139373 - DNA, 15 bp, Homo sapiens
cagcaagaatattgt

SEQ ID NO: 3139374 - DNA, 23 bp, Homo sapiens
cagcaagacctcatctgtggagc

SEQ ID NO: 3139375 - DNA, 23 bp, Homo sapiens
cagcaagagggaacaaaactgtt

SEQ ID NO: 3139376 - DNA, 12 bp, Homo sapiens
cagcaaggcagg

SEQ ID NO: 3139377 - DNA, 14 bp, Homo sapiens
cagcaaggcaggtt

SEQ ID NO: 3139378 - DNA, 16 bp, Homo sapiens
cagcaaggccctgctg

SEQ ID NO: 3139379 - DNA, 12 bp, Homo sapiens
cagcaagtgaga

SEQ ID NO: 3139380 - DNA, 17 bp, Homo sapiens
cagcaagtgagagctgg

SEQ ID NO: 3139381 - DNA, 20 bp, Homo sapiens
cagcaatgatgtccagaaga

SEQ ID NO: 3139382 - DNA, 19 bp, Homo sapiens
cagcaatgccatttcagtg

SEQ ID NO: 3139383 - DNA, 23 bp, Homo sapiens
cagcaatttctaatttttaagaa

SEQ ID NO: 3139384 - DNA, 13 bp, Homo sapiens
cagcacaaccccc

SEQ ID NO: 3139385 - DNA, 12 bp, Homo sapiens
cagcacagagcg

SEQ ID NO: 3139386 - DNA, 17 bp, Homo sapiens
cagcacagcccagggcc

SEQ ID NO: 3139387 - DNA, 17 bp, Homo sapiens
cagcacagctccctgcc

SEQ ID NO: 3139388 - DNA, 13 bp, Homo sapiens
cagcacagcttga

SEQ ID NO: 3139389 - DNA, 15 bp, Homo sapiens
cagcacagcttgacc

SEQ ID NO: 3139390 - DNA, 20 bp, Homo sapiens
cagcacagcttgacctgagg

SEQ ID NO: 3139391 - DNA, 22 bp, Homo sapiens
cagcacagcttgacctgaggct

SEQ ID NO: 3139392 - DNA, 16 bp, Homo sapiens
cagcacaggggcccca

SEQ ID NO: 3139393 - DNA, 15 bp, Homo sapiens
cagcacatgctggcc

SEQ ID NO: 3139394 - DNA, 16 bp, Homo sapiens
cagcacatgctggcca

SEQ ID NO: 3139395 - DNA, 17 bp, Homo sapiens
cagcacatgctggccag

SEQ ID NO: 3139396 - DNA, 22 bp, Homo sapiens
cagcacatgctggccagcctgg

SEQ ID NO: 3139397 - DNA, 13 bp, Homo sapiens
cagcacccccacc

SEQ ID NO: 3139398 - DNA, 17 bp, Homo sapiens
cagcacccccacccacc

SEQ ID NO: 3139399 - DNA, 18 bp, Homo sapiens
cagcaccctcccccgcag

SEQ ID NO: 3139400 - DNA, 14 bp, Homo sapiens
cagcaccctctcct

SEQ ID NO: 3139401 - DNA, 12 bp, Homo sapiens
cagcaccctggg

SEQ ID NO: 3139402 - DNA, 16 bp, Homo sapiens
cagcacctccaggcct

SEQ ID NO: 3139403 - DNA, 15 bp, Homo sapiens
cagcacctgcctcct

SEQ ID NO: 3139404 - DNA, 19 bp, Homo sapiens
cagcacctgcctcctcgtt

SEQ ID NO: 3139405 - DNA, 21 bp, Homo sapiens
cagcaccttctttctggactg

SEQ ID NO: 3139406 - DNA, 14 bp, Homo sapiens
cagcacggacaata

SEQ ID NO: 3139407 - DNA, 19 bp, Homo sapiens
cagcacggacaataaacct

SEQ ID NO: 3139408 - DNA, 19 bp, Homo sapiens
cagcactaaggccgtgtct

SEQ ID NO: 3139409 - DNA, 11 bp, Homo sapiens
cagcactactc

SEQ ID NO: 3139410 - DNA, 21 bp, Homo sapiens
cagcactccccagagctgtgc

SEQ ID NO: 3139411 - DNA, 15 bp, Homo sapiens
cagcactccccttgc

SEQ ID NO: 3139412 - DNA, 18 bp, Homo sapiens
cagcactccccttgcctt

SEQ ID NO: 3139413 - DNA, 12 bp, Homo sapiens
cagcactggctc

SEQ ID NO: 3139414 - DNA, 14 bp, Homo sapiens
cagcactggctctc

SEQ ID NO: 3139415 - DNA, 16 bp, Homo sapiens
cagcactggctctctc

SEQ ID NO: 3139416 - DNA, 23 bp, Homo sapiens
cagcacttgggggttcaggcccg

SEQ ID NO: 3139417 - DNA, 13 bp, Homo sapiens
cagcacttgtata

SEQ ID NO: 3139418 - DNA, 11 bp, Homo sapiens
cagcacttgtt

SEQ ID NO: 3139419 - DNA, 22 bp, Homo sapiens
cagcactttgggaggcctaggc

SEQ ID NO: 3139420 - DNA, 18 bp, Homo sapiens
cagcactttgggaggctg

SEQ ID NO: 3139421 - DNA, 20 bp, Homo sapiens
cagcactttgggaggctgag

SEQ ID NO: 3139422 - DNA, 18 bp, Homo sapiens
cagcagaaaacctgttca

SEQ ID NO: 3139423 - DNA, 21 bp, Homo sapiens
cagcagaatggtgatcactcc

SEQ ID NO: 3139424 - DNA, 21 bp, Homo sapiens
cagcagaggacagtctggaga

SEQ ID NO: 3139425 - DNA, 22 bp, Homo sapiens
cagcagaggcggtcttcaacat

SEQ ID NO: 3139426 - DNA, 23 bp, Homo sapiens
cagcagagtgagcaagggggccc

SEQ ID NO: 3139427 - DNA, 20 bp, Homo sapiens
cagcagataacaatgcagca

SEQ ID NO: 3139428 - DNA, 19 bp, Homo sapiens
cagcagcaccaaccacagc

SEQ ID NO: 3139429 - DNA, 15 bp, Homo sapiens
cagcagcagctctga

SEQ ID NO: 3139430 - DNA, 12 bp, Homo sapiens
cagcagcaggtg

SEQ ID NO: 3139431 - DNA, 21 bp, Homo sapiens
cagcagccatcataggaaggg

SEQ ID NO: 3139432 - DNA, 12 bp, Homo sapiens
cagcagcccagc

SEQ ID NO: 3139433 - DNA, 13 bp, Homo sapiens
cagcagcccagct

SEQ ID NO: 3139434 - DNA, 13 bp, Homo sapiens
cagcagcccccca

SEQ ID NO: 3139435 - DNA, 16 bp, Homo sapiens
cagcagccccccagca

SEQ ID NO: 3139436 - DNA, 23 bp, Homo sapiens
cagcagcccctgcacaaagccct

SEQ ID NO: 3139437 - DNA, 23 bp, Homo sapiens
cagcagccctaaggatctctcag

SEQ ID NO: 3139438 - DNA, 21 bp, Homo sapiens
cagcagcctgcgctcggcagg

SEQ ID NO: 3139439 - DNA, 15 bp, Homo sapiens
cagcagcctgcttcc

SEQ ID NO: 3139440 - DNA, 21 bp, Homo sapiens
cagcagcctgcttcccacctc

SEQ ID NO: 3139441 - DNA, 17 bp, Homo sapiens
cagcagcctttaatgca

SEQ ID NO: 3139442 - DNA, 14 bp, Homo sapiens
cagcagctctgagc

SEQ ID NO: 3139443 - DNA, 23 bp, Homo sapiens
cagcagctctgagccagattaca

SEQ ID NO: 3139444 - DNA, 11 bp, Homo sapiens
cagcagctgcg

SEQ ID NO: 3139445 - DNA, 16 bp, Homo sapiens
cagcagcttcaccaga

SEQ ID NO: 3139446 - DNA, 18 bp, Homo sapiens
cagcagcttcaccagagc

SEQ ID NO: 3139447 - DNA, 17 bp, Homo sapiens
cagcagcttttaataca

SEQ ID NO: 3139448 - DNA, 16 bp, Homo sapiens
cagcaggaactctgga

SEQ ID NO: 3139449 - DNA, 22 bp, Homo sapiens
cagcaggacttgctaaagcact

SEQ ID NO: 3139450 - DNA, 11 bp, Homo sapiens
cagcaggagag

SEQ ID NO: 3139451 - DNA, 16 bp, Homo sapiens
cagcaggagtggtgca

SEQ ID NO: 3139452 - DNA, 22 bp, Homo sapiens
cagcaggagtggtgcagacaga

SEQ ID NO: 3139453 - DNA, 13 bp, Homo sapiens
cagcaggcagcgc

SEQ ID NO: 3139454 - DNA, 16 bp, Homo sapiens
cagcaggcagcgccaa

SEQ ID NO: 3139455 - DNA, 19 bp, Homo sapiens
cagcaggccagggactcag

SEQ ID NO: 3139456 - DNA, 19 bp, Homo sapiens
cagcagggaacaaaactcc

SEQ ID NO: 3139457 - DNA, 15 bp, Homo sapiens
cagcagggcctcaaa

SEQ ID NO: 3139458 - DNA, 23 bp, Homo sapiens
cagcagggggagaaacccttcac

SEQ ID NO: 3139459 - DNA, 15 bp, Homo sapiens
cagcaggggggctgt

SEQ ID NO: 3139460 - DNA, 17 bp, Homo sapiens
cagcaggggggctgtgc

SEQ ID NO: 3139461 - DNA, 21 bp, Homo sapiens
cagcagggttttgggttgacc

SEQ ID NO: 3139462 - DNA, 21 bp, Homo sapiens
cagcaggtgattggaccaggc

SEQ ID NO: 3139463 - DNA, 16 bp, Homo sapiens
cagcaggtgtggtggc

SEQ ID NO: 3139464 - DNA, 22 bp, Homo sapiens
cagcaggtgtggtggctcatgg

SEQ ID NO: 3139465 - DNA, 23 bp, Homo sapiens
cagcagtcccagtattctcagag

SEQ ID NO: 3139466 - DNA, 19 bp, Homo sapiens
cagcagtcctttgtaaaca

SEQ ID NO: 3139467 - DNA, 20 bp, Homo sapiens
cagcagtctccttcagcacg

SEQ ID NO: 3139468 - DNA, 12 bp, Homo sapiens
cagcagtgttcc

SEQ ID NO: 3139469 - DNA, 14 bp, Homo sapiens
cagcagtgttcccc

SEQ ID NO: 3139470 - DNA, 13 bp, Homo sapiens
cagcagttgacat

SEQ ID NO: 3139471 - DNA, 20 bp, Homo sapiens
cagcagttttcaagtcaaat

SEQ ID NO: 3139472 - DNA, 14 bp, Homo sapiens
cagcatatttatag

SEQ ID NO: 3139473 - DNA, 14 bp, Homo sapiens
cagcatcactcccc

SEQ ID NO: 3139474 - DNA, 19 bp, Homo sapiens
cagcatcactccccaagga

SEQ ID NO: 3139475 - DNA, 15 bp, Homo sapiens
cagcctcttaaagct

SEQ ID NO: 3139476 - DNA, 20 bp, Homo sapiens
cagcctcttaaagctgcctg

SEQ ID NO: 3139477 - DNA, 15 bp, Homo sapiens
cagcctcttcagccc

SEQ ID NO: 3139478 - DNA, 17 bp, Homo sapiens
cagcctcttcagcccct

SEQ ID NO: 3139479 - DNA, 20 bp, Homo sapiens
cagcctcttcagccccttct

SEQ ID NO: 3139480 - DNA, 13 bp, Homo sapiens
cagcctgacctga

SEQ ID NO: 3139481 - DNA, 17 bp, Homo sapiens
cagcctgacctgagact

SEQ ID NO: 3139482 - DNA, 19 bp, Homo sapiens
cagcctgaggctgagactg

SEQ ID NO: 3139483 - DNA, 16 bp, Homo sapiens
cagcctgatggccaag

SEQ ID NO: 3139484 - DNA, 23 bp, Homo sapiens
cagcctgcccaagcccaggccac

SEQ ID NO: 3139485 - DNA, 16 bp, Homo sapiens
cagcctgccctccagc

SEQ ID NO: 3139486 - DNA, 15 bp, Homo sapiens
cagcctgctgagagc

SEQ ID NO: 3139487 - DNA, 16 bp, Homo sapiens
cagcctgctgagagcc

SEQ ID NO: 3139488 - DNA, 18 bp, Homo sapiens
cagcctggccccggcctt

SEQ ID NO: 3139489 - DNA, 14 bp, Homo sapiens
cagcctggcttctg

SEQ ID NO: 3139490 - DNA, 15 bp, Homo sapiens
cagcctggcttctgg

SEQ ID NO: 3139491 - DNA, 17 bp, Homo sapiens
cagcctggcttctggag

SEQ ID NO: 3139492 - DNA, 18 bp, Homo sapiens
cagcctgggactcccagt

SEQ ID NO: 3139493 - DNA, 16 bp, Homo sapiens
cagcctgggagcccag

SEQ ID NO: 3139494 - DNA, 11 bp, Homo sapiens
cagcctgggcg

SEQ ID NO: 3139495 - DNA, 19 bp, Homo sapiens
cagcctggggcctggcagg

SEQ ID NO: 3139496 - DNA, 20 bp, Homo sapiens
cagcctggggcctggcaggg

SEQ ID NO: 3139497 - DNA, 22 bp, Homo sapiens
cagcctgtcccatggacactcc

SEQ ID NO: 3139498 - DNA, 11 bp, Homo sapiens
cagcctgtgct

SEQ ID NO: 3139499 - DNA, 12 bp, Homo sapiens
cagcctgtgctg

SEQ ID NO: 3139500 - DNA, 15 bp, Homo sapiens
cagcctgtgctgtgg

SEQ ID NO: 3139501 - DNA, 17 bp, Homo sapiens
cagcctgtgctgtggca

SEQ ID NO: 3139502 - DNA, 18 bp, Homo sapiens
cagcctgtgctgtggcat

SEQ ID NO: 3139503 - DNA, 15 bp, Homo sapiens
cagcctgtggcatct

SEQ ID NO: 3139504 - DNA, 21 bp, Homo sapiens
cagcctgtggcatctttgcct

SEQ ID NO: 3139505 - DNA, 22 bp, Homo sapiens
cagcctgtggttacagtgcaga

SEQ ID NO: 3139506 - DNA, 23 bp, Homo sapiens
cagccttcagacagagaggactg

SEQ ID NO: 3139507 - DNA, 23 bp, Homo sapiens
cagccttcggagcgttctctgtc

SEQ ID NO: 3139508 - DNA, 20 bp, Homo sapiens
cagccttgtaaataaccaca

SEQ ID NO: 3139509 - DNA, 20 bp, Homo sapiens
cagcctttctgaggacacca

SEQ ID NO: 3139510 - DNA, 16 bp, Homo sapiens
cagcgaagtagcttgc

SEQ ID NO: 3139511 - DNA, 17 bp, Homo sapiens
cagcgaccgccccctcc

SEQ ID NO: 3139512 - DNA, 18 bp, Homo sapiens
cagcgaccgccccctcct

SEQ ID NO: 3139513 - DNA, 21 bp, Homo sapiens
cagcgactccgttggccactc

SEQ ID NO: 3139514 - DNA, 19 bp, Homo sapiens
cagcgagccctggtggcag

SEQ ID NO: 3139515 - DNA, 20 bp, Homo sapiens
cagcgccaaatgttcatcct

SEQ ID NO: 3139516 - DNA, 16 bp, Homo sapiens
cagcgccaagcaacct

SEQ ID NO: 3139517 - DNA, 23 bp, Homo sapiens
cagcgccaagcaacctgggtcca

SEQ ID NO: 3139518 - DNA, 24 bp, Homo sapiens
cagcgccaagtaaacagggtacct

SEQ ID NO: 3139519 - DNA, 18 bp, Homo sapiens
cagcgccaagtgcgtgcc

SEQ ID NO: 3139520 - DNA, 14 bp, Homo sapiens
cagcgccagcctgt

SEQ ID NO: 3139521 - DNA, 18 bp, Homo sapiens
cagcgcccctgctgtctt

SEQ ID NO: 3139522 - DNA, 13 bp, Homo sapiens
cagcgcggccagc

SEQ ID NO: 3139523 - DNA, 14 bp, Homo sapiens
cagcgcggccagcg

SEQ ID NO: 3139524 - DNA, 14 bp, Homo sapiens
cagcgctcctcctg

SEQ ID NO: 3139525 - DNA, 20 bp, Homo sapiens
cagcgctctgcctcaccgct

SEQ ID NO: 3139526 - DNA, 22 bp, Homo sapiens
cagcggaggtgtggagccgagg

SEQ ID NO: 3139527 - DNA, 16 bp, Homo sapiens
cagcggcggaggcgca

SEQ ID NO: 3139528 - DNA, 18 bp, Homo sapiens
cagcgggagacctgtgct

SEQ ID NO: 3139529 - DNA, 19 bp, Homo sapiens
cagcgggagacctgtgcta

SEQ ID NO: 3139530 - DNA, 12 bp, Homo sapiens
cagcgggcacag

SEQ ID NO: 3139531 - DNA, 16 bp, Homo sapiens
cagcgggcacagggca

SEQ ID NO: 3139532 - DNA, 13 bp, Homo sapiens
cagcgggcaggtt

SEQ ID NO: 3139533 - DNA, 14 bp, Homo sapiens
cagcgggcccaggc

SEQ ID NO: 3139534 - DNA, 17 bp, Homo sapiens
cagcgggcggaggggat

SEQ ID NO: 3139535 - DNA, 23 bp, Homo sapiens
cagcgggcggaggggatccagcc

SEQ ID NO: 3139536 - DNA, 15 bp, Homo sapiens
cagcggggacagctc

SEQ ID NO: 3139537 - DNA, 18 bp, Homo sapiens
cagcggggacagctcctt

SEQ ID NO: 3139538 - DNA, 18 bp, Homo sapiens
cagcggtccaaagttatc

SEQ ID NO: 3139539 - DNA, 15 bp, Homo sapiens
cagcggtttggggag

SEQ ID NO: 3139540 - DNA, 21 bp, Homo sapiens
cagcgtcagctgctccctggc

SEQ ID NO: 3139541 - DNA, 15 bp, Homo sapiens
cagcgtcccagggta

SEQ ID NO: 3139542 - DNA, 18 bp, Homo sapiens
cagcgtccctagcagtga

SEQ ID NO: 3139543 - DNA, 14 bp, Homo sapiens
cagcgtccctggcg

SEQ ID NO: 3139544 - DNA, 14 bp, Homo sapiens
cagcgtcctgtcca

SEQ ID NO: 3139545 - DNA, 16 bp, Homo sapiens
cagcgtggctctaaaa

SEQ ID NO: 3139546 - DNA, 13 bp, Homo sapiens
cagcgtgtgtatc

SEQ ID NO: 3139547 - DNA, 13 bp, Homo sapiens
cagcgttgcatgt

SEQ ID NO: 3139548 - DNA, 21 bp, Homo sapiens
cagcgtttagtttctagaggc

SEQ ID NO: 3139549 - DNA, 24 bp, Homo sapiens
cagcgtttagtttctagaggcctc

SEQ ID NO: 3139550 - DNA, 22 bp, Homo sapiens
cagcgtttgaggggctggcctt

SEQ ID NO: 3139551 - DNA, 12 bp, Homo sapiens
cagctaagaaaa

SEQ ID NO: 3139552 - DNA, 14 bp, Homo sapiens
cagctaatctgtag

SEQ ID NO: 3139553 - DNA, 19 bp, Homo sapiens
cagctaatctgtagggctg

SEQ ID NO: 3139554 - DNA, 15 bp, Homo sapiens
cagctaatgggacac

SEQ ID NO: 3139555 - DNA, 20 bp, Homo sapiens
cagctacagctttcttgctc

SEQ ID NO: 3139556 - DNA, 18 bp, Homo sapiens
cagctacataagactgga

SEQ ID NO: 3139557 - DNA, 21 bp, Homo sapiens
cagctaccacgggtctgccat

SEQ ID NO: 3139558 - DNA, 22 bp, Homo sapiens
cagctaccacgggtctgccatg

SEQ ID NO: 3139559 - DNA, 23 bp, Homo sapiens
cagctaccccttctttgcagggc

SEQ ID NO: 3139560 - DNA, 13 bp, Homo sapiens
cagctacctgaga

SEQ ID NO: 3139561 - DNA, 19 bp, Homo sapiens
cagctactaatgatgtttt

SEQ ID NO: 3139562 - DNA, 23 bp, Homo sapiens
cagctactcgggaggctgaggca

SEQ ID NO: 3139563 - DNA, 14 bp, Homo sapiens
cagctactctgtcc

SEQ ID NO: 3139564 - DNA, 15 bp, Homo sapiens
cagctactctgtcca

SEQ ID NO: 3139565 - DNA, 18 bp, Homo sapiens
cagctactctgtccaggc

SEQ ID NO: 3139566 - DNA, 20 bp, Homo sapiens
cagctactctgtccaggcca

SEQ ID NO: 3139567 - DNA, 19 bp, Homo sapiens
cagctactgatttttgtga

SEQ ID NO: 3139568 - DNA, 20 bp, Homo sapiens
cagctacttaagagaaatgg

SEQ ID NO: 3139569 - DNA, 16 bp, Homo sapiens
cagctacttgggaagc

SEQ ID NO: 3139570 - DNA, 14 bp, Homo sapiens
cagctactttccat

SEQ ID NO: 3139571 - DNA, 18 bp, Homo sapiens
cagctactttccatttgg

SEQ ID NO: 3139572 - DNA, 23 bp, Homo sapiens
cagctagaaataagcccaacaga

SEQ ID NO: 3139573 - DNA, 15 bp, Homo sapiens
cagctagactggagt

SEQ ID NO: 3139574 - DNA, 16 bp, Homo sapiens
cagctaggaagagcag

SEQ ID NO: 3139575 - DNA, 14 bp, Homo sapiens
cagctaggactgag

SEQ ID NO: 3139576 - DNA, 16 bp, Homo sapiens
cagctaggactgagga

SEQ ID NO: 3139577 - DNA, 24 bp, Homo sapiens
cagctatcgaacttcacaactagg

SEQ ID NO: 3139578 - DNA, 14 bp, Homo sapiens
cagctatctgtcat

SEQ ID NO: 3139579 - DNA, 13 bp, Homo sapiens
cagctatgggagc

SEQ ID NO: 3139580 - DNA, 21 bp, Homo sapiens
cagctatgggagccccagggt

SEQ ID NO: 3139581 - DNA, 12 bp, Homo sapiens
cagctatttaag

SEQ ID NO: 3139582 - DNA, 19 bp, Homo sapiens
cagctcaagtcttccctga

SEQ ID NO: 3139583 - DNA, 13 bp, Homo sapiens
cagctcaccagcc

SEQ ID NO: 3139584 - DNA, 14 bp, Homo sapiens
cagctcaccagccc

SEQ ID NO: 3139585 - DNA, 19 bp, Homo sapiens
cagctcaccagccccagtg

SEQ ID NO: 3139586 - DNA, 20 bp, Homo sapiens
cagctcaccagccccagtgc

SEQ ID NO: 3139587 - DNA, 13 bp, Homo sapiens
cagctcacccctg

SEQ ID NO: 3139588 - DNA, 19 bp, Homo sapiens
cagctcacccctgggcagg

SEQ ID NO: 3139589 - DNA, 20 bp, Homo sapiens
cagctcacccctgggcaggc

SEQ ID NO: 3139590 - DNA, 13 bp, Homo sapiens
cagctcagaaccc

SEQ ID NO: 3139591 - DNA, 17 bp, Homo sapiens
cagctcagaacccaggg

SEQ ID NO: 3139592 - DNA, 13 bp, Homo sapiens
cagctcagcgcca

SEQ ID NO: 3139593 - DNA, 15 bp, Homo sapiens
cagctcaggcagctc

SEQ ID NO: 3139594 - DNA, 17 bp, Homo sapiens
cagctcaggcagctcga

SEQ ID NO: 3139595 - DNA, 14 bp, Homo sapiens
cagctcaggggcag

SEQ ID NO: 3139596 - DNA, 18 bp, Homo sapiens
cagctcaggggcagctca

SEQ ID NO: 3139597 - DNA, 23 bp, Homo sapiens
cagctcataaaatggaagcaatt

SEQ ID NO: 3139598 - DNA, 20 bp, Homo sapiens
cagctcatagagtcccccct

SEQ ID NO: 3139599 - DNA, 22 bp, Homo sapiens
cagctcattataatgtcattaa

SEQ ID NO: 3139600 - DNA, 20 bp, Homo sapiens
cagctccaagacctgttggt

SEQ ID NO: 3139601 - DNA, 19 bp, Homo sapiens
caggcacctagcaattcca

SEQ ID NO: 3139602 - DNA, 14 bp, Homo sapiens
caggcacctcttcc

SEQ ID NO: 3139603 - DNA, 13 bp, Homo sapiens
caggcacctggcc

SEQ ID NO: 3139604 - DNA, 18 bp, Homo sapiens
caggcacctggcctgctg

SEQ ID NO: 3139605 - DNA, 22 bp, Homo sapiens
caggcacctggcctgctgggaa

SEQ ID NO: 3139606 - DNA, 17 bp, Homo sapiens
caggcactgccttctcc

SEQ ID NO: 3139607 - DNA, 16 bp, Homo sapiens
caggcactgctgccca

SEQ ID NO: 3139608 - DNA, 17 bp, Homo sapiens
caggcactgctgcccag

SEQ ID NO: 3139609 - DNA, 14 bp, Homo sapiens
caggcactttgaga

SEQ ID NO: 3139610 - DNA, 23 bp, Homo sapiens
caggcactttgagatgtgttcct

SEQ ID NO: 3139611 - DNA, 15 bp, Homo sapiens
caggcagatctgtgc

SEQ ID NO: 3139612 - DNA, 18 bp, Homo sapiens
caggcagcgatggtctca

SEQ ID NO: 3139613 - DNA, 13 bp, Homo sapiens
caggcagcgccaa

SEQ ID NO: 3139614 - DNA, 17 bp, Homo sapiens
caggcagctttctagaa

SEQ ID NO: 3139615 - DNA, 18 bp, Homo sapiens
caggcagctttctagaag

SEQ ID NO: 3139616 - DNA, 21 bp, Homo sapiens
caggcaggccagatggcccct

SEQ ID NO: 3139617 - DNA, 12 bp, Homo sapiens
caggcaggggtg

SEQ ID NO: 3139618 - DNA, 13 bp, Homo sapiens
caggcaggggtgg

SEQ ID NO: 3139619 - DNA, 20 bp, Homo sapiens
caggcaggtagccaggggga

SEQ ID NO: 3139620 - DNA, 14 bp, Homo sapiens
caggcaggtccagg

SEQ ID NO: 3139621 - DNA, 19 bp, Homo sapiens
caggcaggtccagggtttg

SEQ ID NO: 3139622 - DNA, 23 bp, Homo sapiens
caggcaggtcttgaactcctggc

SEQ ID NO: 3139623 - DNA, 14 bp, Homo sapiens
caggcaggtgcctg

SEQ ID NO: 3139624 - DNA, 18 bp, Homo sapiens
caggcagtcgggggctgg

SEQ ID NO: 3139625 - DNA, 19 bp, Homo sapiens
caggcagtcgggggctggc

SEQ ID NO: 3139626 - DNA, 22 bp, Homo sapiens
caggcagtcgggggctggccta

SEQ ID NO: 3139627 - DNA, 15 bp, Homo sapiens
caggcagtgcatgtg

SEQ ID NO: 3139628 - DNA, 17 bp, Homo sapiens
caggcagttggccagag

SEQ ID NO: 3139629 - DNA, 23 bp, Homo sapiens
caggcataagctatcacctagca

SEQ ID NO: 3139630 - DNA, 23 bp, Homo sapiens
caggcatagaggcttctccgcca

SEQ ID NO: 3139631 - DNA, 17 bp, Homo sapiens
caggcataggcctgggt

SEQ ID NO: 3139632 - DNA, 18 bp, Homo sapiens
caggcataggcctgggtg

SEQ ID NO: 3139633 - DNA, 14 bp, Homo sapiens
caggcatctccttg

SEQ ID NO: 3139634 - DNA, 16 bp, Homo sapiens
caggcatggctcagag

SEQ ID NO: 3139635 - DNA, 14 bp, Homo sapiens
caggcatggggggt

SEQ ID NO: 3139636 - DNA, 20 bp, Homo sapiens
caggcatggtagctcatgcc

SEQ ID NO: 3139637 - DNA, 18 bp, Homo sapiens
caggcatgttctctgagg

SEQ ID NO: 3139638 - DNA, 14 bp, Homo sapiens
caggcattgaggaa

SEQ ID NO: 3139639 - DNA, 15 bp, Homo sapiens
caggcattgaggaag

SEQ ID NO: 3139640 - DNA, 21 bp, Homo sapiens
caggcattggctcagcccgct

SEQ ID NO: 3139641 - DNA, 12 bp, Homo sapiens
caggccacctcc

SEQ ID NO: 3139642 - DNA, 16 bp, Homo sapiens
caggccactgtggcca

SEQ ID NO: 3139643 - DNA, 19 bp, Homo sapiens
caggccactgtggccagag

SEQ ID NO: 3139644 - DNA, 20 bp, Homo sapiens
caggccactgtggccagagc

SEQ ID NO: 3139645 - DNA, 21 bp, Homo sapiens
caggccactgtggccagagct

SEQ ID NO: 3139646 - DNA, 22 bp, Homo sapiens
caggccactgtggccagagctg

SEQ ID NO: 3139647 - DNA, 11 bp, Homo sapiens
caggccagatg

SEQ ID NO: 3139648 - DNA, 12 bp, Homo sapiens
caggccagccca

SEQ ID NO: 3139649 - DNA, 18 bp, Homo sapiens
caggccagcccagccagg

SEQ ID NO: 3139650 - DNA, 12 bp, Homo sapiens
caggccagcctc

SEQ ID NO: 3139651 - DNA, 19 bp, Homo sapiens
caggccagcctccgagagg

SEQ ID NO: 3139652 - DNA, 20 bp, Homo sapiens
caggccaggaccacacagtc

SEQ ID NO: 3139653 - DNA, 18 bp, Homo sapiens
caggccaggtgaggtcca

SEQ ID NO: 3139654 - DNA, 16 bp, Homo sapiens
caggccatgtgagcca

SEQ ID NO: 3139655 - DNA, 16 bp, Homo sapiens
caggccattctgccgc

SEQ ID NO: 3139656 - DNA, 19 bp, Homo sapiens
caggcccaagagatgaaga

SEQ ID NO: 3139657 - DNA, 16 bp, Homo sapiens
caggcccaaggctccc

SEQ ID NO: 3139658 - DNA, 17 bp, Homo sapiens
caggcccaaggctcccg

SEQ ID NO: 3139659 - DNA, 21 bp, Homo sapiens
caggcccacagcgtgggaact

SEQ ID NO: 3139660 - DNA, 11 bp, Homo sapiens
caggcccagaa

SEQ ID NO: 3139661 - DNA, 10 bp, Homo sapiens
caggcccagc

SEQ ID NO: 3139662 - DNA, 11 bp, Homo sapiens
caggcccagcc

SEQ ID NO: 3139663 - DNA, 13 bp, Homo sapiens
caggcccagcgcg

SEQ ID NO: 3139664 - DNA, 15 bp, Homo sapiens
caggcccagcgcggc

SEQ ID NO: 3139665 - DNA, 13 bp, Homo sapiens
caggcccaggcag

SEQ ID NO: 3139666 - DNA, 15 bp, Homo sapiens
caggcccaggcagag

SEQ ID NO: 3139667 - DNA, 12 bp, Homo sapiens
caggcccaggga

SEQ ID NO: 3139668 - DNA, 16 bp, Homo sapiens
caggcccatctcaggt

SEQ ID NO: 3139669 - DNA, 19 bp, Homo sapiens
caggcccatctcaggtgcc

SEQ ID NO: 3139670 - DNA, 21 bp, Homo sapiens
caggcccatctcaggtgccac

SEQ ID NO: 3139671 - DNA, 24 bp, Homo sapiens
caggcccatctcaggtgccactcc

SEQ ID NO: 3139672 - DNA, 20 bp, Homo sapiens
caggccccactccttcctga

SEQ ID NO: 3139673 - DNA, 15 bp, Homo sapiens
caggcccccaccact

SEQ ID NO: 3139674 - DNA, 15 bp, Homo sapiens
caggccccctgcatc

SEQ ID NO: 3139675 - DNA, 14 bp, Homo sapiens
caggcccctgagga

SEQ ID NO: 3139676 - DNA, 15 bp, Homo sapiens
caggcccctgaggac

SEQ ID NO: 3139677 - DNA, 20 bp, Homo sapiens
caggcccctgaggactggag

SEQ ID NO: 3139678 - DNA, 20 bp, Homo sapiens
caggcccctgccaccctggg

SEQ ID NO: 3139679 - DNA, 22 bp, Homo sapiens
caggccccttttcactccctcc

SEQ ID NO: 3139680 - DNA, 23 bp, Homo sapiens
caggcccgagatgtgacccacca

SEQ ID NO: 3139681 - DNA, 22 bp, Homo sapiens
caggcccgcaccccggcctcag

SEQ ID NO: 3139682 - DNA, 23 bp, Homo sapiens
caggcccgcaccccggcctcagg

SEQ ID NO: 3139683 - DNA, 16 bp, Homo sapiens
caggcccggctccagg

SEQ ID NO: 3139684 - DNA, 17 bp, Homo sapiens
caggcccggctccaggc

SEQ ID NO: 3139685 - DNA, 23 bp, Homo sapiens
caggcccggggggaccaggatga

SEQ ID NO: 3139686 - DNA, 16 bp, Homo sapiens
caggccctccatgggc

SEQ ID NO: 3139687 - DNA, 19 bp, Homo sapiens
caggccctccatgggctag

SEQ ID NO: 3139688 - DNA, 20 bp, Homo sapiens
caggccctccatgggctagt

SEQ ID NO: 3139689 - DNA, 20 bp, Homo sapiens
caggccctccctgactccct

SEQ ID NO: 3139690 - DNA, 23 bp, Homo sapiens
caggccctccctgactccctgtg

SEQ ID NO: 3139691 - DNA, 16 bp, Homo sapiens
caggccctcctctccc

SEQ ID NO: 3139692 - DNA, 13 bp, Homo sapiens
caggccctgcagt

SEQ ID NO: 3139693 - DNA, 15 bp, Homo sapiens
caggccctgcagtgt

SEQ ID NO: 3139694 - DNA, 14 bp, Homo sapiens
caggccctgccccc

SEQ ID NO: 3139695 - DNA, 13 bp, Homo sapiens
caggccctgctcc

SEQ ID NO: 3139696 - DNA, 14 bp, Homo sapiens
caggccctggcctc

SEQ ID NO: 3139697 - DNA, 22 bp, Homo sapiens
caggccctggcctcccctgcca

SEQ ID NO: 3139698 - DNA, 22 bp, Homo sapiens
caggccctggctgagggcagct

SEQ ID NO: 3139699 - DNA, 17 bp, Homo sapiens
caggcccttcctctcca

SEQ ID NO: 3139700 - DNA, 21 bp, Homo sapiens
caggccgcaccatttctgtca

SEQ ID NO: 3139701 - DNA, 18 bp, Homo sapiens
caggccggaaccacaggg

SEQ ID NO: 3139702 - DNA, 16 bp, Homo sapiens
caggccggccagcctc

SEQ ID NO: 3139703 - DNA, 18 bp, Homo sapiens
caggccgttccccttggc

SEQ ID NO: 3139704 - DNA, 19 bp, Homo sapiens
caggccgttccccttggct

SEQ ID NO: 3139705 - DNA, 18 bp, Homo sapiens
caggcctaagacatgtga

SEQ ID NO: 3139706 - DNA, 18 bp, Homo sapiens
caggcctacctcactctc

SEQ ID NO: 3139707 - DNA, 18 bp, Homo sapiens
caggcctaggaggccccc

SEQ ID NO: 3139708 - DNA, 20 bp, Homo sapiens
caggcctaggtgcagctcct

SEQ ID NO: 3139709 - DNA, 22 bp, Homo sapiens
caggcctaggtgcagctcctca

SEQ ID NO: 3139710 - DNA, 22 bp, Homo sapiens
caggcctcacctctacccaaac

SEQ ID NO: 3139711 - DNA, 21 bp, Homo sapiens
caggcctccaacgcccctgtg

SEQ ID NO: 3139712 - DNA, 14 bp, Homo sapiens
caggcctccagcct

SEQ ID NO: 3139713 - DNA, 17 bp, Homo sapiens
caggcctccagcctctc

SEQ ID NO: 3139714 - DNA, 12 bp, Homo sapiens
caggcctccctc

SEQ ID NO: 3139715 - DNA, 15 bp, Homo sapiens
caggcctccctctct

SEQ ID NO: 3139716 - DNA, 16 bp, Homo sapiens
caggcctccctctctc

SEQ ID NO: 3139717 - DNA, 17 bp, Homo sapiens
caggcctccctctctct

SEQ ID NO: 3139718 - DNA, 19 bp, Homo sapiens
caggcctccctctctcttc

SEQ ID NO: 3139719 - DNA, 14 bp, Homo sapiens
caggcctccctgtt

SEQ ID NO: 3139720 - DNA, 15 bp, Homo sapiens
caggcctctgagccc

SEQ ID NO: 3139721 - DNA, 18 bp, Homo sapiens
caggcctctgagcccaag

SEQ ID NO: 3139722 - DNA, 19 bp, Homo sapiens
caggcctctgagcccaagc

SEQ ID NO: 3139723 - DNA, 20 bp, Homo sapiens
caggcctctgagcccaagct

SEQ ID NO: 3139724 - DNA, 12 bp, Homo sapiens
caggcctctgtg

SEQ ID NO: 3139725 - DNA, 18 bp, Homo sapiens
caggcctcttggcagtca

SEQ ID NO: 3139726 - DNA, 14 bp, Homo sapiens
caggcctgcctccc

SEQ ID NO: 3139727 - DNA, 19 bp, Homo sapiens
cagggtcttttttcatttc

SEQ ID NO: 3139728 - DNA, 22 bp, Homo sapiens
cagggtgcccagaacttccctg

SEQ ID NO: 3139729 - DNA, 15 bp, Homo sapiens
cagggtggggggtga

SEQ ID NO: 3139730 - DNA, 15 bp, Homo sapiens
cagggttaagaagac

SEQ ID NO: 3139731 - DNA, 14 bp, Homo sapiens
cagggttcatctgt

SEQ ID NO: 3139732 - DNA, 23 bp, Homo sapiens
cagggttctccctcccaccttaa

SEQ ID NO: 3139733 - DNA, 12 bp, Homo sapiens
cagggttggccc

SEQ ID NO: 3139734 - DNA, 14 bp, Homo sapiens
cagggttggcccct

SEQ ID NO: 3139735 - DNA, 15 bp, Homo sapiens
cagggttgggcccag

SEQ ID NO: 3139736 - DNA, 16 bp, Homo sapiens
cagggttgggcccaga

SEQ ID NO: 3139737 - DNA, 18 bp, Homo sapiens
cagggttggtgtgctgag

SEQ ID NO: 3139738 - DNA, 16 bp, Homo sapiens
cagggtttaatagact

SEQ ID NO: 3139739 - DNA, 17 bp, Homo sapiens
cagggtttacccagtgg

SEQ ID NO: 3139740 - DNA, 19 bp, Homo sapiens
cagggtttcaccatgttgc

SEQ ID NO: 3139741 - DNA, 15 bp, Homo sapiens
cagggttttgtattc

SEQ ID NO: 3139742 - DNA, 15 bp, Homo sapiens
caggtaaaacagggc

SEQ ID NO: 3139743 - DNA, 14 bp, Homo sapiens
caggtaacaggcag

SEQ ID NO: 3139744 - DNA, 19 bp, Homo sapiens
caggtaatgtgaataaatt

SEQ ID NO: 3139745 - DNA, 15 bp, Homo sapiens
caggtaccaaggaaa

SEQ ID NO: 3139746 - DNA, 18 bp, Homo sapiens
caggtaccacccttcaga

SEQ ID NO: 3139747 - DNA, 19 bp, Homo sapiens
caggtaccacccttcagac

SEQ ID NO: 3139748 - DNA, 20 bp, Homo sapiens
caggtaccacccttcagacc

SEQ ID NO: 3139749 - DNA, 18 bp, Homo sapiens
caggtaccagctgcgctt

SEQ ID NO: 3139750 - DNA, 20 bp, Homo sapiens
caggtacttcctcctgatgg

SEQ ID NO: 3139751 - DNA, 22 bp, Homo sapiens
caggtacttcctcctgatggcc

SEQ ID NO: 3139752 - DNA, 22 bp, Homo sapiens
caggtagaattatctaatttat

SEQ ID NO: 3139753 - DNA, 19 bp, Homo sapiens
caggtagatcgcttgagcc

SEQ ID NO: 3139754 - DNA, 18 bp, Homo sapiens
caggtagttgcaattgaa

SEQ ID NO: 3139755 - DNA, 18 bp, Homo sapiens
caggtatatactttgaaa

SEQ ID NO: 3139756 - DNA, 22 bp, Homo sapiens
caggtatatactttgaaaggag

SEQ ID NO: 3139757 - DNA, 15 bp, Homo sapiens
caggtatccaaaaat

SEQ ID NO: 3139758 - DNA, 14 bp, Homo sapiens
caggtatgttgcct

SEQ ID NO: 3139759 - DNA, 20 bp, Homo sapiens
caggtatgttgcctttatgg

SEQ ID NO: 3139760 - DNA, 23 bp, Homo sapiens
caggtcaataaacttagaggaaa

SEQ ID NO: 3139761 - DNA, 18 bp, Homo sapiens
caggtcaggatgcacatt

SEQ ID NO: 3139762 - DNA, 18 bp, Homo sapiens
caggtcccacgtctggcc

SEQ ID NO: 3139763 - DNA, 20 bp, Homo sapiens
caggtccctccgcggctgga

SEQ ID NO: 3139764 - DNA, 24 bp, Homo sapiens
caggtccctccgcggctggagcga

SEQ ID NO: 3139765 - DNA, 15 bp, Homo sapiens
caggtcctcagagaa

SEQ ID NO: 3139766 - DNA, 22 bp, Homo sapiens
caggtccttcctttaggtctgg

SEQ ID NO: 3139767 - DNA, 13 bp, Homo sapiens
caggtctcccacg

SEQ ID NO: 3139768 - DNA, 21 bp, Homo sapiens
caggtcttgaactcctggcct

SEQ ID NO: 3139769 - DNA, 22 bp, Homo sapiens
caggtcttgaactcctggcctc

SEQ ID NO: 3139770 - DNA, 17 bp, Homo sapiens
caggtgaaaatgttcat

SEQ ID NO: 3139771 - DNA, 13 bp, Homo sapiens
caggtgaataaag

SEQ ID NO: 3139772 - DNA, 12 bp, Homo sapiens
caggtgacatgt

SEQ ID NO: 3139773 - DNA, 19 bp, Homo sapiens
caggtgagaagtgagggag

SEQ ID NO: 3139774 - DNA, 14 bp, Homo sapiens
caggtgaggcccaa

SEQ ID NO: 3139775 - DNA, 20 bp, Homo sapiens
caggtgaggcccaagagccc

SEQ ID NO: 3139776 - DNA, 16 bp, Homo sapiens
caggtgaggtctgttc

SEQ ID NO: 3139777 - DNA, 21 bp, Homo sapiens
caggtgatccacccacctcag

SEQ ID NO: 3139778 - DNA, 21 bp, Homo sapiens
caggtgattggaccaggccat

SEQ ID NO: 3139779 - DNA, 14 bp, Homo sapiens
caggtgcagccctt

SEQ ID NO: 3139780 - DNA, 13 bp, Homo sapiens
caggtgccactcc

SEQ ID NO: 3139781 - DNA, 14 bp, Homo sapiens
caggtgccactccc

SEQ ID NO: 3139782 - DNA, 19 bp, Homo sapiens
caggtgccactccctgagc

SEQ ID NO: 3139783 - DNA, 20 bp, Homo sapiens
caggtgccactccctgagct

SEQ ID NO: 3139784 - DNA, 21 bp, Homo sapiens
caggtgccactccctgagctt

SEQ ID NO: 3139785 - DNA, 16 bp, Homo sapiens
caggtgccagcctgag

SEQ ID NO: 3139786 - DNA, 15 bp, Homo sapiens
caggtgcctccaggt

SEQ ID NO: 3139787 - DNA, 20 bp, Homo sapiens
caggtgctaatttgttttgg

SEQ ID NO: 3139788 - DNA, 22 bp, Homo sapiens
caggtgctcaataaacacttgt

SEQ ID NO: 3139789 - DNA, 14 bp, Homo sapiens
caggtgctgccatc

SEQ ID NO: 3139790 - DNA, 15 bp, Homo sapiens
caggtggagggcaca

SEQ ID NO: 3139791 - DNA, 16 bp, Homo sapiens
caggtggatgaggaga

SEQ ID NO: 3139792 - DNA, 18 bp, Homo sapiens
caggtggatgaggagaca

SEQ ID NO: 3139793 - DNA, 21 bp, Homo sapiens
caggtggccactccagacccc

SEQ ID NO: 3139794 - DNA, 22 bp, Homo sapiens
caggtggctctgaggtgcctgt

SEQ ID NO: 3139795 - DNA, 18 bp, Homo sapiens
caggtgggcactggagca

SEQ ID NO: 3139796 - DNA, 16 bp, Homo sapiens
caggtgggcagacagt

SEQ ID NO: 3139797 - DNA, 23 bp, Homo sapiens
caggtgggctggacttctacctg

SEQ ID NO: 3139798 - DNA, 17 bp, Homo sapiens
caggtggggcagcttga

SEQ ID NO: 3139799 - DNA, 19 bp, Homo sapiens
caggtggggcatgtcctca

SEQ ID NO: 3139800 - DNA, 21 bp, Homo sapiens
caggtgggggttgctgtataa

SEQ ID NO: 3139801 - DNA, 20 bp, Homo sapiens
caggtggtggcactgagccc

SEQ ID NO: 3139802 - DNA, 11 bp, Homo sapiens
caggtgtccct

SEQ ID NO: 3139803 - DNA, 15 bp, Homo sapiens
caggtgtccctgcac

SEQ ID NO: 3139804 - DNA, 19 bp, Homo sapiens
caggtgtcctttcccctct

SEQ ID NO: 3139805 - DNA, 19 bp, Homo sapiens
caggtgtgaaccaccacac

SEQ ID NO: 3139806 - DNA, 16 bp, Homo sapiens
caggtgtgagtcacca

SEQ ID NO: 3139807 - DNA, 23 bp, Homo sapiens
caggtgtgagtcaccaagcccag

SEQ ID NO: 3139808 - DNA, 13 bp, Homo sapiens
caggtgtggtggc

SEQ ID NO: 3139809 - DNA, 16 bp, Homo sapiens
caggtgtggtggctca

SEQ ID NO: 3139810 - DNA, 17 bp, Homo sapiens
caggtgtggtggctcat

SEQ ID NO: 3139811 - DNA, 20 bp, Homo sapiens
caggtgtggtgtaatttata

SEQ ID NO: 3139812 - DNA, 17 bp, Homo sapiens
caggtgttaacattcca

SEQ ID NO: 3139813 - DNA, 22 bp, Homo sapiens
caggtgttactgtaattcctca

SEQ ID NO: 3139814 - DNA, 16 bp, Homo sapiens
caggtgtttagttgca

SEQ ID NO: 3139815 - DNA, 15 bp, Homo sapiens
caggttataacagtg

SEQ ID NO: 3139816 - DNA, 16 bp, Homo sapiens
caggttataacagtgt

SEQ ID NO: 3139817 - DNA, 19 bp, Homo sapiens
caggttcaacccacagcta

SEQ ID NO: 3139818 - DNA, 18 bp, Homo sapiens
caggttcaagctattctc

SEQ ID NO: 3139819 - DNA, 12 bp, Homo sapiens
caggttcagctt

SEQ ID NO: 3139820 - DNA, 13 bp, Homo sapiens
caggttcagcttg

SEQ ID NO: 3139821 - DNA, 14 bp, Homo sapiens
caggttccatcccg

SEQ ID NO: 3139822 - DNA, 17 bp, Homo sapiens
caggttccccaagggcc

SEQ ID NO: 3139823 - DNA, 15 bp, Homo sapiens
caggttcccccagca

SEQ ID NO: 3139824 - DNA, 15 bp, Homo sapiens
caggttccctcccag

SEQ ID NO: 3139825 - DNA, 21 bp, Homo sapiens
caggttctccgttagctcctg

SEQ ID NO: 3139826 - DNA, 15 bp, Homo sapiens
caggttctgcctgct

SEQ ID NO: 3139827 - DNA, 12 bp, Homo sapiens
caggttcttcag

SEQ ID NO: 3139828 - DNA, 20 bp, Homo sapiens
caggttgaggggctcctgga

SEQ ID NO: 3139829 - DNA, 22 bp, Homo sapiens
caggttgaggggctcctggaaa

SEQ ID NO: 3139830 - DNA, 17 bp, Homo sapiens
caggttgctggttgctg

SEQ ID NO: 3139831 - DNA, 20 bp, Homo sapiens
caggttgctggttgctgtgt

SEQ ID NO: 3139832 - DNA, 15 bp, Homo sapiens
caggttggaagagaa

SEQ ID NO: 3139833 - DNA, 22 bp, Homo sapiens
caggttggatgggagtgggcac

SEQ ID NO: 3139834 - DNA, 23 bp, Homo sapiens
caggtttagtgaaaaactgctgt

SEQ ID NO: 3139835 - DNA, 17 bp, Homo sapiens
caggtttgtcatcagat

SEQ ID NO: 3139836 - DNA, 19 bp, Homo sapiens
caggttttctgggtgtcca

SEQ ID NO: 3139837 - DNA, 15 bp, Homo sapiens
cagtaaaacacattt

SEQ ID NO: 3139838 - DNA, 10 bp, Homo sapiens
cagtaaacat

SEQ ID NO: 3139839 - DNA, 13 bp, Homo sapiens
cagtaaagagaaa

SEQ ID NO: 3139840 - DNA, 14 bp, Homo sapiens
cagtaaagagaaac

SEQ ID NO: 3139841 - DNA, 15 bp, Homo sapiens
cagtaaagagaaact

SEQ ID NO: 3139842 - DNA, 20 bp, Homo sapiens
cagtaaagagaaactttgtg

SEQ ID NO: 3139843 - DNA, 12 bp, Homo sapiens
cagtaaatcttt

SEQ ID NO: 3139844 - DNA, 20 bp, Homo sapiens
cagtaaatcttttacaactg

SEQ ID NO: 3139845 - DNA, 17 bp, Homo sapiens
cagtaacctagtgaatt

SEQ ID NO: 3139846 - DNA, 19 bp, Homo sapiens
cagtaacgcgtcttcctga

SEQ ID NO: 3139847 - DNA, 21 bp, Homo sapiens
cagtaacgcgtcttcctgagt

SEQ ID NO: 3139848 - DNA, 9 bp, Homo sapiens
cagtaactg

SEQ ID NO: 3139849 - DNA, 10 bp, Homo sapiens
cagtaactgt

SEQ ID NO: 3139850 - DNA, 20 bp, Homo sapiens
cagtaactttatgtgtaaat

SEQ ID NO: 3139851 - DNA, 22 bp, Homo sapiens
cagtaacttttttgtgtatgta

SEQ ID NO: 3139852 - DNA, 22 bp, Homo sapiens
cagtaagtctcataggttaaaa

SEQ ID NO: 3139853 - DNA, 15 bp, Homo sapiens
cagtgtagttaattt

SEQ ID NO: 3139854 - DNA, 15 bp, Homo sapiens
cagtgtatcaggtca

SEQ ID NO: 3139855 - DNA, 16 bp, Homo sapiens
cagtgtatggggcagc

SEQ ID NO: 3139856 - DNA, 12 bp, Homo sapiens
cagtgtcacctc

SEQ ID NO: 3139857 - DNA, 20 bp, Homo sapiens
cagtgtcatttatgaaaaga

SEQ ID NO: 3139858 - DNA, 18 bp, Homo sapiens
cagtgtcccaccttgacc

SEQ ID NO: 3139859 - DNA, 14 bp, Homo sapiens
cagtgtcccaggca

SEQ ID NO: 3139860 - DNA, 16 bp, Homo sapiens
cagtgtcccctccact

SEQ ID NO: 3139861 - DNA, 17 bp, Homo sapiens
cagtgtcccctccactg

SEQ ID NO: 3139862 - DNA, 18 bp, Homo sapiens
cagtgtcctcttgctcaa

SEQ ID NO: 3139863 - DNA, 18 bp, Homo sapiens
cagtgtctcacactggcg

SEQ ID NO: 3139864 - DNA, 23 bp, Homo sapiens
cagtgtctgtatcggagacagtg

SEQ ID NO: 3139865 - DNA, 24 bp, Homo sapiens
cagtgtctgtatcggagacagtga

SEQ ID NO: 3139866 - DNA, 13 bp, Homo sapiens
cagtgtctgtccc

SEQ ID NO: 3139867 - DNA, 14 bp, Homo sapiens
cagtgtctgtcccg

SEQ ID NO: 3139868 - DNA, 17 bp, Homo sapiens
cagtgtctgtgccatgg

SEQ ID NO: 3139869 - DNA, 13 bp, Homo sapiens
cagtgtctgtgtt

SEQ ID NO: 3139870 - DNA, 23 bp, Homo sapiens
cagtgtctgtgttttgaaagaat

SEQ ID NO: 3139871 - DNA, 17 bp, Homo sapiens
cagtgtcttccataatg

SEQ ID NO: 3139872 - DNA, 22 bp, Homo sapiens
cagtgtcttccataatgtataa

SEQ ID NO: 3139873 - DNA, 18 bp, Homo sapiens
cagtgtgcacgagtggga

SEQ ID NO: 3139874 - DNA, 13 bp, Homo sapiens
cagtgtgcatggg

SEQ ID NO: 3139875 - DNA, 13 bp, Homo sapiens
cagtgtggagagg

SEQ ID NO: 3139876 - DNA, 14 bp, Homo sapiens
cagtgttaaaaaat

SEQ ID NO: 3139877 - DNA, 19 bp, Homo sapiens
cagtgttccccatctgggt

SEQ ID NO: 3139878 - DNA, 16 bp, Homo sapiens
cagtgttcgcttggct

SEQ ID NO: 3139879 - DNA, 18 bp, Homo sapiens
cagtgttctatgaacaac

SEQ ID NO: 3139880 - DNA, 16 bp, Homo sapiens
cagtgttggtatattt

SEQ ID NO: 3139881 - DNA, 14 bp, Homo sapiens
cagtgttgtttgta

SEQ ID NO: 3139882 - DNA, 18 bp, Homo sapiens
cagtgttgtttgtaaata

SEQ ID NO: 3139883 - DNA, 20 bp, Homo sapiens
cagtgttgtttgtaaataag

SEQ ID NO: 3139884 - DNA, 23 bp, Homo sapiens
cagtgttgtttgtaaataagaga

SEQ ID NO: 3139885 - DNA, 20 bp, Homo sapiens
cagtgtttcccataattttc

SEQ ID NO: 3139886 - DNA, 17 bp, Homo sapiens
cagtgttttaaattctg

SEQ ID NO: 3139887 - DNA, 19 bp, Homo sapiens
cagtgttttataggagaga

SEQ ID NO: 3139888 - DNA, 19 bp, Homo sapiens
cagtgttttcagaagaaat

SEQ ID NO: 3139889 - DNA, 22 bp, Homo sapiens
cagtgttttggactccatctct

SEQ ID NO: 3139890 - DNA, 14 bp, Homo sapiens
cagtgtttttgaaa

SEQ ID NO: 3139891 - DNA, 23 bp, Homo sapiens
cagtgtttttgaaacccacagtt

SEQ ID NO: 3139892 - DNA, 14 bp, Homo sapiens
cagttaaaatgtga

SEQ ID NO: 3139893 - DNA, 12 bp, Homo sapiens
cagttaaagaag

SEQ ID NO: 3139894 - DNA, 16 bp, Homo sapiens
cagttaactttcagaa

SEQ ID NO: 3139895 - DNA, 20 bp, Homo sapiens
cagttaaggaccgtggccct

SEQ ID NO: 3139896 - DNA, 16 bp, Homo sapiens
cagttaattcaatgtg

SEQ ID NO: 3139897 - DNA, 13 bp, Homo sapiens
cagttaatttttc

SEQ ID NO: 3139898 - DNA, 14 bp, Homo sapiens
cagttaatttttcc

SEQ ID NO: 3139899 - DNA, 11 bp, Homo sapiens
cagttacaaag

SEQ ID NO: 3139900 - DNA, 19 bp, Homo sapiens
cagttactccctacactga

SEQ ID NO: 3139901 - DNA, 21 bp, Homo sapiens
cagttagaaggaggttctaat

SEQ ID NO: 3139902 - DNA, 19 bp, Homo sapiens
cagttatacagttataaaa

SEQ ID NO: 3139903 - DNA, 15 bp, Homo sapiens
cagttattacatgta

SEQ ID NO: 3139904 - DNA, 17 bp, Homo sapiens
cagttattttgataaca

SEQ ID NO: 3139905 - DNA, 12 bp, Homo sapiens
cagttattttgg

SEQ ID NO: 3139906 - DNA, 16 bp, Homo sapiens
cagttattttggatat

SEQ ID NO: 3139907 - DNA, 15 bp, Homo sapiens
cagttcaaagtgtat

SEQ ID NO: 3139908 - DNA, 20 bp, Homo sapiens
cagttcaaagtgtatattta

SEQ ID NO: 3139909 - DNA, 16 bp, Homo sapiens
cagttcaacctggtgg

SEQ ID NO: 3139910 - DNA, 14 bp, Homo sapiens
cagttcaactttca

SEQ ID NO: 3139911 - DNA, 20 bp, Homo sapiens
cagttcaactttcagaagtg

SEQ ID NO: 3139912 - DNA, 14 bp, Homo sapiens
cagttcaagaaagc

SEQ ID NO: 3139913 - DNA, 13 bp, Homo sapiens
cagttcacaccct

SEQ ID NO: 3139914 - DNA, 14 bp, Homo sapiens
cagttcacaccctg

SEQ ID NO: 3139915 - DNA, 23 bp, Homo sapiens
cagttcagagttgtacactgtgt

SEQ ID NO: 3139916 - DNA, 13 bp, Homo sapiens
cagttcagcacca

SEQ ID NO: 3139917 - DNA, 19 bp, Homo sapiens
cagttcagtggcagggctc

SEQ ID NO: 3139918 - DNA, 23 bp, Homo sapiens
cagttcatatgtaccatgtacat

SEQ ID NO: 3139919 - DNA, 16 bp, Homo sapiens
cagttccaagaaagat

SEQ ID NO: 3139920 - DNA, 17 bp, Homo sapiens
cagttcccagctccccc

SEQ ID NO: 3139921 - DNA, 18 bp, Homo sapiens
cagttcccagctcccccc

SEQ ID NO: 3139922 - DNA, 17 bp, Homo sapiens
cagttcccccaacctca

SEQ ID NO: 3139923 - DNA, 17 bp, Homo sapiens
cagttcccggagcacag

SEQ ID NO: 3139924 - DNA, 13 bp, Homo sapiens
cagttcccttggc

SEQ ID NO: 3139925 - DNA, 14 bp, Homo sapiens
cagttcccttggcc

SEQ ID NO: 3139926 - DNA, 15 bp, Homo sapiens
cagttcccttggcct

SEQ ID NO: 3139927 - DNA, 16 bp, Homo sapiens
cagttcccttggcctc

SEQ ID NO: 3139928 - DNA, 14 bp, Homo sapiens
cagttctcactcct

SEQ ID NO: 3139929 - DNA, 18 bp, Homo sapiens
cagttctctcccttcctc

SEQ ID NO: 3139930 - DNA, 15 bp, Homo sapiens
cagttctgaataact

SEQ ID NO: 3139931 - DNA, 19 bp, Homo sapiens
cagttctgaataacttgaa

SEQ ID NO: 3139932 - DNA, 14 bp, Homo sapiens
cagttctgtgtaca

SEQ ID NO: 3139933 - DNA, 16 bp, Homo sapiens
cagttcttggtgactg

SEQ ID NO: 3139934 - DNA, 19 bp, Homo sapiens
cagttcttggtgctctgtg

SEQ ID NO: 3139935 - DNA, 16 bp, Homo sapiens
cagttctttttgtaca

SEQ ID NO: 3139936 - DNA, 19 bp, Homo sapiens
cagttgaagggaggggctg

SEQ ID NO: 3139937 - DNA, 21 bp, Homo sapiens
cagttgaatgacaacagaagc

SEQ ID NO: 3139938 - DNA, 14 bp, Homo sapiens
cagttgactttctc

SEQ ID NO: 3139939 - DNA, 15 bp, Homo sapiens
cagttgactttctcc

SEQ ID NO: 3139940 - DNA, 21 bp, Homo sapiens
cagttgccaccacctctgtgg

SEQ ID NO: 3139941 - DNA, 16 bp, Homo sapiens
cagttgcccagagcac

SEQ ID NO: 3139942 - DNA, 19 bp, Homo sapiens
cagttgctcaaaaagaaat

SEQ ID NO: 3139943 - DNA, 17 bp, Homo sapiens
cagttggactctcaggg

SEQ ID NO: 3139944 - DNA, 15 bp, Homo sapiens
cagttggcagagaag

SEQ ID NO: 3139945 - DNA, 17 bp, Homo sapiens
cagttggccagagagcc

SEQ ID NO: 3139946 - DNA, 14 bp, Homo sapiens
cagttgggagcact

SEQ ID NO: 3139947 - DNA, 17 bp, Homo sapiens
cagttgggagcactgga

SEQ ID NO: 3139948 - DNA, 18 bp, Homo sapiens
cagttgggagcactggag

SEQ ID NO: 3139949 - DNA, 21 bp, Homo sapiens
cagttgggagcactggagtgc

SEQ ID NO: 3139950 - DNA, 16 bp, Homo sapiens
cagttggtaacttttg

SEQ ID NO: 3139951 - DNA, 20 bp, Homo sapiens
cagttggtggggccaggcca

SEQ ID NO: 3139952 - DNA, 15 bp, Homo sapiens
cagttggtgtgtttt

SEQ ID NO: 3139953 - DNA, 20 bp, Homo sapiens
cagttgtctattctgagcct

SEQ ID NO: 3139954 - DNA, 23 bp, Homo sapiens
cagttgttcaataataaatattt

SEQ ID NO: 3139955 - DNA, 16 bp, Homo sapiens
cagtttaaaaaaattg

SEQ ID NO: 3139956 - DNA, 15 bp, Homo sapiens
cagtttagtgcttta

SEQ ID NO: 3139957 - DNA, 23 bp, Homo sapiens
cagtttcataaaaggagaaccag

SEQ ID NO: 3139958 - DNA, 23 bp, Homo sapiens
cagtttgaggaagtggctgtccc

SEQ ID NO: 3139959 - DNA, 21 bp, Homo sapiens
cagtttgccggatacaaactg

SEQ ID NO: 3139960 - DNA, 12 bp, Homo sapiens
cagtttgctttg

SEQ ID NO: 3139961 - DNA, 16 bp, Homo sapiens
cagtttggtatttgcg

SEQ ID NO: 3139962 - DNA, 18 bp, Homo sapiens
cagtttgtagtgccactg

SEQ ID NO: 3139963 - DNA, 14 bp, Homo sapiens
cagttttaactgtg

SEQ ID NO: 3139964 - DNA, 20 bp, Homo sapiens
cagttttagttggtgctgat

SEQ ID NO: 3139965 - DNA, 22 bp, Homo sapiens
cagttttagttggtgctgatgg

SEQ ID NO: 3139966 - DNA, 15 bp, Homo sapiens
cagttttatgctctt

SEQ ID NO: 3139967 - DNA, 21 bp, Homo sapiens
cagttttatgctcttttttac

SEQ ID NO: 3139968 - DNA, 12 bp, Homo sapiens
cagttttcataa

SEQ ID NO: 3139969 - DNA, 12 bp, Homo sapiens
cagttttccatg

SEQ ID NO: 3139970 - DNA, 16 bp, Homo sapiens
cagttttgaaagaaaa

SEQ ID NO: 3139971 - DNA, 22 bp, Homo sapiens
cagtttttgtttttgcatgaaa

SEQ ID NO: 3139972 - DNA, 12 bp, Homo sapiens
cataaaaagcag

SEQ ID NO: 3139973 - DNA, 17 bp, Homo sapiens
cataaaaagcagaattt

SEQ ID NO: 3139974 - DNA, 22 bp, Homo sapiens
cataaaattttctactcttttt

SEQ ID NO: 3139975 - DNA, 20 bp, Homo sapiens
cataaaccatttttgttact

SEQ ID NO: 3139976 - DNA, 15 bp, Homo sapiens
cataaactgacttta

SEQ ID NO: 3139977 - DNA, 17 bp, Homo sapiens
cataaactgactttatc

SEQ ID NO: 3139978 - DNA, 18 bp, Homo sapiens
cataaagcataagtatac

SEQ ID NO: 3139979 - DNA, 22 bp, Homo sapiens
catctgcaaaaggcctcttgta

SEQ ID NO: 3139980 - DNA, 16 bp, Homo sapiens
catctgcaccccttct

SEQ ID NO: 3139981 - DNA, 15 bp, Homo sapiens
catctgcattcctga

SEQ ID NO: 3139982 - DNA, 16 bp, Homo sapiens
catctgcattcctgat

SEQ ID NO: 3139983 - DNA, 19 bp, Homo sapiens
catctgcattttcacccca

SEQ ID NO: 3139984 - DNA, 14 bp, Homo sapiens
catctgccagacct

SEQ ID NO: 3139985 - DNA, 21 bp, Homo sapiens
catctgcccaggggtgccccc

SEQ ID NO: 3139986 - DNA, 16 bp, Homo sapiens
catctgcccctccccc

SEQ ID NO: 3139987 - DNA, 18 bp, Homo sapiens
catctgcccctcccccaa

SEQ ID NO: 3139988 - DNA, 20 bp, Homo sapiens
catctgccttaaaaccaaag

SEQ ID NO: 3139989 - DNA, 12 bp, Homo sapiens
catctgctaata

SEQ ID NO: 3139990 - DNA, 22 bp, Homo sapiens
catctgcttggttggctggcag

SEQ ID NO: 3139991 - DNA, 16 bp, Homo sapiens
catctggaatctggag

SEQ ID NO: 3139992 - DNA, 11 bp, Homo sapiens
catctggcctg

SEQ ID NO: 3139993 - DNA, 12 bp, Homo sapiens
catctggcctgg

SEQ ID NO: 3139994 - DNA, 13 bp, Homo sapiens
catctggcctggc

SEQ ID NO: 3139995 - DNA, 14 bp, Homo sapiens
catctggcctggcc

SEQ ID NO: 3139996 - DNA, 18 bp, Homo sapiens
catctggctctaattcac

SEQ ID NO: 3139997 - DNA, 23 bp, Homo sapiens
catctggctgtttagcagaactc

SEQ ID NO: 3139998 - DNA, 17 bp, Homo sapiens
catctggcttattttaa

SEQ ID NO: 3139999 - DNA, 11 bp, Homo sapiens
catctggggat

SEQ ID NO: 3140000 - DNA, 21 bp, Homo sapiens
catctggggcccatactggtt

SEQ ID NO: 3140001 - DNA, 21 bp, Homo sapiens
catctggggttggcaacagga

SEQ ID NO: 3140002 - DNA, 20 bp, Homo sapiens
catctgtataccctctgttt

SEQ ID NO: 3140003 - DNA, 14 bp, Homo sapiens
catctgtcaacagg

SEQ ID NO: 3140004 - DNA, 17 bp, Homo sapiens
catctgtcattatattc

SEQ ID NO: 3140005 - DNA, 19 bp, Homo sapiens
catctgtcattatattcta

SEQ ID NO: 3140006 - DNA, 23 bp, Homo sapiens
catctgtcattatattctaatta

SEQ ID NO: 3140007 - DNA, 22 bp, Homo sapiens
catctgtccatggcctttctaa

SEQ ID NO: 3140008 - DNA, 13 bp, Homo sapiens
catctgtggagct

SEQ ID NO: 3140009 - DNA, 22 bp, Homo sapiens
catctgtggagctgccacagag

SEQ ID NO: 3140010 - DNA, 19 bp, Homo sapiens
catctgtttaatttacaca

SEQ ID NO: 3140011 - DNA, 18 bp, Homo sapiens
catcttaaaaatattgtc

SEQ ID NO: 3140012 - DNA, 15 bp, Homo sapiens
catcttaatgttact

SEQ ID NO: 3140013 - DNA, 19 bp, Homo sapiens
catcttacttgagccttta

SEQ ID NO: 3140014 - DNA, 14 bp, Homo sapiens
catcttagtgcctg

SEQ ID NO: 3140015 - DNA, 19 bp, Homo sapiens
catcttatagcactttgaa

SEQ ID NO: 3140016 - DNA, 14 bp, Homo sapiens
catcttcactggct

SEQ ID NO: 3140017 - DNA, 14 bp, Homo sapiens
catcttcacttcta

SEQ ID NO: 3140018 - DNA, 22 bp, Homo sapiens
catcttccaagggtactaagga

SEQ ID NO: 3140019 - DNA, 17 bp, Homo sapiens
catcttccacctgtgcc

SEQ ID NO: 3140020 - DNA, 20 bp, Homo sapiens
catcttccacctgtgccctc

SEQ ID NO: 3140021 - DNA, 16 bp, Homo sapiens
catcttcctgctgctg

SEQ ID NO: 3140022 - DNA, 21 bp, Homo sapiens
catcttctaaacccaatccaa

SEQ ID NO: 3140023 - DNA, 19 bp, Homo sapiens
catcttctccccacagcct

SEQ ID NO: 3140024 - DNA, 22 bp, Homo sapiens
catcttctccccacagcctctg

SEQ ID NO: 3140025 - DNA, 13 bp, Homo sapiens
catcttctggaat

SEQ ID NO: 3140026 - DNA, 14 bp, Homo sapiens
catcttctggcttg

SEQ ID NO: 3140027 - DNA, 20 bp, Homo sapiens
catcttgaagggcccaggag

SEQ ID NO: 3140028 - DNA, 23 bp, Homo sapiens
catcttgctaccagtatttagaa

SEQ ID NO: 3140029 - DNA, 13 bp, Homo sapiens
catcttgctctgc

SEQ ID NO: 3140030 - DNA, 14 bp, Homo sapiens
catcttgcttccct

SEQ ID NO: 3140031 - DNA, 23 bp, Homo sapiens
catcttgtaatttccagctttct

SEQ ID NO: 3140032 - DNA, 16 bp, Homo sapiens
catcttgttcttcccc

SEQ ID NO: 3140033 - DNA, 22 bp, Homo sapiens
catctttacaaaactacatgag

SEQ ID NO: 3140034 - DNA, 13 bp, Homo sapiens
catctttcctgtc

SEQ ID NO: 3140035 - DNA, 17 bp, Homo sapiens
catctttgccttgggct

SEQ ID NO: 3140036 - DNA, 22 bp, Homo sapiens
catctttgccttgggctgctcc

SEQ ID NO: 3140037 - DNA, 17 bp, Homo sapiens
catcttttattcttttt

SEQ ID NO: 3140038 - DNA, 21 bp, Homo sapiens
catcttttgaggcttctgttc

SEQ ID NO: 3140039 - DNA, 22 bp, Homo sapiens
catctttttctttttaacccta

SEQ ID NO: 3140040 - DNA, 13 bp, Homo sapiens
catgaaaaagcag

SEQ ID NO: 3140041 - DNA, 17 bp, Homo sapiens
catgaaaattttaaaaa

SEQ ID NO: 3140042 - DNA, 19 bp, Homo sapiens
catgaaacagaaacaaaaa

SEQ ID NO: 3140043 - DNA, 14 bp, Homo sapiens
catgaaatatgcat

SEQ ID NO: 3140044 - DNA, 15 bp, Homo sapiens
catgaaatatgcatc

SEQ ID NO: 3140045 - DNA, 13 bp, Homo sapiens
catgaaatgccct

SEQ ID NO: 3140046 - DNA, 18 bp, Homo sapiens
catgaaattgtatctcag

SEQ ID NO: 3140047 - DNA, 17 bp, Homo sapiens
catgaacagctctgaga

SEQ ID NO: 3140048 - DNA, 19 bp, Homo sapiens
catgaacagctctgagatc

SEQ ID NO: 3140049 - DNA, 17 bp, Homo sapiens
catgaagacaggacagt

SEQ ID NO: 3140050 - DNA, 13 bp, Homo sapiens
catgaagatattt

SEQ ID NO: 3140051 - DNA, 12 bp, Homo sapiens
catgaagcatta

SEQ ID NO: 3140052 - DNA, 16 bp, Homo sapiens
catgaagccaggtgtg

SEQ ID NO: 3140053 - DNA, 21 bp, Homo sapiens
catgaattttaaagtatgcat

SEQ ID NO: 3140054 - DNA, 13 bp, Homo sapiens
catgaattttaca

SEQ ID NO: 3140055 - DNA, 15 bp, Homo sapiens
catgaattttacatg

SEQ ID NO: 3140056 - DNA, 21 bp, Homo sapiens
catgacaactttgccagcttt

SEQ ID NO: 3140057 - DNA, 21 bp, Homo sapiens
catgacacccgtgagcgcctg

SEQ ID NO: 3140058 - DNA, 13 bp, Homo sapiens
catgacagcctcc

SEQ ID NO: 3140059 - DNA, 23 bp, Homo sapiens
catgacctaccaggacagaactt

SEQ ID NO: 3140060 - DNA, 18 bp, Homo sapiens
catgacctagttttccat

SEQ ID NO: 3140061 - DNA, 22 bp, Homo sapiens
catgacctgatcactagcctgt

SEQ ID NO: 3140062 - DNA, 23 bp, Homo sapiens
catgacctgatcactagcctgtc

SEQ ID NO: 3140063 - DNA, 14 bp, Homo sapiens
catgacctgtgacc

SEQ ID NO: 3140064 - DNA, 21 bp, Homo sapiens
catgactgcacccagctccag

SEQ ID NO: 3140065 - DNA, 23 bp, Homo sapiens
catgactgcacccagctccaggg

SEQ ID NO: 3140066 - DNA, 18 bp, Homo sapiens
catgactggctgtctgcc

SEQ ID NO: 3140067 - DNA, 21 bp, Homo sapiens
catgactggctgtctgcctgt

SEQ ID NO: 3140068 - DNA, 13 bp, Homo sapiens
catgactgggcct

SEQ ID NO: 3140069 - DNA, 21 bp, Homo sapiens
catgactgggcctcccttggg

SEQ ID NO: 3140070 - DNA, 22 bp, Homo sapiens
catgactgtgaccaccttctgt

SEQ ID NO: 3140071 - DNA, 13 bp, Homo sapiens
catgagaaagaat

SEQ ID NO: 3140072 - DNA, 20 bp, Homo sapiens
catgagaataagagaaagaa

SEQ ID NO: 3140073 - DNA, 16 bp, Homo sapiens
catgagcaccccaagg

SEQ ID NO: 3140074 - DNA, 21 bp, Homo sapiens
catgagcaccccaaggctgcg

SEQ ID NO: 3140075 - DNA, 20 bp, Homo sapiens
catgagccactgagcctggc

SEQ ID NO: 3140076 - DNA, 18 bp, Homo sapiens
catgagcctcagcatcct

SEQ ID NO: 3140077 - DNA, 20 bp, Homo sapiens
catgagcctcagcatcctgg

SEQ ID NO: 3140078 - DNA, 19 bp, Homo sapiens
catgagcctgcccgctgca

SEQ ID NO: 3140079 - DNA, 14 bp, Homo sapiens
catgagcttttata

SEQ ID NO: 3140080 - DNA, 14 bp, Homo sapiens
catgaggccatctc

SEQ ID NO: 3140081 - DNA, 19 bp, Homo sapiens
catgaggccatctcaggag

SEQ ID NO: 3140082 - DNA, 20 bp, Homo sapiens
catgaggccatctcaggaga

SEQ ID NO: 3140083 - DNA, 21 bp, Homo sapiens
catgaggccatctcaggagat

SEQ ID NO: 3140084 - DNA, 17 bp, Homo sapiens
catgagggatcacaggg

SEQ ID NO: 3140085 - DNA, 19 bp, Homo sapiens
catgagggatcacagggcc

SEQ ID NO: 3140086 - DNA, 20 bp, Homo sapiens
catgagtccttgaaaatatt

SEQ ID NO: 3140087 - DNA, 12 bp, Homo sapiens
catgagttattc

SEQ ID NO: 3140088 - DNA, 18 bp, Homo sapiens
catgagttattcataaag

SEQ ID NO: 3140089 - DNA, 21 bp, Homo sapiens
catgagttgtcagctttgact

SEQ ID NO: 3140090 - DNA, 22 bp, Homo sapiens
catgagtttgccctggtttcac

SEQ ID NO: 3140091 - DNA, 21 bp, Homo sapiens
catgatccctgtgttgtctct

SEQ ID NO: 3140092 - DNA, 12 bp, Homo sapiens
catgatctgtat

SEQ ID NO: 3140093 - DNA, 19 bp, Homo sapiens
catgatggagcgcacctgc

SEQ ID NO: 3140094 - DNA, 16 bp, Homo sapiens
catgatgggaaaatat

SEQ ID NO: 3140095 - DNA, 20 bp, Homo sapiens
catgatgggaatagggagac

SEQ ID NO: 3140096 - DNA, 22 bp, Homo sapiens
catgatggttattttcttttct

SEQ ID NO: 3140097 - DNA, 23 bp, Homo sapiens
catgatggttattttcttttctt

SEQ ID NO: 3140098 - DNA, 22 bp, Homo sapiens
catgatgttaaccagaataaag

SEQ ID NO: 3140099 - DNA, 22 bp, Homo sapiens
catgattagcagaagaaaggaa

SEQ ID NO: 3140100 - DNA, 21 bp, Homo sapiens
catgattcatgccaattagca

SEQ ID NO: 3140101 - DNA, 21 bp, Homo sapiens
catgattctttaatagaagtt

SEQ ID NO: 3140102 - DNA, 19 bp, Homo sapiens
catgatttgtcccagcctg

SEQ ID NO: 3140103 - DNA, 16 bp, Homo sapiens
catgcaaaaagaaatg

SEQ ID NO: 3140104 - DNA, 12 bp, Homo sapiens
catgtctggcta

SEQ ID NO: 3140105 - DNA, 13 bp, Homo sapiens
catgtcttgtaca

SEQ ID NO: 3140106 - DNA, 12 bp, Homo sapiens
catgtgaaacct

SEQ ID NO: 3140107 - DNA, 21 bp, Homo sapiens
catgtgaaaccttttttaaga

SEQ ID NO: 3140108 - DNA, 13 bp, Homo sapiens
catgtgacacata

SEQ ID NO: 3140109 - DNA, 12 bp, Homo sapiens
catgtgacattt

SEQ ID NO: 3140110 - DNA, 13 bp, Homo sapiens
catgtgacattta

SEQ ID NO: 3140111 - DNA, 16 bp, Homo sapiens
catgtgacatttatat

SEQ ID NO: 3140112 - DNA, 12 bp, Homo sapiens
catgtgagccac

SEQ ID NO: 3140113 - DNA, 17 bp, Homo sapiens
catgtgagccaccgctg

SEQ ID NO: 3140114 - DNA, 18 bp, Homo sapiens
catgtgaggaggaaaagg

SEQ ID NO: 3140115 - DNA, 16 bp, Homo sapiens
catgtgatcacgcctg

SEQ ID NO: 3140116 - DNA, 12 bp, Homo sapiens
catgtgattaat

SEQ ID NO: 3140117 - DNA, 15 bp, Homo sapiens
catgtgattaatgtt

SEQ ID NO: 3140118 - DNA, 16 bp, Homo sapiens
catgtgattaatgttt

SEQ ID NO: 3140119 - DNA, 22 bp, Homo sapiens
catgtgattaatgttttcatta

SEQ ID NO: 3140120 - DNA, 19 bp, Homo sapiens
catgtgccaagattctact

SEQ ID NO: 3140121 - DNA, 24 bp, Homo sapiens
catgtgccaagattctactcttgt

SEQ ID NO: 3140122 - DNA, 24 bp, Homo sapiens
catgtgccagggcaatgatgaatg

SEQ ID NO: 3140123 - DNA, 19 bp, Homo sapiens
catgtgccatctgtacata

SEQ ID NO: 3140124 - DNA, 16 bp, Homo sapiens
catgtgccgaatgtgc

SEQ ID NO: 3140125 - DNA, 20 bp, Homo sapiens
catgtgcctgcaccaggaga

SEQ ID NO: 3140126 - DNA, 22 bp, Homo sapiens
catgtgcctgcaccaggagaca

SEQ ID NO: 3140127 - DNA, 23 bp, Homo sapiens
catgtgctgtgaccatttataat

SEQ ID NO: 3140128 - DNA, 19 bp, Homo sapiens
catgtggagaaaggagtga

SEQ ID NO: 3140129 - DNA, 11 bp, Homo sapiens
catgtggctga

SEQ ID NO: 3140130 - DNA, 15 bp, Homo sapiens
catgtggctgaagac

SEQ ID NO: 3140131 - DNA, 20 bp, Homo sapiens
catgtggcttttttaaaaaa

SEQ ID NO: 3140132 - DNA, 21 bp, Homo sapiens
catgtggcttttttaaaaaag

SEQ ID NO: 3140133 - DNA, 22 bp, Homo sapiens
catgtgggaaaaaaatgaatga

SEQ ID NO: 3140134 - DNA, 14 bp, Homo sapiens
catgtggggccagg

SEQ ID NO: 3140135 - DNA, 15 bp, Homo sapiens
catgtggggccaggt

SEQ ID NO: 3140136 - DNA, 17 bp, Homo sapiens
catgtgggtgagccagt

SEQ ID NO: 3140137 - DNA, 15 bp, Homo sapiens
catgtggtttataga

SEQ ID NO: 3140138 - DNA, 22 bp, Homo sapiens
catgtgtacattctgcctagag

SEQ ID NO: 3140139 - DNA, 15 bp, Homo sapiens
catgtgtagcctatg

SEQ ID NO: 3140140 - DNA, 16 bp, Homo sapiens
catgtgtagcctatgt

SEQ ID NO: 3140141 - DNA, 16 bp, Homo sapiens
catgtgtagcctgtgc

SEQ ID NO: 3140142 - DNA, 11 bp, Homo sapiens
catgtgtatgt

SEQ ID NO: 3140143 - DNA, 23 bp, Homo sapiens
catgtgtcaacacccctgtgtgg

SEQ ID NO: 3140144 - DNA, 17 bp, Homo sapiens
catgtgtcacttgtgct

SEQ ID NO: 3140145 - DNA, 18 bp, Homo sapiens
catgtgtcacttgtgctt

SEQ ID NO: 3140146 - DNA, 14 bp, Homo sapiens
catgtgtcagagtg

SEQ ID NO: 3140147 - DNA, 14 bp, Homo sapiens
catgtgtcccctca

SEQ ID NO: 3140148 - DNA, 15 bp, Homo sapiens
catgtgtcctggttc

SEQ ID NO: 3140149 - DNA, 14 bp, Homo sapiens
catgtgtgcctgtg

SEQ ID NO: 3140150 - DNA, 19 bp, Homo sapiens
catgtgtgcctgtggcaga

SEQ ID NO: 3140151 - DNA, 12 bp, Homo sapiens
catgtgtggaaa

SEQ ID NO: 3140152 - DNA, 13 bp, Homo sapiens
catgtgtgtatat

SEQ ID NO: 3140153 - DNA, 16 bp, Homo sapiens
catgtgtgtatatatg

SEQ ID NO: 3140154 - DNA, 17 bp, Homo sapiens
catgtgtgtatatatgt

SEQ ID NO: 3140155 - DNA, 15 bp, Homo sapiens
catgtgtgtgagttt

SEQ ID NO: 3140156 - DNA, 20 bp, Homo sapiens
catgtgttttaattccaata

SEQ ID NO: 3140157 - DNA, 15 bp, Homo sapiens
catgttaactttatt

SEQ ID NO: 3140158 - DNA, 17 bp, Homo sapiens
catgttaactttattac

SEQ ID NO: 3140159 - DNA, 17 bp, Homo sapiens
catgttacataagataa

SEQ ID NO: 3140160 - DNA, 21 bp, Homo sapiens
catgttacataagataaatgt

SEQ ID NO: 3140161 - DNA, 17 bp, Homo sapiens
catgttactggataaat

SEQ ID NO: 3140162 - DNA, 20 bp, Homo sapiens
catgttagtaatggcagagc

SEQ ID NO: 3140163 - DNA, 14 bp, Homo sapiens
catgttatatattt

SEQ ID NO: 3140164 - DNA, 20 bp, Homo sapiens
catgttatatttaatgcatt

SEQ ID NO: 3140165 - DNA, 21 bp, Homo sapiens
catgttcattataatctcaaa

SEQ ID NO: 3140166 - DNA, 13 bp, Homo sapiens
catgttcctcaaa

SEQ ID NO: 3140167 - DNA, 15 bp, Homo sapiens
catgttctgccccca

SEQ ID NO: 3140168 - DNA, 17 bp, Homo sapiens
catgttctgcccccagc

SEQ ID NO: 3140169 - DNA, 22 bp, Homo sapiens
catgttgcaaagaactccagag

SEQ ID NO: 3140170 - DNA, 12 bp, Homo sapiens
catgttggccaa

SEQ ID NO: 3140171 - DNA, 14 bp, Homo sapiens
catgttggccaggc

SEQ ID NO: 3140172 - DNA, 17 bp, Homo sapiens
catgttggccaggctgg

SEQ ID NO: 3140173 - DNA, 19 bp, Homo sapiens
catgttggccaggctggtc

SEQ ID NO: 3140174 - DNA, 21 bp, Homo sapiens
catgttggccaggctggtctt

SEQ ID NO: 3140175 - DNA, 15 bp, Homo sapiens
catgttgtaatgctg

SEQ ID NO: 3140176 - DNA, 16 bp, Homo sapiens
catgttgtaatgctgc

SEQ ID NO: 3140177 - DNA, 18 bp, Homo sapiens
catgttgttaaaattatg

SEQ ID NO: 3140178 - DNA, 13 bp, Homo sapiens
catgtttataaat

SEQ ID NO: 3140179 - DNA, 13 bp, Homo sapiens
catgtttatgaaa

SEQ ID NO: 3140180 - DNA, 19 bp, Homo sapiens
catgtttatgaaaataaat

SEQ ID NO: 3140181 - DNA, 23 bp, Homo sapiens
catgtttatgaaaataaatagct

SEQ ID NO: 3140182 - DNA, 20 bp, Homo sapiens
catgtttatttttcttgtct

SEQ ID NO: 3140183 - DNA, 13 bp, Homo sapiens
catgtttcactta

SEQ ID NO: 3140184 - DNA, 20 bp, Homo sapiens
catgtttggtgcatagaact

SEQ ID NO: 3140185 - DNA, 22 bp, Homo sapiens
catgtttggtgcatagaactgg

SEQ ID NO: 3140186 - DNA, 13 bp, Homo sapiens
catgtttgtaaaa

SEQ ID NO: 3140187 - DNA, 15 bp, Homo sapiens
catgttttgtataca

SEQ ID NO: 3140188 - DNA, 22 bp, Homo sapiens
cattaaaaaatgaaatattttt

SEQ ID NO: 3140189 - DNA, 20 bp, Homo sapiens
cattaaaagaagactggaag

SEQ ID NO: 3140190 - DNA, 11 bp, Homo sapiens
cattaaaataa

SEQ ID NO: 3140191 - DNA, 13 bp, Homo sapiens
cattaaacctgtc

SEQ ID NO: 3140192 - DNA, 22 bp, Homo sapiens
cattaaacctgtctccactgtg

SEQ ID NO: 3140193 - DNA, 23 bp, Homo sapiens
cattaaacctgtctccactgtgc

SEQ ID NO: 3140194 - DNA, 17 bp, Homo sapiens
cattaaacttgaagcag

SEQ ID NO: 3140195 - DNA, 15 bp, Homo sapiens
cattaaagtcagaag

SEQ ID NO: 3140196 - DNA, 13 bp, Homo sapiens
cattaaagtctga

SEQ ID NO: 3140197 - DNA, 11 bp, Homo sapiens
cattaaatgaa

SEQ ID NO: 3140198 - DNA, 15 bp, Homo sapiens
cattaaatgaatatt

SEQ ID NO: 3140199 - DNA, 14 bp, Homo sapiens
cattaaatgtttga

SEQ ID NO: 3140200 - DNA, 21 bp, Homo sapiens
cattaaattcacaaactttta

SEQ ID NO: 3140201 - DNA, 13 bp, Homo sapiens
cattaacagtttt

SEQ ID NO: 3140202 - DNA, 16 bp, Homo sapiens
cattaacagttttcca

SEQ ID NO: 3140203 - DNA, 18 bp, Homo sapiens
cattaactaatctattgg

SEQ ID NO: 3140204 - DNA, 21 bp, Homo sapiens
cattaagtaatcaataaagaa

SEQ ID NO: 3140205 - DNA, 20 bp, Homo sapiens
cattaagtcatgtgtgaaca

SEQ ID NO: 3140206 - DNA, 15 bp, Homo sapiens
cattaatagcagcct

SEQ ID NO: 3140207 - DNA, 18 bp, Homo sapiens
cattaatagcagcctttc

SEQ ID NO: 3140208 - DNA, 18 bp, Homo sapiens
cattaatcaatcatctgt

SEQ ID NO: 3140209 - DNA, 16 bp, Homo sapiens
cattaatcatttcccc

SEQ ID NO: 3140210 - DNA, 19 bp, Homo sapiens
cattaatgcctgctttttg

SEQ ID NO: 3140211 - DNA, 23 bp, Homo sapiens
cattaatgcctgctttttggaaa

SEQ ID NO: 3140212 - DNA, 14 bp, Homo sapiens
cattaatgtgttgg

SEQ ID NO: 3140213 - DNA, 13 bp, Homo sapiens
cattaatgttaat

SEQ ID NO: 3140214 - DNA, 12 bp, Homo sapiens
cattaatgtttc

SEQ ID NO: 3140215 - DNA, 16 bp, Homo sapiens
cattaattaattaaag

SEQ ID NO: 3140216 - DNA, 21 bp, Homo sapiens
cattaattcaggcatatttta

SEQ ID NO: 3140217 - DNA, 12 bp, Homo sapiens
cattaattctat

SEQ ID NO: 3140218 - DNA, 18 bp, Homo sapiens
cattaattttgtgcattc

SEQ ID NO: 3140219 - DNA, 22 bp, Homo sapiens
cattacaactgaccaagtttct

SEQ ID NO: 3140220 - DNA, 22 bp, Homo sapiens
cattacagagaggagaaacaca

SEQ ID NO: 3140221 - DNA, 21 bp, Homo sapiens
cattacagaggtattaaaact

SEQ ID NO: 3140222 - DNA, 15 bp, Homo sapiens
cattacagttcataa

SEQ ID NO: 3140223 - DNA, 16 bp, Homo sapiens
cattacccttccctgc

SEQ ID NO: 3140224 - DNA, 19 bp, Homo sapiens
cattacccttccctgcact

SEQ ID NO: 3140225 - DNA, 20 bp, Homo sapiens
cattactgttccagattcct

SEQ ID NO: 3140226 - DNA, 15 bp, Homo sapiens
cattacttgctttca

SEQ ID NO: 3140227 - DNA, 14 bp, Homo sapiens
cattagaaaaagag

SEQ ID NO: 3140228 - DNA, 21 bp, Homo sapiens
cattagattttattttactat

SEQ ID NO: 3140229 - DNA, 17 bp, Homo sapiens
cattagcagtttgcttt

SEQ ID NO: 3140230 - DNA, 15 bp, Homo sapiens
cattagcataatttt

SEQ ID NO: 3140231 - DNA, 13 bp, Homo sapiens
catttactaaaca

SEQ ID NO: 3140232 - DNA, 15 bp, Homo sapiens
catttactaaacata

SEQ ID NO: 3140233 - DNA, 21 bp, Homo sapiens
catttactaaacatatgattt

SEQ ID NO: 3140234 - DNA, 12 bp, Homo sapiens
catttagaaaag

SEQ ID NO: 3140235 - DNA, 15 bp, Homo sapiens
catttagaaaataga

SEQ ID NO: 3140236 - DNA, 18 bp, Homo sapiens
catttagataatttgaaa

SEQ ID NO: 3140237 - DNA, 19 bp, Homo sapiens
catttagataatttgaaaa

SEQ ID NO: 3140238 - DNA, 13 bp, Homo sapiens
catttagcaataa

SEQ ID NO: 3140239 - DNA, 14 bp, Homo sapiens
catttagcaataaa

SEQ ID NO: 3140240 - DNA, 20 bp, Homo sapiens
catttagcaataaataacac

SEQ ID NO: 3140241 - DNA, 16 bp, Homo sapiens
catttagcatgttgtt

SEQ ID NO: 3140242 - DNA, 16 bp, Homo sapiens
catttaggggcaagca

SEQ ID NO: 3140243 - DNA, 15 bp, Homo sapiens
catttagtaagaata

SEQ ID NO: 3140244 - DNA, 17 bp, Homo sapiens
catttagtcatgtgacc

SEQ ID NO: 3140245 - DNA, 19 bp, Homo sapiens
catttagtgagttattcct

SEQ ID NO: 3140246 - DNA, 17 bp, Homo sapiens
catttagtgctaaacaa

SEQ ID NO: 3140247 - DNA, 20 bp, Homo sapiens
catttagttctttgttattt

SEQ ID NO: 3140248 - DNA, 14 bp, Homo sapiens
catttataacccca

SEQ ID NO: 3140249 - DNA, 16 bp, Homo sapiens
catttataaccccagc

SEQ ID NO: 3140250 - DNA, 22 bp, Homo sapiens
catttataaccccagcctgacc

SEQ ID NO: 3140251 - DNA, 14 bp, Homo sapiens
catttataatgttt

SEQ ID NO: 3140252 - DNA, 17 bp, Homo sapiens
catttataatgtttgct

SEQ ID NO: 3140253 - DNA, 21 bp, Homo sapiens
catttataatgtttgctattg

SEQ ID NO: 3140254 - DNA, 15 bp, Homo sapiens
catttatacaaatta

SEQ ID NO: 3140255 - DNA, 12 bp, Homo sapiens
catttatatatt

SEQ ID NO: 3140256 - DNA, 16 bp, Homo sapiens
catttatctataattt

SEQ ID NO: 3140257 - DNA, 21 bp, Homo sapiens
catttatctataatttaccta

SEQ ID NO: 3140258 - DNA, 16 bp, Homo sapiens
catttatgaagcaagc

SEQ ID NO: 3140259 - DNA, 19 bp, Homo sapiens
catttatgagtaactatta

SEQ ID NO: 3140260 - DNA, 20 bp, Homo sapiens
catttatgatttaataaaat

SEQ ID NO: 3140261 - DNA, 14 bp, Homo sapiens
catttatgcacatt

SEQ ID NO: 3140262 - DNA, 21 bp, Homo sapiens
catttatggtcaacacttaag

SEQ ID NO: 3140263 - DNA, 22 bp, Homo sapiens
catttatttatgaaaaaatatg

SEQ ID NO: 3140264 - DNA, 17 bp, Homo sapiens
catttattttttacatt

SEQ ID NO: 3140265 - DNA, 19 bp, Homo sapiens
catttattttttacattat

SEQ ID NO: 3140266 - DNA, 12 bp, Homo sapiens
catttcaaatgt

SEQ ID NO: 3140267 - DNA, 13 bp, Homo sapiens
catttcaaatgtt

SEQ ID NO: 3140268 - DNA, 15 bp, Homo sapiens
catttcaagcagctg

SEQ ID NO: 3140269 - DNA, 23 bp, Homo sapiens
catttcaaggaatggaatcttct

SEQ ID NO: 3140270 - DNA, 14 bp, Homo sapiens
catttcaatgtgta

SEQ ID NO: 3140271 - DNA, 20 bp, Homo sapiens
catttcaatgtgtataaatt

SEQ ID NO: 3140272 - DNA, 16 bp, Homo sapiens
catttcaattctcaaa

SEQ ID NO: 3140273 - DNA, 13 bp, Homo sapiens
catttcacacagt

SEQ ID NO: 3140274 - DNA, 15 bp, Homo sapiens
catttcacattaatg

SEQ ID NO: 3140275 - DNA, 16 bp, Homo sapiens
catttcacattattct

SEQ ID NO: 3140276 - DNA, 17 bp, Homo sapiens
catttcacattgaatca

SEQ ID NO: 3140277 - DNA, 17 bp, Homo sapiens
catttcaggaatttaaa

SEQ ID NO: 3140278 - DNA, 13 bp, Homo sapiens
catttcagggaga

SEQ ID NO: 3140279 - DNA, 14 bp, Homo sapiens
catttcagtatcat

SEQ ID NO: 3140280 - DNA, 15 bp, Homo sapiens
catttcagtggcttc

SEQ ID NO: 3140281 - DNA, 16 bp, Homo sapiens
catttcatcattgttt

SEQ ID NO: 3140282 - DNA, 15 bp, Homo sapiens
catttcattcaaatc

SEQ ID NO: 3140283 - DNA, 12 bp, Homo sapiens
catttcattgta

SEQ ID NO: 3140284 - DNA, 13 bp, Homo sapiens
catttcattgtat

SEQ ID NO: 3140285 - DNA, 16 bp, Homo sapiens
catttcattgtatgat

SEQ ID NO: 3140286 - DNA, 20 bp, Homo sapiens
catttcattgtatgatgtgt

SEQ ID NO: 3140287 - DNA, 19 bp, Homo sapiens
catttccacaccaagcagc

SEQ ID NO: 3140288 - DNA, 14 bp, Homo sapiens
catttcccaagtca

SEQ ID NO: 3140289 - DNA, 20 bp, Homo sapiens
catttcccaagtcagacaga

SEQ ID NO: 3140290 - DNA, 17 bp, Homo sapiens
catttcccacatctttc

SEQ ID NO: 3140291 - DNA, 21 bp, Homo sapiens
catttcccccgagctcttggc

SEQ ID NO: 3140292 - DNA, 23 bp, Homo sapiens
catttcccccgagctcttggcct

SEQ ID NO: 3140293 - DNA, 17 bp, Homo sapiens
catttccccctcctcag

SEQ ID NO: 3140294 - DNA, 15 bp, Homo sapiens
catttcccctccttc

SEQ ID NO: 3140295 - DNA, 16 bp, Homo sapiens
catttccgttttgcct

SEQ ID NO: 3140296 - DNA, 23 bp, Homo sapiens
catttcctatcacctatttccat

SEQ ID NO: 3140297 - DNA, 22 bp, Homo sapiens
catttcctcacactaagagggc

SEQ ID NO: 3140298 - DNA, 13 bp, Homo sapiens
catttcctgacag

SEQ ID NO: 3140299 - DNA, 22 bp, Homo sapiens
catttctaaaagaatattcaga

SEQ ID NO: 3140300 - DNA, 20 bp, Homo sapiens
catttctagcgcatggcctg

SEQ ID NO: 3140301 - DNA, 14 bp, Homo sapiens
catttctatacttt

SEQ ID NO: 3140302 - DNA, 13 bp, Homo sapiens
catttctatttat

SEQ ID NO: 3140303 - DNA, 14 bp, Homo sapiens
catttctatttatt

SEQ ID NO: 3140304 - DNA, 13 bp, Homo sapiens
catttctctgagc

SEQ ID NO: 3140305 - DNA, 16 bp, Homo sapiens
catttctgatcagagg

SEQ ID NO: 3140306 - DNA, 22 bp, Homo sapiens
catttctgatcagaggtgtaca

SEQ ID NO: 3140307 - DNA, 11 bp, Homo sapiens
catttctgttc

SEQ ID NO: 3140308 - DNA, 22 bp, Homo sapiens
catttcttacgttctttcactt

SEQ ID NO: 3140309 - DNA, 21 bp, Homo sapiens
catttcttagatggagaagtt

SEQ ID NO: 3140310 - DNA, 14 bp, Homo sapiens
catttctttcttgc

SEQ ID NO: 3140311 - DNA, 15 bp, Homo sapiens
catttctttcttgct

SEQ ID NO: 3140312 - DNA, 19 bp, Homo sapiens
catttctttcttgctggct

SEQ ID NO: 3140313 - DNA, 17 bp, Homo sapiens
catttgaacctggatcc

SEQ ID NO: 3140314 - DNA, 19 bp, Homo sapiens
catttgaagtgtacctgtg

SEQ ID NO: 3140315 - DNA, 18 bp, Homo sapiens
catttgagcagggctcag

SEQ ID NO: 3140316 - DNA, 20 bp, Homo sapiens
catttgagggcccagccagg

SEQ ID NO: 3140317 - DNA, 21 bp, Homo sapiens
catttgagggcccagccagga

SEQ ID NO: 3140318 - DNA, 22 bp, Homo sapiens
catttgagggcccagccaggag

SEQ ID NO: 3140319 - DNA, 17 bp, Homo sapiens
catttgatacccctggg

SEQ ID NO: 3140320 - DNA, 14 bp, Homo sapiens
catttgatagaaag

SEQ ID NO: 3140321 - DNA, 17 bp, Homo sapiens
catttgatgcatgtctt

SEQ ID NO: 3140322 - DNA, 22 bp, Homo sapiens
catttgatgcatgtcttttaaa

SEQ ID NO: 3140323 - DNA, 16 bp, Homo sapiens
catttgatgctaaata

SEQ ID NO: 3140324 - DNA, 14 bp, Homo sapiens
catttgatttaaac

SEQ ID NO: 3140325 - DNA, 19 bp, Homo sapiens
catttgcaatatggatttc

SEQ ID NO: 3140326 - DNA, 14 bp, Homo sapiens
catttgcacctctg

SEQ ID NO: 3140327 - DNA, 15 bp, Homo sapiens
catttgcacctctgt

SEQ ID NO: 3140328 - DNA, 20 bp, Homo sapiens
catttgcagggtcctcttct

SEQ ID NO: 3140329 - DNA, 12 bp, Homo sapiens
catttgcctatt

SEQ ID NO: 3140330 - DNA, 15 bp, Homo sapiens
catttgcctattccc

SEQ ID NO: 3140331 - DNA, 18 bp, Homo sapiens
catttgcctattcccaca

SEQ ID NO: 3140332 - DNA, 23 bp, Homo sapiens
catttgcctttctgggagcagaa

SEQ ID NO: 3140333 - DNA, 19 bp, Homo sapiens
catttgctctttcatctct

SEQ ID NO: 3140334 - DNA, 15 bp, Homo sapiens
catttgctgttttaa

SEQ ID NO: 3140335 - DNA, 16 bp, Homo sapiens
catttgctgttttaaa

SEQ ID NO: 3140336 - DNA, 20 bp, Homo sapiens
catttgcttgtactgggaca

SEQ ID NO: 3140337 - DNA, 15 bp, Homo sapiens
catttggaatgaata

SEQ ID NO: 3140338 - DNA, 18 bp, Homo sapiens
catttggattagaaattt

SEQ ID NO: 3140339 - DNA, 16 bp, Homo sapiens
catttggtattacaca

SEQ ID NO: 3140340 - DNA, 21 bp, Homo sapiens
catttggtggtactttattct

SEQ ID NO: 3140341 - DNA, 22 bp, Homo sapiens
catttggtggtactttattctt

SEQ ID NO: 3140342 - DNA, 17 bp, Homo sapiens
catttggtgttcctgga

SEQ ID NO: 3140343 - DNA, 13 bp, Homo sapiens
catttgtaataaa

SEQ ID NO: 3140344 - DNA, 17 bp, Homo sapiens
catttgtaataaagtat

SEQ ID NO: 3140345 - DNA, 11 bp, Homo sapiens
catttgtatat

SEQ ID NO: 3140346 - DNA, 15 bp, Homo sapiens
catttgtatattgtg

SEQ ID NO: 3140347 - DNA, 19 bp, Homo sapiens
catttgtatgtcaaagctt

SEQ ID NO: 3140348 - DNA, 20 bp, Homo sapiens
catttgtatgtcaaagcttt

SEQ ID NO: 3140349 - DNA, 14 bp, Homo sapiens
catttgtattttgt

SEQ ID NO: 3140350 - DNA, 17 bp, Homo sapiens
catttgtattttgtgtg

SEQ ID NO: 3140351 - DNA, 21 bp, Homo sapiens
catttgtcagtatttttgccg

SEQ ID NO: 3140352 - DNA, 14 bp, Homo sapiens
catttgtgaaatga

SEQ ID NO: 3140353 - DNA, 12 bp, Homo sapiens
catttgtgaggc

SEQ ID NO: 3140354 - DNA, 15 bp, Homo sapiens
catttgtgaggccca

SEQ ID NO: 3140355 - DNA, 15 bp, Homo sapiens
catttgtgccagagg

SEQ ID NO: 3140356 - DNA, 18 bp, Homo sapiens
catttgtggcagtccctt

SEQ ID NO: 3140357 - DNA, 14 bp, Homo sapiens
catttgtgtcaatg

SEQ ID NO: 3140358 - DNA, 22 bp, Homo sapiens
ccaagcatcttgggggggtggc

SEQ ID NO: 3140359 - DNA, 22 bp, Homo sapiens
ccaagccaagggaacctgtgtc

SEQ ID NO: 3140360 - DNA, 23 bp, Homo sapiens
ccaagccaagggaacctgtgtcc

SEQ ID NO: 3140361 - DNA, 16 bp, Homo sapiens
ccaagccagaggctgg

SEQ ID NO: 3140362 - DNA, 17 bp, Homo sapiens
ccaagccagaggctggg

SEQ ID NO: 3140363 - DNA, 14 bp, Homo sapiens
ccaagccagattct

SEQ ID NO: 3140364 - DNA, 20 bp, Homo sapiens
ccaagccagattctcttgaa

SEQ ID NO: 3140365 - DNA, 19 bp, Homo sapiens
ccaagccccatctcatcct

SEQ ID NO: 3140366 - DNA, 20 bp, Homo sapiens
ccaagccccatctcatcctg

SEQ ID NO: 3140367 - DNA, 24 bp, Homo sapiens
ccaagccccatctcatcctggcac

SEQ ID NO: 3140368 - DNA, 23 bp, Homo sapiens
ccaagccctggagccaactgctg

SEQ ID NO: 3140369 - DNA, 13 bp, Homo sapiens
ccaagccgtggct

SEQ ID NO: 3140370 - DNA, 14 bp, Homo sapiens
ccaagccgtggctt

SEQ ID NO: 3140371 - DNA, 17 bp, Homo sapiens
ccaagccgtggcttccc

SEQ ID NO: 3140372 - DNA, 13 bp, Homo sapiens
ccaagcctccaca

SEQ ID NO: 3140373 - DNA, 15 bp, Homo sapiens
ccaagcctccacagc

SEQ ID NO: 3140374 - DNA, 13 bp, Homo sapiens
ccaagcctgcctc

SEQ ID NO: 3140375 - DNA, 14 bp, Homo sapiens
ccaagcctgctggc

SEQ ID NO: 3140376 - DNA, 20 bp, Homo sapiens
ccaagctaagcactgccact

SEQ ID NO: 3140377 - DNA, 15 bp, Homo sapiens
ccaagctatctaaag

SEQ ID NO: 3140378 - DNA, 13 bp, Homo sapiens
ccaagctccctgc

SEQ ID NO: 3140379 - DNA, 21 bp, Homo sapiens
ccaagctccctgccccaaata

SEQ ID NO: 3140380 - DNA, 19 bp, Homo sapiens
ccaagctccctggagccct

SEQ ID NO: 3140381 - DNA, 16 bp, Homo sapiens
ccaagctgagtttcct

SEQ ID NO: 3140382 - DNA, 19 bp, Homo sapiens
ccaagctgagtttcctatg

SEQ ID NO: 3140383 - DNA, 23 bp, Homo sapiens
ccaagctgcctcccctctccttc

SEQ ID NO: 3140384 - DNA, 14 bp, Homo sapiens
ccaagctgttttct

SEQ ID NO: 3140385 - DNA, 15 bp, Homo sapiens
ccaagcttgttatca

SEQ ID NO: 3140386 - DNA, 15 bp, Homo sapiens
ccaagctttaaatta

SEQ ID NO: 3140387 - DNA, 22 bp, Homo sapiens
ccaaggacctcctcttccccct

SEQ ID NO: 3140388 - DNA, 23 bp, Homo sapiens
ccaaggactgactgagacacgat

SEQ ID NO: 3140389 - DNA, 16 bp, Homo sapiens
ccaaggacttccacat

SEQ ID NO: 3140390 - DNA, 19 bp, Homo sapiens
ccaaggacttccacatttt

SEQ ID NO: 3140391 - DNA, 20 bp, Homo sapiens
ccaaggacttccacattttt

SEQ ID NO: 3140392 - DNA, 21 bp, Homo sapiens
ccaaggagaaacagagacagg

SEQ ID NO: 3140393 - DNA, 13 bp, Homo sapiens
ccaaggagaccaa

SEQ ID NO: 3140394 - DNA, 16 bp, Homo sapiens
ccaaggagcacaggtc

SEQ ID NO: 3140395 - DNA, 18 bp, Homo sapiens
ccaaggagcacaggtccc

SEQ ID NO: 3140396 - DNA, 13 bp, Homo sapiens
ccaaggaggcctg

SEQ ID NO: 3140397 - DNA, 18 bp, Homo sapiens
ccaaggaggcctggggag

SEQ ID NO: 3140398 - DNA, 23 bp, Homo sapiens
ccaaggaggtgaggagcagagca

SEQ ID NO: 3140399 - DNA, 11 bp, Homo sapiens
ccaaggatccc

SEQ ID NO: 3140400 - DNA, 21 bp, Homo sapiens
ccaaggatcctctccactcca

SEQ ID NO: 3140401 - DNA, 15 bp, Homo sapiens
ccaaggcaaaaaact

SEQ ID NO: 3140402 - DNA, 13 bp, Homo sapiens
ccaaggcaaggca

SEQ ID NO: 3140403 - DNA, 14 bp, Homo sapiens
ccaaggcagcctcc

SEQ ID NO: 3140404 - DNA, 16 bp, Homo sapiens
ccaaggcagcctccag

SEQ ID NO: 3140405 - DNA, 17 bp, Homo sapiens
ccaaggcagcctccaga

SEQ ID NO: 3140406 - DNA, 18 bp, Homo sapiens
ccaaggccagagtggcct

SEQ ID NO: 3140407 - DNA, 18 bp, Homo sapiens
ccaaggccctgctttttt

SEQ ID NO: 3140408 - DNA, 18 bp, Homo sapiens
ccaaggctgcgtctggag

SEQ ID NO: 3140409 - DNA, 17 bp, Homo sapiens
ccaagggaacctgtgtc

SEQ ID NO: 3140410 - DNA, 18 bp, Homo sapiens
ccaagggaacctgtgtcc

SEQ ID NO: 3140411 - DNA, 17 bp, Homo sapiens
ccaagggcctcccacca

SEQ ID NO: 3140412 - DNA, 19 bp, Homo sapiens
ccaagggcctcccaccaga

SEQ ID NO: 3140413 - DNA, 22 bp, Homo sapiens
ccaaggggaatgtttgcctctg

SEQ ID NO: 3140414 - DNA, 23 bp, Homo sapiens
ccaagggtatccaagttggactg

SEQ ID NO: 3140415 - DNA, 22 bp, Homo sapiens
ccaagggtttcgactggtccag

SEQ ID NO: 3140416 - DNA, 23 bp, Homo sapiens
ccaaggtcccctccacatcccag

SEQ ID NO: 3140417 - DNA, 14 bp, Homo sapiens
ccaaggtcctgctc

SEQ ID NO: 3140418 - DNA, 14 bp, Homo sapiens
ccaaggtgctgatg

SEQ ID NO: 3140419 - DNA, 23 bp, Homo sapiens
ccaaggtttaaagagtctagatt

SEQ ID NO: 3140420 - DNA, 18 bp, Homo sapiens
ccaagtaccaatgctgtt

SEQ ID NO: 3140421 - DNA, 20 bp, Homo sapiens
ccaagtagctgggactacag

SEQ ID NO: 3140422 - DNA, 20 bp, Homo sapiens
ccaagtagctgggattacag

SEQ ID NO: 3140423 - DNA, 14 bp, Homo sapiens
ccaagtcagacaga

SEQ ID NO: 3140424 - DNA, 20 bp, Homo sapiens
ccaagtcagacagatgtcag

SEQ ID NO: 3140425 - DNA, 13 bp, Homo sapiens
ccaagtcattgtt

SEQ ID NO: 3140426 - DNA, 14 bp, Homo sapiens
ccaagtccaaatgt

SEQ ID NO: 3140427 - DNA, 22 bp, Homo sapiens
ccaagtccctgttttctgagcc

SEQ ID NO: 3140428 - DNA, 21 bp, Homo sapiens
ccaagtccgcagaagccctga

SEQ ID NO: 3140429 - DNA, 19 bp, Homo sapiens
ccaagtcctgaagaggcgg

SEQ ID NO: 3140430 - DNA, 20 bp, Homo sapiens
ccaagtcctgaagaggcggg

SEQ ID NO: 3140431 - DNA, 18 bp, Homo sapiens
ccaagtcggaacagcaga

SEQ ID NO: 3140432 - DNA, 19 bp, Homo sapiens
ccaagtcggaacagcagat

SEQ ID NO: 3140433 - DNA, 12 bp, Homo sapiens
ccaagtctctct

SEQ ID NO: 3140434 - DNA, 16 bp, Homo sapiens
ccaagtctctctgtga

SEQ ID NO: 3140435 - DNA, 17 bp, Homo sapiens
ccaagtctctctgtgaa

SEQ ID NO: 3140436 - DNA, 18 bp, Homo sapiens
ccaagtctctctgtgaat

SEQ ID NO: 3140437 - DNA, 17 bp, Homo sapiens
ccaagtctgtacctcaa

SEQ ID NO: 3140438 - DNA, 22 bp, Homo sapiens
ccaagtgccagaggtgggcagg

SEQ ID NO: 3140439 - DNA, 13 bp, Homo sapiens
ccaagtgcgtgcc

SEQ ID NO: 3140440 - DNA, 19 bp, Homo sapiens
ccaagtggggatggggcct

SEQ ID NO: 3140441 - DNA, 14 bp, Homo sapiens
ccaagtggtcagga

SEQ ID NO: 3140442 - DNA, 23 bp, Homo sapiens
ccaagtggtttccacatgctctg

SEQ ID NO: 3140443 - DNA, 12 bp, Homo sapiens
ccaagtgtgcta

SEQ ID NO: 3140444 - DNA, 20 bp, Homo sapiens
ccaagttataaatcaatgtc

SEQ ID NO: 3140445 - DNA, 16 bp, Homo sapiens
ccaagttatctttccc

SEQ ID NO: 3140446 - DNA, 19 bp, Homo sapiens
ccaagttccgtcagtccaa

SEQ ID NO: 3140447 - DNA, 19 bp, Homo sapiens
ccaagttcttcacctctat

SEQ ID NO: 3140448 - DNA, 16 bp, Homo sapiens
ccaagtttatttctct

SEQ ID NO: 3140449 - DNA, 16 bp, Homo sapiens
ccaagtttccatagca

SEQ ID NO: 3140450 - DNA, 13 bp, Homo sapiens
ccaataaaaacat

SEQ ID NO: 3140451 - DNA, 14 bp, Homo sapiens
ccaataaaaagttc

SEQ ID NO: 3140452 - DNA, 16 bp, Homo sapiens
ccaataaaaagttcag

SEQ ID NO: 3140453 - DNA, 17 bp, Homo sapiens
ccaataaaaagttcaga

SEQ ID NO: 3140454 - DNA, 21 bp, Homo sapiens
ccaataaaaagttcagagttc

SEQ ID NO: 3140455 - DNA, 23 bp, Homo sapiens
ccaataaagcttttggaagccgg

SEQ ID NO: 3140456 - DNA, 14 bp, Homo sapiens
ccaataaaggcagc

SEQ ID NO: 3140457 - DNA, 19 bp, Homo sapiens
ccaataaaggcagctgcct

SEQ ID NO: 3140458 - DNA, 16 bp, Homo sapiens
ccaataaagtgccttc

SEQ ID NO: 3140459 - DNA, 19 bp, Homo sapiens
ccaataaagtgccttctgg

SEQ ID NO: 3140460 - DNA, 23 bp, Homo sapiens
ccaataaagtgccttctgggctt

SEQ ID NO: 3140461 - DNA, 23 bp, Homo sapiens
ccaataacaaggagctcaccctg

SEQ ID NO: 3140462 - DNA, 21 bp, Homo sapiens
ccaatagcactttcattgcca

SEQ ID NO: 3140463 - DNA, 13 bp, Homo sapiens
ccaataggagtct

SEQ ID NO: 3140464 - DNA, 18 bp, Homo sapiens
ccaataggcaaattaatc

SEQ ID NO: 3140465 - DNA, 19 bp, Homo sapiens
ccaataggcaaattaatca

SEQ ID NO: 3140466 - DNA, 22 bp, Homo sapiens
ccaatatgtattgtaaacatgt

SEQ ID NO: 3140467 - DNA, 18 bp, Homo sapiens
ccaatattaaaagagacc

SEQ ID NO: 3140468 - DNA, 15 bp, Homo sapiens
ccaatattaaatctg

SEQ ID NO: 3140469 - DNA, 12 bp, Homo sapiens
ccaatattataa

SEQ ID NO: 3140470 - DNA, 18 bp, Homo sapiens
ccaatatttctgctttct

SEQ ID NO: 3140471 - DNA, 17 bp, Homo sapiens
ccaatcagcactgaaaa

SEQ ID NO: 3140472 - DNA, 14 bp, Homo sapiens
ccaatcattttaat

SEQ ID NO: 3140473 - DNA, 16 bp, Homo sapiens
ccaatcccagggctgg

SEQ ID NO: 3140474 - DNA, 20 bp, Homo sapiens
ccaatcccagggctggctct

SEQ ID NO: 3140475 - DNA, 17 bp, Homo sapiens
ccaatcccctccttggg

SEQ ID NO: 3140476 - DNA, 21 bp, Homo sapiens
ccaatcccctccttgggcact

SEQ ID NO: 3140477 - DNA, 20 bp, Homo sapiens
ccaatctctgctctctatgt

SEQ ID NO: 3140478 - DNA, 12 bp, Homo sapiens
ccaatgaaatga

SEQ ID NO: 3140479 - DNA, 15 bp, Homo sapiens
ccaatgatggtcacc

SEQ ID NO: 3140480 - DNA, 18 bp, Homo sapiens
ccaatgcttttatcaaac

SEQ ID NO: 3140481 - DNA, 14 bp, Homo sapiens
ccaatggaaacctc

SEQ ID NO: 3140482 - DNA, 15 bp, Homo sapiens
ccaatggaaacctca

SEQ ID NO: 3140483 - DNA, 13 bp, Homo sapiens
ccacctccccacg

SEQ ID NO: 3140484 - DNA, 18 bp, Homo sapiens
ccacctccccacgccctc

SEQ ID NO: 3140485 - DNA, 15 bp, Homo sapiens
ccacctccctgccca

SEQ ID NO: 3140486 - DNA, 16 bp, Homo sapiens
ccacctccctgcccag

SEQ ID NO: 3140487 - DNA, 18 bp, Homo sapiens
ccacctccctgcccaggc

SEQ ID NO: 3140488 - DNA, 13 bp, Homo sapiens
ccacctcggagca

SEQ ID NO: 3140489 - DNA, 15 bp, Homo sapiens
ccacctctccaaggg

SEQ ID NO: 3140490 - DNA, 16 bp, Homo sapiens
ccacctctccaagggc

SEQ ID NO: 3140491 - DNA, 16 bp, Homo sapiens
ccacctctccaagtct

SEQ ID NO: 3140492 - DNA, 14 bp, Homo sapiens
ccacctctggccct

SEQ ID NO: 3140493 - DNA, 16 bp, Homo sapiens
ccacctctggccctgt

SEQ ID NO: 3140494 - DNA, 18 bp, Homo sapiens
ccacctctggccctgtgt

SEQ ID NO: 3140495 - DNA, 22 bp, Homo sapiens
ccacctgaggtgggcccaggac

SEQ ID NO: 3140496 - DNA, 11 bp, Homo sapiens
ccacctgcacc

SEQ ID NO: 3140497 - DNA, 15 bp, Homo sapiens
ccacctgcagggctg

SEQ ID NO: 3140498 - DNA, 23 bp, Homo sapiens
ccacctgcccatcacagggttgg

SEQ ID NO: 3140499 - DNA, 13 bp, Homo sapiens
ccacctggccacc

SEQ ID NO: 3140500 - DNA, 15 bp, Homo sapiens
ccacctggccacctg

SEQ ID NO: 3140501 - DNA, 19 bp, Homo sapiens
ccacctgtagccatctgca

SEQ ID NO: 3140502 - DNA, 16 bp, Homo sapiens
ccacctgtctcagcct

SEQ ID NO: 3140503 - DNA, 18 bp, Homo sapiens
ccacctgtctcagcctcc

SEQ ID NO: 3140504 - DNA, 18 bp, Homo sapiens
ccaccttcaattcctggg

SEQ ID NO: 3140505 - DNA, 20 bp, Homo sapiens
ccaccttctgtccccagccc

SEQ ID NO: 3140506 - DNA, 21 bp, Homo sapiens
ccaccttctgtccccagccct

SEQ ID NO: 3140507 - DNA, 13 bp, Homo sapiens
ccaccttggctca

SEQ ID NO: 3140508 - DNA, 15 bp, Homo sapiens
ccaccttggctcaag

SEQ ID NO: 3140509 - DNA, 15 bp, Homo sapiens
ccaccttggctctgc

SEQ ID NO: 3140510 - DNA, 18 bp, Homo sapiens
ccaccttggctctgccag

SEQ ID NO: 3140511 - DNA, 15 bp, Homo sapiens
ccaccttggctgcag

SEQ ID NO: 3140512 - DNA, 16 bp, Homo sapiens
ccaccttggctgcagg

SEQ ID NO: 3140513 - DNA, 14 bp, Homo sapiens
ccacctttactgtg

SEQ ID NO: 3140514 - DNA, 15 bp, Homo sapiens
ccacgaccagcccct

SEQ ID NO: 3140515 - DNA, 15 bp, Homo sapiens
ccacgaggaccatcg

SEQ ID NO: 3140516 - DNA, 15 bp, Homo sapiens
ccacgagggctggct

SEQ ID NO: 3140517 - DNA, 19 bp, Homo sapiens
ccacgagggctggctggcc

SEQ ID NO: 3140518 - DNA, 16 bp, Homo sapiens
ccacgagggtcaggac

SEQ ID NO: 3140519 - DNA, 15 bp, Homo sapiens
ccacgagtcacctgc

SEQ ID NO: 3140520 - DNA, 18 bp, Homo sapiens
ccacgagtcacctgcaag

SEQ ID NO: 3140521 - DNA, 23 bp, Homo sapiens
ccacgagtcacctgcaagcccca

SEQ ID NO: 3140522 - DNA, 15 bp, Homo sapiens
ccacgatcctgccac

SEQ ID NO: 3140523 - DNA, 23 bp, Homo sapiens
ccacgatcctgccaccctgtagc

SEQ ID NO: 3140524 - DNA, 20 bp, Homo sapiens
ccacgattttctccagctca

SEQ ID NO: 3140525 - DNA, 19 bp, Homo sapiens
ccacgcactgggccacgga

SEQ ID NO: 3140526 - DNA, 14 bp, Homo sapiens
ccacgccccagccc

SEQ ID NO: 3140527 - DNA, 12 bp, Homo sapiens
ccacgcccgcac

SEQ ID NO: 3140528 - DNA, 13 bp, Homo sapiens
ccacgcccgcacc

SEQ ID NO: 3140529 - DNA, 17 bp, Homo sapiens
ccacgcccgcacccccg

SEQ ID NO: 3140530 - DNA, 20 bp, Homo sapiens
ccacgcccgtcctgcctgtg

SEQ ID NO: 3140531 - DNA, 15 bp, Homo sapiens
ccacgccctcccctc

SEQ ID NO: 3140532 - DNA, 16 bp, Homo sapiens
ccacgcctcctggcca

SEQ ID NO: 3140533 - DNA, 19 bp, Homo sapiens
ccacgcctcctggccagac

SEQ ID NO: 3140534 - DNA, 20 bp, Homo sapiens
ccacgcctgtcctcctggaa

SEQ ID NO: 3140535 - DNA, 21 bp, Homo sapiens
ccacgcctgtcctcctggaag

SEQ ID NO: 3140536 - DNA, 16 bp, Homo sapiens
ccacgctccagctgcc

SEQ ID NO: 3140537 - DNA, 16 bp, Homo sapiens
ccacgctggagtgcag

SEQ ID NO: 3140538 - DNA, 11 bp, Homo sapiens
ccacgctgtcc

SEQ ID NO: 3140539 - DNA, 13 bp, Homo sapiens
ccacgctgtcctc

SEQ ID NO: 3140540 - DNA, 18 bp, Homo sapiens
ccacgctgtggccctgga

SEQ ID NO: 3140541 - DNA, 15 bp, Homo sapiens
ccacggacccccaga

SEQ ID NO: 3140542 - DNA, 22 bp, Homo sapiens
ccacggaggagggatgctgctc

SEQ ID NO: 3140543 - DNA, 23 bp, Homo sapiens
ccacggaggagggatgctgctcc

SEQ ID NO: 3140544 - DNA, 12 bp, Homo sapiens
ccacggccaggc

SEQ ID NO: 3140545 - DNA, 23 bp, Homo sapiens
ccacggccaggccagagggagtg

SEQ ID NO: 3140546 - DNA, 15 bp, Homo sapiens
ccacggccgctccag

SEQ ID NO: 3140547 - DNA, 19 bp, Homo sapiens
ccacggcctggctggtggg

SEQ ID NO: 3140548 - DNA, 23 bp, Homo sapiens
ccacggcctggctggtgggaagg

SEQ ID NO: 3140549 - DNA, 17 bp, Homo sapiens
ccacggctaagaggctg

SEQ ID NO: 3140550 - DNA, 19 bp, Homo sapiens
ccacggtgcgtggctgtgg

SEQ ID NO: 3140551 - DNA, 14 bp, Homo sapiens
ccacgtcccagcat

SEQ ID NO: 3140552 - DNA, 15 bp, Homo sapiens
ccacgtcccagcatc

SEQ ID NO: 3140553 - DNA, 21 bp, Homo sapiens
ccacgtcccagcatccctgga

SEQ ID NO: 3140554 - DNA, 22 bp, Homo sapiens
ccacgtcccagcatccctggag

SEQ ID NO: 3140555 - DNA, 15 bp, Homo sapiens
ccacgtctgccaggc

SEQ ID NO: 3140556 - DNA, 14 bp, Homo sapiens
ccacgtggatgggc

SEQ ID NO: 3140557 - DNA, 21 bp, Homo sapiens
ccacgttggagaagcccgtgt

SEQ ID NO: 3140558 - DNA, 23 bp, Homo sapiens
ccactaaaaatattgtttctgca

SEQ ID NO: 3140559 - DNA, 21 bp, Homo sapiens
ccactacactccagcctgagc

SEQ ID NO: 3140560 - DNA, 12 bp, Homo sapiens
ccactactgcag

SEQ ID NO: 3140561 - DNA, 18 bp, Homo sapiens
ccactaggactctgaggc

SEQ ID NO: 3140562 - DNA, 16 bp, Homo sapiens
ccactatccttcgtga

SEQ ID NO: 3140563 - DNA, 14 bp, Homo sapiens
ccactcagccccta

SEQ ID NO: 3140564 - DNA, 17 bp, Homo sapiens
ccactcagcccctagga

SEQ ID NO: 3140565 - DNA, 18 bp, Homo sapiens
ccactcagcccctaggag

SEQ ID NO: 3140566 - DNA, 17 bp, Homo sapiens
ccactcagtctcttcca

SEQ ID NO: 3140567 - DNA, 21 bp, Homo sapiens
ccactccagacccctggcttt

SEQ ID NO: 3140568 - DNA, 13 bp, Homo sapiens
ccactccattccc

SEQ ID NO: 3140569 - DNA, 14 bp, Homo sapiens
ccactccattccca

SEQ ID NO: 3140570 - DNA, 16 bp, Homo sapiens
ccactccccaccttca

SEQ ID NO: 3140571 - DNA, 16 bp, Homo sapiens
ccactcccccacctga

SEQ ID NO: 3140572 - DNA, 13 bp, Homo sapiens
ccactccctgagc

SEQ ID NO: 3140573 - DNA, 12 bp, Homo sapiens
ccactccctgct

SEQ ID NO: 3140574 - DNA, 13 bp, Homo sapiens
ccactccctgctc

SEQ ID NO: 3140575 - DNA, 14 bp, Homo sapiens
ccactccctgctcc

SEQ ID NO: 3140576 - DNA, 16 bp, Homo sapiens
ccactccctgctccac

SEQ ID NO: 3140577 - DNA, 20 bp, Homo sapiens
ccactcccttgctggcccca

SEQ ID NO: 3140578 - DNA, 13 bp, Homo sapiens
ccactcccttggt

SEQ ID NO: 3140579 - DNA, 23 bp, Homo sapiens
ccactccgagaggtgggccagtc

SEQ ID NO: 3140580 - DNA, 11 bp, Homo sapiens
ccactcctctc

SEQ ID NO: 3140581 - DNA, 17 bp, Homo sapiens
ccactcctctcccacag

SEQ ID NO: 3140582 - DNA, 15 bp, Homo sapiens
ccactcctgtacact

SEQ ID NO: 3140583 - DNA, 20 bp, Homo sapiens
ccactcctgtcccgccttcc

SEQ ID NO: 3140584 - DNA, 13 bp, Homo sapiens
ccactccttgtcc

SEQ ID NO: 3140585 - DNA, 20 bp, Homo sapiens
ccactcgacccagaatggag

SEQ ID NO: 3140586 - DNA, 18 bp, Homo sapiens
ccactcgcttcccccata

SEQ ID NO: 3140587 - DNA, 21 bp, Homo sapiens
ccactcgcttcccccatagcc

SEQ ID NO: 3140588 - DNA, 23 bp, Homo sapiens
ccactcgggggtggagtgagact

SEQ ID NO: 3140589 - DNA, 18 bp, Homo sapiens
ccactcgtgcatccctga

SEQ ID NO: 3140590 - DNA, 16 bp, Homo sapiens
ccactctaccctccca

SEQ ID NO: 3140591 - DNA, 19 bp, Homo sapiens
ccactctaccctcccaccc

SEQ ID NO: 3140592 - DNA, 21 bp, Homo sapiens
ccactctaggggtcaggctcc

SEQ ID NO: 3140593 - DNA, 22 bp, Homo sapiens
ccactctaggggtcaggctcca

SEQ ID NO: 3140594 - DNA, 14 bp, Homo sapiens
ccactctccccaca

SEQ ID NO: 3140595 - DNA, 15 bp, Homo sapiens
ccactctccccacac

SEQ ID NO: 3140596 - DNA, 11 bp, Homo sapiens
ccactctcctt

SEQ ID NO: 3140597 - DNA, 13 bp, Homo sapiens
ccactctcggggc

SEQ ID NO: 3140598 - DNA, 15 bp, Homo sapiens
ccactctcttccctt

SEQ ID NO: 3140599 - DNA, 17 bp, Homo sapiens
ccactctgcttctctga

SEQ ID NO: 3140600 - DNA, 14 bp, Homo sapiens
ccactcttgaagag

SEQ ID NO: 3140601 - DNA, 15 bp, Homo sapiens
ccactcttgaagagg

SEQ ID NO: 3140602 - DNA, 22 bp, Homo sapiens
ccactgaaaacatttcaaagct

SEQ ID NO: 3140603 - DNA, 14 bp, Homo sapiens
ccactgaagctggg

SEQ ID NO: 3140604 - DNA, 16 bp, Homo sapiens
ccactgaagctgggat

SEQ ID NO: 3140605 - DNA, 16 bp, Homo sapiens
ccactgacagcctccc

SEQ ID NO: 3140606 - DNA, 19 bp, Homo sapiens
ccactgagtaccaggggct

SEQ ID NO: 3140607 - DNA, 22 bp, Homo sapiens
ccactgatagatgtctattctt

SEQ ID NO: 3140608 - DNA, 17 bp, Homo sapiens
ccactgcaccgggccac

SEQ ID NO: 3140609 - DNA, 13 bp, Homo sapiens
ccactgcactcca

SEQ ID NO: 3140610 - DNA, 17 bp, Homo sapiens
ccagcatctcagcgcca

SEQ ID NO: 3140611 - DNA, 11 bp, Homo sapiens
ccagcatctcc

SEQ ID NO: 3140612 - DNA, 16 bp, Homo sapiens
ccagcattccagactt

SEQ ID NO: 3140613 - DNA, 15 bp, Homo sapiens
ccagcattccagccc

SEQ ID NO: 3140614 - DNA, 20 bp, Homo sapiens
ccagcattccagcccctctg

SEQ ID NO: 3140615 - DNA, 17 bp, Homo sapiens
ccagccaaaccctgtct

SEQ ID NO: 3140616 - DNA, 9 bp, Homo sapiens
ccagccaca

SEQ ID NO: 3140617 - DNA, 18 bp, Homo sapiens
ccagccacagacccctgg

SEQ ID NO: 3140618 - DNA, 22 bp, Homo sapiens
ccagccacagacccctgggagc

SEQ ID NO: 3140619 - DNA, 13 bp, Homo sapiens
ccagccaccccgg

SEQ ID NO: 3140620 - DNA, 17 bp, Homo sapiens
ccagccacttgactggc

SEQ ID NO: 3140621 - DNA, 21 bp, Homo sapiens
ccagccagatggactccagcc

SEQ ID NO: 3140622 - DNA, 22 bp, Homo sapiens
ccagccagcaatgatgtccaga

SEQ ID NO: 3140623 - DNA, 22 bp, Homo sapiens
ccagccagtcttgcctaggcca

SEQ ID NO: 3140624 - DNA, 22 bp, Homo sapiens
ccagccagttggtggggccagg

SEQ ID NO: 3140625 - DNA, 18 bp, Homo sapiens
ccagccataaaagcattg

SEQ ID NO: 3140626 - DNA, 21 bp, Homo sapiens
ccagccataaaagcattgtct

SEQ ID NO: 3140627 - DNA, 19 bp, Homo sapiens
ccagccatctgcccagggg

SEQ ID NO: 3140628 - DNA, 20 bp, Homo sapiens
ccagccatctgcccaggggt

SEQ ID NO: 3140629 - DNA, 15 bp, Homo sapiens
ccagccatgcccagg

SEQ ID NO: 3140630 - DNA, 19 bp, Homo sapiens
ccagccattaccatggaga

SEQ ID NO: 3140631 - DNA, 13 bp, Homo sapiens
ccagcccaagtcc

SEQ ID NO: 3140632 - DNA, 21 bp, Homo sapiens
ccagcccaccctgctcctcct

SEQ ID NO: 3140633 - DNA, 16 bp, Homo sapiens
ccagcccacttctgcc

SEQ ID NO: 3140634 - DNA, 13 bp, Homo sapiens
ccagcccagagcc

SEQ ID NO: 3140635 - DNA, 17 bp, Homo sapiens
ccagcccagagccacct

SEQ ID NO: 3140636 - DNA, 20 bp, Homo sapiens
ccagcccagagccacctgga

SEQ ID NO: 3140637 - DNA, 12 bp, Homo sapiens
ccagcccagcca

SEQ ID NO: 3140638 - DNA, 13 bp, Homo sapiens
ccagcccagccag

SEQ ID NO: 3140639 - DNA, 14 bp, Homo sapiens
ccagcccagccagg

SEQ ID NO: 3140640 - DNA, 15 bp, Homo sapiens
ccagcccagccaggc

SEQ ID NO: 3140641 - DNA, 13 bp, Homo sapiens
ccagcccagggct

SEQ ID NO: 3140642 - DNA, 19 bp, Homo sapiens
ccagcccagggctcctgca

SEQ ID NO: 3140643 - DNA, 21 bp, Homo sapiens
ccagcccagggctcctgcact

SEQ ID NO: 3140644 - DNA, 21 bp, Homo sapiens
ccagcccatccattaggccag

SEQ ID NO: 3140645 - DNA, 17 bp, Homo sapiens
ccagcccatctcggagc

SEQ ID NO: 3140646 - DNA, 20 bp, Homo sapiens
ccagcccatggcccccaata

SEQ ID NO: 3140647 - DNA, 19 bp, Homo sapiens
ccagcccatggccctgtgc

SEQ ID NO: 3140648 - DNA, 18 bp, Homo sapiens
ccagccccacccaggagg

SEQ ID NO: 3140649 - DNA, 18 bp, Homo sapiens
ccagccccacccccagcc

SEQ ID NO: 3140650 - DNA, 22 bp, Homo sapiens
ccagccccacccctaagtgccc

SEQ ID NO: 3140651 - DNA, 13 bp, Homo sapiens
ccagccccactgc

SEQ ID NO: 3140652 - DNA, 18 bp, Homo sapiens
ccagccccactgccagca

SEQ ID NO: 3140653 - DNA, 23 bp, Homo sapiens
ccagccccactgccagcagcagc

SEQ ID NO: 3140654 - DNA, 21 bp, Homo sapiens
ccagcccccaggaagacatta

SEQ ID NO: 3140655 - DNA, 23 bp, Homo sapiens
ccagccccctggatgggcattgg

SEQ ID NO: 3140656 - DNA, 22 bp, Homo sapiens
ccagcccctagaaacccaagct

SEQ ID NO: 3140657 - DNA, 16 bp, Homo sapiens
ccagcccctagcccag

SEQ ID NO: 3140658 - DNA, 22 bp, Homo sapiens
ccagcccctagcccaggagaga

SEQ ID NO: 3140659 - DNA, 17 bp, Homo sapiens
ccagcccctcccccatc

SEQ ID NO: 3140660 - DNA, 21 bp, Homo sapiens
ccagcccctcccccatctccc

SEQ ID NO: 3140661 - DNA, 17 bp, Homo sapiens
ccagcccctctggtcgc

SEQ ID NO: 3140662 - DNA, 22 bp, Homo sapiens
ccagcccctctggtcgctcctg

SEQ ID NO: 3140663 - DNA, 13 bp, Homo sapiens
ccagcccctgcct

SEQ ID NO: 3140664 - DNA, 15 bp, Homo sapiens
ccagccccttcctgg

SEQ ID NO: 3140665 - DNA, 16 bp, Homo sapiens
ccagccccttcctggg

SEQ ID NO: 3140666 - DNA, 17 bp, Homo sapiens
ccagccccttcctgggt

SEQ ID NO: 3140667 - DNA, 18 bp, Homo sapiens
ccagccccttcctgggta

SEQ ID NO: 3140668 - DNA, 16 bp, Homo sapiens
ccagccccttctccca

SEQ ID NO: 3140669 - DNA, 17 bp, Homo sapiens
ccagccccttctcccag

SEQ ID NO: 3140670 - DNA, 14 bp, Homo sapiens
ccagccccttgaga

SEQ ID NO: 3140671 - DNA, 22 bp, Homo sapiens
ccagcccgacagtgccatcccc

SEQ ID NO: 3140672 - DNA, 15 bp, Homo sapiens
ccagcccggcctgct

SEQ ID NO: 3140673 - DNA, 19 bp, Homo sapiens
ccagcccggcctgctccca

SEQ ID NO: 3140674 - DNA, 20 bp, Homo sapiens
ccagcccggcctgctcccag

SEQ ID NO: 3140675 - DNA, 17 bp, Homo sapiens
ccagcccggctggtttt

SEQ ID NO: 3140676 - DNA, 21 bp, Homo sapiens
ccagcccgggagcctaggacc

SEQ ID NO: 3140677 - DNA, 22 bp, Homo sapiens
ccagcccgggagcctaggacca

SEQ ID NO: 3140678 - DNA, 15 bp, Homo sapiens
ccagccctatggatg

SEQ ID NO: 3140679 - DNA, 14 bp, Homo sapiens
ccagccctccccat

SEQ ID NO: 3140680 - DNA, 20 bp, Homo sapiens
ccagccctccccatggagcc

SEQ ID NO: 3140681 - DNA, 14 bp, Homo sapiens
ccagccctgggaac

SEQ ID NO: 3140682 - DNA, 15 bp, Homo sapiens
ccagccctggggctg

SEQ ID NO: 3140683 - DNA, 13 bp, Homo sapiens
ccagccctgtcct

SEQ ID NO: 3140684 - DNA, 14 bp, Homo sapiens
ccagccctgtcctg

SEQ ID NO: 3140685 - DNA, 13 bp, Homo sapiens
ccagccctgttct

SEQ ID NO: 3140686 - DNA, 17 bp, Homo sapiens
ccagcccttagcaggga

SEQ ID NO: 3140687 - DNA, 18 bp, Homo sapiens
ccagcccttcaggaagca

SEQ ID NO: 3140688 - DNA, 22 bp, Homo sapiens
ccagcccttcctctcactcctg

SEQ ID NO: 3140689 - DNA, 15 bp, Homo sapiens
ccagcccttctgcct

SEQ ID NO: 3140690 - DNA, 19 bp, Homo sapiens
ccagcccttctgcctttct

SEQ ID NO: 3140691 - DNA, 15 bp, Homo sapiens
ccagccgccccagcc

SEQ ID NO: 3140692 - DNA, 16 bp, Homo sapiens
ccagccgccccagccc

SEQ ID NO: 3140693 - DNA, 16 bp, Homo sapiens
ccagccgctcggaggc

SEQ ID NO: 3140694 - DNA, 20 bp, Homo sapiens
ccagccgctgcagggctccc

SEQ ID NO: 3140695 - DNA, 22 bp, Homo sapiens
ccagccgctgcagggctcccat

SEQ ID NO: 3140696 - DNA, 19 bp, Homo sapiens
ccagccggccaatggaaac

SEQ ID NO: 3140697 - DNA, 14 bp, Homo sapiens
ccagccggcctctc

SEQ ID NO: 3140698 - DNA, 23 bp, Homo sapiens
ccagccggcctctctggcctccc

SEQ ID NO: 3140699 - DNA, 14 bp, Homo sapiens
ccagccgtatttta

SEQ ID NO: 3140700 - DNA, 19 bp, Homo sapiens
ccagccgtgatgctcaggc

SEQ ID NO: 3140701 - DNA, 23 bp, Homo sapiens
ccagccgtgatgctcaggcttga

SEQ ID NO: 3140702 - DNA, 19 bp, Homo sapiens
ccagcctacccttcctgca

SEQ ID NO: 3140703 - DNA, 23 bp, Homo sapiens
ccagcctatgagcatcctgagcc

SEQ ID NO: 3140704 - DNA, 17 bp, Homo sapiens
ccagcctcacccttgcg

SEQ ID NO: 3140705 - DNA, 10 bp, Homo sapiens
ccagcctcag

SEQ ID NO: 3140706 - DNA, 11 bp, Homo sapiens
ccagcctcagt

SEQ ID NO: 3140707 - DNA, 19 bp, Homo sapiens
ccagcctcagtcctcccct

SEQ ID NO: 3140708 - DNA, 14 bp, Homo sapiens
ccagcctcctctgg

SEQ ID NO: 3140709 - DNA, 16 bp, Homo sapiens
ccagcctcctctggac

SEQ ID NO: 3140710 - DNA, 20 bp, Homo sapiens
ccagcctctcccggctgcct

SEQ ID NO: 3140711 - DNA, 17 bp, Homo sapiens
ccagcctgacctgagac

SEQ ID NO: 3140712 - DNA, 15 bp, Homo sapiens
ccagcctgccctcca

SEQ ID NO: 3140713 - DNA, 16 bp, Homo sapiens
ccagcctgccctccag

SEQ ID NO: 3140714 - DNA, 19 bp, Homo sapiens
ccagcctgcctggcaggct

SEQ ID NO: 3140715 - DNA, 20 bp, Homo sapiens
ccagcctggccccggccttt

SEQ ID NO: 3140716 - DNA, 13 bp, Homo sapiens
ccagcctggcttc

SEQ ID NO: 3140717 - DNA, 18 bp, Homo sapiens
ccagcctggcttctggag

SEQ ID NO: 3140718 - DNA, 20 bp, Homo sapiens
ccagcctggcttctggagcc

SEQ ID NO: 3140719 - DNA, 14 bp, Homo sapiens
ccagcctgggactc

SEQ ID NO: 3140720 - DNA, 13 bp, Homo sapiens
ccagcctgggagc

SEQ ID NO: 3140721 - DNA, 19 bp, Homo sapiens
ccagcctgggagcccagag

SEQ ID NO: 3140722 - DNA, 18 bp, Homo sapiens
ccagcctgggcagccagg

SEQ ID NO: 3140723 - DNA, 16 bp, Homo sapiens
ccagcctgggcgacag

SEQ ID NO: 3140724 - DNA, 14 bp, Homo sapiens
ccagcctggggcct

SEQ ID NO: 3140725 - DNA, 17 bp, Homo sapiens
ccagcctggggcctggc

SEQ ID NO: 3140726 - DNA, 19 bp, Homo sapiens
ccagccttgagccctggct

SEQ ID NO: 3140727 - DNA, 19 bp, Homo sapiens
ccagcctttggccttggct

SEQ ID NO: 3140728 - DNA, 13 bp, Homo sapiens
ccagcgagccctg

SEQ ID NO: 3140729 - DNA, 17 bp, Homo sapiens
ccagcgcggccagcgtc

SEQ ID NO: 3140730 - DNA, 20 bp, Homo sapiens
ccagcggcggaggcgcaggc

SEQ ID NO: 3140731 - DNA, 14 bp, Homo sapiens
ccagcgggcacagg

SEQ ID NO: 3140732 - DNA, 16 bp, Homo sapiens
ccagcgggcacagggc

SEQ ID NO: 3140733 - DNA, 18 bp, Homo sapiens
ccagcgtcccagggtacc

SEQ ID NO: 3140734 - DNA, 14 bp, Homo sapiens
ccagcgtgacggag

SEQ ID NO: 3140735 - DNA, 13 bp, Homo sapiens
ccagcgtgtgtat

SEQ ID NO: 3140736 - DNA, 16 bp, Homo sapiens
ccagggctgccctgag

SEQ ID NO: 3140737 - DNA, 21 bp, Homo sapiens
ccagggctgccctgagaagct

SEQ ID NO: 3140738 - DNA, 13 bp, Homo sapiens
ccagggctggctc

SEQ ID NO: 3140739 - DNA, 15 bp, Homo sapiens
ccagggctggctctg

SEQ ID NO: 3140740 - DNA, 12 bp, Homo sapiens
ccagggctgggg

SEQ ID NO: 3140741 - DNA, 18 bp, Homo sapiens
ccagggctggggacagag

SEQ ID NO: 3140742 - DNA, 19 bp, Homo sapiens
ccagggctggggacagagg

SEQ ID NO: 3140743 - DNA, 16 bp, Homo sapiens
ccaggggagttgtgtc

SEQ ID NO: 3140744 - DNA, 15 bp, Homo sapiens
ccaggggcaggactg

SEQ ID NO: 3140745 - DNA, 16 bp, Homo sapiens
ccaggggcaggactga

SEQ ID NO: 3140746 - DNA, 14 bp, Homo sapiens
ccaggggcctgcag

SEQ ID NO: 3140747 - DNA, 21 bp, Homo sapiens
ccaggggctgcttcctcctgg

SEQ ID NO: 3140748 - DNA, 18 bp, Homo sapiens
ccagggggactagcccct

SEQ ID NO: 3140749 - DNA, 20 bp, Homo sapiens
ccagggggactagcccctgt

SEQ ID NO: 3140750 - DNA, 13 bp, Homo sapiens
ccaggggtgcccc

SEQ ID NO: 3140751 - DNA, 19 bp, Homo sapiens
ccaggggtgccccctcctc

SEQ ID NO: 3140752 - DNA, 20 bp, Homo sapiens
ccaggggtgccccctcctct

SEQ ID NO: 3140753 - DNA, 16 bp, Homo sapiens
ccagggtccgcaccag

SEQ ID NO: 3140754 - DNA, 24 bp, Homo sapiens
ccagggtccgcaccagctgctctg

SEQ ID NO: 3140755 - DNA, 19 bp, Homo sapiens
ccagggtcttgggctactg

SEQ ID NO: 3140756 - DNA, 20 bp, Homo sapiens
ccagggtcttgggctactgg

SEQ ID NO: 3140757 - DNA, 23 bp, Homo sapiens
ccagggtcttgggctactggcag

SEQ ID NO: 3140758 - DNA, 22 bp, Homo sapiens
ccagggtggacttagaaagcag

SEQ ID NO: 3140759 - DNA, 13 bp, Homo sapiens
ccaggtacaggag

SEQ ID NO: 3140760 - DNA, 16 bp, Homo sapiens
ccaggtaccacccttc

SEQ ID NO: 3140761 - DNA, 15 bp, Homo sapiens
ccaggtaccagctgc

SEQ ID NO: 3140762 - DNA, 18 bp, Homo sapiens
ccaggtaccagctgcgct

SEQ ID NO: 3140763 - DNA, 23 bp, Homo sapiens
ccaggtaccagctgcgcttgctt

SEQ ID NO: 3140764 - DNA, 20 bp, Homo sapiens
ccaggtactgcattctctcc

SEQ ID NO: 3140765 - DNA, 22 bp, Homo sapiens
ccaggtatccaaaaatgtgtaa

SEQ ID NO: 3140766 - DNA, 17 bp, Homo sapiens
ccaggtatggctctgca

SEQ ID NO: 3140767 - DNA, 14 bp, Homo sapiens
ccaggtcacacgac

SEQ ID NO: 3140768 - DNA, 13 bp, Homo sapiens
ccaggtccagctc

SEQ ID NO: 3140769 - DNA, 14 bp, Homo sapiens
ccaggtccagctct

SEQ ID NO: 3140770 - DNA, 21 bp, Homo sapiens
ccaggtccctccgcggctgga

SEQ ID NO: 3140771 - DNA, 15 bp, Homo sapiens
ccaggtctcacgggc

SEQ ID NO: 3140772 - DNA, 16 bp, Homo sapiens
ccaggtctcacgggca

SEQ ID NO: 3140773 - DNA, 23 bp, Homo sapiens
ccaggtctgggaagctgagggca

SEQ ID NO: 3140774 - DNA, 14 bp, Homo sapiens
ccaggtcttccaga

SEQ ID NO: 3140775 - DNA, 15 bp, Homo sapiens
ccaggtcttccagac

SEQ ID NO: 3140776 - DNA, 15 bp, Homo sapiens
ccaggtgagctctga

SEQ ID NO: 3140777 - DNA, 17 bp, Homo sapiens
ccaggtgagctctgacc

SEQ ID NO: 3140778 - DNA, 21 bp, Homo sapiens
ccaggtgaggcccaagagccc

SEQ ID NO: 3140779 - DNA, 14 bp, Homo sapiens
ccaggtgaggtcca

SEQ ID NO: 3140780 - DNA, 19 bp, Homo sapiens
ccaggtggaaggcagacag

SEQ ID NO: 3140781 - DNA, 17 bp, Homo sapiens
ccaggtggagggcacag

SEQ ID NO: 3140782 - DNA, 18 bp, Homo sapiens
ccaggtggagggcacagc

SEQ ID NO: 3140783 - DNA, 16 bp, Homo sapiens
ccaggtggccactcca

SEQ ID NO: 3140784 - DNA, 20 bp, Homo sapiens
ccaggtgttaacattccaag

SEQ ID NO: 3140785 - DNA, 23 bp, Homo sapiens
ccaggtgttaacattccaagact

SEQ ID NO: 3140786 - DNA, 24 bp, Homo sapiens
ccaggttagcctttgccctgtcac

SEQ ID NO: 3140787 - DNA, 21 bp, Homo sapiens
ccaggttcacactcagaaaga

SEQ ID NO: 3140788 - DNA, 14 bp, Homo sapiens
ccaggttcagcttg

SEQ ID NO: 3140789 - DNA, 15 bp, Homo sapiens
ccaggttcagcttgt

SEQ ID NO: 3140790 - DNA, 21 bp, Homo sapiens
ccaggttccccagccgcccac

SEQ ID NO: 3140791 - DNA, 15 bp, Homo sapiens
ccaggttcccccagc

SEQ ID NO: 3140792 - DNA, 24 bp, Homo sapiens
ccaggttctccgttagctcctgtg

SEQ ID NO: 3140793 - DNA, 20 bp, Homo sapiens
ccaggttgacaccattctcc

SEQ ID NO: 3140794 - DNA, 23 bp, Homo sapiens
ccaggttgacaccattctcctgc

SEQ ID NO: 3140795 - DNA, 19 bp, Homo sapiens
ccaggttttctgggtgtcc

SEQ ID NO: 3140796 - DNA, 13 bp, Homo sapiens
ccagtaacttttt

SEQ ID NO: 3140797 - DNA, 19 bp, Homo sapiens
ccagtaacttttttgtgta

SEQ ID NO: 3140798 - DNA, 12 bp, Homo sapiens
ccagtacctcca

SEQ ID NO: 3140799 - DNA, 17 bp, Homo sapiens
ccagtacctttgtcaca

SEQ ID NO: 3140800 - DNA, 18 bp, Homo sapiens
ccagtatacctcattttt

SEQ ID NO: 3140801 - DNA, 24 bp, Homo sapiens
ccagtatacctcatttttcatact

SEQ ID NO: 3140802 - DNA, 14 bp, Homo sapiens
ccagtatctatata

SEQ ID NO: 3140803 - DNA, 14 bp, Homo sapiens
ccagtatttttaaa

SEQ ID NO: 3140804 - DNA, 21 bp, Homo sapiens
ccagtcacatgacctgatcac

SEQ ID NO: 3140805 - DNA, 18 bp, Homo sapiens
ccagtccaaatgtcctcc

SEQ ID NO: 3140806 - DNA, 14 bp, Homo sapiens
ccagtcccattcct

SEQ ID NO: 3140807 - DNA, 15 bp, Homo sapiens
ccagtccccacccct

SEQ ID NO: 3140808 - DNA, 16 bp, Homo sapiens
ccagtccccacccctg

SEQ ID NO: 3140809 - DNA, 18 bp, Homo sapiens
ccagtccccacccctgcc

SEQ ID NO: 3140810 - DNA, 20 bp, Homo sapiens
ccagtcccccaaccccagcc

SEQ ID NO: 3140811 - DNA, 14 bp, Homo sapiens
ccagtccccctatc

SEQ ID NO: 3140812 - DNA, 18 bp, Homo sapiens
ccagtccccctatccttg

SEQ ID NO: 3140813 - DNA, 22 bp, Homo sapiens
ccagtccccgaggagctgggcc

SEQ ID NO: 3140814 - DNA, 16 bp, Homo sapiens
ccagtcctgcctggcc

SEQ ID NO: 3140815 - DNA, 18 bp, Homo sapiens
ccagtcctgcctggccag

SEQ ID NO: 3140816 - DNA, 20 bp, Homo sapiens
ccagtcgtcatcagatgctt

SEQ ID NO: 3140817 - DNA, 18 bp, Homo sapiens
ccagtcgttagaatatag

SEQ ID NO: 3140818 - DNA, 12 bp, Homo sapiens
ccagtctcccag

SEQ ID NO: 3140819 - DNA, 18 bp, Homo sapiens
ccagtctggaatgcagtg

SEQ ID NO: 3140820 - DNA, 16 bp, Homo sapiens
ccagtctgtggatcag

SEQ ID NO: 3140821 - DNA, 19 bp, Homo sapiens
ccagtctgtgtttacagac

SEQ ID NO: 3140822 - DNA, 16 bp, Homo sapiens
ccagtctgttccccat

SEQ ID NO: 3140823 - DNA, 17 bp, Homo sapiens
ccagtcttcctgacact

SEQ ID NO: 3140824 - DNA, 22 bp, Homo sapiens
ccagtcttcctgacactttaat

SEQ ID NO: 3140825 - DNA, 16 bp, Homo sapiens
ccagtcttccttgtct

SEQ ID NO: 3140826 - DNA, 19 bp, Homo sapiens
ccagtcttccttgtctctg

SEQ ID NO: 3140827 - DNA, 19 bp, Homo sapiens
ccagtctttaaaggcccag

SEQ ID NO: 3140828 - DNA, 21 bp, Homo sapiens
ccagtgaacttacacttggag

SEQ ID NO: 3140829 - DNA, 22 bp, Homo sapiens
ccagtgaacttacacttggagc

SEQ ID NO: 3140830 - DNA, 23 bp, Homo sapiens
ccagtgaacttacacttggagcc

SEQ ID NO: 3140831 - DNA, 12 bp, Homo sapiens
ccagtgaagcct

SEQ ID NO: 3140832 - DNA, 17 bp, Homo sapiens
ccagtgaaggagccacg

SEQ ID NO: 3140833 - DNA, 16 bp, Homo sapiens
ccagtgaattcttgaa

SEQ ID NO: 3140834 - DNA, 23 bp, Homo sapiens
ccagtgacaaagactcctctggg

SEQ ID NO: 3140835 - DNA, 19 bp, Homo sapiens
ccagtgacacttcagagag

SEQ ID NO: 3140836 - DNA, 20 bp, Homo sapiens
ccagtgacacttcagagagc

SEQ ID NO: 3140837 - DNA, 18 bp, Homo sapiens
ccagtgacagacaggctc

SEQ ID NO: 3140838 - DNA, 15 bp, Homo sapiens
ccagtgaccccagaa

SEQ ID NO: 3140839 - DNA, 13 bp, Homo sapiens
ccagtgagtgtaa

SEQ ID NO: 3140840 - DNA, 20 bp, Homo sapiens
ccagtgagtgtaaataattt

SEQ ID NO: 3140841 - DNA, 13 bp, Homo sapiens
ccagtgcagccac

SEQ ID NO: 3140842 - DNA, 14 bp, Homo sapiens
ccagtgccaaggac

SEQ ID NO: 3140843 - DNA, 22 bp, Homo sapiens
ccagtgcccaaagtctgtgtga

SEQ ID NO: 3140844 - DNA, 21 bp, Homo sapiens
ccagtgctccagtttcccggt

SEQ ID NO: 3140845 - DNA, 13 bp, Homo sapiens
ccagtgctgccat

SEQ ID NO: 3140846 - DNA, 20 bp, Homo sapiens
ccagtgctgccatgccactg

SEQ ID NO: 3140847 - DNA, 21 bp, Homo sapiens
ccagtgctgtccatgcttctc

SEQ ID NO: 3140848 - DNA, 22 bp, Homo sapiens
ccagtgctgtccatgcttctca

SEQ ID NO: 3140849 - DNA, 15 bp, Homo sapiens
ccagtggaaaacaaa

SEQ ID NO: 3140850 - DNA, 16 bp, Homo sapiens
ccagtggaggtttgtc

SEQ ID NO: 3140851 - DNA, 22 bp, Homo sapiens
ccagtggatcccctgcggtcag

SEQ ID NO: 3140852 - DNA, 11 bp, Homo sapiens
ccagtgggagg

SEQ ID NO: 3140853 - DNA, 13 bp, Homo sapiens
ccagtgggagggg

SEQ ID NO: 3140854 - DNA, 15 bp, Homo sapiens
ccagtgggaggggca

SEQ ID NO: 3140855 - DNA, 18 bp, Homo sapiens
ccagtgggaggggcaggc

SEQ ID NO: 3140856 - DNA, 19 bp, Homo sapiens
ccagtgggaggggcaggct

SEQ ID NO: 3140857 - DNA, 21 bp, Homo sapiens
ccagtgggaggggcaggctga

SEQ ID NO: 3140858 - DNA, 22 bp, Homo sapiens
ccagtgggaggggcaggctgac

SEQ ID NO: 3140859 - DNA, 16 bp, Homo sapiens
ccagtgggtctgggat

SEQ ID NO: 3140860 - DNA, 14 bp, Homo sapiens
ccagtggtgccttg

SEQ ID NO: 3140861 - DNA, 19 bp, Homo sapiens
ccatgtccaaagaggctgc

SEQ ID NO: 3140862 - DNA, 20 bp, Homo sapiens
ccatgtccaagttcttcacc

SEQ ID NO: 3140863 - DNA, 12 bp, Homo sapiens
ccatgtcgcctc

SEQ ID NO: 3140864 - DNA, 18 bp, Homo sapiens
ccatgtgattaatgtttt

SEQ ID NO: 3140865 - DNA, 19 bp, Homo sapiens
ccatgtgccatctgtacat

SEQ ID NO: 3140866 - DNA, 18 bp, Homo sapiens
ccatgtgcctgcaccagg

SEQ ID NO: 3140867 - DNA, 21 bp, Homo sapiens
ccatgtggataactttacaga

SEQ ID NO: 3140868 - DNA, 13 bp, Homo sapiens
ccatgtggctgaa

SEQ ID NO: 3140869 - DNA, 13 bp, Homo sapiens
ccatgtgtcccct

SEQ ID NO: 3140870 - DNA, 14 bp, Homo sapiens
ccatgtgtcccctc

SEQ ID NO: 3140871 - DNA, 16 bp, Homo sapiens
ccatgtgtcccctcac

SEQ ID NO: 3140872 - DNA, 20 bp, Homo sapiens
ccatgtgtcccctcactctg

SEQ ID NO: 3140873 - DNA, 22 bp, Homo sapiens
ccatgtgtcccctcactctgtc

SEQ ID NO: 3140874 - DNA, 14 bp, Homo sapiens
ccatgtgtcctggt

SEQ ID NO: 3140875 - DNA, 13 bp, Homo sapiens
ccatgttcattat

SEQ ID NO: 3140876 - DNA, 18 bp, Homo sapiens
ccatgttcattataatct

SEQ ID NO: 3140877 - DNA, 14 bp, Homo sapiens
ccatgttctgcccc

SEQ ID NO: 3140878 - DNA, 20 bp, Homo sapiens
ccatgttctgcccccagccc

SEQ ID NO: 3140879 - DNA, 22 bp, Homo sapiens
ccatgttgacgagactggtctc

SEQ ID NO: 3140880 - DNA, 14 bp, Homo sapiens
ccatgttggccagg

SEQ ID NO: 3140881 - DNA, 15 bp, Homo sapiens
ccatgttggccaggc

SEQ ID NO: 3140882 - DNA, 21 bp, Homo sapiens
ccatgtttagtgaatgacttt

SEQ ID NO: 3140883 - DNA, 14 bp, Homo sapiens
ccatgtttgtaaaa

SEQ ID NO: 3140884 - DNA, 14 bp, Homo sapiens
ccattaaaactgct

SEQ ID NO: 3140885 - DNA, 19 bp, Homo sapiens
ccattaaagtcagaagttt

SEQ ID NO: 3140886 - DNA, 13 bp, Homo sapiens
ccattaaagtctg

SEQ ID NO: 3140887 - DNA, 14 bp, Homo sapiens
ccattaaagtctga

SEQ ID NO: 3140888 - DNA, 16 bp, Homo sapiens
ccattaaagtctgaat

SEQ ID NO: 3140889 - DNA, 19 bp, Homo sapiens
ccattaaatgaatattttg

SEQ ID NO: 3140890 - DNA, 16 bp, Homo sapiens
ccattaatcatttccc

SEQ ID NO: 3140891 - DNA, 22 bp, Homo sapiens
ccattacagaggtattaaaact

SEQ ID NO: 3140892 - DNA, 23 bp, Homo sapiens
ccattacagaggtattaaaacta

SEQ ID NO: 3140893 - DNA, 14 bp, Homo sapiens
ccattaccaaaata

SEQ ID NO: 3140894 - DNA, 14 bp, Homo sapiens
ccattaccatggag

SEQ ID NO: 3140895 - DNA, 15 bp, Homo sapiens
ccattagcataattt

SEQ ID NO: 3140896 - DNA, 17 bp, Homo sapiens
ccattatactttatatc

SEQ ID NO: 3140897 - DNA, 14 bp, Homo sapiens
ccattattttctgt

SEQ ID NO: 3140898 - DNA, 17 bp, Homo sapiens
ccattattttctgtcag

SEQ ID NO: 3140899 - DNA, 17 bp, Homo sapiens
ccattcacaagcctcct

SEQ ID NO: 3140900 - DNA, 13 bp, Homo sapiens
ccattcacaccag

SEQ ID NO: 3140901 - DNA, 20 bp, Homo sapiens
ccattcacttcataatccag

SEQ ID NO: 3140902 - DNA, 20 bp, Homo sapiens
ccattcagtgattactgtca

SEQ ID NO: 3140903 - DNA, 11 bp, Homo sapiens
ccattccaaaa

SEQ ID NO: 3140904 - DNA, 15 bp, Homo sapiens
ccattccaaaatatt

SEQ ID NO: 3140905 - DNA, 21 bp, Homo sapiens
ccattccaaaatattatgccc

SEQ ID NO: 3140906 - DNA, 13 bp, Homo sapiens
ccattccactcca

SEQ ID NO: 3140907 - DNA, 18 bp, Homo sapiens
ccattccactccactcag

SEQ ID NO: 3140908 - DNA, 14 bp, Homo sapiens
ccattcccccatgt

SEQ ID NO: 3140909 - DNA, 18 bp, Homo sapiens
ccattcgacctataagaa

SEQ ID NO: 3140910 - DNA, 14 bp, Homo sapiens
ccattctacacaga

SEQ ID NO: 3140911 - DNA, 11 bp, Homo sapiens
ccattctccca

SEQ ID NO: 3140912 - DNA, 13 bp, Homo sapiens
ccattctcccagg

SEQ ID NO: 3140913 - DNA, 14 bp, Homo sapiens
ccattctcccaggt

SEQ ID NO: 3140914 - DNA, 23 bp, Homo sapiens
ccattctcccaggtaccagctgc

SEQ ID NO: 3140915 - DNA, 17 bp, Homo sapiens
ccattctgcctgcccag

SEQ ID NO: 3140916 - DNA, 21 bp, Homo sapiens
ccattctgcctgcccaggccc

SEQ ID NO: 3140917 - DNA, 14 bp, Homo sapiens
ccattcttcctagt

SEQ ID NO: 3140918 - DNA, 20 bp, Homo sapiens
ccattcttcctagttttctc

SEQ ID NO: 3140919 - DNA, 20 bp, Homo sapiens
ccattctttattcttttact

SEQ ID NO: 3140920 - DNA, 15 bp, Homo sapiens
ccattctttgcttga

SEQ ID NO: 3140921 - DNA, 20 bp, Homo sapiens
ccattctttgcttgaacaca

SEQ ID NO: 3140922 - DNA, 17 bp, Homo sapiens
ccattgaaggcttaaac

SEQ ID NO: 3140923 - DNA, 21 bp, Homo sapiens
ccattgaaggcttaaacccat

SEQ ID NO: 3140924 - DNA, 18 bp, Homo sapiens
ccattgcggccccaggag

SEQ ID NO: 3140925 - DNA, 20 bp, Homo sapiens
ccattgcggccccaggaggg

SEQ ID NO: 3140926 - DNA, 18 bp, Homo sapiens
ccattgcttattatgtag

SEQ ID NO: 3140927 - DNA, 16 bp, Homo sapiens
ccattgtaactattaa

SEQ ID NO: 3140928 - DNA, 21 bp, Homo sapiens
ccattgtaactattaaccttt

SEQ ID NO: 3140929 - DNA, 17 bp, Homo sapiens
ccattgtcttgttctgt

SEQ ID NO: 3140930 - DNA, 12 bp, Homo sapiens
ccattgtcttta

SEQ ID NO: 3140931 - DNA, 20 bp, Homo sapiens
ccattgtggctcctatctgt

SEQ ID NO: 3140932 - DNA, 23 bp, Homo sapiens
ccatttacagtctctttcttcct

SEQ ID NO: 3140933 - DNA, 14 bp, Homo sapiens
ccatttactaacag

SEQ ID NO: 3140934 - DNA, 20 bp, Homo sapiens
ccatttataaccccagcctg

SEQ ID NO: 3140935 - DNA, 17 bp, Homo sapiens
ccatttcagtggcttcc

SEQ ID NO: 3140936 - DNA, 15 bp, Homo sapiens
ccatttccattgctt

SEQ ID NO: 3140937 - DNA, 13 bp, Homo sapiens
ccatttcccatct

SEQ ID NO: 3140938 - DNA, 17 bp, Homo sapiens
ccatttcccatctgcac

SEQ ID NO: 3140939 - DNA, 18 bp, Homo sapiens
ccatttcccatctgcacc

SEQ ID NO: 3140940 - DNA, 17 bp, Homo sapiens
ccatttccccctcctca

SEQ ID NO: 3140941 - DNA, 11 bp, Homo sapiens
ccatttccctt

SEQ ID NO: 3140942 - DNA, 13 bp, Homo sapiens
ccatttcctgaga

SEQ ID NO: 3140943 - DNA, 13 bp, Homo sapiens
ccatttctcactg

SEQ ID NO: 3140944 - DNA, 16 bp, Homo sapiens
ccatttctcactgaga

SEQ ID NO: 3140945 - DNA, 13 bp, Homo sapiens
ccatttctccgtt

SEQ ID NO: 3140946 - DNA, 15 bp, Homo sapiens
ccatttctctacact

SEQ ID NO: 3140947 - DNA, 19 bp, Homo sapiens
ccatttctgaactgttaca

SEQ ID NO: 3140948 - DNA, 13 bp, Homo sapiens
ccatttgaagtgt

SEQ ID NO: 3140949 - DNA, 12 bp, Homo sapiens
ccatttgatacc

SEQ ID NO: 3140950 - DNA, 19 bp, Homo sapiens
ccatttgatacccctgggg

SEQ ID NO: 3140951 - DNA, 20 bp, Homo sapiens
ccatttgctactgtacataa

SEQ ID NO: 3140952 - DNA, 13 bp, Homo sapiens
ccatttgtaaaac

SEQ ID NO: 3140953 - DNA, 12 bp, Homo sapiens
ccatttgtaata

SEQ ID NO: 3140954 - DNA, 21 bp, Homo sapiens
ccattttaattttaaagtgca

SEQ ID NO: 3140955 - DNA, 21 bp, Homo sapiens
ccattttattaaacattttca

SEQ ID NO: 3140956 - DNA, 18 bp, Homo sapiens
ccattttcaactgctttg

SEQ ID NO: 3140957 - DNA, 21 bp, Homo sapiens
ccattttcccatcatcctttg

SEQ ID NO: 3140958 - DNA, 23 bp, Homo sapiens
ccattttcttattgcgctgctac

SEQ ID NO: 3140959 - DNA, 17 bp, Homo sapiens
ccattttgcaaaatttc

SEQ ID NO: 3140960 - DNA, 16 bp, Homo sapiens
ccattttgcccttcca

SEQ ID NO: 3140961 - DNA, 18 bp, Homo sapiens
ccattttgttattgacta

SEQ ID NO: 3140962 - DNA, 15 bp, Homo sapiens
ccatttttctataaa

SEQ ID NO: 3140963 - DNA, 19 bp, Homo sapiens
ccattttttaaggaaacaa

SEQ ID NO: 3140964 - DNA, 18 bp, Homo sapiens
ccattttttaatttactt

SEQ ID NO: 3140965 - DNA, 15 bp, Homo sapiens
cccaaaacccagggc

SEQ ID NO: 3140966 - DNA, 14 bp, Homo sapiens
cccaaaagattgct

SEQ ID NO: 3140967 - DNA, 19 bp, Homo sapiens
cccaaacaccttccagctc

SEQ ID NO: 3140968 - DNA, 13 bp, Homo sapiens
cccaaaccctagg

SEQ ID NO: 3140969 - DNA, 16 bp, Homo sapiens
cccaaacgccctttcc

SEQ ID NO: 3140970 - DNA, 15 bp, Homo sapiens
cccaaagcacatgct

SEQ ID NO: 3140971 - DNA, 21 bp, Homo sapiens
cccaaagcacatgcttagctt

SEQ ID NO: 3140972 - DNA, 12 bp, Homo sapiens
cccaaagccctg

SEQ ID NO: 3140973 - DNA, 15 bp, Homo sapiens
cccaaagctttcctg

SEQ ID NO: 3140974 - DNA, 17 bp, Homo sapiens
cccaaaggtaggaaggt

SEQ ID NO: 3140975 - DNA, 22 bp, Homo sapiens
cccaaagtaccacactgagttc

SEQ ID NO: 3140976 - DNA, 15 bp, Homo sapiens
cccaaagtgctggga

SEQ ID NO: 3140977 - DNA, 15 bp, Homo sapiens
cccaacactccaggc

SEQ ID NO: 3140978 - DNA, 20 bp, Homo sapiens
cccaacactgtgccctggtg

SEQ ID NO: 3140979 - DNA, 21 bp, Homo sapiens
cccaacactgtgccctggtgg

SEQ ID NO: 3140980 - DNA, 22 bp, Homo sapiens
cccaacactgtgccctggtgga

SEQ ID NO: 3140981 - DNA, 15 bp, Homo sapiens
cccaacagccttagc

SEQ ID NO: 3140982 - DNA, 23 bp, Homo sapiens
cccaacagccttagctgccagtg

SEQ ID NO: 3140983 - DNA, 23 bp, Homo sapiens
cccaacagcgacatagcccatcc

SEQ ID NO: 3140984 - DNA, 20 bp, Homo sapiens
cccaaccaggcacctcttcc

SEQ ID NO: 3140985 - DNA, 14 bp, Homo sapiens
cccaacccaaacca

SEQ ID NO: 3140986 - DNA, 15 bp, Homo sapiens
cccaacccacctctg

SEQ ID NO: 3140987 - DNA, 16 bp, Homo sapiens
cccaacccacctctgg

SEQ ID NO: 3140988 - DNA, 18 bp, Homo sapiens
cccagccagagttcctgc

SEQ ID NO: 3140989 - DNA, 22 bp, Homo sapiens
cccagccagagttcctgcggag

SEQ ID NO: 3140990 - DNA, 18 bp, Homo sapiens
cccagccaggccaacagc

SEQ ID NO: 3140991 - DNA, 13 bp, Homo sapiens
cccagccaggcta

SEQ ID NO: 3140992 - DNA, 19 bp, Homo sapiens
cccagccagttggtggggc

SEQ ID NO: 3140993 - DNA, 15 bp, Homo sapiens
cccagccatctgccc

SEQ ID NO: 3140994 - DNA, 17 bp, Homo sapiens
cccagccatctgcccag

SEQ ID NO: 3140995 - DNA, 13 bp, Homo sapiens
cccagccatgccc

SEQ ID NO: 3140996 - DNA, 14 bp, Homo sapiens
cccagccatgccca

SEQ ID NO: 3140997 - DNA, 22 bp, Homo sapiens
cccagccattaccatggagaca

SEQ ID NO: 3140998 - DNA, 15 bp, Homo sapiens
cccagcccaccctgc

SEQ ID NO: 3140999 - DNA, 19 bp, Homo sapiens
cccagcccaccctgctcct

SEQ ID NO: 3141000 - DNA, 19 bp, Homo sapiens
cccagcccacttctgccat

SEQ ID NO: 3141001 - DNA, 14 bp, Homo sapiens
cccagcccagagcc

SEQ ID NO: 3141002 - DNA, 15 bp, Homo sapiens
cccagccccacccct

SEQ ID NO: 3141003 - DNA, 21 bp, Homo sapiens
cccagccccacccctaagtgc

SEQ ID NO: 3141004 - DNA, 22 bp, Homo sapiens
cccagcccctagaaacccaagc

SEQ ID NO: 3141005 - DNA, 14 bp, Homo sapiens
cccagcccctagcc

SEQ ID NO: 3141006 - DNA, 18 bp, Homo sapiens
cccagcccctagcccagg

SEQ ID NO: 3141007 - DNA, 19 bp, Homo sapiens
cccagcccctagcccagga

SEQ ID NO: 3141008 - DNA, 22 bp, Homo sapiens
cccagcccctagcccaggagag

SEQ ID NO: 3141009 - DNA, 12 bp, Homo sapiens
cccagcccctgg

SEQ ID NO: 3141010 - DNA, 15 bp, Homo sapiens
cccagccccttctcc

SEQ ID NO: 3141011 - DNA, 20 bp, Homo sapiens
cccagccccttctcccagca

SEQ ID NO: 3141012 - DNA, 12 bp, Homo sapiens
cccagccctgct

SEQ ID NO: 3141013 - DNA, 15 bp, Homo sapiens
cccagccctgctggg

SEQ ID NO: 3141014 - DNA, 15 bp, Homo sapiens
cccagccctggctct

SEQ ID NO: 3141015 - DNA, 13 bp, Homo sapiens
cccagccctggga

SEQ ID NO: 3141016 - DNA, 16 bp, Homo sapiens
cccagccctgtcctgg

SEQ ID NO: 3141017 - DNA, 14 bp, Homo sapiens
cccagcccttctgc

SEQ ID NO: 3141018 - DNA, 15 bp, Homo sapiens
cccagcccttctgcc

SEQ ID NO: 3141019 - DNA, 22 bp, Homo sapiens
cccagccggcctctctggcctc

SEQ ID NO: 3141020 - DNA, 19 bp, Homo sapiens
cccagccgtcgtctccctc

SEQ ID NO: 3141021 - DNA, 15 bp, Homo sapiens
cccagcctctggcat

SEQ ID NO: 3141022 - DNA, 13 bp, Homo sapiens
cccagcctgacct

SEQ ID NO: 3141023 - DNA, 18 bp, Homo sapiens
cccagcctgacctgagac

SEQ ID NO: 3141024 - DNA, 12 bp, Homo sapiens
cccagcctgctg

SEQ ID NO: 3141025 - DNA, 18 bp, Homo sapiens
cccagcctgggagcccag

SEQ ID NO: 3141026 - DNA, 17 bp, Homo sapiens
cccagcctggggctccc

SEQ ID NO: 3141027 - DNA, 14 bp, Homo sapiens
cccagcgagccctg

SEQ ID NO: 3141028 - DNA, 19 bp, Homo sapiens
cccagcgagccctggtggc

SEQ ID NO: 3141029 - DNA, 13 bp, Homo sapiens
cccagcgcggcca

SEQ ID NO: 3141030 - DNA, 14 bp, Homo sapiens
cccagcgcggccag

SEQ ID NO: 3141031 - DNA, 18 bp, Homo sapiens
cccagcgcggccagcgtc

SEQ ID NO: 3141032 - DNA, 23 bp, Homo sapiens
cccagcggccccccgcacagcca

SEQ ID NO: 3141033 - DNA, 20 bp, Homo sapiens
cccagctaatctgtagggct

SEQ ID NO: 3141034 - DNA, 17 bp, Homo sapiens
cccagctactcagaagc

SEQ ID NO: 3141035 - DNA, 22 bp, Homo sapiens
cccagctactcagaagcctgag

SEQ ID NO: 3141036 - DNA, 16 bp, Homo sapiens
cccagctactctgtcc

SEQ ID NO: 3141037 - DNA, 24 bp, Homo sapiens
cccagctactctgtccaggccact

SEQ ID NO: 3141038 - DNA, 16 bp, Homo sapiens
cccagctacttgggaa

SEQ ID NO: 3141039 - DNA, 13 bp, Homo sapiens
cccagctaggaag

SEQ ID NO: 3141040 - DNA, 23 bp, Homo sapiens
cccagctagggggcgttatttat

SEQ ID NO: 3141041 - DNA, 12 bp, Homo sapiens
cccagctcaggg

SEQ ID NO: 3141042 - DNA, 13 bp, Homo sapiens
cccagctcagggg

SEQ ID NO: 3141043 - DNA, 16 bp, Homo sapiens
cccagctcaggggcag

SEQ ID NO: 3141044 - DNA, 20 bp, Homo sapiens
cccagctcaggggcagctca

SEQ ID NO: 3141045 - DNA, 13 bp, Homo sapiens
cccagctccaggg

SEQ ID NO: 3141046 - DNA, 16 bp, Homo sapiens
cccagctccaggggcc

SEQ ID NO: 3141047 - DNA, 22 bp, Homo sapiens
cccagctccttttgtccccagg

SEQ ID NO: 3141048 - DNA, 13 bp, Homo sapiens
cccagctctggct

SEQ ID NO: 3141049 - DNA, 13 bp, Homo sapiens
cccagctctggtg

SEQ ID NO: 3141050 - DNA, 21 bp, Homo sapiens
cccagctgactgtggccccct

SEQ ID NO: 3141051 - DNA, 13 bp, Homo sapiens
cccagctgcacct

SEQ ID NO: 3141052 - DNA, 22 bp, Homo sapiens
cccagctgcacctgccagcctg

SEQ ID NO: 3141053 - DNA, 12 bp, Homo sapiens
cccagctgcctg

SEQ ID NO: 3141054 - DNA, 13 bp, Homo sapiens
cccagctgggagg

SEQ ID NO: 3141055 - DNA, 14 bp, Homo sapiens
cccagctgggaggc

SEQ ID NO: 3141056 - DNA, 15 bp, Homo sapiens
cccagctgggaggca

SEQ ID NO: 3141057 - DNA, 18 bp, Homo sapiens
cccagctgggaggcaaga

SEQ ID NO: 3141058 - DNA, 20 bp, Homo sapiens
cccagctgggaggcaagagg

SEQ ID NO: 3141059 - DNA, 22 bp, Homo sapiens
cccagctgggaggcaagagggg

SEQ ID NO: 3141060 - DNA, 13 bp, Homo sapiens
cccagctgtagcc

SEQ ID NO: 3141061 - DNA, 17 bp, Homo sapiens
cccagctgtagccatgg

SEQ ID NO: 3141062 - DNA, 23 bp, Homo sapiens
cccagctgtagccatggctcagg

SEQ ID NO: 3141063 - DNA, 24 bp, Homo sapiens
cccagctgtagccatggctcaggc

SEQ ID NO: 3141064 - DNA, 17 bp, Homo sapiens
cccagctgtgagccttg

SEQ ID NO: 3141065 - DNA, 16 bp, Homo sapiens
cccaggaagcccacac

SEQ ID NO: 3141066 - DNA, 17 bp, Homo sapiens
cccaggaagcccacact

SEQ ID NO: 3141067 - DNA, 22 bp, Homo sapiens
cccaggaatttgaagctgcagt

SEQ ID NO: 3141068 - DNA, 23 bp, Homo sapiens
cccaggacaccacacccagcctc

SEQ ID NO: 3141069 - DNA, 17 bp, Homo sapiens
cccaggacatctcctgg

SEQ ID NO: 3141070 - DNA, 20 bp, Homo sapiens
cccaggaccaagccacagca

SEQ ID NO: 3141071 - DNA, 13 bp, Homo sapiens
cccaggaccagct

SEQ ID NO: 3141072 - DNA, 19 bp, Homo sapiens
cccaggaccagctggggcg

SEQ ID NO: 3141073 - DNA, 21 bp, Homo sapiens
cccaggaccagctggggcgtg

SEQ ID NO: 3141074 - DNA, 16 bp, Homo sapiens
cccaggacgcttctga

SEQ ID NO: 3141075 - DNA, 20 bp, Homo sapiens
cccaggacgcttctgaatgc

SEQ ID NO: 3141076 - DNA, 23 bp, Homo sapiens
cccaggacgtcctatctccccca

SEQ ID NO: 3141077 - DNA, 15 bp, Homo sapiens
cccaggagacagttc

SEQ ID NO: 3141078 - DNA, 17 bp, Homo sapiens
cccaggagacagttcaa

SEQ ID NO: 3141079 - DNA, 16 bp, Homo sapiens
cccaggagagagaaag

SEQ ID NO: 3141080 - DNA, 21 bp, Homo sapiens
cccaggagccccgaggccttc

SEQ ID NO: 3141081 - DNA, 13 bp, Homo sapiens
cccaggaggctga

SEQ ID NO: 3141082 - DNA, 20 bp, Homo sapiens
cccaggagtttgagacaagc

SEQ ID NO: 3141083 - DNA, 17 bp, Homo sapiens
cccaggatactggcaca

SEQ ID NO: 3141084 - DNA, 19 bp, Homo sapiens
cccaggatactggcacaga

SEQ ID NO: 3141085 - DNA, 19 bp, Homo sapiens
cccaggatggactcttctc

SEQ ID NO: 3141086 - DNA, 13 bp, Homo sapiens
cccaggattcccc

SEQ ID NO: 3141087 - DNA, 17 bp, Homo sapiens
cccaggattcccccagc

SEQ ID NO: 3141088 - DNA, 18 bp, Homo sapiens
cccaggattcccccagcc

SEQ ID NO: 3141089 - DNA, 19 bp, Homo sapiens
cccaggattcccccagcca

SEQ ID NO: 3141090 - DNA, 13 bp, Homo sapiens
cccaggcagagct

SEQ ID NO: 3141091 - DNA, 16 bp, Homo sapiens
cccaggcagagctgac

SEQ ID NO: 3141092 - DNA, 11 bp, Homo sapiens
cccaggcaggt

SEQ ID NO: 3141093 - DNA, 17 bp, Homo sapiens
cccaggcaggtcttgaa

SEQ ID NO: 3141094 - DNA, 23 bp, Homo sapiens
cccaggcatctccttgggctggg

SEQ ID NO: 3141095 - DNA, 15 bp, Homo sapiens
cccaggccacagccg

SEQ ID NO: 3141096 - DNA, 18 bp, Homo sapiens
cccaggccacagccgcct

SEQ ID NO: 3141097 - DNA, 13 bp, Homo sapiens
cccaggcccacca

SEQ ID NO: 3141098 - DNA, 12 bp, Homo sapiens
cccaggccccct

SEQ ID NO: 3141099 - DNA, 15 bp, Homo sapiens
cccaggccccctgca

SEQ ID NO: 3141100 - DNA, 11 bp, Homo sapiens
cccaggcccct

SEQ ID NO: 3141101 - DNA, 21 bp, Homo sapiens
cccaggcccctgccaccctgg

SEQ ID NO: 3141102 - DNA, 15 bp, Homo sapiens
cccaggccctccatg

SEQ ID NO: 3141103 - DNA, 19 bp, Homo sapiens
cccaggccctccatgggct

SEQ ID NO: 3141104 - DNA, 14 bp, Homo sapiens
cccaggccctccct

SEQ ID NO: 3141105 - DNA, 17 bp, Homo sapiens
cccaggccctccctgac

SEQ ID NO: 3141106 - DNA, 16 bp, Homo sapiens
cccaggccgcagctct

SEQ ID NO: 3141107 - DNA, 23 bp, Homo sapiens
cccaggccggccagcctcaccct

SEQ ID NO: 3141108 - DNA, 13 bp, Homo sapiens
cccaggccgttcc

SEQ ID NO: 3141109 - DNA, 12 bp, Homo sapiens
cccaggcctacc

SEQ ID NO: 3141110 - DNA, 15 bp, Homo sapiens
cccaggcctccagcc

SEQ ID NO: 3141111 - DNA, 19 bp, Homo sapiens
cccaggcctccagcctctc

SEQ ID NO: 3141112 - DNA, 22 bp, Homo sapiens
cccaggcctccagcctctcccg

SEQ ID NO: 3141113 - DNA, 16 bp, Homo sapiens
cccaggcctgcctgtt

SEQ ID NO: 3141114 - DNA, 14 bp, Homo sapiens
cccaggcctgggtt

SEQ ID NO: 3141115 - DNA, 21 bp, Homo sapiens
ccccagagatgccagcccttc

SEQ ID NO: 3141116 - DNA, 21 bp, Homo sapiens
ccccagagcacccccaagcct

SEQ ID NO: 3141117 - DNA, 23 bp, Homo sapiens
ccccagagcacccccaagcctgg

SEQ ID NO: 3141118 - DNA, 13 bp, Homo sapiens
ccccagagcactg

SEQ ID NO: 3141119 - DNA, 21 bp, Homo sapiens
ccccagagcccctcctccagc

SEQ ID NO: 3141120 - DNA, 14 bp, Homo sapiens
ccccagagctgtgc

SEQ ID NO: 3141121 - DNA, 22 bp, Homo sapiens
ccccagagctgtttatggcctc

SEQ ID NO: 3141122 - DNA, 12 bp, Homo sapiens
ccccagaggccc

SEQ ID NO: 3141123 - DNA, 14 bp, Homo sapiens
ccccagaggccctg

SEQ ID NO: 3141124 - DNA, 15 bp, Homo sapiens
ccccagaggccctgg

SEQ ID NO: 3141125 - DNA, 18 bp, Homo sapiens
ccccagaggccctggagg

SEQ ID NO: 3141126 - DNA, 18 bp, Homo sapiens
ccccagataccagcccct

SEQ ID NO: 3141127 - DNA, 17 bp, Homo sapiens
ccccagatagagctggg

SEQ ID NO: 3141128 - DNA, 20 bp, Homo sapiens
ccccagatagagctgggtgg

SEQ ID NO: 3141129 - DNA, 22 bp, Homo sapiens
ccccagatctcccactgcgggg

SEQ ID NO: 3141130 - DNA, 16 bp, Homo sapiens
ccccagatctgcctgg

SEQ ID NO: 3141131 - DNA, 20 bp, Homo sapiens
ccccagatctgcctgggcct

SEQ ID NO: 3141132 - DNA, 24 bp, Homo sapiens
ccccagatctgcctgggcctgtgc

SEQ ID NO: 3141133 - DNA, 15 bp, Homo sapiens
ccccagattgcaaca

SEQ ID NO: 3141134 - DNA, 23 bp, Homo sapiens
ccccagattgcaacaggctgggc

SEQ ID NO: 3141135 - DNA, 22 bp, Homo sapiens
ccccagcaagcgggagcccgtg

SEQ ID NO: 3141136 - DNA, 20 bp, Homo sapiens
ccccagcaagtgagagctgg

SEQ ID NO: 3141137 - DNA, 21 bp, Homo sapiens
ccccagcaagtgagagctggg

SEQ ID NO: 3141138 - DNA, 11 bp, Homo sapiens
ccccagcactt

SEQ ID NO: 3141139 - DNA, 11 bp, Homo sapiens
ccccagccagg

SEQ ID NO: 3141140 - DNA, 14 bp, Homo sapiens
ccccagccaggcta

SEQ ID NO: 3141141 - DNA, 22 bp, Homo sapiens
ccccagcccaaaggggacaggc

SEQ ID NO: 3141142 - DNA, 15 bp, Homo sapiens
ccccagcccaagtcc

SEQ ID NO: 3141143 - DNA, 12 bp, Homo sapiens
ccccagcccacc

SEQ ID NO: 3141144 - DNA, 11 bp, Homo sapiens
ccccagcccag

SEQ ID NO: 3141145 - DNA, 15 bp, Homo sapiens
ccccagcccagggct

SEQ ID NO: 3141146 - DNA, 20 bp, Homo sapiens
ccccagcccagggctcctgc

SEQ ID NO: 3141147 - DNA, 23 bp, Homo sapiens
ccccagcccatccattaggccag

SEQ ID NO: 3141148 - DNA, 18 bp, Homo sapiens
ccccagcccctcccccat

SEQ ID NO: 3141149 - DNA, 21 bp, Homo sapiens
ccccagccccttctcccagca

SEQ ID NO: 3141150 - DNA, 20 bp, Homo sapiens
ccccagccctaatctcaccc

SEQ ID NO: 3141151 - DNA, 13 bp, Homo sapiens
ccccagccctgct

SEQ ID NO: 3141152 - DNA, 17 bp, Homo sapiens
ccccagccctgctgggg

SEQ ID NO: 3141153 - DNA, 16 bp, Homo sapiens
ccccagccctgggaac

SEQ ID NO: 3141154 - DNA, 15 bp, Homo sapiens
ccccagccctgtcct

SEQ ID NO: 3141155 - DNA, 11 bp, Homo sapiens
ccccagccctt

SEQ ID NO: 3141156 - DNA, 16 bp, Homo sapiens
ccccagcctacccttc

SEQ ID NO: 3141157 - DNA, 14 bp, Homo sapiens
ccccagcctatgag

SEQ ID NO: 3141158 - DNA, 11 bp, Homo sapiens
ccccagcctgg

SEQ ID NO: 3141159 - DNA, 16 bp, Homo sapiens
ccccagctcaggggca

SEQ ID NO: 3141160 - DNA, 17 bp, Homo sapiens
ccccagctctggcttcc

SEQ ID NO: 3141161 - DNA, 15 bp, Homo sapiens
ccccagctgactgtg

SEQ ID NO: 3141162 - DNA, 13 bp, Homo sapiens
ccccagctgggag

SEQ ID NO: 3141163 - DNA, 14 bp, Homo sapiens
ccccagctgggagg

SEQ ID NO: 3141164 - DNA, 22 bp, Homo sapiens
ccccagctgggaggcaagaggg

SEQ ID NO: 3141165 - DNA, 15 bp, Homo sapiens
ccccagctgtgagcc

SEQ ID NO: 3141166 - DNA, 16 bp, Homo sapiens
ccccagctgtgagcct

SEQ ID NO: 3141167 - DNA, 19 bp, Homo sapiens
ccccagctgtgagccttgg

SEQ ID NO: 3141168 - DNA, 18 bp, Homo sapiens
ccccaggaagcccaggag

SEQ ID NO: 3141169 - DNA, 13 bp, Homo sapiens
ccccaggcccacc

SEQ ID NO: 3141170 - DNA, 15 bp, Homo sapiens
ccccaggccctccct

SEQ ID NO: 3141171 - DNA, 16 bp, Homo sapiens
ccccaggccctccctg

SEQ ID NO: 3141172 - DNA, 20 bp, Homo sapiens
ccccaggcccttcaggaact

SEQ ID NO: 3141173 - DNA, 17 bp, Homo sapiens
ccccagggaatcaggga

SEQ ID NO: 3141174 - DNA, 22 bp, Homo sapiens
ccccagggaatcagggaccagc

SEQ ID NO: 3141175 - DNA, 11 bp, Homo sapiens
ccccagggcac

SEQ ID NO: 3141176 - DNA, 14 bp, Homo sapiens
ccccagggcaccct

SEQ ID NO: 3141177 - DNA, 21 bp, Homo sapiens
ccccagggcccctccctctgc

SEQ ID NO: 3141178 - DNA, 22 bp, Homo sapiens
ccccagggcctgcttccccttc

SEQ ID NO: 3141179 - DNA, 21 bp, Homo sapiens
ccccagggctcccttatgtcc

SEQ ID NO: 3141180 - DNA, 16 bp, Homo sapiens
ccccaggggaaaatga

SEQ ID NO: 3141181 - DNA, 17 bp, Homo sapiens
ccccaggggaaaatgaa

SEQ ID NO: 3141182 - DNA, 18 bp, Homo sapiens
ccccaggggaaaatgaag

SEQ ID NO: 3141183 - DNA, 14 bp, Homo sapiens
ccccaggggcagga

SEQ ID NO: 3141184 - DNA, 15 bp, Homo sapiens
ccccaggggcaggac

SEQ ID NO: 3141185 - DNA, 22 bp, Homo sapiens
ccccaggggtcccagccacccc

SEQ ID NO: 3141186 - DNA, 19 bp, Homo sapiens
ccccagggtcttccctacc

SEQ ID NO: 3141187 - DNA, 17 bp, Homo sapiens
ccccaggtggaaggcag

SEQ ID NO: 3141188 - DNA, 18 bp, Homo sapiens
ccccagtccccacccctg

SEQ ID NO: 3141189 - DNA, 14 bp, Homo sapiens
ccccagtgcccaca

SEQ ID NO: 3141190 - DNA, 15 bp, Homo sapiens
ccccagtgcccacag

SEQ ID NO: 3141191 - DNA, 15 bp, Homo sapiens
ccccagttctgctcc

SEQ ID NO: 3141192 - DNA, 21 bp, Homo sapiens
ccccagttctgctcctctcca

SEQ ID NO: 3141193 - DNA, 15 bp, Homo sapiens
ccccagtttcttctt

SEQ ID NO: 3141194 - DNA, 18 bp, Homo sapiens
ccccatcagttcccccag

SEQ ID NO: 3141195 - DNA, 15 bp, Homo sapiens
ccccatccccaccag

SEQ ID NO: 3141196 - DNA, 14 bp, Homo sapiens
ccccatcctccagc

SEQ ID NO: 3141197 - DNA, 15 bp, Homo sapiens
ccccatcctccagct

SEQ ID NO: 3141198 - DNA, 15 bp, Homo sapiens
ccccatctcatcctg

SEQ ID NO: 3141199 - DNA, 19 bp, Homo sapiens
ccccatctccccaggcctc

SEQ ID NO: 3141200 - DNA, 19 bp, Homo sapiens
ccccatctccctgcctggc

SEQ ID NO: 3141201 - DNA, 14 bp, Homo sapiens
ccccatctctacta

SEQ ID NO: 3141202 - DNA, 16 bp, Homo sapiens
ccccatcttccacctg

SEQ ID NO: 3141203 - DNA, 21 bp, Homo sapiens
ccccatcttccacctgtgccc

SEQ ID NO: 3141204 - DNA, 16 bp, Homo sapiens
ccccatgccacgttcc

SEQ ID NO: 3141205 - DNA, 12 bp, Homo sapiens
ccccatgcctgt

SEQ ID NO: 3141206 - DNA, 18 bp, Homo sapiens
ccccatggccccaggccc

SEQ ID NO: 3141207 - DNA, 14 bp, Homo sapiens
ccccatgtgtcctg

SEQ ID NO: 3141208 - DNA, 16 bp, Homo sapiens
ccccatgtgtcctggt

SEQ ID NO: 3141209 - DNA, 18 bp, Homo sapiens
ccccatgtgtcctggttc

SEQ ID NO: 3141210 - DNA, 23 bp, Homo sapiens
ccccatgtgtcctggttcccgtt

SEQ ID NO: 3141211 - DNA, 19 bp, Homo sapiens
ccccatgttgtaatgctgc

SEQ ID NO: 3141212 - DNA, 20 bp, Homo sapiens
ccccatgttgtaatgctgca

SEQ ID NO: 3141213 - DNA, 21 bp, Homo sapiens
ccccatgttgtaatgctgcac

SEQ ID NO: 3141214 - DNA, 13 bp, Homo sapiens
ccccattctgcct

SEQ ID NO: 3141215 - DNA, 21 bp, Homo sapiens
ccccattctgcctgcccaggc

SEQ ID NO: 3141216 - DNA, 21 bp, Homo sapiens
ccccattcttcctagttttct

SEQ ID NO: 3141217 - DNA, 16 bp, Homo sapiens
ccccatttcccatctg

SEQ ID NO: 3141218 - DNA, 18 bp, Homo sapiens
ccccatttcccatctgca

SEQ ID NO: 3141219 - DNA, 20 bp, Homo sapiens
ccccatttcccatctgcacc

SEQ ID NO: 3141220 - DNA, 13 bp, Homo sapiens
ccccatttctatt

SEQ ID NO: 3141221 - DNA, 17 bp, Homo sapiens
ccccatttctatttatt

SEQ ID NO: 3141222 - DNA, 15 bp, Homo sapiens
cccccaacactccag

SEQ ID NO: 3141223 - DNA, 22 bp, Homo sapiens
cccccaacactgtgccctggtg

SEQ ID NO: 3141224 - DNA, 23 bp, Homo sapiens
cccccaaccaagtggctcccaca

SEQ ID NO: 3141225 - DNA, 16 bp, Homo sapiens
cccccaacccctgagg

SEQ ID NO: 3141226 - DNA, 18 bp, Homo sapiens
cccccaacccctgaggaa

SEQ ID NO: 3141227 - DNA, 20 bp, Homo sapiens
cccccaactctgagcccatg

SEQ ID NO: 3141228 - DNA, 14 bp, Homo sapiens
cccccaagcctggg

SEQ ID NO: 3141229 - DNA, 22 bp, Homo sapiens
cccccaagcctgggcttgagct

SEQ ID NO: 3141230 - DNA, 19 bp, Homo sapiens
cccccaagctgttttcttc

SEQ ID NO: 3141231 - DNA, 12 bp, Homo sapiens
cccccaataaag

SEQ ID NO: 3141232 - DNA, 18 bp, Homo sapiens
cccccaataaaggcagct

SEQ ID NO: 3141233 - DNA, 22 bp, Homo sapiens
cccccaataaaggcagctgcct

SEQ ID NO: 3141234 - DNA, 17 bp, Homo sapiens
cccccacacctcagttc

SEQ ID NO: 3141235 - DNA, 15 bp, Homo sapiens
cccccaccactagga

SEQ ID NO: 3141236 - DNA, 14 bp, Homo sapiens
cccccacctctggt

SEQ ID NO: 3141237 - DNA, 21 bp, Homo sapiens
cccccagatagagctgggtgg

SEQ ID NO: 3141238 - DNA, 19 bp, Homo sapiens
cccccagattccaacattt

SEQ ID NO: 3141239 - DNA, 13 bp, Homo sapiens
cccccagccaggc

SEQ ID NO: 3141240 - DNA, 15 bp, Homo sapiens
cccccagccaggcta

SEQ ID NO: 3141241 - DNA, 14 bp, Homo sapiens
cccccagcccaggg

SEQ ID NO: 3141242 - DNA, 16 bp, Homo sapiens
cccccagccctgggaa

SEQ ID NO: 3141243 - DNA, 12 bp, Homo sapiens
cccccagcctat

SEQ ID NO: 3141244 - DNA, 15 bp, Homo sapiens
cccccagcctatgag

SEQ ID NO: 3141245 - DNA, 20 bp, Homo sapiens
cccccagcctatgagcatcc

SEQ ID NO: 3141246 - DNA, 12 bp, Homo sapiens
cccccagctctg

SEQ ID NO: 3141247 - DNA, 14 bp, Homo sapiens
cccccagctctggt

SEQ ID NO: 3141248 - DNA, 16 bp, Homo sapiens
cccccaggattccccc

SEQ ID NO: 3141249 - DNA, 14 bp, Homo sapiens
cccccaggggcagg

SEQ ID NO: 3141250 - DNA, 14 bp, Homo sapiens
cccccagtacctcc

SEQ ID NO: 3141251 - DNA, 22 bp, Homo sapiens
cccccatccccatcctccagct

SEQ ID NO: 3141252 - DNA, 11 bp, Homo sapiens
ccccccactct

SEQ ID NO: 3141253 - DNA, 13 bp, Homo sapiens
ccccccagcacta

SEQ ID NO: 3141254 - DNA, 12 bp, Homo sapiens
ccccccagcctg

SEQ ID NO: 3141255 - DNA, 12 bp, Homo sapiens
ccccccagctca

SEQ ID NO: 3141256 - DNA, 13 bp, Homo sapiens
cccccccatgcag

SEQ ID NO: 3141257 - DNA, 13 bp, Homo sapiens
ccccccgcccacc

SEQ ID NO: 3141258 - DNA, 16 bp, Homo sapiens
cccccgacactgctgc

SEQ ID NO: 3141259 - DNA, 17 bp, Homo sapiens
cccccgacactgctgca

SEQ ID NO: 3141260 - DNA, 14 bp, Homo sapiens
cccccgcacagcca

SEQ ID NO: 3141261 - DNA, 22 bp, Homo sapiens
cccccgcagtccccagcccttc

SEQ ID NO: 3141262 - DNA, 23 bp, Homo sapiens
cccccgcagtccccagcccttct

SEQ ID NO: 3141263 - DNA, 20 bp, Homo sapiens
cccccgcgctcgcccagcag

SEQ ID NO: 3141264 - DNA, 21 bp, Homo sapiens
cccccgcgctcgcccagcagg

SEQ ID NO: 3141265 - DNA, 16 bp, Homo sapiens
ccccctcaaacctcct

SEQ ID NO: 3141266 - DNA, 13 bp, Homo sapiens
ccccctccctgga

SEQ ID NO: 3141267 - DNA, 16 bp, Homo sapiens
ccccctccctggatga

SEQ ID NO: 3141268 - DNA, 19 bp, Homo sapiens
ccccctccgccctgccact

SEQ ID NO: 3141269 - DNA, 13 bp, Homo sapiens
ccccctcctggca

SEQ ID NO: 3141270 - DNA, 14 bp, Homo sapiens
ccccctcctggcaa

SEQ ID NO: 3141271 - DNA, 19 bp, Homo sapiens
ccccctcttcttctgaaga

SEQ ID NO: 3141272 - DNA, 22 bp, Homo sapiens
ccccctgagatcccctgagccc

SEQ ID NO: 3141273 - DNA, 16 bp, Homo sapiens
ccccctgccccccagc

SEQ ID NO: 3141274 - DNA, 22 bp, Homo sapiens
ccccctgccccccagcctctgg

SEQ ID NO: 3141275 - DNA, 12 bp, Homo sapiens
ccccctgccctc

SEQ ID NO: 3141276 - DNA, 22 bp, Homo sapiens
ccccctgccctcgtggccagcc

SEQ ID NO: 3141277 - DNA, 20 bp, Homo sapiens
ccccctgctccaccagcagc

SEQ ID NO: 3141278 - DNA, 12 bp, Homo sapiens
ccccctggctga

SEQ ID NO: 3141279 - DNA, 20 bp, Homo sapiens
ccccctggctgactggccag

SEQ ID NO: 3141280 - DNA, 23 bp, Homo sapiens
ccccctggtggacagtcctggga

SEQ ID NO: 3141281 - DNA, 12 bp, Homo sapiens
ccccctgtcccc

SEQ ID NO: 3141282 - DNA, 18 bp, Homo sapiens
ccccctgtcccctcagct

SEQ ID NO: 3141283 - DNA, 16 bp, Homo sapiens
cccccttaaatttaat

SEQ ID NO: 3141284 - DNA, 15 bp, Homo sapiens
cccccttcctagtga

SEQ ID NO: 3141285 - DNA, 14 bp, Homo sapiens
cccccttcctttgg

SEQ ID NO: 3141286 - DNA, 22 bp, Homo sapiens
cccccttgccctccgcctggga

SEQ ID NO: 3141287 - DNA, 18 bp, Homo sapiens
ccccctttcagatgtctt

SEQ ID NO: 3141288 - DNA, 18 bp, Homo sapiens
ccccctttgctgtgagga

SEQ ID NO: 3141289 - DNA, 14 bp, Homo sapiens
ccccctttgtgctg

SEQ ID NO: 3141290 - DNA, 16 bp, Homo sapiens
ccccctttgtgctgtg

SEQ ID NO: 3141291 - DNA, 17 bp, Homo sapiens
ccccctttgtgctgtgg

SEQ ID NO: 3141292 - DNA, 18 bp, Homo sapiens
ccccctttgtgctgtggg

SEQ ID NO: 3141293 - DNA, 22 bp, Homo sapiens
cccccttttcagctgagccctg

SEQ ID NO: 3141294 - DNA, 13 bp, Homo sapiens
ccccgaggctgct

SEQ ID NO: 3141295 - DNA, 14 bp, Homo sapiens
ccccgagtgaggac

SEQ ID NO: 3141296 - DNA, 23 bp, Homo sapiens
ccccgagtgaggacgcaccgccg

SEQ ID NO: 3141297 - DNA, 17 bp, Homo sapiens
ccccgatgtcccctgcg

SEQ ID NO: 3141298 - DNA, 13 bp, Homo sapiens
ccccgcacagcca

SEQ ID NO: 3141299 - DNA, 16 bp, Homo sapiens
ccccgcacagccaccc

SEQ ID NO: 3141300 - DNA, 13 bp, Homo sapiens
ccccgcagacctc

SEQ ID NO: 3141301 - DNA, 14 bp, Homo sapiens
ccccgcagacctcc

SEQ ID NO: 3141302 - DNA, 20 bp, Homo sapiens
ccccgcagacctccccagcc

SEQ ID NO: 3141303 - DNA, 21 bp, Homo sapiens
ccccgcagacctccccagccc

SEQ ID NO: 3141304 - DNA, 14 bp, Homo sapiens
ccccgcagcccgtg

SEQ ID NO: 3141305 - DNA, 12 bp, Homo sapiens
ccccgccacagc

SEQ ID NO: 3141306 - DNA, 17 bp, Homo sapiens
ccccgccacctcagggc

SEQ ID NO: 3141307 - DNA, 15 bp, Homo sapiens
ccccgcccacccacg

SEQ ID NO: 3141308 - DNA, 12 bp, Homo sapiens
ccccgcccccag

SEQ ID NO: 3141309 - DNA, 17 bp, Homo sapiens
ccccgccctcttcctga

SEQ ID NO: 3141310 - DNA, 21 bp, Homo sapiens
ccccgcctgcagtcttctggg

SEQ ID NO: 3141311 - DNA, 18 bp, Homo sapiens
ccccgcctgccctcatgg

SEQ ID NO: 3141312 - DNA, 12 bp, Homo sapiens
ccccgcctggcc

SEQ ID NO: 3141313 - DNA, 16 bp, Homo sapiens
ccccgcctggccagga

SEQ ID NO: 3141314 - DNA, 15 bp, Homo sapiens
ccccgccttcctggg

SEQ ID NO: 3141315 - DNA, 18 bp, Homo sapiens
ccccgcgctcgcccagca

SEQ ID NO: 3141316 - DNA, 15 bp, Homo sapiens
ccccggatcagagca

SEQ ID NO: 3141317 - DNA, 21 bp, Homo sapiens
ccccggcaggccctgcagtgt

SEQ ID NO: 3141318 - DNA, 13 bp, Homo sapiens
ccccggccacctc

SEQ ID NO: 3141319 - DNA, 16 bp, Homo sapiens
ccccggccacctctgc

SEQ ID NO: 3141320 - DNA, 18 bp, Homo sapiens
ccccggccccagccagag

SEQ ID NO: 3141321 - DNA, 12 bp, Homo sapiens
ccccggcctcag

SEQ ID NO: 3141322 - DNA, 21 bp, Homo sapiens
ccccggcctcagggcgctcag

SEQ ID NO: 3141323 - DNA, 16 bp, Homo sapiens
ccccggcctttatgtt

SEQ ID NO: 3141324 - DNA, 18 bp, Homo sapiens
ccccgggcaaagggtctt

SEQ ID NO: 3141325 - DNA, 16 bp, Homo sapiens
ccccgggctctctgct

SEQ ID NO: 3141326 - DNA, 21 bp, Homo sapiens
ccccgggctggagaaagagct

SEQ ID NO: 3141327 - DNA, 16 bp, Homo sapiens
ccccggggaccctgtg

SEQ ID NO: 3141328 - DNA, 13 bp, Homo sapiens
ccccggggctggc

SEQ ID NO: 3141329 - DNA, 17 bp, Homo sapiens
ccccgggggaggaaggg

SEQ ID NO: 3141330 - DNA, 22 bp, Homo sapiens
ccccggggtgagtccattctcc

SEQ ID NO: 3141331 - DNA, 20 bp, Homo sapiens
ccccggtcacctagcaagct

SEQ ID NO: 3141332 - DNA, 17 bp, Homo sapiens
ccccggtggctgggcag

SEQ ID NO: 3141333 - DNA, 22 bp, Homo sapiens
ccccgtggccatccctgtgagg

SEQ ID NO: 3141334 - DNA, 21 bp, Homo sapiens
ccccgttcctgacatcacagc

SEQ ID NO: 3141335 - DNA, 19 bp, Homo sapiens
cccctaagtgcccaaagtg

SEQ ID NO: 3141336 - DNA, 19 bp, Homo sapiens
cccctagaaacccaagctc

SEQ ID NO: 3141337 - DNA, 17 bp, Homo sapiens
cccctagcccaggagag

SEQ ID NO: 3141338 - DNA, 15 bp, Homo sapiens
cccctagttccctct

SEQ ID NO: 3141339 - DNA, 16 bp, Homo sapiens
cccctatcctctgagt

SEQ ID NO: 3141340 - DNA, 18 bp, Homo sapiens
cccctcacagcctctgac

SEQ ID NO: 3141341 - DNA, 13 bp, Homo sapiens
cccctcaccctgc

SEQ ID NO: 3141342 - DNA, 13 bp, Homo sapiens
cccctcacctcct

SEQ ID NO: 3141343 - DNA, 21 bp, Homo sapiens
cccctcactctgtcagccagc

SEQ ID NO: 3141344 - DNA, 23 bp, Homo sapiens
cccctcagatgatctctccacgg

SEQ ID NO: 3141345 - DNA, 15 bp, Homo sapiens
cccctcagcccttgc

SEQ ID NO: 3141346 - DNA, 17 bp, Homo sapiens
cccctcagcccttgccc

SEQ ID NO: 3141347 - DNA, 12 bp, Homo sapiens
cccctcagctcc

SEQ ID NO: 3141348 - DNA, 17 bp, Homo sapiens
cccctcagctccagacg

SEQ ID NO: 3141349 - DNA, 23 bp, Homo sapiens
cccctccaatcccaccaaccctc

SEQ ID NO: 3141350 - DNA, 14 bp, Homo sapiens
cccctccacatccc

SEQ ID NO: 3141351 - DNA, 19 bp, Homo sapiens
cccctccacgcctcctggc

SEQ ID NO: 3141352 - DNA, 14 bp, Homo sapiens
cccctccactgtca

SEQ ID NO: 3141353 - DNA, 13 bp, Homo sapiens
cccctccagcctt

SEQ ID NO: 3141354 - DNA, 14 bp, Homo sapiens
cccctccaggagag

SEQ ID NO: 3141355 - DNA, 14 bp, Homo sapiens
cccctcccacctcc

SEQ ID NO: 3141356 - DNA, 12 bp, Homo sapiens
cccctcccaggg

SEQ ID NO: 3141357 - DNA, 14 bp, Homo sapiens
cccctcccatctgg

SEQ ID NO: 3141358 - DNA, 12 bp, Homo sapiens
cccctccccact

SEQ ID NO: 3141359 - DNA, 20 bp, Homo sapiens
cccctccccctgagattcag

SEQ ID NO: 3141360 - DNA, 17 bp, Homo sapiens
cccctccccgcctggcc

SEQ ID NO: 3141361 - DNA, 11 bp, Homo sapiens
cccctcccctc

SEQ ID NO: 3141362 - DNA, 13 bp, Homo sapiens
cccctcccctcca

SEQ ID NO: 3141363 - DNA, 13 bp, Homo sapiens
cccctcccctgaa

SEQ ID NO: 3141364 - DNA, 15 bp, Homo sapiens
cccctcccctgctgc

SEQ ID NO: 3141365 - DNA, 18 bp, Homo sapiens
cccctcccctgctgcagg

SEQ ID NO: 3141366 - DNA, 14 bp, Homo sapiens
cccctccctctgtc

SEQ ID NO: 3141367 - DNA, 12 bp, Homo sapiens
cccctccctggc

SEQ ID NO: 3141368 - DNA, 22 bp, Homo sapiens
cccctccctggctcccatgacc

SEQ ID NO: 3141369 - DNA, 19 bp, Homo sapiens
ccctactccctgcagatgc

SEQ ID NO: 3141370 - DNA, 18 bp, Homo sapiens
ccctactcggatggggca

SEQ ID NO: 3141371 - DNA, 20 bp, Homo sapiens
ccctactttgcttccgccac

SEQ ID NO: 3141372 - DNA, 22 bp, Homo sapiens
ccctactttgcttccgccactc

SEQ ID NO: 3141373 - DNA, 19 bp, Homo sapiens
ccctagaaacccaagctcc

SEQ ID NO: 3141374 - DNA, 19 bp, Homo sapiens
ccctagccagagaatagat

SEQ ID NO: 3141375 - DNA, 14 bp, Homo sapiens
ccctagcccagact

SEQ ID NO: 3141376 - DNA, 20 bp, Homo sapiens
ccctagcccagcgctctgcc

SEQ ID NO: 3141377 - DNA, 18 bp, Homo sapiens
ccctagcccaggagagag

SEQ ID NO: 3141378 - DNA, 19 bp, Homo sapiens
ccctagctttagaccctgg

SEQ ID NO: 3141379 - DNA, 17 bp, Homo sapiens
ccctaggaactcagtcc

SEQ ID NO: 3141380 - DNA, 21 bp, Homo sapiens
ccctaggagtatatttccgca

SEQ ID NO: 3141381 - DNA, 18 bp, Homo sapiens
ccctaggatgctgcagca

SEQ ID NO: 3141382 - DNA, 17 bp, Homo sapiens
ccctagtccccctgttt

SEQ ID NO: 3141383 - DNA, 23 bp, Homo sapiens
ccctagttccctctgctcagcca

SEQ ID NO: 3141384 - DNA, 19 bp, Homo sapiens
ccctagttctacctcaggc

SEQ ID NO: 3141385 - DNA, 16 bp, Homo sapiens
ccctatacactagaca

SEQ ID NO: 3141386 - DNA, 14 bp, Homo sapiens
ccctatcctctgag

SEQ ID NO: 3141387 - DNA, 14 bp, Homo sapiens
ccctatccttggca

SEQ ID NO: 3141388 - DNA, 13 bp, Homo sapiens
ccctatctcctga

SEQ ID NO: 3141389 - DNA, 14 bp, Homo sapiens
ccctatctcctgac

SEQ ID NO: 3141390 - DNA, 15 bp, Homo sapiens
ccctatctcctgaca

SEQ ID NO: 3141391 - DNA, 17 bp, Homo sapiens
ccctatctcctgacaga

SEQ ID NO: 3141392 - DNA, 13 bp, Homo sapiens
ccctatgtctgca

SEQ ID NO: 3141393 - DNA, 18 bp, Homo sapiens
ccctatttattgactttg

SEQ ID NO: 3141394 - DNA, 19 bp, Homo sapiens
ccctcaacaagggagagac

SEQ ID NO: 3141395 - DNA, 15 bp, Homo sapiens
ccctcaacaggccca

SEQ ID NO: 3141396 - DNA, 16 bp, Homo sapiens
ccctcaacaggcccag

SEQ ID NO: 3141397 - DNA, 18 bp, Homo sapiens
ccctcaacaggcccaggg

SEQ ID NO: 3141398 - DNA, 21 bp, Homo sapiens
ccctcaagccaatcccctcct

SEQ ID NO: 3141399 - DNA, 22 bp, Homo sapiens
ccctcaagccccagcagccctc

SEQ ID NO: 3141400 - DNA, 20 bp, Homo sapiens
ccctcacacacacagctggg

SEQ ID NO: 3141401 - DNA, 14 bp, Homo sapiens
ccctcacagcctct

SEQ ID NO: 3141402 - DNA, 18 bp, Homo sapiens
ccctcacagcctctgacc

SEQ ID NO: 3141403 - DNA, 17 bp, Homo sapiens
ccctcacccccatggcc

SEQ ID NO: 3141404 - DNA, 22 bp, Homo sapiens
ccctcaccccctcctggcaatc

SEQ ID NO: 3141405 - DNA, 16 bp, Homo sapiens
ccctcaccttctgagt

SEQ ID NO: 3141406 - DNA, 21 bp, Homo sapiens
ccctcactctgccagggcagt

SEQ ID NO: 3141407 - DNA, 15 bp, Homo sapiens
ccctcactctgtcag

SEQ ID NO: 3141408 - DNA, 18 bp, Homo sapiens
ccctcactctgtcagcca

SEQ ID NO: 3141409 - DNA, 23 bp, Homo sapiens
ccctcactctgtcagccagccgc

SEQ ID NO: 3141410 - DNA, 13 bp, Homo sapiens
ccctcagagccac

SEQ ID NO: 3141411 - DNA, 22 bp, Homo sapiens
ccctcagatgatctctccacgg

SEQ ID NO: 3141412 - DNA, 14 bp, Homo sapiens
ccctcagcacccct

SEQ ID NO: 3141413 - DNA, 15 bp, Homo sapiens
ccctcagcacccctt

SEQ ID NO: 3141414 - DNA, 20 bp, Homo sapiens
ccctcagcctgtaccggttt

SEQ ID NO: 3141415 - DNA, 16 bp, Homo sapiens
ccctcagctctctggg

SEQ ID NO: 3141416 - DNA, 21 bp, Homo sapiens
ccctcaggaattcagtgcctt

SEQ ID NO: 3141417 - DNA, 21 bp, Homo sapiens
ccctcaggcataggcctgggt

SEQ ID NO: 3141418 - DNA, 23 bp, Homo sapiens
ccctcaggcataggcctgggtgc

SEQ ID NO: 3141419 - DNA, 15 bp, Homo sapiens
ccctcaggggaaaac

SEQ ID NO: 3141420 - DNA, 20 bp, Homo sapiens
ccctcaggttctattttctt

SEQ ID NO: 3141421 - DNA, 23 bp, Homo sapiens
ccctcataagtttgtttaaacac

SEQ ID NO: 3141422 - DNA, 17 bp, Homo sapiens
ccctcatctatgaggaa

SEQ ID NO: 3141423 - DNA, 23 bp, Homo sapiens
ccctcatcttgaagggcccagga

SEQ ID NO: 3141424 - DNA, 16 bp, Homo sapiens
ccctcatggcccctct

SEQ ID NO: 3141425 - DNA, 17 bp, Homo sapiens
ccctcatggcccctctg

SEQ ID NO: 3141426 - DNA, 17 bp, Homo sapiens
ccctcattactgggcct

SEQ ID NO: 3141427 - DNA, 18 bp, Homo sapiens
ccctcattactgggcctt

SEQ ID NO: 3141428 - DNA, 22 bp, Homo sapiens
ccctcattccaccttcccatgc

SEQ ID NO: 3141429 - DNA, 11 bp, Homo sapiens
ccctcattttt

SEQ ID NO: 3141430 - DNA, 18 bp, Homo sapiens
ccctccaaaagcacttac

SEQ ID NO: 3141431 - DNA, 11 bp, Homo sapiens
ccctccaaaga

SEQ ID NO: 3141432 - DNA, 13 bp, Homo sapiens
ccctccacatccc

SEQ ID NO: 3141433 - DNA, 19 bp, Homo sapiens
ccctccacatcccagcagc

SEQ ID NO: 3141434 - DNA, 14 bp, Homo sapiens
ccctccaccccaca

SEQ ID NO: 3141435 - DNA, 17 bp, Homo sapiens
ccctccactcagctgtc

SEQ ID NO: 3141436 - DNA, 21 bp, Homo sapiens
ccctccaggaagaagcagggg

SEQ ID NO: 3141437 - DNA, 12 bp, Homo sapiens
ccctccaggaga

SEQ ID NO: 3141438 - DNA, 17 bp, Homo sapiens
ccctccatgtgggctag

SEQ ID NO: 3141439 - DNA, 15 bp, Homo sapiens
ccctcccacctccag

SEQ ID NO: 3141440 - DNA, 13 bp, Homo sapiens
ccctcccacctct

SEQ ID NO: 3141441 - DNA, 17 bp, Homo sapiens
ccctcccacctctgtga

SEQ ID NO: 3141442 - DNA, 14 bp, Homo sapiens
ccctcccagttttc

SEQ ID NO: 3141443 - DNA, 13 bp, Homo sapiens
ccctcccatctgg

SEQ ID NO: 3141444 - DNA, 16 bp, Homo sapiens
ccctcccatctgggag

SEQ ID NO: 3141445 - DNA, 14 bp, Homo sapiens
ccctccccatggag

SEQ ID NO: 3141446 - DNA, 16 bp, Homo sapiens
ccctcccccaaccccc

SEQ ID NO: 3141447 - DNA, 17 bp, Homo sapiens
ccctcccccagacacag

SEQ ID NO: 3141448 - DNA, 16 bp, Homo sapiens
ccctccccctcaacct

SEQ ID NO: 3141449 - DNA, 15 bp, Homo sapiens
ccctcccccttcccc

SEQ ID NO: 3141450 - DNA, 17 bp, Homo sapiens
ccctccccgcctggcca

SEQ ID NO: 3141451 - DNA, 15 bp, Homo sapiens
ccctcccctccttgt

SEQ ID NO: 3141452 - DNA, 17 bp, Homo sapiens
ccctcccctccttgtct

SEQ ID NO: 3141453 - DNA, 14 bp, Homo sapiens
ccctcccctcgtgt

SEQ ID NO: 3141454 - DNA, 14 bp, Homo sapiens
ccctcccctctctt

SEQ ID NO: 3141455 - DNA, 13 bp, Homo sapiens
ccctcccctgctg

SEQ ID NO: 3141456 - DNA, 16 bp, Homo sapiens
ccctcccggcatggga

SEQ ID NO: 3141457 - DNA, 15 bp, Homo sapiens
ccctccctctgcccc

SEQ ID NO: 3141458 - DNA, 16 bp, Homo sapiens
ccctccctggctccca

SEQ ID NO: 3141459 - DNA, 13 bp, Homo sapiens
ccctccgccctgc

SEQ ID NO: 3141460 - DNA, 13 bp, Homo sapiens
ccctccgccttct

SEQ ID NO: 3141461 - DNA, 19 bp, Homo sapiens
ccctcctaaatgtcagctg

SEQ ID NO: 3141462 - DNA, 19 bp, Homo sapiens
ccctcctagacccaggtgg

SEQ ID NO: 3141463 - DNA, 22 bp, Homo sapiens
ccctcctagacccaggtggagg

SEQ ID NO: 3141464 - DNA, 16 bp, Homo sapiens
ccctcctcacctctgg

SEQ ID NO: 3141465 - DNA, 12 bp, Homo sapiens
ccctcctcactg

SEQ ID NO: 3141466 - DNA, 23 bp, Homo sapiens
ccctcctccaggcctgcctccca

SEQ ID NO: 3141467 - DNA, 12 bp, Homo sapiens
ccctcctcgggc

SEQ ID NO: 3141468 - DNA, 14 bp, Homo sapiens
ccctcctcgggccg

SEQ ID NO: 3141469 - DNA, 18 bp, Homo sapiens
ccctcctcgggccgaggc

SEQ ID NO: 3141470 - DNA, 19 bp, Homo sapiens
ccctcctctagctgtgggg

SEQ ID NO: 3141471 - DNA, 15 bp, Homo sapiens
ccctcctctcccatc

SEQ ID NO: 3141472 - DNA, 16 bp, Homo sapiens
ccctcctctcccatcc

SEQ ID NO: 3141473 - DNA, 17 bp, Homo sapiens
ccctcctctcccatccc

SEQ ID NO: 3141474 - DNA, 14 bp, Homo sapiens
ccctcctcttggaa

SEQ ID NO: 3141475 - DNA, 12 bp, Homo sapiens
ccctcctgctcc

SEQ ID NO: 3141476 - DNA, 18 bp, Homo sapiens
ccctcctgctcctccctg

SEQ ID NO: 3141477 - DNA, 11 bp, Homo sapiens
ccctcctggca

SEQ ID NO: 3141478 - DNA, 13 bp, Homo sapiens
ccctcctggcaat

SEQ ID NO: 3141479 - DNA, 20 bp, Homo sapiens
ccctcctggcaatcaataca

SEQ ID NO: 3141480 - DNA, 23 bp, Homo sapiens
ccctccttgggtcattgacctct

SEQ ID NO: 3141481 - DNA, 18 bp, Homo sapiens
ccctcgaaccaaggcagc

SEQ ID NO: 3141482 - DNA, 20 bp, Homo sapiens
ccctcgaaccaaggcagcct

SEQ ID NO: 3141483 - DNA, 22 bp, Homo sapiens
ccctcgaaccaaggcagcctcc

SEQ ID NO: 3141484 - DNA, 22 bp, Homo sapiens
ccctcgaagcgcgccactcgct

SEQ ID NO: 3141485 - DNA, 21 bp, Homo sapiens
ccctcgacagcgcccctgctg

SEQ ID NO: 3141486 - DNA, 16 bp, Homo sapiens
ccctcgccacctttca

SEQ ID NO: 3141487 - DNA, 15 bp, Homo sapiens
ccctcgccagcttct

SEQ ID NO: 3141488 - DNA, 20 bp, Homo sapiens
ccctcgccagcttctcctgc

SEQ ID NO: 3141489 - DNA, 22 bp, Homo sapiens
ccctcgccagcttctcctgcgc

SEQ ID NO: 3141490 - DNA, 23 bp, Homo sapiens
ccctcgcctgtggagctcagccc

SEQ ID NO: 3141491 - DNA, 14 bp, Homo sapiens
ccctcggacccacc

SEQ ID NO: 3141492 - DNA, 23 bp, Homo sapiens
ccctcggggggtcacaggcccag

SEQ ID NO: 3141493 - DNA, 13 bp, Homo sapiens
ccctcgtccacag

SEQ ID NO: 3141494 - DNA, 14 bp, Homo sapiens
ccctcgtcctgtcc

SEQ ID NO: 3141495 - DNA, 15 bp, Homo sapiens
ccctggtttcactgg

SEQ ID NO: 3141496 - DNA, 13 bp, Homo sapiens
ccctgtacagtgt

SEQ ID NO: 3141497 - DNA, 14 bp, Homo sapiens
ccctgtacccagct

SEQ ID NO: 3141498 - DNA, 19 bp, Homo sapiens
ccctgtaccttttgaggag

SEQ ID NO: 3141499 - DNA, 19 bp, Homo sapiens
ccctgtagatgttctagga

SEQ ID NO: 3141500 - DNA, 17 bp, Homo sapiens
ccctgtagctctgcctc

SEQ ID NO: 3141501 - DNA, 18 bp, Homo sapiens
ccctgtagctctgcctcc

SEQ ID NO: 3141502 - DNA, 21 bp, Homo sapiens
ccctgtagctctgcctccctc

SEQ ID NO: 3141503 - DNA, 14 bp, Homo sapiens
ccctgtatggcact

SEQ ID NO: 3141504 - DNA, 18 bp, Homo sapiens
ccctgtcaagttaacaag

SEQ ID NO: 3141505 - DNA, 14 bp, Homo sapiens
ccctgtcagaggct

SEQ ID NO: 3141506 - DNA, 19 bp, Homo sapiens
ccctgtcatttgaacctgg

SEQ ID NO: 3141507 - DNA, 17 bp, Homo sapiens
ccctgtcccatgcaggc

SEQ ID NO: 3141508 - DNA, 20 bp, Homo sapiens
ccctgtcccatgcaggccct

SEQ ID NO: 3141509 - DNA, 21 bp, Homo sapiens
ccctgtcccatgcaggccctt

SEQ ID NO: 3141510 - DNA, 13 bp, Homo sapiens
ccctgtcccccag

SEQ ID NO: 3141511 - DNA, 21 bp, Homo sapiens
ccctgtccccctcccctccca

SEQ ID NO: 3141512 - DNA, 22 bp, Homo sapiens
ccctgtccccctcccctcccag

SEQ ID NO: 3141513 - DNA, 17 bp, Homo sapiens
ccctgtccctcccacct

SEQ ID NO: 3141514 - DNA, 20 bp, Homo sapiens
ccctgtccctcccacctctg

SEQ ID NO: 3141515 - DNA, 14 bp, Homo sapiens
ccctgtcctcactg

SEQ ID NO: 3141516 - DNA, 16 bp, Homo sapiens
ccctgtcctcactgct

SEQ ID NO: 3141517 - DNA, 23 bp, Homo sapiens
ccctgtcctgatggtcagctccc

SEQ ID NO: 3141518 - DNA, 15 bp, Homo sapiens
ccctgtcgagacact

SEQ ID NO: 3141519 - DNA, 21 bp, Homo sapiens
ccctgtcgagttcggctctgg

SEQ ID NO: 3141520 - DNA, 23 bp, Homo sapiens
ccctgtcgagttcggctctgggt

SEQ ID NO: 3141521 - DNA, 23 bp, Homo sapiens
ccctgtctctactaaaaatgcaa

SEQ ID NO: 3141522 - DNA, 16 bp, Homo sapiens
ccctgtctctgcatct

SEQ ID NO: 3141523 - DNA, 17 bp, Homo sapiens
ccctgtctctgcatctg

SEQ ID NO: 3141524 - DNA, 19 bp, Homo sapiens
ccctgtcttcacctgccac

SEQ ID NO: 3141525 - DNA, 21 bp, Homo sapiens
ccctgtcttcacctgccacca

SEQ ID NO: 3141526 - DNA, 20 bp, Homo sapiens
ccctgtcttctgggcacagt

SEQ ID NO: 3141527 - DNA, 16 bp, Homo sapiens
ccctgtcttgctgtca

SEQ ID NO: 3141528 - DNA, 17 bp, Homo sapiens
ccctgtgacatggtgcc

SEQ ID NO: 3141529 - DNA, 19 bp, Homo sapiens
ccctgtgacatggtgcctg

SEQ ID NO: 3141530 - DNA, 20 bp, Homo sapiens
ccctgtgacatggtgcctga

SEQ ID NO: 3141531 - DNA, 22 bp, Homo sapiens
ccctgtgctccgtgcctccacc

SEQ ID NO: 3141532 - DNA, 12 bp, Homo sapiens
ccctgtgctggt

SEQ ID NO: 3141533 - DNA, 13 bp, Homo sapiens
ccctgtgctggtg

SEQ ID NO: 3141534 - DNA, 15 bp, Homo sapiens
ccctgtgctggtgtc

SEQ ID NO: 3141535 - DNA, 14 bp, Homo sapiens
ccctgtggccaact

SEQ ID NO: 3141536 - DNA, 14 bp, Homo sapiens
ccctgtggccgcca

SEQ ID NO: 3141537 - DNA, 12 bp, Homo sapiens
ccctgtggggat

SEQ ID NO: 3141538 - DNA, 12 bp, Homo sapiens
ccctgtgggggt

SEQ ID NO: 3141539 - DNA, 18 bp, Homo sapiens
ccctgtgggggtggccat

SEQ ID NO: 3141540 - DNA, 23 bp, Homo sapiens
ccctgtgggggtggccatccctg

SEQ ID NO: 3141541 - DNA, 19 bp, Homo sapiens
ccctgtgtccacctgtggg

SEQ ID NO: 3141542 - DNA, 21 bp, Homo sapiens
ccctgtgtccacctgtgggtg

SEQ ID NO: 3141543 - DNA, 20 bp, Homo sapiens
ccctgtgtgtaggctggggc

SEQ ID NO: 3141544 - DNA, 15 bp, Homo sapiens
ccctgtgttgtctct

SEQ ID NO: 3141545 - DNA, 14 bp, Homo sapiens
ccctgttcactcta

SEQ ID NO: 3141546 - DNA, 20 bp, Homo sapiens
ccctgttcatgtgcctctgc

SEQ ID NO: 3141547 - DNA, 12 bp, Homo sapiens
ccctgttctctt

SEQ ID NO: 3141548 - DNA, 14 bp, Homo sapiens
ccctgttctcttca

SEQ ID NO: 3141549 - DNA, 20 bp, Homo sapiens
ccctgttcttcctccagctg

SEQ ID NO: 3141550 - DNA, 20 bp, Homo sapiens
ccctgttgacgaagtctctt

SEQ ID NO: 3141551 - DNA, 14 bp, Homo sapiens
ccctgttttctgag

SEQ ID NO: 3141552 - DNA, 15 bp, Homo sapiens
ccctgttttctgagc

SEQ ID NO: 3141553 - DNA, 17 bp, Homo sapiens
ccctgttttctgagccc

SEQ ID NO: 3141554 - DNA, 15 bp, Homo sapiens
ccctgttttctgttt

SEQ ID NO: 3141555 - DNA, 17 bp, Homo sapiens
cccttaacccaaggagc

SEQ ID NO: 3141556 - DNA, 20 bp, Homo sapiens
cccttaacccaaggagcaca

SEQ ID NO: 3141557 - DNA, 14 bp, Homo sapiens
cccttaactgacat

SEQ ID NO: 3141558 - DNA, 22 bp, Homo sapiens
cccttaccccttagcctccctg

SEQ ID NO: 3141559 - DNA, 21 bp, Homo sapiens
cccttactggcttacctcctc

SEQ ID NO: 3141560 - DNA, 14 bp, Homo sapiens
cccttacttagcat

SEQ ID NO: 3141561 - DNA, 20 bp, Homo sapiens
cccttacttgcttctctagc

SEQ ID NO: 3141562 - DNA, 23 bp, Homo sapiens
cccttagcagggaaacagctaat

SEQ ID NO: 3141563 - DNA, 15 bp, Homo sapiens
cccttaggccccgtg

SEQ ID NO: 3141564 - DNA, 16 bp, Homo sapiens
cccttaggccccgtgg

SEQ ID NO: 3141565 - DNA, 17 bp, Homo sapiens
cccttattagttacaaa

SEQ ID NO: 3141566 - DNA, 19 bp, Homo sapiens
cccttattgctgtcctgga

SEQ ID NO: 3141567 - DNA, 14 bp, Homo sapiens
cccttcaaccattc

SEQ ID NO: 3141568 - DNA, 20 bp, Homo sapiens
cccttcaagacgaggggcag

SEQ ID NO: 3141569 - DNA, 22 bp, Homo sapiens
cccttcacaccccaggcccttc

SEQ ID NO: 3141570 - DNA, 16 bp, Homo sapiens
cccttcacagtcccag

SEQ ID NO: 3141571 - DNA, 16 bp, Homo sapiens
cccttcacagtgtttc

SEQ ID NO: 3141572 - DNA, 15 bp, Homo sapiens
cccttcagaccccag

SEQ ID NO: 3141573 - DNA, 20 bp, Homo sapiens
cccttcagcccccagcccct

SEQ ID NO: 3141574 - DNA, 23 bp, Homo sapiens
cccttcaggaagcaggtgtcctt

SEQ ID NO: 3141575 - DNA, 11 bp, Homo sapiens
cccttcatttg

SEQ ID NO: 3141576 - DNA, 15 bp, Homo sapiens
cccttccaaataata

SEQ ID NO: 3141577 - DNA, 12 bp, Homo sapiens
cccttccagaca

SEQ ID NO: 3141578 - DNA, 13 bp, Homo sapiens
cccttccagacat

SEQ ID NO: 3141579 - DNA, 13 bp, Homo sapiens
cccttccagatca

SEQ ID NO: 3141580 - DNA, 14 bp, Homo sapiens
cccttccccaggcc

SEQ ID NO: 3141581 - DNA, 16 bp, Homo sapiens
cccttcccccagccca

SEQ ID NO: 3141582 - DNA, 21 bp, Homo sapiens
cccttcccccagcccatccat

SEQ ID NO: 3141583 - DNA, 23 bp, Homo sapiens
cccttccccgctcttgccctgcc

SEQ ID NO: 3141584 - DNA, 12 bp, Homo sapiens
cccttcccctcc

SEQ ID NO: 3141585 - DNA, 22 bp, Homo sapiens
cccttcccctccctggctccca

SEQ ID NO: 3141586 - DNA, 13 bp, Homo sapiens
cccttccctgcac

SEQ ID NO: 3141587 - DNA, 13 bp, Homo sapiens
cccttcccttccc

SEQ ID NO: 3141588 - DNA, 15 bp, Homo sapiens
cccttccgaccctct

SEQ ID NO: 3141589 - DNA, 16 bp, Homo sapiens
cccttccgaccctctg

SEQ ID NO: 3141590 - DNA, 20 bp, Homo sapiens
cccttccgaccctctgggaa

SEQ ID NO: 3141591 - DNA, 13 bp, Homo sapiens
cccttcctagtga

SEQ ID NO: 3141592 - DNA, 18 bp, Homo sapiens
cccttcctctcactcctg

SEQ ID NO: 3141593 - DNA, 20 bp, Homo sapiens
cccttcctctcactcctgcc

SEQ ID NO: 3141594 - DNA, 14 bp, Homo sapiens
cccttcctggcctc

SEQ ID NO: 3141595 - DNA, 15 bp, Homo sapiens
cccttcctggcctca

SEQ ID NO: 3141596 - DNA, 14 bp, Homo sapiens
cccttcctgggtat

SEQ ID NO: 3141597 - DNA, 19 bp, Homo sapiens
cccttcctttggtgcctca

SEQ ID NO: 3141598 - DNA, 21 bp, Homo sapiens
cccttccttttccctgcttcc

SEQ ID NO: 3141599 - DNA, 22 bp, Homo sapiens
cccttccttttccctgcttcca

SEQ ID NO: 3141600 - DNA, 16 bp, Homo sapiens
cccttcgctcctgtgt

SEQ ID NO: 3141601 - DNA, 18 bp, Homo sapiens
cccttcgctcctgtgtct

SEQ ID NO: 3141602 - DNA, 13 bp, Homo sapiens
cccttctctgctc

SEQ ID NO: 3141603 - DNA, 12 bp, Homo sapiens
cccttctgcctt

SEQ ID NO: 3141604 - DNA, 21 bp, Homo sapiens
cccttctgggcatctgttctg

SEQ ID NO: 3141605 - DNA, 22 bp, Homo sapiens
cccttctgggcatctgttctgg

SEQ ID NO: 3141606 - DNA, 12 bp, Homo sapiens
cccttctgtgtc

SEQ ID NO: 3141607 - DNA, 18 bp, Homo sapiens
cccttgaaactttgggaa

SEQ ID NO: 3141608 - DNA, 15 bp, Homo sapiens
cccttgacacctgct

SEQ ID NO: 3141609 - DNA, 14 bp, Homo sapiens
cccttgagaaacct

SEQ ID NO: 3141610 - DNA, 20 bp, Homo sapiens
cccttgatttaaacacacag

SEQ ID NO: 3141611 - DNA, 15 bp, Homo sapiens
cccttgcacgtaaac

SEQ ID NO: 3141612 - DNA, 16 bp, Homo sapiens
cccttgcagctagttt

SEQ ID NO: 3141613 - DNA, 23 bp, Homo sapiens
cccttgcagttcagcaccaccct

SEQ ID NO: 3141614 - DNA, 16 bp, Homo sapiens
cccttgccctagatag

SEQ ID NO: 3141615 - DNA, 16 bp, Homo sapiens
cccttgccctgacctc

SEQ ID NO: 3141616 - DNA, 12 bp, Homo sapiens
cccttgcctccc

SEQ ID NO: 3141617 - DNA, 12 bp, Homo sapiens
cccttgctgctt

SEQ ID NO: 3141618 - DNA, 13 bp, Homo sapiens
cccttgctggccc

SEQ ID NO: 3141619 - DNA, 15 bp, Homo sapiens
cccttgctggcccca

SEQ ID NO: 3141620 - DNA, 20 bp, Homo sapiens
cccttgctggccccagccct

SEQ ID NO: 3141621 - DNA, 24 bp, Homo sapiens
cccttgctggccccagccctgctg

SEQ ID NO: 3141622 - DNA, 20 bp, Homo sapiens
cccttgctttcctgggcctt

SEQ ID NO: 3141623 - DNA, 22 bp, Homo sapiens
cccttggacaagacaaaccaag

SEQ ID NO: 3141624 - DNA, 17 bp, Homo sapiens
cccttggaggagagaga

SEQ ID NO: 3141625 - DNA, 22 bp, Homo sapiens
cccttggaggagagagaccccg

SEQ ID NO: 3141626 - DNA, 20 bp, Homo sapiens
cccttggcaggtcctggcca

SEQ ID NO: 3141627 - DNA, 12 bp, Homo sapiens
cccttggcccct

SEQ ID NO: 3141628 - DNA, 12 bp, Homo sapiens
cccttggcctca

SEQ ID NO: 3141629 - DNA, 22 bp, Homo sapiens
cccttggctgtgaggcccctgg

SEQ ID NO: 3141630 - DNA, 18 bp, Homo sapiens
cccttggcttcctccgtc

SEQ ID NO: 3141631 - DNA, 22 bp, Homo sapiens
cccttgggacagccagagctgg

SEQ ID NO: 3141632 - DNA, 21 bp, Homo sapiens
cccttgggcctgggcctctgc

SEQ ID NO: 3141633 - DNA, 22 bp, Homo sapiens
cccttggggtaagccagagcct

SEQ ID NO: 3141634 - DNA, 17 bp, Homo sapiens
cccttgtacagtgtctg

SEQ ID NO: 3141635 - DNA, 17 bp, Homo sapiens
cccttgtcctgccagct

SEQ ID NO: 3141636 - DNA, 19 bp, Homo sapiens
cccttgtcctgccagctgc

SEQ ID NO: 3141637 - DNA, 13 bp, Homo sapiens
cccttgtctgaga

SEQ ID NO: 3141638 - DNA, 14 bp, Homo sapiens
cccttgtctgagat

SEQ ID NO: 3141639 - DNA, 23 bp, Homo sapiens
cccttgtctgagatgctggtaat

SEQ ID NO: 3141640 - DNA, 12 bp, Homo sapiens
cccttgtgtgtg

SEQ ID NO: 3141641 - DNA, 18 bp, Homo sapiens
ccctttacaatgtgaata

SEQ ID NO: 3141642 - DNA, 17 bp, Homo sapiens
ccctttcagatgtcttc

SEQ ID NO: 3141643 - DNA, 13 bp, Homo sapiens
ccctttccccttc

SEQ ID NO: 3141644 - DNA, 20 bp, Homo sapiens
ccctttcctaggcccaggcc

SEQ ID NO: 3141645 - DNA, 14 bp, Homo sapiens
ccctttcctcctca

SEQ ID NO: 3141646 - DNA, 14 bp, Homo sapiens
ccctttccttccta

SEQ ID NO: 3141647 - DNA, 18 bp, Homo sapiens
ccctttctctctcctctc

SEQ ID NO: 3141648 - DNA, 14 bp, Homo sapiens
ccctttcttggcca

SEQ ID NO: 3141649 - DNA, 15 bp, Homo sapiens
ccctttcttggccag

SEQ ID NO: 3141650 - DNA, 23 bp, Homo sapiens
ccctttgaagataataatcttgg

SEQ ID NO: 3141651 - DNA, 21 bp, Homo sapiens
ccctttgaagcctcagctacc

SEQ ID NO: 3141652 - DNA, 20 bp, Homo sapiens
ccctttgacttcagctgcct

SEQ ID NO: 3141653 - DNA, 21 bp, Homo sapiens
ccctttgcatagctctccttc

SEQ ID NO: 3141654 - DNA, 22 bp, Homo sapiens
ccctttgcatagctctccttcc

SEQ ID NO: 3141655 - DNA, 22 bp, Homo sapiens
ccctttgcctttcttctgccct

SEQ ID NO: 3141656 - DNA, 14 bp, Homo sapiens
ccctttgctgctga

SEQ ID NO: 3141657 - DNA, 23 bp, Homo sapiens
ccctttgctgtgaggctgtcctg

SEQ ID NO: 3141658 - DNA, 23 bp, Homo sapiens
ccctttggagatgctgagggtgt

SEQ ID NO: 3141659 - DNA, 15 bp, Homo sapiens
ccctttgtgctgtgg

SEQ ID NO: 3141660 - DNA, 16 bp, Homo sapiens
cccttttcagctgagc

SEQ ID NO: 3141661 - DNA, 20 bp, Homo sapiens
cccttttcagctgagccctg

SEQ ID NO: 3141662 - DNA, 18 bp, Homo sapiens
cccttttcctgtcagtgt

SEQ ID NO: 3141663 - DNA, 19 bp, Homo sapiens
cccttttcctgtcagtgtt

SEQ ID NO: 3141664 - DNA, 13 bp, Homo sapiens
cccttttctgttc

SEQ ID NO: 3141665 - DNA, 14 bp, Homo sapiens
cccttttgcctggc

SEQ ID NO: 3141666 - DNA, 19 bp, Homo sapiens
cccttttgcctggctgtgg

SEQ ID NO: 3141667 - DNA, 19 bp, Homo sapiens
ccgaaagggacttggaagc

SEQ ID NO: 3141668 - DNA, 21 bp, Homo sapiens
ccgaactgtgccttcgcttgg

SEQ ID NO: 3141669 - DNA, 16 bp, Homo sapiens
ccgaagctctggctga

SEQ ID NO: 3141670 - DNA, 23 bp, Homo sapiens
ccgaaggtgctggaggtgggagc

SEQ ID NO: 3141671 - DNA, 21 bp, Homo sapiens
ccgaaggttatggtcaatccc

SEQ ID NO: 3141672 - DNA, 13 bp, Homo sapiens
ccgaagtcttttg

SEQ ID NO: 3141673 - DNA, 17 bp, Homo sapiens
ccgaatagctgggacta

SEQ ID NO: 3141674 - DNA, 15 bp, Homo sapiens
ccgaatcccccaggg

SEQ ID NO: 3141675 - DNA, 16 bp, Homo sapiens
ccgaatcccccaggga

SEQ ID NO: 3141676 - DNA, 20 bp, Homo sapiens
ccgaatgtgcaggtttgtta

SEQ ID NO: 3141677 - DNA, 18 bp, Homo sapiens
ccgacactgctgcaccag

SEQ ID NO: 3141678 - DNA, 18 bp, Homo sapiens
ccgacagccccctctgcc

SEQ ID NO: 3141679 - DNA, 14 bp, Homo sapiens
ccgacagcctggca

SEQ ID NO: 3141680 - DNA, 15 bp, Homo sapiens
ccgacagctcttact

SEQ ID NO: 3141681 - DNA, 17 bp, Homo sapiens
ccgaccagacaccttga

SEQ ID NO: 3141682 - DNA, 13 bp, Homo sapiens
ccgaccagagccc

SEQ ID NO: 3141683 - DNA, 16 bp, Homo sapiens
ccgactctaagctgtg

SEQ ID NO: 3141684 - DNA, 22 bp, Homo sapiens
ccgactctaagctgtgtgcagg

SEQ ID NO: 3141685 - DNA, 13 bp, Homo sapiens
ccgactctgcact

SEQ ID NO: 3141686 - DNA, 14 bp, Homo sapiens
ccgactctgcactc

SEQ ID NO: 3141687 - DNA, 13 bp, Homo sapiens
ccgactctggccc

SEQ ID NO: 3141688 - DNA, 23 bp, Homo sapiens
ccgactgcacagcggcccctgca

SEQ ID NO: 3141689 - DNA, 13 bp, Homo sapiens
ccgactgcccctg

SEQ ID NO: 3141690 - DNA, 14 bp, Homo sapiens
ccgactgcgctgct

SEQ ID NO: 3141691 - DNA, 22 bp, Homo sapiens
ccgactgcgctgctttttcaaa

SEQ ID NO: 3141692 - DNA, 23 bp, Homo sapiens
ccgactgcgctgctttttcaaaa

SEQ ID NO: 3141693 - DNA, 19 bp, Homo sapiens
ccgacttggagactcctgg

SEQ ID NO: 3141694 - DNA, 24 bp, Homo sapiens
ccgacttggagactcctggtctgt

SEQ ID NO: 3141695 - DNA, 13 bp, Homo sapiens
ccgagaagaacag

SEQ ID NO: 3141696 - DNA, 21 bp, Homo sapiens
ccgagacctcaagccctgagg

SEQ ID NO: 3141697 - DNA, 13 bp, Homo sapiens
ccgagagggagag

SEQ ID NO: 3141698 - DNA, 15 bp, Homo sapiens
ccgagaggtgggcca

SEQ ID NO: 3141699 - DNA, 19 bp, Homo sapiens
ccgagaggtgggccagtct

SEQ ID NO: 3141700 - DNA, 21 bp, Homo sapiens
ccgagaggtgggccagtctgt

SEQ ID NO: 3141701 - DNA, 18 bp, Homo sapiens
ccgagatcacgccactgc

SEQ ID NO: 3141702 - DNA, 21 bp, Homo sapiens
ccgagatcacgccactgcact

SEQ ID NO: 3141703 - DNA, 22 bp, Homo sapiens
ccgagcaatatttatggatgca

SEQ ID NO: 3141704 - DNA, 16 bp, Homo sapiens
ccgagccgggcctggg

SEQ ID NO: 3141705 - DNA, 19 bp, Homo sapiens
ccgagccgggcctggggct

SEQ ID NO: 3141706 - DNA, 19 bp, Homo sapiens
ccgagcgttcccagcaggg

SEQ ID NO: 3141707 - DNA, 17 bp, Homo sapiens
ccgagctccagagcaac

SEQ ID NO: 3141708 - DNA, 18 bp, Homo sapiens
ccgagctcttggcctttg

SEQ ID NO: 3141709 - DNA, 23 bp, Homo sapiens
ccgagctcttggcctttgcattt

SEQ ID NO: 3141710 - DNA, 13 bp, Homo sapiens
ccgagctgtcccc

SEQ ID NO: 3141711 - DNA, 16 bp, Homo sapiens
ccgaggagccaggcaa

SEQ ID NO: 3141712 - DNA, 18 bp, Homo sapiens
ccgaggagctgggcccct

SEQ ID NO: 3141713 - DNA, 23 bp, Homo sapiens
ccgaggagctgggcccctgcaca

SEQ ID NO: 3141714 - DNA, 19 bp, Homo sapiens
ccgaggcccagcgggcaga

SEQ ID NO: 3141715 - DNA, 22 bp, Homo sapiens
ccgaggcctaccccgcagacac

SEQ ID NO: 3141716 - DNA, 20 bp, Homo sapiens
ccgaggcgggtggatcacga

SEQ ID NO: 3141717 - DNA, 14 bp, Homo sapiens
ccgaggctgctaga

SEQ ID NO: 3141718 - DNA, 18 bp, Homo sapiens
ccgaggggggccccggga

SEQ ID NO: 3141719 - DNA, 19 bp, Homo sapiens
ccgagggtcctggctcctg

SEQ ID NO: 3141720 - DNA, 23 bp, Homo sapiens
ccgagggtcctggctcctgaggg

SEQ ID NO: 3141721 - DNA, 17 bp, Homo sapiens
ccgaggtggttttaaag

SEQ ID NO: 3141722 - DNA, 14 bp, Homo sapiens
ccgagtacagtctg

SEQ ID NO: 3141723 - DNA, 17 bp, Homo sapiens
ccgagtagctgggacta

SEQ ID NO: 3141724 - DNA, 14 bp, Homo sapiens
ccgagtctgggaca

SEQ ID NO: 3141725 - DNA, 22 bp, Homo sapiens
ccgagtctgggacacaaaactc

SEQ ID NO: 3141726 - DNA, 14 bp, Homo sapiens
ccgagtgatttcca

SEQ ID NO: 3141727 - DNA, 23 bp, Homo sapiens
ccgagtgcggcgtggagactggc

SEQ ID NO: 3141728 - DNA, 18 bp, Homo sapiens
ccgatagggtatttgacc

SEQ ID NO: 3141729 - DNA, 22 bp, Homo sapiens
ccgatgctgctttcccctgtgg

SEQ ID NO: 3141730 - DNA, 17 bp, Homo sapiens
ccgatggagcccccaga

SEQ ID NO: 3141731 - DNA, 15 bp, Homo sapiens
ccgcaactctccagc

SEQ ID NO: 3141732 - DNA, 16 bp, Homo sapiens
ccgcaactctccagcc

SEQ ID NO: 3141733 - DNA, 15 bp, Homo sapiens
ccgcacagcagcctg

SEQ ID NO: 3141734 - DNA, 21 bp, Homo sapiens
ccgcacagcagcctgcttccc

SEQ ID NO: 3141735 - DNA, 14 bp, Homo sapiens
ccgcacagccaccc

SEQ ID NO: 3141736 - DNA, 13 bp, Homo sapiens
ccgcacagctcag

SEQ ID NO: 3141737 - DNA, 15 bp, Homo sapiens
ccgcaccagctgctc

SEQ ID NO: 3141738 - DNA, 16 bp, Homo sapiens
ccgcaccagctgctct

SEQ ID NO: 3141739 - DNA, 18 bp, Homo sapiens
ccgcaccccggcctcagg

SEQ ID NO: 3141740 - DNA, 13 bp, Homo sapiens
ccgcacccggctc

SEQ ID NO: 3141741 - DNA, 21 bp, Homo sapiens
ccgcaccctgcacctgctgcg

SEQ ID NO: 3141742 - DNA, 17 bp, Homo sapiens
ccgcactttccacttct

SEQ ID NO: 3141743 - DNA, 14 bp, Homo sapiens
ccgcagacaccttg

SEQ ID NO: 3141744 - DNA, 16 bp, Homo sapiens
ccgcagacaccttgga

SEQ ID NO: 3141745 - DNA, 15 bp, Homo sapiens
ccgcagacctcccca

SEQ ID NO: 3141746 - DNA, 14 bp, Homo sapiens
ccgttagctcctgt

SEQ ID NO: 3141747 - DNA, 18 bp, Homo sapiens
ccgttagctcctgtggcc

SEQ ID NO: 3141748 - DNA, 20 bp, Homo sapiens
ccgttattataattgtatca

SEQ ID NO: 3141749 - DNA, 22 bp, Homo sapiens
ccgttccaccccaagagaactc

SEQ ID NO: 3141750 - DNA, 19 bp, Homo sapiens
ccgttcctgacatcacagc

SEQ ID NO: 3141751 - DNA, 23 bp, Homo sapiens
ccgttcctgacatcacagcagcc

SEQ ID NO: 3141752 - DNA, 15 bp, Homo sapiens
ccgttctgctggcct

SEQ ID NO: 3141753 - DNA, 20 bp, Homo sapiens
ccgttctgttctgctgggag

SEQ ID NO: 3141754 - DNA, 17 bp, Homo sapiens
ccgtttacctagaagaa

SEQ ID NO: 3141755 - DNA, 15 bp, Homo sapiens
ccgtttatgggcctt

SEQ ID NO: 3141756 - DNA, 16 bp, Homo sapiens
ccgtttatgggccttg

SEQ ID NO: 3141757 - DNA, 19 bp, Homo sapiens
ccgtttatgggccttgctt

SEQ ID NO: 3141758 - DNA, 23 bp, Homo sapiens
ccgtttcatttagtcatgtgacc

SEQ ID NO: 3141759 - DNA, 13 bp, Homo sapiens
ccgtttgcttttg

SEQ ID NO: 3141760 - DNA, 19 bp, Homo sapiens
ccgttttgtcactttttct

SEQ ID NO: 3141761 - DNA, 12 bp, Homo sapiens
cctaaaacaaat

SEQ ID NO: 3141762 - DNA, 20 bp, Homo sapiens
cctaaaactggcctgacttg

SEQ ID NO: 3141763 - DNA, 18 bp, Homo sapiens
cctaaaataattggttct

SEQ ID NO: 3141764 - DNA, 15 bp, Homo sapiens
cctaaaattcagtgg

SEQ ID NO: 3141765 - DNA, 23 bp, Homo sapiens
cctaaacagatataaatggctgg

SEQ ID NO: 3141766 - DNA, 16 bp, Homo sapiens
cctaaacataattgtg

SEQ ID NO: 3141767 - DNA, 14 bp, Homo sapiens
cctaaagggcaggg

SEQ ID NO: 3141768 - DNA, 18 bp, Homo sapiens
cctaaagggcagggccca

SEQ ID NO: 3141769 - DNA, 14 bp, Homo sapiens
cctaaatatccaaa

SEQ ID NO: 3141770 - DNA, 14 bp, Homo sapiens
cctaaatatttatc

SEQ ID NO: 3141771 - DNA, 13 bp, Homo sapiens
cctaaatttaatg

SEQ ID NO: 3141772 - DNA, 16 bp, Homo sapiens
cctaaatttaatgctg

SEQ ID NO: 3141773 - DNA, 19 bp, Homo sapiens
cctaaatttaatgctgcct

SEQ ID NO: 3141774 - DNA, 23 bp, Homo sapiens
cctaacatggtttaaaagaaaaa

SEQ ID NO: 3141775 - DNA, 17 bp, Homo sapiens
cctaacattcgatctca

SEQ ID NO: 3141776 - DNA, 12 bp, Homo sapiens
cctaaccaggcc

SEQ ID NO: 3141777 - DNA, 13 bp, Homo sapiens
cctaaccaggccc

SEQ ID NO: 3141778 - DNA, 14 bp, Homo sapiens
cctaaccaggccca

SEQ ID NO: 3141779 - DNA, 16 bp, Homo sapiens
cctaaccccttccaga

SEQ ID NO: 3141780 - DNA, 20 bp, Homo sapiens
cctaactcttttctattttg

SEQ ID NO: 3141781 - DNA, 14 bp, Homo sapiens
cctaacttttcaat

SEQ ID NO: 3141782 - DNA, 17 bp, Homo sapiens
cctaagaatctttagag

SEQ ID NO: 3141783 - DNA, 17 bp, Homo sapiens
cctaagagatttatctt

SEQ ID NO: 3141784 - DNA, 13 bp, Homo sapiens
cctaaggaacctt

SEQ ID NO: 3141785 - DNA, 15 bp, Homo sapiens
cctaagggagtgttt

SEQ ID NO: 3141786 - DNA, 18 bp, Homo sapiens
cctaagggatcctgcctg

SEQ ID NO: 3141787 - DNA, 20 bp, Homo sapiens
cctaatctatggtcgggaga

SEQ ID NO: 3141788 - DNA, 19 bp, Homo sapiens
cctaatgtctcactgttct

SEQ ID NO: 3141789 - DNA, 19 bp, Homo sapiens
cctaatgtttatgagccag

SEQ ID NO: 3141790 - DNA, 21 bp, Homo sapiens
cctaattcttttatctttatt

SEQ ID NO: 3141791 - DNA, 19 bp, Homo sapiens
cctaattggaaagtgccag

SEQ ID NO: 3141792 - DNA, 13 bp, Homo sapiens
cctaattgtggat

SEQ ID NO: 3141793 - DNA, 15 bp, Homo sapiens
cctaatttctcctcc

SEQ ID NO: 3141794 - DNA, 16 bp, Homo sapiens
cctaatttctcctccc

SEQ ID NO: 3141795 - DNA, 17 bp, Homo sapiens
cctaatttctcctccct

SEQ ID NO: 3141796 - DNA, 18 bp, Homo sapiens
cctaatttctcctccctt

SEQ ID NO: 3141797 - DNA, 17 bp, Homo sapiens
cctacaaccatccctgc

SEQ ID NO: 3141798 - DNA, 19 bp, Homo sapiens
cctacaaccatccctgcca

SEQ ID NO: 3141799 - DNA, 14 bp, Homo sapiens
cctacaagatttcc

SEQ ID NO: 3141800 - DNA, 16 bp, Homo sapiens
cctacaagatttcctt

SEQ ID NO: 3141801 - DNA, 14 bp, Homo sapiens
cctacaatatttta

SEQ ID NO: 3141802 - DNA, 18 bp, Homo sapiens
cctacaatattttattct

SEQ ID NO: 3141803 - DNA, 15 bp, Homo sapiens
cctacacactgtcat

SEQ ID NO: 3141804 - DNA, 18 bp, Homo sapiens
cctacactcacctgcact

SEQ ID NO: 3141805 - DNA, 11 bp, Homo sapiens
cctacagaatt

SEQ ID NO: 3141806 - DNA, 15 bp, Homo sapiens
cctacagaggtctct

SEQ ID NO: 3141807 - DNA, 23 bp, Homo sapiens
cctacagaggtctctgccggctc

SEQ ID NO: 3141808 - DNA, 14 bp, Homo sapiens
cctacagccccttt

SEQ ID NO: 3141809 - DNA, 15 bp, Homo sapiens
cctacagttttaact

SEQ ID NO: 3141810 - DNA, 17 bp, Homo sapiens
cctacagttttaactgt

SEQ ID NO: 3141811 - DNA, 21 bp, Homo sapiens
cctacagttttaactgtggat

SEQ ID NO: 3141812 - DNA, 19 bp, Homo sapiens
cctacatgaaacagaaaca

SEQ ID NO: 3141813 - DNA, 23 bp, Homo sapiens
cctaccaatctctgctctctatg

SEQ ID NO: 3141814 - DNA, 14 bp, Homo sapiens
cctaccacagtgtc

SEQ ID NO: 3141815 - DNA, 18 bp, Homo sapiens
cctaccaggacagaactt

SEQ ID NO: 3141816 - DNA, 14 bp, Homo sapiens
cctaccatgctgct

SEQ ID NO: 3141817 - DNA, 18 bp, Homo sapiens
cctacccaccctcctttc

SEQ ID NO: 3141818 - DNA, 18 bp, Homo sapiens
cctacccaccgatggagc

SEQ ID NO: 3141819 - DNA, 22 bp, Homo sapiens
cctacccagagattgcttctca

SEQ ID NO: 3141820 - DNA, 20 bp, Homo sapiens
cctaccccgcagacaccttg

SEQ ID NO: 3141821 - DNA, 21 bp, Homo sapiens
cctaccccgcagacaccttgg

SEQ ID NO: 3141822 - DNA, 15 bp, Homo sapiens
cctaccctccttcca

SEQ ID NO: 3141823 - DNA, 19 bp, Homo sapiens
cctaccctcgggcccacct

SEQ ID NO: 3141824 - DNA, 16 bp, Homo sapiens
cctacccttcctgcat

SEQ ID NO: 3141825 - DNA, 17 bp, Homo sapiens
cctaccgagtctcttct

SEQ ID NO: 3141826 - DNA, 12 bp, Homo sapiens
cctacctcagcc

SEQ ID NO: 3141827 - DNA, 18 bp, Homo sapiens
cctacctcagcctagacc

SEQ ID NO: 3141828 - DNA, 15 bp, Homo sapiens
cctacctcaggcagg

SEQ ID NO: 3141829 - DNA, 14 bp, Homo sapiens
cctacctcaggttg

SEQ ID NO: 3141830 - DNA, 22 bp, Homo sapiens
cctacctcaggttgctggttgc

SEQ ID NO: 3141831 - DNA, 21 bp, Homo sapiens
cctacctgattggtgcaaccc

SEQ ID NO: 3141832 - DNA, 15 bp, Homo sapiens
cctacctgtgcctga

SEQ ID NO: 3141833 - DNA, 16 bp, Homo sapiens
cctacctgtgcctgac

SEQ ID NO: 3141834 - DNA, 20 bp, Homo sapiens
cctaccttttgtctcttggt

SEQ ID NO: 3141835 - DNA, 16 bp, Homo sapiens
cctactccaaaatgtt

SEQ ID NO: 3141836 - DNA, 15 bp, Homo sapiens
cctactccactgccc

SEQ ID NO: 3141837 - DNA, 18 bp, Homo sapiens
cctactccactgccctgg

SEQ ID NO: 3141838 - DNA, 12 bp, Homo sapiens
cctactccctct

SEQ ID NO: 3141839 - DNA, 20 bp, Homo sapiens
cctactccctcttcactgtg

SEQ ID NO: 3141840 - DNA, 16 bp, Homo sapiens
cctactccctcttcca

SEQ ID NO: 3141841 - DNA, 15 bp, Homo sapiens
cctactccctgcaga

SEQ ID NO: 3141842 - DNA, 22 bp, Homo sapiens
cctactcggatggggcacggac

SEQ ID NO: 3141843 - DNA, 21 bp, Homo sapiens
cctactctccttgagtgtatg

SEQ ID NO: 3141844 - DNA, 23 bp, Homo sapiens
cctactgccacccgcttcctgtt

SEQ ID NO: 3141845 - DNA, 14 bp, Homo sapiens
cctactgttccttt

SEQ ID NO: 3141846 - DNA, 12 bp, Homo sapiens
cctacttctgac

SEQ ID NO: 3141847 - DNA, 16 bp, Homo sapiens
cctacttcttttgctc

SEQ ID NO: 3141848 - DNA, 19 bp, Homo sapiens
cctacttgtgactgaaggg

SEQ ID NO: 3141849 - DNA, 14 bp, Homo sapiens
cctactttgacttt

SEQ ID NO: 3141850 - DNA, 17 bp, Homo sapiens
cctactttgcttccgcc

SEQ ID NO: 3141851 - DNA, 15 bp, Homo sapiens
cctagaaagttctgt

SEQ ID NO: 3141852 - DNA, 15 bp, Homo sapiens
cctagaactgtgcct

SEQ ID NO: 3141853 - DNA, 12 bp, Homo sapiens
cctagaagaagc

SEQ ID NO: 3141854 - DNA, 16 bp, Homo sapiens
cctagaccctcctcct

SEQ ID NO: 3141855 - DNA, 15 bp, Homo sapiens
cctagactgttactt

SEQ ID NO: 3141856 - DNA, 21 bp, Homo sapiens
cctagacttcccaacagcctt

SEQ ID NO: 3141857 - DNA, 14 bp, Homo sapiens
cctagagccagacc

SEQ ID NO: 3141858 - DNA, 14 bp, Homo sapiens
cctagagcgcggct

SEQ ID NO: 3141859 - DNA, 22 bp, Homo sapiens
cctagagcgcggctggctctgt

SEQ ID NO: 3141860 - DNA, 17 bp, Homo sapiens
cctagaggtgggcagct

SEQ ID NO: 3141861 - DNA, 20 bp, Homo sapiens
cctagaggtgggcagctggg

SEQ ID NO: 3141862 - DNA, 11 bp, Homo sapiens
cctagagtgta

SEQ ID NO: 3141863 - DNA, 17 bp, Homo sapiens
cctagataaaaagatgg

SEQ ID NO: 3141864 - DNA, 19 bp, Homo sapiens
cctagatccacacacagag

SEQ ID NO: 3141865 - DNA, 20 bp, Homo sapiens
cctagatccacacacagagg

SEQ ID NO: 3141866 - DNA, 11 bp, Homo sapiens
cctagattata

SEQ ID NO: 3141867 - DNA, 18 bp, Homo sapiens
cctagcaagctggcctct

SEQ ID NO: 3141868 - DNA, 13 bp, Homo sapiens
cctagcaattcca

SEQ ID NO: 3141869 - DNA, 17 bp, Homo sapiens
cctagcagacagaaact

SEQ ID NO: 3141870 - DNA, 19 bp, Homo sapiens
cctagcagacagaaactgg

SEQ ID NO: 3141871 - DNA, 13 bp, Homo sapiens
cctagcagcctca

SEQ ID NO: 3141872 - DNA, 15 bp, Homo sapiens
cctagccattcctgg

SEQ ID NO: 3141873 - DNA, 19 bp, Homo sapiens
cctcatggcccccaggggc

SEQ ID NO: 3141874 - DNA, 21 bp, Homo sapiens
cctcatggcccccaggggcag

SEQ ID NO: 3141875 - DNA, 19 bp, Homo sapiens
cctcatggtgcatataaat

SEQ ID NO: 3141876 - DNA, 14 bp, Homo sapiens
cctcatgtaacatt

SEQ ID NO: 3141877 - DNA, 16 bp, Homo sapiens
cctcatgtggctggaa

SEQ ID NO: 3141878 - DNA, 23 bp, Homo sapiens
cctcatgtggctggaagatcctg

SEQ ID NO: 3141879 - DNA, 17 bp, Homo sapiens
cctcatgtttatgaaaa

SEQ ID NO: 3141880 - DNA, 18 bp, Homo sapiens
cctcatgtttatgaaaat

SEQ ID NO: 3141881 - DNA, 13 bp, Homo sapiens
cctcattataaaa

SEQ ID NO: 3141882 - DNA, 16 bp, Homo sapiens
cctcattatcaaacag

SEQ ID NO: 3141883 - DNA, 13 bp, Homo sapiens
cctcattcctgaa

SEQ ID NO: 3141884 - DNA, 17 bp, Homo sapiens
cctcattctgaggcctg

SEQ ID NO: 3141885 - DNA, 16 bp, Homo sapiens
cctcattgcctcctgt

SEQ ID NO: 3141886 - DNA, 10 bp, Homo sapiens
cctcattttg

SEQ ID NO: 3141887 - DNA, 12 bp, Homo sapiens
cctcattttgaa

SEQ ID NO: 3141888 - DNA, 15 bp, Homo sapiens
cctcatttttcatac

SEQ ID NO: 3141889 - DNA, 10 bp, Homo sapiens
cctccaaaga

SEQ ID NO: 3141890 - DNA, 11 bp, Homo sapiens
cctccaaagag

SEQ ID NO: 3141891 - DNA, 20 bp, Homo sapiens
cctccaaccaaataagactt

SEQ ID NO: 3141892 - DNA, 17 bp, Homo sapiens
cctccaacgcccctgtg

SEQ ID NO: 3141893 - DNA, 23 bp, Homo sapiens
cctccaacgcccctgtggccaac

SEQ ID NO: 3141894 - DNA, 16 bp, Homo sapiens
cctccaagcctgcctc

SEQ ID NO: 3141895 - DNA, 23 bp, Homo sapiens
cctccaagggtttcgactggtcc

SEQ ID NO: 3141896 - DNA, 19 bp, Homo sapiens
cctccaagtctgtacctca

SEQ ID NO: 3141897 - DNA, 18 bp, Homo sapiens
cctccaataaagtgcctt

SEQ ID NO: 3141898 - DNA, 21 bp, Homo sapiens
cctccacacaagggaaggaca

SEQ ID NO: 3141899 - DNA, 18 bp, Homo sapiens
cctccacaccagtggcct

SEQ ID NO: 3141900 - DNA, 16 bp, Homo sapiens
cctccacagtgctgct

SEQ ID NO: 3141901 - DNA, 18 bp, Homo sapiens
cctccacagtgctgcttc

SEQ ID NO: 3141902 - DNA, 15 bp, Homo sapiens
cctccacatcccagc

SEQ ID NO: 3141903 - DNA, 13 bp, Homo sapiens
cctccacatcctg

SEQ ID NO: 3141904 - DNA, 15 bp, Homo sapiens
cctccaccaccactg

SEQ ID NO: 3141905 - DNA, 19 bp, Homo sapiens
cctccaccaccactggcca

SEQ ID NO: 3141906 - DNA, 21 bp, Homo sapiens
cctccaccaccactggccacc

SEQ ID NO: 3141907 - DNA, 16 bp, Homo sapiens
cctccaccaccctttc

SEQ ID NO: 3141908 - DNA, 12 bp, Homo sapiens
cctccacccagc

SEQ ID NO: 3141909 - DNA, 14 bp, Homo sapiens
cctccaccctgtcc

SEQ ID NO: 3141910 - DNA, 24 bp, Homo sapiens
cctccaccctgtcccccagctctg

SEQ ID NO: 3141911 - DNA, 19 bp, Homo sapiens
cctccacctaccactcaca

SEQ ID NO: 3141912 - DNA, 14 bp, Homo sapiens
cctccacctcttca

SEQ ID NO: 3141913 - DNA, 12 bp, Homo sapiens
cctccacctgtg

SEQ ID NO: 3141914 - DNA, 14 bp, Homo sapiens
cctccacctgtgag

SEQ ID NO: 3141915 - DNA, 16 bp, Homo sapiens
cctccacctgtgagat

SEQ ID NO: 3141916 - DNA, 14 bp, Homo sapiens
cctccacgcctcct

SEQ ID NO: 3141917 - DNA, 21 bp, Homo sapiens
cctccactcagctgtcctgca

SEQ ID NO: 3141918 - DNA, 23 bp, Homo sapiens
cctccacttcccgtctcagaatc

SEQ ID NO: 3141919 - DNA, 22 bp, Homo sapiens
cctccagaactcactggggcct

SEQ ID NO: 3141920 - DNA, 13 bp, Homo sapiens
cctccagaagcct

SEQ ID NO: 3141921 - DNA, 19 bp, Homo sapiens
cctccagaagcctctggct

SEQ ID NO: 3141922 - DNA, 22 bp, Homo sapiens
cctccagaagcctctggctaga

SEQ ID NO: 3141923 - DNA, 18 bp, Homo sapiens
cctccagagccagcctgg

SEQ ID NO: 3141924 - DNA, 23 bp, Homo sapiens
cctccagagccagcctgggactc

SEQ ID NO: 3141925 - DNA, 12 bp, Homo sapiens
cctccagcccgg

SEQ ID NO: 3141926 - DNA, 19 bp, Homo sapiens
cctccagcccgggagccta

SEQ ID NO: 3141927 - DNA, 23 bp, Homo sapiens
cctccagcccgggagcctaggac

SEQ ID NO: 3141928 - DNA, 13 bp, Homo sapiens
cctccagcctctc

SEQ ID NO: 3141929 - DNA, 15 bp, Homo sapiens
cctccagctgcacca

SEQ ID NO: 3141930 - DNA, 19 bp, Homo sapiens
cctccagctgcaccagagc

SEQ ID NO: 3141931 - DNA, 20 bp, Homo sapiens
cctccagctgcaccagagca

SEQ ID NO: 3141932 - DNA, 13 bp, Homo sapiens
cctccagctgctg

SEQ ID NO: 3141933 - DNA, 22 bp, Homo sapiens
cctccaggaatgatctcttctt

SEQ ID NO: 3141934 - DNA, 16 bp, Homo sapiens
cctccaggagagagcc

SEQ ID NO: 3141935 - DNA, 12 bp, Homo sapiens
cctccaggcctg

SEQ ID NO: 3141936 - DNA, 15 bp, Homo sapiens
cctccaggcctgcct

SEQ ID NO: 3141937 - DNA, 13 bp, Homo sapiens
cctccaggcctgt

SEQ ID NO: 3141938 - DNA, 16 bp, Homo sapiens
cctccagtgctggatt

SEQ ID NO: 3141939 - DNA, 20 bp, Homo sapiens
cctccagtgggctgatgctg

SEQ ID NO: 3141940 - DNA, 23 bp, Homo sapiens
cctccagtgggctgatgctggga

SEQ ID NO: 3141941 - DNA, 14 bp, Homo sapiens
cctccatccctggc

SEQ ID NO: 3141942 - DNA, 17 bp, Homo sapiens
cctccatccctggcccc

SEQ ID NO: 3141943 - DNA, 12 bp, Homo sapiens
cctccatcctga

SEQ ID NO: 3141944 - DNA, 13 bp, Homo sapiens
cctccatcctgag

SEQ ID NO: 3141945 - DNA, 14 bp, Homo sapiens
cctccatcctgagg

SEQ ID NO: 3141946 - DNA, 14 bp, Homo sapiens
cctccatgctgcct

SEQ ID NO: 3141947 - DNA, 23 bp, Homo sapiens
cctccatgtgggctagttgggct

SEQ ID NO: 3141948 - DNA, 21 bp, Homo sapiens
cctccattaaagtctgaatca

SEQ ID NO: 3141949 - DNA, 22 bp, Homo sapiens
cctccatttctctccaggaagt

SEQ ID NO: 3141950 - DNA, 16 bp, Homo sapiens
cctcccaaagtgctgg

SEQ ID NO: 3141951 - DNA, 22 bp, Homo sapiens
cctcccaaggggcccaaattct

SEQ ID NO: 3141952 - DNA, 15 bp, Homo sapiens
cctcccacacttgct

SEQ ID NO: 3141953 - DNA, 21 bp, Homo sapiens
cctcccacccccttctctgct

SEQ ID NO: 3141954 - DNA, 12 bp, Homo sapiens
cctcccacccga

SEQ ID NO: 3141955 - DNA, 19 bp, Homo sapiens
cctcccacccgatgctgct

SEQ ID NO: 3141956 - DNA, 15 bp, Homo sapiens
cctcccacctcagcc

SEQ ID NO: 3141957 - DNA, 17 bp, Homo sapiens
cctcccacctcagcctc

SEQ ID NO: 3141958 - DNA, 13 bp, Homo sapiens
cctcccacctctg

SEQ ID NO: 3141959 - DNA, 16 bp, Homo sapiens
cctcccacttcactgc

SEQ ID NO: 3141960 - DNA, 22 bp, Homo sapiens
cctcccagaggtccagcccatc

SEQ ID NO: 3141961 - DNA, 20 bp, Homo sapiens
cctcccagccctatggatgt

SEQ ID NO: 3141962 - DNA, 22 bp, Homo sapiens
cctcccataattgctttgccaa

SEQ ID NO: 3141963 - DNA, 14 bp, Homo sapiens
cctcccatcccctg

SEQ ID NO: 3141964 - DNA, 13 bp, Homo sapiens
cctcccatctggg

SEQ ID NO: 3141965 - DNA, 16 bp, Homo sapiens
cctcccatctgggagt

SEQ ID NO: 3141966 - DNA, 15 bp, Homo sapiens
cctcccatggcacct

SEQ ID NO: 3141967 - DNA, 18 bp, Homo sapiens
cctccccacacctcccta

SEQ ID NO: 3141968 - DNA, 19 bp, Homo sapiens
cctccccactcctctccca

SEQ ID NO: 3141969 - DNA, 22 bp, Homo sapiens
cctccccagcattccagcccct

SEQ ID NO: 3141970 - DNA, 16 bp, Homo sapiens
cctccccatggagcca

SEQ ID NO: 3141971 - DNA, 14 bp, Homo sapiens
cctccccatttccc

SEQ ID NO: 3141972 - DNA, 19 bp, Homo sapiens
cctcccccaacccccaccc

SEQ ID NO: 3141973 - DNA, 12 bp, Homo sapiens
cctcccccaaga

SEQ ID NO: 3141974 - DNA, 15 bp, Homo sapiens
cctcccccagagggg

SEQ ID NO: 3141975 - DNA, 14 bp, Homo sapiens
cctccccctgcaac

SEQ ID NO: 3141976 - DNA, 15 bp, Homo sapiens
cctccccctgttctg

SEQ ID NO: 3141977 - DNA, 15 bp, Homo sapiens
cctccccgcaccccc

SEQ ID NO: 3141978 - DNA, 21 bp, Homo sapiens
cctccccgcaccccccaagct

SEQ ID NO: 3141979 - DNA, 13 bp, Homo sapiens
cctccccgcctgg

SEQ ID NO: 3141980 - DNA, 21 bp, Homo sapiens
cctccccgcctggccagggca

SEQ ID NO: 3141981 - DNA, 14 bp, Homo sapiens
cctcccctccatcc

SEQ ID NO: 3141982 - DNA, 14 bp, Homo sapiens
cctcccctcccctg

SEQ ID NO: 3141983 - DNA, 15 bp, Homo sapiens
cctcccctccttgtc

SEQ ID NO: 3141984 - DNA, 21 bp, Homo sapiens
cctcccctctcttgcacccgc

SEQ ID NO: 3141985 - DNA, 12 bp, Homo sapiens
cctcccctgcca

SEQ ID NO: 3141986 - DNA, 16 bp, Homo sapiens
cctcccctgccctggt

SEQ ID NO: 3141987 - DNA, 13 bp, Homo sapiens
cctcccctgctgc

SEQ ID NO: 3141988 - DNA, 14 bp, Homo sapiens
cctcccctgctgca

SEQ ID NO: 3141989 - DNA, 18 bp, Homo sapiens
cctcccgaatagctggga

SEQ ID NO: 3141990 - DNA, 19 bp, Homo sapiens
cctcccgaatagctgggac

SEQ ID NO: 3141991 - DNA, 15 bp, Homo sapiens
cctcccgcaccccga

SEQ ID NO: 3141992 - DNA, 21 bp, Homo sapiens
cctcccgggtctcaggcctcc

SEQ ID NO: 3141993 - DNA, 23 bp, Homo sapiens
cctcccgggtctcaggcctccag

SEQ ID NO: 3141994 - DNA, 13 bp, Homo sapiens
cctcccggtgccc

SEQ ID NO: 3141995 - DNA, 21 bp, Homo sapiens
cctccctagccagcacttgta

SEQ ID NO: 3141996 - DNA, 19 bp, Homo sapiens
cctccctatgtctgcaaag

SEQ ID NO: 3141997 - DNA, 22 bp, Homo sapiens
cctccctcagctctctgggacc

SEQ ID NO: 3141998 - DNA, 13 bp, Homo sapiens
cctccctccttgg

SEQ ID NO: 3141999 - DNA, 13 bp, Homo sapiens
cctccctctccat

SEQ ID NO: 3142000 - DNA, 21 bp, Homo sapiens
cctctgtgccttcttttgatt

SEQ ID NO: 3142001 - DNA, 16 bp, Homo sapiens
cctctgtgctgtgtgt

SEQ ID NO: 3142002 - DNA, 18 bp, Homo sapiens
cctctgtgtatttgcttt

SEQ ID NO: 3142003 - DNA, 14 bp, Homo sapiens
cctctgtgtctgct

SEQ ID NO: 3142004 - DNA, 17 bp, Homo sapiens
cctctgtgtctgctctc

SEQ ID NO: 3142005 - DNA, 21 bp, Homo sapiens
cctcttaaagctgcctgtagt

SEQ ID NO: 3142006 - DNA, 23 bp, Homo sapiens
cctcttaaagctgcctgtagtta

SEQ ID NO: 3142007 - DNA, 14 bp, Homo sapiens
cctcttaaattata

SEQ ID NO: 3142008 - DNA, 19 bp, Homo sapiens
cctcttaccgtagcctccg

SEQ ID NO: 3142009 - DNA, 14 bp, Homo sapiens
cctcttactggggc

SEQ ID NO: 3142010 - DNA, 19 bp, Homo sapiens
cctcttagtgattgtgtct

SEQ ID NO: 3142011 - DNA, 18 bp, Homo sapiens
cctcttcaaaaagcagag

SEQ ID NO: 3142012 - DNA, 13 bp, Homo sapiens
cctcttcaccccc

SEQ ID NO: 3142013 - DNA, 20 bp, Homo sapiens
cctcttcaccccggcaggcc

SEQ ID NO: 3142014 - DNA, 21 bp, Homo sapiens
cctcttcaccccggcaggccc

SEQ ID NO: 3142015 - DNA, 13 bp, Homo sapiens
cctcttcactccc

SEQ ID NO: 3142016 - DNA, 14 bp, Homo sapiens
cctcttcagcccct

SEQ ID NO: 3142017 - DNA, 12 bp, Homo sapiens
cctcttccagtc

SEQ ID NO: 3142018 - DNA, 13 bp, Homo sapiens
cctcttcccatga

SEQ ID NO: 3142019 - DNA, 23 bp, Homo sapiens
cctcttcccatgactgcacccag

SEQ ID NO: 3142020 - DNA, 20 bp, Homo sapiens
cctcttccggagatgtagca

SEQ ID NO: 3142021 - DNA, 19 bp, Homo sapiens
cctcttcctccctcattcc

SEQ ID NO: 3142022 - DNA, 16 bp, Homo sapiens
cctcttctcaagtgcc

SEQ ID NO: 3142023 - DNA, 17 bp, Homo sapiens
cctcttctcaagtgcct

SEQ ID NO: 3142024 - DNA, 18 bp, Homo sapiens
cctcttctgacgtgcctt

SEQ ID NO: 3142025 - DNA, 15 bp, Homo sapiens
cctcttcttcttcag

SEQ ID NO: 3142026 - DNA, 14 bp, Homo sapiens
cctcttgagcagtg

SEQ ID NO: 3142027 - DNA, 17 bp, Homo sapiens
cctcttgagcagtggct

SEQ ID NO: 3142028 - DNA, 19 bp, Homo sapiens
cctcttgagctgaagtaat

SEQ ID NO: 3142029 - DNA, 14 bp, Homo sapiens
cctcttgcctctct

SEQ ID NO: 3142030 - DNA, 15 bp, Homo sapiens
cctcttgcctctctc

SEQ ID NO: 3142031 - DNA, 12 bp, Homo sapiens
cctcttgctcaa

SEQ ID NO: 3142032 - DNA, 18 bp, Homo sapiens
cctcttgctgtctctgct

SEQ ID NO: 3142033 - DNA, 23 bp, Homo sapiens
cctcttgctgtctctgctcgccc

SEQ ID NO: 3142034 - DNA, 16 bp, Homo sapiens
cctcttgtaaagactg

SEQ ID NO: 3142035 - DNA, 17 bp, Homo sapiens
cctcttgtaaagactgg

SEQ ID NO: 3142036 - DNA, 19 bp, Homo sapiens
cctcttgtccctttcccta

SEQ ID NO: 3142037 - DNA, 15 bp, Homo sapiens
cctctttccctgcga

SEQ ID NO: 3142038 - DNA, 16 bp, Homo sapiens
cctctttccctgcgag

SEQ ID NO: 3142039 - DNA, 23 bp, Homo sapiens
cctctttcctctctttgttctca

SEQ ID NO: 3142040 - DNA, 15 bp, Homo sapiens
cctcttttcacattt

SEQ ID NO: 3142041 - DNA, 16 bp, Homo sapiens
cctcttttcacatttt

SEQ ID NO: 3142042 - DNA, 17 bp, Homo sapiens
cctcttttcacattttt

SEQ ID NO: 3142043 - DNA, 22 bp, Homo sapiens
cctcttttcacattttttttct

SEQ ID NO: 3142044 - DNA, 12 bp, Homo sapiens
cctcttttgtgc

SEQ ID NO: 3142045 - DNA, 20 bp, Homo sapiens
cctctttttccatcataatt

SEQ ID NO: 3142046 - DNA, 21 bp, Homo sapiens
cctgaaaacgaaggggccccg

SEQ ID NO: 3142047 - DNA, 13 bp, Homo sapiens
cctgaaaagctgc

SEQ ID NO: 3142048 - DNA, 17 bp, Homo sapiens
cctgaaaagctgcattt

SEQ ID NO: 3142049 - DNA, 23 bp, Homo sapiens
cctgaaaagctgcatttaaatca

SEQ ID NO: 3142050 - DNA, 22 bp, Homo sapiens
cctgaaaagtaacttggctttc

SEQ ID NO: 3142051 - DNA, 16 bp, Homo sapiens
cctgaaacagccatgt

SEQ ID NO: 3142052 - DNA, 13 bp, Homo sapiens
cctgaaataaaca

SEQ ID NO: 3142053 - DNA, 18 bp, Homo sapiens
cctgaaataaacactggt

SEQ ID NO: 3142054 - DNA, 13 bp, Homo sapiens
cctgaaattccaa

SEQ ID NO: 3142055 - DNA, 14 bp, Homo sapiens
cctgaaatttcaga

SEQ ID NO: 3142056 - DNA, 20 bp, Homo sapiens
cctgaacaaatcttgggtgg

SEQ ID NO: 3142057 - DNA, 15 bp, Homo sapiens
cctgaaccccatggg

SEQ ID NO: 3142058 - DNA, 16 bp, Homo sapiens
cctgaaccccatgggc

SEQ ID NO: 3142059 - DNA, 23 bp, Homo sapiens
cctgaaccccatgggcttggact

SEQ ID NO: 3142060 - DNA, 21 bp, Homo sapiens
cctgaaccgcacagctcagga

SEQ ID NO: 3142061 - DNA, 13 bp, Homo sapiens
cctgaactgagga

SEQ ID NO: 3142062 - DNA, 17 bp, Homo sapiens
cctgaactttctccctc

SEQ ID NO: 3142063 - DNA, 22 bp, Homo sapiens
cctgaagaggcgggccagccag

SEQ ID NO: 3142064 - DNA, 15 bp, Homo sapiens
cctgaagccagcctt

SEQ ID NO: 3142065 - DNA, 16 bp, Homo sapiens
cctgaagccagccttc

SEQ ID NO: 3142066 - DNA, 17 bp, Homo sapiens
cctgaaggattctggga

SEQ ID NO: 3142067 - DNA, 20 bp, Homo sapiens
cctgaatccaaactaatcca

SEQ ID NO: 3142068 - DNA, 21 bp, Homo sapiens
cctgaatccaaactaatccat

SEQ ID NO: 3142069 - DNA, 13 bp, Homo sapiens
cctgaatgaaata

SEQ ID NO: 3142070 - DNA, 23 bp, Homo sapiens
cctgaatggttccatgcctgagg

SEQ ID NO: 3142071 - DNA, 18 bp, Homo sapiens
cctgaatttccccatctg

SEQ ID NO: 3142072 - DNA, 19 bp, Homo sapiens
cctgacaaccactggtctg

SEQ ID NO: 3142073 - DNA, 14 bp, Homo sapiens
cctgacacaccagg

SEQ ID NO: 3142074 - DNA, 15 bp, Homo sapiens
cctgacacaccaggc

SEQ ID NO: 3142075 - DNA, 17 bp, Homo sapiens
cctgacacaccaggcgc

SEQ ID NO: 3142076 - DNA, 20 bp, Homo sapiens
cctgacacactaaccaagct

SEQ ID NO: 3142077 - DNA, 17 bp, Homo sapiens
cctgacactgagcccca

SEQ ID NO: 3142078 - DNA, 21 bp, Homo sapiens
cctgacactgagccccacctc

SEQ ID NO: 3142079 - DNA, 15 bp, Homo sapiens
cctgacactttaatt

SEQ ID NO: 3142080 - DNA, 16 bp, Homo sapiens
cctgacagaaggactc

SEQ ID NO: 3142081 - DNA, 14 bp, Homo sapiens
cctgacagaaggtg

SEQ ID NO: 3142082 - DNA, 15 bp, Homo sapiens
cctgacagaaggtgc

SEQ ID NO: 3142083 - DNA, 21 bp, Homo sapiens
cctgacagatgtcagccgagc

SEQ ID NO: 3142084 - DNA, 18 bp, Homo sapiens
cctgacagtcttgtgctt

SEQ ID NO: 3142085 - DNA, 14 bp, Homo sapiens
cctgacatcacagc

SEQ ID NO: 3142086 - DNA, 20 bp, Homo sapiens
cctgacatcacagcagcctc

SEQ ID NO: 3142087 - DNA, 13 bp, Homo sapiens
cctgaccaccctc

SEQ ID NO: 3142088 - DNA, 15 bp, Homo sapiens
cctgaccaccctccc

SEQ ID NO: 3142089 - DNA, 17 bp, Homo sapiens
cctgaccaccctcccct

SEQ ID NO: 3142090 - DNA, 18 bp, Homo sapiens
cctgaccaccctcccctc

SEQ ID NO: 3142091 - DNA, 21 bp, Homo sapiens
cctgaccaccctcccctctct

SEQ ID NO: 3142092 - DNA, 23 bp, Homo sapiens
cctgaccaccctcccctctcttg

SEQ ID NO: 3142093 - DNA, 19 bp, Homo sapiens
cctgacccaggccgcagct

SEQ ID NO: 3142094 - DNA, 15 bp, Homo sapiens
cctgacccctgctca

SEQ ID NO: 3142095 - DNA, 16 bp, Homo sapiens
cctgacccctgctcag

SEQ ID NO: 3142096 - DNA, 13 bp, Homo sapiens
cctgacctcttgc

SEQ ID NO: 3142097 - DNA, 16 bp, Homo sapiens
cctgacctcttgctgt

SEQ ID NO: 3142098 - DNA, 23 bp, Homo sapiens
cctgacctcttgctgtctctgct

SEQ ID NO: 3142099 - DNA, 13 bp, Homo sapiens
cctgacgaaactg

SEQ ID NO: 3142100 - DNA, 16 bp, Homo sapiens
cctgacgaaactggcc

SEQ ID NO: 3142101 - DNA, 18 bp, Homo sapiens
cctgacgaaactggcccc

SEQ ID NO: 3142102 - DNA, 22 bp, Homo sapiens
cctgacgccctgcgttggagcc

SEQ ID NO: 3142103 - DNA, 20 bp, Homo sapiens
cctgacggcgcccccagtgt

SEQ ID NO: 3142104 - DNA, 20 bp, Homo sapiens
cctgactaatttttgtattt

SEQ ID NO: 3142105 - DNA, 10 bp, Homo sapiens
cctgactcaa

SEQ ID NO: 3142106 - DNA, 15 bp, Homo sapiens
cctgactccctgtgg

SEQ ID NO: 3142107 - DNA, 16 bp, Homo sapiens
cctgactccctgtggg

SEQ ID NO: 3142108 - DNA, 13 bp, Homo sapiens
cctgactctctgt

SEQ ID NO: 3142109 - DNA, 23 bp, Homo sapiens
cctgacttgagtgttccttttta

SEQ ID NO: 3142110 - DNA, 23 bp, Homo sapiens
cctgagaactgaattttgggact

SEQ ID NO: 3142111 - DNA, 16 bp, Homo sapiens
cctgagaagctgctcc

SEQ ID NO: 3142112 - DNA, 22 bp, Homo sapiens
cctgagaagctgctccaggcct

SEQ ID NO: 3142113 - DNA, 15 bp, Homo sapiens
cctgagaccctggga

SEQ ID NO: 3142114 - DNA, 18 bp, Homo sapiens
cctgagaccctgggagag

SEQ ID NO: 3142115 - DNA, 20 bp, Homo sapiens
cctgagaccctgggagagaa

SEQ ID NO: 3142116 - DNA, 21 bp, Homo sapiens
cctgagaccctgggagagaag

SEQ ID NO: 3142117 - DNA, 22 bp, Homo sapiens
cctgagacgggcatcgcaggag

SEQ ID NO: 3142118 - DNA, 13 bp, Homo sapiens
cctgagactccag

SEQ ID NO: 3142119 - DNA, 14 bp, Homo sapiens
cctgagactccaga

SEQ ID NO: 3142120 - DNA, 15 bp, Homo sapiens
cctgagagaattggc

SEQ ID NO: 3142121 - DNA, 17 bp, Homo sapiens
cctgagaggcaggcata

SEQ ID NO: 3142122 - DNA, 18 bp, Homo sapiens
cctgagaggcaggcatag

SEQ ID NO: 3142123 - DNA, 15 bp, Homo sapiens
cctgagatcccctga

SEQ ID NO: 3142124 - DNA, 17 bp, Homo sapiens
cctgagattcagatgtc

SEQ ID NO: 3142125 - DNA, 23 bp, Homo sapiens
cctgagcaactcttgattatcca

SEQ ID NO: 3142126 - DNA, 21 bp, Homo sapiens
cctgagccccgccctcttcct

SEQ ID NO: 3142127 - DNA, 22 bp, Homo sapiens
cctgagccccgccctcttcctg

SEQ ID NO: 3142128 - DNA, 22 bp, Homo sapiens
cctgagccctactccctgcaga

SEQ ID NO: 3142129 - DNA, 14 bp, Homo sapiens
cctgagccttagct

SEQ ID NO: 3142130 - DNA, 22 bp, Homo sapiens
cctgagccttagctcccagcta

SEQ ID NO: 3142131 - DNA, 21 bp, Homo sapiens
cctgagcgcctggatttctgg

SEQ ID NO: 3142132 - DNA, 16 bp, Homo sapiens
cctgagctggggccac

SEQ ID NO: 3142133 - DNA, 18 bp, Homo sapiens
cctgagctttggggacag

SEQ ID NO: 3142134 - DNA, 23 bp, Homo sapiens
cctgaggaaggaggggaagctgc

SEQ ID NO: 3142135 - DNA, 17 bp, Homo sapiens
cctgaggactggagacc

SEQ ID NO: 3142136 - DNA, 13 bp, Homo sapiens
cctgaggagagga

SEQ ID NO: 3142137 - DNA, 16 bp, Homo sapiens
cctgaggcaaggagtt

SEQ ID NO: 3142138 - DNA, 18 bp, Homo sapiens
cctgaggcctagactctg

SEQ ID NO: 3142139 - DNA, 19 bp, Homo sapiens
cctgaggcctagactctgt

SEQ ID NO: 3142140 - DNA, 14 bp, Homo sapiens
cctgaggcctgagg

SEQ ID NO: 3142141 - DNA, 15 bp, Homo sapiens
cctgaggcctgaggc

SEQ ID NO: 3142142 - DNA, 16 bp, Homo sapiens
cctgaggcctgaggcc

SEQ ID NO: 3142143 - DNA, 17 bp, Homo sapiens
cctgaggcctgaggcct

SEQ ID NO: 3142144 - DNA, 16 bp, Homo sapiens
cctgaggcctgtgcct

SEQ ID NO: 3142145 - DNA, 18 bp, Homo sapiens
cctgaggcctgtgcctgt

SEQ ID NO: 3142146 - DNA, 14 bp, Homo sapiens
cctgaggctccact

SEQ ID NO: 3142147 - DNA, 14 bp, Homo sapiens
cctgaggctgtggt

SEQ ID NO: 3142148 - DNA, 15 bp, Homo sapiens
cctgaggctgtggtc

SEQ ID NO: 3142149 - DNA, 17 bp, Homo sapiens
cctgaggctgtggtcac

SEQ ID NO: 3142150 - DNA, 14 bp, Homo sapiens
cctgaggcttatct

SEQ ID NO: 3142151 - DNA, 20 bp, Homo sapiens
cctgaggggcatctgcccct

SEQ ID NO: 3142152 - DNA, 13 bp, Homo sapiens
cctgagggtggag

SEQ ID NO: 3142153 - DNA, 15 bp, Homo sapiens
cctgagggtggagac

SEQ ID NO: 3142154 - DNA, 16 bp, Homo sapiens
cctgagggtggagact

SEQ ID NO: 3142155 - DNA, 20 bp, Homo sapiens
cctgaggtcagggagtgctg

SEQ ID NO: 3142156 - DNA, 20 bp, Homo sapiens
cctgaggtgaaagggagcta

SEQ ID NO: 3142157 - DNA, 15 bp, Homo sapiens
cctgaggtgggccca

SEQ ID NO: 3142158 - DNA, 19 bp, Homo sapiens
cctgaggtgggcccaggac

SEQ ID NO: 3142159 - DNA, 18 bp, Homo sapiens
cctgaggtgggctggggc

SEQ ID NO: 3142160 - DNA, 15 bp, Homo sapiens
cctgaggtgtggggg

SEQ ID NO: 3142161 - DNA, 22 bp, Homo sapiens
cctgaggtgtgggggctgcagc

SEQ ID NO: 3142162 - DNA, 14 bp, Homo sapiens
cctgagtcactggt

SEQ ID NO: 3142163 - DNA, 16 bp, Homo sapiens
cctgagtcagggccca

SEQ ID NO: 3142164 - DNA, 23 bp, Homo sapiens
cctgagtccaagagggtccttta

SEQ ID NO: 3142165 - DNA, 15 bp, Homo sapiens
cctgagtcctggtcc

SEQ ID NO: 3142166 - DNA, 16 bp, Homo sapiens
cctgagtcctggtccc

SEQ ID NO: 3142167 - DNA, 17 bp, Homo sapiens
cctgagtcctggtccct

SEQ ID NO: 3142168 - DNA, 20 bp, Homo sapiens
cctgagtcctggtccctctg

SEQ ID NO: 3142169 - DNA, 18 bp, Homo sapiens
cctgagtctcctgtgccc

SEQ ID NO: 3142170 - DNA, 21 bp, Homo sapiens
cctgagtggccagggaatcta

SEQ ID NO: 3142171 - DNA, 14 bp, Homo sapiens
cctgagttcatcca

SEQ ID NO: 3142172 - DNA, 20 bp, Homo sapiens
cctgataaaacaacagctcg

SEQ ID NO: 3142173 - DNA, 17 bp, Homo sapiens
cctgatctcttcctgtt

SEQ ID NO: 3142174 - DNA, 20 bp, Homo sapiens
cctgatctcttcctgttttg

SEQ ID NO: 3142175 - DNA, 19 bp, Homo sapiens
cctgatgacacccaccctg

SEQ ID NO: 3142176 - DNA, 22 bp, Homo sapiens
cctgatgacacccaccctgtgc

SEQ ID NO: 3142177 - DNA, 19 bp, Homo sapiens
cctgatgctccctcccctg

SEQ ID NO: 3142178 - DNA, 14 bp, Homo sapiens
cctgatgctgcccc

SEQ ID NO: 3142179 - DNA, 15 bp, Homo sapiens
cctgatgctgccccg

SEQ ID NO: 3142180 - DNA, 21 bp, Homo sapiens
cctgatggaagtaaagcctca

SEQ ID NO: 3142181 - DNA, 22 bp, Homo sapiens
cctgatggtcagctcccttctc

SEQ ID NO: 3142182 - DNA, 13 bp, Homo sapiens
cctgattatttat

SEQ ID NO: 3142183 - DNA, 21 bp, Homo sapiens
cctgattatttatccttgtct

SEQ ID NO: 3142184 - DNA, 13 bp, Homo sapiens
cctgattgtaaac

SEQ ID NO: 3142185 - DNA, 16 bp, Homo sapiens
cctgatttcagaagag

SEQ ID NO: 3142186 - DNA, 19 bp, Homo sapiens
cctgatttcagaagagact

SEQ ID NO: 3142187 - DNA, 22 bp, Homo sapiens
cctgcaaaatttgatgccagga

SEQ ID NO: 3142188 - DNA, 17 bp, Homo sapiens
cctgcaaacagaacagg

SEQ ID NO: 3142189 - DNA, 19 bp, Homo sapiens
cctgcaaacagaacagggt

SEQ ID NO: 3142190 - DNA, 20 bp, Homo sapiens
cctgcaaacagaacagggtc

SEQ ID NO: 3142191 - DNA, 16 bp, Homo sapiens
cctgcaaaccttcctg

SEQ ID NO: 3142192 - DNA, 18 bp, Homo sapiens
cctgcaaaccttcctggg

SEQ ID NO: 3142193 - DNA, 20 bp, Homo sapiens
cctgcaaaccttcctgggag

SEQ ID NO: 3142194 - DNA, 15 bp, Homo sapiens
cctgcaaactcactg

SEQ ID NO: 3142195 - DNA, 22 bp, Homo sapiens
cctgcaaagacagtatttattg

SEQ ID NO: 3142196 - DNA, 18 bp, Homo sapiens
cctgcaactcaaggactt

SEQ ID NO: 3142197 - DNA, 14 bp, Homo sapiens
cctgcaagccccag

SEQ ID NO: 3142198 - DNA, 15 bp, Homo sapiens
cctgcaagccccagg

SEQ ID NO: 3142199 - DNA, 18 bp, Homo sapiens
cctgcaagccccagggcc

SEQ ID NO: 3142200 - DNA, 13 bp, Homo sapiens
cctgcaatatttg

SEQ ID NO: 3142201 - DNA, 13 bp, Homo sapiens
cctgcaatcccag

SEQ ID NO: 3142202 - DNA, 17 bp, Homo sapiens
cctgcaatcccagcacc

SEQ ID NO: 3142203 - DNA, 23 bp, Homo sapiens
cctgcacaaagcccttccatgtc

SEQ ID NO: 3142204 - DNA, 10 bp, Homo sapiens
cctgcacaca

SEQ ID NO: 3142205 - DNA, 23 bp, Homo sapiens
cctgcacacaagcccacagcaca

SEQ ID NO: 3142206 - DNA, 12 bp, Homo sapiens
cctgcacccagg

SEQ ID NO: 3142207 - DNA, 12 bp, Homo sapiens
cctgcaccctgg

SEQ ID NO: 3142208 - DNA, 21 bp, Homo sapiens
cctgcaccctggaaaggggag

SEQ ID NO: 3142209 - DNA, 20 bp, Homo sapiens
cctgcacgtatacacccaga

SEQ ID NO: 3142210 - DNA, 24 bp, Homo sapiens
cctgcacgtatacacccagatggc

SEQ ID NO: 3142211 - DNA, 19 bp, Homo sapiens
cctgcactaaagccagcct

SEQ ID NO: 3142212 - DNA, 21 bp, Homo sapiens
cctgcactaaagccagcctga

SEQ ID NO: 3142213 - DNA, 17 bp, Homo sapiens
cctgcactaacagagtg

SEQ ID NO: 3142214 - DNA, 14 bp, Homo sapiens
cctgcacttacttg

SEQ ID NO: 3142215 - DNA, 17 bp, Homo sapiens
cctgcacttacttgctt

SEQ ID NO: 3142216 - DNA, 17 bp, Homo sapiens
cctgcacttgcagactc

SEQ ID NO: 3142217 - DNA, 19 bp, Homo sapiens
cctgcacttgcagactcta

SEQ ID NO: 3142218 - DNA, 18 bp, Homo sapiens
cctgcagacacctggact

SEQ ID NO: 3142219 - DNA, 13 bp, Homo sapiens
cctgcagatgcca

SEQ ID NO: 3142220 - DNA, 21 bp, Homo sapiens
cctgcagatgccaccctagcc

SEQ ID NO: 3142221 - DNA, 24 bp, Homo sapiens
cctgcagcaaacactccaccctcc

SEQ ID NO: 3142222 - DNA, 19 bp, Homo sapiens
cctgcagcatggtccctgc

SEQ ID NO: 3142223 - DNA, 22 bp, Homo sapiens
cctgcagcatggtccctgcctt

SEQ ID NO: 3142224 - DNA, 18 bp, Homo sapiens
cctgcagcccaaaaccca

SEQ ID NO: 3142225 - DNA, 22 bp, Homo sapiens
cctgcagcctcctccacctcac

SEQ ID NO: 3142226 - DNA, 18 bp, Homo sapiens
cctgcagcctcctcctga

SEQ ID NO: 3142227 - DNA, 16 bp, Homo sapiens
cctgcaggaacgagca

SEQ ID NO: 3142228 - DNA, 17 bp, Homo sapiens
cctgcaggaacgagcac

SEQ ID NO: 3142229 - DNA, 15 bp, Homo sapiens
cctgcaggctgagcc

SEQ ID NO: 3142230 - DNA, 21 bp, Homo sapiens
cctgcagggccatctgactgc

SEQ ID NO: 3142231 - DNA, 13 bp, Homo sapiens
cctgcagggctgc

SEQ ID NO: 3142232 - DNA, 22 bp, Homo sapiens
cctgcataatgtttctggattt

SEQ ID NO: 3142233 - DNA, 23 bp, Homo sapiens
cctgcatccccttggctgtgagg

SEQ ID NO: 3142234 - DNA, 22 bp, Homo sapiens
cctgcatctatcgagtttgcaa

SEQ ID NO: 3142235 - DNA, 18 bp, Homo sapiens
cctgcatgggggcaccgg

SEQ ID NO: 3142236 - DNA, 23 bp, Homo sapiens
cctgcatttgtgaaatgatggtg

SEQ ID NO: 3142237 - DNA, 18 bp, Homo sapiens
cctgccaagactcctcag

SEQ ID NO: 3142238 - DNA, 19 bp, Homo sapiens
cctgccaagactcctcagg

SEQ ID NO: 3142239 - DNA, 19 bp, Homo sapiens
cctgccacaacagaataaa

SEQ ID NO: 3142240 - DNA, 22 bp, Homo sapiens
cctgccacaacagaataaagca

SEQ ID NO: 3142241 - DNA, 18 bp, Homo sapiens
cctgccacatacaggtgc

SEQ ID NO: 3142242 - DNA, 17 bp, Homo sapiens
cctgccaccacacacac

SEQ ID NO: 3142243 - DNA, 13 bp, Homo sapiens
cctgccaccagca

SEQ ID NO: 3142244 - DNA, 14 bp, Homo sapiens
cctgccaccagcat

SEQ ID NO: 3142245 - DNA, 16 bp, Homo sapiens
cctgccaccagcatcc

SEQ ID NO: 3142246 - DNA, 13 bp, Homo sapiens
cctgccaccaggc

SEQ ID NO: 3142247 - DNA, 14 bp, Homo sapiens
cctgccaccaggcc

SEQ ID NO: 3142248 - DNA, 18 bp, Homo sapiens
cctgccaccaggccacct

SEQ ID NO: 3142249 - DNA, 12 bp, Homo sapiens
cctgccaccctg

SEQ ID NO: 3142250 - DNA, 13 bp, Homo sapiens
cctgccaccctgg

SEQ ID NO: 3142251 - DNA, 22 bp, Homo sapiens
cctggatgagaaacagctcagc

SEQ ID NO: 3142252 - DNA, 21 bp, Homo sapiens
cctggatgccaaggagcccct

SEQ ID NO: 3142253 - DNA, 17 bp, Homo sapiens
cctggatgggcattggg

SEQ ID NO: 3142254 - DNA, 21 bp, Homo sapiens
cctggatgggcattgggctga

SEQ ID NO: 3142255 - DNA, 21 bp, Homo sapiens
cctggatgtgtggggcatggt

SEQ ID NO: 3142256 - DNA, 17 bp, Homo sapiens
cctggatgttgtgtgta

SEQ ID NO: 3142257 - DNA, 19 bp, Homo sapiens
cctggcaatagtgtgttct

SEQ ID NO: 3142258 - DNA, 17 bp, Homo sapiens
cctggcaatcaatacag

SEQ ID NO: 3142259 - DNA, 21 bp, Homo sapiens
cctggcaatcaatacagcttc

SEQ ID NO: 3142260 - DNA, 14 bp, Homo sapiens
cctggcacaggact

SEQ ID NO: 3142261 - DNA, 24 bp, Homo sapiens
cctggcacaggactgattctggga

SEQ ID NO: 3142262 - DNA, 16 bp, Homo sapiens
cctggcacagggcagt

SEQ ID NO: 3142263 - DNA, 19 bp, Homo sapiens
cctggcacatttcagggag

SEQ ID NO: 3142264 - DNA, 18 bp, Homo sapiens
cctggcacccccacaagc

SEQ ID NO: 3142265 - DNA, 23 bp, Homo sapiens
cctggcacccccacaagctgtcc

SEQ ID NO: 3142266 - DNA, 20 bp, Homo sapiens
cctggcacccggcccctgct

SEQ ID NO: 3142267 - DNA, 23 bp, Homo sapiens
cctggcacccggcccctgctggt

SEQ ID NO: 3142268 - DNA, 17 bp, Homo sapiens
cctggcacgccctactc

SEQ ID NO: 3142269 - DNA, 23 bp, Homo sapiens
cctggcactaacgttgagcccct

SEQ ID NO: 3142270 - DNA, 12 bp, Homo sapiens
cctggcagacac

SEQ ID NO: 3142271 - DNA, 14 bp, Homo sapiens
cctggcagacacaa

SEQ ID NO: 3142272 - DNA, 19 bp, Homo sapiens
cctggcagacacaacccaa

SEQ ID NO: 3142273 - DNA, 16 bp, Homo sapiens
cctggcagcacagccc

SEQ ID NO: 3142274 - DNA, 18 bp, Homo sapiens
cctggcagcacagcccag

SEQ ID NO: 3142275 - DNA, 21 bp, Homo sapiens
cctggcagcacagcccagggc

SEQ ID NO: 3142276 - DNA, 13 bp, Homo sapiens
cctggcagcagca

SEQ ID NO: 3142277 - DNA, 14 bp, Homo sapiens
cctggcagcagcag

SEQ ID NO: 3142278 - DNA, 16 bp, Homo sapiens
cctggcagcagcaggt

SEQ ID NO: 3142279 - DNA, 13 bp, Homo sapiens
cctggcagcccag

SEQ ID NO: 3142280 - DNA, 15 bp, Homo sapiens
cctggcagcccagag

SEQ ID NO: 3142281 - DNA, 18 bp, Homo sapiens
cctggcagcccagagact

SEQ ID NO: 3142282 - DNA, 21 bp, Homo sapiens
cctggcagccgtgccttcagc

SEQ ID NO: 3142283 - DNA, 17 bp, Homo sapiens
cctggcaggatgaccct

SEQ ID NO: 3142284 - DNA, 12 bp, Homo sapiens
cctggcaggcca

SEQ ID NO: 3142285 - DNA, 18 bp, Homo sapiens
cctggcaggccagtgtct

SEQ ID NO: 3142286 - DNA, 22 bp, Homo sapiens
cctggcagggaggtcaggccct

SEQ ID NO: 3142287 - DNA, 23 bp, Homo sapiens
cctggcagttgaacagagggaga

SEQ ID NO: 3142288 - DNA, 16 bp, Homo sapiens
cctggccacctgaggt

SEQ ID NO: 3142289 - DNA, 21 bp, Homo sapiens
cctggccagatgcaccagccc

SEQ ID NO: 3142290 - DNA, 14 bp, Homo sapiens
cctggccaggagca

SEQ ID NO: 3142291 - DNA, 16 bp, Homo sapiens
cctggccaggagcagg

SEQ ID NO: 3142292 - DNA, 16 bp, Homo sapiens
cctggccaggagctct

SEQ ID NO: 3142293 - DNA, 19 bp, Homo sapiens
cctggccaggagctcttca

SEQ ID NO: 3142294 - DNA, 20 bp, Homo sapiens
cctggccaggagctcttcag

SEQ ID NO: 3142295 - DNA, 21 bp, Homo sapiens
cctggccaggagctcttcagg

SEQ ID NO: 3142296 - DNA, 14 bp, Homo sapiens
cctggccaggcaga

SEQ ID NO: 3142297 - DNA, 15 bp, Homo sapiens
cctggccagggcagg

SEQ ID NO: 3142298 - DNA, 19 bp, Homo sapiens
cctggccagggcagggcca

SEQ ID NO: 3142299 - DNA, 20 bp, Homo sapiens
cctggccagggcagggccac

SEQ ID NO: 3142300 - DNA, 21 bp, Homo sapiens
cctggccagggcagggccacc

SEQ ID NO: 3142301 - DNA, 16 bp, Homo sapiens
cctggcccatctcagc

SEQ ID NO: 3142302 - DNA, 22 bp, Homo sapiens
cctggcccatctcagcctcctg

SEQ ID NO: 3142303 - DNA, 20 bp, Homo sapiens
cctggcccccaacctcaggg

SEQ ID NO: 3142304 - DNA, 23 bp, Homo sapiens
cctggcccccaacctcagggctc

SEQ ID NO: 3142305 - DNA, 21 bp, Homo sapiens
cctggccccggcctttatgtt

SEQ ID NO: 3142306 - DNA, 14 bp, Homo sapiens
cctggcccctcgcc

SEQ ID NO: 3142307 - DNA, 17 bp, Homo sapiens
cctggcccctcgcctgt

SEQ ID NO: 3142308 - DNA, 13 bp, Homo sapiens
cctggccctccac

SEQ ID NO: 3142309 - DNA, 20 bp, Homo sapiens
cctggccctccactcctcat

SEQ ID NO: 3142310 - DNA, 12 bp, Homo sapiens
cctggccctgcc

SEQ ID NO: 3142311 - DNA, 12 bp, Homo sapiens
cctggcccttac

SEQ ID NO: 3142312 - DNA, 18 bp, Homo sapiens
cctggcccttacttgctt

SEQ ID NO: 3142313 - DNA, 13 bp, Homo sapiens
cctggccctttcc

SEQ ID NO: 3142314 - DNA, 17 bp, Homo sapiens
cctggccctttcccctt

SEQ ID NO: 3142315 - DNA, 21 bp, Homo sapiens
cctggccgccccctgcccccc

SEQ ID NO: 3142316 - DNA, 19 bp, Homo sapiens
cctggccggcaaccccagt

SEQ ID NO: 3142317 - DNA, 21 bp, Homo sapiens
cctggccggcaaccccagttc

SEQ ID NO: 3142318 - DNA, 21 bp, Homo sapiens
cctggcctatccgctgccagc

SEQ ID NO: 3142319 - DNA, 15 bp, Homo sapiens
cctggcctcactggc

SEQ ID NO: 3142320 - DNA, 20 bp, Homo sapiens
cctggcctcagttcccagct

SEQ ID NO: 3142321 - DNA, 17 bp, Homo sapiens
cctggcctcccctgcca

SEQ ID NO: 3142322 - DNA, 19 bp, Homo sapiens
cctggcctcccctgccacc

SEQ ID NO: 3142323 - DNA, 16 bp, Homo sapiens
cctggcctctcagcct

SEQ ID NO: 3142324 - DNA, 13 bp, Homo sapiens
cctggcctctgtg

SEQ ID NO: 3142325 - DNA, 17 bp, Homo sapiens
cctggcctgaactgagg

SEQ ID NO: 3142326 - DNA, 15 bp, Homo sapiens
cctggcctgagctgg

SEQ ID NO: 3142327 - DNA, 16 bp, Homo sapiens
cctggcctgagctggg

SEQ ID NO: 3142328 - DNA, 16 bp, Homo sapiens
cctggcctggcacaca

SEQ ID NO: 3142329 - DNA, 14 bp, Homo sapiens
cctggcctggctcc

SEQ ID NO: 3142330 - DNA, 13 bp, Homo sapiens
cctggcgggatgg

SEQ ID NO: 3142331 - DNA, 12 bp, Homo sapiens
cctggctaagcc

SEQ ID NO: 3142332 - DNA, 22 bp, Homo sapiens
cctggctaagcctctgcttccg

SEQ ID NO: 3142333 - DNA, 14 bp, Homo sapiens
cctggctacatccc

SEQ ID NO: 3142334 - DNA, 18 bp, Homo sapiens
cctggctacatcccagcc

SEQ ID NO: 3142335 - DNA, 19 bp, Homo sapiens
cctggctacatcccagcct

SEQ ID NO: 3142336 - DNA, 23 bp, Homo sapiens
cctggctcccacaggcccttcct

SEQ ID NO: 3142337 - DNA, 12 bp, Homo sapiens
cctggctccctc

SEQ ID NO: 3142338 - DNA, 18 bp, Homo sapiens
cctggctccctcccgtag

SEQ ID NO: 3142339 - DNA, 20 bp, Homo sapiens
cctggctccctcctccaggc

SEQ ID NO: 3142340 - DNA, 15 bp, Homo sapiens
cctggctcctgaggg

SEQ ID NO: 3142341 - DNA, 22 bp, Homo sapiens
cctggctctgcaatgggcactg

SEQ ID NO: 3142342 - DNA, 20 bp, Homo sapiens
cctggctctgtggcttgcta

SEQ ID NO: 3142343 - DNA, 20 bp, Homo sapiens
cctggctcttgtgctggatg

SEQ ID NO: 3142344 - DNA, 18 bp, Homo sapiens
cctggctgactggccagt

SEQ ID NO: 3142345 - DNA, 20 bp, Homo sapiens
cctggctgactggccagttg

SEQ ID NO: 3142346 - DNA, 16 bp, Homo sapiens
cctggctgaggttcct

SEQ ID NO: 3142347 - DNA, 19 bp, Homo sapiens
cctggctgaggttcctctg

SEQ ID NO: 3142348 - DNA, 23 bp, Homo sapiens
cctggctgaggttcctctgcctg

SEQ ID NO: 3142349 - DNA, 12 bp, Homo sapiens
cctggctgccca

SEQ ID NO: 3142350 - DNA, 14 bp, Homo sapiens
cctggctgccctgg

SEQ ID NO: 3142351 - DNA, 18 bp, Homo sapiens
cctggctgccctggccct

SEQ ID NO: 3142352 - DNA, 19 bp, Homo sapiens
cctggctgccctggccctg

SEQ ID NO: 3142353 - DNA, 20 bp, Homo sapiens
cctggctgccctggccctga

SEQ ID NO: 3142354 - DNA, 13 bp, Homo sapiens
cctggctgctgcc

SEQ ID NO: 3142355 - DNA, 14 bp, Homo sapiens
cctggctgctgccc

SEQ ID NO: 3142356 - DNA, 17 bp, Homo sapiens
cctggctgctgccccca

SEQ ID NO: 3142357 - DNA, 22 bp, Homo sapiens
cctggctgctgcccccaccccg

SEQ ID NO: 3142358 - DNA, 12 bp, Homo sapiens
cctggctgtgga

SEQ ID NO: 3142359 - DNA, 17 bp, Homo sapiens
cctggctgtggaggcct

SEQ ID NO: 3142360 - DNA, 13 bp, Homo sapiens
cctggcttctgga

SEQ ID NO: 3142361 - DNA, 16 bp, Homo sapiens
cctggcttctggagcc

SEQ ID NO: 3142362 - DNA, 23 bp, Homo sapiens
cctggcttctggagcccttgggt

SEQ ID NO: 3142363 - DNA, 16 bp, Homo sapiens
cctggcttgctccagg

SEQ ID NO: 3142364 - DNA, 19 bp, Homo sapiens
cctggcttgctccagggtc

SEQ ID NO: 3142365 - DNA, 19 bp, Homo sapiens
cctggcttgcttgccgagc

SEQ ID NO: 3142366 - DNA, 20 bp, Homo sapiens
cctggctttcccttccagtt

SEQ ID NO: 3142367 - DNA, 15 bp, Homo sapiens
cctggcttttacttt

SEQ ID NO: 3142368 - DNA, 17 bp, Homo sapiens
cctggcttttcactgct

SEQ ID NO: 3142369 - DNA, 20 bp, Homo sapiens
cctggcttttcactgctggc

SEQ ID NO: 3142370 - DNA, 22 bp, Homo sapiens
cctggcttttcactgctggctg

SEQ ID NO: 3142371 - DNA, 23 bp, Homo sapiens
cctggcttttcactgctggctgc

SEQ ID NO: 3142372 - DNA, 24 bp, Homo sapiens
cctggcttttcactgctggctgcc

SEQ ID NO: 3142373 - DNA, 16 bp, Homo sapiens
cctgggaaaggaccca

SEQ ID NO: 3142374 - DNA, 18 bp, Homo sapiens
cctgggaaaggacccacc

SEQ ID NO: 3142375 - DNA, 23 bp, Homo sapiens
cctgggaaaggacccacccatct

SEQ ID NO: 3142376 - DNA, 20 bp, Homo sapiens
cctgttcttagagtgtagct

SEQ ID NO: 3142377 - DNA, 14 bp, Homo sapiens
cctgttcttcctcc

SEQ ID NO: 3142378 - DNA, 16 bp, Homo sapiens
cctgttcttcctccag

SEQ ID NO: 3142379 - DNA, 22 bp, Homo sapiens
cctgttgccctttctgtaccat

SEQ ID NO: 3142380 - DNA, 22 bp, Homo sapiens
cctgttgctgtgtttaatttga

SEQ ID NO: 3142381 - DNA, 16 bp, Homo sapiens
cctgttggcagctcta

SEQ ID NO: 3142382 - DNA, 18 bp, Homo sapiens
cctgttggcagctctagc

SEQ ID NO: 3142383 - DNA, 17 bp, Homo sapiens
cctgttggttccaagcc

SEQ ID NO: 3142384 - DNA, 21 bp, Homo sapiens
cctgttggttccaagccctgg

SEQ ID NO: 3142385 - DNA, 19 bp, Homo sapiens
cctgtttattcccatcttt

SEQ ID NO: 3142386 - DNA, 16 bp, Homo sapiens
cctgtttcaatcactg

SEQ ID NO: 3142387 - DNA, 13 bp, Homo sapiens
cctgtttccaggg

SEQ ID NO: 3142388 - DNA, 14 bp, Homo sapiens
cctgtttccagggt

SEQ ID NO: 3142389 - DNA, 14 bp, Homo sapiens
cctgtttctgcagc

SEQ ID NO: 3142390 - DNA, 14 bp, Homo sapiens
cctgtttctggcac

SEQ ID NO: 3142391 - DNA, 18 bp, Homo sapiens
cctgtttgaagcctgccc

SEQ ID NO: 3142392 - DNA, 21 bp, Homo sapiens
cctgtttgatgtatgtgtgaa

SEQ ID NO: 3142393 - DNA, 23 bp, Homo sapiens
cctgtttgatgtatgtgtgaaac

SEQ ID NO: 3142394 - DNA, 19 bp, Homo sapiens
cctgttttatactgtactt

SEQ ID NO: 3142395 - DNA, 23 bp, Homo sapiens
cctgttttatatattatgtgaag

SEQ ID NO: 3142396 - DNA, 15 bp, Homo sapiens
cctgttttctgagcc

SEQ ID NO: 3142397 - DNA, 17 bp, Homo sapiens
cctgtttttaagctgtt

SEQ ID NO: 3142398 - DNA, 13 bp, Homo sapiens
cctgtttttcaca

SEQ ID NO: 3142399 - DNA, 20 bp, Homo sapiens
cctgtttttcacattttcct

SEQ ID NO: 3142400 - DNA, 16 bp, Homo sapiens
cctgtttttctgggtg

SEQ ID NO: 3142401 - DNA, 17 bp, Homo sapiens
cctgtttttctgggtgg

SEQ ID NO: 3142402 - DNA, 18 bp, Homo sapiens
ccttaaaattaccagaca

SEQ ID NO: 3142403 - DNA, 15 bp, Homo sapiens
ccttaaactgtgtgg

SEQ ID NO: 3142404 - DNA, 22 bp, Homo sapiens
ccttaaagagggacaggctgaa

SEQ ID NO: 3142405 - DNA, 13 bp, Homo sapiens
ccttaacccaagg

SEQ ID NO: 3142406 - DNA, 15 bp, Homo sapiens
ccttaacccaaggag

SEQ ID NO: 3142407 - DNA, 17 bp, Homo sapiens
ccttaacccaaggagca

SEQ ID NO: 3142408 - DNA, 23 bp, Homo sapiens
ccttaaccctaaaattttaaggc

SEQ ID NO: 3142409 - DNA, 21 bp, Homo sapiens
ccttaagatttttcttttccg

SEQ ID NO: 3142410 - DNA, 14 bp, Homo sapiens
ccttaaggtctcca

SEQ ID NO: 3142411 - DNA, 18 bp, Homo sapiens
ccttaaggtctccaaacc

SEQ ID NO: 3142412 - DNA, 17 bp, Homo sapiens
ccttaatgacaacactt

SEQ ID NO: 3142413 - DNA, 13 bp, Homo sapiens
ccttaatttatat

SEQ ID NO: 3142414 - DNA, 16 bp, Homo sapiens
ccttacgctttgtcac

SEQ ID NO: 3142415 - DNA, 15 bp, Homo sapiens
ccttactctgagccc

SEQ ID NO: 3142416 - DNA, 21 bp, Homo sapiens
ccttactctgagcccaggccg

SEQ ID NO: 3142417 - DNA, 16 bp, Homo sapiens
ccttactcttcttgaa

SEQ ID NO: 3142418 - DNA, 17 bp, Homo sapiens
ccttactcttcttgaaa

SEQ ID NO: 3142419 - DNA, 22 bp, Homo sapiens
ccttactcttcttgaaatttta

SEQ ID NO: 3142420 - DNA, 19 bp, Homo sapiens
ccttactggtttccccagg

SEQ ID NO: 3142421 - DNA, 14 bp, Homo sapiens
ccttacttagcatg

SEQ ID NO: 3142422 - DNA, 21 bp, Homo sapiens
ccttacttccagcaagcaaag

SEQ ID NO: 3142423 - DNA, 20 bp, Homo sapiens
ccttacttgcttctctagct

SEQ ID NO: 3142424 - DNA, 16 bp, Homo sapiens
ccttagaaaatgtgtc

SEQ ID NO: 3142425 - DNA, 18 bp, Homo sapiens
ccttagaaatgtaaactg

SEQ ID NO: 3142426 - DNA, 20 bp, Homo sapiens
ccttagaacattttaattca

SEQ ID NO: 3142427 - DNA, 16 bp, Homo sapiens
ccttagaacctttctt

SEQ ID NO: 3142428 - DNA, 20 bp, Homo sapiens
ccttagactcttttccttcc

SEQ ID NO: 3142429 - DNA, 17 bp, Homo sapiens
ccttagaggtcctctgg

SEQ ID NO: 3142430 - DNA, 18 bp, Homo sapiens
ccttagaggtcctctgga

SEQ ID NO: 3142431 - DNA, 13 bp, Homo sapiens
ccttagctcccag

SEQ ID NO: 3142432 - DNA, 19 bp, Homo sapiens
ccttagctggcattacagc

SEQ ID NO: 3142433 - DNA, 20 bp, Homo sapiens
ccttagctttccctgtgcca

SEQ ID NO: 3142434 - DNA, 19 bp, Homo sapiens
ccttaggatggggctccca

SEQ ID NO: 3142435 - DNA, 19 bp, Homo sapiens
ccttaggcctacctgatgg

SEQ ID NO: 3142436 - DNA, 23 bp, Homo sapiens
ccttaggccttcctctctccaga

SEQ ID NO: 3142437 - DNA, 18 bp, Homo sapiens
ccttagggaagctggcct

SEQ ID NO: 3142438 - DNA, 22 bp, Homo sapiens
ccttagtcccccaactctgagc

SEQ ID NO: 3142439 - DNA, 20 bp, Homo sapiens
ccttagtctcagtttgtgtg

SEQ ID NO: 3142440 - DNA, 17 bp, Homo sapiens
ccttataaaccaatctt

SEQ ID NO: 3142441 - DNA, 20 bp, Homo sapiens
ccttatatatgcacttaatt

SEQ ID NO: 3142442 - DNA, 13 bp, Homo sapiens
ccttatcaagtgt

SEQ ID NO: 3142443 - DNA, 19 bp, Homo sapiens
ccttatcctacagtacaat

SEQ ID NO: 3142444 - DNA, 20 bp, Homo sapiens
ccttatctgtgcgtgaaaca

SEQ ID NO: 3142445 - DNA, 21 bp, Homo sapiens
ccttatctgtgcgtgaaacac

SEQ ID NO: 3142446 - DNA, 23 bp, Homo sapiens
ccttatgcccggcgccgggcacc

SEQ ID NO: 3142447 - DNA, 20 bp, Homo sapiens
ccttattggaaggtattttt

SEQ ID NO: 3142448 - DNA, 22 bp, Homo sapiens
ccttatttgctaatcaaagcca

SEQ ID NO: 3142449 - DNA, 18 bp, Homo sapiens
ccttattttcaagaaact

SEQ ID NO: 3142450 - DNA, 13 bp, Homo sapiens
ccttatttttagc

SEQ ID NO: 3142451 - DNA, 20 bp, Homo sapiens
ccttcaaaactatagcttgc

SEQ ID NO: 3142452 - DNA, 15 bp, Homo sapiens
ccttcaaagaaactt

SEQ ID NO: 3142453 - DNA, 13 bp, Homo sapiens
ccttcaactgaaa

SEQ ID NO: 3142454 - DNA, 19 bp, Homo sapiens
ccttcaagttagctcagga

SEQ ID NO: 3142455 - DNA, 14 bp, Homo sapiens
ccttcaattcctgg

SEQ ID NO: 3142456 - DNA, 15 bp, Homo sapiens
ccttcaattcctggg

SEQ ID NO: 3142457 - DNA, 20 bp, Homo sapiens
ccttcacaccccaggccctt

SEQ ID NO: 3142458 - DNA, 12 bp, Homo sapiens
ccttcacagtgt

SEQ ID NO: 3142459 - DNA, 17 bp, Homo sapiens
ccttcacctcggaggga

SEQ ID NO: 3142460 - DNA, 19 bp, Homo sapiens
ccttcacctcggagggatg

SEQ ID NO: 3142461 - DNA, 14 bp, Homo sapiens
ccttcactccggtg

SEQ ID NO: 3142462 - DNA, 23 bp, Homo sapiens
ccttcactccggtgtgcctgcag

SEQ ID NO: 3142463 - DNA, 15 bp, Homo sapiens
ccttcactgccatga

SEQ ID NO: 3142464 - DNA, 17 bp, Homo sapiens
ccttcactgttccctct

SEQ ID NO: 3142465 - DNA, 19 bp, Homo sapiens
ccttcactgttccctctgg

SEQ ID NO: 3142466 - DNA, 18 bp, Homo sapiens
ccttcagaaccatccata

SEQ ID NO: 3142467 - DNA, 19 bp, Homo sapiens
ccttcagaatgctcctgag

SEQ ID NO: 3142468 - DNA, 20 bp, Homo sapiens
ccttcagacaccctcaacct

SEQ ID NO: 3142469 - DNA, 17 bp, Homo sapiens
ccttcagaccccagttc

SEQ ID NO: 3142470 - DNA, 18 bp, Homo sapiens
ccttcagactttgcttcc

SEQ ID NO: 3142471 - DNA, 17 bp, Homo sapiens
ccttcagcccccagccc

SEQ ID NO: 3142472 - DNA, 23 bp, Homo sapiens
ccttcaggaactggggctttgcc

SEQ ID NO: 3142473 - DNA, 23 bp, Homo sapiens
ccttcaggaagcaggtgtccttt

SEQ ID NO: 3142474 - DNA, 18 bp, Homo sapiens
ccttcagttatgattttt

SEQ ID NO: 3142475 - DNA, 16 bp, Homo sapiens
ccttcatggccccagc

SEQ ID NO: 3142476 - DNA, 17 bp, Homo sapiens
ccttccaaaaattatta

SEQ ID NO: 3142477 - DNA, 18 bp, Homo sapiens
ccttccaaaaattattat

SEQ ID NO: 3142478 - DNA, 17 bp, Homo sapiens
ccttccacagttatctt

SEQ ID NO: 3142479 - DNA, 16 bp, Homo sapiens
ccttccacatgtacat

SEQ ID NO: 3142480 - DNA, 15 bp, Homo sapiens
ccttccactgcctct

SEQ ID NO: 3142481 - DNA, 16 bp, Homo sapiens
ccttccactgcctctg

SEQ ID NO: 3142482 - DNA, 17 bp, Homo sapiens
ccttccactgcctctgc

SEQ ID NO: 3142483 - DNA, 20 bp, Homo sapiens
ccttccactgcctctgcctt

SEQ ID NO: 3142484 - DNA, 22 bp, Homo sapiens
ccttccacttctaactccactg

SEQ ID NO: 3142485 - DNA, 13 bp, Homo sapiens
ccttccagatcac

SEQ ID NO: 3142486 - DNA, 20 bp, Homo sapiens
ccttccagatcactgccaca

SEQ ID NO: 3142487 - DNA, 22 bp, Homo sapiens
ccttccagtggctcgctccctg

SEQ ID NO: 3142488 - DNA, 14 bp, Homo sapiens
ccttccatacattt

SEQ ID NO: 3142489 - DNA, 12 bp, Homo sapiens
ccttccatccct

SEQ ID NO: 3142490 - DNA, 19 bp, Homo sapiens
ccttccatccctaccccct

SEQ ID NO: 3142491 - DNA, 17 bp, Homo sapiens
ccttccattttccccca

SEQ ID NO: 3142492 - DNA, 18 bp, Homo sapiens
ccttcccaatcagcactg

SEQ ID NO: 3142493 - DNA, 15 bp, Homo sapiens
ccttcccatcgctgt

SEQ ID NO: 3142494 - DNA, 15 bp, Homo sapiens
ccttcccatctcttc

SEQ ID NO: 3142495 - DNA, 15 bp, Homo sapiens
ccttcccatgcctgt

SEQ ID NO: 3142496 - DNA, 22 bp, Homo sapiens
ccttccccagctttgctgcctg

SEQ ID NO: 3142497 - DNA, 12 bp, Homo sapiens
ccttccccagga

SEQ ID NO: 3142498 - DNA, 21 bp, Homo sapiens
ccttccccaggatggactctt

SEQ ID NO: 3142499 - DNA, 17 bp, Homo sapiens
ccttccccaggcccacc

SEQ ID NO: 3142500 - DNA, 21 bp, Homo sapiens
ccttcccccaccggtccagct

SEQ ID NO: 3142501 - DNA, 16 bp, Homo sapiens
cctttctctttctctc

SEQ ID NO: 3142502 - DNA, 22 bp, Homo sapiens
cctttctctttctctcttccct

SEQ ID NO: 3142503 - DNA, 17 bp, Homo sapiens
cctttctgccgacccct

SEQ ID NO: 3142504 - DNA, 19 bp, Homo sapiens
cctttctgccttggcctcg

SEQ ID NO: 3142505 - DNA, 19 bp, Homo sapiens
cctttctggaagtttctgg

SEQ ID NO: 3142506 - DNA, 20 bp, Homo sapiens
cctttctggaagtttctggt

SEQ ID NO: 3142507 - DNA, 21 bp, Homo sapiens
cctttctggaagtttctggtg

SEQ ID NO: 3142508 - DNA, 12 bp, Homo sapiens
cctttctgtgcc

SEQ ID NO: 3142509 - DNA, 20 bp, Homo sapiens
cctttctgtgccctactcat

SEQ ID NO: 3142510 - DNA, 11 bp, Homo sapiens
cctttctgtgt

SEQ ID NO: 3142511 - DNA, 15 bp, Homo sapiens
cctttctttttcttc

SEQ ID NO: 3142512 - DNA, 23 bp, Homo sapiens
cctttctttttcttcttccctcc

SEQ ID NO: 3142513 - DNA, 20 bp, Homo sapiens
cctttgaagcctcagctacc

SEQ ID NO: 3142514 - DNA, 17 bp, Homo sapiens
cctttgagtgtcttcta

SEQ ID NO: 3142515 - DNA, 14 bp, Homo sapiens
cctttgcaccctgt

SEQ ID NO: 3142516 - DNA, 13 bp, Homo sapiens
cctttgcagggca

SEQ ID NO: 3142517 - DNA, 15 bp, Homo sapiens
cctttgcagggcagc

SEQ ID NO: 3142518 - DNA, 11 bp, Homo sapiens
cctttgcccct

SEQ ID NO: 3142519 - DNA, 13 bp, Homo sapiens
cctttgctcttgc

SEQ ID NO: 3142520 - DNA, 14 bp, Homo sapiens
cctttgctcttgcc

SEQ ID NO: 3142521 - DNA, 13 bp, Homo sapiens
cctttgctgtgag

SEQ ID NO: 3142522 - DNA, 17 bp, Homo sapiens
cctttgctgtgaggctg

SEQ ID NO: 3142523 - DNA, 21 bp, Homo sapiens
cctttggagaacgccagtctc

SEQ ID NO: 3142524 - DNA, 20 bp, Homo sapiens
cctttggagatgctgagggt

SEQ ID NO: 3142525 - DNA, 15 bp, Homo sapiens
cctttggccttggct

SEQ ID NO: 3142526 - DNA, 15 bp, Homo sapiens
cctttggctctggag

SEQ ID NO: 3142527 - DNA, 16 bp, Homo sapiens
cctttggctctggaga

SEQ ID NO: 3142528 - DNA, 16 bp, Homo sapiens
cctttgtaagacattt

SEQ ID NO: 3142529 - DNA, 15 bp, Homo sapiens
cctttgtaagttatt

SEQ ID NO: 3142530 - DNA, 23 bp, Homo sapiens
cctttgtcttgtacttctgtgtt

SEQ ID NO: 3142531 - DNA, 13 bp, Homo sapiens
cctttgtgctgtg

SEQ ID NO: 3142532 - DNA, 22 bp, Homo sapiens
cctttgtggttttatggagacc

SEQ ID NO: 3142533 - DNA, 19 bp, Homo sapiens
cctttgtgtgtactcactg

SEQ ID NO: 3142534 - DNA, 20 bp, Homo sapiens
cctttgtgtttatatggcgt

SEQ ID NO: 3142535 - DNA, 14 bp, Homo sapiens
cctttgtttcttgt

SEQ ID NO: 3142536 - DNA, 14 bp, Homo sapiens
ccttttaacatttt

SEQ ID NO: 3142537 - DNA, 15 bp, Homo sapiens
ccttttaacattttg

SEQ ID NO: 3142538 - DNA, 15 bp, Homo sapiens
ccttttaagacattt

SEQ ID NO: 3142539 - DNA, 16 bp, Homo sapiens
ccttttaatataaaag

SEQ ID NO: 3142540 - DNA, 21 bp, Homo sapiens
ccttttagcctagttcatcca

SEQ ID NO: 3142541 - DNA, 16 bp, Homo sapiens
ccttttatagctatta

SEQ ID NO: 3142542 - DNA, 14 bp, Homo sapiens
ccttttatctggtg

SEQ ID NO: 3142543 - DNA, 16 bp, Homo sapiens
ccttttatctggtgcc

SEQ ID NO: 3142544 - DNA, 13 bp, Homo sapiens
ccttttcagctga

SEQ ID NO: 3142545 - DNA, 12 bp, Homo sapiens
ccttttccatgc

SEQ ID NO: 3142546 - DNA, 15 bp, Homo sapiens
ccttttctattcctt

SEQ ID NO: 3142547 - DNA, 21 bp, Homo sapiens
ccttttctattccttctggcc

SEQ ID NO: 3142548 - DNA, 22 bp, Homo sapiens
ccttttctattccttctggcct

SEQ ID NO: 3142549 - DNA, 15 bp, Homo sapiens
ccttttcttcatttt

SEQ ID NO: 3142550 - DNA, 18 bp, Homo sapiens
ccttttcttttctaccct

SEQ ID NO: 3142551 - DNA, 13 bp, Homo sapiens
ccttttcttttgt

SEQ ID NO: 3142552 - DNA, 14 bp, Homo sapiens
ccttttcttttgtt

SEQ ID NO: 3142553 - DNA, 22 bp, Homo sapiens
ccttttcttttgttactgttct

SEQ ID NO: 3142554 - DNA, 16 bp, Homo sapiens
ccttttgaggagcccc

SEQ ID NO: 3142555 - DNA, 15 bp, Homo sapiens
ccttttgcacccctc

SEQ ID NO: 3142556 - DNA, 16 bp, Homo sapiens
ccttttgcacccctcc

SEQ ID NO: 3142557 - DNA, 17 bp, Homo sapiens
ccttttgcacccctccc

SEQ ID NO: 3142558 - DNA, 20 bp, Homo sapiens
ccttttgcacccctcccatt

SEQ ID NO: 3142559 - DNA, 19 bp, Homo sapiens
ccttttgcagaagagggtg

SEQ ID NO: 3142560 - DNA, 15 bp, Homo sapiens
ccttttgcctggctg

SEQ ID NO: 3142561 - DNA, 16 bp, Homo sapiens
ccttttgcctggctgt

SEQ ID NO: 3142562 - DNA, 11 bp, Homo sapiens
ccttttggaac

SEQ ID NO: 3142563 - DNA, 17 bp, Homo sapiens
ccttttggaacatttct

SEQ ID NO: 3142564 - DNA, 22 bp, Homo sapiens
ccttttggaacatttctttctt

SEQ ID NO: 3142565 - DNA, 19 bp, Homo sapiens
ccttttgtaccatggtgtg

SEQ ID NO: 3142566 - DNA, 19 bp, Homo sapiens
ccttttgtatacatcctgg

SEQ ID NO: 3142567 - DNA, 18 bp, Homo sapiens
ccttttgtatcttccttt

SEQ ID NO: 3142568 - DNA, 19 bp, Homo sapiens
ccttttgtatcttcctttc

SEQ ID NO: 3142569 - DNA, 17 bp, Homo sapiens
ccttttgtccccagggc

SEQ ID NO: 3142570 - DNA, 21 bp, Homo sapiens
ccttttgtccccagggcccct

SEQ ID NO: 3142571 - DNA, 19 bp, Homo sapiens
ccttttgttgagccaggcc

SEQ ID NO: 3142572 - DNA, 21 bp, Homo sapiens
cctttttaaatgtgaattttt

SEQ ID NO: 3142573 - DNA, 20 bp, Homo sapiens
cctttttctttataaacttt

SEQ ID NO: 3142574 - DNA, 19 bp, Homo sapiens
cctttttgtataaaataga

SEQ ID NO: 3142575 - DNA, 18 bp, Homo sapiens
ccttttttaagatttttc

SEQ ID NO: 3142576 - DNA, 21 bp, Homo sapiens
ccttttttaagatttttctca

SEQ ID NO: 3142577 - DNA, 21 bp, Homo sapiens
ccttttttcaatatgcaagca

SEQ ID NO: 3142578 - DNA, 11 bp, Homo sapiens
ccttttttcct

SEQ ID NO: 3142579 - DNA, 21 bp, Homo sapiens
ccttttttgtcattttatgaa

SEQ ID NO: 3142580 - DNA, 16 bp, Homo sapiens
ccttttttgtctatga

SEQ ID NO: 3142581 - DNA, 14 bp, Homo sapiens
ccttttttgtctta

SEQ ID NO: 3142582 - DNA, 16 bp, Homo sapiens
cctttttttttgaaac

SEQ ID NO: 3142583 - DNA, 23 bp, Homo sapiens
cgaaacacaaaccacaactgaca

SEQ ID NO: 3142584 - DNA, 22 bp, Homo sapiens
cgaaacaggctactctcctcgg

SEQ ID NO: 3142585 - DNA, 18 bp, Homo sapiens
cgaaacctgggattcagg

SEQ ID NO: 3142586 - DNA, 17 bp, Homo sapiens
cgaaacttgttattgtg

SEQ ID NO: 3142587 - DNA, 18 bp, Homo sapiens
cgaaagctctagaatctg

SEQ ID NO: 3142588 - DNA, 19 bp, Homo sapiens
cgaaagggacttggaagct

SEQ ID NO: 3142589 - DNA, 23 bp, Homo sapiens
cgaaagggacttggaagctccgc

SEQ ID NO: 3142590 - DNA, 11 bp, Homo sapiens
cgaaatgccac

SEQ ID NO: 3142591 - DNA, 21 bp, Homo sapiens
cgaacaccctcgaagcgcgcc

SEQ ID NO: 3142592 - DNA, 14 bp, Homo sapiens
cgaaccacccaaaa

SEQ ID NO: 3142593 - DNA, 15 bp, Homo sapiens
cgaacgctcttagct

SEQ ID NO: 3142594 - DNA, 13 bp, Homo sapiens
cgaagacacagac

SEQ ID NO: 3142595 - DNA, 21 bp, Homo sapiens
cgaagagggaatggatgggga

SEQ ID NO: 3142596 - DNA, 23 bp, Homo sapiens
cgaagagggaatggatggggaga

SEQ ID NO: 3142597 - DNA, 15 bp, Homo sapiens
cgaagctgcaggggc

SEQ ID NO: 3142598 - DNA, 21 bp, Homo sapiens
cgaaggggccccggggctggc

SEQ ID NO: 3142599 - DNA, 22 bp, Homo sapiens
cgaaggggccccggggctggca

SEQ ID NO: 3142600 - DNA, 15 bp, Homo sapiens
cgaagtagcttgctc

SEQ ID NO: 3142601 - DNA, 20 bp, Homo sapiens
cgaagtctttgccttctctg

SEQ ID NO: 3142602 - DNA, 13 bp, Homo sapiens
cgaatagctggga

SEQ ID NO: 3142603 - DNA, 15 bp, Homo sapiens
cgaatagctgggact

SEQ ID NO: 3142604 - DNA, 18 bp, Homo sapiens
cgaatcagctatttactg

SEQ ID NO: 3142605 - DNA, 17 bp, Homo sapiens
cgaatctactaattcca

SEQ ID NO: 3142606 - DNA, 19 bp, Homo sapiens
cgaatggggtagaaacatt

SEQ ID NO: 3142607 - DNA, 23 bp, Homo sapiens
cgaatggggtagaaacattgtaa

SEQ ID NO: 3142608 - DNA, 16 bp, Homo sapiens
cgaattaatagctttt

SEQ ID NO: 3142609 - DNA, 13 bp, Homo sapiens
cgacaaagctgct

SEQ ID NO: 3142610 - DNA, 17 bp, Homo sapiens
cgacaaagctgctaaat

SEQ ID NO: 3142611 - DNA, 22 bp, Homo sapiens
cgacaatgtcgagtatattatt

SEQ ID NO: 3142612 - DNA, 23 bp, Homo sapiens
cgacaatgtcgagtatattatta

SEQ ID NO: 3142613 - DNA, 15 bp, Homo sapiens
cgacagagagagggg

SEQ ID NO: 3142614 - DNA, 14 bp, Homo sapiens
cgacagcgcccctg

SEQ ID NO: 3142615 - DNA, 19 bp, Homo sapiens
cgacatcccagaccagcca

SEQ ID NO: 3142616 - DNA, 14 bp, Homo sapiens
cgaccacctgccca

SEQ ID NO: 3142617 - DNA, 13 bp, Homo sapiens
cgaccctcatggc

SEQ ID NO: 3142618 - DNA, 14 bp, Homo sapiens
cgaccctcatggcc

SEQ ID NO: 3142619 - DNA, 19 bp, Homo sapiens
cgaccctcatggcccccag

SEQ ID NO: 3142620 - DNA, 22 bp, Homo sapiens
cgaccctcatggcccccagggg

SEQ ID NO: 3142621 - DNA, 16 bp, Homo sapiens
cgaccctctgggaacc

SEQ ID NO: 3142622 - DNA, 22 bp, Homo sapiens
cgaccctctgggaacctcccag

SEQ ID NO: 3142623 - DNA, 13 bp, Homo sapiens
cgacgtggtgacg

SEQ ID NO: 3142624 - DNA, 14 bp, Homo sapiens
cgactaatttcaaa

SEQ ID NO: 3142625 - DNA, 19 bp, Homo sapiens
cgactccgttggccactcc

SEQ ID NO: 3142626 - DNA, 19 bp, Homo sapiens
cgactctaagctgtgtgca

SEQ ID NO: 3142627 - DNA, 20 bp, Homo sapiens
cgcggcctcccgaggagggg

SEQ ID NO: 3142628 - DNA, 22 bp, Homo sapiens
cgcggcctcccgaggaggggcc

SEQ ID NO: 3142629 - DNA, 23 bp, Homo sapiens
cgcgggagccatgcgccccctcc

SEQ ID NO: 3142630 - DNA, 15 bp, Homo sapiens
cgcgggaggcaccag

SEQ ID NO: 3142631 - DNA, 15 bp, Homo sapiens
cgcgggcagcgggcc

SEQ ID NO: 3142632 - DNA, 22 bp, Homo sapiens
cgcggtgccatgtctgcagtgt

SEQ ID NO: 3142633 - DNA, 14 bp, Homo sapiens
cgcggtgctctggc

SEQ ID NO: 3142634 - DNA, 12 bp, Homo sapiens
cgcgtcttcctg

SEQ ID NO: 3142635 - DNA, 13 bp, Homo sapiens
cgcgtcttcctga

SEQ ID NO: 3142636 - DNA, 16 bp, Homo sapiens
cgcgtcttcctgagtg

SEQ ID NO: 3142637 - DNA, 19 bp, Homo sapiens
cgcgtgcacacaccagagc

SEQ ID NO: 3142638 - DNA, 20 bp, Homo sapiens
cgcgtgcacacaccagagcc

SEQ ID NO: 3142639 - DNA, 22 bp, Homo sapiens
cgctaaagagcccttgcctccc

SEQ ID NO: 3142640 - DNA, 12 bp, Homo sapiens
cgctaaggaaga

SEQ ID NO: 3142641 - DNA, 14 bp, Homo sapiens
cgctacctccctcc

SEQ ID NO: 3142642 - DNA, 15 bp, Homo sapiens
cgctacctctctgtc

SEQ ID NO: 3142643 - DNA, 16 bp, Homo sapiens
cgctactataaagaga

SEQ ID NO: 3142644 - DNA, 17 bp, Homo sapiens
cgctactataaagagaa

SEQ ID NO: 3142645 - DNA, 15 bp, Homo sapiens
cgctaggagagactg

SEQ ID NO: 3142646 - DNA, 13 bp, Homo sapiens
cgctattacaaat

SEQ ID NO: 3142647 - DNA, 18 bp, Homo sapiens
cgctcacctagagccaga

SEQ ID NO: 3142648 - DNA, 18 bp, Homo sapiens
cgctcagacggcggccag

SEQ ID NO: 3142649 - DNA, 22 bp, Homo sapiens
cgctcagacggcggccaggcac

SEQ ID NO: 3142650 - DNA, 14 bp, Homo sapiens
cgctcaggacccag

SEQ ID NO: 3142651 - DNA, 16 bp, Homo sapiens
cgctcaggacccaggc

SEQ ID NO: 3142652 - DNA, 22 bp, Homo sapiens
cgctcaggcctaggaggccccc

SEQ ID NO: 3142653 - DNA, 15 bp, Homo sapiens
cgctcagtaaacggg

SEQ ID NO: 3142654 - DNA, 18 bp, Homo sapiens
cgctcccaacccccctcc

SEQ ID NO: 3142655 - DNA, 13 bp, Homo sapiens
cgctcccaccgcc

SEQ ID NO: 3142656 - DNA, 14 bp, Homo sapiens
cgctcccaccgccc

SEQ ID NO: 3142657 - DNA, 16 bp, Homo sapiens
cgctcccaccgccccc

SEQ ID NO: 3142658 - DNA, 14 bp, Homo sapiens
cgctcccagcctgc

SEQ ID NO: 3142659 - DNA, 15 bp, Homo sapiens
cgctcccagcctgcc

SEQ ID NO: 3142660 - DNA, 23 bp, Homo sapiens
cgctcccaggttcccccagcaag

SEQ ID NO: 3142661 - DNA, 18 bp, Homo sapiens
cgctccccgcctgttccc

SEQ ID NO: 3142662 - DNA, 19 bp, Homo sapiens
cgctccccgcctgttcccc

SEQ ID NO: 3142663 - DNA, 20 bp, Homo sapiens
cgctccctgtagctctgcct

SEQ ID NO: 3142664 - DNA, 22 bp, Homo sapiens
cgctcctgccgcagacgggcac

SEQ ID NO: 3142665 - DNA, 23 bp, Homo sapiens
cgctcctgccgcagacgggcaca

SEQ ID NO: 3142666 - DNA, 18 bp, Homo sapiens
cgctcgcccagcaggaga

SEQ ID NO: 3142667 - DNA, 20 bp, Homo sapiens
cgctcgcccagcaggagaga

SEQ ID NO: 3142668 - DNA, 13 bp, Homo sapiens
cgctcgcgggcag

SEQ ID NO: 3142669 - DNA, 14 bp, Homo sapiens
cgctcgcgggcagc

SEQ ID NO: 3142670 - DNA, 23 bp, Homo sapiens
cgctcgcgggcagcgggccaggc

SEQ ID NO: 3142671 - DNA, 14 bp, Homo sapiens
cgctcgctgccatc

SEQ ID NO: 3142672 - DNA, 19 bp, Homo sapiens
cgctcggaggccccaaagg

SEQ ID NO: 3142673 - DNA, 13 bp, Homo sapiens
cgctcggcaggaa

SEQ ID NO: 3142674 - DNA, 15 bp, Homo sapiens
cgctcgtgtgttcta

SEQ ID NO: 3142675 - DNA, 14 bp, Homo sapiens
cgctctcagttctc

SEQ ID NO: 3142676 - DNA, 18 bp, Homo sapiens
cgctctctggccttcggc

SEQ ID NO: 3142677 - DNA, 13 bp, Homo sapiens
cgctctcttttct

SEQ ID NO: 3142678 - DNA, 16 bp, Homo sapiens
cgctctgctggcctgg

SEQ ID NO: 3142679 - DNA, 20 bp, Homo sapiens
cgctctgctggcctggccgg

SEQ ID NO: 3142680 - DNA, 24 bp, Homo sapiens
cgctcttcgcgcccgcccctgcag

SEQ ID NO: 3142681 - DNA, 16 bp, Homo sapiens
cgctgacttcatggaa

SEQ ID NO: 3142682 - DNA, 17 bp, Homo sapiens
cgctgagctgagtggcc

SEQ ID NO: 3142683 - DNA, 13 bp, Homo sapiens
cgctgagtggcag

SEQ ID NO: 3142684 - DNA, 14 bp, Homo sapiens
cgctgagtggcagg

SEQ ID NO: 3142685 - DNA, 20 bp, Homo sapiens
cgctgagtggcaggggacag

SEQ ID NO: 3142686 - DNA, 20 bp, Homo sapiens
cgctgatacataactaaatt

SEQ ID NO: 3142687 - DNA, 15 bp, Homo sapiens
cgctgattcctcgtg

SEQ ID NO: 3142688 - DNA, 19 bp, Homo sapiens
cgctgcacttgacaccaac

SEQ ID NO: 3142689 - DNA, 21 bp, Homo sapiens
cgctgcacttgacaccaacca

SEQ ID NO: 3142690 - DNA, 21 bp, Homo sapiens
cgctgccaccacgtctgccag

SEQ ID NO: 3142691 - DNA, 23 bp, Homo sapiens
cgctgccaccacgtctgccaggc

SEQ ID NO: 3142692 - DNA, 21 bp, Homo sapiens
cgctgccagccttgagccctg

SEQ ID NO: 3142693 - DNA, 23 bp, Homo sapiens
cgctgccagccttgagccctggc

SEQ ID NO: 3142694 - DNA, 18 bp, Homo sapiens
cgctgccgctgcaccacg

SEQ ID NO: 3142695 - DNA, 14 bp, Homo sapiens
cgctgccttttgtt

SEQ ID NO: 3142696 - DNA, 15 bp, Homo sapiens
cgctgctccttggct

SEQ ID NO: 3142697 - DNA, 17 bp, Homo sapiens
cgctgctctagctggca

SEQ ID NO: 3142698 - DNA, 18 bp, Homo sapiens
cgctgctctagctggcag

SEQ ID NO: 3142699 - DNA, 19 bp, Homo sapiens
cgctgctctagctggcagg

SEQ ID NO: 3142700 - DNA, 14 bp, Homo sapiens
cgctgcttccagga

SEQ ID NO: 3142701 - DNA, 23 bp, Homo sapiens
cgctggaccttgaactgggtact

SEQ ID NO: 3142702 - DNA, 13 bp, Homo sapiens
cgctggcccagcc

SEQ ID NO: 3142703 - DNA, 24 bp, Homo sapiens
cgctggcccagccggcctctctgg

SEQ ID NO: 3142704 - DNA, 22 bp, Homo sapiens
cgctggctttgggaaagcccag

SEQ ID NO: 3142705 - DNA, 22 bp, Homo sapiens
cgctgggatttcttcgctgctc

SEQ ID NO: 3142706 - DNA, 20 bp, Homo sapiens
cgctggggctctctgagact

SEQ ID NO: 3142707 - DNA, 22 bp, Homo sapiens
cgctgggtggttttttccccct

SEQ ID NO: 3142708 - DNA, 14 bp, Homo sapiens
cgctgtcactggct

SEQ ID NO: 3142709 - DNA, 23 bp, Homo sapiens
cgctgtcctctcgagcccagatg

SEQ ID NO: 3142710 - DNA, 16 bp, Homo sapiens
cgctgtcgccccaggc

SEQ ID NO: 3142711 - DNA, 18 bp, Homo sapiens
cgctgtcgccccaggccc

SEQ ID NO: 3142712 - DNA, 23 bp, Homo sapiens
cgctgtcgccccaggccctccct

SEQ ID NO: 3142713 - DNA, 18 bp, Homo sapiens
cgcttccctcctgcccgc

SEQ ID NO: 3142714 - DNA, 17 bp, Homo sapiens
cgcttctgaatgctgct

SEQ ID NO: 3142715 - DNA, 14 bp, Homo sapiens
cgcttctgcctgca

SEQ ID NO: 3142716 - DNA, 18 bp, Homo sapiens
cgcttcttgcctctgtgc

SEQ ID NO: 3142717 - DNA, 12 bp, Homo sapiens
cgcttggctcca

SEQ ID NO: 3142718 - DNA, 21 bp, Homo sapiens
cgcttggctccatgctcctca

SEQ ID NO: 3142719 - DNA, 19 bp, Homo sapiens
cgcttgtagaactcactct

SEQ ID NO: 3142720 - DNA, 21 bp, Homo sapiens
cgcttgtagaactcactctgg

SEQ ID NO: 3142721 - DNA, 23 bp, Homo sapiens
cgcttgtagaactcactctgggc

SEQ ID NO: 3142722 - DNA, 20 bp, Homo sapiens
cgcttgtggggacccaggct

SEQ ID NO: 3142723 - DNA, 21 bp, Homo sapiens
cgcttgtggggacccaggctc

SEQ ID NO: 3142724 - DNA, 14 bp, Homo sapiens
cgctttctacccag

SEQ ID NO: 3142725 - DNA, 16 bp, Homo sapiens
cgctttctagctgttg

SEQ ID NO: 3142726 - DNA, 16 bp, Homo sapiens
cgcttttgttcttccc

SEQ ID NO: 3142727 - DNA, 16 bp, Homo sapiens
cggaaccacagggcca

SEQ ID NO: 3142728 - DNA, 19 bp, Homo sapiens
cggaaccacagggccagag

SEQ ID NO: 3142729 - DNA, 16 bp, Homo sapiens
cggaacgttggacttt

SEQ ID NO: 3142730 - DNA, 21 bp, Homo sapiens
cggaagccgtctgactccaga

SEQ ID NO: 3142731 - DNA, 20 bp, Homo sapiens
cggaagtacttccctcaggc

SEQ ID NO: 3142732 - DNA, 20 bp, Homo sapiens
cggaatgaaccacatcttgc

SEQ ID NO: 3142733 - DNA, 16 bp, Homo sapiens
cggacaagacccccag

SEQ ID NO: 3142734 - DNA, 20 bp, Homo sapiens
cggacaataaacctccgcca

SEQ ID NO: 3142735 - DNA, 22 bp, Homo sapiens
cggacaataaacctccgccaat

SEQ ID NO: 3142736 - DNA, 15 bp, Homo sapiens
cggacagccacggcc

SEQ ID NO: 3142737 - DNA, 17 bp, Homo sapiens
cggacagtcggaaaagc

SEQ ID NO: 3142738 - DNA, 16 bp, Homo sapiens
cggacatactctctgc

SEQ ID NO: 3142739 - DNA, 17 bp, Homo sapiens
cggacatactctctgcc

SEQ ID NO: 3142740 - DNA, 21 bp, Homo sapiens
cggacatgcttttctgccact

SEQ ID NO: 3142741 - DNA, 17 bp, Homo sapiens
cggaccactcgaggcct

SEQ ID NO: 3142742 - DNA, 12 bp, Homo sapiens
cggaccccagct

SEQ ID NO: 3142743 - DNA, 22 bp, Homo sapiens
cggaccgcttgtggggacccag

SEQ ID NO: 3142744 - DNA, 18 bp, Homo sapiens
cggacgtttccatcaggt

SEQ ID NO: 3142745 - DNA, 15 bp, Homo sapiens
cggactcccgggcca

SEQ ID NO: 3142746 - DNA, 17 bp, Homo sapiens
cggactcccgggccacg

SEQ ID NO: 3142747 - DNA, 18 bp, Homo sapiens
cggactcccgggccacgc

SEQ ID NO: 3142748 - DNA, 22 bp, Homo sapiens
cggactcccgggccacgcccca

SEQ ID NO: 3142749 - DNA, 15 bp, Homo sapiens
cggacttttctgcaa

SEQ ID NO: 3142750 - DNA, 18 bp, Homo sapiens
cggagactatggcctcgc

SEQ ID NO: 3142751 - DNA, 19 bp, Homo sapiens
cggagactatggcctcgcc

SEQ ID NO: 3142752 - DNA, 13 bp, Homo sapiens
cggtggctgcccc

SEQ ID NO: 3142753 - DNA, 14 bp, Homo sapiens
cggtggctgccccg

SEQ ID NO: 3142754 - DNA, 19 bp, Homo sapiens
cggtgggcatttgtgaggc

SEQ ID NO: 3142755 - DNA, 14 bp, Homo sapiens
cggtggtgcccgtg

SEQ ID NO: 3142756 - DNA, 20 bp, Homo sapiens
cggtggtgcccgtgcccgca

SEQ ID NO: 3142757 - DNA, 22 bp, Homo sapiens
cggtggtgcccgtgcccgcagg

SEQ ID NO: 3142758 - DNA, 24 bp, Homo sapiens
cggtgtcgccgcctgctccctgca

SEQ ID NO: 3142759 - DNA, 16 bp, Homo sapiens
cggtgtgggctgtgtc

SEQ ID NO: 3142760 - DNA, 13 bp, Homo sapiens
cggtgttctaaga

SEQ ID NO: 3142761 - DNA, 14 bp, Homo sapiens
cggttaaattccat

SEQ ID NO: 3142762 - DNA, 18 bp, Homo sapiens
cggttataaaaaatggtt

SEQ ID NO: 3142763 - DNA, 20 bp, Homo sapiens
cggttataaaaaatggttca

SEQ ID NO: 3142764 - DNA, 16 bp, Homo sapiens
cggttcagacccctgc

SEQ ID NO: 3142765 - DNA, 19 bp, Homo sapiens
cggttccacgtccccctgg

SEQ ID NO: 3142766 - DNA, 20 bp, Homo sapiens
cggttccacgtccccctggg

SEQ ID NO: 3142767 - DNA, 18 bp, Homo sapiens
cggttcctggtgactcct

SEQ ID NO: 3142768 - DNA, 19 bp, Homo sapiens
cggttctccagaatgtaag

SEQ ID NO: 3142769 - DNA, 21 bp, Homo sapiens
cggtttaaccacattaattaa

SEQ ID NO: 3142770 - DNA, 13 bp, Homo sapiens
cggtttcctgaat

SEQ ID NO: 3142771 - DNA, 19 bp, Homo sapiens
cggtttctttttaagtaat

SEQ ID NO: 3142772 - DNA, 20 bp, Homo sapiens
cggtttgccatgttgccaga

SEQ ID NO: 3142773 - DNA, 21 bp, Homo sapiens
cggtttggggagcagagacac

SEQ ID NO: 3142774 - DNA, 24 bp, Homo sapiens
cgtaagatacaagtttcagacagg

SEQ ID NO: 3142775 - DNA, 14 bp, Homo sapiens
cgtaataattatta

SEQ ID NO: 3142776 - DNA, 13 bp, Homo sapiens
cgtaatgggcctg

SEQ ID NO: 3142777 - DNA, 14 bp, Homo sapiens
cgtaatgggcctgc

SEQ ID NO: 3142778 - DNA, 17 bp, Homo sapiens
cgtaatgggcctgccca

SEQ ID NO: 3142779 - DNA, 16 bp, Homo sapiens
cgtaattttgccaaat

SEQ ID NO: 3142780 - DNA, 14 bp, Homo sapiens
cgtacatctgcaat

SEQ ID NO: 3142781 - DNA, 19 bp, Homo sapiens
cgtaccccactgggccagc

SEQ ID NO: 3142782 - DNA, 22 bp, Homo sapiens
cgtactaggttggacagccccc

SEQ ID NO: 3142783 - DNA, 14 bp, Homo sapiens
cgtactctcacatg

SEQ ID NO: 3142784 - DNA, 17 bp, Homo sapiens
cgtactctcacatgtgg

SEQ ID NO: 3142785 - DNA, 20 bp, Homo sapiens
cgtagccaaggtgggctgag

SEQ ID NO: 3142786 - DNA, 17 bp, Homo sapiens
cgtaggggaggggttgc

SEQ ID NO: 3142787 - DNA, 15 bp, Homo sapiens
cgtagtctcctgggt

SEQ ID NO: 3142788 - DNA, 13 bp, Homo sapiens
cgtataatcttgt

SEQ ID NO: 3142789 - DNA, 16 bp, Homo sapiens
cgtatcccgagtctgg

SEQ ID NO: 3142790 - DNA, 22 bp, Homo sapiens
cgtatgatcagtactgactttc

SEQ ID NO: 3142791 - DNA, 17 bp, Homo sapiens
cgtatgcaagtctgtga

SEQ ID NO: 3142792 - DNA, 18 bp, Homo sapiens
cgtatgcaagtctgtgag

SEQ ID NO: 3142793 - DNA, 16 bp, Homo sapiens
cgtatttatatttgga

SEQ ID NO: 3142794 - DNA, 21 bp, Homo sapiens
cgtatttatatttggaaagag

SEQ ID NO: 3142795 - DNA, 15 bp, Homo sapiens
cgtcacactcttcag

SEQ ID NO: 3142796 - DNA, 20 bp, Homo sapiens
cgtcagggttggtgtgctga

SEQ ID NO: 3142797 - DNA, 19 bp, Homo sapiens
cgtcatggcttaatgttta

SEQ ID NO: 3142798 - DNA, 14 bp, Homo sapiens
cgtccacaggggca

SEQ ID NO: 3142799 - DNA, 19 bp, Homo sapiens
cgtccacaggggcaggcct

SEQ ID NO: 3142800 - DNA, 21 bp, Homo sapiens
cgtccacaggggcaggcctgg

SEQ ID NO: 3142801 - DNA, 23 bp, Homo sapiens
cgtccacaggggcaggcctggga

SEQ ID NO: 3142802 - DNA, 13 bp, Homo sapiens
cgtccacccaggc

SEQ ID NO: 3142803 - DNA, 15 bp, Homo sapiens
cgtccacccaggctg

SEQ ID NO: 3142804 - DNA, 19 bp, Homo sapiens
cgtccaggagcctgtgcct

SEQ ID NO: 3142805 - DNA, 14 bp, Homo sapiens
cgtccatagctcct

SEQ ID NO: 3142806 - DNA, 13 bp, Homo sapiens
cgtccatctccct

SEQ ID NO: 3142807 - DNA, 19 bp, Homo sapiens
cgtcccagcatccctggag

SEQ ID NO: 3142808 - DNA, 19 bp, Homo sapiens
cgtcccagctgaaggcagt

SEQ ID NO: 3142809 - DNA, 23 bp, Homo sapiens
cgtcccagggtacccgcctgagc

SEQ ID NO: 3142810 - DNA, 14 bp, Homo sapiens
cgtccccactccct

SEQ ID NO: 3142811 - DNA, 22 bp, Homo sapiens
cgtcctatctcccccaacccac

SEQ ID NO: 3142812 - DNA, 17 bp, Homo sapiens
cgtcctcacccctgtcc

SEQ ID NO: 3142813 - DNA, 21 bp, Homo sapiens
cgtcctgcagaggaccacagt

SEQ ID NO: 3142814 - DNA, 18 bp, Homo sapiens
cgtcctttgggtgactcg

SEQ ID NO: 3142815 - DNA, 16 bp, Homo sapiens
cgtcgaggggctctca

SEQ ID NO: 3142816 - DNA, 21 bp, Homo sapiens
cgtcgtctccctcgacagcgc

SEQ ID NO: 3142817 - DNA, 16 bp, Homo sapiens
cgtctcagaatctaaa

SEQ ID NO: 3142818 - DNA, 20 bp, Homo sapiens
cgtctccaggggctgcttcc

SEQ ID NO: 3142819 - DNA, 14 bp, Homo sapiens
cgtctccctcgaca

SEQ ID NO: 3142820 - DNA, 23 bp, Homo sapiens
cgtctgactccagagtctgagcc

SEQ ID NO: 3142821 - DNA, 12 bp, Homo sapiens
cgtctgccaggc

SEQ ID NO: 3142822 - DNA, 15 bp, Homo sapiens
cgtctggaagtccaa

SEQ ID NO: 3142823 - DNA, 20 bp, Homo sapiens
cgtctggaggggcccctgct

SEQ ID NO: 3142824 - DNA, 17 bp, Homo sapiens
cgtctggcccaccaggg

SEQ ID NO: 3142825 - DNA, 17 bp, Homo sapiens
cgtcttctccctattcc

SEQ ID NO: 3142826 - DNA, 13 bp, Homo sapiens
cgtctttaagaga

SEQ ID NO: 3142827 - DNA, 20 bp, Homo sapiens
cgtgaaacacaccaggctgt

SEQ ID NO: 3142828 - DNA, 12 bp, Homo sapiens
cgtgaactgtgc

SEQ ID NO: 3142829 - DNA, 13 bp, Homo sapiens
cgtgaagcagtgc

SEQ ID NO: 3142830 - DNA, 15 bp, Homo sapiens
cgtgaagcagtgcct

SEQ ID NO: 3142831 - DNA, 22 bp, Homo sapiens
cgtgaatagtcttttgcatgtc

SEQ ID NO: 3142832 - DNA, 22 bp, Homo sapiens
cgtgaatatcgagaactgccat

SEQ ID NO: 3142833 - DNA, 12 bp, Homo sapiens
cgtgacaacact

SEQ ID NO: 3142834 - DNA, 17 bp, Homo sapiens
cgtgacagtgcctggga

SEQ ID NO: 3142835 - DNA, 17 bp, Homo sapiens
cgtgacccttcagggcc

SEQ ID NO: 3142836 - DNA, 13 bp, Homo sapiens
cgtgacctattca

SEQ ID NO: 3142837 - DNA, 12 bp, Homo sapiens
cgtgagaagcat

SEQ ID NO: 3142838 - DNA, 17 bp, Homo sapiens
cgtgagagaaagagaga

SEQ ID NO: 3142839 - DNA, 20 bp, Homo sapiens
cgtgagagaaagagagaagc

SEQ ID NO: 3142840 - DNA, 21 bp, Homo sapiens
cgtgagagaaagagagaagcc

SEQ ID NO: 3142841 - DNA, 21 bp, Homo sapiens
cgtgagcaggaaggcctgggt

SEQ ID NO: 3142842 - DNA, 15 bp, Homo sapiens
cgtgagccactgcac

SEQ ID NO: 3142843 - DNA, 22 bp, Homo sapiens
cgtgagccactgcaccgggcca

SEQ ID NO: 3142844 - DNA, 22 bp, Homo sapiens
cgtgagctatgattatgccact

SEQ ID NO: 3142845 - DNA, 18 bp, Homo sapiens
cgtgagctggggactcag

SEQ ID NO: 3142846 - DNA, 12 bp, Homo sapiens
cgtgaggggcaa

SEQ ID NO: 3142847 - DNA, 22 bp, Homo sapiens
cgtgaggggcaagctaggcccc

SEQ ID NO: 3142848 - DNA, 15 bp, Homo sapiens
cgtgagttctcaggg

SEQ ID NO: 3142849 - DNA, 21 bp, Homo sapiens
cgtgatccatccatctccagg

SEQ ID NO: 3142850 - DNA, 15 bp, Homo sapiens
cgtgatctcccctca

SEQ ID NO: 3142851 - DNA, 13 bp, Homo sapiens
cgtgatcttggct

SEQ ID NO: 3142852 - DNA, 17 bp, Homo sapiens
cgtgatggagaggacag

SEQ ID NO: 3142853 - DNA, 18 bp, Homo sapiens
cgtgatggagaggacaga

SEQ ID NO: 3142854 - DNA, 21 bp, Homo sapiens
cgtgcacacaccagagcccac

SEQ ID NO: 3142855 - DNA, 22 bp, Homo sapiens
cgtgcacgtggagagctggtgc

SEQ ID NO: 3142856 - DNA, 13 bp, Homo sapiens
cgtgcactctgct

SEQ ID NO: 3142857 - DNA, 14 bp, Homo sapiens
cgtgcactctgcta

SEQ ID NO: 3142858 - DNA, 18 bp, Homo sapiens
cgtgcactctgctaatca

SEQ ID NO: 3142859 - DNA, 16 bp, Homo sapiens
cgtgcagagctgcact

SEQ ID NO: 3142860 - DNA, 19 bp, Homo sapiens
cgtgcagagctgcacttgg

SEQ ID NO: 3142861 - DNA, 22 bp, Homo sapiens
cgtgcagagctgcacttggcct

SEQ ID NO: 3142862 - DNA, 21 bp, Homo sapiens
cgtgcagtggtgcgatctggg

SEQ ID NO: 3142863 - DNA, 17 bp, Homo sapiens
cgtgcatccctgagaca

SEQ ID NO: 3142864 - DNA, 19 bp, Homo sapiens
cgtgcattagcacagattt

SEQ ID NO: 3142865 - DNA, 21 bp, Homo sapiens
cgtgcattagcacagatttta

SEQ ID NO: 3142866 - DNA, 16 bp, Homo sapiens
cgtgccagctctagtt

SEQ ID NO: 3142867 - DNA, 19 bp, Homo sapiens
cgtgcccccgcctgccacc

SEQ ID NO: 3142868 - DNA, 22 bp, Homo sapiens
cgtgccgtgtgagtgtgacagg

SEQ ID NO: 3142869 - DNA, 13 bp, Homo sapiens
cgtgcctccacca

SEQ ID NO: 3142870 - DNA, 18 bp, Homo sapiens
cgtgcctccaccaccact

SEQ ID NO: 3142871 - DNA, 22 bp, Homo sapiens
cgtgcctccaccaccactggcc

SEQ ID NO: 3142872 - DNA, 15 bp, Homo sapiens
cgtgcctgtgtccat

SEQ ID NO: 3142873 - DNA, 18 bp, Homo sapiens
cgtgccttcagctctaca

SEQ ID NO: 3142874 - DNA, 16 bp, Homo sapiens
cgtgccttttgcaccc

SEQ ID NO: 3142875 - DNA, 21 bp, Homo sapiens
cgtgccttttgcacccctccc

SEQ ID NO: 3142876 - DNA, 15 bp, Homo sapiens
cgtgctactgcactc

SEQ ID NO: 3142877 - DNA, 18 bp, Homo sapiens
ctaagatgtgatattcta

SEQ ID NO: 3142878 - DNA, 17 bp, Homo sapiens
ctaagatgttcactgtg

SEQ ID NO: 3142879 - DNA, 19 bp, Homo sapiens
ctaagattacaaatcagaa

SEQ ID NO: 3142880 - DNA, 14 bp, Homo sapiens
ctaagattctaaag

SEQ ID NO: 3142881 - DNA, 16 bp, Homo sapiens
ctaagattctaaaggt

SEQ ID NO: 3142882 - DNA, 15 bp, Homo sapiens
ctaagattctaatga

SEQ ID NO: 3142883 - DNA, 14 bp, Homo sapiens
ctaagattctttta

SEQ ID NO: 3142884 - DNA, 12 bp, Homo sapiens
ctaagcaatttc

SEQ ID NO: 3142885 - DNA, 15 bp, Homo sapiens
ctaagcaatttcttg

SEQ ID NO: 3142886 - DNA, 13 bp, Homo sapiens
ctaagcatctaag

SEQ ID NO: 3142887 - DNA, 15 bp, Homo sapiens
ctaagcatctaagtt

SEQ ID NO: 3142888 - DNA, 24 bp, Homo sapiens
ctaagcatgtgtcccaggagcagg

SEQ ID NO: 3142889 - DNA, 16 bp, Homo sapiens
ctaagcattgcctggc

SEQ ID NO: 3142890 - DNA, 23 bp, Homo sapiens
ctaagccatcatatcccctgtgc

SEQ ID NO: 3142891 - DNA, 12 bp, Homo sapiens
ctaagccctgtc

SEQ ID NO: 3142892 - DNA, 22 bp, Homo sapiens
ctaagctaggaatgaaatcctg

SEQ ID NO: 3142893 - DNA, 14 bp, Homo sapiens
ctaagctgcggaat

SEQ ID NO: 3142894 - DNA, 16 bp, Homo sapiens
ctaagctgtgtgcagg

SEQ ID NO: 3142895 - DNA, 12 bp, Homo sapiens
ctaaggacacac

SEQ ID NO: 3142896 - DNA, 17 bp, Homo sapiens
ctaaggatctctcagga

SEQ ID NO: 3142897 - DNA, 20 bp, Homo sapiens
ctaaggatctctcaggagca

SEQ ID NO: 3142898 - DNA, 22 bp, Homo sapiens
ctaaggcaggtgggcagacagt

SEQ ID NO: 3142899 - DNA, 13 bp, Homo sapiens
ctaaggcccccaa

SEQ ID NO: 3142900 - DNA, 22 bp, Homo sapiens
ctaaggcccccaaacatagccc

SEQ ID NO: 3142901 - DNA, 22 bp, Homo sapiens
ctaaggcctaggattctaaaat

SEQ ID NO: 3142902 - DNA, 15 bp, Homo sapiens
ctaaggctcctcctt

SEQ ID NO: 3142903 - DNA, 22 bp, Homo sapiens
ctaaggctctatgagtctagat

SEQ ID NO: 3142904 - DNA, 14 bp, Homo sapiens
ctaaggctctgaga

SEQ ID NO: 3142905 - DNA, 20 bp, Homo sapiens
ctaaggctctgagagtctag

SEQ ID NO: 3142906 - DNA, 22 bp, Homo sapiens
ctaagggaacaatccatgtgat

SEQ ID NO: 3142907 - DNA, 18 bp, Homo sapiens
ctaagggggaggggaagt

SEQ ID NO: 3142908 - DNA, 23 bp, Homo sapiens
ctaagggtcgaaagctctagaat

SEQ ID NO: 3142909 - DNA, 18 bp, Homo sapiens
ctaagggtgtaagtaatt

SEQ ID NO: 3142910 - DNA, 14 bp, Homo sapiens
ctaaggtcatttct

SEQ ID NO: 3142911 - DNA, 19 bp, Homo sapiens
ctaaggtccggtgttctaa

SEQ ID NO: 3142912 - DNA, 22 bp, Homo sapiens
ctaaggtccggtgttctaagat

SEQ ID NO: 3142913 - DNA, 14 bp, Homo sapiens
ctaaggtctcatgc

SEQ ID NO: 3142914 - DNA, 15 bp, Homo sapiens
ctaaggtgtgctctg

SEQ ID NO: 3142915 - DNA, 13 bp, Homo sapiens
ctaaggttctaag

SEQ ID NO: 3142916 - DNA, 15 bp, Homo sapiens
ctaaggttctaaggc

SEQ ID NO: 3142917 - DNA, 20 bp, Homo sapiens
ctaagtaagtttcttcctgc

SEQ ID NO: 3142918 - DNA, 13 bp, Homo sapiens
ctaagtatttaaa

SEQ ID NO: 3142919 - DNA, 15 bp, Homo sapiens
ctaagtcctttatgt

SEQ ID NO: 3142920 - DNA, 16 bp, Homo sapiens
ctaagtcgcgagccag

SEQ ID NO: 3142921 - DNA, 18 bp, Homo sapiens
ctaagtctttactctgac

SEQ ID NO: 3142922 - DNA, 16 bp, Homo sapiens
ctaagtgatataaatc

SEQ ID NO: 3142923 - DNA, 14 bp, Homo sapiens
ctaagtgcccaaag

SEQ ID NO: 3142924 - DNA, 15 bp, Homo sapiens
ctaagtgcccaaagt

SEQ ID NO: 3142925 - DNA, 23 bp, Homo sapiens
ctaagtgttcgtctttagttttg

SEQ ID NO: 3142926 - DNA, 17 bp, Homo sapiens
ctaagttataagactct

SEQ ID NO: 3142927 - DNA, 17 bp, Homo sapiens
ctaagttatttactttt

SEQ ID NO: 3142928 - DNA, 14 bp, Homo sapiens
ctaagttcacatta

SEQ ID NO: 3142929 - DNA, 13 bp, Homo sapiens
ctaagtttctaag

SEQ ID NO: 3142930 - DNA, 15 bp, Homo sapiens
ctaagtttctaagat

SEQ ID NO: 3142931 - DNA, 17 bp, Homo sapiens
ctaagtttctaagattc

SEQ ID NO: 3142932 - DNA, 18 bp, Homo sapiens
ctaagttttcaaatttgt

SEQ ID NO: 3142933 - DNA, 15 bp, Homo sapiens
ctaataaagtgccgg

SEQ ID NO: 3142934 - DNA, 11 bp, Homo sapiens
ctaataaatac

SEQ ID NO: 3142935 - DNA, 16 bp, Homo sapiens
ctaataatttctaatg

SEQ ID NO: 3142936 - DNA, 16 bp, Homo sapiens
ctaatacctctgtgtg

SEQ ID NO: 3142937 - DNA, 20 bp, Homo sapiens
ctaatagaactcagttttaa

SEQ ID NO: 3142938 - DNA, 20 bp, Homo sapiens
ctaatagaataaaggcagtt

SEQ ID NO: 3142939 - DNA, 18 bp, Homo sapiens
ctaatatatatgaataaa

SEQ ID NO: 3142940 - DNA, 15 bp, Homo sapiens
ctaatatatttttat

SEQ ID NO: 3142941 - DNA, 21 bp, Homo sapiens
ctaatatatttttatatttag

SEQ ID NO: 3142942 - DNA, 23 bp, Homo sapiens
ctaatatccaacacaactatcaa

SEQ ID NO: 3142943 - DNA, 14 bp, Homo sapiens
ctaatatgattata

SEQ ID NO: 3142944 - DNA, 15 bp, Homo sapiens
ctaatatgattatac

SEQ ID NO: 3142945 - DNA, 17 bp, Homo sapiens
ctaatatgattatacaa

SEQ ID NO: 3142946 - DNA, 18 bp, Homo sapiens
ctaatatgtaacaagcca

SEQ ID NO: 3142947 - DNA, 19 bp, Homo sapiens
ctaatattcacatgttcta

SEQ ID NO: 3142948 - DNA, 12 bp, Homo sapiens
ctaatattgctt

SEQ ID NO: 3142949 - DNA, 15 bp, Homo sapiens
ctaatattgcttctt

SEQ ID NO: 3142950 - DNA, 23 bp, Homo sapiens
ctaatattgcttcttgtgtttta

SEQ ID NO: 3142951 - DNA, 19 bp, Homo sapiens
ctaatcaaagccagggtct

SEQ ID NO: 3142952 - DNA, 20 bp, Homo sapiens
ctaatcagcattctcactcc

SEQ ID NO: 3142953 - DNA, 12 bp, Homo sapiens
ctaatcagtgtc

SEQ ID NO: 3142954 - DNA, 13 bp, Homo sapiens
ctaatcagtgtct

SEQ ID NO: 3142955 - DNA, 16 bp, Homo sapiens
ctaatcagtgtctcac

SEQ ID NO: 3142956 - DNA, 20 bp, Homo sapiens
ctaatcagtgtctcacactg

SEQ ID NO: 3142957 - DNA, 20 bp, Homo sapiens
ctaatcatgtgggtgagcca

SEQ ID NO: 3142958 - DNA, 22 bp, Homo sapiens
ctaatccctgggcattgctttc

SEQ ID NO: 3142959 - DNA, 22 bp, Homo sapiens
ctaatcctatctggggagctcc

SEQ ID NO: 3142960 - DNA, 17 bp, Homo sapiens
ctaatctaacaatggaa

SEQ ID NO: 3142961 - DNA, 18 bp, Homo sapiens
ctaatctatggtcgggag

SEQ ID NO: 3142962 - DNA, 21 bp, Homo sapiens
ctaatctattgggttcattat

SEQ ID NO: 3142963 - DNA, 22 bp, Homo sapiens
ctaatctattgggttcattatt

SEQ ID NO: 3142964 - DNA, 15 bp, Homo sapiens
ctaatctcatacctc

SEQ ID NO: 3142965 - DNA, 22 bp, Homo sapiens
ctaatctgtagggctggaccta

SEQ ID NO: 3142966 - DNA, 11 bp, Homo sapiens
ctaatctttca

SEQ ID NO: 3142967 - DNA, 20 bp, Homo sapiens
ctaatgataatcccaccacc

SEQ ID NO: 3142968 - DNA, 12 bp, Homo sapiens
ctaatgatgttt

SEQ ID NO: 3142969 - DNA, 14 bp, Homo sapiens
ctaatgcaaattaa

SEQ ID NO: 3142970 - DNA, 17 bp, Homo sapiens
ctaatgcttgtttatga

SEQ ID NO: 3142971 - DNA, 12 bp, Homo sapiens
ctaatgggacac

SEQ ID NO: 3142972 - DNA, 19 bp, Homo sapiens
ctaatgtctcactgttctg

SEQ ID NO: 3142973 - DNA, 22 bp, Homo sapiens
ctaatgtctcactgttctgcaa

SEQ ID NO: 3142974 - DNA, 16 bp, Homo sapiens
ctaatgtcttcataaa

SEQ ID NO: 3142975 - DNA, 21 bp, Homo sapiens
ctaatgtcttcatttcattgt

SEQ ID NO: 3142976 - DNA, 23 bp, Homo sapiens
ctaatgtgaaaatcatcactcaa

SEQ ID NO: 3142977 - DNA, 20 bp, Homo sapiens
ctaatgtttatgagccagac

SEQ ID NO: 3142978 - DNA, 18 bp, Homo sapiens
ctaattaaaattgtgcat

SEQ ID NO: 3142979 - DNA, 23 bp, Homo sapiens
ctaattaatatattaaaattcca

SEQ ID NO: 3142980 - DNA, 18 bp, Homo sapiens
ctaattagggtacattta

SEQ ID NO: 3142981 - DNA, 12 bp, Homo sapiens
ctaattatttaa

SEQ ID NO: 3142982 - DNA, 18 bp, Homo sapiens
ctaattcaaggaatttct

SEQ ID NO: 3142983 - DNA, 20 bp, Homo sapiens
ctaattcaaggaatttctta

SEQ ID NO: 3142984 - DNA, 16 bp, Homo sapiens
ctaattcacagtgctc

SEQ ID NO: 3142985 - DNA, 13 bp, Homo sapiens
ctaattcatttat

SEQ ID NO: 3142986 - DNA, 19 bp, Homo sapiens
ctaattcccattttgcaaa

SEQ ID NO: 3142987 - DNA, 21 bp, Homo sapiens
ctaattcccattttgcaaaat

SEQ ID NO: 3142988 - DNA, 17 bp, Homo sapiens
ctaattcgatgaaggct

SEQ ID NO: 3142989 - DNA, 16 bp, Homo sapiens
ctaattctattaaagt

SEQ ID NO: 3142990 - DNA, 15 bp, Homo sapiens
ctaattgacttgcaa

SEQ ID NO: 3142991 - DNA, 20 bp, Homo sapiens
ctaattgcatctcaaaatta

SEQ ID NO: 3142992 - DNA, 17 bp, Homo sapiens
ctaattggaaagtgcca

SEQ ID NO: 3142993 - DNA, 13 bp, Homo sapiens
ctaatttaacacc

SEQ ID NO: 3142994 - DNA, 21 bp, Homo sapiens
ctaatttatcttgtctctggg

SEQ ID NO: 3142995 - DNA, 14 bp, Homo sapiens
ctaatttattaatc

SEQ ID NO: 3142996 - DNA, 19 bp, Homo sapiens
ctaatttcaaaaatataac

SEQ ID NO: 3142997 - DNA, 19 bp, Homo sapiens
ctaatttcaaaatgctttt

SEQ ID NO: 3142998 - DNA, 20 bp, Homo sapiens
ctaatttctcctcccttcct

SEQ ID NO: 3142999 - DNA, 19 bp, Homo sapiens
ctaatttgttttggatata

SEQ ID NO: 3143000 - DNA, 13 bp, Homo sapiens
ctaattttctcaa

SEQ ID NO: 3143001 - DNA, 19 bp, Homo sapiens
ctaattttctcaaaagcat

SEQ ID NO: 3143002 - DNA, 20 bp, Homo sapiens
ctaattttctcaaaagcatt

SEQ ID NO: 3143003 - DNA, 17 bp, Homo sapiens
ctagagttgatgggggt

SEQ ID NO: 3143004 - DNA, 16 bp, Homo sapiens
ctagagttttatcaac

SEQ ID NO: 3143005 - DNA, 15 bp, Homo sapiens
ctagataaaaagatg

SEQ ID NO: 3143006 - DNA, 17 bp, Homo sapiens
ctagatactactttctc

SEQ ID NO: 3143007 - DNA, 12 bp, Homo sapiens
ctagatagttta

SEQ ID NO: 3143008 - DNA, 15 bp, Homo sapiens
ctagatcataaggct

SEQ ID NO: 3143009 - DNA, 17 bp, Homo sapiens
ctagatcctaagggtcg

SEQ ID NO: 3143010 - DNA, 20 bp, Homo sapiens
ctagatgattaaataagatt

SEQ ID NO: 3143011 - DNA, 22 bp, Homo sapiens
ctagatgattaaataagattct

SEQ ID NO: 3143012 - DNA, 23 bp, Homo sapiens
ctagatgattaaataagattcta

SEQ ID NO: 3143013 - DNA, 21 bp, Homo sapiens
ctagatgattttttgaaagtt

SEQ ID NO: 3143014 - DNA, 16 bp, Homo sapiens
ctagatgcatcactgg

SEQ ID NO: 3143015 - DNA, 17 bp, Homo sapiens
ctagatgcatcactggg

SEQ ID NO: 3143016 - DNA, 16 bp, Homo sapiens
ctagatgtagtatttt

SEQ ID NO: 3143017 - DNA, 22 bp, Homo sapiens
ctagatgtgtagggctgagggc

SEQ ID NO: 3143018 - DNA, 17 bp, Homo sapiens
ctagatgtttaacaaat

SEQ ID NO: 3143019 - DNA, 21 bp, Homo sapiens
ctagattaccccctcattgtt

SEQ ID NO: 3143020 - DNA, 15 bp, Homo sapiens
ctagattatatcaaa

SEQ ID NO: 3143021 - DNA, 21 bp, Homo sapiens
ctagattatatcaaagtattt

SEQ ID NO: 3143022 - DNA, 22 bp, Homo sapiens
ctagattccattggtccaagat

SEQ ID NO: 3143023 - DNA, 23 bp, Homo sapiens
ctagattccattggtccaagatt

SEQ ID NO: 3143024 - DNA, 24 bp, Homo sapiens
ctagattgagagaagagacaaaca

SEQ ID NO: 3143025 - DNA, 17 bp, Homo sapiens
ctagatttctacattaa

SEQ ID NO: 3143026 - DNA, 15 bp, Homo sapiens
ctagatttgtccttt

SEQ ID NO: 3143027 - DNA, 16 bp, Homo sapiens
ctagattttaatttat

SEQ ID NO: 3143028 - DNA, 17 bp, Homo sapiens
ctagattttaatttatt

SEQ ID NO: 3143029 - DNA, 22 bp, Homo sapiens
ctagattttaatttatttgttt

SEQ ID NO: 3143030 - DNA, 17 bp, Homo sapiens
ctagcaattttctttgt

SEQ ID NO: 3143031 - DNA, 20 bp, Homo sapiens
ctagcaattttctttgtttc

SEQ ID NO: 3143032 - DNA, 19 bp, Homo sapiens
ctagcactcattttctata

SEQ ID NO: 3143033 - DNA, 19 bp, Homo sapiens
ctagcagagcaggggcagg

SEQ ID NO: 3143034 - DNA, 22 bp, Homo sapiens
ctagcaggcaatgctgtacttt

SEQ ID NO: 3143035 - DNA, 18 bp, Homo sapiens
ctagcagggaaggtgaag

SEQ ID NO: 3143036 - DNA, 22 bp, Homo sapiens
ctagcagtgatgaaaatgaatc

SEQ ID NO: 3143037 - DNA, 23 bp, Homo sapiens
ctagcattgtaaaattatttcat

SEQ ID NO: 3143038 - DNA, 16 bp, Homo sapiens
ctagccaaaccaggac

SEQ ID NO: 3143039 - DNA, 20 bp, Homo sapiens
ctagccaaaccaggaccctg

SEQ ID NO: 3143040 - DNA, 22 bp, Homo sapiens
ctagccaatattaaaagagacc

SEQ ID NO: 3143041 - DNA, 20 bp, Homo sapiens
ctagccagagaatagatcag

SEQ ID NO: 3143042 - DNA, 19 bp, Homo sapiens
ctagccagagcccttcact

SEQ ID NO: 3143043 - DNA, 23 bp, Homo sapiens
ctagccagagcccttcactgcca

SEQ ID NO: 3143044 - DNA, 22 bp, Homo sapiens
ctagccaggaagtacttccacc

SEQ ID NO: 3143045 - DNA, 15 bp, Homo sapiens
ctagccattcctggt

SEQ ID NO: 3143046 - DNA, 21 bp, Homo sapiens
ctagccattcctggtacccag

SEQ ID NO: 3143047 - DNA, 18 bp, Homo sapiens
ctagcccaatgaaatgaa

SEQ ID NO: 3143048 - DNA, 16 bp, Homo sapiens
ctagcccagactctga

SEQ ID NO: 3143049 - DNA, 19 bp, Homo sapiens
ctagcccagcgctctgcct

SEQ ID NO: 3143050 - DNA, 22 bp, Homo sapiens
ctagcccaggagagagaaagcc

SEQ ID NO: 3143051 - DNA, 14 bp, Homo sapiens
ctagcccctgtgga

SEQ ID NO: 3143052 - DNA, 12 bp, Homo sapiens
ctagcccttgtc

SEQ ID NO: 3143053 - DNA, 19 bp, Homo sapiens
ctagcccttgtccctttta

SEQ ID NO: 3143054 - DNA, 21 bp, Homo sapiens
ctagcctatttacctgcaggc

SEQ ID NO: 3143055 - DNA, 22 bp, Homo sapiens
ctagcctatttacctgcaggct

SEQ ID NO: 3143056 - DNA, 23 bp, Homo sapiens
ctagcctatttacctgcaggctg

SEQ ID NO: 3143057 - DNA, 13 bp, Homo sapiens
ctagcctctccag

SEQ ID NO: 3143058 - DNA, 21 bp, Homo sapiens
ctagcctgtgcctctgggact

SEQ ID NO: 3143059 - DNA, 22 bp, Homo sapiens
ctagccttaatcaggtcctcag

SEQ ID NO: 3143060 - DNA, 21 bp, Homo sapiens
ctagcctttggctctggagac

SEQ ID NO: 3143061 - DNA, 23 bp, Homo sapiens
ctagcctttggctctggagacag

SEQ ID NO: 3143062 - DNA, 16 bp, Homo sapiens
ctagcgatctctcctg

SEQ ID NO: 3143063 - DNA, 17 bp, Homo sapiens
ctagcgatctctcctgg

SEQ ID NO: 3143064 - DNA, 20 bp, Homo sapiens
ctagcgatctctcctggcct

SEQ ID NO: 3143065 - DNA, 17 bp, Homo sapiens
ctagcggagcccagcct

SEQ ID NO: 3143066 - DNA, 20 bp, Homo sapiens
ctagcggagcccagcctggg

SEQ ID NO: 3143067 - DNA, 16 bp, Homo sapiens
ctagctagaaatatga

SEQ ID NO: 3143068 - DNA, 17 bp, Homo sapiens
ctagctagaaatatgat

SEQ ID NO: 3143069 - DNA, 21 bp, Homo sapiens
ctagctcctgccacatggagc

SEQ ID NO: 3143070 - DNA, 22 bp, Homo sapiens
ctagctgcctagcaagctggcc

SEQ ID NO: 3143071 - DNA, 14 bp, Homo sapiens
ctagctggctctgt

SEQ ID NO: 3143072 - DNA, 22 bp, Homo sapiens
ctagctggtggtttcacggtgc

SEQ ID NO: 3143073 - DNA, 14 bp, Homo sapiens
ctagctgtgggggt

SEQ ID NO: 3143074 - DNA, 18 bp, Homo sapiens
ctagctgttgagctgttt

SEQ ID NO: 3143075 - DNA, 16 bp, Homo sapiens
ctagcttagtttcaga

SEQ ID NO: 3143076 - DNA, 14 bp, Homo sapiens
ctagcttctgcttt

SEQ ID NO: 3143077 - DNA, 21 bp, Homo sapiens
ctagcttctgcttttctgccc

SEQ ID NO: 3143078 - DNA, 20 bp, Homo sapiens
ctagcttgacacagtcagca

SEQ ID NO: 3143079 - DNA, 19 bp, Homo sapiens
ctagctttagaccctgggt

SEQ ID NO: 3143080 - DNA, 23 bp, Homo sapiens
ctaggaagagcaggactccaggc

SEQ ID NO: 3143081 - DNA, 19 bp, Homo sapiens
ctaggacacagttcctggg

SEQ ID NO: 3143082 - DNA, 16 bp, Homo sapiens
ctaggaccactcagcc

SEQ ID NO: 3143083 - DNA, 18 bp, Homo sapiens
ctaggaccactcagcccc

SEQ ID NO: 3143084 - DNA, 19 bp, Homo sapiens
ctaggaccactcagcccct

SEQ ID NO: 3143085 - DNA, 21 bp, Homo sapiens
ctaggaccactcagcccctag

SEQ ID NO: 3143086 - DNA, 22 bp, Homo sapiens
ctaggactctgaggctctttct

SEQ ID NO: 3143087 - DNA, 14 bp, Homo sapiens
ctaggactgaggag

SEQ ID NO: 3143088 - DNA, 18 bp, Homo sapiens
ctaggactgaggagtggg

SEQ ID NO: 3143089 - DNA, 13 bp, Homo sapiens
ctaggagaagagt

SEQ ID NO: 3143090 - DNA, 15 bp, Homo sapiens
ctaggagaggggggc

SEQ ID NO: 3143091 - DNA, 21 bp, Homo sapiens
ctaggagatatctgagggagg

SEQ ID NO: 3143092 - DNA, 23 bp, Homo sapiens
ctaggagatatctgagggaggag

SEQ ID NO: 3143093 - DNA, 13 bp, Homo sapiens
ctaggagggagac

SEQ ID NO: 3143094 - DNA, 21 bp, Homo sapiens
ctaggagggagccttgtgaga

SEQ ID NO: 3143095 - DNA, 22 bp, Homo sapiens
ctaggagttgagtacagtgagg

SEQ ID NO: 3143096 - DNA, 20 bp, Homo sapiens
ctaggatagttgatgcatgt

SEQ ID NO: 3143097 - DNA, 23 bp, Homo sapiens
ctaggatgtatattttatataaa

SEQ ID NO: 3143098 - DNA, 13 bp, Homo sapiens
ctaggatttcatg

SEQ ID NO: 3143099 - DNA, 12 bp, Homo sapiens
ctaggcaagcag

SEQ ID NO: 3143100 - DNA, 14 bp, Homo sapiens
ctaggcaagcagga

SEQ ID NO: 3143101 - DNA, 18 bp, Homo sapiens
ctaggcaagcaggacctg

SEQ ID NO: 3143102 - DNA, 21 bp, Homo sapiens
ctaggcaagcaggacctggca

SEQ ID NO: 3143103 - DNA, 15 bp, Homo sapiens
ctaggcacaaggttg

SEQ ID NO: 3143104 - DNA, 19 bp, Homo sapiens
ctaggcactgtagttctaa

SEQ ID NO: 3143105 - DNA, 18 bp, Homo sapiens
ctaggcccaggcctgggt

SEQ ID NO: 3143106 - DNA, 19 bp, Homo sapiens
ctaggcccaggcctgggtt

SEQ ID NO: 3143107 - DNA, 19 bp, Homo sapiens
ctaggccccagaggccctg

SEQ ID NO: 3143108 - DNA, 13 bp, Homo sapiens
ctaggcccccact

SEQ ID NO: 3143109 - DNA, 19 bp, Homo sapiens
ctaggcccccacttgcctc

SEQ ID NO: 3143110 - DNA, 20 bp, Homo sapiens
ctaggcccctcctagaccca

SEQ ID NO: 3143111 - DNA, 21 bp, Homo sapiens
ctaggcccctcctagacccag

SEQ ID NO: 3143112 - DNA, 15 bp, Homo sapiens
ctaggcctctccagt

SEQ ID NO: 3143113 - DNA, 13 bp, Homo sapiens
ctaggcctggcca

SEQ ID NO: 3143114 - DNA, 15 bp, Homo sapiens
ctaggcctggccaga

SEQ ID NO: 3143115 - DNA, 13 bp, Homo sapiens
ctaggcctttcct

SEQ ID NO: 3143116 - DNA, 16 bp, Homo sapiens
ctaggctaggacgttg

SEQ ID NO: 3143117 - DNA, 13 bp, Homo sapiens
ctaggctccaccc

SEQ ID NO: 3143118 - DNA, 22 bp, Homo sapiens
ctaggctcttatgtgtgccttt

SEQ ID NO: 3143119 - DNA, 15 bp, Homo sapiens
ctaggctgctgctgt

SEQ ID NO: 3143120 - DNA, 16 bp, Homo sapiens
ctaggctgttttctcc

SEQ ID NO: 3143121 - DNA, 15 bp, Homo sapiens
ctagggaatctggat

SEQ ID NO: 3143122 - DNA, 22 bp, Homo sapiens
ctagggacatgaaatttacaaa

SEQ ID NO: 3143123 - DNA, 14 bp, Homo sapiens
ctagggaggacctt

SEQ ID NO: 3143124 - DNA, 16 bp, Homo sapiens
ctagggattcaggctg

SEQ ID NO: 3143125 - DNA, 17 bp, Homo sapiens
ctagggattcaggctgc

SEQ ID NO: 3143126 - DNA, 20 bp, Homo sapiens
ctagggattcaggctgcttg

SEQ ID NO: 3143127 - DNA, 13 bp, Homo sapiens
ctcaagtaaaaga

SEQ ID NO: 3143128 - DNA, 15 bp, Homo sapiens
ctcaagtaaaagaaa

SEQ ID NO: 3143129 - DNA, 14 bp, Homo sapiens
ctcaagtcctcttt

SEQ ID NO: 3143130 - DNA, 21 bp, Homo sapiens
ctcaagtcctcttttctgaga

SEQ ID NO: 3143131 - DNA, 18 bp, Homo sapiens
ctcaagtcttccctgatc

SEQ ID NO: 3143132 - DNA, 21 bp, Homo sapiens
ctcaagtgattctcctgcctc

SEQ ID NO: 3143133 - DNA, 14 bp, Homo sapiens
ctcaagttctaaga

SEQ ID NO: 3143134 - DNA, 18 bp, Homo sapiens
ctcaagttctaagattct

SEQ ID NO: 3143135 - DNA, 20 bp, Homo sapiens
ctcaagttctaagattctaa

SEQ ID NO: 3143136 - DNA, 16 bp, Homo sapiens
ctcaataaacacttgt

SEQ ID NO: 3143137 - DNA, 13 bp, Homo sapiens
ctcaataaagatt

SEQ ID NO: 3143138 - DNA, 18 bp, Homo sapiens
ctcaataaattgcaacat

SEQ ID NO: 3143139 - DNA, 15 bp, Homo sapiens
ctcaatactacctct

SEQ ID NO: 3143140 - DNA, 15 bp, Homo sapiens
ctcaatcacactaca

SEQ ID NO: 3143141 - DNA, 18 bp, Homo sapiens
ctcaatcacactacacat

SEQ ID NO: 3143142 - DNA, 14 bp, Homo sapiens
ctcaatcctaattt

SEQ ID NO: 3143143 - DNA, 20 bp, Homo sapiens
ctcaatcctaatttctcctc

SEQ ID NO: 3143144 - DNA, 22 bp, Homo sapiens
ctcaatcctaatttctcctccc

SEQ ID NO: 3143145 - DNA, 19 bp, Homo sapiens
ctcaatgaaccataaattc

SEQ ID NO: 3143146 - DNA, 16 bp, Homo sapiens
ctcaatgaagccagct

SEQ ID NO: 3143147 - DNA, 13 bp, Homo sapiens
ctcaatgcactga

SEQ ID NO: 3143148 - DNA, 20 bp, Homo sapiens
ctcaatgcattgtcttgtgg

SEQ ID NO: 3143149 - DNA, 21 bp, Homo sapiens
ctcaatgcattgtcttgtgga

SEQ ID NO: 3143150 - DNA, 13 bp, Homo sapiens
ctcaatggactgg

SEQ ID NO: 3143151 - DNA, 17 bp, Homo sapiens
ctcaatggactggaagg

SEQ ID NO: 3143152 - DNA, 18 bp, Homo sapiens
ctcaatgtttgtaataat

SEQ ID NO: 3143153 - DNA, 17 bp, Homo sapiens
ctcaatttttgtctcag

SEQ ID NO: 3143154 - DNA, 20 bp, Homo sapiens
ctcaatttttgtctcagaag

SEQ ID NO: 3143155 - DNA, 16 bp, Homo sapiens
ctcacaagcgctccca

SEQ ID NO: 3143156 - DNA, 21 bp, Homo sapiens
ctcacaagcgctcccagcctg

SEQ ID NO: 3143157 - DNA, 22 bp, Homo sapiens
ctcacaagcgctcccagcctgc

SEQ ID NO: 3143158 - DNA, 13 bp, Homo sapiens
ctcacacacacag

SEQ ID NO: 3143159 - DNA, 15 bp, Homo sapiens
ctcacacaccctgag

SEQ ID NO: 3143160 - DNA, 13 bp, Homo sapiens
ctcacaccaaatt

SEQ ID NO: 3143161 - DNA, 15 bp, Homo sapiens
ctcacacctgaactg

SEQ ID NO: 3143162 - DNA, 19 bp, Homo sapiens
ctcacacctgcaatcccag

SEQ ID NO: 3143163 - DNA, 17 bp, Homo sapiens
ctcacagacctggagcc

SEQ ID NO: 3143164 - DNA, 22 bp, Homo sapiens
ctcacagacctggagcccctgg

SEQ ID NO: 3143165 - DNA, 20 bp, Homo sapiens
ctcacagatgtgactgtata

SEQ ID NO: 3143166 - DNA, 16 bp, Homo sapiens
ctcacagcacttgttt

SEQ ID NO: 3143167 - DNA, 12 bp, Homo sapiens
ctcacagcctct

SEQ ID NO: 3143168 - DNA, 15 bp, Homo sapiens
ctcacagcctctgac

SEQ ID NO: 3143169 - DNA, 17 bp, Homo sapiens
ctcacagccttggctcc

SEQ ID NO: 3143170 - DNA, 17 bp, Homo sapiens
ctcacaggccctggaga

SEQ ID NO: 3143171 - DNA, 19 bp, Homo sapiens
ctcacagtaacccaaacct

SEQ ID NO: 3143172 - DNA, 23 bp, Homo sapiens
ctcacagtaacccaaacctcaag

SEQ ID NO: 3143173 - DNA, 13 bp, Homo sapiens
ctcacagtacagc

SEQ ID NO: 3143174 - DNA, 19 bp, Homo sapiens
ctcacagtgacccttccca

SEQ ID NO: 3143175 - DNA, 20 bp, Homo sapiens
ctcacatgtggcaaaatatg

SEQ ID NO: 3143176 - DNA, 14 bp, Homo sapiens
ctcacattttctca

SEQ ID NO: 3143177 - DNA, 15 bp, Homo sapiens
ctcacatttttttct

SEQ ID NO: 3143178 - DNA, 17 bp, Homo sapiens
ctcaccagccccactgc

SEQ ID NO: 3143179 - DNA, 22 bp, Homo sapiens
ctcaccagccccactgccagca

SEQ ID NO: 3143180 - DNA, 14 bp, Homo sapiens
ctcaccagccccag

SEQ ID NO: 3143181 - DNA, 20 bp, Homo sapiens
ctcaccagccccagtgccca

SEQ ID NO: 3143182 - DNA, 21 bp, Homo sapiens
ctcaccagggtccgcaccagc

SEQ ID NO: 3143183 - DNA, 22 bp, Homo sapiens
ctcaccagggtccgcaccagct

SEQ ID NO: 3143184 - DNA, 23 bp, Homo sapiens
ctcaccagggtccgcaccagctg

SEQ ID NO: 3143185 - DNA, 21 bp, Homo sapiens
ctcaccccatcccacaccctg

SEQ ID NO: 3143186 - DNA, 22 bp, Homo sapiens
ctcaccccatcccacaccctgg

SEQ ID NO: 3143187 - DNA, 20 bp, Homo sapiens
ctcaccccgttacagctccc

SEQ ID NO: 3143188 - DNA, 13 bp, Homo sapiens
ctcacccctgtcc

SEQ ID NO: 3143189 - DNA, 15 bp, Homo sapiens
ctcacccctgtcctc

SEQ ID NO: 3143190 - DNA, 18 bp, Homo sapiens
ctcacccctgtcctcact

SEQ ID NO: 3143191 - DNA, 16 bp, Homo sapiens
ctcaccctactctgga

SEQ ID NO: 3143192 - DNA, 18 bp, Homo sapiens
ctcaccctactctggatg

SEQ ID NO: 3143193 - DNA, 15 bp, Homo sapiens
ctcaccctgcccgct

SEQ ID NO: 3143194 - DNA, 17 bp, Homo sapiens
ctcaccctgcccgctcc

SEQ ID NO: 3143195 - DNA, 23 bp, Homo sapiens
ctcaccctgcccgctcccaaccc

SEQ ID NO: 3143196 - DNA, 13 bp, Homo sapiens
ctcaccctgcctt

SEQ ID NO: 3143197 - DNA, 21 bp, Homo sapiens
ctcaccctgccttatcttgca

SEQ ID NO: 3143198 - DNA, 14 bp, Homo sapiens
ctcacccttgcacc

SEQ ID NO: 3143199 - DNA, 13 bp, Homo sapiens
ctcaccgcccatc

SEQ ID NO: 3143200 - DNA, 14 bp, Homo sapiens
ctcaccgcccatca

SEQ ID NO: 3143201 - DNA, 21 bp, Homo sapiens
ctcaccgtgctgtcttctggt

SEQ ID NO: 3143202 - DNA, 17 bp, Homo sapiens
ctcacctagagccagac

SEQ ID NO: 3143203 - DNA, 18 bp, Homo sapiens
ctcacctagagccagacc

SEQ ID NO: 3143204 - DNA, 13 bp, Homo sapiens
ctcacctctaccc

SEQ ID NO: 3143205 - DNA, 15 bp, Homo sapiens
ctcacctctacccaa

SEQ ID NO: 3143206 - DNA, 14 bp, Homo sapiens
ctcacctctccctc

SEQ ID NO: 3143207 - DNA, 12 bp, Homo sapiens
ctcacctctgcc

SEQ ID NO: 3143208 - DNA, 21 bp, Homo sapiens
ctcacctctggactggctaga

SEQ ID NO: 3143209 - DNA, 12 bp, Homo sapiens
ctcacctggact

SEQ ID NO: 3143210 - DNA, 22 bp, Homo sapiens
ctcacctgtctaggtctcctca

SEQ ID NO: 3143211 - DNA, 14 bp, Homo sapiens
ctcacctttgtttt

SEQ ID NO: 3143212 - DNA, 22 bp, Homo sapiens
ctcacgagatttgccaggggca

SEQ ID NO: 3143213 - DNA, 13 bp, Homo sapiens
ctcacgcctgtaa

SEQ ID NO: 3143214 - DNA, 17 bp, Homo sapiens
ctcacgctcccccgcag

SEQ ID NO: 3143215 - DNA, 18 bp, Homo sapiens
ctcacgctcccccgcagt

SEQ ID NO: 3143216 - DNA, 23 bp, Homo sapiens
ctcacgcttacctcaaccatcct

SEQ ID NO: 3143217 - DNA, 21 bp, Homo sapiens
ctcacgggcatgggcactccc

SEQ ID NO: 3143218 - DNA, 14 bp, Homo sapiens
ctcacggggcctcc

SEQ ID NO: 3143219 - DNA, 17 bp, Homo sapiens
ctcactaatttttgtat

SEQ ID NO: 3143220 - DNA, 22 bp, Homo sapiens
ctcactatggtatgctggccag

SEQ ID NO: 3143221 - DNA, 24 bp, Homo sapiens
ctcactatggtatgctggccagca

SEQ ID NO: 3143222 - DNA, 20 bp, Homo sapiens
ctcactatgttgcccaggca

SEQ ID NO: 3143223 - DNA, 22 bp, Homo sapiens
ctcactatgttgcccaggcagg

SEQ ID NO: 3143224 - DNA, 16 bp, Homo sapiens
ctcactcactcattcc

SEQ ID NO: 3143225 - DNA, 15 bp, Homo sapiens
ctcactcccagtcca

SEQ ID NO: 3143226 - DNA, 13 bp, Homo sapiens
ctcactccccagc

SEQ ID NO: 3143227 - DNA, 19 bp, Homo sapiens
ctcactccccatgccacgt

SEQ ID NO: 3143228 - DNA, 13 bp, Homo sapiens
ctcactcctagga

SEQ ID NO: 3143229 - DNA, 18 bp, Homo sapiens
ctcactcctaggagagcc

SEQ ID NO: 3143230 - DNA, 11 bp, Homo sapiens
ctcactcctgc

SEQ ID NO: 3143231 - DNA, 14 bp, Homo sapiens
ctcactcctgcctc

SEQ ID NO: 3143232 - DNA, 11 bp, Homo sapiens
ctcactcctgt

SEQ ID NO: 3143233 - DNA, 14 bp, Homo sapiens
ctcactctgccagg

SEQ ID NO: 3143234 - DNA, 14 bp, Homo sapiens
ctcactctgggctg

SEQ ID NO: 3143235 - DNA, 11 bp, Homo sapiens
ctcactctgtc

SEQ ID NO: 3143236 - DNA, 12 bp, Homo sapiens
ctcactgaagcc

SEQ ID NO: 3143237 - DNA, 15 bp, Homo sapiens
ctcactgaagcctgc

SEQ ID NO: 3143238 - DNA, 15 bp, Homo sapiens
ctcactgcagtctta

SEQ ID NO: 3143239 - DNA, 11 bp, Homo sapiens
ctcactgccag

SEQ ID NO: 3143240 - DNA, 12 bp, Homo sapiens
ctcactgccagg

SEQ ID NO: 3143241 - DNA, 14 bp, Homo sapiens
ctcactgccaggcc

SEQ ID NO: 3143242 - DNA, 20 bp, Homo sapiens
ctcactgccaggccagcctc

SEQ ID NO: 3143243 - DNA, 22 bp, Homo sapiens
ctcactgccaggccagcctccg

SEQ ID NO: 3143244 - DNA, 12 bp, Homo sapiens
ctcactgctgat

SEQ ID NO: 3143245 - DNA, 18 bp, Homo sapiens
ctcactgcttgaactagg

SEQ ID NO: 3143246 - DNA, 14 bp, Homo sapiens
ctcactggaggagc

SEQ ID NO: 3143247 - DNA, 14 bp, Homo sapiens
ctcactggccatcc

SEQ ID NO: 3143248 - DNA, 12 bp, Homo sapiens
ctcactggctgg

SEQ ID NO: 3143249 - DNA, 14 bp, Homo sapiens
ctcactggctgggg

SEQ ID NO: 3143250 - DNA, 16 bp, Homo sapiens
ctcactggctggggca

SEQ ID NO: 3143251 - DNA, 20 bp, Homo sapiens
ctcactggctggggcagagg

SEQ ID NO: 3143252 - DNA, 12 bp, Homo sapiens
ctcactgttccc

SEQ ID NO: 3143253 - DNA, 18 bp, Homo sapiens
ctcactgttccctctgct

SEQ ID NO: 3143254 - DNA, 20 bp, Homo sapiens
ctcatctgctggtccgtggg

SEQ ID NO: 3143255 - DNA, 16 bp, Homo sapiens
ctcatctgtggagctg

SEQ ID NO: 3143256 - DNA, 22 bp, Homo sapiens
ctcatctgtggagctgccacag

SEQ ID NO: 3143257 - DNA, 16 bp, Homo sapiens
ctcatcttaaaaatat

SEQ ID NO: 3143258 - DNA, 14 bp, Homo sapiens
ctcatctttctcct

SEQ ID NO: 3143259 - DNA, 14 bp, Homo sapiens
ctcatctttttact

SEQ ID NO: 3143260 - DNA, 20 bp, Homo sapiens
ctcatgacggcttttgtcag

SEQ ID NO: 3143261 - DNA, 16 bp, Homo sapiens
ctcatgcaaatcaatt

SEQ ID NO: 3143262 - DNA, 18 bp, Homo sapiens
ctcatgcatagtcccagc

SEQ ID NO: 3143263 - DNA, 12 bp, Homo sapiens
ctcatgccacac

SEQ ID NO: 3143264 - DNA, 14 bp, Homo sapiens
ctcatgccacacct

SEQ ID NO: 3143265 - DNA, 17 bp, Homo sapiens
ctcatgccacaccttct

SEQ ID NO: 3143266 - DNA, 13 bp, Homo sapiens
ctcatgcccaccc

SEQ ID NO: 3143267 - DNA, 22 bp, Homo sapiens
ctcatgcccaccccctgccctg

SEQ ID NO: 3143268 - DNA, 17 bp, Homo sapiens
ctcatgccccctttcag

SEQ ID NO: 3143269 - DNA, 14 bp, Homo sapiens
ctcatgcctcagcc

SEQ ID NO: 3143270 - DNA, 15 bp, Homo sapiens
ctcatgctgttgctg

SEQ ID NO: 3143271 - DNA, 20 bp, Homo sapiens
ctcatggcccccaggggcag

SEQ ID NO: 3143272 - DNA, 20 bp, Homo sapiens
ctcatggcccctctgacctg

SEQ ID NO: 3143273 - DNA, 12 bp, Homo sapiens
ctcatgggaagc

SEQ ID NO: 3143274 - DNA, 21 bp, Homo sapiens
ctcatgggaagcaggacctag

SEQ ID NO: 3143275 - DNA, 22 bp, Homo sapiens
ctcatgggaagcaggacctaga

SEQ ID NO: 3143276 - DNA, 23 bp, Homo sapiens
ctcatgggtggcactcagtctct

SEQ ID NO: 3143277 - DNA, 11 bp, Homo sapiens
ctcatgtaaca

SEQ ID NO: 3143278 - DNA, 19 bp, Homo sapiens
ctcattactgcaaattgat

SEQ ID NO: 3143279 - DNA, 18 bp, Homo sapiens
ctcattactgggccttag

SEQ ID NO: 3143280 - DNA, 17 bp, Homo sapiens
ctcattacttttgaagt

SEQ ID NO: 3143281 - DNA, 20 bp, Homo sapiens
ctcattataaaatgggaaga

SEQ ID NO: 3143282 - DNA, 18 bp, Homo sapiens
ctcattccaacagtgagt

SEQ ID NO: 3143283 - DNA, 12 bp, Homo sapiens
ctcattcctgta

SEQ ID NO: 3143284 - DNA, 22 bp, Homo sapiens
ctcattcgcctttgtcttgtac

SEQ ID NO: 3143285 - DNA, 20 bp, Homo sapiens
ctcattcgtggcatgttttg

SEQ ID NO: 3143286 - DNA, 21 bp, Homo sapiens
ctcattctatccccaatcagc

SEQ ID NO: 3143287 - DNA, 13 bp, Homo sapiens
ctcattcttctgt

SEQ ID NO: 3143288 - DNA, 11 bp, Homo sapiens
ctcattgaaat

SEQ ID NO: 3143289 - DNA, 18 bp, Homo sapiens
ctcattgacaagaactga

SEQ ID NO: 3143290 - DNA, 21 bp, Homo sapiens
ctcattgacttttataaagca

SEQ ID NO: 3143291 - DNA, 16 bp, Homo sapiens
ctcattgcccccacct

SEQ ID NO: 3143292 - DNA, 17 bp, Homo sapiens
ctcattgcccccacctc

SEQ ID NO: 3143293 - DNA, 14 bp, Homo sapiens
ctcattgcctcctg

SEQ ID NO: 3143294 - DNA, 16 bp, Homo sapiens
ctcattgctgagcctc

SEQ ID NO: 3143295 - DNA, 19 bp, Homo sapiens
ctcattgctgagcctctgc

SEQ ID NO: 3143296 - DNA, 13 bp, Homo sapiens
ctcattgcttctg

SEQ ID NO: 3143297 - DNA, 16 bp, Homo sapiens
ctcattggccagctca

SEQ ID NO: 3143298 - DNA, 21 bp, Homo sapiens
ctcatttgtcacacactttgg

SEQ ID NO: 3143299 - DNA, 16 bp, Homo sapiens
ctcattttagttgcct

SEQ ID NO: 3143300 - DNA, 20 bp, Homo sapiens
ctcattttgaattatgtgca

SEQ ID NO: 3143301 - DNA, 14 bp, Homo sapiens
ctcatttttcatac

SEQ ID NO: 3143302 - DNA, 23 bp, Homo sapiens
ctcatttttgccatacatcagtt

SEQ ID NO: 3143303 - DNA, 22 bp, Homo sapiens
ctcatttttttttttgtttctg

SEQ ID NO: 3143304 - DNA, 23 bp, Homo sapiens
ctccaaaaaaaaaaaaaatacaa

SEQ ID NO: 3143305 - DNA, 20 bp, Homo sapiens
ctccaaaacccatgtgggaa

SEQ ID NO: 3143306 - DNA, 23 bp, Homo sapiens
ctccaaactgaagcagcctctcc

SEQ ID NO: 3143307 - DNA, 22 bp, Homo sapiens
ctccaaaggggctgctggggca

SEQ ID NO: 3143308 - DNA, 22 bp, Homo sapiens
ctccaaccaaataagacttcca

SEQ ID NO: 3143309 - DNA, 18 bp, Homo sapiens
ctccaacgcccctgtggc

SEQ ID NO: 3143310 - DNA, 21 bp, Homo sapiens
ctccaacgcccctgtggccaa

SEQ ID NO: 3143311 - DNA, 14 bp, Homo sapiens
ctccaagacctagg

SEQ ID NO: 3143312 - DNA, 16 bp, Homo sapiens
ctccaagacctaggct

SEQ ID NO: 3143313 - DNA, 21 bp, Homo sapiens
ctccaagacctgttggttcca

SEQ ID NO: 3143314 - DNA, 16 bp, Homo sapiens
ctccaagataagcctg

SEQ ID NO: 3143315 - DNA, 17 bp, Homo sapiens
ctccaagataagcctga

SEQ ID NO: 3143316 - DNA, 19 bp, Homo sapiens
ctccaagataagcctgagc

SEQ ID NO: 3143317 - DNA, 21 bp, Homo sapiens
ctccaagataagcctgagcct

SEQ ID NO: 3143318 - DNA, 13 bp, Homo sapiens
ctccaagattcta

SEQ ID NO: 3143319 - DNA, 17 bp, Homo sapiens
ctccaagattctagatg

SEQ ID NO: 3143320 - DNA, 17 bp, Homo sapiens
ctccaagcctgcctccc

SEQ ID NO: 3143321 - DNA, 14 bp, Homo sapiens
ctccaagctccatc

SEQ ID NO: 3143322 - DNA, 20 bp, Homo sapiens
ctccaaggaggggctgtaaa

SEQ ID NO: 3143323 - DNA, 22 bp, Homo sapiens
ctccaaggaggggctgtaaaat

SEQ ID NO: 3143324 - DNA, 17 bp, Homo sapiens
ctccaaggatcctctcc

SEQ ID NO: 3143325 - DNA, 19 bp, Homo sapiens
ctccaagggaccctttgcc

SEQ ID NO: 3143326 - DNA, 21 bp, Homo sapiens
ctccaagggaccctttgcctt

SEQ ID NO: 3143327 - DNA, 18 bp, Homo sapiens
ctccaagggcttctgcac

SEQ ID NO: 3143328 - DNA, 21 bp, Homo sapiens
ctccaagggtttcgactggtc

SEQ ID NO: 3143329 - DNA, 23 bp, Homo sapiens
ctccaagggtttcgactggtcca

SEQ ID NO: 3143330 - DNA, 13 bp, Homo sapiens
ctccaagtctctc

SEQ ID NO: 3143331 - DNA, 18 bp, Homo sapiens
ctccaagtgccagaggtg

SEQ ID NO: 3143332 - DNA, 22 bp, Homo sapiens
ctccaagtgccagaggtgggca

SEQ ID NO: 3143333 - DNA, 20 bp, Homo sapiens
ctccaataaagtgccttctg

SEQ ID NO: 3143334 - DNA, 15 bp, Homo sapiens
ctccaatctggtaat

SEQ ID NO: 3143335 - DNA, 17 bp, Homo sapiens
ctccaatgtctgctgag

SEQ ID NO: 3143336 - DNA, 15 bp, Homo sapiens
ctccacacaagggaa

SEQ ID NO: 3143337 - DNA, 20 bp, Homo sapiens
ctccacacaagggaaggaca

SEQ ID NO: 3143338 - DNA, 15 bp, Homo sapiens
ctccacaccagtggc

SEQ ID NO: 3143339 - DNA, 17 bp, Homo sapiens
ctccacaccagtggcct

SEQ ID NO: 3143340 - DNA, 14 bp, Homo sapiens
ctccacagcgaggg

SEQ ID NO: 3143341 - DNA, 13 bp, Homo sapiens
ctccacagtgctg

SEQ ID NO: 3143342 - DNA, 12 bp, Homo sapiens
ctccacatcctg

SEQ ID NO: 3143343 - DNA, 15 bp, Homo sapiens
ctccacatcctgtgt

SEQ ID NO: 3143344 - DNA, 16 bp, Homo sapiens
ctccacatcctgtgtc

SEQ ID NO: 3143345 - DNA, 17 bp, Homo sapiens
ctccacatcctgtgtca

SEQ ID NO: 3143346 - DNA, 14 bp, Homo sapiens
ctccacatctgcct

SEQ ID NO: 3143347 - DNA, 16 bp, Homo sapiens
ctccacatctgcctta

SEQ ID NO: 3143348 - DNA, 17 bp, Homo sapiens
ctccaccacatctgcca

SEQ ID NO: 3143349 - DNA, 21 bp, Homo sapiens
ctccaccaccactggccacca

SEQ ID NO: 3143350 - DNA, 14 bp, Homo sapiens
ctccaccagcagca

SEQ ID NO: 3143351 - DNA, 17 bp, Homo sapiens
ctccaccatccccaccc

SEQ ID NO: 3143352 - DNA, 17 bp, Homo sapiens
ctccaccccacagaacc

SEQ ID NO: 3143353 - DNA, 18 bp, Homo sapiens
ctccaccctgtcccccag

SEQ ID NO: 3143354 - DNA, 22 bp, Homo sapiens
ctccaccctgtcccccagctct

SEQ ID NO: 3143355 - DNA, 12 bp, Homo sapiens
ctccacccttgg

SEQ ID NO: 3143356 - DNA, 15 bp, Homo sapiens
ctccacccttggcct

SEQ ID NO: 3143357 - DNA, 17 bp, Homo sapiens
ctccacccttggcctgt

SEQ ID NO: 3143358 - DNA, 22 bp, Homo sapiens
ctccaccgttcaagcgccagaa

SEQ ID NO: 3143359 - DNA, 12 bp, Homo sapiens
ctccacctacca

SEQ ID NO: 3143360 - DNA, 12 bp, Homo sapiens
ctccacctgtga

SEQ ID NO: 3143361 - DNA, 14 bp, Homo sapiens
ctccacctgtgaga

SEQ ID NO: 3143362 - DNA, 21 bp, Homo sapiens
ctccacgaagccttaagccat

SEQ ID NO: 3143363 - DNA, 23 bp, Homo sapiens
ctccacgatcctgccaccctgta

SEQ ID NO: 3143364 - DNA, 19 bp, Homo sapiens
ctccacgcctcctggccag

SEQ ID NO: 3143365 - DNA, 15 bp, Homo sapiens
ctccacggagagccc

SEQ ID NO: 3143366 - DNA, 14 bp, Homo sapiens
ctccacgggcaggg

SEQ ID NO: 3143367 - DNA, 21 bp, Homo sapiens
ctccacggtagcacttgacct

SEQ ID NO: 3143368 - DNA, 15 bp, Homo sapiens
ctccactcagctgtc

SEQ ID NO: 3143369 - DNA, 18 bp, Homo sapiens
ctccactcagctgtcctg

SEQ ID NO: 3143370 - DNA, 15 bp, Homo sapiens
ctccactccatccct

SEQ ID NO: 3143371 - DNA, 18 bp, Homo sapiens
ctccactcctcatcccca

SEQ ID NO: 3143372 - DNA, 14 bp, Homo sapiens
ctccactcgaccca

SEQ ID NO: 3143373 - DNA, 16 bp, Homo sapiens
ctccactctgcttctc

SEQ ID NO: 3143374 - DNA, 15 bp, Homo sapiens
ctccactgccctggc

SEQ ID NO: 3143375 - DNA, 16 bp, Homo sapiens
ctccactgccctggca

SEQ ID NO: 3143376 - DNA, 17 bp, Homo sapiens
ctccactgccctggcag

SEQ ID NO: 3143377 - DNA, 17 bp, Homo sapiens
ctccactggacagaccc

SEQ ID NO: 3143378 - DNA, 22 bp, Homo sapiens
ctccactggacagacccaggtc

SEQ ID NO: 3143379 - DNA, 16 bp, Homo sapiens
ctccactggatggagg

SEQ ID NO: 3143380 - DNA, 15 bp, Homo sapiens
ctcccaacccattca

SEQ ID NO: 3143381 - DNA, 22 bp, Homo sapiens
ctcccaacccccctcctgctcc

SEQ ID NO: 3143382 - DNA, 23 bp, Homo sapiens
ctcccaacccccctcctgctcct

SEQ ID NO: 3143383 - DNA, 20 bp, Homo sapiens
ctcccaagctatctaaagtt

SEQ ID NO: 3143384 - DNA, 22 bp, Homo sapiens
ctcccaaggctgcgtctggagg

SEQ ID NO: 3143385 - DNA, 21 bp, Homo sapiens
ctcccaaggggcccaaattct

SEQ ID NO: 3143386 - DNA, 20 bp, Homo sapiens
ctcccacaagtatatacttt

SEQ ID NO: 3143387 - DNA, 20 bp, Homo sapiens
ctcccacactgaaaccaaaa

SEQ ID NO: 3143388 - DNA, 15 bp, Homo sapiens
ctcccacaggccctt

SEQ ID NO: 3143389 - DNA, 21 bp, Homo sapiens
ctcccacatgaggccatctca

SEQ ID NO: 3143390 - DNA, 22 bp, Homo sapiens
ctcccaccactccactcctcca

SEQ ID NO: 3143391 - DNA, 14 bp, Homo sapiens
ctcccaccagagac

SEQ ID NO: 3143392 - DNA, 19 bp, Homo sapiens
ctcccacccccatctctcc

SEQ ID NO: 3143393 - DNA, 17 bp, Homo sapiens
ctcccacccggctgcag

SEQ ID NO: 3143394 - DNA, 12 bp, Homo sapiens
ctcccaccctgt

SEQ ID NO: 3143395 - DNA, 13 bp, Homo sapiens
ctcccaccctgta

SEQ ID NO: 3143396 - DNA, 20 bp, Homo sapiens
ctcccaccctgtacctcatc

SEQ ID NO: 3143397 - DNA, 13 bp, Homo sapiens
ctcccaccgcccc

SEQ ID NO: 3143398 - DNA, 12 bp, Homo sapiens
ctcccacctcag

SEQ ID NO: 3143399 - DNA, 17 bp, Homo sapiens
ctcccacctcagcctcc

SEQ ID NO: 3143400 - DNA, 15 bp, Homo sapiens
ctcccacctctcctt

SEQ ID NO: 3143401 - DNA, 12 bp, Homo sapiens
ctcccacctctg

SEQ ID NO: 3143402 - DNA, 15 bp, Homo sapiens
ctcccacctctgtga

SEQ ID NO: 3143403 - DNA, 18 bp, Homo sapiens
ctcccacctctgtgacct

SEQ ID NO: 3143404 - DNA, 19 bp, Homo sapiens
ctcccacctctgtgacctc

SEQ ID NO: 3143405 - DNA, 20 bp, Homo sapiens
ctcccacctctgtgacctca

SEQ ID NO: 3143406 - DNA, 14 bp, Homo sapiens
ctcccacctgacac

SEQ ID NO: 3143407 - DNA, 21 bp, Homo sapiens
ctcccacgcctgtcctcctgg

SEQ ID NO: 3143408 - DNA, 21 bp, Homo sapiens
ctcccagaatcccagccggcc

SEQ ID NO: 3143409 - DNA, 22 bp, Homo sapiens
ctcccagaggagccaccagttc

SEQ ID NO: 3143410 - DNA, 23 bp, Homo sapiens
ctcccagaggagccaccagttct

SEQ ID NO: 3143411 - DNA, 15 bp, Homo sapiens
ctcccagaggtccag

SEQ ID NO: 3143412 - DNA, 21 bp, Homo sapiens
ctcccagaggtccagcccatc

SEQ ID NO: 3143413 - DNA, 14 bp, Homo sapiens
ctcccagcactccc

SEQ ID NO: 3143414 - DNA, 16 bp, Homo sapiens
ctcccagccctatgga

SEQ ID NO: 3143415 - DNA, 11 bp, Homo sapiens
ctcccagcctg

SEQ ID NO: 3143416 - DNA, 23 bp, Homo sapiens
ctcccagcctgccctccagctgc

SEQ ID NO: 3143417 - DNA, 13 bp, Homo sapiens
ctcccagcctgct

SEQ ID NO: 3143418 - DNA, 14 bp, Homo sapiens
ctcccagcctgctg

SEQ ID NO: 3143419 - DNA, 20 bp, Homo sapiens
ctcccagcctgctgagagcc

SEQ ID NO: 3143420 - DNA, 16 bp, Homo sapiens
ctcccagcgtgtgtat

SEQ ID NO: 3143421 - DNA, 14 bp, Homo sapiens
ctcccagctccttt

SEQ ID NO: 3143422 - DNA, 14 bp, Homo sapiens
ctcccagctgtgct

SEQ ID NO: 3143423 - DNA, 17 bp, Homo sapiens
ctcccagctgtgctgtg

SEQ ID NO: 3143424 - DNA, 18 bp, Homo sapiens
ctcccagctgtgctgtgg

SEQ ID NO: 3143425 - DNA, 16 bp, Homo sapiens
ctcccaggagacagtt

SEQ ID NO: 3143426 - DNA, 18 bp, Homo sapiens
ctcccaggccccctgcat

SEQ ID NO: 3143427 - DNA, 12 bp, Homo sapiens
ctcccaggcccg

SEQ ID NO: 3143428 - DNA, 20 bp, Homo sapiens
ctcccaggcgccccttcccc

SEQ ID NO: 3143429 - DNA, 22 bp, Homo sapiens
ctcccagggccagggccctgca

SEQ ID NO: 3143430 - DNA, 13 bp, Homo sapiens
ctcccaggggtct

SEQ ID NO: 3143431 - DNA, 21 bp, Homo sapiens
ctcccaggggtctccctggct

SEQ ID NO: 3143432 - DNA, 17 bp, Homo sapiens
ctcccaggtaccagctg

SEQ ID NO: 3143433 - DNA, 18 bp, Homo sapiens
ctcccaggtaccagctgc

SEQ ID NO: 3143434 - DNA, 21 bp, Homo sapiens
ctcccaggtaccagctgcgct

SEQ ID NO: 3143435 - DNA, 22 bp, Homo sapiens
ctcccaggtgttaacattccaa

SEQ ID NO: 3143436 - DNA, 22 bp, Homo sapiens
ctcccaggttcccccagcaagc

SEQ ID NO: 3143437 - DNA, 16 bp, Homo sapiens
ctcccagtcctccaga

SEQ ID NO: 3143438 - DNA, 19 bp, Homo sapiens
ctcccagtcctccagacca

SEQ ID NO: 3143439 - DNA, 21 bp, Homo sapiens
ctcccatcattacccttccct

SEQ ID NO: 3143440 - DNA, 14 bp, Homo sapiens
ctcccatccccctg

SEQ ID NO: 3143441 - DNA, 24 bp, Homo sapiens
ctcccatccccctgccctcgtggc

SEQ ID NO: 3143442 - DNA, 13 bp, Homo sapiens
ctcccatcccctg

SEQ ID NO: 3143443 - DNA, 16 bp, Homo sapiens
ctcccatcccctggac

SEQ ID NO: 3143444 - DNA, 23 bp, Homo sapiens
ctcccatcccctggactgggagg

SEQ ID NO: 3143445 - DNA, 16 bp, Homo sapiens
ctcccatgaccatact

SEQ ID NO: 3143446 - DNA, 16 bp, Homo sapiens
ctcccatgcctggtcc

SEQ ID NO: 3143447 - DNA, 16 bp, Homo sapiens
ctccccacagcctctg

SEQ ID NO: 3143448 - DNA, 15 bp, Homo sapiens
ctccccacagcgtcc

SEQ ID NO: 3143449 - DNA, 20 bp, Homo sapiens
ctccccacagcgtccctggc

SEQ ID NO: 3143450 - DNA, 16 bp, Homo sapiens
ctccccacgagggctg

SEQ ID NO: 3143451 - DNA, 18 bp, Homo sapiens
ctccccacgagggctggc

SEQ ID NO: 3143452 - DNA, 24 bp, Homo sapiens
ctccccacgagtcacctgcaagcc

SEQ ID NO: 3143453 - DNA, 21 bp, Homo sapiens
ctccccacggccgctccaggg

SEQ ID NO: 3143454 - DNA, 11 bp, Homo sapiens
ctccccactcc

SEQ ID NO: 3143455 - DNA, 16 bp, Homo sapiens
ctccccagagcactgg

SEQ ID NO: 3143456 - DNA, 18 bp, Homo sapiens
ctccccagagctgtgcca

SEQ ID NO: 3143457 - DNA, 23 bp, Homo sapiens
ctccccagagctgtgccagcagg

SEQ ID NO: 3143458 - DNA, 19 bp, Homo sapiens
ctccccagcattccagccc

SEQ ID NO: 3143459 - DNA, 11 bp, Homo sapiens
ctccccagccc

SEQ ID NO: 3143460 - DNA, 13 bp, Homo sapiens
ctccccagccctg

SEQ ID NO: 3143461 - DNA, 16 bp, Homo sapiens
ctccccagccctggct

SEQ ID NO: 3143462 - DNA, 12 bp, Homo sapiens
ctccccaggcct

SEQ ID NO: 3143463 - DNA, 11 bp, Homo sapiens
ctccccagggc

SEQ ID NO: 3143464 - DNA, 13 bp, Homo sapiens
ctccccagggctc

SEQ ID NO: 3143465 - DNA, 18 bp, Homo sapiens
ctccccaggtccagctct

SEQ ID NO: 3143466 - DNA, 19 bp, Homo sapiens
ctccccaggtccagctctg

SEQ ID NO: 3143467 - DNA, 21 bp, Homo sapiens
ctccccaggtccagctctgga

SEQ ID NO: 3143468 - DNA, 23 bp, Homo sapiens
ctccccaggtccagctctggagg

SEQ ID NO: 3143469 - DNA, 13 bp, Homo sapiens
ctccccagtacag

SEQ ID NO: 3143470 - DNA, 16 bp, Homo sapiens
ctccccagtgtatgtc

SEQ ID NO: 3143471 - DNA, 15 bp, Homo sapiens
gttttaactgtggat

SEQ ID NO: 3143472 - DNA, 22 bp, Homo sapiens
gttttaactgtggatattgtta

SEQ ID NO: 3143473 - DNA, 15 bp, Homo sapiens
gttttaacttccagt

SEQ ID NO: 3143474 - DNA, 19 bp, Homo sapiens
gttttaatctgaaattcta

SEQ ID NO: 3143475 - DNA, 21 bp, Homo sapiens
gttttaatctgaaattctaaa

SEQ ID NO: 3143476 - DNA, 20 bp, Homo sapiens
gttttaattccaatatgatg

SEQ ID NO: 3143477 - DNA, 23 bp, Homo sapiens
gttttaattccaatatgatgact

SEQ ID NO: 3143478 - DNA, 12 bp, Homo sapiens
gttttaattgta

SEQ ID NO: 3143479 - DNA, 14 bp, Homo sapiens
gttttaatttaaac

SEQ ID NO: 3143480 - DNA, 23 bp, Homo sapiens
gttttacaataaaatcttgaaaa

SEQ ID NO: 3143481 - DNA, 12 bp, Homo sapiens
gttttacattgt

SEQ ID NO: 3143482 - DNA, 21 bp, Homo sapiens
gttttacattgttgagctatt

SEQ ID NO: 3143483 - DNA, 14 bp, Homo sapiens
gttttacatttgga

SEQ ID NO: 3143484 - DNA, 21 bp, Homo sapiens
gttttacatttggattagaaa

SEQ ID NO: 3143485 - DNA, 17 bp, Homo sapiens
gttttactgtcagatta

SEQ ID NO: 3143486 - DNA, 19 bp, Homo sapiens
gttttactgtcagattaaa

SEQ ID NO: 3143487 - DNA, 13 bp, Homo sapiens
gttttactgtcta

SEQ ID NO: 3143488 - DNA, 20 bp, Homo sapiens
gttttactgttttaattgta

SEQ ID NO: 3143489 - DNA, 13 bp, Homo sapiens
gttttacttttaa

SEQ ID NO: 3143490 - DNA, 18 bp, Homo sapiens
gttttacttttaaactgt

SEQ ID NO: 3143491 - DNA, 21 bp, Homo sapiens
gttttagattttctggttcta

SEQ ID NO: 3143492 - DNA, 18 bp, Homo sapiens
gttttagcattgtcttgt

SEQ ID NO: 3143493 - DNA, 20 bp, Homo sapiens
gttttagcggggagggggat

SEQ ID NO: 3143494 - DNA, 12 bp, Homo sapiens
gttttaggttct

SEQ ID NO: 3143495 - DNA, 15 bp, Homo sapiens
gttttaggttctaaa

SEQ ID NO: 3143496 - DNA, 16 bp, Homo sapiens
gttttataatgaaccc

SEQ ID NO: 3143497 - DNA, 15 bp, Homo sapiens
gttttatactgaagg

SEQ ID NO: 3143498 - DNA, 14 bp, Homo sapiens
gttttattcattgg

SEQ ID NO: 3143499 - DNA, 15 bp, Homo sapiens
gttttattctgactt

SEQ ID NO: 3143500 - DNA, 20 bp, Homo sapiens
gttttattctgacttcctct

SEQ ID NO: 3143501 - DNA, 17 bp, Homo sapiens
gttttattcttggtttt

SEQ ID NO: 3143502 - DNA, 17 bp, Homo sapiens
gttttcaaattggactt

SEQ ID NO: 3143503 - DNA, 19 bp, Homo sapiens
gttttcacttgtattgact

SEQ ID NO: 3143504 - DNA, 20 bp, Homo sapiens
gttttcagaacctcttcccc

SEQ ID NO: 3143505 - DNA, 22 bp, Homo sapiens
gttttcaggttgcccatttata

SEQ ID NO: 3143506 - DNA, 16 bp, Homo sapiens
gttttcagtgtacatg

SEQ ID NO: 3143507 - DNA, 14 bp, Homo sapiens
gttttcataataaa

SEQ ID NO: 3143508 - DNA, 22 bp, Homo sapiens
gttttcataataaaactttaaa

SEQ ID NO: 3143509 - DNA, 21 bp, Homo sapiens
gttttcatggtgaaaatgtac

SEQ ID NO: 3143510 - DNA, 16 bp, Homo sapiens
gttttcattatgttca

SEQ ID NO: 3143511 - DNA, 19 bp, Homo sapiens
gttttcattcccccttcct

SEQ ID NO: 3143512 - DNA, 11 bp, Homo sapiens
gttttccaaac

SEQ ID NO: 3143513 - DNA, 17 bp, Homo sapiens
gttttctcagaacagct

SEQ ID NO: 3143514 - DNA, 16 bp, Homo sapiens
gttttctcctcccagg

SEQ ID NO: 3143515 - DNA, 17 bp, Homo sapiens
gttttctctttgtgggg

SEQ ID NO: 3143516 - DNA, 15 bp, Homo sapiens
gttttctgagcccgg

SEQ ID NO: 3143517 - DNA, 17 bp, Homo sapiens
gttttctgtagtcattt

SEQ ID NO: 3143518 - DNA, 22 bp, Homo sapiens
gttttcttcaagggaagaaaca

SEQ ID NO: 3143519 - DNA, 23 bp, Homo sapiens
gttttcttcaagggaagaaacac

SEQ ID NO: 3143520 - DNA, 19 bp, Homo sapiens
gttttcttgtaaatgtttc

SEQ ID NO: 3143521 - DNA, 20 bp, Homo sapiens
gttttctttctttaaatgtt

SEQ ID NO: 3143522 - DNA, 14 bp, Homo sapiens
gttttgaaaagcta

SEQ ID NO: 3143523 - DNA, 18 bp, Homo sapiens
gttttgaaagaaaaatac

SEQ ID NO: 3143524 - DNA, 22 bp, Homo sapiens
gttttgaactaataaaagcata

SEQ ID NO: 3143525 - DNA, 19 bp, Homo sapiens
gttttgaagctactgtgtg

SEQ ID NO: 3143526 - DNA, 18 bp, Homo sapiens
gttttgaatggtgttgta

SEQ ID NO: 3143527 - DNA, 12 bp, Homo sapiens
gttttgaatttt

SEQ ID NO: 3143528 - DNA, 21 bp, Homo sapiens
gttttgaattttgtttttatt

SEQ ID NO: 3143529 - DNA, 21 bp, Homo sapiens
gttttgatgaaattcttgaag

SEQ ID NO: 3143530 - DNA, 13 bp, Homo sapiens
gttttgcactttt

SEQ ID NO: 3143531 - DNA, 20 bp, Homo sapiens
gttttgccatgttggccagg

SEQ ID NO: 3143532 - DNA, 22 bp, Homo sapiens
gttttgccatgttggccaggct

SEQ ID NO: 3143533 - DNA, 18 bp, Homo sapiens
gttttggacagtttacca

SEQ ID NO: 3143534 - DNA, 22 bp, Homo sapiens
gttttggctgaaattctcctgg

SEQ ID NO: 3143535 - DNA, 15 bp, Homo sapiens
gttttgggtatgttt

SEQ ID NO: 3143536 - DNA, 16 bp, Homo sapiens
gttttgggtgaatctt

SEQ ID NO: 3143537 - DNA, 16 bp, Homo sapiens
gttttggttaataaaa

SEQ ID NO: 3143538 - DNA, 18 bp, Homo sapiens
gttttgtaagatgctggg

SEQ ID NO: 3143539 - DNA, 23 bp, Homo sapiens
gttttgtaagatgctgggttggt

SEQ ID NO: 3143540 - DNA, 20 bp, Homo sapiens
gttttgtacaaagttttcct

SEQ ID NO: 3143541 - DNA, 15 bp, Homo sapiens
gttttgtacactgct

SEQ ID NO: 3143542 - DNA, 14 bp, Homo sapiens
gttttgtacataga

SEQ ID NO: 3143543 - DNA, 21 bp, Homo sapiens
gttttgtataaataataaaga

SEQ ID NO: 3143544 - DNA, 17 bp, Homo sapiens
gttttgtatatacagtt

SEQ ID NO: 3143545 - DNA, 20 bp, Homo sapiens
gttttgtattttttaaaaca

SEQ ID NO: 3143546 - DNA, 17 bp, Homo sapiens
gttttgtcaaactgtag

SEQ ID NO: 3143547 - DNA, 14 bp, Homo sapiens
gttttgtcttgaat

SEQ ID NO: 3143548 - DNA, 24 bp, Homo sapiens
gttttgtgactatatagagatgtt

SEQ ID NO: 3143549 - DNA, 16 bp, Homo sapiens
gttttgtgttgtgtct

SEQ ID NO: 3143550 - DNA, 15 bp, Homo sapiens
gttttgtttgtctct

SEQ ID NO: 3143551 - DNA, 18 bp, Homo sapiens
gtttttaaaagtttcaat

SEQ ID NO: 3143552 - DNA, 18 bp, Homo sapiens
gtttttaaatagagtttg

SEQ ID NO: 3143553 - DNA, 18 bp, Homo sapiens
gtttttaacaatctaaca

SEQ ID NO: 3143554 - DNA, 20 bp, Homo sapiens
gtttttaatctttgtgacag

SEQ ID NO: 3143555 - DNA, 23 bp, Homo sapiens
gtttttaatgaccaattgagtaa

SEQ ID NO: 3143556 - DNA, 24 bp, Homo sapiens
gtttttaatgaccaattgagtaag

SEQ ID NO: 3143557 - DNA, 17 bp, Homo sapiens
gtttttacagctgtgtt

SEQ ID NO: 3143558 - DNA, 21 bp, Homo sapiens
gtttttacctaccacagtgtc

SEQ ID NO: 3143559 - DNA, 21 bp, Homo sapiens
gtttttagacaccttcatttt

SEQ ID NO: 3143560 - DNA, 21 bp, Homo sapiens
gtttttaggctgttccttgta

SEQ ID NO: 3143561 - DNA, 17 bp, Homo sapiens
gtttttattaatttata

SEQ ID NO: 3143562 - DNA, 16 bp, Homo sapiens
gtttttattccttgtg

SEQ ID NO: 3143563 - DNA, 17 bp, Homo sapiens
gtttttcatttgttttg

SEQ ID NO: 3143564 - DNA, 21 bp, Homo sapiens
gtttttcatttgttttgcttt

SEQ ID NO: 3143565 - DNA, 18 bp, Homo sapiens
gtttttcctatcatgtta

SEQ ID NO: 3143566 - DNA, 17 bp, Homo sapiens
gtttttccttatttgct

SEQ ID NO: 3143567 - DNA, 15 bp, Homo sapiens
gtttttcctttaaaa

SEQ ID NO: 3143568 - DNA, 11 bp, Homo sapiens
gtttttctcac

SEQ ID NO: 3143569 - DNA, 16 bp, Homo sapiens
gtttttctccagtgct

SEQ ID NO: 3143570 - DNA, 16 bp, Homo sapiens
gtttttctgggtggcc

SEQ ID NO: 3143571 - DNA, 23 bp, Homo sapiens
gtttttcttcaacatcaatgttc

SEQ ID NO: 3143572 - DNA, 18 bp, Homo sapiens
gtttttctttttccacaa

SEQ ID NO: 3143573 - DNA, 15 bp, Homo sapiens
gtttttgaaatacct

SEQ ID NO: 3143574 - DNA, 15 bp, Homo sapiens
gtttttgcatgaaat

SEQ ID NO: 3143575 - DNA, 13 bp, Homo sapiens
gtttttgggatgt

SEQ ID NO: 3143576 - DNA, 20 bp, Homo sapiens
gtttttgtatctttatgctg

SEQ ID NO: 3143577 - DNA, 17 bp, Homo sapiens
gtttttgtgctgtgggc

SEQ ID NO: 3143578 - DNA, 15 bp, Homo sapiens
gtttttgtttggaga

SEQ ID NO: 3143579 - DNA, 16 bp, Homo sapiens
gtttttgtttttgcat

SEQ ID NO: 3143580 - DNA, 12 bp, Homo sapiens
gttttttaagtc

SEQ ID NO: 3143581 - DNA, 20 bp, Homo sapiens
gttttttcctcagtgcattt

SEQ ID NO: 3143582 - DNA, 16 bp, Homo sapiens
gttttttcctttgctc

SEQ ID NO: 3143583 - DNA, 18 bp, Homo sapiens
gttttttgtaactacaaa

SEQ ID NO: 3143584 - DNA, 13 bp, Homo sapiens
gtttttttaatga

SEQ ID NO: 3143585 - DNA, 18 bp, Homo sapiens
gtttttttacaacattca

SEQ ID NO: 3143586 - DNA, 16 bp, Homo sapiens
gtttttttttttaaaa

SEQ ID NO: 3143587 - DNA, 22 bp, Homo sapiens
gtttttttttttaaaaaaagaa

SEQ ID NO: 3143588 - DNA, 20 bp, Homo sapiens
gtttttttttttttacatgt

SEQ ID NO: 3143589 - DNA, 20 bp, Homo sapiens
gttttttttttttttatgtg

SEQ ID NO: 3143590 - DNA, 23 bp, Homo sapiens
gttttttttttttttatgtgatc

SEQ ID NO: 3143591 - DNA, 23 bp, Homo sapiens
taaaaaaaaaaaaaaaagactaa

SEQ ID NO: 3143592 - DNA, 22 bp, Homo sapiens
taaaaaaaaaaaaaatgttctt

SEQ ID NO: 3143593 - DNA, 17 bp, Homo sapiens
taaaaaaaaaaggatga

SEQ ID NO: 3143594 - DNA, 15 bp, Homo sapiens
taaaaaaaaaagtca

SEQ ID NO: 3143595 - DNA, 17 bp, Homo sapiens
taaaaaaaaaagttaca

SEQ ID NO: 3143596 - DNA, 19 bp, Homo sapiens
taaaaaaaaagatctgttt

SEQ ID NO: 3143597 - DNA, 15 bp, Homo sapiens
taaaaaaaaatgcct

SEQ ID NO: 3143598 - DNA, 11 bp, Homo sapiens
taaaaaaagaa

SEQ ID NO: 3143599 - DNA, 13 bp, Homo sapiens
taaaaaaagaaaa

SEQ ID NO: 3143600 - DNA, 14 bp, Homo sapiens
taaaaaaagaaaat

SEQ ID NO: 3143601 - DNA, 13 bp, Homo sapiens
taaaaaaagcaaa

SEQ ID NO: 3143602 - DNA, 21 bp, Homo sapiens
taaaaaaagcaaaaatgacaa

SEQ ID NO: 3143603 - DNA, 17 bp, Homo sapiens
taaaaaaagtgcatgat

SEQ ID NO: 3143604 - DNA, 20 bp, Homo sapiens
taaaaaaataataataatgt

SEQ ID NO: 3143605 - DNA, 13 bp, Homo sapiens
taaaaaaattggt

SEQ ID NO: 3143606 - DNA, 16 bp, Homo sapiens
taaaaaaatttaagtg

SEQ ID NO: 3143607 - DNA, 17 bp, Homo sapiens
taaaaaaatttaagtgc

SEQ ID NO: 3143608 - DNA, 11 bp, Homo sapiens
taaaaaacaac

SEQ ID NO: 3143609 - DNA, 12 bp, Homo sapiens
taaaaaacattt

SEQ ID NO: 3143610 - DNA, 13 bp, Homo sapiens
taaaaaacatttt

SEQ ID NO: 3143611 - DNA, 15 bp, Homo sapiens
taaaaaacttgtaaa

SEQ ID NO: 3143612 - DNA, 21 bp, Homo sapiens
taaaaaagactgaacatgttt

SEQ ID NO: 3143613 - DNA, 18 bp, Homo sapiens
taaaaaagcatacttcta

SEQ ID NO: 3143614 - DNA, 22 bp, Homo sapiens
taaaaaagtctctatttaaatt

SEQ ID NO: 3143615 - DNA, 20 bp, Homo sapiens
taaaaaagttattatgtagc

SEQ ID NO: 3143616 - DNA, 15 bp, Homo sapiens
taaaaaatctgaaga

SEQ ID NO: 3143617 - DNA, 16 bp, Homo sapiens
taaaaaatggaaaaaa

SEQ ID NO: 3143618 - DNA, 14 bp, Homo sapiens
taaaaaatgtaaca

SEQ ID NO: 3143619 - DNA, 16 bp, Homo sapiens
taaaaaatgtaacatc

SEQ ID NO: 3143620 - DNA, 19 bp, Homo sapiens
taaaaacactacttttgct

SEQ ID NO: 3143621 - DNA, 16 bp, Homo sapiens
taaaaacagcattgct

SEQ ID NO: 3143622 - DNA, 18 bp, Homo sapiens
taaaaacagcattgcttt

SEQ ID NO: 3143623 - DNA, 19 bp, Homo sapiens
taaaaacagcattgctttc

SEQ ID NO: 3143624 - DNA, 15 bp, Homo sapiens
taaaaacattttgaa

SEQ ID NO: 3143625 - DNA, 19 bp, Homo sapiens
taaaaaccaaacccagaca

SEQ ID NO: 3143626 - DNA, 18 bp, Homo sapiens
taaaaaccagacaaggaa

SEQ ID NO: 3143627 - DNA, 19 bp, Homo sapiens
taaaaaccatgctggtata

SEQ ID NO: 3143628 - DNA, 16 bp, Homo sapiens
taaaaacccacaaaaa

SEQ ID NO: 3143629 - DNA, 17 bp, Homo sapiens
taaaaacccacaaaaat

SEQ ID NO: 3143630 - DNA, 20 bp, Homo sapiens
taaaaacctgaactttcatt

SEQ ID NO: 3143631 - DNA, 17 bp, Homo sapiens
taaaaactaatttcata

SEQ ID NO: 3143632 - DNA, 15 bp, Homo sapiens
taaaaactcttcagt

SEQ ID NO: 3143633 - DNA, 13 bp, Homo sapiens
taaaaagattctt

SEQ ID NO: 3143634 - DNA, 19 bp, Homo sapiens
taaaaagattctttttctg

SEQ ID NO: 3143635 - DNA, 21 bp, Homo sapiens
taaaaagcagaattttaatgt

SEQ ID NO: 3143636 - DNA, 23 bp, Homo sapiens
taaaaagccactagactcttcac

SEQ ID NO: 3143637 - DNA, 22 bp, Homo sapiens
taaaaagcctgcaatttcatat

SEQ ID NO: 3143638 - DNA, 12 bp, Homo sapiens
taaaaagctcac

SEQ ID NO: 3143639 - DNA, 20 bp, Homo sapiens
taaaaagcttccatgattct

SEQ ID NO: 3143640 - DNA, 23 bp, Homo sapiens
taaaaaggactatattaatcacc

SEQ ID NO: 3143641 - DNA, 18 bp, Homo sapiens
taaaaaggccaaagataa

SEQ ID NO: 3143642 - DNA, 20 bp, Homo sapiens
taaaaaggccaaagataaaa

SEQ ID NO: 3143643 - DNA, 19 bp, Homo sapiens
taaaaagtaccagcatgtt

SEQ ID NO: 3143644 - DNA, 16 bp, Homo sapiens
taaaaagtatatgtta

SEQ ID NO: 3143645 - DNA, 22 bp, Homo sapiens
taaaaagtccataccttatata

SEQ ID NO: 3143646 - DNA, 14 bp, Homo sapiens
taaaaagtcttcac

SEQ ID NO: 3143647 - DNA, 18 bp, Homo sapiens
taaaaagtgacacagcag

SEQ ID NO: 3143648 - DNA, 14 bp, Homo sapiens
taaaaagttgttca

SEQ ID NO: 3143649 - DNA, 15 bp, Homo sapiens
taaaaagttgttcaa

SEQ ID NO: 3143650 - DNA, 18 bp, Homo sapiens
taaaaagtttcacgtctt

SEQ ID NO: 3143651 - DNA, 20 bp, Homo sapiens
taaaaagttttagttttgat

SEQ ID NO: 3143652 - DNA, 21 bp, Homo sapiens
taaaaataaatagaaaagtag

SEQ ID NO: 3143653 - DNA, 14 bp, Homo sapiens
taaaaataaatccc

SEQ ID NO: 3143654 - DNA, 19 bp, Homo sapiens
taaaaataaatcccatgga

SEQ ID NO: 3143655 - DNA, 19 bp, Homo sapiens
taaaaatacttaaatttgg

SEQ ID NO: 3143656 - DNA, 22 bp, Homo sapiens
taaaaatatatatagtgctata

SEQ ID NO: 3143657 - DNA, 16 bp, Homo sapiens
taaaaatatccttgat

SEQ ID NO: 3143658 - DNA, 15 bp, Homo sapiens
taaaaatatgtacaa

SEQ ID NO: 3143659 - DNA, 13 bp, Homo sapiens
taaaaatattcct

SEQ ID NO: 3143660 - DNA, 22 bp, Homo sapiens
taaaaatattgtgttgtgaatg

SEQ ID NO: 3143661 - DNA, 17 bp, Homo sapiens
taaaaatatttcagata

SEQ ID NO: 3143662 - DNA, 16 bp, Homo sapiens
taaaaatcacactgta

SEQ ID NO: 3143663 - DNA, 18 bp, Homo sapiens
taaaaatgaaagtgactt

SEQ ID NO: 3143664 - DNA, 23 bp, Homo sapiens
taaaaatggcagggggtggaatt

SEQ ID NO: 3143665 - DNA, 21 bp, Homo sapiens
taaaaatggctcaagtagaaa

SEQ ID NO: 3143666 - DNA, 20 bp, Homo sapiens
taaaaatggtatcaaaatta

SEQ ID NO: 3143667 - DNA, 20 bp, Homo sapiens
taaaaatgtaaatattctat

SEQ ID NO: 3143668 - DNA, 15 bp, Homo sapiens
taaaaatgttctcaa

SEQ ID NO: 3143669 - DNA, 14 bp, Homo sapiens
taaaaattctgaat

SEQ ID NO: 3143670 - DNA, 17 bp, Homo sapiens
taaaaattgtgatcaga

SEQ ID NO: 3143671 - DNA, 22 bp, Homo sapiens
taaaaattgttaatttttccta

SEQ ID NO: 3143672 - DNA, 13 bp, Homo sapiens
taaaaattgtttc

SEQ ID NO: 3143673 - DNA, 14 bp, Homo sapiens
taaaaattgtttct

SEQ ID NO: 3143674 - DNA, 16 bp, Homo sapiens
taaaacaaaatctgaa

SEQ ID NO: 3143675 - DNA, 15 bp, Homo sapiens
taaaacaaaatttga

SEQ ID NO: 3143676 - DNA, 17 bp, Homo sapiens
taaaacaaaatttgttt

SEQ ID NO: 3143677 - DNA, 22 bp, Homo sapiens
taaaacaattttttttttcctc

SEQ ID NO: 3143678 - DNA, 14 bp, Homo sapiens
taaaacacacaggt

SEQ ID NO: 3143679 - DNA, 19 bp, Homo sapiens
taaaacacttccataatct

SEQ ID NO: 3143680 - DNA, 19 bp, Homo sapiens
taaaacagacactggcatg

SEQ ID NO: 3143681 - DNA, 12 bp, Homo sapiens
taaaacagctgt

SEQ ID NO: 3143682 - DNA, 20 bp, Homo sapiens
taaaacatatttcattttaa

SEQ ID NO: 3143683 - DNA, 15 bp, Homo sapiens
taaaaccctatacaa

SEQ ID NO: 3143684 - DNA, 16 bp, Homo sapiens
taaaacctgtcaatga

SEQ ID NO: 3143685 - DNA, 21 bp, Homo sapiens
taaaaccttgttctatttttc

SEQ ID NO: 3143686 - DNA, 20 bp, Homo sapiens
taaaacctttcaaatttcac

SEQ ID NO: 3143687 - DNA, 21 bp, Homo sapiens
taaaacctttcaaatttcaca

SEQ ID NO: 3143688 - DNA, 22 bp, Homo sapiens
taaaactatattcatttccact

SEQ ID NO: 3143689 - DNA, 12 bp, Homo sapiens
taaaactcagaa

SEQ ID NO: 3143690 - DNA, 21 bp, Homo sapiens
taaaactcgcttttattttaa

SEQ ID NO: 3143691 - DNA, 20 bp, Homo sapiens
taaaactgcacagtgctgtt

SEQ ID NO: 3143692 - DNA, 13 bp, Homo sapiens
taaaactgctttt

SEQ ID NO: 3143693 - DNA, 16 bp, Homo sapiens
taaaactgtcactgtt

SEQ ID NO: 3143694 - DNA, 16 bp, Homo sapiens
taaaacttaagatatt

SEQ ID NO: 3143695 - DNA, 18 bp, Homo sapiens
taaaacttatgctagttt

SEQ ID NO: 3143696 - DNA, 19 bp, Homo sapiens
taaaacttcaaaaactaaa

SEQ ID NO: 3143697 - DNA, 22 bp, Homo sapiens
taaaacttgatgtgttatctct

SEQ ID NO: 3143698 - DNA, 15 bp, Homo sapiens
taaaactttgctgcc

SEQ ID NO: 3143699 - DNA, 15 bp, Homo sapiens
taaaagaaaaaatga

SEQ ID NO: 3143700 - DNA, 18 bp, Homo sapiens
taaaagaacagtaaacat

SEQ ID NO: 3143701 - DNA, 17 bp, Homo sapiens
taaaagaatattcagag

SEQ ID NO: 3143702 - DNA, 15 bp, Homo sapiens
taaaagaatgactat

SEQ ID NO: 3143703 - DNA, 14 bp, Homo sapiens
taaaagacagcagg

SEQ ID NO: 3143704 - DNA, 19 bp, Homo sapiens
taaaagagagagagagaaa

SEQ ID NO: 3143705 - DNA, 13 bp, Homo sapiens
taaaagattcacc

SEQ ID NO: 3143706 - DNA, 22 bp, Homo sapiens
taaaagcagaaaataaaggaag

SEQ ID NO: 3143707 - DNA, 11 bp, Homo sapiens
taaaagcagca

SEQ ID NO: 3143708 - DNA, 20 bp, Homo sapiens
taaaagcagcatctgctaat

SEQ ID NO: 3143709 - DNA, 18 bp, Homo sapiens
taaaagcataaatgcaaa

SEQ ID NO: 3143710 - DNA, 21 bp, Homo sapiens
taaaagccaaccttcaaagaa

SEQ ID NO: 3143711 - DNA, 19 bp, Homo sapiens
taaaagctataaagtatat

SEQ ID NO: 3143712 - DNA, 12 bp, Homo sapiens
taaaagctatga

SEQ ID NO: 3143713 - DNA, 18 bp, Homo sapiens
taaaaggcttgaagctgt

SEQ ID NO: 3143714 - DNA, 20 bp, Homo sapiens
taaaaggtagagtcttacaa

SEQ ID NO: 3143715 - DNA, 14 bp, Homo sapiens
taaaagtaaacatt

SEQ ID NO: 3143716 - DNA, 15 bp, Homo sapiens
taaaagtactttaaa

SEQ ID NO: 3143717 - DNA, 14 bp, Homo sapiens
taaaagtcataaat

SEQ ID NO: 3143718 - DNA, 14 bp, Homo sapiens
taaaagtctatttt

SEQ ID NO: 3143719 - DNA, 20 bp, Homo sapiens
taaaagtctattttattatg

SEQ ID NO: 3143720 - DNA, 13 bp, Homo sapiens
taaaagtgatcaa

SEQ ID NO: 3143721 - DNA, 21 bp, Homo sapiens
taaaagttcataacagtgcca

SEQ ID NO: 3143722 - DNA, 15 bp, Homo sapiens
taaaagtttcaatgt

SEQ ID NO: 3143723 - DNA, 19 bp, Homo sapiens
taaaagtttcaatgtgatt

SEQ ID NO: 3143724 - DNA, 18 bp, Homo sapiens
taaaagtttgaaaagcaa

SEQ ID NO: 3143725 - DNA, 17 bp, Homo sapiens
taaaagttttatatgct

SEQ ID NO: 3143726 - DNA, 17 bp, Homo sapiens
taaaagttttgttcttt

SEQ ID NO: 3143727 - DNA, 22 bp, Homo sapiens
taaaagttttttattatgcatt

SEQ ID NO: 3143728 - DNA, 14 bp, Homo sapiens
taaaataaaatgaa

SEQ ID NO: 3143729 - DNA, 19 bp, Homo sapiens
taaaataaaatgaaaattg

SEQ ID NO: 3143730 - DNA, 11 bp, Homo sapiens
taaaataaacc

SEQ ID NO: 3143731 - DNA, 18 bp, Homo sapiens
taaaataaaccaaatatg

SEQ ID NO: 3143732 - DNA, 15 bp, Homo sapiens
taaaataaattccta

SEQ ID NO: 3143733 - DNA, 16 bp, Homo sapiens
taaaataactaaaatg

SEQ ID NO: 3143734 - DNA, 18 bp, Homo sapiens
taaaataactaaaatgta

SEQ ID NO: 3143735 - DNA, 21 bp, Homo sapiens
taaaataactaaaatgtatct

SEQ ID NO: 3143736 - DNA, 15 bp, Homo sapiens
taaaataattctaaa

SEQ ID NO: 3143737 - DNA, 14 bp, Homo sapiens
taaaatacatttaa

SEQ ID NO: 3143738 - DNA, 15 bp, Homo sapiens
taaaatacatttaaa

SEQ ID NO: 3143739 - DNA, 18 bp, Homo sapiens
taaaatacatttaaaact

SEQ ID NO: 3143740 - DNA, 22 bp, Homo sapiens
taaaatactctagcctgggcca

SEQ ID NO: 3143741 - DNA, 17 bp, Homo sapiens
taaaatacttgtttcag

SEQ ID NO: 3143742 - DNA, 22 bp, Homo sapiens
taaaatagaaatatagccaaaa

SEQ ID NO: 3143743 - DNA, 18 bp, Homo sapiens
taaaatagcttgtatagt

SEQ ID NO: 3143744 - DNA, 23 bp, Homo sapiens
taaaatagttgtccatattttca

SEQ ID NO: 3143745 - DNA, 20 bp, Homo sapiens
taaaatatataatatactaa

SEQ ID NO: 3143746 - DNA, 13 bp, Homo sapiens
taaaatatctata

SEQ ID NO: 3143747 - DNA, 18 bp, Homo sapiens
taaaatatggctataaat

SEQ ID NO: 3143748 - DNA, 22 bp, Homo sapiens
taaaatattcctgcatttgtga

SEQ ID NO: 3143749 - DNA, 11 bp, Homo sapiens
taaaatattta

SEQ ID NO: 3143750 - DNA, 12 bp, Homo sapiens
taaaatatttaa

SEQ ID NO: 3143751 - DNA, 14 bp, Homo sapiens
taaaatatttgaat

SEQ ID NO: 3143752 - DNA, 20 bp, Homo sapiens
taaaatatttgaatgaaaac

SEQ ID NO: 3143753 - DNA, 16 bp, Homo sapiens
taaaatattttggatg

SEQ ID NO: 3143754 - DNA, 15 bp, Homo sapiens
taaaatcacgttaaa

SEQ ID NO: 3143755 - DNA, 13 bp, Homo sapiens
taaaatctgtgaa

SEQ ID NO: 3143756 - DNA, 16 bp, Homo sapiens
taaaatcttgaaaatg

SEQ ID NO: 3143757 - DNA, 17 bp, Homo sapiens
taaaatcttggaagtac

SEQ ID NO: 3143758 - DNA, 22 bp, Homo sapiens
taaaatcttggaagtacatgaa

SEQ ID NO: 3143759 - DNA, 16 bp, Homo sapiens
taaaatgaaaattgta

SEQ ID NO: 3143760 - DNA, 14 bp, Homo sapiens
taaaatgattgtaa

SEQ ID NO: 3143761 - DNA, 15 bp, Homo sapiens
taaaatgattgtaaa

SEQ ID NO: 3143762 - DNA, 17 bp, Homo sapiens
taaaatgattgtaaaat

SEQ ID NO: 3143763 - DNA, 20 bp, Homo sapiens
taaaatgattgtaaaatagc

SEQ ID NO: 3143764 - DNA, 17 bp, Homo sapiens
taaaatgcagtaacatt

SEQ ID NO: 3143765 - DNA, 21 bp, Homo sapiens
taaaatgcagtaacattctac

SEQ ID NO: 3143766 - DNA, 14 bp, Homo sapiens
taaaatggaagcaa

SEQ ID NO: 3143767 - DNA, 22 bp, Homo sapiens
taaaatggacacaaattttcaa

SEQ ID NO: 3143768 - DNA, 16 bp, Homo sapiens
taaaatgtaatttaaa

SEQ ID NO: 3143769 - DNA, 17 bp, Homo sapiens
taaaatgtatctaagaa

SEQ ID NO: 3143770 - DNA, 13 bp, Homo sapiens
taaaatgtatttt

SEQ ID NO: 3143771 - DNA, 14 bp, Homo sapiens
taaaatgtattttt

SEQ ID NO: 3143772 - DNA, 21 bp, Homo sapiens
taaaatgtcagtgtttgggaa

SEQ ID NO: 3143773 - DNA, 20 bp, Homo sapiens
taaaatgtcggatttatctt

SEQ ID NO: 3143774 - DNA, 22 bp, Homo sapiens
taaaatgtctttccaaattatt

SEQ ID NO: 3143775 - DNA, 19 bp, Homo sapiens
taaaatgtgatgttctaag

SEQ ID NO: 3143776 - DNA, 18 bp, Homo sapiens
taaaatgtgatttttctg

SEQ ID NO: 3143777 - DNA, 19 bp, Homo sapiens
taaaatgtgatttttctga

SEQ ID NO: 3143778 - DNA, 13 bp, Homo sapiens
taaaatgtgtaca

SEQ ID NO: 3143779 - DNA, 16 bp, Homo sapiens
taaaatgtgtacagtg

SEQ ID NO: 3143780 - DNA, 15 bp, Homo sapiens
taaaatgtgttgaaa

SEQ ID NO: 3143781 - DNA, 15 bp, Homo sapiens
taaaattaaaagttt

SEQ ID NO: 3143782 - DNA, 18 bp, Homo sapiens
taaaattacagatgtgaa

SEQ ID NO: 3143783 - DNA, 18 bp, Homo sapiens
taaaattaggactgtata

SEQ ID NO: 3143784 - DNA, 15 bp, Homo sapiens
taaaattataaactt

SEQ ID NO: 3143785 - DNA, 20 bp, Homo sapiens
taaaattatcctctttgtaa

SEQ ID NO: 3143786 - DNA, 17 bp, Homo sapiens
taaaattatgaatctga

SEQ ID NO: 3143787 - DNA, 15 bp, Homo sapiens
taaaattatttcatg

SEQ ID NO: 3143788 - DNA, 21 bp, Homo sapiens
taaaattattttggattttgt

SEQ ID NO: 3143789 - DNA, 21 bp, Homo sapiens
taaaattcagtttttgtatct

SEQ ID NO: 3143790 - DNA, 17 bp, Homo sapiens
taaaattccaaattcat

SEQ ID NO: 3143791 - DNA, 23 bp, Homo sapiens
taaaattggaaatgtcatctaac

SEQ ID NO: 3143792 - DNA, 18 bp, Homo sapiens
taaaattgtaacctgcat

SEQ ID NO: 3143793 - DNA, 22 bp, Homo sapiens
taaaattgtaacctgcattttt

SEQ ID NO: 3143794 - DNA, 13 bp, Homo sapiens
taaaattgtgcat

SEQ ID NO: 3143795 - DNA, 21 bp, Homo sapiens
taaaattgtgcataatgcttt

SEQ ID NO: 3143796 - DNA, 12 bp, Homo sapiens
taaaatttgtgg

SEQ ID NO: 3143797 - DNA, 20 bp, Homo sapiens
taaaattttacttttgttct

SEQ ID NO: 3143798 - DNA, 22 bp, Homo sapiens
taaaattttaggcactcttaaa

SEQ ID NO: 3143799 - DNA, 19 bp, Homo sapiens
taaaattttgcttttaatt

SEQ ID NO: 3143800 - DNA, 18 bp, Homo sapiens
taaacaaaatagaagctg

SEQ ID NO: 3143801 - DNA, 13 bp, Homo sapiens
taaacaaaggttg

SEQ ID NO: 3143802 - DNA, 17 bp, Homo sapiens
taaacaaagttactagg

SEQ ID NO: 3143803 - DNA, 22 bp, Homo sapiens
taaacaaattcatattctgtct

SEQ ID NO: 3143804 - DNA, 20 bp, Homo sapiens
taaacaagaaccatttgcaa

SEQ ID NO: 3143805 - DNA, 15 bp, Homo sapiens
taaacaagtaagaaa

SEQ ID NO: 3143806 - DNA, 17 bp, Homo sapiens
taaacaagtattttata

SEQ ID NO: 3143807 - DNA, 22 bp, Homo sapiens
taaacaatgatgccctgctcca

SEQ ID NO: 3143808 - DNA, 21 bp, Homo sapiens
taaacaatgctgatttggtga

SEQ ID NO: 3143809 - DNA, 15 bp, Homo sapiens
taaacaatgtataaa

SEQ ID NO: 3143810 - DNA, 12 bp, Homo sapiens
taaacacacaga

SEQ ID NO: 3143811 - DNA, 21 bp, Homo sapiens
taaacacacagatacacacac

SEQ ID NO: 3143812 - DNA, 17 bp, Homo sapiens
taaacactggctctggg

SEQ ID NO: 3143813 - DNA, 17 bp, Homo sapiens
taaacactggtgccaac

SEQ ID NO: 3143814 - DNA, 19 bp, Homo sapiens
taaacactggtgccaacca

SEQ ID NO: 3143815 - DNA, 12 bp, Homo sapiens
taaacagaaatg

SEQ ID NO: 3143816 - DNA, 16 bp, Homo sapiens
taaacagactgttaat

SEQ ID NO: 3143817 - DNA, 15 bp, Homo sapiens
taaacagatttttac

SEQ ID NO: 3143818 - DNA, 13 bp, Homo sapiens
taaacagcagtgt

SEQ ID NO: 3143819 - DNA, 17 bp, Homo sapiens
taaacagcagtgttccc

SEQ ID NO: 3143820 - DNA, 22 bp, Homo sapiens
taaacagcagtgttccccatct

SEQ ID NO: 3143821 - DNA, 12 bp, Homo sapiens
taaacagctatt

SEQ ID NO: 3143822 - DNA, 12 bp, Homo sapiens
taaacaggccca

SEQ ID NO: 3143823 - DNA, 17 bp, Homo sapiens
taaacaggtggtgagaa

SEQ ID NO: 3143824 - DNA, 23 bp, Homo sapiens
taaacaggtggtgagaaatttct

SEQ ID NO: 3143825 - DNA, 15 bp, Homo sapiens
taaacagtatttcat

SEQ ID NO: 3143826 - DNA, 14 bp, Homo sapiens
taaacataaaacaa

SEQ ID NO: 3143827 - DNA, 15 bp, Homo sapiens
taaacataataaatc

SEQ ID NO: 3143828 - DNA, 16 bp, Homo sapiens
taaacataataaatca

SEQ ID NO: 3143829 - DNA, 15 bp, Homo sapiens
taaacataattgtgg

SEQ ID NO: 3143830 - DNA, 17 bp, Homo sapiens
taaacataattgtggat

SEQ ID NO: 3143831 - DNA, 21 bp, Homo sapiens
taaacataattgtggattata

SEQ ID NO: 3143832 - DNA, 16 bp, Homo sapiens
taaacatatgatttca

SEQ ID NO: 3143833 - DNA, 16 bp, Homo sapiens
taaacatcacacacac

SEQ ID NO: 3143834 - DNA, 15 bp, Homo sapiens
taaacatgtgtttta

SEQ ID NO: 3143835 - DNA, 17 bp, Homo sapiens
taaacattaaaaatgga

SEQ ID NO: 3143836 - DNA, 14 bp, Homo sapiens
taaacattaaaaga

SEQ ID NO: 3143837 - DNA, 21 bp, Homo sapiens
taaacattaaaagaagactgg

SEQ ID NO: 3143838 - DNA, 16 bp, Homo sapiens
taaacattaaatgtct

SEQ ID NO: 3143839 - DNA, 17 bp, Homo sapiens
taaacattaaatgtctt

SEQ ID NO: 3143840 - DNA, 21 bp, Homo sapiens
taaacattaaatgtcttatat

SEQ ID NO: 3143841 - DNA, 21 bp, Homo sapiens
taaacattaatagcagccttt

SEQ ID NO: 3143842 - DNA, 18 bp, Homo sapiens
taaacattaattttgtgc

SEQ ID NO: 3143843 - DNA, 19 bp, Homo sapiens
taaacattaattttgtgca

SEQ ID NO: 3143844 - DNA, 20 bp, Homo sapiens
taaacattaattttgtgcat

SEQ ID NO: 3143845 - DNA, 22 bp, Homo sapiens
taaacattaattttgtgcattc

SEQ ID NO: 3143846 - DNA, 20 bp, Homo sapiens
taaacattgacgattccttc

SEQ ID NO: 3143847 - DNA, 21 bp, Homo sapiens
taaaccaaaggacattatgtg

SEQ ID NO: 3143848 - DNA, 18 bp, Homo sapiens
taaaccaaatatgttaaa

SEQ ID NO: 3143849 - DNA, 20 bp, Homo sapiens
taaaccaactctaatattgc

SEQ ID NO: 3143850 - DNA, 21 bp, Homo sapiens
taaaccaactctaatattgct

SEQ ID NO: 3143851 - DNA, 22 bp, Homo sapiens
taaaccacttaaacgaagagtt

SEQ ID NO: 3143852 - DNA, 18 bp, Homo sapiens
taaaccatttttgttact

SEQ ID NO: 3143853 - DNA, 19 bp, Homo sapiens
taaaccatttttgttactc

SEQ ID NO: 3143854 - DNA, 21 bp, Homo sapiens
taaacctaggacttccgagct

SEQ ID NO: 3143855 - DNA, 17 bp, Homo sapiens
taaacctagtaaaacct

SEQ ID NO: 3143856 - DNA, 20 bp, Homo sapiens
taaacctgtctccactgtgc

SEQ ID NO: 3143857 - DNA, 21 bp, Homo sapiens
taaacctgtttttttttcatt

SEQ ID NO: 3143858 - DNA, 13 bp, Homo sapiens
taaaccttcagaa

SEQ ID NO: 3143859 - DNA, 14 bp, Homo sapiens
taaaccttcagaag

SEQ ID NO: 3143860 - DNA, 20 bp, Homo sapiens
taaacctttttcttgatctt

SEQ ID NO: 3143861 - DNA, 16 bp, Homo sapiens
taaacgcattatcagc

SEQ ID NO: 3143862 - DNA, 17 bp, Homo sapiens
taaacgcttcttatgta

SEQ ID NO: 3143863 - DNA, 16 bp, Homo sapiens
taaacggttcagtttc

SEQ ID NO: 3143864 - DNA, 14 bp, Homo sapiens
taaacggttcctgg

SEQ ID NO: 3143865 - DNA, 16 bp, Homo sapiens
taaacggttcctggtg

SEQ ID NO: 3143866 - DNA, 22 bp, Homo sapiens
taaacggttcctggtgactcct

SEQ ID NO: 3143867 - DNA, 17 bp, Homo sapiens
taaacgtgatgatcagc

SEQ ID NO: 3143868 - DNA, 22 bp, Homo sapiens
taaacgtgatgatcagctgttt

SEQ ID NO: 3143869 - DNA, 19 bp, Homo sapiens
taaactaaaaaaaaaaagg

SEQ ID NO: 3143870 - DNA, 13 bp, Homo sapiens
taaactaaatgtg

SEQ ID NO: 3143871 - DNA, 14 bp, Homo sapiens
taaactaaatgtgc

SEQ ID NO: 3143872 - DNA, 22 bp, Homo sapiens
taaactatcttggtgaattttt

SEQ ID NO: 3143873 - DNA, 15 bp, Homo sapiens
taaactatttgtctt

SEQ ID NO: 3143874 - DNA, 20 bp, Homo sapiens
taaactcaaaacttaacata

SEQ ID NO: 3143875 - DNA, 21 bp, Homo sapiens
taaactcaaaatatttgtaca

SEQ ID NO: 3143876 - DNA, 17 bp, Homo sapiens
taaactcctactaaatc

SEQ ID NO: 3143877 - DNA, 14 bp, Homo sapiens
taaactctaaacat

SEQ ID NO: 3143878 - DNA, 22 bp, Homo sapiens
taaactctaaacattaatcaat

SEQ ID NO: 3143879 - DNA, 22 bp, Homo sapiens
taaactgaaaactcccatttac

SEQ ID NO: 3143880 - DNA, 19 bp, Homo sapiens
taaactgactttttccccc

SEQ ID NO: 3143881 - DNA, 12 bp, Homo sapiens
taaactgagcct

SEQ ID NO: 3143882 - DNA, 16 bp, Homo sapiens
taaactggtatgaata

SEQ ID NO: 3143883 - DNA, 19 bp, Homo sapiens
taaactgtactagtctgtg

SEQ ID NO: 3143884 - DNA, 16 bp, Homo sapiens
taaactgtattaaatc

SEQ ID NO: 3143885 - DNA, 18 bp, Homo sapiens
taaactgtattaaatctt

SEQ ID NO: 3143886 - DNA, 13 bp, Homo sapiens
taaactgtgttta

SEQ ID NO: 3143887 - DNA, 22 bp, Homo sapiens
taaactgttagcactgttgatg

SEQ ID NO: 3143888 - DNA, 13 bp, Homo sapiens
taaactgtttata

SEQ ID NO: 3143889 - DNA, 21 bp, Homo sapiens
taaactgtttatataaaggtt

SEQ ID NO: 3143890 - DNA, 18 bp, Homo sapiens
taaactgtttcagatttt

SEQ ID NO: 3143891 - DNA, 14 bp, Homo sapiens
taaacttaacttta

SEQ ID NO: 3143892 - DNA, 16 bp, Homo sapiens
taaacttataaatcat

SEQ ID NO: 3143893 - DNA, 21 bp, Homo sapiens
taaacttccaaagaaagttct

SEQ ID NO: 3143894 - DNA, 14 bp, Homo sapiens
taaacttctgaaga

SEQ ID NO: 3143895 - DNA, 17 bp, Homo sapiens
taaacttgtttgctgtg

SEQ ID NO: 3143896 - DNA, 22 bp, Homo sapiens
taaacttgtttgctgtgaacaa

SEQ ID NO: 3143897 - DNA, 21 bp, Homo sapiens
taaactttatttgtaaaccat

SEQ ID NO: 3143898 - DNA, 12 bp, Homo sapiens
taaactttttgt

SEQ ID NO: 3143899 - DNA, 16 bp, Homo sapiens
taaactttttttcaat

SEQ ID NO: 3143900 - DNA, 17 bp, Homo sapiens
taaactttttttcaatg

SEQ ID NO: 3143901 - DNA, 19 bp, Homo sapiens
taaactttttttcaatgtg

SEQ ID NO: 3143902 - DNA, 12 bp, Homo sapiens
taaagaaaactg

SEQ ID NO: 3143903 - DNA, 20 bp, Homo sapiens
taaagaaaatgaactgccca

SEQ ID NO: 3143904 - DNA, 14 bp, Homo sapiens
taaagaaacagctt

SEQ ID NO: 3143905 - DNA, 19 bp, Homo sapiens
taaagaaacagctttcaag

SEQ ID NO: 3143906 - DNA, 20 bp, Homo sapiens
taaagaaacagctttcaagt

SEQ ID NO: 3143907 - DNA, 13 bp, Homo sapiens
taaagaaaggaaa

SEQ ID NO: 3143908 - DNA, 15 bp, Homo sapiens
taaagaaaggaaaag

SEQ ID NO: 3143909 - DNA, 17 bp, Homo sapiens
taaagaaaggaaaagaa

SEQ ID NO: 3143910 - DNA, 22 bp, Homo sapiens
taaagaaaggaaaagaaaacaa

SEQ ID NO: 3143911 - DNA, 11 bp, Homo sapiens
taaagaaagtc

SEQ ID NO: 3143912 - DNA, 16 bp, Homo sapiens
taaagaaagtgtattt

SEQ ID NO: 3143913 - DNA, 24 bp, Homo sapiens
taaagaaagtgtatttggaaataa

SEQ ID NO: 3143914 - DNA, 16 bp, Homo sapiens
taaagaatatgacttt

SEQ ID NO: 3143915 - DNA, 19 bp, Homo sapiens
taaagaatatgacttttta

SEQ ID NO: 3143916 - DNA, 13 bp, Homo sapiens
taaagaatttaaa

SEQ ID NO: 3143917 - DNA, 23 bp, Homo sapiens
taaagaatttaagctgtaaatta

SEQ ID NO: 3143918 - DNA, 15 bp, Homo sapiens
taaagacacctactg

SEQ ID NO: 3143919 - DNA, 11 bp, Homo sapiens
taaagaccaaa

SEQ ID NO: 3143920 - DNA, 14 bp, Homo sapiens
taaagaccaaactt

SEQ ID NO: 3143921 - DNA, 22 bp, Homo sapiens
taaagaccaatttatgggagaa

SEQ ID NO: 3143922 - DNA, 13 bp, Homo sapiens
taaagactggttt

SEQ ID NO: 3143923 - DNA, 22 bp, Homo sapiens
taaagactggttttctgccaat

SEQ ID NO: 3143924 - DNA, 11 bp, Homo sapiens
taaagagaaac

SEQ ID NO: 3143925 - DNA, 19 bp, Homo sapiens
taaagagaaactttgtgct

SEQ ID NO: 3143926 - DNA, 13 bp, Homo sapiens
taaagagaatgag

SEQ ID NO: 3143927 - DNA, 15 bp, Homo sapiens
taaagagacctacct

SEQ ID NO: 3143928 - DNA, 20 bp, Homo sapiens
taaagagacctacctcaggt

SEQ ID NO: 3143929 - DNA, 15 bp, Homo sapiens
taaagagcccttgcc

SEQ ID NO: 3143930 - DNA, 17 bp, Homo sapiens
taaagagcccttgcctc

SEQ ID NO: 3143931 - DNA, 18 bp, Homo sapiens
taaagagtagccattctt

SEQ ID NO: 3143932 - DNA, 21 bp, Homo sapiens
taaagagtctagattcaaagg

SEQ ID NO: 3143933 - DNA, 20 bp, Homo sapiens
taaagatatatagagatgca

SEQ ID NO: 3143934 - DNA, 17 bp, Homo sapiens
taaagatatcagagctc

SEQ ID NO: 3143935 - DNA, 20 bp, Homo sapiens
taaagatatggagaattgct

SEQ ID NO: 3143936 - DNA, 17 bp, Homo sapiens
taaagatattgttcaaa

SEQ ID NO: 3143937 - DNA, 16 bp, Homo sapiens
taaagatgaactctga

SEQ ID NO: 3143938 - DNA, 13 bp, Homo sapiens
taaagatgatcta

SEQ ID NO: 3143939 - DNA, 22 bp, Homo sapiens
taaagatgcaaggaccaggact

SEQ ID NO: 3143940 - DNA, 17 bp, Homo sapiens
taaagatggagtttcta

SEQ ID NO: 3143941 - DNA, 22 bp, Homo sapiens
taaagatggagtttctaaggtc

SEQ ID NO: 3143942 - DNA, 19 bp, Homo sapiens
taaagattctctttaaaaa

SEQ ID NO: 3143943 - DNA, 15 bp, Homo sapiens
taaagattgtactta

SEQ ID NO: 3143944 - DNA, 23 bp, Homo sapiens
taaagcaataatggtcccatcca

SEQ ID NO: 3143945 - DNA, 14 bp, Homo sapiens
taaagcaattgcat

SEQ ID NO: 3143946 - DNA, 18 bp, Homo sapiens
taaagcactttgcactta

SEQ ID NO: 3143947 - DNA, 13 bp, Homo sapiens
taaagcagacagt

SEQ ID NO: 3143948 - DNA, 15 bp, Homo sapiens
taaagcagacagtca

SEQ ID NO: 3143949 - DNA, 11 bp, Homo sapiens
taaagcagcct

SEQ ID NO: 3143950 - DNA, 12 bp, Homo sapiens
taaagcagcctg

SEQ ID NO: 3143951 - DNA, 13 bp, Homo sapiens
taaagcagcctga

SEQ ID NO: 3143952 - DNA, 20 bp, Homo sapiens
taaagcagtttattataatg

SEQ ID NO: 3143953 - DNA, 16 bp, Homo sapiens
taaagcataagtatac

SEQ ID NO: 3143954 - DNA, 14 bp, Homo sapiens
taaagcatcagaga

SEQ ID NO: 3143955 - DNA, 21 bp, Homo sapiens
taaagcatcagagatggtaat

SEQ ID NO: 3143956 - DNA, 15 bp, Homo sapiens
taaagcattctttaa

SEQ ID NO: 3143957 - DNA, 13 bp, Homo sapiens
taaagcatttata

SEQ ID NO: 3143958 - DNA, 23 bp, Homo sapiens
taaagccaaaaccatcttctgtg

SEQ ID NO: 3143959 - DNA, 18 bp, Homo sapiens
taaagccatcatgccttg

SEQ ID NO: 3143960 - DNA, 17 bp, Homo sapiens
taaagccattctgatta

SEQ ID NO: 3143961 - DNA, 18 bp, Homo sapiens
taaagccttgttttctct

SEQ ID NO: 3143962 - DNA, 18 bp, Homo sapiens
taaagcgatatacagatg

SEQ ID NO: 3143963 - DNA, 23 bp, Homo sapiens
taaagcgatatacagatgaaaat

SEQ ID NO: 3143964 - DNA, 20 bp, Homo sapiens
taaagctaaaatgattttat

SEQ ID NO: 3143965 - DNA, 19 bp, Homo sapiens
taaagctactgatttcctt

SEQ ID NO: 3143966 - DNA, 16 bp, Homo sapiens
taaagctgcctgtagt

SEQ ID NO: 3143967 - DNA, 18 bp, Homo sapiens
taaagctgcctgtagtta

SEQ ID NO: 3143968 - DNA, 21 bp, Homo sapiens
taaagctgcctgtagttagga

SEQ ID NO: 3143969 - DNA, 13 bp, Homo sapiens
taaagctggaaca

SEQ ID NO: 3143970 - DNA, 22 bp, Homo sapiens
taaagctggaacatttgatatt

SEQ ID NO: 3143971 - DNA, 17 bp, Homo sapiens
taaaggagaaggcatga

SEQ ID NO: 3143972 - DNA, 13 bp, Homo sapiens
taaaggagggaga

SEQ ID NO: 3143973 - DNA, 15 bp, Homo sapiens
taaaggataactctg

SEQ ID NO: 3143974 - DNA, 23 bp, Homo sapiens
taaaggatatgaaactctacatt

SEQ ID NO: 3143975 - DNA, 17 bp, Homo sapiens
taaaggatgttggtgtt

SEQ ID NO: 3143976 - DNA, 15 bp, Homo sapiens
taaaggattgatcac

SEQ ID NO: 3143977 - DNA, 12 bp, Homo sapiens
taaaggcagctg

SEQ ID NO: 3143978 - DNA, 13 bp, Homo sapiens
taaaggcagctgc

SEQ ID NO: 3143979 - DNA, 16 bp, Homo sapiens
taaaggcagctgcctc

SEQ ID NO: 3143980 - DNA, 19 bp, Homo sapiens
taaaggcagctgcctctgc

SEQ ID NO: 3143981 - DNA, 16 bp, Homo sapiens
taaaggcccagcccct

SEQ ID NO: 3143982 - DNA, 15 bp, Homo sapiens
taaaggcctcctccc

SEQ ID NO: 3143983 - DNA, 19 bp, Homo sapiens
taaaggcctggaaccaggg

SEQ ID NO: 3143984 - DNA, 14 bp, Homo sapiens
taaagggagaagga

SEQ ID NO: 3143985 - DNA, 16 bp, Homo sapiens
taaagggatctgctta

SEQ ID NO: 3143986 - DNA, 21 bp, Homo sapiens
taaagggcagggcccacgtgt

SEQ ID NO: 3143987 - DNA, 15 bp, Homo sapiens
ctcctaattttaaat

SEQ ID NO: 3143988 - DNA, 21 bp, Homo sapiens
ctcctaattttaaataatttc

SEQ ID NO: 3143989 - DNA, 12 bp, Homo sapiens
ctcctacctcag

SEQ ID NO: 3143990 - DNA, 13 bp, Homo sapiens
ctcctacctcagc

SEQ ID NO: 3143991 - DNA, 17 bp, Homo sapiens
ctcctacctgccctgga

SEQ ID NO: 3143992 - DNA, 19 bp, Homo sapiens
ctcctagacccaggtggag

SEQ ID NO: 3143993 - DNA, 13 bp, Homo sapiens
ctcctagaggtgg

SEQ ID NO: 3143994 - DNA, 16 bp, Homo sapiens
ctcctagaggtgggca

SEQ ID NO: 3143995 - DNA, 18 bp, Homo sapiens
ctcctagcagacagaaac

SEQ ID NO: 3143996 - DNA, 22 bp, Homo sapiens
ctcctagcctgtgcctctggga

SEQ ID NO: 3143997 - DNA, 23 bp, Homo sapiens
ctcctaggagagccaacctcggc

SEQ ID NO: 3143998 - DNA, 20 bp, Homo sapiens
ctcctaggggaacagaccag

SEQ ID NO: 3143999 - DNA, 19 bp, Homo sapiens
ctcctagtttgacctcaca

SEQ ID NO: 3144000 - DNA, 18 bp, Homo sapiens
ctcctataatctgtcaaa

SEQ ID NO: 3144001 - DNA, 22 bp, Homo sapiens
ctcctataatctgtcaaaacac

SEQ ID NO: 3144002 - DNA, 15 bp, Homo sapiens
ctcctatatatttct

SEQ ID NO: 3144003 - DNA, 16 bp, Homo sapiens
ctcctatttttttaaa

SEQ ID NO: 3144004 - DNA, 18 bp, Homo sapiens
ctcctatttttttaaaat

SEQ ID NO: 3144005 - DNA, 14 bp, Homo sapiens
ctcctcaactcacc

SEQ ID NO: 3144006 - DNA, 17 bp, Homo sapiens
ctcctcacacaccctga

SEQ ID NO: 3144007 - DNA, 19 bp, Homo sapiens
ctcctcacacaccctgagg

SEQ ID NO: 3144008 - DNA, 14 bp, Homo sapiens
ctcctcacccccag

SEQ ID NO: 3144009 - DNA, 14 bp, Homo sapiens
ctcctcacctctgg

SEQ ID NO: 3144010 - DNA, 16 bp, Homo sapiens
ctcctcacctctggac

SEQ ID NO: 3144011 - DNA, 18 bp, Homo sapiens
ctcctcacctctggactg

SEQ ID NO: 3144012 - DNA, 21 bp, Homo sapiens
ctcctcacctctggactggct

SEQ ID NO: 3144013 - DNA, 22 bp, Homo sapiens
ctcctcacctctggactggcta

SEQ ID NO: 3144014 - DNA, 12 bp, Homo sapiens
ctcctcacctgt

SEQ ID NO: 3144015 - DNA, 15 bp, Homo sapiens
ctcctcactgcccgc

SEQ ID NO: 3144016 - DNA, 16 bp, Homo sapiens
ctcctcactgcccgca

SEQ ID NO: 3144017 - DNA, 18 bp, Homo sapiens
ctcctcactggccatccc

SEQ ID NO: 3144018 - DNA, 16 bp, Homo sapiens
ctcctcagatggggca

SEQ ID NO: 3144019 - DNA, 18 bp, Homo sapiens
ctcctcagcccccaggcc

SEQ ID NO: 3144020 - DNA, 21 bp, Homo sapiens
ctcctcagcccccaggccagg

SEQ ID NO: 3144021 - DNA, 18 bp, Homo sapiens
ctcctcaggcacacagct

SEQ ID NO: 3144022 - DNA, 21 bp, Homo sapiens
ctcctcaggcacacagctact

SEQ ID NO: 3144023 - DNA, 23 bp, Homo sapiens
ctcctcaggcacacagctactct

SEQ ID NO: 3144024 - DNA, 11 bp, Homo sapiens
ctcctcagggt

SEQ ID NO: 3144025 - DNA, 13 bp, Homo sapiens
ctcctcagggtgg

SEQ ID NO: 3144026 - DNA, 16 bp, Homo sapiens
ctcctcagtgacatca

SEQ ID NO: 3144027 - DNA, 15 bp, Homo sapiens
ctcctcatcccgtgt

SEQ ID NO: 3144028 - DNA, 13 bp, Homo sapiens
ctcctccacagtg

SEQ ID NO: 3144029 - DNA, 14 bp, Homo sapiens
ctcctccacagtgc

SEQ ID NO: 3144030 - DNA, 15 bp, Homo sapiens
ctcctccacagtgct

SEQ ID NO: 3144031 - DNA, 14 bp, Homo sapiens
ctcctccaggcctg

SEQ ID NO: 3144032 - DNA, 15 bp, Homo sapiens
ctcctccaggcctgc

SEQ ID NO: 3144033 - DNA, 15 bp, Homo sapiens
ctcctcccacccggc

SEQ ID NO: 3144034 - DNA, 20 bp, Homo sapiens
ctcctcccacccggctgcag

SEQ ID NO: 3144035 - DNA, 11 bp, Homo sapiens
ctcctcccagc

SEQ ID NO: 3144036 - DNA, 18 bp, Homo sapiens
ctcctcccagcgtgtgta

SEQ ID NO: 3144037 - DNA, 20 bp, Homo sapiens
ctcctcccagcgtgtgtatc

SEQ ID NO: 3144038 - DNA, 23 bp, Homo sapiens
ctcctcccagcttgtaggagctg

SEQ ID NO: 3144039 - DNA, 17 bp, Homo sapiens
ctcctcccaggcgcccc

SEQ ID NO: 3144040 - DNA, 14 bp, Homo sapiens
ctcctccccaaatc

SEQ ID NO: 3144041 - DNA, 19 bp, Homo sapiens
ctcctccccaactgtgggg

SEQ ID NO: 3144042 - DNA, 14 bp, Homo sapiens
ctcctcccccaccc

SEQ ID NO: 3144043 - DNA, 11 bp, Homo sapiens
ctcctccccct

SEQ ID NO: 3144044 - DNA, 14 bp, Homo sapiens
ctcctcccggtgcc

SEQ ID NO: 3144045 - DNA, 17 bp, Homo sapiens
ctcctcccggtgcccaa

SEQ ID NO: 3144046 - DNA, 10 bp, Homo sapiens
ctcctccctc

SEQ ID NO: 3144047 - DNA, 16 bp, Homo sapiens
ctcctccctgcccccc

SEQ ID NO: 3144048 - DNA, 13 bp, Homo sapiens
ctcctccctggct

SEQ ID NO: 3144049 - DNA, 20 bp, Homo sapiens
ctcctccctggctgccctgg

SEQ ID NO: 3144050 - DNA, 14 bp, Homo sapiens
ctcctcctccccca

SEQ ID NO: 3144051 - DNA, 13 bp, Homo sapiens
ctcctcctgccct

SEQ ID NO: 3144052 - DNA, 12 bp, Homo sapiens
ctcctcctgtgt

SEQ ID NO: 3144053 - DNA, 13 bp, Homo sapiens
ctcctcctgtgtg

SEQ ID NO: 3144054 - DNA, 14 bp, Homo sapiens
ctcctcctgtgtga

SEQ ID NO: 3144055 - DNA, 18 bp, Homo sapiens
ctcctcctgtgtgactgg

SEQ ID NO: 3144056 - DNA, 18 bp, Homo sapiens
ctcctccttgcccagact

SEQ ID NO: 3144057 - DNA, 19 bp, Homo sapiens
ctcctcggaaccgctcacc

SEQ ID NO: 3144058 - DNA, 17 bp, Homo sapiens
ctcctcggagagcagca

SEQ ID NO: 3144059 - DNA, 19 bp, Homo sapiens
ctcctcggagagcagcagc

SEQ ID NO: 3144060 - DNA, 21 bp, Homo sapiens
ctcctcgggccgaggcccagc

SEQ ID NO: 3144061 - DNA, 17 bp, Homo sapiens
ctcctcggggctccagg

SEQ ID NO: 3144062 - DNA, 19 bp, Homo sapiens
ctcctcggggctccaggct

SEQ ID NO: 3144063 - DNA, 13 bp, Homo sapiens
ctcctcgttcctt

SEQ ID NO: 3144064 - DNA, 15 bp, Homo sapiens
ctcctctcagtgttt

SEQ ID NO: 3144065 - DNA, 12 bp, Homo sapiens
ctcctctcccat

SEQ ID NO: 3144066 - DNA, 13 bp, Homo sapiens
ctcctctccccag

SEQ ID NO: 3144067 - DNA, 17 bp, Homo sapiens
ctcctctccttgggctc

SEQ ID NO: 3144068 - DNA, 20 bp, Homo sapiens
ctcctctccttgggctcctg

SEQ ID NO: 3144069 - DNA, 22 bp, Homo sapiens
ctcctctccttgggctcctggc

SEQ ID NO: 3144070 - DNA, 12 bp, Homo sapiens
ctcctctctgct

SEQ ID NO: 3144071 - DNA, 16 bp, Homo sapiens
ctcctctctgggcctt

SEQ ID NO: 3144072 - DNA, 21 bp, Homo sapiens
ctcctctggacggcaggctca

SEQ ID NO: 3144073 - DNA, 14 bp, Homo sapiens
ctcctctgggcctg

SEQ ID NO: 3144074 - DNA, 20 bp, Homo sapiens
ctcctctgtcctgcttctga

SEQ ID NO: 3144075 - DNA, 20 bp, Homo sapiens
ctcctcttaccgtagcctcc

SEQ ID NO: 3144076 - DNA, 21 bp, Homo sapiens
ctcctcttaccgtagcctccg

SEQ ID NO: 3144077 - DNA, 23 bp, Homo sapiens
ctcctcttcaactgaccagcctc

SEQ ID NO: 3144078 - DNA, 23 bp, Homo sapiens
ctcctcttcttttttttcattat

SEQ ID NO: 3144079 - DNA, 15 bp, Homo sapiens
ctcctcttgccactg

SEQ ID NO: 3144080 - DNA, 22 bp, Homo sapiens
ctcctgaaacccaaagccctgg

SEQ ID NO: 3144081 - DNA, 20 bp, Homo sapiens
ctcctgacgtctgaagcttg

SEQ ID NO: 3144082 - DNA, 18 bp, Homo sapiens
ctcctgagcctgtgggtc

SEQ ID NO: 3144083 - DNA, 17 bp, Homo sapiens
ctcctgaggctttggat

SEQ ID NO: 3144084 - DNA, 20 bp, Homo sapiens
ctcctgatggccaagagcat

SEQ ID NO: 3144085 - DNA, 15 bp, Homo sapiens
ctcctgcactgttta

SEQ ID NO: 3144086 - DNA, 15 bp, Homo sapiens
ctcctgcacttactt

SEQ ID NO: 3144087 - DNA, 17 bp, Homo sapiens
ctcctgcacttacttgc

SEQ ID NO: 3144088 - DNA, 16 bp, Homo sapiens
ctcctgcagacacctg

SEQ ID NO: 3144089 - DNA, 22 bp, Homo sapiens
ctcctgcagacacctggactga

SEQ ID NO: 3144090 - DNA, 14 bp, Homo sapiens
ctcctgccaccagc

SEQ ID NO: 3144091 - DNA, 19 bp, Homo sapiens
ctcctgccaccagcatcca

SEQ ID NO: 3144092 - DNA, 19 bp, Homo sapiens
ctcctgccattcttctggt

SEQ ID NO: 3144093 - DNA, 23 bp, Homo sapiens
ctcctgcccagatgccctttgga

SEQ ID NO: 3144094 - DNA, 15 bp, Homo sapiens
ctcctgcccagtccc

SEQ ID NO: 3144095 - DNA, 12 bp, Homo sapiens
ctcctgccctgt

SEQ ID NO: 3144096 - DNA, 16 bp, Homo sapiens
ctcctgccctgtccct

SEQ ID NO: 3144097 - DNA, 17 bp, Homo sapiens
ctcctgccgctcctctc

SEQ ID NO: 3144098 - DNA, 20 bp, Homo sapiens
ctcctgcctcaccctcccaa

SEQ ID NO: 3144099 - DNA, 13 bp, Homo sapiens
ctcctgcctcagc

SEQ ID NO: 3144100 - DNA, 15 bp, Homo sapiens
ctcctgcctcagcct

SEQ ID NO: 3144101 - DNA, 17 bp, Homo sapiens
ctcctgcctcagcctcc

SEQ ID NO: 3144102 - DNA, 13 bp, Homo sapiens
ctcctgcctccgc

SEQ ID NO: 3144103 - DNA, 17 bp, Homo sapiens
ctcctgcctccgctggc

SEQ ID NO: 3144104 - DNA, 19 bp, Homo sapiens
ctcctgcctccgctggctt

SEQ ID NO: 3144105 - DNA, 21 bp, Homo sapiens
ctcctgcctcgaactggctgc

SEQ ID NO: 3144106 - DNA, 22 bp, Homo sapiens
ctcctgccttctgtcctggtgt

SEQ ID NO: 3144107 - DNA, 12 bp, Homo sapiens
ctcctgcgcccc

SEQ ID NO: 3144108 - DNA, 16 bp, Homo sapiens
ctcctgcgccccgccc

SEQ ID NO: 3144109 - DNA, 20 bp, Homo sapiens
ctcctgcgccccgcccacac

SEQ ID NO: 3144110 - DNA, 21 bp, Homo sapiens
ctcctgcgccccgcccacacc

SEQ ID NO: 3144111 - DNA, 22 bp, Homo sapiens
ctcctgcgccccgcccacaccc

SEQ ID NO: 3144112 - DNA, 20 bp, Homo sapiens
ctcctgctcctccctgcccc

SEQ ID NO: 3144113 - DNA, 14 bp, Homo sapiens
ctcctgctgccaca

SEQ ID NO: 3144114 - DNA, 12 bp, Homo sapiens
gttcctctctgg

SEQ ID NO: 3144115 - DNA, 13 bp, Homo sapiens
gttcctctgcctg

SEQ ID NO: 3144116 - DNA, 15 bp, Homo sapiens
gttcctctgcctgcc

SEQ ID NO: 3144117 - DNA, 13 bp, Homo sapiens
gttcctctgctca

SEQ ID NO: 3144118 - DNA, 21 bp, Homo sapiens
gttcctgaattctatttgctg

SEQ ID NO: 3144119 - DNA, 23 bp, Homo sapiens
gttcctgacatcacagcagcctc

SEQ ID NO: 3144120 - DNA, 13 bp, Homo sapiens
gttcctgactggc

SEQ ID NO: 3144121 - DNA, 22 bp, Homo sapiens
gttcctgcagccccagaagaaa

SEQ ID NO: 3144122 - DNA, 15 bp, Homo sapiens
gttcctgccccaccc

SEQ ID NO: 3144123 - DNA, 19 bp, Homo sapiens
gttcctgcggagtgaagag

SEQ ID NO: 3144124 - DNA, 23 bp, Homo sapiens
gttcctggaagcaggtgctacaa

SEQ ID NO: 3144125 - DNA, 13 bp, Homo sapiens
gttcctggcaata

SEQ ID NO: 3144126 - DNA, 19 bp, Homo sapiens
gttcctggcccactctgta

SEQ ID NO: 3144127 - DNA, 16 bp, Homo sapiens
gttcctggtgactcct

SEQ ID NO: 3144128 - DNA, 17 bp, Homo sapiens
gttcctggtgactcctg

SEQ ID NO: 3144129 - DNA, 13 bp, Homo sapiens
gttccttagacct

SEQ ID NO: 3144130 - DNA, 19 bp, Homo sapiens
gttccttcctatgcccagg

SEQ ID NO: 3144131 - DNA, 23 bp, Homo sapiens
gttcctttccttttctttaaaga

SEQ ID NO: 3144132 - DNA, 13 bp, Homo sapiens
gttcctttctttt

SEQ ID NO: 3144133 - DNA, 17 bp, Homo sapiens
gttcctttgcaccctgt

SEQ ID NO: 3144134 - DNA, 18 bp, Homo sapiens
gttcctttgtgtgtactc

SEQ ID NO: 3144135 - DNA, 18 bp, Homo sapiens
gttcctttttaaatgtga

SEQ ID NO: 3144136 - DNA, 19 bp, Homo sapiens
gttcctttttaaatgtgaa

SEQ ID NO: 3144137 - DNA, 18 bp, Homo sapiens
gttcgagaccagcctggc

SEQ ID NO: 3144138 - DNA, 19 bp, Homo sapiens
gttcgagaccagcctggcc

SEQ ID NO: 3144139 - DNA, 22 bp, Homo sapiens
gttcgaggactacaaccaattt

SEQ ID NO: 3144140 - DNA, 12 bp, Homo sapiens
gttcgatttcta

SEQ ID NO: 3144141 - DNA, 19 bp, Homo sapiens
gttcgcaccattctcctgc

SEQ ID NO: 3144142 - DNA, 17 bp, Homo sapiens
gttcgtaccgcttcctt

SEQ ID NO: 3144143 - DNA, 12 bp, Homo sapiens
gttctaaagttc

SEQ ID NO: 3144144 - DNA, 13 bp, Homo sapiens
gttctaaagttct

SEQ ID NO: 3144145 - DNA, 14 bp, Homo sapiens
gttctaaagttcta

SEQ ID NO: 3144146 - DNA, 15 bp, Homo sapiens
gttctaaagttctaa

SEQ ID NO: 3144147 - DNA, 18 bp, Homo sapiens
gttctaaagttctaagat

SEQ ID NO: 3144148 - DNA, 19 bp, Homo sapiens
gttctaaagttctaagatt

SEQ ID NO: 3144149 - DNA, 13 bp, Homo sapiens
gttctaagatgtg

SEQ ID NO: 3144150 - DNA, 13 bp, Homo sapiens
gttctaagattct

SEQ ID NO: 3144151 - DNA, 15 bp, Homo sapiens
gttctaagattctaa

SEQ ID NO: 3144152 - DNA, 14 bp, Homo sapiens
gttctaagattctg

SEQ ID NO: 3144153 - DNA, 15 bp, Homo sapiens
gttctaagattctga

SEQ ID NO: 3144154 - DNA, 13 bp, Homo sapiens
gttctaaggccta

SEQ ID NO: 3144155 - DNA, 22 bp, Homo sapiens
gttctaaggcctaggattctaa

SEQ ID NO: 3144156 - DNA, 12 bp, Homo sapiens
gttctaaggctc

SEQ ID NO: 3144157 - DNA, 17 bp, Homo sapiens
gttctaagtttctaaga

SEQ ID NO: 3144158 - DNA, 18 bp, Homo sapiens
gttctaagtttctaagat

SEQ ID NO: 3144159 - DNA, 22 bp, Homo sapiens
gttctaagtttctaagattcta

SEQ ID NO: 3144160 - DNA, 16 bp, Homo sapiens
gttctacactcatctt

SEQ ID NO: 3144161 - DNA, 13 bp, Homo sapiens
gttctagaaccac

SEQ ID NO: 3144162 - DNA, 21 bp, Homo sapiens
gttctagaaccacttcctgct

SEQ ID NO: 3144163 - DNA, 22 bp, Homo sapiens
gttctagacatggaggttctaa

SEQ ID NO: 3144164 - DNA, 16 bp, Homo sapiens
gttctaggtttcaaag

SEQ ID NO: 3144165 - DNA, 20 bp, Homo sapiens
gttctatcagttatcctttg

SEQ ID NO: 3144166 - DNA, 22 bp, Homo sapiens
gttctattaatcacctctctgt

SEQ ID NO: 3144167 - DNA, 16 bp, Homo sapiens
gttctatttttcaatc

SEQ ID NO: 3144168 - DNA, 14 bp, Homo sapiens
gttctcaaagttaa

SEQ ID NO: 3144169 - DNA, 12 bp, Homo sapiens
gttctcactgtt

SEQ ID NO: 3144170 - DNA, 19 bp, Homo sapiens
gttctcagctccccctgtc

SEQ ID NO: 3144171 - DNA, 13 bp, Homo sapiens
gttctcagggctc

SEQ ID NO: 3144172 - DNA, 15 bp, Homo sapiens
gttctcagggctcct

SEQ ID NO: 3144173 - DNA, 22 bp, Homo sapiens
gttctcatgataccacctttac

SEQ ID NO: 3144174 - DNA, 18 bp, Homo sapiens
gttctccgttagctcctg

SEQ ID NO: 3144175 - DNA, 19 bp, Homo sapiens
gttctccgttagctcctgt

SEQ ID NO: 3144176 - DNA, 13 bp, Homo sapiens
gttctccttttcc

SEQ ID NO: 3144177 - DNA, 19 bp, Homo sapiens
gttctcgttttgggccaga

SEQ ID NO: 3144178 - DNA, 14 bp, Homo sapiens
gttctctgaggaca

SEQ ID NO: 3144179 - DNA, 13 bp, Homo sapiens
gttctctgtccta

SEQ ID NO: 3144180 - DNA, 16 bp, Homo sapiens
gttctcttatctttga

SEQ ID NO: 3144181 - DNA, 15 bp, Homo sapiens
gttctctttaaaata

SEQ ID NO: 3144182 - DNA, 20 bp, Homo sapiens
gttctgaggattcaggggct

SEQ ID NO: 3144183 - DNA, 16 bp, Homo sapiens
gttctgattagaaatg

SEQ ID NO: 3144184 - DNA, 13 bp, Homo sapiens
gttctgcactgaa

SEQ ID NO: 3144185 - DNA, 15 bp, Homo sapiens
gttctgccagatctt

SEQ ID NO: 3144186 - DNA, 15 bp, Homo sapiens
gttctgcccccagcc

SEQ ID NO: 3144187 - DNA, 20 bp, Homo sapiens
gttctgcccccagcccaaag

SEQ ID NO: 3144188 - DNA, 16 bp, Homo sapiens
gttctgctcctctcca

SEQ ID NO: 3144189 - DNA, 18 bp, Homo sapiens
gttctgctcctctccagg

SEQ ID NO: 3144190 - DNA, 22 bp, Homo sapiens
gttctgctctggttgtttctgt

SEQ ID NO: 3144191 - DNA, 13 bp, Homo sapiens
gttctgctggcct

SEQ ID NO: 3144192 - DNA, 16 bp, Homo sapiens
gttctgctggcctgga

SEQ ID NO: 3144193 - DNA, 15 bp, Homo sapiens
gttctgggacacagt

SEQ ID NO: 3144194 - DNA, 16 bp, Homo sapiens
gttctgggacacagtt

SEQ ID NO: 3144195 - DNA, 13 bp, Homo sapiens
gttctggttccat

SEQ ID NO: 3144196 - DNA, 15 bp, Homo sapiens
gttctgtcccttcca

SEQ ID NO: 3144197 - DNA, 15 bp, Homo sapiens
gttctgtgaagagga

SEQ ID NO: 3144198 - DNA, 16 bp, Homo sapiens
gttctgtgacccatct

SEQ ID NO: 3144199 - DNA, 18 bp, Homo sapiens
gttctgtgacccatctgt

SEQ ID NO: 3144200 - DNA, 21 bp, Homo sapiens
gttctgtgacccatctgtagt

SEQ ID NO: 3144201 - DNA, 22 bp, Homo sapiens
gttctgtgacccatctgtagta

SEQ ID NO: 3144202 - DNA, 19 bp, Homo sapiens
gttctgtgtatttaattgt

SEQ ID NO: 3144203 - DNA, 18 bp, Homo sapiens
gttctgtgtattttcagt

SEQ ID NO: 3144204 - DNA, 23 bp, Homo sapiens
gttctgtgtctttcacagctcct

SEQ ID NO: 3144205 - DNA, 15 bp, Homo sapiens
gttctgtgtttaatt

SEQ ID NO: 3144206 - DNA, 23 bp, Homo sapiens
gttctgttatatcccctgctacc

SEQ ID NO: 3144207 - DNA, 16 bp, Homo sapiens
gttctgttctggggga

SEQ ID NO: 3144208 - DNA, 13 bp, Homo sapiens
gttctgtttcaag

SEQ ID NO: 3144209 - DNA, 13 bp, Homo sapiens
gttctgtttgctg

SEQ ID NO: 3144210 - DNA, 17 bp, Homo sapiens
gttctgtttgttaaaac

SEQ ID NO: 3144211 - DNA, 14 bp, Homo sapiens
gttcttaaaagcat

SEQ ID NO: 3144212 - DNA, 15 bp, Homo sapiens
gttcttaaatgttta

SEQ ID NO: 3144213 - DNA, 21 bp, Homo sapiens
gttcttaaatgtttatactgt

SEQ ID NO: 3144214 - DNA, 17 bp, Homo sapiens
gttcttaattgcactct

SEQ ID NO: 3144215 - DNA, 22 bp, Homo sapiens
gttcttacacatacagttttat

SEQ ID NO: 3144216 - DNA, 21 bp, Homo sapiens
gttcttatttgccagagccaa

SEQ ID NO: 3144217 - DNA, 15 bp, Homo sapiens
gttcttcaagccagc

SEQ ID NO: 3144218 - DNA, 14 bp, Homo sapiens
gttcttcacctcta

SEQ ID NO: 3144219 - DNA, 17 bp, Homo sapiens
gttcttcacctctatcc

SEQ ID NO: 3144220 - DNA, 22 bp, Homo sapiens
gttcttcccccacttcccctcc

SEQ ID NO: 3144221 - DNA, 13 bp, Homo sapiens
gttcttgctgcta

SEQ ID NO: 3144222 - DNA, 14 bp, Homo sapiens
gttcttgctgctag

SEQ ID NO: 3144223 - DNA, 18 bp, Homo sapiens
gttcttgctgctagaact

SEQ ID NO: 3144224 - DNA, 19 bp, Homo sapiens
gttcttgctgctagaactt

SEQ ID NO: 3144225 - DNA, 21 bp, Homo sapiens
gttcttgctgctagaactttt

SEQ ID NO: 3144226 - DNA, 20 bp, Homo sapiens
gttcttgggtggttcctaag

SEQ ID NO: 3144227 - DNA, 14 bp, Homo sapiens
gttcttggtgactg

SEQ ID NO: 3144228 - DNA, 18 bp, Homo sapiens
gttcttggtgactgtccc

SEQ ID NO: 3144229 - DNA, 16 bp, Homo sapiens
gttcttggtgctctgt

SEQ ID NO: 3144230 - DNA, 16 bp, Homo sapiens
gttcttgttttatata

SEQ ID NO: 3144231 - DNA, 15 bp, Homo sapiens
gttctttccggccaa

SEQ ID NO: 3144232 - DNA, 15 bp, Homo sapiens
gttctttcttcctct

SEQ ID NO: 3144233 - DNA, 21 bp, Homo sapiens
gttctttgagggactgcctct

SEQ ID NO: 3144234 - DNA, 11 bp, Homo sapiens
gttctttggaa

SEQ ID NO: 3144235 - DNA, 13 bp, Homo sapiens
gttctttgttcat

SEQ ID NO: 3144236 - DNA, 12 bp, Homo sapiens
gttgaaaaaatt

SEQ ID NO: 3144237 - DNA, 20 bp, Homo sapiens
gttgaaaaatctagtttttt

SEQ ID NO: 3144238 - DNA, 19 bp, Homo sapiens
gttgaaaattattttaaac

SEQ ID NO: 3144239 - DNA, 14 bp, Homo sapiens
gttgaaaggttttt

SEQ ID NO: 3144240 - DNA, 21 bp, Homo sapiens
gttgaaaggttttttttcagt

SEQ ID NO: 3144241 - DNA, 24 bp, Homo sapiens
gttgaaattttgcaaatataaaca

SEQ ID NO: 3144242 - DNA, 12 bp, Homo sapiens
gttgaacagagg

SEQ ID NO: 3144243 - DNA, 22 bp, Homo sapiens
gttgaagctaagatttagagat

SEQ ID NO: 3144244 - DNA, 12 bp, Homo sapiens
gttgaagtcacc

SEQ ID NO: 3144245 - DNA, 19 bp, Homo sapiens
gttgaatatagcctgcctc

SEQ ID NO: 3144246 - DNA, 22 bp, Homo sapiens
gttgaatatagcctgcctcagt

SEQ ID NO: 3144247 - DNA, 16 bp, Homo sapiens
gttgaatggcctgcct

SEQ ID NO: 3144248 - DNA, 13 bp, Homo sapiens
gttgaatgttgca

SEQ ID NO: 3144249 - DNA, 20 bp, Homo sapiens
gttgacaccattctcctgcc

SEQ ID NO: 3144250 - DNA, 22 bp, Homo sapiens
gttgacttccaggcacggtttg

SEQ ID NO: 3144251 - DNA, 13 bp, Homo sapiens
gttgactttctcc

SEQ ID NO: 3144252 - DNA, 12 bp, Homo sapiens
gttgagaagaat

SEQ ID NO: 3144253 - DNA, 16 bp, Homo sapiens
gttgagaatgcagtga

SEQ ID NO: 3144254 - DNA, 11 bp, Homo sapiens
gttgagagaac

SEQ ID NO: 3144255 - DNA, 16 bp, Homo sapiens
gttgaggaactgtaca

SEQ ID NO: 3144256 - DNA, 17 bp, Homo sapiens
gttgaggaactgtacag

SEQ ID NO: 3144257 - DNA, 16 bp, Homo sapiens
gttgaggggctcctgg

SEQ ID NO: 3144258 - DNA, 18 bp, Homo sapiens
gttgaggggctcctggaa

SEQ ID NO: 3144259 - DNA, 22 bp, Homo sapiens
gttgagttacattaaaataaac

SEQ ID NO: 3144260 - DNA, 18 bp, Homo sapiens
gttgataaattccactgg

SEQ ID NO: 3144261 - DNA, 14 bp, Homo sapiens
gttgatcttcttca

SEQ ID NO: 3144262 - DNA, 14 bp, Homo sapiens
gttgatggaaaata

SEQ ID NO: 3144263 - DNA, 14 bp, Homo sapiens
gttgatgtatctga

SEQ ID NO: 3144264 - DNA, 23 bp, Homo sapiens
gttgattcggtatccccccatct

SEQ ID NO: 3144265 - DNA, 16 bp, Homo sapiens
gttgcagatgtattga

SEQ ID NO: 3144266 - DNA, 15 bp, Homo sapiens
gttgcagtggagagg

SEQ ID NO: 3144267 - DNA, 16 bp, Homo sapiens
gttgcatagcagtata

SEQ ID NO: 3144268 - DNA, 14 bp, Homo sapiens
gttgcatgaaattt

SEQ ID NO: 3144269 - DNA, 20 bp, Homo sapiens
gttgccaaatatgtcctggg

SEQ ID NO: 3144270 - DNA, 18 bp, Homo sapiens
gttgccaactaagccctc

SEQ ID NO: 3144271 - DNA, 13 bp, Homo sapiens
gttgccaagacaa

SEQ ID NO: 3144272 - DNA, 16 bp, Homo sapiens
gttgccaagacaaatc

SEQ ID NO: 3144273 - DNA, 18 bp, Homo sapiens
gttgccaagctccaagcc

SEQ ID NO: 3144274 - DNA, 19 bp, Homo sapiens
gttgccaagctccaagccc

SEQ ID NO: 3144275 - DNA, 11 bp, Homo sapiens
gttgccacagg

SEQ ID NO: 3144276 - DNA, 12 bp, Homo sapiens
gttgccacaggc

SEQ ID NO: 3144277 - DNA, 16 bp, Homo sapiens
gttgccacaggcctcc

SEQ ID NO: 3144278 - DNA, 19 bp, Homo sapiens
gttgccacaggcctccctg

SEQ ID NO: 3144279 - DNA, 20 bp, Homo sapiens
gttgccaccacctctgtggc

SEQ ID NO: 3144280 - DNA, 15 bp, Homo sapiens
gttgcccaggctgga

SEQ ID NO: 3144281 - DNA, 21 bp, Homo sapiens
gttgcccaggctggcgtgcag

SEQ ID NO: 3144282 - DNA, 19 bp, Homo sapiens
gttgccctagcccagactc

SEQ ID NO: 3144283 - DNA, 16 bp, Homo sapiens
gttgcctaattggaaa

SEQ ID NO: 3144284 - DNA, 17 bp, Homo sapiens
gttgcctaattggaaag

SEQ ID NO: 3144285 - DNA, 15 bp, Homo sapiens
gttgcgacggagaga

SEQ ID NO: 3144286 - DNA, 23 bp, Homo sapiens
gttgcgtggactctgcacatgtc

SEQ ID NO: 3144287 - DNA, 12 bp, Homo sapiens
gttgctaaaaaa

SEQ ID NO: 3144288 - DNA, 22 bp, Homo sapiens
gttgctaagaagcgagcactga

SEQ ID NO: 3144289 - DNA, 20 bp, Homo sapiens
gttgctcaaatctattcaga

SEQ ID NO: 3144290 - DNA, 19 bp, Homo sapiens
gttgctcttggaaagctga

SEQ ID NO: 3144291 - DNA, 16 bp, Homo sapiens
gttgctggttgctgtg

SEQ ID NO: 3144292 - DNA, 19 bp, Homo sapiens
gttgctggttgctgtgtgg

SEQ ID NO: 3144293 - DNA, 17 bp, Homo sapiens
gttgcttgaaattactg

SEQ ID NO: 3144294 - DNA, 13 bp, Homo sapiens
gttggaaaaaatt

SEQ ID NO: 3144295 - DNA, 15 bp, Homo sapiens
gttggaaaagaatac

SEQ ID NO: 3144296 - DNA, 20 bp, Homo sapiens
gttggaaaagaatacagaaa

SEQ ID NO: 3144297 - DNA, 18 bp, Homo sapiens
gttggaaatattcatgct

SEQ ID NO: 3144298 - DNA, 22 bp, Homo sapiens
gttggaactatacccgggacca

SEQ ID NO: 3144299 - DNA, 14 bp, Homo sapiens
gttggaagagaatc

SEQ ID NO: 3144300 - DNA, 16 bp, Homo sapiens
gttggaagagaatcac

SEQ ID NO: 3144301 - DNA, 14 bp, Homo sapiens
gttggacagccccc

SEQ ID NO: 3144302 - DNA, 23 bp, Homo sapiens
gttggactaaatgcctagttttt

SEQ ID NO: 3144303 - DNA, 16 bp, Homo sapiens
gttggactctcaggga

SEQ ID NO: 3144304 - DNA, 23 bp, Homo sapiens
gttggacttttcgttaacattga

SEQ ID NO: 3144305 - DNA, 21 bp, Homo sapiens
gttggagccactcctgtcccg

SEQ ID NO: 3144306 - DNA, 15 bp, Homo sapiens
gttggagctcattct

SEQ ID NO: 3144307 - DNA, 20 bp, Homo sapiens
gttggaggtggggaaggctt

SEQ ID NO: 3144308 - DNA, 19 bp, Homo sapiens
gttggatgggagtgggcac

SEQ ID NO: 3144309 - DNA, 15 bp, Homo sapiens
gttggcaacaggaca

SEQ ID NO: 3144310 - DNA, 16 bp, Homo sapiens
gttggcaacaggacag

SEQ ID NO: 3144311 - DNA, 15 bp, Homo sapiens
gttggcactcacaga

SEQ ID NO: 3144312 - DNA, 15 bp, Homo sapiens
gttggcaggctggcc

SEQ ID NO: 3144313 - DNA, 16 bp, Homo sapiens
gttggcaggctggcca

SEQ ID NO: 3144314 - DNA, 23 bp, Homo sapiens
gttggcagtgagtgagcctggct

SEQ ID NO: 3144315 - DNA, 23 bp, Homo sapiens
gttggccaaagccaaagctaggc

SEQ ID NO: 3144316 - DNA, 13 bp, Homo sapiens
gttggccaggctg

SEQ ID NO: 3144317 - DNA, 14 bp, Homo sapiens
gttggccagtgtga

SEQ ID NO: 3144318 - DNA, 19 bp, Homo sapiens
gttggcctcagggccagga

SEQ ID NO: 3144319 - DNA, 12 bp, Homo sapiens
gttggctggggg

SEQ ID NO: 3144320 - DNA, 23 bp, Homo sapiens
gttggctgggggcctcagtgcca

SEQ ID NO: 3144321 - DNA, 23 bp, Homo sapiens
gttggcttctgtttctagttgag

SEQ ID NO: 3144322 - DNA, 23 bp, Homo sapiens
gttgggaatgaggaaaattctta

SEQ ID NO: 3144323 - DNA, 22 bp, Homo sapiens
gttgggagccctttggagaacg

SEQ ID NO: 3144324 - DNA, 23 bp, Homo sapiens
gttgggattcctgacccaggccg

SEQ ID NO: 3144325 - DNA, 19 bp, Homo sapiens
gttgggcagccagaccagc

SEQ ID NO: 3144326 - DNA, 16 bp, Homo sapiens
gttgggcccagatctg

SEQ ID NO: 3144327 - DNA, 17 bp, Homo sapiens
gttgggctggtgtcacc

SEQ ID NO: 3144328 - DNA, 18 bp, Homo sapiens
gttggggaagggcctgcc

SEQ ID NO: 3144329 - DNA, 14 bp, Homo sapiens
gttggggaggggcg

SEQ ID NO: 3144330 - DNA, 15 bp, Homo sapiens
gttgggggcactcag

SEQ ID NO: 3144331 - DNA, 16 bp, Homo sapiens
gttgggggcactcagc

SEQ ID NO: 3144332 - DNA, 17 bp, Homo sapiens
gttgggggcactcagcc

SEQ ID NO: 3144333 - DNA, 20 bp, Homo sapiens
gttgggggcactcagccacg

SEQ ID NO: 3144334 - DNA, 14 bp, Homo sapiens
gttggggtgacagt

SEQ ID NO: 3144335 - DNA, 21 bp, Homo sapiens
gttgggtgtctccttaagctg

SEQ ID NO: 3144336 - DNA, 18 bp, Homo sapiens
gttggtattaataaaaag

SEQ ID NO: 3144337 - DNA, 23 bp, Homo sapiens
gttggtccagagcggaggctgtg

SEQ ID NO: 3144338 - DNA, 14 bp, Homo sapiens
gttggtgactgaaa

SEQ ID NO: 3144339 - DNA, 12 bp, Homo sapiens
gttggtggcagt

SEQ ID NO: 3144340 - DNA, 17 bp, Homo sapiens
gttggtggggccaggcc

SEQ ID NO: 3144341 - DNA, 15 bp, Homo sapiens
gttggtgtgtttttg

SEQ ID NO: 3144342 - DNA, 12 bp, Homo sapiens
gttgtaaaaaga

SEQ ID NO: 3144343 - DNA, 14 bp, Homo sapiens
gttgtaacctgctg

SEQ ID NO: 3144344 - DNA, 17 bp, Homo sapiens
gttgtaacctgctgtga

SEQ ID NO: 3144345 - DNA, 14 bp, Homo sapiens
gttgtacaaatgta

SEQ ID NO: 3144346 - DNA, 17 bp, Homo sapiens
gttgtacaaatgtattt

SEQ ID NO: 3144347 - DNA, 23 bp, Homo sapiens
gttgtacctcttttgcttgccaa

SEQ ID NO: 3144348 - DNA, 23 bp, Homo sapiens
gttgtactatggaaaatcagctg

SEQ ID NO: 3144349 - DNA, 18 bp, Homo sapiens
gttgtactttggaattct

SEQ ID NO: 3144350 - DNA, 12 bp, Homo sapiens
gttgtataattt

SEQ ID NO: 3144351 - DNA, 14 bp, Homo sapiens
gttgtatgccttta

SEQ ID NO: 3144352 - DNA, 23 bp, Homo sapiens
gttgtatgcctttaaatctgtga

SEQ ID NO: 3144353 - DNA, 16 bp, Homo sapiens
gttgtattaacaaaag

SEQ ID NO: 3144354 - DNA, 14 bp, Homo sapiens
gttgtattcttctg

SEQ ID NO: 3144355 - DNA, 23 bp, Homo sapiens
gttgtattttaactcataccttt

SEQ ID NO: 3144356 - DNA, 23 bp, Homo sapiens
gttgtcaatattaaatacagaca

SEQ ID NO: 3144357 - DNA, 13 bp, Homo sapiens
gttgtcagcctgt

SEQ ID NO: 3144358 - DNA, 15 bp, Homo sapiens
gttgtcagcctgtgc

SEQ ID NO: 3144359 - DNA, 22 bp, Homo sapiens
gttgtccaattgttgacagttc

SEQ ID NO: 3144360 - DNA, 18 bp, Homo sapiens
gttgtccatattttcaca

SEQ ID NO: 3144361 - DNA, 17 bp, Homo sapiens
gttgtcgtaaagatttg

SEQ ID NO: 3144362 - DNA, 18 bp, Homo sapiens
gttgtctattctgagcct

SEQ ID NO: 3144363 - DNA, 22 bp, Homo sapiens
gttgtctattctgagccttgag

SEQ ID NO: 3144364 - DNA, 22 bp, Homo sapiens
gttgtctgaagtcactgcacag

SEQ ID NO: 3144365 - DNA, 22 bp, Homo sapiens
gttgtgaatcaccaaaggagct

SEQ ID NO: 3144366 - DNA, 23 bp, Homo sapiens
gttgtgactttttagccagtgac

SEQ ID NO: 3144367 - DNA, 21 bp, Homo sapiens
gttgtgatgtcttttcttggc

SEQ ID NO: 3144368 - DNA, 13 bp, Homo sapiens
gttgtgcttgagc

SEQ ID NO: 3144369 - DNA, 19 bp, Homo sapiens
gttgtggaaagcctctgct

SEQ ID NO: 3144370 - DNA, 14 bp, Homo sapiens
gttgtggctcttat

SEQ ID NO: 3144371 - DNA, 15 bp, Homo sapiens
gttgtgtaagagaat

SEQ ID NO: 3144372 - DNA, 17 bp, Homo sapiens
gttgtgtaagagaatgt

SEQ ID NO: 3144373 - DNA, 23 bp, Homo sapiens
gttgtgtccctccgcctccccca

SEQ ID NO: 3144374 - DNA, 14 bp, Homo sapiens
gttgtgttgtcacc

SEQ ID NO: 3144375 - DNA, 23 bp, Homo sapiens
gttgttaaaattatgaatctgat

SEQ ID NO: 3144376 - DNA, 15 bp, Homo sapiens
gttgttaagagacat

SEQ ID NO: 3144377 - DNA, 10 bp, Homo sapiens
gttgttcttt

SEQ ID NO: 3144378 - DNA, 20 bp, Homo sapiens
gttgttgccaactaagccct

SEQ ID NO: 3144379 - DNA, 13 bp, Homo sapiens
gttgttgttgttt

SEQ ID NO: 3144380 - DNA, 17 bp, Homo sapiens
gttgtttctgttccaaa

SEQ ID NO: 3144381 - DNA, 13 bp, Homo sapiens
gttgtttctttct

SEQ ID NO: 3144382 - DNA, 23 bp, Homo sapiens
gttgtttgaggcaaattaactgt

SEQ ID NO: 3144383 - DNA, 20 bp, Homo sapiens
gttgtttgtaaataagagat

SEQ ID NO: 3144384 - DNA, 17 bp, Homo sapiens
gttgtttgtaaatgcct

SEQ ID NO: 3144385 - DNA, 20 bp, Homo sapiens
gtttaaaaaaacaaataaat

SEQ ID NO: 3144386 - DNA, 14 bp, Homo sapiens
gtttaaaaaaacat

SEQ ID NO: 3144387 - DNA, 13 bp, Homo sapiens
gtttaaaaagtaa

SEQ ID NO: 3144388 - DNA, 16 bp, Homo sapiens
gtttaaaaagtttcac

SEQ ID NO: 3144389 - DNA, 12 bp, Homo sapiens
gtttaaaaatgg

SEQ ID NO: 3144390 - DNA, 15 bp, Homo sapiens
gtttaaaagccatgt

SEQ ID NO: 3144391 - DNA, 19 bp, Homo sapiens
gtttaaaatgtaatttaaa

SEQ ID NO: 3144392 - DNA, 10 bp, Homo sapiens
gtttaaaatt

SEQ ID NO: 3144393 - DNA, 11 bp, Homo sapiens
gtttaaaattc

SEQ ID NO: 3144394 - DNA, 16 bp, Homo sapiens
gtttaaaattcagttt

SEQ ID NO: 3144395 - DNA, 21 bp, Homo sapiens
gtttaaactgattcataataa

SEQ ID NO: 3144396 - DNA, 14 bp, Homo sapiens
gtttaaagaaagtg

SEQ ID NO: 3144397 - DNA, 15 bp, Homo sapiens
gtttaaagaaagtgt

SEQ ID NO: 3144398 - DNA, 17 bp, Homo sapiens
gtttaaagagtctagat

SEQ ID NO: 3144399 - DNA, 19 bp, Homo sapiens
gtttaaagagtctagattc

SEQ ID NO: 3144400 - DNA, 21 bp, Homo sapiens
gtttaacatttgccttgcaga

SEQ ID NO: 3144401 - DNA, 12 bp, Homo sapiens
gtttaagtgttg

SEQ ID NO: 3144402 - DNA, 15 bp, Homo sapiens
gtttaatagactgag

SEQ ID NO: 3144403 - DNA, 17 bp, Homo sapiens
gtttaatatttaaacag

SEQ ID NO: 3144404 - DNA, 14 bp, Homo sapiens
gtttaatctgttat

SEQ ID NO: 3144405 - DNA, 15 bp, Homo sapiens
gtttaattgtttgtc

SEQ ID NO: 3144406 - DNA, 20 bp, Homo sapiens
gtttacaaaaatttctgtaa

SEQ ID NO: 3144407 - DNA, 19 bp, Homo sapiens
gtttacaacatttttgcaa

SEQ ID NO: 3144408 - DNA, 19 bp, Homo sapiens
gtttacaagtgtatatcag

SEQ ID NO: 3144409 - DNA, 13 bp, Homo sapiens
gtttacagaaaaa

SEQ ID NO: 3144410 - DNA, 14 bp, Homo sapiens
gtttacagaaaaat

SEQ ID NO: 3144411 - DNA, 14 bp, Homo sapiens
gtttacaggccctg

SEQ ID NO: 3144412 - DNA, 18 bp, Homo sapiens
gtttacagggagcctcct

SEQ ID NO: 3144413 - DNA, 19 bp, Homo sapiens
gtttacagggagcctcctg

SEQ ID NO: 3144414 - DNA, 22 bp, Homo sapiens
gtttacatgtgtagcctatgtt

SEQ ID NO: 3144415 - DNA, 15 bp, Homo sapiens
gtttaccagttgcct

SEQ ID NO: 3144416 - DNA, 16 bp, Homo sapiens
gtttacccggtttctt

SEQ ID NO: 3144417 - DNA, 22 bp, Homo sapiens
gtttaccctcaaccctattcat

SEQ ID NO: 3144418 - DNA, 21 bp, Homo sapiens
gtttacctggcttatttaata

SEQ ID NO: 3144419 - DNA, 15 bp, Homo sapiens
gtttacctggggatc

SEQ ID NO: 3144420 - DNA, 12 bp, Homo sapiens
gtttaccttgta

SEQ ID NO: 3144421 - DNA, 14 bp, Homo sapiens
gtttactgaaattt

SEQ ID NO: 3144422 - DNA, 22 bp, Homo sapiens
gtttagaagctgagacacaaag

SEQ ID NO: 3144423 - DNA, 20 bp, Homo sapiens
gtttagaccaaggaacaaaa

SEQ ID NO: 3144424 - DNA, 22 bp, Homo sapiens
gtttagaccaaggaacaaaaaa

SEQ ID NO: 3144425 - DNA, 18 bp, Homo sapiens
gtttagagtaaataaact

SEQ ID NO: 3144426 - DNA, 20 bp, Homo sapiens
gtttagagtaaataaactgt

SEQ ID NO: 3144427 - DNA, 23 bp, Homo sapiens
gtttagagtaaataaactgttta

SEQ ID NO: 3144428 - DNA, 15 bp, Homo sapiens
gtttagcagaactca

SEQ ID NO: 3144429 - DNA, 22 bp, Homo sapiens
gtttaggctatttgtaaatctg

SEQ ID NO: 3144430 - DNA, 23 bp, Homo sapiens
gtttaggctatttgtaaatctgc

SEQ ID NO: 3144431 - DNA, 14 bp, Homo sapiens
gtttataaacagaa

SEQ ID NO: 3144432 - DNA, 13 bp, Homo sapiens
gtttataatctga

SEQ ID NO: 3144433 - DNA, 21 bp, Homo sapiens
gtttatagagggccaagactt

SEQ ID NO: 3144434 - DNA, 23 bp, Homo sapiens
gtttatatactgggttcttgttt

SEQ ID NO: 3144435 - DNA, 23 bp, Homo sapiens
gtttatcagatacatcactgctt

SEQ ID NO: 3144436 - DNA, 12 bp, Homo sapiens
gtttatccaaat

SEQ ID NO: 3144437 - DNA, 16 bp, Homo sapiens
gtttatccaaatcttg

SEQ ID NO: 3144438 - DNA, 18 bp, Homo sapiens
gtttatgagatgctggtt

SEQ ID NO: 3144439 - DNA, 21 bp, Homo sapiens
gtttatgagatgctggttttc

SEQ ID NO: 3144440 - DNA, 21 bp, Homo sapiens
gtttatgataataaaggcacc

SEQ ID NO: 3144441 - DNA, 15 bp, Homo sapiens
gtttatgatatttct

SEQ ID NO: 3144442 - DNA, 21 bp, Homo sapiens
gtttatgatatttcttgcttt

SEQ ID NO: 3144443 - DNA, 17 bp, Homo sapiens
gtttatgatctatttgt

SEQ ID NO: 3144444 - DNA, 14 bp, Homo sapiens
gtttatggcagaag

SEQ ID NO: 3144445 - DNA, 18 bp, Homo sapiens
gtttatggccacatttaa

SEQ ID NO: 3144446 - DNA, 22 bp, Homo sapiens
gtttatggcctcagctgcctca

SEQ ID NO: 3144447 - DNA, 15 bp, Homo sapiens
gtttattaaattgca

SEQ ID NO: 3144448 - DNA, 13 bp, Homo sapiens
gtttattaacaaa

SEQ ID NO: 3144449 - DNA, 20 bp, Homo sapiens
gtttattaatcttagtgtat

SEQ ID NO: 3144450 - DNA, 13 bp, Homo sapiens
gtttattgtaaaa

SEQ ID NO: 3144451 - DNA, 16 bp, Homo sapiens
gtttatttatcagtga

SEQ ID NO: 3144452 - DNA, 19 bp, Homo sapiens
gtttattttcaagaataat

SEQ ID NO: 3144453 - DNA, 18 bp, Homo sapiens
gtttatttttatatagct

SEQ ID NO: 3144454 - DNA, 17 bp, Homo sapiens
gtttatttttcatattg

SEQ ID NO: 3144455 - DNA, 18 bp, Homo sapiens
gtttatttttcatattgt

SEQ ID NO: 3144456 - DNA, 15 bp, Homo sapiens
gtttatttttgtaat

SEQ ID NO: 3144457 - DNA, 20 bp, Homo sapiens
gtttcaaagctttcctgttt

SEQ ID NO: 3144458 - DNA, 20 bp, Homo sapiens
gtttcaaagtaaaggcctcc

SEQ ID NO: 3144459 - DNA, 18 bp, Homo sapiens
gtttcaacggaaagtgct

SEQ ID NO: 3144460 - DNA, 13 bp, Homo sapiens
gtttcaagaaaat

SEQ ID NO: 3144461 - DNA, 14 bp, Homo sapiens
gtttcaagaaaatc

SEQ ID NO: 3144462 - DNA, 17 bp, Homo sapiens
gtttcaagaaaatcttt

SEQ ID NO: 3144463 - DNA, 18 bp, Homo sapiens
gtttcaaggcactctaga

SEQ ID NO: 3144464 - DNA, 23 bp, Homo sapiens
gtttcaagttattcaaatttgta

SEQ ID NO: 3144465 - DNA, 13 bp, Homo sapiens
gtttcaatgtgat

SEQ ID NO: 3144466 - DNA, 21 bp, Homo sapiens
gtttcaatgtgattctaatgt

SEQ ID NO: 3144467 - DNA, 22 bp, Homo sapiens
gtttcaattccacctgcaatca

SEQ ID NO: 3144468 - DNA, 21 bp, Homo sapiens
gtttcacccttaacccaagga

SEQ ID NO: 3144469 - DNA, 22 bp, Homo sapiens
gtttcacccttaacccaaggag

SEQ ID NO: 3144470 - DNA, 18 bp, Homo sapiens
gtttcactgaaatgtttg

SEQ ID NO: 3144471 - DNA, 21 bp, Homo sapiens
gtttcactgaaatgtttggat

SEQ ID NO: 3144472 - DNA, 21 bp, Homo sapiens
gtttcactttcacatagatgt

SEQ ID NO: 3144473 - DNA, 14 bp, Homo sapiens
gtttcagtaaataa

SEQ ID NO: 3144474 - DNA, 22 bp, Homo sapiens
gtttcagtaataaaacatcttt

SEQ ID NO: 3144475 - DNA, 18 bp, Homo sapiens
gtttcagttctgtgtaca

SEQ ID NO: 3144476 - DNA, 21 bp, Homo sapiens
gtttcagtttgttggaaagta

SEQ ID NO: 3144477 - DNA, 21 bp, Homo sapiens
gtttcatgttagttaccttat

SEQ ID NO: 3144478 - DNA, 18 bp, Homo sapiens
gtttcatgttttgtgact

SEQ ID NO: 3144479 - DNA, 19 bp, Homo sapiens
gtttcatgttttgtgacta

SEQ ID NO: 3144480 - DNA, 16 bp, Homo sapiens
gtttcattctcctgcc

SEQ ID NO: 3144481 - DNA, 21 bp, Homo sapiens
gtttcatttagtcatgtgacc

SEQ ID NO: 3144482 - DNA, 20 bp, Homo sapiens
gtttccaacttgtctgggaa

SEQ ID NO: 3144483 - DNA, 17 bp, Homo sapiens
gtttccaatgtgttcaa

SEQ ID NO: 3144484 - DNA, 13 bp, Homo sapiens
gtttccacatgct

SEQ ID NO: 3144485 - DNA, 21 bp, Homo sapiens
gtttccatagcaacaggaaaa

SEQ ID NO: 3144486 - DNA, 17 bp, Homo sapiens
gtttccatcatttctgt

SEQ ID NO: 3144487 - DNA, 13 bp, Homo sapiens
gtttcccataatt

SEQ ID NO: 3144488 - DNA, 19 bp, Homo sapiens
gtttccccactaataaagt

SEQ ID NO: 3144489 - DNA, 21 bp, Homo sapiens
gtttccccactaataaagtgc

SEQ ID NO: 3144490 - DNA, 14 bp, Homo sapiens
gtttccccagggaa

SEQ ID NO: 3144491 - DNA, 23 bp, Homo sapiens
gtttccctcaaatgcgcgtgtgc

SEQ ID NO: 3144492 - DNA, 11 bp, Homo sapiens
gtttccctgct

SEQ ID NO: 3144493 - DNA, 15 bp, Homo sapiens
gtttcccttgctttg

SEQ ID NO: 3144494 - DNA, 16 bp, Homo sapiens
gtttcctaaaagttca

SEQ ID NO: 3144495 - DNA, 15 bp, Homo sapiens
gtttcctaaatccaa

SEQ ID NO: 3144496 - DNA, 18 bp, Homo sapiens
gtttcctctagttctttg

SEQ ID NO: 3144497 - DNA, 14 bp, Homo sapiens
gtttcctcttccaa

SEQ ID NO: 3144498 - DNA, 15 bp, Homo sapiens
gtttcctgacattgt

SEQ ID NO: 3144499 - DNA, 15 bp, Homo sapiens
gtttcctgcaggcat

SEQ ID NO: 3144500 - DNA, 13 bp, Homo sapiens
gtttccttttgga

SEQ ID NO: 3144501 - DNA, 21 bp, Homo sapiens
gtttccttttggaacatttct

SEQ ID NO: 3144502 - DNA, 15 bp, Homo sapiens
gtttcgactggtcca

SEQ ID NO: 3144503 - DNA, 14 bp, Homo sapiens
gtttcgtttctgta

SEQ ID NO: 3144504 - DNA, 16 bp, Homo sapiens
gtttcgtttctgtata

SEQ ID NO: 3144505 - DNA, 20 bp, Homo sapiens
gtttctaagattctaaaggt

SEQ ID NO: 3144506 - DNA, 15 bp, Homo sapiens
gtttctagaggcctc

SEQ ID NO: 3144507 - DNA, 18 bp, Homo sapiens
gtttctagctagaaatat

SEQ ID NO: 3144508 - DNA, 23 bp, Homo sapiens
gtttctagctagaaatatgattt

SEQ ID NO: 3144509 - DNA, 15 bp, Homo sapiens
gtttctatacaaata

SEQ ID NO: 3144510 - DNA, 13 bp, Homo sapiens
gtttctcattctt

SEQ ID NO: 3144511 - DNA, 14 bp, Homo sapiens
gtttctcattcttg

SEQ ID NO: 3144512 - DNA, 23 bp, Homo sapiens
gtttctctgccgctacctccctc

SEQ ID NO: 3144513 - DNA, 15 bp, Homo sapiens
gtttctgaagtactt

SEQ ID NO: 3144514 - DNA, 17 bp, Homo sapiens
gtttctgagaaaagaac

SEQ ID NO: 3144515 - DNA, 15 bp, Homo sapiens
gtttctgcagccctt

SEQ ID NO: 3144516 - DNA, 22 bp, Homo sapiens
gtttctgcagcccttgggcagt

SEQ ID NO: 3144517 - DNA, 16 bp, Homo sapiens
gtttctgggtcctgaa

SEQ ID NO: 3144518 - DNA, 19 bp, Homo sapiens
gtttctgggtcctgaagaa

SEQ ID NO: 3144519 - DNA, 21 bp, Homo sapiens
gtttctggtggtctgttggca

SEQ ID NO: 3144520 - DNA, 17 bp, Homo sapiens
gtttctgtcaggagagc

SEQ ID NO: 3144521 - DNA, 14 bp, Homo sapiens
gtttctgttattaa

SEQ ID NO: 3144522 - DNA, 17 bp, Homo sapiens
gtttcttaagggcacac

SEQ ID NO: 3144523 - DNA, 13 bp, Homo sapiens
gtttcttccaaag

SEQ ID NO: 3144524 - DNA, 18 bp, Homo sapiens
gtttcttcctgccagcag

SEQ ID NO: 3144525 - DNA, 20 bp, Homo sapiens
gtttcttcctgttaatgtat

SEQ ID NO: 3144526 - DNA, 15 bp, Homo sapiens
gtttcttgacaagct

SEQ ID NO: 3144527 - DNA, 23 bp, Homo sapiens
gtttctttctagtggtctttgta

SEQ ID NO: 3144528 - DNA, 14 bp, Homo sapiens
gtttcttttgtttg

SEQ ID NO: 3144529 - DNA, 18 bp, Homo sapiens
gtttcttttgtttggtaa

SEQ ID NO: 3144530 - DNA, 11 bp, Homo sapiens
gtttgaaaagc

SEQ ID NO: 3144531 - DNA, 15 bp, Homo sapiens
gtttgaaaagcaata

SEQ ID NO: 3144532 - DNA, 20 bp, Homo sapiens
gtttgaaaagcaatattgta

SEQ ID NO: 3144533 - DNA, 23 bp, Homo sapiens
gtttgaaatagttcaaactgcag

SEQ ID NO: 3144534 - DNA, 21 bp, Homo sapiens
gtttgaacacgaaagaaatgt

SEQ ID NO: 3144535 - DNA, 13 bp, Homo sapiens
gtttgacctcaca

SEQ ID NO: 3144536 - DNA, 19 bp, Homo sapiens
gtttgactagatgatggat

SEQ ID NO: 3144537 - DNA, 14 bp, Homo sapiens
gtttgactgtgcta

SEQ ID NO: 3144538 - DNA, 15 bp, Homo sapiens
gtttgacttgtttgt

SEQ ID NO: 3144539 - DNA, 20 bp, Homo sapiens
gtttgagacaagccctggca

SEQ ID NO: 3144540 - DNA, 15 bp, Homo sapiens
gtttgagatgctgta

SEQ ID NO: 3144541 - DNA, 19 bp, Homo sapiens
gtttgaggcaaattaactg

SEQ ID NO: 3144542 - DNA, 12 bp, Homo sapiens
gtttgatgtatg

SEQ ID NO: 3144543 - DNA, 17 bp, Homo sapiens
gtttgatgtatgtgtga

SEQ ID NO: 3144544 - DNA, 21 bp, Homo sapiens
gtttgatgtatgtgtgaaaca

SEQ ID NO: 3144545 - DNA, 18 bp, Homo sapiens
gtttgatgtccccaaagt

SEQ ID NO: 3144546 - DNA, 14 bp, Homo sapiens
gtttgattattatg

SEQ ID NO: 3144547 - DNA, 13 bp, Homo sapiens
gtttgatttcaac

SEQ ID NO: 3144548 - DNA, 17 bp, Homo sapiens
gtttgatttttgttttt

SEQ ID NO: 3144549 - DNA, 20 bp, Homo sapiens
gtttgcacaagttccctgga

SEQ ID NO: 3144550 - DNA, 19 bp, Homo sapiens
gtttgcactgtatgctgga

SEQ ID NO: 3144551 - DNA, 15 bp, Homo sapiens
gtttgccatactttg

SEQ ID NO: 3144552 - DNA, 18 bp, Homo sapiens
gtttgccttctactttta

SEQ ID NO: 3144553 - DNA, 19 bp, Homo sapiens
gtttgctcttttaagcagt

SEQ ID NO: 3144554 - DNA, 20 bp, Homo sapiens
gtttgctcttttaagcagtc

SEQ ID NO: 3144555 - DNA, 12 bp, Homo sapiens
gtttgctgctat

SEQ ID NO: 3144556 - DNA, 13 bp, Homo sapiens
gtttgcttaaaca

SEQ ID NO: 3144557 - DNA, 18 bp, Homo sapiens
gtttgcttattgttccaa

SEQ ID NO: 3144558 - DNA, 16 bp, Homo sapiens
gtttgcttcataaatg

SEQ ID NO: 3144559 - DNA, 20 bp, Homo sapiens
gtttgctttgtatgcacttt

SEQ ID NO: 3144560 - DNA, 16 bp, Homo sapiens
gtttggaccccagctg

SEQ ID NO: 3144561 - DNA, 21 bp, Homo sapiens
gtttggactgcagaagcaagg

SEQ ID NO: 3144562 - DNA, 16 bp, Homo sapiens
gtttggattcctcaca

SEQ ID NO: 3144563 - DNA, 22 bp, Homo sapiens
gtttggattcctcacagccttg

SEQ ID NO: 3144564 - DNA, 18 bp, Homo sapiens
gtttggattcttatgtag

SEQ ID NO: 3144565 - DNA, 20 bp, Homo sapiens
gtttggattcttatgtagca

SEQ ID NO: 3144566 - DNA, 19 bp, Homo sapiens
gtttggcaatagtttgcat

SEQ ID NO: 3144567 - DNA, 15 bp, Homo sapiens
gtttggcacttgtat

SEQ ID NO: 3144568 - DNA, 21 bp, Homo sapiens
gtttggctggcttgtttgatt

SEQ ID NO: 3144569 - DNA, 16 bp, Homo sapiens
gtttggcttataaaca

SEQ ID NO: 3144570 - DNA, 18 bp, Homo sapiens
gtttggcttataaacaca

SEQ ID NO: 3144571 - DNA, 16 bp, Homo sapiens
gtttggcttcctcctg

SEQ ID NO: 3144572 - DNA, 13 bp, Homo sapiens
gtttgggcagagc

SEQ ID NO: 3144573 - DNA, 18 bp, Homo sapiens
gtttggggatgagaaagg

SEQ ID NO: 3144574 - DNA, 19 bp, Homo sapiens
gtttgggggcgccctctct

SEQ ID NO: 3144575 - DNA, 21 bp, Homo sapiens
gtttgggggcgccctctctgc

SEQ ID NO: 3144576 - DNA, 19 bp, Homo sapiens
gtttggtaaatgtttcttt

SEQ ID NO: 3144577 - DNA, 15 bp, Homo sapiens
gtttggtgtgtccca

SEQ ID NO: 3144578 - DNA, 15 bp, Homo sapiens
gtttggtgtgttccc

SEQ ID NO: 3144579 - DNA, 14 bp, Homo sapiens
gtttggttcctctc

SEQ ID NO: 3144580 - DNA, 18 bp, Homo sapiens
gtttggttcctctctggt

SEQ ID NO: 3144581 - DNA, 14 bp, Homo sapiens
gtttgtaaaaatat

SEQ ID NO: 3144582 - DNA, 14 bp, Homo sapiens
gtttgtaaatgcct

SEQ ID NO: 3144583 - DNA, 14 bp, Homo sapiens
gtttgtatgagatg

SEQ ID NO: 3144584 - DNA, 19 bp, Homo sapiens
gtttgtatgagatggttaa

SEQ ID NO: 3144585 - DNA, 20 bp, Homo sapiens
gtttgtatgtgtgtagacaa

SEQ ID NO: 3144586 - DNA, 20 bp, Homo sapiens
gtttgtcatcagatggaaat

SEQ ID NO: 3144587 - DNA, 17 bp, Homo sapiens
gtttgtcccccggggca

SEQ ID NO: 3144588 - DNA, 13 bp, Homo sapiens
gtttgtctatttt

SEQ ID NO: 3144589 - DNA, 14 bp, Homo sapiens
gtttgtctatttta

SEQ ID NO: 3144590 - DNA, 15 bp, Homo sapiens
gtttgtctattttaa

SEQ ID NO: 3144591 - DNA, 19 bp, Homo sapiens
gtttgtctattttaaaata

SEQ ID NO: 3144592 - DNA, 18 bp, Homo sapiens
gtttgtctcagttggaaa

SEQ ID NO: 3144593 - DNA, 21 bp, Homo sapiens
gtttgtctctccttttctttt

SEQ ID NO: 3144594 - DNA, 19 bp, Homo sapiens
gtttgtggaaaatgaaaat

SEQ ID NO: 3144595 - DNA, 12 bp, Homo sapiens
gtttgtggcctc

SEQ ID NO: 3144596 - DNA, 22 bp, Homo sapiens
gtttgtgtatttacgctttgat

SEQ ID NO: 3144597 - DNA, 19 bp, Homo sapiens
gtttgtgtgatttcctaaa

SEQ ID NO: 3144598 - DNA, 17 bp, Homo sapiens
gtttgtgtgtatttgta

SEQ ID NO: 3144599 - DNA, 13 bp, Homo sapiens
gtttgtgtgtctt

SEQ ID NO: 3144600 - DNA, 13 bp, Homo sapiens
gtttgttccctgt

SEQ ID NO: 3144601 - DNA, 14 bp, Homo sapiens
gtttgttctgttct

SEQ ID NO: 3144602 - DNA, 15 bp, Homo sapiens
gtttgttctgttctg

SEQ ID NO: 3144603 - DNA, 20 bp, Homo sapiens
gtttgtttctccccctgggc

SEQ ID NO: 3144604 - DNA, 21 bp, Homo sapiens
gtttgtttctccccctgggct

SEQ ID NO: 3144605 - DNA, 20 bp, Homo sapiens
gtttgttttagaaccagccg

SEQ ID NO: 3144606 - DNA, 21 bp, Homo sapiens
gttttaaaataaaaattctga

SEQ ID NO: 3144607 - DNA, 14 bp, Homo sapiens
gttttaaattctga

SEQ ID NO: 3144608 - DNA, 16 bp, Homo sapiens
gttttaaattctgaga

SEQ ID NO: 3144609 - DNA, 16 bp, Homo sapiens
taaagggcctgcctgg

SEQ ID NO: 3144610 - DNA, 18 bp, Homo sapiens
taaagggtgtacttatat

SEQ ID NO: 3144611 - DNA, 21 bp, Homo sapiens
taaagggttgaaaatgtgttt

SEQ ID NO: 3144612 - DNA, 19 bp, Homo sapiens
taaaggtccacaggtctag

SEQ ID NO: 3144613 - DNA, 22 bp, Homo sapiens
taaaggtccacaggtctagact

SEQ ID NO: 3144614 - DNA, 15 bp, Homo sapiens
taaaggtcctgccct

SEQ ID NO: 3144615 - DNA, 21 bp, Homo sapiens
taaaggtggtgaggcaataaa

SEQ ID NO: 3144616 - DNA, 15 bp, Homo sapiens
taaagtaaagctaaa

SEQ ID NO: 3144617 - DNA, 16 bp, Homo sapiens
taaagtaatttctaaa

SEQ ID NO: 3144618 - DNA, 22 bp, Homo sapiens
taaagtactttcttataaattt

SEQ ID NO: 3144619 - DNA, 13 bp, Homo sapiens
taaagtataatgt

SEQ ID NO: 3144620 - DNA, 19 bp, Homo sapiens
taaagtatagagagaagtt

SEQ ID NO: 3144621 - DNA, 21 bp, Homo sapiens
taaagtatgcattattaaatt

SEQ ID NO: 3144622 - DNA, 15 bp, Homo sapiens
taaagtatgtaaaca

SEQ ID NO: 3144623 - DNA, 22 bp, Homo sapiens
taaagtatgtaaacaggagaca

SEQ ID NO: 3144624 - DNA, 22 bp, Homo sapiens
taaagtatgtaaagtatgtaaa

SEQ ID NO: 3144625 - DNA, 16 bp, Homo sapiens
taaagtctatggacag

SEQ ID NO: 3144626 - DNA, 15 bp, Homo sapiens
taaagtctattcaaa

SEQ ID NO: 3144627 - DNA, 16 bp, Homo sapiens
taaagtgccttctggg

SEQ ID NO: 3144628 - DNA, 21 bp, Homo sapiens
taaagtgctaaggttctaagg

SEQ ID NO: 3144629 - DNA, 22 bp, Homo sapiens
taaagtgctaaggttctaaggc

SEQ ID NO: 3144630 - DNA, 18 bp, Homo sapiens
taaagtgtaataatatga

SEQ ID NO: 3144631 - DNA, 17 bp, Homo sapiens
taaagtgtgtttctatg

SEQ ID NO: 3144632 - DNA, 20 bp, Homo sapiens
taaagtgttctgccagatct

SEQ ID NO: 3144633 - DNA, 19 bp, Homo sapiens
taaagtgttggtctttcta

SEQ ID NO: 3144634 - DNA, 13 bp, Homo sapiens
taaagtgttttca

SEQ ID NO: 3144635 - DNA, 15 bp, Homo sapiens
taaagttacactttt

SEQ ID NO: 3144636 - DNA, 13 bp, Homo sapiens
taaagttctaaga

SEQ ID NO: 3144637 - DNA, 16 bp, Homo sapiens
taaagttctaagattc

SEQ ID NO: 3144638 - DNA, 18 bp, Homo sapiens
taaagttctaagattctg

SEQ ID NO: 3144639 - DNA, 19 bp, Homo sapiens
taaagttctaagattctga

SEQ ID NO: 3144640 - DNA, 12 bp, Homo sapiens
taaagttctgtg

SEQ ID NO: 3144641 - DNA, 13 bp, Homo sapiens
taaagttctgtgt

SEQ ID NO: 3144642 - DNA, 14 bp, Homo sapiens
taaagttctgtgta

SEQ ID NO: 3144643 - DNA, 18 bp, Homo sapiens
taaagttgtataaaaaca

SEQ ID NO: 3144644 - DNA, 19 bp, Homo sapiens
taaagttgtataaaaacat

SEQ ID NO: 3144645 - DNA, 14 bp, Homo sapiens
taaataaaaactaa

SEQ ID NO: 3144646 - DNA, 14 bp, Homo sapiens
taaataaaactgaa

SEQ ID NO: 3144647 - DNA, 15 bp, Homo sapiens
taaataaaactgaat

SEQ ID NO: 3144648 - DNA, 13 bp, Homo sapiens
taaataaaagaaa

SEQ ID NO: 3144649 - DNA, 21 bp, Homo sapiens
taaataaaagaaaaaatatct

SEQ ID NO: 3144650 - DNA, 22 bp, Homo sapiens
taaataaaagcacaagtacttt

SEQ ID NO: 3144651 - DNA, 19 bp, Homo sapiens
taaataaaagtgatcaata

SEQ ID NO: 3144652 - DNA, 12 bp, Homo sapiens
taaataaaatca

SEQ ID NO: 3144653 - DNA, 22 bp, Homo sapiens
taaataaaatgtgtacagtgaa

SEQ ID NO: 3144654 - DNA, 12 bp, Homo sapiens
taaataaactgt

SEQ ID NO: 3144655 - DNA, 13 bp, Homo sapiens
taaataaactgtt

SEQ ID NO: 3144656 - DNA, 16 bp, Homo sapiens
taaataaactgtttat

SEQ ID NO: 3144657 - DNA, 17 bp, Homo sapiens
taaataaactgtttata

SEQ ID NO: 3144658 - DNA, 11 bp, Homo sapiens
taaataaactt

SEQ ID NO: 3144659 - DNA, 15 bp, Homo sapiens
taaataaactttttt

SEQ ID NO: 3144660 - DNA, 18 bp, Homo sapiens
taaataaactttttttca

SEQ ID NO: 3144661 - DNA, 22 bp, Homo sapiens
taaataaactttttttcaatgt

SEQ ID NO: 3144662 - DNA, 13 bp, Homo sapiens
taaataaataatc

SEQ ID NO: 3144663 - DNA, 16 bp, Homo sapiens
taaataaatcattaat

SEQ ID NO: 3144664 - DNA, 22 bp, Homo sapiens
taaataaatgaagtatttctca

SEQ ID NO: 3144665 - DNA, 20 bp, Homo sapiens
taaataaatgaataaatcca

SEQ ID NO: 3144666 - DNA, 15 bp, Homo sapiens
taaataacacttgtc

SEQ ID NO: 3144667 - DNA, 19 bp, Homo sapiens
taaataaccccattctttg

SEQ ID NO: 3144668 - DNA, 21 bp, Homo sapiens
taaataaccccattctttgct

SEQ ID NO: 3144669 - DNA, 15 bp, Homo sapiens
taaataacctctggc

SEQ ID NO: 3144670 - DNA, 23 bp, Homo sapiens
taaataacctctggcccttggaa

SEQ ID NO: 3144671 - DNA, 15 bp, Homo sapiens
taaataagagatttg

SEQ ID NO: 3144672 - DNA, 15 bp, Homo sapiens
taaataagcaaataa

SEQ ID NO: 3144673 - DNA, 17 bp, Homo sapiens
taaataagcaaataaac

SEQ ID NO: 3144674 - DNA, 16 bp, Homo sapiens
taaataagcccagtgc

SEQ ID NO: 3144675 - DNA, 15 bp, Homo sapiens
taaataataaataaa

SEQ ID NO: 3144676 - DNA, 14 bp, Homo sapiens
taaataataatata

SEQ ID NO: 3144677 - DNA, 18 bp, Homo sapiens
taaataatgaataaactg

SEQ ID NO: 3144678 - DNA, 19 bp, Homo sapiens
taaataatgaataaactga

SEQ ID NO: 3144679 - DNA, 20 bp, Homo sapiens
taaataatgaataaactgaa

SEQ ID NO: 3144680 - DNA, 21 bp, Homo sapiens
taaataatgaataaactgaat

SEQ ID NO: 3144681 - DNA, 18 bp, Homo sapiens
taaataatgcttcagata

SEQ ID NO: 3144682 - DNA, 17 bp, Homo sapiens
taaatacaaaacttcca

SEQ ID NO: 3144683 - DNA, 14 bp, Homo sapiens
taaatacaagactg

SEQ ID NO: 3144684 - DNA, 15 bp, Homo sapiens
taaatacaagactgt

SEQ ID NO: 3144685 - DNA, 23 bp, Homo sapiens
taaatacaagactgttgtgatct

SEQ ID NO: 3144686 - DNA, 23 bp, Homo sapiens
taaatacaccacctcactcctgt

SEQ ID NO: 3144687 - DNA, 14 bp, Homo sapiens
taaatacagacact

SEQ ID NO: 3144688 - DNA, 16 bp, Homo sapiens
taaatacagacactaa

SEQ ID NO: 3144689 - DNA, 19 bp, Homo sapiens
taaatacagacactaagtt

SEQ ID NO: 3144690 - DNA, 14 bp, Homo sapiens
taaatacataaata

SEQ ID NO: 3144691 - DNA, 17 bp, Homo sapiens
taaataccattgacaca

SEQ ID NO: 3144692 - DNA, 17 bp, Homo sapiens
taaatactgtgcagaat

SEQ ID NO: 3144693 - DNA, 19 bp, Homo sapiens
taaatactgtgcagaataa

SEQ ID NO: 3144694 - DNA, 20 bp, Homo sapiens
taaatactgtgcagaataat

SEQ ID NO: 3144695 - DNA, 21 bp, Homo sapiens
taaatactgtgcagaataatg

SEQ ID NO: 3144696 - DNA, 16 bp, Homo sapiens
taaatactgtgtggaa

SEQ ID NO: 3144697 - DNA, 11 bp, Homo sapiens
taaatactttg

SEQ ID NO: 3144698 - DNA, 19 bp, Homo sapiens
taaatagctatatccatgt

SEQ ID NO: 3144699 - DNA, 22 bp, Homo sapiens
taaatagctatatccatgtact

SEQ ID NO: 3144700 - DNA, 13 bp, Homo sapiens
taaataggaaagt

SEQ ID NO: 3144701 - DNA, 15 bp, Homo sapiens
taaataggaaagttt

SEQ ID NO: 3144702 - DNA, 21 bp, Homo sapiens
taaataggagaggatgagagc

SEQ ID NO: 3144703 - DNA, 14 bp, Homo sapiens
taaatagtagaaaa

SEQ ID NO: 3144704 - DNA, 17 bp, Homo sapiens
taaatataaatgtttaa

SEQ ID NO: 3144705 - DNA, 17 bp, Homo sapiens
taaatataccactcttt

SEQ ID NO: 3144706 - DNA, 21 bp, Homo sapiens
taaatataccactctttacct

SEQ ID NO: 3144707 - DNA, 19 bp, Homo sapiens
taaatatactcaagtttca

SEQ ID NO: 3144708 - DNA, 21 bp, Homo sapiens
taaatatactcaagtttcagg

SEQ ID NO: 3144709 - DNA, 17 bp, Homo sapiens
taaatatagattagaaa

SEQ ID NO: 3144710 - DNA, 19 bp, Homo sapiens
taaatatagttcctaagaa

SEQ ID NO: 3144711 - DNA, 20 bp, Homo sapiens
taaatatagttcctaagaag

SEQ ID NO: 3144712 - DNA, 14 bp, Homo sapiens
taaatatatctacc

SEQ ID NO: 3144713 - DNA, 20 bp, Homo sapiens
taaatatatctaccccagac

SEQ ID NO: 3144714 - DNA, 16 bp, Homo sapiens
taaatatatgtctgat

SEQ ID NO: 3144715 - DNA, 19 bp, Homo sapiens
taaatatatgtctgataat

SEQ ID NO: 3144716 - DNA, 22 bp, Homo sapiens
taaatatatttaagataattat

SEQ ID NO: 3144717 - DNA, 18 bp, Homo sapiens
taaatatccaaagactgt

SEQ ID NO: 3144718 - DNA, 22 bp, Homo sapiens
taaatatctgtacttcttcgat

SEQ ID NO: 3144719 - DNA, 17 bp, Homo sapiens
taaatatcttctgattt

SEQ ID NO: 3144720 - DNA, 13 bp, Homo sapiens
taaatatgcagtg

SEQ ID NO: 3144721 - DNA, 14 bp, Homo sapiens
taaatatgcagtga

SEQ ID NO: 3144722 - DNA, 17 bp, Homo sapiens
taaatatgcagtgatat

SEQ ID NO: 3144723 - DNA, 20 bp, Homo sapiens
taaatatgtacaattgtggg

SEQ ID NO: 3144724 - DNA, 16 bp, Homo sapiens
taaatatgtcagatgt

SEQ ID NO: 3144725 - DNA, 15 bp, Homo sapiens
taaatattctatatg

SEQ ID NO: 3144726 - DNA, 20 bp, Homo sapiens
taaatatttactctttgcaa

SEQ ID NO: 3144727 - DNA, 14 bp, Homo sapiens
taaatattttctat

SEQ ID NO: 3144728 - DNA, 17 bp, Homo sapiens
taaatattttctatttt

SEQ ID NO: 3144729 - DNA, 22 bp, Homo sapiens
taaatcaaccacctatttttga

SEQ ID NO: 3144730 - DNA, 20 bp, Homo sapiens
taaatcaagtcccaaattca

SEQ ID NO: 3144731 - DNA, 22 bp, Homo sapiens
taaatcaagtcccaaattcatt

SEQ ID NO: 3144732 - DNA, 23 bp, Homo sapiens
taaatcaatgtcacttaaaggct

SEQ ID NO: 3144733 - DNA, 17 bp, Homo sapiens
taaatcagtaagaggtg

SEQ ID NO: 3144734 - DNA, 19 bp, Homo sapiens
taaatcatattgatgaaaa

SEQ ID NO: 3144735 - DNA, 20 bp, Homo sapiens
taaatcatattgatgaaaag

SEQ ID NO: 3144736 - DNA, 14 bp, Homo sapiens
taaatcattaatac

SEQ ID NO: 3144737 - DNA, 19 bp, Homo sapiens
taaatcatttcagtatcat

SEQ ID NO: 3144738 - DNA, 23 bp, Homo sapiens
taaatcatttcagtatcatctcc

SEQ ID NO: 3144739 - DNA, 12 bp, Homo sapiens
taaatcctccag

SEQ ID NO: 3144740 - DNA, 18 bp, Homo sapiens
taaatcctgccatttaaa

SEQ ID NO: 3144741 - DNA, 17 bp, Homo sapiens
taaatcctttactgtta

SEQ ID NO: 3144742 - DNA, 17 bp, Homo sapiens
taaatcctttttcttta

SEQ ID NO: 3144743 - DNA, 15 bp, Homo sapiens
taaatctaaatctat

SEQ ID NO: 3144744 - DNA, 19 bp, Homo sapiens
taaatctaaatctatttat

SEQ ID NO: 3144745 - DNA, 20 bp, Homo sapiens
taaatctatttattaatatt

SEQ ID NO: 3144746 - DNA, 16 bp, Homo sapiens
taaatctcctattttt

SEQ ID NO: 3144747 - DNA, 17 bp, Homo sapiens
taaatctcctatttttt

SEQ ID NO: 3144748 - DNA, 15 bp, Homo sapiens
taaatctcttctttg

SEQ ID NO: 3144749 - DNA, 20 bp, Homo sapiens
taaatctgctggagtttcat

SEQ ID NO: 3144750 - DNA, 12 bp, Homo sapiens
taaatctgtgat

SEQ ID NO: 3144751 - DNA, 14 bp, Homo sapiens
taaatctgtgatga

SEQ ID NO: 3144752 - DNA, 13 bp, Homo sapiens
taaatcttaaaca

SEQ ID NO: 3144753 - DNA, 19 bp, Homo sapiens
taaatcttaaacaatgtat

SEQ ID NO: 3144754 - DNA, 13 bp, Homo sapiens
taaatctttcttc

SEQ ID NO: 3144755 - DNA, 16 bp, Homo sapiens
taaatctttcttcaaa

SEQ ID NO: 3144756 - DNA, 14 bp, Homo sapiens
taaatgaaattgta

SEQ ID NO: 3144757 - DNA, 17 bp, Homo sapiens
taaatgaagcagcttta

SEQ ID NO: 3144758 - DNA, 23 bp, Homo sapiens
taaatgaagcagctttaaacaaa

SEQ ID NO: 3144759 - DNA, 13 bp, Homo sapiens
taaatgaataaat

SEQ ID NO: 3144760 - DNA, 15 bp, Homo sapiens
taaatgaatattttg

SEQ ID NO: 3144761 - DNA, 16 bp, Homo sapiens
taaatgaatattttga

SEQ ID NO: 3144762 - DNA, 23 bp, Homo sapiens
taaatgaatctcgttcccaaaga

SEQ ID NO: 3144763 - DNA, 19 bp, Homo sapiens
taaatgagaagtacttggt

SEQ ID NO: 3144764 - DNA, 19 bp, Homo sapiens
taaatgcaaccagaattgt

SEQ ID NO: 3144765 - DNA, 20 bp, Homo sapiens
taaatgcatatcctgagcca

SEQ ID NO: 3144766 - DNA, 14 bp, Homo sapiens
taaatgcattatag

SEQ ID NO: 3144767 - DNA, 22 bp, Homo sapiens
taaatgccctcttctcgtgcct

SEQ ID NO: 3144768 - DNA, 19 bp, Homo sapiens
taaatgcctcttaaattat

SEQ ID NO: 3144769 - DNA, 17 bp, Homo sapiens
taaatgccttgtataaa

SEQ ID NO: 3144770 - DNA, 15 bp, Homo sapiens
taaatgctctatttt

SEQ ID NO: 3144771 - DNA, 22 bp, Homo sapiens
taaatggaattattttgaatgt

SEQ ID NO: 3144772 - DNA, 12 bp, Homo sapiens
taaatggcctca

SEQ ID NO: 3144773 - DNA, 22 bp, Homo sapiens
taaatggcctcatgtggctgga

SEQ ID NO: 3144774 - DNA, 18 bp, Homo sapiens
taaatggtaataagcact

SEQ ID NO: 3144775 - DNA, 18 bp, Homo sapiens
taaatggtgctgcagatt

SEQ ID NO: 3144776 - DNA, 20 bp, Homo sapiens
taaatggtttggtgcttttt

SEQ ID NO: 3144777 - DNA, 16 bp, Homo sapiens
taaatgtaaagatatt

SEQ ID NO: 3144778 - DNA, 17 bp, Homo sapiens
taaatgtaaagatattt

SEQ ID NO: 3144779 - DNA, 16 bp, Homo sapiens
taaatgtaggtatgaa

SEQ ID NO: 3144780 - DNA, 22 bp, Homo sapiens
taaatgtataaatatacagtat

SEQ ID NO: 3144781 - DNA, 13 bp, Homo sapiens
taaatgtatatac

SEQ ID NO: 3144782 - DNA, 15 bp, Homo sapiens
taaatgtatatacac

SEQ ID NO: 3144783 - DNA, 17 bp, Homo sapiens
taaatgtatttaattaa

SEQ ID NO: 3144784 - DNA, 12 bp, Homo sapiens
taaatgtctgtt

SEQ ID NO: 3144785 - DNA, 12 bp, Homo sapiens
taaatgtgttcc

SEQ ID NO: 3144786 - DNA, 11 bp, Homo sapiens
taaatgttcac

SEQ ID NO: 3144787 - DNA, 13 bp, Homo sapiens
taaatgttctatg

SEQ ID NO: 3144788 - DNA, 20 bp, Homo sapiens
taaatgttgaaagatcaaaa

SEQ ID NO: 3144789 - DNA, 18 bp, Homo sapiens
taaatgtttcttttccct

SEQ ID NO: 3144790 - DNA, 19 bp, Homo sapiens
taaatgtttcttttccctt

SEQ ID NO: 3144791 - DNA, 22 bp, Homo sapiens
taaatgtttgacacaattggaa

SEQ ID NO: 3144792 - DNA, 14 bp, Homo sapiens
taaatgttttataa

SEQ ID NO: 3144793 - DNA, 18 bp, Homo sapiens
taaattaaagcctttagt

SEQ ID NO: 3144794 - DNA, 19 bp, Homo sapiens
taaattaaagcctttagta

SEQ ID NO: 3144795 - DNA, 13 bp, Homo sapiens
taaattaagacat

SEQ ID NO: 3144796 - DNA, 15 bp, Homo sapiens
taaattaagacatgc

SEQ ID NO: 3144797 - DNA, 12 bp, Homo sapiens
taaattaatatc

SEQ ID NO: 3144798 - DNA, 17 bp, Homo sapiens
taaattaatatctttct

SEQ ID NO: 3144799 - DNA, 13 bp, Homo sapiens
taaattacaattt

SEQ ID NO: 3144800 - DNA, 14 bp, Homo sapiens
taaattacaatttt

SEQ ID NO: 3144801 - DNA, 17 bp, Homo sapiens
taaattacagcttttat

SEQ ID NO: 3144802 - DNA, 17 bp, Homo sapiens
taaattacgtatgcaag

SEQ ID NO: 3144803 - DNA, 21 bp, Homo sapiens
taaattacgtatgcaagtctg

SEQ ID NO: 3144804 - DNA, 22 bp, Homo sapiens
taaattagatttggcatctcct

SEQ ID NO: 3144805 - DNA, 22 bp, Homo sapiens
taaattaggaataaataaaaat

SEQ ID NO: 3144806 - DNA, 23 bp, Homo sapiens
taaattaggaggctcaacaataa

SEQ ID NO: 3144807 - DNA, 17 bp, Homo sapiens
taaattataacttaaaa

SEQ ID NO: 3144808 - DNA, 22 bp, Homo sapiens
taaattataacttaaaatattt

SEQ ID NO: 3144809 - DNA, 15 bp, Homo sapiens
taaattatacaaatt

SEQ ID NO: 3144810 - DNA, 22 bp, Homo sapiens
taaattatgtgaccataatgta

SEQ ID NO: 3144811 - DNA, 23 bp, Homo sapiens
taaattcaaccactgtaaaatga

SEQ ID NO: 3144812 - DNA, 18 bp, Homo sapiens
taaattcagatatatttt

SEQ ID NO: 3144813 - DNA, 16 bp, Homo sapiens
taaattccactggact

SEQ ID NO: 3144814 - DNA, 18 bp, Homo sapiens
taaattccatatgctcca

SEQ ID NO: 3144815 - DNA, 22 bp, Homo sapiens
taaattcctactccctcttcca

SEQ ID NO: 3144816 - DNA, 19 bp, Homo sapiens
taaattcctcaacagtgtt

SEQ ID NO: 3144817 - DNA, 13 bp, Homo sapiens
taaattctatgtt

SEQ ID NO: 3144818 - DNA, 16 bp, Homo sapiens
taaattctatgttaaa

SEQ ID NO: 3144819 - DNA, 21 bp, Homo sapiens
taaattctatgttaaatactg

SEQ ID NO: 3144820 - DNA, 15 bp, Homo sapiens
taaattctgagacat

SEQ ID NO: 3144821 - DNA, 22 bp, Homo sapiens
taaattctgagacatgtgtcaa

SEQ ID NO: 3144822 - DNA, 15 bp, Homo sapiens
taaattcttttttaa

SEQ ID NO: 3144823 - DNA, 15 bp, Homo sapiens
taaattgaagaaagt

SEQ ID NO: 3144824 - DNA, 22 bp, Homo sapiens
taaattgaatcagtataaacaa

SEQ ID NO: 3144825 - DNA, 16 bp, Homo sapiens
taaattgcaacatatt

SEQ ID NO: 3144826 - DNA, 17 bp, Homo sapiens
taaattgcaacatatta

SEQ ID NO: 3144827 - DNA, 17 bp, Homo sapiens
taaattgcataaagcat

SEQ ID NO: 3144828 - DNA, 16 bp, Homo sapiens
taaattgcctgatttg

SEQ ID NO: 3144829 - DNA, 15 bp, Homo sapiens
taaattgctccttga

SEQ ID NO: 3144830 - DNA, 20 bp, Homo sapiens
taaattggtgataagtggaa

SEQ ID NO: 3144831 - DNA, 22 bp, Homo sapiens
taaattggtgataagtggaaaa

SEQ ID NO: 3144832 - DNA, 13 bp, Homo sapiens
taaattgtaaaac

SEQ ID NO: 3144833 - DNA, 16 bp, Homo sapiens
taaattgtctttaaaa

SEQ ID NO: 3144834 - DNA, 20 bp, Homo sapiens
taaattgtttagtggaaaat

SEQ ID NO: 3144835 - DNA, 14 bp, Homo sapiens
taaatttaaagata

SEQ ID NO: 3144836 - DNA, 22 bp, Homo sapiens
taaatttaaagatattgttcaa

SEQ ID NO: 3144837 - DNA, 18 bp, Homo sapiens
taaatttaaatttaaaga

SEQ ID NO: 3144838 - DNA, 15 bp, Homo sapiens
taaatttaactttaa

SEQ ID NO: 3144839 - DNA, 16 bp, Homo sapiens
taaatttaatgctgcc

SEQ ID NO: 3144840 - DNA, 19 bp, Homo sapiens
taaatttcacaatataaag

SEQ ID NO: 3144841 - DNA, 21 bp, Homo sapiens
taaatttcactactagattga

SEQ ID NO: 3144842 - DNA, 11 bp, Homo sapiens
taaatttctgg

SEQ ID NO: 3144843 - DNA, 14 bp, Homo sapiens
taaatttgaatgtt

SEQ ID NO: 3144844 - DNA, 15 bp, Homo sapiens
taaatttgtaagttt

SEQ ID NO: 3144845 - DNA, 16 bp, Homo sapiens
taaatttgtaagtttc

SEQ ID NO: 3144846 - DNA, 18 bp, Homo sapiens
taaatttgtaagtttcag

SEQ ID NO: 3144847 - DNA, 17 bp, Homo sapiens
taaatttgtttaattaa

SEQ ID NO: 3144848 - DNA, 19 bp, Homo sapiens
taaatttgtttaattaaat

SEQ ID NO: 3144849 - DNA, 16 bp, Homo sapiens
taaattttaaagccat

SEQ ID NO: 3144850 - DNA, 15 bp, Homo sapiens
taaattttagtacat

SEQ ID NO: 3144851 - DNA, 17 bp, Homo sapiens
taaattttagtacattt

SEQ ID NO: 3144852 - DNA, 22 bp, Homo sapiens
taaattttataggactgttctt

SEQ ID NO: 3144853 - DNA, 15 bp, Homo sapiens
taaattttcacctgt

SEQ ID NO: 3144854 - DNA, 16 bp, Homo sapiens
taaattttcttcagtt

SEQ ID NO: 3144855 - DNA, 20 bp, Homo sapiens
taaattttgtctttaactca

SEQ ID NO: 3144856 - DNA, 18 bp, Homo sapiens
taacaaaagatgaaagca

SEQ ID NO: 3144857 - DNA, 20 bp, Homo sapiens
taacaaaagatgaaagcagg

SEQ ID NO: 3144858 - DNA, 22 bp, Homo sapiens
taacaaacatcactctgctgct

SEQ ID NO: 3144859 - DNA, 16 bp, Homo sapiens
taacaaactaaaaata

SEQ ID NO: 3144860 - DNA, 13 bp, Homo sapiens
taacaaagacaaa

SEQ ID NO: 3144861 - DNA, 12 bp, Homo sapiens
taacaaattatg

SEQ ID NO: 3144862 - DNA, 17 bp, Homo sapiens
taacaaccaacttgttg

SEQ ID NO: 3144863 - DNA, 15 bp, Homo sapiens
taacaagaaaacata

SEQ ID NO: 3144864 - DNA, 15 bp, Homo sapiens
taacaagaggggaaa

SEQ ID NO: 3144865 - DNA, 16 bp, Homo sapiens
taacaagatttgtaat

SEQ ID NO: 3144866 - DNA, 18 bp, Homo sapiens
taacaagatttgtaatta

SEQ ID NO: 3144867 - DNA, 20 bp, Homo sapiens
taacaagatttgtaattaca

SEQ ID NO: 3144868 - DNA, 17 bp, Homo sapiens
taacaataactactgtg

SEQ ID NO: 3144869 - DNA, 18 bp, Homo sapiens
taacaataactactgtgt

SEQ ID NO: 3144870 - DNA, 23 bp, Homo sapiens
taacaataactactgtgttcctg

SEQ ID NO: 3144871 - DNA, 20 bp, Homo sapiens
taacaataatatttcaagtg

SEQ ID NO: 3144872 - DNA, 19 bp, Homo sapiens
taacaatacaaatggattt

SEQ ID NO: 3144873 - DNA, 21 bp, Homo sapiens
taacaatacatgagaaagatg

SEQ ID NO: 3144874 - DNA, 17 bp, Homo sapiens
taacaatgcaactttta

SEQ ID NO: 3144875 - DNA, 20 bp, Homo sapiens
taacaatgcagcaaggccct

SEQ ID NO: 3144876 - DNA, 21 bp, Homo sapiens
taacaatgcagcaaggccctg

SEQ ID NO: 3144877 - DNA, 16 bp, Homo sapiens
taacaatgtatgtgaa

SEQ ID NO: 3144878 - DNA, 14 bp, Homo sapiens
taacaatgttaagg

SEQ ID NO: 3144879 - DNA, 19 bp, Homo sapiens
taacaatgttaaggaaact

SEQ ID NO: 3144880 - DNA, 22 bp, Homo sapiens
taacaatgttaaggaaactctt

SEQ ID NO: 3144881 - DNA, 19 bp, Homo sapiens
taacaattgtgtagccttt

SEQ ID NO: 3144882 - DNA, 15 bp, Homo sapiens
taacaatttattctg

SEQ ID NO: 3144883 - DNA, 14 bp, Homo sapiens
taacaatttctgtc

SEQ ID NO: 3144884 - DNA, 14 bp, Homo sapiens
taacacaaaggaag

SEQ ID NO: 3144885 - DNA, 15 bp, Homo sapiens
taacacacacagaaa

SEQ ID NO: 3144886 - DNA, 21 bp, Homo sapiens
taacacacacagaaaagcata

SEQ ID NO: 3144887 - DNA, 21 bp, Homo sapiens
taacacagcattgtatatgtg

SEQ ID NO: 3144888 - DNA, 18 bp, Homo sapiens
taacacataactagaaac

SEQ ID NO: 3144889 - DNA, 22 bp, Homo sapiens
taacacatagcgccgtgctgta

SEQ ID NO: 3144890 - DNA, 23 bp, Homo sapiens
taacacatagcgccgtgctgtaa

SEQ ID NO: 3144891 - DNA, 17 bp, Homo sapiens
taacacatttgattctg

SEQ ID NO: 3144892 - DNA, 21 bp, Homo sapiens
taacacatttttttgcatgca

SEQ ID NO: 3144893 - DNA, 13 bp, Homo sapiens
taacacccttcct

SEQ ID NO: 3144894 - DNA, 15 bp, Homo sapiens
taacacccttccttc

SEQ ID NO: 3144895 - DNA, 24 bp, Homo sapiens
taacacccttccttctgtaaatac

SEQ ID NO: 3144896 - DNA, 16 bp, Homo sapiens
taacactataaaggtt

SEQ ID NO: 3144897 - DNA, 15 bp, Homo sapiens
taacactgttaagag

SEQ ID NO: 3144898 - DNA, 13 bp, Homo sapiens
taacactttgtat

SEQ ID NO: 3144899 - DNA, 12 bp, Homo sapiens
taacagaacagc

SEQ ID NO: 3144900 - DNA, 16 bp, Homo sapiens
taacagaacagcttca

SEQ ID NO: 3144901 - DNA, 21 bp, Homo sapiens
taacagaacagcttcaggtta

SEQ ID NO: 3144902 - DNA, 15 bp, Homo sapiens
taacagatctttact

SEQ ID NO: 3144903 - DNA, 16 bp, Homo sapiens
taacagatgtgaaaat

SEQ ID NO: 3144904 - DNA, 23 bp, Homo sapiens
taacagatgtgaaaatatacttg

SEQ ID NO: 3144905 - DNA, 22 bp, Homo sapiens
taacagattttggggttgtgtt

SEQ ID NO: 3144906 - DNA, 22 bp, Homo sapiens
taacagcattcttgtcacaata

SEQ ID NO: 3144907 - DNA, 19 bp, Homo sapiens
taacagccaggagtgttaa

SEQ ID NO: 3144908 - DNA, 15 bp, Homo sapiens
taacagctgaattat

SEQ ID NO: 3144909 - DNA, 15 bp, Homo sapiens
taacaggccaaagag

SEQ ID NO: 3144910 - DNA, 21 bp, Homo sapiens
taacagtatgtgggatattga

SEQ ID NO: 3144911 - DNA, 15 bp, Homo sapiens
taacagtcttactgc

SEQ ID NO: 3144912 - DNA, 14 bp, Homo sapiens
taacagtgccattg

SEQ ID NO: 3144913 - DNA, 17 bp, Homo sapiens
taacagtgccattgtct

SEQ ID NO: 3144914 - DNA, 22 bp, Homo sapiens
taacagtgccattgtctttata

SEQ ID NO: 3144915 - DNA, 14 bp, Homo sapiens
taacagttatattt

SEQ ID NO: 3144916 - DNA, 20 bp, Homo sapiens
taacagttatatttttgtgt

SEQ ID NO: 3144917 - DNA, 22 bp, Homo sapiens
taacagttatatttttgtgttt

SEQ ID NO: 3144918 - DNA, 14 bp, Homo sapiens
taacagttttccat

SEQ ID NO: 3144919 - DNA, 15 bp, Homo sapiens
taacataaaatctgt

SEQ ID NO: 3144920 - DNA, 20 bp, Homo sapiens
taacataaaatctgtgaatt

SEQ ID NO: 3144921 - DNA, 21 bp, Homo sapiens
taacataaaatctgtgaatta

SEQ ID NO: 3144922 - DNA, 14 bp, Homo sapiens
taacatataatgtt

SEQ ID NO: 3144923 - DNA, 23 bp, Homo sapiens
taacatataatgttgttatttaa

SEQ ID NO: 3144924 - DNA, 17 bp, Homo sapiens
taacatatgtacataaa

SEQ ID NO: 3144925 - DNA, 20 bp, Homo sapiens
taacatatgtacataaattg

SEQ ID NO: 3144926 - DNA, 23 bp, Homo sapiens
taacatatttactaagccacaag

SEQ ID NO: 3144927 - DNA, 16 bp, Homo sapiens
taacatcataattaca

SEQ ID NO: 3144928 - DNA, 20 bp, Homo sapiens
taacatctttattgaaattc

SEQ ID NO: 3144929 - DNA, 22 bp, Homo sapiens
taacatctttattgaaattcta

SEQ ID NO: 3144930 - DNA, 20 bp, Homo sapiens
taacatgaggggacattttg

SEQ ID NO: 3144931 - DNA, 14 bp, Homo sapiens
taacatgatttcaa

SEQ ID NO: 3144932 - DNA, 15 bp, Homo sapiens
taacatgatttcaaa

SEQ ID NO: 3144933 - DNA, 21 bp, Homo sapiens
taacatgggctcttcactagt

SEQ ID NO: 3144934 - DNA, 12 bp, Homo sapiens
taacatgtaaaa

SEQ ID NO: 3144935 - DNA, 13 bp, Homo sapiens
taacatgtaaaat

SEQ ID NO: 3144936 - DNA, 15 bp, Homo sapiens
taacatgtatcccaa

SEQ ID NO: 3144937 - DNA, 22 bp, Homo sapiens
taacatgtcctgcctattatct

SEQ ID NO: 3144938 - DNA, 13 bp, Homo sapiens
taacattatattg

SEQ ID NO: 3144939 - DNA, 15 bp, Homo sapiens
taacattatttatat

SEQ ID NO: 3144940 - DNA, 18 bp, Homo sapiens
taacattccaagactcta

SEQ ID NO: 3144941 - DNA, 22 bp, Homo sapiens
taacattccaagactctagagt

SEQ ID NO: 3144942 - DNA, 16 bp, Homo sapiens
taacattcgatctcat

SEQ ID NO: 3144943 - DNA, 23 bp, Homo sapiens
taacattcgatctcattcagtat

SEQ ID NO: 3144944 - DNA, 16 bp, Homo sapiens
taacattctacttgct

SEQ ID NO: 3144945 - DNA, 23 bp, Homo sapiens
taacattctacttgcttattaca

SEQ ID NO: 3144946 - DNA, 19 bp, Homo sapiens
taacattgaccaagaactg

SEQ ID NO: 3144947 - DNA, 22 bp, Homo sapiens
taacattgaccaagaactgcat

SEQ ID NO: 3144948 - DNA, 13 bp, Homo sapiens
taacattggtgaa

SEQ ID NO: 3144949 - DNA, 21 bp, Homo sapiens
taacatttcccccgagctctt

SEQ ID NO: 3144950 - DNA, 12 bp, Homo sapiens
taacatttctgt

SEQ ID NO: 3144951 - DNA, 17 bp, Homo sapiens
taacatttctgttctca

SEQ ID NO: 3144952 - DNA, 11 bp, Homo sapiens
taacatttgcc

SEQ ID NO: 3144953 - DNA, 13 bp, Homo sapiens
taacatttgcctt

SEQ ID NO: 3144954 - DNA, 21 bp, Homo sapiens
taacatttgccttgcagaact

SEQ ID NO: 3144955 - DNA, 13 bp, Homo sapiens
taacattttaaat

SEQ ID NO: 3144956 - DNA, 21 bp, Homo sapiens
taacattttaaataaaagaaa

SEQ ID NO: 3144957 - DNA, 14 bp, Homo sapiens
taacattttgttct

SEQ ID NO: 3144958 - DNA, 15 bp, Homo sapiens
taaccaaatattaaa

SEQ ID NO: 3144959 - DNA, 16 bp, Homo sapiens
taaccaagctgagttt

SEQ ID NO: 3144960 - DNA, 19 bp, Homo sapiens
taaccaagctgagtttcct

SEQ ID NO: 3144961 - DNA, 13 bp, Homo sapiens
taaccacaaggtc

SEQ ID NO: 3144962 - DNA, 15 bp, Homo sapiens
taaccacaaggtcca

SEQ ID NO: 3144963 - DNA, 15 bp, Homo sapiens
taaccacattaatta

SEQ ID NO: 3144964 - DNA, 16 bp, Homo sapiens
taaccacattaattaa

SEQ ID NO: 3144965 - DNA, 19 bp, Homo sapiens
taaccacgtctgtcttcac

SEQ ID NO: 3144966 - DNA, 23 bp, Homo sapiens
taaccattgtcttgttctgtgat

SEQ ID NO: 3144967 - DNA, 12 bp, Homo sapiens
taacccaaggag

SEQ ID NO: 3144968 - DNA, 18 bp, Homo sapiens
taacccaaggagcacagg

SEQ ID NO: 3144969 - DNA, 24 bp, Homo sapiens
taacccacttgtcactgacacaaa

SEQ ID NO: 3144970 - DNA, 16 bp, Homo sapiens
taacccagattttatt

SEQ ID NO: 3144971 - DNA, 19 bp, Homo sapiens
taacccaggcctgtctgac

SEQ ID NO: 3144972 - DNA, 15 bp, Homo sapiens
taacccagttacttt

SEQ ID NO: 3144973 - DNA, 22 bp, Homo sapiens
taacccagttacttttttacac

SEQ ID NO: 3144974 - DNA, 14 bp, Homo sapiens
taaccccattcttt

SEQ ID NO: 3144975 - DNA, 23 bp, Homo sapiens
taacccgctcatcactggatgaa

SEQ ID NO: 3144976 - DNA, 15 bp, Homo sapiens
taaccctactttgct

SEQ ID NO: 3144977 - DNA, 18 bp, Homo sapiens
taaccctcccatggcacc

SEQ ID NO: 3144978 - DNA, 17 bp, Homo sapiens
taaccctggcacttaag

SEQ ID NO: 3144979 - DNA, 20 bp, Homo sapiens
taaccctttggtttttttct

SEQ ID NO: 3144980 - DNA, 19 bp, Homo sapiens
taacctagttaaagaaagg

SEQ ID NO: 3144981 - DNA, 20 bp, Homo sapiens
taacctagttaaagaaagga

SEQ ID NO: 3144982 - DNA, 20 bp, Homo sapiens
taacctatgatattttctgt

SEQ ID NO: 3144983 - DNA, 14 bp, Homo sapiens
taacctcagctctg

SEQ ID NO: 3144984 - DNA, 15 bp, Homo sapiens
taacctcagctctgg

SEQ ID NO: 3144985 - DNA, 19 bp, Homo sapiens
taacctcagctctgggaga

SEQ ID NO: 3144986 - DNA, 19 bp, Homo sapiens
taacctcagtgtcatttat

SEQ ID NO: 3144987 - DNA, 14 bp, Homo sapiens
taacctctgcacta

SEQ ID NO: 3144988 - DNA, 17 bp, Homo sapiens
taacctctgcttttatc

SEQ ID NO: 3144989 - DNA, 13 bp, Homo sapiens
taacctctggccc

SEQ ID NO: 3144990 - DNA, 15 bp, Homo sapiens
taacctctggccctt

SEQ ID NO: 3144991 - DNA, 18 bp, Homo sapiens
taacctctggcccttgga

SEQ ID NO: 3144992 - DNA, 21 bp, Homo sapiens
taacctctggcccttggaata

SEQ ID NO: 3144993 - DNA, 17 bp, Homo sapiens
taacctcttttctgcat

SEQ ID NO: 3144994 - DNA, 17 bp, Homo sapiens
taacctggacctggaac

SEQ ID NO: 3144995 - DNA, 23 bp, Homo sapiens
taacgcaataaacgcattatcag

SEQ ID NO: 3144996 - DNA, 15 bp, Homo sapiens
taacgcgtcttcctg

SEQ ID NO: 3144997 - DNA, 16 bp, Homo sapiens
taacgcgtcttcctga

SEQ ID NO: 3144998 - DNA, 12 bp, Homo sapiens
taacggctccag

SEQ ID NO: 3144999 - DNA, 13 bp, Homo sapiens
taacggctccagg

SEQ ID NO: 3145000 - DNA, 16 bp, Homo sapiens
taacgggaggctgggc

SEQ ID NO: 3145001 - DNA, 18 bp, Homo sapiens
taacgtttttcctttaaa

SEQ ID NO: 3145002 - DNA, 14 bp, Homo sapiens
taactaaaggggac

SEQ ID NO: 3145003 - DNA, 18 bp, Homo sapiens
taactaaatttgatactt

SEQ ID NO: 3145004 - DNA, 21 bp, Homo sapiens
taactaaatttgatacttata

SEQ ID NO: 3145005 - DNA, 15 bp, Homo sapiens
taactaatgttattt

SEQ ID NO: 3145006 - DNA, 16 bp, Homo sapiens
taactaattttgttga

SEQ ID NO: 3145007 - DNA, 22 bp, Homo sapiens
taactactatattgattgtcct

SEQ ID NO: 3145008 - DNA, 16 bp, Homo sapiens
taactactgtgttcct

SEQ ID NO: 3145009 - DNA, 16 bp, Homo sapiens
taactactttataact

SEQ ID NO: 3145010 - DNA, 15 bp, Homo sapiens
taactagaattagta

SEQ ID NO: 3145011 - DNA, 20 bp, Homo sapiens
taactagaattagtatgtct

SEQ ID NO: 3145012 - DNA, 17 bp, Homo sapiens
taactagaatttattca

SEQ ID NO: 3145013 - DNA, 22 bp, Homo sapiens
taactagacaccaaagttctaa

SEQ ID NO: 3145014 - DNA, 17 bp, Homo sapiens
taactataaatatgtac

SEQ ID NO: 3145015 - DNA, 18 bp, Homo sapiens
taactatgtggctgaaaa

SEQ ID NO: 3145016 - DNA, 16 bp, Homo sapiens
taactattaacctttt

SEQ ID NO: 3145017 - DNA, 22 bp, Homo sapiens
taactcaaggataccttcttat

SEQ ID NO: 3145018 - DNA, 23 bp, Homo sapiens
taactcaaggataccttcttatt

SEQ ID NO: 3145019 - DNA, 15 bp, Homo sapiens
taactcaccagcccc

SEQ ID NO: 3145020 - DNA, 21 bp, Homo sapiens
taactcaccagccccactgcc

SEQ ID NO: 3145021 - DNA, 12 bp, Homo sapiens
taactcaccgtg

SEQ ID NO: 3145022 - DNA, 14 bp, Homo sapiens
taactcagaattat

SEQ ID NO: 3145023 - DNA, 17 bp, Homo sapiens
taactccactggctcca

SEQ ID NO: 3145024 - DNA, 19 bp, Homo sapiens
taactccagatagagaaat

SEQ ID NO: 3145025 - DNA, 17 bp, Homo sapiens
taactcctgagaaatgt

SEQ ID NO: 3145026 - DNA, 19 bp, Homo sapiens
taactcctgccattcttct

SEQ ID NO: 3145027 - DNA, 22 bp, Homo sapiens
taactctaattcccattttgca

SEQ ID NO: 3145028 - DNA, 16 bp, Homo sapiens
taactctgcaaaggcc

SEQ ID NO: 3145029 - DNA, 18 bp, Homo sapiens
taactctgtataatagag

SEQ ID NO: 3145030 - DNA, 14 bp, Homo sapiens
taactcttgtctat

SEQ ID NO: 3145031 - DNA, 16 bp, Homo sapiens
taactcttttctattt

SEQ ID NO: 3145032 - DNA, 16 bp, Homo sapiens
taactgaaaatgtaaa

SEQ ID NO: 3145033 - DNA, 21 bp, Homo sapiens
taactgaaaatgtgctatact

SEQ ID NO: 3145034 - DNA, 15 bp, Homo sapiens
taactgaaccaaatt

SEQ ID NO: 3145035 - DNA, 20 bp, Homo sapiens
taactgaaccaaattgcact

SEQ ID NO: 3145036 - DNA, 14 bp, Homo sapiens
taactgaagagaca

SEQ ID NO: 3145037 - DNA, 13 bp, Homo sapiens
taactgatttcta

SEQ ID NO: 3145038 - DNA, 13 bp, Homo sapiens
taactgcagacca

SEQ ID NO: 3145039 - DNA, 17 bp, Homo sapiens
taactgccgtaatttaa

SEQ ID NO: 3145040 - DNA, 16 bp, Homo sapiens
taactgctgagccact

SEQ ID NO: 3145041 - DNA, 19 bp, Homo sapiens
taactggcctaaatttctt

SEQ ID NO: 3145042 - DNA, 20 bp, Homo sapiens
taactggcctaaatttcttc

SEQ ID NO: 3145043 - DNA, 23 bp, Homo sapiens
taactgtaaagatgtttatttca

SEQ ID NO: 3145044 - DNA, 12 bp, Homo sapiens
taactgtaaatc

SEQ ID NO: 3145045 - DNA, 14 bp, Homo sapiens
taactgtgaaatac

SEQ ID NO: 3145046 - DNA, 21 bp, Homo sapiens
taactgtggagggagtgttca

SEQ ID NO: 3145047 - DNA, 22 bp, Homo sapiens
taactgttaactatgacagata

SEQ ID NO: 3145048 - DNA, 17 bp, Homo sapiens
taacttaaaaatgtaaa

SEQ ID NO: 3145049 - DNA, 16 bp, Homo sapiens
taacttaatagtattt

SEQ ID NO: 3145050 - DNA, 17 bp, Homo sapiens
taacttactgtatatgt

SEQ ID NO: 3145051 - DNA, 17 bp, Homo sapiens
taacttatgtagatatt

SEQ ID NO: 3145052 - DNA, 13 bp, Homo sapiens
taacttcagtcct

SEQ ID NO: 3145053 - DNA, 18 bp, Homo sapiens
taacttctatattttaat

SEQ ID NO: 3145054 - DNA, 22 bp, Homo sapiens
taacttctatattttaatagaa

SEQ ID NO: 3145055 - DNA, 13 bp, Homo sapiens
taacttcttcctg

SEQ ID NO: 3145056 - DNA, 17 bp, Homo sapiens
taacttcttcctgctgg

SEQ ID NO: 3145057 - DNA, 13 bp, Homo sapiens
taacttcttgctt

SEQ ID NO: 3145058 - DNA, 19 bp, Homo sapiens
taacttcttgcttctttct

SEQ ID NO: 3145059 - DNA, 16 bp, Homo sapiens
taacttgaaaattttt

SEQ ID NO: 3145060 - DNA, 21 bp, Homo sapiens
taacttgagttttatttattt

SEQ ID NO: 3145061 - DNA, 15 bp, Homo sapiens
taacttgatgcatgt

SEQ ID NO: 3145062 - DNA, 16 bp, Homo sapiens
taacttgatgcatgtg

SEQ ID NO: 3145063 - DNA, 15 bp, Homo sapiens
taactttaagtttca

SEQ ID NO: 3145064 - DNA, 16 bp, Homo sapiens
taactttaatgttttt

SEQ ID NO: 3145065 - DNA, 22 bp, Homo sapiens
taactttaattctctttcaaag

SEQ ID NO: 3145066 - DNA, 21 bp, Homo sapiens
taactttactctgtgtttaaa

SEQ ID NO: 3145067 - DNA, 14 bp, Homo sapiens
taactttatgtgta

SEQ ID NO: 3145068 - DNA, 14 bp, Homo sapiens
taactttattcttt

SEQ ID NO: 3145069 - DNA, 15 bp, Homo sapiens
taactttattctttg

SEQ ID NO: 3145070 - DNA, 13 bp, Homo sapiens
taactttctgggt

SEQ ID NO: 3145071 - DNA, 13 bp, Homo sapiens
taactttctttac

SEQ ID NO: 3145072 - DNA, 20 bp, Homo sapiens
taagaaaaaataacacacat

SEQ ID NO: 3145073 - DNA, 21 bp, Homo sapiens
taagaaaagatacgactttat

SEQ ID NO: 3145074 - DNA, 13 bp, Homo sapiens
taagaaaagcact

SEQ ID NO: 3145075 - DNA, 16 bp, Homo sapiens
taagaaaagcactttt

SEQ ID NO: 3145076 - DNA, 14 bp, Homo sapiens
taagaaaatacaat

SEQ ID NO: 3145077 - DNA, 12 bp, Homo sapiens
taagaaacagag

SEQ ID NO: 3145078 - DNA, 21 bp, Homo sapiens
taagaaaccctctgtcattcg

SEQ ID NO: 3145079 - DNA, 16 bp, Homo sapiens
taagaaagtagaggca

SEQ ID NO: 3145080 - DNA, 24 bp, Homo sapiens
taagaaatctagtatttcatgctg

SEQ ID NO: 3145081 - DNA, 18 bp, Homo sapiens
taagaacaaaagcgaccc

SEQ ID NO: 3145082 - DNA, 22 bp, Homo sapiens
taagaacaaagagaaaaaatac

SEQ ID NO: 3145083 - DNA, 23 bp, Homo sapiens
taagaaccttaatgacaacactt

SEQ ID NO: 3145084 - DNA, 13 bp, Homo sapiens
taagaagctgttg

SEQ ID NO: 3145085 - DNA, 20 bp, Homo sapiens
taagaagcttctaataaatt

SEQ ID NO: 3145086 - DNA, 19 bp, Homo sapiens
taagaatatctgtaatggt

SEQ ID NO: 3145087 - DNA, 20 bp, Homo sapiens
taagaatcagagtagaaata

SEQ ID NO: 3145088 - DNA, 21 bp, Homo sapiens
taagaatcagagtagaaataa

SEQ ID NO: 3145089 - DNA, 14 bp, Homo sapiens
taagaatgcattat

SEQ ID NO: 3145090 - DNA, 15 bp, Homo sapiens
taagaatgctggttt

SEQ ID NO: 3145091 - DNA, 23 bp, Homo sapiens
taagaatgctggttttcctaaat

SEQ ID NO: 3145092 - DNA, 16 bp, Homo sapiens
taagaattgagtaatg

SEQ ID NO: 3145093 - DNA, 20 bp, Homo sapiens
taagaattgagtaatggtgt

SEQ ID NO: 3145094 - DNA, 21 bp, Homo sapiens
taagaattgagtaatggtgta

SEQ ID NO: 3145095 - DNA, 17 bp, Homo sapiens
taagaattttaaatatt

SEQ ID NO: 3145096 - DNA, 19 bp, Homo sapiens
taagaattttaaatatttt

SEQ ID NO: 3145097 - DNA, 15 bp, Homo sapiens
taagacaatagtatt

SEQ ID NO: 3145098 - DNA, 18 bp, Homo sapiens
taagacaatagtatttct

SEQ ID NO: 3145099 - DNA, 11 bp, Homo sapiens
taagacagtgt

SEQ ID NO: 3145100 - DNA, 23 bp, Homo sapiens
taagacagtgtacaaaactgtaa

SEQ ID NO: 3145101 - DNA, 17 bp, Homo sapiens
taagacataacgttttt

SEQ ID NO: 3145102 - DNA, 20 bp, Homo sapiens
taagacatactccttccatc

SEQ ID NO: 3145103 - DNA, 16 bp, Homo sapiens
taagacatgatttcct

SEQ ID NO: 3145104 - DNA, 20 bp, Homo sapiens
taagacatgatttccttgaa

SEQ ID NO: 3145105 - DNA, 12 bp, Homo sapiens
taagacatgtga

SEQ ID NO: 3145106 - DNA, 20 bp, Homo sapiens
taagacatttgtatattgtg

SEQ ID NO: 3145107 - DNA, 13 bp, Homo sapiens
taagaccagcctg

SEQ ID NO: 3145108 - DNA, 16 bp, Homo sapiens
taagaccgtgtcccaa

SEQ ID NO: 3145109 - DNA, 22 bp, Homo sapiens
taagaccgtgtcccaaggagct

SEQ ID NO: 3145110 - DNA, 14 bp, Homo sapiens
taagacctactgtt

SEQ ID NO: 3145111 - DNA, 21 bp, Homo sapiens
taagacctactgttctaaagc

SEQ ID NO: 3145112 - DNA, 18 bp, Homo sapiens
taagactatatatataaa

SEQ ID NO: 3145113 - DNA, 19 bp, Homo sapiens
taagactcaaatgttctaa

SEQ ID NO: 3145114 - DNA, 22 bp, Homo sapiens
taagactcaaatgttctaagtt

SEQ ID NO: 3145115 - DNA, 20 bp, Homo sapiens
taagacttactctaagatct

SEQ ID NO: 3145116 - DNA, 15 bp, Homo sapiens
taagacttgtgcatg

SEQ ID NO: 3145117 - DNA, 15 bp, Homo sapiens
taagagaaaagagag

SEQ ID NO: 3145118 - DNA, 18 bp, Homo sapiens
taagagaaagaaaatgaa

SEQ ID NO: 3145119 - DNA, 15 bp, Homo sapiens
taagagaaatggcaa

SEQ ID NO: 3145120 - DNA, 21 bp, Homo sapiens
taagagaattatatatttcta

SEQ ID NO: 3145121 - DNA, 23 bp, Homo sapiens
taagagacagaatgtatctgtga

SEQ ID NO: 3145122 - DNA, 12 bp, Homo sapiens
taagaggcaggg

SEQ ID NO: 3145123 - DNA, 15 bp, Homo sapiens
taagagggcagactg

SEQ ID NO: 3145124 - DNA, 23 bp, Homo sapiens
taagagggcagactgtgaacttg

SEQ ID NO: 3145125 - DNA, 18 bp, Homo sapiens
taagagtgtagaagcatt

SEQ ID NO: 3145126 - DNA, 17 bp, Homo sapiens
taagataaatgtgctga

SEQ ID NO: 3145127 - DNA, 23 bp, Homo sapiens
taagataatagtttacatgtagt

SEQ ID NO: 3145128 - DNA, 12 bp, Homo sapiens
taagataattat

SEQ ID NO: 3145129 - DNA, 22 bp, Homo sapiens
taagatacaaattaattttact

SEQ ID NO: 3145130 - DNA, 17 bp, Homo sapiens
taagatatccatctttt

SEQ ID NO: 3145131 - DNA, 21 bp, Homo sapiens
taagatatccatctttttctt

SEQ ID NO: 3145132 - DNA, 17 bp, Homo sapiens
taagatatctcaatgaa

SEQ ID NO: 3145133 - DNA, 15 bp, Homo sapiens
taagatccaccccct

SEQ ID NO: 3145134 - DNA, 20 bp, Homo sapiens
taagatcttagattctctgt

SEQ ID NO: 3145135 - DNA, 12 bp, Homo sapiens
taagatgctggg

SEQ ID NO: 3145136 - DNA, 21 bp, Homo sapiens
taagatggattctcagatatt

SEQ ID NO: 3145137 - DNA, 22 bp, Homo sapiens
taagatggattctcagatattt

SEQ ID NO: 3145138 - DNA, 19 bp, Homo sapiens
taagatgtgatattctaag

SEQ ID NO: 3145139 - DNA, 22 bp, Homo sapiens
taagatgtgatattctaagact

SEQ ID NO: 3145140 - DNA, 23 bp, Homo sapiens
taagatgtgatattctaagactt

SEQ ID NO: 3145141 - DNA, 13 bp, Homo sapiens
taagattaaagga

SEQ ID NO: 3145142 - DNA, 17 bp, Homo sapiens
taagattaaaggaagga

SEQ ID NO: 3145143 - DNA, 22 bp, Homo sapiens
taagattacaaatcagaagtca

SEQ ID NO: 3145144 - DNA, 21 bp, Homo sapiens
taagattccagagagtggctc

SEQ ID NO: 3145145 - DNA, 10 bp, Homo sapiens
taagattcta

SEQ ID NO: 3145146 - DNA, 11 bp, Homo sapiens
taagattctaa

SEQ ID NO: 3145147 - DNA, 13 bp, Homo sapiens
taagattctaaag

SEQ ID NO: 3145148 - DNA, 17 bp, Homo sapiens
taagattctaacggtct

SEQ ID NO: 3145149 - DNA, 21 bp, Homo sapiens
taagattctagatcagatgct

SEQ ID NO: 3145150 - DNA, 17 bp, Homo sapiens
taagattctgattttag

SEQ ID NO: 3145151 - DNA, 17 bp, Homo sapiens
taagattgtaaaaataa

SEQ ID NO: 3145152 - DNA, 21 bp, Homo sapiens
taagcaaaggctctgaaataa

SEQ ID NO: 3145153 - DNA, 13 bp, Homo sapiens
taagcaaataaac

SEQ ID NO: 3145154 - DNA, 18 bp, Homo sapiens
taagcaaatttcaaaaga

SEQ ID NO: 3145155 - DNA, 21 bp, Homo sapiens
taagcaaatttcaaaagacat

SEQ ID NO: 3145156 - DNA, 16 bp, Homo sapiens
taagcactacataaac

SEQ ID NO: 3145157 - DNA, 17 bp, Homo sapiens
taagcactacataaact

SEQ ID NO: 3145158 - DNA, 17 bp, Homo sapiens
taagcactcttaaagca

SEQ ID NO: 3145159 - DNA, 20 bp, Homo sapiens
taagcactgaaaaacaacaa

SEQ ID NO: 3145160 - DNA, 18 bp, Homo sapiens
taagcagcatggaaaaat

SEQ ID NO: 3145161 - DNA, 22 bp, Homo sapiens
taagcaggtggatctatttcat

SEQ ID NO: 3145162 - DNA, 15 bp, Homo sapiens
taagcagtaaaaact

SEQ ID NO: 3145163 - DNA, 18 bp, Homo sapiens
taagcatctggctctaat

SEQ ID NO: 3145164 - DNA, 17 bp, Homo sapiens
taagcatgtgtcccagg

SEQ ID NO: 3145165 - DNA, 14 bp, Homo sapiens
taagcattgcctgg

SEQ ID NO: 3145166 - DNA, 17 bp, Homo sapiens
taagcattgtttgctta

SEQ ID NO: 3145167 - DNA, 20 bp, Homo sapiens
taagcattgtttgcttattg

SEQ ID NO: 3145168 - DNA, 23 bp, Homo sapiens
taagcattgtttgcttattgttc

SEQ ID NO: 3145169 - DNA, 16 bp, Homo sapiens
taagccaaagaaatga

SEQ ID NO: 3145170 - DNA, 22 bp, Homo sapiens
taagccacaagaaatttgattt

SEQ ID NO: 3145171 - DNA, 14 bp, Homo sapiens
taagccagagcctg

SEQ ID NO: 3145172 - DNA, 20 bp, Homo sapiens
taagccctcgaaccaaggca

SEQ ID NO: 3145173 - DNA, 22 bp, Homo sapiens
taagccctgtcgagacacttgc

SEQ ID NO: 3145174 - DNA, 23 bp, Homo sapiens
taagccgatggtcactatagctc

SEQ ID NO: 3145175 - DNA, 14 bp, Homo sapiens
taagcctccattta

SEQ ID NO: 3145176 - DNA, 11 bp, Homo sapiens
taagcctgagc

SEQ ID NO: 3145177 - DNA, 15 bp, Homo sapiens
taagcctttccataa

SEQ ID NO: 3145178 - DNA, 21 bp, Homo sapiens
taagctaaagaggctgaaaga

SEQ ID NO: 3145179 - DNA, 23 bp, Homo sapiens
taagctaggatgttgctcagaag

SEQ ID NO: 3145180 - DNA, 14 bp, Homo sapiens
taagctatcagcaa

SEQ ID NO: 3145181 - DNA, 21 bp, Homo sapiens
taagctattcagtaataactc

SEQ ID NO: 3145182 - DNA, 14 bp, Homo sapiens
taagctctttgaaa

SEQ ID NO: 3145183 - DNA, 17 bp, Homo sapiens
taagctctttgaaacaa

SEQ ID NO: 3145184 - DNA, 18 bp, Homo sapiens
taagctggctctgtttga

SEQ ID NO: 3145185 - DNA, 13 bp, Homo sapiens
taagctgtgtctg

SEQ ID NO: 3145186 - DNA, 22 bp, Homo sapiens
taagctgttcctgttcagtaat

SEQ ID NO: 3145187 - DNA, 15 bp, Homo sapiens
taagctttctctcag

SEQ ID NO: 3145188 - DNA, 21 bp, Homo sapiens
taagctttggacccaaggaaa

SEQ ID NO: 3145189 - DNA, 15 bp, Homo sapiens
taagctttttggaat

SEQ ID NO: 3145190 - DNA, 15 bp, Homo sapiens
taaggaaactagaca

SEQ ID NO: 3145191 - DNA, 16 bp, Homo sapiens
taaggaaactagacaa

SEQ ID NO: 3145192 - DNA, 19 bp, Homo sapiens
taaggaaactcttatctca

SEQ ID NO: 3145193 - DNA, 15 bp, Homo sapiens
taaggaagatatcta

SEQ ID NO: 3145194 - DNA, 17 bp, Homo sapiens
taaggacttctgcagct

SEQ ID NO: 3145195 - DNA, 22 bp, Homo sapiens
taaggagagttcaagcctgtgg

SEQ ID NO: 3145196 - DNA, 16 bp, Homo sapiens
taaggagatgggcctt

SEQ ID NO: 3145197 - DNA, 18 bp, Homo sapiens
taaggaggaggagggaga

SEQ ID NO: 3145198 - DNA, 21 bp, Homo sapiens
taaggaggaggagggagaaga

SEQ ID NO: 3145199 - DNA, 15 bp, Homo sapiens
taaggataattttcc

SEQ ID NO: 3145200 - DNA, 17 bp, Homo sapiens
taaggatccggaaagaa

SEQ ID NO: 3145201 - DNA, 21 bp, Homo sapiens
taaggatggaaaggtgacagt

SEQ ID NO: 3145202 - DNA, 19 bp, Homo sapiens
taaggatggagccagctct

SEQ ID NO: 3145203 - DNA, 20 bp, Homo sapiens
taaggcacagtgggagctga

SEQ ID NO: 3145204 - DNA, 16 bp, Homo sapiens
taaggcctaggattct

SEQ ID NO: 3145205 - DNA, 13 bp, Homo sapiens
taaggctcctcct

SEQ ID NO: 3145206 - DNA, 14 bp, Homo sapiens
taaggctctagatc

SEQ ID NO: 3145207 - DNA, 14 bp, Homo sapiens
taaggctctgagag

SEQ ID NO: 3145208 - DNA, 22 bp, Homo sapiens
taaggctctgagagtctagatt

SEQ ID NO: 3145209 - DNA, 24 bp, Homo sapiens
taaggctctgagagtctagattct

SEQ ID NO: 3145210 - DNA, 21 bp, Homo sapiens
taagggagagctgagccagtt

SEQ ID NO: 3145211 - DNA, 14 bp, Homo sapiens
taagggcagtgccc

SEQ ID NO: 3145212 - DNA, 23 bp, Homo sapiens
taagggcagtgcccatgtgtaca

SEQ ID NO: 3145213 - DNA, 15 bp, Homo sapiens
taagggcatgccttg

SEQ ID NO: 3145214 - DNA, 22 bp, Homo sapiens
taagggctggtctctgctgaag

SEQ ID NO: 3145215 - DNA, 15 bp, Homo sapiens
taaggggaagaatga

SEQ ID NO: 3145216 - DNA, 19 bp, Homo sapiens
taagggtgggtgctcagaa

SEQ ID NO: 3145217 - DNA, 20 bp, Homo sapiens
taagggttagtttacaatca

SEQ ID NO: 3145218 - DNA, 21 bp, Homo sapiens
taaggtccggtgttctaagat

SEQ ID NO: 3145219 - DNA, 13 bp, Homo sapiens
taaggtctcatgc

SEQ ID NO: 3145220 - DNA, 18 bp, Homo sapiens
taaggtgatatatttaaa

SEQ ID NO: 3145221 - DNA, 15 bp, Homo sapiens
taaggttctaaggcc

SEQ ID NO: 3145222 - DNA, 16 bp, Homo sapiens
taaggttctcatagga

SEQ ID NO: 3145223 - DNA, 20 bp, Homo sapiens
taaggttgaactttgccaaa

SEQ ID NO: 3145224 - DNA, 19 bp, Homo sapiens
taaggtttcgtttctgtat

SEQ ID NO: 3145225 - DNA, 20 bp, Homo sapiens
taaggtttcgtttctgtata

SEQ ID NO: 3145226 - DNA, 19 bp, Homo sapiens
taagtaaacctagtaaaac

SEQ ID NO: 3145227 - DNA, 22 bp, Homo sapiens
taagtaaattagtaatgtacta

SEQ ID NO: 3145228 - DNA, 13 bp, Homo sapiens
taagtaagacttt

SEQ ID NO: 3145229 - DNA, 14 bp, Homo sapiens
taagtaagactttt

SEQ ID NO: 3145230 - DNA, 19 bp, Homo sapiens
taagtaagacttttattaa

SEQ ID NO: 3145231 - DNA, 18 bp, Homo sapiens
taagtaagtttcttcctg

SEQ ID NO: 3145232 - DNA, 14 bp, Homo sapiens
taagtaatcaataa

SEQ ID NO: 3145233 - DNA, 15 bp, Homo sapiens
taagtaatgtggaag

SEQ ID NO: 3145234 - DNA, 17 bp, Homo sapiens
taagtaccactcaggcc

SEQ ID NO: 3145235 - DNA, 15 bp, Homo sapiens
taagtactagatgca

SEQ ID NO: 3145236 - DNA, 17 bp, Homo sapiens
taagtactgtaataata

SEQ ID NO: 3145237 - DNA, 22 bp, Homo sapiens
taagtacttccacttgtgtata

SEQ ID NO: 3145238 - DNA, 20 bp, Homo sapiens
taagtagggctaagccagtt

SEQ ID NO: 3145239 - DNA, 17 bp, Homo sapiens
taagtagttggtttgta

SEQ ID NO: 3145240 - DNA, 21 bp, Homo sapiens
taagtataaacaaaagttttt

SEQ ID NO: 3145241 - DNA, 19 bp, Homo sapiens
taagtatcaggggaaaaaa

SEQ ID NO: 3145242 - DNA, 20 bp, Homo sapiens
taagtatgtgtaaaatgtga

SEQ ID NO: 3145243 - DNA, 14 bp, Homo sapiens
taagtatgttattt

SEQ ID NO: 3145244 - DNA, 19 bp, Homo sapiens
taagtattcttatttaatg

SEQ ID NO: 3145245 - DNA, 21 bp, Homo sapiens
taagtattcttatttaatgaa

SEQ ID NO: 3145246 - DNA, 16 bp, Homo sapiens
taagtatttaaatgtt

SEQ ID NO: 3145247 - DNA, 17 bp, Homo sapiens
taagtatttgaaactga

SEQ ID NO: 3145248 - DNA, 23 bp, Homo sapiens
taagtcaaaaggaacaaaaatta

SEQ ID NO: 3145249 - DNA, 20 bp, Homo sapiens
taagtcatctacttaataaa

SEQ ID NO: 3145250 - DNA, 20 bp, Homo sapiens
taagtcattttcatgtgtgt

SEQ ID NO: 3145251 - DNA, 15 bp, Homo sapiens
taagtcctttatgtg

SEQ ID NO: 3145252 - DNA, 18 bp, Homo sapiens
taagtctaaatatttcct

SEQ ID NO: 3145253 - DNA, 17 bp, Homo sapiens
taagtgaagtaaaactt

SEQ ID NO: 3145254 - DNA, 15 bp, Homo sapiens
taagtgacatttgta

SEQ ID NO: 3145255 - DNA, 24 bp, Homo sapiens
taagtgagagagacaagaagcaaa

SEQ ID NO: 3145256 - DNA, 15 bp, Homo sapiens
taagtgcacacagaa

SEQ ID NO: 3145257 - DNA, 17 bp, Homo sapiens
taagtgcacacagaaat

SEQ ID NO: 3145258 - DNA, 22 bp, Homo sapiens
taagtgcacacagaaatatata

SEQ ID NO: 3145259 - DNA, 23 bp, Homo sapiens
taagtgcacttttttatgaagaa

SEQ ID NO: 3145260 - DNA, 16 bp, Homo sapiens
taagtgcccaaagtgg

SEQ ID NO: 3145261 - DNA, 15 bp, Homo sapiens
taagtgctttgtaat

SEQ ID NO: 3145262 - DNA, 12 bp, Homo sapiens
taagtggaaaaa

SEQ ID NO: 3145263 - DNA, 22 bp, Homo sapiens
taagtggaaaaaagagaaaaac

SEQ ID NO: 3145264 - DNA, 19 bp, Homo sapiens
taagtgtgagtaagagctg

SEQ ID NO: 3145265 - DNA, 21 bp, Homo sapiens
taagtgtgagtaagagctggt

SEQ ID NO: 3145266 - DNA, 22 bp, Homo sapiens
taagtgtgcagccatagtttgg

SEQ ID NO: 3145267 - DNA, 24 bp, Homo sapiens
taagtgtgtcttcctagaattcga

SEQ ID NO: 3145268 - DNA, 22 bp, Homo sapiens
taagtgttcgtctttagttttg

SEQ ID NO: 3145269 - DNA, 17 bp, Homo sapiens
taagttacaattacatc

SEQ ID NO: 3145270 - DNA, 19 bp, Homo sapiens
taagttagagaatatattt

SEQ ID NO: 3145271 - DNA, 15 bp, Homo sapiens
taagttatcaacttt

SEQ ID NO: 3145272 - DNA, 23 bp, Homo sapiens
taagttattttatgacatgaaaa

SEQ ID NO: 3145273 - DNA, 18 bp, Homo sapiens
taagttatttttgtacat

SEQ ID NO: 3145274 - DNA, 19 bp, Homo sapiens
taagttatttttgtacatg

SEQ ID NO: 3145275 - DNA, 20 bp, Homo sapiens
taagttcaaattcttctgaa

SEQ ID NO: 3145276 - DNA, 13 bp, Homo sapiens
taagttcacatta

SEQ ID NO: 3145277 - DNA, 22 bp, Homo sapiens
taagttcatattccatatttat

SEQ ID NO: 3145278 - DNA, 16 bp, Homo sapiens
taagttcatgtttgta

SEQ ID NO: 3145279 - DNA, 17 bp, Homo sapiens
taagttcatgtttgtaa

SEQ ID NO: 3145280 - DNA, 18 bp, Homo sapiens
taagttcatgtttgtaaa

SEQ ID NO: 3145281 - DNA, 17 bp, Homo sapiens
taagttcgaacatgttt

SEQ ID NO: 3145282 - DNA, 18 bp, Homo sapiens
taagttcgaacatgtttc

SEQ ID NO: 3145283 - DNA, 19 bp, Homo sapiens
taagttcgaacatgtttca

SEQ ID NO: 3145284 - DNA, 18 bp, Homo sapiens
taagttctaagttcatgt

SEQ ID NO: 3145285 - DNA, 16 bp, Homo sapiens
taagttggcttctgtt

SEQ ID NO: 3145286 - DNA, 12 bp, Homo sapiens
taagttgtacaa

SEQ ID NO: 3145287 - DNA, 13 bp, Homo sapiens
taagttgtacaaa

SEQ ID NO: 3145288 - DNA, 17 bp, Homo sapiens
taagttgtacaaatgta

SEQ ID NO: 3145289 - DNA, 17 bp, Homo sapiens
taagtttatccaaatct

SEQ ID NO: 3145290 - DNA, 18 bp, Homo sapiens
taagtttatccaaatctt

SEQ ID NO: 3145291 - DNA, 20 bp, Homo sapiens
taagtttcaaacttactatt

SEQ ID NO: 3145292 - DNA, 18 bp, Homo sapiens
taagtttcaggtgacatg

SEQ ID NO: 3145293 - DNA, 19 bp, Homo sapiens
taagtttcaggtgacatgt

SEQ ID NO: 3145294 - DNA, 17 bp, Homo sapiens
taagtttctaagattct

SEQ ID NO: 3145295 - DNA, 12 bp, Homo sapiens
taagtttgatca

SEQ ID NO: 3145296 - DNA, 16 bp, Homo sapiens
taagtttgatcaaatc

SEQ ID NO: 3145297 - DNA, 21 bp, Homo sapiens
taagttttgattaatgtttct

SEQ ID NO: 3145298 - DNA, 14 bp, Homo sapiens
taataaaaaatgga

SEQ ID NO: 3145299 - DNA, 20 bp, Homo sapiens
taataaaaaatggaaagaat

SEQ ID NO: 3145300 - DNA, 21 bp, Homo sapiens
taataaaaaatggaaagaatc

SEQ ID NO: 3145301 - DNA, 13 bp, Homo sapiens
taataaaaagatt

SEQ ID NO: 3145302 - DNA, 19 bp, Homo sapiens
taataaaaagctttttcct

SEQ ID NO: 3145303 - DNA, 19 bp, Homo sapiens
taataaaacaatactcaaa

SEQ ID NO: 3145304 - DNA, 19 bp, Homo sapiens
taataaaactttatgtact

SEQ ID NO: 3145305 - DNA, 18 bp, Homo sapiens
taataaaatgtgttgaaa

SEQ ID NO: 3145306 - DNA, 15 bp, Homo sapiens
taataaactgtatta

SEQ ID NO: 3145307 - DNA, 20 bp, Homo sapiens
taataaactgtattaaatct

SEQ ID NO: 3145308 - DNA, 14 bp, Homo sapiens
taataaactgtgtt

SEQ ID NO: 3145309 - DNA, 14 bp, Homo sapiens
taataaagatgagt

SEQ ID NO: 3145310 - DNA, 10 bp, Homo sapiens
taataaagca

SEQ ID NO: 3145311 - DNA, 11 bp, Homo sapiens
taataaagcat

SEQ ID NO: 3145312 - DNA, 10 bp, Homo sapiens
taataaagtg

SEQ ID NO: 3145313 - DNA, 16 bp, Homo sapiens
taataaagtgttttca

SEQ ID NO: 3145314 - DNA, 20 bp, Homo sapiens
taataaagtgttttcagagc

SEQ ID NO: 3145315 - DNA, 15 bp, Homo sapiens
taataaatatactat

SEQ ID NO: 3145316 - DNA, 19 bp, Homo sapiens
taataaatatttttgccat

SEQ ID NO: 3145317 - DNA, 19 bp, Homo sapiens
taataaatgtacattaatt

SEQ ID NO: 3145318 - DNA, 14 bp, Homo sapiens
taataaattcaaaa

SEQ ID NO: 3145319 - DNA, 17 bp, Homo sapiens
taataaattgaaattgt

SEQ ID NO: 3145320 - DNA, 12 bp, Homo sapiens
taataaattgct

SEQ ID NO: 3145321 - DNA, 13 bp, Homo sapiens
taataaattgctt

SEQ ID NO: 3145322 - DNA, 21 bp, Homo sapiens
taataaattgtttggcttcct

SEQ ID NO: 3145323 - DNA, 16 bp, Homo sapiens
taataaatttactcac

SEQ ID NO: 3145324 - DNA, 13 bp, Homo sapiens
taataacaatata

SEQ ID NO: 3145325 - DNA, 17 bp, Homo sapiens
taataacagtgcatatt

SEQ ID NO: 3145326 - DNA, 21 bp, Homo sapiens
taataacattaccttactgtg

SEQ ID NO: 3145327 - DNA, 18 bp, Homo sapiens
taataacgtgaaacttat

SEQ ID NO: 3145328 - DNA, 20 bp, Homo sapiens
taataagacataacgttttt

SEQ ID NO: 3145329 - DNA, 22 bp, Homo sapiens
taataagacataacgtttttcc

SEQ ID NO: 3145330 - DNA, 15 bp, Homo sapiens
taataagtttgatca

SEQ ID NO: 3145331 - DNA, 21 bp, Homo sapiens
taataagtttgatcaaatcta

SEQ ID NO: 3145332 - DNA, 14 bp, Homo sapiens
taataatattgttt

SEQ ID NO: 3145333 - DNA, 20 bp, Homo sapiens
taataatcttattagggaga

SEQ ID NO: 3145334 - DNA, 23 bp, Homo sapiens
taataatcttattagggagaaaa

SEQ ID NO: 3145335 - DNA, 20 bp, Homo sapiens
taataatgtattgtaatctt

SEQ ID NO: 3145336 - DNA, 15 bp, Homo sapiens
taataatgtttaata

SEQ ID NO: 3145337 - DNA, 13 bp, Homo sapiens
taataatttctaa

SEQ ID NO: 3145338 - DNA, 16 bp, Homo sapiens
taataatttgcactta

SEQ ID NO: 3145339 - DNA, 22 bp, Homo sapiens
taatacactaattcctttctat

SEQ ID NO: 3145340 - DNA, 18 bp, Homo sapiens
taatacagcaacaattta

SEQ ID NO: 3145341 - DNA, 22 bp, Homo sapiens
taatacagcaacaatttatgaa

SEQ ID NO: 3145342 - DNA, 14 bp, Homo sapiens
taatacctctgtgt

SEQ ID NO: 3145343 - DNA, 14 bp, Homo sapiens
taatactaccttga

SEQ ID NO: 3145344 - DNA, 15 bp, Homo sapiens
taatactaccttgaa

SEQ ID NO: 3145345 - DNA, 20 bp, Homo sapiens
taatactcaaatgagtaaca

SEQ ID NO: 3145346 - DNA, 17 bp, Homo sapiens
taatacttcatttggtg

SEQ ID NO: 3145347 - DNA, 18 bp, Homo sapiens
taatagaaaactgaaaat

SEQ ID NO: 3145348 - DNA, 19 bp, Homo sapiens
taatagaaaactgaaaatc

SEQ ID NO: 3145349 - DNA, 22 bp, Homo sapiens
taatagaataaaggcagttttc

SEQ ID NO: 3145350 - DNA, 21 bp, Homo sapiens
taatagagcaaaattgatgtg

SEQ ID NO: 3145351 - DNA, 22 bp, Homo sapiens
taatagcgggttactttcacat

SEQ ID NO: 3145352 - DNA, 14 bp, Homo sapiens
taatagtgcttttt

SEQ ID NO: 3145353 - DNA, 23 bp, Homo sapiens
taatagttcagtagaattaccat

SEQ ID NO: 3145354 - DNA, 13 bp, Homo sapiens
taatagtttgtct

SEQ ID NO: 3145355 - DNA, 17 bp, Homo sapiens
taatagtttgtctattt

SEQ ID NO: 3145356 - DNA, 11 bp, Homo sapiens
taatataaaag

SEQ ID NO: 3145357 - DNA, 14 bp, Homo sapiens
taatataaaagata

SEQ ID NO: 3145358 - DNA, 19 bp, Homo sapiens
taatataatggaagagaaa

SEQ ID NO: 3145359 - DNA, 18 bp, Homo sapiens
taatatatatgaataaag

SEQ ID NO: 3145360 - DNA, 12 bp, Homo sapiens
taatatattaaa

SEQ ID NO: 3145361 - DNA, 15 bp, Homo sapiens
taatatattaaaatt

SEQ ID NO: 3145362 - DNA, 21 bp, Homo sapiens
taatatattaaaattccaaat

SEQ ID NO: 3145363 - DNA, 16 bp, Homo sapiens
taatatattgtacaaa

SEQ ID NO: 3145364 - DNA, 12 bp, Homo sapiens
taatatcttgct

SEQ ID NO: 3145365 - DNA, 22 bp, Homo sapiens
taatatcttgctggattaatgt

SEQ ID NO: 3145366 - DNA, 14 bp, Homo sapiens
taatatgaaaactt

SEQ ID NO: 3145367 - DNA, 16 bp, Homo sapiens
taatatgaaaacttat

SEQ ID NO: 3145368 - DNA, 23 bp, Homo sapiens
taatatgattttttaaaagaaat

SEQ ID NO: 3145369 - DNA, 20 bp, Homo sapiens
taatatgcttataacctagt

SEQ ID NO: 3145370 - DNA, 19 bp, Homo sapiens
taatatgggcattgtagtt

SEQ ID NO: 3145371 - DNA, 20 bp, Homo sapiens
taatatgggcattgtagtta

SEQ ID NO: 3145372 - DNA, 23 bp, Homo sapiens
taatatgttaacctcagtgtcat

SEQ ID NO: 3145373 - DNA, 23 bp, Homo sapiens
taatattaccgtggtttatgaac

SEQ ID NO: 3145374 - DNA, 22 bp, Homo sapiens
taatattactgtttatttctgt

SEQ ID NO: 3145375 - DNA, 11 bp, Homo sapiens
taatattatta

SEQ ID NO: 3145376 - DNA, 21 bp, Homo sapiens
taatattcagggtaaatagga

SEQ ID NO: 3145377 - DNA, 21 bp, Homo sapiens
taatattgaaaattgaaaagt

SEQ ID NO: 3145378 - DNA, 21 bp, Homo sapiens
taatattgatatgcttataca

SEQ ID NO: 3145379 - DNA, 16 bp, Homo sapiens
taatattgatgtcagt

SEQ ID NO: 3145380 - DNA, 19 bp, Homo sapiens
taatattgttgtataattt

SEQ ID NO: 3145381 - DNA, 13 bp, Homo sapiens
taatatttaacat

SEQ ID NO: 3145382 - DNA, 16 bp, Homo sapiens
taatatttatatattt

SEQ ID NO: 3145383 - DNA, 21 bp, Homo sapiens
taatatttatgtctatttaag

SEQ ID NO: 3145384 - DNA, 17 bp, Homo sapiens
taatatttcaagtgcct

SEQ ID NO: 3145385 - DNA, 18 bp, Homo sapiens
taatatttcaagtgccta

SEQ ID NO: 3145386 - DNA, 14 bp, Homo sapiens
taatattttgttct

SEQ ID NO: 3145387 - DNA, 23 bp, Homo sapiens
taatatttttagctctgttcttt

SEQ ID NO: 3145388 - DNA, 15 bp, Homo sapiens
taatcaaatgatttc

SEQ ID NO: 3145389 - DNA, 16 bp, Homo sapiens
taatcaaatgatttca

SEQ ID NO: 3145390 - DNA, 17 bp, Homo sapiens
taatcaaatgatttcat

SEQ ID NO: 3145391 - DNA, 18 bp, Homo sapiens
taatcaaatgatttcata

SEQ ID NO: 3145392 - DNA, 21 bp, Homo sapiens
taatcaaatgatttcatattg

SEQ ID NO: 3145393 - DNA, 13 bp, Homo sapiens
taatcaagatttt

SEQ ID NO: 3145394 - DNA, 21 bp, Homo sapiens
taatcaccctaccaactttac

SEQ ID NO: 3145395 - DNA, 13 bp, Homo sapiens
taatcagaaattt

SEQ ID NO: 3145396 - DNA, 15 bp, Homo sapiens
taatcagaaattttt

SEQ ID NO: 3145397 - DNA, 18 bp, Homo sapiens
taatcagaaatttttatc

SEQ ID NO: 3145398 - DNA, 20 bp, Homo sapiens
taatcagaaatttttatcag

SEQ ID NO: 3145399 - DNA, 15 bp, Homo sapiens
taatcagaatatcag

SEQ ID NO: 3145400 - DNA, 14 bp, Homo sapiens
taatcagcctctta

SEQ ID NO: 3145401 - DNA, 15 bp, Homo sapiens
taatcagcctcttaa

SEQ ID NO: 3145402 - DNA, 17 bp, Homo sapiens
taatcagctctcctggc

SEQ ID NO: 3145403 - DNA, 19 bp, Homo sapiens
taatcagctctcctggctc

SEQ ID NO: 3145404 - DNA, 22 bp, Homo sapiens
taatcaggtcctcagagaattt

SEQ ID NO: 3145405 - DNA, 23 bp, Homo sapiens
taatcagtgactgaaaccatttt

SEQ ID NO: 3145406 - DNA, 16 bp, Homo sapiens
taatcagtgtctcaca

SEQ ID NO: 3145407 - DNA, 17 bp, Homo sapiens
taatcagtgtctcacac

SEQ ID NO: 3145408 - DNA, 17 bp, Homo sapiens
taatcagtgtgtctaaa

SEQ ID NO: 3145409 - DNA, 20 bp, Homo sapiens
taatcagttttgtataactt

SEQ ID NO: 3145410 - DNA, 20 bp, Homo sapiens
taatcatatgtgtctttata

SEQ ID NO: 3145411 - DNA, 17 bp, Homo sapiens
taatcatatttgaaaac

SEQ ID NO: 3145412 - DNA, 22 bp, Homo sapiens
taatcatatttgaaaaccatat

SEQ ID NO: 3145413 - DNA, 19 bp, Homo sapiens
taatcatctgcagttcttt

SEQ ID NO: 3145414 - DNA, 15 bp, Homo sapiens
taatcatgaaccaat

SEQ ID NO: 3145415 - DNA, 19 bp, Homo sapiens
taatcatttgatttaaaca

SEQ ID NO: 3145416 - DNA, 20 bp, Homo sapiens
taatcatttgatttaaacaa

SEQ ID NO: 3145417 - DNA, 14 bp, Homo sapiens
taatcatttgttta

SEQ ID NO: 3145418 - DNA, 13 bp, Homo sapiens
taatcattttcat

SEQ ID NO: 3145419 - DNA, 19 bp, Homo sapiens
taatcccagcactttggga

SEQ ID NO: 3145420 - DNA, 14 bp, Homo sapiens
taatccctgggcat

SEQ ID NO: 3145421 - DNA, 19 bp, Homo sapiens
taatccctgggcattgctt

SEQ ID NO: 3145422 - DNA, 21 bp, Homo sapiens
taatcctatctggggagctcc

SEQ ID NO: 3145423 - DNA, 16 bp, Homo sapiens
taatccttgataatat

SEQ ID NO: 3145424 - DNA, 17 bp, Homo sapiens
taatcctttctgccgac

SEQ ID NO: 3145425 - DNA, 16 bp, Homo sapiens
taatcctttgttttct

SEQ ID NO: 3145426 - DNA, 18 bp, Homo sapiens
taatcctttgttttctga

SEQ ID NO: 3145427 - DNA, 22 bp, Homo sapiens
taatcctttgttttctgactaa

SEQ ID NO: 3145428 - DNA, 21 bp, Homo sapiens
taatctaaatttaattacctt

SEQ ID NO: 3145429 - DNA, 22 bp, Homo sapiens
taatctactccttgtaaagact

SEQ ID NO: 3145430 - DNA, 14 bp, Homo sapiens
taatctagaacaca

SEQ ID NO: 3145431 - DNA, 17 bp, Homo sapiens
taatctagatatcgact

SEQ ID NO: 3145432 - DNA, 18 bp, Homo sapiens
taatctattgggttcatt

SEQ ID NO: 3145433 - DNA, 15 bp, Homo sapiens
taatctcaaaggaga

SEQ ID NO: 3145434 - DNA, 13 bp, Homo sapiens
taatctccacagt

SEQ ID NO: 3145435 - DNA, 18 bp, Homo sapiens
taatctcctcttttatct

SEQ ID NO: 3145436 - DNA, 12 bp, Homo sapiens
taatctctgtta

SEQ ID NO: 3145437 - DNA, 16 bp, Homo sapiens
taatctctgttatgta

SEQ ID NO: 3145438 - DNA, 15 bp, Homo sapiens
taatctcttattcta

SEQ ID NO: 3145439 - DNA, 15 bp, Homo sapiens
taatctgaaattcta

SEQ ID NO: 3145440 - DNA, 13 bp, Homo sapiens
taatctgaagata

SEQ ID NO: 3145441 - DNA, 20 bp, Homo sapiens
taatctgaagatatatttca

SEQ ID NO: 3145442 - DNA, 19 bp, Homo sapiens
taatctggaaggcccctcc

SEQ ID NO: 3145443 - DNA, 17 bp, Homo sapiens
taatctggactcctctg

SEQ ID NO: 3145444 - DNA, 21 bp, Homo sapiens
taatctggactcctctgtcca

SEQ ID NO: 3145445 - DNA, 16 bp, Homo sapiens
taatctgtagggctgg

SEQ ID NO: 3145446 - DNA, 20 bp, Homo sapiens
taatctgtagggctggacct

SEQ ID NO: 3145447 - DNA, 16 bp, Homo sapiens
taatctgtcaaaacac

SEQ ID NO: 3145448 - DNA, 20 bp, Homo sapiens
taatcttagagacaaacctt

SEQ ID NO: 3145449 - DNA, 13 bp, Homo sapiens
taatcttattagg

SEQ ID NO: 3145450 - DNA, 14 bp, Homo sapiens
taatcttcaggtga

SEQ ID NO: 3145451 - DNA, 19 bp, Homo sapiens
taatcttcaggtgaacact

SEQ ID NO: 3145452 - DNA, 20 bp, Homo sapiens
taatcttcagttttatcttt

SEQ ID NO: 3145453 - DNA, 16 bp, Homo sapiens
taatcttgtagacact

SEQ ID NO: 3145454 - DNA, 14 bp, Homo sapiens
taatctttatactg

SEQ ID NO: 3145455 - DNA, 22 bp, Homo sapiens
taatctttatactgggtttcaa

SEQ ID NO: 3145456 - DNA, 17 bp, Homo sapiens
taatctttcacttgaaa

SEQ ID NO: 3145457 - DNA, 18 bp, Homo sapiens
taatctttctttacctga

SEQ ID NO: 3145458 - DNA, 23 bp, Homo sapiens
taatctttctttacctgagacca

SEQ ID NO: 3145459 - DNA, 18 bp, Homo sapiens
taatgaaaatgaatatct

SEQ ID NO: 3145460 - DNA, 13 bp, Homo sapiens
taatgaaaatgtc

SEQ ID NO: 3145461 - DNA, 15 bp, Homo sapiens
taatgaaaatgtcag

SEQ ID NO: 3145462 - DNA, 14 bp, Homo sapiens
taatgaaagactgt

SEQ ID NO: 3145463 - DNA, 22 bp, Homo sapiens
taatgaaagactgtacaaagta

SEQ ID NO: 3145464 - DNA, 21 bp, Homo sapiens
taatgaactaccatctgatgt

SEQ ID NO: 3145465 - DNA, 19 bp, Homo sapiens
taatgaattataacagtta

SEQ ID NO: 3145466 - DNA, 13 bp, Homo sapiens
taatgacaacact

SEQ ID NO: 3145467 - DNA, 22 bp, Homo sapiens
taatgacaacacttaatagcaa

SEQ ID NO: 3145468 - DNA, 22 bp, Homo sapiens
taatgaccaattgagtaagaac

SEQ ID NO: 3145469 - DNA, 14 bp, Homo sapiens
taatgagtatttgg

SEQ ID NO: 3145470 - DNA, 23 bp, Homo sapiens
taatgatactgattatgaaatgt

SEQ ID NO: 3145471 - DNA, 20 bp, Homo sapiens
taatgatcgaaaaaataatt

SEQ ID NO: 3145472 - DNA, 15 bp, Homo sapiens
taatgatggcagagg

SEQ ID NO: 3145473 - DNA, 10 bp, Homo sapiens
taatgcactg

SEQ ID NO: 3145474 - DNA, 17 bp, Homo sapiens
taatgcagttgcttact

SEQ ID NO: 3145475 - DNA, 22 bp, Homo sapiens
taatgcatctagattatggagc

SEQ ID NO: 3145476 - DNA, 18 bp, Homo sapiens
taatgcattaaacctgtc

SEQ ID NO: 3145477 - DNA, 18 bp, Homo sapiens
taatgcattcttctctgt

SEQ ID NO: 3145478 - DNA, 15 bp, Homo sapiens
taatgccttactctt

SEQ ID NO: 3145479 - DNA, 17 bp, Homo sapiens
taatgctatttgaacaa

SEQ ID NO: 3145480 - DNA, 15 bp, Homo sapiens
taatgctctatgttt

SEQ ID NO: 3145481 - DNA, 16 bp, Homo sapiens
taatgcttaatttcta

SEQ ID NO: 3145482 - DNA, 14 bp, Homo sapiens
taatgctttggaaa

SEQ ID NO: 3145483 - DNA, 17 bp, Homo sapiens
taatggaaaaaaagact

SEQ ID NO: 3145484 - DNA, 12 bp, Homo sapiens
taatggaaacat

SEQ ID NO: 3145485 - DNA, 19 bp, Homo sapiens
taatggaactgaccccctc

SEQ ID NO: 3145486 - DNA, 14 bp, Homo sapiens
taatggaagagaaa

SEQ ID NO: 3145487 - DNA, 15 bp, Homo sapiens
taatggatatttctc

SEQ ID NO: 3145488 - DNA, 16 bp, Homo sapiens
taatggcatgtcagac

SEQ ID NO: 3145489 - DNA, 19 bp, Homo sapiens
taatggccatggtaccccc

SEQ ID NO: 3145490 - DNA, 17 bp, Homo sapiens
taatggctagtactgta

SEQ ID NO: 3145491 - DNA, 15 bp, Homo sapiens
taatgggattttctt

SEQ ID NO: 3145492 - DNA, 14 bp, Homo sapiens
taatgggcctgccc

SEQ ID NO: 3145493 - DNA, 16 bp, Homo sapiens
taatggggattaatta

SEQ ID NO: 3145494 - DNA, 15 bp, Homo sapiens
taatgggggtagcag

SEQ ID NO: 3145495 - DNA, 18 bp, Homo sapiens
taatgggggtagcagctg

SEQ ID NO: 3145496 - DNA, 18 bp, Homo sapiens
taatggtgaacattttaa

SEQ ID NO: 3145497 - DNA, 14 bp, Homo sapiens
taatggtgttttaa

SEQ ID NO: 3145498 - DNA, 14 bp, Homo sapiens
taatggtttttatt

SEQ ID NO: 3145499 - DNA, 23 bp, Homo sapiens
taatgtaaactttgtcatggttt

SEQ ID NO: 3145500 - DNA, 16 bp, Homo sapiens
taatgtaagctctact

SEQ ID NO: 3145501 - DNA, 15 bp, Homo sapiens
taatgtacaagtttt

SEQ ID NO: 3145502 - DNA, 18 bp, Homo sapiens
taatgtacaagttttgta

SEQ ID NO: 3145503 - DNA, 22 bp, Homo sapiens
taatgtagcgtgtttacatgtg

SEQ ID NO: 3145504 - DNA, 13 bp, Homo sapiens
taatgtagctatt

SEQ ID NO: 3145505 - DNA, 16 bp, Homo sapiens
taatgtagctattttt

SEQ ID NO: 3145506 - DNA, 13 bp, Homo sapiens
taatgtatataaa

SEQ ID NO: 3145507 - DNA, 22 bp, Homo sapiens
taatgtatggctcatttgcttt

SEQ ID NO: 3145508 - DNA, 16 bp, Homo sapiens
taatgtatgttaccaa

SEQ ID NO: 3145509 - DNA, 17 bp, Homo sapiens
taatgtatgttaccaaa

SEQ ID NO: 3145510 - DNA, 13 bp, Homo sapiens
taatgtattttca

SEQ ID NO: 3145511 - DNA, 16 bp, Homo sapiens
taatgtattttcagct

SEQ ID NO: 3145512 - DNA, 21 bp, Homo sapiens
taatgtattttcagctcaatt

SEQ ID NO: 3145513 - DNA, 15 bp, Homo sapiens
taatgtcacaggcag

SEQ ID NO: 3145514 - DNA, 18 bp, Homo sapiens
taatgtctcactgttctg

SEQ ID NO: 3145515 - DNA, 17 bp, Homo sapiens
taatgtctcctttgctc

SEQ ID NO: 3145516 - DNA, 14 bp, Homo sapiens
taatgtcttcataa

SEQ ID NO: 3145517 - DNA, 13 bp, Homo sapiens
taatgtcttcatt

SEQ ID NO: 3145518 - DNA, 17 bp, Homo sapiens
taatgtcttcatttcat

SEQ ID NO: 3145519 - DNA, 21 bp, Homo sapiens
taatgtcttcatttcattgta

SEQ ID NO: 3145520 - DNA, 12 bp, Homo sapiens
taatgtgaactt

SEQ ID NO: 3145521 - DNA, 22 bp, Homo sapiens
taatgtgaacttgtagctgtaa

SEQ ID NO: 3145522 - DNA, 19 bp, Homo sapiens
taatgtgatgatgtaattg

SEQ ID NO: 3145523 - DNA, 21 bp, Homo sapiens
taatgtgatggatggcacaat

SEQ ID NO: 3145524 - DNA, 19 bp, Homo sapiens
taatgtggaagaaaatggt

SEQ ID NO: 3145525 - DNA, 19 bp, Homo sapiens
taatgtgtggtggcctcag

SEQ ID NO: 3145526 - DNA, 12 bp, Homo sapiens
taatgtgtgtat

SEQ ID NO: 3145527 - DNA, 14 bp, Homo sapiens
taatgtgtgtatgt

SEQ ID NO: 3145528 - DNA, 16 bp, Homo sapiens
taatgtgtgtatgtgt

SEQ ID NO: 3145529 - DNA, 13 bp, Homo sapiens
taatgttaaattt

SEQ ID NO: 3145530 - DNA, 13 bp, Homo sapiens
taatgttactgat

SEQ ID NO: 3145531 - DNA, 14 bp, Homo sapiens
taatgttactgatc

SEQ ID NO: 3145532 - DNA, 15 bp, Homo sapiens
taatgttactgatca

SEQ ID NO: 3145533 - DNA, 18 bp, Homo sapiens
taatgttatatcatatgt

SEQ ID NO: 3145534 - DNA, 20 bp, Homo sapiens
taatgttctgaataatttct

SEQ ID NO: 3145535 - DNA, 22 bp, Homo sapiens
taatgttctgaataatttctta

SEQ ID NO: 3145536 - DNA, 14 bp, Homo sapiens
taatgtttaaatca

SEQ ID NO: 3145537 - DNA, 15 bp, Homo sapiens
taatgtttatgagcc

SEQ ID NO: 3145538 - DNA, 18 bp, Homo sapiens
taatgtttatgagccaga

SEQ ID NO: 3145539 - DNA, 22 bp, Homo sapiens
taatgtttatgagccagacaaa

SEQ ID NO: 3145540 - DNA, 16 bp, Homo sapiens
taatgtttattaaatg

SEQ ID NO: 3145541 - DNA, 22 bp, Homo sapiens
taatgtttattaaatgcttcat

SEQ ID NO: 3145542 - DNA, 21 bp, Homo sapiens
taatgttttcattatgttcat

SEQ ID NO: 3145543 - DNA, 12 bp, Homo sapiens
taatgttttgta

SEQ ID NO: 3145544 - DNA, 14 bp, Homo sapiens
taatgttttgtata

SEQ ID NO: 3145545 - DNA, 15 bp, Homo sapiens
taatgttttgtatat

SEQ ID NO: 3145546 - DNA, 16 bp, Homo sapiens
taatgttttgtatata

SEQ ID NO: 3145547 - DNA, 18 bp, Homo sapiens
taatgttttgtatataca

SEQ ID NO: 3145548 - DNA, 21 bp, Homo sapiens
taatgttttgtatatacagtt

SEQ ID NO: 3145549 - DNA, 22 bp, Homo sapiens
taatgttttttgccacagcttt

SEQ ID NO: 3145550 - DNA, 19 bp, Homo sapiens
taattaaagcccacaatcc

SEQ ID NO: 3145551 - DNA, 23 bp, Homo sapiens
taattaaattttgagttctacat

SEQ ID NO: 3145552 - DNA, 12 bp, Homo sapiens
taattaagtaaa

SEQ ID NO: 3145553 - DNA, 15 bp, Homo sapiens
taattaattaaagcc

SEQ ID NO: 3145554 - DNA, 21 bp, Homo sapiens
taattaatttgattaacaaat

SEQ ID NO: 3145555 - DNA, 15 bp, Homo sapiens
taattaatttggagc

SEQ ID NO: 3145556 - DNA, 20 bp, Homo sapiens
taattaatttggagcacaaa

SEQ ID NO: 3145557 - DNA, 14 bp, Homo sapiens
taattacattccta

SEQ ID NO: 3145558 - DNA, 16 bp, Homo sapiens
taattacattcctaac

SEQ ID NO: 3145559 - DNA, 21 bp, Homo sapiens
taattacattcctaactagaa

SEQ ID NO: 3145560 - DNA, 22 bp, Homo sapiens
taattacattcctaactagaat

SEQ ID NO: 3145561 - DNA, 17 bp, Homo sapiens
taattaccaacctgtta

SEQ ID NO: 3145562 - DNA, 17 bp, Homo sapiens
taattactgttttcttt

SEQ ID NO: 3145563 - DNA, 22 bp, Homo sapiens
taattacttattgtatttatgt

SEQ ID NO: 3145564 - DNA, 15 bp, Homo sapiens
taattagctctgggg

SEQ ID NO: 3145565 - DNA, 21 bp, Homo sapiens
taattaggcaaggctatgtga

SEQ ID NO: 3145566 - DNA, 22 bp, Homo sapiens
taattaggcaaggctatgtgat

SEQ ID NO: 3145567 - DNA, 18 bp, Homo sapiens
taattaggggttgctaag

SEQ ID NO: 3145568 - DNA, 18 bp, Homo sapiens
taattagggtacatttat

SEQ ID NO: 3145569 - DNA, 21 bp, Homo sapiens
taattatcggaagcagtgcct

SEQ ID NO: 3145570 - DNA, 22 bp, Homo sapiens
taattatctcctaattgtatgt

SEQ ID NO: 3145571 - DNA, 18 bp, Homo sapiens
taattattataaaaatat

SEQ ID NO: 3145572 - DNA, 13 bp, Homo sapiens
taattattattaa

SEQ ID NO: 3145573 - DNA, 12 bp, Homo sapiens
taattattattc

SEQ ID NO: 3145574 - DNA, 14 bp, Homo sapiens
taattattattctt

SEQ ID NO: 3145575 - DNA, 12 bp, Homo sapiens
taattattattt

SEQ ID NO: 3145576 - DNA, 17 bp, Homo sapiens
taattattatttatata

SEQ ID NO: 3145577 - DNA, 14 bp, Homo sapiens
taattattatttgt

SEQ ID NO: 3145578 - DNA, 13 bp, Homo sapiens
taattatttaaat

SEQ ID NO: 3145579 - DNA, 14 bp, Homo sapiens
taattatttaaata

SEQ ID NO: 3145580 - DNA, 15 bp, Homo sapiens
taattatttaaataa

SEQ ID NO: 3145581 - DNA, 18 bp, Homo sapiens
taattatttaaataaaat

SEQ ID NO: 3145582 - DNA, 13 bp, Homo sapiens
taattattttaaa

SEQ ID NO: 3145583 - DNA, 18 bp, Homo sapiens
taattattttaaaatatt

SEQ ID NO: 3145584 - DNA, 19 bp, Homo sapiens
taattattttaaaatattt

SEQ ID NO: 3145585 - DNA, 20 bp, Homo sapiens
taattattttggtactttta

SEQ ID NO: 3145586 - DNA, 18 bp, Homo sapiens
taattcaaggaatttctt

SEQ ID NO: 3145587 - DNA, 17 bp, Homo sapiens
taattcaaggagaatat

SEQ ID NO: 3145588 - DNA, 14 bp, Homo sapiens
taattcacagtgct

SEQ ID NO: 3145589 - DNA, 21 bp, Homo sapiens
taattcacagtgctcttttct

SEQ ID NO: 3145590 - DNA, 16 bp, Homo sapiens
taattcaccaaagtat

SEQ ID NO: 3145591 - DNA, 17 bp, Homo sapiens
taattcacctatgttat

SEQ ID NO: 3145592 - DNA, 16 bp, Homo sapiens
taattcacttcagttt

SEQ ID NO: 3145593 - DNA, 21 bp, Homo sapiens
taattcagcactgatttcaca

SEQ ID NO: 3145594 - DNA, 22 bp, Homo sapiens
taattcagcactgatttcacaa

SEQ ID NO: 3145595 - DNA, 17 bp, Homo sapiens
taattcaggcatatttt

SEQ ID NO: 3145596 - DNA, 22 bp, Homo sapiens
taattcaggggctgacacttca

SEQ ID NO: 3145597 - DNA, 19 bp, Homo sapiens
taattcatcccaactgtct

SEQ ID NO: 3145598 - DNA, 13 bp, Homo sapiens
taattcatttgta

SEQ ID NO: 3145599 - DNA, 18 bp, Homo sapiens
taattcatttgtattgct

SEQ ID NO: 3145600 - DNA, 19 bp, Homo sapiens
taattcccattttgcaaaa

SEQ ID NO: 3145601 - DNA, 13 bp, Homo sapiens
taattcctatgaa

SEQ ID NO: 3145602 - DNA, 15 bp, Homo sapiens
taattcctcttttta

SEQ ID NO: 3145603 - DNA, 11 bp, Homo sapiens
taattctaaag

SEQ ID NO: 3145604 - DNA, 12 bp, Homo sapiens
taattctaagtt

SEQ ID NO: 3145605 - DNA, 23 bp, Homo sapiens
taattctattaaagtgctaaggt

SEQ ID NO: 3145606 - DNA, 13 bp, Homo sapiens
taattctgtaaat

SEQ ID NO: 3145607 - DNA, 19 bp, Homo sapiens
taattcttaagtcttttgt

SEQ ID NO: 3145608 - DNA, 18 bp, Homo sapiens
taattcttcacctttgta

SEQ ID NO: 3145609 - DNA, 15 bp, Homo sapiens
taattctttgttctg

SEQ ID NO: 3145610 - DNA, 18 bp, Homo sapiens
taattgatcaaattcatt

SEQ ID NO: 3145611 - DNA, 14 bp, Homo sapiens
taattgatttcaag

SEQ ID NO: 3145612 - DNA, 21 bp, Homo sapiens
taattgcaaaaacatagaaat

SEQ ID NO: 3145613 - DNA, 11 bp, Homo sapiens
taattgcactc

SEQ ID NO: 3145614 - DNA, 18 bp, Homo sapiens
taattgcatctcaaaatt

SEQ ID NO: 3145615 - DNA, 21 bp, Homo sapiens
taattgcttacatttttacaa

SEQ ID NO: 3145616 - DNA, 14 bp, Homo sapiens
taattgctttgcca

SEQ ID NO: 3145617 - DNA, 17 bp, Homo sapiens
taattggatattgatga

SEQ ID NO: 3145618 - DNA, 16 bp, Homo sapiens
taattggatttcctaa

SEQ ID NO: 3145619 - DNA, 17 bp, Homo sapiens
taattggatttcctaat

SEQ ID NO: 3145620 - DNA, 18 bp, Homo sapiens
taattggtccgatctttg

SEQ ID NO: 3145621 - DNA, 19 bp, Homo sapiens
taattggtgctatttgaag

SEQ ID NO: 3145622 - DNA, 21 bp, Homo sapiens
taattggtgctatttgaagaa

SEQ ID NO: 3145623 - DNA, 12 bp, Homo sapiens
taattgtaaact

SEQ ID NO: 3145624 - DNA, 15 bp, Homo sapiens
taattgtaaactgta

SEQ ID NO: 3145625 - DNA, 18 bp, Homo sapiens
taattgtaaactgtacta

SEQ ID NO: 3145626 - DNA, 24 bp, Homo sapiens
taattgtataagtcaagcacatgt

SEQ ID NO: 3145627 - DNA, 15 bp, Homo sapiens
taattgtcagtgatt

SEQ ID NO: 3145628 - DNA, 19 bp, Homo sapiens
taattgtgtaaaaaatgga

SEQ ID NO: 3145629 - DNA, 21 bp, Homo sapiens
taattgtgtaaaaaatggaaa

SEQ ID NO: 3145630 - DNA, 22 bp, Homo sapiens
taattgtgtaaaaaatggaaaa

SEQ ID NO: 3145631 - DNA, 12 bp, Homo sapiens
taattgttgaaa

SEQ ID NO: 3145632 - DNA, 20 bp, Homo sapiens
taattgttgtggtttaaata

SEQ ID NO: 3145633 - DNA, 22 bp, Homo sapiens
taattgttgtttctttctagtg

SEQ ID NO: 3145634 - DNA, 12 bp, Homo sapiens
taattgtttcca

SEQ ID NO: 3145635 - DNA, 19 bp, Homo sapiens
taattgttttttaaagcaa

SEQ ID NO: 3145636 - DNA, 21 bp, Homo sapiens
taattgttttttaaagcaagt

SEQ ID NO: 3145637 - DNA, 15 bp, Homo sapiens
taatttaaaaaataa

SEQ ID NO: 3145638 - DNA, 17 bp, Homo sapiens
taatttaaacacctcct

SEQ ID NO: 3145639 - DNA, 14 bp, Homo sapiens
taatttaaacaggc

SEQ ID NO: 3145640 - DNA, 12 bp, Homo sapiens
taatttaacacc

SEQ ID NO: 3145641 - DNA, 19 bp, Homo sapiens
taatttaacaccctttaga

SEQ ID NO: 3145642 - DNA, 19 bp, Homo sapiens
taatttaactttctgggtt

SEQ ID NO: 3145643 - DNA, 14 bp, Homo sapiens
taatttaatgaaaa

SEQ ID NO: 3145644 - DNA, 13 bp, Homo sapiens
taatttagaaact

SEQ ID NO: 3145645 - DNA, 19 bp, Homo sapiens
taatttagaaactgatttc

SEQ ID NO: 3145646 - DNA, 21 bp, Homo sapiens
taatttagaatggttgagtta

SEQ ID NO: 3145647 - DNA, 23 bp, Homo sapiens
taatttagggtactaaatttaaa

SEQ ID NO: 3145648 - DNA, 16 bp, Homo sapiens
taatttagtgatctta

SEQ ID NO: 3145649 - DNA, 15 bp, Homo sapiens
taatttagttattga

SEQ ID NO: 3145650 - DNA, 19 bp, Homo sapiens
taatttagttgtttctaga

SEQ ID NO: 3145651 - DNA, 21 bp, Homo sapiens
taatttataaaagaataaaat

SEQ ID NO: 3145652 - DNA, 14 bp, Homo sapiens
taatttatagcaag

SEQ ID NO: 3145653 - DNA, 11 bp, Homo sapiens
taatttatgca

SEQ ID NO: 3145654 - DNA, 18 bp, Homo sapiens
taatttattattgaaatt

SEQ ID NO: 3145655 - DNA, 12 bp, Homo sapiens
taatttatttgt

SEQ ID NO: 3145656 - DNA, 14 bp, Homo sapiens
taatttatttgttt

SEQ ID NO: 3145657 - DNA, 17 bp, Homo sapiens
taatttcaaaaatataa

SEQ ID NO: 3145658 - DNA, 19 bp, Homo sapiens
taatttcaaaaatataact

SEQ ID NO: 3145659 - DNA, 21 bp, Homo sapiens
taatttcaaaaatataactta

SEQ ID NO: 3145660 - DNA, 15 bp, Homo sapiens
taatttcaaaatgct

SEQ ID NO: 3145661 - DNA, 16 bp, Homo sapiens
taatttcagtgtaaag

SEQ ID NO: 3145662 - DNA, 17 bp, Homo sapiens
taatttcgagatttgta

SEQ ID NO: 3145663 - DNA, 14 bp, Homo sapiens
taatttctaaagca

SEQ ID NO: 3145664 - DNA, 22 bp, Homo sapiens
taatttctactctgtcttaaat

SEQ ID NO: 3145665 - DNA, 18 bp, Homo sapiens
taatttctgtcagaatgc

SEQ ID NO: 3145666 - DNA, 19 bp, Homo sapiens
taatttcttactaaacatt

SEQ ID NO: 3145667 - DNA, 15 bp, Homo sapiens
taatttcttcaaaat

SEQ ID NO: 3145668 - DNA, 20 bp, Homo sapiens
taatttcttcaaaatgtata

SEQ ID NO: 3145669 - DNA, 23 bp, Homo sapiens
taatttcttcaaaatgtatatat

SEQ ID NO: 3145670 - DNA, 13 bp, Homo sapiens
taatttgaaaaag

SEQ ID NO: 3145671 - DNA, 13 bp, Homo sapiens
taatttgaatgtg

SEQ ID NO: 3145672 - DNA, 15 bp, Homo sapiens
taatttgacttgaat

SEQ ID NO: 3145673 - DNA, 20 bp, Homo sapiens
taatttgatgaaagctgatt

SEQ ID NO: 3145674 - DNA, 17 bp, Homo sapiens
taatttgatgaggtatt

SEQ ID NO: 3145675 - DNA, 20 bp, Homo sapiens
taatttgatgaggtattttt

SEQ ID NO: 3145676 - DNA, 15 bp, Homo sapiens
taatttgattaacaa

SEQ ID NO: 3145677 - DNA, 17 bp, Homo sapiens
taatttgattaacaaat

SEQ ID NO: 3145678 - DNA, 17 bp, Homo sapiens
taatttggagcacaaaa

SEQ ID NO: 3145679 - DNA, 21 bp, Homo sapiens
taatttggagcacaaaattca

SEQ ID NO: 3145680 - DNA, 22 bp, Homo sapiens
taatttggggaaacctagagaa

SEQ ID NO: 3145681 - DNA, 14 bp, Homo sapiens
taatttgtaaactt

SEQ ID NO: 3145682 - DNA, 13 bp, Homo sapiens
taatttgtgtaat

SEQ ID NO: 3145683 - DNA, 15 bp, Homo sapiens
taatttgtgtgtttt

SEQ ID NO: 3145684 - DNA, 21 bp, Homo sapiens
taatttgttggggctttacat

SEQ ID NO: 3145685 - DNA, 22 bp, Homo sapiens
taatttgttggggctttacata

SEQ ID NO: 3145686 - DNA, 14 bp, Homo sapiens
taattttaaagtaa

SEQ ID NO: 3145687 - DNA, 14 bp, Homo sapiens
taattttacacatt

SEQ ID NO: 3145688 - DNA, 21 bp, Homo sapiens
taattttacatgtttataaat

SEQ ID NO: 3145689 - DNA, 21 bp, Homo sapiens
taattttaccaagagtaactt

SEQ ID NO: 3145690 - DNA, 23 bp, Homo sapiens
taattttcttcatgcaatgacat

SEQ ID NO: 3145691 - DNA, 15 bp, Homo sapiens
taattttgaataaat

SEQ ID NO: 3145692 - DNA, 19 bp, Homo sapiens
taattttgatatacattgt

SEQ ID NO: 3145693 - DNA, 14 bp, Homo sapiens
taattttgcatact

SEQ ID NO: 3145694 - DNA, 17 bp, Homo sapiens
taattttgcatactgaa

SEQ ID NO: 3145695 - DNA, 13 bp, Homo sapiens
taattttggattt

SEQ ID NO: 3145696 - DNA, 12 bp, Homo sapiens
taattttgtcac

SEQ ID NO: 3145697 - DNA, 13 bp, Homo sapiens
taattttgtcttt

SEQ ID NO: 3145698 - DNA, 13 bp, Homo sapiens
taattttgtgcat

SEQ ID NO: 3145699 - DNA, 16 bp, Homo sapiens
taattttgtgttgcta

SEQ ID NO: 3145700 - DNA, 22 bp, Homo sapiens
taattttgtgttgtacaattaa

SEQ ID NO: 3145701 - DNA, 13 bp, Homo sapiens
taattttgttgaa

SEQ ID NO: 3145702 - DNA, 19 bp, Homo sapiens
taattttgttgaaaatggt

SEQ ID NO: 3145703 - DNA, 19 bp, Homo sapiens
taatttttaatgatgacaa

SEQ ID NO: 3145704 - DNA, 18 bp, Homo sapiens
taatttttaccctaatgt

SEQ ID NO: 3145705 - DNA, 21 bp, Homo sapiens
taatttttaccctaatgtctt

SEQ ID NO: 3145706 - DNA, 16 bp, Homo sapiens
taatttttatatttaa

SEQ ID NO: 3145707 - DNA, 16 bp, Homo sapiens
taatttttatttcttc

SEQ ID NO: 3145708 - DNA, 14 bp, Homo sapiens
taatttttccaact

SEQ ID NO: 3145709 - DNA, 16 bp, Homo sapiens
taatttttcctatatt

SEQ ID NO: 3145710 - DNA, 15 bp, Homo sapiens
taatttttgctttta

SEQ ID NO: 3145711 - DNA, 24 bp, Homo sapiens
taatttttggggaaaaaagcacat

SEQ ID NO: 3145712 - DNA, 21 bp, Homo sapiens
taatttttgtattatttttgt

SEQ ID NO: 3145713 - DNA, 17 bp, Homo sapiens
taattttttaagaggaa

SEQ ID NO: 3145714 - DNA, 15 bp, Homo sapiens
tacaaaaaaacacgt

SEQ ID NO: 3145715 - DNA, 23 bp, Homo sapiens
tacaaaaaggtataaataataat

SEQ ID NO: 3145716 - DNA, 13 bp, Homo sapiens
tacaaaaatggga

SEQ ID NO: 3145717 - DNA, 19 bp, Homo sapiens
tacaaaacctgatgttaaa

SEQ ID NO: 3145718 - DNA, 12 bp, Homo sapiens
tacaaaacttcc

SEQ ID NO: 3145719 - DNA, 12 bp, Homo sapiens
tacaaaacttta

SEQ ID NO: 3145720 - DNA, 19 bp, Homo sapiens
tacaaaagagcatggatgc

SEQ ID NO: 3145721 - DNA, 20 bp, Homo sapiens
tacaaaagagcatggatgca

SEQ ID NO: 3145722 - DNA, 15 bp, Homo sapiens
tacaaaattaagcaa

SEQ ID NO: 3145723 - DNA, 13 bp, Homo sapiens
tacaaactgcaat

SEQ ID NO: 3145724 - DNA, 22 bp, Homo sapiens
tacaaactgcaatagagactgt

SEQ ID NO: 3145725 - DNA, 23 bp, Homo sapiens
tacaaagaaccatgcaggaagga

SEQ ID NO: 3145726 - DNA, 17 bp, Homo sapiens
tacaaagcgtgcacaag

SEQ ID NO: 3145727 - DNA, 15 bp, Homo sapiens
tacaaagctttgcta

SEQ ID NO: 3145728 - DNA, 15 bp, Homo sapiens
tacaaagtaaataca

SEQ ID NO: 3145729 - DNA, 17 bp, Homo sapiens
tacaaagtaatttcttt

SEQ ID NO: 3145730 - DNA, 17 bp, Homo sapiens
tacaaatactcttagga

SEQ ID NO: 3145731 - DNA, 17 bp, Homo sapiens
tacaaatataaatctta

SEQ ID NO: 3145732 - DNA, 16 bp, Homo sapiens
tacaaatcagaagtca

SEQ ID NO: 3145733 - DNA, 20 bp, Homo sapiens
tacaaatcagaagtcatctt

SEQ ID NO: 3145734 - DNA, 21 bp, Homo sapiens
tacaaatcagaagtcatcttg

SEQ ID NO: 3145735 - DNA, 13 bp, Homo sapiens
tacaaatggattt

SEQ ID NO: 3145736 - DNA, 19 bp, Homo sapiens
tacaaattaaaaagattct

SEQ ID NO: 3145737 - DNA, 14 bp, Homo sapiens
tacaaattgtcgtt

SEQ ID NO: 3145738 - DNA, 12 bp, Homo sapiens
tacaaatttatg

SEQ ID NO: 3145739 - DNA, 18 bp, Homo sapiens
tacaaatttatgcatttc

SEQ ID NO: 3145740 - DNA, 22 bp, Homo sapiens
tacaaatttatgcatttcattc

SEQ ID NO: 3145741 - DNA, 16 bp, Homo sapiens
tacaaatttgttattt

SEQ ID NO: 3145742 - DNA, 17 bp, Homo sapiens
tacaacattcaacttta

SEQ ID NO: 3145743 - DNA, 16 bp, Homo sapiens
tacaacctccctcttg

SEQ ID NO: 3145744 - DNA, 23 bp, Homo sapiens
tacaactggagtttttttataca

SEQ ID NO: 3145745 - DNA, 15 bp, Homo sapiens
tacaacttaatggaa

SEQ ID NO: 3145746 - DNA, 16 bp, Homo sapiens
tacaacttaatggaaa

SEQ ID NO: 3145747 - DNA, 14 bp, Homo sapiens
tacaacttcagcag

SEQ ID NO: 3145748 - DNA, 16 bp, Homo sapiens
tacaagagcagcctgt

SEQ ID NO: 3145749 - DNA, 21 bp, Homo sapiens
tacaagatccatttgcctttc

SEQ ID NO: 3145750 - DNA, 23 bp, Homo sapiens
tacaagatccatttgcctttctg

SEQ ID NO: 3145751 - DNA, 13 bp, Homo sapiens
tacaagattagaa

SEQ ID NO: 3145752 - DNA, 15 bp, Homo sapiens
tacaagattgaaaat

SEQ ID NO: 3145753 - DNA, 12 bp, Homo sapiens
tacaagatttcc

SEQ ID NO: 3145754 - DNA, 21 bp, Homo sapiens
tacaagccattctaaggaaat

SEQ ID NO: 3145755 - DNA, 20 bp, Homo sapiens
tacaagcgtgagccactgca

SEQ ID NO: 3145756 - DNA, 20 bp, Homo sapiens
tacaagtatacttatatttc

SEQ ID NO: 3145757 - DNA, 15 bp, Homo sapiens
tacaagttagaaaac

SEQ ID NO: 3145758 - DNA, 12 bp, Homo sapiens
tacaagtttcag

SEQ ID NO: 3145759 - DNA, 13 bp, Homo sapiens
tacaagtttcaga

SEQ ID NO: 3145760 - DNA, 13 bp, Homo sapiens
tacaataaactgg

SEQ ID NO: 3145761 - DNA, 14 bp, Homo sapiens
tacaataaactggt

SEQ ID NO: 3145762 - DNA, 18 bp, Homo sapiens
tacaataacccagttact

SEQ ID NO: 3145763 - DNA, 13 bp, Homo sapiens
tacaatatataaa

SEQ ID NO: 3145764 - DNA, 17 bp, Homo sapiens
tacaatatataaaaata

SEQ ID NO: 3145765 - DNA, 18 bp, Homo sapiens
tacaatatataaaaatat

SEQ ID NO: 3145766 - DNA, 19 bp, Homo sapiens
tacaatattgattgggaaa

SEQ ID NO: 3145767 - DNA, 14 bp, Homo sapiens
tacaatcctgttta

SEQ ID NO: 3145768 - DNA, 15 bp, Homo sapiens
tacaatcctgtttat

SEQ ID NO: 3145769 - DNA, 21 bp, Homo sapiens
tacaatgaacacttataagtg

SEQ ID NO: 3145770 - DNA, 19 bp, Homo sapiens
tacaatgaactgcttttcc

SEQ ID NO: 3145771 - DNA, 15 bp, Homo sapiens
tacaatgtgaacttt

SEQ ID NO: 3145772 - DNA, 20 bp, Homo sapiens
tacaatgtgaactttattaa

SEQ ID NO: 3145773 - DNA, 12 bp, Homo sapiens
tacaatgtgaat

SEQ ID NO: 3145774 - DNA, 15 bp, Homo sapiens
tacaatgtgaatagt

SEQ ID NO: 3145775 - DNA, 17 bp, Homo sapiens
tacaatgtgtttttctc

SEQ ID NO: 3145776 - DNA, 22 bp, Homo sapiens
tacaattaatagtttgtctatt

SEQ ID NO: 3145777 - DNA, 22 bp, Homo sapiens
tacaattacatctctaattttg

SEQ ID NO: 3145778 - DNA, 19 bp, Homo sapiens
tacaattactaaattgtat

SEQ ID NO: 3145779 - DNA, 14 bp, Homo sapiens
tacaattgcactgc

SEQ ID NO: 3145780 - DNA, 20 bp, Homo sapiens
tacaatttgttaattcctat

SEQ ID NO: 3145781 - DNA, 13 bp, Homo sapiens
tacaattttaaga

SEQ ID NO: 3145782 - DNA, 12 bp, Homo sapiens
tacaattttatc

SEQ ID NO: 3145783 - DNA, 16 bp, Homo sapiens
tacaatttttaataaa

SEQ ID NO: 3145784 - DNA, 18 bp, Homo sapiens
tacaatttttaataaatt

SEQ ID NO: 3145785 - DNA, 19 bp, Homo sapiens
tacaatttttaataaattg

SEQ ID NO: 3145786 - DNA, 13 bp, Homo sapiens
tacaatttttatt

SEQ ID NO: 3145787 - DNA, 17 bp, Homo sapiens
tacaatttttatttctt

SEQ ID NO: 3145788 - DNA, 22 bp, Homo sapiens
tacaatttttatttcttttact

SEQ ID NO: 3145789 - DNA, 22 bp, Homo sapiens
tacacaaatgtgatttttgtaa

SEQ ID NO: 3145790 - DNA, 23 bp, Homo sapiens
tacacaaatgtgatttttgtaat

SEQ ID NO: 3145791 - DNA, 16 bp, Homo sapiens
tacacaagcaatgcaa

SEQ ID NO: 3145792 - DNA, 17 bp, Homo sapiens
tacacaagcaatgcaag

SEQ ID NO: 3145793 - DNA, 11 bp, Homo sapiens
tacacacacac

SEQ ID NO: 3145794 - DNA, 21 bp, Homo sapiens
tacacacacacgcgtgcacac

SEQ ID NO: 3145795 - DNA, 14 bp, Homo sapiens
tacacacacagatg

SEQ ID NO: 3145796 - DNA, 15 bp, Homo sapiens
tacacacacatacac

SEQ ID NO: 3145797 - DNA, 18 bp, Homo sapiens
tacacacatgccctcctg

SEQ ID NO: 3145798 - DNA, 19 bp, Homo sapiens
tacacacatgccctcctgg

SEQ ID NO: 3145799 - DNA, 17 bp, Homo sapiens
tacacacccgcctgaca

SEQ ID NO: 3145800 - DNA, 15 bp, Homo sapiens
tacacaccctgcccc

SEQ ID NO: 3145801 - DNA, 23 bp, Homo sapiens
tacacactctgagtctctgaatg

SEQ ID NO: 3145802 - DNA, 20 bp, Homo sapiens
tacacactgtcatgcttcat

SEQ ID NO: 3145803 - DNA, 17 bp, Homo sapiens
tacacagcacaccagcc

SEQ ID NO: 3145804 - DNA, 15 bp, Homo sapiens
tacacagtactttat

SEQ ID NO: 3145805 - DNA, 20 bp, Homo sapiens
tacacagtactttattgtac

SEQ ID NO: 3145806 - DNA, 21 bp, Homo sapiens
tacacagtactttattgtaca

SEQ ID NO: 3145807 - DNA, 22 bp, Homo sapiens
tacacagtgggaactctgacaa

SEQ ID NO: 3145808 - DNA, 23 bp, Homo sapiens
tacacatagcatgtaatggtatc

SEQ ID NO: 3145809 - DNA, 13 bp, Homo sapiens
tacacatatacct

SEQ ID NO: 3145810 - DNA, 14 bp, Homo sapiens
tacacatataccta

SEQ ID NO: 3145811 - DNA, 17 bp, Homo sapiens
tacacatcacacaagat

SEQ ID NO: 3145812 - DNA, 18 bp, Homo sapiens
tacacattaagtaatcaa

SEQ ID NO: 3145813 - DNA, 13 bp, Homo sapiens
tacacatttgcta

SEQ ID NO: 3145814 - DNA, 21 bp, Homo sapiens
tacacatttgctactgttgta

SEQ ID NO: 3145815 - DNA, 16 bp, Homo sapiens
tacaccacactttcaa

SEQ ID NO: 3145816 - DNA, 14 bp, Homo sapiens
tacacccagacccc

SEQ ID NO: 3145817 - DNA, 19 bp, Homo sapiens
tacacccagaccccaggct

SEQ ID NO: 3145818 - DNA, 16 bp, Homo sapiens
tacaccgactagccag

SEQ ID NO: 3145819 - DNA, 15 bp, Homo sapiens
tacacctaaaggtgt

SEQ ID NO: 3145820 - DNA, 13 bp, Homo sapiens
tacacctccctcc

SEQ ID NO: 3145821 - DNA, 16 bp, Homo sapiens
tacaccttccccaccc

SEQ ID NO: 3145822 - DNA, 23 bp, Homo sapiens
tacacctttatctttccatggga

SEQ ID NO: 3145823 - DNA, 21 bp, Homo sapiens
tacacgaccatttgataggga

SEQ ID NO: 3145824 - DNA, 15 bp, Homo sapiens
tacactaaaaggtga

SEQ ID NO: 3145825 - DNA, 17 bp, Homo sapiens
tacactagacaaaactg

SEQ ID NO: 3145826 - DNA, 14 bp, Homo sapiens
tacactagttgttt

SEQ ID NO: 3145827 - DNA, 15 bp, Homo sapiens
tacactccagcctga

SEQ ID NO: 3145828 - DNA, 13 bp, Homo sapiens
tacactctgctgt

SEQ ID NO: 3145829 - DNA, 15 bp, Homo sapiens
tacactctgctgttt

SEQ ID NO: 3145830 - DNA, 20 bp, Homo sapiens
tacactgaagttaacagaga

SEQ ID NO: 3145831 - DNA, 16 bp, Homo sapiens
tacactgaggagagat

SEQ ID NO: 3145832 - DNA, 17 bp, Homo sapiens
tacactgcctgtatact

SEQ ID NO: 3145833 - DNA, 20 bp, Homo sapiens
tacactgcctgtatacttta

SEQ ID NO: 3145834 - DNA, 21 bp, Homo sapiens
tacactgcctgtatactttag

SEQ ID NO: 3145835 - DNA, 12 bp, Homo sapiens
tacactgctgta

SEQ ID NO: 3145836 - DNA, 15 bp, Homo sapiens
tacacttcttttgaa

SEQ ID NO: 3145837 - DNA, 16 bp, Homo sapiens
tacacttgtataaatg

SEQ ID NO: 3145838 - DNA, 19 bp, Homo sapiens
tacacttgtataaatgtat

SEQ ID NO: 3145839 - DNA, 22 bp, Homo sapiens
tacacttgtataaatgtatata

SEQ ID NO: 3145840 - DNA, 13 bp, Homo sapiens
tacactttatgca

SEQ ID NO: 3145841 - DNA, 19 bp, Homo sapiens
tacactttcattactttta

SEQ ID NO: 3145842 - DNA, 13 bp, Homo sapiens
tacagaaactgat

SEQ ID NO: 3145843 - DNA, 15 bp, Homo sapiens
tacagaaactgatgc

SEQ ID NO: 3145844 - DNA, 22 bp, Homo sapiens
tacagaaatactataacatatg

SEQ ID NO: 3145845 - DNA, 23 bp, Homo sapiens
tacagaaatataataaaatgtgt

SEQ ID NO: 3145846 - DNA, 17 bp, Homo sapiens
tacagaaattagccggg

SEQ ID NO: 3145847 - DNA, 18 bp, Homo sapiens
tacagaaattagccgggc

SEQ ID NO: 3145848 - DNA, 18 bp, Homo sapiens
tacagaacttcagaaaga

SEQ ID NO: 3145849 - DNA, 23 bp, Homo sapiens
tacagaagccaagctccctggag

SEQ ID NO: 3145850 - DNA, 21 bp, Homo sapiens
tacagaatatttctattgaat

SEQ ID NO: 3145851 - DNA, 18 bp, Homo sapiens
tacagaatcttgttttga

SEQ ID NO: 3145852 - DNA, 17 bp, Homo sapiens
tacagaatttgaattat

SEQ ID NO: 3145853 - DNA, 13 bp, Homo sapiens
tacagacactaag

SEQ ID NO: 3145854 - DNA, 13 bp, Homo sapiens
tacagacagaaga

SEQ ID NO: 3145855 - DNA, 20 bp, Homo sapiens
tacagacagaagagaaggaa

SEQ ID NO: 3145856 - DNA, 18 bp, Homo sapiens
tacagacctgctttttga

SEQ ID NO: 3145857 - DNA, 21 bp, Homo sapiens
tacagacctgctttttgaaat

SEQ ID NO: 3145858 - DNA, 16 bp, Homo sapiens
tacagactgttttact

SEQ ID NO: 3145859 - DNA, 14 bp, Homo sapiens
tacagacttctcca

SEQ ID NO: 3145860 - DNA, 15 bp, Homo sapiens
tacagacttctccag

SEQ ID NO: 3145861 - DNA, 22 bp, Homo sapiens
tacagacttgttgtgactttga

SEQ ID NO: 3145862 - DNA, 18 bp, Homo sapiens
tacagagaggagaaacac

SEQ ID NO: 3145863 - DNA, 16 bp, Homo sapiens
tacagaggtattaaaa

SEQ ID NO: 3145864 - DNA, 20 bp, Homo sapiens
tacagaggtctctgccggct

SEQ ID NO: 3145865 - DNA, 23 bp, Homo sapiens
tacagaggtctctgccggctctt

SEQ ID NO: 3145866 - DNA, 23 bp, Homo sapiens
tacagagtgggccccgggctgga

SEQ ID NO: 3145867 - DNA, 12 bp, Homo sapiens
tacagataacat

SEQ ID NO: 3145868 - DNA, 13 bp, Homo sapiens
tacagataacatt

SEQ ID NO: 3145869 - DNA, 16 bp, Homo sapiens
tacagataattcattt

SEQ ID NO: 3145870 - DNA, 17 bp, Homo sapiens
tacagataattcatttg

SEQ ID NO: 3145871 - DNA, 14 bp, Homo sapiens
tacagatgaaaatt

SEQ ID NO: 3145872 - DNA, 10 bp, Homo sapiens
tacagcattg

SEQ ID NO: 3145873 - DNA, 15 bp, Homo sapiens
tacagcattgtcttt

SEQ ID NO: 3145874 - DNA, 19 bp, Homo sapiens
tacagcattgtctttgctg

SEQ ID NO: 3145875 - DNA, 20 bp, Homo sapiens
tacagccttaatattttcct

SEQ ID NO: 3145876 - DNA, 20 bp, Homo sapiens
tacagcgcggaggaggaggg

SEQ ID NO: 3145877 - DNA, 16 bp, Homo sapiens
tacagctaatcagcat

SEQ ID NO: 3145878 - DNA, 22 bp, Homo sapiens
tacagctcccttccctgcaggg

SEQ ID NO: 3145879 - DNA, 22 bp, Homo sapiens
tacagctctcccctcccttgtc

SEQ ID NO: 3145880 - DNA, 20 bp, Homo sapiens
tacagctgggctggggagga

SEQ ID NO: 3145881 - DNA, 14 bp, Homo sapiens
tacagctgtattgt

SEQ ID NO: 3145882 - DNA, 18 bp, Homo sapiens
tacagctgtattgtctga

SEQ ID NO: 3145883 - DNA, 17 bp, Homo sapiens
tacagctgtgttattct

SEQ ID NO: 3145884 - DNA, 18 bp, Homo sapiens
tacagcttcattatctga

SEQ ID NO: 3145885 - DNA, 23 bp, Homo sapiens
tacagctttcttgctcccttcag

SEQ ID NO: 3145886 - DNA, 13 bp, Homo sapiens
tacagcttttatg

SEQ ID NO: 3145887 - DNA, 17 bp, Homo sapiens
tacaggaaggcaggagg

SEQ ID NO: 3145888 - DNA, 14 bp, Homo sapiens
tacaggaatgaaga

SEQ ID NO: 3145889 - DNA, 18 bp, Homo sapiens
tacaggactgtaaagatt

SEQ ID NO: 3145890 - DNA, 16 bp, Homo sapiens
tacaggagaggcagca

SEQ ID NO: 3145891 - DNA, 15 bp, Homo sapiens
tacaggagtgagcac

SEQ ID NO: 3145892 - DNA, 22 bp, Homo sapiens
tacaggcaaaacacgcaagggc

SEQ ID NO: 3145893 - DNA, 16 bp, Homo sapiens
tacaggcacccaccat

SEQ ID NO: 3145894 - DNA, 13 bp, Homo sapiens
tacagggagcctc

SEQ ID NO: 3145895 - DNA, 22 bp, Homo sapiens
tacagggcgagactctgtctca

SEQ ID NO: 3145896 - DNA, 19 bp, Homo sapiens
tacagggtaactgtgctga

SEQ ID NO: 3145897 - DNA, 12 bp, Homo sapiens
tacaggtgctca

SEQ ID NO: 3145898 - DNA, 23 bp, Homo sapiens
tacaggtgggatatgctagaaaa

SEQ ID NO: 3145899 - DNA, 16 bp, Homo sapiens
tacaggtgtgagtcac

SEQ ID NO: 3145900 - DNA, 22 bp, Homo sapiens
tacagtaactaattttgttgaa

SEQ ID NO: 3145901 - DNA, 13 bp, Homo sapiens
tacagtaacttta

SEQ ID NO: 3145902 - DNA, 14 bp, Homo sapiens
tacagtaagcatag

SEQ ID NO: 3145903 - DNA, 17 bp, Homo sapiens
tacagtagattttccaa

SEQ ID NO: 3145904 - DNA, 21 bp, Homo sapiens
tacagtagattttccaaatgt

SEQ ID NO: 3145905 - DNA, 13 bp, Homo sapiens
tacagtattgaaa

SEQ ID NO: 3145906 - DNA, 22 bp, Homo sapiens
tacagtcattggaataaggcat

SEQ ID NO: 3145907 - DNA, 15 bp, Homo sapiens
tacagtccttcaaaa

SEQ ID NO: 3145908 - DNA, 16 bp, Homo sapiens
tacagtctagtactta

SEQ ID NO: 3145909 - DNA, 16 bp, Homo sapiens
tacagtctgtcatgaa

SEQ ID NO: 3145910 - DNA, 20 bp, Homo sapiens
tacagtgaaaatgtaagctg

SEQ ID NO: 3145911 - DNA, 22 bp, Homo sapiens
tacagtgaaaatgtaagctgtt

SEQ ID NO: 3145912 - DNA, 23 bp, Homo sapiens
tacagtgaaaatgtaagctgttt

SEQ ID NO: 3145913 - DNA, 19 bp, Homo sapiens
tacagtgaaattttggtga

SEQ ID NO: 3145914 - DNA, 12 bp, Homo sapiens
tacagtgaagat

SEQ ID NO: 3145915 - DNA, 14 bp, Homo sapiens
tacagtgaagatgt

SEQ ID NO: 3145916 - DNA, 17 bp, Homo sapiens
tacagtgaccttttctt

SEQ ID NO: 3145917 - DNA, 17 bp, Homo sapiens
tacagtgaggagggtgg

SEQ ID NO: 3145918 - DNA, 12 bp, Homo sapiens
tacagtgccttg

SEQ ID NO: 3145919 - DNA, 11 bp, Homo sapiens
tacagtggttt

SEQ ID NO: 3145920 - DNA, 19 bp, Homo sapiens
tacagtgttattttctttg

SEQ ID NO: 3145921 - DNA, 23 bp, Homo sapiens
tacagttaggcaccagaagaaca

SEQ ID NO: 3145922 - DNA, 14 bp, Homo sapiens
tacagttataaaat

SEQ ID NO: 3145923 - DNA, 13 bp, Homo sapiens
tacagttattttg

SEQ ID NO: 3145924 - DNA, 15 bp, Homo sapiens
tacagttattttgga

SEQ ID NO: 3145925 - DNA, 13 bp, Homo sapiens
tacagttctgctc

SEQ ID NO: 3145926 - DNA, 19 bp, Homo sapiens
tacagttgaaataactgga

SEQ ID NO: 3145927 - DNA, 23 bp, Homo sapiens
tacagtttatttttaaagataga

SEQ ID NO: 3145928 - DNA, 21 bp, Homo sapiens
tacagtttgctgtactagaga

SEQ ID NO: 3145929 - DNA, 20 bp, Homo sapiens
tacagttttaactgtggata

SEQ ID NO: 3145930 - DNA, 21 bp, Homo sapiens
tacagttttaactgtggatat

SEQ ID NO: 3145931 - DNA, 14 bp, Homo sapiens
tacataaacaatga

SEQ ID NO: 3145932 - DNA, 21 bp, Homo sapiens
tacataaattgcataaagcat

SEQ ID NO: 3145933 - DNA, 13 bp, Homo sapiens
tacataactaaat

SEQ ID NO: 3145934 - DNA, 19 bp, Homo sapiens
tacataactaaatttgata

SEQ ID NO: 3145935 - DNA, 20 bp, Homo sapiens
tacataactctgtaaaaaca

SEQ ID NO: 3145936 - DNA, 13 bp, Homo sapiens
tacataactgaaa

SEQ ID NO: 3145937 - DNA, 18 bp, Homo sapiens
tacataagataaatgtgc

SEQ ID NO: 3145938 - DNA, 15 bp, Homo sapiens
tacataagtaattca

SEQ ID NO: 3145939 - DNA, 16 bp, Homo sapiens
tacataagtaattcaa

SEQ ID NO: 3145940 - DNA, 19 bp, Homo sapiens
tacataatcagtatatttg

SEQ ID NO: 3145941 - DNA, 13 bp, Homo sapiens
tacataatgtttt

SEQ ID NO: 3145942 - DNA, 18 bp, Homo sapiens
tacataatgtttttcctt

SEQ ID NO: 3145943 - DNA, 14 bp, Homo sapiens
tacatacacttgta

SEQ ID NO: 3145944 - DNA, 16 bp, Homo sapiens
tacatacagattttac

SEQ ID NO: 3145945 - DNA, 13 bp, Homo sapiens
tacatacggtcag

SEQ ID NO: 3145946 - DNA, 17 bp, Homo sapiens
tacatacggtcaggttt

SEQ ID NO: 3145947 - DNA, 15 bp, Homo sapiens
tacatacttttgcaa

SEQ ID NO: 3145948 - DNA, 21 bp, Homo sapiens
tacatagatttatttttcagt

SEQ ID NO: 3145949 - DNA, 13 bp, Homo sapiens
tacatagcctata

SEQ ID NO: 3145950 - DNA, 15 bp, Homo sapiens
tacatagcctatatt

SEQ ID NO: 3145951 - DNA, 21 bp, Homo sapiens
tacatagcctatatttacagt

SEQ ID NO: 3145952 - DNA, 15 bp, Homo sapiens
tacatagttttaaac

SEQ ID NO: 3145953 - DNA, 20 bp, Homo sapiens
tacatataaaatgtaattac

SEQ ID NO: 3145954 - DNA, 22 bp, Homo sapiens
tacatatatattttttgctttt

SEQ ID NO: 3145955 - DNA, 18 bp, Homo sapiens
tacatatcacctcatggc

SEQ ID NO: 3145956 - DNA, 15 bp, Homo sapiens
tacatatcgctgact

SEQ ID NO: 3145957 - DNA, 17 bp, Homo sapiens
tacatatcgctgacttc

SEQ ID NO: 3145958 - DNA, 22 bp, Homo sapiens
tacatatcgctgacttcatgga

SEQ ID NO: 3145959 - DNA, 16 bp, Homo sapiens
tacatatctttattaa

SEQ ID NO: 3145960 - DNA, 16 bp, Homo sapiens
tacatatgagtgtgga

SEQ ID NO: 3145961 - DNA, 15 bp, Homo sapiens
tacatatgtagacta

SEQ ID NO: 3145962 - DNA, 14 bp, Homo sapiens
tacatattactgtt

SEQ ID NO: 3145963 - DNA, 18 bp, Homo sapiens
tacatattactgttgcat

SEQ ID NO: 3145964 - DNA, 19 bp, Homo sapiens
tacatattaggaaaatatg

SEQ ID NO: 3145965 - DNA, 20 bp, Homo sapiens
tacatattgcaggagacatt

SEQ ID NO: 3145966 - DNA, 21 bp, Homo sapiens
tacatcaatttaaaaagcaaa

SEQ ID NO: 3145967 - DNA, 17 bp, Homo sapiens
tacatcagtttgataca

SEQ ID NO: 3145968 - DNA, 14 bp, Homo sapiens
tacatcatgttatt

SEQ ID NO: 3145969 - DNA, 13 bp, Homo sapiens
tacatcctgggta

SEQ ID NO: 3145970 - DNA, 15 bp, Homo sapiens
tacatctaatgcttc

SEQ ID NO: 3145971 - DNA, 19 bp, Homo sapiens
tacatctattttggattgt

SEQ ID NO: 3145972 - DNA, 20 bp, Homo sapiens
tacatctattttggattgta

SEQ ID NO: 3145973 - DNA, 18 bp, Homo sapiens
tacatctctaattttgga

SEQ ID NO: 3145974 - DNA, 20 bp, Homo sapiens
tacatctctaattttggata

SEQ ID NO: 3145975 - DNA, 17 bp, Homo sapiens
tacatctggcttatttt

SEQ ID NO: 3145976 - DNA, 13 bp, Homo sapiens
tacatctgtgatg

SEQ ID NO: 3145977 - DNA, 23 bp, Homo sapiens
tacatcttctgtgaaatataatt

SEQ ID NO: 3145978 - DNA, 16 bp, Homo sapiens
tacatctttaaacagt

SEQ ID NO: 3145979 - DNA, 23 bp, Homo sapiens
tacatgacgacaaagctgctaaa

SEQ ID NO: 3145980 - DNA, 13 bp, Homo sapiens
tacatgactgggc

SEQ ID NO: 3145981 - DNA, 15 bp, Homo sapiens
tacatgactgggcct

SEQ ID NO: 3145982 - DNA, 17 bp, Homo sapiens
tacatgagaacaaacag

SEQ ID NO: 3145983 - DNA, 18 bp, Homo sapiens
tacatgagaacaaacaga

SEQ ID NO: 3145984 - DNA, 16 bp, Homo sapiens
tacatgagaaggaact

SEQ ID NO: 3145985 - DNA, 19 bp, Homo sapiens
tacatgcaaaaagaaatga

SEQ ID NO: 3145986 - DNA, 17 bp, Homo sapiens
tacatgccacatcaaac

SEQ ID NO: 3145987 - DNA, 14 bp, Homo sapiens
tacatgccagtgac

SEQ ID NO: 3145988 - DNA, 12 bp, Homo sapiens
tacatgctgcta

SEQ ID NO: 3145989 - DNA, 14 bp, Homo sapiens
tacatgctgctaat

SEQ ID NO: 3145990 - DNA, 18 bp, Homo sapiens
tacatggaataacatgta

SEQ ID NO: 3145991 - DNA, 22 bp, Homo sapiens
tacatggaataacatgtaatta

SEQ ID NO: 3145992 - DNA, 22 bp, Homo sapiens
tacatggcagagtttgtgtgtt

SEQ ID NO: 3145993 - DNA, 16 bp, Homo sapiens
tacatggccagtgtga

SEQ ID NO: 3145994 - DNA, 19 bp, Homo sapiens
tacatgtattgcacattgt

SEQ ID NO: 3145995 - DNA, 22 bp, Homo sapiens
tacatgtattgcacattgtaaa

SEQ ID NO: 3145996 - DNA, 20 bp, Homo sapiens
tacatgtgccgaatgtgcag

SEQ ID NO: 3145997 - DNA, 14 bp, Homo sapiens
tacatgtggtttat

SEQ ID NO: 3145998 - DNA, 16 bp, Homo sapiens
tacatgtgtaaaggtt

SEQ ID NO: 3145999 - DNA, 14 bp, Homo sapiens
tacatgtgtagcct

SEQ ID NO: 3146000 - DNA, 19 bp, Homo sapiens
tacatgtgtagcctgtgca

SEQ ID NO: 3146001 - DNA, 17 bp, Homo sapiens
tacatgtttataaatct

SEQ ID NO: 3146002 - DNA, 21 bp, Homo sapiens
tacatgtttccatcatttctg

SEQ ID NO: 3146003 - DNA, 22 bp, Homo sapiens
tacatgtttccatcatttctgt

SEQ ID NO: 3146004 - DNA, 17 bp, Homo sapiens
tacattaaaactaggta

SEQ ID NO: 3146005 - DNA, 21 bp, Homo sapiens
tacattaaaactaggtaatgt

SEQ ID NO: 3146006 - DNA, 18 bp, Homo sapiens
tacattaaaataaaccaa

SEQ ID NO: 3146007 - DNA, 23 bp, Homo sapiens
tacattaatgttaattcagcact

SEQ ID NO: 3146008 - DNA, 20 bp, Homo sapiens
tacattagcagtttgctttg

SEQ ID NO: 3146009 - DNA, 13 bp, Homo sapiens
tacattcatttag

SEQ ID NO: 3146010 - DNA, 17 bp, Homo sapiens
tacattccctctcctgc

SEQ ID NO: 3146011 - DNA, 22 bp, Homo sapiens
tacattcctaactagaattagt

SEQ ID NO: 3146012 - DNA, 22 bp, Homo sapiens
tacattctaatttgcattgtgt

SEQ ID NO: 3146013 - DNA, 15 bp, Homo sapiens
tacattgttcaatta

SEQ ID NO: 3146014 - DNA, 13 bp, Homo sapiens
tacattgttgagc

SEQ ID NO: 3146015 - DNA, 19 bp, Homo sapiens
tacattgtttgtctgtctt

SEQ ID NO: 3146016 - DNA, 23 bp, Homo sapiens
tacattgtttgtctgtcttcata

SEQ ID NO: 3146017 - DNA, 15 bp, Homo sapiens
tacatttaaaactta

SEQ ID NO: 3146018 - DNA, 17 bp, Homo sapiens
tacatttaaacaagtat

SEQ ID NO: 3146019 - DNA, 21 bp, Homo sapiens
tacatttatctattaaaattg

SEQ ID NO: 3146020 - DNA, 16 bp, Homo sapiens
tacatttatgatttaa

SEQ ID NO: 3146021 - DNA, 17 bp, Homo sapiens
tacatttatgatttaat

SEQ ID NO: 3146022 - DNA, 18 bp, Homo sapiens
tacatttatgatttaata

SEQ ID NO: 3146023 - DNA, 19 bp, Homo sapiens
tacatttatgatttaataa

SEQ ID NO: 3146024 - DNA, 23 bp, Homo sapiens
tacatttatgatttaataaaata

SEQ ID NO: 3146025 - DNA, 16 bp, Homo sapiens
tacatttctctgagca

SEQ ID NO: 3146026 - DNA, 18 bp, Homo sapiens
tacattttaaaggataat

SEQ ID NO: 3146027 - DNA, 23 bp, Homo sapiens
tacattttatatttttgtacata

SEQ ID NO: 3146028 - DNA, 20 bp, Homo sapiens
tacattttgttgtaaaaaga

SEQ ID NO: 3146029 - DNA, 21 bp, Homo sapiens
tacattttgttgtaaaaagaa

SEQ ID NO: 3146030 - DNA, 14 bp, Homo sapiens
taccaaaattttaa

SEQ ID NO: 3146031 - DNA, 23 bp, Homo sapiens
taccaaaattttaaaaaagggag

SEQ ID NO: 3146032 - DNA, 13 bp, Homo sapiens
taccaaaggatag

SEQ ID NO: 3146033 - DNA, 19 bp, Homo sapiens
taccaaaggtttttaaagt

SEQ ID NO: 3146034 - DNA, 17 bp, Homo sapiens
taccaaagttttatcaa

SEQ ID NO: 3146035 - DNA, 18 bp, Homo sapiens
taccaaagttttatcaag

SEQ ID NO: 3146036 - DNA, 18 bp, Homo sapiens
taccaaatacacatttca

SEQ ID NO: 3146037 - DNA, 19 bp, Homo sapiens
taccaaatctgacatatta

SEQ ID NO: 3146038 - DNA, 23 bp, Homo sapiens
taccaaattaaaaaaaaattgta

SEQ ID NO: 3146039 - DNA, 23 bp, Homo sapiens
taccaagagtaactttactctgt

SEQ ID NO: 3146040 - DNA, 21 bp, Homo sapiens
taccaagatgccatctgtgtc

SEQ ID NO: 3146041 - DNA, 14 bp, Homo sapiens
taccaagtcaaact

SEQ ID NO: 3146042 - DNA, 21 bp, Homo sapiens
taccaatgccaagataattca

SEQ ID NO: 3146043 - DNA, 19 bp, Homo sapiens
taccaatgcttttatcaaa

SEQ ID NO: 3146044 - DNA, 17 bp, Homo sapiens
taccacaagcctgagaa

SEQ ID NO: 3146045 - DNA, 13 bp, Homo sapiens
taccacactgagt

SEQ ID NO: 3146046 - DNA, 14 bp, Homo sapiens
taccacactgagtt

SEQ ID NO: 3146047 - DNA, 16 bp, Homo sapiens
taccacactgagttct

SEQ ID NO: 3146048 - DNA, 22 bp, Homo sapiens
taccacactgagttctatcagt

SEQ ID NO: 3146049 - DNA, 23 bp, Homo sapiens
taccacagacacaatatgtatgc

SEQ ID NO: 3146050 - DNA, 16 bp, Homo sapiens
taccaccgaatcccta

SEQ ID NO: 3146051 - DNA, 23 bp, Homo sapiens
taccacgaggaaaagaacaaaca

SEQ ID NO: 3146052 - DNA, 14 bp, Homo sapiens
taccacttacctca

SEQ ID NO: 3146053 - DNA, 12 bp, Homo sapiens
taccagatataa

SEQ ID NO: 3146054 - DNA, 16 bp, Homo sapiens
taccagatataaaata

SEQ ID NO: 3146055 - DNA, 16 bp, Homo sapiens
taccagatgctactgg

SEQ ID NO: 3146056 - DNA, 21 bp, Homo sapiens
taccagatgctactggacttg

SEQ ID NO: 3146057 - DNA, 21 bp, Homo sapiens
taccagcaagaataaaaaaga

SEQ ID NO: 3146058 - DNA, 20 bp, Homo sapiens
taccagcatgttaactttat

SEQ ID NO: 3146059 - DNA, 16 bp, Homo sapiens
taccagccctggggct

SEQ ID NO: 3146060 - DNA, 21 bp, Homo sapiens
taccagccctggggctgggcc

SEQ ID NO: 3146061 - DNA, 17 bp, Homo sapiens
taccagctaccctgtgt

SEQ ID NO: 3146062 - DNA, 14 bp, Homo sapiens
taccagctgcgctt

SEQ ID NO: 3146063 - DNA, 22 bp, Homo sapiens
taccagctgcgcttgcttttct

SEQ ID NO: 3146064 - DNA, 16 bp, Homo sapiens
taccaggacagaactt

SEQ ID NO: 3146065 - DNA, 17 bp, Homo sapiens
taccaggcaaattcact

SEQ ID NO: 3146066 - DNA, 16 bp, Homo sapiens
taccaggttgaaagac

SEQ ID NO: 3146067 - DNA, 11 bp, Homo sapiens
taccagtgtgg

SEQ ID NO: 3146068 - DNA, 15 bp, Homo sapiens
taccagttgccctag

SEQ ID NO: 3146069 - DNA, 12 bp, Homo sapiens
taccataatctt

SEQ ID NO: 3146070 - DNA, 16 bp, Homo sapiens
taccataatcttagag

SEQ ID NO: 3146071 - DNA, 17 bp, Homo sapiens
taccatcttacttgagc

SEQ ID NO: 3146072 - DNA, 12 bp, Homo sapiens
taccatgctgct

SEQ ID NO: 3146073 - DNA, 17 bp, Homo sapiens
taccatggttgtgcaca

SEQ ID NO: 3146074 - DNA, 23 bp, Homo sapiens
taccatggttgtgcacatgcttc

SEQ ID NO: 3146075 - DNA, 14 bp, Homo sapiens
taccatgtcactgt

SEQ ID NO: 3146076 - DNA, 16 bp, Homo sapiens
taccatgtcactgtgg

SEQ ID NO: 3146077 - DNA, 14 bp, Homo sapiens
taccattaaaactg

SEQ ID NO: 3146078 - DNA, 19 bp, Homo sapiens
taccattaaaactgctttt

SEQ ID NO: 3146079 - DNA, 15 bp, Homo sapiens
taccattaattacat

SEQ ID NO: 3146080 - DNA, 14 bp, Homo sapiens
taccattagcataa

SEQ ID NO: 3146081 - DNA, 21 bp, Homo sapiens
taccattcacaataaaagctt

SEQ ID NO: 3146082 - DNA, 13 bp, Homo sapiens
taccattcagatc

SEQ ID NO: 3146083 - DNA, 14 bp, Homo sapiens
taccattcagtgat

SEQ ID NO: 3146084 - DNA, 13 bp, Homo sapiens
taccatttacatg

SEQ ID NO: 3146085 - DNA, 17 bp, Homo sapiens
taccatttacatgtttt

SEQ ID NO: 3146086 - DNA, 18 bp, Homo sapiens
taccatttagtaagaata

SEQ ID NO: 3146087 - DNA, 17 bp, Homo sapiens
taccatttatacaaatt

SEQ ID NO: 3146088 - DNA, 13 bp, Homo sapiens
taccatttgtaat

SEQ ID NO: 3146089 - DNA, 14 bp, Homo sapiens
taccatttgtaata

SEQ ID NO: 3146090 - DNA, 18 bp, Homo sapiens
taccatttgtaataaagt

SEQ ID NO: 3146091 - DNA, 20 bp, Homo sapiens
taccatttgtaataaagtat

SEQ ID NO: 3146092 - DNA, 20 bp, Homo sapiens
taccattttaacgctgccta

SEQ ID NO: 3146093 - DNA, 17 bp, Homo sapiens
tacccaaaagagaaaaa

SEQ ID NO: 3146094 - DNA, 14 bp, Homo sapiens
tacccaaactgctt

SEQ ID NO: 3146095 - DNA, 23 bp, Homo sapiens
tacccaccgatggagcccccaga

SEQ ID NO: 3146096 - DNA, 15 bp, Homo sapiens
tacccacctagaaca

SEQ ID NO: 3146097 - DNA, 21 bp, Homo sapiens
tacccacgttctcacacccac

SEQ ID NO: 3146098 - DNA, 11 bp, Homo sapiens
tacccactgct

SEQ ID NO: 3146099 - DNA, 12 bp, Homo sapiens
tacccactgctc

SEQ ID NO: 3146100 - DNA, 13 bp, Homo sapiens
tacccactgctct

SEQ ID NO: 3146101 - DNA, 17 bp, Homo sapiens
tacccactgtcaggcct

SEQ ID NO: 3146102 - DNA, 20 bp, Homo sapiens
tacccagagaatatatacat

SEQ ID NO: 3146103 - DNA, 12 bp, Homo sapiens
tacccagatgcc

SEQ ID NO: 3146104 - DNA, 17 bp, Homo sapiens
tacccagccatctgccc

SEQ ID NO: 3146105 - DNA, 19 bp, Homo sapiens
tacccagccatctgcccag

SEQ ID NO: 3146106 - DNA, 23 bp, Homo sapiens
tacccagccatctgcccaggggt

SEQ ID NO: 3146107 - DNA, 17 bp, Homo sapiens
tacccatagacatgaaa

SEQ ID NO: 3146108 - DNA, 16 bp, Homo sapiens
tacccatgagcctgcc

SEQ ID NO: 3146109 - DNA, 14 bp, Homo sapiens
tacccattcaacca

SEQ ID NO: 3146110 - DNA, 18 bp, Homo sapiens
taccccaatttcggattt

SEQ ID NO: 3146111 - DNA, 12 bp, Homo sapiens
taccccaccctc

SEQ ID NO: 3146112 - DNA, 22 bp, Homo sapiens
taccccaccctcagcacccctt

SEQ ID NO: 3146113 - DNA, 23 bp, Homo sapiens
taccccaccctcagcaccccttc

SEQ ID NO: 3146114 - DNA, 16 bp, Homo sapiens
tacccccaacctcatt

SEQ ID NO: 3146115 - DNA, 22 bp, Homo sapiens
tacccccaggaaactagctttt

SEQ ID NO: 3146116 - DNA, 19 bp, Homo sapiens
tacccccattaaattcact

SEQ ID NO: 3146117 - DNA, 17 bp, Homo sapiens
taccccctccttcagac

SEQ ID NO: 3146118 - DNA, 13 bp, Homo sapiens
tacccccttctgg

SEQ ID NO: 3146119 - DNA, 17 bp, Homo sapiens
tacccccttctgggcat

SEQ ID NO: 3146120 - DNA, 17 bp, Homo sapiens
taccccttacttagcat

SEQ ID NO: 3146121 - DNA, 14 bp, Homo sapiens
tacccctttcttct

SEQ ID NO: 3146122 - DNA, 19 bp, Homo sapiens
taccctaatgtcttcataa

SEQ ID NO: 3146123 - DNA, 15 bp, Homo sapiens
taccctagccattcc

SEQ ID NO: 3146124 - DNA, 16 bp, Homo sapiens
taccctagccattcct

SEQ ID NO: 3146125 - DNA, 21 bp, Homo sapiens
taccctcaggcataggcctgg

SEQ ID NO: 3146126 - DNA, 23 bp, Homo sapiens
taccctccaagtctgtacctcaa

SEQ ID NO: 3146127 - DNA, 17 bp, Homo sapiens
taccctccttccacatg

SEQ ID NO: 3146128 - DNA, 22 bp, Homo sapiens
taccctcgggcccacctggcca

SEQ ID NO: 3146129 - DNA, 13 bp, Homo sapiens
taccctctcagct

SEQ ID NO: 3146130 - DNA, 15 bp, Homo sapiens
taccctctcagctcc

SEQ ID NO: 3146131 - DNA, 21 bp, Homo sapiens
taccctctcagctccaggtgg

SEQ ID NO: 3146132 - DNA, 15 bp, Homo sapiens
taccctctgcagaac

SEQ ID NO: 3146133 - DNA, 20 bp, Homo sapiens
taccctgcgattttgcctgt

SEQ ID NO: 3146134 - DNA, 16 bp, Homo sapiens
taccctgctccctgct

SEQ ID NO: 3146135 - DNA, 20 bp, Homo sapiens
taccctgctccctgctttgg

SEQ ID NO: 3146136 - DNA, 15 bp, Homo sapiens
tacccttccctgcac

SEQ ID NO: 3146137 - DNA, 14 bp, Homo sapiens
tacccttcttttat

SEQ ID NO: 3146138 - DNA, 20 bp, Homo sapiens
taccctttagactgtagcct

SEQ ID NO: 3146139 - DNA, 15 bp, Homo sapiens
taccctttatagaac

SEQ ID NO: 3146140 - DNA, 16 bp, Homo sapiens
taccctttggggagca

SEQ ID NO: 3146141 - DNA, 16 bp, Homo sapiens
tacccttttcctttgt

SEQ ID NO: 3146142 - DNA, 17 bp, Homo sapiens
taccgaaaccttgcctt

SEQ ID NO: 3146143 - DNA, 19 bp, Homo sapiens
taccgaaaccttgcctttc

SEQ ID NO: 3146144 - DNA, 17 bp, Homo sapiens
taccgagtctcttctcc

SEQ ID NO: 3146145 - DNA, 12 bp, Homo sapiens
taccgccctggg

SEQ ID NO: 3146146 - DNA, 16 bp, Homo sapiens
taccgccctgggctgg

SEQ ID NO: 3146147 - DNA, 14 bp, Homo sapiens
taccgcttccttag

SEQ ID NO: 3146148 - DNA, 18 bp, Homo sapiens
taccggagagagaatgta

SEQ ID NO: 3146149 - DNA, 22 bp, Homo sapiens
tacctaagattacaaatcagaa

SEQ ID NO: 3146150 - DNA, 13 bp, Homo sapiens
tacctaagtactg

SEQ ID NO: 3146151 - DNA, 15 bp, Homo sapiens
tacctaagtactgta

SEQ ID NO: 3146152 - DNA, 21 bp, Homo sapiens
tacctaatgtctcactgttct

SEQ ID NO: 3146153 - DNA, 22 bp, Homo sapiens
tacctaatgtctcactgttctg

SEQ ID NO: 3146154 - DNA, 21 bp, Homo sapiens
tacctacatgctgaaaaatat

SEQ ID NO: 3146155 - DNA, 14 bp, Homo sapiens
tacctacctgtgtg

SEQ ID NO: 3146156 - DNA, 16 bp, Homo sapiens
tacctactttcttcag

SEQ ID NO: 3146157 - DNA, 14 bp, Homo sapiens
tacctactttgact

SEQ ID NO: 3146158 - DNA, 21 bp, Homo sapiens
tacctactttgactttttgca

SEQ ID NO: 3146159 - DNA, 13 bp, Homo sapiens
tacctagaaatct

SEQ ID NO: 3146160 - DNA, 13 bp, Homo sapiens
tacctagaagaag

SEQ ID NO: 3146161 - DNA, 16 bp, Homo sapiens
tacctataatgtgtgt

SEQ ID NO: 3146162 - DNA, 23 bp, Homo sapiens
tacctatataataaagctactga

SEQ ID NO: 3146163 - DNA, 13 bp, Homo sapiens
tacctatccacaa

SEQ ID NO: 3146164 - DNA, 17 bp, Homo sapiens
tacctattttatatgat

SEQ ID NO: 3146165 - DNA, 13 bp, Homo sapiens
tacctcaaatgaa

SEQ ID NO: 3146166 - DNA, 22 bp, Homo sapiens
tacctcaacccccatttctatt

SEQ ID NO: 3146167 - DNA, 12 bp, Homo sapiens
tacctcagccta

SEQ ID NO: 3146168 - DNA, 17 bp, Homo sapiens
tacctcaggcagctcaa

SEQ ID NO: 3146169 - DNA, 15 bp, Homo sapiens
tacctcaggcaggaa

SEQ ID NO: 3146170 - DNA, 12 bp, Homo sapiens
tacctcatgttt

SEQ ID NO: 3146171 - DNA, 15 bp, Homo sapiens
tacctcatgtttatg

SEQ ID NO: 3146172 - DNA, 20 bp, Homo sapiens
tacctcatgtttatgaaaat

SEQ ID NO: 3146173 - DNA, 15 bp, Homo sapiens
tacctcatttttcat

SEQ ID NO: 3146174 - DNA, 16 bp, Homo sapiens
tacctcatttttcata

SEQ ID NO: 3146175 - DNA, 11 bp, Homo sapiens
tacctccctcc

SEQ ID NO: 3146176 - DNA, 14 bp, Homo sapiens
tacctccttagctt

SEQ ID NO: 3146177 - DNA, 19 bp, Homo sapiens
tacctccttagctttccct

SEQ ID NO: 3146178 - DNA, 20 bp, Homo sapiens
tacctctctgtcccttgctg

SEQ ID NO: 3146179 - DNA, 17 bp, Homo sapiens
tacctctcttatagaat

SEQ ID NO: 3146180 - DNA, 13 bp, Homo sapiens
tacctctgagaag

SEQ ID NO: 3146181 - DNA, 14 bp, Homo sapiens
tacctctgatacct

SEQ ID NO: 3146182 - DNA, 12 bp, Homo sapiens
tacctcttttgc

SEQ ID NO: 3146183 - DNA, 16 bp, Homo sapiens
tacctgacctcttgct

SEQ ID NO: 3146184 - DNA, 17 bp, Homo sapiens
tacctgacctcttgctg

SEQ ID NO: 3146185 - DNA, 18 bp, Homo sapiens
tacctgacctcttgctgt

SEQ ID NO: 3146186 - DNA, 12 bp, Homo sapiens
tacctgagacca

SEQ ID NO: 3146187 - DNA, 19 bp, Homo sapiens
tacctgccctaagggactt

SEQ ID NO: 3146188 - DNA, 15 bp, Homo sapiens
tacctgccctggaac

SEQ ID NO: 3146189 - DNA, 16 bp, Homo sapiens
tacctgccctggaaca

SEQ ID NO: 3146190 - DNA, 16 bp, Homo sapiens
tacctgctggacagcc

SEQ ID NO: 3146191 - DNA, 22 bp, Homo sapiens
tacctgggaaaggacccaccca

SEQ ID NO: 3146192 - DNA, 14 bp, Homo sapiens
taccttatcttaca

SEQ ID NO: 3146193 - DNA, 20 bp, Homo sapiens
taccttattggatatttgat

SEQ ID NO: 3146194 - DNA, 18 bp, Homo sapiens
taccttccttaagccagg

SEQ ID NO: 3146195 - DNA, 15 bp, Homo sapiens
taccttgaccatcgt

SEQ ID NO: 3146196 - DNA, 14 bp, Homo sapiens
tacctttatggttt

SEQ ID NO: 3146197 - DNA, 12 bp, Homo sapiens
tacctttcatac

SEQ ID NO: 3146198 - DNA, 12 bp, Homo sapiens
tacctttgtagt

SEQ ID NO: 3146199 - DNA, 22 bp, Homo sapiens
tacctttgtagttactcaagca

SEQ ID NO: 3146200 - DNA, 12 bp, Homo sapiens
tacctttgtcac

SEQ ID NO: 3146201 - DNA, 18 bp, Homo sapiens
taccttttaagacatttt

SEQ ID NO: 3146202 - DNA, 19 bp, Homo sapiens
taccttttaagacattttc

SEQ ID NO: 3146203 - DNA, 14 bp, Homo sapiens
taccttttgtctct

SEQ ID NO: 3146204 - DNA, 20 bp, Homo sapiens
tacctttttatttgcatgtg

SEQ ID NO: 3146205 - DNA, 18 bp, Homo sapiens
tacctttttgtatgtgaa

SEQ ID NO: 3146206 - DNA, 19 bp, Homo sapiens
tacgagagcagaggtctcc

SEQ ID NO: 3146207 - DNA, 21 bp, Homo sapiens
tacgagggaggaacacctgat

SEQ ID NO: 3146208 - DNA, 14 bp, Homo sapiens
tacgatacgctact

SEQ ID NO: 3146209 - DNA, 13 bp, Homo sapiens
tacgatgcttcaa

SEQ ID NO: 3146210 - DNA, 20 bp, Homo sapiens
tacgctttgtcacacaaaaa

SEQ ID NO: 3146211 - DNA, 17 bp, Homo sapiens
tacggattttcagttac

SEQ ID NO: 3146212 - DNA, 20 bp, Homo sapiens
tacggtcaggtttaacattt

SEQ ID NO: 3146213 - DNA, 17 bp, Homo sapiens
tacgtaaagccttgttt

SEQ ID NO: 3146214 - DNA, 16 bp, Homo sapiens
tacgtagtaaaagtca

SEQ ID NO: 3146215 - DNA, 12 bp, Homo sapiens
tacgtgcacagg

SEQ ID NO: 3146216 - DNA, 14 bp, Homo sapiens
tacgtgcacagggt

SEQ ID NO: 3146217 - DNA, 12 bp, Homo sapiens
tactaaaagcaa

SEQ ID NO: 3146218 - DNA, 13 bp, Homo sapiens
tactaaaagcaaa

SEQ ID NO: 3146219 - DNA, 21 bp, Homo sapiens
tactaaaagcaaatctacaga

SEQ ID NO: 3146220 - DNA, 20 bp, Homo sapiens
tactaaagatatcagagctc

SEQ ID NO: 3146221 - DNA, 14 bp, Homo sapiens
tactaaattacgta

SEQ ID NO: 3146222 - DNA, 20 bp, Homo sapiens
tactaaattgtatacatttt

SEQ ID NO: 3146223 - DNA, 16 bp, Homo sapiens
tactaattccacacct

SEQ ID NO: 3146224 - DNA, 18 bp, Homo sapiens
tactaattttacacatta

SEQ ID NO: 3146225 - DNA, 16 bp, Homo sapiens
tactaattttctagat

SEQ ID NO: 3146226 - DNA, 18 bp, Homo sapiens
tactacaaaatttgaaat

SEQ ID NO: 3146227 - DNA, 15 bp, Homo sapiens
tactacactgaggag

SEQ ID NO: 3146228 - DNA, 17 bp, Homo sapiens
tactacagtcaagatag

SEQ ID NO: 3146229 - DNA, 21 bp, Homo sapiens
tactacagtcaagatagaaag

SEQ ID NO: 3146230 - DNA, 21 bp, Homo sapiens
tactacagttgttttttgaaa

SEQ ID NO: 3146231 - DNA, 11 bp, Homo sapiens
tactacatctg

SEQ ID NO: 3146232 - DNA, 17 bp, Homo sapiens
tactaccacaaggaaaa

SEQ ID NO: 3146233 - DNA, 18 bp, Homo sapiens
tactacctcactactaca

SEQ ID NO: 3146234 - DNA, 22 bp, Homo sapiens
tactacctgtgtatatagtttt

SEQ ID NO: 3146235 - DNA, 17 bp, Homo sapiens
tactactagatgtcttt

SEQ ID NO: 3146236 - DNA, 15 bp, Homo sapiens
tactactgaaacaga

SEQ ID NO: 3146237 - DNA, 13 bp, Homo sapiens
tactactttctct

SEQ ID NO: 3146238 - DNA, 19 bp, Homo sapiens
tactagaatttgtattttg

SEQ ID NO: 3146239 - DNA, 19 bp, Homo sapiens
tactagagtctgaacagct

SEQ ID NO: 3146240 - DNA, 17 bp, Homo sapiens
tactagatgcatcactg

SEQ ID NO: 3146241 - DNA, 19 bp, Homo sapiens
tactagatgtctttaggca

SEQ ID NO: 3146242 - DNA, 20 bp, Homo sapiens
tactagcttttcaaacaaga

SEQ ID NO: 3146243 - DNA, 20 bp, Homo sapiens
tactagggagccatttgaga

SEQ ID NO: 3146244 - DNA, 23 bp, Homo sapiens
tactagtctgtgtgggactgtac

SEQ ID NO: 3146245 - DNA, 20 bp, Homo sapiens
tactagtgtggtgtgtttgc

SEQ ID NO: 3146246 - DNA, 15 bp, Homo sapiens
tactagtgttctgtt

SEQ ID NO: 3146247 - DNA, 14 bp, Homo sapiens
tactagttacacat

SEQ ID NO: 3146248 - DNA, 22 bp, Homo sapiens
tactagttcagacactttggaa

SEQ ID NO: 3146249 - DNA, 19 bp, Homo sapiens
tactagttttagttttctc

SEQ ID NO: 3146250 - DNA, 14 bp, Homo sapiens
tactataacatatg

SEQ ID NO: 3146251 - DNA, 15 bp, Homo sapiens
tactataatcaaatg

SEQ ID NO: 3146252 - DNA, 21 bp, Homo sapiens
tactataatcaaatgatttca

SEQ ID NO: 3146253 - DNA, 14 bp, Homo sapiens
tactatatttacaa

SEQ ID NO: 3146254 - DNA, 14 bp, Homo sapiens
tactatatttatgg

SEQ ID NO: 3146255 - DNA, 14 bp, Homo sapiens
tactatcattctca

SEQ ID NO: 3146256 - DNA, 15 bp, Homo sapiens
tactatggagtacca

SEQ ID NO: 3146257 - DNA, 13 bp, Homo sapiens
tactatgtatcaa

SEQ ID NO: 3146258 - DNA, 17 bp, Homo sapiens
tactattaagcagtaaa

SEQ ID NO: 3146259 - DNA, 13 bp, Homo sapiens
tactattattgtt

SEQ ID NO: 3146260 - DNA, 19 bp, Homo sapiens
tactattcaggtaacacta

SEQ ID NO: 3146261 - DNA, 18 bp, Homo sapiens
tactattccctttgactt

SEQ ID NO: 3146262 - DNA, 23 bp, Homo sapiens
tactattggaacaaatatttaga

SEQ ID NO: 3146263 - DNA, 12 bp, Homo sapiens
tactatttaaag

SEQ ID NO: 3146264 - DNA, 18 bp, Homo sapiens
tactattttctacaatta

SEQ ID NO: 3146265 - DNA, 17 bp, Homo sapiens
tactcaaattcaatgat

SEQ ID NO: 3146266 - DNA, 17 bp, Homo sapiens
tactcaatactacctct

SEQ ID NO: 3146267 - DNA, 22 bp, Homo sapiens
tactcaatgcctggagacagat

SEQ ID NO: 3146268 - DNA, 23 bp, Homo sapiens
tactcaatggagtatgtctgatg

SEQ ID NO: 3146269 - DNA, 21 bp, Homo sapiens
tactcacagcacttgttttca

SEQ ID NO: 3146270 - DNA, 15 bp, Homo sapiens
tactcactgaagcct

SEQ ID NO: 3146271 - DNA, 17 bp, Homo sapiens
tactcagaagcctgagg

SEQ ID NO: 3146272 - DNA, 15 bp, Homo sapiens
tactcagagcagatg

SEQ ID NO: 3146273 - DNA, 15 bp, Homo sapiens
tactcagcacagaga

SEQ ID NO: 3146274 - DNA, 16 bp, Homo sapiens
tactcagcctgctgcc

SEQ ID NO: 3146275 - DNA, 16 bp, Homo sapiens
tactcagggctcctcc

SEQ ID NO: 3146276 - DNA, 17 bp, Homo sapiens
tactcagggttcatctg

SEQ ID NO: 3146277 - DNA, 19 bp, Homo sapiens
tactcagggttcatctgtc

SEQ ID NO: 3146278 - DNA, 19 bp, Homo sapiens
tactcagtgttagagaaat

SEQ ID NO: 3146279 - DNA, 17 bp, Homo sapiens
tactcatcagagcagct

SEQ ID NO: 3146280 - DNA, 13 bp, Homo sapiens
tactcattactgc

SEQ ID NO: 3146281 - DNA, 16 bp, Homo sapiens
tactcattgaaatgtc

SEQ ID NO: 3146282 - DNA, 18 bp, Homo sapiens
tactcattgcccccacct

SEQ ID NO: 3146283 - DNA, 15 bp, Homo sapiens
tactcatttctaaaa

SEQ ID NO: 3146284 - DNA, 22 bp, Homo sapiens
tactcatttctaaaagaatatt

SEQ ID NO: 3146285 - DNA, 20 bp, Homo sapiens
tactccactgccctggcagc

SEQ ID NO: 3146286 - DNA, 23 bp, Homo sapiens
tactccactgccctggcagcagc

SEQ ID NO: 3146287 - DNA, 15 bp, Homo sapiens
tactccataaacaga

SEQ ID NO: 3146288 - DNA, 14 bp, Homo sapiens
tactcccctgggca

SEQ ID NO: 3146289 - DNA, 21 bp, Homo sapiens
tactcccctgggcatcttctg

SEQ ID NO: 3146290 - DNA, 16 bp, Homo sapiens
tactccctcttcactg

SEQ ID NO: 3146291 - DNA, 14 bp, Homo sapiens
tactccctcttcca

SEQ ID NO: 3146292 - DNA, 13 bp, Homo sapiens
tactccctgcaga

SEQ ID NO: 3146293 - DNA, 15 bp, Homo sapiens
tactcctacctcagc

SEQ ID NO: 3146294 - DNA, 17 bp, Homo sapiens
tactcctacctcagcct

SEQ ID NO: 3146295 - DNA, 18 bp, Homo sapiens
tactcctatttttgtaaa

SEQ ID NO: 3146296 - DNA, 20 bp, Homo sapiens
tactcctatttttgtaaact

SEQ ID NO: 3146297 - DNA, 12 bp, Homo sapiens
tactcctcccag

SEQ ID NO: 3146298 - DNA, 13 bp, Homo sapiens
tactcctctgcag

SEQ ID NO: 3146299 - DNA, 11 bp, Homo sapiens
tactcctgact

SEQ ID NO: 3146300 - DNA, 12 bp, Homo sapiens
tactcctgcaaa

SEQ ID NO: 3146301 - DNA, 17 bp, Homo sapiens
tactcctgtgctctgga

SEQ ID NO: 3146302 - DNA, 19 bp, Homo sapiens
tactcctgtgctctggagg

SEQ ID NO: 3146303 - DNA, 14 bp, Homo sapiens
tactccttaagaac

SEQ ID NO: 3146304 - DNA, 17 bp, Homo sapiens
tactcggatggggcacg

SEQ ID NO: 3146305 - DNA, 13 bp, Homo sapiens
tactctaagatct

SEQ ID NO: 3146306 - DNA, 15 bp, Homo sapiens
tactctaagatctta

SEQ ID NO: 3146307 - DNA, 21 bp, Homo sapiens
tactctaagatcttagattct

SEQ ID NO: 3146308 - DNA, 22 bp, Homo sapiens
tactctcctggaaatattaaga

SEQ ID NO: 3146309 - DNA, 14 bp, Homo sapiens
tactctctgctcta

SEQ ID NO: 3146310 - DNA, 13 bp, Homo sapiens
tactctgagccca

SEQ ID NO: 3146311 - DNA, 15 bp, Homo sapiens
tactctgagcccagg

SEQ ID NO: 3146312 - DNA, 17 bp, Homo sapiens
tactctgagcccaggcc

SEQ ID NO: 3146313 - DNA, 18 bp, Homo sapiens
tactctgagcccaggccg

SEQ ID NO: 3146314 - DNA, 15 bp, Homo sapiens
tactctgtcagatgg

SEQ ID NO: 3146315 - DNA, 11 bp, Homo sapiens
tactctgtcca

SEQ ID NO: 3146316 - DNA, 16 bp, Homo sapiens
tactctgtccaggcca

SEQ ID NO: 3146317 - DNA, 17 bp, Homo sapiens
tactctgtccaggccac

SEQ ID NO: 3146318 - DNA, 18 bp, Homo sapiens
tactctgtcttaaatgag

SEQ ID NO: 3146319 - DNA, 16 bp, Homo sapiens
tactctgtgtttaaaa

SEQ ID NO: 3146320 - DNA, 20 bp, Homo sapiens
tactctgtgtttaaaaagta

SEQ ID NO: 3146321 - DNA, 21 bp, Homo sapiens
tactcttaggaagagaaacca

SEQ ID NO: 3146322 - DNA, 15 bp, Homo sapiens
tactcttcagggtct

SEQ ID NO: 3146323 - DNA, 17 bp, Homo sapiens
tactcttcttgaaattt

SEQ ID NO: 3146324 - DNA, 19 bp, Homo sapiens
tactcttgatgtgaagata

SEQ ID NO: 3146325 - DNA, 13 bp, Homo sapiens
tactcttgctgat

SEQ ID NO: 3146326 - DNA, 17 bp, Homo sapiens
tactcttgctgatggct

SEQ ID NO: 3146327 - DNA, 22 bp, Homo sapiens
tactcttgtcatttttaatatt

SEQ ID NO: 3146328 - DNA, 23 bp, Homo sapiens
tactgaaatttgttatacttcaa

SEQ ID NO: 3146329 - DNA, 20 bp, Homo sapiens
tactgaagaaatctttccag

SEQ ID NO: 3146330 - DNA, 22 bp, Homo sapiens
tactgaagaaatctttccagtt

SEQ ID NO: 3146331 - DNA, 18 bp, Homo sapiens
tactgaagccaaatgaaa

SEQ ID NO: 3146332 - DNA, 12 bp, Homo sapiens
tactgaaggaaa

SEQ ID NO: 3146333 - DNA, 19 bp, Homo sapiens
tactgaaggaaaaacacaa

SEQ ID NO: 3146334 - DNA, 20 bp, Homo sapiens
tactgaaggaaaaacacaag

SEQ ID NO: 3146335 - DNA, 23 bp, Homo sapiens
tactgaaggaaaaacacaagcaa

SEQ ID NO: 3146336 - DNA, 13 bp, Homo sapiens
tactgaatctgct

SEQ ID NO: 3146337 - DNA, 16 bp, Homo sapiens
tactgactttctgatt

SEQ ID NO: 3146338 - DNA, 18 bp, Homo sapiens
tactgactttgcttgctt

SEQ ID NO: 3146339 - DNA, 21 bp, Homo sapiens
tactgagcatttgcacctctg

SEQ ID NO: 3146340 - DNA, 18 bp, Homo sapiens
tactgagccttgtaattc

SEQ ID NO: 3146341 - DNA, 19 bp, Homo sapiens
tactgagccttgtaattct

SEQ ID NO: 3146342 - DNA, 23 bp, Homo sapiens
tactgagccttgtaattctaaat

SEQ ID NO: 3146343 - DNA, 16 bp, Homo sapiens
tactgagctgagacca

SEQ ID NO: 3146344 - DNA, 20 bp, Homo sapiens
tactgagtatgtggaaggca

SEQ ID NO: 3146345 - DNA, 16 bp, Homo sapiens
tactgatatattttac

SEQ ID NO: 3146346 - DNA, 17 bp, Homo sapiens
tactgatcatgcattgt

SEQ ID NO: 3146347 - DNA, 18 bp, Homo sapiens
tactgatcatgcattgtt

SEQ ID NO: 3146348 - DNA, 15 bp, Homo sapiens
tactgattatgaaat

SEQ ID NO: 3146349 - DNA, 22 bp, Homo sapiens
tactgattattttcttcatcca

SEQ ID NO: 3146350 - DNA, 18 bp, Homo sapiens
tactgattcactgcatgg

SEQ ID NO: 3146351 - DNA, 14 bp, Homo sapiens
tactgattgtttca

SEQ ID NO: 3146352 - DNA, 19 bp, Homo sapiens
tactgatttcagtaagtct

SEQ ID NO: 3146353 - DNA, 16 bp, Homo sapiens
tactgatttttaagtc

SEQ ID NO: 3146354 - DNA, 13 bp, Homo sapiens
tactgatttttgt

SEQ ID NO: 3146355 - DNA, 22 bp, Homo sapiens
tactgcaaattgattgtctttc

SEQ ID NO: 3146356 - DNA, 17 bp, Homo sapiens
tactgcacagtggcaca

SEQ ID NO: 3146357 - DNA, 21 bp, Homo sapiens
tactgcacagtggcacaaaaa

SEQ ID NO: 3146358 - DNA, 21 bp, Homo sapiens
tactgcagcacctccaggcct

SEQ ID NO: 3146359 - DNA, 22 bp, Homo sapiens
tactgcagctttacatgcaatt

SEQ ID NO: 3146360 - DNA, 16 bp, Homo sapiens
tactgcagggccagga

SEQ ID NO: 3146361 - DNA, 22 bp, Homo sapiens
tactgcatactttttaaatgta

SEQ ID NO: 3146362 - DNA, 19 bp, Homo sapiens
tactgccatgtactagttt

SEQ ID NO: 3146363 - DNA, 19 bp, Homo sapiens
tactgcccaggcctgcctg

SEQ ID NO: 3146364 - DNA, 20 bp, Homo sapiens
tactgcgactttctgcctgg

SEQ ID NO: 3146365 - DNA, 19 bp, Homo sapiens
tactgcggaccaagggact

SEQ ID NO: 3146366 - DNA, 16 bp, Homo sapiens
tactgctgtcttccaa

SEQ ID NO: 3146367 - DNA, 23 bp, Homo sapiens
tactgcttgcttacaatctttat

SEQ ID NO: 3146368 - DNA, 15 bp, Homo sapiens
tactggacctgaaat

SEQ ID NO: 3146369 - DNA, 16 bp, Homo sapiens
tactggacctgaaatt

SEQ ID NO: 3146370 - DNA, 23 bp, Homo sapiens
tactggagtggaaggtctattgg

SEQ ID NO: 3146371 - DNA, 14 bp, Homo sapiens
tactggataaattg

SEQ ID NO: 3146372 - DNA, 13 bp, Homo sapiens
tactggattctta

SEQ ID NO: 3146373 - DNA, 16 bp, Homo sapiens
tactggccagtgtcat

SEQ ID NO: 3146374 - DNA, 15 bp, Homo sapiens
tactgggagaatcac

SEQ ID NO: 3146375 - DNA, 12 bp, Homo sapiens
tactgggcctta

SEQ ID NO: 3146376 - DNA, 22 bp, Homo sapiens
tactgggccttagtgggccagg

SEQ ID NO: 3146377 - DNA, 18 bp, Homo sapiens
tactgtaactgtcagtgt

SEQ ID NO: 3146378 - DNA, 16 bp, Homo sapiens
tactgtaataatacct

SEQ ID NO: 3146379 - DNA, 23 bp, Homo sapiens
tactgtaataatacctcaatgtt

SEQ ID NO: 3146380 - DNA, 13 bp, Homo sapiens
tactgtaattcct

SEQ ID NO: 3146381 - DNA, 15 bp, Homo sapiens
tactgtactaattct

SEQ ID NO: 3146382 - DNA, 22 bp, Homo sapiens
tactgtactttgccatttttct

SEQ ID NO: 3146383 - DNA, 17 bp, Homo sapiens
tactgtagctgatgaaa

SEQ ID NO: 3146384 - DNA, 18 bp, Homo sapiens
tactgtatggaaacactg

SEQ ID NO: 3146385 - DNA, 15 bp, Homo sapiens
tactgtatttctaag

SEQ ID NO: 3146386 - DNA, 13 bp, Homo sapiens
tactgtcaataaa

SEQ ID NO: 3146387 - DNA, 15 bp, Homo sapiens
tactgtcaataaaca

SEQ ID NO: 3146388 - DNA, 14 bp, Homo sapiens
tactgtcagattaa

SEQ ID NO: 3146389 - DNA, 18 bp, Homo sapiens
tactgtcagattaaatta

SEQ ID NO: 3146390 - DNA, 23 bp, Homo sapiens
tactgtcatcctcaaagaaagtg

SEQ ID NO: 3146391 - DNA, 21 bp, Homo sapiens
tactgtccagcttatagtctt

SEQ ID NO: 3146392 - DNA, 19 bp, Homo sapiens
tactgtcccacttctcatc

SEQ ID NO: 3146393 - DNA, 12 bp, Homo sapiens
tactgtcctcag

SEQ ID NO: 3146394 - DNA, 22 bp, Homo sapiens
tactgtctcactgaaacattta

SEQ ID NO: 3146395 - DNA, 23 bp, Homo sapiens
tactgtctctggcatttgtttcc

SEQ ID NO: 3146396 - DNA, 21 bp, Homo sapiens
tactgtctggttttaacaatt

SEQ ID NO: 3146397 - DNA, 15 bp, Homo sapiens
tactgtgaaactggc

SEQ ID NO: 3146398 - DNA, 20 bp, Homo sapiens
tactgtgcagaataatggaa

SEQ ID NO: 3146399 - DNA, 23 bp, Homo sapiens
tactgtgcagaataatggaaaca

SEQ ID NO: 3146400 - DNA, 23 bp, Homo sapiens
tactgtgcatctccttgactgcc

SEQ ID NO: 3146401 - DNA, 16 bp, Homo sapiens
tactgtgtcataaaca

SEQ ID NO: 3146402 - DNA, 21 bp, Homo sapiens
tactgtgtgcttgttttataa

SEQ ID NO: 3146403 - DNA, 13 bp, Homo sapiens
tactgtgtggaac

SEQ ID NO: 3146404 - DNA, 19 bp, Homo sapiens
tactgtgtgtgtgaatgaa

SEQ ID NO: 3146405 - DNA, 19 bp, Homo sapiens
tactgttaaccatttaagt

SEQ ID NO: 3146406 - DNA, 23 bp, Homo sapiens
tactgttcaatggttctgaaata

SEQ ID NO: 3146407 - DNA, 16 bp, Homo sapiens
tactgttcctttcaga

SEQ ID NO: 3146408 - DNA, 19 bp, Homo sapiens
tactgttcctttcagatga

SEQ ID NO: 3146409 - DNA, 12 bp, Homo sapiens
tactgttctaaa

SEQ ID NO: 3146410 - DNA, 15 bp, Homo sapiens
tactgttctaaagct

SEQ ID NO: 3146411 - DNA, 10 bp, Homo sapiens
tactgttctt

SEQ ID NO: 3146412 - DNA, 18 bp, Homo sapiens
tactgttcttgctgctag

SEQ ID NO: 3146413 - DNA, 20 bp, Homo sapiens
tactgttcttgctgctagaa

SEQ ID NO: 3146414 - DNA, 22 bp, Homo sapiens
tactgttcttgctgctagaact

SEQ ID NO: 3146415 - DNA, 16 bp, Homo sapiens
tactgttgtaagaatt

SEQ ID NO: 3146416 - DNA, 15 bp, Homo sapiens
tactgtttatttctg

SEQ ID NO: 3146417 - DNA, 23 bp, Homo sapiens
tactgtttatttctgtttctcat

SEQ ID NO: 3146418 - DNA, 19 bp, Homo sapiens
tactgttttaattgtagtt

SEQ ID NO: 3146419 - DNA, 13 bp, Homo sapiens
tacttaactattc

SEQ ID NO: 3146420 - DNA, 15 bp, Homo sapiens
tacttaagagtggca

SEQ ID NO: 3146421 - DNA, 11 bp, Homo sapiens
tacttaataaa

SEQ ID NO: 3146422 - DNA, 15 bp, Homo sapiens
tacttaatccaatgg

SEQ ID NO: 3146423 - DNA, 22 bp, Homo sapiens
tacttacctaaacagatataaa

SEQ ID NO: 3146424 - DNA, 14 bp, Homo sapiens
tacttagctgtact

SEQ ID NO: 3146425 - DNA, 20 bp, Homo sapiens
tacttaggttattttgcttt

SEQ ID NO: 3146426 - DNA, 15 bp, Homo sapiens
tacttagtggtatgt

SEQ ID NO: 3146427 - DNA, 17 bp, Homo sapiens
tacttatattttcgtat

SEQ ID NO: 3146428 - DNA, 20 bp, Homo sapiens
tacttattacatgctgctat

SEQ ID NO: 3146429 - DNA, 20 bp, Homo sapiens
tacttattttcagtgcatca

SEQ ID NO: 3146430 - DNA, 21 bp, Homo sapiens
tacttattttcagtgcatcat

SEQ ID NO: 3146431 - DNA, 20 bp, Homo sapiens
tacttatttttgacagtgtt

SEQ ID NO: 3146432 - DNA, 16 bp, Homo sapiens
tacttcaaaaataatg

SEQ ID NO: 3146433 - DNA, 15 bp, Homo sapiens
tacttcaaccagcct

SEQ ID NO: 3146434 - DNA, 19 bp, Homo sapiens
tacttcactgtcatcttca

SEQ ID NO: 3146435 - DNA, 20 bp, Homo sapiens
tacttcactgtcatcttcaa

SEQ ID NO: 3146436 - DNA, 23 bp, Homo sapiens
tacttccataggacatactgcat

SEQ ID NO: 3146437 - DNA, 14 bp, Homo sapiens
tacttccctcaggc

SEQ ID NO: 3146438 - DNA, 14 bp, Homo sapiens
tacttcctcctccc

SEQ ID NO: 3146439 - DNA, 16 bp, Homo sapiens
tacttcctcctcccca

SEQ ID NO: 3146440 - DNA, 13 bp, Homo sapiens
tacttcctcctga

SEQ ID NO: 3146441 - DNA, 14 bp, Homo sapiens
tacttcctgggtca

SEQ ID NO: 3146442 - DNA, 20 bp, Homo sapiens
tacttctccaccctgctctc

SEQ ID NO: 3146443 - DNA, 18 bp, Homo sapiens
tacttctgactttacttg

SEQ ID NO: 3146444 - DNA, 13 bp, Homo sapiens
tacttctgaggta

SEQ ID NO: 3146445 - DNA, 17 bp, Homo sapiens
tacttctgtaattgtgt

SEQ ID NO: 3146446 - DNA, 18 bp, Homo sapiens
tacttctgtgttcatttt

SEQ ID NO: 3146447 - DNA, 14 bp, Homo sapiens
tacttcttattgca

SEQ ID NO: 3146448 - DNA, 20 bp, Homo sapiens
tacttcttgaatataaaaaa

SEQ ID NO: 3146449 - DNA, 15 bp, Homo sapiens
tacttgaaaaagtaa

SEQ ID NO: 3146450 - DNA, 22 bp, Homo sapiens
tacttgaagtctaaaagcagaa

SEQ ID NO: 3146451 - DNA, 23 bp, Homo sapiens
tacttgaagtctaaaagcagaaa

SEQ ID NO: 3146452 - DNA, 14 bp, Homo sapiens
tacttgacctccta

SEQ ID NO: 3146453 - DNA, 15 bp, Homo sapiens
tacttgataatatta

SEQ ID NO: 3146454 - DNA, 13 bp, Homo sapiens
tacttgatactga

SEQ ID NO: 3146455 - DNA, 17 bp, Homo sapiens
tacttgatactgaatgc

SEQ ID NO: 3146456 - DNA, 19 bp, Homo sapiens
tacttgcagcattcatttg

SEQ ID NO: 3146457 - DNA, 15 bp, Homo sapiens
tacttgcagtacatc

SEQ ID NO: 3146458 - DNA, 19 bp, Homo sapiens
tacttgcttattacattta

SEQ ID NO: 3146459 - DNA, 20 bp, Homo sapiens
tacttgcttattacatttaa

SEQ ID NO: 3146460 - DNA, 15 bp, Homo sapiens
tacttgctttcaatt

SEQ ID NO: 3146461 - DNA, 18 bp, Homo sapiens
tacttgggaggctgaggc

SEQ ID NO: 3146462 - DNA, 15 bp, Homo sapiens
tacttgtctgaggcc

SEQ ID NO: 3146463 - DNA, 16 bp, Homo sapiens
tacttgtctgaggcct

SEQ ID NO: 3146464 - DNA, 18 bp, Homo sapiens
tacttgtgaaacacagct

SEQ ID NO: 3146465 - DNA, 19 bp, Homo sapiens
tacttgtgaaacacagctg

SEQ ID NO: 3146466 - DNA, 14 bp, Homo sapiens
tacttgtggacaca

SEQ ID NO: 3146467 - DNA, 14 bp, Homo sapiens
tacttgtggtgtga

SEQ ID NO: 3146468 - DNA, 16 bp, Homo sapiens
tacttgtgtttgctta

SEQ ID NO: 3146469 - DNA, 20 bp, Homo sapiens
tacttgtgtttgcttaaaca

SEQ ID NO: 3146470 - DNA, 21 bp, Homo sapiens
tacttgtgtttgcttaaacaa

SEQ ID NO: 3146471 - DNA, 14 bp, Homo sapiens
tacttgtttcagct

SEQ ID NO: 3146472 - DNA, 16 bp, Homo sapiens
tacttgtttctctgtt

SEQ ID NO: 3146473 - DNA, 14 bp, Homo sapiens
tactttaaaaagga

SEQ ID NO: 3146474 - DNA, 22 bp, Homo sapiens
tactttaaaaaggaaatttgtt

SEQ ID NO: 3146475 - DNA, 20 bp, Homo sapiens
tactttataactaacatgtc

SEQ ID NO: 3146476 - DNA, 14 bp, Homo sapiens
tactttatatctgt

SEQ ID NO: 3146477 - DNA, 18 bp, Homo sapiens
tactttatatctgtaatg

SEQ ID NO: 3146478 - DNA, 14 bp, Homo sapiens
tactttatcacttt

SEQ ID NO: 3146479 - DNA, 11 bp, Homo sapiens
tactttattct

SEQ ID NO: 3146480 - DNA, 19 bp, Homo sapiens
tactttcctttccccagcc

SEQ ID NO: 3146481 - DNA, 20 bp, Homo sapiens
tactttcctttccccagccc

SEQ ID NO: 3146482 - DNA, 20 bp, Homo sapiens
tactttcggagaaattctct

SEQ ID NO: 3146483 - DNA, 21 bp, Homo sapiens
tactttcggagaaattctctt

SEQ ID NO: 3146484 - DNA, 19 bp, Homo sapiens
tactttctctgtagttcct

SEQ ID NO: 3146485 - DNA, 20 bp, Homo sapiens
tactttgacagtgtttttag

SEQ ID NO: 3146486 - DNA, 14 bp, Homo sapiens
tactttgacttttt

SEQ ID NO: 3146487 - DNA, 20 bp, Homo sapiens
tactttgccatttttctata

SEQ ID NO: 3146488 - DNA, 24 bp, Homo sapiens
tactttggaatgactataaacatt

SEQ ID NO: 3146489 - DNA, 13 bp, Homo sapiens
tactttgtaaata

SEQ ID NO: 3146490 - DNA, 23 bp, Homo sapiens
tactttgtaaataggatttttag

SEQ ID NO: 3146491 - DNA, 22 bp, Homo sapiens
tactttgtaagtgagagagaca

SEQ ID NO: 3146492 - DNA, 21 bp, Homo sapiens
tactttgtattttgattattt

SEQ ID NO: 3146493 - DNA, 15 bp, Homo sapiens
tactttgtgcattct

SEQ ID NO: 3146494 - DNA, 21 bp, Homo sapiens
tacttttaaacagtgagcctg

SEQ ID NO: 3146495 - DNA, 21 bp, Homo sapiens
tacttttaaactgtgtacata

SEQ ID NO: 3146496 - DNA, 22 bp, Homo sapiens
tacttttagttgactcacaggc

SEQ ID NO: 3146497 - DNA, 18 bp, Homo sapiens
tacttttcagtttttaac

SEQ ID NO: 3146498 - DNA, 18 bp, Homo sapiens
tacttttcccctgttaaa

SEQ ID NO: 3146499 - DNA, 17 bp, Homo sapiens
tacttttcttcagtcct

SEQ ID NO: 3146500 - DNA, 13 bp, Homo sapiens
tacttttggctcc

SEQ ID NO: 3146501 - DNA, 20 bp, Homo sapiens
tacttttgttctgtattttc

SEQ ID NO: 3146502 - DNA, 17 bp, Homo sapiens
tacttttgttgtatggg

SEQ ID NO: 3146503 - DNA, 13 bp, Homo sapiens
tacttttttaaat

SEQ ID NO: 3146504 - DNA, 22 bp, Homo sapiens
tacttttttaaatattttctat

SEQ ID NO: 3146505 - DNA, 14 bp, Homo sapiens
tactttttttcaca

SEQ ID NO: 3146506 - DNA, 18 bp, Homo sapiens
tacttttttttagttcaa

SEQ ID NO: 3146507 - DNA, 19 bp, Homo sapiens
tacttttttttagttcaat

SEQ ID NO: 3146508 - DNA, 21 bp, Homo sapiens
tacttttttttagttcaatac

SEQ ID NO: 3146509 - DNA, 15 bp, Homo sapiens
tagaaaaaaattact

SEQ ID NO: 3146510 - DNA, 15 bp, Homo sapiens
tagaaaactgaaaat

SEQ ID NO: 3146511 - DNA, 21 bp, Homo sapiens
tagaaaagaaaaaaaaaatat

SEQ ID NO: 3146512 - DNA, 23 bp, Homo sapiens
tagaaaagcagtcccattcatat

SEQ ID NO: 3146513 - DNA, 14 bp, Homo sapiens
tagaaaagtgaatt

SEQ ID NO: 3146514 - DNA, 17 bp, Homo sapiens
tagaaaagtgaattgaa

SEQ ID NO: 3146515 - DNA, 18 bp, Homo sapiens
tagaaaagtgaattgaag

SEQ ID NO: 3146516 - DNA, 13 bp, Homo sapiens
tagaaaatattct

SEQ ID NO: 3146517 - DNA, 21 bp, Homo sapiens
tagaaaatgacttatttctgc

SEQ ID NO: 3146518 - DNA, 12 bp, Homo sapiens
tagaaaatgtgt

SEQ ID NO: 3146519 - DNA, 24 bp, Homo sapiens
tagaaaatgtgtcctatctatctt

SEQ ID NO: 3146520 - DNA, 21 bp, Homo sapiens
tagaaaatttagccctttaaa

SEQ ID NO: 3146521 - DNA, 17 bp, Homo sapiens
tagaaacaaaaagagct

SEQ ID NO: 3146522 - DNA, 13 bp, Homo sapiens
tagaaacatgaca

SEQ ID NO: 3146523 - DNA, 14 bp, Homo sapiens
tagaaacattgtaa

SEQ ID NO: 3146524 - DNA, 17 bp, Homo sapiens
tagaaacccaaattggg

SEQ ID NO: 3146525 - DNA, 20 bp, Homo sapiens
tagaaacccaagctcctcct

SEQ ID NO: 3146526 - DNA, 15 bp, Homo sapiens
tagaaaccttaatat

SEQ ID NO: 3146527 - DNA, 17 bp, Homo sapiens
tagaaactactaatttt

SEQ ID NO: 3146528 - DNA, 22 bp, Homo sapiens
tagaaactgatttcttcagaat

SEQ ID NO: 3146529 - DNA, 23 bp, Homo sapiens
tagaaagaaaagaccctgagact

SEQ ID NO: 3146530 - DNA, 23 bp, Homo sapiens
tagaaagaagcccaatattataa

SEQ ID NO: 3146531 - DNA, 22 bp, Homo sapiens
tagaaagcaggggctacaagag

SEQ ID NO: 3146532 - DNA, 21 bp, Homo sapiens
tagaaagttgatattcaacct

SEQ ID NO: 3146533 - DNA, 16 bp, Homo sapiens
tagaaataaattccta

SEQ ID NO: 3146534 - DNA, 12 bp, Homo sapiens
tagaaataagtg

SEQ ID NO: 3146535 - DNA, 16 bp, Homo sapiens
tagaaataagtggtta

SEQ ID NO: 3146536 - DNA, 23 bp, Homo sapiens
tagaaataagtggttatttctca

SEQ ID NO: 3146537 - DNA, 14 bp, Homo sapiens
tagaaatatgattt

SEQ ID NO: 3146538 - DNA, 15 bp, Homo sapiens
tagaaatattcacat

SEQ ID NO: 3146539 - DNA, 16 bp, Homo sapiens
tagaaattacctgtgg

SEQ ID NO: 3146540 - DNA, 23 bp, Homo sapiens
tagaaattagaaaaaaattacta

SEQ ID NO: 3146541 - DNA, 18 bp, Homo sapiens
tagaaattagctgtgtga

SEQ ID NO: 3146542 - DNA, 21 bp, Homo sapiens
tagaaattcttcatgaacata

SEQ ID NO: 3146543 - DNA, 12 bp, Homo sapiens
tagaaatttaac

SEQ ID NO: 3146544 - DNA, 14 bp, Homo sapiens
tagaaattttacaa

SEQ ID NO: 3146545 - DNA, 17 bp, Homo sapiens
tagaaattttacaatag

SEQ ID NO: 3146546 - DNA, 22 bp, Homo sapiens
tagaaatttttcagatgcttct

SEQ ID NO: 3146547 - DNA, 20 bp, Homo sapiens
tagaacaaaggacagagtat

SEQ ID NO: 3146548 - DNA, 17 bp, Homo sapiens
tagaacaagcccaaatt

SEQ ID NO: 3146549 - DNA, 15 bp, Homo sapiens
tagaacacaggcaaa

SEQ ID NO: 3146550 - DNA, 19 bp, Homo sapiens
tagaacactaattcataat

SEQ ID NO: 3146551 - DNA, 19 bp, Homo sapiens
tagaacactattttcagaa

SEQ ID NO: 3146552 - DNA, 22 bp, Homo sapiens
tagaacagggaaaataggcagg

SEQ ID NO: 3146553 - DNA, 13 bp, Homo sapiens
tagaacatatttt

SEQ ID NO: 3146554 - DNA, 15 bp, Homo sapiens
tagaacatattttcc

SEQ ID NO: 3146555 - DNA, 20 bp, Homo sapiens
tagaacctgggctgtgctgc

SEQ ID NO: 3146556 - DNA, 21 bp, Homo sapiens
tagaaccttctagaacctggg

SEQ ID NO: 3146557 - DNA, 14 bp, Homo sapiens
tagaactagccaaa

SEQ ID NO: 3146558 - DNA, 16 bp, Homo sapiens
tagaactcactctggg

SEQ ID NO: 3146559 - DNA, 17 bp, Homo sapiens
tagaactcagcagttga

SEQ ID NO: 3146560 - DNA, 22 bp, Homo sapiens
tagaactcagttttaactagaa

SEQ ID NO: 3146561 - DNA, 16 bp, Homo sapiens
tagaactccaggccct

SEQ ID NO: 3146562 - DNA, 16 bp, Homo sapiens
tagaactccctttcaa

SEQ ID NO: 3146563 - DNA, 17 bp, Homo sapiens
tagaactccctttcaac

SEQ ID NO: 3146564 - DNA, 18 bp, Homo sapiens
tagaactccctttcaaca

SEQ ID NO: 3146565 - DNA, 13 bp, Homo sapiens
tagaactgggtaa

SEQ ID NO: 3146566 - DNA, 21 bp, Homo sapiens
tagaactttctgctttgcaca

SEQ ID NO: 3146567 - DNA, 12 bp, Homo sapiens
tagaactttttt

SEQ ID NO: 3146568 - DNA, 15 bp, Homo sapiens
tagaacttttttaaa

SEQ ID NO: 3146569 - DNA, 17 bp, Homo sapiens
tagaacttttttaaata

SEQ ID NO: 3146570 - DNA, 20 bp, Homo sapiens
tagaacttttttaaataaac

SEQ ID NO: 3146571 - DNA, 22 bp, Homo sapiens
tagaacttttttaaataaactt

SEQ ID NO: 3146572 - DNA, 17 bp, Homo sapiens
tagaagaaaagcccatt

SEQ ID NO: 3146573 - DNA, 21 bp, Homo sapiens
tagaagcactacaccttgcct

SEQ ID NO: 3146574 - DNA, 14 bp, Homo sapiens
tagaagcattcctt

SEQ ID NO: 3146575 - DNA, 12 bp, Homo sapiens
tagaagccaagg

SEQ ID NO: 3146576 - DNA, 23 bp, Homo sapiens
tagaaggaaaaaagttccttcct

SEQ ID NO: 3146577 - DNA, 13 bp, Homo sapiens
tagaaggagcctt

SEQ ID NO: 3146578 - DNA, 19 bp, Homo sapiens
tagaagggccagtcctgcc

SEQ ID NO: 3146579 - DNA, 22 bp, Homo sapiens
tagaagggccagtcctgcctgg

SEQ ID NO: 3146580 - DNA, 17 bp, Homo sapiens
tagaagtcttagatgta

SEQ ID NO: 3146581 - DNA, 14 bp, Homo sapiens
tagaagtttgtcca

SEQ ID NO: 3146582 - DNA, 23 bp, Homo sapiens
tagaagtttgtccatttgtaaaa

SEQ ID NO: 3146583 - DNA, 16 bp, Homo sapiens
tagaagtttttgtact

SEQ ID NO: 3146584 - DNA, 18 bp, Homo sapiens
tagaagtttttgtactgt

SEQ ID NO: 3146585 - DNA, 21 bp, Homo sapiens
tagaataaaagctataaagta

SEQ ID NO: 3146586 - DNA, 17 bp, Homo sapiens
tagaataaggaggagga

SEQ ID NO: 3146587 - DNA, 21 bp, Homo sapiens
tagaataattttattagaata

SEQ ID NO: 3146588 - DNA, 12 bp, Homo sapiens
tagaatactttt

SEQ ID NO: 3146589 - DNA, 21 bp, Homo sapiens
tagaatacttttttctagttt

SEQ ID NO: 3146590 - DNA, 15 bp, Homo sapiens
tagaatataattatc

SEQ ID NO: 3146591 - DNA, 15 bp, Homo sapiens
tagaatataggtctc

SEQ ID NO: 3146592 - DNA, 16 bp, Homo sapiens
tagaatataggtctct

SEQ ID NO: 3146593 - DNA, 18 bp, Homo sapiens
tagaatctgcaattcaaa

SEQ ID NO: 3146594 - DNA, 17 bp, Homo sapiens
tagaatgaaaactcatt

SEQ ID NO: 3146595 - DNA, 18 bp, Homo sapiens
tagaatgatctattgctc

SEQ ID NO: 3146596 - DNA, 16 bp, Homo sapiens
tagaatgccggttaaa

SEQ ID NO: 3146597 - DNA, 22 bp, Homo sapiens
tagaatgccggttaaattccat

SEQ ID NO: 3146598 - DNA, 18 bp, Homo sapiens
tagaatggttgagttaca

SEQ ID NO: 3146599 - DNA, 19 bp, Homo sapiens
tagaatgtggccacttatt

SEQ ID NO: 3146600 - DNA, 22 bp, Homo sapiens
tagaatgtggccacttatttca

SEQ ID NO: 3146601 - DNA, 21 bp, Homo sapiens
tagaattaccattaattacat

SEQ ID NO: 3146602 - DNA, 17 bp, Homo sapiens
tagaattataagtcaca

SEQ ID NO: 3146603 - DNA, 16 bp, Homo sapiens
tagaattatctaattt

SEQ ID NO: 3146604 - DNA, 23 bp, Homo sapiens
tagaattatctaatttataaaaa

SEQ ID NO: 3146605 - DNA, 18 bp, Homo sapiens
tagaattgtagactgatg

SEQ ID NO: 3146606 - DNA, 22 bp, Homo sapiens
tagaatttattcaattcctctg

SEQ ID NO: 3146607 - DNA, 14 bp, Homo sapiens
tagacaaaaagtat

SEQ ID NO: 3146608 - DNA, 14 bp, Homo sapiens
tagacaaagtacat

SEQ ID NO: 3146609 - DNA, 20 bp, Homo sapiens
tagacaacgatgaatttctt

SEQ ID NO: 3146610 - DNA, 21 bp, Homo sapiens
tagacaacgatgaatttcttc

SEQ ID NO: 3146611 - DNA, 13 bp, Homo sapiens
tagacaactagat

SEQ ID NO: 3146612 - DNA, 18 bp, Homo sapiens
tagacaactagatttgtc

SEQ ID NO: 3146613 - DNA, 16 bp, Homo sapiens
tagacaatcattgttt

SEQ ID NO: 3146614 - DNA, 17 bp, Homo sapiens
tagacaccaaagttcta

SEQ ID NO: 3146615 - DNA, 20 bp, Homo sapiens
tagacaccaaagttctaata

SEQ ID NO: 3146616 - DNA, 10 bp, Homo sapiens
tagacagagt

SEQ ID NO: 3146617 - DNA, 22 bp, Homo sapiens
tagacagtatgagtcaatgtgc

SEQ ID NO: 3146618 - DNA, 18 bp, Homo sapiens
tagacatggaggttctaa

SEQ ID NO: 3146619 - DNA, 21 bp, Homo sapiens
tagacatggaggttctaaggc

SEQ ID NO: 3146620 - DNA, 22 bp, Homo sapiens
tagacatggatgcgaggaccac

SEQ ID NO: 3146621 - DNA, 11 bp, Homo sapiens
tagacatgtag

SEQ ID NO: 3146622 - DNA, 13 bp, Homo sapiens
tagacatgtcatg

SEQ ID NO: 3146623 - DNA, 13 bp, Homo sapiens
tagaccaaaataa

SEQ ID NO: 3146624 - DNA, 14 bp, Homo sapiens
tagaccaaggaaca

SEQ ID NO: 3146625 - DNA, 23 bp, Homo sapiens
tagaccacggctgccccttccac

SEQ ID NO: 3146626 - DNA, 17 bp, Homo sapiens
tagaccaggatttctaa

SEQ ID NO: 3146627 - DNA, 13 bp, Homo sapiens
tagacccaggtgg

SEQ ID NO: 3146628 - DNA, 21 bp, Homo sapiens
tagacccaggtggagggcaca

SEQ ID NO: 3146629 - DNA, 23 bp, Homo sapiens
tagacccaggtggagggcacagc

SEQ ID NO: 3146630 - DNA, 16 bp, Homo sapiens
tagaccctgggtgggc

SEQ ID NO: 3146631 - DNA, 19 bp, Homo sapiens
tagacctagggaggacctt

SEQ ID NO: 3146632 - DNA, 17 bp, Homo sapiens
tagaccttgttacttct

SEQ ID NO: 3146633 - DNA, 19 bp, Homo sapiens
tagactatatacatgtgtg

SEQ ID NO: 3146634 - DNA, 23 bp, Homo sapiens
tagactatatacatgtgtgtata

SEQ ID NO: 3146635 - DNA, 17 bp, Homo sapiens
tagactcatcttactgt

SEQ ID NO: 3146636 - DNA, 19 bp, Homo sapiens
tagactcatcttactgtac

SEQ ID NO: 3146637 - DNA, 16 bp, Homo sapiens
tagactctagtattta

SEQ ID NO: 3146638 - DNA, 22 bp, Homo sapiens
tagactctgtctacctggtctg

SEQ ID NO: 3146639 - DNA, 19 bp, Homo sapiens
tagactgaggtataaagac

SEQ ID NO: 3146640 - DNA, 20 bp, Homo sapiens
tagactgaggtataaagaca

SEQ ID NO: 3146641 - DNA, 19 bp, Homo sapiens
tagactgttactttggcaa

SEQ ID NO: 3146642 - DNA, 12 bp, Homo sapiens
tagactttctgt

SEQ ID NO: 3146643 - DNA, 17 bp, Homo sapiens
tagagaaaagtgtatta

SEQ ID NO: 3146644 - DNA, 21 bp, Homo sapiens
tagagaaaccgtcctcttttt

SEQ ID NO: 3146645 - DNA, 13 bp, Homo sapiens
tagagaagctgaa

SEQ ID NO: 3146646 - DNA, 13 bp, Homo sapiens
tagagaaggaccc

SEQ ID NO: 3146647 - DNA, 19 bp, Homo sapiens
tagagaagtatacataagt

SEQ ID NO: 3146648 - DNA, 13 bp, Homo sapiens
tagagaatgcaca

SEQ ID NO: 3146649 - DNA, 15 bp, Homo sapiens
tagagactgtagatt

SEQ ID NO: 3146650 - DNA, 13 bp, Homo sapiens
tagagagaaagag

SEQ ID NO: 3146651 - DNA, 21 bp, Homo sapiens
tagagaggacaatactggggt

SEQ ID NO: 3146652 - DNA, 17 bp, Homo sapiens
tagagaggggactgggg

SEQ ID NO: 3146653 - DNA, 13 bp, Homo sapiens
tagagagggggct

SEQ ID NO: 3146654 - DNA, 20 bp, Homo sapiens
tagagatatatatacttgtg

SEQ ID NO: 3146655 - DNA, 15 bp, Homo sapiens
tagagatctattttt

SEQ ID NO: 3146656 - DNA, 23 bp, Homo sapiens
tagagatgctgtaacttaaaata

SEQ ID NO: 3146657 - DNA, 13 bp, Homo sapiens
tagagatgtgcaa

SEQ ID NO: 3146658 - DNA, 14 bp, Homo sapiens
tagagcaaaattga

SEQ ID NO: 3146659 - DNA, 22 bp, Homo sapiens
tagagcaaaattgatgtgttta

SEQ ID NO: 3146660 - DNA, 22 bp, Homo sapiens
tagagcatatttgccaataaag

SEQ ID NO: 3146661 - DNA, 19 bp, Homo sapiens
tagagcattgccattccct

SEQ ID NO: 3146662 - DNA, 13 bp, Homo sapiens
tagagccagcttg

SEQ ID NO: 3146663 - DNA, 14 bp, Homo sapiens
tagagccagggtct

SEQ ID NO: 3146664 - DNA, 13 bp, Homo sapiens
tagagccctggcc

SEQ ID NO: 3146665 - DNA, 14 bp, Homo sapiens
tagagccctggcca

SEQ ID NO: 3146666 - DNA, 15 bp, Homo sapiens
tagagccctggccag

SEQ ID NO: 3146667 - DNA, 16 bp, Homo sapiens
tagagccctggccagc

SEQ ID NO: 3146668 - DNA, 18 bp, Homo sapiens
tagagccctggccagccc

SEQ ID NO: 3146669 - DNA, 21 bp, Homo sapiens
tagagccctggccagcccttc

SEQ ID NO: 3146670 - DNA, 22 bp, Homo sapiens
tagagccttttatctgcagaac

SEQ ID NO: 3146671 - DNA, 17 bp, Homo sapiens
tagagcgcggctggctc

SEQ ID NO: 3146672 - DNA, 18 bp, Homo sapiens
tagagctgggtggcctgt

SEQ ID NO: 3146673 - DNA, 21 bp, Homo sapiens
tagagcttgtaataaatactg

SEQ ID NO: 3146674 - DNA, 22 bp, Homo sapiens
tagaggaaaaaaatgactaaaa

SEQ ID NO: 3146675 - DNA, 12 bp, Homo sapiens
tagaggaaaatg

SEQ ID NO: 3146676 - DNA, 22 bp, Homo sapiens
tagaggatgaaggctgtgaaaa

SEQ ID NO: 3146677 - DNA, 16 bp, Homo sapiens
tagaggcaacaggatt

SEQ ID NO: 3146678 - DNA, 15 bp, Homo sapiens
tagaggcattgttag

SEQ ID NO: 3146679 - DNA, 12 bp, Homo sapiens
tagaggcctggg

SEQ ID NO: 3146680 - DNA, 18 bp, Homo sapiens
tagaggctccccagggct

SEQ ID NO: 3146681 - DNA, 19 bp, Homo sapiens
tagaggcttctccgccagc

SEQ ID NO: 3146682 - DNA, 20 bp, Homo sapiens
tagagggaggtgtttaaaga

SEQ ID NO: 3146683 - DNA, 13 bp, Homo sapiens
tagagggttcctg

SEQ ID NO: 3146684 - DNA, 17 bp, Homo sapiens
tagaggtatattggaag

SEQ ID NO: 3146685 - DNA, 18 bp, Homo sapiens
tagaggtgggcagctggg

SEQ ID NO: 3146686 - DNA, 20 bp, Homo sapiens
tagaggtgggcagctgggcc

SEQ ID NO: 3146687 - DNA, 15 bp, Homo sapiens
tagagtaaataaact

SEQ ID NO: 3146688 - DNA, 23 bp, Homo sapiens
tagagtaaataaactgtttatat

SEQ ID NO: 3146689 - DNA, 18 bp, Homo sapiens
tagagtaaatacaggtag

SEQ ID NO: 3146690 - DNA, 14 bp, Homo sapiens
tagagtcctcactc

SEQ ID NO: 3146691 - DNA, 21 bp, Homo sapiens
tagagtgtagctgtaagggca

SEQ ID NO: 3146692 - DNA, 16 bp, Homo sapiens
tagagttaagaagctg

SEQ ID NO: 3146693 - DNA, 17 bp, Homo sapiens
tagagttaagaagctgt

SEQ ID NO: 3146694 - DNA, 12 bp, Homo sapiens
tagagttgctga

SEQ ID NO: 3146695 - DNA, 13 bp, Homo sapiens
tagagttgctgag

SEQ ID NO: 3146696 - DNA, 22 bp, Homo sapiens
tagagtttttatgcctttctct

SEQ ID NO: 3146697 - DNA, 21 bp, Homo sapiens
tagagttttttttttctttca

SEQ ID NO: 3146698 - DNA, 15 bp, Homo sapiens
tagataaaaagatgg

SEQ ID NO: 3146699 - DNA, 15 bp, Homo sapiens
tagataatattgttt

SEQ ID NO: 3146700 - DNA, 17 bp, Homo sapiens
tagataatttgaaaaag

SEQ ID NO: 3146701 - DNA, 22 bp, Homo sapiens
tagataccctacgctgtccaga

SEQ ID NO: 3146702 - DNA, 23 bp, Homo sapiens
tagataccctacgctgtccagaa

SEQ ID NO: 3146703 - DNA, 20 bp, Homo sapiens
tagatactactttctctttt

SEQ ID NO: 3146704 - DNA, 12 bp, Homo sapiens
tagatagaaata

SEQ ID NO: 3146705 - DNA, 22 bp, Homo sapiens
tagatagctgcatgtggctttt

SEQ ID NO: 3146706 - DNA, 17 bp, Homo sapiens
tagatagttagaacctg

SEQ ID NO: 3146707 - DNA, 15 bp, Homo sapiens
tagatatatgctctg

SEQ ID NO: 3146708 - DNA, 19 bp, Homo sapiens
tagatatatgctctgcatg

SEQ ID NO: 3146709 - DNA, 15 bp, Homo sapiens
tagatatgaaagctg

SEQ ID NO: 3146710 - DNA, 17 bp, Homo sapiens
tagatatttggcttaaa

SEQ ID NO: 3146711 - DNA, 20 bp, Homo sapiens
tagatattttcacaatgtca

SEQ ID NO: 3146712 - DNA, 24 bp, Homo sapiens
tagatattttcacaatgtcagtat

SEQ ID NO: 3146713 - DNA, 17 bp, Homo sapiens
tagatcacgagatcaag

SEQ ID NO: 3146714 - DNA, 19 bp, Homo sapiens
tagatcagatgctccaaga

SEQ ID NO: 3146715 - DNA, 14 bp, Homo sapiens
tagatcagtatttc

SEQ ID NO: 3146716 - DNA, 14 bp, Homo sapiens
tagatcataaggct

SEQ ID NO: 3146717 - DNA, 15 bp, Homo sapiens
tagatcataaggctt

SEQ ID NO: 3146718 - DNA, 16 bp, Homo sapiens
tagatccacacacaga

SEQ ID NO: 3146719 - DNA, 21 bp, Homo sapiens
tagatcctaagatgtgttctt

SEQ ID NO: 3146720 - DNA, 17 bp, Homo sapiens
tagatcgcttgagccca

SEQ ID NO: 3146721 - DNA, 18 bp, Homo sapiens
tagatcgcttgagcccag

SEQ ID NO: 3146722 - DNA, 19 bp, Homo sapiens
tagatcgcttgagcccagg

SEQ ID NO: 3146723 - DNA, 21 bp, Homo sapiens
tagatctgatggtgagctggg

SEQ ID NO: 3146724 - DNA, 23 bp, Homo sapiens
tagatcttatattggtttgcaca

SEQ ID NO: 3146725 - DNA, 13 bp, Homo sapiens
tagatgaccaaaa

SEQ ID NO: 3146726 - DNA, 16 bp, Homo sapiens
tagatgagggtgactg

SEQ ID NO: 3146727 - DNA, 21 bp, Homo sapiens
tagatgattaaataagattct

SEQ ID NO: 3146728 - DNA, 18 bp, Homo sapiens
tagatgattttttgaaag

SEQ ID NO: 3146729 - DNA, 19 bp, Homo sapiens
tagatgattttttgaaagt

SEQ ID NO: 3146730 - DNA, 10 bp, Homo sapiens
tagatgctga

SEQ ID NO: 3146731 - DNA, 14 bp, Homo sapiens
tagatgctgactgt

SEQ ID NO: 3146732 - DNA, 13 bp, Homo sapiens
tagatgggtgggg

SEQ ID NO: 3146733 - DNA, 21 bp, Homo sapiens
tagatggttacactgttagaa

SEQ ID NO: 3146734 - DNA, 17 bp, Homo sapiens
tagatgtagtatttttt

SEQ ID NO: 3146735 - DNA, 12 bp, Homo sapiens
tagatgtggttt

SEQ ID NO: 3146736 - DNA, 18 bp, Homo sapiens
tagatgttccagtaatct

SEQ ID NO: 3146737 - DNA, 14 bp, Homo sapiens
tagatgttctagga

SEQ ID NO: 3146738 - DNA, 15 bp, Homo sapiens
tagatgttctaggat

SEQ ID NO: 3146739 - DNA, 14 bp, Homo sapiens
tagatgtttaacaa

SEQ ID NO: 3146740 - DNA, 19 bp, Homo sapiens
tagatgtttaacaaatcta

SEQ ID NO: 3146741 - DNA, 13 bp, Homo sapiens
tagatgtttcaca

SEQ ID NO: 3146742 - DNA, 21 bp, Homo sapiens
tagatgttttggtagattaaa

SEQ ID NO: 3146743 - DNA, 15 bp, Homo sapiens
tagattaaatataga

SEQ ID NO: 3146744 - DNA, 15 bp, Homo sapiens
tagattaatggcact

SEQ ID NO: 3146745 - DNA, 16 bp, Homo sapiens
tagattaatggcactg

SEQ ID NO: 3146746 - DNA, 18 bp, Homo sapiens
tagattaatggcactgat

SEQ ID NO: 3146747 - DNA, 14 bp, Homo sapiens
tagattatatcaaa

SEQ ID NO: 3146748 - DNA, 24 bp, Homo sapiens
tagattcaagttgtgtctgaaaat

SEQ ID NO: 3146749 - DNA, 23 bp, Homo sapiens
tagattcctcttgcctctctcag

SEQ ID NO: 3146750 - DNA, 11 bp, Homo sapiens
tagattctaaa

SEQ ID NO: 3146751 - DNA, 17 bp, Homo sapiens
tagattctaaagattct

SEQ ID NO: 3146752 - DNA, 19 bp, Homo sapiens
tagattctctgtgtctaag

SEQ ID NO: 3146753 - DNA, 21 bp, Homo sapiens
tagattctctgtgtctaagat

SEQ ID NO: 3146754 - DNA, 23 bp, Homo sapiens
tagattctctgtgtctaagattc

SEQ ID NO: 3146755 - DNA, 18 bp, Homo sapiens
tagatttcatagttcaga

SEQ ID NO: 3146756 - DNA, 19 bp, Homo sapiens
tagatttcatagttcagaa

SEQ ID NO: 3146757 - DNA, 18 bp, Homo sapiens
tagatttggcatctcctg

SEQ ID NO: 3146758 - DNA, 17 bp, Homo sapiens
tagattttctggttcta

SEQ ID NO: 3146759 - DNA, 19 bp, Homo sapiens
tagattttctggttctaac

SEQ ID NO: 3146760 - DNA, 21 bp, Homo sapiens
tagcaaagattaaatgtgtca

SEQ ID NO: 3146761 - DNA, 15 bp, Homo sapiens
tagcaaagcaaaagg

SEQ ID NO: 3146762 - DNA, 23 bp, Homo sapiens
tagcaaagcaaaaggctgagaag

SEQ ID NO: 3146763 - DNA, 15 bp, Homo sapiens
tagcaacagagcact

SEQ ID NO: 3146764 - DNA, 13 bp, Homo sapiens
tagcaagctggcc

SEQ ID NO: 3146765 - DNA, 14 bp, Homo sapiens
tagcaagctggcct

SEQ ID NO: 3146766 - DNA, 15 bp, Homo sapiens
tagcaagctggcctc

SEQ ID NO: 3146767 - DNA, 16 bp, Homo sapiens
tagcaaggcatgatgt

SEQ ID NO: 3146768 - DNA, 21 bp, Homo sapiens
tagcaatccatgttagttttt

SEQ ID NO: 3146769 - DNA, 15 bp, Homo sapiens
tagcaattttctttg

SEQ ID NO: 3146770 - DNA, 14 bp, Homo sapiens
tagcacagatttta

SEQ ID NO: 3146771 - DNA, 18 bp, Homo sapiens
tagcacagattttaattg

SEQ ID NO: 3146772 - DNA, 19 bp, Homo sapiens
tagcacagattttaattgt

SEQ ID NO: 3146773 - DNA, 22 bp, Homo sapiens
tagcacagattttaattgtcat

SEQ ID NO: 3146774 - DNA, 16 bp, Homo sapiens
tagcacctttcaacca

SEQ ID NO: 3146775 - DNA, 19 bp, Homo sapiens
tagcactgttgatgtatct

SEQ ID NO: 3146776 - DNA, 20 bp, Homo sapiens
tagcactttcattgccagtg

SEQ ID NO: 3146777 - DNA, 17 bp, Homo sapiens
tagcactttgaaatacc

SEQ ID NO: 3146778 - DNA, 16 bp, Homo sapiens
tagcagaagaaaggaa

SEQ ID NO: 3146779 - DNA, 17 bp, Homo sapiens
tagcagaagaaaggaac

SEQ ID NO: 3146780 - DNA, 18 bp, Homo sapiens
tagcagacagaaactgga

SEQ ID NO: 3146781 - DNA, 19 bp, Homo sapiens
tagcagagaatgaaagggc

SEQ ID NO: 3146782 - DNA, 13 bp, Homo sapiens
tagcagaggggcc

SEQ ID NO: 3146783 - DNA, 15 bp, Homo sapiens
tagcagaggggccag

SEQ ID NO: 3146784 - DNA, 23 bp, Homo sapiens
tagcagagtccttattcttctca

SEQ ID NO: 3146785 - DNA, 17 bp, Homo sapiens
tagcagatctgttttgt

SEQ ID NO: 3146786 - DNA, 14 bp, Homo sapiens
tagcagatggagta

SEQ ID NO: 3146787 - DNA, 14 bp, Homo sapiens
tagcagatggtttc

SEQ ID NO: 3146788 - DNA, 23 bp, Homo sapiens
tagcagattgtttcctcttccaa

SEQ ID NO: 3146789 - DNA, 18 bp, Homo sapiens
tagcagattttaattttg

SEQ ID NO: 3146790 - DNA, 20 bp, Homo sapiens
tagcagcaaaaatataaaat

SEQ ID NO: 3146791 - DNA, 18 bp, Homo sapiens
tagcagccagttcaaaaa

SEQ ID NO: 3146792 - DNA, 10 bp, Homo sapiens
tagcagctgg

SEQ ID NO: 3146793 - DNA, 11 bp, Homo sapiens
tagcagggaaa

SEQ ID NO: 3146794 - DNA, 18 bp, Homo sapiens
tagcaggggcaccttccg

SEQ ID NO: 3146795 - DNA, 15 bp, Homo sapiens
tagcagttataacag

SEQ ID NO: 3146796 - DNA, 16 bp, Homo sapiens
tagcagttataacaga

SEQ ID NO: 3146797 - DNA, 21 bp, Homo sapiens
tagcagttataacagatgtga

SEQ ID NO: 3146798 - DNA, 22 bp, Homo sapiens
tagcagttataacagatgtgaa

SEQ ID NO: 3146799 - DNA, 23 bp, Homo sapiens
tagcagttataacagatgtgaaa

SEQ ID NO: 3146800 - DNA, 13 bp, Homo sapiens
tagcataaataaa

SEQ ID NO: 3146801 - DNA, 16 bp, Homo sapiens
tagcataaataaaact

SEQ ID NO: 3146802 - DNA, 13 bp, Homo sapiens
tagcataactgta

SEQ ID NO: 3146803 - DNA, 21 bp, Homo sapiens
tagcatacatttataatgttt

SEQ ID NO: 3146804 - DNA, 12 bp, Homo sapiens
tagcatatcaat

SEQ ID NO: 3146805 - DNA, 20 bp, Homo sapiens
tagcatgggtccaagagaca

SEQ ID NO: 3146806 - DNA, 22 bp, Homo sapiens
tagcatgggtccaagagacatg

SEQ ID NO: 3146807 - DNA, 12 bp, Homo sapiens
tagcatgtaatg

SEQ ID NO: 3146808 - DNA, 13 bp, Homo sapiens
tagcatgtttgct

SEQ ID NO: 3146809 - DNA, 16 bp, Homo sapiens
tagcattaactaatct

SEQ ID NO: 3146810 - DNA, 11 bp, Homo sapiens
tagcattctgt

SEQ ID NO: 3146811 - DNA, 18 bp, Homo sapiens
tagcattgataatcttca

SEQ ID NO: 3146812 - DNA, 16 bp, Homo sapiens
tagcattgtcttgttc

SEQ ID NO: 3146813 - DNA, 19 bp, Homo sapiens
tagcattgtcttgttctgt

SEQ ID NO: 3146814 - DNA, 17 bp, Homo sapiens
tagcatttcattcttct

SEQ ID NO: 3146815 - DNA, 20 bp, Homo sapiens
tagccaactgtttccctgct

SEQ ID NO: 3146816 - DNA, 21 bp, Homo sapiens
tagccaactgtttccctgctg

SEQ ID NO: 3146817 - DNA, 22 bp, Homo sapiens
tagccaactgtttccctgctga

SEQ ID NO: 3146818 - DNA, 20 bp, Homo sapiens
tagccacatttggaatactt

SEQ ID NO: 3146819 - DNA, 22 bp, Homo sapiens
tagccactagtaagtaattatg

SEQ ID NO: 3146820 - DNA, 19 bp, Homo sapiens
tagccagcacttgtatata

SEQ ID NO: 3146821 - DNA, 16 bp, Homo sapiens
tagccaggagtctgtg

SEQ ID NO: 3146822 - DNA, 19 bp, Homo sapiens
tagccaggagtctgtgctc

SEQ ID NO: 3146823 - DNA, 20 bp, Homo sapiens
tagccaggagtctgtgctct

SEQ ID NO: 3146824 - DNA, 15 bp, Homo sapiens
tagccaggatcatgg

SEQ ID NO: 3146825 - DNA, 16 bp, Homo sapiens
tagccaggatggtctc

SEQ ID NO: 3146826 - DNA, 22 bp, Homo sapiens
tagccagggggactagcccctg

SEQ ID NO: 3146827 - DNA, 15 bp, Homo sapiens
tagccagtgaaacac

SEQ ID NO: 3146828 - DNA, 16 bp, Homo sapiens
tagccagtgaaacact

SEQ ID NO: 3146829 - DNA, 14 bp, Homo sapiens
tagccagtgacttt

SEQ ID NO: 3146830 - DNA, 23 bp, Homo sapiens
tagccagtgctccaggcacccag

SEQ ID NO: 3146831 - DNA, 15 bp, Homo sapiens
tagccagttcaaagt

SEQ ID NO: 3146832 - DNA, 16 bp, Homo sapiens
tagccagttcaaagtg

SEQ ID NO: 3146833 - DNA, 19 bp, Homo sapiens
tagccagttcaaagtgtat

SEQ ID NO: 3146834 - DNA, 24 bp, Homo sapiens
tagccataattttgcatactgaaa

SEQ ID NO: 3146835 - DNA, 23 bp, Homo sapiens
tagccatgatttgtcccagcctg

SEQ ID NO: 3146836 - DNA, 15 bp, Homo sapiens
tagccatggctcagg

SEQ ID NO: 3146837 - DNA, 20 bp, Homo sapiens
tagccatggctcaggcaagc

SEQ ID NO: 3146838 - DNA, 17 bp, Homo sapiens
tagcccaagaggtctga

SEQ ID NO: 3146839 - DNA, 20 bp, Homo sapiens
tagcccaagaggtctgagcc

SEQ ID NO: 3146840 - DNA, 18 bp, Homo sapiens
tagcccaatgaaatgaat

SEQ ID NO: 3146841 - DNA, 18 bp, Homo sapiens
tagcccaccctgctgcct

SEQ ID NO: 3146842 - DNA, 17 bp, Homo sapiens
tagcccagactctgagc

SEQ ID NO: 3146843 - DNA, 12 bp, Homo sapiens
tagcccaggaga

SEQ ID NO: 3146844 - DNA, 16 bp, Homo sapiens
tagcccaggagagaga

SEQ ID NO: 3146845 - DNA, 16 bp, Homo sapiens
tagcccatccctgcct

SEQ ID NO: 3146846 - DNA, 17 bp, Homo sapiens
tagcccatccctgcctg

SEQ ID NO: 3146847 - DNA, 21 bp, Homo sapiens
tagcccatccctgcctggtca

SEQ ID NO: 3146848 - DNA, 21 bp, Homo sapiens
tagccccagagatgccagccc

SEQ ID NO: 3146849 - DNA, 18 bp, Homo sapiens
tagccccctggcctctgt

SEQ ID NO: 3146850 - DNA, 15 bp, Homo sapiens
tagccctccccctca

SEQ ID NO: 3146851 - DNA, 18 bp, Homo sapiens
tagccctccccctcaacc

SEQ ID NO: 3146852 - DNA, 13 bp, Homo sapiens
tagccctttaaaa

SEQ ID NO: 3146853 - DNA, 14 bp, Homo sapiens
tagccctttctgtg

SEQ ID NO: 3146854 - DNA, 17 bp, Homo sapiens
tagccgactgcgctgct

SEQ ID NO: 3146855 - DNA, 14 bp, Homo sapiens
tagccgcaccctgc

SEQ ID NO: 3146856 - DNA, 22 bp, Homo sapiens
tagccgcaccctgcacctgctg

SEQ ID NO: 3146857 - DNA, 17 bp, Homo sapiens
tagccgtccatggcacc

SEQ ID NO: 3146858 - DNA, 18 bp, Homo sapiens
tagccgtccatggcacca

SEQ ID NO: 3146859 - DNA, 16 bp, Homo sapiens
tagcctaaagggcagg

SEQ ID NO: 3146860 - DNA, 20 bp, Homo sapiens
tagcctaaggctcctgtttt

SEQ ID NO: 3146861 - DNA, 12 bp, Homo sapiens
tagcctccctga

SEQ ID NO: 3146862 - DNA, 20 bp, Homo sapiens
tagcctccgtttatgggcct

SEQ ID NO: 3146863 - DNA, 21 bp, Homo sapiens
tagcctccgtttatgggcctt

SEQ ID NO: 3146864 - DNA, 21 bp, Homo sapiens
tagcctgaaggattctgggaa

SEQ ID NO: 3146865 - DNA, 20 bp, Homo sapiens
tagcctgcctcagtggcagc

SEQ ID NO: 3146866 - DNA, 22 bp, Homo sapiens
tagcctggatattattcttgta

SEQ ID NO: 3146867 - DNA, 13 bp, Homo sapiens
tagcctgggccag

SEQ ID NO: 3146868 - DNA, 15 bp, Homo sapiens
tagcctgtttcttcc

SEQ ID NO: 3146869 - DNA, 15 bp, Homo sapiens
tagccttgtgccctg

SEQ ID NO: 3146870 - DNA, 18 bp, Homo sapiens
tagccttgtgccctgccc

SEQ ID NO: 3146871 - DNA, 19 bp, Homo sapiens
tagccttgtgccctgcccc

SEQ ID NO: 3146872 - DNA, 18 bp, Homo sapiens
tagcctttacctgtgaag

SEQ ID NO: 3146873 - DNA, 22 bp, Homo sapiens
tagcctttacctgtgaagtgtt

SEQ ID NO: 3146874 - DNA, 18 bp, Homo sapiens
tagcctttggctctggag

SEQ ID NO: 3146875 - DNA, 22 bp, Homo sapiens
tagcctttttgtataaaataga

SEQ ID NO: 3146876 - DNA, 17 bp, Homo sapiens
tagcgatctctcctggc

SEQ ID NO: 3146877 - DNA, 20 bp, Homo sapiens
tagcgatctctcctggccta

SEQ ID NO: 3146878 - DNA, 15 bp, Homo sapiens
tagcgatttcagacc

SEQ ID NO: 3146879 - DNA, 16 bp, Homo sapiens
tagcgatttcagacct

SEQ ID NO: 3146880 - DNA, 19 bp, Homo sapiens
tagcgccgtgctgtaaata

SEQ ID NO: 3146881 - DNA, 18 bp, Homo sapiens
tagcggagcccagcctgg

SEQ ID NO: 3146882 - DNA, 17 bp, Homo sapiens
tagcggcaagaagccgt

SEQ ID NO: 3146883 - DNA, 22 bp, Homo sapiens
tagcgtttaaggtgagcataaa

SEQ ID NO: 3146884 - DNA, 20 bp, Homo sapiens
tagctaaacggattccaaag

SEQ ID NO: 3146885 - DNA, 12 bp, Homo sapiens
tagctaatgtaa

SEQ ID NO: 3146886 - DNA, 20 bp, Homo sapiens
tagctacaggaagcacccca

SEQ ID NO: 3146887 - DNA, 15 bp, Homo sapiens
tagctacatcagttt

SEQ ID NO: 3146888 - DNA, 20 bp, Homo sapiens
tagctacccaaaagagaaaa

SEQ ID NO: 3146889 - DNA, 18 bp, Homo sapiens
tagctatatccatgtact

SEQ ID NO: 3146890 - DNA, 20 bp, Homo sapiens
tagctatatccatgtactgt

SEQ ID NO: 3146891 - DNA, 21 bp, Homo sapiens
tagctatatccatgtactgta

SEQ ID NO: 3146892 - DNA, 14 bp, Homo sapiens
tagctatcagaaga

SEQ ID NO: 3146893 - DNA, 22 bp, Homo sapiens
tagctcaagtttaaaagccatg

SEQ ID NO: 3146894 - DNA, 11 bp, Homo sapiens
tagctcagttt

SEQ ID NO: 3146895 - DNA, 14 bp, Homo sapiens
tagctcccagctag

SEQ ID NO: 3146896 - DNA, 21 bp, Homo sapiens
tagctccccgcttctgcctgc

SEQ ID NO: 3146897 - DNA, 16 bp, Homo sapiens
tagctcctccccttcc

SEQ ID NO: 3146898 - DNA, 14 bp, Homo sapiens
tagctcctgtggcc

SEQ ID NO: 3146899 - DNA, 14 bp, Homo sapiens
tagctccttggagc

SEQ ID NO: 3146900 - DNA, 14 bp, Homo sapiens
tagctctccttccc

SEQ ID NO: 3146901 - DNA, 17 bp, Homo sapiens
tagctctctaggcctct

SEQ ID NO: 3146902 - DNA, 12 bp, Homo sapiens
tagctctgcctc

SEQ ID NO: 3146903 - DNA, 14 bp, Homo sapiens
tagctctgttcttt

SEQ ID NO: 3146904 - DNA, 15 bp, Homo sapiens
tagctgaagaattga

SEQ ID NO: 3146905 - DNA, 23 bp, Homo sapiens
tagctgatgaacttattctgtag

SEQ ID NO: 3146906 - DNA, 16 bp, Homo sapiens
tagctgccagtgctgg

SEQ ID NO: 3146907 - DNA, 23 bp, Homo sapiens
tagctgcctagcaagctggcctc

SEQ ID NO: 3146908 - DNA, 11 bp, Homo sapiens
tagctggcagg

SEQ ID NO: 3146909 - DNA, 18 bp, Homo sapiens
tagctgggaaagcataaa

SEQ ID NO: 3146910 - DNA, 11 bp, Homo sapiens
tagctgggact

SEQ ID NO: 3146911 - DNA, 12 bp, Homo sapiens
tagctgggacta

SEQ ID NO: 3146912 - DNA, 14 bp, Homo sapiens
tagctgggactaca

SEQ ID NO: 3146913 - DNA, 15 bp, Homo sapiens
tagctgggactacag

SEQ ID NO: 3146914 - DNA, 19 bp, Homo sapiens
tagctgggactacaggcac

SEQ ID NO: 3146915 - DNA, 15 bp, Homo sapiens
tagctgggattacag

SEQ ID NO: 3146916 - DNA, 22 bp, Homo sapiens
tagctgggcggggctcgaggct

SEQ ID NO: 3146917 - DNA, 14 bp, Homo sapiens
tagctggtggtttc

SEQ ID NO: 3146918 - DNA, 12 bp, Homo sapiens
tagctgtaaaac

SEQ ID NO: 3146919 - DNA, 19 bp, Homo sapiens
tagctgtaagggcagtgcc

SEQ ID NO: 3146920 - DNA, 20 bp, Homo sapiens
tagctgtggcctcaccctga

SEQ ID NO: 3146921 - DNA, 13 bp, Homo sapiens
tagctgtgggggt

SEQ ID NO: 3146922 - DNA, 14 bp, Homo sapiens
tagctgtgtgaaat

SEQ ID NO: 3146923 - DNA, 15 bp, Homo sapiens
tagcttaactaattt

SEQ ID NO: 3146924 - DNA, 19 bp, Homo sapiens
tagcttacctgacacaaga

SEQ ID NO: 3146925 - DNA, 17 bp, Homo sapiens
tagcttagtttcagaga

SEQ ID NO: 3146926 - DNA, 21 bp, Homo sapiens
tagcttagtttcagagacctt

SEQ ID NO: 3146927 - DNA, 18 bp, Homo sapiens
tagcttatctttctttcc

SEQ ID NO: 3146928 - DNA, 19 bp, Homo sapiens
tagcttatctttctttcca

SEQ ID NO: 3146929 - DNA, 12 bp, Homo sapiens
tagcttccatga

SEQ ID NO: 3146930 - DNA, 13 bp, Homo sapiens
tagcttctgcttt

SEQ ID NO: 3146931 - DNA, 23 bp, Homo sapiens
tagcttgacacagtcagcatgct

SEQ ID NO: 3146932 - DNA, 13 bp, Homo sapiens
tagcttgtatagt

SEQ ID NO: 3146933 - DNA, 17 bp, Homo sapiens
tagcttgtatagtgtaa

SEQ ID NO: 3146934 - DNA, 19 bp, Homo sapiens
tagcttgtatagtgtaaaa

SEQ ID NO: 3146935 - DNA, 15 bp, Homo sapiens
tagctttaccctcag

SEQ ID NO: 3146936 - DNA, 17 bp, Homo sapiens
tagctttagaccctggg

SEQ ID NO: 3146937 - DNA, 14 bp, Homo sapiens
tagctttattcttc

SEQ ID NO: 3146938 - DNA, 18 bp, Homo sapiens
tagctttattttttaagt

SEQ ID NO: 3146939 - DNA, 15 bp, Homo sapiens
tagctttccctgtgc

SEQ ID NO: 3146940 - DNA, 16 bp, Homo sapiens
tagctttccctgtgcc

SEQ ID NO: 3146941 - DNA, 14 bp, Homo sapiens
tagctttcctggtc

SEQ ID NO: 3146942 - DNA, 13 bp, Homo sapiens
tagctttctcagg

SEQ ID NO: 3146943 - DNA, 20 bp, Homo sapiens
tagcttttaggaaaatcact

SEQ ID NO: 3146944 - DNA, 14 bp, Homo sapiens
tagcttttattgta

SEQ ID NO: 3146945 - DNA, 22 bp, Homo sapiens
tagcttttcttaaagactgaaa

SEQ ID NO: 3146946 - DNA, 20 bp, Homo sapiens
tagcttttgccagtattatg

SEQ ID NO: 3146947 - DNA, 21 bp, Homo sapiens
taggaaaatcactttgtctaa

SEQ ID NO: 3146948 - DNA, 19 bp, Homo sapiens
taggaaataaaacctttca

SEQ ID NO: 3146949 - DNA, 20 bp, Homo sapiens
taggaaataaaacctttcaa

SEQ ID NO: 3146950 - DNA, 23 bp, Homo sapiens
taggaaatggctttgtgattcaa

SEQ ID NO: 3146951 - DNA, 22 bp, Homo sapiens
taggaactgtctcaaaaggatg

SEQ ID NO: 3146952 - DNA, 14 bp, Homo sapiens
taggaacttcagag

SEQ ID NO: 3146953 - DNA, 15 bp, Homo sapiens
taggaacttcagaga

SEQ ID NO: 3146954 - DNA, 23 bp, Homo sapiens
taggaagaacgttttttcctcag

SEQ ID NO: 3146955 - DNA, 22 bp, Homo sapiens
taggaagaagtggtactagtgt

SEQ ID NO: 3146956 - DNA, 24 bp, Homo sapiens
taggaagaagtggtactagtgtgg

SEQ ID NO: 3146957 - DNA, 19 bp, Homo sapiens
taggaagagaaaccaggga

SEQ ID NO: 3146958 - DNA, 18 bp, Homo sapiens
taggaagagcaggactcc

SEQ ID NO: 3146959 - DNA, 15 bp, Homo sapiens
taggaagggaccaag

SEQ ID NO: 3146960 - DNA, 19 bp, Homo sapiens
taggaagtgtaacagctga

SEQ ID NO: 3146961 - DNA, 22 bp, Homo sapiens
taggaagtgtaacagctgaggt

SEQ ID NO: 3146962 - DNA, 14 bp, Homo sapiens
taggaatagaggaa

SEQ ID NO: 3146963 - DNA, 16 bp, Homo sapiens
taggaatagaggaaga

SEQ ID NO: 3146964 - DNA, 14 bp, Homo sapiens
taggaatcccagag

SEQ ID NO: 3146965 - DNA, 18 bp, Homo sapiens
taggacaatcagtcccct

SEQ ID NO: 3146966 - DNA, 20 bp, Homo sapiens
taggacaatcagtcccctcc

SEQ ID NO: 3146967 - DNA, 19 bp, Homo sapiens
taggacacagttcctggga

SEQ ID NO: 3146968 - DNA, 18 bp, Homo sapiens
taggacatactgcatgta

SEQ ID NO: 3146969 - DNA, 18 bp, Homo sapiens
taggaccaagcatcttgg

SEQ ID NO: 3146970 - DNA, 16 bp, Homo sapiens
taggaccactcagccc

SEQ ID NO: 3146971 - DNA, 17 bp, Homo sapiens
taggaccactcagcccc

SEQ ID NO: 3146972 - DNA, 19 bp, Homo sapiens
taggaccatggttaagagt

SEQ ID NO: 3146973 - DNA, 15 bp, Homo sapiens
taggacggctgcttc

SEQ ID NO: 3146974 - DNA, 16 bp, Homo sapiens
taggacgttggcctca

SEQ ID NO: 3146975 - DNA, 14 bp, Homo sapiens
taggactctgaggc

SEQ ID NO: 3146976 - DNA, 13 bp, Homo sapiens
taggactgaggag

SEQ ID NO: 3146977 - DNA, 21 bp, Homo sapiens
taggagaagaggcatcctgcc

SEQ ID NO: 3146978 - DNA, 14 bp, Homo sapiens
taggagagaccgag

SEQ ID NO: 3146979 - DNA, 22 bp, Homo sapiens
taggagataccaggttgaaaga

SEQ ID NO: 3146980 - DNA, 17 bp, Homo sapiens
taggagctaaggctcta

SEQ ID NO: 3146981 - DNA, 16 bp, Homo sapiens
taggagctgaggtttc

SEQ ID NO: 3146982 - DNA, 15 bp, Homo sapiens
taggaggctcctcct

SEQ ID NO: 3146983 - DNA, 14 bp, Homo sapiens
taggagggagacac

SEQ ID NO: 3146984 - DNA, 21 bp, Homo sapiens
taggagggagttatctaaaag

SEQ ID NO: 3146985 - DNA, 21 bp, Homo sapiens
taggagtgggtgacaagagcc

SEQ ID NO: 3146986 - DNA, 19 bp, Homo sapiens
taggagtggtgatttgaaa

SEQ ID NO: 3146987 - DNA, 17 bp, Homo sapiens
taggagtgtgtgatttt

SEQ ID NO: 3146988 - DNA, 17 bp, Homo sapiens
taggagttcgagaccag

SEQ ID NO: 3146989 - DNA, 13 bp, Homo sapiens
taggatagcattt

SEQ ID NO: 3146990 - DNA, 19 bp, Homo sapiens
taggatagctaactgtaaa

SEQ ID NO: 3146991 - DNA, 20 bp, Homo sapiens
taggatatttgagtcacttg

SEQ ID NO: 3146992 - DNA, 17 bp, Homo sapiens
taggatggttctgtgac

SEQ ID NO: 3146993 - DNA, 12 bp, Homo sapiens
taggatttaaca

SEQ ID NO: 3146994 - DNA, 14 bp, Homo sapiens
taggatttttagaa

SEQ ID NO: 3146995 - DNA, 14 bp, Homo sapiens
taggcaagcaggac

SEQ ID NO: 3146996 - DNA, 15 bp, Homo sapiens
taggcaagcaggacc

SEQ ID NO: 3146997 - DNA, 17 bp, Homo sapiens
taggcaagcaggacctg

SEQ ID NO: 3146998 - DNA, 18 bp, Homo sapiens
taggcaagcaggacctgg

SEQ ID NO: 3146999 - DNA, 20 bp, Homo sapiens
taggcaagcaggacctggca

SEQ ID NO: 3147000 - DNA, 18 bp, Homo sapiens
taggcactcttaaatgat

SEQ ID NO: 3147001 - DNA, 21 bp, Homo sapiens
taggcactgtagttctaagac

SEQ ID NO: 3147002 - DNA, 22 bp, Homo sapiens
taggcactgtagttctaagact

SEQ ID NO: 3147003 - DNA, 14 bp, Homo sapiens
taggccatgaaaaa

SEQ ID NO: 3147004 - DNA, 17 bp, Homo sapiens
taggcccaggcctgggt

SEQ ID NO: 3147005 - DNA, 19 bp, Homo sapiens
taggcccaggcctgggttt

SEQ ID NO: 3147006 - DNA, 16 bp, Homo sapiens
taggccccagaggccc

SEQ ID NO: 3147007 - DNA, 17 bp, Homo sapiens
taggccccagaggccct

SEQ ID NO: 3147008 - DNA, 21 bp, Homo sapiens
taggccccagaggccctggag

SEQ ID NO: 3147009 - DNA, 13 bp, Homo sapiens
taggcccttgtcc

SEQ ID NO: 3147010 - DNA, 13 bp, Homo sapiens
taggcctgggtgc

SEQ ID NO: 3147011 - DNA, 23 bp, Homo sapiens
taggccttcctctctccagatgt

SEQ ID NO: 3147012 - DNA, 17 bp, Homo sapiens
taggcggcgatttttgt

SEQ ID NO: 3147013 - DNA, 20 bp, Homo sapiens
taggcggcgatttttgtatg

SEQ ID NO: 3147014 - DNA, 21 bp, Homo sapiens
taggcgggcggtcaggggttc

SEQ ID NO: 3147015 - DNA, 15 bp, Homo sapiens
taggctaaaaggtct

SEQ ID NO: 3147016 - DNA, 18 bp, Homo sapiens
taggctatttgtaaatct

SEQ ID NO: 3147017 - DNA, 18 bp, Homo sapiens
taggctctgcacagatgg

SEQ ID NO: 3147018 - DNA, 20 bp, Homo sapiens
taggctctgcacagatggat

SEQ ID NO: 3147019 - DNA, 20 bp, Homo sapiens
taggctggggcggggcccag

SEQ ID NO: 3147020 - DNA, 22 bp, Homo sapiens
taggctggggcggggcccagga

SEQ ID NO: 3147021 - DNA, 21 bp, Homo sapiens
taggctgtaactactttataa

SEQ ID NO: 3147022 - DNA, 21 bp, Homo sapiens
taggctgttccttgtactctt

SEQ ID NO: 3147023 - DNA, 18 bp, Homo sapiens
taggcttagtttgtgtgt

SEQ ID NO: 3147024 - DNA, 20 bp, Homo sapiens
taggcttcaggccgagccag

SEQ ID NO: 3147025 - DNA, 18 bp, Homo sapiens
taggcttttaagaaacac

SEQ ID NO: 3147026 - DNA, 14 bp, Homo sapiens
taggcttttaccat

SEQ ID NO: 3147027 - DNA, 16 bp, Homo sapiens
tagggaaaagttcata

SEQ ID NO: 3147028 - DNA, 15 bp, Homo sapiens
tagggaactctgggg

SEQ ID NO: 3147029 - DNA, 20 bp, Homo sapiens
tagggaagaaaactatcctg

SEQ ID NO: 3147030 - DNA, 22 bp, Homo sapiens
tagggaataaaatcctaagaca

SEQ ID NO: 3147031 - DNA, 14 bp, Homo sapiens
tagggaatctggat

SEQ ID NO: 3147032 - DNA, 18 bp, Homo sapiens
tagggacctcagaggttt

SEQ ID NO: 3147033 - DNA, 13 bp, Homo sapiens
tagggacttaaaa

SEQ ID NO: 3147034 - DNA, 22 bp, Homo sapiens
tagggaggaccttatctgtgcg

SEQ ID NO: 3147035 - DNA, 13 bp, Homo sapiens
tagggaggcagcc

SEQ ID NO: 3147036 - DNA, 22 bp, Homo sapiens
tagggagttcatctggagggtt

SEQ ID NO: 3147037 - DNA, 21 bp, Homo sapiens
tagggatgcggatcctgctgg

SEQ ID NO: 3147038 - DNA, 11 bp, Homo sapiens
tagggcagctt

SEQ ID NO: 3147039 - DNA, 13 bp, Homo sapiens
tagggcagcttgc

SEQ ID NO: 3147040 - DNA, 11 bp, Homo sapiens
tagggccaggc

SEQ ID NO: 3147041 - DNA, 14 bp, Homo sapiens
tagggccaggcagg

SEQ ID NO: 3147042 - DNA, 23 bp, Homo sapiens
tagggctacaaaacctgatgtta

SEQ ID NO: 3147043 - DNA, 15 bp, Homo sapiens
taggggaacagacca

SEQ ID NO: 3147044 - DNA, 22 bp, Homo sapiens
taggggcagggatgggggtggc

SEQ ID NO: 3147045 - DNA, 12 bp, Homo sapiens
taggggccacct

SEQ ID NO: 3147046 - DNA, 15 bp, Homo sapiens
tagggggctttctgg

SEQ ID NO: 3147047 - DNA, 17 bp, Homo sapiens
taggggtcaggctccat

SEQ ID NO: 3147048 - DNA, 12 bp, Homo sapiens
tagggtaaatca

SEQ ID NO: 3147049 - DNA, 16 bp, Homo sapiens
tagggtaaatcagtaa

SEQ ID NO: 3147050 - DNA, 22 bp, Homo sapiens
tagggtaaatcagtaagaggtg

SEQ ID NO: 3147051 - DNA, 18 bp, Homo sapiens
tagggtacatttataatt

SEQ ID NO: 3147052 - DNA, 22 bp, Homo sapiens
tagggtacatttataattgcat

SEQ ID NO: 3147053 - DNA, 16 bp, Homo sapiens
tagggtactaaattta

SEQ ID NO: 3147054 - DNA, 18 bp, Homo sapiens
tagggtactaaatttaaa

SEQ ID NO: 3147055 - DNA, 13 bp, Homo sapiens
tagggtagaatga

SEQ ID NO: 3147056 - DNA, 16 bp, Homo sapiens
tagggtcttgggggtc

SEQ ID NO: 3147057 - DNA, 22 bp, Homo sapiens
tagggtgaaccacttcattctg

SEQ ID NO: 3147058 - DNA, 12 bp, Homo sapiens
tagggtggccct

SEQ ID NO: 3147059 - DNA, 15 bp, Homo sapiens
tagggttataataat

SEQ ID NO: 3147060 - DNA, 19 bp, Homo sapiens
tagggttttgcaataactt

SEQ ID NO: 3147061 - DNA, 16 bp, Homo sapiens
taggtaaaatgtattt

SEQ ID NO: 3147062 - DNA, 17 bp, Homo sapiens
taggtaaactaacctgg

SEQ ID NO: 3147063 - DNA, 13 bp, Homo sapiens
taggtaacacatt

SEQ ID NO: 3147064 - DNA, 18 bp, Homo sapiens
taggtaacttattagaaa

SEQ ID NO: 3147065 - DNA, 19 bp, Homo sapiens
taggtaacttattagaaac

SEQ ID NO: 3147066 - DNA, 13 bp, Homo sapiens
taggtaacttcat

SEQ ID NO: 3147067 - DNA, 14 bp, Homo sapiens
taggtacacagctc

SEQ ID NO: 3147068 - DNA, 13 bp, Homo sapiens
taggtagatccag

SEQ ID NO: 3147069 - DNA, 23 bp, Homo sapiens
taggtagccttgtgttctgagta

SEQ ID NO: 3147070 - DNA, 12 bp, Homo sapiens
taggtcactggc

SEQ ID NO: 3147071 - DNA, 14 bp, Homo sapiens
taggtcactggctc

SEQ ID NO: 3147072 - DNA, 24 bp, Homo sapiens
taggtcactggctctccaagtgcc

SEQ ID NO: 3147073 - DNA, 13 bp, Homo sapiens
taggtcagatgga

SEQ ID NO: 3147074 - DNA, 16 bp, Homo sapiens
taggtctcatctcttc

SEQ ID NO: 3147075 - DNA, 15 bp, Homo sapiens
taggtctcctcaggg

SEQ ID NO: 3147076 - DNA, 18 bp, Homo sapiens
taggtctcttctcccaga

SEQ ID NO: 3147077 - DNA, 15 bp, Homo sapiens
taggtctttctctca

SEQ ID NO: 3147078 - DNA, 17 bp, Homo sapiens
taggtgaaagaacaagt

SEQ ID NO: 3147079 - DNA, 23 bp, Homo sapiens
taggtgacagagtgagactctgt

SEQ ID NO: 3147080 - DNA, 22 bp, Homo sapiens
taggtgatgtttgctcttgttt

SEQ ID NO: 3147081 - DNA, 12 bp, Homo sapiens
taggtgattcta

SEQ ID NO: 3147082 - DNA, 22 bp, Homo sapiens
taggtgttgattttctgttgta

SEQ ID NO: 3147083 - DNA, 22 bp, Homo sapiens
taggttaattccaattatatga

SEQ ID NO: 3147084 - DNA, 18 bp, Homo sapiens
taggttatacaataaccc

SEQ ID NO: 3147085 - DNA, 18 bp, Homo sapiens
taggttatctttttaaaa

SEQ ID NO: 3147086 - DNA, 15 bp, Homo sapiens
taggttcagccaagg

SEQ ID NO: 3147087 - DNA, 17 bp, Homo sapiens
taggttccctgttcttc

SEQ ID NO: 3147088 - DNA, 22 bp, Homo sapiens
taggttccctgttcttcctcca

SEQ ID NO: 3147089 - DNA, 18 bp, Homo sapiens
taggttctttgctgcatt

SEQ ID NO: 3147090 - DNA, 17 bp, Homo sapiens
taggttggacagccccc

SEQ ID NO: 3147091 - DNA, 11 bp, Homo sapiens
taggtttcaaa

SEQ ID NO: 3147092 - DNA, 15 bp, Homo sapiens
taggtttttattagt

SEQ ID NO: 3147093 - DNA, 18 bp, Homo sapiens
tagtaacttcttatggaa

SEQ ID NO: 3147094 - DNA, 18 bp, Homo sapiens
tagtaagaagacaaactg

SEQ ID NO: 3147095 - DNA, 17 bp, Homo sapiens
tagtaagatgcactgaa

SEQ ID NO: 3147096 - DNA, 14 bp, Homo sapiens
tagtaatagagcaa

SEQ ID NO: 3147097 - DNA, 15 bp, Homo sapiens
tagtaatcacagttg

SEQ ID NO: 3147098 - DNA, 15 bp, Homo sapiens
tagtaatctgtacat

SEQ ID NO: 3147099 - DNA, 16 bp, Homo sapiens
tagtaatctgtacatt

SEQ ID NO: 3147100 - DNA, 23 bp, Homo sapiens
tagtaatttattgtctgtctaca

SEQ ID NO: 3147101 - DNA, 16 bp, Homo sapiens
tagtaccaatcatttt

SEQ ID NO: 3147102 - DNA, 19 bp, Homo sapiens
tagtaccatttatacaaat

SEQ ID NO: 3147103 - DNA, 15 bp, Homo sapiens
tagtacctgaaaagt

SEQ ID NO: 3147104 - DNA, 19 bp, Homo sapiens
tagtactcctgcaaaattt

SEQ ID NO: 3147105 - DNA, 14 bp, Homo sapiens
tagtactctctgct

SEQ ID NO: 3147106 - DNA, 20 bp, Homo sapiens
tagtactgaagccaaatgaa

SEQ ID NO: 3147107 - DNA, 15 bp, Homo sapiens
tagtactgctcttgt

SEQ ID NO: 3147108 - DNA, 19 bp, Homo sapiens
tagtagaaattttacaata

SEQ ID NO: 3147109 - DNA, 20 bp, Homo sapiens
tagtagaaattttacaatag

SEQ ID NO: 3147110 - DNA, 15 bp, Homo sapiens
tagtagagacagggt

SEQ ID NO: 3147111 - DNA, 19 bp, Homo sapiens
tagtagccctttctgtgtg

SEQ ID NO: 3147112 - DNA, 18 bp, Homo sapiens
tagtagtatgatgataca

SEQ ID NO: 3147113 - DNA, 19 bp, Homo sapiens
tagtagttcctgctacaac

SEQ ID NO: 3147114 - DNA, 21 bp, Homo sapiens
tagtatagccacaaatgcctt

SEQ ID NO: 3147115 - DNA, 16 bp, Homo sapiens
tagtatatctggacaa

SEQ ID NO: 3147116 - DNA, 17 bp, Homo sapiens
tagtatcagtgttttaa

SEQ ID NO: 3147117 - DNA, 13 bp, Homo sapiens
tagtatcttcaaa

SEQ ID NO: 3147118 - DNA, 20 bp, Homo sapiens
tagtatcttcaaactttcac

SEQ ID NO: 3147119 - DNA, 16 bp, Homo sapiens
tagtatggttcaagat

SEQ ID NO: 3147120 - DNA, 14 bp, Homo sapiens
tagtatgtctgttt

SEQ ID NO: 3147121 - DNA, 13 bp, Homo sapiens
tagtatgtgactt

SEQ ID NO: 3147122 - DNA, 15 bp, Homo sapiens
tagtatgtgactttt

SEQ ID NO: 3147123 - DNA, 20 bp, Homo sapiens
tagtatttatgggtggattt

SEQ ID NO: 3147124 - DNA, 17 bp, Homo sapiens
tagtattttaatcctgt

SEQ ID NO: 3147125 - DNA, 15 bp, Homo sapiens
tagtcaaaactattt

SEQ ID NO: 3147126 - DNA, 15 bp, Homo sapiens
tagtcaatcactgca

SEQ ID NO: 3147127 - DNA, 24 bp, Homo sapiens
tagtcaatcactgcactgcatgca

SEQ ID NO: 3147128 - DNA, 16 bp, Homo sapiens
tagtcaatttctactt

SEQ ID NO: 3147129 - DNA, 19 bp, Homo sapiens
tagtcaatttctacttctg

SEQ ID NO: 3147130 - DNA, 17 bp, Homo sapiens
tagtcacttatttcata

SEQ ID NO: 3147131 - DNA, 15 bp, Homo sapiens
tagtcattcttccct

SEQ ID NO: 3147132 - DNA, 13 bp, Homo sapiens
tagtccaaaatta

SEQ ID NO: 3147133 - DNA, 16 bp, Homo sapiens
tagtccacggaccccc

SEQ ID NO: 3147134 - DNA, 21 bp, Homo sapiens
tagtcccagctactcagaagc

SEQ ID NO: 3147135 - DNA, 22 bp, Homo sapiens
tagtcccccaactctgagccca

SEQ ID NO: 3147136 - DNA, 14 bp, Homo sapiens
tagtcccttcccct

SEQ ID NO: 3147137 - DNA, 22 bp, Homo sapiens
tagtcccttcccctccctggct

SEQ ID NO: 3147138 - DNA, 11 bp, Homo sapiens
tagtcctgtga

SEQ ID NO: 3147139 - DNA, 16 bp, Homo sapiens
tagtcctttctgcctt

SEQ ID NO: 3147140 - DNA, 21 bp, Homo sapiens
tagtcctttctgccttggcct

SEQ ID NO: 3147141 - DNA, 12 bp, Homo sapiens
tagtctcctggg

SEQ ID NO: 3147142 - DNA, 20 bp, Homo sapiens
tagtctcctttgcactgagg

SEQ ID NO: 3147143 - DNA, 21 bp, Homo sapiens
tagtctcctttgcactgaggg

SEQ ID NO: 3147144 - DNA, 21 bp, Homo sapiens
tagtctcttgtattaaactct

SEQ ID NO: 3147145 - DNA, 12 bp, Homo sapiens
tagtctggtttc

SEQ ID NO: 3147146 - DNA, 22 bp, Homo sapiens
tagtcttccacaaaaaatactt

SEQ ID NO: 3147147 - DNA, 14 bp, Homo sapiens
tagtcttctcatag

SEQ ID NO: 3147148 - DNA, 23 bp, Homo sapiens
tagtcttggaagctgtttggaaa

SEQ ID NO: 3147149 - DNA, 11 bp, Homo sapiens
tagtgaaaatt

SEQ ID NO: 3147150 - DNA, 24 bp, Homo sapiens
tagtgaaaccccatctctactgaa

SEQ ID NO: 3147151 - DNA, 13 bp, Homo sapiens
tagtgaatgggaa

SEQ ID NO: 3147152 - DNA, 21 bp, Homo sapiens
tagtgacaagtgaagaacact

SEQ ID NO: 3147153 - DNA, 22 bp, Homo sapiens
tagtgaccccttccctgtcctt

SEQ ID NO: 3147154 - DNA, 18 bp, Homo sapiens
tagtgagacccctgtctc

SEQ ID NO: 3147155 - DNA, 19 bp, Homo sapiens
tagtgatcaaattgtgcag

SEQ ID NO: 3147156 - DNA, 13 bp, Homo sapiens
tagtgatggttcc

SEQ ID NO: 3147157 - DNA, 13 bp, Homo sapiens
tagtgcagctgat

SEQ ID NO: 3147158 - DNA, 14 bp, Homo sapiens
tagtgcagctgatt

SEQ ID NO: 3147159 - DNA, 17 bp, Homo sapiens
tagtgcagctgatttta

SEQ ID NO: 3147160 - DNA, 20 bp, Homo sapiens
tagtgcagctgattttaaca

SEQ ID NO: 3147161 - DNA, 18 bp, Homo sapiens
tagtgcatttcaaggaat

SEQ ID NO: 3147162 - DNA, 13 bp, Homo sapiens
tagtgccacccac

SEQ ID NO: 3147163 - DNA, 22 bp, Homo sapiens
tagtgccacttaatgtatgtta

SEQ ID NO: 3147164 - DNA, 23 bp, Homo sapiens
tagtgccctccacagccgcagcc

SEQ ID NO: 3147165 - DNA, 23 bp, Homo sapiens
tagtgccgtagggagtacctgct

SEQ ID NO: 3147166 - DNA, 15 bp, Homo sapiens
tagtgctatatatat

SEQ ID NO: 3147167 - DNA, 22 bp, Homo sapiens
tagtgcttcagagtttgtgtgt

SEQ ID NO: 3147168 - DNA, 16 bp, Homo sapiens
tagtggaaaataggct

SEQ ID NO: 3147169 - DNA, 14 bp, Homo sapiens
tagtggaagagcag

SEQ ID NO: 3147170 - DNA, 16 bp, Homo sapiens
tagtggaagagcagcc

SEQ ID NO: 3147171 - DNA, 15 bp, Homo sapiens
tagtggatgttctga

SEQ ID NO: 3147172 - DNA, 20 bp, Homo sapiens
tagtgggccctctctctggg

SEQ ID NO: 3147173 - DNA, 18 bp, Homo sapiens
tagtggtctttgtaagag

SEQ ID NO: 3147174 - DNA, 21 bp, Homo sapiens
tagtggtctttgtaagagtgt

SEQ ID NO: 3147175 - DNA, 22 bp, Homo sapiens
tagtggtgttttaaagagaatg

SEQ ID NO: 3147176 - DNA, 22 bp, Homo sapiens
tagtgtacctcctctcagtgtt

SEQ ID NO: 3147177 - DNA, 23 bp, Homo sapiens
tagtgtacctcctctcagtgttt

SEQ ID NO: 3147178 - DNA, 14 bp, Homo sapiens
tagtgtataaaaac

SEQ ID NO: 3147179 - DNA, 15 bp, Homo sapiens
tagtgtatgattact

SEQ ID NO: 3147180 - DNA, 19 bp, Homo sapiens
tagtgtatgattactggcc

SEQ ID NO: 3147181 - DNA, 15 bp, Homo sapiens
tagtgtgttctgatt

SEQ ID NO: 3147182 - DNA, 19 bp, Homo sapiens
tagtgtgttctgattagaa

SEQ ID NO: 3147183 - DNA, 20 bp, Homo sapiens
tagtgtgttctgattagaaa

SEQ ID NO: 3147184 - DNA, 20 bp, Homo sapiens
tagtgttaatgactctttct

SEQ ID NO: 3147185 - DNA, 14 bp, Homo sapiens
tagttaaaatgctg

SEQ ID NO: 3147186 - DNA, 14 bp, Homo sapiens
tagttaagacatga

SEQ ID NO: 3147187 - DNA, 21 bp, Homo sapiens
tagttaagacatgatttcctt

SEQ ID NO: 3147188 - DNA, 14 bp, Homo sapiens
tagttaatttatct

SEQ ID NO: 3147189 - DNA, 16 bp, Homo sapiens
tagttaatttatctaa

SEQ ID NO: 3147190 - DNA, 14 bp, Homo sapiens
tagttaccttatag

SEQ ID NO: 3147191 - DNA, 19 bp, Homo sapiens
tagttaccttatagttact

SEQ ID NO: 3147192 - DNA, 12 bp, Homo sapiens
tagttactcaag

SEQ ID NO: 3147193 - DNA, 17 bp, Homo sapiens
tagttactgtgtaatta

SEQ ID NO: 3147194 - DNA, 15 bp, Homo sapiens
tagttagccctcagt

SEQ ID NO: 3147195 - DNA, 16 bp, Homo sapiens
tagttaggaaataaaa

SEQ ID NO: 3147196 - DNA, 15 bp, Homo sapiens
tagttagtagcatgt

SEQ ID NO: 3147197 - DNA, 15 bp, Homo sapiens
tagttatagtttcag

SEQ ID NO: 3147198 - DNA, 17 bp, Homo sapiens
tagttcaaactgcagct

SEQ ID NO: 3147199 - DNA, 12 bp, Homo sapiens
tagttcaataca

SEQ ID NO: 3147200 - DNA, 21 bp, Homo sapiens
tagttcaatacagtgaaggtc

SEQ ID NO: 3147201 - DNA, 22 bp, Homo sapiens
tagttcactccatttggtcctt

SEQ ID NO: 3147202 - DNA, 16 bp, Homo sapiens
tagttcagaatttagt

SEQ ID NO: 3147203 - DNA, 22 bp, Homo sapiens
tagttcagcatccgcaggtgct

SEQ ID NO: 3147204 - DNA, 13 bp, Homo sapiens
tagttcatatata

SEQ ID NO: 3147205 - DNA, 14 bp, Homo sapiens
tagttcatccaatc

SEQ ID NO: 3147206 - DNA, 19 bp, Homo sapiens
tagttccctctgctcagcc

SEQ ID NO: 3147207 - DNA, 20 bp, Homo sapiens
tagttccctttgccaacaga

SEQ ID NO: 3147208 - DNA, 18 bp, Homo sapiens
tagttcctgtggccagga

SEQ ID NO: 3147209 - DNA, 17 bp, Homo sapiens
tagttcctttatttaat

SEQ ID NO: 3147210 - DNA, 15 bp, Homo sapiens
tagttcgtagctttc

SEQ ID NO: 3147211 - DNA, 13 bp, Homo sapiens
tagttctaaaatt

SEQ ID NO: 3147212 - DNA, 15 bp, Homo sapiens
tagttctaagactca

SEQ ID NO: 3147213 - DNA, 23 bp, Homo sapiens
tagttctagacatggaggttcta

SEQ ID NO: 3147214 - DNA, 15 bp, Homo sapiens
tagttctaggcactg

SEQ ID NO: 3147215 - DNA, 20 bp, Homo sapiens
tagttctcactgttccctct

SEQ ID NO: 3147216 - DNA, 12 bp, Homo sapiens
tagttctgccag

SEQ ID NO: 3147217 - DNA, 16 bp, Homo sapiens
tagttctttcctcccc

SEQ ID NO: 3147218 - DNA, 22 bp, Homo sapiens
tagttctttcctccccctgcaa

SEQ ID NO: 3147219 - DNA, 15 bp, Homo sapiens
tagttgaaaaatcta

SEQ ID NO: 3147220 - DNA, 17 bp, Homo sapiens
tagttgcagaaacattt

SEQ ID NO: 3147221 - DNA, 19 bp, Homo sapiens
tagttgcagaaacattttg

SEQ ID NO: 3147222 - DNA, 19 bp, Homo sapiens
tagttgcatagcagtatat

SEQ ID NO: 3147223 - DNA, 23 bp, Homo sapiens
tagttggtaatgcttggaatggc

SEQ ID NO: 3147224 - DNA, 15 bp, Homo sapiens
tagttggtgctgatg

SEQ ID NO: 3147225 - DNA, 14 bp, Homo sapiens
tagttggtttgtat

SEQ ID NO: 3147226 - DNA, 16 bp, Homo sapiens
tagttggtttgtatga

SEQ ID NO: 3147227 - DNA, 20 bp, Homo sapiens
tagttggtttgtatgagatg

SEQ ID NO: 3147228 - DNA, 21 bp, Homo sapiens
tagttgtccatattttcacag

SEQ ID NO: 3147229 - DNA, 16 bp, Homo sapiens
tagtttaaaacacatt

SEQ ID NO: 3147230 - DNA, 19 bp, Homo sapiens
tagtttacaatattatgtt

SEQ ID NO: 3147231 - DNA, 19 bp, Homo sapiens
tagtttacagaaaaatctt

SEQ ID NO: 3147232 - DNA, 22 bp, Homo sapiens
tagtttacctgaataaatggta

SEQ ID NO: 3147233 - DNA, 13 bp, Homo sapiens
tagtttaggagaa

SEQ ID NO: 3147234 - DNA, 11 bp, Homo sapiens
tagtttcaagc

SEQ ID NO: 3147235 - DNA, 18 bp, Homo sapiens
tagtttcagatatatatc

SEQ ID NO: 3147236 - DNA, 12 bp, Homo sapiens
tagtttctcatg

SEQ ID NO: 3147237 - DNA, 15 bp, Homo sapiens
tagtttgaattcagt

SEQ ID NO: 3147238 - DNA, 17 bp, Homo sapiens
tagtttggatatttttg

SEQ ID NO: 3147239 - DNA, 20 bp, Homo sapiens
tagtttggatatttttgtac

SEQ ID NO: 3147240 - DNA, 21 bp, Homo sapiens
tagtttggatatttttgtact

SEQ ID NO: 3147241 - DNA, 18 bp, Homo sapiens
tagtttgtataacttctt

SEQ ID NO: 3147242 - DNA, 12 bp, Homo sapiens
tagtttgtctat

SEQ ID NO: 3147243 - DNA, 22 bp, Homo sapiens
tagtttgtctattttaaaataa

SEQ ID NO: 3147244 - DNA, 13 bp, Homo sapiens
tagtttgtttaat

SEQ ID NO: 3147245 - DNA, 16 bp, Homo sapiens
tagttttaaactcatt

SEQ ID NO: 3147246 - DNA, 20 bp, Homo sapiens
tagttttacttttaaactgt

SEQ ID NO: 3147247 - DNA, 13 bp, Homo sapiens
tagttttattctt

SEQ ID NO: 3147248 - DNA, 22 bp, Homo sapiens
tagttttcagctgctcagaatt

SEQ ID NO: 3147249 - DNA, 15 bp, Homo sapiens
tagttttgtcaaact

SEQ ID NO: 3147250 - DNA, 14 bp, Homo sapiens
tataaaaaatggtt

SEQ ID NO: 3147251 - DNA, 15 bp, Homo sapiens
tataaaaaatggttc

SEQ ID NO: 3147252 - DNA, 21 bp, Homo sapiens
tataaaaaatggttcagaatt

SEQ ID NO: 3147253 - DNA, 13 bp, Homo sapiens
tataaaaaatgta

SEQ ID NO: 3147254 - DNA, 14 bp, Homo sapiens
tataaaaaatgtaa

SEQ ID NO: 3147255 - DNA, 11 bp, Homo sapiens
tataaaaacaa

SEQ ID NO: 3147256 - DNA, 20 bp, Homo sapiens
tataaaaacatgagttattc

SEQ ID NO: 3147257 - DNA, 14 bp, Homo sapiens
tataaaaagataat

SEQ ID NO: 3147258 - DNA, 12 bp, Homo sapiens
tataaaacttct

SEQ ID NO: 3147259 - DNA, 13 bp, Homo sapiens
tataaaagatata

SEQ ID NO: 3147260 - DNA, 12 bp, Homo sapiens
tataaaagcctt

SEQ ID NO: 3147261 - DNA, 12 bp, Homo sapiens
tataaaataact

SEQ ID NO: 3147262 - DNA, 19 bp, Homo sapiens
tataaaataactaaaatgt

SEQ ID NO: 3147263 - DNA, 19 bp, Homo sapiens
tataaaatagttgtccata

SEQ ID NO: 3147264 - DNA, 13 bp, Homo sapiens
tataaaatatcta

SEQ ID NO: 3147265 - DNA, 14 bp, Homo sapiens
tataaaatatctat

SEQ ID NO: 3147266 - DNA, 15 bp, Homo sapiens
tataaaatggacaca

SEQ ID NO: 3147267 - DNA, 18 bp, Homo sapiens
tataaaatgtattcaagc

SEQ ID NO: 3147268 - DNA, 19 bp, Homo sapiens
tataaaatgtattcaagca

SEQ ID NO: 3147269 - DNA, 23 bp, Homo sapiens
tataaaattaaatgccttgtata

SEQ ID NO: 3147270 - DNA, 15 bp, Homo sapiens
tataaaattagaaag

SEQ ID NO: 3147271 - DNA, 18 bp, Homo sapiens
tataaaattagaaagcaa

SEQ ID NO: 3147272 - DNA, 15 bp, Homo sapiens
tataaacacattgaa

SEQ ID NO: 3147273 - DNA, 17 bp, Homo sapiens
tataaacagaaatggaa

SEQ ID NO: 3147274 - DNA, 19 bp, Homo sapiens
tataaacagaactcccttc

SEQ ID NO: 3147275 - DNA, 16 bp, Homo sapiens
tataaacattaaatgt

SEQ ID NO: 3147276 - DNA, 15 bp, Homo sapiens
tataaaccaatctta

SEQ ID NO: 3147277 - DNA, 17 bp, Homo sapiens
tataaactaggtaaaat

SEQ ID NO: 3147278 - DNA, 17 bp, Homo sapiens
tataaagagaagacgaa

SEQ ID NO: 3147279 - DNA, 13 bp, Homo sapiens
tataaagatatat

SEQ ID NO: 3147280 - DNA, 16 bp, Homo sapiens
tataaagtaaagctaa

SEQ ID NO: 3147281 - DNA, 19 bp, Homo sapiens
tataaagtacccatctagt

SEQ ID NO: 3147282 - DNA, 15 bp, Homo sapiens
tataaagtatagaga

SEQ ID NO: 3147283 - DNA, 18 bp, Homo sapiens
tataaagtatagagagaa

SEQ ID NO: 3147284 - DNA, 19 bp, Homo sapiens
tataaagtatagagagaag

SEQ ID NO: 3147285 - DNA, 13 bp, Homo sapiens
tataaataataaa

SEQ ID NO: 3147286 - DNA, 19 bp, Homo sapiens
tataaataataaagaactc

SEQ ID NO: 3147287 - DNA, 17 bp, Homo sapiens
tataaatacgtattaca

SEQ ID NO: 3147288 - DNA, 17 bp, Homo sapiens
tataaatataagccttt

SEQ ID NO: 3147289 - DNA, 19 bp, Homo sapiens
tataaatatatataaagaa

SEQ ID NO: 3147290 - DNA, 18 bp, Homo sapiens
tataaatatatttaactt

SEQ ID NO: 3147291 - DNA, 20 bp, Homo sapiens
tataaatcaatgtcacttaa

SEQ ID NO: 3147292 - DNA, 13 bp, Homo sapiens
tataaatgagcaa

SEQ ID NO: 3147293 - DNA, 12 bp, Homo sapiens
tataaatgtata

SEQ ID NO: 3147294 - DNA, 14 bp, Homo sapiens
tataaatgtataaa

SEQ ID NO: 3147295 - DNA, 18 bp, Homo sapiens
tataaatgtatatacaca

SEQ ID NO: 3147296 - DNA, 14 bp, Homo sapiens
tataaattcagaac

SEQ ID NO: 3147297 - DNA, 16 bp, Homo sapiens
tataaattctactaag

SEQ ID NO: 3147298 - DNA, 19 bp, Homo sapiens
tataaattctactaagtta

SEQ ID NO: 3147299 - DNA, 22 bp, Homo sapiens
tataaattgtctttaaaaactg

SEQ ID NO: 3147300 - DNA, 20 bp, Homo sapiens
tataaatttcgcttcttaga

SEQ ID NO: 3147301 - DNA, 19 bp, Homo sapiens
tataacaaggttcttctaa

SEQ ID NO: 3147302 - DNA, 16 bp, Homo sapiens
tataacagatgtgaaa

SEQ ID NO: 3147303 - DNA, 18 bp, Homo sapiens
tataacagatgtgaaaat

SEQ ID NO: 3147304 - DNA, 17 bp, Homo sapiens
tataacagttatatttt

SEQ ID NO: 3147305 - DNA, 17 bp, Homo sapiens
tataacatatgtacata

SEQ ID NO: 3147306 - DNA, 20 bp, Homo sapiens
tataaccacaaagcacagtt

SEQ ID NO: 3147307 - DNA, 14 bp, Homo sapiens
tataaccccagcct

SEQ ID NO: 3147308 - DNA, 20 bp, Homo sapiens
tataacctagttaaagaaag

SEQ ID NO: 3147309 - DNA, 14 bp, Homo sapiens
tataactaacatgt

SEQ ID NO: 3147310 - DNA, 16 bp, Homo sapiens
tataactcatcataaa

SEQ ID NO: 3147311 - DNA, 18 bp, Homo sapiens
tataactcatcataaaat

SEQ ID NO: 3147312 - DNA, 19 bp, Homo sapiens
tataactcatcataaaata

SEQ ID NO: 3147313 - DNA, 17 bp, Homo sapiens
tataacttattagcagt

SEQ ID NO: 3147314 - DNA, 15 bp, Homo sapiens
tataacttcttaaaa

SEQ ID NO: 3147315 - DNA, 12 bp, Homo sapiens
tataacttgatg

SEQ ID NO: 3147316 - DNA, 13 bp, Homo sapiens
tataagaaggaaa

SEQ ID NO: 3147317 - DNA, 16 bp, Homo sapiens
tataagaaggaaaaat

SEQ ID NO: 3147318 - DNA, 16 bp, Homo sapiens
tataagagaagtctca

SEQ ID NO: 3147319 - DNA, 18 bp, Homo sapiens
tataagagaagtctcatt

SEQ ID NO: 3147320 - DNA, 14 bp, Homo sapiens
tataagatcctaga

SEQ ID NO: 3147321 - DNA, 19 bp, Homo sapiens
tataagatcctagatccta

SEQ ID NO: 3147322 - DNA, 15 bp, Homo sapiens
tataagcaaatttca

SEQ ID NO: 3147323 - DNA, 23 bp, Homo sapiens
tataagcaaatttcaaaagacat

SEQ ID NO: 3147324 - DNA, 18 bp, Homo sapiens
tataagcattgaaattat

SEQ ID NO: 3147325 - DNA, 23 bp, Homo sapiens
tataaggagagttcaagcctgtg

SEQ ID NO: 3147326 - DNA, 20 bp, Homo sapiens
tataagggagagctgagcca

SEQ ID NO: 3147327 - DNA, 17 bp, Homo sapiens
tataaggtttaaaaaga

SEQ ID NO: 3147328 - DNA, 14 bp, Homo sapiens
tataagtcacaaag

SEQ ID NO: 3147329 - DNA, 18 bp, Homo sapiens
tataagtgaagtgatact

SEQ ID NO: 3147330 - DNA, 17 bp, Homo sapiens
tataagtgcacacagaa

SEQ ID NO: 3147331 - DNA, 14 bp, Homo sapiens
tataagtgtacata

SEQ ID NO: 3147332 - DNA, 20 bp, Homo sapiens
tataagttatttttgtacat

SEQ ID NO: 3147333 - DNA, 16 bp, Homo sapiens
tataagtttgaaggaa

SEQ ID NO: 3147334 - DNA, 14 bp, Homo sapiens
tataatactctgtt

SEQ ID NO: 3147335 - DNA, 17 bp, Homo sapiens
tataatactctgttgta

SEQ ID NO: 3147336 - DNA, 17 bp, Homo sapiens
tataatagcaacttttg

SEQ ID NO: 3147337 - DNA, 22 bp, Homo sapiens
tataataggaacaatctttgct

SEQ ID NO: 3147338 - DNA, 15 bp, Homo sapiens
tataatatcctttgt

SEQ ID NO: 3147339 - DNA, 19 bp, Homo sapiens
tataatattgaaaattgaa

SEQ ID NO: 3147340 - DNA, 14 bp, Homo sapiens
tataatcaaatgat

SEQ ID NO: 3147341 - DNA, 19 bp, Homo sapiens
tataatcaaatgatttcat

SEQ ID NO: 3147342 - DNA, 18 bp, Homo sapiens
tataatctcaaaggagaa

SEQ ID NO: 3147343 - DNA, 13 bp, Homo sapiens
tataatctgaaga

SEQ ID NO: 3147344 - DNA, 15 bp, Homo sapiens
tataatctgaagata

SEQ ID NO: 3147345 - DNA, 14 bp, Homo sapiens
tataatcttataca

SEQ ID NO: 3147346 - DNA, 17 bp, Homo sapiens
tataatcttatacaaca

SEQ ID NO: 3147347 - DNA, 20 bp, Homo sapiens
tataatcttccatacttctt

SEQ ID NO: 3147348 - DNA, 24 bp, Homo sapiens
tataatgaatactttcttagattt

SEQ ID NO: 3147349 - DNA, 18 bp, Homo sapiens
tataatgaatgaaacatt

SEQ ID NO: 3147350 - DNA, 17 bp, Homo sapiens
tataatggaagagaaat

SEQ ID NO: 3147351 - DNA, 19 bp, Homo sapiens
tataatgtaagctctactg

SEQ ID NO: 3147352 - DNA, 20 bp, Homo sapiens
tataatgtcattaaacatga

SEQ ID NO: 3147353 - DNA, 17 bp, Homo sapiens
tataatgtgtgtatgtg

SEQ ID NO: 3147354 - DNA, 19 bp, Homo sapiens
tataatgtttaaatcatgt

SEQ ID NO: 3147355 - DNA, 23 bp, Homo sapiens
tataattcactcaagcactgata

SEQ ID NO: 3147356 - DNA, 22 bp, Homo sapiens
tataattctgtacatagcctat

SEQ ID NO: 3147357 - DNA, 19 bp, Homo sapiens
tataattggtgctatttga

SEQ ID NO: 3147358 - DNA, 23 bp, Homo sapiens
tataattgtacaaaattaagcaa

SEQ ID NO: 3147359 - DNA, 20 bp, Homo sapiens
tataattgttccctatgaaa

SEQ ID NO: 3147360 - DNA, 18 bp, Homo sapiens
tataatttacctaagatt

SEQ ID NO: 3147361 - DNA, 20 bp, Homo sapiens
tataatttacctaagattac

SEQ ID NO: 3147362 - DNA, 20 bp, Homo sapiens
tataatttcgagatttgtag

SEQ ID NO: 3147363 - DNA, 21 bp, Homo sapiens
tataatttcgagatttgtagg

SEQ ID NO: 3147364 - DNA, 22 bp, Homo sapiens
tataattttatgaatgtctttg

SEQ ID NO: 3147365 - DNA, 13 bp, Homo sapiens
tataattttcact

SEQ ID NO: 3147366 - DNA, 19 bp, Homo sapiens
tataattttttgtaatgtg

SEQ ID NO: 3147367 - DNA, 15 bp, Homo sapiens
tatacaaaactttat

SEQ ID NO: 3147368 - DNA, 15 bp, Homo sapiens
tatacaaaagagcat

SEQ ID NO: 3147369 - DNA, 21 bp, Homo sapiens
tatacaaaagagcatggatgc

SEQ ID NO: 3147370 - DNA, 12 bp, Homo sapiens
tatacaaatata

SEQ ID NO: 3147371 - DNA, 18 bp, Homo sapiens
tatacaaattaaaaagat

SEQ ID NO: 3147372 - DNA, 13 bp, Homo sapiens
tatacaaattaga

SEQ ID NO: 3147373 - DNA, 17 bp, Homo sapiens
tatacaaattagaaaat

SEQ ID NO: 3147374 - DNA, 18 bp, Homo sapiens
tatacaaattagaaaatg

SEQ ID NO: 3147375 - DNA, 21 bp, Homo sapiens
tatacaacagcaaaccctgat

SEQ ID NO: 3147376 - DNA, 20 bp, Homo sapiens
tatacaataacccagttact

SEQ ID NO: 3147377 - DNA, 19 bp, Homo sapiens
tatacaatatataaaaata

SEQ ID NO: 3147378 - DNA, 14 bp, Homo sapiens
tatacacacacaca

SEQ ID NO: 3147379 - DNA, 22 bp, Homo sapiens
tatacacttacactttatgcac

SEQ ID NO: 3147380 - DNA, 12 bp, Homo sapiens
tatacagatgaa

SEQ ID NO: 3147381 - DNA, 18 bp, Homo sapiens
tatacagatgaaaatttg

SEQ ID NO: 3147382 - DNA, 12 bp, Homo sapiens
tatacagatttt

SEQ ID NO: 3147383 - DNA, 16 bp, Homo sapiens
tatacagtaactttat

SEQ ID NO: 3147384 - DNA, 19 bp, Homo sapiens
tatacagtaactttatgtg

SEQ ID NO: 3147385 - DNA, 22 bp, Homo sapiens
tatacagttataaaattaaaag

SEQ ID NO: 3147386 - DNA, 21 bp, Homo sapiens
tatacatatctttattaatca

SEQ ID NO: 3147387 - DNA, 15 bp, Homo sapiens
tatacatatgtagac

SEQ ID NO: 3147388 - DNA, 16 bp, Homo sapiens
tatacatatgtagact

SEQ ID NO: 3147389 - DNA, 21 bp, Homo sapiens
tatacatcctgggtaatgaga

SEQ ID NO: 3147390 - DNA, 15 bp, Homo sapiens
tatacatgaaaattt

SEQ ID NO: 3147391 - DNA, 19 bp, Homo sapiens
tatacatgaaaattttaaa

SEQ ID NO: 3147392 - DNA, 13 bp, Homo sapiens
tatacatgccagt

SEQ ID NO: 3147393 - DNA, 13 bp, Homo sapiens
tatacatgtgtgt

SEQ ID NO: 3147394 - DNA, 15 bp, Homo sapiens
tatacatgtgtgtat

SEQ ID NO: 3147395 - DNA, 20 bp, Homo sapiens
tatacatgtgtgtatatatg

SEQ ID NO: 3147396 - DNA, 14 bp, Homo sapiens
tatacatttgataa

SEQ ID NO: 3147397 - DNA, 21 bp, Homo sapiens
tatacattttgttatagaata

SEQ ID NO: 3147398 - DNA, 24 bp, Homo sapiens
tatacccccaggaaactagctttt

SEQ ID NO: 3147399 - DNA, 22 bp, Homo sapiens
tataccccttacttagcatgca

SEQ ID NO: 3147400 - DNA, 21 bp, Homo sapiens
tatacctataatgtgtgtatg

SEQ ID NO: 3147401 - DNA, 14 bp, Homo sapiens
tatacctggctttt

SEQ ID NO: 3147402 - DNA, 15 bp, Homo sapiens
tatacgcttttcttt

SEQ ID NO: 3147403 - DNA, 16 bp, Homo sapiens
tatactaaaaaatgtc

SEQ ID NO: 3147404 - DNA, 22 bp, Homo sapiens
tatactaaaaaatgtctataga

SEQ ID NO: 3147405 - DNA, 23 bp, Homo sapiens
tatactaaaccaactctaatatt

SEQ ID NO: 3147406 - DNA, 21 bp, Homo sapiens
tatactactttgttaggattt

SEQ ID NO: 3147407 - DNA, 16 bp, Homo sapiens
tatactctttctgtat

SEQ ID NO: 3147408 - DNA, 23 bp, Homo sapiens
tatactgatcttcattaccaata

SEQ ID NO: 3147409 - DNA, 19 bp, Homo sapiens
tatactgcacagtggcaca

SEQ ID NO: 3147410 - DNA, 18 bp, Homo sapiens
tatactggaaatgtaaaa

SEQ ID NO: 3147411 - DNA, 16 bp, Homo sapiens
tatactgggttcttgt

SEQ ID NO: 3147412 - DNA, 19 bp, Homo sapiens
tatactgggtttcaagaaa

SEQ ID NO: 3147413 - DNA, 14 bp, Homo sapiens
tatactgtaattta

SEQ ID NO: 3147414 - DNA, 14 bp, Homo sapiens
tatacttgactcta

SEQ ID NO: 3147415 - DNA, 18 bp, Homo sapiens
tatacttgtggttttcaa

SEQ ID NO: 3147416 - DNA, 22 bp, Homo sapiens
tatacttgtggttttcaaattg

SEQ ID NO: 3147417 - DNA, 15 bp, Homo sapiens
tatactttagtatga

SEQ ID NO: 3147418 - DNA, 15 bp, Homo sapiens
tatactttatatctg

SEQ ID NO: 3147419 - DNA, 16 bp, Homo sapiens
tatactttatatctgt

SEQ ID NO: 3147420 - DNA, 19 bp, Homo sapiens
tatactttatatctgtaat

SEQ ID NO: 3147421 - DNA, 14 bp, Homo sapiens
tatactttgtggac

SEQ ID NO: 3147422 - DNA, 17 bp, Homo sapiens
tatacttttaaattatg

SEQ ID NO: 3147423 - DNA, 17 bp, Homo sapiens
tatacttttttcttatt

SEQ ID NO: 3147424 - DNA, 22 bp, Homo sapiens
tatagaaaaataaaaatctctt

SEQ ID NO: 3147425 - DNA, 16 bp, Homo sapiens
tatagaagtttgtcca

SEQ ID NO: 3147426 - DNA, 22 bp, Homo sapiens
tatagagatgtttttaaaagtt

SEQ ID NO: 3147427 - DNA, 21 bp, Homo sapiens
tatagaggaccctaacacagt

SEQ ID NO: 3147428 - DNA, 17 bp, Homo sapiens
tatagagttcatcccag

SEQ ID NO: 3147429 - DNA, 15 bp, Homo sapiens
tatagatataatgaa

SEQ ID NO: 3147430 - DNA, 23 bp, Homo sapiens
tatagatataatgaacaaaatta

SEQ ID NO: 3147431 - DNA, 12 bp, Homo sapiens
tatagatgtcta

SEQ ID NO: 3147432 - DNA, 17 bp, Homo sapiens
tatagattagaaaaatt

SEQ ID NO: 3147433 - DNA, 15 bp, Homo sapiens
tatagattctaaaga

SEQ ID NO: 3147434 - DNA, 16 bp, Homo sapiens
tatagcaagatattga

SEQ ID NO: 3147435 - DNA, 14 bp, Homo sapiens
tatagcactttgaa

SEQ ID NO: 3147436 - DNA, 15 bp, Homo sapiens
tatagcactttgaaa

SEQ ID NO: 3147437 - DNA, 20 bp, Homo sapiens
tatagcactttgaaatacct

SEQ ID NO: 3147438 - DNA, 21 bp, Homo sapiens
tatagctgagactacaagtgt

SEQ ID NO: 3147439 - DNA, 12 bp, Homo sapiens
tatagcttgaaa

SEQ ID NO: 3147440 - DNA, 19 bp, Homo sapiens
tataggaaaaaaactggga

SEQ ID NO: 3147441 - DNA, 15 bp, Homo sapiens
tataggatcatttgt

SEQ ID NO: 3147442 - DNA, 14 bp, Homo sapiens
tataggccagggca

SEQ ID NO: 3147443 - DNA, 15 bp, Homo sapiens
tataggccagggcat

SEQ ID NO: 3147444 - DNA, 22 bp, Homo sapiens
tataggccagggcatgtgtatg

SEQ ID NO: 3147445 - DNA, 17 bp, Homo sapiens
tataggtcactcctggg

SEQ ID NO: 3147446 - DNA, 22 bp, Homo sapiens
tataggttgtgcaaattaacag

SEQ ID NO: 3147447 - DNA, 21 bp, Homo sapiens
tatagtatgtgacttttctga

SEQ ID NO: 3147448 - DNA, 21 bp, Homo sapiens
tatagtcatttattttaaaaa

SEQ ID NO: 3147449 - DNA, 11 bp, Homo sapiens
tatagtgccta

SEQ ID NO: 3147450 - DNA, 13 bp, Homo sapiens
tatagtgtaaaat

SEQ ID NO: 3147451 - DNA, 15 bp, Homo sapiens
tatagttactgtgta

SEQ ID NO: 3147452 - DNA, 16 bp, Homo sapiens
tatagttactgtgtaa

SEQ ID NO: 3147453 - DNA, 17 bp, Homo sapiens
tatagttaggatagcat

SEQ ID NO: 3147454 - DNA, 19 bp, Homo sapiens
tatagttaggatagcattt

SEQ ID NO: 3147455 - DNA, 13 bp, Homo sapiens
tatagttctaggc

SEQ ID NO: 3147456 - DNA, 22 bp, Homo sapiens
tatagttttacttttaaactgt

SEQ ID NO: 3147457 - DNA, 23 bp, Homo sapiens
tatagttttacttttaaactgtg

SEQ ID NO: 3147458 - DNA, 11 bp, Homo sapiens
tatataaaaat

SEQ ID NO: 3147459 - DNA, 18 bp, Homo sapiens
tatataaaaatatatata

SEQ ID NO: 3147460 - DNA, 10 bp, Homo sapiens
tatataaaat

SEQ ID NO: 3147461 - DNA, 12 bp, Homo sapiens
tatataaagtat

SEQ ID NO: 3147462 - DNA, 22 bp, Homo sapiens
tatataaatgtaaaaataataa

SEQ ID NO: 3147463 - DNA, 12 bp, Homo sapiens
tatatacacata

SEQ ID NO: 3147464 - DNA, 14 bp, Homo sapiens
tatatacagttatt

SEQ ID NO: 3147465 - DNA, 19 bp, Homo sapiens
tatatacagttattttgga

SEQ ID NO: 3147466 - DNA, 18 bp, Homo sapiens
tatatacatacataatgt

SEQ ID NO: 3147467 - DNA, 16 bp, Homo sapiens
tatatacatgtgtgta

SEQ ID NO: 3147468 - DNA, 21 bp, Homo sapiens
tatatacctaatacccagttt

SEQ ID NO: 3147469 - DNA, 22 bp, Homo sapiens
tatatacctggcttttacttta

SEQ ID NO: 3147470 - DNA, 19 bp, Homo sapiens
tatatactgggttcttgtt

SEQ ID NO: 3147471 - DNA, 17 bp, Homo sapiens
tatatacttttaaatta

SEQ ID NO: 3147472 - DNA, 13 bp, Homo sapiens
tatatagaattgt

SEQ ID NO: 3147473 - DNA, 14 bp, Homo sapiens
tatatagaattgta

SEQ ID NO: 3147474 - DNA, 18 bp, Homo sapiens
tatatagaattgtagact

SEQ ID NO: 3147475 - DNA, 19 bp, Homo sapiens
tatatagagatgtttttaa

SEQ ID NO: 3147476 - DNA, 18 bp, Homo sapiens
tatatagcagcaaaaata

SEQ ID NO: 3147477 - DNA, 22 bp, Homo sapiens
tatatagcagcaaaaatataaa

SEQ ID NO: 3147478 - DNA, 14 bp, Homo sapiens
tatatagcttgaaa

SEQ ID NO: 3147479 - DNA, 13 bp, Homo sapiens
tatatataaacag

SEQ ID NO: 3147480 - DNA, 13 bp, Homo sapiens
tatatatacagta

SEQ ID NO: 3147481 - DNA, 12 bp, Homo sapiens
tatatatacata

SEQ ID NO: 3147482 - DNA, 14 bp, Homo sapiens
tatatatacataca

SEQ ID NO: 3147483 - DNA, 15 bp, Homo sapiens
tatatatacatatgt

SEQ ID NO: 3147484 - DNA, 18 bp, Homo sapiens
tatatatacatatgtaga

SEQ ID NO: 3147485 - DNA, 19 bp, Homo sapiens
tatatatagtgctatatat

SEQ ID NO: 3147486 - DNA, 15 bp, Homo sapiens
tatatatagtttatt

SEQ ID NO: 3147487 - DNA, 14 bp, Homo sapiens
tatatatataaatg

SEQ ID NO: 3147488 - DNA, 16 bp, Homo sapiens
tatatatataaatgta

SEQ ID NO: 3147489 - DNA, 14 bp, Homo sapiens
tatatatatatata

SEQ ID NO: 3147490 - DNA, 22 bp, Homo sapiens
tatatatcatattggtattcac

SEQ ID NO: 3147491 - DNA, 19 bp, Homo sapiens
tatatatgcctttttccta

SEQ ID NO: 3147492 - DNA, 21 bp, Homo sapiens
tatatatgcctttttcctagc

SEQ ID NO: 3147493 - DNA, 12 bp, Homo sapiens
tatatatgtgta

SEQ ID NO: 3147494 - DNA, 16 bp, Homo sapiens
tatatattatgtgaag

SEQ ID NO: 3147495 - DNA, 17 bp, Homo sapiens
tatatattatgtgaaga

SEQ ID NO: 3147496 - DNA, 20 bp, Homo sapiens
tatatattatgtgaagaatt

SEQ ID NO: 3147497 - DNA, 20 bp, Homo sapiens
tatatatttgaatatcatta

SEQ ID NO: 3147498 - DNA, 17 bp, Homo sapiens
tatatattttaaaaaca

SEQ ID NO: 3147499 - DNA, 23 bp, Homo sapiens
tatatattttgtgtgaaattgca

SEQ ID NO: 3147500 - DNA, 22 bp, Homo sapiens
tatatatttttggttgtcaata

SEQ ID NO: 3147501 - DNA, 15 bp, Homo sapiens
tatatcaaagtattt

SEQ ID NO: 3147502 - DNA, 18 bp, Homo sapiens
tatatcagaaaagggaag

SEQ ID NO: 3147503 - DNA, 18 bp, Homo sapiens
tatatcagtttcatgaaa

SEQ ID NO: 3147504 - DNA, 21 bp, Homo sapiens
tatatcatacattgttttcaa

SEQ ID NO: 3147505 - DNA, 13 bp, Homo sapiens
tatatcatgcaaa

SEQ ID NO: 3147506 - DNA, 20 bp, Homo sapiens
tatatcatgctttaaagtgt

SEQ ID NO: 3147507 - DNA, 18 bp, Homo sapiens
tatatcattctacagaat

SEQ ID NO: 3147508 - DNA, 22 bp, Homo sapiens
tatatcattggaacaactgata

SEQ ID NO: 3147509 - DNA, 16 bp, Homo sapiens
tatatccatgtactgt

SEQ ID NO: 3147510 - DNA, 17 bp, Homo sapiens
tatatccatgtactgta

SEQ ID NO: 3147511 - DNA, 19 bp, Homo sapiens
tatatccatgtactgtagt

SEQ ID NO: 3147512 - DNA, 21 bp, Homo sapiens
tatatctaccccagactagat

SEQ ID NO: 3147513 - DNA, 13 bp, Homo sapiens
tatatctatatat

SEQ ID NO: 3147514 - DNA, 22 bp, Homo sapiens
tatatctatatataattctgta

SEQ ID NO: 3147515 - DNA, 15 bp, Homo sapiens
tatatctctatttga

SEQ ID NO: 3147516 - DNA, 15 bp, Homo sapiens
tatatctcttggaaa

SEQ ID NO: 3147517 - DNA, 20 bp, Homo sapiens
tatatctgggctggccagtt

SEQ ID NO: 3147518 - DNA, 15 bp, Homo sapiens
tatatgaacatagac

SEQ ID NO: 3147519 - DNA, 19 bp, Homo sapiens
tatatgaagaaaatcactt

SEQ ID NO: 3147520 - DNA, 19 bp, Homo sapiens
tatatgaggacttgtgtct

SEQ ID NO: 3147521 - DNA, 14 bp, Homo sapiens
tatatgatcattga

SEQ ID NO: 3147522 - DNA, 20 bp, Homo sapiens
tatatgctctgcatgttaca

SEQ ID NO: 3147523 - DNA, 18 bp, Homo sapiens
tatatgctttattaatgt

SEQ ID NO: 3147524 - DNA, 15 bp, Homo sapiens
tatatggaagaaagt

SEQ ID NO: 3147525 - DNA, 16 bp, Homo sapiens
tatatggaagaaagta

SEQ ID NO: 3147526 - DNA, 16 bp, Homo sapiens
tatatggatgattcag

SEQ ID NO: 3147527 - DNA, 18 bp, Homo sapiens
tatatggatgattcagaa

SEQ ID NO: 3147528 - DNA, 19 bp, Homo sapiens
tatatggatgattcagaaa

SEQ ID NO: 3147529 - DNA, 22 bp, Homo sapiens
tatatggatgattcagaaattg

SEQ ID NO: 3147530 - DNA, 16 bp, Homo sapiens
tatatggcaagaaagc

SEQ ID NO: 3147531 - DNA, 21 bp, Homo sapiens
tatatggcgttttgtctgtgt

SEQ ID NO: 3147532 - DNA, 19 bp, Homo sapiens
tatatgtattatttataat

SEQ ID NO: 3147533 - DNA, 13 bp, Homo sapiens
tatatgtccttgg

SEQ ID NO: 3147534 - DNA, 12 bp, Homo sapiens
tatatgtctgat

SEQ ID NO: 3147535 - DNA, 23 bp, Homo sapiens
tatatgtgaaaaaaatgagactt

SEQ ID NO: 3147536 - DNA, 22 bp, Homo sapiens
tatatgtgaatcctcttcttta

SEQ ID NO: 3147537 - DNA, 22 bp, Homo sapiens
tatatgtgacactgcagcagaa

SEQ ID NO: 3147538 - DNA, 18 bp, Homo sapiens
tatatgtgtatatataca

SEQ ID NO: 3147539 - DNA, 14 bp, Homo sapiens
tatatgtgtatgta

SEQ ID NO: 3147540 - DNA, 18 bp, Homo sapiens
tatatgttcttcataagc

SEQ ID NO: 3147541 - DNA, 16 bp, Homo sapiens
tatatgtttacacaat

SEQ ID NO: 3147542 - DNA, 18 bp, Homo sapiens
tatatgtttacacaatta

SEQ ID NO: 3147543 - DNA, 14 bp, Homo sapiens
tatatgtttatata

SEQ ID NO: 3147544 - DNA, 13 bp, Homo sapiens
tatattaaaattc

SEQ ID NO: 3147545 - DNA, 22 bp, Homo sapiens
tatattaatcaccttctttgta

SEQ ID NO: 3147546 - DNA, 15 bp, Homo sapiens
tatattaatgtactt

SEQ ID NO: 3147547 - DNA, 20 bp, Homo sapiens
tatattacacatttgtacag

SEQ ID NO: 3147548 - DNA, 20 bp, Homo sapiens
tatattacggaggaacagat

SEQ ID NO: 3147549 - DNA, 18 bp, Homo sapiens
tatattaggatctgcaaa

SEQ ID NO: 3147550 - DNA, 23 bp, Homo sapiens
tatattaggatctgcaaacaatg

SEQ ID NO: 3147551 - DNA, 19 bp, Homo sapiens
tatattatgtcttcttttg

SEQ ID NO: 3147552 - DNA, 16 bp, Homo sapiens
tatattatgtgaagaa

SEQ ID NO: 3147553 - DNA, 17 bp, Homo sapiens
tatattatgtgaagaat

SEQ ID NO: 3147554 - DNA, 14 bp, Homo sapiens
tatattattgtaag

SEQ ID NO: 3147555 - DNA, 14 bp, Homo sapiens
tatattatttggca

SEQ ID NO: 3147556 - DNA, 22 bp, Homo sapiens
tatattatttggcagtttggta

SEQ ID NO: 3147557 - DNA, 15 bp, Homo sapiens
tatattcacagtttt

SEQ ID NO: 3147558 - DNA, 14 bp, Homo sapiens
tatattcatatatt

SEQ ID NO: 3147559 - DNA, 12 bp, Homo sapiens
tatattctaatt

SEQ ID NO: 3147560 - DNA, 17 bp, Homo sapiens
tatattctgaaaggaaa

SEQ ID NO: 3147561 - DNA, 20 bp, Homo sapiens
tatattgagaatcccttaaa

SEQ ID NO: 3147562 - DNA, 14 bp, Homo sapiens
tatattgcaatgaa

SEQ ID NO: 3147563 - DNA, 20 bp, Homo sapiens
tatatttaaaaaattatgga

SEQ ID NO: 3147564 - DNA, 23 bp, Homo sapiens
tatatttaaaaaattatggaata

SEQ ID NO: 3147565 - DNA, 15 bp, Homo sapiens
tatatttaaaaattg

SEQ ID NO: 3147566 - DNA, 18 bp, Homo sapiens
tatatttaaaaattgttt

SEQ ID NO: 3147567 - DNA, 22 bp, Homo sapiens
tatatttaaaaattgtttcttg

SEQ ID NO: 3147568 - DNA, 13 bp, Homo sapiens
tatatttaaactc

SEQ ID NO: 3147569 - DNA, 13 bp, Homo sapiens
tatatttaatata

SEQ ID NO: 3147570 - DNA, 16 bp, Homo sapiens
tatatttaatatattg

SEQ ID NO: 3147571 - DNA, 11 bp, Homo sapiens
tatatttaatg

SEQ ID NO: 3147572 - DNA, 22 bp, Homo sapiens
tatatttaatgcattaaacctg

SEQ ID NO: 3147573 - DNA, 12 bp, Homo sapiens
tatatttattgt

SEQ ID NO: 3147574 - DNA, 12 bp, Homo sapiens
tatatttattta

SEQ ID NO: 3147575 - DNA, 16 bp, Homo sapiens
tatatttatttaaagc

SEQ ID NO: 3147576 - DNA, 22 bp, Homo sapiens
tatatttcacttttgttctgct

SEQ ID NO: 3147577 - DNA, 12 bp, Homo sapiens
tatatttctcat

SEQ ID NO: 3147578 - DNA, 17 bp, Homo sapiens
tatatttgaatatcatt

SEQ ID NO: 3147579 - DNA, 18 bp, Homo sapiens
tatatttggaaagagacc

SEQ ID NO: 3147580 - DNA, 12 bp, Homo sapiens
tatatttgtaca

SEQ ID NO: 3147581 - DNA, 15 bp, Homo sapiens
tatatttgtacaaaa

SEQ ID NO: 3147582 - DNA, 13 bp, Homo sapiens
tatatttgtagga

SEQ ID NO: 3147583 - DNA, 13 bp, Homo sapiens
tatatttgtgtat

SEQ ID NO: 3147584 - DNA, 20 bp, Homo sapiens
tatatttgtttatgaaatgt

SEQ ID NO: 3147585 - DNA, 13 bp, Homo sapiens
tatattttaaaaa

SEQ ID NO: 3147586 - DNA, 15 bp, Homo sapiens
tatattttaaaaaca

SEQ ID NO: 3147587 - DNA, 13 bp, Homo sapiens
tatattttaagaa

SEQ ID NO: 3147588 - DNA, 15 bp, Homo sapiens
tatattttaatagaa

SEQ ID NO: 3147589 - DNA, 15 bp, Homo sapiens
tatattttatattac

SEQ ID NO: 3147590 - DNA, 18 bp, Homo sapiens
tatattttcgtatgaaaa

SEQ ID NO: 3147591 - DNA, 13 bp, Homo sapiens
tatattttgctgt

SEQ ID NO: 3147592 - DNA, 16 bp, Homo sapiens
tatattttgtgtgaaa

SEQ ID NO: 3147593 - DNA, 19 bp, Homo sapiens
tatattttgtgtgaaattg

SEQ ID NO: 3147594 - DNA, 22 bp, Homo sapiens
tatattttgtgtgaaattgcat

SEQ ID NO: 3147595 - DNA, 17 bp, Homo sapiens
tatattttgtttacaaa

SEQ ID NO: 3147596 - DNA, 13 bp, Homo sapiens
tatatttttatat

SEQ ID NO: 3147597 - DNA, 15 bp, Homo sapiens
tatatttttgtacat

SEQ ID NO: 3147598 - DNA, 16 bp, Homo sapiens
tatatttttgtacata

SEQ ID NO: 3147599 - DNA, 20 bp, Homo sapiens
tatatttttgtgttttcttg

SEQ ID NO: 3147600 - DNA, 24 bp, Homo sapiens
tatatttttgtgttttcttgtaaa

SEQ ID NO: 3147601 - DNA, 22 bp, Homo sapiens
tatattttttaatttgatgaaa

SEQ ID NO: 3147602 - DNA, 16 bp, Homo sapiens
tatattttttgaactt

SEQ ID NO: 3147603 - DNA, 21 bp, Homo sapiens
tatcaaaaaaagactcagcca

SEQ ID NO: 3147604 - DNA, 18 bp, Homo sapiens
tatcaaaacgagggctga

SEQ ID NO: 3147605 - DNA, 23 bp, Homo sapiens
tatcaaaagaaatagaaaaggaa

SEQ ID NO: 3147606 - DNA, 17 bp, Homo sapiens
tatcaaaccctagcctt

SEQ ID NO: 3147607 - DNA, 20 bp, Homo sapiens
tatcaaaccctagccttgct

SEQ ID NO: 3147608 - DNA, 21 bp, Homo sapiens
tatcaaaccctagccttgctt

SEQ ID NO: 3147609 - DNA, 22 bp, Homo sapiens
tatcaaaccctagccttgcttg

SEQ ID NO: 3147610 - DNA, 21 bp, Homo sapiens
tatcaaacttcagctgtactt

SEQ ID NO: 3147611 - DNA, 12 bp, Homo sapiens
tatcaaagcata

SEQ ID NO: 3147612 - DNA, 21 bp, Homo sapiens
tatcaacactgttactttcgt

SEQ ID NO: 3147613 - DNA, 14 bp, Homo sapiens
tatcaatatctaat

SEQ ID NO: 3147614 - DNA, 18 bp, Homo sapiens
tatcaatgtgtctttcta

SEQ ID NO: 3147615 - DNA, 21 bp, Homo sapiens
tatcaattggcagtgactttg

SEQ ID NO: 3147616 - DNA, 23 bp, Homo sapiens
tatcacaaccaccgttacaagta

SEQ ID NO: 3147617 - DNA, 13 bp, Homo sapiens
tatcacacttctg

SEQ ID NO: 3147618 - DNA, 17 bp, Homo sapiens
tatcacacttctgtgag

SEQ ID NO: 3147619 - DNA, 13 bp, Homo sapiens
tatcacattattt

SEQ ID NO: 3147620 - DNA, 14 bp, Homo sapiens
tatcacctcatggc

SEQ ID NO: 3147621 - DNA, 22 bp, Homo sapiens
tatcaccttccaaacaaaagca

SEQ ID NO: 3147622 - DNA, 15 bp, Homo sapiens
tatcactctaaaaaa

SEQ ID NO: 3147623 - DNA, 17 bp, Homo sapiens
tatcactctaaaaaaca

SEQ ID NO: 3147624 - DNA, 21 bp, Homo sapiens
tatcagaagaccacaaaaatt

SEQ ID NO: 3147625 - DNA, 23 bp, Homo sapiens
tatcagaagaccacaaaaattga

SEQ ID NO: 3147626 - DNA, 15 bp, Homo sapiens
tatcagaagagaggg

SEQ ID NO: 3147627 - DNA, 13 bp, Homo sapiens
tatcagacaagca

SEQ ID NO: 3147628 - DNA, 20 bp, Homo sapiens
tatcagaggcctataatgaa

SEQ ID NO: 3147629 - DNA, 15 bp, Homo sapiens
tatcagatacatcac

SEQ ID NO: 3147630 - DNA, 13 bp, Homo sapiens
tatcagcctgagt

SEQ ID NO: 3147631 - DNA, 21 bp, Homo sapiens
tatcagctacttaagagaaat

SEQ ID NO: 3147632 - DNA, 15 bp, Homo sapiens
tatcaggtctcccac

SEQ ID NO: 3147633 - DNA, 15 bp, Homo sapiens
tatcagtgacagagt

SEQ ID NO: 3147634 - DNA, 20 bp, Homo sapiens
tatcagtgttttaaattctg

SEQ ID NO: 3147635 - DNA, 23 bp, Homo sapiens
tatcagttatcctttgtgagcct

SEQ ID NO: 3147636 - DNA, 17 bp, Homo sapiens
tatcagtttcatgaaat

SEQ ID NO: 3147637 - DNA, 15 bp, Homo sapiens
tatcatactgttcaa

SEQ ID NO: 3147638 - DNA, 20 bp, Homo sapiens
tatcatataaacattttatt

SEQ ID NO: 3147639 - DNA, 15 bp, Homo sapiens
tatcatctgtcatta

SEQ ID NO: 3147640 - DNA, 16 bp, Homo sapiens
tatcatgagtgaataa

SEQ ID NO: 3147641 - DNA, 14 bp, Homo sapiens
tatcatgcaaaata

SEQ ID NO: 3147642 - DNA, 15 bp, Homo sapiens
tatcatgcaaaatat

SEQ ID NO: 3147643 - DNA, 15 bp, Homo sapiens
tatcatggaatattt

SEQ ID NO: 3147644 - DNA, 19 bp, Homo sapiens
tatcatgtcgtaggtaaac

SEQ ID NO: 3147645 - DNA, 20 bp, Homo sapiens
tatcattgattttataattg

SEQ ID NO: 3147646 - DNA, 18 bp, Homo sapiens
tatcatttattctgcttc

SEQ ID NO: 3147647 - DNA, 19 bp, Homo sapiens
tatcattttaaaaacttta

SEQ ID NO: 3147648 - DNA, 19 bp, Homo sapiens
tatccaaaaatagccctgc

SEQ ID NO: 3147649 - DNA, 13 bp, Homo sapiens
tatccaaaagctt

SEQ ID NO: 3147650 - DNA, 23 bp, Homo sapiens
tatccaaaatgtgtatttcttat

SEQ ID NO: 3147651 - DNA, 20 bp, Homo sapiens
tatccaaagaacttgatttg

SEQ ID NO: 3147652 - DNA, 22 bp, Homo sapiens
tatccaaagaacttgatttgca

SEQ ID NO: 3147653 - DNA, 19 bp, Homo sapiens
tatccaacacaactatcaa

SEQ ID NO: 3147654 - DNA, 19 bp, Homo sapiens
tatccaagtaccaatgctg

SEQ ID NO: 3147655 - DNA, 14 bp, Homo sapiens
tatccaatctgtga

SEQ ID NO: 3147656 - DNA, 20 bp, Homo sapiens
tatccacaatagtcagaaaa

SEQ ID NO: 3147657 - DNA, 21 bp, Homo sapiens
tatccacaatagtcagaaaac

SEQ ID NO: 3147658 - DNA, 11 bp, Homo sapiens
tatccaggagt

SEQ ID NO: 3147659 - DNA, 15 bp, Homo sapiens
tatccaggcaccagg

SEQ ID NO: 3147660 - DNA, 18 bp, Homo sapiens
tatccaggcaccaggact

SEQ ID NO: 3147661 - DNA, 24 bp, Homo sapiens
tatccataatgcattcttctctgt

SEQ ID NO: 3147662 - DNA, 22 bp, Homo sapiens
tatccatattgagtcaaatggt

SEQ ID NO: 3147663 - DNA, 12 bp, Homo sapiens
tatccatctttt

SEQ ID NO: 3147664 - DNA, 20 bp, Homo sapiens
tatccatctttttcttttta

SEQ ID NO: 3147665 - DNA, 20 bp, Homo sapiens
tatccatgtacttgtttgca

SEQ ID NO: 3147666 - DNA, 22 bp, Homo sapiens
tatcccaaagttgttgtaacct

SEQ ID NO: 3147667 - DNA, 22 bp, Homo sapiens
tatcccaatcaaagaattacag

SEQ ID NO: 3147668 - DNA, 13 bp, Homo sapiens
tatcccattctgc

SEQ ID NO: 3147669 - DNA, 13 bp, Homo sapiens
tatccccaaatta

SEQ ID NO: 3147670 - DNA, 13 bp, Homo sapiens
tatccccatctcc

SEQ ID NO: 3147671 - DNA, 17 bp, Homo sapiens
tatccccatctccctgc

SEQ ID NO: 3147672 - DNA, 20 bp, Homo sapiens
tatccccatctccctgcctg

SEQ ID NO: 3147673 - DNA, 15 bp, Homo sapiens
tatccccccatcttg

SEQ ID NO: 3147674 - DNA, 19 bp, Homo sapiens
tatccccccatcttgcttc

SEQ ID NO: 3147675 - DNA, 14 bp, Homo sapiens
tatcccccccagcc

SEQ ID NO: 3147676 - DNA, 18 bp, Homo sapiens
tatcccccccagcctggc

SEQ ID NO: 3147677 - DNA, 14 bp, Homo sapiens
tatcccctgctacc

SEQ ID NO: 3147678 - DNA, 17 bp, Homo sapiens
tatcccgagtctgggac

SEQ ID NO: 3147679 - DNA, 15 bp, Homo sapiens
tatccctcacctgta

SEQ ID NO: 3147680 - DNA, 19 bp, Homo sapiens
tatccctgcggcctccaca

SEQ ID NO: 3147681 - DNA, 10 bp, Homo sapiens
tatcccttcc

SEQ ID NO: 3147682 - DNA, 11 bp, Homo sapiens
tatcccttccg

SEQ ID NO: 3147683 - DNA, 12 bp, Homo sapiens
tatcccttctca

SEQ ID NO: 3147684 - DNA, 21 bp, Homo sapiens
tatccctttacaatgtgaata

SEQ ID NO: 3147685 - DNA, 17 bp, Homo sapiens
tatccgactctaagctg

SEQ ID NO: 3147686 - DNA, 19 bp, Homo sapiens
tatccgactctaagctgtg

SEQ ID NO: 3147687 - DNA, 23 bp, Homo sapiens
tatccgactctaagctgtgtgca

SEQ ID NO: 3147688 - DNA, 14 bp, Homo sapiens
tatccgctgccagc

SEQ ID NO: 3147689 - DNA, 19 bp, Homo sapiens
tatcctacaacaagagttt

SEQ ID NO: 3147690 - DNA, 16 bp, Homo sapiens
tatcctcactgccctc

SEQ ID NO: 3147691 - DNA, 23 bp, Homo sapiens
tatcctgacttctaatatcattc

SEQ ID NO: 3147692 - DNA, 18 bp, Homo sapiens
tatcctgccaaaatcatt

SEQ ID NO: 3147693 - DNA, 14 bp, Homo sapiens
tatcctgtgactgt

SEQ ID NO: 3147694 - DNA, 16 bp, Homo sapiens
tatcctgtgactgtct

SEQ ID NO: 3147695 - DNA, 20 bp, Homo sapiens
tatcgaaataacaatgttaa

SEQ ID NO: 3147696 - DNA, 22 bp, Homo sapiens
tatcgagtttgcaatgtcacaa

SEQ ID NO: 3147697 - DNA, 16 bp, Homo sapiens
tatcgatctcttattt

SEQ ID NO: 3147698 - DNA, 16 bp, Homo sapiens
tatcgatgttttatta

SEQ ID NO: 3147699 - DNA, 17 bp, Homo sapiens
tatcgggaacagtgttt

SEQ ID NO: 3147700 - DNA, 12 bp, Homo sapiens
tatcgtttttgt

SEQ ID NO: 3147701 - DNA, 18 bp, Homo sapiens
tatcgtttttgtattttc

SEQ ID NO: 3147702 - DNA, 23 bp, Homo sapiens
tatctaaaccatatgaacatata

SEQ ID NO: 3147703 - DNA, 15 bp, Homo sapiens
tatctaaagtttgtt

SEQ ID NO: 3147704 - DNA, 12 bp, Homo sapiens
tatctaaatgat

SEQ ID NO: 3147705 - DNA, 15 bp, Homo sapiens
tatctaaatgttgaa

SEQ ID NO: 3147706 - DNA, 16 bp, Homo sapiens
tatctaatacctctgt

SEQ ID NO: 3147707 - DNA, 17 bp, Homo sapiens
tatctaatatatatgaa

SEQ ID NO: 3147708 - DNA, 18 bp, Homo sapiens
tatctaattatttccact

SEQ ID NO: 3147709 - DNA, 17 bp, Homo sapiens
tatctagaaagaaaaga

SEQ ID NO: 3147710 - DNA, 21 bp, Homo sapiens
tatctagaaagaaaagaccct

SEQ ID NO: 3147711 - DNA, 19 bp, Homo sapiens
tatctagtgcagctgattt

SEQ ID NO: 3147712 - DNA, 13 bp, Homo sapiens
tatctatataaaa

SEQ ID NO: 3147713 - DNA, 14 bp, Homo sapiens
tatctatataaaat

SEQ ID NO: 3147714 - DNA, 13 bp, Homo sapiens
tatctatatatgt

SEQ ID NO: 3147715 - DNA, 16 bp, Homo sapiens
tatctatatatgtgta

SEQ ID NO: 3147716 - DNA, 20 bp, Homo sapiens
tatctattaaaattgccatt

SEQ ID NO: 3147717 - DNA, 15 bp, Homo sapiens
tatctattaatatat

SEQ ID NO: 3147718 - DNA, 18 bp, Homo sapiens
tatctattaatatatgta

SEQ ID NO: 3147719 - DNA, 22 bp, Homo sapiens
tatctcaatgaaccataaattc

SEQ ID NO: 3147720 - DNA, 10 bp, Homo sapiens
tatctcagaa

SEQ ID NO: 3147721 - DNA, 12 bp, Homo sapiens
tatctcagaaag

SEQ ID NO: 3147722 - DNA, 19 bp, Homo sapiens
tatctcagaaagtgcctga

SEQ ID NO: 3147723 - DNA, 18 bp, Homo sapiens
tatctcagtcatgcataa

SEQ ID NO: 3147724 - DNA, 21 bp, Homo sapiens
tatctcagtctaaggtctcat

SEQ ID NO: 3147725 - DNA, 22 bp, Homo sapiens
tatctcagtctaaggtctcatg

SEQ ID NO: 3147726 - DNA, 16 bp, Homo sapiens
tatctcatactgtctg

SEQ ID NO: 3147727 - DNA, 22 bp, Homo sapiens
tatctccatgatgatagttgaa

SEQ ID NO: 3147728 - DNA, 13 bp, Homo sapiens
tatctcctgacag

SEQ ID NO: 3147729 - DNA, 13 bp, Homo sapiens
tatctcctgctct

SEQ ID NO: 3147730 - DNA, 20 bp, Homo sapiens
tatctcctgtgatcctttga

SEQ ID NO: 3147731 - DNA, 16 bp, Homo sapiens
tatctcgtgggagagc

SEQ ID NO: 3147732 - DNA, 18 bp, Homo sapiens
tatctctatttaatattt

SEQ ID NO: 3147733 - DNA, 20 bp, Homo sapiens
tatctctctctctttttgga

SEQ ID NO: 3147734 - DNA, 16 bp, Homo sapiens
tatctctgaagcatgt

SEQ ID NO: 3147735 - DNA, 17 bp, Homo sapiens
tatctctgaagcatgtt

SEQ ID NO: 3147736 - DNA, 18 bp, Homo sapiens
tatctctgaagcatgttt

SEQ ID NO: 3147737 - DNA, 18 bp, Homo sapiens
tatctctgagttctgtgt

SEQ ID NO: 3147738 - DNA, 12 bp, Homo sapiens
tatctctgtgtt

SEQ ID NO: 3147739 - DNA, 13 bp, Homo sapiens
tatctcttggaaa

SEQ ID NO: 3147740 - DNA, 14 bp, Homo sapiens
tatctcttggaaaa

SEQ ID NO: 3147741 - DNA, 18 bp, Homo sapiens
tatctcttggaaaataag

SEQ ID NO: 3147742 - DNA, 16 bp, Homo sapiens
tatctcttttatattt

SEQ ID NO: 3147743 - DNA, 14 bp, Homo sapiens
tatctgaaaatgta

SEQ ID NO: 3147744 - DNA, 17 bp, Homo sapiens
tatctgagggaggaggc

SEQ ID NO: 3147745 - DNA, 14 bp, Homo sapiens
tatctgagttgcca

SEQ ID NO: 3147746 - DNA, 23 bp, Homo sapiens
tatctgagttgccaagacaaatc

SEQ ID NO: 3147747 - DNA, 16 bp, Homo sapiens
tatctgattttgtgca

SEQ ID NO: 3147748 - DNA, 13 bp, Homo sapiens
tatctgcctggcc

SEQ ID NO: 3147749 - DNA, 14 bp, Homo sapiens
tatctgcctggcct

SEQ ID NO: 3147750 - DNA, 20 bp, Homo sapiens
tatctgcttcagtggagaat

SEQ ID NO: 3147751 - DNA, 19 bp, Homo sapiens
tatctggaagtaaccattt

SEQ ID NO: 3147752 - DNA, 23 bp, Homo sapiens
tatctgggattatggttttgtga

SEQ ID NO: 3147753 - DNA, 22 bp, Homo sapiens
tatctgggattattctttgaaa

SEQ ID NO: 3147754 - DNA, 13 bp, Homo sapiens
tatctgtaatgat

SEQ ID NO: 3147755 - DNA, 21 bp, Homo sapiens
tatctgtagacggctcagtat

SEQ ID NO: 3147756 - DNA, 15 bp, Homo sapiens
tatctgtcagctgca

SEQ ID NO: 3147757 - DNA, 18 bp, Homo sapiens
tatctgtcatatagtaaa

SEQ ID NO: 3147758 - DNA, 23 bp, Homo sapiens
tatctgtcatttgagcagggctc

SEQ ID NO: 3147759 - DNA, 20 bp, Homo sapiens
tatctgtgtttttgaaatat

SEQ ID NO: 3147760 - DNA, 15 bp, Homo sapiens
tatcttaaagaaaca

SEQ ID NO: 3147761 - DNA, 23 bp, Homo sapiens
tatcttaaagaaacagctttcaa

SEQ ID NO: 3147762 - DNA, 17 bp, Homo sapiens
tatcttaattctttgtt

SEQ ID NO: 3147763 - DNA, 19 bp, Homo sapiens
tatcttagatgtttcacac

SEQ ID NO: 3147764 - DNA, 18 bp, Homo sapiens
tatcttcaaactttcact

SEQ ID NO: 3147765 - DNA, 14 bp, Homo sapiens
tatcttcacatagt

SEQ ID NO: 3147766 - DNA, 19 bp, Homo sapiens
tatcttcacattgtgtgaa

SEQ ID NO: 3147767 - DNA, 13 bp, Homo sapiens
tatcttccaaatg

SEQ ID NO: 3147768 - DNA, 16 bp, Homo sapiens
tatcttcctttcttgt

SEQ ID NO: 3147769 - DNA, 20 bp, Homo sapiens
tatcttctcaagttctaaga

SEQ ID NO: 3147770 - DNA, 22 bp, Homo sapiens
tatcttctcaagttctaagatt

SEQ ID NO: 3147771 - DNA, 23 bp, Homo sapiens
tatcttggtgaatttttttttcc

SEQ ID NO: 3147772 - DNA, 15 bp, Homo sapiens
tatcttgtctctggg

SEQ ID NO: 3147773 - DNA, 13 bp, Homo sapiens
tatcttgtgttgt

SEQ ID NO: 3147774 - DNA, 18 bp, Homo sapiens
tatcttgtgttgtccttt

SEQ ID NO: 3147775 - DNA, 16 bp, Homo sapiens
tatctttatacagatt

SEQ ID NO: 3147776 - DNA, 14 bp, Homo sapiens
tatctttattaatc

SEQ ID NO: 3147777 - DNA, 13 bp, Homo sapiens
tatctttctttcc

SEQ ID NO: 3147778 - DNA, 18 bp, Homo sapiens
tatctttgtgataattta

SEQ ID NO: 3147779 - DNA, 23 bp, Homo sapiens
tatctttttaaaaactcttcagt

SEQ ID NO: 3147780 - DNA, 18 bp, Homo sapiens
tatctttttacctttcat

SEQ ID NO: 3147781 - DNA, 20 bp, Homo sapiens
tatgaaaaaatatgaaccta

SEQ ID NO: 3147782 - DNA, 20 bp, Homo sapiens
tatgaaaacaagttccaaat

SEQ ID NO: 3147783 - DNA, 15 bp, Homo sapiens
tatgaaaacttatga

SEQ ID NO: 3147784 - DNA, 19 bp, Homo sapiens
tatgaaaatgagttgtgaa

SEQ ID NO: 3147785 - DNA, 14 bp, Homo sapiens
tatgaaataaagaa

SEQ ID NO: 3147786 - DNA, 14 bp, Homo sapiens
tatgaacaactcca

SEQ ID NO: 3147787 - DNA, 19 bp, Homo sapiens
tatgaacatattgttgaaa

SEQ ID NO: 3147788 - DNA, 16 bp, Homo sapiens
tatgaaccctttgttt

SEQ ID NO: 3147789 - DNA, 14 bp, Homo sapiens
tatgaacctatttt

SEQ ID NO: 3147790 - DNA, 21 bp, Homo sapiens
tatgaagaaaaagtacaatga

SEQ ID NO: 3147791 - DNA, 19 bp, Homo sapiens
tatgaagataagtgtattt

SEQ ID NO: 3147792 - DNA, 16 bp, Homo sapiens
tatgaagttggcacat

SEQ ID NO: 3147793 - DNA, 17 bp, Homo sapiens
tatgaagttggcacatt

SEQ ID NO: 3147794 - DNA, 15 bp, Homo sapiens
tatgaataattgcat

SEQ ID NO: 3147795 - DNA, 16 bp, Homo sapiens
tatgaatatcattgat

SEQ ID NO: 3147796 - DNA, 18 bp, Homo sapiens
tatgaatattactctcaa

SEQ ID NO: 3147797 - DNA, 20 bp, Homo sapiens
tatgaatggaggatattcta

SEQ ID NO: 3147798 - DNA, 21 bp, Homo sapiens
tatgaattcaagaaaggaaat

SEQ ID NO: 3147799 - DNA, 18 bp, Homo sapiens
tatgaattgaattatctt

SEQ ID NO: 3147800 - DNA, 22 bp, Homo sapiens
tatgaattgtacagaatatttc

SEQ ID NO: 3147801 - DNA, 15 bp, Homo sapiens
tatgaatttaaatat

SEQ ID NO: 3147802 - DNA, 21 bp, Homo sapiens
tatgaatttaaatataattct

SEQ ID NO: 3147803 - DNA, 23 bp, Homo sapiens
tatgaatttaaatataattctgt

SEQ ID NO: 3147804 - DNA, 22 bp, Homo sapiens
tatgacagatatatttaagcct

SEQ ID NO: 3147805 - DNA, 19 bp, Homo sapiens
tatgacatcacttgtacaa

SEQ ID NO: 3147806 - DNA, 12 bp, Homo sapiens
tatgacatttaa

SEQ ID NO: 3147807 - DNA, 13 bp, Homo sapiens
tatgacatttcta

SEQ ID NO: 3147808 - DNA, 18 bp, Homo sapiens
tatgaccatatttactct

SEQ ID NO: 3147809 - DNA, 23 bp, Homo sapiens
tatgacgcggctcaaaaggaaac

SEQ ID NO: 3147810 - DNA, 23 bp, Homo sapiens
tatgacgctgatacataactaaa

SEQ ID NO: 3147811 - DNA, 15 bp, Homo sapiens
tatgactaaagagag

SEQ ID NO: 3147812 - DNA, 16 bp, Homo sapiens
tatgactaaagagaga

SEQ ID NO: 3147813 - DNA, 17 bp, Homo sapiens
tatgactgctccccagc

SEQ ID NO: 3147814 - DNA, 19 bp, Homo sapiens
tatgagatggttaaaaagg

SEQ ID NO: 3147815 - DNA, 14 bp, Homo sapiens
tatgagattggttt

SEQ ID NO: 3147816 - DNA, 20 bp, Homo sapiens
tatgagattggttttcctgt

SEQ ID NO: 3147817 - DNA, 16 bp, Homo sapiens
tatgagccagacaaat

SEQ ID NO: 3147818 - DNA, 16 bp, Homo sapiens
tatgagctacaacaaa

SEQ ID NO: 3147819 - DNA, 21 bp, Homo sapiens
tatgagcttccttctgtgaaa

SEQ ID NO: 3147820 - DNA, 15 bp, Homo sapiens
tatgagggaaaatga

SEQ ID NO: 3147821 - DNA, 15 bp, Homo sapiens
tatgagggtgtttcc

SEQ ID NO: 3147822 - DNA, 16 bp, Homo sapiens
tatgagtatacaatat

SEQ ID NO: 3147823 - DNA, 20 bp, Homo sapiens
tatgagtatacaatatataa

SEQ ID NO: 3147824 - DNA, 15 bp, Homo sapiens
tatgagtcaatgtgc

SEQ ID NO: 3147825 - DNA, 14 bp, Homo sapiens
tatgagtctagatg

SEQ ID NO: 3147826 - DNA, 16 bp, Homo sapiens
tatgagtctagatgtt

SEQ ID NO: 3147827 - DNA, 23 bp, Homo sapiens
tatgagtttttgatagctttatt

SEQ ID NO: 3147828 - DNA, 15 bp, Homo sapiens
tatgataatagattc

SEQ ID NO: 3147829 - DNA, 23 bp, Homo sapiens
tatgatattgtttaaaattcagt

SEQ ID NO: 3147830 - DNA, 13 bp, Homo sapiens
tatgatatttctt

SEQ ID NO: 3147831 - DNA, 21 bp, Homo sapiens
tatgatcacggctcactgcag

SEQ ID NO: 3147832 - DNA, 16 bp, Homo sapiens
tatgatcagtgttact

SEQ ID NO: 3147833 - DNA, 17 bp, Homo sapiens
tatgatcagtgttgttg

SEQ ID NO: 3147834 - DNA, 20 bp, Homo sapiens
tatgatcattgaaatacttt

SEQ ID NO: 3147835 - DNA, 15 bp, Homo sapiens
tatgatccagagcag

SEQ ID NO: 3147836 - DNA, 18 bp, Homo sapiens
tatgatccagagcagagt

SEQ ID NO: 3147837 - DNA, 19 bp, Homo sapiens
tatgatccttttttgtcat

SEQ ID NO: 3147838 - DNA, 15 bp, Homo sapiens
tatgatcgcgccact

SEQ ID NO: 3147839 - DNA, 22 bp, Homo sapiens
tatgatgatgaaaattttacca

SEQ ID NO: 3147840 - DNA, 17 bp, Homo sapiens
tatgatgcatacagttt

SEQ ID NO: 3147841 - DNA, 21 bp, Homo sapiens
tatgatgcatacagttttcta

SEQ ID NO: 3147842 - DNA, 18 bp, Homo sapiens
tatgatgctaatcttgtc

SEQ ID NO: 3147843 - DNA, 21 bp, Homo sapiens
tatgatggatggcagactctt

SEQ ID NO: 3147844 - DNA, 13 bp, Homo sapiens
tatgatgtatatt

SEQ ID NO: 3147845 - DNA, 15 bp, Homo sapiens
tatgatgtgttgtga

SEQ ID NO: 3147846 - DNA, 15 bp, Homo sapiens
tatgattactggcct

SEQ ID NO: 3147847 - DNA, 21 bp, Homo sapiens
tatgattattaacgatgtcca

SEQ ID NO: 3147848 - DNA, 15 bp, Homo sapiens
tatgattattaatca

SEQ ID NO: 3147849 - DNA, 14 bp, Homo sapiens
tatgattgtacttt

SEQ ID NO: 3147850 - DNA, 15 bp, Homo sapiens
tatgattgtactttg

SEQ ID NO: 3147851 - DNA, 14 bp, Homo sapiens
tatgatttaataaa

SEQ ID NO: 3147852 - DNA, 17 bp, Homo sapiens
tatgatttataaacaga

SEQ ID NO: 3147853 - DNA, 19 bp, Homo sapiens
tatgatttataaacagaca

SEQ ID NO: 3147854 - DNA, 22 bp, Homo sapiens
tatgatttcactagaaaagctg

SEQ ID NO: 3147855 - DNA, 16 bp, Homo sapiens
tatgatttgtaacatt

SEQ ID NO: 3147856 - DNA, 16 bp, Homo sapiens
tatgatttgttttgaa

SEQ ID NO: 3147857 - DNA, 22 bp, Homo sapiens
tatgatttgttttgaattttgt

SEQ ID NO: 3147858 - DNA, 17 bp, Homo sapiens
tatgatttttttttcca

SEQ ID NO: 3147859 - DNA, 12 bp, Homo sapiens
tatgcaagcagc

SEQ ID NO: 3147860 - DNA, 18 bp, Homo sapiens
tatgcaatcaaatctgct

SEQ ID NO: 3147861 - DNA, 18 bp, Homo sapiens
tatgcaccttgtgtctgt

SEQ ID NO: 3147862 - DNA, 23 bp, Homo sapiens
tatgcagaagcatattttgctgg

SEQ ID NO: 3147863 - DNA, 13 bp, Homo sapiens
tatgcagcctgct

SEQ ID NO: 3147864 - DNA, 17 bp, Homo sapiens
tatgcattattaaattg

SEQ ID NO: 3147865 - DNA, 19 bp, Homo sapiens
tatgcattcacatttagaa

SEQ ID NO: 3147866 - DNA, 23 bp, Homo sapiens
tatgcattcacatttagaaaagt

SEQ ID NO: 3147867 - DNA, 21 bp, Homo sapiens
tatgcattcttataacataac

SEQ ID NO: 3147868 - DNA, 13 bp, Homo sapiens
tatgcatttcatt

SEQ ID NO: 3147869 - DNA, 23 bp, Homo sapiens
tatgcatttcattcaaatcagtg

SEQ ID NO: 3147870 - DNA, 17 bp, Homo sapiens
tatgccacacctggcct

SEQ ID NO: 3147871 - DNA, 23 bp, Homo sapiens
tatgccctcaagtaaaagaaaag

SEQ ID NO: 3147872 - DNA, 13 bp, Homo sapiens
tatgcctgacccc

SEQ ID NO: 3147873 - DNA, 14 bp, Homo sapiens
tatgccttcttatt

SEQ ID NO: 3147874 - DNA, 20 bp, Homo sapiens
tatgcctttaaatctgtgat

SEQ ID NO: 3147875 - DNA, 22 bp, Homo sapiens
tatgcctttaaatctgtgatga

SEQ ID NO: 3147876 - DNA, 13 bp, Homo sapiens
tatgcctttctct

SEQ ID NO: 3147877 - DNA, 18 bp, Homo sapiens
tatgctctacccttgtgt

SEQ ID NO: 3147878 - DNA, 14 bp, Homo sapiens
tatgctctgcatgt

SEQ ID NO: 3147879 - DNA, 22 bp, Homo sapiens
tatgctgagtatgttaagctct

SEQ ID NO: 3147880 - DNA, 15 bp, Homo sapiens
tatgctgatcatcgc

SEQ ID NO: 3147881 - DNA, 20 bp, Homo sapiens
tatgctgatcatcgccagag

SEQ ID NO: 3147882 - DNA, 16 bp, Homo sapiens
tatgctgccaaatttt

SEQ ID NO: 3147883 - DNA, 20 bp, Homo sapiens
tatgctgccaaattttggcc

SEQ ID NO: 3147884 - DNA, 22 bp, Homo sapiens
tatgctgccaaattttggccaa

SEQ ID NO: 3147885 - DNA, 13 bp, Homo sapiens
tatgctgtcatgg

SEQ ID NO: 3147886 - DNA, 19 bp, Homo sapiens
tatgcttaaaataagcagg

SEQ ID NO: 3147887 - DNA, 21 bp, Homo sapiens
tatgcttactgatatatttta

SEQ ID NO: 3147888 - DNA, 17 bp, Homo sapiens
tatgcttccattaacaa

SEQ ID NO: 3147889 - DNA, 18 bp, Homo sapiens
tatgcttccattaacaaa

SEQ ID NO: 3147890 - DNA, 13 bp, Homo sapiens
tatgctttattaa

SEQ ID NO: 3147891 - DNA, 15 bp, Homo sapiens
tatggaacttctaat

SEQ ID NO: 3147892 - DNA, 20 bp, Homo sapiens
tatggaatatcatctgtcat

SEQ ID NO: 3147893 - DNA, 14 bp, Homo sapiens
tatggaattacatg

SEQ ID NO: 3147894 - DNA, 14 bp, Homo sapiens
tatggaccactttt

SEQ ID NO: 3147895 - DNA, 13 bp, Homo sapiens
tatggactatctg

SEQ ID NO: 3147896 - DNA, 17 bp, Homo sapiens
tatggactatctgtctg

SEQ ID NO: 3147897 - DNA, 17 bp, Homo sapiens
tatggagaattgctgaa

SEQ ID NO: 3147898 - DNA, 18 bp, Homo sapiens
tatggagaattgctgaag

SEQ ID NO: 3147899 - DNA, 18 bp, Homo sapiens
tatggaggaacaactctc

SEQ ID NO: 3147900 - DNA, 20 bp, Homo sapiens
tatggatgattaaattttag

SEQ ID NO: 3147901 - DNA, 10 bp, Homo sapiens
tatggcactt

SEQ ID NO: 3147902 - DNA, 13 bp, Homo sapiens
tatggcacttctc

SEQ ID NO: 3147903 - DNA, 12 bp, Homo sapiens
tatggcagaaga

SEQ ID NO: 3147904 - DNA, 15 bp, Homo sapiens
tatggcagaagacac

SEQ ID NO: 3147905 - DNA, 23 bp, Homo sapiens
tatggcagaagggaattgctcag

SEQ ID NO: 3147906 - DNA, 13 bp, Homo sapiens
tatggcccagcct

SEQ ID NO: 3147907 - DNA, 12 bp, Homo sapiens
tatggcctcagc

SEQ ID NO: 3147908 - DNA, 14 bp, Homo sapiens
tatggctgcccagg

SEQ ID NO: 3147909 - DNA, 23 bp, Homo sapiens
tatggctttcaaagctaaaatat

SEQ ID NO: 3147910 - DNA, 18 bp, Homo sapiens
tatgggactgagcctggc

SEQ ID NO: 3147911 - DNA, 14 bp, Homo sapiens
tatgggatgtaaac

SEQ ID NO: 3147912 - DNA, 23 bp, Homo sapiens
tatgggatgtaaacaatgtaaag

SEQ ID NO: 3147913 - DNA, 15 bp, Homo sapiens
tatgggcattgacaa

SEQ ID NO: 3147914 - DNA, 17 bp, Homo sapiens
tatgggcattgtagtta

SEQ ID NO: 3147915 - DNA, 18 bp, Homo sapiens
tatgggtagggtaaatca

SEQ ID NO: 3147916 - DNA, 19 bp, Homo sapiens
tatgggtagggtaaatcag

SEQ ID NO: 3147917 - DNA, 22 bp, Homo sapiens
tatggtatgctggccagcaccc

SEQ ID NO: 3147918 - DNA, 14 bp, Homo sapiens
tatggtatgtagcc

SEQ ID NO: 3147919 - DNA, 21 bp, Homo sapiens
tatggtatttattttttcttt

SEQ ID NO: 3147920 - DNA, 14 bp, Homo sapiens
tatggtatttgagt

SEQ ID NO: 3147921 - DNA, 21 bp, Homo sapiens
tatggtcaatcccaaaagtca

SEQ ID NO: 3147922 - DNA, 16 bp, Homo sapiens
tatggtgaacccacaa

SEQ ID NO: 3147923 - DNA, 16 bp, Homo sapiens
tatggtgtgttcctaa

SEQ ID NO: 3147924 - DNA, 19 bp, Homo sapiens
tatggttactaaaaagtac

SEQ ID NO: 3147925 - DNA, 13 bp, Homo sapiens
tatggttatgaaa

SEQ ID NO: 3147926 - DNA, 20 bp, Homo sapiens
tatggttgatagtttacctg

SEQ ID NO: 3147927 - DNA, 22 bp, Homo sapiens
tatggttgatagtttacctgaa

SEQ ID NO: 3147928 - DNA, 15 bp, Homo sapiens
tatgtaaacaggaga

SEQ ID NO: 3147929 - DNA, 18 bp, Homo sapiens
tatgtaaacataattctt

SEQ ID NO: 3147930 - DNA, 23 bp, Homo sapiens
tatgtaaactgcattagaaatta

SEQ ID NO: 3147931 - DNA, 15 bp, Homo sapiens
tatgtaagagcacct

SEQ ID NO: 3147932 - DNA, 12 bp, Homo sapiens
tatgtaatactt

SEQ ID NO: 3147933 - DNA, 16 bp, Homo sapiens
tatgtaatgaagtaaa

SEQ ID NO: 3147934 - DNA, 23 bp, Homo sapiens
tatgtaatgaagtaaagccatta

SEQ ID NO: 3147935 - DNA, 14 bp, Homo sapiens
tatgtacaattgtg

SEQ ID NO: 3147936 - DNA, 15 bp, Homo sapiens
tatgtacatgagaag

SEQ ID NO: 3147937 - DNA, 17 bp, Homo sapiens
tatgtacatttgtcttt

SEQ ID NO: 3147938 - DNA, 16 bp, Homo sapiens
tatgtacgtttgtatg

SEQ ID NO: 3147939 - DNA, 21 bp, Homo sapiens
tatgtacgtttgtatgtgtgt

SEQ ID NO: 3147940 - DNA, 20 bp, Homo sapiens
tatgtactcctctttacact

SEQ ID NO: 3147941 - DNA, 15 bp, Homo sapiens
tatgtacttagctgt

SEQ ID NO: 3147942 - DNA, 20 bp, Homo sapiens
tatgtacttgatactgaatg

SEQ ID NO: 3147943 - DNA, 15 bp, Homo sapiens
tatgtagatatttgg

SEQ ID NO: 3147944 - DNA, 18 bp, Homo sapiens
tatgtagatatttggctt

SEQ ID NO: 3147945 - DNA, 12 bp, Homo sapiens
tatgtagatgtg

SEQ ID NO: 3147946 - DNA, 21 bp, Homo sapiens
tatgtagcaggaaataaagta

SEQ ID NO: 3147947 - DNA, 17 bp, Homo sapiens
tatgtaggtaagactgt

SEQ ID NO: 3147948 - DNA, 22 bp, Homo sapiens
tatgtatatgacatttaaatgt

SEQ ID NO: 3147949 - DNA, 17 bp, Homo sapiens
tatgtatgtttacatat

SEQ ID NO: 3147950 - DNA, 17 bp, Homo sapiens
tatgtattcccttgtat

SEQ ID NO: 3147951 - DNA, 18 bp, Homo sapiens
tatgtattcccttgtatt

SEQ ID NO: 3147952 - DNA, 20 bp, Homo sapiens
tatgtattcccttgtatttt

SEQ ID NO: 3147953 - DNA, 12 bp, Homo sapiens
tatgtattcttt

SEQ ID NO: 3147954 - DNA, 14 bp, Homo sapiens
tatgtattcttttc

SEQ ID NO: 3147955 - DNA, 12 bp, Homo sapiens
tatgtatttata

SEQ ID NO: 3147956 - DNA, 15 bp, Homo sapiens
tatgtcagtactatt

SEQ ID NO: 3147957 - DNA, 23 bp, Homo sapiens
tatgtccactgtgtatagaagta

SEQ ID NO: 3147958 - DNA, 16 bp, Homo sapiens
tatgtcgatgcacagt

SEQ ID NO: 3147959 - DNA, 14 bp, Homo sapiens
tatgtctcttctga

SEQ ID NO: 3147960 - DNA, 19 bp, Homo sapiens
tatgtctcttctgagctat

SEQ ID NO: 3147961 - DNA, 10 bp, Homo sapiens
tatgtctgtt

SEQ ID NO: 3147962 - DNA, 15 bp, Homo sapiens
tatgtcttcttttgt

SEQ ID NO: 3147963 - DNA, 21 bp, Homo sapiens
tatgtcttggacactgtacaa

SEQ ID NO: 3147964 - DNA, 17 bp, Homo sapiens
tatgtgaaagtgtaaaa

SEQ ID NO: 3147965 - DNA, 23 bp, Homo sapiens
tatgtgagtgccttttgcagaag

SEQ ID NO: 3147966 - DNA, 17 bp, Homo sapiens
tatgtgcactaccatag

SEQ ID NO: 3147967 - DNA, 17 bp, Homo sapiens
tatgtgcactgtcactt

SEQ ID NO: 3147968 - DNA, 20 bp, Homo sapiens
tatgtgcactgtcactttgc

SEQ ID NO: 3147969 - DNA, 21 bp, Homo sapiens
tatgtgcactgtcactttgct

SEQ ID NO: 3147970 - DNA, 21 bp, Homo sapiens
tatgtggctgaaaatgcaaag

SEQ ID NO: 3147971 - DNA, 19 bp, Homo sapiens
tatgtgggatattgaatgt

SEQ ID NO: 3147972 - DNA, 21 bp, Homo sapiens
tatgtgggtcttatgcttcca

SEQ ID NO: 3147973 - DNA, 16 bp, Homo sapiens
tatgtggttttagatt

SEQ ID NO: 3147974 - DNA, 17 bp, Homo sapiens
tatgtgtaaaatgtgaa

SEQ ID NO: 3147975 - DNA, 14 bp, Homo sapiens
tatgtgtatatata

SEQ ID NO: 3147976 - DNA, 12 bp, Homo sapiens
tatgtgtatgta

SEQ ID NO: 3147977 - DNA, 15 bp, Homo sapiens
tatgtgtctgctaat

SEQ ID NO: 3147978 - DNA, 15 bp, Homo sapiens
tatgtgtgaggagct

SEQ ID NO: 3147979 - DNA, 23 bp, Homo sapiens
tatgtgtggtttcagttctgtgt

SEQ ID NO: 3147980 - DNA, 15 bp, Homo sapiens
tatgttaaaagattt

SEQ ID NO: 3147981 - DNA, 19 bp, Homo sapiens
tatgttaaagtttaagtgt

SEQ ID NO: 3147982 - DNA, 19 bp, Homo sapiens
tatgttaacctcagtgtca

SEQ ID NO: 3147983 - DNA, 19 bp, Homo sapiens
tatgttaagggaagaattc

SEQ ID NO: 3147984 - DNA, 12 bp, Homo sapiens
tatgttactatt

SEQ ID NO: 3147985 - DNA, 16 bp, Homo sapiens
tatgttactattttct

SEQ ID NO: 3147986 - DNA, 17 bp, Homo sapiens
tatgttatacaaggcaa

SEQ ID NO: 3147987 - DNA, 20 bp, Homo sapiens
tatgttatgatattgtttaa

SEQ ID NO: 3147988 - DNA, 12 bp, Homo sapiens
tatgttcatttt

SEQ ID NO: 3147989 - DNA, 23 bp, Homo sapiens
tatgttcttgggtggttcctaag

SEQ ID NO: 3147990 - DNA, 15 bp, Homo sapiens
tatgttgaatacttt

SEQ ID NO: 3147991 - DNA, 16 bp, Homo sapiens
tatgttgcccaggcag

SEQ ID NO: 3147992 - DNA, 19 bp, Homo sapiens
tatgttgcccaggcaggtc

SEQ ID NO: 3147993 - DNA, 21 bp, Homo sapiens
tatgttgcccaggcaggtctt

SEQ ID NO: 3147994 - DNA, 17 bp, Homo sapiens
tatgttgctcagtctcc

SEQ ID NO: 3147995 - DNA, 22 bp, Homo sapiens
tatgttgtaatatttcttcaaa

SEQ ID NO: 3147996 - DNA, 16 bp, Homo sapiens
tatgttgtacaatcaa

SEQ ID NO: 3147997 - DNA, 21 bp, Homo sapiens
tatgttgtccaattgttgaca

SEQ ID NO: 3147998 - DNA, 16 bp, Homo sapiens
tatgttgtgttctaat

SEQ ID NO: 3147999 - DNA, 13 bp, Homo sapiens
tatgtttattaca

SEQ ID NO: 3148000 - DNA, 15 bp, Homo sapiens
tatgtttattacaat

SEQ ID NO: 3148001 - DNA, 23 bp, Homo sapiens
tatgtttattacaatttttaata

SEQ ID NO: 3148002 - DNA, 14 bp, Homo sapiens
tatgtttccttgtt

SEQ ID NO: 3148003 - DNA, 14 bp, Homo sapiens
tatgtttgcacact

SEQ ID NO: 3148004 - DNA, 19 bp, Homo sapiens
tatgtttgcacacttgtgt

SEQ ID NO: 3148005 - DNA, 18 bp, Homo sapiens
tatgtttgtgtgatttcc

SEQ ID NO: 3148006 - DNA, 18 bp, Homo sapiens
tatgttttgtttctgaaa

SEQ ID NO: 3148007 - DNA, 18 bp, Homo sapiens
tatgttttttgtaagata

SEQ ID NO: 3148008 - DNA, 13 bp, Homo sapiens
tattaaaaaacaa

SEQ ID NO: 3148009 - DNA, 15 bp, Homo sapiens
tattaaaaaacttca

SEQ ID NO: 3148010 - DNA, 18 bp, Homo sapiens
tattaaaaaacttcatgt

SEQ ID NO: 3148011 - DNA, 20 bp, Homo sapiens
tattaaaaatatggaacttc

SEQ ID NO: 3148012 - DNA, 14 bp, Homo sapiens
tattaaaaatgttc

SEQ ID NO: 3148013 - DNA, 21 bp, Homo sapiens
tattaaaaatgttctcaaata

SEQ ID NO: 3148014 - DNA, 12 bp, Homo sapiens
tattaaaactaa

SEQ ID NO: 3148015 - DNA, 17 bp, Homo sapiens
tattaaaactaaatttc

SEQ ID NO: 3148016 - DNA, 17 bp, Homo sapiens
tattaaaatgattgtaa

SEQ ID NO: 3148017 - DNA, 18 bp, Homo sapiens
tattaaaatgattgtaaa

SEQ ID NO: 3148018 - DNA, 21 bp, Homo sapiens
tattaaaattacagatgtgaa

SEQ ID NO: 3148019 - DNA, 22 bp, Homo sapiens
tattaaaattacagatgtgaaa

SEQ ID NO: 3148020 - DNA, 14 bp, Homo sapiens
tattaaaattccaa

SEQ ID NO: 3148021 - DNA, 19 bp, Homo sapiens
tattaaaattccaaattca

SEQ ID NO: 3148022 - DNA, 19 bp, Homo sapiens
tattaaaattgccatttta

SEQ ID NO: 3148023 - DNA, 14 bp, Homo sapiens
tattaaaattgtaa

SEQ ID NO: 3148024 - DNA, 18 bp, Homo sapiens
tattaaacaaagtttcag

SEQ ID NO: 3148025 - DNA, 19 bp, Homo sapiens
tattaaagattctctttaa

SEQ ID NO: 3148026 - DNA, 20 bp, Homo sapiens
tattaaagattctctttaaa

SEQ ID NO: 3148027 - DNA, 18 bp, Homo sapiens
tattaaagggtctggaaa

SEQ ID NO: 3148028 - DNA, 14 bp, Homo sapiens
tattaaataaaatc

SEQ ID NO: 3148029 - DNA, 16 bp, Homo sapiens
tattaaatacaaaact

SEQ ID NO: 3148030 - DNA, 19 bp, Homo sapiens
tattaaatacaaaacttcc

SEQ ID NO: 3148031 - DNA, 12 bp, Homo sapiens
tattaaatagtt

SEQ ID NO: 3148032 - DNA, 20 bp, Homo sapiens
tattaaattgtgtacacttt

SEQ ID NO: 3148033 - DNA, 22 bp, Homo sapiens
tattaaatttgttgacaaaatt

SEQ ID NO: 3148034 - DNA, 14 bp, Homo sapiens
tattaacaaaagtt

SEQ ID NO: 3148035 - DNA, 23 bp, Homo sapiens
tattaacaaacatcactctgctg

SEQ ID NO: 3148036 - DNA, 16 bp, Homo sapiens
tattaagaaagactat

SEQ ID NO: 3148037 - DNA, 15 bp, Homo sapiens
tattaagacagtgta

SEQ ID NO: 3148038 - DNA, 17 bp, Homo sapiens
tattaagacagtgtaca

SEQ ID NO: 3148039 - DNA, 21 bp, Homo sapiens
tattaagatggattctcagat

SEQ ID NO: 3148040 - DNA, 15 bp, Homo sapiens
tattaagatttccaa

SEQ ID NO: 3148041 - DNA, 19 bp, Homo sapiens
tattaagctttttggaatc

SEQ ID NO: 3148042 - DNA, 22 bp, Homo sapiens
tattaagtctgggatgtagaac

SEQ ID NO: 3148043 - DNA, 16 bp, Homo sapiens
tattaataaaaagaca

SEQ ID NO: 3148044 - DNA, 12 bp, Homo sapiens
tattaataaagc

SEQ ID NO: 3148045 - DNA, 17 bp, Homo sapiens
tattaataaagcattct

SEQ ID NO: 3148046 - DNA, 18 bp, Homo sapiens
tattaataaagcattctt

SEQ ID NO: 3148047 - DNA, 21 bp, Homo sapiens
tattaatataataatgatgat

SEQ ID NO: 3148048 - DNA, 14 bp, Homo sapiens
tattaatatatgta

SEQ ID NO: 3148049 - DNA, 22 bp, Homo sapiens
tattaatattcagggtaaatag

SEQ ID NO: 3148050 - DNA, 19 bp, Homo sapiens
tattaatcaccttctttgt

SEQ ID NO: 3148051 - DNA, 22 bp, Homo sapiens
tattaatttgaaaccaggacat

SEQ ID NO: 3148052 - DNA, 20 bp, Homo sapiens
tattaattttccaatgcaca

SEQ ID NO: 3148053 - DNA, 11 bp, Homo sapiens
tattacaaata

SEQ ID NO: 3148054 - DNA, 14 bp, Homo sapiens
tattacaatttgta

SEQ ID NO: 3148055 - DNA, 17 bp, Homo sapiens
tattacactgtatttgt

SEQ ID NO: 3148056 - DNA, 14 bp, Homo sapiens
tattacatctaatg

SEQ ID NO: 3148057 - DNA, 16 bp, Homo sapiens
tattaccagcaagaat

SEQ ID NO: 3148058 - DNA, 19 bp, Homo sapiens
tattaccagcaagaataaa

SEQ ID NO: 3148059 - DNA, 17 bp, Homo sapiens
tattaccaggtccattt

SEQ ID NO: 3148060 - DNA, 23 bp, Homo sapiens
tattaccttaagatttttctttt

SEQ ID NO: 3148061 - DNA, 16 bp, Homo sapiens
tattactgacatttct

SEQ ID NO: 3148062 - DNA, 17 bp, Homo sapiens
tattactgacatttctt

SEQ ID NO: 3148063 - DNA, 22 bp, Homo sapiens
tattactgttgcatttactttt

SEQ ID NO: 3148064 - DNA, 18 bp, Homo sapiens
tattactgtttatttctg

SEQ ID NO: 3148065 - DNA, 23 bp, Homo sapiens
tattacttaggttattttgcttt

SEQ ID NO: 3148066 - DNA, 14 bp, Homo sapiens
tattacttctgcta

SEQ ID NO: 3148067 - DNA, 18 bp, Homo sapiens
tattactttatcactttt

SEQ ID NO: 3148068 - DNA, 16 bp, Homo sapiens
tattagagcattgaat

SEQ ID NO: 3148069 - DNA, 15 bp, Homo sapiens
tattagatgtggttt

SEQ ID NO: 3148070 - DNA, 13 bp, Homo sapiens
tattagccaactg

SEQ ID NO: 3148071 - DNA, 17 bp, Homo sapiens
tattagccaggatcatg

SEQ ID NO: 3148072 - DNA, 16 bp, Homo sapiens
tattaggatctgcaaa

SEQ ID NO: 3148073 - DNA, 15 bp, Homo sapiens
tattagggagaaaat

SEQ ID NO: 3148074 - DNA, 14 bp, Homo sapiens
tattagtaccatag

SEQ ID NO: 3148075 - DNA, 22 bp, Homo sapiens
tattagtgattctgatttcagt

SEQ ID NO: 3148076 - DNA, 17 bp, Homo sapiens
tattataaaaatattaa

SEQ ID NO: 3148077 - DNA, 13 bp, Homo sapiens
tattataaatata

SEQ ID NO: 3148078 - DNA, 15 bp, Homo sapiens
tattataaatatata

SEQ ID NO: 3148079 - DNA, 23 bp, Homo sapiens
tattataaatatatataaagaat

SEQ ID NO: 3148080 - DNA, 13 bp, Homo sapiens
tattataaattct

SEQ ID NO: 3148081 - DNA, 16 bp, Homo sapiens
tattataacttaaaaa

SEQ ID NO: 3148082 - DNA, 23 bp, Homo sapiens
tattataagggagagctgagcca

SEQ ID NO: 3148083 - DNA, 14 bp, Homo sapiens
tattataattgtat

SEQ ID NO: 3148084 - DNA, 15 bp, Homo sapiens
tattatactaagaaa

SEQ ID NO: 3148085 - DNA, 20 bp, Homo sapiens
tattataggtaatcaatgaa

SEQ ID NO: 3148086 - DNA, 23 bp, Homo sapiens
tattatcctagattatatcaaag

SEQ ID NO: 3148087 - DNA, 18 bp, Homo sapiens
tattatcttgttcaggaa

SEQ ID NO: 3148088 - DNA, 19 bp, Homo sapiens
tattatgcattatatcaaa

SEQ ID NO: 3148089 - DNA, 20 bp, Homo sapiens
tattatggcttgtgaactgc

SEQ ID NO: 3148090 - DNA, 21 bp, Homo sapiens
tattatggcttgtgaactgct

SEQ ID NO: 3148091 - DNA, 22 bp, Homo sapiens
tattatggcttgtgaactgctg

SEQ ID NO: 3148092 - DNA, 21 bp, Homo sapiens
tattatgtctcttctgagcta

SEQ ID NO: 3148093 - DNA, 14 bp, Homo sapiens
tattatgtcttctt

SEQ ID NO: 3148094 - DNA, 13 bp, Homo sapiens
tattatgtgaaga

SEQ ID NO: 3148095 - DNA, 16 bp, Homo sapiens
tattatgtgaagaatt

SEQ ID NO: 3148096 - DNA, 16 bp, Homo sapiens
tattatgtttattaca

SEQ ID NO: 3148097 - DNA, 13 bp, Homo sapiens
tattattatatat

SEQ ID NO: 3148098 - DNA, 13 bp, Homo sapiens
tattattcaaacc

SEQ ID NO: 3148099 - DNA, 18 bp, Homo sapiens
tattattcaaaccaattt

SEQ ID NO: 3148100 - DNA, 13 bp, Homo sapiens
tattattctgcag

SEQ ID NO: 3148101 - DNA, 14 bp, Homo sapiens
tattattctgtttt

SEQ ID NO: 3148102 - DNA, 15 bp, Homo sapiens
tattattctgttttg

SEQ ID NO: 3148103 - DNA, 22 bp, Homo sapiens
tattattctgttttgcacagtt

SEQ ID NO: 3148104 - DNA, 22 bp, Homo sapiens
tattattgtaagttgtacaaat

SEQ ID NO: 3148105 - DNA, 21 bp, Homo sapiens
tattattgtggtaggcctttt

SEQ ID NO: 3148106 - DNA, 15 bp, Homo sapiens
tattatttggagtta

SEQ ID NO: 3148107 - DNA, 12 bp, Homo sapiens
tattatttggca

SEQ ID NO: 3148108 - DNA, 18 bp, Homo sapiens
tattattttggggtctct

SEQ ID NO: 3148109 - DNA, 15 bp, Homo sapiens
tattcaaaccaattt

SEQ ID NO: 3148110 - DNA, 19 bp, Homo sapiens
tattcaaaccaatttcttc

SEQ ID NO: 3148111 - DNA, 20 bp, Homo sapiens
tattcaaaccaatttcttcc

SEQ ID NO: 3148112 - DNA, 13 bp, Homo sapiens
tattcaaactttt

SEQ ID NO: 3148113 - DNA, 13 bp, Homo sapiens
tattcaaatttgt

SEQ ID NO: 3148114 - DNA, 14 bp, Homo sapiens
tattcaaatttgta

SEQ ID NO: 3148115 - DNA, 16 bp, Homo sapiens
tattcaaatttgtaca

SEQ ID NO: 3148116 - DNA, 18 bp, Homo sapiens
tattcaagcaaacatcaa

SEQ ID NO: 3148117 - DNA, 20 bp, Homo sapiens
tattcaagcaaacatcaaat

SEQ ID NO: 3148118 - DNA, 16 bp, Homo sapiens
tattcaagttattgta

SEQ ID NO: 3148119 - DNA, 20 bp, Homo sapiens
tattcaagttattgtacagc

SEQ ID NO: 3148120 - DNA, 13 bp, Homo sapiens
tattcacagtttt

SEQ ID NO: 3148121 - DNA, 15 bp, Homo sapiens
tattcacatgttcta

SEQ ID NO: 3148122 - DNA, 17 bp, Homo sapiens
tattcacatgttctaat

SEQ ID NO: 3148123 - DNA, 20 bp, Homo sapiens
tattcaccctccacttcccg

SEQ ID NO: 3148124 - DNA, 19 bp, Homo sapiens
tattcaccttttcttcaaa

SEQ ID NO: 3148125 - DNA, 22 bp, Homo sapiens
tattcagacaagcaacaggttt

SEQ ID NO: 3148126 - DNA, 14 bp, Homo sapiens
tattcagcttcatt

SEQ ID NO: 3148127 - DNA, 16 bp, Homo sapiens
tattcagcttcatttg

SEQ ID NO: 3148128 - DNA, 21 bp, Homo sapiens
tattcagcttcatttgtgtca

SEQ ID NO: 3148129 - DNA, 12 bp, Homo sapiens
tattcaggactt

SEQ ID NO: 3148130 - DNA, 16 bp, Homo sapiens
tattcagggtaaatag

SEQ ID NO: 3148131 - DNA, 22 bp, Homo sapiens
tattcagtgctgtggcctgggc

SEQ ID NO: 3148132 - DNA, 12 bp, Homo sapiens
tattcatttaaa

SEQ ID NO: 3148133 - DNA, 19 bp, Homo sapiens
tattcatttaaaatgatta

SEQ ID NO: 3148134 - DNA, 16 bp, Homo sapiens
tattccaaaccaaatt

SEQ ID NO: 3148135 - DNA, 17 bp, Homo sapiens
tattccaaaccaaattt

SEQ ID NO: 3148136 - DNA, 17 bp, Homo sapiens
tattccaagacatgtct

SEQ ID NO: 3148137 - DNA, 19 bp, Homo sapiens
tattccaagacatgtctgt

SEQ ID NO: 3148138 - DNA, 18 bp, Homo sapiens
tattccacagatatcttt

SEQ ID NO: 3148139 - DNA, 22 bp, Homo sapiens
tattccacagatatctttttca

SEQ ID NO: 3148140 - DNA, 16 bp, Homo sapiens
tattccagaatgctgt

SEQ ID NO: 3148141 - DNA, 15 bp, Homo sapiens
tattccatatttatt

SEQ ID NO: 3148142 - DNA, 18 bp, Homo sapiens
tattccatccatatactt

SEQ ID NO: 3148143 - DNA, 17 bp, Homo sapiens
tattccccattcttcct

SEQ ID NO: 3148144 - DNA, 18 bp, Homo sapiens
tattccccatttcctgta

SEQ ID NO: 3148145 - DNA, 22 bp, Homo sapiens
tattccccatttcctgtacaat

SEQ ID NO: 3148146 - DNA, 22 bp, Homo sapiens
tattcccctatctctagaattt

SEQ ID NO: 3148147 - DNA, 14 bp, Homo sapiens
tattccctgcccaa

SEQ ID NO: 3148148 - DNA, 11 bp, Homo sapiens
tattccctttg

SEQ ID NO: 3148149 - DNA, 20 bp, Homo sapiens
tattccctttgacttcagct

SEQ ID NO: 3148150 - DNA, 17 bp, Homo sapiens
tattccgagcattccag

SEQ ID NO: 3148151 - DNA, 21 bp, Homo sapiens
tattcctagtggatgactgtt

SEQ ID NO: 3148152 - DNA, 15 bp, Homo sapiens
tattcctctaggcaa

SEQ ID NO: 3148153 - DNA, 14 bp, Homo sapiens
tattcctgaatgaa

SEQ ID NO: 3148154 - DNA, 17 bp, Homo sapiens
tattcctgcatttgtga

SEQ ID NO: 3148155 - DNA, 21 bp, Homo sapiens
tattcctgcatttgtgaaatg

SEQ ID NO: 3148156 - DNA, 20 bp, Homo sapiens
tattccttttgtgtacagtg

SEQ ID NO: 3148157 - DNA, 21 bp, Homo sapiens
tattccttttgtgtacagtgt

SEQ ID NO: 3148158 - DNA, 22 bp, Homo sapiens
tattcgatactgcgactttctg

SEQ ID NO: 3148159 - DNA, 12 bp, Homo sapiens
tattcgctgtgt

SEQ ID NO: 3148160 - DNA, 13 bp, Homo sapiens
tattctaagactt

SEQ ID NO: 3148161 - DNA, 21 bp, Homo sapiens
tattctaagacttactctaag

SEQ ID NO: 3148162 - DNA, 21 bp, Homo sapiens
tattctaagccagttttcatt

SEQ ID NO: 3148163 - DNA, 22 bp, Homo sapiens
tattctaagccagttttcattt

SEQ ID NO: 3148164 - DNA, 14 bp, Homo sapiens
tattctaattaaaa

SEQ ID NO: 3148165 - DNA, 15 bp, Homo sapiens
tattctactgtactt

SEQ ID NO: 3148166 - DNA, 19 bp, Homo sapiens
tattctactgtactttttt

SEQ ID NO: 3148167 - DNA, 16 bp, Homo sapiens
tattctagcctgcatt

SEQ ID NO: 3148168 - DNA, 17 bp, Homo sapiens
tattctatatgaattta

SEQ ID NO: 3148169 - DNA, 20 bp, Homo sapiens
tattctattacattttcagt

SEQ ID NO: 3148170 - DNA, 17 bp, Homo sapiens
tattctcagagcatgtg

SEQ ID NO: 3148171 - DNA, 13 bp, Homo sapiens
tattctctattta

SEQ ID NO: 3148172 - DNA, 14 bp, Homo sapiens
tattctgattccac

SEQ ID NO: 3148173 - DNA, 20 bp, Homo sapiens
tattctgggcaccacaaaat

SEQ ID NO: 3148174 - DNA, 15 bp, Homo sapiens
tattcttataaaaat

SEQ ID NO: 3148175 - DNA, 14 bp, Homo sapiens
tattcttctagagt

SEQ ID NO: 3148176 - DNA, 17 bp, Homo sapiens
tattcttctagagttca

SEQ ID NO: 3148177 - DNA, 17 bp, Homo sapiens
tattcttctcttgcttt

SEQ ID NO: 3148178 - DNA, 16 bp, Homo sapiens
tattcttgctgggcat

SEQ ID NO: 3148179 - DNA, 23 bp, Homo sapiens
tattcttgttttacatttggatt

SEQ ID NO: 3148180 - DNA, 19 bp, Homo sapiens
tattcttttccaagctcct

SEQ ID NO: 3148181 - DNA, 13 bp, Homo sapiens
tattcttttctca

SEQ ID NO: 3148182 - DNA, 18 bp, Homo sapiens
tattcttttctgcaaaat

SEQ ID NO: 3148183 - DNA, 15 bp, Homo sapiens
tattgaaaacttcaa

SEQ ID NO: 3148184 - DNA, 17 bp, Homo sapiens
tattgaaaacttcaaag

SEQ ID NO: 3148185 - DNA, 22 bp, Homo sapiens
tattgaaaacttcaaagctgaa

SEQ ID NO: 3148186 - DNA, 14 bp, Homo sapiens
tattgaaaattgaa

SEQ ID NO: 3148187 - DNA, 20 bp, Homo sapiens
tattgaaattgtacatattt

SEQ ID NO: 3148188 - DNA, 14 bp, Homo sapiens
tattgaagaaacag

SEQ ID NO: 3148189 - DNA, 22 bp, Homo sapiens
tattgaaggaattagaaatgaa

SEQ ID NO: 3148190 - DNA, 14 bp, Homo sapiens
tattgaaggaattt

SEQ ID NO: 3148191 - DNA, 16 bp, Homo sapiens
tattgaagtttcagct

SEQ ID NO: 3148192 - DNA, 13 bp, Homo sapiens
tattgaatattgt

SEQ ID NO: 3148193 - DNA, 15 bp, Homo sapiens
tattgaatattgtgt

SEQ ID NO: 3148194 - DNA, 16 bp, Homo sapiens
tattgacacagaaaat

SEQ ID NO: 3148195 - DNA, 19 bp, Homo sapiens
tattgactttgacaattac

SEQ ID NO: 3148196 - DNA, 18 bp, Homo sapiens
tattgagaatcccttaaa

SEQ ID NO: 3148197 - DNA, 15 bp, Homo sapiens
tattgagatttctta

SEQ ID NO: 3148198 - DNA, 23 bp, Homo sapiens
tattgagggtcattctttattct

SEQ ID NO: 3148199 - DNA, 19 bp, Homo sapiens
tattgagttccagttgaag

SEQ ID NO: 3148200 - DNA, 22 bp, Homo sapiens
tattgagtttgtaggtaaaatg

SEQ ID NO: 3148201 - DNA, 18 bp, Homo sapiens
tattgatatatattataa

SEQ ID NO: 3148202 - DNA, 20 bp, Homo sapiens
tattgatatgcttatacact

SEQ ID NO: 3148203 - DNA, 12 bp, Homo sapiens
tattgatcaaat

SEQ ID NO: 3148204 - DNA, 20 bp, Homo sapiens
tattgatgtacagtctgtca

SEQ ID NO: 3148205 - DNA, 22 bp, Homo sapiens
tattgatgtacagtctgtcatg

SEQ ID NO: 3148206 - DNA, 22 bp, Homo sapiens
tattgcaaaggttccaactgta

SEQ ID NO: 3148207 - DNA, 23 bp, Homo sapiens
tattgcaaaggttccaactgtat

SEQ ID NO: 3148208 - DNA, 23 bp, Homo sapiens
tattgcaaggcagtctctatatt

SEQ ID NO: 3148209 - DNA, 14 bp, Homo sapiens
tattgcaataaagt

SEQ ID NO: 3148210 - DNA, 17 bp, Homo sapiens
tattgcaatgaaggaaa

SEQ ID NO: 3148211 - DNA, 17 bp, Homo sapiens
tattgcaggagacattt

SEQ ID NO: 3148212 - DNA, 14 bp, Homo sapiens
tattgcccacgctg

SEQ ID NO: 3148213 - DNA, 17 bp, Homo sapiens
tattgccttttaatttt

SEQ ID NO: 3148214 - DNA, 14 bp, Homo sapiens
tattgcgctgctac

SEQ ID NO: 3148215 - DNA, 13 bp, Homo sapiens
tattgctattaaa

SEQ ID NO: 3148216 - DNA, 16 bp, Homo sapiens
tattgctgagagaaat

SEQ ID NO: 3148217 - DNA, 16 bp, Homo sapiens
tattgcttagtaaaat

SEQ ID NO: 3148218 - DNA, 17 bp, Homo sapiens
tattgcttagtaaaatt

SEQ ID NO: 3148219 - DNA, 14 bp, Homo sapiens
tattgcttatttta

SEQ ID NO: 3148220 - DNA, 19 bp, Homo sapiens
tattggaaatggatgcaaa

SEQ ID NO: 3148221 - DNA, 15 bp, Homo sapiens
tattggaacttgcga

SEQ ID NO: 3148222 - DNA, 14 bp, Homo sapiens
tattggaaggtatt

SEQ ID NO: 3148223 - DNA, 19 bp, Homo sapiens
tattggaagtgttcaagaa

SEQ ID NO: 3148224 - DNA, 15 bp, Homo sapiens
tattggaattaacct

SEQ ID NO: 3148225 - DNA, 16 bp, Homo sapiens
tattggacctgcccac

SEQ ID NO: 3148226 - DNA, 16 bp, Homo sapiens
tattggatatttgata

SEQ ID NO: 3148227 - DNA, 18 bp, Homo sapiens
tattgggatgtgagcccc

SEQ ID NO: 3148228 - DNA, 16 bp, Homo sapiens
tattggggtctgaccc

SEQ ID NO: 3148229 - DNA, 16 bp, Homo sapiens
tattgggttcattatt

SEQ ID NO: 3148230 - DNA, 14 bp, Homo sapiens
tattgggtttttat

SEQ ID NO: 3148231 - DNA, 16 bp, Homo sapiens
tattggtggctttcct

SEQ ID NO: 3148232 - DNA, 20 bp, Homo sapiens
tattggtttaaagaaagtgt

SEQ ID NO: 3148233 - DNA, 14 bp, Homo sapiens
tattggtttgcaca

SEQ ID NO: 3148234 - DNA, 19 bp, Homo sapiens
tattgtaaaacagctaaat

SEQ ID NO: 3148235 - DNA, 15 bp, Homo sapiens
tattgtaaaacaggt

SEQ ID NO: 3148236 - DNA, 17 bp, Homo sapiens
tattgtaaattttagaa

SEQ ID NO: 3148237 - DNA, 15 bp, Homo sapiens
tattgtacagactgt

SEQ ID NO: 3148238 - DNA, 20 bp, Homo sapiens
tattgtacagctgtttaaga

SEQ ID NO: 3148239 - DNA, 21 bp, Homo sapiens
tattgtataaactatcagttt

SEQ ID NO: 3148240 - DNA, 23 bp, Homo sapiens
tattgtcagccatcgtcctggga

SEQ ID NO: 3148241 - DNA, 20 bp, Homo sapiens
tattgtcccctttttagttt

SEQ ID NO: 3148242 - DNA, 20 bp, Homo sapiens
tattgtctgtctacatttct

SEQ ID NO: 3148243 - DNA, 17 bp, Homo sapiens
tattgtgaagtacatat

SEQ ID NO: 3148244 - DNA, 13 bp, Homo sapiens
tattgtgaatgat

SEQ ID NO: 3148245 - DNA, 23 bp, Homo sapiens
tattgtggtaggccttttaacat

SEQ ID NO: 3148246 - DNA, 13 bp, Homo sapiens
tattgtggtattg

SEQ ID NO: 3148247 - DNA, 17 bp, Homo sapiens
tattgtgttgactttat

SEQ ID NO: 3148248 - DNA, 17 bp, Homo sapiens
tattgttaactcttgtc

SEQ ID NO: 3148249 - DNA, 21 bp, Homo sapiens
tattgttaactcttgtctatt

SEQ ID NO: 3148250 - DNA, 16 bp, Homo sapiens
tattgttagaaaatga

SEQ ID NO: 3148251 - DNA, 20 bp, Homo sapiens
tattgttagggtcagccatt

SEQ ID NO: 3148252 - DNA, 14 bp, Homo sapiens
tattgttcaaacaa

SEQ ID NO: 3148253 - DNA, 13 bp, Homo sapiens
tattgttcccagt

SEQ ID NO: 3148254 - DNA, 21 bp, Homo sapiens
tattgttcccagtgacacttc

SEQ ID NO: 3148255 - DNA, 18 bp, Homo sapiens
tattgttcccctaagtgg

SEQ ID NO: 3148256 - DNA, 16 bp, Homo sapiens
tattgtttaaaattca

SEQ ID NO: 3148257 - DNA, 13 bp, Homo sapiens
tattgtttatgta

SEQ ID NO: 3148258 - DNA, 22 bp, Homo sapiens
tattgtttattctttttaaagt

SEQ ID NO: 3148259 - DNA, 24 bp, Homo sapiens
tattgtttattctttttaaagtat

SEQ ID NO: 3148260 - DNA, 14 bp, Homo sapiens
tattgtttctagaa

SEQ ID NO: 3148261 - DNA, 18 bp, Homo sapiens
tattgttttcagtgtaca

SEQ ID NO: 3148262 - DNA, 16 bp, Homo sapiens
tatttaaaaaattatg

SEQ ID NO: 3148263 - DNA, 17 bp, Homo sapiens
tatttaaaaatatttca

SEQ ID NO: 3148264 - DNA, 20 bp, Homo sapiens
tatttaaaaatatttcagat

SEQ ID NO: 3148265 - DNA, 14 bp, Homo sapiens
tatttaaaaattgt

SEQ ID NO: 3148266 - DNA, 15 bp, Homo sapiens
tatttaaaaattgtt

SEQ ID NO: 3148267 - DNA, 16 bp, Homo sapiens
tatttaaaaattgttt

SEQ ID NO: 3148268 - DNA, 21 bp, Homo sapiens
tatttaaacctttttcttgat

SEQ ID NO: 3148269 - DNA, 16 bp, Homo sapiens
tatttaaacttataaa

SEQ ID NO: 3148270 - DNA, 22 bp, Homo sapiens
tatttaaagacagggaagagca

SEQ ID NO: 3148271 - DNA, 18 bp, Homo sapiens
tatttaaatgttctaaca

SEQ ID NO: 3148272 - DNA, 14 bp, Homo sapiens
tatttaaattcttt

SEQ ID NO: 3148273 - DNA, 15 bp, Homo sapiens
tatttaacagctgaa

SEQ ID NO: 3148274 - DNA, 15 bp, Homo sapiens
tatttaacattattt

SEQ ID NO: 3148275 - DNA, 18 bp, Homo sapiens
tatttaacctatttccac

SEQ ID NO: 3148276 - DNA, 17 bp, Homo sapiens
tatttaagaaaagcact

SEQ ID NO: 3148277 - DNA, 20 bp, Homo sapiens
tatttaagaaaatacaataa

SEQ ID NO: 3148278 - DNA, 22 bp, Homo sapiens
tatttaagaaaatacaataaac

SEQ ID NO: 3148279 - DNA, 17 bp, Homo sapiens
tatttaagataattata

SEQ ID NO: 3148280 - DNA, 20 bp, Homo sapiens
tatttaagcctcatatttaa

SEQ ID NO: 3148281 - DNA, 17 bp, Homo sapiens
tatttaagccttataaa

SEQ ID NO: 3148282 - DNA, 21 bp, Homo sapiens
tatttaaggtagcttcagcta

SEQ ID NO: 3148283 - DNA, 14 bp, Homo sapiens
tatttaagttatca

SEQ ID NO: 3148284 - DNA, 10 bp, Homo sapiens
tatttaataa

SEQ ID NO: 3148285 - DNA, 15 bp, Homo sapiens
tatttaatatgctta

SEQ ID NO: 3148286 - DNA, 17 bp, Homo sapiens
tatttaatgcattaaac

SEQ ID NO: 3148287 - DNA, 21 bp, Homo sapiens
tatttaatgccgatatactct

SEQ ID NO: 3148288 - DNA, 15 bp, Homo sapiens
tatttaatgttatgt

SEQ ID NO: 3148289 - DNA, 20 bp, Homo sapiens
tatttaattaaatctcaaat

SEQ ID NO: 3148290 - DNA, 14 bp, Homo sapiens
tatttacattttat

SEQ ID NO: 3148291 - DNA, 15 bp, Homo sapiens
tatttacattttata

SEQ ID NO: 3148292 - DNA, 23 bp, Homo sapiens
tatttacattttatatttttgta

SEQ ID NO: 3148293 - DNA, 19 bp, Homo sapiens
tatttaccgttgcttgaaa

SEQ ID NO: 3148294 - DNA, 21 bp, Homo sapiens
tatttaccgttgcttgaaatt

SEQ ID NO: 3148295 - DNA, 18 bp, Homo sapiens
tatttaccttttaagaca

SEQ ID NO: 3148296 - DNA, 20 bp, Homo sapiens
tatttactctttctaacttt

SEQ ID NO: 3148297 - DNA, 14 bp, Homo sapiens
tatttactgagctt

SEQ ID NO: 3148298 - DNA, 13 bp, Homo sapiens
tatttagacaaga

SEQ ID NO: 3148299 - DNA, 17 bp, Homo sapiens
tatttagttatagtttc

SEQ ID NO: 3148300 - DNA, 14 bp, Homo sapiens
tatttagtttttaa

SEQ ID NO: 3148301 - DNA, 17 bp, Homo sapiens
tatttataaaacttctc

SEQ ID NO: 3148302 - DNA, 16 bp, Homo sapiens
tatttataaagaatgt

SEQ ID NO: 3148303 - DNA, 16 bp, Homo sapiens
tatttataaatatatt

SEQ ID NO: 3148304 - DNA, 14 bp, Homo sapiens
tatttataacagca

SEQ ID NO: 3148305 - DNA, 13 bp, Homo sapiens
tatttataactca

SEQ ID NO: 3148306 - DNA, 22 bp, Homo sapiens
tatttataactcatcataaaat

SEQ ID NO: 3148307 - DNA, 14 bp, Homo sapiens
tatttataagcaga

SEQ ID NO: 3148308 - DNA, 16 bp, Homo sapiens
tatttataatacagaa

SEQ ID NO: 3148309 - DNA, 18 bp, Homo sapiens
tatttataatacagaatc

SEQ ID NO: 3148310 - DNA, 20 bp, Homo sapiens
tatttataatacagaatctt

SEQ ID NO: 3148311 - DNA, 15 bp, Homo sapiens
tatttataattccta

SEQ ID NO: 3148312 - DNA, 20 bp, Homo sapiens
tatttatacaagattgaaaa

SEQ ID NO: 3148313 - DNA, 18 bp, Homo sapiens
tatttatagcaatccatg

SEQ ID NO: 3148314 - DNA, 23 bp, Homo sapiens
tatttatatatgtatttataaat

SEQ ID NO: 3148315 - DNA, 17 bp, Homo sapiens
tatttatatatttataa

SEQ ID NO: 3148316 - DNA, 18 bp, Homo sapiens
tatttatatatttataac

SEQ ID NO: 3148317 - DNA, 15 bp, Homo sapiens
tatttatatgtacat

SEQ ID NO: 3148318 - DNA, 13 bp, Homo sapiens
tatttatatttgg

SEQ ID NO: 3148319 - DNA, 14 bp, Homo sapiens
tatttatatttgga

SEQ ID NO: 3148320 - DNA, 15 bp, Homo sapiens
tatttatccatttgt

SEQ ID NO: 3148321 - DNA, 17 bp, Homo sapiens
tatttatctctatttaa

SEQ ID NO: 3148322 - DNA, 12 bp, Homo sapiens
tatttatcttta

SEQ ID NO: 3148323 - DNA, 19 bp, Homo sapiens
tatttatgcactgtgggat

SEQ ID NO: 3148324 - DNA, 20 bp, Homo sapiens
tatttatggatatcacacat

SEQ ID NO: 3148325 - DNA, 14 bp, Homo sapiens
tatttatgtgtgag

SEQ ID NO: 3148326 - DNA, 15 bp, Homo sapiens
tatttatgttaaaag

SEQ ID NO: 3148327 - DNA, 19 bp, Homo sapiens
tatttattaaaaatgttct

SEQ ID NO: 3148328 - DNA, 17 bp, Homo sapiens
tatttattaaataaaat

SEQ ID NO: 3148329 - DNA, 13 bp, Homo sapiens
tatttattaagat

SEQ ID NO: 3148330 - DNA, 17 bp, Homo sapiens
tatttattaatatttaa

SEQ ID NO: 3148331 - DNA, 18 bp, Homo sapiens
tatttattaatatttaac

SEQ ID NO: 3148332 - DNA, 13 bp, Homo sapiens
tatttattacctc

SEQ ID NO: 3148333 - DNA, 15 bp, Homo sapiens
tatttattacctctg

SEQ ID NO: 3148334 - DNA, 19 bp, Homo sapiens
tatttattattttcacctg

SEQ ID NO: 3148335 - DNA, 20 bp, Homo sapiens
tatttattgactttgacaat

SEQ ID NO: 3148336 - DNA, 13 bp, Homo sapiens
tatttattgcatt

SEQ ID NO: 3148337 - DNA, 11 bp, Homo sapiens
tatttattgtt

SEQ ID NO: 3148338 - DNA, 16 bp, Homo sapiens
tatttatttaaagcat

SEQ ID NO: 3148339 - DNA, 14 bp, Homo sapiens
tatttatttaaatt

SEQ ID NO: 3148340 - DNA, 16 bp, Homo sapiens
tatttatttaagctta

SEQ ID NO: 3148341 - DNA, 21 bp, Homo sapiens
tatttatttaataacaattgt

SEQ ID NO: 3148342 - DNA, 17 bp, Homo sapiens
tatttatttactgagct

SEQ ID NO: 3148343 - DNA, 14 bp, Homo sapiens
tatttatttatgga

SEQ ID NO: 3148344 - DNA, 14 bp, Homo sapiens
tatttatttctagt

SEQ ID NO: 3148345 - DNA, 13 bp, Homo sapiens
tatttattttcag

SEQ ID NO: 3148346 - DNA, 21 bp, Homo sapiens
tatttattttcagtatactgt

SEQ ID NO: 3148347 - DNA, 16 bp, Homo sapiens
tatttattttcctaaa

SEQ ID NO: 3148348 - DNA, 20 bp, Homo sapiens
tatttattttcctaaagaga

SEQ ID NO: 3148349 - DNA, 21 bp, Homo sapiens
tatttattttcctaaagagag

SEQ ID NO: 3148350 - DNA, 18 bp, Homo sapiens
tatttatttttacaagaa

SEQ ID NO: 3148351 - DNA, 20 bp, Homo sapiens
tatttattttttttaagtat

SEQ ID NO: 3148352 - DNA, 22 bp, Homo sapiens
tatttcaactgctgtaaaatta

SEQ ID NO: 3148353 - DNA, 11 bp, Homo sapiens
tatttcaagtg

SEQ ID NO: 3148354 - DNA, 12 bp, Homo sapiens
tatttcaagtgc

SEQ ID NO: 3148355 - DNA, 14 bp, Homo sapiens
tatttcaagtgcct

SEQ ID NO: 3148356 - DNA, 17 bp, Homo sapiens
tatttcacaggctgtaa

SEQ ID NO: 3148357 - DNA, 21 bp, Homo sapiens
tatttcacaggctgtaaattg

SEQ ID NO: 3148358 - DNA, 22 bp, Homo sapiens
tatttcacaggctgtaaattga

SEQ ID NO: 3148359 - DNA, 16 bp, Homo sapiens
tatttcactatcttct

SEQ ID NO: 3148360 - DNA, 18 bp, Homo sapiens
tatttcagatatcaaaat

SEQ ID NO: 3148361 - DNA, 20 bp, Homo sapiens
tatttcagatatcaaaattc

SEQ ID NO: 3148362 - DNA, 21 bp, Homo sapiens
tatttcaggcattggatattt

SEQ ID NO: 3148363 - DNA, 21 bp, Homo sapiens
tatttcatgctgggaatgaga

SEQ ID NO: 3148364 - DNA, 15 bp, Homo sapiens
tatttcatgtcttta

SEQ ID NO: 3148365 - DNA, 13 bp, Homo sapiens
tatttcatgtttt

SEQ ID NO: 3148366 - DNA, 18 bp, Homo sapiens
tatttcattttttgcatc

SEQ ID NO: 3148367 - DNA, 19 bp, Homo sapiens
tatttccactaaaaatatt

SEQ ID NO: 3148368 - DNA, 21 bp, Homo sapiens
tatttccattccagaatatct

SEQ ID NO: 3148369 - DNA, 21 bp, Homo sapiens
tatttccccaggggaaaatga

SEQ ID NO: 3148370 - DNA, 19 bp, Homo sapiens
tatttccctaaaatacatt

SEQ ID NO: 3148371 - DNA, 20 bp, Homo sapiens
tatttccctaaaatacattt

SEQ ID NO: 3148372 - DNA, 13 bp, Homo sapiens
tatttcctgactt

SEQ ID NO: 3148373 - DNA, 15 bp, Homo sapiens
tatttctaactatat

SEQ ID NO: 3148374 - DNA, 14 bp, Homo sapiens
tatttctaggcaca

SEQ ID NO: 3148375 - DNA, 21 bp, Homo sapiens
tatttctagtccaaaattaca

SEQ ID NO: 3148376 - DNA, 14 bp, Homo sapiens
tatttctattatta

SEQ ID NO: 3148377 - DNA, 23 bp, Homo sapiens
tatttctgaattcaaagcttgtg

SEQ ID NO: 3148378 - DNA, 13 bp, Homo sapiens
tatttctgatcta

SEQ ID NO: 3148379 - DNA, 17 bp, Homo sapiens
tatttctgggtcttttg

SEQ ID NO: 3148380 - DNA, 19 bp, Homo sapiens
tatttctgttccagtcaca

SEQ ID NO: 3148381 - DNA, 16 bp, Homo sapiens
tatttctgtttctcat

SEQ ID NO: 3148382 - DNA, 17 bp, Homo sapiens
tatttctgtttctcata

SEQ ID NO: 3148383 - DNA, 22 bp, Homo sapiens
tatttcttcctaccaagtcaaa

SEQ ID NO: 3148384 - DNA, 14 bp, Homo sapiens
tatttcttgctttc

SEQ ID NO: 3148385 - DNA, 14 bp, Homo sapiens
tatttctttgttat

SEQ ID NO: 3148386 - DNA, 21 bp, Homo sapiens
tatttgaaaaccatattttat

SEQ ID NO: 3148387 - DNA, 15 bp, Homo sapiens
tatttgaaatactaa

SEQ ID NO: 3148388 - DNA, 18 bp, Homo sapiens
tatttgaaatactaaaag

SEQ ID NO: 3148389 - DNA, 22 bp, Homo sapiens
tatttgaaatactaaaagcaaa

SEQ ID NO: 3148390 - DNA, 21 bp, Homo sapiens
tatttgaacatgtgccttttc

SEQ ID NO: 3148391 - DNA, 23 bp, Homo sapiens
tatttgaacatgtgccttttctg

SEQ ID NO: 3148392 - DNA, 16 bp, Homo sapiens
tatttgaatatcatta

SEQ ID NO: 3148393 - DNA, 18 bp, Homo sapiens
tatttgaattttaaatct

SEQ ID NO: 3148394 - DNA, 16 bp, Homo sapiens
tatttgagactagttt

SEQ ID NO: 3148395 - DNA, 15 bp, Homo sapiens
tatttgagagttcta

SEQ ID NO: 3148396 - DNA, 16 bp, Homo sapiens
tatttgatatttggtt

SEQ ID NO: 3148397 - DNA, 15 bp, Homo sapiens
tatttgcacttatgt

SEQ ID NO: 3148398 - DNA, 18 bp, Homo sapiens
tatttgcacttatgtact

SEQ ID NO: 3148399 - DNA, 19 bp, Homo sapiens
tatttgcacttatgtactt

SEQ ID NO: 3148400 - DNA, 22 bp, Homo sapiens
tatttgcacttatgtacttgat

SEQ ID NO: 3148401 - DNA, 18 bp, Homo sapiens
tatttgcagttcacctgc

SEQ ID NO: 3148402 - DNA, 16 bp, Homo sapiens
tatttgcatgttacct

SEQ ID NO: 3148403 - DNA, 19 bp, Homo sapiens
tatttgccaataaagcttt

SEQ ID NO: 3148404 - DNA, 23 bp, Homo sapiens
tatttgccagagccaaattttat

SEQ ID NO: 3148405 - DNA, 17 bp, Homo sapiens
tatttgccatgggcttc

SEQ ID NO: 3148406 - DNA, 21 bp, Homo sapiens
tatttgctaatcaaagccagg

SEQ ID NO: 3148407 - DNA, 15 bp, Homo sapiens
tatttgctgttaact

SEQ ID NO: 3148408 - DNA, 16 bp, Homo sapiens
tatttggaaataaagt

SEQ ID NO: 3148409 - DNA, 21 bp, Homo sapiens
tatttggaagaaaaaaatctt

SEQ ID NO: 3148410 - DNA, 14 bp, Homo sapiens
tatttggcagtttg

SEQ ID NO: 3148411 - DNA, 13 bp, Homo sapiens
tatttggctgggc

SEQ ID NO: 3148412 - DNA, 20 bp, Homo sapiens
tatttggctgggctacaatt

SEQ ID NO: 3148413 - DNA, 16 bp, Homo sapiens
tatttggcttaaatat

SEQ ID NO: 3148414 - DNA, 17 bp, Homo sapiens
tatttggtactgtattt

SEQ ID NO: 3148415 - DNA, 15 bp, Homo sapiens
tatttggtccaaaaa

SEQ ID NO: 3148416 - DNA, 18 bp, Homo sapiens
tatttggtctctatttca

SEQ ID NO: 3148417 - DNA, 21 bp, Homo sapiens
tatttggtgggagttatatca

SEQ ID NO: 3148418 - DNA, 12 bp, Homo sapiens
tatttgtaagat

SEQ ID NO: 3148419 - DNA, 15 bp, Homo sapiens
tatttgtaggagaaa

SEQ ID NO: 3148420 - DNA, 22 bp, Homo sapiens
tatttgtataaaagtgtgaaat

SEQ ID NO: 3148421 - DNA, 22 bp, Homo sapiens
tatttgtatctctgaagcatgt

SEQ ID NO: 3148422 - DNA, 15 bp, Homo sapiens
tatttgtattaataa

SEQ ID NO: 3148423 - DNA, 17 bp, Homo sapiens
tatttgtattaataaag

SEQ ID NO: 3148424 - DNA, 18 bp, Homo sapiens
tatttgtattaataaagc

SEQ ID NO: 3148425 - DNA, 22 bp, Homo sapiens
tatttgtattaataaagcattc

SEQ ID NO: 3148426 - DNA, 17 bp, Homo sapiens
tatttgtctttaaacag

SEQ ID NO: 3148427 - DNA, 16 bp, Homo sapiens
tatttgtgctatttaa

SEQ ID NO: 3148428 - DNA, 14 bp, Homo sapiens
tatttgttattttc

SEQ ID NO: 3148429 - DNA, 18 bp, Homo sapiens
tatttgttattttcagta

SEQ ID NO: 3148430 - DNA, 22 bp, Homo sapiens
tatttgttcatgtttggtgcat

SEQ ID NO: 3148431 - DNA, 13 bp, Homo sapiens
tatttgttcatta

SEQ ID NO: 3148432 - DNA, 13 bp, Homo sapiens
tatttgttttcat

SEQ ID NO: 3148433 - DNA, 22 bp, Homo sapiens
tattttaaaatatttaaacctt

SEQ ID NO: 3148434 - DNA, 14 bp, Homo sapiens
tattttaaacaaaa

SEQ ID NO: 3148435 - DNA, 20 bp, Homo sapiens
tattttaaagtaaaagtcta

SEQ ID NO: 3148436 - DNA, 17 bp, Homo sapiens
tattttaaatataaata

SEQ ID NO: 3148437 - DNA, 14 bp, Homo sapiens
tattttaacacttt

SEQ ID NO: 3148438 - DNA, 19 bp, Homo sapiens
tattttaagcactcttaaa

SEQ ID NO: 3148439 - DNA, 21 bp, Homo sapiens
tattttaatattgatgtcagt

SEQ ID NO: 3148440 - DNA, 12 bp, Homo sapiens
tattttaatcct

SEQ ID NO: 3148441 - DNA, 20 bp, Homo sapiens
tattttagaaattataattt

SEQ ID NO: 3148442 - DNA, 22 bp, Homo sapiens
tattttagactcaaagaatata

SEQ ID NO: 3148443 - DNA, 20 bp, Homo sapiens
tattttatgtctgtaatcat

SEQ ID NO: 3148444 - DNA, 17 bp, Homo sapiens
tattttatttagacaag

SEQ ID NO: 3148445 - DNA, 22 bp, Homo sapiens
tattttcaaattgtatctagtg

SEQ ID NO: 3148446 - DNA, 20 bp, Homo sapiens
tattttcagaatctgaatgt

SEQ ID NO: 3148447 - DNA, 19 bp, Homo sapiens
tattttcagtcaaaacttt

SEQ ID NO: 3148448 - DNA, 18 bp, Homo sapiens
tattttcccaatagcact

SEQ ID NO: 3148449 - DNA, 17 bp, Homo sapiens
tattttctgtcagatga

SEQ ID NO: 3148450 - DNA, 14 bp, Homo sapiens
tattttctttaatg

SEQ ID NO: 3148451 - DNA, 22 bp, Homo sapiens
tattttgaagaatatttaagaa

SEQ ID NO: 3148452 - DNA, 19 bp, Homo sapiens
tattttgcatatatgttct

SEQ ID NO: 3148453 - DNA, 18 bp, Homo sapiens
tattttgctgagttgttc

SEQ ID NO: 3148454 - DNA, 14 bp, Homo sapiens
tattttgctgttta

SEQ ID NO: 3148455 - DNA, 12 bp, Homo sapiens
tattttgctttg

SEQ ID NO: 3148456 - DNA, 12 bp, Homo sapiens
tattttggaaac

SEQ ID NO: 3148457 - DNA, 19 bp, Homo sapiens
tattttggaaactgctaaa

SEQ ID NO: 3148458 - DNA, 12 bp, Homo sapiens
tattttggatat

SEQ ID NO: 3148459 - DNA, 15 bp, Homo sapiens
tattttggatatatt

SEQ ID NO: 3148460 - DNA, 19 bp, Homo sapiens
tattttggatatattattg

SEQ ID NO: 3148461 - DNA, 23 bp, Homo sapiens
tattttggatatattattgtaag

SEQ ID NO: 3148462 - DNA, 23 bp, Homo sapiens
tattttggattgtatattgtgtt

SEQ ID NO: 3148463 - DNA, 19 bp, Homo sapiens
tattttggttcttagttct

SEQ ID NO: 3148464 - DNA, 20 bp, Homo sapiens
tattttgtaaactcaaaata

SEQ ID NO: 3148465 - DNA, 15 bp, Homo sapiens
tattttgtactttgt

SEQ ID NO: 3148466 - DNA, 20 bp, Homo sapiens
tattttgtactttgtggaga

SEQ ID NO: 3148467 - DNA, 16 bp, Homo sapiens
tattttgtattgtggt

SEQ ID NO: 3148468 - DNA, 17 bp, Homo sapiens
tattttgtattgtggta

SEQ ID NO: 3148469 - DNA, 20 bp, Homo sapiens
tattttgtgatgatgctgtg

SEQ ID NO: 3148470 - DNA, 17 bp, Homo sapiens
tattttgtgctcattta

SEQ ID NO: 3148471 - DNA, 17 bp, Homo sapiens
tattttgtgtacaagtt

SEQ ID NO: 3148472 - DNA, 14 bp, Homo sapiens
tattttgtgtgaaa

SEQ ID NO: 3148473 - DNA, 15 bp, Homo sapiens
tattttgtgtgaaat

SEQ ID NO: 3148474 - DNA, 13 bp, Homo sapiens
tattttgtgtgac

SEQ ID NO: 3148475 - DNA, 22 bp, Homo sapiens
tattttgtgtgaccaactgtgt

SEQ ID NO: 3148476 - DNA, 17 bp, Homo sapiens
tatttttaaaatattac

SEQ ID NO: 3148477 - DNA, 15 bp, Homo sapiens
tatttttaaaggcat

SEQ ID NO: 3148478 - DNA, 16 bp, Homo sapiens
tatttttacatttaaa

SEQ ID NO: 3148479 - DNA, 23 bp, Homo sapiens
tatttttagatggttacactgtt

SEQ ID NO: 3148480 - DNA, 14 bp, Homo sapiens
tatttttcagttcc

SEQ ID NO: 3148481 - DNA, 13 bp, Homo sapiens
tatttttcatatt

SEQ ID NO: 3148482 - DNA, 21 bp, Homo sapiens
tatttttccatttatttatga

SEQ ID NO: 3148483 - DNA, 22 bp, Homo sapiens
tatttttcttgttgcatctttt

SEQ ID NO: 3148484 - DNA, 18 bp, Homo sapiens
tatttttgacatggaaat

SEQ ID NO: 3148485 - DNA, 12 bp, Homo sapiens
tatttttgtaat

SEQ ID NO: 3148486 - DNA, 13 bp, Homo sapiens
tatttttgtaatg

SEQ ID NO: 3148487 - DNA, 13 bp, Homo sapiens
tatttttgtacat

SEQ ID NO: 3148488 - DNA, 14 bp, Homo sapiens
tatttttgtacata

SEQ ID NO: 3148489 - DNA, 12 bp, Homo sapiens
tatttttgtact

SEQ ID NO: 3148490 - DNA, 15 bp, Homo sapiens
tatttttgtacttga

SEQ ID NO: 3148491 - DNA, 13 bp, Homo sapiens
tattttttaagta

SEQ ID NO: 3148492 - DNA, 15 bp, Homo sapiens
tattttttaattatt

SEQ ID NO: 3148493 - DNA, 17 bp, Homo sapiens
tattttttattgttttc

SEQ ID NO: 3148494 - DNA, 19 bp, Homo sapiens
tattttttcttttctttac

SEQ ID NO: 3148495 - DNA, 14 bp, Homo sapiens
tattttttcttttg

SEQ ID NO: 3148496 - DNA, 18 bp, Homo sapiens
tattttttgaactttgta

SEQ ID NO: 3148497 - DNA, 14 bp, Homo sapiens
tattttttgtataa

SEQ ID NO: 3148498 - DNA, 17 bp, Homo sapiens
tatttttttaaaatcac

SEQ ID NO: 3148499 - DNA, 18 bp, Homo sapiens
tatttttttaaaatcact

SEQ ID NO: 3148500 - DNA, 20 bp, Homo sapiens
tatttttttaatttaacatg

SEQ ID NO: 3148501 - DNA, 14 bp, Homo sapiens
tatttttttctacc

SEQ ID NO: 3148502 - DNA, 15 bp, Homo sapiens
tatttttttctacct

SEQ ID NO: 3148503 - DNA, 23 bp, Homo sapiens
tatttttttctaccttgaggtct

SEQ ID NO: 3148504 - DNA, 16 bp, Homo sapiens
tattttttttttcttc

SEQ ID NO: 3148505 - DNA, 19 bp, Homo sapiens
tattttttttttcttcttg

SEQ ID NO: 3148506 - DNA, 14 bp, Homo sapiens
tcaaaaagaaatca

SEQ ID NO: 3148507 - DNA, 20 bp, Homo sapiens
tcaaaaagcagagtggactg

SEQ ID NO: 3148508 - DNA, 21 bp, Homo sapiens
tcaaaaagggaagtaagcaaa

SEQ ID NO: 3148509 - DNA, 23 bp, Homo sapiens
tcaaaaagggaagtaagcaaaca

SEQ ID NO: 3148510 - DNA, 19 bp, Homo sapiens
tcaaaaagtgtttattttt

SEQ ID NO: 3148511 - DNA, 23 bp, Homo sapiens
tcaaaaataaaaaatctgaagag

SEQ ID NO: 3148512 - DNA, 13 bp, Homo sapiens
tcaaaaatataac

SEQ ID NO: 3148513 - DNA, 20 bp, Homo sapiens
tcaaaaatatttatattgtc

SEQ ID NO: 3148514 - DNA, 13 bp, Homo sapiens
tcaaaacacacta

SEQ ID NO: 3148515 - DNA, 19 bp, Homo sapiens
tcaaaacacactactacct

SEQ ID NO: 3148516 - DNA, 12 bp, Homo sapiens
tcaaaacactgt

SEQ ID NO: 3148517 - DNA, 14 bp, Homo sapiens
tcaaaacactgtgg

SEQ ID NO: 3148518 - DNA, 17 bp, Homo sapiens
tcaaaacactgtggaac

SEQ ID NO: 3148519 - DNA, 11 bp, Homo sapiens
tcaaaacattc

SEQ ID NO: 3148520 - DNA, 14 bp, Homo sapiens
tcaaaacattccaa

SEQ ID NO: 3148521 - DNA, 15 bp, Homo sapiens
tcaaaacattccaag

SEQ ID NO: 3148522 - DNA, 16 bp, Homo sapiens
tcaaaacgggtcagta

SEQ ID NO: 3148523 - DNA, 13 bp, Homo sapiens
tcaaaactatttt

SEQ ID NO: 3148524 - DNA, 18 bp, Homo sapiens
tcaaaactttaaacctgt

SEQ ID NO: 3148525 - DNA, 17 bp, Homo sapiens
tcaaaagaaatagaaaa

SEQ ID NO: 3148526 - DNA, 19 bp, Homo sapiens
tcaaaagaatcagaaacag

SEQ ID NO: 3148527 - DNA, 18 bp, Homo sapiens
tcaaaagctgggaaccag

SEQ ID NO: 3148528 - DNA, 21 bp, Homo sapiens
tcaaaaggaacaaaaattaca

SEQ ID NO: 3148529 - DNA, 13 bp, Homo sapiens
tcaaaagttccaa

SEQ ID NO: 3148530 - DNA, 22 bp, Homo sapiens
tcaaaagttccaagagtctaaa

SEQ ID NO: 3148531 - DNA, 12 bp, Homo sapiens
tcaaaataaaaa

SEQ ID NO: 3148532 - DNA, 13 bp, Homo sapiens
tcaaaataattct

SEQ ID NO: 3148533 - DNA, 17 bp, Homo sapiens
tcaaaatatattttgta

SEQ ID NO: 3148534 - DNA, 19 bp, Homo sapiens
tcaaaatcagtttttcata

SEQ ID NO: 3148535 - DNA, 16 bp, Homo sapiens
tcaaaatccttccaaa

SEQ ID NO: 3148536 - DNA, 19 bp, Homo sapiens
tcaaaatccttccaaagaa

SEQ ID NO: 3148537 - DNA, 17 bp, Homo sapiens
tcaaaatctttgtataa

SEQ ID NO: 3148538 - DNA, 20 bp, Homo sapiens
tcaaaatctttgtataaata

SEQ ID NO: 3148539 - DNA, 13 bp, Homo sapiens
tcaaaatgccttt

SEQ ID NO: 3148540 - DNA, 17 bp, Homo sapiens
tcaaaatgctttttatt

SEQ ID NO: 3148541 - DNA, 14 bp, Homo sapiens
tcaaaatgtctaag

SEQ ID NO: 3148542 - DNA, 16 bp, Homo sapiens
tcaaaattacttttct

SEQ ID NO: 3148543 - DNA, 14 bp, Homo sapiens
tcaaacaagaatgt

SEQ ID NO: 3148544 - DNA, 20 bp, Homo sapiens
tcaaacattcgtgagctggg

SEQ ID NO: 3148545 - DNA, 22 bp, Homo sapiens
tcaaacattcgtgagctgggga

SEQ ID NO: 3148546 - DNA, 14 bp, Homo sapiens
tcaaaccaatttct

SEQ ID NO: 3148547 - DNA, 16 bp, Homo sapiens
tcaaaccaatttcttc

SEQ ID NO: 3148548 - DNA, 19 bp, Homo sapiens
tcaaaccaatttcttcctt

SEQ ID NO: 3148549 - DNA, 16 bp, Homo sapiens
tcaaaccctagccttg

SEQ ID NO: 3148550 - DNA, 13 bp, Homo sapiens
tcaaactaaaaga

SEQ ID NO: 3148551 - DNA, 17 bp, Homo sapiens
tcaaactcattgcagca

SEQ ID NO: 3148552 - DNA, 14 bp, Homo sapiens
tcaaactgcacttt

SEQ ID NO: 3148553 - DNA, 16 bp, Homo sapiens
tcaaactgcactttta

SEQ ID NO: 3148554 - DNA, 14 bp, Homo sapiens
tcaaactggggcct

SEQ ID NO: 3148555 - DNA, 20 bp, Homo sapiens
tcaaactggggcctccagaa

SEQ ID NO: 3148556 - DNA, 15 bp, Homo sapiens
tcaaacttactattt

SEQ ID NO: 3148557 - DNA, 16 bp, Homo sapiens
tcaaacttactatttt

SEQ ID NO: 3148558 - DNA, 22 bp, Homo sapiens
tcaaacttggatacttggattt

SEQ ID NO: 3148559 - DNA, 16 bp, Homo sapiens
tcaaactttcactttg

SEQ ID NO: 3148560 - DNA, 21 bp, Homo sapiens
tcaaagaaagaaagtttagaa

SEQ ID NO: 3148561 - DNA, 22 bp, Homo sapiens
tcaaagaaagaaagtttagaag

SEQ ID NO: 3148562 - DNA, 14 bp, Homo sapiens
tcaaagaaagtgta

SEQ ID NO: 3148563 - DNA, 14 bp, Homo sapiens
tcaaagaaggcatt

SEQ ID NO: 3148564 - DNA, 14 bp, Homo sapiens
tcaaagaattacag

SEQ ID NO: 3148565 - DNA, 17 bp, Homo sapiens
tcaaagaattacagtac

SEQ ID NO: 3148566 - DNA, 16 bp, Homo sapiens
tcaaagagaaaactta

SEQ ID NO: 3148567 - DNA, 20 bp, Homo sapiens
tcaaagagatgggccttttc

SEQ ID NO: 3148568 - DNA, 21 bp, Homo sapiens
tcaaagagatgggccttttct

SEQ ID NO: 3148569 - DNA, 19 bp, Homo sapiens
tcaaagatgctgtgagtct

SEQ ID NO: 3148570 - DNA, 13 bp, Homo sapiens
tcaaagcaagggc

SEQ ID NO: 3148571 - DNA, 14 bp, Homo sapiens
tcaaagcagcagcc

SEQ ID NO: 3148572 - DNA, 15 bp, Homo sapiens
tcaaagccagggtct

SEQ ID NO: 3148573 - DNA, 19 bp, Homo sapiens
tcaaagctcacaccaaatt

SEQ ID NO: 3148574 - DNA, 12 bp, Homo sapiens
tcaaagctgagt

SEQ ID NO: 3148575 - DNA, 20 bp, Homo sapiens
tcaaagcttgaagatcgtta

SEQ ID NO: 3148576 - DNA, 18 bp, Homo sapiens
tcaaagctttcctgtttc

SEQ ID NO: 3148577 - DNA, 16 bp, Homo sapiens
tcaaagctttttccag

SEQ ID NO: 3148578 - DNA, 14 bp, Homo sapiens
tcaaaggagaaaaa

SEQ ID NO: 3148579 - DNA, 12 bp, Homo sapiens
tcaaaggttcta

SEQ ID NO: 3148580 - DNA, 20 bp, Homo sapiens
tcaaaggttctaggtttcaa

SEQ ID NO: 3148581 - DNA, 17 bp, Homo sapiens
tcaaagtaaaggcctcc

SEQ ID NO: 3148582 - DNA, 13 bp, Homo sapiens
tcaaagtcaaaaa

SEQ ID NO: 3148583 - DNA, 13 bp, Homo sapiens
tcaaagtgtatat

SEQ ID NO: 3148584 - DNA, 15 bp, Homo sapiens
tcaaagtgtatattt

SEQ ID NO: 3148585 - DNA, 15 bp, Homo sapiens
tcaaagttaattcac

SEQ ID NO: 3148586 - DNA, 19 bp, Homo sapiens
tcaaagttaattcacctat

SEQ ID NO: 3148587 - DNA, 15 bp, Homo sapiens
tcaaagttttgaaaa

SEQ ID NO: 3148588 - DNA, 13 bp, Homo sapiens
tcaaagttttgtt

SEQ ID NO: 3148589 - DNA, 12 bp, Homo sapiens
tcaaataagaaa

SEQ ID NO: 3148590 - DNA, 13 bp, Homo sapiens
tcaaataagaaat

SEQ ID NO: 3148591 - DNA, 17 bp, Homo sapiens
tcaaataagtatttata

SEQ ID NO: 3148592 - DNA, 18 bp, Homo sapiens
tcaaataagtatttataa

SEQ ID NO: 3148593 - DNA, 17 bp, Homo sapiens
tcaaatacaaagtaaat

SEQ ID NO: 3148594 - DNA, 19 bp, Homo sapiens
tcaaatacaaagtaaatac

SEQ ID NO: 3148595 - DNA, 14 bp, Homo sapiens
tcaaatacacattt

SEQ ID NO: 3148596 - DNA, 16 bp, Homo sapiens
tcaaatacacatttgc

SEQ ID NO: 3148597 - DNA, 20 bp, Homo sapiens
tcaaataggctattaaaaaa

SEQ ID NO: 3148598 - DNA, 13 bp, Homo sapiens
tcaaatatagaaa

SEQ ID NO: 3148599 - DNA, 21 bp, Homo sapiens
tcaaatccttccaaaaattat

SEQ ID NO: 3148600 - DNA, 22 bp, Homo sapiens
tcaaatccttccaaaaattatt

SEQ ID NO: 3148601 - DNA, 14 bp, Homo sapiens
tcaaatctattcag

SEQ ID NO: 3148602 - DNA, 17 bp, Homo sapiens
tcaaatctattcagaca

SEQ ID NO: 3148603 - DNA, 17 bp, Homo sapiens
tcaaatctcctgctgat

SEQ ID NO: 3148604 - DNA, 22 bp, Homo sapiens
tcaaatgagtaacatttgctgt

SEQ ID NO: 3148605 - DNA, 21 bp, Homo sapiens
tcaaatggtaggcatttccta

SEQ ID NO: 3148606 - DNA, 14 bp, Homo sapiens
tcaaatgttctaag

SEQ ID NO: 3148607 - DNA, 15 bp, Homo sapiens
tcaaatgttctaagt

SEQ ID NO: 3148608 - DNA, 21 bp, Homo sapiens
tcaaatgttctaagtttctaa

SEQ ID NO: 3148609 - DNA, 13 bp, Homo sapiens
tcaaattcaatga

SEQ ID NO: 3148610 - DNA, 18 bp, Homo sapiens
tcaaattcaatgattctt

SEQ ID NO: 3148611 - DNA, 15 bp, Homo sapiens
tcaaattcttctgaa

SEQ ID NO: 3148612 - DNA, 16 bp, Homo sapiens
tcaaattcttctgaac

SEQ ID NO: 3148613 - DNA, 12 bp, Homo sapiens
tcaaattgctgc

SEQ ID NO: 3148614 - DNA, 13 bp, Homo sapiens
tcaaattgcttaa

SEQ ID NO: 3148615 - DNA, 22 bp, Homo sapiens
tcaaattgtgcagtactttgtg

SEQ ID NO: 3148616 - DNA, 15 bp, Homo sapiens
tcaaatttacattta

SEQ ID NO: 3148617 - DNA, 21 bp, Homo sapiens
tcaacaaagaaacaaagatgt

SEQ ID NO: 3148618 - DNA, 14 bp, Homo sapiens
tcaacaaagcacag

SEQ ID NO: 3148619 - DNA, 17 bp, Homo sapiens
tcaacaacgtgagagaa

SEQ ID NO: 3148620 - DNA, 20 bp, Homo sapiens
tcaacaagatttccttgtgc

SEQ ID NO: 3148621 - DNA, 19 bp, Homo sapiens
tcaacaagggagagacctc

SEQ ID NO: 3148622 - DNA, 14 bp, Homo sapiens
tcaacaataaaaca

SEQ ID NO: 3148623 - DNA, 18 bp, Homo sapiens
tcaacaatttcaataaaa

SEQ ID NO: 3148624 - DNA, 22 bp, Homo sapiens
tcaacacacaacagcagatggc

SEQ ID NO: 3148625 - DNA, 18 bp, Homo sapiens
tcaacactatatatttta

SEQ ID NO: 3148626 - DNA, 19 bp, Homo sapiens
tcaacactatatattttat

SEQ ID NO: 3148627 - DNA, 23 bp, Homo sapiens
tcaacacttaagggttttagaaa

SEQ ID NO: 3148628 - DNA, 20 bp, Homo sapiens
tcaacagaagcatttgtatt

SEQ ID NO: 3148629 - DNA, 13 bp, Homo sapiens
tcaacatatcatt

SEQ ID NO: 3148630 - DNA, 15 bp, Homo sapiens
tcaacatatcatttt

SEQ ID NO: 3148631 - DNA, 14 bp, Homo sapiens
tcaacatcaatgtt

SEQ ID NO: 3148632 - DNA, 17 bp, Homo sapiens
tcaacatcaatgttcat

SEQ ID NO: 3148633 - DNA, 19 bp, Homo sapiens
tcaacatcaatgttcattg

SEQ ID NO: 3148634 - DNA, 15 bp, Homo sapiens
tcaacatcttttaca

SEQ ID NO: 3148635 - DNA, 21 bp, Homo sapiens
tcaacatgttactgaccagca

SEQ ID NO: 3148636 - DNA, 13 bp, Homo sapiens
tcaaccatcctgg

SEQ ID NO: 3148637 - DNA, 20 bp, Homo sapiens
tcaaccccaccatatgaatt

SEQ ID NO: 3148638 - DNA, 15 bp, Homo sapiens
tcaacccctcccctc

SEQ ID NO: 3148639 - DNA, 23 bp, Homo sapiens
tcaacctaaaacaatctgtaatt

SEQ ID NO: 3148640 - DNA, 15 bp, Homo sapiens
tcaacctcctgtgga

SEQ ID NO: 3148641 - DNA, 18 bp, Homo sapiens
tcaacctcctgtggaacc

SEQ ID NO: 3148642 - DNA, 19 bp, Homo sapiens
tcaacctcttctggctcaa

SEQ ID NO: 3148643 - DNA, 14 bp, Homo sapiens
tcaacgcagccctg

SEQ ID NO: 3148644 - DNA, 15 bp, Homo sapiens
tcaacgtattgtttc

SEQ ID NO: 3148645 - DNA, 14 bp, Homo sapiens
tcaactaaatgaga

SEQ ID NO: 3148646 - DNA, 22 bp, Homo sapiens
tcaactacggttgggagaatga

SEQ ID NO: 3148647 - DNA, 23 bp, Homo sapiens
tcaactctacccctgctcccatt

SEQ ID NO: 3148648 - DNA, 17 bp, Homo sapiens
tcaactctgagcccata

SEQ ID NO: 3148649 - DNA, 23 bp, Homo sapiens
tcaactgaaaagactcagtgttc

SEQ ID NO: 3148650 - DNA, 24 bp, Homo sapiens
tcaactgaccagcctccatgctgc

SEQ ID NO: 3148651 - DNA, 18 bp, Homo sapiens
tcaactgcctactccaaa

SEQ ID NO: 3148652 - DNA, 20 bp, Homo sapiens
tcaactgcctactccaaaat

SEQ ID NO: 3148653 - DNA, 18 bp, Homo sapiens
tcaactgggctctgtccc

SEQ ID NO: 3148654 - DNA, 21 bp, Homo sapiens
tcaactgtaggttatttaaaa

SEQ ID NO: 3148655 - DNA, 18 bp, Homo sapiens
tcaacttctggctcctca

SEQ ID NO: 3148656 - DNA, 13 bp, Homo sapiens
tcaactttgtaaa

SEQ ID NO: 3148657 - DNA, 14 bp, Homo sapiens
tcaactttgtaaaa

SEQ ID NO: 3148658 - DNA, 23 bp, Homo sapiens
tcaagaaaaaataaatggaaatc

SEQ ID NO: 3148659 - DNA, 17 bp, Homo sapiens
tcaagaaaacaacttca

SEQ ID NO: 3148660 - DNA, 20 bp, Homo sapiens
tcaagaaacagccagcaaga

SEQ ID NO: 3148661 - DNA, 13 bp, Homo sapiens
tcaagaaactgag

SEQ ID NO: 3148662 - DNA, 13 bp, Homo sapiens
tcaagaaaggaaa

SEQ ID NO: 3148663 - DNA, 11 bp, Homo sapiens
tcaagaaatga

SEQ ID NO: 3148664 - DNA, 14 bp, Homo sapiens
tcaagaagaaaaag

SEQ ID NO: 3148665 - DNA, 20 bp, Homo sapiens
tcaagacatagcatccaagt

SEQ ID NO: 3148666 - DNA, 21 bp, Homo sapiens
tcaagacatagcatccaagtg

SEQ ID NO: 3148667 - DNA, 16 bp, Homo sapiens
tcaagacccctgtctt

SEQ ID NO: 3148668 - DNA, 16 bp, Homo sapiens
tcaagagatctttctt

SEQ ID NO: 3148669 - DNA, 21 bp, Homo sapiens
tcaagagatctttctttccaa

SEQ ID NO: 3148670 - DNA, 20 bp, Homo sapiens
tcaagagggcactggtggcc

SEQ ID NO: 3148671 - DNA, 22 bp, Homo sapiens
tcaagatactgctactgtaatt

SEQ ID NO: 3148672 - DNA, 13 bp, Homo sapiens
tcaagatagaaag

SEQ ID NO: 3148673 - DNA, 16 bp, Homo sapiens
tcaagatattaaaatg

SEQ ID NO: 3148674 - DNA, 15 bp, Homo sapiens
tcaagattctacttg

SEQ ID NO: 3148675 - DNA, 12 bp, Homo sapiens
tcaagcaaacat

SEQ ID NO: 3148676 - DNA, 14 bp, Homo sapiens
tcaagcaataattg

SEQ ID NO: 3148677 - DNA, 16 bp, Homo sapiens
tcaagcacatgtaata

SEQ ID NO: 3148678 - DNA, 20 bp, Homo sapiens
tcaagcacatgtaataaatt

SEQ ID NO: 3148679 - DNA, 13 bp, Homo sapiens
tcaagcactgata

SEQ ID NO: 3148680 - DNA, 20 bp, Homo sapiens
tcaagcagtcgtgcctgtgt

SEQ ID NO: 3148681 - DNA, 21 bp, Homo sapiens
tcaagcagtcgtgcctgtgtc

SEQ ID NO: 3148682 - DNA, 16 bp, Homo sapiens
tcaagccaatcccctc

SEQ ID NO: 3148683 - DNA, 17 bp, Homo sapiens
tcaagccaatcccctcc

SEQ ID NO: 3148684 - DNA, 21 bp, Homo sapiens
tcaagccagctctaggcttca

SEQ ID NO: 3148685 - DNA, 14 bp, Homo sapiens
tcaagccccagcag

SEQ ID NO: 3148686 - DNA, 16 bp, Homo sapiens
tcaagccccagcagcc

SEQ ID NO: 3148687 - DNA, 18 bp, Homo sapiens
tcaagccccagcagccct

SEQ ID NO: 3148688 - DNA, 20 bp, Homo sapiens
tcaagccccagcagccctca

SEQ ID NO: 3148689 - DNA, 18 bp, Homo sapiens
tcaagccccatttcctca

SEQ ID NO: 3148690 - DNA, 14 bp, Homo sapiens
tcaagcctgcctag

SEQ ID NO: 3148691 - DNA, 15 bp, Homo sapiens
tcaagcgattctcct

SEQ ID NO: 3148692 - DNA, 17 bp, Homo sapiens
tcaagcgattcttctgc

SEQ ID NO: 3148693 - DNA, 18 bp, Homo sapiens
tcaagcgattcttctgct

SEQ ID NO: 3148694 - DNA, 19 bp, Homo sapiens
tcaagcgattcttctgctt

SEQ ID NO: 3148695 - DNA, 21 bp, Homo sapiens
tcaagcgattcttctgcttca

SEQ ID NO: 3148696 - DNA, 16 bp, Homo sapiens
tcaagctagccagagg

SEQ ID NO: 3148697 - DNA, 15 bp, Homo sapiens
tcaagctatttaata

SEQ ID NO: 3148698 - DNA, 18 bp, Homo sapiens
tcaagctgaccttgctga

SEQ ID NO: 3148699 - DNA, 21 bp, Homo sapiens
tcaagctggtggcctctgcag

SEQ ID NO: 3148700 - DNA, 18 bp, Homo sapiens
tcaaggaaaaatgctgct

SEQ ID NO: 3148701 - DNA, 21 bp, Homo sapiens
tcaaggaaaaatgctgcttct

SEQ ID NO: 3148702 - DNA, 18 bp, Homo sapiens
tcaaggaaggttcatgta

SEQ ID NO: 3148703 - DNA, 14 bp, Homo sapiens
tcaaggaatcggct

SEQ ID NO: 3148704 - DNA, 16 bp, Homo sapiens
tcaaggaatttcttaa

SEQ ID NO: 3148705 - DNA, 22 bp, Homo sapiens
tcaaggactctggtttctcatt

SEQ ID NO: 3148706 - DNA, 16 bp, Homo sapiens
tcaaggagaatatgat

SEQ ID NO: 3148707 - DNA, 22 bp, Homo sapiens
tcaaggcaaaaatatcaggagc

SEQ ID NO: 3148708 - DNA, 15 bp, Homo sapiens
tcaaggcactctaga

SEQ ID NO: 3148709 - DNA, 17 bp, Homo sapiens
tcaaggcactctagatt

SEQ ID NO: 3148710 - DNA, 18 bp, Homo sapiens
tcaaggcactctagattc

SEQ ID NO: 3148711 - DNA, 17 bp, Homo sapiens
tcaaggctgcttagaat

SEQ ID NO: 3148712 - DNA, 17 bp, Homo sapiens
tcaagggcttactattt

SEQ ID NO: 3148713 - DNA, 23 bp, Homo sapiens
tcaaggttttaggttctaaagtt

SEQ ID NO: 3148714 - DNA, 12 bp, Homo sapiens
tcaagtaaaaga

SEQ ID NO: 3148715 - DNA, 14 bp, Homo sapiens
tcaagtaaaagaaa

SEQ ID NO: 3148716 - DNA, 22 bp, Homo sapiens
tcaagtaagaagacatgaacca

SEQ ID NO: 3148717 - DNA, 19 bp, Homo sapiens
tcaagtaccaccaagggat

SEQ ID NO: 3148718 - DNA, 13 bp, Homo sapiens
tcaagtagctggg

SEQ ID NO: 3148719 - DNA, 16 bp, Homo sapiens
tcaagtatcttctatt

SEQ ID NO: 3148720 - DNA, 15 bp, Homo sapiens
tcaagtcaaattaat

SEQ ID NO: 3148721 - DNA, 18 bp, Homo sapiens
tcaagtcccttgttttgt

SEQ ID NO: 3148722 - DNA, 18 bp, Homo sapiens
tcaagtccttacctcttc

SEQ ID NO: 3148723 - DNA, 17 bp, Homo sapiens
tcaagtctctgctggcc

SEQ ID NO: 3148724 - DNA, 20 bp, Homo sapiens
tcaagtgaggggccctttgc

SEQ ID NO: 3148725 - DNA, 20 bp, Homo sapiens
tcaagtgatctgcccacctc

SEQ ID NO: 3148726 - DNA, 21 bp, Homo sapiens
tcaagtgatctgccgcctcag

SEQ ID NO: 3148727 - DNA, 18 bp, Homo sapiens
tcaagtgattctcctgcc

SEQ ID NO: 3148728 - DNA, 20 bp, Homo sapiens
tcaagtgattctcctgcctc

SEQ ID NO: 3148729 - DNA, 15 bp, Homo sapiens
tcaagtgattctctt

SEQ ID NO: 3148730 - DNA, 13 bp, Homo sapiens
tcaagtgccaaac

SEQ ID NO: 3148731 - DNA, 18 bp, Homo sapiens
tcaagtgccaaacagagt

SEQ ID NO: 3148732 - DNA, 21 bp, Homo sapiens
tcaagtgccttttgctgcgca

SEQ ID NO: 3148733 - DNA, 15 bp, Homo sapiens
tcaagttagctcagg

SEQ ID NO: 3148734 - DNA, 20 bp, Homo sapiens
tcaagttattcaaatttgta

SEQ ID NO: 3148735 - DNA, 23 bp, Homo sapiens
tcaagttattcaaatttgtacag

SEQ ID NO: 3148736 - DNA, 13 bp, Homo sapiens
tcaagttctaaga

SEQ ID NO: 3148737 - DNA, 14 bp, Homo sapiens
tcaagttgtgcttg

SEQ ID NO: 3148738 - DNA, 22 bp, Homo sapiens
tcaagttgtgcttgtttacagc

SEQ ID NO: 3148739 - DNA, 14 bp, Homo sapiens
tcaagtttacactt

SEQ ID NO: 3148740 - DNA, 17 bp, Homo sapiens
tcaagttttaaagttca

SEQ ID NO: 3148741 - DNA, 21 bp, Homo sapiens
tcaagttttgggtatgtttaa

SEQ ID NO: 3148742 - DNA, 13 bp, Homo sapiens
tcaataaaatgtg

SEQ ID NO: 3148743 - DNA, 15 bp, Homo sapiens
tcaataaaatgtgat

SEQ ID NO: 3148744 - DNA, 14 bp, Homo sapiens
tcaataaacacttg

SEQ ID NO: 3148745 - DNA, 21 bp, Homo sapiens
tcaataaacagcttcatgcct

SEQ ID NO: 3148746 - DNA, 15 bp, Homo sapiens
tcaataaagaaaact

SEQ ID NO: 3148747 - DNA, 19 bp, Homo sapiens
tcaataaagcatttataaa

SEQ ID NO: 3148748 - DNA, 12 bp, Homo sapiens
tcaataaatctt

SEQ ID NO: 3148749 - DNA, 18 bp, Homo sapiens
tcaatacactagttgttt

SEQ ID NO: 3148750 - DNA, 16 bp, Homo sapiens
tcaatactacctctga

SEQ ID NO: 3148751 - DNA, 14 bp, Homo sapiens
tcaatagaactgtt

SEQ ID NO: 3148752 - DNA, 20 bp, Homo sapiens
tcaatagatttaggagcaga

SEQ ID NO: 3148753 - DNA, 19 bp, Homo sapiens
tcaatagtaaaagataaca

SEQ ID NO: 3148754 - DNA, 15 bp, Homo sapiens
tcaatagttgaatta

SEQ ID NO: 3148755 - DNA, 18 bp, Homo sapiens
tcaatatccaaaccaaat

SEQ ID NO: 3148756 - DNA, 13 bp, Homo sapiens
tcaatatctaata

SEQ ID NO: 3148757 - DNA, 19 bp, Homo sapiens
tcaatatctaatatatatg

SEQ ID NO: 3148758 - DNA, 15 bp, Homo sapiens
tcaatatgcaagcag

SEQ ID NO: 3148759 - DNA, 18 bp, Homo sapiens
tcaatatgcaagcagctt

SEQ ID NO: 3148760 - DNA, 13 bp, Homo sapiens
tcaatatgcttac

SEQ ID NO: 3148761 - DNA, 17 bp, Homo sapiens
tcaatattaaatacaga

SEQ ID NO: 3148762 - DNA, 10 bp, Homo sapiens
tcaatattta

SEQ ID NO: 3148763 - DNA, 11 bp, Homo sapiens
tcaatatttat

SEQ ID NO: 3148764 - DNA, 12 bp, Homo sapiens
tcaatatttatt

SEQ ID NO: 3148765 - DNA, 16 bp, Homo sapiens
tcaatatttttatatc

SEQ ID NO: 3148766 - DNA, 16 bp, Homo sapiens
tcaatcaactttactg

SEQ ID NO: 3148767 - DNA, 20 bp, Homo sapiens
tcaatcatctgtgtgaaaat

SEQ ID NO: 3148768 - DNA, 13 bp, Homo sapiens
tcaatcatgccct

SEQ ID NO: 3148769 - DNA, 13 bp, Homo sapiens
tcaatcattgaag

SEQ ID NO: 3148770 - DNA, 22 bp, Homo sapiens
tcaatcattgaagtatattctt

SEQ ID NO: 3148771 - DNA, 12 bp, Homo sapiens
tcaatcatttct

SEQ ID NO: 3148772 - DNA, 14 bp, Homo sapiens
tcaatcatttctca

SEQ ID NO: 3148773 - DNA, 19 bp, Homo sapiens
tcaatcatttctcactgtg

SEQ ID NO: 3148774 - DNA, 13 bp, Homo sapiens
tcaatcccaaaag

SEQ ID NO: 3148775 - DNA, 19 bp, Homo sapiens
tcaatcccaaaagtcacca

SEQ ID NO: 3148776 - DNA, 21 bp, Homo sapiens
tcaatctgtgtaagaaaacaa

SEQ ID NO: 3148777 - DNA, 11 bp, Homo sapiens
tcaatgaaaaa

SEQ ID NO: 3148778 - DNA, 17 bp, Homo sapiens
tcaatgaaccataaatt

SEQ ID NO: 3148779 - DNA, 16 bp, Homo sapiens
tcaatgaggtgtccaa

SEQ ID NO: 3148780 - DNA, 17 bp, Homo sapiens
tcaatgaggtgtccaac

SEQ ID NO: 3148781 - DNA, 14 bp, Homo sapiens
tcaatgcactgaca

SEQ ID NO: 3148782 - DNA, 16 bp, Homo sapiens
tcaatgctagaaaatc

SEQ ID NO: 3148783 - DNA, 20 bp, Homo sapiens
tcaatggatttgatgctgtt

SEQ ID NO: 3148784 - DNA, 15 bp, Homo sapiens
tcaatgtagtctgta

SEQ ID NO: 3148785 - DNA, 11 bp, Homo sapiens
tcaatgtcact

SEQ ID NO: 3148786 - DNA, 15 bp, Homo sapiens
tcaatgtgacattta

SEQ ID NO: 3148787 - DNA, 21 bp, Homo sapiens
tcaatgtgattctaatgtctt

SEQ ID NO: 3148788 - DNA, 20 bp, Homo sapiens
tcaatgtgtctttctaagaa

SEQ ID NO: 3148789 - DNA, 11 bp, Homo sapiens
tcaatgttcat

SEQ ID NO: 3148790 - DNA, 12 bp, Homo sapiens
tcaatgttcatt

SEQ ID NO: 3148791 - DNA, 13 bp, Homo sapiens
tcaatgttcattg

SEQ ID NO: 3148792 - DNA, 14 bp, Homo sapiens
tcaatgttcattgt

SEQ ID NO: 3148793 - DNA, 18 bp, Homo sapiens
tcaatgtttcttctaggt

SEQ ID NO: 3148794 - DNA, 23 bp, Homo sapiens
tcaatgtttgaaatagttcaaac

SEQ ID NO: 3148795 - DNA, 22 bp, Homo sapiens
tcaatgtttgaggagcatgttt

SEQ ID NO: 3148796 - DNA, 23 bp, Homo sapiens
tcaatgtttgaggagcatgtttt

SEQ ID NO: 3148797 - DNA, 13 bp, Homo sapiens
tcaattaaagtct

SEQ ID NO: 3148798 - DNA, 15 bp, Homo sapiens
tcaattaaagtctat

SEQ ID NO: 3148799 - DNA, 19 bp, Homo sapiens
tcaattaaagtctattcaa

SEQ ID NO: 3148800 - DNA, 16 bp, Homo sapiens
tcaattaacatcgtgg

SEQ ID NO: 3148801 - DNA, 11 bp, Homo sapiens
tcaattaataa

SEQ ID NO: 3148802 - DNA, 20 bp, Homo sapiens
tcaattagcgtttaaggtga

SEQ ID NO: 3148803 - DNA, 17 bp, Homo sapiens
tcaattatagtttctga

SEQ ID NO: 3148804 - DNA, 18 bp, Homo sapiens
tcaattatagtttctgag

SEQ ID NO: 3148805 - DNA, 21 bp, Homo sapiens
tcaattccatttaaaaaacaa

SEQ ID NO: 3148806 - DNA, 16 bp, Homo sapiens
tcaattcctctgggaa

SEQ ID NO: 3148807 - DNA, 13 bp, Homo sapiens
tcaattcctgggc

SEQ ID NO: 3148808 - DNA, 14 bp, Homo sapiens
tcaatttccctcag

SEQ ID NO: 3148809 - DNA, 23 bp, Homo sapiens
tcaatttctttctttccttaata

SEQ ID NO: 3148810 - DNA, 20 bp, Homo sapiens
tcaatttgtaattgcttaca

SEQ ID NO: 3148811 - DNA, 21 bp, Homo sapiens
tcaattttatccctcacctgt

SEQ ID NO: 3148812 - DNA, 22 bp, Homo sapiens
tcaattttatccctcacctgta

SEQ ID NO: 3148813 - DNA, 18 bp, Homo sapiens
tcaattttcattaaactt

SEQ ID NO: 3148814 - DNA, 23 bp, Homo sapiens
tcacaaaaatttgaacactggct

SEQ ID NO: 3148815 - DNA, 20 bp, Homo sapiens
tcacaaaatatattttgttt

SEQ ID NO: 3148816 - DNA, 16 bp, Homo sapiens
tcacaaactacctctg

SEQ ID NO: 3148817 - DNA, 17 bp, Homo sapiens
tcacaaactacctctgg

SEQ ID NO: 3148818 - DNA, 21 bp, Homo sapiens
tcacaaacttttatactcttt

SEQ ID NO: 3148819 - DNA, 20 bp, Homo sapiens
tcacaaatcctaaaagaagc

SEQ ID NO: 3148820 - DNA, 18 bp, Homo sapiens
tcacaaattgatcaagat

SEQ ID NO: 3148821 - DNA, 18 bp, Homo sapiens
tcacaagcgctcccagcc

SEQ ID NO: 3148822 - DNA, 17 bp, Homo sapiens
tcacaagtactatctgt

SEQ ID NO: 3148823 - DNA, 14 bp, Homo sapiens
tcacaataaaagct

SEQ ID NO: 3148824 - DNA, 16 bp, Homo sapiens
tcacaatagaaactca

SEQ ID NO: 3148825 - DNA, 15 bp, Homo sapiens
tcacaatgagattga

SEQ ID NO: 3148826 - DNA, 17 bp, Homo sapiens
tcacaatgtcagtattt

SEQ ID NO: 3148827 - DNA, 19 bp, Homo sapiens
tcacaatgtcagtatttca

SEQ ID NO: 3148828 - DNA, 12 bp, Homo sapiens
tcacaattatta

SEQ ID NO: 3148829 - DNA, 10 bp, Homo sapiens
tcacacacac

SEQ ID NO: 3148830 - DNA, 13 bp, Homo sapiens
tcacacacacagc

SEQ ID NO: 3148831 - DNA, 19 bp, Homo sapiens
tcacacacacagctgggca

SEQ ID NO: 3148832 - DNA, 14 bp, Homo sapiens
tcacacacatagat

SEQ ID NO: 3148833 - DNA, 16 bp, Homo sapiens
tcacacaccctgaggt

SEQ ID NO: 3148834 - DNA, 12 bp, Homo sapiens
tcacacactgat

SEQ ID NO: 3148835 - DNA, 17 bp, Homo sapiens
tcacacagggctctttg

SEQ ID NO: 3148836 - DNA, 21 bp, Homo sapiens
tcacacagtagctccaacact

SEQ ID NO: 3148837 - DNA, 12 bp, Homo sapiens
tcacacagtgaa

SEQ ID NO: 3148838 - DNA, 22 bp, Homo sapiens
tcacacagtgagtcgaggacag

SEQ ID NO: 3148839 - DNA, 20 bp, Homo sapiens
tcacacccaccgtccgccct

SEQ ID NO: 3148840 - DNA, 21 bp, Homo sapiens
tcacacccaccgtccgccctg

SEQ ID NO: 3148841 - DNA, 12 bp, Homo sapiens
tcacaccctgca

SEQ ID NO: 3148842 - DNA, 17 bp, Homo sapiens
tcacacctgactctgaa

SEQ ID NO: 3148843 - DNA, 16 bp, Homo sapiens
tcacacgaccggggcc

SEQ ID NO: 3148844 - DNA, 21 bp, Homo sapiens
tcacactaagagggcagactg

SEQ ID NO: 3148845 - DNA, 15 bp, Homo sapiens
tcacactacacatca

SEQ ID NO: 3148846 - DNA, 23 bp, Homo sapiens
tcacactcagaaagaggtctccc

SEQ ID NO: 3148847 - DNA, 13 bp, Homo sapiens
tcacactcttcag

SEQ ID NO: 3148848 - DNA, 22 bp, Homo sapiens
tcacactgggtggtggcctggt

SEQ ID NO: 3148849 - DNA, 17 bp, Homo sapiens
tcacactggtctgctgt

SEQ ID NO: 3148850 - DNA, 18 bp, Homo sapiens
tcacactttttatttaat

SEQ ID NO: 3148851 - DNA, 21 bp, Homo sapiens
tcacagaaatcagaggagaga

SEQ ID NO: 3148852 - DNA, 22 bp, Homo sapiens
tcacagaacctactgttccttt

SEQ ID NO: 3148853 - DNA, 23 bp, Homo sapiens
tcacagaacctactgttcctttc

SEQ ID NO: 3148854 - DNA, 15 bp, Homo sapiens
tcacagacctggagc

SEQ ID NO: 3148855 - DNA, 19 bp, Homo sapiens
tcacagacctggagcccct

SEQ ID NO: 3148856 - DNA, 22 bp, Homo sapiens
tcacagacctggagcccctggg

SEQ ID NO: 3148857 - DNA, 22 bp, Homo sapiens
tcacagagacattcctccgagc

SEQ ID NO: 3148858 - DNA, 23 bp, Homo sapiens
tcacagagacattcctccgagcc

SEQ ID NO: 3148859 - DNA, 12 bp, Homo sapiens
tcacagcctcca

SEQ ID NO: 3148860 - DNA, 16 bp, Homo sapiens
tcacagcctctgaccc

SEQ ID NO: 3148861 - DNA, 17 bp, Homo sapiens
tcacagcctctgacccc

SEQ ID NO: 3148862 - DNA, 21 bp, Homo sapiens
tcacagcctctgacccctcct

SEQ ID NO: 3148863 - DNA, 12 bp, Homo sapiens
tcacagccttgg

SEQ ID NO: 3148864 - DNA, 17 bp, Homo sapiens
tcacagccttggctcct

SEQ ID NO: 3148865 - DNA, 14 bp, Homo sapiens
tcacagctcctccc

SEQ ID NO: 3148866 - DNA, 13 bp, Homo sapiens
tcacagctgcagc

SEQ ID NO: 3148867 - DNA, 16 bp, Homo sapiens
tcacaggaggccagtg

SEQ ID NO: 3148868 - DNA, 18 bp, Homo sapiens
tcacaggatgccagcccc

SEQ ID NO: 3148869 - DNA, 20 bp, Homo sapiens
tcacaggatgccagcccctg

SEQ ID NO: 3148870 - DNA, 21 bp, Homo sapiens
tcacaggatgccagcccctgc

SEQ ID NO: 3148871 - DNA, 19 bp, Homo sapiens
tcacaggcaggtccagggt

SEQ ID NO: 3148872 - DNA, 17 bp, Homo sapiens
tcacaggcagtgcatgt

SEQ ID NO: 3148873 - DNA, 20 bp, Homo sapiens
tcacaggcagtgcatgtgaa

SEQ ID NO: 3148874 - DNA, 15 bp, Homo sapiens
tcacaggcctctctt

SEQ ID NO: 3148875 - DNA, 16 bp, Homo sapiens
tcacaggcctctcttt

SEQ ID NO: 3148876 - DNA, 14 bp, Homo sapiens
tcacaggctgtaaa

SEQ ID NO: 3148877 - DNA, 15 bp, Homo sapiens
tcacagggcagagcc

SEQ ID NO: 3148878 - DNA, 12 bp, Homo sapiens
tcacagggccaa

SEQ ID NO: 3148879 - DNA, 22 bp, Homo sapiens
tcacagggccaacttgagggcc

SEQ ID NO: 3148880 - DNA, 14 bp, Homo sapiens
tcacagggttgggc

SEQ ID NO: 3148881 - DNA, 21 bp, Homo sapiens
tcacaggtgtggtgtaattta

SEQ ID NO: 3148882 - DNA, 18 bp, Homo sapiens
tcacaggttggaagagaa

SEQ ID NO: 3148883 - DNA, 21 bp, Homo sapiens
tcacaggttggaagagaatca

SEQ ID NO: 3148884 - DNA, 22 bp, Homo sapiens
tcacaggttggaagagaatcac

SEQ ID NO: 3148885 - DNA, 15 bp, Homo sapiens
tcacagtaaaaataa

SEQ ID NO: 3148886 - DNA, 16 bp, Homo sapiens
tcacagtaaaaataaa

SEQ ID NO: 3148887 - DNA, 17 bp, Homo sapiens
tcacagtacagcatgtg

SEQ ID NO: 3148888 - DNA, 19 bp, Homo sapiens
tcacagtacagcatgtgcc

SEQ ID NO: 3148889 - DNA, 20 bp, Homo sapiens
tcacagtacagcatgtgcct

SEQ ID NO: 3148890 - DNA, 18 bp, Homo sapiens
tcacagtagagccagctt

SEQ ID NO: 3148891 - DNA, 22 bp, Homo sapiens
tcacagtcccaggtttagtgaa

SEQ ID NO: 3148892 - DNA, 16 bp, Homo sapiens
tcacagtgacccttcc

SEQ ID NO: 3148893 - DNA, 17 bp, Homo sapiens
tcacagtgacccttccc

SEQ ID NO: 3148894 - DNA, 17 bp, Homo sapiens
tcacagtgctcttttct

SEQ ID NO: 3148895 - DNA, 17 bp, Homo sapiens
tcacagtgttgcccagg

SEQ ID NO: 3148896 - DNA, 14 bp, Homo sapiens
tcacagtgtttcga

SEQ ID NO: 3148897 - DNA, 13 bp, Homo sapiens
tcacatacactca

SEQ ID NO: 3148898 - DNA, 17 bp, Homo sapiens
tcacatagatgtccctt

SEQ ID NO: 3148899 - DNA, 21 bp, Homo sapiens
tcacatagctacccaaaagag

SEQ ID NO: 3148900 - DNA, 18 bp, Homo sapiens
tcacatcagataagacat

SEQ ID NO: 3148901 - DNA, 13 bp, Homo sapiens
tcacatgacctga

SEQ ID NO: 3148902 - DNA, 16 bp, Homo sapiens
tcacatggcctatgca

SEQ ID NO: 3148903 - DNA, 21 bp, Homo sapiens
tcacatggcctatgcacatat

SEQ ID NO: 3148904 - DNA, 16 bp, Homo sapiens
tcacattaatggtcta

SEQ ID NO: 3148905 - DNA, 22 bp, Homo sapiens
tcacattaatggtctaaaaata

SEQ ID NO: 3148906 - DNA, 15 bp, Homo sapiens
tcacattagaattag

SEQ ID NO: 3148907 - DNA, 16 bp, Homo sapiens
tcacattatttgcatg

SEQ ID NO: 3148908 - DNA, 22 bp, Homo sapiens
tcacattcctctgcccttcctg

SEQ ID NO: 3148909 - DNA, 21 bp, Homo sapiens
tcacattgagctgatataaat

SEQ ID NO: 3148910 - DNA, 23 bp, Homo sapiens
tcacattgagctgatataaattc

SEQ ID NO: 3148911 - DNA, 18 bp, Homo sapiens
tcacatttattctgctca

SEQ ID NO: 3148912 - DNA, 19 bp, Homo sapiens
tcacatttattctgctcac

SEQ ID NO: 3148913 - DNA, 14 bp, Homo sapiens
tcacattttccttt

SEQ ID NO: 3148914 - DNA, 14 bp, Homo sapiens
tcacatttttttct

SEQ ID NO: 3148915 - DNA, 17 bp, Homo sapiens
tcacatttttttctacc

SEQ ID NO: 3148916 - DNA, 17 bp, Homo sapiens
tcaccaaaatttctaca

SEQ ID NO: 3148917 - DNA, 16 bp, Homo sapiens
tcaccacatgtgcaca

SEQ ID NO: 3148918 - DNA, 22 bp, Homo sapiens
tcaccaccacccgaaatgccac

SEQ ID NO: 3148919 - DNA, 13 bp, Homo sapiens
tcaccaccgcctc

SEQ ID NO: 3148920 - DNA, 15 bp, Homo sapiens
tcaccaccgcctctg

SEQ ID NO: 3148921 - DNA, 13 bp, Homo sapiens
tcaccacctctcc

SEQ ID NO: 3148922 - DNA, 18 bp, Homo sapiens
tcaccacgactggccagg

SEQ ID NO: 3148923 - DNA, 21 bp, Homo sapiens
tcaccacgtggggctcacttt

SEQ ID NO: 3148924 - DNA, 15 bp, Homo sapiens
tcaccagccccactg

SEQ ID NO: 3148925 - DNA, 17 bp, Homo sapiens
tcaccagccccagtgcc

SEQ ID NO: 3148926 - DNA, 22 bp, Homo sapiens
tcaccagccccagtgcccacag

SEQ ID NO: 3148927 - DNA, 19 bp, Homo sapiens
tcaccagcccggcctgctc

SEQ ID NO: 3148928 - DNA, 18 bp, Homo sapiens
tcaccagctatctgtcat

SEQ ID NO: 3148929 - DNA, 18 bp, Homo sapiens
tcaccagctgctgctctg

SEQ ID NO: 3148930 - DNA, 14 bp, Homo sapiens
tcaccaggggagga

SEQ ID NO: 3148931 - DNA, 19 bp, Homo sapiens
tcaccaggggaggagcctg

SEQ ID NO: 3148932 - DNA, 24 bp, Homo sapiens
tcaccaggggaggagcctgtgcgt

SEQ ID NO: 3148933 - DNA, 21 bp, Homo sapiens
tcaccagggtccgcaccagct

SEQ ID NO: 3148934 - DNA, 21 bp, Homo sapiens
tcaccagtctgtctactgtgg

SEQ ID NO: 3148935 - DNA, 23 bp, Homo sapiens
tcaccagtctgtctactgtggtg

SEQ ID NO: 3148936 - DNA, 20 bp, Homo sapiens
tcaccagttaaaagcatttt

SEQ ID NO: 3148937 - DNA, 17 bp, Homo sapiens
tcaccataacctctggg

SEQ ID NO: 3148938 - DNA, 11 bp, Homo sapiens
tcaccatctct

SEQ ID NO: 3148939 - DNA, 14 bp, Homo sapiens
tcaccatctcttca

SEQ ID NO: 3148940 - DNA, 19 bp, Homo sapiens
tcacccaagagattgttgt

SEQ ID NO: 3148941 - DNA, 13 bp, Homo sapiens
tcacccacccctg

SEQ ID NO: 3148942 - DNA, 14 bp, Homo sapiens
tcacccagactgga

SEQ ID NO: 3148943 - DNA, 17 bp, Homo sapiens
tcacccatgaagacagg

SEQ ID NO: 3148944 - DNA, 22 bp, Homo sapiens
tcaccccaagtagtctgctcac

SEQ ID NO: 3148945 - DNA, 12 bp, Homo sapiens
tcaccccatccc

SEQ ID NO: 3148946 - DNA, 13 bp, Homo sapiens
tcaccccatccca

SEQ ID NO: 3148947 - DNA, 12 bp, Homo sapiens
tcacccccatcc

SEQ ID NO: 3148948 - DNA, 14 bp, Homo sapiens
tcacccccatccct

SEQ ID NO: 3148949 - DNA, 14 bp, Homo sapiens
tcacccccatggcc

SEQ ID NO: 3148950 - DNA, 18 bp, Homo sapiens
tcaccccctcctggcaat

SEQ ID NO: 3148951 - DNA, 14 bp, Homo sapiens
tcaccccctgagat

SEQ ID NO: 3148952 - DNA, 23 bp, Homo sapiens
tcaccccgctgtaagctcctttg

SEQ ID NO: 3148953 - DNA, 16 bp, Homo sapiens
tcaccccggcaggccc

SEQ ID NO: 3148954 - DNA, 17 bp, Homo sapiens
tcaccccggcaggccct

SEQ ID NO: 3148955 - DNA, 18 bp, Homo sapiens
tcaccccggcaggccctg

SEQ ID NO: 3148956 - DNA, 19 bp, Homo sapiens
tcaccccggcaggccctgc

SEQ ID NO: 3148957 - DNA, 23 bp, Homo sapiens
tcaccccggcaggccctgcagtg

SEQ ID NO: 3148958 - DNA, 13 bp, Homo sapiens
tcacccctgcact

SEQ ID NO: 3148959 - DNA, 14 bp, Homo sapiens
tcacccctgggcag

SEQ ID NO: 3148960 - DNA, 15 bp, Homo sapiens
tcacccctgtttctg

SEQ ID NO: 3148961 - DNA, 18 bp, Homo sapiens
tcaccctactctggatgg

SEQ ID NO: 3148962 - DNA, 15 bp, Homo sapiens
tcaccctgcccgctc

SEQ ID NO: 3148963 - DNA, 20 bp, Homo sapiens
tcaccctgcccgctcccaac

SEQ ID NO: 3148964 - DNA, 13 bp, Homo sapiens
tcaccctgggagc

SEQ ID NO: 3148965 - DNA, 22 bp, Homo sapiens
tcacccttaacccaaggagcac

SEQ ID NO: 3148966 - DNA, 13 bp, Homo sapiens
tcacccttgtcct

SEQ ID NO: 3148967 - DNA, 16 bp, Homo sapiens
tcaccgagtgggggca

SEQ ID NO: 3148968 - DNA, 22 bp, Homo sapiens
tcaccgcagtcgtcgcacagtc

SEQ ID NO: 3148969 - DNA, 15 bp, Homo sapiens
tcaccgcccatcagg

SEQ ID NO: 3148970 - DNA, 12 bp, Homo sapiens
tcaccgctgggt

SEQ ID NO: 3148971 - DNA, 19 bp, Homo sapiens
tcaccggccgatggagaca

SEQ ID NO: 3148972 - DNA, 16 bp, Homo sapiens
tcaccgggatgaacct

SEQ ID NO: 3148973 - DNA, 18 bp, Homo sapiens
tcaccggggtggtttagt

SEQ ID NO: 3148974 - DNA, 16 bp, Homo sapiens
tcaccggtcagtgcct

SEQ ID NO: 3148975 - DNA, 23 bp, Homo sapiens
tcaccgtgcagagctgcacttgg

SEQ ID NO: 3148976 - DNA, 17 bp, Homo sapiens
tcaccgtgctgtcttct

SEQ ID NO: 3148977 - DNA, 22 bp, Homo sapiens
tcaccgtgctgtcttctggtct

SEQ ID NO: 3148978 - DNA, 14 bp, Homo sapiens
tcacctaatgttta

SEQ ID NO: 3148979 - DNA, 14 bp, Homo sapiens
tcacctagagccag

SEQ ID NO: 3148980 - DNA, 16 bp, Homo sapiens
tcacctatgttatttt

SEQ ID NO: 3148981 - DNA, 23 bp, Homo sapiens
tcacctatgttattttgtgtaca

SEQ ID NO: 3148982 - DNA, 18 bp, Homo sapiens
tcacctcaggccaggtgc

SEQ ID NO: 3148983 - DNA, 17 bp, Homo sapiens
tcacctctatccaaaga

SEQ ID NO: 3148984 - DNA, 15 bp, Homo sapiens
tcacctctctcagag

SEQ ID NO: 3148985 - DNA, 16 bp, Homo sapiens
tcacctgaagactcat

SEQ ID NO: 3148986 - DNA, 19 bp, Homo sapiens
tcacctgaagactcattct

SEQ ID NO: 3148987 - DNA, 14 bp, Homo sapiens
tcacctgcaagccc

SEQ ID NO: 3148988 - DNA, 18 bp, Homo sapiens
tcacctgcaagccccagg

SEQ ID NO: 3148989 - DNA, 23 bp, Homo sapiens
tcacctgcaagccccagggcctg

SEQ ID NO: 3148990 - DNA, 18 bp, Homo sapiens
tcacctgccaccacacac

SEQ ID NO: 3148991 - DNA, 22 bp, Homo sapiens
tcacctggacttaagcatctgg

SEQ ID NO: 3148992 - DNA, 15 bp, Homo sapiens
tcacctgggccctgg

SEQ ID NO: 3148993 - DNA, 19 bp, Homo sapiens
tcacctgggccctggagga

SEQ ID NO: 3148994 - DNA, 16 bp, Homo sapiens
tcacctgtaaacctga

SEQ ID NO: 3148995 - DNA, 17 bp, Homo sapiens
tcacctgttatgtatga

SEQ ID NO: 3148996 - DNA, 18 bp, Homo sapiens
tcacctgtttttaagctg

SEQ ID NO: 3148997 - DNA, 21 bp, Homo sapiens
tcacctgtttttaagctgttt

SEQ ID NO: 3148998 - DNA, 17 bp, Homo sapiens
tcaccttccaaacaaaa

SEQ ID NO: 3148999 - DNA, 15 bp, Homo sapiens
tcaccttctttgtaa

SEQ ID NO: 3149000 - DNA, 20 bp, Homo sapiens
tcaccttgtgtgttccaagt

SEQ ID NO: 3149001 - DNA, 14 bp, Homo sapiens
tcacctttgtaaga

SEQ ID NO: 3149002 - DNA, 21 bp, Homo sapiens
tcacctttgtaagacatttgt

SEQ ID NO: 3149003 - DNA, 14 bp, Homo sapiens
tcaccttttcttca

SEQ ID NO: 3149004 - DNA, 16 bp, Homo sapiens
tcacgccactgcactc

SEQ ID NO: 3149005 - DNA, 16 bp, Homo sapiens
tcacgcccccaggaat

SEQ ID NO: 3149006 - DNA, 21 bp, Homo sapiens
tcacgcctatgatcccagcac

SEQ ID NO: 3149007 - DNA, 14 bp, Homo sapiens
tcacgcctgtaatc

SEQ ID NO: 3149008 - DNA, 21 bp, Homo sapiens
tcacgctccccgcctgttccc

SEQ ID NO: 3149009 - DNA, 18 bp, Homo sapiens
tcacgctggggctctctg

SEQ ID NO: 3149010 - DNA, 14 bp, Homo sapiens
tcacggggcctcca

SEQ ID NO: 3149011 - DNA, 17 bp, Homo sapiens
tcacggtggtaaagaaa

SEQ ID NO: 3149012 - DNA, 21 bp, Homo sapiens
tcacgtaccccactgggccag

SEQ ID NO: 3149013 - DNA, 20 bp, Homo sapiens
tcacgttaccatttacatgt

SEQ ID NO: 3149014 - DNA, 20 bp, Homo sapiens
tcacgttggggtgatttaat

SEQ ID NO: 3149015 - DNA, 19 bp, Homo sapiens
tcactaaactttatttgta

SEQ ID NO: 3149016 - DNA, 22 bp, Homo sapiens
tcactaacattatattgcaatg

SEQ ID NO: 3149017 - DNA, 15 bp, Homo sapiens
tcactaaccaacaag

SEQ ID NO: 3149018 - DNA, 19 bp, Homo sapiens
tcactacagggagaaaatc

SEQ ID NO: 3149019 - DNA, 15 bp, Homo sapiens
tcactagaagaaaag

SEQ ID NO: 3149020 - DNA, 14 bp, Homo sapiens
tcactagccatgat

SEQ ID NO: 3149021 - DNA, 20 bp, Homo sapiens
tcactaggaaaatcatgtgc

SEQ ID NO: 3149022 - DNA, 22 bp, Homo sapiens
tcactagtgaccccttccctgt

SEQ ID NO: 3149023 - DNA, 17 bp, Homo sapiens
tcactataaatggtgtt

SEQ ID NO: 3149024 - DNA, 14 bp, Homo sapiens
tcactatccatgca

SEQ ID NO: 3149025 - DNA, 15 bp, Homo sapiens
tcactatcttcttca

SEQ ID NO: 3149026 - DNA, 22 bp, Homo sapiens
tcactatggtatgctggccagc

SEQ ID NO: 3149027 - DNA, 17 bp, Homo sapiens
tcactatgttgcccagg

SEQ ID NO: 3149028 - DNA, 18 bp, Homo sapiens
tcactatgttgcccaggc

SEQ ID NO: 3149029 - DNA, 15 bp, Homo sapiens
tcactatttaaacta

SEQ ID NO: 3149030 - DNA, 20 bp, Homo sapiens
tcactatttttatttatatt

SEQ ID NO: 3149031 - DNA, 15 bp, Homo sapiens
tcactcaagcactga

SEQ ID NO: 3149032 - DNA, 17 bp, Homo sapiens
tcactcaagcactgata

SEQ ID NO: 3149033 - DNA, 17 bp, Homo sapiens
tcactcacattttctca

SEQ ID NO: 3149034 - DNA, 17 bp, Homo sapiens
tcactcactcactcatt

SEQ ID NO: 3149035 - DNA, 16 bp, Homo sapiens
tcactcactgtcaatg

SEQ ID NO: 3149036 - DNA, 13 bp, Homo sapiens
tcactcattgctg

SEQ ID NO: 3149037 - DNA, 15 bp, Homo sapiens
tcactcattgctgag

SEQ ID NO: 3149038 - DNA, 20 bp, Homo sapiens
tcactcatttacgtaaaaag

SEQ ID NO: 3149039 - DNA, 15 bp, Homo sapiens
tcactccaccatccc

SEQ ID NO: 3149040 - DNA, 23 bp, Homo sapiens
tcactcccacctgcatctggggc

SEQ ID NO: 3149041 - DNA, 21 bp, Homo sapiens
tcactcccagcactccccttg

SEQ ID NO: 3149042 - DNA, 14 bp, Homo sapiens
tcactcccagtcca

SEQ ID NO: 3149043 - DNA, 18 bp, Homo sapiens
tcactcccatttttactt

SEQ ID NO: 3149044 - DNA, 11 bp, Homo sapiens
tcactccccag

SEQ ID NO: 3149045 - DNA, 14 bp, Homo sapiens
tcactccccagccc

SEQ ID NO: 3149046 - DNA, 19 bp, Homo sapiens
tcactccggtgtgcctgca

SEQ ID NO: 3149047 - DNA, 20 bp, Homo sapiens
tcactccggtgtgcctgcag

SEQ ID NO: 3149048 - DNA, 22 bp, Homo sapiens
tcactccggtgtgcctgcagcc

SEQ ID NO: 3149049 - DNA, 13 bp, Homo sapiens
tcactcctgcctc

SEQ ID NO: 3149050 - DNA, 14 bp, Homo sapiens
tcactcctgcctcc

SEQ ID NO: 3149051 - DNA, 15 bp, Homo sapiens
tcactcctgcctccg

SEQ ID NO: 3149052 - DNA, 13 bp, Homo sapiens
tcactcctggggc

SEQ ID NO: 3149053 - DNA, 17 bp, Homo sapiens
tcactcggcaccctgca

SEQ ID NO: 3149054 - DNA, 14 bp, Homo sapiens
tcactctaaaaaac

SEQ ID NO: 3149055 - DNA, 16 bp, Homo sapiens
tcactctaaaaaacat

SEQ ID NO: 3149056 - DNA, 21 bp, Homo sapiens
tcactctaattaattgtaatc

SEQ ID NO: 3149057 - DNA, 19 bp, Homo sapiens
tcactctacttagcatgtc

SEQ ID NO: 3149058 - DNA, 12 bp, Homo sapiens
tcactctgccag

SEQ ID NO: 3149059 - DNA, 14 bp, Homo sapiens
tcactctgccaggg

SEQ ID NO: 3149060 - DNA, 13 bp, Homo sapiens
tcactctgtcagc

SEQ ID NO: 3149061 - DNA, 20 bp, Homo sapiens
tcactctgtcagccagccgc

SEQ ID NO: 3149062 - DNA, 14 bp, Homo sapiens
tcactctgtccctg

SEQ ID NO: 3149063 - DNA, 21 bp, Homo sapiens
tcactctgtccctgtccttcc

SEQ ID NO: 3149064 - DNA, 23 bp, Homo sapiens
tcactcttattgcccacgctgga

SEQ ID NO: 3149065 - DNA, 19 bp, Homo sapiens
tcactcttgtactgcctgc

SEQ ID NO: 3149066 - DNA, 15 bp, Homo sapiens
tcactgaaatgtttg

SEQ ID NO: 3149067 - DNA, 14 bp, Homo sapiens
tcactgaagcctgc

SEQ ID NO: 3149068 - DNA, 15 bp, Homo sapiens
tcactgacacaaagg

SEQ ID NO: 3149069 - DNA, 17 bp, Homo sapiens
tcactgagaggcctgga

SEQ ID NO: 3149070 - DNA, 14 bp, Homo sapiens
tcactgagctcccc

SEQ ID NO: 3149071 - DNA, 16 bp, Homo sapiens
tcactgagctccccag

SEQ ID NO: 3149072 - DNA, 17 bp, Homo sapiens
tcactgcaacctccgcc

SEQ ID NO: 3149073 - DNA, 18 bp, Homo sapiens
tcactgcaattttgtgta

SEQ ID NO: 3149074 - DNA, 24 bp, Homo sapiens
tcactgcacagtgcatctcagccc

SEQ ID NO: 3149075 - DNA, 13 bp, Homo sapiens
tcactgcagccca

SEQ ID NO: 3149076 - DNA, 14 bp, Homo sapiens
tcactgcagcctca

SEQ ID NO: 3149077 - DNA, 16 bp, Homo sapiens
tcactgccactttgca

SEQ ID NO: 3149078 - DNA, 15 bp, Homo sapiens
tcactgccaggccag

SEQ ID NO: 3149079 - DNA, 16 bp, Homo sapiens
tcactgccaggccagc

SEQ ID NO: 3149080 - DNA, 23 bp, Homo sapiens
tcactgccaggccagcctccgag

SEQ ID NO: 3149081 - DNA, 11 bp, Homo sapiens
tcactgccatg

SEQ ID NO: 3149082 - DNA, 12 bp, Homo sapiens
tcactgccatga

SEQ ID NO: 3149083 - DNA, 13 bp, Homo sapiens
tcactgccatgat

SEQ ID NO: 3149084 - DNA, 19 bp, Homo sapiens
tcactgcccgcacaccctc

SEQ ID NO: 3149085 - DNA, 15 bp, Homo sapiens
tcactgcctgtagag

SEQ ID NO: 3149086 - DNA, 20 bp, Homo sapiens
tcactgctccctgaagccag

SEQ ID NO: 3149087 - DNA, 21 bp, Homo sapiens
tcactgctccctgaagccagc

SEQ ID NO: 3149088 - DNA, 24 bp, Homo sapiens
tcactgctccctgaagccagcctt

SEQ ID NO: 3149089 - DNA, 19 bp, Homo sapiens
tcactgctgatcgtagaaa

SEQ ID NO: 3149090 - DNA, 12 bp, Homo sapiens
tcactgctggct

SEQ ID NO: 3149091 - DNA, 13 bp, Homo sapiens
tcactgctggctg

SEQ ID NO: 3149092 - DNA, 14 bp, Homo sapiens
tcactgctggctgc

SEQ ID NO: 3149093 - DNA, 15 bp, Homo sapiens
tcactgctggctgcc

SEQ ID NO: 3149094 - DNA, 17 bp, Homo sapiens
tcactgctggctgcctt

SEQ ID NO: 3149095 - DNA, 16 bp, Homo sapiens
tcactgctgtcatcaa

SEQ ID NO: 3149096 - DNA, 21 bp, Homo sapiens
tcactgcttgatgaagcaagg

SEQ ID NO: 3149097 - DNA, 21 bp, Homo sapiens
tcactggaaaggggagagcct

SEQ ID NO: 3149098 - DNA, 23 bp, Homo sapiens
tcactggaaaggggagagcctgc

SEQ ID NO: 3149099 - DNA, 12 bp, Homo sapiens
tcactggagccc

SEQ ID NO: 3149100 - DNA, 13 bp, Homo sapiens
tcactggagccca

SEQ ID NO: 3149101 - DNA, 21 bp, Homo sapiens
tcactggaggagcagcttcct

SEQ ID NO: 3149102 - DNA, 15 bp, Homo sapiens
tcactggccatccct

SEQ ID NO: 3149103 - DNA, 17 bp, Homo sapiens
tcactggctctccaagt

SEQ ID NO: 3149104 - DNA, 13 bp, Homo sapiens
tcactggctggct

SEQ ID NO: 3149105 - DNA, 15 bp, Homo sapiens
tcactggctggctcc

SEQ ID NO: 3149106 - DNA, 19 bp, Homo sapiens
tcactggctggctcctagg

SEQ ID NO: 3149107 - DNA, 13 bp, Homo sapiens
tcactggcttcca

SEQ ID NO: 3149108 - DNA, 16 bp, Homo sapiens
tcactgggggctttgg

SEQ ID NO: 3149109 - DNA, 18 bp, Homo sapiens
tcactgggtggggtgagg

SEQ ID NO: 3149110 - DNA, 16 bp, Homo sapiens
tcactggtctctaagt

SEQ ID NO: 3149111 - DNA, 23 bp, Homo sapiens
tcactggttttacttacaaaaat

SEQ ID NO: 3149112 - DNA, 23 bp, Homo sapiens
tcactgtaagactcattccctag

SEQ ID NO: 3149113 - DNA, 20 bp, Homo sapiens
tcactgtagaatgatttcat

SEQ ID NO: 3149114 - DNA, 15 bp, Homo sapiens
tcactgtataaatag

SEQ ID NO: 3149115 - DNA, 16 bp, Homo sapiens
tcactgtataaatagg

SEQ ID NO: 3149116 - DNA, 23 bp, Homo sapiens
tcactgtataaataggagaggat

SEQ ID NO: 3149117 - DNA, 18 bp, Homo sapiens
tcactgtatcattttctt

SEQ ID NO: 3149118 - DNA, 14 bp, Homo sapiens
tcactgtcaatgat

SEQ ID NO: 3149119 - DNA, 12 bp, Homo sapiens
tcactgtgatca

SEQ ID NO: 3149120 - DNA, 22 bp, Homo sapiens
tcactgtgcttcgagccaactc

SEQ ID NO: 3149121 - DNA, 18 bp, Homo sapiens
tcactgtgggaaggccag

SEQ ID NO: 3149122 - DNA, 21 bp, Homo sapiens
tcactgtgggaaggccagctg

SEQ ID NO: 3149123 - DNA, 15 bp, Homo sapiens
tcactgtgtacataa

SEQ ID NO: 3149124 - DNA, 16 bp, Homo sapiens
tcactgtgtacataat

SEQ ID NO: 3149125 - DNA, 17 bp, Homo sapiens
tcactgtgtacataatg

SEQ ID NO: 3149126 - DNA, 21 bp, Homo sapiens
tcactgttccctctgctcctg

SEQ ID NO: 3149127 - DNA, 22 bp, Homo sapiens
tcactgttccctctgctcctgg

SEQ ID NO: 3149128 - DNA, 16 bp, Homo sapiens
tcactgttctgcaaag

SEQ ID NO: 3149129 - DNA, 18 bp, Homo sapiens
tcactgttgaaaattatt

SEQ ID NO: 3149130 - DNA, 16 bp, Homo sapiens
tcactgttgcccaggc

SEQ ID NO: 3149131 - DNA, 19 bp, Homo sapiens
tcactgttgcccaggctgg

SEQ ID NO: 3149132 - DNA, 23 bp, Homo sapiens
tcactgttgcccaggctggcgtg

SEQ ID NO: 3149133 - DNA, 15 bp, Homo sapiens
tcacttaaagggtct

SEQ ID NO: 3149134 - DNA, 13 bp, Homo sapiens
tcacttagccatg

SEQ ID NO: 3149135 - DNA, 21 bp, Homo sapiens
tcacttaggaaatggctttgt

SEQ ID NO: 3149136 - DNA, 19 bp, Homo sapiens
tcacttaggggcagcatgt

SEQ ID NO: 3149137 - DNA, 19 bp, Homo sapiens
tcacttatcccaagagaat

SEQ ID NO: 3149138 - DNA, 15 bp, Homo sapiens
tcacttcaccctgga

SEQ ID NO: 3149139 - DNA, 22 bp, Homo sapiens
tcacttccatacagctctacgt

SEQ ID NO: 3149140 - DNA, 23 bp, Homo sapiens
tcacttcgggctgtgtaaacaca

SEQ ID NO: 3149141 - DNA, 13 bp, Homo sapiens
tcacttctaaatg

SEQ ID NO: 3149142 - DNA, 22 bp, Homo sapiens
tcacttctcttaaacttgtgaa

SEQ ID NO: 3149143 - DNA, 13 bp, Homo sapiens
tcacttgaatgtg

SEQ ID NO: 3149144 - DNA, 13 bp, Homo sapiens
tcacttgccttag

SEQ ID NO: 3149145 - DNA, 9 bp, Homo sapiens
tcacttgta

SEQ ID NO: 3149146 - DNA, 13 bp, Homo sapiens
tcacttgtacaaa

SEQ ID NO: 3149147 - DNA, 23 bp, Homo sapiens
tcacttgtgctttgctcttgtcc

SEQ ID NO: 3149148 - DNA, 13 bp, Homo sapiens
tcactttaaacct

SEQ ID NO: 3149149 - DNA, 21 bp, Homo sapiens
tcactttacataagaaatgta

SEQ ID NO: 3149150 - DNA, 16 bp, Homo sapiens
tcactttagatgctga

SEQ ID NO: 3149151 - DNA, 13 bp, Homo sapiens
tcactttcaattc

SEQ ID NO: 3149152 - DNA, 17 bp, Homo sapiens
tcactttcacatagatg

SEQ ID NO: 3149153 - DNA, 12 bp, Homo sapiens
tcactttcataa

SEQ ID NO: 3149154 - DNA, 14 bp, Homo sapiens
tcactttgctctgg

SEQ ID NO: 3149155 - DNA, 15 bp, Homo sapiens
tcactttgctctggg

SEQ ID NO: 3149156 - DNA, 19 bp, Homo sapiens
tcactttgtctaactcaga

SEQ ID NO: 3149157 - DNA, 13 bp, Homo sapiens
tcacttttcagtg

SEQ ID NO: 3149158 - DNA, 12 bp, Homo sapiens
tcacttttcctc

SEQ ID NO: 3149159 - DNA, 13 bp, Homo sapiens
tcacttttcctcc

SEQ ID NO: 3149160 - DNA, 22 bp, Homo sapiens
tcacttttgaatctataaaaga

SEQ ID NO: 3149161 - DNA, 21 bp, Homo sapiens
tcacttttgctccgaagctac

SEQ ID NO: 3149162 - DNA, 13 bp, Homo sapiens
tcacttttgttct

SEQ ID NO: 3149163 - DNA, 15 bp, Homo sapiens
tcacttttgttctgc

SEQ ID NO: 3149164 - DNA, 17 bp, Homo sapiens
tcacttttgttctgctt

SEQ ID NO: 3149165 - DNA, 17 bp, Homo sapiens
tcactttttgaactaag

SEQ ID NO: 3149166 - DNA, 15 bp, Homo sapiens
tcagaaaagaaaacc

SEQ ID NO: 3149167 - DNA, 20 bp, Homo sapiens
tcagaaaatattatgtgttt

SEQ ID NO: 3149168 - DNA, 23 bp, Homo sapiens
tcagaaaatgttctgtttgctgt

SEQ ID NO: 3149169 - DNA, 22 bp, Homo sapiens
tcagaaaccagttatgtgaatg

SEQ ID NO: 3149170 - DNA, 13 bp, Homo sapiens
tcagaaaggattt

SEQ ID NO: 3149171 - DNA, 15 bp, Homo sapiens
tcagaaaggatttta

SEQ ID NO: 3149172 - DNA, 13 bp, Homo sapiens
tcagaaatataac

SEQ ID NO: 3149173 - DNA, 19 bp, Homo sapiens
tcagaaatataacacattt

SEQ ID NO: 3149174 - DNA, 20 bp, Homo sapiens
tcagaaatataacacatttt

SEQ ID NO: 3149175 - DNA, 16 bp, Homo sapiens
tcagaaattggaacag

SEQ ID NO: 3149176 - DNA, 20 bp, Homo sapiens
tcagaacacacagactttct

SEQ ID NO: 3149177 - DNA, 16 bp, Homo sapiens
tcagaacatgttaaga

SEQ ID NO: 3149178 - DNA, 20 bp, Homo sapiens
tcagaacattcagctctgga

SEQ ID NO: 3149179 - DNA, 12 bp, Homo sapiens
tcagaacccagg

SEQ ID NO: 3149180 - DNA, 13 bp, Homo sapiens
tcagaacccaggg

SEQ ID NO: 3149181 - DNA, 18 bp, Homo sapiens
tcagaacctcttccccag

SEQ ID NO: 3149182 - DNA, 20 bp, Homo sapiens
tcagaacctcttccccagaa

SEQ ID NO: 3149183 - DNA, 13 bp, Homo sapiens
tcagaactgccct

SEQ ID NO: 3149184 - DNA, 19 bp, Homo sapiens
tcagaactgcccttgctgc

SEQ ID NO: 3149185 - DNA, 12 bp, Homo sapiens
tcagaagaaaga

SEQ ID NO: 3149186 - DNA, 17 bp, Homo sapiens
tcagaagagaggggaag

SEQ ID NO: 3149187 - DNA, 19 bp, Homo sapiens
tcagaagaggaaatgactc

SEQ ID NO: 3149188 - DNA, 12 bp, Homo sapiens
tcagaagataac

SEQ ID NO: 3149189 - DNA, 20 bp, Homo sapiens
tcagaagatagtcttggaag

SEQ ID NO: 3149190 - DNA, 23 bp, Homo sapiens
tcagaagcctccaagcctgcctc

SEQ ID NO: 3149191 - DNA, 18 bp, Homo sapiens
tcagaagtcatcttgcta

SEQ ID NO: 3149192 - DNA, 22 bp, Homo sapiens
tcagaagtcatcttgctaccag

SEQ ID NO: 3149193 - DNA, 19 bp, Homo sapiens
tcagaagtttctcagctcc

SEQ ID NO: 3149194 - DNA, 19 bp, Homo sapiens
tcagaataaattgatcctt

SEQ ID NO: 3149195 - DNA, 23 bp, Homo sapiens
tcagaataaattgatcctttgat

SEQ ID NO: 3149196 - DNA, 20 bp, Homo sapiens
tcagaataaggcaggcattg

SEQ ID NO: 3149197 - DNA, 19 bp, Homo sapiens
tcagaatataacatgtaaa

SEQ ID NO: 3149198 - DNA, 21 bp, Homo sapiens
tcagaatatgattcactattt

SEQ ID NO: 3149199 - DNA, 18 bp, Homo sapiens
tcagaatattgtctgcct

SEQ ID NO: 3149200 - DNA, 15 bp, Homo sapiens
tcagaatcagaagat

SEQ ID NO: 3149201 - DNA, 22 bp, Homo sapiens
tcagaatcctttacattcaact

SEQ ID NO: 3149202 - DNA, 22 bp, Homo sapiens
tcagaatctgaatgtaatttgt

SEQ ID NO: 3149203 - DNA, 19 bp, Homo sapiens
tcagaatgctattgaaaat

SEQ ID NO: 3149204 - DNA, 14 bp, Homo sapiens
tcagaatgtaaaag

SEQ ID NO: 3149205 - DNA, 18 bp, Homo sapiens
tcagaatgtaaaagaact

SEQ ID NO: 3149206 - DNA, 18 bp, Homo sapiens
tcagaattaaacttttaa

SEQ ID NO: 3149207 - DNA, 12 bp, Homo sapiens
tcagaattctca

SEQ ID NO: 3149208 - DNA, 19 bp, Homo sapiens
tcagacacctgttcacaga

SEQ ID NO: 3149209 - DNA, 20 bp, Homo sapiens
tcagacacctgttcacagaa

SEQ ID NO: 3149210 - DNA, 22 bp, Homo sapiens
tcagacactgccgacatcagca

SEQ ID NO: 3149211 - DNA, 12 bp, Homo sapiens
tcagacataaag

SEQ ID NO: 3149212 - DNA, 13 bp, Homo sapiens
tcagacataaagc

SEQ ID NO: 3149213 - DNA, 16 bp, Homo sapiens
tcagacataaagccat

SEQ ID NO: 3149214 - DNA, 20 bp, Homo sapiens
tcagacatgttttccgtgaa

SEQ ID NO: 3149215 - DNA, 19 bp, Homo sapiens
tcagaccccagttctaggg

SEQ ID NO: 3149216 - DNA, 16 bp, Homo sapiens
tcagacccctgcctgg

SEQ ID NO: 3149217 - DNA, 18 bp, Homo sapiens
tcagacctagcagggaag

SEQ ID NO: 3149218 - DNA, 18 bp, Homo sapiens
tcagacctgtcttccaag

SEQ ID NO: 3149219 - DNA, 22 bp, Homo sapiens
tcagacctgtcttccaaggaga

SEQ ID NO: 3149220 - DNA, 23 bp, Homo sapiens
tcagacctgtcttccaaggagac

SEQ ID NO: 3149221 - DNA, 21 bp, Homo sapiens
tcagaccttggatcagatgaa

SEQ ID NO: 3149222 - DNA, 15 bp, Homo sapiens
tcagacggcggccag

SEQ ID NO: 3149223 - DNA, 20 bp, Homo sapiens
tcagacggcggccaggcaca

SEQ ID NO: 3149224 - DNA, 21 bp, Homo sapiens
tcagacggcggccaggcacag

SEQ ID NO: 3149225 - DNA, 22 bp, Homo sapiens
tcagacggcggccaggcacagg

SEQ ID NO: 3149226 - DNA, 19 bp, Homo sapiens
tcagactaagaaatattcc

SEQ ID NO: 3149227 - DNA, 21 bp, Homo sapiens
tcagactaagaaatattccaa

SEQ ID NO: 3149228 - DNA, 15 bp, Homo sapiens
tcagactccgccctc

SEQ ID NO: 3149229 - DNA, 16 bp, Homo sapiens
tcagactctcagccca

SEQ ID NO: 3149230 - DNA, 17 bp, Homo sapiens
tcagactctcagcccag

SEQ ID NO: 3149231 - DNA, 18 bp, Homo sapiens
tcagactctcagcccaga

SEQ ID NO: 3149232 - DNA, 16 bp, Homo sapiens
tcagactgctgggact

SEQ ID NO: 3149233 - DNA, 20 bp, Homo sapiens
tcagactggctggctgcagt

SEQ ID NO: 3149234 - DNA, 15 bp, Homo sapiens
tcagacttaccagga

SEQ ID NO: 3149235 - DNA, 15 bp, Homo sapiens
tcagacttttatcaa

SEQ ID NO: 3149236 - DNA, 19 bp, Homo sapiens
tcagacttttatcaaaatc

SEQ ID NO: 3149237 - DNA, 14 bp, Homo sapiens
tcagacttttgtac

SEQ ID NO: 3149238 - DNA, 23 bp, Homo sapiens
tcagagaatttctaccatttcag

SEQ ID NO: 3149239 - DNA, 16 bp, Homo sapiens
tcagagaccttaattt

SEQ ID NO: 3149240 - DNA, 16 bp, Homo sapiens
tcagagaggccttttg

SEQ ID NO: 3149241 - DNA, 21 bp, Homo sapiens
tcagagagtgtacatcatgtt

SEQ ID NO: 3149242 - DNA, 16 bp, Homo sapiens
tcagagataggcctgt

SEQ ID NO: 3149243 - DNA, 21 bp, Homo sapiens
tcagagatgcaccaccaagcc

SEQ ID NO: 3149244 - DNA, 22 bp, Homo sapiens
tcagagatggtaatctacagct

SEQ ID NO: 3149245 - DNA, 17 bp, Homo sapiens
tcagagatttatataaa

SEQ ID NO: 3149246 - DNA, 18 bp, Homo sapiens
tcagagatttatataaat

SEQ ID NO: 3149247 - DNA, 13 bp, Homo sapiens
tcagagcactccc

SEQ ID NO: 3149248 - DNA, 13 bp, Homo sapiens
tcagagcaggacc

SEQ ID NO: 3149249 - DNA, 19 bp, Homo sapiens
tcagagcaggagcatcctc

SEQ ID NO: 3149250 - DNA, 13 bp, Homo sapiens
tcagagccaagtc

SEQ ID NO: 3149251 - DNA, 12 bp, Homo sapiens
tcagagccactc

SEQ ID NO: 3149252 - DNA, 18 bp, Homo sapiens
tcagagccactctatgag

SEQ ID NO: 3149253 - DNA, 18 bp, Homo sapiens
tcagagccagtgaaggag

SEQ ID NO: 3149254 - DNA, 20 bp, Homo sapiens
tcagagcccctacagcattg

SEQ ID NO: 3149255 - DNA, 10 bp, Homo sapiens
tcagagccct

SEQ ID NO: 3149256 - DNA, 11 bp, Homo sapiens
tcagagccctg

SEQ ID NO: 3149257 - DNA, 12 bp, Homo sapiens
tcagagccctgc

SEQ ID NO: 3149258 - DNA, 15 bp, Homo sapiens
tcagagccctggctg

SEQ ID NO: 3149259 - DNA, 15 bp, Homo sapiens
tcagagcctgcagtt

SEQ ID NO: 3149260 - DNA, 16 bp, Homo sapiens
tcagagcgcacaggga

SEQ ID NO: 3149261 - DNA, 23 bp, Homo sapiens
tcagagctaagggtgggtgctca

SEQ ID NO: 3149262 - DNA, 23 bp, Homo sapiens
tcagagctcttcaagctgtcccc

SEQ ID NO: 3149263 - DNA, 16 bp, Homo sapiens
tcagagcttgaagatt

SEQ ID NO: 3149264 - DNA, 15 bp, Homo sapiens
tcagaggcctataat

SEQ ID NO: 3149265 - DNA, 15 bp, Homo sapiens
tcagaggctgggagc

SEQ ID NO: 3149266 - DNA, 16 bp, Homo sapiens
tcagaggctgggagca

SEQ ID NO: 3149267 - DNA, 14 bp, Homo sapiens
tcagaggtgtacac

SEQ ID NO: 3149268 - DNA, 20 bp, Homo sapiens
tcagaggtgtacactaacat

SEQ ID NO: 3149269 - DNA, 13 bp, Homo sapiens
tcagagtagaaat

SEQ ID NO: 3149270 - DNA, 23 bp, Homo sapiens
tcagagtccttgcaaaattgtct

SEQ ID NO: 3149271 - DNA, 19 bp, Homo sapiens
tcagagtctataacagaaa

SEQ ID NO: 3149272 - DNA, 17 bp, Homo sapiens
tcagagtttgtgtgtat

SEQ ID NO: 3149273 - DNA, 18 bp, Homo sapiens
tcagatatatatcatatt

SEQ ID NO: 3149274 - DNA, 18 bp, Homo sapiens
tcagatatatttttcaca

SEQ ID NO: 3149275 - DNA, 22 bp, Homo sapiens
tcagatatcatactgattttta

SEQ ID NO: 3149276 - DNA, 23 bp, Homo sapiens
tcagatattttttcagaaatatg

SEQ ID NO: 3149277 - DNA, 23 bp, Homo sapiens
tcagatcagtgtaccatttgcct

SEQ ID NO: 3149278 - DNA, 13 bp, Homo sapiens
tcagatctgaggt

SEQ ID NO: 3149279 - DNA, 13 bp, Homo sapiens
tcagatgagaaca

SEQ ID NO: 3149280 - DNA, 14 bp, Homo sapiens
tcagatgagaacaa

SEQ ID NO: 3149281 - DNA, 15 bp, Homo sapiens
tcagatgagaacaaa

SEQ ID NO: 3149282 - DNA, 17 bp, Homo sapiens
tcagatgcgtgcccagc

SEQ ID NO: 3149283 - DNA, 15 bp, Homo sapiens
tcagatgctccaaga

SEQ ID NO: 3149284 - DNA, 20 bp, Homo sapiens
tcagatgctccaagattcta

SEQ ID NO: 3149285 - DNA, 22 bp, Homo sapiens
tcagatgctccaagattctaga

SEQ ID NO: 3149286 - DNA, 14 bp, Homo sapiens
tcagatgcttctgg

SEQ ID NO: 3149287 - DNA, 22 bp, Homo sapiens
tcagatgcttgcggcaaaagga

SEQ ID NO: 3149288 - DNA, 20 bp, Homo sapiens
tcagatggaaaattcatttt

SEQ ID NO: 3149289 - DNA, 19 bp, Homo sapiens
tcagatggaaatattttga

SEQ ID NO: 3149290 - DNA, 21 bp, Homo sapiens
tcagatggaggttctcagagc

SEQ ID NO: 3149291 - DNA, 22 bp, Homo sapiens
tcagatgggaggaaagagagca

SEQ ID NO: 3149292 - DNA, 23 bp, Homo sapiens
tcagatgggtctgatattaatca

SEQ ID NO: 3149293 - DNA, 14 bp, Homo sapiens
tcagatgtcttctg

SEQ ID NO: 3149294 - DNA, 19 bp, Homo sapiens
tcagatgtcttctgcctgt

SEQ ID NO: 3149295 - DNA, 22 bp, Homo sapiens
tcagatgtcttctgcctgttat

SEQ ID NO: 3149296 - DNA, 12 bp, Homo sapiens
tcagattaaatt

SEQ ID NO: 3149297 - DNA, 16 bp, Homo sapiens
tcagattaaattacag

SEQ ID NO: 3149298 - DNA, 14 bp, Homo sapiens
tcagattcccagag

SEQ ID NO: 3149299 - DNA, 22 bp, Homo sapiens
tcagattcccagagcaaaataa

SEQ ID NO: 3149300 - DNA, 16 bp, Homo sapiens
tcagattgctgggagg

SEQ ID NO: 3149301 - DNA, 18 bp, Homo sapiens
tcagattgtcttgcaact

SEQ ID NO: 3149302 - DNA, 22 bp, Homo sapiens
tcagatttctagttttttttct

SEQ ID NO: 3149303 - DNA, 23 bp, Homo sapiens
tcagatttctagttttttttcta

SEQ ID NO: 3149304 - DNA, 19 bp, Homo sapiens
tcagattttaaaaagtctt

SEQ ID NO: 3149305 - DNA, 21 bp, Homo sapiens
tcagattttaaaaagtcttca

SEQ ID NO: 3149306 - DNA, 22 bp, Homo sapiens
tcagcaaaaatctcccagtgac

SEQ ID NO: 3149307 - DNA, 13 bp, Homo sapiens
tcagcaaaccatt

SEQ ID NO: 3149308 - DNA, 13 bp, Homo sapiens
tcagcaaagaaaa

SEQ ID NO: 3149309 - DNA, 15 bp, Homo sapiens
tcagcaaagaaaaaa

SEQ ID NO: 3149310 - DNA, 20 bp, Homo sapiens
tcagcaaggggctctgccct

SEQ ID NO: 3149311 - DNA, 19 bp, Homo sapiens
tcagcaatactcatcagag

SEQ ID NO: 3149312 - DNA, 13 bp, Homo sapiens
tcagcaccaccct

SEQ ID NO: 3149313 - DNA, 14 bp, Homo sapiens
tcagcaccacccta

SEQ ID NO: 3149314 - DNA, 15 bp, Homo sapiens
tcagcaccaccctag

SEQ ID NO: 3149315 - DNA, 14 bp, Homo sapiens
tcagcacccccacc

SEQ ID NO: 3149316 - DNA, 17 bp, Homo sapiens
tcagcacccccacccac

SEQ ID NO: 3149317 - DNA, 13 bp, Homo sapiens
tcagcaccccttc

SEQ ID NO: 3149318 - DNA, 17 bp, Homo sapiens
tcagcaccccttccatg

SEQ ID NO: 3149319 - DNA, 13 bp, Homo sapiens
tcagcaccctggg

SEQ ID NO: 3149320 - DNA, 17 bp, Homo sapiens
tcagcaccctgggtgcc

SEQ ID NO: 3149321 - DNA, 13 bp, Homo sapiens
tcagcactgaaaa

SEQ ID NO: 3149322 - DNA, 14 bp, Homo sapiens
tcagcactgaaaat

SEQ ID NO: 3149323 - DNA, 12 bp, Homo sapiens
tcagcactgtcc

SEQ ID NO: 3149324 - DNA, 23 bp, Homo sapiens
tcagcactttgggaggctgaggc

SEQ ID NO: 3149325 - DNA, 15 bp, Homo sapiens
tcagcagtcaataca

SEQ ID NO: 3149326 - DNA, 15 bp, Homo sapiens
tcagcagttgacatc

SEQ ID NO: 3149327 - DNA, 20 bp, Homo sapiens
tcagcagttgacatccaaat

SEQ ID NO: 3149328 - DNA, 16 bp, Homo sapiens
tcagcatcctggcacc

SEQ ID NO: 3149329 - DNA, 16 bp, Homo sapiens
tcagcatgcttcccag

SEQ ID NO: 3149330 - DNA, 16 bp, Homo sapiens
tcagcatgtctattca

SEQ ID NO: 3149331 - DNA, 18 bp, Homo sapiens
tcagcattaggcttttaa

SEQ ID NO: 3149332 - DNA, 18 bp, Homo sapiens
tcagcattattcttcaga

SEQ ID NO: 3149333 - DNA, 17 bp, Homo sapiens
tcagcattctcactcct

SEQ ID NO: 3149334 - DNA, 23 bp, Homo sapiens
tcagcattgtctcgtgtacagct

SEQ ID NO: 3149335 - DNA, 14 bp, Homo sapiens
tcagccaaatgtaa

SEQ ID NO: 3149336 - DNA, 22 bp, Homo sapiens
tcagccaaatgtaattgaataa

SEQ ID NO: 3149337 - DNA, 23 bp, Homo sapiens
tcagccaagacaaggaggtagag

SEQ ID NO: 3149338 - DNA, 16 bp, Homo sapiens
tcagccacgaccagcc

SEQ ID NO: 3149339 - DNA, 20 bp, Homo sapiens
tcagccacgaccagcccctt

SEQ ID NO: 3149340 - DNA, 22 bp, Homo sapiens
tcagccacgaccagccccttcc

SEQ ID NO: 3149341 - DNA, 17 bp, Homo sapiens
tcagccagccgccctgg

SEQ ID NO: 3149342 - DNA, 18 bp, Homo sapiens
tcagccaggagctgtcac

SEQ ID NO: 3149343 - DNA, 20 bp, Homo sapiens
tcagccagtgaatctgtttc

SEQ ID NO: 3149344 - DNA, 16 bp, Homo sapiens
tcagccatcgtcctgg

SEQ ID NO: 3149345 - DNA, 16 bp, Homo sapiens
tcagccatttccccct

SEQ ID NO: 3149346 - DNA, 18 bp, Homo sapiens
tcagccatttccccctcc

SEQ ID NO: 3149347 - DNA, 21 bp, Homo sapiens
tcagccatttccccctcctca

SEQ ID NO: 3149348 - DNA, 23 bp, Homo sapiens
tcagccatttccccctcctcaga

SEQ ID NO: 3149349 - DNA, 22 bp, Homo sapiens
tcagcccacctgcacccaggtg

SEQ ID NO: 3149350 - DNA, 13 bp, Homo sapiens
tcagcccagaaga

SEQ ID NO: 3149351 - DNA, 16 bp, Homo sapiens
tcagcccagaagaaaa

SEQ ID NO: 3149352 - DNA, 15 bp, Homo sapiens
tcagcccccaggcca

SEQ ID NO: 3149353 - DNA, 16 bp, Homo sapiens
tcagccccgagctgtc

SEQ ID NO: 3149354 - DNA, 13 bp, Homo sapiens
tcagcccctagga

SEQ ID NO: 3149355 - DNA, 22 bp, Homo sapiens
tcagcccctaggagtatatttc

SEQ ID NO: 3149356 - DNA, 18 bp, Homo sapiens
tcagccccttctcccctc

SEQ ID NO: 3149357 - DNA, 13 bp, Homo sapiens
tcagccctccctg

SEQ ID NO: 3149358 - DNA, 13 bp, Homo sapiens
tcagcccttgccc

SEQ ID NO: 3149359 - DNA, 19 bp, Homo sapiens
tcagccgagccgggcctgg

SEQ ID NO: 3149360 - DNA, 19 bp, Homo sapiens
tcagcctcagaggagctct

SEQ ID NO: 3149361 - DNA, 13 bp, Homo sapiens
tcagcctcccaaa

SEQ ID NO: 3149362 - DNA, 20 bp, Homo sapiens
tcagcctccctagtagctgg

SEQ ID NO: 3149363 - DNA, 20 bp, Homo sapiens
tcagcctccggagtagctgg

SEQ ID NO: 3149364 - DNA, 21 bp, Homo sapiens
tcagcctcttaaagctgcctg

SEQ ID NO: 3149365 - DNA, 19 bp, Homo sapiens
tcagcctgagtctcctgtg

SEQ ID NO: 3149366 - DNA, 21 bp, Homo sapiens
tcagcctgctgcccaggctgt

SEQ ID NO: 3149367 - DNA, 14 bp, Homo sapiens
tcagcctgtaccgg

SEQ ID NO: 3149368 - DNA, 18 bp, Homo sapiens
tcagccttacatttgtga

SEQ ID NO: 3149369 - DNA, 21 bp, Homo sapiens
tcagccttccccctcccaggg

SEQ ID NO: 3149370 - DNA, 22 bp, Homo sapiens
tcagccttccccctcccagggc

SEQ ID NO: 3149371 - DNA, 23 bp, Homo sapiens
tcagcgactccgttggccactcc

SEQ ID NO: 3149372 - DNA, 19 bp, Homo sapiens
tcagcggcgaccgccctcc

SEQ ID NO: 3149373 - DNA, 17 bp, Homo sapiens
tcagcgggcccaggcct

SEQ ID NO: 3149374 - DNA, 14 bp, Homo sapiens
tcagcgttgcatgt

SEQ ID NO: 3149375 - DNA, 15 bp, Homo sapiens
tcagctactttccat

SEQ ID NO: 3149376 - DNA, 20 bp, Homo sapiens
tcagctactttccatttggt

SEQ ID NO: 3149377 - DNA, 19 bp, Homo sapiens
tcagctatttactgccaaa

SEQ ID NO: 3149378 - DNA, 19 bp, Homo sapiens
tcagctcaggcagctcgag

SEQ ID NO: 3149379 - DNA, 23 bp, Homo sapiens
tcagctccagacgtaggggaggg

SEQ ID NO: 3149380 - DNA, 22 bp, Homo sapiens
tcagctccagctcaccagcccc

SEQ ID NO: 3149381 - DNA, 24 bp, Homo sapiens
tcagctccagctcaccagccccag

SEQ ID NO: 3149382 - DNA, 19 bp, Homo sapiens
tcagctccaggtggctctg

SEQ ID NO: 3149383 - DNA, 15 bp, Homo sapiens
tcagctccccctgtc

SEQ ID NO: 3149384 - DNA, 20 bp, Homo sapiens
tcagctccccctgtcccctc

SEQ ID NO: 3149385 - DNA, 21 bp, Homo sapiens
tcagctcctggggaccccact

SEQ ID NO: 3149386 - DNA, 14 bp, Homo sapiens
tcagctccttttcc

SEQ ID NO: 3149387 - DNA, 13 bp, Homo sapiens
tcagctctcctgg

SEQ ID NO: 3149388 - DNA, 15 bp, Homo sapiens
tcagctctcctggct

SEQ ID NO: 3149389 - DNA, 22 bp, Homo sapiens
tcagctctctgggacctcctta

SEQ ID NO: 3149390 - DNA, 14 bp, Homo sapiens
tcagctctctgtat

SEQ ID NO: 3149391 - DNA, 20 bp, Homo sapiens
tcagctctctgtataaacat

SEQ ID NO: 3149392 - DNA, 14 bp, Homo sapiens
tcagctctggagaa

SEQ ID NO: 3149393 - DNA, 12 bp, Homo sapiens
tcagctctggga

SEQ ID NO: 3149394 - DNA, 16 bp, Homo sapiens
tcagctctgggagagg

SEQ ID NO: 3149395 - DNA, 21 bp, Homo sapiens
tcagctcttgtcaaaaggtct

SEQ ID NO: 3149396 - DNA, 13 bp, Homo sapiens
tcagctctttttg

SEQ ID NO: 3149397 - DNA, 13 bp, Homo sapiens
tcagctgagccct

SEQ ID NO: 3149398 - DNA, 16 bp, Homo sapiens
tcagctgagccctggg

SEQ ID NO: 3149399 - DNA, 23 bp, Homo sapiens
tcagctgagccctggggactgtt

SEQ ID NO: 3149400 - DNA, 21 bp, Homo sapiens
tcagctgcaaggtactctggt

SEQ ID NO: 3149401 - DNA, 12 bp, Homo sapiens
tcagctgcctca

SEQ ID NO: 3149402 - DNA, 14 bp, Homo sapiens
tcagctgcctcact

SEQ ID NO: 3149403 - DNA, 15 bp, Homo sapiens
tcagctgcctgaaac

SEQ ID NO: 3149404 - DNA, 23 bp, Homo sapiens
tcagctgcctgaaacagccatgt

SEQ ID NO: 3149405 - DNA, 22 bp, Homo sapiens
tcagctgctcagcaacctttca

SEQ ID NO: 3149406 - DNA, 15 bp, Homo sapiens
tcagctggctgtatg

SEQ ID NO: 3149407 - DNA, 19 bp, Homo sapiens
tcagctgtcctccctccac

SEQ ID NO: 3149408 - DNA, 15 bp, Homo sapiens
tcagctgtcctgcag

SEQ ID NO: 3149409 - DNA, 19 bp, Homo sapiens
tcagctgtcctgcagcaaa

SEQ ID NO: 3149410 - DNA, 17 bp, Homo sapiens
tcagctgttactttctt

SEQ ID NO: 3149411 - DNA, 15 bp, Homo sapiens
tcagctgtttgtcat

SEQ ID NO: 3149412 - DNA, 21 bp, Homo sapiens
tcagcttaaaataaacagttg

SEQ ID NO: 3149413 - DNA, 13 bp, Homo sapiens
tcagcttatctct

SEQ ID NO: 3149414 - DNA, 16 bp, Homo sapiens
tcagcttatgggatcc

SEQ ID NO: 3149415 - DNA, 23 bp, Homo sapiens
tcagcttcagaatggcattgtac

SEQ ID NO: 3149416 - DNA, 14 bp, Homo sapiens
tcagcttcccagcc

SEQ ID NO: 3149417 - DNA, 19 bp, Homo sapiens
tcagcttcgtttattttca

SEQ ID NO: 3149418 - DNA, 16 bp, Homo sapiens
tcagcttcttcctagg

SEQ ID NO: 3149419 - DNA, 18 bp, Homo sapiens
tcagctttcagagccagt

SEQ ID NO: 3149420 - DNA, 23 bp, Homo sapiens
tcagctttttgatcctctactgt

SEQ ID NO: 3149421 - DNA, 15 bp, Homo sapiens
tcaggaaaaggttga

SEQ ID NO: 3149422 - DNA, 19 bp, Homo sapiens
tcaggaaaaggttgaataa

SEQ ID NO: 3149423 - DNA, 23 bp, Homo sapiens
tcaggaaagagattagaacattt

SEQ ID NO: 3149424 - DNA, 19 bp, Homo sapiens
tcaggaaatatatatgtgt

SEQ ID NO: 3149425 - DNA, 16 bp, Homo sapiens
tcaggaagaagagatg

SEQ ID NO: 3149426 - DNA, 18 bp, Homo sapiens
tcaggaagaagagatgca

SEQ ID NO: 3149427 - DNA, 15 bp, Homo sapiens
tcaggaatataaata

SEQ ID NO: 3149428 - DNA, 15 bp, Homo sapiens
tcaggaattcagtgc

SEQ ID NO: 3149429 - DNA, 20 bp, Homo sapiens
tcaggaatttaaaattaagt

SEQ ID NO: 3149430 - DNA, 13 bp, Homo sapiens
tcaggacccaggc

SEQ ID NO: 3149431 - DNA, 23 bp, Homo sapiens
tcaggacccaggccctccatggg

SEQ ID NO: 3149432 - DNA, 14 bp, Homo sapiens
tcaggaccttttga

SEQ ID NO: 3149433 - DNA, 14 bp, Homo sapiens
tcaggaggcgccct

SEQ ID NO: 3149434 - DNA, 21 bp, Homo sapiens
tcaggaggctggaggaagggg

SEQ ID NO: 3149435 - DNA, 12 bp, Homo sapiens
tcaggagttcct

SEQ ID NO: 3149436 - DNA, 20 bp, Homo sapiens
tcaggagttcgagaccagcc

SEQ ID NO: 3149437 - DNA, 14 bp, Homo sapiens
tcaggatacatgtg

SEQ ID NO: 3149438 - DNA, 18 bp, Homo sapiens
tcaggatactctgtcaga

SEQ ID NO: 3149439 - DNA, 20 bp, Homo sapiens
tcaggatactctgtcagatg

SEQ ID NO: 3149440 - DNA, 20 bp, Homo sapiens
tcaggatgatacactatgaa

SEQ ID NO: 3149441 - DNA, 13 bp, Homo sapiens
tcaggatgcacat

SEQ ID NO: 3149442 - DNA, 19 bp, Homo sapiens
tcaggatgcacatttctgg

SEQ ID NO: 3149443 - DNA, 20 bp, Homo sapiens
tcaggcaagcccctcagccc

SEQ ID NO: 3149444 - DNA, 21 bp, Homo sapiens
tcaggcaagcccctcagccct

SEQ ID NO: 3149445 - DNA, 23 bp, Homo sapiens
tcaggcacccggggccagagaca

SEQ ID NO: 3149446 - DNA, 14 bp, Homo sapiens
tcaggcactggtgg

SEQ ID NO: 3149447 - DNA, 15 bp, Homo sapiens
tcaggcactggtggc

SEQ ID NO: 3149448 - DNA, 17 bp, Homo sapiens
tcaggcactggtggcat

SEQ ID NO: 3149449 - DNA, 13 bp, Homo sapiens
tcaggcagctcaa

SEQ ID NO: 3149450 - DNA, 23 bp, Homo sapiens
tcaggcaggcacctagcaattcc

SEQ ID NO: 3149451 - DNA, 20 bp, Homo sapiens
tcaggcataggcctgggtgc

SEQ ID NO: 3149452 - DNA, 22 bp, Homo sapiens
tcaggcataggcctgggtgctg

SEQ ID NO: 3149453 - DNA, 14 bp, Homo sapiens
tcaggccagcccag

SEQ ID NO: 3149454 - DNA, 15 bp, Homo sapiens
tcaggccagcccagc

SEQ ID NO: 3149455 - DNA, 17 bp, Homo sapiens
tcaggccagcccagcca

SEQ ID NO: 3149456 - DNA, 18 bp, Homo sapiens
tcaggccagcccagccag

SEQ ID NO: 3149457 - DNA, 17 bp, Homo sapiens
tcaggccaggtgcagtg

SEQ ID NO: 3149458 - DNA, 21 bp, Homo sapiens
tcaggcccggcagggcgggca

SEQ ID NO: 3149459 - DNA, 22 bp, Homo sapiens
tcaggccgagccaggttcacac

SEQ ID NO: 3149460 - DNA, 14 bp, Homo sapiens
tcaggcctaggagg

SEQ ID NO: 3149461 - DNA, 16 bp, Homo sapiens
tcaggcctaggaggcc

SEQ ID NO: 3149462 - DNA, 19 bp, Homo sapiens
tcaggcctctgagcccaag

SEQ ID NO: 3149463 - DNA, 21 bp, Homo sapiens
tcaggcgatccacctgtctca

SEQ ID NO: 3149464 - DNA, 24 bp, Homo sapiens
tcaggctgctggggcctcagacga

SEQ ID NO: 3149465 - DNA, 15 bp, Homo sapiens
tcaggctgcttggga

SEQ ID NO: 3149466 - DNA, 16 bp, Homo sapiens
tcaggctgggcagccc

SEQ ID NO: 3149467 - DNA, 16 bp, Homo sapiens
tcaggctggtgggagg

SEQ ID NO: 3149468 - DNA, 14 bp, Homo sapiens
tcaggcttccttgg

SEQ ID NO: 3149469 - DNA, 18 bp, Homo sapiens
tcaggcttgaaatgcatt

SEQ ID NO: 3149470 - DNA, 19 bp, Homo sapiens
tcagggaaactaagattct

SEQ ID NO: 3149471 - DNA, 22 bp, Homo sapiens
tcagggaatccagctccctaga

SEQ ID NO: 3149472 - DNA, 22 bp, Homo sapiens
tcagggaatttcaggaactaga

SEQ ID NO: 3149473 - DNA, 14 bp, Homo sapiens
tcagggacagagcc

SEQ ID NO: 3149474 - DNA, 18 bp, Homo sapiens
tcagggaccagctttact

SEQ ID NO: 3149475 - DNA, 16 bp, Homo sapiens
tcagggacttggacag

SEQ ID NO: 3149476 - DNA, 21 bp, Homo sapiens
tcagggagaaactccaaagtc

SEQ ID NO: 3149477 - DNA, 19 bp, Homo sapiens
tcagggagtgctggctcac

SEQ ID NO: 3149478 - DNA, 18 bp, Homo sapiens
tcagggcacgcaggacca

SEQ ID NO: 3149479 - DNA, 16 bp, Homo sapiens
tcagggccagactgga

SEQ ID NO: 3149480 - DNA, 15 bp, Homo sapiens
tcagggccaggaagg

SEQ ID NO: 3149481 - DNA, 20 bp, Homo sapiens
tcagggccagtcctcctggg

SEQ ID NO: 3149482 - DNA, 17 bp, Homo sapiens
tcagggccatgctgagg

SEQ ID NO: 3149483 - DNA, 21 bp, Homo sapiens
tcagggccatgctgaggcctg

SEQ ID NO: 3149484 - DNA, 23 bp, Homo sapiens
tcagggccatgctgaggcctggg

SEQ ID NO: 3149485 - DNA, 14 bp, Homo sapiens
tcagggcccagagg

SEQ ID NO: 3149486 - DNA, 18 bp, Homo sapiens
tcagggcccagaggctga

SEQ ID NO: 3149487 - DNA, 13 bp, Homo sapiens
tcagggcctggca

SEQ ID NO: 3149488 - DNA, 18 bp, Homo sapiens
tcagggcctggcaggcca

SEQ ID NO: 3149489 - DNA, 19 bp, Homo sapiens
tcagggcctggcaggccag

SEQ ID NO: 3149490 - DNA, 21 bp, Homo sapiens
tcagggcctggcaggccagtg

SEQ ID NO: 3149491 - DNA, 23 bp, Homo sapiens
tcagggcctggggcctgagagaa

SEQ ID NO: 3149492 - DNA, 14 bp, Homo sapiens
tcagggcgctcaga

SEQ ID NO: 3149493 - DNA, 18 bp, Homo sapiens
tcagggcgctcagacggc

SEQ ID NO: 3149494 - DNA, 16 bp, Homo sapiens
tcagggctcccagggg

SEQ ID NO: 3149495 - DNA, 17 bp, Homo sapiens
tcagggctcctcccagc

SEQ ID NO: 3149496 - DNA, 14 bp, Homo sapiens
tcagggctcctgcc

SEQ ID NO: 3149497 - DNA, 23 bp, Homo sapiens
tcagggctcctgccttctgtcct

SEQ ID NO: 3149498 - DNA, 17 bp, Homo sapiens
tcaggggaaaactgtta

SEQ ID NO: 3149499 - DNA, 15 bp, Homo sapiens
tcaggggatgggtgt

SEQ ID NO: 3149500 - DNA, 15 bp, Homo sapiens
tcaggggccagagga

SEQ ID NO: 3149501 - DNA, 17 bp, Homo sapiens
tcaggggctgacacttc

SEQ ID NO: 3149502 - DNA, 14 bp, Homo sapiens
tcaggggctgtttg

SEQ ID NO: 3149503 - DNA, 13 bp, Homo sapiens
tcaggggggagaa

SEQ ID NO: 3149504 - DNA, 23 bp, Homo sapiens
tcaggggtcgtcaccacctctcc

SEQ ID NO: 3149505 - DNA, 15 bp, Homo sapiens
tcagggtgggaagaa

SEQ ID NO: 3149506 - DNA, 19 bp, Homo sapiens
tcagggtgggaagaaagaa

SEQ ID NO: 3149507 - DNA, 18 bp, Homo sapiens
tcagggttcatctgtcca

SEQ ID NO: 3149508 - DNA, 16 bp, Homo sapiens
tcagggttggcccctg

SEQ ID NO: 3149509 - DNA, 17 bp, Homo sapiens
tcagggttggcccctgc

SEQ ID NO: 3149510 - DNA, 18 bp, Homo sapiens
tcagggttggcccctgcc

SEQ ID NO: 3149511 - DNA, 18 bp, Homo sapiens
tcagggttggtgtgctga

SEQ ID NO: 3149512 - DNA, 13 bp, Homo sapiens
tcaggtaacaggc

SEQ ID NO: 3149513 - DNA, 16 bp, Homo sapiens
tcaggtaacaggcaga

SEQ ID NO: 3149514 - DNA, 22 bp, Homo sapiens
tcaggtaacaggcagatacagg

SEQ ID NO: 3149515 - DNA, 17 bp, Homo sapiens
tcaggtaggcccttgtc

SEQ ID NO: 3149516 - DNA, 21 bp, Homo sapiens
tcaggtatgttgcctttatgg

SEQ ID NO: 3149517 - DNA, 18 bp, Homo sapiens
tcaggtcacataaaactt

SEQ ID NO: 3149518 - DNA, 23 bp, Homo sapiens
tcaggtcacataaaactttgtat

SEQ ID NO: 3149519 - DNA, 15 bp, Homo sapiens
tcaggtcagggactt

SEQ ID NO: 3149520 - DNA, 14 bp, Homo sapiens
tcaggtgaaaatgt

SEQ ID NO: 3149521 - DNA, 14 bp, Homo sapiens
tcaggtgaacactt

SEQ ID NO: 3149522 - DNA, 15 bp, Homo sapiens
tcaggtgacatgtga

SEQ ID NO: 3149523 - DNA, 16 bp, Homo sapiens
tcaggtgatccaccca

SEQ ID NO: 3149524 - DNA, 23 bp, Homo sapiens
tcaggtgatccacccacctcagc

SEQ ID NO: 3149525 - DNA, 14 bp, Homo sapiens
tcaggtgctgccat

SEQ ID NO: 3149526 - DNA, 18 bp, Homo sapiens
tcaggtgctgccatccag

SEQ ID NO: 3149527 - DNA, 15 bp, Homo sapiens
tcaggtggggcagct

SEQ ID NO: 3149528 - DNA, 18 bp, Homo sapiens
tcaggtggggcagcttga

SEQ ID NO: 3149529 - DNA, 22 bp, Homo sapiens
tcaggtgtccctgcacttgcag

SEQ ID NO: 3149530 - DNA, 14 bp, Homo sapiens
tcaggttccatccc

SEQ ID NO: 3149531 - DNA, 21 bp, Homo sapiens
tcaggttgctggttgctgtgt

SEQ ID NO: 3149532 - DNA, 22 bp, Homo sapiens
tcaggttgctggttgctgtgtg

SEQ ID NO: 3149533 - DNA, 23 bp, Homo sapiens
tcaggttgctggttgctgtgtgg

SEQ ID NO: 3149534 - DNA, 22 bp, Homo sapiens
tcaggttgtctgaagtcactgc

SEQ ID NO: 3149535 - DNA, 17 bp, Homo sapiens
tcaggtttaacatttgc

SEQ ID NO: 3149536 - DNA, 16 bp, Homo sapiens
tcaggtttgagaaaaa

SEQ ID NO: 3149537 - DNA, 14 bp, Homo sapiens
tcaggtttgttttg

SEQ ID NO: 3149538 - DNA, 14 bp, Homo sapiens
tcagtaaataatga

SEQ ID NO: 3149539 - DNA, 18 bp, Homo sapiens
tcagtaacatttctgttc

SEQ ID NO: 3149540 - DNA, 23 bp, Homo sapiens
tcagtaacccccttaaatttaat

SEQ ID NO: 3149541 - DNA, 15 bp, Homo sapiens
tcagtaataaaacat

SEQ ID NO: 3149542 - DNA, 13 bp, Homo sapiens
tcagtaataactc

SEQ ID NO: 3149543 - DNA, 14 bp, Homo sapiens
tcagtaatatttat

SEQ ID NO: 3149544 - DNA, 17 bp, Homo sapiens
tcagtaatcacttttca

SEQ ID NO: 3149545 - DNA, 22 bp, Homo sapiens
tcagtacacttggtgtactggg

SEQ ID NO: 3149546 - DNA, 19 bp, Homo sapiens
tcagtaccctctcagctcc

SEQ ID NO: 3149547 - DNA, 15 bp, Homo sapiens
tcagtactgactttc

SEQ ID NO: 3149548 - DNA, 20 bp, Homo sapiens
tcagtacttgtgaaacacag

SEQ ID NO: 3149549 - DNA, 24 bp, Homo sapiens
tcagtacttgtgaaacacagctgt

SEQ ID NO: 3149550 - DNA, 17 bp, Homo sapiens
tcagtaggtccaagggc

SEQ ID NO: 3149551 - DNA, 14 bp, Homo sapiens
tcagtatactgtgt

SEQ ID NO: 3149552 - DNA, 15 bp, Homo sapiens
tcagtatactgtgtg

SEQ ID NO: 3149553 - DNA, 17 bp, Homo sapiens
tcagtatccaggctttg

SEQ ID NO: 3149554 - DNA, 18 bp, Homo sapiens
tcagtatctgtatctctc

SEQ ID NO: 3149555 - DNA, 23 bp, Homo sapiens
tcagtatgctgcccctgtcttgc

SEQ ID NO: 3149556 - DNA, 15 bp, Homo sapiens
tcagtatgtattctt

SEQ ID NO: 3149557 - DNA, 22 bp, Homo sapiens
tcagtattaaaggggggagggg

SEQ ID NO: 3149558 - DNA, 16 bp, Homo sapiens
tcagtattaatactaa

SEQ ID NO: 3149559 - DNA, 21 bp, Homo sapiens
tcagtattaatactaaaatat

SEQ ID NO: 3149560 - DNA, 23 bp, Homo sapiens
tcagtattaatactaaaatatgt

SEQ ID NO: 3149561 - DNA, 18 bp, Homo sapiens
tcagtatttaatgaaacc

SEQ ID NO: 3149562 - DNA, 13 bp, Homo sapiens
tcagtatttcaac

SEQ ID NO: 3149563 - DNA, 15 bp, Homo sapiens
tcagtatttcaactg

SEQ ID NO: 3149564 - DNA, 14 bp, Homo sapiens
tcagtatttcagtg

SEQ ID NO: 3149565 - DNA, 22 bp, Homo sapiens
tcagtattttggagaaattatt

SEQ ID NO: 3149566 - DNA, 19 bp, Homo sapiens
tcagtatttttttttaatt

SEQ ID NO: 3149567 - DNA, 13 bp, Homo sapiens
tcagtcaaaactt

SEQ ID NO: 3149568 - DNA, 15 bp, Homo sapiens
tcagtcagttcccgg

SEQ ID NO: 3149569 - DNA, 14 bp, Homo sapiens
tcagtcatgcataa

SEQ ID NO: 3149570 - DNA, 18 bp, Homo sapiens
tcagtccccgtgaaggag

SEQ ID NO: 3149571 - DNA, 12 bp, Homo sapiens
tcagtcccctcc

SEQ ID NO: 3149572 - DNA, 18 bp, Homo sapiens
tcagtcccctcccatctg

SEQ ID NO: 3149573 - DNA, 16 bp, Homo sapiens
tcagtccctatgtatt

SEQ ID NO: 3149574 - DNA, 18 bp, Homo sapiens
tcagtcctcccctcacag

SEQ ID NO: 3149575 - DNA, 21 bp, Homo sapiens
tcagtcctcccctcacagcct

SEQ ID NO: 3149576 - DNA, 23 bp, Homo sapiens
tcagtcctcccctcacagcctct

SEQ ID NO: 3149577 - DNA, 14 bp, Homo sapiens
tcagtctaaggtct

SEQ ID NO: 3149578 - DNA, 17 bp, Homo sapiens
tcagtctaaggtctcat

SEQ ID NO: 3149579 - DNA, 16 bp, Homo sapiens
tcagtctatccacaga

SEQ ID NO: 3149580 - DNA, 14 bp, Homo sapiens
tcagtctcaggagc

SEQ ID NO: 3149581 - DNA, 23 bp, Homo sapiens
tcagtctccctttcccttcttgg

SEQ ID NO: 3149582 - DNA, 20 bp, Homo sapiens
tcagtctctcttctctccag

SEQ ID NO: 3149583 - DNA, 21 bp, Homo sapiens
tcagtctgattcccaagctct

SEQ ID NO: 3149584 - DNA, 12 bp, Homo sapiens
tcagtcttgtag

SEQ ID NO: 3149585 - DNA, 23 bp, Homo sapiens
tcagtgacatcaaagcctggcct

SEQ ID NO: 3149586 - DNA, 17 bp, Homo sapiens
tcagtgactcctgctgg

SEQ ID NO: 3149587 - DNA, 18 bp, Homo sapiens
tcagtgactcctgctggt

SEQ ID NO: 3149588 - DNA, 17 bp, Homo sapiens
tcagtgactgaaaccat

SEQ ID NO: 3149589 - DNA, 22 bp, Homo sapiens
tcagtgcaaattgtatcttatt

SEQ ID NO: 3149590 - DNA, 17 bp, Homo sapiens
tcagtgcagcagaggac

SEQ ID NO: 3149591 - DNA, 12 bp, Homo sapiens
tcagtgccacta

SEQ ID NO: 3149592 - DNA, 14 bp, Homo sapiens
tcagtgctgtggcc

SEQ ID NO: 3149593 - DNA, 17 bp, Homo sapiens
tcagtgctgtggcctgg

SEQ ID NO: 3149594 - DNA, 22 bp, Homo sapiens
tcagtgctgtggcctgggcaag

SEQ ID NO: 3149595 - DNA, 16 bp, Homo sapiens
tcagtgcttgggctcc

SEQ ID NO: 3149596 - DNA, 19 bp, Homo sapiens
tcagtggaaaccctgagag

SEQ ID NO: 3149597 - DNA, 15 bp, Homo sapiens
tcagtggcagctgct

SEQ ID NO: 3149598 - DNA, 17 bp, Homo sapiens
tcagtgggcaggataaa

SEQ ID NO: 3149599 - DNA, 14 bp, Homo sapiens
tcagtgtagttaat

SEQ ID NO: 3149600 - DNA, 21 bp, Homo sapiens
tcagtgtcccaccttgaccaa

SEQ ID NO: 3149601 - DNA, 21 bp, Homo sapiens
tcagtgtcccaggcagcacag

SEQ ID NO: 3149602 - DNA, 21 bp, Homo sapiens
tcagtgtctcacactggcgta

SEQ ID NO: 3149603 - DNA, 14 bp, Homo sapiens
tcagtgtctggctt

SEQ ID NO: 3149604 - DNA, 12 bp, Homo sapiens
tcagtgtgatgg

SEQ ID NO: 3149605 - DNA, 14 bp, Homo sapiens
tcagtgtgcccttc

SEQ ID NO: 3149606 - DNA, 13 bp, Homo sapiens
tcagtgtggagag

SEQ ID NO: 3149607 - DNA, 13 bp, Homo sapiens
tcagtgttaaaaa

SEQ ID NO: 3149608 - DNA, 16 bp, Homo sapiens
tcagtgttagagaaat

SEQ ID NO: 3149609 - DNA, 22 bp, Homo sapiens
tcagtgtttgggtcacccctcc

SEQ ID NO: 3149610 - DNA, 15 bp, Homo sapiens
tcagtgttttggact

SEQ ID NO: 3149611 - DNA, 16 bp, Homo sapiens
tcagtgttttggactc

SEQ ID NO: 3149612 - DNA, 14 bp, Homo sapiens
tcagttactggtat

SEQ ID NO: 3149613 - DNA, 17 bp, Homo sapiens
tcagttatattttgctg

SEQ ID NO: 3149614 - DNA, 16 bp, Homo sapiens
tcagttattcattctg

SEQ ID NO: 3149615 - DNA, 22 bp, Homo sapiens
tcagttcaacctggtggcacca

SEQ ID NO: 3149616 - DNA, 15 bp, Homo sapiens
tcagttcccggagca

SEQ ID NO: 3149617 - DNA, 19 bp, Homo sapiens
tcagttcccttggcctcag

SEQ ID NO: 3149618 - DNA, 20 bp, Homo sapiens
tcagttcctttgtgtgtact

SEQ ID NO: 3149619 - DNA, 19 bp, Homo sapiens
tcagttctacggatcatca

SEQ ID NO: 3149620 - DNA, 21 bp, Homo sapiens
tcagttcttggtgctctgtgt

SEQ ID NO: 3149621 - DNA, 23 bp, Homo sapiens
tcagttgagcttcatataccagc

SEQ ID NO: 3149622 - DNA, 20 bp, Homo sapiens
tcagttgctcaaaaagaaat

SEQ ID NO: 3149623 - DNA, 18 bp, Homo sapiens
tcagttgtgttttttaag

SEQ ID NO: 3149624 - DNA, 15 bp, Homo sapiens
tcagttgttcttttt

SEQ ID NO: 3149625 - DNA, 14 bp, Homo sapiens
tcagtttcatgaaa

SEQ ID NO: 3149626 - DNA, 15 bp, Homo sapiens
tcagtttgtgtgtct

SEQ ID NO: 3149627 - DNA, 17 bp, Homo sapiens
tcagttttatcattttc

SEQ ID NO: 3149628 - DNA, 14 bp, Homo sapiens
tcagttttatcttt

SEQ ID NO: 3149629 - DNA, 18 bp, Homo sapiens
tcagttttgtataactta

SEQ ID NO: 3149630 - DNA, 14 bp, Homo sapiens
tcagtttttcattt

SEQ ID NO: 3149631 - DNA, 15 bp, Homo sapiens
tcagtttttcatttg

SEQ ID NO: 3149632 - DNA, 13 bp, Homo sapiens
tcagtttttgtat

SEQ ID NO: 3149633 - DNA, 17 bp, Homo sapiens
tcagttttttgttttac

SEQ ID NO: 3149634 - DNA, 20 bp, Homo sapiens
tcataaaaagcaaaacaaaa

SEQ ID NO: 3149635 - DNA, 16 bp, Homo sapiens
tcataaaataaagtat

SEQ ID NO: 3149636 - DNA, 15 bp, Homo sapiens
tcataaagtacttga

SEQ ID NO: 3149637 - DNA, 11 bp, Homo sapiens
tcataaagtca

SEQ ID NO: 3149638 - DNA, 14 bp, Homo sapiens
tcataaggcttcaa

SEQ ID NO: 3149639 - DNA, 19 bp, Homo sapiens
tcataataaatatctgtac

SEQ ID NO: 3149640 - DNA, 21 bp, Homo sapiens
tcataataggtagtttggata

SEQ ID NO: 3149641 - DNA, 13 bp, Homo sapiens
tcataatccttct

SEQ ID NO: 3149642 - DNA, 21 bp, Homo sapiens
tcataatgaattataacagtt

SEQ ID NO: 3149643 - DNA, 13 bp, Homo sapiens
tcataattacatt

SEQ ID NO: 3149644 - DNA, 14 bp, Homo sapiens
tcataattacattc

SEQ ID NO: 3149645 - DNA, 15 bp, Homo sapiens
tcataattacattcc

SEQ ID NO: 3149646 - DNA, 16 bp, Homo sapiens
tcataattacattcct

SEQ ID NO: 3149647 - DNA, 13 bp, Homo sapiens
tcataattggaat

SEQ ID NO: 3149648 - DNA, 14 bp, Homo sapiens
tcatacaaaataaa

SEQ ID NO: 3149649 - DNA, 13 bp, Homo sapiens
tcatacacagaaa

SEQ ID NO: 3149650 - DNA, 15 bp, Homo sapiens
tcatacctaagtact

SEQ ID NO: 3149651 - DNA, 16 bp, Homo sapiens
tcatacctaagtactg

SEQ ID NO: 3149652 - DNA, 18 bp, Homo sapiens
tcatacctaagtactgta

SEQ ID NO: 3149653 - DNA, 23 bp, Homo sapiens
tcatactgaaaaaaaaagcttgt

SEQ ID NO: 3149654 - DNA, 15 bp, Homo sapiens
tcatactgattttta

SEQ ID NO: 3149655 - DNA, 18 bp, Homo sapiens
tcatactgtctgggatta

SEQ ID NO: 3149656 - DNA, 13 bp, Homo sapiens
tcatagaaatgta

SEQ ID NO: 3149657 - DNA, 20 bp, Homo sapiens
tcatagagatttgtctaatt

SEQ ID NO: 3149658 - DNA, 17 bp, Homo sapiens
tcatagctccttggagc

SEQ ID NO: 3149659 - DNA, 12 bp, Homo sapiens
tcatagctgaga

SEQ ID NO: 3149660 - DNA, 14 bp, Homo sapiens
tcataggagactgc

SEQ ID NO: 3149661 - DNA, 18 bp, Homo sapiens
tcatagggtctcttcagg

SEQ ID NO: 3149662 - DNA, 15 bp, Homo sapiens
tcatagtaacttctt

SEQ ID NO: 3149663 - DNA, 18 bp, Homo sapiens
tcatagtatggtggctgg

SEQ ID NO: 3149664 - DNA, 21 bp, Homo sapiens
tcatagtatggtggctgggtt

SEQ ID NO: 3149665 - DNA, 14 bp, Homo sapiens
tcatataaacattt

SEQ ID NO: 3149666 - DNA, 15 bp, Homo sapiens
tcatataaacatttt

SEQ ID NO: 3149667 - DNA, 15 bp, Homo sapiens
tcatataataaatgt

SEQ ID NO: 3149668 - DNA, 16 bp, Homo sapiens
tcatataccagcaata

SEQ ID NO: 3149669 - DNA, 17 bp, Homo sapiens
tcatatagtcaatgtaa

SEQ ID NO: 3149670 - DNA, 19 bp, Homo sapiens
tcatatagtcaatgtaaaa

SEQ ID NO: 3149671 - DNA, 23 bp, Homo sapiens
tcatatgccaccccatgtgcctt

SEQ ID NO: 3149672 - DNA, 12 bp, Homo sapiens
tcatatgctctg

SEQ ID NO: 3149673 - DNA, 21 bp, Homo sapiens
tcatatgtaccatgtacatga

SEQ ID NO: 3149674 - DNA, 22 bp, Homo sapiens
tcatatgtaccatgtacatgaa

SEQ ID NO: 3149675 - DNA, 18 bp, Homo sapiens
tcatatgttgctcagtct

SEQ ID NO: 3149676 - DNA, 18 bp, Homo sapiens
tcatattaagacagtgta

SEQ ID NO: 3149677 - DNA, 20 bp, Homo sapiens
tcatattaagacagtgtaca

SEQ ID NO: 3149678 - DNA, 21 bp, Homo sapiens
tcatattaagacagtgtacaa

SEQ ID NO: 3149679 - DNA, 15 bp, Homo sapiens
tcatattgatgaaaa

SEQ ID NO: 3149680 - DNA, 21 bp, Homo sapiens
tcatattgatgaaaagattta

SEQ ID NO: 3149681 - DNA, 14 bp, Homo sapiens
tcatattgtgccaa

SEQ ID NO: 3149682 - DNA, 20 bp, Homo sapiens
tcatattgtgccaatatgta

SEQ ID NO: 3149683 - DNA, 19 bp, Homo sapiens
tcatatttaaagacaggga

SEQ ID NO: 3149684 - DNA, 19 bp, Homo sapiens
tcatatttaagtgtattta

SEQ ID NO: 3149685 - DNA, 16 bp, Homo sapiens
tcatatttacttctta

SEQ ID NO: 3149686 - DNA, 22 bp, Homo sapiens
tcatatttacttcttatacatt

SEQ ID NO: 3149687 - DNA, 14 bp, Homo sapiens
tcatatttcccctt

SEQ ID NO: 3149688 - DNA, 13 bp, Homo sapiens
tcatatttgaaaa

SEQ ID NO: 3149689 - DNA, 20 bp, Homo sapiens
tcatatttgaggagtgttaa

SEQ ID NO: 3149690 - DNA, 14 bp, Homo sapiens
tcatattttgatta

SEQ ID NO: 3149691 - DNA, 20 bp, Homo sapiens
tcatcaaaaagaaaaatcaa

SEQ ID NO: 3149692 - DNA, 19 bp, Homo sapiens
tcatcaaaaagtaattata

SEQ ID NO: 3149693 - DNA, 19 bp, Homo sapiens
tcatcaacaagatttcctt

SEQ ID NO: 3149694 - DNA, 22 bp, Homo sapiens
tcatcaactgaatgaggtcagc

SEQ ID NO: 3149695 - DNA, 20 bp, Homo sapiens
tcatcaatatccctcttgta

SEQ ID NO: 3149696 - DNA, 21 bp, Homo sapiens
tcatcaatatccctcttgtaa

SEQ ID NO: 3149697 - DNA, 22 bp, Homo sapiens
tcatcaatatccctcttgtaag

SEQ ID NO: 3149698 - DNA, 16 bp, Homo sapiens
tcatcaatgtgacatt

SEQ ID NO: 3149699 - DNA, 24 bp, Homo sapiens
tcatcaattgaatggtcagcgttg

SEQ ID NO: 3149700 - DNA, 15 bp, Homo sapiens
tcatcagaagataac

SEQ ID NO: 3149701 - DNA, 21 bp, Homo sapiens
tcatcagagctcctctgtcct

SEQ ID NO: 3149702 - DNA, 22 bp, Homo sapiens
tcatcagatgcttgcggcaaaa

SEQ ID NO: 3149703 - DNA, 15 bp, Homo sapiens
tcatcagatggaaat

SEQ ID NO: 3149704 - DNA, 20 bp, Homo sapiens
tcatcagatggaaatatttt

SEQ ID NO: 3149705 - DNA, 11 bp, Homo sapiens
tcatcaggatg

SEQ ID NO: 3149706 - DNA, 22 bp, Homo sapiens
tcatcaggatgaacccaggacg

SEQ ID NO: 3149707 - DNA, 12 bp, Homo sapiens
tcatcagggcct

SEQ ID NO: 3149708 - DNA, 14 bp, Homo sapiens
tcatcagggcctgg

SEQ ID NO: 3149709 - DNA, 16 bp, Homo sapiens
tcatcagggcctgggg

SEQ ID NO: 3149710 - DNA, 21 bp, Homo sapiens
tcatcagggcctggggcctga

SEQ ID NO: 3149711 - DNA, 15 bp, Homo sapiens
tcatcataaaataaa

SEQ ID NO: 3149712 - DNA, 16 bp, Homo sapiens
tcatcatcagggcctg

SEQ ID NO: 3149713 - DNA, 14 bp, Homo sapiens
tcatcattccctct

SEQ ID NO: 3149714 - DNA, 13 bp, Homo sapiens
tcatccaaaatat

SEQ ID NO: 3149715 - DNA, 21 bp, Homo sapiens
tcatccaaaatattttttgca

SEQ ID NO: 3149716 - DNA, 15 bp, Homo sapiens
tcatccaatcctcac

SEQ ID NO: 3149717 - DNA, 20 bp, Homo sapiens
tcatccaatcctcactgggt

SEQ ID NO: 3149718 - DNA, 12 bp, Homo sapiens
tcatccacccca

SEQ ID NO: 3149719 - DNA, 16 bp, Homo sapiens
tcatccaccccatccc

SEQ ID NO: 3149720 - DNA, 21 bp, Homo sapiens
tcatccactgtgccatgtgcc

SEQ ID NO: 3149721 - DNA, 21 bp, Homo sapiens
tcatccagtttgttctccggg

SEQ ID NO: 3149722 - DNA, 13 bp, Homo sapiens
tcatccattcctc

SEQ ID NO: 3149723 - DNA, 13 bp, Homo sapiens
tcatcccagctgc

SEQ ID NO: 3149724 - DNA, 21 bp, Homo sapiens
tcatccccacaatctggctta

SEQ ID NO: 3149725 - DNA, 18 bp, Homo sapiens
tcatcccctcgtcctgtc

SEQ ID NO: 3149726 - DNA, 13 bp, Homo sapiens
tcatccctttcca

SEQ ID NO: 3149727 - DNA, 14 bp, Homo sapiens
tcatccctttccag

SEQ ID NO: 3149728 - DNA, 15 bp, Homo sapiens
tcatcctaagctatt

SEQ ID NO: 3149729 - DNA, 22 bp, Homo sapiens
tcatcctcaaagaaagtgtatt

SEQ ID NO: 3149730 - DNA, 15 bp, Homo sapiens
tcatcctcctggaac

SEQ ID NO: 3149731 - DNA, 23 bp, Homo sapiens
tcatcctcctggaaccttgctgt

SEQ ID NO: 3149732 - DNA, 21 bp, Homo sapiens
tcatcctggcacgccctactc

SEQ ID NO: 3149733 - DNA, 15 bp, Homo sapiens
tcatcctgttttctc

SEQ ID NO: 3149734 - DNA, 16 bp, Homo sapiens
tcatcctgttttctct

SEQ ID NO: 3149735 - DNA, 20 bp, Homo sapiens
tcatccttggtctttgtatc

SEQ ID NO: 3149736 - DNA, 18 bp, Homo sapiens
tcatcgaaaattcatttc

SEQ ID NO: 3149737 - DNA, 19 bp, Homo sapiens
tcatcgaaaattcatttca

SEQ ID NO: 3149738 - DNA, 15 bp, Homo sapiens
tcatcgccagaggtg

SEQ ID NO: 3149739 - DNA, 17 bp, Homo sapiens
tcatcgcgtcctcctac

SEQ ID NO: 3149740 - DNA, 18 bp, Homo sapiens
tcatcgcgtcctcctacc

SEQ ID NO: 3149741 - DNA, 17 bp, Homo sapiens
tcatcgctcgtgtgttc

SEQ ID NO: 3149742 - DNA, 14 bp, Homo sapiens
tcatcggaggctgg

SEQ ID NO: 3149743 - DNA, 13 bp, Homo sapiens
tcatctacttttt

SEQ ID NO: 3149744 - DNA, 23 bp, Homo sapiens
tcatctataaagaagaacttgca

SEQ ID NO: 3149745 - DNA, 17 bp, Homo sapiens
tcatctatgaggaaagg

SEQ ID NO: 3149746 - DNA, 22 bp, Homo sapiens
tcatctatgagggtgtttcctc

SEQ ID NO: 3149747 - DNA, 21 bp, Homo sapiens
tcatctattcaagcacttaca

SEQ ID NO: 3149748 - DNA, 15 bp, Homo sapiens
tcatctattctagca

SEQ ID NO: 3149749 - DNA, 21 bp, Homo sapiens
tcatctcggctgttcctgaga

SEQ ID NO: 3149750 - DNA, 13 bp, Homo sapiens
tcatctctctggg

SEQ ID NO: 3149751 - DNA, 16 bp, Homo sapiens
tcatctctctggggcc

SEQ ID NO: 3149752 - DNA, 22 bp, Homo sapiens
tcatctctctggggccctgggc

SEQ ID NO: 3149753 - DNA, 17 bp, Homo sapiens
tcatctgaaacccacag

SEQ ID NO: 3149754 - DNA, 22 bp, Homo sapiens
tcatctgatcacttcatgtttt

SEQ ID NO: 3149755 - DNA, 14 bp, Homo sapiens
tcatctggggtggg

SEQ ID NO: 3149756 - DNA, 20 bp, Homo sapiens
tcatctggttgaactctggt

SEQ ID NO: 3149757 - DNA, 15 bp, Homo sapiens
tcatctgtcattata

SEQ ID NO: 3149758 - DNA, 21 bp, Homo sapiens
tcatctgtccatggcctttct

SEQ ID NO: 3149759 - DNA, 14 bp, Homo sapiens
tcatctgtggagct

SEQ ID NO: 3149760 - DNA, 21 bp, Homo sapiens
tcatcttacatttctcaccct

SEQ ID NO: 3149761 - DNA, 16 bp, Homo sapiens
tcatcttactgtacct

SEQ ID NO: 3149762 - DNA, 13 bp, Homo sapiens
tcatcttctggaa

SEQ ID NO: 3149763 - DNA, 15 bp, Homo sapiens
tcatcttctggaata

SEQ ID NO: 3149764 - DNA, 22 bp, Homo sapiens
tcatgaaaactgtttttactaa

SEQ ID NO: 3149765 - DNA, 15 bp, Homo sapiens
tcatgaacagctctg

SEQ ID NO: 3149766 - DNA, 16 bp, Homo sapiens
tcatgaacagctctga

SEQ ID NO: 3149767 - DNA, 21 bp, Homo sapiens
tcatgaacagctctgagatcc

SEQ ID NO: 3149768 - DNA, 13 bp, Homo sapiens
tcatgaatgcttt

SEQ ID NO: 3149769 - DNA, 21 bp, Homo sapiens
tcatgaatgcttttagtgtgt

SEQ ID NO: 3149770 - DNA, 14 bp, Homo sapiens
tcatgaattttaca

SEQ ID NO: 3149771 - DNA, 16 bp, Homo sapiens
tcatgacaagcatttt

SEQ ID NO: 3149772 - DNA, 17 bp, Homo sapiens
tcatgagtcagacattt

SEQ ID NO: 3149773 - DNA, 22 bp, Homo sapiens
tcatgataccacctttactgtg

SEQ ID NO: 3149774 - DNA, 13 bp, Homo sapiens
tcatgatccaact

SEQ ID NO: 3149775 - DNA, 13 bp, Homo sapiens
tcatgattagcaa

SEQ ID NO: 3149776 - DNA, 14 bp, Homo sapiens
tcatgattagcaag

SEQ ID NO: 3149777 - DNA, 17 bp, Homo sapiens
tcatgatttcatttcaa

SEQ ID NO: 3149778 - DNA, 14 bp, Homo sapiens
tcatgcagctgtgg

SEQ ID NO: 3149779 - DNA, 16 bp, Homo sapiens
tcatgcagttcctggc

SEQ ID NO: 3149780 - DNA, 17 bp, Homo sapiens
tcatgcatagtcccagc

SEQ ID NO: 3149781 - DNA, 18 bp, Homo sapiens
tcatgcatgtcctgtaaa

SEQ ID NO: 3149782 - DNA, 12 bp, Homo sapiens
tcatgcattgtt

SEQ ID NO: 3149783 - DNA, 12 bp, Homo sapiens
tcatgccagcta

SEQ ID NO: 3149784 - DNA, 16 bp, Homo sapiens
tcatgcccaccccctg

SEQ ID NO: 3149785 - DNA, 18 bp, Homo sapiens
tcatgcccaccccctgcc

SEQ ID NO: 3149786 - DNA, 23 bp, Homo sapiens
tcatgcccaccccctgccctgca

SEQ ID NO: 3149787 - DNA, 22 bp, Homo sapiens
tcatgcccccctcaaacctcct

SEQ ID NO: 3149788 - DNA, 13 bp, Homo sapiens
tcatgcctgctga

SEQ ID NO: 3149789 - DNA, 14 bp, Homo sapiens
tcatgcctgctgag

SEQ ID NO: 3149790 - DNA, 13 bp, Homo sapiens
tcatgcctttgta

SEQ ID NO: 3149791 - DNA, 15 bp, Homo sapiens
tcatgctatctctgt

SEQ ID NO: 3149792 - DNA, 15 bp, Homo sapiens
tcatgctgaatccac

SEQ ID NO: 3149793 - DNA, 23 bp, Homo sapiens
tcatgctgaatccacctcggagc

SEQ ID NO: 3149794 - DNA, 14 bp, Homo sapiens
tcatgctgggattt

SEQ ID NO: 3149795 - DNA, 18 bp, Homo sapiens
tcatgctgggatttccaa

SEQ ID NO: 3149796 - DNA, 23 bp, Homo sapiens
tcatgctgttgctgctactgtct

SEQ ID NO: 3149797 - DNA, 13 bp, Homo sapiens
tcatgctttaaag

SEQ ID NO: 3149798 - DNA, 22 bp, Homo sapiens
tcatgctttaaagtgtaataat

SEQ ID NO: 3149799 - DNA, 23 bp, Homo sapiens
tcatgctttaaagtgtaataata

SEQ ID NO: 3149800 - DNA, 20 bp, Homo sapiens
tcatggaagtggcagtgaaa

SEQ ID NO: 3149801 - DNA, 17 bp, Homo sapiens
tcatggaatggacatcc

SEQ ID NO: 3149802 - DNA, 18 bp, Homo sapiens
tcatggaatggacatcct

SEQ ID NO: 3149803 - DNA, 18 bp, Homo sapiens
tcatggaatggcaggtgt

SEQ ID NO: 3149804 - DNA, 22 bp, Homo sapiens
tcatggcaagttgccattttgt

SEQ ID NO: 3149805 - DNA, 15 bp, Homo sapiens
tcatggcccccaggg

SEQ ID NO: 3149806 - DNA, 17 bp, Homo sapiens
tcatggcccccaggggc

SEQ ID NO: 3149807 - DNA, 13 bp, Homo sapiens
tcatggcccctct

SEQ ID NO: 3149808 - DNA, 14 bp, Homo sapiens
tcatggcccctctg

SEQ ID NO: 3149809 - DNA, 16 bp, Homo sapiens
tcatggccttgaaaca

SEQ ID NO: 3149810 - DNA, 18 bp, Homo sapiens
tcatggcgtaatgggcct

SEQ ID NO: 3149811 - DNA, 22 bp, Homo sapiens
tcatggcgtaatgggcctgccc

SEQ ID NO: 3149812 - DNA, 20 bp, Homo sapiens
tcatggctgcttgattttgt

SEQ ID NO: 3149813 - DNA, 15 bp, Homo sapiens
tcatggcttaatgtt

SEQ ID NO: 3149814 - DNA, 19 bp, Homo sapiens
tcatggggatcaattttca

SEQ ID NO: 3149815 - DNA, 21 bp, Homo sapiens
tcatggggatcaattttcatt

SEQ ID NO: 3149816 - DNA, 23 bp, Homo sapiens
tcatgggtcccttgaaggaagag

SEQ ID NO: 3149817 - DNA, 22 bp, Homo sapiens
tcatgggttatgtgtatgtgcc

SEQ ID NO: 3149818 - DNA, 15 bp, Homo sapiens
tcatggtgtaataag

SEQ ID NO: 3149819 - DNA, 16 bp, Homo sapiens
tcatggtgtaataaga

SEQ ID NO: 3149820 - DNA, 19 bp, Homo sapiens
tcatggtgtaataagacat

SEQ ID NO: 3149821 - DNA, 15 bp, Homo sapiens
tcatggtttccattt

SEQ ID NO: 3149822 - DNA, 11 bp, Homo sapiens
tcatgtaacat

SEQ ID NO: 3149823 - DNA, 13 bp, Homo sapiens
tcatgtaacattg

SEQ ID NO: 3149824 - DNA, 16 bp, Homo sapiens
tcatgtacaagatgaa

SEQ ID NO: 3149825 - DNA, 17 bp, Homo sapiens
tcatgtacaagatgaag

SEQ ID NO: 3149826 - DNA, 18 bp, Homo sapiens
tcatgtacaagatgaagg

SEQ ID NO: 3149827 - DNA, 15 bp, Homo sapiens
tcatgtactttttag

SEQ ID NO: 3149828 - DNA, 22 bp, Homo sapiens
tcatgtactttttagtaatttc

SEQ ID NO: 3149829 - DNA, 17 bp, Homo sapiens
tcatgtagaactcagca

SEQ ID NO: 3149830 - DNA, 22 bp, Homo sapiens
tcatgtagaactcagcagttga

SEQ ID NO: 3149831 - DNA, 19 bp, Homo sapiens
tcatgtatgttatgatatt

SEQ ID NO: 3149832 - DNA, 21 bp, Homo sapiens
tcatgtcaacttctggctcct

SEQ ID NO: 3149833 - DNA, 21 bp, Homo sapiens
tcatgtccatcccttttcctg

SEQ ID NO: 3149834 - DNA, 13 bp, Homo sapiens
tcatgtctggcta

SEQ ID NO: 3149835 - DNA, 17 bp, Homo sapiens
tcatgtgaccactctgt

SEQ ID NO: 3149836 - DNA, 20 bp, Homo sapiens
tcatgtgtgcaacagggtat

SEQ ID NO: 3149837 - DNA, 15 bp, Homo sapiens
tcatgttagttacct

SEQ ID NO: 3149838 - DNA, 17 bp, Homo sapiens
tcatgttcactgtgagt

SEQ ID NO: 3149839 - DNA, 14 bp, Homo sapiens
tcatgtttatgaaa

SEQ ID NO: 3149840 - DNA, 15 bp, Homo sapiens
tcatgtttatgaaaa

SEQ ID NO: 3149841 - DNA, 17 bp, Homo sapiens
tcatgtttatgaaaata

SEQ ID NO: 3149842 - DNA, 13 bp, Homo sapiens
tcatgtttgtaaa

SEQ ID NO: 3149843 - DNA, 14 bp, Homo sapiens
tcatgttttgtgac

SEQ ID NO: 3149844 - DNA, 15 bp, Homo sapiens
tcatgtttttgatca

SEQ ID NO: 3149845 - DNA, 15 bp, Homo sapiens
tcattaaacttgaag

SEQ ID NO: 3149846 - DNA, 15 bp, Homo sapiens
tcattaaatgtttga

SEQ ID NO: 3149847 - DNA, 14 bp, Homo sapiens
tcattaattctata

SEQ ID NO: 3149848 - DNA, 13 bp, Homo sapiens
tcattactgcaaa

SEQ ID NO: 3149849 - DNA, 17 bp, Homo sapiens
tcattactgttccagat

SEQ ID NO: 3149850 - DNA, 21 bp, Homo sapiens
tcattactgttccagattcct

SEQ ID NO: 3149851 - DNA, 13 bp, Homo sapiens
tcattacttgatt

SEQ ID NO: 3149852 - DNA, 15 bp, Homo sapiens
tcattacttgattaa

SEQ ID NO: 3149853 - DNA, 14 bp, Homo sapiens
tcattacttttaaa

SEQ ID NO: 3149854 - DNA, 12 bp, Homo sapiens
tcattataaaat

SEQ ID NO: 3149855 - DNA, 13 bp, Homo sapiens
tcattataaacgt

SEQ ID NO: 3149856 - DNA, 18 bp, Homo sapiens
tcattatctgagttgcat

SEQ ID NO: 3149857 - DNA, 18 bp, Homo sapiens
tcattatgtcaaccaggt

SEQ ID NO: 3149858 - DNA, 14 bp, Homo sapiens
tcattatgttcatg

SEQ ID NO: 3149859 - DNA, 21 bp, Homo sapiens
tcattatgttcatgtaagaag

SEQ ID NO: 3149860 - DNA, 14 bp, Homo sapiens
tcattattggaatt

SEQ ID NO: 3149861 - DNA, 19 bp, Homo sapiens
tcattattggaattaacct

SEQ ID NO: 3149862 - DNA, 20 bp, Homo sapiens
tcattcaaactgcactttta

SEQ ID NO: 3149863 - DNA, 22 bp, Homo sapiens
tcattcaaatcagtgatctatg

SEQ ID NO: 3149864 - DNA, 15 bp, Homo sapiens
tcattcaagctattt

SEQ ID NO: 3149865 - DNA, 16 bp, Homo sapiens
tcattcactagctttg

SEQ ID NO: 3149866 - DNA, 16 bp, Homo sapiens
tcattcacttctctta

SEQ ID NO: 3149867 - DNA, 13 bp, Homo sapiens
tcattcagaaatg

SEQ ID NO: 3149868 - DNA, 14 bp, Homo sapiens
tcattcagaaatgt

SEQ ID NO: 3149869 - DNA, 23 bp, Homo sapiens
tcattcagcagcaaattttcagc

SEQ ID NO: 3149870 - DNA, 17 bp, Homo sapiens
tcattcagtattaaagg

SEQ ID NO: 3149871 - DNA, 13 bp, Homo sapiens
tcattccagtgct

SEQ ID NO: 3149872 - DNA, 14 bp, Homo sapiens
tcattccagtgcta

SEQ ID NO: 3149873 - DNA, 15 bp, Homo sapiens
tcattcccccttcct

SEQ ID NO: 3149874 - DNA, 21 bp, Homo sapiens
tcattcccccttcctagtgaa

SEQ ID NO: 3149875 - DNA, 17 bp, Homo sapiens
tcattccgttgtctgtg

SEQ ID NO: 3149876 - DNA, 22 bp, Homo sapiens
tcattcctgaaagaaacagtta

SEQ ID NO: 3149877 - DNA, 18 bp, Homo sapiens
tcattcgcctttgtcttg

SEQ ID NO: 3149878 - DNA, 15 bp, Homo sapiens
tcattcgggatgatt

SEQ ID NO: 3149879 - DNA, 22 bp, Homo sapiens
tcattctacagaataatccagt

SEQ ID NO: 3149880 - DNA, 13 bp, Homo sapiens
tcattctcctgcc

SEQ ID NO: 3149881 - DNA, 14 bp, Homo sapiens
tcattctcctgcct

SEQ ID NO: 3149882 - DNA, 15 bp, Homo sapiens
tcattctgaggcctg

SEQ ID NO: 3149883 - DNA, 18 bp, Homo sapiens
tcattctgctacttcact

SEQ ID NO: 3149884 - DNA, 13 bp, Homo sapiens
tcattcttctcta

SEQ ID NO: 3149885 - DNA, 12 bp, Homo sapiens
tcattcttctgt

SEQ ID NO: 3149886 - DNA, 17 bp, Homo sapiens
tcattgaaatgtcacgt

SEQ ID NO: 3149887 - DNA, 18 bp, Homo sapiens
tcattgaagtatattctt

SEQ ID NO: 3149888 - DNA, 13 bp, Homo sapiens
tcattgactcttg

SEQ ID NO: 3149889 - DNA, 12 bp, Homo sapiens
tcattgacttca

SEQ ID NO: 3149890 - DNA, 13 bp, Homo sapiens
tcattgacttcat

SEQ ID NO: 3149891 - DNA, 18 bp, Homo sapiens
tcattgacttcattttat

SEQ ID NO: 3149892 - DNA, 11 bp, Homo sapiens
tcattgacttt

SEQ ID NO: 3149893 - DNA, 16 bp, Homo sapiens
tcattgacttttataa

SEQ ID NO: 3149894 - DNA, 21 bp, Homo sapiens
tcattgacttttataaagcat

SEQ ID NO: 3149895 - DNA, 18 bp, Homo sapiens
tcattgagagttttgtct

SEQ ID NO: 3149896 - DNA, 13 bp, Homo sapiens
tcattgccagtgt

SEQ ID NO: 3149897 - DNA, 17 bp, Homo sapiens
tcattgccagtgtcttt

SEQ ID NO: 3149898 - DNA, 22 bp, Homo sapiens
tcattgccagtgtctttctttg

SEQ ID NO: 3149899 - DNA, 20 bp, Homo sapiens
tcattgcccccacctctggt

SEQ ID NO: 3149900 - DNA, 21 bp, Homo sapiens
tcattgcccccacctctggtc

SEQ ID NO: 3149901 - DNA, 22 bp, Homo sapiens
tcattgcccccacctctggtcc

SEQ ID NO: 3149902 - DNA, 22 bp, Homo sapiens
tcattgcctgtgtatggaaaaa

SEQ ID NO: 3149903 - DNA, 23 bp, Homo sapiens
tcattgcctgtgtatggaaaaac

SEQ ID NO: 3149904 - DNA, 17 bp, Homo sapiens
tcattgctaaactgatg

SEQ ID NO: 3149905 - DNA, 17 bp, Homo sapiens
tcattgctgagcctctg

SEQ ID NO: 3149906 - DNA, 23 bp, Homo sapiens
tcattgctgagcctctgctcccc

SEQ ID NO: 3149907 - DNA, 20 bp, Homo sapiens
tcattgctgctgctaccagc

SEQ ID NO: 3149908 - DNA, 23 bp, Homo sapiens
tcattgctttgaagcagttgtgt

SEQ ID NO: 3149909 - DNA, 18 bp, Homo sapiens
tcattggaacaactgata

SEQ ID NO: 3149910 - DNA, 17 bp, Homo sapiens
tcattggtctaatttat

SEQ ID NO: 3149911 - DNA, 14 bp, Homo sapiens
tcattgtaaacaaa

SEQ ID NO: 3149912 - DNA, 21 bp, Homo sapiens
tcattgtaaacaaactcttga

SEQ ID NO: 3149913 - DNA, 16 bp, Homo sapiens
tcattgtaatgttact

SEQ ID NO: 3149914 - DNA, 17 bp, Homo sapiens
tcattgtaatgttactg

SEQ ID NO: 3149915 - DNA, 20 bp, Homo sapiens
tcattgtaatgttactgatc

SEQ ID NO: 3149916 - DNA, 21 bp, Homo sapiens
tcattgtactacctgtgtata

SEQ ID NO: 3149917 - DNA, 22 bp, Homo sapiens
tcattgtagaaacacagttttg

SEQ ID NO: 3149918 - DNA, 18 bp, Homo sapiens
tcattgtatgatgtgttg

SEQ ID NO: 3149919 - DNA, 14 bp, Homo sapiens
tcattgtattcaga

SEQ ID NO: 3149920 - DNA, 16 bp, Homo sapiens
tcattgtcaaaattaa

SEQ ID NO: 3149921 - DNA, 13 bp, Homo sapiens
tcattgtccctct

SEQ ID NO: 3149922 - DNA, 16 bp, Homo sapiens
tcattgtccctcttca

SEQ ID NO: 3149923 - DNA, 20 bp, Homo sapiens
tcattgtccctcttcactcc

SEQ ID NO: 3149924 - DNA, 21 bp, Homo sapiens
tcattgtccctcttcactccc

SEQ ID NO: 3149925 - DNA, 20 bp, Homo sapiens
tcattgtgtatcagtttcca

SEQ ID NO: 3149926 - DNA, 22 bp, Homo sapiens
tcattgtgtatcagtttccatg

SEQ ID NO: 3149927 - DNA, 13 bp, Homo sapiens
tcattgttttgaa

SEQ ID NO: 3149928 - DNA, 22 bp, Homo sapiens
tcatttactaaacatatgattt

SEQ ID NO: 3149929 - DNA, 17 bp, Homo sapiens
tcatttagataatttga

SEQ ID NO: 3149930 - DNA, 18 bp, Homo sapiens
tcatttagtgctaaacaa

SEQ ID NO: 3149931 - DNA, 21 bp, Homo sapiens
tcatttataaaaccatcaaaa

SEQ ID NO: 3149932 - DNA, 15 bp, Homo sapiens
tcatttatgaaaaga

SEQ ID NO: 3149933 - DNA, 18 bp, Homo sapiens
tcatttattgtttatgta

SEQ ID NO: 3149934 - DNA, 15 bp, Homo sapiens
tcatttcaatcattg

SEQ ID NO: 3149935 - DNA, 20 bp, Homo sapiens
tcatttcagtatcatctcca

SEQ ID NO: 3149936 - DNA, 16 bp, Homo sapiens
tcatttcattcctaac

SEQ ID NO: 3149937 - DNA, 19 bp, Homo sapiens
tcatttcattgtatgatgt

SEQ ID NO: 3149938 - DNA, 16 bp, Homo sapiens
tcatttcctgtgtctt

SEQ ID NO: 3149939 - DNA, 17 bp, Homo sapiens
tcatttctaaaagaata

SEQ ID NO: 3149940 - DNA, 16 bp, Homo sapiens
tcatttcttcctcagc

SEQ ID NO: 3149941 - DNA, 19 bp, Homo sapiens
tcatttgactgtctcactt

SEQ ID NO: 3149942 - DNA, 19 bp, Homo sapiens
tcatttgagcagggctcag

SEQ ID NO: 3149943 - DNA, 18 bp, Homo sapiens
tcatttggtgttcctgga

SEQ ID NO: 3149944 - DNA, 19 bp, Homo sapiens
tcatttggtgttcctggaa

SEQ ID NO: 3149945 - DNA, 16 bp, Homo sapiens
tcatttgtattgctta

SEQ ID NO: 3149946 - DNA, 16 bp, Homo sapiens
tcatttgtcacacact

SEQ ID NO: 3149947 - DNA, 16 bp, Homo sapiens
tcatttgtgtgctcat

SEQ ID NO: 3149948 - DNA, 15 bp, Homo sapiens
tcatttgttggaatg

SEQ ID NO: 3149949 - DNA, 22 bp, Homo sapiens
tcatttgttgtgatgtcttttc

SEQ ID NO: 3149950 - DNA, 16 bp, Homo sapiens
tcatttgttttttcaa

SEQ ID NO: 3149951 - DNA, 19 bp, Homo sapiens
tcattttaaaaactttatt

SEQ ID NO: 3149952 - DNA, 20 bp, Homo sapiens
tcattttaacatgatttcaa

SEQ ID NO: 3149953 - DNA, 23 bp, Homo sapiens
tcattttaacatgatttcaaaat

SEQ ID NO: 3149954 - DNA, 14 bp, Homo sapiens
tcattttagtgact

SEQ ID NO: 3149955 - DNA, 16 bp, Homo sapiens
tcattttagtgactgt

SEQ ID NO: 3149956 - DNA, 21 bp, Homo sapiens
tcattttattttttccctcct

SEQ ID NO: 3149957 - DNA, 18 bp, Homo sapiens
tcattttcatcactggga

SEQ ID NO: 3149958 - DNA, 13 bp, Homo sapiens
tcattttcatgtg

SEQ ID NO: 3149959 - DNA, 12 bp, Homo sapiens
tcattttctgac

SEQ ID NO: 3149960 - DNA, 22 bp, Homo sapiens
tcattttctgacatgcattgtt

SEQ ID NO: 3149961 - DNA, 20 bp, Homo sapiens
tcattttgaattatgtgcac

SEQ ID NO: 3149962 - DNA, 18 bp, Homo sapiens
tcattttggttttgtgtt

SEQ ID NO: 3149963 - DNA, 19 bp, Homo sapiens
tcatttttagtagagacag

SEQ ID NO: 3149964 - DNA, 14 bp, Homo sapiens
tcatttttcactgt

SEQ ID NO: 3149965 - DNA, 19 bp, Homo sapiens
tcatttttcatactgaaaa

SEQ ID NO: 3149966 - DNA, 15 bp, Homo sapiens
tcatttttgtacagt

SEQ ID NO: 3149967 - DNA, 15 bp, Homo sapiens
tcattttttaaaaaa

SEQ ID NO: 3149968 - DNA, 17 bp, Homo sapiens
tcatttttttttcaatc

SEQ ID NO: 3149969 - DNA, 23 bp, Homo sapiens
tccaaaaaaaaaaaaaatacaat

SEQ ID NO: 3149970 - DNA, 14 bp, Homo sapiens
tccaaaaaaaggaa

SEQ ID NO: 3149971 - DNA, 16 bp, Homo sapiens
tccaaaaaaaggaaaa

SEQ ID NO: 3149972 - DNA, 17 bp, Homo sapiens
tccaaaaaaaggaaaaa

SEQ ID NO: 3149973 - DNA, 20 bp, Homo sapiens
tccaaaaaaaggaaaaataa

SEQ ID NO: 3149974 - DNA, 14 bp, Homo sapiens
tccaaaaaattaaa

SEQ ID NO: 3149975 - DNA, 12 bp, Homo sapiens
tccaaaactgcc

SEQ ID NO: 3149976 - DNA, 19 bp, Homo sapiens
tccaaaataattttaagaa

SEQ ID NO: 3149977 - DNA, 19 bp, Homo sapiens
tccaaaatgtgtatttctt

SEQ ID NO: 3149978 - DNA, 23 bp, Homo sapiens
tccaaaatttgaaatattaaaat

SEQ ID NO: 3149979 - DNA, 15 bp, Homo sapiens
tccaaacatgtattt

SEQ ID NO: 3149980 - DNA, 19 bp, Homo sapiens
tccaaacatgtatttatgt

SEQ ID NO: 3149981 - DNA, 20 bp, Homo sapiens
tccaaacatgtatttatgta

SEQ ID NO: 3149982 - DNA, 14 bp, Homo sapiens
tccaaacctggttc

SEQ ID NO: 3149983 - DNA, 22 bp, Homo sapiens
tccaaacctggttcatatttat

SEQ ID NO: 3149984 - DNA, 20 bp, Homo sapiens
tccaaacctgtcttggggcc

SEQ ID NO: 3149985 - DNA, 22 bp, Homo sapiens
tccaaacttggatttttgactc

SEQ ID NO: 3149986 - DNA, 13 bp, Homo sapiens
tccaaagactgta

SEQ ID NO: 3149987 - DNA, 18 bp, Homo sapiens
tccaaagactgtactggc

SEQ ID NO: 3149988 - DNA, 14 bp, Homo sapiens
tccaaagaggctgc

SEQ ID NO: 3149989 - DNA, 22 bp, Homo sapiens
tccaaagagtagaattgcattg

SEQ ID NO: 3149990 - DNA, 19 bp, Homo sapiens
tccaaaggaggctggcagg

SEQ ID NO: 3149991 - DNA, 19 bp, Homo sapiens
tccaaaggggctgctgggg

SEQ ID NO: 3149992 - DNA, 21 bp, Homo sapiens
tccaaaggggctgctggggca

SEQ ID NO: 3149993 - DNA, 15 bp, Homo sapiens
tccaaagtaaaattg

SEQ ID NO: 3149994 - DNA, 13 bp, Homo sapiens
tccaaagtctcta

SEQ ID NO: 3149995 - DNA, 18 bp, Homo sapiens
tccaaagtctctaattct

SEQ ID NO: 3149996 - DNA, 18 bp, Homo sapiens
tccaaataaaaactaaat

SEQ ID NO: 3149997 - DNA, 16 bp, Homo sapiens
tccaaataaaaattag

SEQ ID NO: 3149998 - DNA, 15 bp, Homo sapiens
tccaaataataaagt

SEQ ID NO: 3149999 - DNA, 20 bp, Homo sapiens
tccaaatgaatgttgtctgt

SEQ ID NO: 3150000 - DNA, 16 bp, Homo sapiens
tccaaatgcaatttga

SEQ ID NO: 3150001 - DNA, 18 bp, Homo sapiens
tccaaatggcgtctggaa

SEQ ID NO: 3150002 - DNA, 19 bp, Homo sapiens
tccaaatgtcctccagaag

SEQ ID NO: 3150003 - DNA, 15 bp, Homo sapiens
tccaaattgtgcttc

SEQ ID NO: 3150004 - DNA, 16 bp, Homo sapiens
tccaacaataaacagg

SEQ ID NO: 3150005 - DNA, 17 bp, Homo sapiens
tccaacaataaacagga

SEQ ID NO: 3150006 - DNA, 16 bp, Homo sapiens
tccaacaccacagaca

SEQ ID NO: 3150007 - DNA, 20 bp, Homo sapiens
tccaacaccacagacacaca

SEQ ID NO: 3150008 - DNA, 21 bp, Homo sapiens
tccaacaccacagacacacac

SEQ ID NO: 3150009 - DNA, 21 bp, Homo sapiens
tccaacagaaataaaatacac

SEQ ID NO: 3150010 - DNA, 17 bp, Homo sapiens
tccaacagaagaactgt

SEQ ID NO: 3150011 - DNA, 19 bp, Homo sapiens
tccaacagctcaagtcttc

SEQ ID NO: 3150012 - DNA, 22 bp, Homo sapiens
tccaacccccgccacctcaggg

SEQ ID NO: 3150013 - DNA, 14 bp, Homo sapiens
tccaaccttcccaa

SEQ ID NO: 3150014 - DNA, 16 bp, Homo sapiens
tccaacgcccctgtgg

SEQ ID NO: 3150015 - DNA, 17 bp, Homo sapiens
tccaacgcccctgtggc

SEQ ID NO: 3150016 - DNA, 18 bp, Homo sapiens
tccaacgcccctgtggcc

SEQ ID NO: 3150017 - DNA, 20 bp, Homo sapiens
tccaacgcccctgtggccaa

SEQ ID NO: 3150018 - DNA, 21 bp, Homo sapiens
tccaacgcccctgtggccaac

SEQ ID NO: 3150019 - DNA, 15 bp, Homo sapiens
tccaactaatgcctt

SEQ ID NO: 3150020 - DNA, 19 bp, Homo sapiens
tccaactaatgccttactc

SEQ ID NO: 3150021 - DNA, 19 bp, Homo sapiens
tccaactcgaatctgtgtg

SEQ ID NO: 3150022 - DNA, 16 bp, Homo sapiens
tccaactggcactctg

SEQ ID NO: 3150023 - DNA, 17 bp, Homo sapiens
tccaactggcactctgt

SEQ ID NO: 3150024 - DNA, 23 bp, Homo sapiens
tccaactggccctatttagatga

SEQ ID NO: 3150025 - DNA, 15 bp, Homo sapiens
tccaacttcatttga

SEQ ID NO: 3150026 - DNA, 16 bp, Homo sapiens
tccaacttgtctggga

SEQ ID NO: 3150027 - DNA, 16 bp, Homo sapiens
tccaagaatccacatt

SEQ ID NO: 3150028 - DNA, 19 bp, Homo sapiens
tccaagaatccacatttct

SEQ ID NO: 3150029 - DNA, 21 bp, Homo sapiens
tccaagaatccacatttctaa

SEQ ID NO: 3150030 - DNA, 17 bp, Homo sapiens
tccaagacattgtcaat

SEQ ID NO: 3150031 - DNA, 13 bp, Homo sapiens
tccaagagacatg

SEQ ID NO: 3150032 - DNA, 12 bp, Homo sapiens
tccaagattcta

SEQ ID NO: 3150033 - DNA, 14 bp, Homo sapiens
tccaagattctaga

SEQ ID NO: 3150034 - DNA, 15 bp, Homo sapiens
tccaagattctagat

SEQ ID NO: 3150035 - DNA, 19 bp, Homo sapiens
tccaagcaagtagctttcc

SEQ ID NO: 3150036 - DNA, 23 bp, Homo sapiens
tccaagcagcctgagcaactctt

SEQ ID NO: 3150037 - DNA, 19 bp, Homo sapiens
tccaagccccatcttctaa

SEQ ID NO: 3150038 - DNA, 23 bp, Homo sapiens
tccaagccccatcttctaaatgg

SEQ ID NO: 3150039 - DNA, 18 bp, Homo sapiens
tccaagccccccacacct

SEQ ID NO: 3150040 - DNA, 15 bp, Homo sapiens
tccaagcctccacag

SEQ ID NO: 3150041 - DNA, 14 bp, Homo sapiens
tccaagctaagcac

SEQ ID NO: 3150042 - DNA, 14 bp, Homo sapiens
tccaagctccctgc

SEQ ID NO: 3150043 - DNA, 15 bp, Homo sapiens
tccaagctccctgcc

SEQ ID NO: 3150044 - DNA, 17 bp, Homo sapiens
tccaagctgagagtcta

SEQ ID NO: 3150045 - DNA, 11 bp, Homo sapiens
tccaagctggt

SEQ ID NO: 3150046 - DNA, 16 bp, Homo sapiens
tccaagctggtcccac

SEQ ID NO: 3150047 - DNA, 15 bp, Homo sapiens
tccaaggagaaacag

SEQ ID NO: 3150048 - DNA, 22 bp, Homo sapiens
tccaaggagaaacagagacagg

SEQ ID NO: 3150049 - DNA, 23 bp, Homo sapiens
tccaaggagaaacagagacaggc

SEQ ID NO: 3150050 - DNA, 14 bp, Homo sapiens
tccaaggagaccaa

SEQ ID NO: 3150051 - DNA, 13 bp, Homo sapiens
tccaaggcaaaca

SEQ ID NO: 3150052 - DNA, 14 bp, Homo sapiens
tccaaggcaaacaa

SEQ ID NO: 3150053 - DNA, 19 bp, Homo sapiens
tccaagggaccctttgcct

SEQ ID NO: 3150054 - DNA, 16 bp, Homo sapiens
tccaagggcttctgca

SEQ ID NO: 3150055 - DNA, 19 bp, Homo sapiens
tccaagggcttctgcaccc

SEQ ID NO: 3150056 - DNA, 18 bp, Homo sapiens
tccaagggtactaaggaa

SEQ ID NO: 3150057 - DNA, 20 bp, Homo sapiens
tccaaggtttaaagagtcta

SEQ ID NO: 3150058 - DNA, 20 bp, Homo sapiens
tccaagtaccaatgctgttg

SEQ ID NO: 3150059 - DNA, 19 bp, Homo sapiens
tccaagtctctctgtgaat

SEQ ID NO: 3150060 - DNA, 17 bp, Homo sapiens
tccaagtctgtacctca

SEQ ID NO: 3150061 - DNA, 18 bp, Homo sapiens
tccaagtgccagaggtgg

SEQ ID NO: 3150062 - DNA, 18 bp, Homo sapiens
tccaagttcttcacctct

SEQ ID NO: 3150063 - DNA, 14 bp, Homo sapiens
tccaagtttccaaa

SEQ ID NO: 3150064 - DNA, 14 bp, Homo sapiens
tccaataaaccagg

SEQ ID NO: 3150065 - DNA, 13 bp, Homo sapiens
tccaatatttctg

SEQ ID NO: 3150066 - DNA, 16 bp, Homo sapiens
tccaatatttctgctt

SEQ ID NO: 3150067 - DNA, 22 bp, Homo sapiens
tccaatctgtgatgacattccc

SEQ ID NO: 3150068 - DNA, 22 bp, Homo sapiens
tccaatgcacagttgccacatt

SEQ ID NO: 3150069 - DNA, 18 bp, Homo sapiens
tccaatgtggcaaggaaa

SEQ ID NO: 3150070 - DNA, 16 bp, Homo sapiens
tccaattagtttcctt

SEQ ID NO: 3150071 - DNA, 23 bp, Homo sapiens
tccaattagtttcctttttaata

SEQ ID NO: 3150072 - DNA, 13 bp, Homo sapiens
tccaattgatgta

SEQ ID NO: 3150073 - DNA, 22 bp, Homo sapiens
tccaattgatgtatatgtttat

SEQ ID NO: 3150074 - DNA, 21 bp, Homo sapiens
tccaattgttgacagttctga

SEQ ID NO: 3150075 - DNA, 18 bp, Homo sapiens
tccaatttacatactctg

SEQ ID NO: 3150076 - DNA, 22 bp, Homo sapiens
tccaatttgtaaaaacagcatt

SEQ ID NO: 3150077 - DNA, 18 bp, Homo sapiens
tccacaaggaataaatga

SEQ ID NO: 3150078 - DNA, 18 bp, Homo sapiens
tccacacaaagattttct

SEQ ID NO: 3150079 - DNA, 23 bp, Homo sapiens
tccacacaagggaaggacagaaa

SEQ ID NO: 3150080 - DNA, 12 bp, Homo sapiens
tccacacacaga

SEQ ID NO: 3150081 - DNA, 13 bp, Homo sapiens
tccacacacagag

SEQ ID NO: 3150082 - DNA, 15 bp, Homo sapiens
tccacacacagagga

SEQ ID NO: 3150083 - DNA, 23 bp, Homo sapiens
tccacaccactgttgccttttaa

SEQ ID NO: 3150084 - DNA, 18 bp, Homo sapiens
tccacaccagtggcctcg

SEQ ID NO: 3150085 - DNA, 18 bp, Homo sapiens
tccacacccaatgctgct

SEQ ID NO: 3150086 - DNA, 21 bp, Homo sapiens
tccacaccttttattgacaca

SEQ ID NO: 3150087 - DNA, 14 bp, Homo sapiens
tccacactagaaag

SEQ ID NO: 3150088 - DNA, 18 bp, Homo sapiens
tccacagagagtcccact

SEQ ID NO: 3150089 - DNA, 20 bp, Homo sapiens
tccacagagtgagccagtga

SEQ ID NO: 3150090 - DNA, 16 bp, Homo sapiens
tccacagccgcagcct

SEQ ID NO: 3150091 - DNA, 18 bp, Homo sapiens
tccacagccgcagcctcc

SEQ ID NO: 3150092 - DNA, 23 bp, Homo sapiens
tccacagccgcctgaaagccaca

SEQ ID NO: 3150093 - DNA, 18 bp, Homo sapiens
tccacagcctgcaagtca

SEQ ID NO: 3150094 - DNA, 17 bp, Homo sapiens
tccacagcgagggcagc

SEQ ID NO: 3150095 - DNA, 19 bp, Homo sapiens
tccacagcgagggcagctg

SEQ ID NO: 3150096 - DNA, 20 bp, Homo sapiens
tccacagcgagggcagctgc

SEQ ID NO: 3150097 - DNA, 18 bp, Homo sapiens
tccacaggcaaaactcag

SEQ ID NO: 3150098 - DNA, 13 bp, Homo sapiens
tccacaggggcag

SEQ ID NO: 3150099 - DNA, 20 bp, Homo sapiens
tccacaggggcaggcctggg

SEQ ID NO: 3150100 - DNA, 14 bp, Homo sapiens
tccacaggtctaga

SEQ ID NO: 3150101 - DNA, 16 bp, Homo sapiens
tccacaggtctagact

SEQ ID NO: 3150102 - DNA, 17 bp, Homo sapiens
tccacaggtctagacta

SEQ ID NO: 3150103 - DNA, 15 bp, Homo sapiens
tccacagtgctgctt

SEQ ID NO: 3150104 - DNA, 22 bp, Homo sapiens
tccacagtgttcatttgaaaga

SEQ ID NO: 3150105 - DNA, 19 bp, Homo sapiens
tccacagttatcttagctg

SEQ ID NO: 3150106 - DNA, 22 bp, Homo sapiens
tccacagttatcttagctggat

SEQ ID NO: 3150107 - DNA, 12 bp, Homo sapiens
tccacagttgcc

SEQ ID NO: 3150108 - DNA, 14 bp, Homo sapiens
tccacagttgccac

SEQ ID NO: 3150109 - DNA, 19 bp, Homo sapiens
tccacagttgccaccacct

SEQ ID NO: 3150110 - DNA, 18 bp, Homo sapiens
tccacatcccagcagccc

SEQ ID NO: 3150111 - DNA, 16 bp, Homo sapiens
tccacatttctaaaat

SEQ ID NO: 3150112 - DNA, 16 bp, Homo sapiens
tccacatttgtcacag

SEQ ID NO: 3150113 - DNA, 22 bp, Homo sapiens
tccacatttttgcacagattat

SEQ ID NO: 3150114 - DNA, 15 bp, Homo sapiens
tccaccacatctgcc

SEQ ID NO: 3150115 - DNA, 21 bp, Homo sapiens
tccaccaccactggccaccag

SEQ ID NO: 3150116 - DNA, 23 bp, Homo sapiens
tccaccacccaacccaaaccatg

SEQ ID NO: 3150117 - DNA, 13 bp, Homo sapiens
tccaccagcagca

SEQ ID NO: 3150118 - DNA, 22 bp, Homo sapiens
tccaccagcccatggccctgtg

SEQ ID NO: 3150119 - DNA, 19 bp, Homo sapiens
tccacccaaccctatctcc

SEQ ID NO: 3150120 - DNA, 23 bp, Homo sapiens
tccacccaaccctatctcctgac

SEQ ID NO: 3150121 - DNA, 17 bp, Homo sapiens
tccacccacctcagcct

SEQ ID NO: 3150122 - DNA, 11 bp, Homo sapiens
tccacccagcc

SEQ ID NO: 3150123 - DNA, 15 bp, Homo sapiens
tccacccaggctgca

SEQ ID NO: 3150124 - DNA, 23 bp, Homo sapiens
tccacccaggctgcactgcagtg

SEQ ID NO: 3150125 - DNA, 15 bp, Homo sapiens
tccacccagtgctgc

SEQ ID NO: 3150126 - DNA, 16 bp, Homo sapiens
tccacccagtgctgcc

SEQ ID NO: 3150127 - DNA, 18 bp, Homo sapiens
tccacccagtgctgccat

SEQ ID NO: 3150128 - DNA, 19 bp, Homo sapiens
tccacccagtgctgccatg

SEQ ID NO: 3150129 - DNA, 20 bp, Homo sapiens
tccacccataatcctttctg

SEQ ID NO: 3150130 - DNA, 19 bp, Homo sapiens
tccaccccaagagaactcg

SEQ ID NO: 3150131 - DNA, 20 bp, Homo sapiens
tccaccccatccctccccag

SEQ ID NO: 3150132 - DNA, 22 bp, Homo sapiens
tccaccccatccctccccagtt

SEQ ID NO: 3150133 - DNA, 14 bp, Homo sapiens
tccaccccctgccc

SEQ ID NO: 3150134 - DNA, 17 bp, Homo sapiens
tccaccccctgcccaca

SEQ ID NO: 3150135 - DNA, 14 bp, Homo sapiens
tccaccctgccaag

SEQ ID NO: 3150136 - DNA, 20 bp, Homo sapiens
tccaccctgccaagactcct

SEQ ID NO: 3150137 - DNA, 21 bp, Homo sapiens
tccaccctgctctccgaccag

SEQ ID NO: 3150138 - DNA, 12 bp, Homo sapiens
tccaccctgtcc

SEQ ID NO: 3150139 - DNA, 16 bp, Homo sapiens
tccaccctgtccccca

SEQ ID NO: 3150140 - DNA, 18 bp, Homo sapiens
tccaccctgtcccccagc

SEQ ID NO: 3150141 - DNA, 17 bp, Homo sapiens
tccacccttggcctgtc

SEQ ID NO: 3150142 - DNA, 20 bp, Homo sapiens
tccaccgcctatcccaaacc

SEQ ID NO: 3150143 - DNA, 14 bp, Homo sapiens
tccaccgctgctcc

SEQ ID NO: 3150144 - DNA, 15 bp, Homo sapiens
tccaccgctgctcca

SEQ ID NO: 3150145 - DNA, 16 bp, Homo sapiens
tccaccggcccctggc

SEQ ID NO: 3150146 - DNA, 22 bp, Homo sapiens
tccacctccaccacatctgcca

SEQ ID NO: 3150147 - DNA, 13 bp, Homo sapiens
tccacctccctcc

SEQ ID NO: 3150148 - DNA, 18 bp, Homo sapiens
tccacctcttcacccccc

SEQ ID NO: 3150149 - DNA, 20 bp, Homo sapiens
tccacctgtctcagcctccc

SEQ ID NO: 3150150 - DNA, 13 bp, Homo sapiens
tccacctgtgggt

SEQ ID NO: 3150151 - DNA, 12 bp, Homo sapiens
tccaccttccca

SEQ ID NO: 3150152 - DNA, 18 bp, Homo sapiens
tccaccttcccatgccct

SEQ ID NO: 3150153 - DNA, 14 bp, Homo sapiens
tccaccttggctct

SEQ ID NO: 3150154 - DNA, 12 bp, Homo sapiens
tccaccttttct

SEQ ID NO: 3150155 - DNA, 18 bp, Homo sapiens
tccacgatcctgccaccc

SEQ ID NO: 3150156 - DNA, 15 bp, Homo sapiens
tccacggtgcgtggc

SEQ ID NO: 3150157 - DNA, 16 bp, Homo sapiens
tccacggtgcgtggct

SEQ ID NO: 3150158 - DNA, 18 bp, Homo sapiens
tccacgtccccctggggc

SEQ ID NO: 3150159 - DNA, 21 bp, Homo sapiens
tccactcagctgtcctgcagc

SEQ ID NO: 3150160 - DNA, 15 bp, Homo sapiens
tccactccattgtcg

SEQ ID NO: 3150161 - DNA, 18 bp, Homo sapiens
tccactcgacccagaatg

SEQ ID NO: 3150162 - DNA, 21 bp, Homo sapiens
tccactctaccctcccacccc

SEQ ID NO: 3150163 - DNA, 21 bp, Homo sapiens
tccactctcggggcccttggg

SEQ ID NO: 3150164 - DNA, 19 bp, Homo sapiens
tccactctgcttctctgac

SEQ ID NO: 3150165 - DNA, 21 bp, Homo sapiens
tccactgcaaataaagccttt

SEQ ID NO: 3150166 - DNA, 17 bp, Homo sapiens
tccactgcctctgcctt

SEQ ID NO: 3150167 - DNA, 13 bp, Homo sapiens
tccactgccttcg

SEQ ID NO: 3150168 - DNA, 10 bp, Homo sapiens
tccactggac

SEQ ID NO: 3150169 - DNA, 15 bp, Homo sapiens
tccactggacagacc

SEQ ID NO: 3150170 - DNA, 23 bp, Homo sapiens
tccactggacagacccaggtctt

SEQ ID NO: 3150171 - DNA, 16 bp, Homo sapiens
tccactgggcacaact

SEQ ID NO: 3150172 - DNA, 12 bp, Homo sapiens
tccactgtcacc

SEQ ID NO: 3150173 - DNA, 13 bp, Homo sapiens
tccactgtggcaa

SEQ ID NO: 3150174 - DNA, 13 bp, Homo sapiens
tccactgtggcac

SEQ ID NO: 3150175 - DNA, 23 bp, Homo sapiens
tccacttagaaattgcatttcct

SEQ ID NO: 3150176 - DNA, 20 bp, Homo sapiens
tccacttcttcctttctctt

SEQ ID NO: 3150177 - DNA, 12 bp, Homo sapiens
tccacttggtct

SEQ ID NO: 3150178 - DNA, 14 bp, Homo sapiens
tccacttggtctgt

SEQ ID NO: 3150179 - DNA, 16 bp, Homo sapiens
tccactttgttcttta

SEQ ID NO: 3150180 - DNA, 22 bp, Homo sapiens
tccactttgtttcgtggggagg

SEQ ID NO: 3150181 - DNA, 18 bp, Homo sapiens
tccagaaaaccccagcat

SEQ ID NO: 3150182 - DNA, 17 bp, Homo sapiens
tccagaaaggatattta

SEQ ID NO: 3150183 - DNA, 16 bp, Homo sapiens
tccagaagaatattca

SEQ ID NO: 3150184 - DNA, 16 bp, Homo sapiens
tccagaagcctctggc

SEQ ID NO: 3150185 - DNA, 18 bp, Homo sapiens
tccagaagcctctggcta

SEQ ID NO: 3150186 - DNA, 20 bp, Homo sapiens
tccagaagttttaacttcca

SEQ ID NO: 3150187 - DNA, 12 bp, Homo sapiens
tccagaatatct

SEQ ID NO: 3150188 - DNA, 16 bp, Homo sapiens
tccagaatctgctgtt

SEQ ID NO: 3150189 - DNA, 18 bp, Homo sapiens
tccagaatctgctgttgc

SEQ ID NO: 3150190 - DNA, 15 bp, Homo sapiens
tccagaatgctgtac

SEQ ID NO: 3150191 - DNA, 17 bp, Homo sapiens
tccagaatgtaagaaaa

SEQ ID NO: 3150192 - DNA, 23 bp, Homo sapiens
tccagaatgtaagaaaacaaaat

SEQ ID NO: 3150193 - DNA, 16 bp, Homo sapiens
tccagaattgaccttt

SEQ ID NO: 3150194 - DNA, 19 bp, Homo sapiens
tccagacatacgaaacaca

SEQ ID NO: 3150195 - DNA, 20 bp, Homo sapiens
tccagacatacgaaacacaa

SEQ ID NO: 3150196 - DNA, 13 bp, Homo sapiens
tccagacccctgg

SEQ ID NO: 3150197 - DNA, 19 bp, Homo sapiens
tccagacccggctgcgtgg

SEQ ID NO: 3150198 - DNA, 19 bp, Homo sapiens
tccagacctgcttcctgaa

SEQ ID NO: 3150199 - DNA, 18 bp, Homo sapiens
tccagacgtaggggaggg

SEQ ID NO: 3150200 - DNA, 23 bp, Homo sapiens
tccagactgcttccaattttctg

SEQ ID NO: 3150201 - DNA, 12 bp, Homo sapiens
tccagactgtaa

SEQ ID NO: 3150202 - DNA, 20 bp, Homo sapiens
tccagacttccttgagacac

SEQ ID NO: 3150203 - DNA, 17 bp, Homo sapiens
tccagagagtggctcct

SEQ ID NO: 3150204 - DNA, 19 bp, Homo sapiens
tccagagagtggctcctcc

SEQ ID NO: 3150205 - DNA, 14 bp, Homo sapiens
tccagagccagcct

SEQ ID NO: 3150206 - DNA, 20 bp, Homo sapiens
tccagagccagcctgggact

SEQ ID NO: 3150207 - DNA, 21 bp, Homo sapiens
tccagagcggaggctgtgtgc

SEQ ID NO: 3150208 - DNA, 23 bp, Homo sapiens
tccagagcggaggctgtgtgcct

SEQ ID NO: 3150209 - DNA, 14 bp, Homo sapiens
tccagagtctgagc

SEQ ID NO: 3150210 - DNA, 22 bp, Homo sapiens
tccagagttctgtgacacatgc

SEQ ID NO: 3150211 - DNA, 22 bp, Homo sapiens
tccagatagtgtagctgaggag

SEQ ID NO: 3150212 - DNA, 15 bp, Homo sapiens
tccagatcactgcca

SEQ ID NO: 3150213 - DNA, 14 bp, Homo sapiens
tccagatccagact

SEQ ID NO: 3150214 - DNA, 19 bp, Homo sapiens
tccagattcctatgatgga

SEQ ID NO: 3150215 - DNA, 18 bp, Homo sapiens
tccagcaacttcttctcc

SEQ ID NO: 3150216 - DNA, 13 bp, Homo sapiens
tccagcaccttct

SEQ ID NO: 3150217 - DNA, 20 bp, Homo sapiens
tccagcaccttctttctgga

SEQ ID NO: 3150218 - DNA, 14 bp, Homo sapiens
tccagcagctgcgg

SEQ ID NO: 3150219 - DNA, 15 bp, Homo sapiens
tccagcagctgcggg

SEQ ID NO: 3150220 - DNA, 18 bp, Homo sapiens
tccagcatccagcctgtg

SEQ ID NO: 3150221 - DNA, 11 bp, Homo sapiens
tccagcccatc

SEQ ID NO: 3150222 - DNA, 13 bp, Homo sapiens
tccagcccctgtc

SEQ ID NO: 3150223 - DNA, 14 bp, Homo sapiens
tccagcccctgtcc

SEQ ID NO: 3150224 - DNA, 13 bp, Homo sapiens
tccagcccgggag

SEQ ID NO: 3150225 - DNA, 21 bp, Homo sapiens
tccagcccgggagcctaggac

SEQ ID NO: 3150226 - DNA, 23 bp, Homo sapiens
tccagcccgggagcctaggacca

SEQ ID NO: 3150227 - DNA, 19 bp, Homo sapiens
tccagccctattctgccac

SEQ ID NO: 3150228 - DNA, 22 bp, Homo sapiens
tccagccgaagctgcaggggca

SEQ ID NO: 3150229 - DNA, 18 bp, Homo sapiens
tccagccgccattgccac

SEQ ID NO: 3150230 - DNA, 22 bp, Homo sapiens
tccagccgccattgccaccagg

SEQ ID NO: 3150231 - DNA, 23 bp, Homo sapiens
tccagccgccattgccaccagga

SEQ ID NO: 3150232 - DNA, 19 bp, Homo sapiens
tccagcctctcccggctgc

SEQ ID NO: 3150233 - DNA, 21 bp, Homo sapiens
tccagcctctcccggctgcct

SEQ ID NO: 3150234 - DNA, 13 bp, Homo sapiens
tccagcctggacc

SEQ ID NO: 3150235 - DNA, 19 bp, Homo sapiens
tccagcctggacccccagc

SEQ ID NO: 3150236 - DNA, 21 bp, Homo sapiens
tccagcctggacccccagctt

SEQ ID NO: 3150237 - DNA, 19 bp, Homo sapiens
tccagcctgggcagccagg

SEQ ID NO: 3150238 - DNA, 22 bp, Homo sapiens
tccagcctgggcagccaggctg

SEQ ID NO: 3150239 - DNA, 16 bp, Homo sapiens
tccagctcaccagccc

SEQ ID NO: 3150240 - DNA, 22 bp, Homo sapiens
tccagctccaagacctgttggt

SEQ ID NO: 3150241 - DNA, 10 bp, Homo sapiens
tccagctccc

SEQ ID NO: 3150242 - DNA, 15 bp, Homo sapiens
tccagctccctagac

SEQ ID NO: 3150243 - DNA, 16 bp, Homo sapiens
tccagctccctagact

SEQ ID NO: 3150244 - DNA, 19 bp, Homo sapiens
tccagctccctagactgca

SEQ ID NO: 3150245 - DNA, 13 bp, Homo sapiens
tccagctcctgta

SEQ ID NO: 3150246 - DNA, 21 bp, Homo sapiens
tccagctctgacatcccttcc

SEQ ID NO: 3150247 - DNA, 14 bp, Homo sapiens
tccagctgaggcag

SEQ ID NO: 3150248 - DNA, 16 bp, Homo sapiens
tccagctgcaccagag

SEQ ID NO: 3150249 - DNA, 12 bp, Homo sapiens
tccagctgcccc

SEQ ID NO: 3150250 - DNA, 13 bp, Homo sapiens
tccagctgccccg

SEQ ID NO: 3150251 - DNA, 16 bp, Homo sapiens
tccagctgctgctctc

SEQ ID NO: 3150252 - DNA, 14 bp, Homo sapiens
tccaggaaggcagc

SEQ ID NO: 3150253 - DNA, 18 bp, Homo sapiens
tccaggaaggcagctgct

SEQ ID NO: 3150254 - DNA, 20 bp, Homo sapiens
tccaggaaggcagctgctct

SEQ ID NO: 3150255 - DNA, 23 bp, Homo sapiens
tccaggaaggcagctgctcttag

SEQ ID NO: 3150256 - DNA, 12 bp, Homo sapiens
tccaggactcca

SEQ ID NO: 3150257 - DNA, 18 bp, Homo sapiens
tccaggactccactggac

SEQ ID NO: 3150258 - DNA, 19 bp, Homo sapiens
tccaggactccactggaca

SEQ ID NO: 3150259 - DNA, 22 bp, Homo sapiens
tccaggactccactggacagac

SEQ ID NO: 3150260 - DNA, 16 bp, Homo sapiens
tccaggagagagccag

SEQ ID NO: 3150261 - DNA, 13 bp, Homo sapiens
tccaggagcctgg

SEQ ID NO: 3150262 - DNA, 15 bp, Homo sapiens
tccaggagctcagga

SEQ ID NO: 3150263 - DNA, 14 bp, Homo sapiens
tccaggatcctgca

SEQ ID NO: 3150264 - DNA, 18 bp, Homo sapiens
tccaggatcctgcaggaa

SEQ ID NO: 3150265 - DNA, 20 bp, Homo sapiens
tccaggatctccactgataa

SEQ ID NO: 3150266 - DNA, 20 bp, Homo sapiens
tccaggatctttgactgaaa

SEQ ID NO: 3150267 - DNA, 19 bp, Homo sapiens
tccaggatgctaacatcta

SEQ ID NO: 3150268 - DNA, 13 bp, Homo sapiens
tccaggcaccagg

SEQ ID NO: 3150269 - DNA, 20 bp, Homo sapiens
tccaggcacccttctttcct

SEQ ID NO: 3150270 - DNA, 21 bp, Homo sapiens
tccaggcacccttctttcctc

SEQ ID NO: 3150271 - DNA, 19 bp, Homo sapiens
tccaggccactgtggccag

SEQ ID NO: 3150272 - DNA, 21 bp, Homo sapiens
tccaggccactgtggccagag

SEQ ID NO: 3150273 - DNA, 20 bp, Homo sapiens
tccaggcccaaggctcccgg

SEQ ID NO: 3150274 - DNA, 16 bp, Homo sapiens
tccaggcccctgagga

SEQ ID NO: 3150275 - DNA, 17 bp, Homo sapiens
tccaggcccctgaggac

SEQ ID NO: 3150276 - DNA, 18 bp, Homo sapiens
tccaggcccctgaggact

SEQ ID NO: 3150277 - DNA, 15 bp, Homo sapiens
tccaggccctccagt

SEQ ID NO: 3150278 - DNA, 16 bp, Homo sapiens
tccaggccctccagtg

SEQ ID NO: 3150279 - DNA, 13 bp, Homo sapiens
tccaggccctgcc

SEQ ID NO: 3150280 - DNA, 16 bp, Homo sapiens
tccaggccctgccccc

SEQ ID NO: 3150281 - DNA, 16 bp, Homo sapiens
tccaggcctgcctccc

SEQ ID NO: 3150282 - DNA, 19 bp, Homo sapiens
tccaggcctgcctcccact

SEQ ID NO: 3150283 - DNA, 20 bp, Homo sapiens
tccaggctagtccggaccca

SEQ ID NO: 3150284 - DNA, 12 bp, Homo sapiens
tccaggctcctt

SEQ ID NO: 3150285 - DNA, 20 bp, Homo sapiens
tccaggctttgtacagagtg

SEQ ID NO: 3150286 - DNA, 17 bp, Homo sapiens
tccagggaagctggccg

SEQ ID NO: 3150287 - DNA, 23 bp, Homo sapiens
tccaggggctgcttcctcctgga

SEQ ID NO: 3150288 - DNA, 16 bp, Homo sapiens
tccagggtccctctgt

SEQ ID NO: 3150289 - DNA, 16 bp, Homo sapiens
tccagggtcttgggct

SEQ ID NO: 3150290 - DNA, 22 bp, Homo sapiens
tccagggtcttgggctactggc

SEQ ID NO: 3150291 - DNA, 16 bp, Homo sapiens
tccaggtcaggatgca

SEQ ID NO: 3150292 - DNA, 15 bp, Homo sapiens
tccaggtcatgcagt

SEQ ID NO: 3150293 - DNA, 16 bp, Homo sapiens
tccaggtgttactgta

SEQ ID NO: 3150294 - DNA, 23 bp, Homo sapiens
tccaggttcaacccacagctact

SEQ ID NO: 3150295 - DNA, 17 bp, Homo sapiens
tccaggttccctcccag

SEQ ID NO: 3150296 - DNA, 21 bp, Homo sapiens
tccagtaccataatcttagag

SEQ ID NO: 3150297 - DNA, 22 bp, Homo sapiens
tccagtaccttgcttcttactg

SEQ ID NO: 3150298 - DNA, 16 bp, Homo sapiens
tccagtattgaaaact

SEQ ID NO: 3150299 - DNA, 13 bp, Homo sapiens
tccagtattgctg

SEQ ID NO: 3150300 - DNA, 17 bp, Homo sapiens
tccagtccccctatcct

SEQ ID NO: 3150301 - DNA, 18 bp, Homo sapiens
tccagtccccctatcctt

SEQ ID NO: 3150302 - DNA, 14 bp, Homo sapiens
tccagtctcttgta

SEQ ID NO: 3150303 - DNA, 15 bp, Homo sapiens
tccagtgagtgtaaa

SEQ ID NO: 3150304 - DNA, 14 bp, Homo sapiens
tccagtgcaattgt

SEQ ID NO: 3150305 - DNA, 14 bp, Homo sapiens
tccagtgccagcaa

SEQ ID NO: 3150306 - DNA, 16 bp, Homo sapiens
tccagtgctggatttg

SEQ ID NO: 3150307 - DNA, 19 bp, Homo sapiens
tccagtgctggatttgatg

SEQ ID NO: 3150308 - DNA, 23 bp, Homo sapiens
tccagtggctcgctccctgtagc

SEQ ID NO: 3150309 - DNA, 20 bp, Homo sapiens
tccagtggctggtttctgag

SEQ ID NO: 3150310 - DNA, 13 bp, Homo sapiens
tccagtgggctga

SEQ ID NO: 3150311 - DNA, 20 bp, Homo sapiens
tccagtgtacatagtgtaat

SEQ ID NO: 3150312 - DNA, 14 bp, Homo sapiens
tccagtgtcacctc

SEQ ID NO: 3150313 - DNA, 15 bp, Homo sapiens
tccagtgtcacctct

SEQ ID NO: 3150314 - DNA, 19 bp, Homo sapiens
tccagtgtgggcttgacca

SEQ ID NO: 3150315 - DNA, 22 bp, Homo sapiens
tccagttaaggaccgtggccct

SEQ ID NO: 3150316 - DNA, 21 bp, Homo sapiens
tccagttagaaggaggttcta

SEQ ID NO: 3150317 - DNA, 21 bp, Homo sapiens
tccagttcatcgattttctat

SEQ ID NO: 3150318 - DNA, 19 bp, Homo sapiens
tccagtttgcacctgtccc

SEQ ID NO: 3150319 - DNA, 18 bp, Homo sapiens
tccagtttgttctccggg

SEQ ID NO: 3150320 - DNA, 19 bp, Homo sapiens
tccagtttgttctccgggt

SEQ ID NO: 3150321 - DNA, 17 bp, Homo sapiens
tccataaatgtgttcct

SEQ ID NO: 3150322 - DNA, 22 bp, Homo sapiens
tccataatctggactcctctgt

SEQ ID NO: 3150323 - DNA, 12 bp, Homo sapiens
tccataatgtat

SEQ ID NO: 3150324 - DNA, 12 bp, Homo sapiens
tccataattatg

SEQ ID NO: 3150325 - DNA, 17 bp, Homo sapiens
tccataattatgacagt

SEQ ID NO: 3150326 - DNA, 21 bp, Homo sapiens
tccatacagggtctcttcctt

SEQ ID NO: 3150327 - DNA, 12 bp, Homo sapiens
tccataccagct

SEQ ID NO: 3150328 - DNA, 13 bp, Homo sapiens
tccatactcagga

SEQ ID NO: 3150329 - DNA, 15 bp, Homo sapiens
tccatagcaacagga

SEQ ID NO: 3150330 - DNA, 16 bp, Homo sapiens
tccatagcaacaggaa

SEQ ID NO: 3150331 - DNA, 15 bp, Homo sapiens
tccatagtaactgac

SEQ ID NO: 3150332 - DNA, 16 bp, Homo sapiens
tccatagtaactgaca

SEQ ID NO: 3150333 - DNA, 14 bp, Homo sapiens
tccatatcttgcga

SEQ ID NO: 3150334 - DNA, 21 bp, Homo sapiens
tccatatttaacctatttcca

SEQ ID NO: 3150335 - DNA, 13 bp, Homo sapiens
tccatatttggaa

SEQ ID NO: 3150336 - DNA, 15 bp, Homo sapiens
tccatatttggaaga

SEQ ID NO: 3150337 - DNA, 18 bp, Homo sapiens
tccatattttcacaggtg

SEQ ID NO: 3150338 - DNA, 23 bp, Homo sapiens
tccatcaataaatgctctatttt

SEQ ID NO: 3150339 - DNA, 19 bp, Homo sapiens
tccatcaccctttccggca

SEQ ID NO: 3150340 - DNA, 21 bp, Homo sapiens
tccatcaggtgaggtgtgctc

SEQ ID NO: 3150341 - DNA, 21 bp, Homo sapiens
tccatcatatgcctgacccct

SEQ ID NO: 3150342 - DNA, 22 bp, Homo sapiens
tccatcatttctgtctttaaga

SEQ ID NO: 3150343 - DNA, 13 bp, Homo sapiens
tccatcattttac

SEQ ID NO: 3150344 - DNA, 18 bp, Homo sapiens
tccatcattttacagtga

SEQ ID NO: 3150345 - DNA, 21 bp, Homo sapiens
tccatccaaggccaggttctc

SEQ ID NO: 3150346 - DNA, 18 bp, Homo sapiens
tccatcccaaccagtgcc

SEQ ID NO: 3150347 - DNA, 21 bp, Homo sapiens
tccatcccaaccagtgccaag

SEQ ID NO: 3150348 - DNA, 15 bp, Homo sapiens
tccatcccaggacac

SEQ ID NO: 3150349 - DNA, 22 bp, Homo sapiens
tccatcccaggacaccacaccc

SEQ ID NO: 3150350 - DNA, 14 bp, Homo sapiens
tccatcccatcatc

SEQ ID NO: 3150351 - DNA, 20 bp, Homo sapiens
tccatcccgaaaatctctcg

SEQ ID NO: 3150352 - DNA, 22 bp, Homo sapiens
tccatccctaccccctaagagc

SEQ ID NO: 3150353 - DNA, 20 bp, Homo sapiens
tccatccctggccccctccc

SEQ ID NO: 3150354 - DNA, 22 bp, Homo sapiens
tccatccctggccccctccctg

SEQ ID NO: 3150355 - DNA, 24 bp, Homo sapiens
tccatccctggccccctccctgga

SEQ ID NO: 3150356 - DNA, 16 bp, Homo sapiens
tccatcccttttcctg

SEQ ID NO: 3150357 - DNA, 20 bp, Homo sapiens
tccatcccttttcctgtcag

SEQ ID NO: 3150358 - DNA, 23 bp, Homo sapiens
tccatcccttttcctgtcagtgt

SEQ ID NO: 3150359 - DNA, 12 bp, Homo sapiens
tccatcctgagg

SEQ ID NO: 3150360 - DNA, 19 bp, Homo sapiens
tccatcctgaggctccact

SEQ ID NO: 3150361 - DNA, 14 bp, Homo sapiens
tccatctctggtaa

SEQ ID NO: 3150362 - DNA, 21 bp, Homo sapiens
tccatcttctccccacagcct

SEQ ID NO: 3150363 - DNA, 11 bp, Homo sapiens
tccatgaaaac

SEQ ID NO: 3150364 - DNA, 15 bp, Homo sapiens
tccatgaaaacgttt

SEQ ID NO: 3150365 - DNA, 19 bp, Homo sapiens
tccatgaaaacgttttatt

SEQ ID NO: 3150366 - DNA, 22 bp, Homo sapiens
tccatgaaaacgttttattgtg

SEQ ID NO: 3150367 - DNA, 15 bp, Homo sapiens
tccatgaaggcagag

SEQ ID NO: 3150368 - DNA, 14 bp, Homo sapiens
tccatgaatgtatc

SEQ ID NO: 3150369 - DNA, 21 bp, Homo sapiens
tccatgaatgtatcaggaaat

SEQ ID NO: 3150370 - DNA, 19 bp, Homo sapiens
tccatgactggctgtctgc

SEQ ID NO: 3150371 - DNA, 22 bp, Homo sapiens
tccatgagttatcatgaatttt

SEQ ID NO: 3150372 - DNA, 18 bp, Homo sapiens
tccatgagtttgccctgg

SEQ ID NO: 3150373 - DNA, 18 bp, Homo sapiens
tccatgattctctgagtg

SEQ ID NO: 3150374 - DNA, 14 bp, Homo sapiens
tccatgcaccaaac

SEQ ID NO: 3150375 - DNA, 19 bp, Homo sapiens
tccatgcagactcctcaga

SEQ ID NO: 3150376 - DNA, 18 bp, Homo sapiens
tccatgcctctggaggcc

SEQ ID NO: 3150377 - DNA, 16 bp, Homo sapiens
tccatgcctgagggtg

SEQ ID NO: 3150378 - DNA, 21 bp, Homo sapiens
tccatgcctgtagctttcctg

SEQ ID NO: 3150379 - DNA, 13 bp, Homo sapiens
tccatgctcctca

SEQ ID NO: 3150380 - DNA, 15 bp, Homo sapiens
tccatgctgcctcca

SEQ ID NO: 3150381 - DNA, 23 bp, Homo sapiens
tccatgcttctcatcttgtgaaa

SEQ ID NO: 3150382 - DNA, 16 bp, Homo sapiens
tccatggcaattttgt

SEQ ID NO: 3150383 - DNA, 14 bp, Homo sapiens
tccatggcaccagc

SEQ ID NO: 3150384 - DNA, 20 bp, Homo sapiens
tccatgtactgtagtttttc

SEQ ID NO: 3150385 - DNA, 14 bp, Homo sapiens
tccatgtacttgtt

SEQ ID NO: 3150386 - DNA, 17 bp, Homo sapiens
tccatgtacttgtttgc

SEQ ID NO: 3150387 - DNA, 17 bp, Homo sapiens
tccatgtcctatgtgtg

SEQ ID NO: 3150388 - DNA, 17 bp, Homo sapiens
tccatgtcgcctctgca

SEQ ID NO: 3150389 - DNA, 13 bp, Homo sapiens
tccatgtggagaa

SEQ ID NO: 3150390 - DNA, 22 bp, Homo sapiens
tccatgtggagaaaggagtgaa

SEQ ID NO: 3150391 - DNA, 18 bp, Homo sapiens
tccatgtggttcttcaaa

SEQ ID NO: 3150392 - DNA, 17 bp, Homo sapiens
tccatgtgtggactcaa

SEQ ID NO: 3150393 - DNA, 19 bp, Homo sapiens
tccatgttagtttttactt

SEQ ID NO: 3150394 - DNA, 16 bp, Homo sapiens
tccatgtttgtaaaac

SEQ ID NO: 3150395 - DNA, 20 bp, Homo sapiens
tccattaacttagcatgtgt

SEQ ID NO: 3150396 - DNA, 14 bp, Homo sapiens
tccattaggccagc

SEQ ID NO: 3150397 - DNA, 17 bp, Homo sapiens
tccattaggccagcaac

SEQ ID NO: 3150398 - DNA, 15 bp, Homo sapiens
tccattatttatatt

SEQ ID NO: 3150399 - DNA, 15 bp, Homo sapiens
tccattattttgtat

SEQ ID NO: 3150400 - DNA, 15 bp, Homo sapiens
tccattcacaagcct

SEQ ID NO: 3150401 - DNA, 20 bp, Homo sapiens
tccattcacaagcctcctgt

SEQ ID NO: 3150402 - DNA, 12 bp, Homo sapiens
tccattctcatt

SEQ ID NO: 3150403 - DNA, 14 bp, Homo sapiens
tccattctcccagg

SEQ ID NO: 3150404 - DNA, 21 bp, Homo sapiens
tccattgaagccgactctggc

SEQ ID NO: 3150405 - DNA, 22 bp, Homo sapiens
tccattgaagccgactctggcc

SEQ ID NO: 3150406 - DNA, 15 bp, Homo sapiens
tccattggtccaaga

SEQ ID NO: 3150407 - DNA, 22 bp, Homo sapiens
tccattggtccaagattccgga

SEQ ID NO: 3150408 - DNA, 15 bp, Homo sapiens
tccattgtttaaaga

SEQ ID NO: 3150409 - DNA, 18 bp, Homo sapiens
tccatttacagtctcttt

SEQ ID NO: 3150410 - DNA, 19 bp, Homo sapiens
tccatttacagtctctttc

SEQ ID NO: 3150411 - DNA, 19 bp, Homo sapiens
tccatttccattgcttatt

SEQ ID NO: 3150412 - DNA, 12 bp, Homo sapiens
tccatttctgat

SEQ ID NO: 3150413 - DNA, 13 bp, Homo sapiens
tccatttgccttt

SEQ ID NO: 3150414 - DNA, 13 bp, Homo sapiens
tccattttatgca

SEQ ID NO: 3150415 - DNA, 15 bp, Homo sapiens
tccatttttcctctg

SEQ ID NO: 3150416 - DNA, 16 bp, Homo sapiens
tccatttttcctctgt

SEQ ID NO: 3150417 - DNA, 22 bp, Homo sapiens
tcccaaacgccctttcctcctc

SEQ ID NO: 3150418 - DNA, 18 bp, Homo sapiens
tcccaaaggtaagtctga

SEQ ID NO: 3150419 - DNA, 18 bp, Homo sapiens
tcccaaagtgctgagatt

SEQ ID NO: 3150420 - DNA, 19 bp, Homo sapiens
tcccaaagtgctgagatta

SEQ ID NO: 3150421 - DNA, 23 bp, Homo sapiens
tcccaaagtgctgagattacagg

SEQ ID NO: 3150422 - DNA, 14 bp, Homo sapiens
tcccaaagtgctgg

SEQ ID NO: 3150423 - DNA, 17 bp, Homo sapiens
tcccaaatttgattgat

SEQ ID NO: 3150424 - DNA, 14 bp, Homo sapiens
tcccaacccccctc

SEQ ID NO: 3150425 - DNA, 21 bp, Homo sapiens
tcccaacccccctcctgctcc

SEQ ID NO: 3150426 - DNA, 12 bp, Homo sapiens
tcccaagctctg

SEQ ID NO: 3150427 - DNA, 13 bp, Homo sapiens
tcccaagctctgc

SEQ ID NO: 3150428 - DNA, 21 bp, Homo sapiens
tcccaaggacttccacatttt

SEQ ID NO: 3150429 - DNA, 22 bp, Homo sapiens
tcccaaggacttccacattttt

SEQ ID NO: 3150430 - DNA, 15 bp, Homo sapiens
tcccaagtagctggg

SEQ ID NO: 3150431 - DNA, 21 bp, Homo sapiens
tcccaagtagctgggattaca

SEQ ID NO: 3150432 - DNA, 16 bp, Homo sapiens
tcccaagtcagacaga

SEQ ID NO: 3150433 - DNA, 17 bp, Homo sapiens
tcccaagtcagacagat

SEQ ID NO: 3150434 - DNA, 21 bp, Homo sapiens
tcccaagtttccatagcaaca

SEQ ID NO: 3150435 - DNA, 19 bp, Homo sapiens
tcccaatcaaagaattaca

SEQ ID NO: 3150436 - DNA, 20 bp, Homo sapiens
tcccaatcaaagaattacag

SEQ ID NO: 3150437 - DNA, 15 bp, Homo sapiens
tcccaatcttaccag

SEQ ID NO: 3150438 - DNA, 20 bp, Homo sapiens
tcccaattagcttggcctac

SEQ ID NO: 3150439 - DNA, 21 bp, Homo sapiens
tcccacaagtatatactttta

SEQ ID NO: 3150440 - DNA, 17 bp, Homo sapiens
tcccacaggcccttcct

SEQ ID NO: 3150441 - DNA, 23 bp, Homo sapiens
tcccacatccaactccagcaact

SEQ ID NO: 3150442 - DNA, 13 bp, Homo sapiens
tcccacatctttc

SEQ ID NO: 3150443 - DNA, 10 bp, Homo sapiens
tcccaccacc

SEQ ID NO: 3150444 - DNA, 16 bp, Homo sapiens
tcccaccattcctgcc

SEQ ID NO: 3150445 - DNA, 16 bp, Homo sapiens
tcccacccacatgtga

SEQ ID NO: 3150446 - DNA, 22 bp, Homo sapiens
tcccacccacatgtgacacata

SEQ ID NO: 3150447 - DNA, 11 bp, Homo sapiens
tcccacccacc

SEQ ID NO: 3150448 - DNA, 20 bp, Homo sapiens
tcccacccccacccccagct

SEQ ID NO: 3150449 - DNA, 23 bp, Homo sapiens
tcccacccccacccccagctcaa

SEQ ID NO: 3150450 - DNA, 20 bp, Homo sapiens
tcccacccccttctctgctc

SEQ ID NO: 3150451 - DNA, 22 bp, Homo sapiens
tcccacccccttctctgctcca

SEQ ID NO: 3150452 - DNA, 17 bp, Homo sapiens
tcccaccccggcctcca

SEQ ID NO: 3150453 - DNA, 19 bp, Homo sapiens
tcccaccccggcctccact

SEQ ID NO: 3150454 - DNA, 15 bp, Homo sapiens
tcccacccgatgctg

SEQ ID NO: 3150455 - DNA, 17 bp, Homo sapiens
tcccacccgatgctgct

SEQ ID NO: 3150456 - DNA, 12 bp, Homo sapiens
tcccaccctgta

SEQ ID NO: 3150457 - DNA, 19 bp, Homo sapiens
tcccaccgcccccacccct

SEQ ID NO: 3150458 - DNA, 12 bp, Homo sapiens
tcccaccgggag

SEQ ID NO: 3150459 - DNA, 18 bp, Homo sapiens
tcccaccgggagcctccc

SEQ ID NO: 3150460 - DNA, 16 bp, Homo sapiens
tcccacctagcccagg

SEQ ID NO: 3150461 - DNA, 13 bp, Homo sapiens
tcccacctcagcc

SEQ ID NO: 3150462 - DNA, 15 bp, Homo sapiens
tcccacctcagcctc

SEQ ID NO: 3150463 - DNA, 22 bp, Homo sapiens
tcccacctccagcccgggagcc

SEQ ID NO: 3150464 - DNA, 14 bp, Homo sapiens
tcccacctccagtc

SEQ ID NO: 3150465 - DNA, 15 bp, Homo sapiens
tcccacctccatccc

SEQ ID NO: 3150466 - DNA, 17 bp, Homo sapiens
tcccacctccctgccca

SEQ ID NO: 3150467 - DNA, 19 bp, Homo sapiens
tcccacctccctgcccagg

SEQ ID NO: 3150468 - DNA, 20 bp, Homo sapiens
tcccacctccctgcccaggc

SEQ ID NO: 3150469 - DNA, 15 bp, Homo sapiens
tcccacctctccttt

SEQ ID NO: 3150470 - DNA, 20 bp, Homo sapiens
tcccacctctgtgacctcag

SEQ ID NO: 3150471 - DNA, 21 bp, Homo sapiens
tcccacctctgtgacctcagg

SEQ ID NO: 3150472 - DNA, 13 bp, Homo sapiens
tcccacctgacac

SEQ ID NO: 3150473 - DNA, 19 bp, Homo sapiens
tcccaccttggctgcaggg

SEQ ID NO: 3150474 - DNA, 20 bp, Homo sapiens
tcccacctttcgggccatgt

SEQ ID NO: 3150475 - DNA, 21 bp, Homo sapiens
tcccacgaatttgctggggaa

SEQ ID NO: 3150476 - DNA, 16 bp, Homo sapiens
tcccacgtctggccag

SEQ ID NO: 3150477 - DNA, 17 bp, Homo sapiens
tcccacgtgtcttccac

SEQ ID NO: 3150478 - DNA, 14 bp, Homo sapiens
tcccactcttgaag

SEQ ID NO: 3150479 - DNA, 16 bp, Homo sapiens
tcccactcttgaagag

SEQ ID NO: 3150480 - DNA, 17 bp, Homo sapiens
tcccactcttgaagagg

SEQ ID NO: 3150481 - DNA, 14 bp, Homo sapiens
tcccactgcctcag

SEQ ID NO: 3150482 - DNA, 16 bp, Homo sapiens
tcccacttagccgcac

SEQ ID NO: 3150483 - DNA, 22 bp, Homo sapiens
tcccacttagccgcaccctgca

SEQ ID NO: 3150484 - DNA, 16 bp, Homo sapiens
tcccacttctcatctt

SEQ ID NO: 3150485 - DNA, 12 bp, Homo sapiens
tcccacttgtca

SEQ ID NO: 3150486 - DNA, 22 bp, Homo sapiens
tcccagaaaaccagtctgtgtt

SEQ ID NO: 3150487 - DNA, 12 bp, Homo sapiens
tcccagaaatta

SEQ ID NO: 3150488 - DNA, 14 bp, Homo sapiens
tcccagaatcccag

SEQ ID NO: 3150489 - DNA, 16 bp, Homo sapiens
tcccagaatcccagcc

SEQ ID NO: 3150490 - DNA, 18 bp, Homo sapiens
tcccagaatcccagccgg

SEQ ID NO: 3150491 - DNA, 19 bp, Homo sapiens
tcccagaatcccagccggc

SEQ ID NO: 3150492 - DNA, 19 bp, Homo sapiens
tcccagaattgtatctcat

SEQ ID NO: 3150493 - DNA, 15 bp, Homo sapiens
tcccagagcacctca

SEQ ID NO: 3150494 - DNA, 16 bp, Homo sapiens
tcccagaggagccacc

SEQ ID NO: 3150495 - DNA, 21 bp, Homo sapiens
tcccagaggagccaccagttc

SEQ ID NO: 3150496 - DNA, 23 bp, Homo sapiens
tcccagaggagccaccagttctc

SEQ ID NO: 3150497 - DNA, 13 bp, Homo sapiens
tcccagaggcaga

SEQ ID NO: 3150498 - DNA, 17 bp, Homo sapiens
tcccagagggagcaggc

SEQ ID NO: 3150499 - DNA, 17 bp, Homo sapiens
tcccagaggtccagccc

SEQ ID NO: 3150500 - DNA, 19 bp, Homo sapiens
tcccagaggtccagcccat

SEQ ID NO: 3150501 - DNA, 21 bp, Homo sapiens
tcccagaggtgggatcctccc

SEQ ID NO: 3150502 - DNA, 21 bp, Homo sapiens
tcccagaggttatctgcctgg

SEQ ID NO: 3150503 - DNA, 24 bp, Homo sapiens
tcccagaggttatctgcctggcct

SEQ ID NO: 3150504 - DNA, 14 bp, Homo sapiens
tcccagagtcagag

SEQ ID NO: 3150505 - DNA, 19 bp, Homo sapiens
tcccagagtcagaggagaa

SEQ ID NO: 3150506 - DNA, 20 bp, Homo sapiens
tcccagagtcagaggagaag

SEQ ID NO: 3150507 - DNA, 15 bp, Homo sapiens
tcccagagtgctggg

SEQ ID NO: 3150508 - DNA, 15 bp, Homo sapiens
tcccagcacctgcct

SEQ ID NO: 3150509 - DNA, 17 bp, Homo sapiens
tcccagcactccccttg

SEQ ID NO: 3150510 - DNA, 23 bp, Homo sapiens
tcccagcactccccttgccttcc

SEQ ID NO: 3150511 - DNA, 13 bp, Homo sapiens
tcccagcagccct

SEQ ID NO: 3150512 - DNA, 21 bp, Homo sapiens
tcccagcagccctaaggatct

SEQ ID NO: 3150513 - DNA, 15 bp, Homo sapiens
tcccagcatccctgg

SEQ ID NO: 3150514 - DNA, 13 bp, Homo sapiens
tcccagccatgcc

SEQ ID NO: 3150515 - DNA, 17 bp, Homo sapiens
tcccagccctatggatg

SEQ ID NO: 3150516 - DNA, 12 bp, Homo sapiens
tcccagcctgct

SEQ ID NO: 3150517 - DNA, 18 bp, Homo sapiens
tcccagcctgctgagagc

SEQ ID NO: 3150518 - DNA, 24 bp, Homo sapiens
tcccagcctggggctccctctctg

SEQ ID NO: 3150519 - DNA, 20 bp, Homo sapiens
tcccagcgtgtgtatccgac

SEQ ID NO: 3150520 - DNA, 24 bp, Homo sapiens
tcccagcgtttagtttctagaggc

SEQ ID NO: 3150521 - DNA, 21 bp, Homo sapiens
tcccagctactcagaagcctg

SEQ ID NO: 3150522 - DNA, 16 bp, Homo sapiens
tcccagctacttggga

SEQ ID NO: 3150523 - DNA, 17 bp, Homo sapiens
tcccagctacttgggag

SEQ ID NO: 3150524 - DNA, 19 bp, Homo sapiens
tcccagctacttgggaggc

SEQ ID NO: 3150525 - DNA, 20 bp, Homo sapiens
tcccagctaggaagagcagg

SEQ ID NO: 3150526 - DNA, 23 bp, Homo sapiens
tcccagctaggaagagcaggact

SEQ ID NO: 3150527 - DNA, 20 bp, Homo sapiens
tcccagctccccccgcccac

SEQ ID NO: 3150528 - DNA, 15 bp, Homo sapiens
tcccagctcctttct

SEQ ID NO: 3150529 - DNA, 23 bp, Homo sapiens
tcccagctcctttctcctgtgaa

SEQ ID NO: 3150530 - DNA, 13 bp, Homo sapiens
tcccagctgtgct

SEQ ID NO: 3150531 - DNA, 20 bp, Homo sapiens
tcccagctgtgctctggaca

SEQ ID NO: 3150532 - DNA, 21 bp, Homo sapiens
tcccagctgtgctctggacag

SEQ ID NO: 3150533 - DNA, 17 bp, Homo sapiens
tcccagctgtgctgtgg

SEQ ID NO: 3150534 - DNA, 16 bp, Homo sapiens
tcccaggaactgggcc

SEQ ID NO: 3150535 - DNA, 18 bp, Homo sapiens
tcccaggatgctgggtgg

SEQ ID NO: 3150536 - DNA, 12 bp, Homo sapiens
tcccaggccagg

SEQ ID NO: 3150537 - DNA, 14 bp, Homo sapiens
tcccagggaaggac

SEQ ID NO: 3150538 - DNA, 20 bp, Homo sapiens
tcccagggaaggacttggag

SEQ ID NO: 3150539 - DNA, 16 bp, Homo sapiens
tcccagggccagggcc

SEQ ID NO: 3150540 - DNA, 22 bp, Homo sapiens
tcccagggccagggccctgcag

SEQ ID NO: 3150541 - DNA, 23 bp, Homo sapiens
tcccagggccagggccctgcaga

SEQ ID NO: 3150542 - DNA, 11 bp, Homo sapiens
tcccagggctg

SEQ ID NO: 3150543 - DNA, 14 bp, Homo sapiens
tcccagggctggct

SEQ ID NO: 3150544 - DNA, 18 bp, Homo sapiens
tcccaggggaccacacct

SEQ ID NO: 3150545 - DNA, 18 bp, Homo sapiens
tcccaggggtctccctgg

SEQ ID NO: 3150546 - DNA, 22 bp, Homo sapiens
tcccaggggtctccctggctcc

SEQ ID NO: 3150547 - DNA, 18 bp, Homo sapiens
tcccaggtaccagctgcg

SEQ ID NO: 3150548 - DNA, 21 bp, Homo sapiens
tcccaggtgttaacattccaa

SEQ ID NO: 3150549 - DNA, 22 bp, Homo sapiens
tcccaggtgttaacattccaag

SEQ ID NO: 3150550 - DNA, 16 bp, Homo sapiens
tcccagtatacctcat

SEQ ID NO: 3150551 - DNA, 15 bp, Homo sapiens
tcccagtgacacttc

SEQ ID NO: 3150552 - DNA, 19 bp, Homo sapiens
tcccagtgacacttcagag

SEQ ID NO: 3150553 - DNA, 20 bp, Homo sapiens
tcccagtgacacttcagaga

SEQ ID NO: 3150554 - DNA, 22 bp, Homo sapiens
tcccagtgacacttcagagagc

SEQ ID NO: 3150555 - DNA, 20 bp, Homo sapiens
tcccagtgggaggggcaggc

SEQ ID NO: 3150556 - DNA, 21 bp, Homo sapiens
tcccagtgggaggggcaggct

SEQ ID NO: 3150557 - DNA, 14 bp, Homo sapiens
tcccatcaaaactc

SEQ ID NO: 3150558 - DNA, 22 bp, Homo sapiens
tcccatcattacccttccctgc

SEQ ID NO: 3150559 - DNA, 18 bp, Homo sapiens
tcccatccccctgccctc

SEQ ID NO: 3150560 - DNA, 14 bp, Homo sapiens
tcccatcctaccct

SEQ ID NO: 3150561 - DNA, 13 bp, Homo sapiens
tcccatcctgggg

SEQ ID NO: 3150562 - DNA, 13 bp, Homo sapiens
tcccatctgggag

SEQ ID NO: 3150563 - DNA, 14 bp, Homo sapiens
tcccatctgggagt

SEQ ID NO: 3150564 - DNA, 23 bp, Homo sapiens
tcccatctgggagtccccttttc

SEQ ID NO: 3150565 - DNA, 14 bp, Homo sapiens
tcccatgacccacc

SEQ ID NO: 3150566 - DNA, 16 bp, Homo sapiens
tcccatgacccacccc

SEQ ID NO: 3150567 - DNA, 20 bp, Homo sapiens
tcccatgacccacccctgtg

SEQ ID NO: 3150568 - DNA, 22 bp, Homo sapiens
tcccatgacccacccctgtgct

SEQ ID NO: 3150569 - DNA, 15 bp, Homo sapiens
tcccatgactgcacc

SEQ ID NO: 3150570 - DNA, 20 bp, Homo sapiens
tcccatgactgcacccagct

SEQ ID NO: 3150571 - DNA, 23 bp, Homo sapiens
tcccatgactgcacccagctcca

SEQ ID NO: 3150572 - DNA, 21 bp, Homo sapiens
tcccatgagaccctggtgcct

SEQ ID NO: 3150573 - DNA, 22 bp, Homo sapiens
tcccatgagaccctggtgcctg

SEQ ID NO: 3150574 - DNA, 15 bp, Homo sapiens
tcccatgatccctgt

SEQ ID NO: 3150575 - DNA, 19 bp, Homo sapiens
tcccatgatccctgtgttg

SEQ ID NO: 3150576 - DNA, 13 bp, Homo sapiens
tcccatgcctggt

SEQ ID NO: 3150577 - DNA, 16 bp, Homo sapiens
tcccatgcctggtccc

SEQ ID NO: 3150578 - DNA, 12 bp, Homo sapiens
tcccatgcctgt

SEQ ID NO: 3150579 - DNA, 14 bp, Homo sapiens
tcccatggacactc

SEQ ID NO: 3150580 - DNA, 21 bp, Homo sapiens
tcccatggacactccagtgcc

SEQ ID NO: 3150581 - DNA, 22 bp, Homo sapiens
tcccatggacactccagtgcca

SEQ ID NO: 3150582 - DNA, 23 bp, Homo sapiens
tcccatgggcagaggaccaggct

SEQ ID NO: 3150583 - DNA, 14 bp, Homo sapiens
tcccatggggaggg

SEQ ID NO: 3150584 - DNA, 15 bp, Homo sapiens
tcccatgtagccccc

SEQ ID NO: 3150585 - DNA, 21 bp, Homo sapiens
tcccatgtggcttgtttgcct

SEQ ID NO: 3150586 - DNA, 20 bp, Homo sapiens
tcccattaatcatttcccca

SEQ ID NO: 3150587 - DNA, 23 bp, Homo sapiens
tcccattaggacaatcagtcccc

SEQ ID NO: 3150588 - DNA, 13 bp, Homo sapiens
tcccatttcagct

SEQ ID NO: 3150589 - DNA, 14 bp, Homo sapiens
tcccatttcaggaa

SEQ ID NO: 3150590 - DNA, 17 bp, Homo sapiens
tcccatttgtgccagag

SEQ ID NO: 3150591 - DNA, 19 bp, Homo sapiens
tcccattttggaagttttc

SEQ ID NO: 3150592 - DNA, 18 bp, Homo sapiens
tccccaaaccataaaacc

SEQ ID NO: 3150593 - DNA, 20 bp, Homo sapiens
tccccaaagtaccacactga

SEQ ID NO: 3150594 - DNA, 23 bp, Homo sapiens
tccccaaatcaatacactagttg

SEQ ID NO: 3150595 - DNA, 23 bp, Homo sapiens
tccccaacagcgacatagcccat

SEQ ID NO: 3150596 - DNA, 18 bp, Homo sapiens
tccccaacttccctagtc

SEQ ID NO: 3150597 - DNA, 20 bp, Homo sapiens
tccccaagggccctggcacc

SEQ ID NO: 3150598 - DNA, 14 bp, Homo sapiens
tccccaatcagctc

SEQ ID NO: 3150599 - DNA, 22 bp, Homo sapiens
tccccaattacagggtgactca

SEQ ID NO: 3150600 - DNA, 16 bp, Homo sapiens
tccccacagcctctgg

SEQ ID NO: 3150601 - DNA, 12 bp, Homo sapiens
tccccaccagct

SEQ ID NO: 3150602 - DNA, 15 bp, Homo sapiens
tccccaccctccact

SEQ ID NO: 3150603 - DNA, 16 bp, Homo sapiens
tccccaccctccactc

SEQ ID NO: 3150604 - DNA, 19 bp, Homo sapiens
tccccaccctccactcagc

SEQ ID NO: 3150605 - DNA, 20 bp, Homo sapiens
tccccaccctcctcttggaa

SEQ ID NO: 3150606 - DNA, 18 bp, Homo sapiens
tccccaccttcaattcct

SEQ ID NO: 3150607 - DNA, 22 bp, Homo sapiens
tccccaccttcaattcctgggc

SEQ ID NO: 3150608 - DNA, 20 bp, Homo sapiens
tccccaccttcacctcggag

SEQ ID NO: 3150609 - DNA, 20 bp, Homo sapiens
tccccacgagtcacctgcaa

SEQ ID NO: 3150610 - DNA, 19 bp, Homo sapiens
tccccacgccctcccctcc

SEQ ID NO: 3150611 - DNA, 19 bp, Homo sapiens
tccccacggccgctccagg

SEQ ID NO: 3150612 - DNA, 20 bp, Homo sapiens
tccccacggccgctccaggg

SEQ ID NO: 3150613 - DNA, 13 bp, Homo sapiens
tccccactccctt

SEQ ID NO: 3150614 - DNA, 16 bp, Homo sapiens
tccccactcccttggt

SEQ ID NO: 3150615 - DNA, 18 bp, Homo sapiens
tccccactcctctcccac

SEQ ID NO: 3150616 - DNA, 19 bp, Homo sapiens
tccccactgacagcctccc

SEQ ID NO: 3150617 - DNA, 19 bp, Homo sapiens
tccccacttgcagccctgt

SEQ ID NO: 3150618 - DNA, 17 bp, Homo sapiens
tccccagaaaggagact

SEQ ID NO: 3150619 - DNA, 14 bp, Homo sapiens
tccccagactcagc

SEQ ID NO: 3150620 - DNA, 15 bp, Homo sapiens
tccccagactcagct

SEQ ID NO: 3150621 - DNA, 14 bp, Homo sapiens
tccccagagctgtg

SEQ ID NO: 3150622 - DNA, 16 bp, Homo sapiens
tccccagagctgtgcc

SEQ ID NO: 3150623 - DNA, 19 bp, Homo sapiens
tccccagattgcaacaggc

SEQ ID NO: 3150624 - DNA, 22 bp, Homo sapiens
tccccagattgcaacaggctgg

SEQ ID NO: 3150625 - DNA, 23 bp, Homo sapiens
tccccagattgcaacaggctggg

SEQ ID NO: 3150626 - DNA, 20 bp, Homo sapiens
tccccagcaagtgagagctg

SEQ ID NO: 3150627 - DNA, 22 bp, Homo sapiens
tccccagcaagtgagagctggg

SEQ ID NO: 3150628 - DNA, 18 bp, Homo sapiens
tccccagcatcactcccc

SEQ ID NO: 3150629 - DNA, 19 bp, Homo sapiens
tccccagcatcactcccca

SEQ ID NO: 3150630 - DNA, 12 bp, Homo sapiens
tccccagcccag

SEQ ID NO: 3150631 - DNA, 13 bp, Homo sapiens
tccccagccccta

SEQ ID NO: 3150632 - DNA, 19 bp, Homo sapiens
tccccagcccctagcccag

SEQ ID NO: 3150633 - DNA, 22 bp, Homo sapiens
tccccagccctgtcctggttcc

SEQ ID NO: 3150634 - DNA, 13 bp, Homo sapiens
tccccagcccttc

SEQ ID NO: 3150635 - DNA, 14 bp, Homo sapiens
tccccagcccttct

SEQ ID NO: 3150636 - DNA, 17 bp, Homo sapiens
tccccagcccttctgcc

SEQ ID NO: 3150637 - DNA, 19 bp, Homo sapiens
tccccagcccttctgcctt

SEQ ID NO: 3150638 - DNA, 16 bp, Homo sapiens
tccccaggcacctcac

SEQ ID NO: 3150639 - DNA, 15 bp, Homo sapiens
tccccaggcctccag

SEQ ID NO: 3150640 - DNA, 16 bp, Homo sapiens
tccccaggcctccagc

SEQ ID NO: 3150641 - DNA, 17 bp, Homo sapiens
tccccaggcctccagcc

SEQ ID NO: 3150642 - DNA, 19 bp, Homo sapiens
tccccaggcctccagcctc

SEQ ID NO: 3150643 - DNA, 11 bp, Homo sapiens
tccccagggcc

SEQ ID NO: 3150644 - DNA, 13 bp, Homo sapiens
tccccagggctcc

SEQ ID NO: 3150645 - DNA, 20 bp, Homo sapiens
tccccaggggtcccagccac

SEQ ID NO: 3150646 - DNA, 23 bp, Homo sapiens
tccccaggggtcccagccacccc

SEQ ID NO: 3150647 - DNA, 15 bp, Homo sapiens
tccccaggtccagct

SEQ ID NO: 3150648 - DNA, 15 bp, Homo sapiens
tccccatatccaagt

SEQ ID NO: 3150649 - DNA, 14 bp, Homo sapiens
tccccatcctccag

SEQ ID NO: 3150650 - DNA, 18 bp, Homo sapiens
tccccatcctccagcttc

SEQ ID NO: 3150651 - DNA, 14 bp, Homo sapiens
tccccatctccctg

SEQ ID NO: 3150652 - DNA, 16 bp, Homo sapiens
tccccatctgccacag

SEQ ID NO: 3150653 - DNA, 14 bp, Homo sapiens
tccccatcttctaa

SEQ ID NO: 3150654 - DNA, 20 bp, Homo sapiens
tccccatgccacgttccaca

SEQ ID NO: 3150655 - DNA, 13 bp, Homo sapiens
tccccatggagcc

SEQ ID NO: 3150656 - DNA, 16 bp, Homo sapiens
tccccatggagccagc

SEQ ID NO: 3150657 - DNA, 14 bp, Homo sapiens
tccccattcttcct

SEQ ID NO: 3150658 - DNA, 17 bp, Homo sapiens
tccccattcttcctagt

SEQ ID NO: 3150659 - DNA, 22 bp, Homo sapiens
tccccattcttcctagttttct

SEQ ID NO: 3150660 - DNA, 17 bp, Homo sapiens
tccccatttcccatctg

SEQ ID NO: 3150661 - DNA, 17 bp, Homo sapiens
tcccccaacccacctct

SEQ ID NO: 3150662 - DNA, 15 bp, Homo sapiens
tcccccaacccccac

SEQ ID NO: 3150663 - DNA, 17 bp, Homo sapiens
tcccccaacccccaccc

SEQ ID NO: 3150664 - DNA, 22 bp, Homo sapiens
tcccccaacccccaccccacac

SEQ ID NO: 3150665 - DNA, 17 bp, Homo sapiens
tcccccaacctcagact

SEQ ID NO: 3150666 - DNA, 17 bp, Homo sapiens
tcccccaccccttaggc

SEQ ID NO: 3150667 - DNA, 18 bp, Homo sapiens
tcccccaccccttaggcc

SEQ ID NO: 3150668 - DNA, 23 bp, Homo sapiens
tcccccaccggtccagctggcct

SEQ ID NO: 3150669 - DNA, 23 bp, Homo sapiens
tcccccacctgacaatggcagct

SEQ ID NO: 3150670 - DNA, 18 bp, Homo sapiens
tcccccactactgcagca

SEQ ID NO: 3150671 - DNA, 12 bp, Homo sapiens
tcccccagcctc

SEQ ID NO: 3150672 - DNA, 18 bp, Homo sapiens
tcccccagctctggtgag

SEQ ID NO: 3150673 - DNA, 20 bp, Homo sapiens
tcccccagggaatcagggac

SEQ ID NO: 3150674 - DNA, 16 bp, Homo sapiens
tcccccatcatgtggc

SEQ ID NO: 3150675 - DNA, 17 bp, Homo sapiens
tcccccatgtggctgaa

SEQ ID NO: 3150676 - DNA, 12 bp, Homo sapiens
tccccccatctt

SEQ ID NO: 3150677 - DNA, 22 bp, Homo sapiens
tccccccatcttgcttccctaa

SEQ ID NO: 3150678 - DNA, 15 bp, Homo sapiens
tcccccccagcctgg

SEQ ID NO: 3150679 - DNA, 17 bp, Homo sapiens
tcccccccctgtatagt

SEQ ID NO: 3150680 - DNA, 16 bp, Homo sapiens
tccccccgcccaccca

SEQ ID NO: 3150681 - DNA, 19 bp, Homo sapiens
tccccccgcccacccacgc

SEQ ID NO: 3150682 - DNA, 13 bp, Homo sapiens
tcccccgagctct

SEQ ID NO: 3150683 - DNA, 22 bp, Homo sapiens
tcccccgcagtccccagccctt

SEQ ID NO: 3150684 - DNA, 12 bp, Homo sapiens
tccccctaccca

SEQ ID NO: 3150685 - DNA, 16 bp, Homo sapiens
tccccctacccaccga

SEQ ID NO: 3150686 - DNA, 20 bp, Homo sapiens
tccccctatttattgacttt

SEQ ID NO: 3150687 - DNA, 22 bp, Homo sapiens
tccccctcagatgatctctcca

SEQ ID NO: 3150688 - DNA, 18 bp, Homo sapiens
tccccctcccagggccag

SEQ ID NO: 3150689 - DNA, 11 bp, Homo sapiens
tccccctcctc

SEQ ID NO: 3150690 - DNA, 22 bp, Homo sapiens
tccccctgccctcgtggccagc

SEQ ID NO: 3150691 - DNA, 23 bp, Homo sapiens
tccccctgccctcgtggccagcc

SEQ ID NO: 3150692 - DNA, 17 bp, Homo sapiens
tccccctggcactggtt

SEQ ID NO: 3150693 - DNA, 10 bp, Homo sapiens
tccccctggg

SEQ ID NO: 3150694 - DNA, 15 bp, Homo sapiens
tccccctgggctctg

SEQ ID NO: 3150695 - DNA, 21 bp, Homo sapiens
tccccctggggcttctcctga

SEQ ID NO: 3150696 - DNA, 16 bp, Homo sapiens
tccccctggttgggtg

SEQ ID NO: 3150697 - DNA, 17 bp, Homo sapiens
tcccccttcctagtgaa

SEQ ID NO: 3150698 - DNA, 21 bp, Homo sapiens
tcccccttgaggattgtggaa

SEQ ID NO: 3150699 - DNA, 19 bp, Homo sapiens
tccccgaaggtgctggagg

SEQ ID NO: 3150700 - DNA, 14 bp, Homo sapiens
tccccgcacccccc

SEQ ID NO: 3150701 - DNA, 22 bp, Homo sapiens
tccccgcctgcagtcttctggg

SEQ ID NO: 3150702 - DNA, 12 bp, Homo sapiens
tccccgcctggc

SEQ ID NO: 3150703 - DNA, 15 bp, Homo sapiens
tccccgcctggccag

SEQ ID NO: 3150704 - DNA, 16 bp, Homo sapiens
tccccgcctggccagg

SEQ ID NO: 3150705 - DNA, 18 bp, Homo sapiens
tccccgcctggccaggag

SEQ ID NO: 3150706 - DNA, 17 bp, Homo sapiens
tccccgcctggccaggg

SEQ ID NO: 3150707 - DNA, 19 bp, Homo sapiens
tccccgcctggccagggca

SEQ ID NO: 3150708 - DNA, 13 bp, Homo sapiens
tccccgcctgttc

SEQ ID NO: 3150709 - DNA, 22 bp, Homo sapiens
tccccggacatactctctgcct

SEQ ID NO: 3150710 - DNA, 21 bp, Homo sapiens
tccccgggcatctttggggag

SEQ ID NO: 3150711 - DNA, 20 bp, Homo sapiens
tccccgttcctgacatcaca

SEQ ID NO: 3150712 - DNA, 23 bp, Homo sapiens
tcccctaaccctactttgcttcc

SEQ ID NO: 3150713 - DNA, 16 bp, Homo sapiens
tcccctcacagcctct

SEQ ID NO: 3150714 - DNA, 20 bp, Homo sapiens
tcccctcacagcctctgacc

SEQ ID NO: 3150715 - DNA, 15 bp, Homo sapiens
tcccctcacctcctc

SEQ ID NO: 3150716 - DNA, 14 bp, Homo sapiens
tcccctcactctgt

SEQ ID NO: 3150717 - DNA, 17 bp, Homo sapiens
tcccctcactctgtcag

SEQ ID NO: 3150718 - DNA, 14 bp, Homo sapiens
tcccctcagctcca

SEQ ID NO: 3150719 - DNA, 19 bp, Homo sapiens
tcccctccacatcccagca

SEQ ID NO: 3150720 - DNA, 13 bp, Homo sapiens
tcccctccagcct

SEQ ID NO: 3150721 - DNA, 15 bp, Homo sapiens
tcccctccaggaaga

SEQ ID NO: 3150722 - DNA, 14 bp, Homo sapiens
tcccctccatccct

SEQ ID NO: 3150723 - DNA, 13 bp, Homo sapiens
tcccctcccagtc

SEQ ID NO: 3150724 - DNA, 14 bp, Homo sapiens
tcccctcccagtcc

SEQ ID NO: 3150725 - DNA, 15 bp, Homo sapiens
tcccctcccagtcct

SEQ ID NO: 3150726 - DNA, 13 bp, Homo sapiens
tcccctcccccaa

SEQ ID NO: 3150727 - DNA, 21 bp, Homo sapiens
tcccctccccgcctggccagg

SEQ ID NO: 3150728 - DNA, 12 bp, Homo sapiens
tcccctcccctc

SEQ ID NO: 3150729 - DNA, 13 bp, Homo sapiens
tcccctcccctgc

SEQ ID NO: 3150730 - DNA, 14 bp, Homo sapiens
tcccctcccctgct

SEQ ID NO: 3150731 - DNA, 15 bp, Homo sapiens
tcccctccctggctc

SEQ ID NO: 3150732 - DNA, 16 bp, Homo sapiens
tcccctccctggctcc

SEQ ID NO: 3150733 - DNA, 19 bp, Homo sapiens
tcccctccctggctcccat

SEQ ID NO: 3150734 - DNA, 19 bp, Homo sapiens
tcccctccggactggtgcc

SEQ ID NO: 3150735 - DNA, 20 bp, Homo sapiens
tcccctccggactggtgccc

SEQ ID NO: 3150736 - DNA, 14 bp, Homo sapiens
tcccctccttgggc

SEQ ID NO: 3150737 - DNA, 23 bp, Homo sapiens
tcccctcgtcctgtcccagaggt

SEQ ID NO: 3150738 - DNA, 17 bp, Homo sapiens
tcccctctctgcccctg

SEQ ID NO: 3150739 - DNA, 15 bp, Homo sapiens
tcccctctgctgctg

SEQ ID NO: 3150740 - DNA, 17 bp, Homo sapiens
tcccctctgctgctgtc

SEQ ID NO: 3150741 - DNA, 14 bp, Homo sapiens
tcccctgccaccag

SEQ ID NO: 3150742 - DNA, 16 bp, Homo sapiens
tcccctgccaccaggc

SEQ ID NO: 3150743 - DNA, 19 bp, Homo sapiens
tcccctgccaccaggccac

SEQ ID NO: 3150744 - DNA, 14 bp, Homo sapiens
tcccctgcccatgc

SEQ ID NO: 3150745 - DNA, 15 bp, Homo sapiens
tcccctgcccatgct

SEQ ID NO: 3150746 - DNA, 21 bp, Homo sapiens
tcccctgcccatgctgggagc

SEQ ID NO: 3150747 - DNA, 13 bp, Homo sapiens
tcccctgccctgg

SEQ ID NO: 3150748 - DNA, 17 bp, Homo sapiens
tcccctgccctggtcca

SEQ ID NO: 3150749 - DNA, 24 bp, Homo sapiens
tcccctgccctggtccagggaagc

SEQ ID NO: 3150750 - DNA, 17 bp, Homo sapiens
tcccctgctgcaggggc

SEQ ID NO: 3150751 - DNA, 21 bp, Homo sapiens
tcccctgctgcaggggctctg

SEQ ID NO: 3150752 - DNA, 17 bp, Homo sapiens
tcccctggactgggagg

SEQ ID NO: 3150753 - DNA, 19 bp, Homo sapiens
tcccctggcctcagttccc

SEQ ID NO: 3150754 - DNA, 21 bp, Homo sapiens
tcccctggcctcagttcccag

SEQ ID NO: 3150755 - DNA, 23 bp, Homo sapiens
tcccctgtcctgtgaatggaagc

SEQ ID NO: 3150756 - DNA, 20 bp, Homo sapiens
tcccctgtcttcacctgcca

SEQ ID NO: 3150757 - DNA, 17 bp, Homo sapiens
tcccctgtgccctgcac

SEQ ID NO: 3150758 - DNA, 15 bp, Homo sapiens
tcccctgttcactct

SEQ ID NO: 3150759 - DNA, 13 bp, Homo sapiens
tcccctgtttcaa

SEQ ID NO: 3150760 - DNA, 20 bp, Homo sapiens
tccccttccccaattactat

SEQ ID NO: 3150761 - DNA, 17 bp, Homo sapiens
tccccttcccctcccct

SEQ ID NO: 3150762 - DNA, 21 bp, Homo sapiens
tccccttcctaaatatccaaa

SEQ ID NO: 3150763 - DNA, 13 bp, Homo sapiens
tccccttcctaag

SEQ ID NO: 3150764 - DNA, 18 bp, Homo sapiens
tccccttcctcttgtctg

SEQ ID NO: 3150765 - DNA, 23 bp, Homo sapiens
tccccttgatttaaacacacaga

SEQ ID NO: 3150766 - DNA, 18 bp, Homo sapiens
tccccttgcccttgccct

SEQ ID NO: 3150767 - DNA, 20 bp, Homo sapiens
tccccttgcccttgccctga

SEQ ID NO: 3150768 - DNA, 21 bp, Homo sapiens
tccccttgcccttgccctgac

SEQ ID NO: 3150769 - DNA, 23 bp, Homo sapiens
tccccttgccttcccctgtcttc

SEQ ID NO: 3150770 - DNA, 22 bp, Homo sapiens
tccccttttcttttctacccta

SEQ ID NO: 3150771 - DNA, 16 bp, Homo sapiens
tccccttttgcctggc

SEQ ID NO: 3150772 - DNA, 18 bp, Homo sapiens
tccccttttgcctggctg

SEQ ID NO: 3150773 - DNA, 21 bp, Homo sapiens
tccccttttgcctggctgtgg

SEQ ID NO: 3150774 - DNA, 18 bp, Homo sapiens
tcccgaatagctgggact

SEQ ID NO: 3150775 - DNA, 20 bp, Homo sapiens
tcccgaatagctgggactac

SEQ ID NO: 3150776 - DNA, 13 bp, Homo sapiens
tcccgaggtcagc

SEQ ID NO: 3150777 - DNA, 18 bp, Homo sapiens
tcccgaggtcagccaggc

SEQ ID NO: 3150778 - DNA, 16 bp, Homo sapiens
tcccgagtacagtctg

SEQ ID NO: 3150779 - DNA, 18 bp, Homo sapiens
tcccgagtacagtctgta

SEQ ID NO: 3150780 - DNA, 15 bp, Homo sapiens
tcccgagtagctggg

SEQ ID NO: 3150781 - DNA, 14 bp, Homo sapiens
tcccgagtctggga

SEQ ID NO: 3150782 - DNA, 16 bp, Homo sapiens
tcccgagtctgggaca

SEQ ID NO: 3150783 - DNA, 22 bp, Homo sapiens
tcccgcaaaccccctttgtgct

SEQ ID NO: 3150784 - DNA, 19 bp, Homo sapiens
tcccgcctcttcttcttca

SEQ ID NO: 3150785 - DNA, 12 bp, Homo sapiens
tcccgcggtgcc

SEQ ID NO: 3150786 - DNA, 16 bp, Homo sapiens
tcccgctcagccctcc

SEQ ID NO: 3150787 - DNA, 20 bp, Homo sapiens
tcccgctcagccctccctgc

SEQ ID NO: 3150788 - DNA, 18 bp, Homo sapiens
tcccggagcacagccctg

SEQ ID NO: 3150789 - DNA, 15 bp, Homo sapiens
tcccggaggaaatct

SEQ ID NO: 3150790 - DNA, 20 bp, Homo sapiens
tcccggcctcttccacccat

SEQ ID NO: 3150791 - DNA, 17 bp, Homo sapiens
tcccgggccacgcccca

SEQ ID NO: 3150792 - DNA, 21 bp, Homo sapiens
tcccggggccagcacttccat

SEQ ID NO: 3150793 - DNA, 18 bp, Homo sapiens
tcccgggtctcaggcctc

SEQ ID NO: 3150794 - DNA, 20 bp, Homo sapiens
tcccgtcagggcccaagtcc

SEQ ID NO: 3150795 - DNA, 17 bp, Homo sapiens
tccctaactcaactgtt

SEQ ID NO: 3150796 - DNA, 22 bp, Homo sapiens
tccctaagcatgtgtcccagga

SEQ ID NO: 3150797 - DNA, 23 bp, Homo sapiens
tccctaatctatggtcgggagac

SEQ ID NO: 3150798 - DNA, 14 bp, Homo sapiens
tccctaatgtgttt

SEQ ID NO: 3150799 - DNA, 14 bp, Homo sapiens
tccctacactgatg

SEQ ID NO: 3150800 - DNA, 24 bp, Homo sapiens
tccctacatgtattgcacattgta

SEQ ID NO: 3150801 - DNA, 19 bp, Homo sapiens
tccctaccccctaagagcc

SEQ ID NO: 3150802 - DNA, 19 bp, Homo sapiens
tccctaccgagtctcttct

SEQ ID NO: 3150803 - DNA, 23 bp, Homo sapiens
tccctaccgagtctcttctccac

SEQ ID NO: 3150804 - DNA, 13 bp, Homo sapiens
tccctacctcagg

SEQ ID NO: 3150805 - DNA, 15 bp, Homo sapiens
tccctacttcctgtg

SEQ ID NO: 3150806 - DNA, 16 bp, Homo sapiens
tccctacttcctgtga

SEQ ID NO: 3150807 - DNA, 18 bp, Homo sapiens
tccctagactgcatcccg

SEQ ID NO: 3150808 - DNA, 19 bp, Homo sapiens
tccctagagggttcctgta

SEQ ID NO: 3150809 - DNA, 23 bp, Homo sapiens
tccctagatctttctattccaaa

SEQ ID NO: 3150810 - DNA, 13 bp, Homo sapiens
tccctagcagtga

SEQ ID NO: 3150811 - DNA, 22 bp, Homo sapiens
tccctagccagcacttgtatat

SEQ ID NO: 3150812 - DNA, 17 bp, Homo sapiens
tccctaggagagtttac

SEQ ID NO: 3150813 - DNA, 20 bp, Homo sapiens
tccctaggagagtttactga

SEQ ID NO: 3150814 - DNA, 21 bp, Homo sapiens
tccctagggctggcagaaagg

SEQ ID NO: 3150815 - DNA, 17 bp, Homo sapiens
tccctagtctccacctg

SEQ ID NO: 3150816 - DNA, 22 bp, Homo sapiens
tccctatacactagacaaaact

SEQ ID NO: 3150817 - DNA, 19 bp, Homo sapiens
tccctatggctgagccttg

SEQ ID NO: 3150818 - DNA, 18 bp, Homo sapiens
tccctatgtatttgcagt

SEQ ID NO: 3150819 - DNA, 21 bp, Homo sapiens
tccctcacaagcgctcccagc

SEQ ID NO: 3150820 - DNA, 23 bp, Homo sapiens
tccctcacaagcgctcccagcct

SEQ ID NO: 3150821 - DNA, 12 bp, Homo sapiens
tccctcacctgt

SEQ ID NO: 3150822 - DNA, 13 bp, Homo sapiens
tccctcacctgta

SEQ ID NO: 3150823 - DNA, 20 bp, Homo sapiens
tccctcacctgtagcagcca

SEQ ID NO: 3150824 - DNA, 14 bp, Homo sapiens
tccctcaccttctg

SEQ ID NO: 3150825 - DNA, 20 bp, Homo sapiens
tccctcactccacagagtga

SEQ ID NO: 3150826 - DNA, 16 bp, Homo sapiens
tccctcagcctcagag

SEQ ID NO: 3150827 - DNA, 17 bp, Homo sapiens
tccctcagcctcagagg

SEQ ID NO: 3150828 - DNA, 18 bp, Homo sapiens
tccctcagcctcagagga

SEQ ID NO: 3150829 - DNA, 14 bp, Homo sapiens
tccctcatcctttc

SEQ ID NO: 3150830 - DNA, 14 bp, Homo sapiens
tccctccaccccac

SEQ ID NO: 3150831 - DNA, 13 bp, Homo sapiens
tccctcccacctc

SEQ ID NO: 3150832 - DNA, 14 bp, Homo sapiens
tccctcccacctct

SEQ ID NO: 3150833 - DNA, 19 bp, Homo sapiens
tccctcccacctctgtgac

SEQ ID NO: 3150834 - DNA, 17 bp, Homo sapiens
tccctccccagaaacag

SEQ ID NO: 3150835 - DNA, 15 bp, Homo sapiens
tccctccccttctct

SEQ ID NO: 3150836 - DNA, 15 bp, Homo sapiens
tccctcctctcacct

SEQ ID NO: 3150837 - DNA, 17 bp, Homo sapiens
tccctcctgacaaatat

SEQ ID NO: 3150838 - DNA, 22 bp, Homo sapiens
tccctccttgggtcattgacct

SEQ ID NO: 3150839 - DNA, 16 bp, Homo sapiens
tccctcgacagcgccc

SEQ ID NO: 3150840 - DNA, 21 bp, Homo sapiens
tccctcgacagcgcccctgct

SEQ ID NO: 3150841 - DNA, 22 bp, Homo sapiens
tccctcgctgcacaaatactcc

SEQ ID NO: 3150842 - DNA, 19 bp, Homo sapiens
tccctcgggaagcagccag

SEQ ID NO: 3150843 - DNA, 21 bp, Homo sapiens
tccctcgggaagcagccagct

SEQ ID NO: 3150844 - DNA, 18 bp, Homo sapiens
tccctcgtccacaggggc

SEQ ID NO: 3150845 - DNA, 16 bp, Homo sapiens
tccctctaatgagact

SEQ ID NO: 3150846 - DNA, 14 bp, Homo sapiens
tccctctaatttat

SEQ ID NO: 3150847 - DNA, 16 bp, Homo sapiens
tccctctaatttatct

SEQ ID NO: 3150848 - DNA, 19 bp, Homo sapiens
tccctctatttatgtttgc

SEQ ID NO: 3150849 - DNA, 17 bp, Homo sapiens
tccctctcactccccag

SEQ ID NO: 3150850 - DNA, 15 bp, Homo sapiens
tccctctcagaggcc

SEQ ID NO: 3150851 - DNA, 16 bp, Homo sapiens
tccctctcagaggcct

SEQ ID NO: 3150852 - DNA, 16 bp, Homo sapiens
tccctctcaggatcca

SEQ ID NO: 3150853 - DNA, 17 bp, Homo sapiens
tccctctcatctcaggt

SEQ ID NO: 3150854 - DNA, 12 bp, Homo sapiens
tccctctccctg

SEQ ID NO: 3150855 - DNA, 12 bp, Homo sapiens
tccctctcggaa

SEQ ID NO: 3150856 - DNA, 17 bp, Homo sapiens
tccctctctcccatttc

SEQ ID NO: 3150857 - DNA, 13 bp, Homo sapiens
tccctctctggtt

SEQ ID NO: 3150858 - DNA, 18 bp, Homo sapiens
tccctctgacctgcaggc

SEQ ID NO: 3150859 - DNA, 11 bp, Homo sapiens
tccctctgagg

SEQ ID NO: 3150860 - DNA, 12 bp, Homo sapiens
tccctctgaggc

SEQ ID NO: 3150861 - DNA, 16 bp, Homo sapiens
tccctctgccccaagc

SEQ ID NO: 3150862 - DNA, 20 bp, Homo sapiens
tccctctgccccaagcagcc

SEQ ID NO: 3150863 - DNA, 23 bp, Homo sapiens
tccctctgccccaagcagccagc

SEQ ID NO: 3150864 - DNA, 14 bp, Homo sapiens
tccctctgctcagc

SEQ ID NO: 3150865 - DNA, 12 bp, Homo sapiens
tccctctggctt

SEQ ID NO: 3150866 - DNA, 14 bp, Homo sapiens
tccctctggcttcc

SEQ ID NO: 3150867 - DNA, 18 bp, Homo sapiens
tccctctgtgtctgctct

SEQ ID NO: 3150868 - DNA, 12 bp, Homo sapiens
tccctcttgttt

SEQ ID NO: 3150869 - DNA, 15 bp, Homo sapiens
tccctcttgttttgt

SEQ ID NO: 3150870 - DNA, 16 bp, Homo sapiens
tccctcttgttttgtt

SEQ ID NO: 3150871 - DNA, 19 bp, Homo sapiens
tccctcttgttttgtttgt

SEQ ID NO: 3150872 - DNA, 22 bp, Homo sapiens
tccctcttgttttgtttgtctc

SEQ ID NO: 3150873 - DNA, 18 bp, Homo sapiens
tccctctttggctcccct

SEQ ID NO: 3150874 - DNA, 23 bp, Homo sapiens
tccctctttggctcccctgtacc

SEQ ID NO: 3150875 - DNA, 21 bp, Homo sapiens
tccctgaaacacgaaacttgt

SEQ ID NO: 3150876 - DNA, 22 bp, Homo sapiens
tccctgaaacacgaaacttgtt

SEQ ID NO: 3150877 - DNA, 12 bp, Homo sapiens
tccctgaagcca

SEQ ID NO: 3150878 - DNA, 21 bp, Homo sapiens
tccctgacctccctctaattt

SEQ ID NO: 3150879 - DNA, 17 bp, Homo sapiens
tccctgactctctgtga

SEQ ID NO: 3150880 - DNA, 15 bp, Homo sapiens
tccctgacttgcttt

SEQ ID NO: 3150881 - DNA, 14 bp, Homo sapiens
tccctgattattta

SEQ ID NO: 3150882 - DNA, 16 bp, Homo sapiens
tccctgattgacctgc

SEQ ID NO: 3150883 - DNA, 17 bp, Homo sapiens
tccctgattgacctgct

SEQ ID NO: 3150884 - DNA, 20 bp, Homo sapiens
tccctgattgacctgctccg

SEQ ID NO: 3150885 - DNA, 14 bp, Homo sapiens
tccctgcagggcca

SEQ ID NO: 3150886 - DNA, 10 bp, Homo sapiens
tccctgccaa

SEQ ID NO: 3150887 - DNA, 15 bp, Homo sapiens
tccctgccaaactga

SEQ ID NO: 3150888 - DNA, 19 bp, Homo sapiens
tccctgccaagtctcagaa

SEQ ID NO: 3150889 - DNA, 18 bp, Homo sapiens
tccctgcccaaaccctta

SEQ ID NO: 3150890 - DNA, 12 bp, Homo sapiens
tccctgcccagg

SEQ ID NO: 3150891 - DNA, 16 bp, Homo sapiens
tccctgcccaggccgg

SEQ ID NO: 3150892 - DNA, 13 bp, Homo sapiens
tccctgccccaaa

SEQ ID NO: 3150893 - DNA, 13 bp, Homo sapiens
tccctgcccccca

SEQ ID NO: 3150894 - DNA, 14 bp, Homo sapiens
tccctgcccctccc

SEQ ID NO: 3150895 - DNA, 19 bp, Homo sapiens
tccctgcccctcccttcaa

SEQ ID NO: 3150896 - DNA, 20 bp, Homo sapiens
tccctgcccctcccttcaac

SEQ ID NO: 3150897 - DNA, 21 bp, Homo sapiens
tccctgcgcctgtgatgctgg

SEQ ID NO: 3150898 - DNA, 15 bp, Homo sapiens
tccctgctaatctcc

SEQ ID NO: 3150899 - DNA, 15 bp, Homo sapiens
tccctgctcagtgct

SEQ ID NO: 3150900 - DNA, 22 bp, Homo sapiens
tccctgctcagtgcttgggctc

SEQ ID NO: 3150901 - DNA, 21 bp, Homo sapiens
tccctgctctaacacctgcct

SEQ ID NO: 3150902 - DNA, 12 bp, Homo sapiens
tccctgctgaat

SEQ ID NO: 3150903 - DNA, 17 bp, Homo sapiens
tccctgctgctgccagg

SEQ ID NO: 3150904 - DNA, 14 bp, Homo sapiens
tccctgctttggct

SEQ ID NO: 3150905 - DNA, 18 bp, Homo sapiens
tccctggaaggacatcca

SEQ ID NO: 3150906 - DNA, 12 bp, Homo sapiens
tccctggacaca

SEQ ID NO: 3150907 - DNA, 19 bp, Homo sapiens
tccctggacacagctcttc

SEQ ID NO: 3150908 - DNA, 19 bp, Homo sapiens
tccctggagcaggagcccc

SEQ ID NO: 3150909 - DNA, 23 bp, Homo sapiens
tccctggagcaggagccccgcca

SEQ ID NO: 3150910 - DNA, 22 bp, Homo sapiens
tccctggatgtgtggggcatgg

SEQ ID NO: 3150911 - DNA, 15 bp, Homo sapiens
tccctggcagacaca

SEQ ID NO: 3150912 - DNA, 11 bp, Homo sapiens
tccctggcgca

SEQ ID NO: 3150913 - DNA, 12 bp, Homo sapiens
tccctggctccc

SEQ ID NO: 3150914 - DNA, 14 bp, Homo sapiens
tccctggctcccat

SEQ ID NO: 3150915 - DNA, 18 bp, Homo sapiens
tccctggctctcagaagg

SEQ ID NO: 3150916 - DNA, 19 bp, Homo sapiens
tccctggctctcagaaggt

SEQ ID NO: 3150917 - DNA, 20 bp, Homo sapiens
tccctggctctcagaaggta

SEQ ID NO: 3150918 - DNA, 16 bp, Homo sapiens
tccctggctgccctgg

SEQ ID NO: 3150919 - DNA, 18 bp, Homo sapiens
tccctggctgccctggcc

SEQ ID NO: 3150920 - DNA, 19 bp, Homo sapiens
tccctgggaggaaatttga

SEQ ID NO: 3150921 - DNA, 17 bp, Homo sapiens
tccctgggcattgcttt

SEQ ID NO: 3150922 - DNA, 16 bp, Homo sapiens
tccctgggccagggtc

SEQ ID NO: 3150923 - DNA, 17 bp, Homo sapiens
tccctgggccagggtct

SEQ ID NO: 3150924 - DNA, 18 bp, Homo sapiens
tccctgggcccctccacg

SEQ ID NO: 3150925 - DNA, 17 bp, Homo sapiens
tccctggtccctcgtcc

SEQ ID NO: 3150926 - DNA, 19 bp, Homo sapiens
tccctggtcccttggagac

SEQ ID NO: 3150927 - DNA, 14 bp, Homo sapiens
tccctggttcattg

SEQ ID NO: 3150928 - DNA, 17 bp, Homo sapiens
tccctgtagctctgcct

SEQ ID NO: 3150929 - DNA, 18 bp, Homo sapiens
tccctgtagctctgcctc

SEQ ID NO: 3150930 - DNA, 14 bp, Homo sapiens
tccctgtccccctc

SEQ ID NO: 3150931 - DNA, 15 bp, Homo sapiens
tccctgtccttccct

SEQ ID NO: 3150932 - DNA, 15 bp, Homo sapiens
tccctgtctctgcat

SEQ ID NO: 3150933 - DNA, 12 bp, Homo sapiens
tccctgtgaggg

SEQ ID NO: 3150934 - DNA, 12 bp, Homo sapiens
tccctgtgccac

SEQ ID NO: 3150935 - DNA, 22 bp, Homo sapiens
tccctgtgccactttgactcag

SEQ ID NO: 3150936 - DNA, 20 bp, Homo sapiens
tccctgtgcctaacaccagc

SEQ ID NO: 3150937 - DNA, 16 bp, Homo sapiens
tccctgtgggggtggc

SEQ ID NO: 3150938 - DNA, 21 bp, Homo sapiens
tccctgtgggggtggccatcc

SEQ ID NO: 3150939 - DNA, 22 bp, Homo sapiens
tccctgtgtccacctgtgggtg

SEQ ID NO: 3150940 - DNA, 18 bp, Homo sapiens
tccctgtgtgtaggctgg

SEQ ID NO: 3150941 - DNA, 17 bp, Homo sapiens
tccctgttcttcctcca

SEQ ID NO: 3150942 - DNA, 22 bp, Homo sapiens
tccctgtttaatatttaaacag

SEQ ID NO: 3150943 - DNA, 20 bp, Homo sapiens
tccctgtttgaagcctgccc

SEQ ID NO: 3150944 - DNA, 11 bp, Homo sapiens
tccctgttttc

SEQ ID NO: 3150945 - DNA, 15 bp, Homo sapiens
tccctgttttctgag

SEQ ID NO: 3150946 - DNA, 23 bp, Homo sapiens
tccctgttttctgagcccgggct

SEQ ID NO: 3150947 - DNA, 18 bp, Homo sapiens
tcccttaaaatagaaata

SEQ ID NO: 3150948 - DNA, 18 bp, Homo sapiens
tcccttaaggtctccaaa

SEQ ID NO: 3150949 - DNA, 11 bp, Homo sapiens
tcccttcaacc

SEQ ID NO: 3150950 - DNA, 12 bp, Homo sapiens
tcccttcagccc

SEQ ID NO: 3150951 - DNA, 13 bp, Homo sapiens
tcccttcagcccc

SEQ ID NO: 3150952 - DNA, 16 bp, Homo sapiens
tcccttcagtaccctc

SEQ ID NO: 3150953 - DNA, 19 bp, Homo sapiens
tcccttccactgcctctgc

SEQ ID NO: 3150954 - DNA, 22 bp, Homo sapiens
tcccttccactgcctctgcctt

SEQ ID NO: 3150955 - DNA, 12 bp, Homo sapiens
tcccttccagtt

SEQ ID NO: 3150956 - DNA, 12 bp, Homo sapiens
tcccttcccctc

SEQ ID NO: 3150957 - DNA, 21 bp, Homo sapiens
tcccttcccctccctggctcc

SEQ ID NO: 3150958 - DNA, 15 bp, Homo sapiens
tcccttcctggaaac

SEQ ID NO: 3150959 - DNA, 23 bp, Homo sapiens
tcccttcctggaaacagcatgaa

SEQ ID NO: 3150960 - DNA, 14 bp, Homo sapiens
tcccttcctggcct

SEQ ID NO: 3150961 - DNA, 19 bp, Homo sapiens
tcccttccttttccctgct

SEQ ID NO: 3150962 - DNA, 20 bp, Homo sapiens
tcccttccttttccctgctt

SEQ ID NO: 3150963 - DNA, 19 bp, Homo sapiens
tcccttctggacactgaga

SEQ ID NO: 3150964 - DNA, 16 bp, Homo sapiens
tcccttcttgcatcct

SEQ ID NO: 3150965 - DNA, 20 bp, Homo sapiens
tcccttgaaactttgggaaa

SEQ ID NO: 3150966 - DNA, 17 bp, Homo sapiens
tcccttgaaattttaaa

SEQ ID NO: 3150967 - DNA, 20 bp, Homo sapiens
tcccttgcctcaatgccagt

SEQ ID NO: 3150968 - DNA, 12 bp, Homo sapiens
tcccttggcctc

SEQ ID NO: 3150969 - DNA, 13 bp, Homo sapiens
tcccttggcctca

SEQ ID NO: 3150970 - DNA, 12 bp, Homo sapiens
tcccttgtattt

SEQ ID NO: 3150971 - DNA, 18 bp, Homo sapiens
tcccttgtattttgttaa

SEQ ID NO: 3150972 - DNA, 15 bp, Homo sapiens
tcccttgtgtcaaga

SEQ ID NO: 3150973 - DNA, 12 bp, Homo sapiens
tccctttacaat

SEQ ID NO: 3150974 - DNA, 14 bp, Homo sapiens
tccctttccctacc

SEQ ID NO: 3150975 - DNA, 15 bp, Homo sapiens
tccctttcccttctt

SEQ ID NO: 3150976 - DNA, 22 bp, Homo sapiens
tccctttctctctcctctctgc

SEQ ID NO: 3150977 - DNA, 19 bp, Homo sapiens
tccctttctgcttgtgtta

SEQ ID NO: 3150978 - DNA, 13 bp, Homo sapiens
tccctttgacttc

SEQ ID NO: 3150979 - DNA, 15 bp, Homo sapiens
tccctttgacttcag

SEQ ID NO: 3150980 - DNA, 17 bp, Homo sapiens
tccctttgacttcagct

SEQ ID NO: 3150981 - DNA, 13 bp, Homo sapiens
tccctttgctgct

SEQ ID NO: 3150982 - DNA, 20 bp, Homo sapiens
tcccttttctgttctagttt

SEQ ID NO: 3150983 - DNA, 20 bp, Homo sapiens
tcccttttgcataagattaa

SEQ ID NO: 3150984 - DNA, 21 bp, Homo sapiens
tccgaaagggacttggaagct

SEQ ID NO: 3150985 - DNA, 19 bp, Homo sapiens
tccgaacaccctcgaagcg

SEQ ID NO: 3150986 - DNA, 14 bp, Homo sapiens
tccgaagaaaagaa

SEQ ID NO: 3150987 - DNA, 18 bp, Homo sapiens
tccgaagctacttctcca

SEQ ID NO: 3150988 - DNA, 17 bp, Homo sapiens
tccgacatcccagacca

SEQ ID NO: 3150989 - DNA, 17 bp, Homo sapiens
tccgaccctcatggccc

SEQ ID NO: 3150990 - DNA, 12 bp, Homo sapiens
tccgagaactaa

SEQ ID NO: 3150991 - DNA, 20 bp, Homo sapiens
tccgagcattccagtaactt

SEQ ID NO: 3150992 - DNA, 19 bp, Homo sapiens
tccgagccggggagtttct

SEQ ID NO: 3150993 - DNA, 21 bp, Homo sapiens
tccgagccggggagtttcttt

SEQ ID NO: 3150994 - DNA, 14 bp, Homo sapiens
tccgcaccagctgc

SEQ ID NO: 3150995 - DNA, 18 bp, Homo sapiens
tccgcaccagctgctctg

SEQ ID NO: 3150996 - DNA, 21 bp, Homo sapiens
tccgcaccagctgctctgccc

SEQ ID NO: 3150997 - DNA, 23 bp, Homo sapiens
tccgcaccagctgctctgcccct

SEQ ID NO: 3150998 - DNA, 18 bp, Homo sapiens
tccgcaggtgctggtccc

SEQ ID NO: 3150999 - DNA, 11 bp, Homo sapiens
tccgccactca

SEQ ID NO: 3151000 - DNA, 11 bp, Homo sapiens
tccgccagcct

SEQ ID NO: 3151001 - DNA, 14 bp, Homo sapiens
tccgccagcctcct

SEQ ID NO: 3151002 - DNA, 14 bp, Homo sapiens
tccgcccccagcct

SEQ ID NO: 3151003 - DNA, 15 bp, Homo sapiens
tccgcccccagccta

SEQ ID NO: 3151004 - DNA, 17 bp, Homo sapiens
tccgccccttcccttcc

SEQ ID NO: 3151005 - DNA, 16 bp, Homo sapiens
tccgccctcctcgggc

SEQ ID NO: 3151006 - DNA, 13 bp, Homo sapiens
tccgccctgccac

SEQ ID NO: 3151007 - DNA, 14 bp, Homo sapiens
tccgccctgccact

SEQ ID NO: 3151008 - DNA, 17 bp, Homo sapiens
tccgccctgctcctccc

SEQ ID NO: 3151009 - DNA, 13 bp, Homo sapiens
tccgcctctgtcc

SEQ ID NO: 3151010 - DNA, 14 bp, Homo sapiens
tccgcctcttgggt

SEQ ID NO: 3151011 - DNA, 14 bp, Homo sapiens
tccgcctgcctctg

SEQ ID NO: 3151012 - DNA, 16 bp, Homo sapiens
tccgcctgcctctgcc

SEQ ID NO: 3151013 - DNA, 12 bp, Homo sapiens
tccgcctgggat

SEQ ID NO: 3151014 - DNA, 13 bp, Homo sapiens
tccgccttttgta

SEQ ID NO: 3151015 - DNA, 12 bp, Homo sapiens
tccgctgccacc

SEQ ID NO: 3151016 - DNA, 14 bp, Homo sapiens
tccgctgccagcct

SEQ ID NO: 3151017 - DNA, 12 bp, Homo sapiens
tccgctgctcct

SEQ ID NO: 3151018 - DNA, 18 bp, Homo sapiens
tccgctttgaaagaagca

SEQ ID NO: 3151019 - DNA, 21 bp, Homo sapiens
tccgctttgaaagaagcaaga

SEQ ID NO: 3151020 - DNA, 19 bp, Homo sapiens
tccggccaaggtgccacca

SEQ ID NO: 3151021 - DNA, 21 bp, Homo sapiens
tccggccaaggtgccaccacc

SEQ ID NO: 3151022 - DNA, 16 bp, Homo sapiens
tccggcccagtgccac

SEQ ID NO: 3151023 - DNA, 15 bp, Homo sapiens
tccggcctgtaatca

SEQ ID NO: 3151024 - DNA, 19 bp, Homo sapiens
tccgggtgtggcctcagcc

SEQ ID NO: 3151025 - DNA, 17 bp, Homo sapiens
tccggtagggaggcagc

SEQ ID NO: 3151026 - DNA, 19 bp, Homo sapiens
tccggtcccctgcctggaa

SEQ ID NO: 3151027 - DNA, 15 bp, Homo sapiens
tccggtgtgcctgca

SEQ ID NO: 3151028 - DNA, 14 bp, Homo sapiens
tccggtgttctaag

SEQ ID NO: 3151029 - DNA, 20 bp, Homo sapiens
tccgtaataacacccttcct

SEQ ID NO: 3151030 - DNA, 17 bp, Homo sapiens
tccgtcattgctgctgc

SEQ ID NO: 3151031 - DNA, 13 bp, Homo sapiens
tccgtccacccag

SEQ ID NO: 3151032 - DNA, 18 bp, Homo sapiens
tccgtccacccaggctgc

SEQ ID NO: 3151033 - DNA, 21 bp, Homo sapiens
tccgtccacccaggctgcact

SEQ ID NO: 3151034 - DNA, 22 bp, Homo sapiens
tccgtccacccaggctgcactg

SEQ ID NO: 3151035 - DNA, 20 bp, Homo sapiens
tccgtccatccgactgcccc

SEQ ID NO: 3151036 - DNA, 14 bp, Homo sapiens
tccgtcccctgccc

SEQ ID NO: 3151037 - DNA, 18 bp, Homo sapiens
tccgtcccctgcccatgc

SEQ ID NO: 3151038 - DNA, 17 bp, Homo sapiens
tccgtgaattctcggaa

SEQ ID NO: 3151039 - DNA, 19 bp, Homo sapiens
tccgtggccccgccctcag

SEQ ID NO: 3151040 - DNA, 17 bp, Homo sapiens
tccgtgggacggtgccc

SEQ ID NO: 3151041 - DNA, 23 bp, Homo sapiens
tccgtgggacggtgcccaagcca

SEQ ID NO: 3151042 - DNA, 22 bp, Homo sapiens
tccgtggtagaggcctggggcc

SEQ ID NO: 3151043 - DNA, 17 bp, Homo sapiens
tccgttagctcctgtgg

SEQ ID NO: 3151044 - DNA, 13 bp, Homo sapiens
tccgttctgttct

SEQ ID NO: 3151045 - DNA, 19 bp, Homo sapiens
tccgttctgttctgctggg

SEQ ID NO: 3151046 - DNA, 19 bp, Homo sapiens
tccgtttccaggtgtttat

SEQ ID NO: 3151047 - DNA, 19 bp, Homo sapiens
tcctaaatgcagtgaattg

SEQ ID NO: 3151048 - DNA, 14 bp, Homo sapiens
tcctaactccaccg

SEQ ID NO: 3151049 - DNA, 16 bp, Homo sapiens
tcctaactccaccgcc

SEQ ID NO: 3151050 - DNA, 17 bp, Homo sapiens
tcctaactccaccgcct

SEQ ID NO: 3151051 - DNA, 16 bp, Homo sapiens
tcctaagaagcttcta

SEQ ID NO: 3151052 - DNA, 13 bp, Homo sapiens
tcctaagacacaa

SEQ ID NO: 3151053 - DNA, 16 bp, Homo sapiens
tcctaagacacaaatg

SEQ ID NO: 3151054 - DNA, 19 bp, Homo sapiens
tcctaagagtgctgggcat

SEQ ID NO: 3151055 - DNA, 14 bp, Homo sapiens
tcctaagcatctaa

SEQ ID NO: 3151056 - DNA, 14 bp, Homo sapiens
tcctaagcctaaaa

SEQ ID NO: 3151057 - DNA, 18 bp, Homo sapiens
tcctaagggtcgaaagct

SEQ ID NO: 3151058 - DNA, 23 bp, Homo sapiens
tcctaagggtcgaaagctctaga

SEQ ID NO: 3151059 - DNA, 15 bp, Homo sapiens
tcctaatttctcctc

SEQ ID NO: 3151060 - DNA, 23 bp, Homo sapiens
tcctaattttaaataatttctac

SEQ ID NO: 3151061 - DNA, 15 bp, Homo sapiens
tcctacaaagatgtt

SEQ ID NO: 3151062 - DNA, 18 bp, Homo sapiens
tcctacaacttaatggaa

SEQ ID NO: 3151063 - DNA, 18 bp, Homo sapiens
tcctacaagagcagcctg

SEQ ID NO: 3151064 - DNA, 17 bp, Homo sapiens
tcctacaagatttagaa

SEQ ID NO: 3151065 - DNA, 19 bp, Homo sapiens
tcctacaagatttagaaaa

SEQ ID NO: 3151066 - DNA, 19 bp, Homo sapiens
tcctacacttgagagaaaa

SEQ ID NO: 3151067 - DNA, 17 bp, Homo sapiens
tcctacagccccttttt

SEQ ID NO: 3151068 - DNA, 14 bp, Homo sapiens
tcctaccaagtcaa

SEQ ID NO: 3151069 - DNA, 17 bp, Homo sapiens
tcctaccagttgcccta

SEQ ID NO: 3151070 - DNA, 23 bp, Homo sapiens
tcctaccagttgccctagcccag

SEQ ID NO: 3151071 - DNA, 23 bp, Homo sapiens
tcctaccccggctgcttggcagt

SEQ ID NO: 3151072 - DNA, 14 bp, Homo sapiens
tcctacctcagcct

SEQ ID NO: 3151073 - DNA, 17 bp, Homo sapiens
tcctacctcagcctaga

SEQ ID NO: 3151074 - DNA, 14 bp, Homo sapiens
tcctacctgccctg

SEQ ID NO: 3151075 - DNA, 18 bp, Homo sapiens
tcctacctgccctggaac

SEQ ID NO: 3151076 - DNA, 17 bp, Homo sapiens
tcctaccttttgtctct

SEQ ID NO: 3151077 - DNA, 16 bp, Homo sapiens
tcctactccctcttcc

SEQ ID NO: 3151078 - DNA, 12 bp, Homo sapiens
tcctactctgtg

SEQ ID NO: 3151079 - DNA, 19 bp, Homo sapiens
tcctacttctgactttact

SEQ ID NO: 3151080 - DNA, 18 bp, Homo sapiens
tcctacttgcagtacatc

SEQ ID NO: 3151081 - DNA, 18 bp, Homo sapiens
tcctagaggtgggcagct

SEQ ID NO: 3151082 - DNA, 19 bp, Homo sapiens
tcctagaggtgggcagctg

SEQ ID NO: 3151083 - DNA, 15 bp, Homo sapiens
tcctagataaaaaga

SEQ ID NO: 3151084 - DNA, 17 bp, Homo sapiens
tcctagataaaaagatg

SEQ ID NO: 3151085 - DNA, 14 bp, Homo sapiens
tcctagatcctaag

SEQ ID NO: 3151086 - DNA, 15 bp, Homo sapiens
tcctagcagacagaa

SEQ ID NO: 3151087 - DNA, 21 bp, Homo sapiens
tcctagcctgtgcctctggga

SEQ ID NO: 3151088 - DNA, 15 bp, Homo sapiens
tcctagcctgtttct

SEQ ID NO: 3151089 - DNA, 16 bp, Homo sapiens
tcctagcctgtttctt

SEQ ID NO: 3151090 - DNA, 19 bp, Homo sapiens
tcctagcctgtttcttcct

SEQ ID NO: 3151091 - DNA, 14 bp, Homo sapiens
tcctagctcttaca

SEQ ID NO: 3151092 - DNA, 17 bp, Homo sapiens
tcctagctgtgtgaata

SEQ ID NO: 3151093 - DNA, 20 bp, Homo sapiens
tcctaggctccaccccatcc

SEQ ID NO: 3151094 - DNA, 13 bp, Homo sapiens
tcctagtaagaag

SEQ ID NO: 3151095 - DNA, 14 bp, Homo sapiens
tcctagtaagaaga

SEQ ID NO: 3151096 - DNA, 14 bp, Homo sapiens
tcctagtgaaccac

SEQ ID NO: 3151097 - DNA, 16 bp, Homo sapiens
tcctagtgaaccacag

SEQ ID NO: 3151098 - DNA, 22 bp, Homo sapiens
tcctagtgagtgtgctgacttt

SEQ ID NO: 3151099 - DNA, 18 bp, Homo sapiens
tcctagtggatgactgtt

SEQ ID NO: 3151100 - DNA, 19 bp, Homo sapiens
tcctagtgtttctttgtgg

SEQ ID NO: 3151101 - DNA, 15 bp, Homo sapiens
tcctagtttgacctc

SEQ ID NO: 3151102 - DNA, 21 bp, Homo sapiens
tcctagtttgacctcacagtg

SEQ ID NO: 3151103 - DNA, 13 bp, Homo sapiens
tcctagttttctc

SEQ ID NO: 3151104 - DNA, 19 bp, Homo sapiens
tcctataacttcttcctgc

SEQ ID NO: 3151105 - DNA, 21 bp, Homo sapiens
tcctataacttcttcctgctg

SEQ ID NO: 3151106 - DNA, 14 bp, Homo sapiens
tcctataacttgat

SEQ ID NO: 3151107 - DNA, 20 bp, Homo sapiens
tcctataagcttaaatagga

SEQ ID NO: 3151108 - DNA, 23 bp, Homo sapiens
tcctataatctgtcaaaacactg

SEQ ID NO: 3151109 - DNA, 20 bp, Homo sapiens
tcctataattccctatcttt

SEQ ID NO: 3151110 - DNA, 16 bp, Homo sapiens
tcctatatatttctat

SEQ ID NO: 3151111 - DNA, 20 bp, Homo sapiens
tcctatatatttctattatt

SEQ ID NO: 3151112 - DNA, 18 bp, Homo sapiens
tcctatatcctgtgactg

SEQ ID NO: 3151113 - DNA, 23 bp, Homo sapiens
tcctatattgttttcagtgtaca

SEQ ID NO: 3151114 - DNA, 21 bp, Homo sapiens
tcctatccactgggcacaact

SEQ ID NO: 3151115 - DNA, 19 bp, Homo sapiens
tcctatgaagttggcacat

SEQ ID NO: 3151116 - DNA, 21 bp, Homo sapiens
tcctatgatggatggcagact

SEQ ID NO: 3151117 - DNA, 22 bp, Homo sapiens
tcctatgatggatggcagactc

SEQ ID NO: 3151118 - DNA, 20 bp, Homo sapiens
tcctatggctggccactgca

SEQ ID NO: 3151119 - DNA, 22 bp, Homo sapiens
tcctatggctggccactgcaca

SEQ ID NO: 3151120 - DNA, 15 bp, Homo sapiens
tcctattctataaaa

SEQ ID NO: 3151121 - DNA, 14 bp, Homo sapiens
tcctattctattgc

SEQ ID NO: 3151122 - DNA, 17 bp, Homo sapiens
tcctatttttgtaaact

SEQ ID NO: 3151123 - DNA, 22 bp, Homo sapiens
tcctatttttttaaaatcacta

SEQ ID NO: 3151124 - DNA, 15 bp, Homo sapiens
tcctcaaagaaagtg

SEQ ID NO: 3151125 - DNA, 22 bp, Homo sapiens
tcctcaacccctcccctccatc

SEQ ID NO: 3151126 - DNA, 18 bp, Homo sapiens
tcctcaagcaataattgt

SEQ ID NO: 3151127 - DNA, 18 bp, Homo sapiens
tcctcaagtccccaagat

SEQ ID NO: 3151128 - DNA, 19 bp, Homo sapiens
tcctcacagccttggctcc

SEQ ID NO: 3151129 - DNA, 20 bp, Homo sapiens
tcctcacagccttggctcct

SEQ ID NO: 3151130 - DNA, 15 bp, Homo sapiens
tcctcacataaaaaa

SEQ ID NO: 3151131 - DNA, 17 bp, Homo sapiens
tcctcacctgtctaggt

SEQ ID NO: 3151132 - DNA, 13 bp, Homo sapiens
tcctcactcccag

SEQ ID NO: 3151133 - DNA, 17 bp, Homo sapiens
tcctcactcccagtcca

SEQ ID NO: 3151134 - DNA, 21 bp, Homo sapiens
tcctcactctgtccctgtcct

SEQ ID NO: 3151135 - DNA, 13 bp, Homo sapiens
tcctcactgctcc

SEQ ID NO: 3151136 - DNA, 15 bp, Homo sapiens
tcctcactgctccct

SEQ ID NO: 3151137 - DNA, 18 bp, Homo sapiens
tcctcactggaggagcag

SEQ ID NO: 3151138 - DNA, 23 bp, Homo sapiens
tcctcactggaggagcagcttcc

SEQ ID NO: 3151139 - DNA, 22 bp, Homo sapiens
tcctcactggccatccctcgtg

SEQ ID NO: 3151140 - DNA, 16 bp, Homo sapiens
tcctcagaggacagtt

SEQ ID NO: 3151141 - DNA, 13 bp, Homo sapiens
tcctcagccccca

SEQ ID NO: 3151142 - DNA, 18 bp, Homo sapiens
tcctcagcccccaggcca

SEQ ID NO: 3151143 - DNA, 20 bp, Homo sapiens
tcctcagcccccaggccagg

SEQ ID NO: 3151144 - DNA, 22 bp, Homo sapiens
tcctcagcccccaggccaggtg

SEQ ID NO: 3151145 - DNA, 21 bp, Homo sapiens
tcctcagctggttactcaggg

SEQ ID NO: 3151146 - DNA, 22 bp, Homo sapiens
tcctcagcttcttcacaggcac

SEQ ID NO: 3151147 - DNA, 21 bp, Homo sapiens
tcctcagggagcagggaaggc

SEQ ID NO: 3151148 - DNA, 13 bp, Homo sapiens
tcctcagggtggg

SEQ ID NO: 3151149 - DNA, 16 bp, Homo sapiens
tcctcagggtgggggg

SEQ ID NO: 3151150 - DNA, 22 bp, Homo sapiens
tcctcaggtggccagcctggat

SEQ ID NO: 3151151 - DNA, 23 bp, Homo sapiens
tcctcataaaaagcaaaacaaaa

SEQ ID NO: 3151152 - DNA, 21 bp, Homo sapiens
tcctcatatggcccagtgtca

SEQ ID NO: 3151153 - DNA, 14 bp, Homo sapiens
tcctcatccacccc

SEQ ID NO: 3151154 - DNA, 15 bp, Homo sapiens
tcctcatcccctcgt

SEQ ID NO: 3151155 - DNA, 12 bp, Homo sapiens
tcctcatccctg

SEQ ID NO: 3151156 - DNA, 23 bp, Homo sapiens
tcctcatggtgcatataaatata

SEQ ID NO: 3151157 - DNA, 15 bp, Homo sapiens
tcctcatgtaacatt

SEQ ID NO: 3151158 - DNA, 21 bp, Homo sapiens
tcctcatgtaacattggtgaa

SEQ ID NO: 3151159 - DNA, 17 bp, Homo sapiens
tcctcattgcctcctgt

SEQ ID NO: 3151160 - DNA, 12 bp, Homo sapiens
tcctcattttga

SEQ ID NO: 3151161 - DNA, 14 bp, Homo sapiens
tcctccaagaattt

SEQ ID NO: 3151162 - DNA, 13 bp, Homo sapiens
tcctccacagtgc

SEQ ID NO: 3151163 - DNA, 18 bp, Homo sapiens
tcctccacagtgctgctt

SEQ ID NO: 3151164 - DNA, 19 bp, Homo sapiens
tcctccacagtgctgcttc

SEQ ID NO: 3151165 - DNA, 19 bp, Homo sapiens
tcctccacatcctgtgtca

SEQ ID NO: 3151166 - DNA, 14 bp, Homo sapiens
tcctccagaagcct

SEQ ID NO: 3151167 - DNA, 19 bp, Homo sapiens
tcctccagaagcctctggc

SEQ ID NO: 3151168 - DNA, 16 bp, Homo sapiens
tcctccagaccaccag

SEQ ID NO: 3151169 - DNA, 13 bp, Homo sapiens
tcctccaggcctg

SEQ ID NO: 3151170 - DNA, 19 bp, Homo sapiens
tcctccaggcctgcctccc

SEQ ID NO: 3151171 - DNA, 21 bp, Homo sapiens
tcctccagggatgatcaacag

SEQ ID NO: 3151172 - DNA, 17 bp, Homo sapiens
tcctccagggtgatttt

SEQ ID NO: 3151173 - DNA, 18 bp, Homo sapiens
tcctccagtaccttgctt

SEQ ID NO: 3151174 - DNA, 10 bp, Homo sapiens
tcctccagtc

SEQ ID NO: 3151175 - DNA, 20 bp, Homo sapiens
tcctccatcccaacagccat

SEQ ID NO: 3151176 - DNA, 21 bp, Homo sapiens
tcctccatctttctacagaga

SEQ ID NO: 3151177 - DNA, 20 bp, Homo sapiens
tcctcccacccggctgcaga

SEQ ID NO: 3151178 - DNA, 18 bp, Homo sapiens
tcctcccacctcagcctc

SEQ ID NO: 3151179 - DNA, 16 bp, Homo sapiens
tcctccccaaatcaat

SEQ ID NO: 3151180 - DNA, 15 bp, Homo sapiens
tcctcccccacccct

SEQ ID NO: 3151181 - DNA, 21 bp, Homo sapiens
tcctcccctcacagcctctga

SEQ ID NO: 3151182 - DNA, 15 bp, Homo sapiens
tcctcccctcttgag

SEQ ID NO: 3151183 - DNA, 19 bp, Homo sapiens
tcctccctcatggctctgg

SEQ ID NO: 3151184 - DNA, 12 bp, Homo sapiens
tcctccctccac

SEQ ID NO: 3151185 - DNA, 17 bp, Homo sapiens
tcctccctgccccccaa

SEQ ID NO: 3151186 - DNA, 15 bp, Homo sapiens
tcctccctggcagac

SEQ ID NO: 3151187 - DNA, 18 bp, Homo sapiens
tcctccctggctgccctg

SEQ ID NO: 3151188 - DNA, 14 bp, Homo sapiens
tcctccgaggccag

SEQ ID NO: 3151189 - DNA, 15 bp, Homo sapiens
tcctccgtccaccca

SEQ ID NO: 3151190 - DNA, 17 bp, Homo sapiens
tcctccgtccacccagg

SEQ ID NO: 3151191 - DNA, 16 bp, Homo sapiens
tcctccgtccagccgc

SEQ ID NO: 3151192 - DNA, 16 bp, Homo sapiens
tcctcctaccttttgt

SEQ ID NO: 3151193 - DNA, 18 bp, Homo sapiens
tcctcctcacctcatgcc

SEQ ID NO: 3151194 - DNA, 15 bp, Homo sapiens
tcctcctcagccccc

SEQ ID NO: 3151195 - DNA, 13 bp, Homo sapiens
tcctcctccacag

SEQ ID NO: 3151196 - DNA, 18 bp, Homo sapiens
tcctcctccacagtgctg

SEQ ID NO: 3151197 - DNA, 20 bp, Homo sapiens
tcctcctccacagtgctgct

SEQ ID NO: 3151198 - DNA, 12 bp, Homo sapiens
tcctcctccagg

SEQ ID NO: 3151199 - DNA, 13 bp, Homo sapiens
tcctcctccaggg

SEQ ID NO: 3151200 - DNA, 12 bp, Homo sapiens
tcctcctgcaga

SEQ ID NO: 3151201 - DNA, 20 bp, Homo sapiens
tcctcctgcagacacctgga

SEQ ID NO: 3151202 - DNA, 23 bp, Homo sapiens
tcctcctgcagacacctggactg

SEQ ID NO: 3151203 - DNA, 13 bp, Homo sapiens
tcctcctgccctg

SEQ ID NO: 3151204 - DNA, 15 bp, Homo sapiens
tcctcctgccctgtc

SEQ ID NO: 3151205 - DNA, 16 bp, Homo sapiens
tcctcctgccctgtcc

SEQ ID NO: 3151206 - DNA, 21 bp, Homo sapiens
tcctcctggaaccttgctgtc

SEQ ID NO: 3151207 - DNA, 22 bp, Homo sapiens
tcctcctggaaccttgctgtcc

SEQ ID NO: 3151208 - DNA, 12 bp, Homo sapiens
tcctcctgggag

SEQ ID NO: 3151209 - DNA, 13 bp, Homo sapiens
tcctcctgtgtga

SEQ ID NO: 3151210 - DNA, 16 bp, Homo sapiens
tcctccttggtgcctg

SEQ ID NO: 3151211 - DNA, 17 bp, Homo sapiens
tcctcgctctgggatgc

SEQ ID NO: 3151212 - DNA, 21 bp, Homo sapiens
tcctcggagagcagcagcacc

SEQ ID NO: 3151213 - DNA, 19 bp, Homo sapiens
tcctcggccccctccatcg

SEQ ID NO: 3151214 - DNA, 16 bp, Homo sapiens
tcctcgggccgaggcc

SEQ ID NO: 3151215 - DNA, 19 bp, Homo sapiens
tcctcgggccgaggcccag

SEQ ID NO: 3151216 - DNA, 20 bp, Homo sapiens
tcctcgggccgaggcccagc

SEQ ID NO: 3151217 - DNA, 18 bp, Homo sapiens
tcctcgttcaaaacattc

SEQ ID NO: 3151218 - DNA, 17 bp, Homo sapiens
tcctctagaagccaagg

SEQ ID NO: 3151219 - DNA, 18 bp, Homo sapiens
tcctctagaagccaaggg

SEQ ID NO: 3151220 - DNA, 15 bp, Homo sapiens
tcctctagctgtggg

SEQ ID NO: 3151221 - DNA, 21 bp, Homo sapiens
tcctctagctgtgggggtgag

SEQ ID NO: 3151222 - DNA, 17 bp, Homo sapiens
tcctctaggcaagcagg

SEQ ID NO: 3151223 - DNA, 21 bp, Homo sapiens
tcctctaggcaagcaggacct

SEQ ID NO: 3151224 - DNA, 16 bp, Homo sapiens
tcctctagtaagatgc

SEQ ID NO: 3151225 - DNA, 15 bp, Homo sapiens
tcctctataattagt

SEQ ID NO: 3151226 - DNA, 17 bp, Homo sapiens
tcctctatacatctctc

SEQ ID NO: 3151227 - DNA, 19 bp, Homo sapiens
tcctctattgatgtacagt

SEQ ID NO: 3151228 - DNA, 11 bp, Homo sapiens
tcctctatttt

SEQ ID NO: 3151229 - DNA, 17 bp, Homo sapiens
tcctctcacctcagcct

SEQ ID NO: 3151230 - DNA, 14 bp, Homo sapiens
tcctctcactcctg

SEQ ID NO: 3151231 - DNA, 15 bp, Homo sapiens
tcctctcactcctgc

SEQ ID NO: 3151232 - DNA, 17 bp, Homo sapiens
tcctctcagttctctcc

SEQ ID NO: 3151233 - DNA, 13 bp, Homo sapiens
tcctctccactcc

SEQ ID NO: 3151234 - DNA, 16 bp, Homo sapiens
tcctctccactgcctt

SEQ ID NO: 3151235 - DNA, 18 bp, Homo sapiens
tcctctccactgccttcg

SEQ ID NO: 3151236 - DNA, 14 bp, Homo sapiens
tcctctccaggcac

SEQ ID NO: 3151237 - DNA, 20 bp, Homo sapiens
tcctctcccacagagtgctg

SEQ ID NO: 3151238 - DNA, 23 bp, Homo sapiens
tcctctcccacagagtgctggac

SEQ ID NO: 3151239 - DNA, 14 bp, Homo sapiens
tcctctcccatccc

SEQ ID NO: 3151240 - DNA, 17 bp, Homo sapiens
tcctctcccatccccct

SEQ ID NO: 3151241 - DNA, 18 bp, Homo sapiens
tcctctcccatccccctg

SEQ ID NO: 3151242 - DNA, 19 bp, Homo sapiens
tcctctcccatccccctgc

SEQ ID NO: 3151243 - DNA, 22 bp, Homo sapiens
tcctctcccatccccctgccct

SEQ ID NO: 3151244 - DNA, 12 bp, Homo sapiens
tcctctccccag

SEQ ID NO: 3151245 - DNA, 15 bp, Homo sapiens
tcctctccccagcaa

SEQ ID NO: 3151246 - DNA, 16 bp, Homo sapiens
tcctctcccctccagc

SEQ ID NO: 3151247 - DNA, 16 bp, Homo sapiens
tcctctccctctctct

SEQ ID NO: 3151248 - DNA, 20 bp, Homo sapiens
tcctctccctctctcttttc

SEQ ID NO: 3151249 - DNA, 20 bp, Homo sapiens
tcctctccgcagttcctgtc

SEQ ID NO: 3151250 - DNA, 14 bp, Homo sapiens
tcctctccttgggc

SEQ ID NO: 3151251 - DNA, 16 bp, Homo sapiens
tcctctcgagcccaga

SEQ ID NO: 3151252 - DNA, 17 bp, Homo sapiens
tcctctctggtggctct

SEQ ID NO: 3151253 - DNA, 19 bp, Homo sapiens
tcctctctttgttctcagc

SEQ ID NO: 3151254 - DNA, 13 bp, Homo sapiens
tcctctgagccca

SEQ ID NO: 3151255 - DNA, 16 bp, Homo sapiens
tcctctgagcccagct

SEQ ID NO: 3151256 - DNA, 18 bp, Homo sapiens
tcctctgagcccagctgc

SEQ ID NO: 3151257 - DNA, 16 bp, Homo sapiens
tcctctgcactcccac

SEQ ID NO: 3151258 - DNA, 11 bp, Homo sapiens
tcctctgcctg

SEQ ID NO: 3151259 - DNA, 12 bp, Homo sapiens
tcctctgcctgc

SEQ ID NO: 3151260 - DNA, 15 bp, Homo sapiens
tcctctggacggcag

SEQ ID NO: 3151261 - DNA, 20 bp, Homo sapiens
tcctctggacggcaggctca

SEQ ID NO: 3151262 - DNA, 14 bp, Homo sapiens
tcctctgggcctgg

SEQ ID NO: 3151263 - DNA, 15 bp, Homo sapiens
tcctctgggcctggg

SEQ ID NO: 3151264 - DNA, 17 bp, Homo sapiens
tcctctggggctctagg

SEQ ID NO: 3151265 - DNA, 15 bp, Homo sapiens
tcctctgttcacaaa

SEQ ID NO: 3151266 - DNA, 20 bp, Homo sapiens
tcctcttaccgtagcctccg

SEQ ID NO: 3151267 - DNA, 15 bp, Homo sapiens
tcctcttccccttgc

SEQ ID NO: 3151268 - DNA, 16 bp, Homo sapiens
tcctcttccccttgcc

SEQ ID NO: 3151269 - DNA, 19 bp, Homo sapiens
tcctcttccccttgccctt

SEQ ID NO: 3151270 - DNA, 19 bp, Homo sapiens
tcctcttctattttgtaaa

SEQ ID NO: 3151271 - DNA, 15 bp, Homo sapiens
tcctcttctgacgtg

SEQ ID NO: 3151272 - DNA, 19 bp, Homo sapiens
tcctctttagtttttggtt

SEQ ID NO: 3151273 - DNA, 23 bp, Homo sapiens
tcctgaaacccaaagccctggta

SEQ ID NO: 3151274 - DNA, 21 bp, Homo sapiens
tcctgaaagaaacagttaact

SEQ ID NO: 3151275 - DNA, 15 bp, Homo sapiens
tcctgaaagggcact

SEQ ID NO: 3151276 - DNA, 15 bp, Homo sapiens
tcctgaaataaacac

SEQ ID NO: 3151277 - DNA, 16 bp, Homo sapiens
tcctgaaataaacact

SEQ ID NO: 3151278 - DNA, 17 bp, Homo sapiens
tcctgaaccgcacagct

SEQ ID NO: 3151279 - DNA, 22 bp, Homo sapiens
tcctgaaccgcacagctcagga

SEQ ID NO: 3151280 - DNA, 15 bp, Homo sapiens
tcctgaactttctcc

SEQ ID NO: 3151281 - DNA, 21 bp, Homo sapiens
tcctgaagaggcgggccagcc

SEQ ID NO: 3151282 - DNA, 22 bp, Homo sapiens
tcctgaatccaaactaatccat

SEQ ID NO: 3151283 - DNA, 14 bp, Homo sapiens
tcctgaatgaaata

SEQ ID NO: 3151284 - DNA, 19 bp, Homo sapiens
tcctgacaagttattactg

SEQ ID NO: 3151285 - DNA, 16 bp, Homo sapiens
tcctgacatcacagca

SEQ ID NO: 3151286 - DNA, 19 bp, Homo sapiens
tcctgacatcacagcagcc

SEQ ID NO: 3151287 - DNA, 20 bp, Homo sapiens
tcctgacatcacagcagcct

SEQ ID NO: 3151288 - DNA, 13 bp, Homo sapiens
tcctgacccaggc

SEQ ID NO: 3151289 - DNA, 14 bp, Homo sapiens
tcctgacccagtcc

SEQ ID NO: 3151290 - DNA, 18 bp, Homo sapiens
tcctgacgaaactggccc

SEQ ID NO: 3151291 - DNA, 22 bp, Homo sapiens
tcctgacggcgcccccagtgtg

SEQ ID NO: 3151292 - DNA, 13 bp, Homo sapiens
tcctgagaagcat

SEQ ID NO: 3151293 - DNA, 16 bp, Homo sapiens
tcctgagaccacagag

SEQ ID NO: 3151294 - DNA, 20 bp, Homo sapiens
tcctgagatttcctcctggc

SEQ ID NO: 3151295 - DNA, 12 bp, Homo sapiens
tcctgagccccg

SEQ ID NO: 3151296 - DNA, 16 bp, Homo sapiens
tcctgaggctccactt

SEQ ID NO: 3151297 - DNA, 17 bp, Homo sapiens
tcctgaggctttggatt

SEQ ID NO: 3151298 - DNA, 22 bp, Homo sapiens
tcctgagggtccccacctggga

SEQ ID NO: 3151299 - DNA, 15 bp, Homo sapiens
tcctgataaagcaca

SEQ ID NO: 3151300 - DNA, 20 bp, Homo sapiens
tcctgataaagcacagctgt

SEQ ID NO: 3151301 - DNA, 18 bp, Homo sapiens
tcctgataataattgatc

SEQ ID NO: 3151302 - DNA, 14 bp, Homo sapiens
tcctgatctgtgat

SEQ ID NO: 3151303 - DNA, 14 bp, Homo sapiens
tcctgatggccaag

SEQ ID NO: 3151304 - DNA, 17 bp, Homo sapiens
tcctgatggccaagagc

SEQ ID NO: 3151305 - DNA, 18 bp, Homo sapiens
tcctgatggccaagagca

SEQ ID NO: 3151306 - DNA, 23 bp, Homo sapiens
tcctgatggtacaggaaagctca

SEQ ID NO: 3151307 - DNA, 21 bp, Homo sapiens
tcctgatggtcagctcccttc

SEQ ID NO: 3151308 - DNA, 17 bp, Homo sapiens
tcctgcaactcaaggac

SEQ ID NO: 3151309 - DNA, 15 bp, Homo sapiens
tcctgcaattttcta

SEQ ID NO: 3151310 - DNA, 18 bp, Homo sapiens
tcctgcagacacctggac

SEQ ID NO: 3151311 - DNA, 12 bp, Homo sapiens
tcctgcagcatg

SEQ ID NO: 3151312 - DNA, 15 bp, Homo sapiens
tcctgcagcctcctc

SEQ ID NO: 3151313 - DNA, 18 bp, Homo sapiens
tcctgcagcctcctcctg

SEQ ID NO: 3151314 - DNA, 19 bp, Homo sapiens
tcctgcagcctcctcctga

SEQ ID NO: 3151315 - DNA, 20 bp, Homo sapiens
tcctgcaggaacgagcactg

SEQ ID NO: 3151316 - DNA, 23 bp, Homo sapiens
tcctgcaggaacgagcactggcc

SEQ ID NO: 3151317 - DNA, 17 bp, Homo sapiens
tcctgcaggcaggaaca

SEQ ID NO: 3151318 - DNA, 17 bp, Homo sapiens
tcctgcatttctcttct

SEQ ID NO: 3151319 - DNA, 20 bp, Homo sapiens
tcctgccacatggagccccc

SEQ ID NO: 3151320 - DNA, 10 bp, Homo sapiens
tcctgccagc

SEQ ID NO: 3151321 - DNA, 14 bp, Homo sapiens
tcctgccagcccca

SEQ ID NO: 3151322 - DNA, 15 bp, Homo sapiens
tcctgccagccccac

SEQ ID NO: 3151323 - DNA, 22 bp, Homo sapiens
tcctgccagccccacacagcta

SEQ ID NO: 3151324 - DNA, 14 bp, Homo sapiens
tcctgccagctgcc

SEQ ID NO: 3151325 - DNA, 20 bp, Homo sapiens
tcctgcccactgctgcagta

SEQ ID NO: 3151326 - DNA, 16 bp, Homo sapiens
tcctgcccagtccccc

SEQ ID NO: 3151327 - DNA, 17 bp, Homo sapiens
tcctgcccagtgttgtt

SEQ ID NO: 3151328 - DNA, 19 bp, Homo sapiens
tcctgcccagtgttgtttg

SEQ ID NO: 3151329 - DNA, 14 bp, Homo sapiens
tcctgccccaggcc

SEQ ID NO: 3151330 - DNA, 15 bp, Homo sapiens
tcctgccccaggcct

SEQ ID NO: 3151331 - DNA, 12 bp, Homo sapiens
tcctgccctaca

SEQ ID NO: 3151332 - DNA, 14 bp, Homo sapiens
tcctgccctacaga

SEQ ID NO: 3151333 - DNA, 17 bp, Homo sapiens
tcctgccgagtgctctg

SEQ ID NO: 3151334 - DNA, 23 bp, Homo sapiens
tcctgccgagtgctctgatgcaa

SEQ ID NO: 3151335 - DNA, 13 bp, Homo sapiens
tcctgccgcagac

SEQ ID NO: 3151336 - DNA, 21 bp, Homo sapiens
tcctgccgcagacgggcacag

SEQ ID NO: 3151337 - DNA, 18 bp, Homo sapiens
tcctgccgctcctctcta

SEQ ID NO: 3151338 - DNA, 21 bp, Homo sapiens
tcctgcctcgaactggctgca

SEQ ID NO: 3151339 - DNA, 10 bp, Homo sapiens
tcctgcctgg

SEQ ID NO: 3151340 - DNA, 14 bp, Homo sapiens
tcctgcctggccag

SEQ ID NO: 3151341 - DNA, 14 bp, Homo sapiens
tcctgcctgggtgg

SEQ ID NO: 3151342 - DNA, 12 bp, Homo sapiens
tcctgcctgtgg

SEQ ID NO: 3151343 - DNA, 13 bp, Homo sapiens
tcctgcctgtggc

SEQ ID NO: 3151344 - DNA, 14 bp, Homo sapiens
tcctgccttctgtc

SEQ ID NO: 3151345 - DNA, 17 bp, Homo sapiens
tcctgccttctgtcctg

SEQ ID NO: 3151346 - DNA, 22 bp, Homo sapiens
tcctgccttctgtcctggtgtc

SEQ ID NO: 3151347 - DNA, 21 bp, Homo sapiens
tcctgccttggcctcccaagt

SEQ ID NO: 3151348 - DNA, 16 bp, Homo sapiens
tcctgcctttaagcca

SEQ ID NO: 3151349 - DNA, 18 bp, Homo sapiens
tcctgcctttaagccaaa

SEQ ID NO: 3151350 - DNA, 18 bp, Homo sapiens
tcctgcgccccgcccaca

SEQ ID NO: 3151351 - DNA, 22 bp, Homo sapiens
tcctgcggagtgaagaggggca

SEQ ID NO: 3151352 - DNA, 23 bp, Homo sapiens
tcctgcggagtgaagaggggcag

SEQ ID NO: 3151353 - DNA, 16 bp, Homo sapiens
tcctgcgggttttaat

SEQ ID NO: 3151354 - DNA, 21 bp, Homo sapiens
tcctgcgggttttaatttatt

SEQ ID NO: 3151355 - DNA, 18 bp, Homo sapiens
tcctgcgtcctcctcacc

SEQ ID NO: 3151356 - DNA, 19 bp, Homo sapiens
tcctgctacaacttcagca

SEQ ID NO: 3151357 - DNA, 20 bp, Homo sapiens
tcctgctacaacttcagcag

SEQ ID NO: 3151358 - DNA, 15 bp, Homo sapiens
tcctgctacaggagg

SEQ ID NO: 3151359 - DNA, 16 bp, Homo sapiens
tcctgctacaggaggg

SEQ ID NO: 3151360 - DNA, 17 bp, Homo sapiens
tcctgctacaggagggg

SEQ ID NO: 3151361 - DNA, 16 bp, Homo sapiens
tcctgctcatattgtg

SEQ ID NO: 3151362 - DNA, 20 bp, Homo sapiens
tcctgctccagaatttggaa

SEQ ID NO: 3151363 - DNA, 16 bp, Homo sapiens
tcctgctccatgactg

SEQ ID NO: 3151364 - DNA, 20 bp, Homo sapiens
tcctgctccctgtggcactc

SEQ ID NO: 3151365 - DNA, 17 bp, Homo sapiens
tcctgctggggccgcca

SEQ ID NO: 3151366 - DNA, 23 bp, Homo sapiens
tcctgctgtagtcctttctgcct

SEQ ID NO: 3151367 - DNA, 18 bp, Homo sapiens
tcctggaaacagcatgaa

SEQ ID NO: 3151368 - DNA, 20 bp, Homo sapiens
tcctggaaacagcatgaata

SEQ ID NO: 3151369 - DNA, 17 bp, Homo sapiens
tcctggaaccttgctgt

SEQ ID NO: 3151370 - DNA, 19 bp, Homo sapiens
tcctggacactcagacctg

SEQ ID NO: 3151371 - DNA, 18 bp, Homo sapiens
tcctggacatcaccagtc

SEQ ID NO: 3151372 - DNA, 22 bp, Homo sapiens
tcctggacatcctcttctgctt

SEQ ID NO: 3151373 - DNA, 22 bp, Homo sapiens
tcctggacctgagtcggcccca

SEQ ID NO: 3151374 - DNA, 21 bp, Homo sapiens
tcctggagggaagcactgcct

SEQ ID NO: 3151375 - DNA, 22 bp, Homo sapiens
tcctggaggggtgttgtatggc

SEQ ID NO: 3151376 - DNA, 18 bp, Homo sapiens
tcctggatgttgtgtgta

SEQ ID NO: 3151377 - DNA, 20 bp, Homo sapiens
tcctggcaatagtgtgttct

SEQ ID NO: 3151378 - DNA, 17 bp, Homo sapiens
tcctggcacgccctact

SEQ ID NO: 3151379 - DNA, 18 bp, Homo sapiens
tcctggcacgccctactc

SEQ ID NO: 3151380 - DNA, 23 bp, Homo sapiens
tcctggcacgccctactccactg

SEQ ID NO: 3151381 - DNA, 20 bp, Homo sapiens
tcctggcagtttaaaaaaat

SEQ ID NO: 3151382 - DNA, 10 bp, Homo sapiens
tcctggccag

SEQ ID NO: 3151383 - DNA, 20 bp, Homo sapiens
tcctggcccactctgtaata

SEQ ID NO: 3151384 - DNA, 19 bp, Homo sapiens
tcctggccctccactcctc

SEQ ID NO: 3151385 - DNA, 22 bp, Homo sapiens
tcctggcctatccgctgccagc

SEQ ID NO: 3151386 - DNA, 12 bp, Homo sapiens
tcctggcctcaa

SEQ ID NO: 3151387 - DNA, 14 bp, Homo sapiens
tcctggctacatcc

SEQ ID NO: 3151388 - DNA, 13 bp, Homo sapiens
tcctggctcctga

SEQ ID NO: 3151389 - DNA, 12 bp, Homo sapiens
tcctggctgcgg

SEQ ID NO: 3151390 - DNA, 23 bp, Homo sapiens
tcctggctttttaactcccctgt

SEQ ID NO: 3151391 - DNA, 23 bp, Homo sapiens
tcctgggaagatgaggttctgag

SEQ ID NO: 3151392 - DNA, 18 bp, Homo sapiens
tcctgggagaacctcagg

SEQ ID NO: 3151393 - DNA, 20 bp, Homo sapiens
tcctgggagaacctcaggct

SEQ ID NO: 3151394 - DNA, 15 bp, Homo sapiens
tcctgggagacccat

SEQ ID NO: 3151395 - DNA, 23 bp, Homo sapiens
tcctgggagcccccaccacaaac

SEQ ID NO: 3151396 - DNA, 14 bp, Homo sapiens
tcctgggaggacag

SEQ ID NO: 3151397 - DNA, 12 bp, Homo sapiens
tcctgggagtga

SEQ ID NO: 3151398 - DNA, 16 bp, Homo sapiens
tcctgggcaaaggtat

SEQ ID NO: 3151399 - DNA, 23 bp, Homo sapiens
tcctgggcagcctttccagcctc

SEQ ID NO: 3151400 - DNA, 20 bp, Homo sapiens
tcctgggccagggatctctc

SEQ ID NO: 3151401 - DNA, 13 bp, Homo sapiens
tcctgggcctgcc

SEQ ID NO: 3151402 - DNA, 16 bp, Homo sapiens
tcctgggcctgtcccc

SEQ ID NO: 3151403 - DNA, 12 bp, Homo sapiens
tcctgggctcag

SEQ ID NO: 3151404 - DNA, 22 bp, Homo sapiens
tcctggggaaggtggagcagct

SEQ ID NO: 3151405 - DNA, 16 bp, Homo sapiens
tcctggggcagcactc

SEQ ID NO: 3151406 - DNA, 15 bp, Homo sapiens
tcctggggcctcttg

SEQ ID NO: 3151407 - DNA, 16 bp, Homo sapiens
tcctggggctctgtgc

SEQ ID NO: 3151408 - DNA, 19 bp, Homo sapiens
tcctggggctctgtgcagg

SEQ ID NO: 3151409 - DNA, 13 bp, Homo sapiens
tcctgggggtggc

SEQ ID NO: 3151410 - DNA, 15 bp, Homo sapiens
tcctgggggtggcag

SEQ ID NO: 3151411 - DNA, 16 bp, Homo sapiens
tcctgggggtggcagg

SEQ ID NO: 3151412 - DNA, 23 bp, Homo sapiens
tcctgggggttctttcttcctct

SEQ ID NO: 3151413 - DNA, 21 bp, Homo sapiens
tcctgggtgagtctgccaact

SEQ ID NO: 3151414 - DNA, 20 bp, Homo sapiens
tcctgggtttcctgcaggca

SEQ ID NO: 3151415 - DNA, 18 bp, Homo sapiens
tcctggtacccagccatc

SEQ ID NO: 3151416 - DNA, 14 bp, Homo sapiens
tcctggtgactcct

SEQ ID NO: 3151417 - DNA, 16 bp, Homo sapiens
tcctggtggccttctg

SEQ ID NO: 3151418 - DNA, 17 bp, Homo sapiens
tcctggtggccttctgc

SEQ ID NO: 3151419 - DNA, 14 bp, Homo sapiens
tcctggtgtcactt

SEQ ID NO: 3151420 - DNA, 15 bp, Homo sapiens
tcctggttcccgttt

SEQ ID NO: 3151421 - DNA, 22 bp, Homo sapiens
tcctggttccttcctatgccca

SEQ ID NO: 3151422 - DNA, 20 bp, Homo sapiens
tcctggttttgtacactgct

SEQ ID NO: 3151423 - DNA, 19 bp, Homo sapiens
tcctgtaaaggttacaagc

SEQ ID NO: 3151424 - DNA, 15 bp, Homo sapiens
tcctgtaacttttaa

SEQ ID NO: 3151425 - DNA, 17 bp, Homo sapiens
tcctgtacactgaatat

SEQ ID NO: 3151426 - DNA, 16 bp, Homo sapiens
tcctgtaccaaatctg

SEQ ID NO: 3151427 - DNA, 20 bp, Homo sapiens
tcctgtacctcagtggatct

SEQ ID NO: 3151428 - DNA, 21 bp, Homo sapiens
tcctgtagttgcgtggactct

SEQ ID NO: 3151429 - DNA, 22 bp, Homo sapiens
tcctgtataagcactgaaaaac

SEQ ID NO: 3151430 - DNA, 19 bp, Homo sapiens
tcctgtatgaaagattgtg

SEQ ID NO: 3151431 - DNA, 22 bp, Homo sapiens
tcctgtatgttgtacaatcaaa

SEQ ID NO: 3151432 - DNA, 20 bp, Homo sapiens
tcctgtattcttgttttaca

SEQ ID NO: 3151433 - DNA, 15 bp, Homo sapiens
tcctgtcagtgtttt

SEQ ID NO: 3151434 - DNA, 19 bp, Homo sapiens
tcctgtccactctcggggc

SEQ ID NO: 3151435 - DNA, 21 bp, Homo sapiens
tcctgtccactctcggggccc

SEQ ID NO: 3151436 - DNA, 13 bp, Homo sapiens
tcctgtcccagag

SEQ ID NO: 3151437 - DNA, 15 bp, Homo sapiens
tcctgtctctgcctg

SEQ ID NO: 3151438 - DNA, 15 bp, Homo sapiens
tcctgtcttccaaat

SEQ ID NO: 3151439 - DNA, 16 bp, Homo sapiens
tcctgtgaatgccact

SEQ ID NO: 3151440 - DNA, 12 bp, Homo sapiens
tcctgtgaatgg

SEQ ID NO: 3151441 - DNA, 21 bp, Homo sapiens
tcctgtgatccacccaaccct

SEQ ID NO: 3151442 - DNA, 18 bp, Homo sapiens
tcctgtgatcctttgatg

SEQ ID NO: 3151443 - DNA, 16 bp, Homo sapiens
tcctgtgcatgggtga

SEQ ID NO: 3151444 - DNA, 20 bp, Homo sapiens
tcctgtgctaagtctttccc

SEQ ID NO: 3151445 - DNA, 18 bp, Homo sapiens
tcctgtggagatgacttg

SEQ ID NO: 3151446 - DNA, 21 bp, Homo sapiens
tcctgtggcaggcagcgccaa

SEQ ID NO: 3151447 - DNA, 22 bp, Homo sapiens
tcctgtgtcagaaaccctggtc

SEQ ID NO: 3151448 - DNA, 23 bp, Homo sapiens
tcctgtgtcagaaaccctggtct

SEQ ID NO: 3151449 - DNA, 15 bp, Homo sapiens
tcctgtgtgcagtga

SEQ ID NO: 3151450 - DNA, 13 bp, Homo sapiens
tcctgtgtgtgcg

SEQ ID NO: 3151451 - DNA, 18 bp, Homo sapiens
tcctgtgtgtgcgcctac

SEQ ID NO: 3151452 - DNA, 18 bp, Homo sapiens
tcctgttacttacctaaa

SEQ ID NO: 3151453 - DNA, 19 bp, Homo sapiens
tcctgttgttgttaatgaa

SEQ ID NO: 3151454 - DNA, 18 bp, Homo sapiens
tcctgtttcctagctgtg

SEQ ID NO: 3151455 - DNA, 16 bp, Homo sapiens
tcctgtttttctgggt

SEQ ID NO: 3151456 - DNA, 20 bp, Homo sapiens
tcctgtttttctgggtggcc

SEQ ID NO: 3151457 - DNA, 18 bp, Homo sapiens
tccttaaaatgtaagatt

SEQ ID NO: 3151458 - DNA, 14 bp, Homo sapiens
tccttaaactgtgt

SEQ ID NO: 3151459 - DNA, 23 bp, Homo sapiens
tccttaaactgtgtggactgtga

SEQ ID NO: 3151460 - DNA, 13 bp, Homo sapiens
tccttaagaacac

SEQ ID NO: 3151461 - DNA, 16 bp, Homo sapiens
tccttaagaacacaaa

SEQ ID NO: 3151462 - DNA, 20 bp, Homo sapiens
tccttaataaatttaagttt

SEQ ID NO: 3151463 - DNA, 22 bp, Homo sapiens
tccttacaagttagaaaacata

SEQ ID NO: 3151464 - DNA, 18 bp, Homo sapiens
tccttagactcttttcct

SEQ ID NO: 3151465 - DNA, 19 bp, Homo sapiens
tccttagctttccctgtgc

SEQ ID NO: 3151466 - DNA, 20 bp, Homo sapiens
tccttagctttccctgtgcc

SEQ ID NO: 3151467 - DNA, 21 bp, Homo sapiens
tccttagctttccctgtgcca

SEQ ID NO: 3151468 - DNA, 24 bp, Homo sapiens
tccttagctttccctgtgccactt

SEQ ID NO: 3151469 - DNA, 20 bp, Homo sapiens
tccttaggagacgctgcact

SEQ ID NO: 3151470 - DNA, 15 bp, Homo sapiens
tccttagtcttctca

SEQ ID NO: 3151471 - DNA, 17 bp, Homo sapiens
tccttattccacagata

SEQ ID NO: 3151472 - DNA, 15 bp, Homo sapiens
tccttcaaaatcctt

SEQ ID NO: 3151473 - DNA, 16 bp, Homo sapiens
tccttcactgttccct

SEQ ID NO: 3151474 - DNA, 15 bp, Homo sapiens
tccttcactgtttca

SEQ ID NO: 3151475 - DNA, 14 bp, Homo sapiens
tccttcagatttgg

SEQ ID NO: 3151476 - DNA, 19 bp, Homo sapiens
tccttcatgacagcctcca

SEQ ID NO: 3151477 - DNA, 19 bp, Homo sapiens
tccttccaaagaattctta

SEQ ID NO: 3151478 - DNA, 23 bp, Homo sapiens
tccttccacagttatcttagctg

SEQ ID NO: 3151479 - DNA, 14 bp, Homo sapiens
tccttccacatgta

SEQ ID NO: 3151480 - DNA, 15 bp, Homo sapiens
tccttccaccaagtt

SEQ ID NO: 3151481 - DNA, 17 bp, Homo sapiens
tccttccacctccctcc

SEQ ID NO: 3151482 - DNA, 21 bp, Homo sapiens
tccttccaggcccccaccact

SEQ ID NO: 3151483 - DNA, 13 bp, Homo sapiens
tccttccagtggc

SEQ ID NO: 3151484 - DNA, 15 bp, Homo sapiens
tccttcccatgcctg

SEQ ID NO: 3151485 - DNA, 16 bp, Homo sapiens
tccttcccatgcctgt

SEQ ID NO: 3151486 - DNA, 18 bp, Homo sapiens
tccttcccatgcctgtct

SEQ ID NO: 3151487 - DNA, 23 bp, Homo sapiens
tccttcccatgcctgtctctgtt

SEQ ID NO: 3151488 - DNA, 15 bp, Homo sapiens
tccttccccaacttc

SEQ ID NO: 3151489 - DNA, 20 bp, Homo sapiens
tccttccccaacttccctag

SEQ ID NO: 3151490 - DNA, 22 bp, Homo sapiens
tccttccccctgtagactagtg

SEQ ID NO: 3151491 - DNA, 23 bp, Homo sapiens
tccttccctaactcaactgttgc

SEQ ID NO: 3151492 - DNA, 11 bp, Homo sapiens
tccttccctgt

SEQ ID NO: 3151493 - DNA, 12 bp, Homo sapiens
tccttccctgta

SEQ ID NO: 3151494 - DNA, 21 bp, Homo sapiens
tccttccctgttctccctttc

SEQ ID NO: 3151495 - DNA, 17 bp, Homo sapiens
tccttcctatgcccagg

SEQ ID NO: 3151496 - DNA, 15 bp, Homo sapiens
tccttccttcagggt

SEQ ID NO: 3151497 - DNA, 20 bp, Homo sapiens
tccttcggggcgatgctccc

SEQ ID NO: 3151498 - DNA, 23 bp, Homo sapiens
tccttcggggcgatgctccctca

SEQ ID NO: 3151499 - DNA, 17 bp, Homo sapiens
tccttcggtcttttgta

SEQ ID NO: 3151500 - DNA, 18 bp, Homo sapiens
tccttcgtgtctctccca

SEQ ID NO: 3151501 - DNA, 19 bp, Homo sapiens
tccttcgtgtctctcccac

SEQ ID NO: 3151502 - DNA, 20 bp, Homo sapiens
tccttctggcctttcctctc

SEQ ID NO: 3151503 - DNA, 20 bp, Homo sapiens
tccttctgtgaaagtacatt

SEQ ID NO: 3151504 - DNA, 15 bp, Homo sapiens
tccttctttgtctta

SEQ ID NO: 3151505 - DNA, 15 bp, Homo sapiens
tccttctttttaaaa

SEQ ID NO: 3151506 - DNA, 20 bp, Homo sapiens
tccttgaagaactgcaggcc

SEQ ID NO: 3151507 - DNA, 23 bp, Homo sapiens
tccttgaagaactgcaggccctg

SEQ ID NO: 3151508 - DNA, 14 bp, Homo sapiens
tccttgaccttcct

SEQ ID NO: 3151509 - DNA, 21 bp, Homo sapiens
tccttgaccttcctctggggc

SEQ ID NO: 3151510 - DNA, 13 bp, Homo sapiens
tccttgagactgg

SEQ ID NO: 3151511 - DNA, 13 bp, Homo sapiens
tccttgagcattt

SEQ ID NO: 3151512 - DNA, 16 bp, Homo sapiens
tccttgagtgctcttg

SEQ ID NO: 3151513 - DNA, 15 bp, Homo sapiens
tccttgcacccctca

SEQ ID NO: 3151514 - DNA, 22 bp, Homo sapiens
tccttgcacccctcactctggc

SEQ ID NO: 3151515 - DNA, 24 bp, Homo sapiens
tccttgcacccctcactctggcct

SEQ ID NO: 3151516 - DNA, 21 bp, Homo sapiens
tccttgcaggtgggggttgct

SEQ ID NO: 3151517 - DNA, 13 bp, Homo sapiens
tccttgccccaca

SEQ ID NO: 3151518 - DNA, 16 bp, Homo sapiens
tccttgccccacagtt

SEQ ID NO: 3151519 - DNA, 20 bp, Homo sapiens
tccttgccccacagttgtgt

SEQ ID NO: 3151520 - DNA, 17 bp, Homo sapiens
tccttgctgtcctaggc

SEQ ID NO: 3151521 - DNA, 22 bp, Homo sapiens
tccttggatcctgaatctgtgc

SEQ ID NO: 3151522 - DNA, 22 bp, Homo sapiens
tccttggcctagcccaccctgc

SEQ ID NO: 3151523 - DNA, 17 bp, Homo sapiens
tccttgggcacttttta

SEQ ID NO: 3151524 - DNA, 18 bp, Homo sapiens
tccttgggctcctggctg

SEQ ID NO: 3151525 - DNA, 16 bp, Homo sapiens
tccttggtctttgtat

SEQ ID NO: 3151526 - DNA, 17 bp, Homo sapiens
tccttggtctttgtatc

SEQ ID NO: 3151527 - DNA, 17 bp, Homo sapiens
tccttgtactcttagga

SEQ ID NO: 3151528 - DNA, 18 bp, Homo sapiens
tccttgtactcttaggat

SEQ ID NO: 3151529 - DNA, 19 bp, Homo sapiens
tccttgtctagtttcccac

SEQ ID NO: 3151530 - DNA, 22 bp, Homo sapiens
tcctttaaaaaaatttaagtgc

SEQ ID NO: 3151531 - DNA, 12 bp, Homo sapiens
tcctttacaaaa

SEQ ID NO: 3151532 - DNA, 15 bp, Homo sapiens
tcctttagcgcccag

SEQ ID NO: 3151533 - DNA, 22 bp, Homo sapiens
tcctttagcgcccagttgggtg

SEQ ID NO: 3151534 - DNA, 23 bp, Homo sapiens
tcctttagcgcccagttgggtgg

SEQ ID NO: 3151535 - DNA, 12 bp, Homo sapiens
tcctttatagag

SEQ ID NO: 3151536 - DNA, 16 bp, Homo sapiens
tcctttatatttagtg

SEQ ID NO: 3151537 - DNA, 23 bp, Homo sapiens
tcctttattataatcaaagctca

SEQ ID NO: 3151538 - DNA, 21 bp, Homo sapiens
tcctttcagggaatttcagga

SEQ ID NO: 3151539 - DNA, 23 bp, Homo sapiens
tcctttcagggaatttcaggaac

SEQ ID NO: 3151540 - DNA, 19 bp, Homo sapiens
tcctttcaggttttcaggt

SEQ ID NO: 3151541 - DNA, 15 bp, Homo sapiens
tcctttccccagccc

SEQ ID NO: 3151542 - DNA, 16 bp, Homo sapiens
tcctttccccagccca

SEQ ID NO: 3151543 - DNA, 17 bp, Homo sapiens
tcctttccccagcccag

SEQ ID NO: 3151544 - DNA, 18 bp, Homo sapiens
tcctttccccagcccagg

SEQ ID NO: 3151545 - DNA, 13 bp, Homo sapiens
tcctttcccttta

SEQ ID NO: 3151546 - DNA, 15 bp, Homo sapiens
tcctttctcatccca

SEQ ID NO: 3151547 - DNA, 16 bp, Homo sapiens
tcctttctcctgtgaa

SEQ ID NO: 3151548 - DNA, 17 bp, Homo sapiens
tcctttctcctgtgaat

SEQ ID NO: 3151549 - DNA, 19 bp, Homo sapiens
tcctttctcctgtgaatgg

SEQ ID NO: 3151550 - DNA, 23 bp, Homo sapiens
tcctttctctttctctcttccct

SEQ ID NO: 3151551 - DNA, 13 bp, Homo sapiens
tcctttctgccca

SEQ ID NO: 3151552 - DNA, 14 bp, Homo sapiens
tcctttctgccttg

SEQ ID NO: 3151553 - DNA, 15 bp, Homo sapiens
tcctttctgccttgg

SEQ ID NO: 3151554 - DNA, 20 bp, Homo sapiens
tcctttctgccttggcctcg

SEQ ID NO: 3151555 - DNA, 19 bp, Homo sapiens
tcctttcttgtctttcctc

SEQ ID NO: 3151556 - DNA, 13 bp, Homo sapiens
tcctttcttttcc

SEQ ID NO: 3151557 - DNA, 14 bp, Homo sapiens
tcctttctttttct

SEQ ID NO: 3151558 - DNA, 16 bp, Homo sapiens
tcctttctttttcttc

SEQ ID NO: 3151559 - DNA, 20 bp, Homo sapiens
tcctttctttttcttcttcc

SEQ ID NO: 3151560 - DNA, 18 bp, Homo sapiens
tcctttgaacctgtgcaa

SEQ ID NO: 3151561 - DNA, 13 bp, Homo sapiens
tcctttgacattt

SEQ ID NO: 3151562 - DNA, 21 bp, Homo sapiens
tcctttgaccactgtcttttt

SEQ ID NO: 3151563 - DNA, 22 bp, Homo sapiens
tcctttgaccactgtctttttc

SEQ ID NO: 3151564 - DNA, 21 bp, Homo sapiens
tcctttgagtgtcttctaact

SEQ ID NO: 3151565 - DNA, 22 bp, Homo sapiens
tcctttgatcagtataattttt

SEQ ID NO: 3151566 - DNA, 24 bp, Homo sapiens
tcctttgatggctttttttgccta

SEQ ID NO: 3151567 - DNA, 12 bp, Homo sapiens
tcctttgcaata

SEQ ID NO: 3151568 - DNA, 15 bp, Homo sapiens
tcctttgcactgagg

SEQ ID NO: 3151569 - DNA, 15 bp, Homo sapiens
tcctttgcagggcag

SEQ ID NO: 3151570 - DNA, 18 bp, Homo sapiens
tcctttgcagggcagccc

SEQ ID NO: 3151571 - DNA, 13 bp, Homo sapiens
tcctttgctcttg

SEQ ID NO: 3151572 - DNA, 15 bp, Homo sapiens
tcctttgtgtttcta

SEQ ID NO: 3151573 - DNA, 16 bp, Homo sapiens
tcctttgttctgagca

SEQ ID NO: 3151574 - DNA, 18 bp, Homo sapiens
tcctttgttttctgacta

SEQ ID NO: 3151575 - DNA, 13 bp, Homo sapiens
tccttttagccta

SEQ ID NO: 3151576 - DNA, 21 bp, Homo sapiens
tccttttatctggtgcctcct

SEQ ID NO: 3151577 - DNA, 23 bp, Homo sapiens
tccttttccgttctgttctgctg

SEQ ID NO: 3151578 - DNA, 14 bp, Homo sapiens
tccttttccttacc

SEQ ID NO: 3151579 - DNA, 20 bp, Homo sapiens
tccttttgactccttttgga

SEQ ID NO: 3151580 - DNA, 15 bp, Homo sapiens
tccttttggtgtgtt

SEQ ID NO: 3151581 - DNA, 14 bp, Homo sapiens
tccttttgtcccca

SEQ ID NO: 3151582 - DNA, 18 bp, Homo sapiens
tccttttgtccccagggc

SEQ ID NO: 3151583 - DNA, 19 bp, Homo sapiens
tccttttgtccccagggcc

SEQ ID NO: 3151584 - DNA, 17 bp, Homo sapiens
tccttttgtgtacagtg

SEQ ID NO: 3151585 - DNA, 18 bp, Homo sapiens
tccttttgtgtacagtgt

SEQ ID NO: 3151586 - DNA, 16 bp, Homo sapiens
tcctttttaaatgtga

SEQ ID NO: 3151587 - DNA, 18 bp, Homo sapiens
tcctttttaaatgtgaat

SEQ ID NO: 3151588 - DNA, 19 bp, Homo sapiens
tcctttttaaatgtgaatt

SEQ ID NO: 3151589 - DNA, 21 bp, Homo sapiens
tcctttttaaatgtgaatttt

SEQ ID NO: 3151590 - DNA, 12 bp, Homo sapiens
tcctttttaagg

SEQ ID NO: 3151591 - DNA, 13 bp, Homo sapiens
tcctttttataac

SEQ ID NO: 3151592 - DNA, 12 bp, Homo sapiens
tcctttttatga

SEQ ID NO: 3151593 - DNA, 21 bp, Homo sapiens
tcctttttatgaggcaacctg

SEQ ID NO: 3151594 - DNA, 16 bp, Homo sapiens
tcctttttccatcatt

SEQ ID NO: 3151595 - DNA, 18 bp, Homo sapiens
tcctttttccatcatttt

SEQ ID NO: 3151596 - DNA, 16 bp, Homo sapiens
tccttttttgtctatg

SEQ ID NO: 3151597 - DNA, 19 bp, Homo sapiens
tccttttttgtctatgaag

SEQ ID NO: 3151598 - DNA, 21 bp, Homo sapiens
tcctttttttccatctttaca

SEQ ID NO: 3151599 - DNA, 12 bp, Homo sapiens
tcgaaaaaataa

SEQ ID NO: 3151600 - DNA, 21 bp, Homo sapiens
tcgaaaattcatttcacatta

SEQ ID NO: 3151601 - DNA, 13 bp, Homo sapiens
tcgaaacacagaa

SEQ ID NO: 3151602 - DNA, 12 bp, Homo sapiens
tcgaaccaaggc

SEQ ID NO: 3151603 - DNA, 13 bp, Homo sapiens
tcgaaccaaggca

SEQ ID NO: 3151604 - DNA, 17 bp, Homo sapiens
tcgaaccaaggcagcct

SEQ ID NO: 3151605 - DNA, 14 bp, Homo sapiens
tcgaactggctgca

SEQ ID NO: 3151606 - DNA, 23 bp, Homo sapiens
tcgaagcgcgccactcgcttccc

SEQ ID NO: 3151607 - DNA, 20 bp, Homo sapiens
tcgaatctactaattccaca

SEQ ID NO: 3151608 - DNA, 14 bp, Homo sapiens
tcgaatgaaaagct

SEQ ID NO: 3151609 - DNA, 15 bp, Homo sapiens
tcgaattaagaatat

SEQ ID NO: 3151610 - DNA, 15 bp, Homo sapiens
tcgacagggcctgga

SEQ ID NO: 3151611 - DNA, 14 bp, Homo sapiens
tcgaccccaaagcc

SEQ ID NO: 3151612 - DNA, 15 bp, Homo sapiens
tcgaccgcacttatg

SEQ ID NO: 3151613 - DNA, 17 bp, Homo sapiens
tcgactggtccagctct

SEQ ID NO: 3151614 - DNA, 14 bp, Homo sapiens
tcgagacacttgcc

SEQ ID NO: 3151615 - DNA, 14 bp, Homo sapiens
tcgagaccagcctc

SEQ ID NO: 3151616 - DNA, 14 bp, Homo sapiens
tcgagaccagtctg

SEQ ID NO: 3151617 - DNA, 15 bp, Homo sapiens
tcgagaccatcctgg

SEQ ID NO: 3151618 - DNA, 16 bp, Homo sapiens
tcgagatttgggagct

SEQ ID NO: 3151619 - DNA, 17 bp, Homo sapiens
tcgagcagtcctgcctc

SEQ ID NO: 3151620 - DNA, 22 bp, Homo sapiens
tcgagcagtcctgcctcagcct

SEQ ID NO: 3151621 - DNA, 22 bp, Homo sapiens
tcgagccaactctaacaggcac

SEQ ID NO: 3151622 - DNA, 13 bp, Homo sapiens
tcgagccactgca

SEQ ID NO: 3151623 - DNA, 14 bp, Homo sapiens
tcgaggacagggag

SEQ ID NO: 3151624 - DNA, 20 bp, Homo sapiens
tcgaggagtaacaatacaaa

SEQ ID NO: 3151625 - DNA, 19 bp, Homo sapiens
tcgaggcaccggcgctgca

SEQ ID NO: 3151626 - DNA, 16 bp, Homo sapiens
tcgaggggctctcagc

SEQ ID NO: 3151627 - DNA, 22 bp, Homo sapiens
tcgagttggcaaaatggggttt

SEQ ID NO: 3151628 - DNA, 22 bp, Homo sapiens
tcgatactgcgactttctgcct

SEQ ID NO: 3151629 - DNA, 14 bp, Homo sapiens
tcgatccaaattgt

SEQ ID NO: 3151630 - DNA, 12 bp, Homo sapiens
tcgatctcctga

SEQ ID NO: 3151631 - DNA, 15 bp, Homo sapiens
tcgatgaaggctgcc

SEQ ID NO: 3151632 - DNA, 21 bp, Homo sapiens
tcgattgtgtagcaattgaca

SEQ ID NO: 3151633 - DNA, 11 bp, Homo sapiens
tcgatttctac

SEQ ID NO: 3151634 - DNA, 14 bp, Homo sapiens
tcgatttctacctc

SEQ ID NO: 3151635 - DNA, 16 bp, Homo sapiens
tcgatttctacctcag

SEQ ID NO: 3151636 - DNA, 23 bp, Homo sapiens
tcgcaaagacgtaataaaattaa

SEQ ID NO: 3151637 - DNA, 16 bp, Homo sapiens
tcgcacagtctctctc

SEQ ID NO: 3151638 - DNA, 19 bp, Homo sapiens
tcgcacccccctgttctaa

SEQ ID NO: 3151639 - DNA, 18 bp, Homo sapiens
tcgcacctaccatcaggg

SEQ ID NO: 3151640 - DNA, 14 bp, Homo sapiens
tcgcagaccagagc

SEQ ID NO: 3151641 - DNA, 14 bp, Homo sapiens
tcgcagctacataa

SEQ ID NO: 3151642 - DNA, 22 bp, Homo sapiens
tcgcaggagtctctgccaccca

SEQ ID NO: 3151643 - DNA, 21 bp, Homo sapiens
tcgcaggatccgctgccacca

SEQ ID NO: 3151644 - DNA, 14 bp, Homo sapiens
tcgcagtcgcagga

SEQ ID NO: 3151645 - DNA, 15 bp, Homo sapiens
tcgcatttgtcaatg

SEQ ID NO: 3151646 - DNA, 22 bp, Homo sapiens
tcgccaaggactgactgagaca

SEQ ID NO: 3151647 - DNA, 19 bp, Homo sapiens
tcgccacctttcaccctca

SEQ ID NO: 3151648 - DNA, 14 bp, Homo sapiens
tcgccagcttctcc

SEQ ID NO: 3151649 - DNA, 16 bp, Homo sapiens
tcgccagcttctcctg

SEQ ID NO: 3151650 - DNA, 13 bp, Homo sapiens
tcgccatgccggg

SEQ ID NO: 3151651 - DNA, 14 bp, Homo sapiens
tcgccatgccgggg

SEQ ID NO: 3151652 - DNA, 14 bp, Homo sapiens
tcgcccaggaaggc

SEQ ID NO: 3151653 - DNA, 19 bp, Homo sapiens
tcgcccaggctggagtgca

SEQ ID NO: 3151654 - DNA, 14 bp, Homo sapiens
tcgcccagtctgga

SEQ ID NO: 3151655 - DNA, 19 bp, Homo sapiens
tcgcccagtctggaatgca

SEQ ID NO: 3151656 - DNA, 23 bp, Homo sapiens
tcgcccagtctggaatgcagtgg

SEQ ID NO: 3151657 - DNA, 17 bp, Homo sapiens
tcgccccacctccacct

SEQ ID NO: 3151658 - DNA, 14 bp, Homo sapiens
tcgccctcctttct

SEQ ID NO: 3151659 - DNA, 20 bp, Homo sapiens
tcgcctaccaatctctgctc

SEQ ID NO: 3151660 - DNA, 20 bp, Homo sapiens
tcgcctgacaaccactggtc

SEQ ID NO: 3151661 - DNA, 22 bp, Homo sapiens
tcgcctgacaaccactggtctg

SEQ ID NO: 3151662 - DNA, 22 bp, Homo sapiens
tcgcctgagggaagagtagctg

SEQ ID NO: 3151663 - DNA, 18 bp, Homo sapiens
tcgcctgtggagctcagc

SEQ ID NO: 3151664 - DNA, 14 bp, Homo sapiens
tcgcgctcagtaaa

SEQ ID NO: 3151665 - DNA, 15 bp, Homo sapiens
tcgcgggcagcgggc

SEQ ID NO: 3151666 - DNA, 12 bp, Homo sapiens
tcgctcactgtt

SEQ ID NO: 3151667 - DNA, 16 bp, Homo sapiens
tcgctccctgtagctc

SEQ ID NO: 3151668 - DNA, 22 bp, Homo sapiens
tcgctccctgtagctctgcctc

SEQ ID NO: 3151669 - DNA, 11 bp, Homo sapiens
tcgctcctagg

SEQ ID NO: 3151670 - DNA, 16 bp, Homo sapiens
tcgctcctcaacccct

SEQ ID NO: 3151671 - DNA, 19 bp, Homo sapiens
tcgctcctcaacccctccc

SEQ ID NO: 3151672 - DNA, 14 bp, Homo sapiens
tcgctctcagttct

SEQ ID NO: 3151673 - DNA, 18 bp, Homo sapiens
tcgctgaattgcccgttt

SEQ ID NO: 3151674 - DNA, 22 bp, Homo sapiens
tcgctgagggcagactggggca

SEQ ID NO: 3151675 - DNA, 22 bp, Homo sapiens
tcgctgccatcaccgctgggtg

SEQ ID NO: 3151676 - DNA, 23 bp, Homo sapiens
tcgctgccatcaccgctgggtgg

SEQ ID NO: 3151677 - DNA, 18 bp, Homo sapiens
tcgctgccctctctgcca

SEQ ID NO: 3151678 - DNA, 17 bp, Homo sapiens
tcgctgctctagctggc

SEQ ID NO: 3151679 - DNA, 18 bp, Homo sapiens
tcgctgctctagctggca

SEQ ID NO: 3151680 - DNA, 21 bp, Homo sapiens
tcgctgctctagctggcagga

SEQ ID NO: 3151681 - DNA, 13 bp, Homo sapiens
tcgctggctccta

SEQ ID NO: 3151682 - DNA, 22 bp, Homo sapiens
tcgctggctcctaccccatctc

SEQ ID NO: 3151683 - DNA, 23 bp, Homo sapiens
tcgctggctcctaccccatctcc

SEQ ID NO: 3151684 - DNA, 21 bp, Homo sapiens
tcgctgttggagcaaaccatt

SEQ ID NO: 3151685 - DNA, 19 bp, Homo sapiens
tcgcttcttgcctctgtgc

SEQ ID NO: 3151686 - DNA, 15 bp, Homo sapiens
tcgcttgagcccagg

SEQ ID NO: 3151687 - DNA, 18 bp, Homo sapiens
tcgcttgagcccaggagt

SEQ ID NO: 3151688 - DNA, 16 bp, Homo sapiens
tcgcttggctccatgc

SEQ ID NO: 3151689 - DNA, 22 bp, Homo sapiens
tcgcttggctccatgctcctca

SEQ ID NO: 3151690 - DNA, 22 bp, Homo sapiens
tcggaaaagcgtctttaagaga

SEQ ID NO: 3151691 - DNA, 14 bp, Homo sapiens
tcggaacagcagat

SEQ ID NO: 3151692 - DNA, 20 bp, Homo sapiens
tcggaacccaagcttagaac

SEQ ID NO: 3151693 - DNA, 16 bp, Homo sapiens
tcggaaccgctcacct

SEQ ID NO: 3151694 - DNA, 20 bp, Homo sapiens
tcggaaccgctcacctagag

SEQ ID NO: 3151695 - DNA, 18 bp, Homo sapiens
tcggaactgtcctttcct

SEQ ID NO: 3151696 - DNA, 19 bp, Homo sapiens
tcggacaagacccccagca

SEQ ID NO: 3151697 - DNA, 21 bp, Homo sapiens
tcggacagcccatctgcctgt

SEQ ID NO: 3151698 - DNA, 21 bp, Homo sapiens
tcggacatgcttttctgccac

SEQ ID NO: 3151699 - DNA, 22 bp, Homo sapiens
tcggacatgcttttctgccact

SEQ ID NO: 3151700 - DNA, 21 bp, Homo sapiens
tcggacccaccaaactgcaca

SEQ ID NO: 3151701 - DNA, 22 bp, Homo sapiens
tcggacccaccaaactgcacac

SEQ ID NO: 3151702 - DNA, 14 bp, Homo sapiens
tcggagacagtgat

SEQ ID NO: 3151703 - DNA, 23 bp, Homo sapiens
tcggagacagtgatctccatatg

SEQ ID NO: 3151704 - DNA, 17 bp, Homo sapiens
tcggagactatggcctc

SEQ ID NO: 3151705 - DNA, 14 bp, Homo sapiens
tcggagagcagcag

SEQ ID NO: 3151706 - DNA, 16 bp, Homo sapiens
tcggagcatcccggag

SEQ ID NO: 3151707 - DNA, 19 bp, Homo sapiens
tcggagcatggtgttttca

SEQ ID NO: 3151708 - DNA, 13 bp, Homo sapiens
tcggagctcctgt

SEQ ID NO: 3151709 - DNA, 19 bp, Homo sapiens
tcggaggctgggcccctgg

SEQ ID NO: 3151710 - DNA, 20 bp, Homo sapiens
tcggagggatggagaaagaa

SEQ ID NO: 3151711 - DNA, 13 bp, Homo sapiens
tcggagtttctta

SEQ ID NO: 3151712 - DNA, 21 bp, Homo sapiens
tcggatgacaccctggcctga

SEQ ID NO: 3151713 - DNA, 22 bp, Homo sapiens
tcggatgaccaaaccagccttc

SEQ ID NO: 3151714 - DNA, 16 bp, Homo sapiens
tcggattttttccaaa

SEQ ID NO: 3151715 - DNA, 17 bp, Homo sapiens
tcggattttttccaaaa

SEQ ID NO: 3151716 - DNA, 18 bp, Homo sapiens
tcggcaactaagcagtcc

SEQ ID NO: 3151717 - DNA, 12 bp, Homo sapiens
tcggcaggaagg

SEQ ID NO: 3151718 - DNA, 16 bp, Homo sapiens
tcggcatttcaaatgt

SEQ ID NO: 3151719 - DNA, 14 bp, Homo sapiens
tcggccccacatgg

SEQ ID NO: 3151720 - DNA, 14 bp, Homo sapiens
tcggccctgcccaa

SEQ ID NO: 3151721 - DNA, 15 bp, Homo sapiens
tcggcctccatcctg

SEQ ID NO: 3151722 - DNA, 14 bp, Homo sapiens
tcggctcaggctct

SEQ ID NO: 3151723 - DNA, 23 bp, Homo sapiens
tcggctccgggcaaatggctgag

SEQ ID NO: 3151724 - DNA, 13 bp, Homo sapiens
tcggctctgggtg

SEQ ID NO: 3151725 - DNA, 16 bp, Homo sapiens
tcggctgaccatgctc

SEQ ID NO: 3151726 - DNA, 23 bp, Homo sapiens
tcggcttgtgggctggtgcccca

SEQ ID NO: 3151727 - DNA, 14 bp, Homo sapiens
tcgggaaagaagaa

SEQ ID NO: 3151728 - DNA, 14 bp, Homo sapiens
tcgggaacagtgtt

SEQ ID NO: 3151729 - DNA, 19 bp, Homo sapiens
tcgggaagcagccagctcc

SEQ ID NO: 3151730 - DNA, 19 bp, Homo sapiens
tcgggacacctgccctgcc

SEQ ID NO: 3151731 - DNA, 16 bp, Homo sapiens
tcgggagacagcatca

SEQ ID NO: 3151732 - DNA, 20 bp, Homo sapiens
tcgggagcacccagagcacc

SEQ ID NO: 3151733 - DNA, 21 bp, Homo sapiens
tcgggagtcctctagcaggcc

SEQ ID NO: 3151734 - DNA, 12 bp, Homo sapiens
tcgggattcttt

SEQ ID NO: 3151735 - DNA, 15 bp, Homo sapiens
tcgggcaccagccag

SEQ ID NO: 3151736 - DNA, 16 bp, Homo sapiens
tcgggcaccagccagc

SEQ ID NO: 3151737 - DNA, 15 bp, Homo sapiens
tcgggcagccagcag

SEQ ID NO: 3151738 - DNA, 14 bp, Homo sapiens
tcgggccacagggc

SEQ ID NO: 3151739 - DNA, 17 bp, Homo sapiens
tcgggcccacctggcca

SEQ ID NO: 3151740 - DNA, 16 bp, Homo sapiens
tcgggccgaggcccag

SEQ ID NO: 3151741 - DNA, 18 bp, Homo sapiens
tcggggcatgctggggca

SEQ ID NO: 3151742 - DNA, 17 bp, Homo sapiens
tcggggcccttggggcc

SEQ ID NO: 3151743 - DNA, 22 bp, Homo sapiens
tcggggcccttggggcctggct

SEQ ID NO: 3151744 - DNA, 23 bp, Homo sapiens
tcggggcccttggggcctggctt

SEQ ID NO: 3151745 - DNA, 18 bp, Homo sapiens
tcggggcgatgctccctc

SEQ ID NO: 3151746 - DNA, 20 bp, Homo sapiens
tcggggcgatgctccctcag

SEQ ID NO: 3151747 - DNA, 21 bp, Homo sapiens
tcggggcgatgctccctcagc

SEQ ID NO: 3151748 - DNA, 22 bp, Homo sapiens
tcggggcgatgctccctcagcc

SEQ ID NO: 3151749 - DNA, 16 bp, Homo sapiens
tcggtaggttcagcca

SEQ ID NO: 3151750 - DNA, 23 bp, Homo sapiens
tcggttccacgtccccctggggc

SEQ ID NO: 3151751 - DNA, 18 bp, Homo sapiens
tcggttctccagaatgta

SEQ ID NO: 3151752 - DNA, 13 bp, Homo sapiens
tcggtttctccaa

SEQ ID NO: 3151753 - DNA, 22 bp, Homo sapiens
tcggtttgccaaaattcatttc

SEQ ID NO: 3151754 - DNA, 15 bp, Homo sapiens
tcgtaaagatttggg

SEQ ID NO: 3151755 - DNA, 16 bp, Homo sapiens
tcgtacagaaagctgc

SEQ ID NO: 3151756 - DNA, 15 bp, Homo sapiens
tcgtaccgcttcctt

SEQ ID NO: 3151757 - DNA, 16 bp, Homo sapiens
tcgtaccgcttcctta

SEQ ID NO: 3151758 - DNA, 17 bp, Homo sapiens
tcgtaccgcttccttag

SEQ ID NO: 3151759 - DNA, 19 bp, Homo sapiens
tcgtccacaggggcaggcc

SEQ ID NO: 3151760 - DNA, 22 bp, Homo sapiens
tcgtccacaggggcaggcctgg

SEQ ID NO: 3151761 - DNA, 12 bp, Homo sapiens
tcgtctgtgaat

SEQ ID NO: 3151762 - DNA, 13 bp, Homo sapiens
tcgtctgtgaatg

SEQ ID NO: 3151763 - DNA, 17 bp, Homo sapiens
tcgtctgtgaatgctaa

SEQ ID NO: 3151764 - DNA, 12 bp, Homo sapiens
tcgtcttcactc

SEQ ID NO: 3151765 - DNA, 20 bp, Homo sapiens
tcgtctttcccatggggagg

SEQ ID NO: 3151766 - DNA, 19 bp, Homo sapiens
tcgtgaacatcccctccca

SEQ ID NO: 3151767 - DNA, 13 bp, Homo sapiens
tcgtgacaacact

SEQ ID NO: 3151768 - DNA, 19 bp, Homo sapiens
tcgtgacccttcagggcca

SEQ ID NO: 3151769 - DNA, 14 bp, Homo sapiens
tcgtgagctgggga

SEQ ID NO: 3151770 - DNA, 13 bp, Homo sapiens
tcgtgaggggcaa

SEQ ID NO: 3151771 - DNA, 18 bp, Homo sapiens
tcgtgccatgatctgtat

SEQ ID NO: 3151772 - DNA, 18 bp, Homo sapiens
tcgtgcctgggggagaga

SEQ ID NO: 3151773 - DNA, 14 bp, Homo sapiens
tcgtgcctgtgtcc

SEQ ID NO: 3151774 - DNA, 22 bp, Homo sapiens
tcgtgctactgcactccagcct

SEQ ID NO: 3151775 - DNA, 21 bp, Homo sapiens
tcgtggcagataatcagcctc

SEQ ID NO: 3151776 - DNA, 17 bp, Homo sapiens
tcgtggccagcccggct

SEQ ID NO: 3151777 - DNA, 11 bp, Homo sapiens
tcgtggccttc

SEQ ID NO: 3151778 - DNA, 22 bp, Homo sapiens
tcgtggtgatcaattaaatgta

SEQ ID NO: 3151779 - DNA, 19 bp, Homo sapiens
tcgtggttattagcaaggc

SEQ ID NO: 3151780 - DNA, 17 bp, Homo sapiens
tcgtgtaattggcccaa

SEQ ID NO: 3151781 - DNA, 19 bp, Homo sapiens
tcgtgtagtggaagagcag

SEQ ID NO: 3151782 - DNA, 15 bp, Homo sapiens
tcgtgtatttattac

SEQ ID NO: 3151783 - DNA, 17 bp, Homo sapiens
tcgtgtggatcttgcca

SEQ ID NO: 3151784 - DNA, 16 bp, Homo sapiens
tcgttaaaaagttgtt

SEQ ID NO: 3151785 - DNA, 18 bp, Homo sapiens
tcgttcaaaacattccaa

SEQ ID NO: 3151786 - DNA, 20 bp, Homo sapiens
tcgttcaaaacattccaaga

SEQ ID NO: 3151787 - DNA, 22 bp, Homo sapiens
tcgtttaccttcaaactttagg

SEQ ID NO: 3151788 - DNA, 20 bp, Homo sapiens
tcgtttgtttgtttgtttaa

SEQ ID NO: 3151789 - DNA, 11 bp, Homo sapiens
tcgtttttgta

SEQ ID NO: 3151790 - DNA, 20 bp, Homo sapiens
tcgtttttgtattttcatga

SEQ ID NO: 3151791 - DNA, 22 bp, Homo sapiens
tctaaaaataaaccaaaggaca

SEQ ID NO: 3151792 - DNA, 14 bp, Homo sapiens
tctaaaacattccc

SEQ ID NO: 3151793 - DNA, 22 bp, Homo sapiens
tctaaaacattcccctccccac

SEQ ID NO: 3151794 - DNA, 14 bp, Homo sapiens
tctaaaacttcaaa

SEQ ID NO: 3151795 - DNA, 12 bp, Homo sapiens
tctaaaagcacc

SEQ ID NO: 3151796 - DNA, 18 bp, Homo sapiens
tctaaaaggtaatgtgtg

SEQ ID NO: 3151797 - DNA, 23 bp, Homo sapiens
tctaaaatcttatagttctaggc

SEQ ID NO: 3151798 - DNA, 18 bp, Homo sapiens
tctaaaattataaatgac

SEQ ID NO: 3151799 - DNA, 21 bp, Homo sapiens
tctaaacaagaaccatttgca

SEQ ID NO: 3151800 - DNA, 22 bp, Homo sapiens
tctaaacaagaaccatttgcaa

SEQ ID NO: 3151801 - DNA, 13 bp, Homo sapiens
tctaaacattaat

SEQ ID NO: 3151802 - DNA, 14 bp, Homo sapiens
tctaaacattaatc

SEQ ID NO: 3151803 - DNA, 17 bp, Homo sapiens
tctaaactggtacaatt

SEQ ID NO: 3151804 - DNA, 18 bp, Homo sapiens
tctaaagaccaaacttca

SEQ ID NO: 3151805 - DNA, 12 bp, Homo sapiens
tctaaagagcac

SEQ ID NO: 3151806 - DNA, 15 bp, Homo sapiens
tctaaagagcactta

SEQ ID NO: 3151807 - DNA, 22 bp, Homo sapiens
tctaaagatcaagtgggccttg

SEQ ID NO: 3151808 - DNA, 19 bp, Homo sapiens
tctaaagatggagtttcta

SEQ ID NO: 3151809 - DNA, 21 bp, Homo sapiens
tctaaagatggagtttctaag

SEQ ID NO: 3151810 - DNA, 20 bp, Homo sapiens
tctaaagattctatagttct

SEQ ID NO: 3151811 - DNA, 18 bp, Homo sapiens
tctaaagctttggacaag

SEQ ID NO: 3151812 - DNA, 20 bp, Homo sapiens
tctaaagggatctgcttaaa

SEQ ID NO: 3151813 - DNA, 14 bp, Homo sapiens
tctaaaggtccaca

SEQ ID NO: 3151814 - DNA, 19 bp, Homo sapiens
tctaaagtgtgttgttgct

SEQ ID NO: 3151815 - DNA, 12 bp, Homo sapiens
tctaaagtgttg

SEQ ID NO: 3151816 - DNA, 15 bp, Homo sapiens
tctaaagtgttggtc

SEQ ID NO: 3151817 - DNA, 22 bp, Homo sapiens
tctaaagtgttggtctttctaa

SEQ ID NO: 3151818 - DNA, 11 bp, Homo sapiens
tctaaagttct

SEQ ID NO: 3151819 - DNA, 13 bp, Homo sapiens
tctaaagttctaa

SEQ ID NO: 3151820 - DNA, 13 bp, Homo sapiens
tctaaatatttcc

SEQ ID NO: 3151821 - DNA, 17 bp, Homo sapiens
tctaaatcaagtattta

SEQ ID NO: 3151822 - DNA, 14 bp, Homo sapiens
tctaaatctattta

SEQ ID NO: 3151823 - DNA, 14 bp, Homo sapiens
tctaaatgcatatc

SEQ ID NO: 3151824 - DNA, 20 bp, Homo sapiens
tctaaatggtgctgcagatt

SEQ ID NO: 3151825 - DNA, 21 bp, Homo sapiens
tctaaatggtgctgcagattt

SEQ ID NO: 3151826 - DNA, 17 bp, Homo sapiens
tctaaatttcttttgct

SEQ ID NO: 3151827 - DNA, 13 bp, Homo sapiens
tctaaatttgaat

SEQ ID NO: 3151828 - DNA, 19 bp, Homo sapiens
tctaacactggcatgttca

SEQ ID NO: 3151829 - DNA, 12 bp, Homo sapiens
tctaacagccct

SEQ ID NO: 3151830 - DNA, 13 bp, Homo sapiens
tctaacagccctc

SEQ ID NO: 3151831 - DNA, 20 bp, Homo sapiens
tctaacagccctcctctgca

SEQ ID NO: 3151832 - DNA, 16 bp, Homo sapiens
tctaacaggcactttg

SEQ ID NO: 3151833 - DNA, 23 bp, Homo sapiens
tctaaccattaagtcatgtgtga

SEQ ID NO: 3151834 - DNA, 20 bp, Homo sapiens
tctaaccctcccatggcacc

SEQ ID NO: 3151835 - DNA, 17 bp, Homo sapiens
tctaacggtctgttctg

SEQ ID NO: 3151836 - DNA, 16 bp, Homo sapiens
tctaactcagaattat

SEQ ID NO: 3151837 - DNA, 15 bp, Homo sapiens
tctaactcctgccat

SEQ ID NO: 3151838 - DNA, 13 bp, Homo sapiens
tctaactttagaa

SEQ ID NO: 3151839 - DNA, 11 bp, Homo sapiens
tctaagaaaag

SEQ ID NO: 3151840 - DNA, 12 bp, Homo sapiens
tctaagaaaccc

SEQ ID NO: 3151841 - DNA, 19 bp, Homo sapiens
tctaagaataataaaatca

SEQ ID NO: 3151842 - DNA, 16 bp, Homo sapiens
tctaagactatatata

SEQ ID NO: 3151843 - DNA, 16 bp, Homo sapiens
tctaagactcaaatgt

SEQ ID NO: 3151844 - DNA, 19 bp, Homo sapiens
tctaagactcaaatgttct

SEQ ID NO: 3151845 - DNA, 20 bp, Homo sapiens
tctaagacttactctaagat

SEQ ID NO: 3151846 - DNA, 21 bp, Homo sapiens
tctaagatagtaacaatgaag

SEQ ID NO: 3151847 - DNA, 17 bp, Homo sapiens
tctaagatcttagattc

SEQ ID NO: 3151848 - DNA, 19 bp, Homo sapiens
tctaagatcttagattctc

SEQ ID NO: 3151849 - DNA, 22 bp, Homo sapiens
tctaagatgtgatattctaaga

SEQ ID NO: 3151850 - DNA, 24 bp, Homo sapiens
tctaagatgtgatattctaagact

SEQ ID NO: 3151851 - DNA, 19 bp, Homo sapiens
tctaagattctaaaggtcc

SEQ ID NO: 3151852 - DNA, 20 bp, Homo sapiens
tctaagattctaatgatgat

SEQ ID NO: 3151853 - DNA, 15 bp, Homo sapiens
tctaagattctagat

SEQ ID NO: 3151854 - DNA, 19 bp, Homo sapiens
tctaagattctagatcaga

SEQ ID NO: 3151855 - DNA, 12 bp, Homo sapiens
tctaagattctg

SEQ ID NO: 3151856 - DNA, 17 bp, Homo sapiens
tctaagccagttttcat

SEQ ID NO: 3151857 - DNA, 23 bp, Homo sapiens
tctaaggatgtcacagggccaac

SEQ ID NO: 3151858 - DNA, 19 bp, Homo sapiens
tctaaggcctaggattcta

SEQ ID NO: 3151859 - DNA, 20 bp, Homo sapiens
tctaaggcctaggattctaa

SEQ ID NO: 3151860 - DNA, 21 bp, Homo sapiens
tctaaggcctaggattctaaa

SEQ ID NO: 3151861 - DNA, 14 bp, Homo sapiens
tctaaggctctgag

SEQ ID NO: 3151862 - DNA, 16 bp, Homo sapiens
tctaaggctctgagag

SEQ ID NO: 3151863 - DNA, 20 bp, Homo sapiens
tctaaggctctgagagtcta

SEQ ID NO: 3151864 - DNA, 23 bp, Homo sapiens
tctaaggctctgagagtctagat

SEQ ID NO: 3151865 - DNA, 13 bp, Homo sapiens
tctaagtgatata

SEQ ID NO: 3151866 - DNA, 13 bp, Homo sapiens
tctaagtttctaa

SEQ ID NO: 3151867 - DNA, 18 bp, Homo sapiens
tctaagtttctaagattc

SEQ ID NO: 3151868 - DNA, 22 bp, Homo sapiens
tctaataaacttggattctcta

SEQ ID NO: 3151869 - DNA, 15 bp, Homo sapiens
tctaataatttctaa

SEQ ID NO: 3151870 - DNA, 20 bp, Homo sapiens
tctaatacctctgtgtgctc

SEQ ID NO: 3151871 - DNA, 21 bp, Homo sapiens
tctaatagcgggttactttca

SEQ ID NO: 3151872 - DNA, 13 bp, Homo sapiens
tctaatagtgctt

SEQ ID NO: 3151873 - DNA, 14 bp, Homo sapiens
tctaatatgtaaca

SEQ ID NO: 3151874 - DNA, 18 bp, Homo sapiens
tctaatattaaaaatatg

SEQ ID NO: 3151875 - DNA, 16 bp, Homo sapiens
tctaatcatctgcagt

SEQ ID NO: 3151876 - DNA, 17 bp, Homo sapiens
tctaatcgaaagaaaat

SEQ ID NO: 3151877 - DNA, 17 bp, Homo sapiens
tctaatgtcttcatttc

SEQ ID NO: 3151878 - DNA, 14 bp, Homo sapiens
tctaatgtgaaaat

SEQ ID NO: 3151879 - DNA, 20 bp, Homo sapiens
tctaatgttccccgtggcta

SEQ ID NO: 3151880 - DNA, 23 bp, Homo sapiens
tctaattaaccttactaattata

SEQ ID NO: 3151881 - DNA, 17 bp, Homo sapiens
tctaattaattgtaatc

SEQ ID NO: 3151882 - DNA, 16 bp, Homo sapiens
tctaattcacagtgct

SEQ ID NO: 3151883 - DNA, 19 bp, Homo sapiens
tctaattcccattttgcaa

SEQ ID NO: 3151884 - DNA, 19 bp, Homo sapiens
tctaattctattaaagtgc

SEQ ID NO: 3151885 - DNA, 13 bp, Homo sapiens
tctaatttataaa

SEQ ID NO: 3151886 - DNA, 14 bp, Homo sapiens
tctaatttataaaa

SEQ ID NO: 3151887 - DNA, 22 bp, Homo sapiens
tctaatttatcttgtctctggg

SEQ ID NO: 3151888 - DNA, 23 bp, Homo sapiens
tctaatttatcttgtctctgggc

SEQ ID NO: 3151889 - DNA, 19 bp, Homo sapiens
tctaatttcaaaaatataa

SEQ ID NO: 3151890 - DNA, 20 bp, Homo sapiens
tctaatttcaaaaatataac

SEQ ID NO: 3151891 - DNA, 17 bp, Homo sapiens
tctaatttgcattgtgt

SEQ ID NO: 3151892 - DNA, 16 bp, Homo sapiens
tctacaaaaaggtata

SEQ ID NO: 3151893 - DNA, 18 bp, Homo sapiens
tctacaaatataagattt

SEQ ID NO: 3151894 - DNA, 19 bp, Homo sapiens
tctacaaatataagatttt

SEQ ID NO: 3151895 - DNA, 14 bp, Homo sapiens
tctacaactggagt

SEQ ID NO: 3151896 - DNA, 14 bp, Homo sapiens
tctacaatctcttt

SEQ ID NO: 3151897 - DNA, 19 bp, Homo sapiens
tctacaatctctttttgtt

SEQ ID NO: 3151898 - DNA, 15 bp, Homo sapiens
tctacaatgtgaact

SEQ ID NO: 3151899 - DNA, 20 bp, Homo sapiens
tctacaatgtgaactttatt

SEQ ID NO: 3151900 - DNA, 16 bp, Homo sapiens
tctacacaatttaatt

SEQ ID NO: 3151901 - DNA, 18 bp, Homo sapiens
tctacacagtgggaactc

SEQ ID NO: 3151902 - DNA, 23 bp, Homo sapiens
tctacacagtgggaactctgaca

SEQ ID NO: 3151903 - DNA, 15 bp, Homo sapiens
tctacactcatctta

SEQ ID NO: 3151904 - DNA, 19 bp, Homo sapiens
tctacactcttgtaataaa

SEQ ID NO: 3151905 - DNA, 17 bp, Homo sapiens
tctacagacttctccag

SEQ ID NO: 3151906 - DNA, 21 bp, Homo sapiens
tctacagatcctttttccatc

SEQ ID NO: 3151907 - DNA, 23 bp, Homo sapiens
tctacagatcctttttccatcat

SEQ ID NO: 3151908 - DNA, 19 bp, Homo sapiens
tctacagccttgtccccct

SEQ ID NO: 3151909 - DNA, 23 bp, Homo sapiens
tctacagctaatcagcattctca

SEQ ID NO: 3151910 - DNA, 23 bp, Homo sapiens
tctacaggacaaagggagggagc

SEQ ID NO: 3151911 - DNA, 12 bp, Homo sapiens
tctacagtggtt

SEQ ID NO: 3151912 - DNA, 13 bp, Homo sapiens
tctacagtgtcct

SEQ ID NO: 3151913 - DNA, 23 bp, Homo sapiens
tctacagttaattatgtgcatat

SEQ ID NO: 3151914 - DNA, 17 bp, Homo sapiens
tctacatcttctgcctt

SEQ ID NO: 3151915 - DNA, 14 bp, Homo sapiens
tctacattattgct

SEQ ID NO: 3151916 - DNA, 15 bp, Homo sapiens
tctacattattgctt

SEQ ID NO: 3151917 - DNA, 12 bp, Homo sapiens
tctacatttcac

SEQ ID NO: 3151918 - DNA, 16 bp, Homo sapiens
tctacatttctgcaga

SEQ ID NO: 3151919 - DNA, 16 bp, Homo sapiens
tctaccaggcaaattc

SEQ ID NO: 3151920 - DNA, 19 bp, Homo sapiens
tctaccatgaacagaaaac

SEQ ID NO: 3151921 - DNA, 18 bp, Homo sapiens
tctaccatttcagagagg

SEQ ID NO: 3151922 - DNA, 16 bp, Homo sapiens
tctacccatgagcctg

SEQ ID NO: 3151923 - DNA, 16 bp, Homo sapiens
tctaccccagactaga

SEQ ID NO: 3151924 - DNA, 21 bp, Homo sapiens
tctaccccagactagatgtag

SEQ ID NO: 3151925 - DNA, 12 bp, Homo sapiens
tctacccctgct

SEQ ID NO: 3151926 - DNA, 16 bp, Homo sapiens
tctaccctcccacccc

SEQ ID NO: 3151927 - DNA, 16 bp, Homo sapiens
tctacctgaggccagg

SEQ ID NO: 3151928 - DNA, 22 bp, Homo sapiens
tctacctgtacacattcctgca

SEQ ID NO: 3151929 - DNA, 17 bp, Homo sapiens
tctaccttgaggtcttt

SEQ ID NO: 3151930 - DNA, 21 bp, Homo sapiens
tctacggatcatcaacaagat

SEQ ID NO: 3151931 - DNA, 20 bp, Homo sapiens
tctactaaaaatacaaaaat

SEQ ID NO: 3151932 - DNA, 15 bp, Homo sapiens
tctactaattccaca

SEQ ID NO: 3151933 - DNA, 16 bp, Homo sapiens
tctactatatacatat

SEQ ID NO: 3151934 - DNA, 17 bp, Homo sapiens
tctactcctacctcagc

SEQ ID NO: 3151935 - DNA, 22 bp, Homo sapiens
tctactcctacctcagcctaga

SEQ ID NO: 3151936 - DNA, 14 bp, Homo sapiens
tctacttcatagct

SEQ ID NO: 3151937 - DNA, 16 bp, Homo sapiens
tctactttaagcacta

SEQ ID NO: 3151938 - DNA, 16 bp, Homo sapiens
tctagaaagaaaagac

SEQ ID NO: 3151939 - DNA, 22 bp, Homo sapiens
tctagaaatacacttttttcca

SEQ ID NO: 3151940 - DNA, 16 bp, Homo sapiens
tctagaacacaggcaa

SEQ ID NO: 3151941 - DNA, 17 bp, Homo sapiens
tctagaacacaggcaaa

SEQ ID NO: 3151942 - DNA, 22 bp, Homo sapiens
tctagaaccttctagaacctgg

SEQ ID NO: 3151943 - DNA, 22 bp, Homo sapiens
tctagaatctgcaattcaaaag

SEQ ID NO: 3151944 - DNA, 19 bp, Homo sapiens
tctagaatttatcacactt

SEQ ID NO: 3151945 - DNA, 19 bp, Homo sapiens
tctagaattttaagtgctt

SEQ ID NO: 3151946 - DNA, 23 bp, Homo sapiens
tctagacaatatacaagccaaag

SEQ ID NO: 3151947 - DNA, 14 bp, Homo sapiens
tctagacactgcca

SEQ ID NO: 3151948 - DNA, 18 bp, Homo sapiens
tctagacatggaggttct

SEQ ID NO: 3151949 - DNA, 14 bp, Homo sapiens
tctagactttctgt

SEQ ID NO: 3151950 - DNA, 15 bp, Homo sapiens
tctagactttctgtt

SEQ ID NO: 3151951 - DNA, 15 bp, Homo sapiens
tctagagcagggatt

SEQ ID NO: 3151952 - DNA, 12 bp, Homo sapiens
tctagaggcctc

SEQ ID NO: 3151953 - DNA, 13 bp, Homo sapiens
tctagagtccaag

SEQ ID NO: 3151954 - DNA, 15 bp, Homo sapiens
tctagagtccaaggt

SEQ ID NO: 3151955 - DNA, 20 bp, Homo sapiens
tctagagtccaaggtttaaa

SEQ ID NO: 3151956 - DNA, 16 bp, Homo sapiens
tctagatcagatgctc

SEQ ID NO: 3151957 - DNA, 21 bp, Homo sapiens
tctagatcagatgctccaaga

SEQ ID NO: 3151958 - DNA, 19 bp, Homo sapiens
tctagatgaagttttacat

SEQ ID NO: 3151959 - DNA, 23 bp, Homo sapiens
tctagatgaagttttacattgtt

SEQ ID NO: 3151960 - DNA, 14 bp, Homo sapiens
tctagatgattttt

SEQ ID NO: 3151961 - DNA, 22 bp, Homo sapiens
tctagatgattttttgaaagtt

SEQ ID NO: 3151962 - DNA, 23 bp, Homo sapiens
tctagatgtttattcttctagag

SEQ ID NO: 3151963 - DNA, 21 bp, Homo sapiens
tctagattccattggtccaag

SEQ ID NO: 3151964 - DNA, 23 bp, Homo sapiens
tctagattccattggtccaagat

SEQ ID NO: 3151965 - DNA, 14 bp, Homo sapiens
tctagcaattttct

SEQ ID NO: 3151966 - DNA, 16 bp, Homo sapiens
tctagcaattttcttt

SEQ ID NO: 3151967 - DNA, 21 bp, Homo sapiens
tctagcaattttctttgtttc

SEQ ID NO: 3151968 - DNA, 22 bp, Homo sapiens
tctagcacaatttgcactaaat

SEQ ID NO: 3151969 - DNA, 16 bp, Homo sapiens
tctagctagaaatatg

SEQ ID NO: 3151970 - DNA, 21 bp, Homo sapiens
tctagctagaaatatgatttt

SEQ ID NO: 3151971 - DNA, 23 bp, Homo sapiens
tctagctagaaatatgattttat

SEQ ID NO: 3151972 - DNA, 15 bp, Homo sapiens
tctagctctctaggc

SEQ ID NO: 3151973 - DNA, 17 bp, Homo sapiens
tctagctggtggtttca

SEQ ID NO: 3151974 - DNA, 17 bp, Homo sapiens
tctagctgtatgatttg

SEQ ID NO: 3151975 - DNA, 18 bp, Homo sapiens
tctagctgttgagctgtt

SEQ ID NO: 3151976 - DNA, 23 bp, Homo sapiens
tctaggaagaagacaaatgacag

SEQ ID NO: 3151977 - DNA, 15 bp, Homo sapiens
tctaggaagacattt

SEQ ID NO: 3151978 - DNA, 13 bp, Homo sapiens
tctaggacacagt

SEQ ID NO: 3151979 - DNA, 23 bp, Homo sapiens
tctaggacacagttcctgggaac

SEQ ID NO: 3151980 - DNA, 21 bp, Homo sapiens
tctaggaggctcctcctcgca

SEQ ID NO: 3151981 - DNA, 19 bp, Homo sapiens
tctaggagggagacactgg

SEQ ID NO: 3151982 - DNA, 20 bp, Homo sapiens
tctaggagggagccttgtga

SEQ ID NO: 3151983 - DNA, 23 bp, Homo sapiens
tctaggatagctaactgtaaatc

SEQ ID NO: 3151984 - DNA, 22 bp, Homo sapiens
tctaggatagttgatgcatgtt

SEQ ID NO: 3151985 - DNA, 23 bp, Homo sapiens
tctaggatagttgatgcatgtta

SEQ ID NO: 3151986 - DNA, 17 bp, Homo sapiens
tctaggcaagcaggacc

SEQ ID NO: 3151987 - DNA, 18 bp, Homo sapiens
tctaggcaagcaggacct

SEQ ID NO: 3151988 - DNA, 22 bp, Homo sapiens
tctaggcaagcaggacctggca

SEQ ID NO: 3151989 - DNA, 23 bp, Homo sapiens
tctaggcaagcaggacctggcat

SEQ ID NO: 3151990 - DNA, 15 bp, Homo sapiens
tctaggcacaaggtt

SEQ ID NO: 3151991 - DNA, 14 bp, Homo sapiens
tctaggcctctcca

SEQ ID NO: 3151992 - DNA, 21 bp, Homo sapiens
tctagggttgctggagcctga

SEQ ID NO: 3151993 - DNA, 22 bp, Homo sapiens
tctagggttgctggagcctgag

SEQ ID NO: 3151994 - DNA, 18 bp, Homo sapiens
tctagggtttcttaaata

SEQ ID NO: 3151995 - DNA, 14 bp, Homo sapiens
tctaggtctcctca

SEQ ID NO: 3151996 - DNA, 19 bp, Homo sapiens
tctaggtggagttgaaaga

SEQ ID NO: 3151997 - DNA, 19 bp, Homo sapiens
tctaggttatacaataacc

SEQ ID NO: 3151998 - DNA, 22 bp, Homo sapiens
tctagtatttatgggtggattt

SEQ ID NO: 3151999 - DNA, 16 bp, Homo sapiens
tctagtcattgtcata

SEQ ID NO: 3152000 - DNA, 22 bp, Homo sapiens
tctagtgaattttttaaatgaa

SEQ ID NO: 3152001 - DNA, 16 bp, Homo sapiens
tctagtgcagctgatt

SEQ ID NO: 3152002 - DNA, 19 bp, Homo sapiens
tctagtgcagctgatttta

SEQ ID NO: 3152003 - DNA, 22 bp, Homo sapiens
tctagtgcagctgattttaaca

SEQ ID NO: 3152004 - DNA, 14 bp, Homo sapiens
tctagtgccctcca

SEQ ID NO: 3152005 - DNA, 20 bp, Homo sapiens
tctagtgccctccacagccg

SEQ ID NO: 3152006 - DNA, 15 bp, Homo sapiens
tctagtgggacagcc

SEQ ID NO: 3152007 - DNA, 24 bp, Homo sapiens
tctagtgggacagcccagagcctg

SEQ ID NO: 3152008 - DNA, 16 bp, Homo sapiens
tctagtggtctttgta

SEQ ID NO: 3152009 - DNA, 22 bp, Homo sapiens
tctagtggtctttgtaagagtg

SEQ ID NO: 3152010 - DNA, 15 bp, Homo sapiens
tctagttctttcctc

SEQ ID NO: 3152011 - DNA, 13 bp, Homo sapiens
tctagttctttgt

SEQ ID NO: 3152012 - DNA, 14 bp, Homo sapiens
tctagttgaggagt

SEQ ID NO: 3152013 - DNA, 19 bp, Homo sapiens
tctagttgaggagtttcct

SEQ ID NO: 3152014 - DNA, 21 bp, Homo sapiens
tctagttgaggagtttcctaa

SEQ ID NO: 3152015 - DNA, 23 bp, Homo sapiens
tctagtttcagtaaataatgaaa

SEQ ID NO: 3152016 - DNA, 17 bp, Homo sapiens
tctagttttttttgtaa

SEQ ID NO: 3152017 - DNA, 18 bp, Homo sapiens
tctagttttttttgtaaa

SEQ ID NO: 3152018 - DNA, 21 bp, Homo sapiens
tctataaactataacctctcc

SEQ ID NO: 3152019 - DNA, 21 bp, Homo sapiens
tctataagcaaattgcttttt

SEQ ID NO: 3152020 - DNA, 22 bp, Homo sapiens
tctataaggccataaaacaggt

SEQ ID NO: 3152021 - DNA, 15 bp, Homo sapiens
tctataattttgcct

SEQ ID NO: 3152022 - DNA, 21 bp, Homo sapiens
tctatacaaatataaatctta

SEQ ID NO: 3152023 - DNA, 17 bp, Homo sapiens
tctatacacaccctgcc

SEQ ID NO: 3152024 - DNA, 18 bp, Homo sapiens
tctatacatctctcccca

SEQ ID NO: 3152025 - DNA, 20 bp, Homo sapiens
tctatacctgtctcctttct

SEQ ID NO: 3152026 - DNA, 16 bp, Homo sapiens
tctatagagaaaaact

SEQ ID NO: 3152027 - DNA, 21 bp, Homo sapiens
tctataggaacatatgaaaat

SEQ ID NO: 3152028 - DNA, 14 bp, Homo sapiens
tctatagttctaga

SEQ ID NO: 3152029 - DNA, 12 bp, Homo sapiens
tctatataaaat

SEQ ID NO: 3152030 - DNA, 17 bp, Homo sapiens
tctatataaaatgtatt

SEQ ID NO: 3152031 - DNA, 21 bp, Homo sapiens
tctatataaaatgtattcaag

SEQ ID NO: 3152032 - DNA, 23 bp, Homo sapiens
tctatataaaatgtattcaagca

SEQ ID NO: 3152033 - DNA, 13 bp, Homo sapiens
tctatatataatt

SEQ ID NO: 3152034 - DNA, 16 bp, Homo sapiens
tctatatatgtgtatg

SEQ ID NO: 3152035 - DNA, 12 bp, Homo sapiens
tctatatgaatt

SEQ ID NO: 3152036 - DNA, 16 bp, Homo sapiens
tctatattattatata

SEQ ID NO: 3152037 - DNA, 13 bp, Homo sapiens
tctatcagttatc

SEQ ID NO: 3152038 - DNA, 14 bp, Homo sapiens
tctatcagttatcc

SEQ ID NO: 3152039 - DNA, 16 bp, Homo sapiens
tctatcagttatcctt

SEQ ID NO: 3152040 - DNA, 16 bp, Homo sapiens
tctatcatttttgtac

SEQ ID NO: 3152041 - DNA, 22 bp, Homo sapiens
tctatccaaacatgtatttatg

SEQ ID NO: 3152042 - DNA, 22 bp, Homo sapiens
tctatccaaagaacttgatttg

SEQ ID NO: 3152043 - DNA, 19 bp, Homo sapiens
tctatcgagtttgcaatgt

SEQ ID NO: 3152044 - DNA, 12 bp, Homo sapiens
tctatctcatct

SEQ ID NO: 3152045 - DNA, 18 bp, Homo sapiens
tctatctgggcctgggct

SEQ ID NO: 3152046 - DNA, 23 bp, Homo sapiens
tctatcttccaaatgcaatttga

SEQ ID NO: 3152047 - DNA, 22 bp, Homo sapiens
tctatgaagcccacccagaaaa

SEQ ID NO: 3152048 - DNA, 11 bp, Homo sapiens
tctatgaagtt

SEQ ID NO: 3152049 - DNA, 15 bp, Homo sapiens
tctatgaagttgctg

SEQ ID NO: 3152050 - DNA, 17 bp, Homo sapiens
tctatgaagttgctgtt

SEQ ID NO: 3152051 - DNA, 21 bp, Homo sapiens
tctatgagggtgtttcctcta

SEQ ID NO: 3152052 - DNA, 22 bp, Homo sapiens
tctatgagggtgtttcctctaa

SEQ ID NO: 3152053 - DNA, 16 bp, Homo sapiens
tctatgattgtacttt

SEQ ID NO: 3152054 - DNA, 18 bp, Homo sapiens
tctatgattgtactttga

SEQ ID NO: 3152055 - DNA, 21 bp, Homo sapiens
tctatggacagggctgtctct

SEQ ID NO: 3152056 - DNA, 14 bp, Homo sapiens
tctatggctttcaa

SEQ ID NO: 3152057 - DNA, 17 bp, Homo sapiens
tctatggctttcaaagc

SEQ ID NO: 3152058 - DNA, 12 bp, Homo sapiens
tctatgggactc

SEQ ID NO: 3152059 - DNA, 14 bp, Homo sapiens
tctatggttatgaa

SEQ ID NO: 3152060 - DNA, 20 bp, Homo sapiens
tctatggttatgaaagaata

SEQ ID NO: 3152061 - DNA, 16 bp, Homo sapiens
tctatgtatgttaatt

SEQ ID NO: 3152062 - DNA, 23 bp, Homo sapiens
tctatgtatgttaatttatttag

SEQ ID NO: 3152063 - DNA, 18 bp, Homo sapiens
tctatgtttgtatttgga

SEQ ID NO: 3152064 - DNA, 16 bp, Homo sapiens
tctattaagatttcca

SEQ ID NO: 3152065 - DNA, 17 bp, Homo sapiens
tctattaagatttccaa

SEQ ID NO: 3152066 - DNA, 18 bp, Homo sapiens
tctattaagatttccaag

SEQ ID NO: 3152067 - DNA, 12 bp, Homo sapiens
tctattaatata

SEQ ID NO: 3152068 - DNA, 16 bp, Homo sapiens
tctattaatatatgta

SEQ ID NO: 3152069 - DNA, 22 bp, Homo sapiens
tctattaatatatgtattattt

SEQ ID NO: 3152070 - DNA, 16 bp, Homo sapiens
tctattaatattcagg

SEQ ID NO: 3152071 - DNA, 17 bp, Homo sapiens
tctattataaaaccatg

SEQ ID NO: 3152072 - DNA, 12 bp, Homo sapiens
tctattcagctt

SEQ ID NO: 3152073 - DNA, 23 bp, Homo sapiens
tctattctcaaagttaaaagtaa

SEQ ID NO: 3152074 - DNA, 13 bp, Homo sapiens
tctattctgagcc

SEQ ID NO: 3152075 - DNA, 16 bp, Homo sapiens
tctattgcttcaccat

SEQ ID NO: 3152076 - DNA, 20 bp, Homo sapiens
tctattggaggtgagatcac

SEQ ID NO: 3152077 - DNA, 15 bp, Homo sapiens
tctattgtagcattt

SEQ ID NO: 3152078 - DNA, 17 bp, Homo sapiens
tctattgtagcatttct

SEQ ID NO: 3152079 - DNA, 16 bp, Homo sapiens
tctattgtattatttg

SEQ ID NO: 3152080 - DNA, 23 bp, Homo sapiens
tctattgtcatggggatcaattt

SEQ ID NO: 3152081 - DNA, 12 bp, Homo sapiens
tctattgttact

SEQ ID NO: 3152082 - DNA, 15 bp, Homo sapiens
tctatttaaattctt

SEQ ID NO: 3152083 - DNA, 12 bp, Homo sapiens
tctatttaagcc

SEQ ID NO: 3152084 - DNA, 13 bp, Homo sapiens
tctatttatatgt

SEQ ID NO: 3152085 - DNA, 12 bp, Homo sapiens
tctatttattag

SEQ ID NO: 3152086 - DNA, 12 bp, Homo sapiens
tctatttattgg

SEQ ID NO: 3152087 - DNA, 15 bp, Homo sapiens
tctatttattgggga

SEQ ID NO: 3152088 - DNA, 15 bp, Homo sapiens
tctatttatttactg

SEQ ID NO: 3152089 - DNA, 16 bp, Homo sapiens
tctatttcatgttttt

SEQ ID NO: 3152090 - DNA, 12 bp, Homo sapiens
tctatttgtaga

SEQ ID NO: 3152091 - DNA, 14 bp, Homo sapiens
tctattttattatg

SEQ ID NO: 3152092 - DNA, 13 bp, Homo sapiens
tctattttcacaa

SEQ ID NO: 3152093 - DNA, 18 bp, Homo sapiens
tctattttggattgtata

SEQ ID NO: 3152094 - DNA, 17 bp, Homo sapiens
tctatttttacatttaa

SEQ ID NO: 3152095 - DNA, 22 bp, Homo sapiens
tctatttttacctactgtgtct

SEQ ID NO: 3152096 - DNA, 17 bp, Homo sapiens
tctatttttcaatcatc

SEQ ID NO: 3152097 - DNA, 14 bp, Homo sapiens
tctcaaaaatacaa

SEQ ID NO: 3152098 - DNA, 23 bp, Homo sapiens
tctcaaaaatacaaaataaaaac

SEQ ID NO: 3152099 - DNA, 18 bp, Homo sapiens
tctcaaaacagagggctg

SEQ ID NO: 3152100 - DNA, 14 bp, Homo sapiens
tctcaaaagcattt

SEQ ID NO: 3152101 - DNA, 23 bp, Homo sapiens
tctcaaaagcatttatcattctt

SEQ ID NO: 3152102 - DNA, 18 bp, Homo sapiens
tctcaaaagtctattttt

SEQ ID NO: 3152103 - DNA, 17 bp, Homo sapiens
tctcaaactaaaagaca

SEQ ID NO: 3152104 - DNA, 14 bp, Homo sapiens
tctcaaaggagaaa

SEQ ID NO: 3152105 - DNA, 21 bp, Homo sapiens
tctcaaaggccctcagtgaga

SEQ ID NO: 3152106 - DNA, 17 bp, Homo sapiens
tctcaaagtataatctt

SEQ ID NO: 3152107 - DNA, 18 bp, Homo sapiens
tctcaaagtataatcttt

SEQ ID NO: 3152108 - DNA, 11 bp, Homo sapiens
tctcaaagtta

SEQ ID NO: 3152109 - DNA, 22 bp, Homo sapiens
tctcaaagttaaaagtaaaatt

SEQ ID NO: 3152110 - DNA, 13 bp, Homo sapiens
tctcaaagtttta

SEQ ID NO: 3152111 - DNA, 14 bp, Homo sapiens
tctcaaagttttat

SEQ ID NO: 3152112 - DNA, 16 bp, Homo sapiens
tctcaaagttttgaaa

SEQ ID NO: 3152113 - DNA, 18 bp, Homo sapiens
tctcaaagttttgaaaag

SEQ ID NO: 3152114 - DNA, 22 bp, Homo sapiens
tctcaaataggctattaaaaaa

SEQ ID NO: 3152115 - DNA, 19 bp, Homo sapiens
tctcaacaaagcacagtgt

SEQ ID NO: 3152116 - DNA, 21 bp, Homo sapiens
tctcaacaaagcacagtgtta

SEQ ID NO: 3152117 - DNA, 19 bp, Homo sapiens
tctcaagagggcactggtg

SEQ ID NO: 3152118 - DNA, 16 bp, Homo sapiens
tctcaatgaagccagc

SEQ ID NO: 3152119 - DNA, 14 bp, Homo sapiens
tctcacacccaccg

SEQ ID NO: 3152120 - DNA, 21 bp, Homo sapiens
tctcacactggcgtagaagtt

SEQ ID NO: 3152121 - DNA, 11 bp, Homo sapiens
tctcacagcac

SEQ ID NO: 3152122 - DNA, 17 bp, Homo sapiens
tctcacagcacatgctg

SEQ ID NO: 3152123 - DNA, 23 bp, Homo sapiens
tctcacagcacatgctggccagc

SEQ ID NO: 3152124 - DNA, 12 bp, Homo sapiens
tctcacctcagc

SEQ ID NO: 3152125 - DNA, 13 bp, Homo sapiens
tctcacctggact

SEQ ID NO: 3152126 - DNA, 22 bp, Homo sapiens
tctcacgggcatgggcactccc

SEQ ID NO: 3152127 - DNA, 19 bp, Homo sapiens
tctcactatgttgcccagg

SEQ ID NO: 3152128 - DNA, 20 bp, Homo sapiens
tctcactatgttgcccaggc

SEQ ID NO: 3152129 - DNA, 21 bp, Homo sapiens
tctcactatgttgcccaggca

SEQ ID NO: 3152130 - DNA, 21 bp, Homo sapiens
tctcactccccagccccaccc

SEQ ID NO: 3152131 - DNA, 14 bp, Homo sapiens
tctcactcctagga

SEQ ID NO: 3152132 - DNA, 13 bp, Homo sapiens
tctcactcctgcc

SEQ ID NO: 3152133 - DNA, 17 bp, Homo sapiens
tctcactcctgcctccg

SEQ ID NO: 3152134 - DNA, 14 bp, Homo sapiens
tctcactgcagtct

SEQ ID NO: 3152135 - DNA, 20 bp, Homo sapiens
tctcactgtgggaaggccag

SEQ ID NO: 3152136 - DNA, 16 bp, Homo sapiens
tctcactgttccctct

SEQ ID NO: 3152137 - DNA, 21 bp, Homo sapiens
tctcactgttccctctgctcc

SEQ ID NO: 3152138 - DNA, 13 bp, Homo sapiens
tctcactgttctg

SEQ ID NO: 3152139 - DNA, 15 bp, Homo sapiens
tctcactgttctgca

SEQ ID NO: 3152140 - DNA, 12 bp, Homo sapiens
tctcacttttca

SEQ ID NO: 3152141 - DNA, 15 bp, Homo sapiens
tctcacttttcatct

SEQ ID NO: 3152142 - DNA, 14 bp, Homo sapiens
tctcagaaatgctg

SEQ ID NO: 3152143 - DNA, 24 bp, Homo sapiens
tctcagaatctaaacgtggtcacc

SEQ ID NO: 3152144 - DNA, 17 bp, Homo sapiens
tctcagaatctcaaata

SEQ ID NO: 3152145 - DNA, 20 bp, Homo sapiens
tctcagaggcctgctgccag

SEQ ID NO: 3152146 - DNA, 19 bp, Homo sapiens
tctcagagtccactgtggc

SEQ ID NO: 3152147 - DNA, 18 bp, Homo sapiens
tctcagatgttaaaataa

SEQ ID NO: 3152148 - DNA, 14 bp, Homo sapiens
tctcagcctcccac

SEQ ID NO: 3152149 - DNA, 15 bp, Homo sapiens
tctcagccttacatt

SEQ ID NO: 3152150 - DNA, 17 bp, Homo sapiens
tctcagctccccctgtc

SEQ ID NO: 3152151 - DNA, 18 bp, Homo sapiens
tctcagctccccctgtcc

SEQ ID NO: 3152152 - DNA, 22 bp, Homo sapiens
tctcagctccccctgtcccctc

SEQ ID NO: 3152153 - DNA, 15 bp, Homo sapiens
tctcaggagcacagg

SEQ ID NO: 3152154 - DNA, 16 bp, Homo sapiens
tctcaggagcacaggc

SEQ ID NO: 3152155 - DNA, 20 bp, Homo sapiens
tctcaggagcacaggcagct

SEQ ID NO: 3152156 - DNA, 15 bp, Homo sapiens
tctcaggagcatggg

SEQ ID NO: 3152157 - DNA, 13 bp, Homo sapiens
tctcaggatccaa

SEQ ID NO: 3152158 - DNA, 16 bp, Homo sapiens
tctcaggatccaagct

SEQ ID NO: 3152159 - DNA, 14 bp, Homo sapiens
tctcaggcctccag

SEQ ID NO: 3152160 - DNA, 16 bp, Homo sapiens
tctcagggcctggcag

SEQ ID NO: 3152161 - DNA, 12 bp, Homo sapiens
tctcagggctcc

SEQ ID NO: 3152162 - DNA, 23 bp, Homo sapiens
tctcagggctcctgccttctgtc

SEQ ID NO: 3152163 - DNA, 17 bp, Homo sapiens
tctcaggggccagagga

SEQ ID NO: 3152164 - DNA, 17 bp, Homo sapiens
tctcaggggctgtttga

SEQ ID NO: 3152165 - DNA, 16 bp, Homo sapiens
tctcaggtgccactcc

SEQ ID NO: 3152166 - DNA, 23 bp, Homo sapiens
tctcaggtgccactccctgagct

SEQ ID NO: 3152167 - DNA, 21 bp, Homo sapiens
tctcaggtttgttttgtgaat

SEQ ID NO: 3152168 - DNA, 15 bp, Homo sapiens
tctcagtcagtaatt

SEQ ID NO: 3152169 - DNA, 14 bp, Homo sapiens
tctcagtcatgcat

SEQ ID NO: 3152170 - DNA, 20 bp, Homo sapiens
tctcagtcatgcataaatat

SEQ ID NO: 3152171 - DNA, 23 bp, Homo sapiens
tctcagtcatgcataaatatgca

SEQ ID NO: 3152172 - DNA, 11 bp, Homo sapiens
tctcagtgtgc

SEQ ID NO: 3152173 - DNA, 22 bp, Homo sapiens
tctcagtgttgagccttttccc

SEQ ID NO: 3152174 - DNA, 12 bp, Homo sapiens
tctcagtgtttt

SEQ ID NO: 3152175 - DNA, 19 bp, Homo sapiens
tctcagtgttttggactcc

SEQ ID NO: 3152176 - DNA, 23 bp, Homo sapiens
tctcagtgttttggactccatct

SEQ ID NO: 3152177 - DNA, 16 bp, Homo sapiens
tctcagtttgtataga

SEQ ID NO: 3152178 - DNA, 16 bp, Homo sapiens
tctcagtttgtgtgtc

SEQ ID NO: 3152179 - DNA, 17 bp, Homo sapiens
tctcagtttgtgtgtct

SEQ ID NO: 3152180 - DNA, 19 bp, Homo sapiens
tctcagtttgtgtgtctta

SEQ ID NO: 3152181 - DNA, 15 bp, Homo sapiens
tctcataatgctttg

SEQ ID NO: 3152182 - DNA, 18 bp, Homo sapiens
tctcataatgtgaaatat

SEQ ID NO: 3152183 - DNA, 16 bp, Homo sapiens
tctcatacctctgacc

SEQ ID NO: 3152184 - DNA, 21 bp, Homo sapiens
tctcatactcccccacagttt

SEQ ID NO: 3152185 - DNA, 20 bp, Homo sapiens
tctcatatatattttaaaaa

SEQ ID NO: 3152186 - DNA, 15 bp, Homo sapiens
tctcatcagtgtcct

SEQ ID NO: 3152187 - DNA, 19 bp, Homo sapiens
tctcatcccacgcactcca

SEQ ID NO: 3152188 - DNA, 15 bp, Homo sapiens
tctcatcctcctgga

SEQ ID NO: 3152189 - DNA, 16 bp, Homo sapiens
tctcatccttttggat

SEQ ID NO: 3152190 - DNA, 18 bp, Homo sapiens
tctcatctcttcaggttc

SEQ ID NO: 3152191 - DNA, 20 bp, Homo sapiens
tctcatctgatcacttcatg

SEQ ID NO: 3152192 - DNA, 13 bp, Homo sapiens
tctcatcttaaaa

SEQ ID NO: 3152193 - DNA, 15 bp, Homo sapiens
tctcatcttctctca

SEQ ID NO: 3152194 - DNA, 15 bp, Homo sapiens
tctcatcttgtgaaa

SEQ ID NO: 3152195 - DNA, 14 bp, Homo sapiens
tctcatcttttatc

SEQ ID NO: 3152196 - DNA, 17 bp, Homo sapiens
tctcatgggtggcactc

SEQ ID NO: 3152197 - DNA, 16 bp, Homo sapiens
tctcatgtcctgctgg

SEQ ID NO: 3152198 - DNA, 18 bp, Homo sapiens
tctcatgtcctgctggct

SEQ ID NO: 3152199 - DNA, 17 bp, Homo sapiens
tctcattccaacagtga

SEQ ID NO: 3152200 - DNA, 10 bp, Homo sapiens
tctcattccc

SEQ ID NO: 3152201 - DNA, 14 bp, Homo sapiens
tctcattccgttgt

SEQ ID NO: 3152202 - DNA, 18 bp, Homo sapiens
tctcattccgttgtctgt

SEQ ID NO: 3152203 - DNA, 18 bp, Homo sapiens
tctcattcgcctttgtct

SEQ ID NO: 3152204 - DNA, 22 bp, Homo sapiens
tctcattcgcctttgtcttgta

SEQ ID NO: 3152205 - DNA, 13 bp, Homo sapiens
tctcattcttgtt

SEQ ID NO: 3152206 - DNA, 13 bp, Homo sapiens
tctcattgtgaat

SEQ ID NO: 3152207 - DNA, 15 bp, Homo sapiens
tctccaaaggggctg

SEQ ID NO: 3152208 - DNA, 24 bp, Homo sapiens
tctccaaatgagatctaagccttt

SEQ ID NO: 3152209 - DNA, 19 bp, Homo sapiens
tctccaaggatcctctcca

SEQ ID NO: 3152210 - DNA, 22 bp, Homo sapiens
tctccaaggatcctctccactc

SEQ ID NO: 3152211 - DNA, 20 bp, Homo sapiens
tctccaagggcttctgcacc

SEQ ID NO: 3152212 - DNA, 21 bp, Homo sapiens
tctccaagggcttctgcaccc

SEQ ID NO: 3152213 - DNA, 22 bp, Homo sapiens
tctccaagggcttctgcaccct

SEQ ID NO: 3152214 - DNA, 23 bp, Homo sapiens
tctccaagggcttctgcaccctc

SEQ ID NO: 3152215 - DNA, 23 bp, Homo sapiens
tctccaagtctctctgtgaatac

SEQ ID NO: 3152216 - DNA, 14 bp, Homo sapiens
tctccaagtgccag

SEQ ID NO: 3152217 - DNA, 12 bp, Homo sapiens
tctccaccctgc

SEQ ID NO: 3152218 - DNA, 16 bp, Homo sapiens
tctccaccctggctgg

SEQ ID NO: 3152219 - DNA, 13 bp, Homo sapiens
tctccactccaga

SEQ ID NO: 3152220 - DNA, 23 bp, Homo sapiens
tctccactccatgtttgcaatgc

SEQ ID NO: 3152221 - DNA, 12 bp, Homo sapiens
tctccactgtgc

SEQ ID NO: 3152222 - DNA, 19 bp, Homo sapiens
tctccactgtgcctttgca

SEQ ID NO: 3152223 - DNA, 13 bp, Homo sapiens
tctccagaatgta

SEQ ID NO: 3152224 - DNA, 20 bp, Homo sapiens
tctccagaatgtaagaaaac

SEQ ID NO: 3152225 - DNA, 21 bp, Homo sapiens
tctccagctcagaacccaggg

SEQ ID NO: 3152226 - DNA, 22 bp, Homo sapiens
tctccagctcagaacccagggc

SEQ ID NO: 3152227 - DNA, 14 bp, Homo sapiens
tctccagctgacta

SEQ ID NO: 3152228 - DNA, 21 bp, Homo sapiens
tctccagctgggctctgcaat

SEQ ID NO: 3152229 - DNA, 14 bp, Homo sapiens
tctccaggaccaat

SEQ ID NO: 3152230 - DNA, 17 bp, Homo sapiens
tctccaggcaccatctc

SEQ ID NO: 3152231 - DNA, 11 bp, Homo sapiens
tctccaggcca

SEQ ID NO: 3152232 - DNA, 20 bp, Homo sapiens
tctccagggagcaagacaga

SEQ ID NO: 3152233 - DNA, 17 bp, Homo sapiens
tctccaggggctgcttc

SEQ ID NO: 3152234 - DNA, 22 bp, Homo sapiens
tctccaggggctgcttcctcct

SEQ ID NO: 3152235 - DNA, 21 bp, Homo sapiens
tctccagtgctgtccatgctt

SEQ ID NO: 3152236 - DNA, 21 bp, Homo sapiens
tctccatcaccctcttcctgt

SEQ ID NO: 3152237 - DNA, 16 bp, Homo sapiens
tctccatctttataga

SEQ ID NO: 3152238 - DNA, 19 bp, Homo sapiens
tctcccaaggctgcgtctg

SEQ ID NO: 3152239 - DNA, 22 bp, Homo sapiens
tctcccacatgaggccatctca

SEQ ID NO: 3152240 - DNA, 18 bp, Homo sapiens
tctcccactccagcgctg

SEQ ID NO: 3152241 - DNA, 18 bp, Homo sapiens
tctcccagaatcccagcc

SEQ ID NO: 3152242 - DNA, 13 bp, Homo sapiens
tctcccaggcccg

SEQ ID NO: 3152243 - DNA, 19 bp, Homo sapiens
tctcccaggtaccagctgc

SEQ ID NO: 3152244 - DNA, 19 bp, Homo sapiens
tctcccatccccctgccct

SEQ ID NO: 3152245 - DNA, 20 bp, Homo sapiens
tctcccatttcaggaattta

SEQ ID NO: 3152246 - DNA, 22 bp, Homo sapiens
tctcccatttcaggaatttaaa

SEQ ID NO: 3152247 - DNA, 11 bp, Homo sapiens
tctccccacac

SEQ ID NO: 3152248 - DNA, 13 bp, Homo sapiens
tctccccacacta

SEQ ID NO: 3152249 - DNA, 16 bp, Homo sapiens
tctccccacccacccc

SEQ ID NO: 3152250 - DNA, 12 bp, Homo sapiens
tctccccaggcc

SEQ ID NO: 3152251 - DNA, 13 bp, Homo sapiens
tctccccaggcct

SEQ ID NO: 3152252 - DNA, 16 bp, Homo sapiens
tctccccaggcctcca

SEQ ID NO: 3152253 - DNA, 20 bp, Homo sapiens
tctccccaggcctccagcct

SEQ ID NO: 3152254 - DNA, 22 bp, Homo sapiens
tctccccaggtccagctctgga

SEQ ID NO: 3152255 - DNA, 15 bp, Homo sapiens
tctcccccaacccac

SEQ ID NO: 3152256 - DNA, 18 bp, Homo sapiens
tctcccccaacccacctc

SEQ ID NO: 3152257 - DNA, 21 bp, Homo sapiens
tctcccccaacccacctctgg

SEQ ID NO: 3152258 - DNA, 16 bp, Homo sapiens
tctcccccgacactgc

SEQ ID NO: 3152259 - DNA, 21 bp, Homo sapiens
tctccccctatttattgactt

SEQ ID NO: 3152260 - DNA, 19 bp, Homo sapiens
tctccccgctaaggaagat

SEQ ID NO: 3152261 - DNA, 19 bp, Homo sapiens
tctccccgtgtcctctccc

SEQ ID NO: 3152262 - DNA, 13 bp, Homo sapiens
tctcccctcaaag

SEQ ID NO: 3152263 - DNA, 15 bp, Homo sapiens
tctcccctcccttgt

SEQ ID NO: 3152264 - DNA, 22 bp, Homo sapiens
tctcccctcccttgtccttgaa

SEQ ID NO: 3152265 - DNA, 15 bp, Homo sapiens
tctcccggctgcctg

SEQ ID NO: 3152266 - DNA, 13 bp, Homo sapiens
tctcccgtcaggg

SEQ ID NO: 3152267 - DNA, 20 bp, Homo sapiens
tctccctagctcctcccctt

SEQ ID NO: 3152268 - DNA, 12 bp, Homo sapiens
tctccctcccct

SEQ ID NO: 3152269 - DNA, 18 bp, Homo sapiens
tctccctcccctgccatt

SEQ ID NO: 3152270 - DNA, 14 bp, Homo sapiens
tctccctgccaagt

SEQ ID NO: 3152271 - DNA, 14 bp, Homo sapiens
tctccctgccagag

SEQ ID NO: 3152272 - DNA, 13 bp, Homo sapiens
tctccctgcctgg

SEQ ID NO: 3152273 - DNA, 16 bp, Homo sapiens
tctccctgcctggccc

SEQ ID NO: 3152274 - DNA, 14 bp, Homo sapiens
tctccctggctccc

SEQ ID NO: 3152275 - DNA, 20 bp, Homo sapiens
tctccctggctccctcctcc

SEQ ID NO: 3152276 - DNA, 14 bp, Homo sapiens
tctccctgtacagt

SEQ ID NO: 3152277 - DNA, 17 bp, Homo sapiens
tctcccttcctctctcc

SEQ ID NO: 3152278 - DNA, 18 bp, Homo sapiens
tctccctttatgtatctc

SEQ ID NO: 3152279 - DNA, 13 bp, Homo sapiens
tctccctttctct

SEQ ID NO: 3152280 - DNA, 17 bp, Homo sapiens
tctccgaccagacacct

SEQ ID NO: 3152281 - DNA, 21 bp, Homo sapiens
tctccgccagcctcctctgga

SEQ ID NO: 3152282 - DNA, 13 bp, Homo sapiens
tctccgcgcctac

SEQ ID NO: 3152283 - DNA, 16 bp, Homo sapiens
tctccggggtctgtgc

SEQ ID NO: 3152284 - DNA, 19 bp, Homo sapiens
tctccggggtctgtgctgt

SEQ ID NO: 3152285 - DNA, 23 bp, Homo sapiens
tctccggggtctgtgctgtgcct

SEQ ID NO: 3152286 - DNA, 15 bp, Homo sapiens
tctccgggtgtggcc

SEQ ID NO: 3152287 - DNA, 23 bp, Homo sapiens
tctccgggtgtggcctcagccct

SEQ ID NO: 3152288 - DNA, 18 bp, Homo sapiens
tctccgtggcacttgtaa

SEQ ID NO: 3152289 - DNA, 18 bp, Homo sapiens
tctccgttagctcctgtg

SEQ ID NO: 3152290 - DNA, 19 bp, Homo sapiens
tctccgttagctcctgtgg

SEQ ID NO: 3152291 - DNA, 21 bp, Homo sapiens
tctccgttagctcctgtggcc

SEQ ID NO: 3152292 - DNA, 22 bp, Homo sapiens
tctccgttagctcctgtggccc

SEQ ID NO: 3152293 - DNA, 19 bp, Homo sapiens
tctcctagagacagaagca

SEQ ID NO: 3152294 - DNA, 16 bp, Homo sapiens
tctcctataatctgtc

SEQ ID NO: 3152295 - DNA, 22 bp, Homo sapiens
tctcctatatatttctattatt

SEQ ID NO: 3152296 - DNA, 20 bp, Homo sapiens
tctcctcactctgtccctgt

SEQ ID NO: 3152297 - DNA, 15 bp, Homo sapiens
tctcctcactgtatc

SEQ ID NO: 3152298 - DNA, 17 bp, Homo sapiens
tctcctcagggtggggg

SEQ ID NO: 3152299 - DNA, 18 bp, Homo sapiens
tctcctccatactcagga

SEQ ID NO: 3152300 - DNA, 14 bp, Homo sapiens
tctcctcccagcgt

SEQ ID NO: 3152301 - DNA, 19 bp, Homo sapiens
tctcctcccagcgtgtgta

SEQ ID NO: 3152302 - DNA, 14 bp, Homo sapiens
tctcctccccttcc

SEQ ID NO: 3152303 - DNA, 23 bp, Homo sapiens
tctcctcccttccttttccctgc

SEQ ID NO: 3152304 - DNA, 21 bp, Homo sapiens
tctcctcggccccctccatcg

SEQ ID NO: 3152305 - DNA, 9 bp, Homo sapiens
tctcctctc

SEQ ID NO: 3152306 - DNA, 14 bp, Homo sapiens
tctcctctctgctt

SEQ ID NO: 3152307 - DNA, 15 bp, Homo sapiens
tctcctctctgcttc

SEQ ID NO: 3152308 - DNA, 16 bp, Homo sapiens
tctcctgacccagtcc

SEQ ID NO: 3152309 - DNA, 16 bp, Homo sapiens
tctcctgacctcgtga

SEQ ID NO: 3152310 - DNA, 22 bp, Homo sapiens
tctcctgcccaagcacttcaca

SEQ ID NO: 3152311 - DNA, 13 bp, Homo sapiens
tctcctgcctcag

SEQ ID NO: 3152312 - DNA, 19 bp, Homo sapiens
tctcctgcctcagcctccc

SEQ ID NO: 3152313 - DNA, 22 bp, Homo sapiens
tctcctgcctcagcctcccaaa

SEQ ID NO: 3152314 - DNA, 22 bp, Homo sapiens
tctcctgcctgtagcagtgaga

SEQ ID NO: 3152315 - DNA, 13 bp, Homo sapiens
tctcctgcgcccc

SEQ ID NO: 3152316 - DNA, 16 bp, Homo sapiens
tctcctgcgccccgcc

SEQ ID NO: 3152317 - DNA, 17 bp, Homo sapiens
tctcctgctgatttcac

SEQ ID NO: 3152318 - DNA, 21 bp, Homo sapiens
tctcctggcctatccgctgcc

SEQ ID NO: 3152319 - DNA, 19 bp, Homo sapiens
tctcctgtaagccaaagaa

SEQ ID NO: 3152320 - DNA, 23 bp, Homo sapiens
tctcctgtgaatggaggcagaga

SEQ ID NO: 3152321 - DNA, 23 bp, Homo sapiens
tctcctgtgcatgggtgaaggga

SEQ ID NO: 3152322 - DNA, 17 bp, Homo sapiens
tctcctgtttcccttcc

SEQ ID NO: 3152323 - DNA, 14 bp, Homo sapiens
tctcctgttttata

SEQ ID NO: 3152324 - DNA, 17 bp, Homo sapiens
tctcctgtttttctggg

SEQ ID NO: 3152325 - DNA, 20 bp, Homo sapiens
tctccttaagctgcagagat

SEQ ID NO: 3152326 - DNA, 21 bp, Homo sapiens
tctccttactctgagcccagg

SEQ ID NO: 3152327 - DNA, 23 bp, Homo sapiens
tctccttactctgagcccaggcc

SEQ ID NO: 3152328 - DNA, 14 bp, Homo sapiens
tctccttactgtgt

SEQ ID NO: 3152329 - DNA, 17 bp, Homo sapiens
tctccttactgtgtttc

SEQ ID NO: 3152330 - DNA, 17 bp, Homo sapiens
tctccttagtcttctca

SEQ ID NO: 3152331 - DNA, 19 bp, Homo sapiens
tctccttagtcttctcata

SEQ ID NO: 3152332 - DNA, 21 bp, Homo sapiens
tctccttcatgacagcctcca

SEQ ID NO: 3152333 - DNA, 21 bp, Homo sapiens
tctccttcccatttctctaca

SEQ ID NO: 3152334 - DNA, 11 bp, Homo sapiens
tctccttcctt

SEQ ID NO: 3152335 - DNA, 14 bp, Homo sapiens
tctccttccttacc

SEQ ID NO: 3152336 - DNA, 16 bp, Homo sapiens
tctccttgagtgtatg

SEQ ID NO: 3152337 - DNA, 19 bp, Homo sapiens
tctccttgccctagatgag

SEQ ID NO: 3152338 - DNA, 16 bp, Homo sapiens
tctccttgggctcctg

SEQ ID NO: 3152339 - DNA, 17 bp, Homo sapiens
tctccttgggctcctgg

SEQ ID NO: 3152340 - DNA, 16 bp, Homo sapiens
tctccttgggctggga

SEQ ID NO: 3152341 - DNA, 17 bp, Homo sapiens
tctccttgggctgggac

SEQ ID NO: 3152342 - DNA, 14 bp, Homo sapiens
tctcctttcagggc

SEQ ID NO: 3152343 - DNA, 12 bp, Homo sapiens
tctcctttgcaa

SEQ ID NO: 3152344 - DNA, 14 bp, Homo sapiens
tctcctttgcaata

SEQ ID NO: 3152345 - DNA, 16 bp, Homo sapiens
tctcctttgcactgag

SEQ ID NO: 3152346 - DNA, 14 bp, Homo sapiens
tctcctttgctctt

SEQ ID NO: 3152347 - DNA, 21 bp, Homo sapiens
tctccttttatctggtgcctc

SEQ ID NO: 3152348 - DNA, 16 bp, Homo sapiens
tctccttttccttacc

SEQ ID NO: 3152349 - DNA, 17 bp, Homo sapiens
tctccttttcttttgtt

SEQ ID NO: 3152350 - DNA, 21 bp, Homo sapiens
tctccttttcttttgttactg

SEQ ID NO: 3152351 - DNA, 22 bp, Homo sapiens
tctcctttttattttaggcact

SEQ ID NO: 3152352 - DNA, 15 bp, Homo sapiens
tctcgaactcctggc

SEQ ID NO: 3152353 - DNA, 17 bp, Homo sapiens
tctcgcctcactttcca

SEQ ID NO: 3152354 - DNA, 14 bp, Homo sapiens
tctcgctgtcactg

SEQ ID NO: 3152355 - DNA, 17 bp, Homo sapiens
tctcgctgtcactggct

SEQ ID NO: 3152356 - DNA, 19 bp, Homo sapiens
tctcgctgtcactggctgg

SEQ ID NO: 3152357 - DNA, 22 bp, Homo sapiens
tctcgctgtcactggctggctc

SEQ ID NO: 3152358 - DNA, 17 bp, Homo sapiens
tctcggaaggctggctg

SEQ ID NO: 3152359 - DNA, 19 bp, Homo sapiens
tctcggatgacaccctggc

SEQ ID NO: 3152360 - DNA, 15 bp, Homo sapiens
tctcggatgaccaaa

SEQ ID NO: 3152361 - DNA, 20 bp, Homo sapiens
tctcggatgaccaaaccagc

SEQ ID NO: 3152362 - DNA, 21 bp, Homo sapiens
tctcggcaactaagcagtccc

SEQ ID NO: 3152363 - DNA, 14 bp, Homo sapiens
tctcggctcaggct

SEQ ID NO: 3152364 - DNA, 20 bp, Homo sapiens
tctcggctcaggctctgctg

SEQ ID NO: 3152365 - DNA, 14 bp, Homo sapiens
tctcgggagaggat

SEQ ID NO: 3152366 - DNA, 20 bp, Homo sapiens
tctcggggcccttggggcct

SEQ ID NO: 3152367 - DNA, 14 bp, Homo sapiens
tctcgggtgcattt

SEQ ID NO: 3152368 - DNA, 21 bp, Homo sapiens
tctcgggtgcatttgagagaa

SEQ ID NO: 3152369 - DNA, 23 bp, Homo sapiens
tctcgtgtacagctcccttccct

SEQ ID NO: 3152370 - DNA, 17 bp, Homo sapiens
tctctaactcctgccat

SEQ ID NO: 3152371 - DNA, 22 bp, Homo sapiens
tctctaatagaggcattacttg

SEQ ID NO: 3152372 - DNA, 11 bp, Homo sapiens
tctctaatatg

SEQ ID NO: 3152373 - DNA, 15 bp, Homo sapiens
tctctaattctatta

SEQ ID NO: 3152374 - DNA, 16 bp, Homo sapiens
tctctactcactggga

SEQ ID NO: 3152375 - DNA, 20 bp, Homo sapiens
tctctactcctacctcagcc

SEQ ID NO: 3152376 - DNA, 21 bp, Homo sapiens
tctctactcctacctcagcct

SEQ ID NO: 3152377 - DNA, 15 bp, Homo sapiens
tctctactggagtgg

SEQ ID NO: 3152378 - DNA, 13 bp, Homo sapiens
tctctagcacaat

SEQ ID NO: 3152379 - DNA, 22 bp, Homo sapiens
tctctaggaccatggttaagag

SEQ ID NO: 3152380 - DNA, 14 bp, Homo sapiens
tctctatattatgt

SEQ ID NO: 3152381 - DNA, 18 bp, Homo sapiens
tctctatattatgtcttc

SEQ ID NO: 3152382 - DNA, 14 bp, Homo sapiens
tctctatttaaatt

SEQ ID NO: 3152383 - DNA, 17 bp, Homo sapiens
tctctatttaaattctt

SEQ ID NO: 3152384 - DNA, 15 bp, Homo sapiens
tctctatttaatatt

SEQ ID NO: 3152385 - DNA, 14 bp, Homo sapiens
tctctatttattgg

SEQ ID NO: 3152386 - DNA, 20 bp, Homo sapiens
tctctcaatatgcttacaaa

SEQ ID NO: 3152387 - DNA, 17 bp, Homo sapiens
tctctcagagcatctgg

SEQ ID NO: 3152388 - DNA, 17 bp, Homo sapiens
tctctcaggagcacagg

SEQ ID NO: 3152389 - DNA, 21 bp, Homo sapiens
tctctcaggagcacaggcagc

SEQ ID NO: 3152390 - DNA, 22 bp, Homo sapiens
tctctcaggagcacaggcagct

SEQ ID NO: 3152391 - DNA, 12 bp, Homo sapiens
tctctcagtgaa

SEQ ID NO: 3152392 - DNA, 11 bp, Homo sapiens
tctctccagga

SEQ ID NO: 3152393 - DNA, 14 bp, Homo sapiens
tctctccaggaagt

SEQ ID NO: 3152394 - DNA, 14 bp, Homo sapiens
tctctcccaccccg

SEQ ID NO: 3152395 - DNA, 19 bp, Homo sapiens
tctctcccaccccggcctc

SEQ ID NO: 3152396 - DNA, 20 bp, Homo sapiens
tctctcccatttcaggaatt

SEQ ID NO: 3152397 - DNA, 14 bp, Homo sapiens
tctctccctcccct

SEQ ID NO: 3152398 - DNA, 14 bp, Homo sapiens
tctctcccttcctc

SEQ ID NO: 3152399 - DNA, 19 bp, Homo sapiens
tctctccgccattgagaat

SEQ ID NO: 3152400 - DNA, 13 bp, Homo sapiens
tctctcctcccca

SEQ ID NO: 3152401 - DNA, 21 bp, Homo sapiens
tctctcctctctgcttcataa

SEQ ID NO: 3152402 - DNA, 16 bp, Homo sapiens
tctctcctggcctatc

SEQ ID NO: 3152403 - DNA, 12 bp, Homo sapiens
tctctccttttc

SEQ ID NO: 3152404 - DNA, 17 bp, Homo sapiens
tctctccttttcttttg

SEQ ID NO: 3152405 - DNA, 23 bp, Homo sapiens
tctctcggctccccatgtgtcct

SEQ ID NO: 3152406 - DNA, 19 bp, Homo sapiens
tctctctactcctacctca

SEQ ID NO: 3152407 - DNA, 20 bp, Homo sapiens
tctctctactcctacctcag

SEQ ID NO: 3152408 - DNA, 22 bp, Homo sapiens
tctctctactcctacctcagcc

SEQ ID NO: 3152409 - DNA, 11 bp, Homo sapiens
tctctctcctc

SEQ ID NO: 3152410 - DNA, 17 bp, Homo sapiens
tctctctcgaccttctg

SEQ ID NO: 3152411 - DNA, 14 bp, Homo sapiens
tctctctctcttcc

SEQ ID NO: 3152412 - DNA, 13 bp, Homo sapiens
tctctctgtgaat

SEQ ID NO: 3152413 - DNA, 23 bp, Homo sapiens
tctctctgtgaatacaattaaag

SEQ ID NO: 3152414 - DNA, 14 bp, Homo sapiens
tctctcttaaagtt

SEQ ID NO: 3152415 - DNA, 14 bp, Homo sapiens
tctctcttccctca

SEQ ID NO: 3152416 - DNA, 16 bp, Homo sapiens
tctctctttatacagc

SEQ ID NO: 3152417 - DNA, 21 bp, Homo sapiens
tctctgaacacaggcagcttt

SEQ ID NO: 3152418 - DNA, 13 bp, Homo sapiens
tctctgaagatga

SEQ ID NO: 3152419 - DNA, 21 bp, Homo sapiens
tctctgaagcatgtttcatgt

SEQ ID NO: 3152420 - DNA, 17 bp, Homo sapiens
tctctgacttctgcctg

SEQ ID NO: 3152421 - DNA, 18 bp, Homo sapiens
tctctgacttctgcctgg

SEQ ID NO: 3152422 - DNA, 19 bp, Homo sapiens
tctctgacttctgcctgga

SEQ ID NO: 3152423 - DNA, 17 bp, Homo sapiens
tctctgaggacactaac

SEQ ID NO: 3152424 - DNA, 13 bp, Homo sapiens
tctctgagtggtg

SEQ ID NO: 3152425 - DNA, 23 bp, Homo sapiens
tctctgagtggtggttcctttgc

SEQ ID NO: 3152426 - DNA, 14 bp, Homo sapiens
tctctgatcttgtg

SEQ ID NO: 3152427 - DNA, 19 bp, Homo sapiens
tctctgatcttgtgctcag

SEQ ID NO: 3152428 - DNA, 23 bp, Homo sapiens
tctctgatcttgtgctcagcatg

SEQ ID NO: 3152429 - DNA, 14 bp, Homo sapiens
tctctgcaatgctt

SEQ ID NO: 3152430 - DNA, 19 bp, Homo sapiens
tctctgcaatgcttctgta

SEQ ID NO: 3152431 - DNA, 15 bp, Homo sapiens
tctctgcagacttcc

SEQ ID NO: 3152432 - DNA, 13 bp, Homo sapiens
tctctgcagtaaa

SEQ ID NO: 3152433 - DNA, 14 bp, Homo sapiens
tctctgcagtaaaa

SEQ ID NO: 3152434 - DNA, 15 bp, Homo sapiens
tctctgccagtgaca

SEQ ID NO: 3152435 - DNA, 12 bp, Homo sapiens
tctctgcccctg

SEQ ID NO: 3152436 - DNA, 11 bp, Homo sapiens
tctctgctcca

SEQ ID NO: 3152437 - DNA, 17 bp, Homo sapiens
tctctgctccaccacat

SEQ ID NO: 3152438 - DNA, 13 bp, Homo sapiens
tctctgctccttc

SEQ ID NO: 3152439 - DNA, 13 bp, Homo sapiens
tctctgctctagc

SEQ ID NO: 3152440 - DNA, 20 bp, Homo sapiens
tctctgctctagccaggagt

SEQ ID NO: 3152441 - DNA, 16 bp, Homo sapiens
tctctgctctctatgt

SEQ ID NO: 3152442 - DNA, 22 bp, Homo sapiens
tctctgctgagctgggcccagc

SEQ ID NO: 3152443 - DNA, 12 bp, Homo sapiens
tctctgctggcc

SEQ ID NO: 3152444 - DNA, 14 bp, Homo sapiens
tctctgctggccca

SEQ ID NO: 3152445 - DNA, 19 bp, Homo sapiens
tctctgctggcccagccaa

SEQ ID NO: 3152446 - DNA, 19 bp, Homo sapiens
tctctggaagcccctgggc

SEQ ID NO: 3152447 - DNA, 15 bp, Homo sapiens
tctctggcctcccac

SEQ ID NO: 3152448 - DNA, 12 bp, Homo sapiens
tctctggccttc

SEQ ID NO: 3152449 - DNA, 13 bp, Homo sapiens
tctctggccttcg

SEQ ID NO: 3152450 - DNA, 16 bp, Homo sapiens
tctctggccttcggcc

SEQ ID NO: 3152451 - DNA, 17 bp, Homo sapiens
tctctggccttcggcct

SEQ ID NO: 3152452 - DNA, 22 bp, Homo sapiens
tctctggccttcggcctccatc

SEQ ID NO: 3152453 - DNA, 18 bp, Homo sapiens
tctctggggccctgggcc

SEQ ID NO: 3152454 - DNA, 19 bp, Homo sapiens
tctctgtagggaactctgg

SEQ ID NO: 3152455 - DNA, 22 bp, Homo sapiens
tctctgtagttcctaatggatt

SEQ ID NO: 3152456 - DNA, 15 bp, Homo sapiens
tctctgtataaacat

SEQ ID NO: 3152457 - DNA, 21 bp, Homo sapiens
tctctgtataaacattaaatg

SEQ ID NO: 3152458 - DNA, 19 bp, Homo sapiens
tctctgtcacccttgtcct

SEQ ID NO: 3152459 - DNA, 14 bp, Homo sapiens
tctctgtcccttgc

SEQ ID NO: 3152460 - DNA, 18 bp, Homo sapiens
tctctgtcccttgctgta

SEQ ID NO: 3152461 - DNA, 23 bp, Homo sapiens
tctctgtgaacgatttagaaaga

SEQ ID NO: 3152462 - DNA, 15 bp, Homo sapiens
tctctgtgaatacaa

SEQ ID NO: 3152463 - DNA, 11 bp, Homo sapiens
tctctgtgctt

SEQ ID NO: 3152464 - DNA, 19 bp, Homo sapiens
tctctgtgcttcaattaat

SEQ ID NO: 3152465 - DNA, 22 bp, Homo sapiens
tctctgtgtctaagattctaga

SEQ ID NO: 3152466 - DNA, 17 bp, Homo sapiens
tctctgtgtctttctct

SEQ ID NO: 3152467 - DNA, 18 bp, Homo sapiens
tctctgtgtgcacaaata

SEQ ID NO: 3152468 - DNA, 10 bp, Homo sapiens
tctctgtgtt

SEQ ID NO: 3152469 - DNA, 15 bp, Homo sapiens
tctctgttcttcatc

SEQ ID NO: 3152470 - DNA, 18 bp, Homo sapiens
tctctgttgtcgtaaaga

SEQ ID NO: 3152471 - DNA, 13 bp, Homo sapiens
tctcttaaagttg

SEQ ID NO: 3152472 - DNA, 16 bp, Homo sapiens
tctcttagctactgta

SEQ ID NO: 3152473 - DNA, 21 bp, Homo sapiens
tctcttatagaatatttatta

SEQ ID NO: 3152474 - DNA, 14 bp, Homo sapiens
tctcttattctaat

SEQ ID NO: 3152475 - DNA, 15 bp, Homo sapiens
tctcttattctaata

SEQ ID NO: 3152476 - DNA, 17 bp, Homo sapiens
tctcttcagactctcag

SEQ ID NO: 3152477 - DNA, 22 bp, Homo sapiens
tctcttcagactctcagcccag

SEQ ID NO: 3152478 - DNA, 13 bp, Homo sapiens
tctcttcaggttc

SEQ ID NO: 3152479 - DNA, 16 bp, Homo sapiens
tctcttcaggttctta

SEQ ID NO: 3152480 - DNA, 9 bp, Homo sapiens
tctcttcat

SEQ ID NO: 3152481 - DNA, 22 bp, Homo sapiens
tctcttccagctgcttcaggga

SEQ ID NO: 3152482 - DNA, 18 bp, Homo sapiens
tctcttctctgcaatgct

SEQ ID NO: 3152483 - DNA, 19 bp, Homo sapiens
tctcttctgctccaccctt

SEQ ID NO: 3152484 - DNA, 11 bp, Homo sapiens
tctcttcttac

SEQ ID NO: 3152485 - DNA, 16 bp, Homo sapiens
tctcttcttactcatt

SEQ ID NO: 3152486 - DNA, 22 bp, Homo sapiens
tctcttgagggagcttagccaa

SEQ ID NO: 3152487 - DNA, 14 bp, Homo sapiens
tctcttgcacccgc

SEQ ID NO: 3152488 - DNA, 15 bp, Homo sapiens
tctcttgcacccgcc

SEQ ID NO: 3152489 - DNA, 22 bp, Homo sapiens
tctcttgcacccgcctctcccg

SEQ ID NO: 3152490 - DNA, 12 bp, Homo sapiens
tctcttgcttgt

SEQ ID NO: 3152491 - DNA, 21 bp, Homo sapiens
tctcttgctttatactactca

SEQ ID NO: 3152492 - DNA, 21 bp, Homo sapiens
tctcttggaaaataagacaat

SEQ ID NO: 3152493 - DNA, 23 bp, Homo sapiens
tctcttgggaactgaactcactt

SEQ ID NO: 3152494 - DNA, 16 bp, Homo sapiens
tctcttggtggggagg

SEQ ID NO: 3152495 - DNA, 22 bp, Homo sapiens
tctcttgtataagatcctagat

SEQ ID NO: 3152496 - DNA, 22 bp, Homo sapiens
tctctttaagggcatgccttgt

SEQ ID NO: 3152497 - DNA, 16 bp, Homo sapiens
tctctttaatcttcag

SEQ ID NO: 3152498 - DNA, 20 bp, Homo sapiens
tctctttaatgtcacaggca

SEQ ID NO: 3152499 - DNA, 22 bp, Homo sapiens
tctctttaatgtcacaggcagg

SEQ ID NO: 3152500 - DNA, 17 bp, Homo sapiens
tctctttagtataattg

SEQ ID NO: 3152501 - DNA, 13 bp, Homo sapiens
tctctttgtctgc

SEQ ID NO: 3152502 - DNA, 21 bp, Homo sapiens
tctctttgtctgccttcccaa

SEQ ID NO: 3152503 - DNA, 23 bp, Homo sapiens
tctctttgttctcagctccccct

SEQ ID NO: 3152504 - DNA, 12 bp, Homo sapiens
tctcttttccac

SEQ ID NO: 3152505 - DNA, 22 bp, Homo sapiens
tctcttttccactccattgtcg

SEQ ID NO: 3152506 - DNA, 14 bp, Homo sapiens
tctcttttccccgc

SEQ ID NO: 3152507 - DNA, 15 bp, Homo sapiens
tctcttttccccgcc

SEQ ID NO: 3152508 - DNA, 21 bp, Homo sapiens
tctcttttcctgttgtattga

SEQ ID NO: 3152509 - DNA, 13 bp, Homo sapiens
tctcttttcttta

SEQ ID NO: 3152510 - DNA, 18 bp, Homo sapiens
tctcttttctttagagca

SEQ ID NO: 3152511 - DNA, 12 bp, Homo sapiens
tctctttttgtt

SEQ ID NO: 3152512 - DNA, 16 bp, Homo sapiens
tctgaaaaacattcca

SEQ ID NO: 3152513 - DNA, 23 bp, Homo sapiens
tctgaaaatgtatgtgtaagtat

SEQ ID NO: 3152514 - DNA, 23 bp, Homo sapiens
tctgaaataaaatgccatagttt

SEQ ID NO: 3152515 - DNA, 14 bp, Homo sapiens
tctgaaatgaaaca

SEQ ID NO: 3152516 - DNA, 17 bp, Homo sapiens
tctgaacacaggcagct

SEQ ID NO: 3152517 - DNA, 18 bp, Homo sapiens
tctgaacacaggcagctt

SEQ ID NO: 3152518 - DNA, 21 bp, Homo sapiens
tctgaacccttgtgcttggtg

SEQ ID NO: 3152519 - DNA, 22 bp, Homo sapiens
tctgaacccttgtgcttggtgg

SEQ ID NO: 3152520 - DNA, 21 bp, Homo sapiens
tctgaactcaaactgaggaat

SEQ ID NO: 3152521 - DNA, 14 bp, Homo sapiens
tctgaactctcaaa

SEQ ID NO: 3152522 - DNA, 17 bp, Homo sapiens
tctgaacttgccttaaa

SEQ ID NO: 3152523 - DNA, 13 bp, Homo sapiens
tctgaactttgga

SEQ ID NO: 3152524 - DNA, 15 bp, Homo sapiens
tctgaactttggaga

SEQ ID NO: 3152525 - DNA, 18 bp, Homo sapiens
tctgaagactgagaactt

SEQ ID NO: 3152526 - DNA, 10 bp, Homo sapiens
tctgaagagg

SEQ ID NO: 3152527 - DNA, 17 bp, Homo sapiens
tctgaagagtatccttc

SEQ ID NO: 3152528 - DNA, 22 bp, Homo sapiens
tctgaagagtatccttccttca

SEQ ID NO: 3152529 - DNA, 21 bp, Homo sapiens
tctgaagcatgtttcatgttt

SEQ ID NO: 3152530 - DNA, 16 bp, Homo sapiens
tctgaagccctcccag

SEQ ID NO: 3152531 - DNA, 16 bp, Homo sapiens
tctgaagcttgactcc

SEQ ID NO: 3152532 - DNA, 14 bp, Homo sapiens
tctgaaggaagaga

SEQ ID NO: 3152533 - DNA, 18 bp, Homo sapiens
tctgaaggaatagccaga

SEQ ID NO: 3152534 - DNA, 20 bp, Homo sapiens
tctgaaggaatagccagaga

SEQ ID NO: 3152535 - DNA, 22 bp, Homo sapiens
tctgaaggacattgcggacagc

SEQ ID NO: 3152536 - DNA, 17 bp, Homo sapiens
tctgaaggcaaatataa

SEQ ID NO: 3152537 - DNA, 13 bp, Homo sapiens
tctgaagtactta

SEQ ID NO: 3152538 - DNA, 15 bp, Homo sapiens
tctgaagtcactgca

SEQ ID NO: 3152539 - DNA, 14 bp, Homo sapiens
tctgaataacttga

SEQ ID NO: 3152540 - DNA, 15 bp, Homo sapiens
tctgaataacttgaa

SEQ ID NO: 3152541 - DNA, 22 bp, Homo sapiens
tctgaatcgagtgagacaaaat

SEQ ID NO: 3152542 - DNA, 20 bp, Homo sapiens
tctgaatgaaaataactgaa

SEQ ID NO: 3152543 - DNA, 17 bp, Homo sapiens
tctgaatgctgctactt

SEQ ID NO: 3152544 - DNA, 12 bp, Homo sapiens
tctgaatgtaat

SEQ ID NO: 3152545 - DNA, 16 bp, Homo sapiens
tctgaatgtaatttgt

SEQ ID NO: 3152546 - DNA, 20 bp, Homo sapiens
tctgaatgtaatttgtgtaa

SEQ ID NO: 3152547 - DNA, 21 bp, Homo sapiens
tctgaatgtaatttgtgtaat

SEQ ID NO: 3152548 - DNA, 14 bp, Homo sapiens
tctgaatgtattta

SEQ ID NO: 3152549 - DNA, 15 bp, Homo sapiens
tctgaatgtatttat

SEQ ID NO: 3152550 - DNA, 19 bp, Homo sapiens
tctgaatgtatttatgtgt

SEQ ID NO: 3152551 - DNA, 23 bp, Homo sapiens
tctgaatgttctgacattaacag

SEQ ID NO: 3152552 - DNA, 15 bp, Homo sapiens
tctgaatttatttaa

SEQ ID NO: 3152553 - DNA, 13 bp, Homo sapiens
tctgacaagggct

SEQ ID NO: 3152554 - DNA, 23 bp, Homo sapiens
tctgacaagggctgacctgcctc

SEQ ID NO: 3152555 - DNA, 18 bp, Homo sapiens
tctgacacacagctctgt

SEQ ID NO: 3152556 - DNA, 12 bp, Homo sapiens
tctgacaggcaa

SEQ ID NO: 3152557 - DNA, 12 bp, Homo sapiens
tctgacatccct

SEQ ID NO: 3152558 - DNA, 13 bp, Homo sapiens
tctgacatccctt

SEQ ID NO: 3152559 - DNA, 14 bp, Homo sapiens
tctgacatcccttc

SEQ ID NO: 3152560 - DNA, 13 bp, Homo sapiens
tctgacatgcatt

SEQ ID NO: 3152561 - DNA, 15 bp, Homo sapiens
tctgacattaacagt

SEQ ID NO: 3152562 - DNA, 19 bp, Homo sapiens
tctgacattaacagttttc

SEQ ID NO: 3152563 - DNA, 23 bp, Homo sapiens
tctgacattaacagttttccatg

SEQ ID NO: 3152564 - DNA, 18 bp, Homo sapiens
tctgaccatttcaggggt

SEQ ID NO: 3152565 - DNA, 21 bp, Homo sapiens
tctgaccccagtggaaaacaa

SEQ ID NO: 3152566 - DNA, 15 bp, Homo sapiens
tctgacccctcctca

SEQ ID NO: 3152567 - DNA, 17 bp, Homo sapiens
tctgacccctcctcact

SEQ ID NO: 3152568 - DNA, 12 bp, Homo sapiens
tctgacctgcag

SEQ ID NO: 3152569 - DNA, 14 bp, Homo sapiens
tctgacctgcaggc

SEQ ID NO: 3152570 - DNA, 20 bp, Homo sapiens
tctgacgtgccttttgcacc

SEQ ID NO: 3152571 - DNA, 17 bp, Homo sapiens
tctgactagtagatttc

SEQ ID NO: 3152572 - DNA, 20 bp, Homo sapiens
tctgactagtagatttctat

SEQ ID NO: 3152573 - DNA, 12 bp, Homo sapiens
tctgactataac

SEQ ID NO: 3152574 - DNA, 18 bp, Homo sapiens
tctgactcaggcgcctgg

SEQ ID NO: 3152575 - DNA, 19 bp, Homo sapiens
tctgactcaggcgcctggc

SEQ ID NO: 3152576 - DNA, 22 bp, Homo sapiens
tctgactcaggcgcctggcaca

SEQ ID NO: 3152577 - DNA, 13 bp, Homo sapiens
tctgactccagag

SEQ ID NO: 3152578 - DNA, 21 bp, Homo sapiens
tctgactccagagtctgagcc

SEQ ID NO: 3152579 - DNA, 14 bp, Homo sapiens
tctgactgccaagc

SEQ ID NO: 3152580 - DNA, 18 bp, Homo sapiens
tctgactgccaagccaga

SEQ ID NO: 3152581 - DNA, 20 bp, Homo sapiens
tctgacttaagcaaaagaaa

SEQ ID NO: 3152582 - DNA, 15 bp, Homo sapiens
tctgacttcctctga

SEQ ID NO: 3152583 - DNA, 19 bp, Homo sapiens
tctgacttctgcctggaga

SEQ ID NO: 3152584 - DNA, 20 bp, Homo sapiens
tctgacttctgcctggagac

SEQ ID NO: 3152585 - DNA, 14 bp, Homo sapiens
tctgactttacttg

SEQ ID NO: 3152586 - DNA, 15 bp, Homo sapiens
tctgactttacttgt

SEQ ID NO: 3152587 - DNA, 14 bp, Homo sapiens
tctgagaagaggag

SEQ ID NO: 3152588 - DNA, 13 bp, Homo sapiens
tctgagactcaca

SEQ ID NO: 3152589 - DNA, 21 bp, Homo sapiens
tctgagactctttagagcagc

SEQ ID NO: 3152590 - DNA, 15 bp, Homo sapiens
tctgagagtctagat

SEQ ID NO: 3152591 - DNA, 15 bp, Homo sapiens
tctgagccagattac

SEQ ID NO: 3152592 - DNA, 18 bp, Homo sapiens
tctgagccagattacagg

SEQ ID NO: 3152593 - DNA, 23 bp, Homo sapiens
tctgagcccatgttctgccccca

SEQ ID NO: 3152594 - DNA, 23 bp, Homo sapiens
tctgagcccccggctagtaccct

SEQ ID NO: 3152595 - DNA, 17 bp, Homo sapiens
tctgagcccgggctgcc

SEQ ID NO: 3152596 - DNA, 19 bp, Homo sapiens
tctgagcccgggctgcctg

SEQ ID NO: 3152597 - DNA, 11 bp, Homo sapiens
tctgagccctg

SEQ ID NO: 3152598 - DNA, 18 bp, Homo sapiens
tctgagccttgagagaaa

SEQ ID NO: 3152599 - DNA, 16 bp, Homo sapiens
tctgagcgggaggcag

SEQ ID NO: 3152600 - DNA, 17 bp, Homo sapiens
tctgagcgggaggcaga

SEQ ID NO: 3152601 - DNA, 20 bp, Homo sapiens
tctgagcttttcatggaagt

SEQ ID NO: 3152602 - DNA, 18 bp, Homo sapiens
tctgaggaatccagaccc

SEQ ID NO: 3152603 - DNA, 22 bp, Homo sapiens
tctgaggaatccagacccggct

SEQ ID NO: 3152604 - DNA, 20 bp, Homo sapiens
tctgaggacactaaccacgc

SEQ ID NO: 3152605 - DNA, 12 bp, Homo sapiens
tctgaggcctca

SEQ ID NO: 3152606 - DNA, 21 bp, Homo sapiens
tctgaggcctcatccctcgga

SEQ ID NO: 3152607 - DNA, 16 bp, Homo sapiens
tctgagggaaagtgca

SEQ ID NO: 3152608 - DNA, 21 bp, Homo sapiens
tctgagggaggaggccacctc

SEQ ID NO: 3152609 - DNA, 12 bp, Homo sapiens
tctgagtcctgt

SEQ ID NO: 3152610 - DNA, 18 bp, Homo sapiens
tctgagtcctgtctctgc

SEQ ID NO: 3152611 - DNA, 21 bp, Homo sapiens
tctgagtcctgtctctgcctg

SEQ ID NO: 3152612 - DNA, 15 bp, Homo sapiens
tctgagtttaccatt

SEQ ID NO: 3152613 - DNA, 21 bp, Homo sapiens
tctgagtttatattctgaaag

SEQ ID NO: 3152614 - DNA, 22 bp, Homo sapiens
tctgataagcttcctagaaagt

SEQ ID NO: 3152615 - DNA, 13 bp, Homo sapiens
tctgatattaatc

SEQ ID NO: 3152616 - DNA, 19 bp, Homo sapiens
tctgatattccatgaatgt

SEQ ID NO: 3152617 - DNA, 21 bp, Homo sapiens
tctgatcatccactgtgccat

SEQ ID NO: 3152618 - DNA, 13 bp, Homo sapiens
tctgatctataca

SEQ ID NO: 3152619 - DNA, 19 bp, Homo sapiens
tctgatggaccttctagaa

SEQ ID NO: 3152620 - DNA, 15 bp, Homo sapiens
tctgattctggcttt

SEQ ID NO: 3152621 - DNA, 22 bp, Homo sapiens
tctgattgatttgattgggatg

SEQ ID NO: 3152622 - DNA, 22 bp, Homo sapiens
tctgattggcttgtagaattgt

SEQ ID NO: 3152623 - DNA, 12 bp, Homo sapiens
tctgatttcagt

SEQ ID NO: 3152624 - DNA, 16 bp, Homo sapiens
tctgatttcagttttt

SEQ ID NO: 3152625 - DNA, 18 bp, Homo sapiens
tctgatttcagtttttca

SEQ ID NO: 3152626 - DNA, 13 bp, Homo sapiens
tctgattttagga

SEQ ID NO: 3152627 - DNA, 16 bp, Homo sapiens
tctgatttttaaagta

SEQ ID NO: 3152628 - DNA, 20 bp, Homo sapiens
tctgatttttaaagtacttt

SEQ ID NO: 3152629 - DNA, 24 bp, Homo sapiens
tctgcaaacaccaacatgttggga

SEQ ID NO: 3152630 - DNA, 21 bp, Homo sapiens
tctgcaaaggtggcaatgctt

SEQ ID NO: 3152631 - DNA, 15 bp, Homo sapiens
tctgcaactagccaa

SEQ ID NO: 3152632 - DNA, 16 bp, Homo sapiens
tctgcaactagccaag

SEQ ID NO: 3152633 - DNA, 20 bp, Homo sapiens
tctgcaagcacatctgcatt

SEQ ID NO: 3152634 - DNA, 17 bp, Homo sapiens
tctgcaagtcagaggat

SEQ ID NO: 3152635 - DNA, 19 bp, Homo sapiens
tctgcaagtgtctggagcg

SEQ ID NO: 3152636 - DNA, 15 bp, Homo sapiens
tctgcaatgcttctg

SEQ ID NO: 3152637 - DNA, 18 bp, Homo sapiens
tctgcaatgcttctgtag

SEQ ID NO: 3152638 - DNA, 19 bp, Homo sapiens
tctgcaatgcttctgtagc

SEQ ID NO: 3152639 - DNA, 20 bp, Homo sapiens
tctgcaatgcttctgtagct

SEQ ID NO: 3152640 - DNA, 23 bp, Homo sapiens
tctgcaatgcttctgtagcttct

SEQ ID NO: 3152641 - DNA, 16 bp, Homo sapiens
tctgcaattcccctct

SEQ ID NO: 3152642 - DNA, 20 bp, Homo sapiens
tctgcaattcccctctgctg

SEQ ID NO: 3152643 - DNA, 22 bp, Homo sapiens
tctgcaattcccctctgctgct

SEQ ID NO: 3152644 - DNA, 14 bp, Homo sapiens
tctgcacacaaata

SEQ ID NO: 3152645 - DNA, 22 bp, Homo sapiens
tctgcacacacctccgagacag

SEQ ID NO: 3152646 - DNA, 21 bp, Homo sapiens
tctgcacagacaagcagccct

SEQ ID NO: 3152647 - DNA, 15 bp, Homo sapiens
tctgcaccccttctc

SEQ ID NO: 3152648 - DNA, 19 bp, Homo sapiens
tctgcaccccttctctcct

SEQ ID NO: 3152649 - DNA, 20 bp, Homo sapiens
tctgcaccccttctctcctc

SEQ ID NO: 3152650 - DNA, 12 bp, Homo sapiens
tctgcaccctcc

SEQ ID NO: 3152651 - DNA, 15 bp, Homo sapiens
tctgcaccctccacc

SEQ ID NO: 3152652 - DNA, 21 bp, Homo sapiens
tctgcaccctccaccctgtcc

SEQ ID NO: 3152653 - DNA, 21 bp, Homo sapiens
tctgcacctatgtagctctgc

SEQ ID NO: 3152654 - DNA, 23 bp, Homo sapiens
tctgcactactcctctgcagtgc

SEQ ID NO: 3152655 - DNA, 21 bp, Homo sapiens
tctgcactactgacatgtggg

SEQ ID NO: 3152656 - DNA, 18 bp, Homo sapiens
tctgcactcccacctgac

SEQ ID NO: 3152657 - DNA, 21 bp, Homo sapiens
tctgcactcccacctgacaca

SEQ ID NO: 3152658 - DNA, 20 bp, Homo sapiens
tctgcactctccaccctggc

SEQ ID NO: 3152659 - DNA, 13 bp, Homo sapiens
tctgcactgaaaa

SEQ ID NO: 3152660 - DNA, 21 bp, Homo sapiens
tctgcagaaatttgcaactca

SEQ ID NO: 3152661 - DNA, 18 bp, Homo sapiens
tctgcagaacagtgaaag

SEQ ID NO: 3152662 - DNA, 15 bp, Homo sapiens
tctgcagacctggtt

SEQ ID NO: 3152663 - DNA, 11 bp, Homo sapiens
tctgcagccct

SEQ ID NO: 3152664 - DNA, 17 bp, Homo sapiens
tctgcagcccttgggca

SEQ ID NO: 3152665 - DNA, 19 bp, Homo sapiens
tctgcaggcttaataaaaa

SEQ ID NO: 3152666 - DNA, 13 bp, Homo sapiens
tctgcagtgcctt

SEQ ID NO: 3152667 - DNA, 16 bp, Homo sapiens
tctgcatatgttgaat

SEQ ID NO: 3152668 - DNA, 21 bp, Homo sapiens
tctgcatatgttgaatacttt

SEQ ID NO: 3152669 - DNA, 19 bp, Homo sapiens
tctgcatcatctgtagata

SEQ ID NO: 3152670 - DNA, 14 bp, Homo sapiens
tctgcatcccagca

SEQ ID NO: 3152671 - DNA, 21 bp, Homo sapiens
tctgcatcccagcacctgcct

SEQ ID NO: 3152672 - DNA, 22 bp, Homo sapiens
tctgcatcccagcacctgcctc

SEQ ID NO: 3152673 - DNA, 23 bp, Homo sapiens
tctgcatcccagcacctgcctcc

SEQ ID NO: 3152674 - DNA, 14 bp, Homo sapiens
tctgcatctgactc

SEQ ID NO: 3152675 - DNA, 15 bp, Homo sapiens
tctgcatggattcag

SEQ ID NO: 3152676 - DNA, 17 bp, Homo sapiens
tctgcattcaggatcaa

SEQ ID NO: 3152677 - DNA, 17 bp, Homo sapiens
tctgcattcctgtaact

SEQ ID NO: 3152678 - DNA, 15 bp, Homo sapiens
tctgcattttaacaa

SEQ ID NO: 3152679 - DNA, 15 bp, Homo sapiens
tctgccacactctga

SEQ ID NO: 3152680 - DNA, 15 bp, Homo sapiens
tctgccaccagagac

SEQ ID NO: 3152681 - DNA, 12 bp, Homo sapiens
tctgccaggcaa

SEQ ID NO: 3152682 - DNA, 12 bp, Homo sapiens
tctgccaggccc

SEQ ID NO: 3152683 - DNA, 16 bp, Homo sapiens
tctgccaggcccatct

SEQ ID NO: 3152684 - DNA, 12 bp, Homo sapiens
tctgccagtgga

SEQ ID NO: 3152685 - DNA, 16 bp, Homo sapiens
tctgccagtggatccc

SEQ ID NO: 3152686 - DNA, 18 bp, Homo sapiens
tctgccatctagccagcc

SEQ ID NO: 3152687 - DNA, 17 bp, Homo sapiens
tctgccattgggaccct

SEQ ID NO: 3152688 - DNA, 21 bp, Homo sapiens
tctgccatttcaaatttctat

SEQ ID NO: 3152689 - DNA, 14 bp, Homo sapiens
tctgcccaggggtg

SEQ ID NO: 3152690 - DNA, 19 bp, Homo sapiens
tctgcccaggggtgccccc

SEQ ID NO: 3152691 - DNA, 22 bp, Homo sapiens
tctgcccaggggtgccccctcc

SEQ ID NO: 3152692 - DNA, 12 bp, Homo sapiens
tctgccccaagc

SEQ ID NO: 3152693 - DNA, 14 bp, Homo sapiens
tctgccccaagcag

SEQ ID NO: 3152694 - DNA, 19 bp, Homo sapiens
tctgccccaagcagccagc

SEQ ID NO: 3152695 - DNA, 15 bp, Homo sapiens
tctgccccaagcccc

SEQ ID NO: 3152696 - DNA, 17 bp, Homo sapiens
tctgccccacgctgtgg

SEQ ID NO: 3152697 - DNA, 21 bp, Homo sapiens
tctgccccacgctgtggccct

SEQ ID NO: 3152698 - DNA, 16 bp, Homo sapiens
tctgccccagctctgg

SEQ ID NO: 3152699 - DNA, 17 bp, Homo sapiens
tctgccccagctctggc

SEQ ID NO: 3152700 - DNA, 20 bp, Homo sapiens
tctgccccagctctggcttc

SEQ ID NO: 3152701 - DNA, 17 bp, Homo sapiens
tctgcccctcccaaccc

SEQ ID NO: 3152702 - DNA, 15 bp, Homo sapiens
tctgcccctccccca

SEQ ID NO: 3152703 - DNA, 21 bp, Homo sapiens
tctgccctcattactgggcct

SEQ ID NO: 3152704 - DNA, 13 bp, Homo sapiens
tctgccctggctg

SEQ ID NO: 3152705 - DNA, 14 bp, Homo sapiens
tctgccctggctgc

SEQ ID NO: 3152706 - DNA, 21 bp, Homo sapiens
tctgccctggctgctgccccc

SEQ ID NO: 3152707 - DNA, 22 bp, Homo sapiens
tctgccctttcctaggcccagg

SEQ ID NO: 3152708 - DNA, 21 bp, Homo sapiens
tctgcctctgacacacagctc

SEQ ID NO: 3152709 - DNA, 22 bp, Homo sapiens
tctgcctctgacacacagctct

SEQ ID NO: 3152710 - DNA, 23 bp, Homo sapiens
tctgcctctgacacacagctctg

SEQ ID NO: 3152711 - DNA, 19 bp, Homo sapiens
tctgcctgaagtcacacag

SEQ ID NO: 3152712 - DNA, 22 bp, Homo sapiens
tctgcctgcccaggcccctgcc

SEQ ID NO: 3152713 - DNA, 13 bp, Homo sapiens
tctgcctggagtg

SEQ ID NO: 3152714 - DNA, 14 bp, Homo sapiens
tctgcctggcctgg

SEQ ID NO: 3152715 - DNA, 13 bp, Homo sapiens
tctgcctgggcct

SEQ ID NO: 3152716 - DNA, 14 bp, Homo sapiens
tctgcctgggcctg

SEQ ID NO: 3152717 - DNA, 15 bp, Homo sapiens
tctgcctgggcctgt

SEQ ID NO: 3152718 - DNA, 19 bp, Homo sapiens
tctgcctgggcctgtgcag

SEQ ID NO: 3152719 - DNA, 20 bp, Homo sapiens
tctgcctgggcctgtgcagc

SEQ ID NO: 3152720 - DNA, 19 bp, Homo sapiens
tctgcctgttataactctg

SEQ ID NO: 3152721 - DNA, 17 bp, Homo sapiens
tctgccttactggtttc

SEQ ID NO: 3152722 - DNA, 16 bp, Homo sapiens
tctgccttagaggagc

SEQ ID NO: 3152723 - DNA, 20 bp, Homo sapiens
tctgccttctcatgatccaa

SEQ ID NO: 3152724 - DNA, 23 bp, Homo sapiens
tctgcctttgacatttaatttag

SEQ ID NO: 3152725 - DNA, 14 bp, Homo sapiens
tctgcggaccccag

SEQ ID NO: 3152726 - DNA, 21 bp, Homo sapiens
tctgctaggcgctggggagac

SEQ ID NO: 3152727 - DNA, 17 bp, Homo sapiens
tctgctcacatatctgt

SEQ ID NO: 3152728 - DNA, 20 bp, Homo sapiens
tctgctcacatatctgtcat

SEQ ID NO: 3152729 - DNA, 15 bp, Homo sapiens
tctgctcaccgccca

SEQ ID NO: 3152730 - DNA, 16 bp, Homo sapiens
tctgctcagccaagct

SEQ ID NO: 3152731 - DNA, 14 bp, Homo sapiens
tctgctccaccaca

SEQ ID NO: 3152732 - DNA, 15 bp, Homo sapiens
tctgctccacccttg

SEQ ID NO: 3152733 - DNA, 23 bp, Homo sapiens
tctgctccacccttggcctgtct

SEQ ID NO: 3152734 - DNA, 13 bp, Homo sapiens
tctgctcctctcc

SEQ ID NO: 3152735 - DNA, 14 bp, Homo sapiens
tctgctcctctcca

SEQ ID NO: 3152736 - DNA, 18 bp, Homo sapiens
tctgctccttcactgttc

SEQ ID NO: 3152737 - DNA, 17 bp, Homo sapiens
tctgctcgccctccttt

SEQ ID NO: 3152738 - DNA, 16 bp, Homo sapiens
tctgctctagccagga

SEQ ID NO: 3152739 - DNA, 15 bp, Homo sapiens
tctgctctagggaat

SEQ ID NO: 3152740 - DNA, 12 bp, Homo sapiens
tctgctctggaa

SEQ ID NO: 3152741 - DNA, 21 bp, Homo sapiens
tctgctctggttgtttctgtt

SEQ ID NO: 3152742 - DNA, 19 bp, Homo sapiens
tctgctctttctctgccag

SEQ ID NO: 3152743 - DNA, 20 bp, Homo sapiens
tctgctgacagacacaggcc

SEQ ID NO: 3152744 - DNA, 19 bp, Homo sapiens
tctgctgagctgggcccag

SEQ ID NO: 3152745 - DNA, 22 bp, Homo sapiens
tctgctgagctgggcccagccc

SEQ ID NO: 3152746 - DNA, 16 bp, Homo sapiens
tctgctgatataatat

SEQ ID NO: 3152747 - DNA, 17 bp, Homo sapiens
tctgctgcccaggccac

SEQ ID NO: 3152748 - DNA, 19 bp, Homo sapiens
tctgctgcccaggccacag

SEQ ID NO: 3152749 - DNA, 18 bp, Homo sapiens
tctgctgctgtccctccc

SEQ ID NO: 3152750 - DNA, 13 bp, Homo sapiens
tctgctggatatt

SEQ ID NO: 3152751 - DNA, 14 bp, Homo sapiens
tctgctggcctgga

SEQ ID NO: 3152752 - DNA, 15 bp, Homo sapiens
tctgctggcctggat

SEQ ID NO: 3152753 - DNA, 16 bp, Homo sapiens
tctgctggcctggccg

SEQ ID NO: 3152754 - DNA, 15 bp, Homo sapiens
tctgctgggagttct

SEQ ID NO: 3152755 - DNA, 19 bp, Homo sapiens
tctgctgggagttctagaa

SEQ ID NO: 3152756 - DNA, 21 bp, Homo sapiens
tctgctgggatgtgtgctttc

SEQ ID NO: 3152757 - DNA, 17 bp, Homo sapiens
tctgctggttcctgact

SEQ ID NO: 3152758 - DNA, 15 bp, Homo sapiens
tctgctgtccccttg

SEQ ID NO: 3152759 - DNA, 16 bp, Homo sapiens
tctgcttaggagagac

SEQ ID NO: 3152760 - DNA, 18 bp, Homo sapiens
tctgcttcaataaatctt

SEQ ID NO: 3152761 - DNA, 14 bp, Homo sapiens
tctgcttgtgttaa

SEQ ID NO: 3152762 - DNA, 22 bp, Homo sapiens
tctgctttctttgattctcctt

SEQ ID NO: 3152763 - DNA, 22 bp, Homo sapiens
tctgcttttatctcagatgtta

SEQ ID NO: 3152764 - DNA, 16 bp, Homo sapiens
tctgcttttctgccct

SEQ ID NO: 3152765 - DNA, 21 bp, Homo sapiens
tctgcttttctgccctggctg

SEQ ID NO: 3152766 - DNA, 23 bp, Homo sapiens
tctgctttttaaagaatgctctt

SEQ ID NO: 3152767 - DNA, 19 bp, Homo sapiens
tctggaaaagaactgttta

SEQ ID NO: 3152768 - DNA, 15 bp, Homo sapiens
tctggaaactaccag

SEQ ID NO: 3152769 - DNA, 19 bp, Homo sapiens
tctggaaaggggggagctg

SEQ ID NO: 3152770 - DNA, 21 bp, Homo sapiens
tctggaaagtgatgtcagaat

SEQ ID NO: 3152771 - DNA, 13 bp, Homo sapiens
tctggaagagagg

SEQ ID NO: 3152772 - DNA, 20 bp, Homo sapiens
tctggaagagaggaatgcct

SEQ ID NO: 3152773 - DNA, 20 bp, Homo sapiens
tctggaaggcccctcccagc

SEQ ID NO: 3152774 - DNA, 14 bp, Homo sapiens
tctggaaggctggc

SEQ ID NO: 3152775 - DNA, 19 bp, Homo sapiens
tctggaaggctggctgagt

SEQ ID NO: 3152776 - DNA, 16 bp, Homo sapiens
tctggaatgcagtggt

SEQ ID NO: 3152777 - DNA, 23 bp, Homo sapiens
tctggaatggtacatgtcttcca

SEQ ID NO: 3152778 - DNA, 19 bp, Homo sapiens
tctggaatttaaggcccaa

SEQ ID NO: 3152779 - DNA, 21 bp, Homo sapiens
tctggacaagccaacttgtaa

SEQ ID NO: 3152780 - DNA, 15 bp, Homo sapiens
tctggacagtacctg

SEQ ID NO: 3152781 - DNA, 23 bp, Homo sapiens
tctggacagtacctgattgtatt

SEQ ID NO: 3152782 - DNA, 20 bp, Homo sapiens
tctggaccaaggtgaagcaa

SEQ ID NO: 3152783 - DNA, 21 bp, Homo sapiens
tctggaccccgtttcattttt

SEQ ID NO: 3152784 - DNA, 22 bp, Homo sapiens
tctggacggcaggctcactgcc

SEQ ID NO: 3152785 - DNA, 16 bp, Homo sapiens
tctggactcctctgtc

SEQ ID NO: 3152786 - DNA, 18 bp, Homo sapiens
tctggactctaaagacca

SEQ ID NO: 3152787 - DNA, 20 bp, Homo sapiens
tctggactctaaagaccaaa

SEQ ID NO: 3152788 - DNA, 20 bp, Homo sapiens
tctggactgaagcctgcagg

SEQ ID NO: 3152789 - DNA, 14 bp, Homo sapiens
tctggactggctag

SEQ ID NO: 3152790 - DNA, 15 bp, Homo sapiens
tctggagacagcccc

SEQ ID NO: 3152791 - DNA, 21 bp, Homo sapiens
tctggagccctaaccccttcc

SEQ ID NO: 3152792 - DNA, 12 bp, Homo sapiens
tctggagccctt

SEQ ID NO: 3152793 - DNA, 16 bp, Homo sapiens
tctggagcccttgggt

SEQ ID NO: 3152794 - DNA, 15 bp, Homo sapiens
tctggaggcctctgg

SEQ ID NO: 3152795 - DNA, 16 bp, Homo sapiens
tctggaggcctctggc

SEQ ID NO: 3152796 - DNA, 18 bp, Homo sapiens
tctggaggcctctggccc

SEQ ID NO: 3152797 - DNA, 21 bp, Homo sapiens
tctggaggggagggggatccg

SEQ ID NO: 3152798 - DNA, 15 bp, Homo sapiens
tctggaggggcccct

SEQ ID NO: 3152799 - DNA, 23 bp, Homo sapiens
tctggaggggcccctgcttctcc

SEQ ID NO: 3152800 - DNA, 18 bp, Homo sapiens
tctggagtggtaacagct

SEQ ID NO: 3152801 - DNA, 19 bp, Homo sapiens
tctggagtggtaacagctc

SEQ ID NO: 3152802 - DNA, 21 bp, Homo sapiens
tctggagtggtaacagctctc

SEQ ID NO: 3152803 - DNA, 13 bp, Homo sapiens
tctggattgtggt

SEQ ID NO: 3152804 - DNA, 15 bp, Homo sapiens
tctggcaacatcttt

SEQ ID NO: 3152805 - DNA, 19 bp, Homo sapiens
tctggccaggatggagggg

SEQ ID NO: 3152806 - DNA, 23 bp, Homo sapiens
tctggccaggcactgccttctcc

SEQ ID NO: 3152807 - DNA, 16 bp, Homo sapiens
tctggcccaccagggt

SEQ ID NO: 3152808 - DNA, 13 bp, Homo sapiens
tctggccctggcc

SEQ ID NO: 3152809 - DNA, 15 bp, Homo sapiens
tctggccctggccct

SEQ ID NO: 3152810 - DNA, 22 bp, Homo sapiens
tctggcctaaaatcttggaagt

SEQ ID NO: 3152811 - DNA, 23 bp, Homo sapiens
tctggcctcccacccgatgctgc

SEQ ID NO: 3152812 - DNA, 12 bp, Homo sapiens
tctggcctggcc

SEQ ID NO: 3152813 - DNA, 13 bp, Homo sapiens
tctggcctggcct

SEQ ID NO: 3152814 - DNA, 19 bp, Homo sapiens
tctggcctggcctggccct

SEQ ID NO: 3152815 - DNA, 20 bp, Homo sapiens
tctggcctggcctggccctg

SEQ ID NO: 3152816 - DNA, 10 bp, Homo sapiens
tctggccttc

SEQ ID NO: 3152817 - DNA, 18 bp, Homo sapiens
tctggccttcggcctcca

SEQ ID NO: 3152818 - DNA, 17 bp, Homo sapiens
tctggctagaggccagc

SEQ ID NO: 3152819 - DNA, 13 bp, Homo sapiens
tctggctccacac

SEQ ID NO: 3152820 - DNA, 19 bp, Homo sapiens
tctggctccacacctccac

SEQ ID NO: 3152821 - DNA, 19 bp, Homo sapiens
tctggctcctcaaacagta

SEQ ID NO: 3152822 - DNA, 15 bp, Homo sapiens
tctggctctaattca

SEQ ID NO: 3152823 - DNA, 17 bp, Homo sapiens
tctggctgaaccctgtg

SEQ ID NO: 3152824 - DNA, 19 bp, Homo sapiens
tctggctgaaccctgtgct

SEQ ID NO: 3152825 - DNA, 16 bp, Homo sapiens
tctggctgtaaggctc

SEQ ID NO: 3152826 - DNA, 18 bp, Homo sapiens
tctggctgtaaggctcta

SEQ ID NO: 3152827 - DNA, 18 bp, Homo sapiens
tctggctgtttagcagaa

SEQ ID NO: 3152828 - DNA, 19 bp, Homo sapiens
tctggctgtttagcagaac

SEQ ID NO: 3152829 - DNA, 13 bp, Homo sapiens
tctggcttagtgc

SEQ ID NO: 3152830 - DNA, 22 bp, Homo sapiens
tctggcttagtgccacccacct

SEQ ID NO: 3152831 - DNA, 21 bp, Homo sapiens
tctggcttattttaatgtgat

SEQ ID NO: 3152832 - DNA, 22 bp, Homo sapiens
tctggctttacctttttgtatg

SEQ ID NO: 3152833 - DNA, 20 bp, Homo sapiens
tctgggaacctcccagaggt

SEQ ID NO: 3152834 - DNA, 14 bp, Homo sapiens
tctgggaattgtgt

SEQ ID NO: 3152835 - DNA, 13 bp, Homo sapiens
tctgggacctcag

SEQ ID NO: 3152836 - DNA, 21 bp, Homo sapiens
tctgggacctgccaggcaggg

SEQ ID NO: 3152837 - DNA, 13 bp, Homo sapiens
tctgggagaggat

SEQ ID NO: 3152838 - DNA, 15 bp, Homo sapiens
tctgggagaggattt

SEQ ID NO: 3152839 - DNA, 13 bp, Homo sapiens
tctgggagcagaa

SEQ ID NO: 3152840 - DNA, 22 bp, Homo sapiens
tctgggagcagaaacagccatt

SEQ ID NO: 3152841 - DNA, 18 bp, Homo sapiens
tctgggaggcaagaaaag

SEQ ID NO: 3152842 - DNA, 13 bp, Homo sapiens
tctgggaggcaga

SEQ ID NO: 3152843 - DNA, 18 bp, Homo sapiens
tctgggagtcacacagtg

SEQ ID NO: 3152844 - DNA, 16 bp, Homo sapiens
tctgggagtccccttt

SEQ ID NO: 3152845 - DNA, 23 bp, Homo sapiens
tctgggatgtagaacttcaagaa

SEQ ID NO: 3152846 - DNA, 16 bp, Homo sapiens
tctgggattattcttt

SEQ ID NO: 3152847 - DNA, 20 bp, Homo sapiens
tctgggcaccacaaaatata

SEQ ID NO: 3152848 - DNA, 13 bp, Homo sapiens
tctgggcagacat

SEQ ID NO: 3152849 - DNA, 16 bp, Homo sapiens
tctgggcagacattat

SEQ ID NO: 3152850 - DNA, 12 bp, Homo sapiens
tctgggccaagt

SEQ ID NO: 3152851 - DNA, 16 bp, Homo sapiens
tctgggccaagttcct

SEQ ID NO: 3152852 - DNA, 23 bp, Homo sapiens
tctgggccaagttcctctagtgc

SEQ ID NO: 3152853 - DNA, 13 bp, Homo sapiens
tctgggcctgggc

SEQ ID NO: 3152854 - DNA, 18 bp, Homo sapiens
tctgggcctgggctaggg

SEQ ID NO: 3152855 - DNA, 20 bp, Homo sapiens
tctgggcggcgggcggctgg

SEQ ID NO: 3152856 - DNA, 12 bp, Homo sapiens
tctgggctcagg

SEQ ID NO: 3152857 - DNA, 13 bp, Homo sapiens
tctgggctcaggg

SEQ ID NO: 3152858 - DNA, 20 bp, Homo sapiens
tctgggctcagggctggagt

SEQ ID NO: 3152859 - DNA, 23 bp, Homo sapiens
tctgggctgcgggaggccctggc

SEQ ID NO: 3152860 - DNA, 21 bp, Homo sapiens
tctgggctgtaacgtggcact

SEQ ID NO: 3152861 - DNA, 22 bp, Homo sapiens
tctgggctgtaacgtggcactg

SEQ ID NO: 3152862 - DNA, 23 bp, Homo sapiens
tctgggctgtaacgtggcactgg

SEQ ID NO: 3152863 - DNA, 17 bp, Homo sapiens
tctggggagctcctggc

SEQ ID NO: 3152864 - DNA, 13 bp, Homo sapiens
tctggggcagatc

SEQ ID NO: 3152865 - DNA, 13 bp, Homo sapiens
tctggggcccagg

SEQ ID NO: 3152866 - DNA, 14 bp, Homo sapiens
tctggggcccagga

SEQ ID NO: 3152867 - DNA, 20 bp, Homo sapiens
tctggggcccaggaagccca

SEQ ID NO: 3152868 - DNA, 21 bp, Homo sapiens
tctggggcccaggaagcccac

SEQ ID NO: 3152869 - DNA, 15 bp, Homo sapiens
tctggggccctgggc

SEQ ID NO: 3152870 - DNA, 14 bp, Homo sapiens
tctggggctctagg

SEQ ID NO: 3152871 - DNA, 20 bp, Homo sapiens
tctggggggcagttgggtag

SEQ ID NO: 3152872 - DNA, 16 bp, Homo sapiens
tctgggtaagaagaaa

SEQ ID NO: 3152873 - DNA, 17 bp, Homo sapiens
tctgggtaagaagaaag

SEQ ID NO: 3152874 - DNA, 14 bp, Homo sapiens
tctgggttcactgc

SEQ ID NO: 3152875 - DNA, 16 bp, Homo sapiens
tctgggttcactgcaa

SEQ ID NO: 3152876 - DNA, 15 bp, Homo sapiens
tctgggttgccttta

SEQ ID NO: 3152877 - DNA, 18 bp, Homo sapiens
tctgggtttttcttgtgg

SEQ ID NO: 3152878 - DNA, 22 bp, Homo sapiens
tctggtaatattgacttgtata

SEQ ID NO: 3152879 - DNA, 15 bp, Homo sapiens
tctggtactctccta

SEQ ID NO: 3152880 - DNA, 18 bp, Homo sapiens
tctggtagatagaaataa

SEQ ID NO: 3152881 - DNA, 20 bp, Homo sapiens
tctggtcaagggctgtcatt

SEQ ID NO: 3152882 - DNA, 13 bp, Homo sapiens
tctggtccttttt

SEQ ID NO: 3152883 - DNA, 12 bp, Homo sapiens
tctggtctgtgt

SEQ ID NO: 3152884 - DNA, 16 bp, Homo sapiens
tctggtcttccaggca

SEQ ID NO: 3152885 - DNA, 17 bp, Homo sapiens
tctggtgaagctcactt

SEQ ID NO: 3152886 - DNA, 17 bp, Homo sapiens
tctggtgatctcccaag

SEQ ID NO: 3152887 - DNA, 16 bp, Homo sapiens
tctggtgcctccagag

SEQ ID NO: 3152888 - DNA, 14 bp, Homo sapiens
tctggtggccccgt

SEQ ID NO: 3152889 - DNA, 16 bp, Homo sapiens
tctggtggtctgttgg

SEQ ID NO: 3152890 - DNA, 13 bp, Homo sapiens
tctggtgttctat

SEQ ID NO: 3152891 - DNA, 16 bp, Homo sapiens
tctggttagttaaaag

SEQ ID NO: 3152892 - DNA, 20 bp, Homo sapiens
tctggttccatttttcctct

SEQ ID NO: 3152893 - DNA, 15 bp, Homo sapiens
tctggttgaactctg

SEQ ID NO: 3152894 - DNA, 14 bp, Homo sapiens
tctggttgtatttc

SEQ ID NO: 3152895 - DNA, 15 bp, Homo sapiens
tctggttgtttctgt

SEQ ID NO: 3152896 - DNA, 20 bp, Homo sapiens
tctggttgtttctgttccaa

SEQ ID NO: 3152897 - DNA, 13 bp, Homo sapiens
tctggttttaaca

SEQ ID NO: 3152898 - DNA, 15 bp, Homo sapiens
tctgtaaactcaaaa

SEQ ID NO: 3152899 - DNA, 12 bp, Homo sapiens
tctgtaaactgt

SEQ ID NO: 3152900 - DNA, 13 bp, Homo sapiens
tctgtaaactgtg

SEQ ID NO: 3152901 - DNA, 16 bp, Homo sapiens
tctgtaaactgtgtat

SEQ ID NO: 3152902 - DNA, 19 bp, Homo sapiens
tctgtaaactgtgtattcc

SEQ ID NO: 3152903 - DNA, 23 bp, Homo sapiens
tctgtaacatcactatccatgca

SEQ ID NO: 3152904 - DNA, 13 bp, Homo sapiens
tctgtaatgatac

SEQ ID NO: 3152905 - DNA, 23 bp, Homo sapiens
tctgtaatgatactgattatgaa

SEQ ID NO: 3152906 - DNA, 14 bp, Homo sapiens
tctgtacatagcct

SEQ ID NO: 3152907 - DNA, 22 bp, Homo sapiens
tctgtaccatagcgctgctctt

SEQ ID NO: 3152908 - DNA, 14 bp, Homo sapiens
tctgtacttcctga

SEQ ID NO: 3152909 - DNA, 19 bp, Homo sapiens
tctgtagacttctggttgt

SEQ ID NO: 3152910 - DNA, 22 bp, Homo sapiens
tctgtagacttctggttgtatt

SEQ ID NO: 3152911 - DNA, 17 bp, Homo sapiens
tctgtagatgttgtctt

SEQ ID NO: 3152912 - DNA, 23 bp, Homo sapiens
tctgtagattctgtggaacaagc

SEQ ID NO: 3152913 - DNA, 15 bp, Homo sapiens
tctgtagccactagt

SEQ ID NO: 3152914 - DNA, 15 bp, Homo sapiens
tctgtagcctccttt

SEQ ID NO: 3152915 - DNA, 19 bp, Homo sapiens
tctgtagcttctaatgttc

SEQ ID NO: 3152916 - DNA, 14 bp, Homo sapiens
tctgtagggctgga

SEQ ID NO: 3152917 - DNA, 16 bp, Homo sapiens
tctgtagtaatttatt

SEQ ID NO: 3152918 - DNA, 20 bp, Homo sapiens
tctgtagttcctaatggatt

SEQ ID NO: 3152919 - DNA, 15 bp, Homo sapiens
tctgtataatagaga

SEQ ID NO: 3152920 - DNA, 16 bp, Homo sapiens
tctgtataatagagat

SEQ ID NO: 3152921 - DNA, 22 bp, Homo sapiens
tctgtatagaaatctaaaagaa

SEQ ID NO: 3152922 - DNA, 16 bp, Homo sapiens
tctgtatcatcagtgc

SEQ ID NO: 3152923 - DNA, 18 bp, Homo sapiens
tctgtatcggagacagtg

SEQ ID NO: 3152924 - DNA, 21 bp, Homo sapiens
tctgtatcggagacagtgatc

SEQ ID NO: 3152925 - DNA, 20 bp, Homo sapiens
tctgtattgccatggtcttt

SEQ ID NO: 3152926 - DNA, 15 bp, Homo sapiens
tctgtatttattatt

SEQ ID NO: 3152927 - DNA, 18 bp, Homo sapiens
tctgtatttcatgtggct

SEQ ID NO: 3152928 - DNA, 15 bp, Homo sapiens
tctgtattttcatgt

SEQ ID NO: 3152929 - DNA, 17 bp, Homo sapiens
tctgtcaaaacactgtg

SEQ ID NO: 3152930 - DNA, 19 bp, Homo sapiens
tctgtcaaaacactgtgga

SEQ ID NO: 3152931 - DNA, 13 bp, Homo sapiens
tctgtcaagaaga

SEQ ID NO: 3152932 - DNA, 19 bp, Homo sapiens
tctgtcacagtaaaaataa

SEQ ID NO: 3152933 - DNA, 15 bp, Homo sapiens
tctgtcagatgagaa

SEQ ID NO: 3152934 - DNA, 21 bp, Homo sapiens
tctgtcagatgagaacaaagc

SEQ ID NO: 3152935 - DNA, 23 bp, Homo sapiens
tctgtcagatgagaacaaagctg

SEQ ID NO: 3152936 - DNA, 13 bp, Homo sapiens
tctgtcagccagc

SEQ ID NO: 3152937 - DNA, 21 bp, Homo sapiens
tctgtcagccagccgccctgg

SEQ ID NO: 3152938 - DNA, 13 bp, Homo sapiens
tctgtcagctgca

SEQ ID NO: 3152939 - DNA, 14 bp, Homo sapiens
tctgtcagctgcaa

SEQ ID NO: 3152940 - DNA, 18 bp, Homo sapiens
tctgtcatcactccctgg

SEQ ID NO: 3152941 - DNA, 17 bp, Homo sapiens
tctgtcatctctctggg

SEQ ID NO: 3152942 - DNA, 18 bp, Homo sapiens
tctgtcattatattctaa

SEQ ID NO: 3152943 - DNA, 22 bp, Homo sapiens
tctgtccaaaggaggctggcag

SEQ ID NO: 3152944 - DNA, 23 bp, Homo sapiens
tctgtccaaaggaggctggcagg

SEQ ID NO: 3152945 - DNA, 19 bp, Homo sapiens
tctgtccagaggctgcaag

SEQ ID NO: 3152946 - DNA, 12 bp, Homo sapiens
tctgtccaggcc

SEQ ID NO: 3152947 - DNA, 22 bp, Homo sapiens
tctgtccatggcctttctaata

SEQ ID NO: 3152948 - DNA, 20 bp, Homo sapiens
tctgtccccagccctgtcct

SEQ ID NO: 3152949 - DNA, 20 bp, Homo sapiens
tctgtcccggggtcctgtgg

SEQ ID NO: 3152950 - DNA, 23 bp, Homo sapiens
tctgtccctgagagtgtctctga

SEQ ID NO: 3152951 - DNA, 14 bp, Homo sapiens
tctgtcccttccac

SEQ ID NO: 3152952 - DNA, 18 bp, Homo sapiens
tctgtcccttccacttct

SEQ ID NO: 3152953 - DNA, 15 bp, Homo sapiens
tctgtcccttgctgt

SEQ ID NO: 3152954 - DNA, 11 bp, Homo sapiens
tctgtcctact

SEQ ID NO: 3152955 - DNA, 20 bp, Homo sapiens
tctgtcctactctgtgtcag

SEQ ID NO: 3152956 - DNA, 13 bp, Homo sapiens
tctgtcctacttc

SEQ ID NO: 3152957 - DNA, 17 bp, Homo sapiens
tctgtcctacttctgac

SEQ ID NO: 3152958 - DNA, 18 bp, Homo sapiens
tctgtcctacttctgact

SEQ ID NO: 3152959 - DNA, 15 bp, Homo sapiens
tctgtcctgcttctg

SEQ ID NO: 3152960 - DNA, 12 bp, Homo sapiens
tctgtcctggga

SEQ ID NO: 3152961 - DNA, 14 bp, Homo sapiens
tctgtcctggtgtc

SEQ ID NO: 3152962 - DNA, 17 bp, Homo sapiens
tctgtcctggtgtcact

SEQ ID NO: 3152963 - DNA, 20 bp, Homo sapiens
tctgtccttcagatggaaac

SEQ ID NO: 3152964 - DNA, 16 bp, Homo sapiens
tctgtcgccttagcat

SEQ ID NO: 3152965 - DNA, 19 bp, Homo sapiens
tctgtcgccttagcatgtt

SEQ ID NO: 3152966 - DNA, 23 bp, Homo sapiens
tctgtcgccttagcatgtttgct

SEQ ID NO: 3152967 - DNA, 17 bp, Homo sapiens
tctgtctaaaaaccaga

SEQ ID NO: 3152968 - DNA, 14 bp, Homo sapiens
tctgtctacaaata

SEQ ID NO: 3152969 - DNA, 14 bp, Homo sapiens
tctgtctactgtgg

SEQ ID NO: 3152970 - DNA, 17 bp, Homo sapiens
tctgtctactgtggtga

SEQ ID NO: 3152971 - DNA, 15 bp, Homo sapiens
tctgtctcagacttt

SEQ ID NO: 3152972 - DNA, 12 bp, Homo sapiens
tctgtctcatcc

SEQ ID NO: 3152973 - DNA, 20 bp, Homo sapiens
tctgtctcatcctcctggaa

SEQ ID NO: 3152974 - DNA, 12 bp, Homo sapiens
tctgtctggcac

SEQ ID NO: 3152975 - DNA, 12 bp, Homo sapiens
tctgtcttcaca

SEQ ID NO: 3152976 - DNA, 22 bp, Homo sapiens
tctgtcttcacagctctgtgtt

SEQ ID NO: 3152977 - DNA, 15 bp, Homo sapiens
tctgtctttaagaac

SEQ ID NO: 3152978 - DNA, 14 bp, Homo sapiens
tctgtctttcctga

SEQ ID NO: 3152979 - DNA, 21 bp, Homo sapiens
tctgtctttcctgaaccatgt

SEQ ID NO: 3152980 - DNA, 14 bp, Homo sapiens
tctgtgaaacctgt

SEQ ID NO: 3152981 - DNA, 22 bp, Homo sapiens
tctgtgaaacctgtgaagctga

SEQ ID NO: 3152982 - DNA, 20 bp, Homo sapiens
tctgtgaaatataattgtac

SEQ ID NO: 3152983 - DNA, 17 bp, Homo sapiens
tctgtgaacagagagac

SEQ ID NO: 3152984 - DNA, 22 bp, Homo sapiens
tctgtgaagaggaacagtgtgg

SEQ ID NO: 3152985 - DNA, 19 bp, Homo sapiens
tctgtgaatacaattaaag

SEQ ID NO: 3152986 - DNA, 20 bp, Homo sapiens
tctgtgaatacaattaaagg

SEQ ID NO: 3152987 - DNA, 22 bp, Homo sapiens
tctgtgaatacaattaaaggtc

SEQ ID NO: 3152988 - DNA, 23 bp, Homo sapiens
tctgtgaatgctaagtccatcac

SEQ ID NO: 3152989 - DNA, 15 bp, Homo sapiens
tctgtgaattcagat

SEQ ID NO: 3152990 - DNA, 21 bp, Homo sapiens
tctgtgaccaaaataccttgg

SEQ ID NO: 3152991 - DNA, 15 bp, Homo sapiens
tctgtgacccatctg

SEQ ID NO: 3152992 - DNA, 20 bp, Homo sapiens
tctgtgacccatctgtagta

SEQ ID NO: 3152993 - DNA, 13 bp, Homo sapiens
tctgtgacctcag

SEQ ID NO: 3152994 - DNA, 14 bp, Homo sapiens
tctgtgagatgcta

SEQ ID NO: 3152995 - DNA, 20 bp, Homo sapiens
tctgtgaggaaagcacacag

SEQ ID NO: 3152996 - DNA, 18 bp, Homo sapiens
tctgtgagtgcgtctgag

SEQ ID NO: 3152997 - DNA, 20 bp, Homo sapiens
tctgtgatgacattccctgc

SEQ ID NO: 3152998 - DNA, 23 bp, Homo sapiens
tctgtgatgactggttgttcaaa

SEQ ID NO: 3152999 - DNA, 14 bp, Homo sapiens
tctgtgatgagctg

SEQ ID NO: 3153000 - DNA, 22 bp, Homo sapiens
tctgtgcaggatatttgcacta

SEQ ID NO: 3153001 - DNA, 16 bp, Homo sapiens
tctgtgccagaaacag

SEQ ID NO: 3153002 - DNA, 14 bp, Homo sapiens
tctgtgccccatgc

SEQ ID NO: 3153003 - DNA, 15 bp, Homo sapiens
tctgtgcctgaatat

SEQ ID NO: 3153004 - DNA, 22 bp, Homo sapiens
tctgtgcgtgaaacacaccagg

SEQ ID NO: 3153005 - DNA, 22 bp, Homo sapiens
tctgtgctcttttggtggggag

SEQ ID NO: 3153006 - DNA, 15 bp, Homo sapiens
tctgtgctgtgcctg

SEQ ID NO: 3153007 - DNA, 17 bp, Homo sapiens
tctgtgctgtgcctgct

SEQ ID NO: 3153008 - DNA, 19 bp, Homo sapiens
tctgtgctgtgcctgctag

SEQ ID NO: 3153009 - DNA, 23 bp, Homo sapiens
tctgtgctgtgcctgctagagca

SEQ ID NO: 3153010 - DNA, 22 bp, Homo sapiens
tctgtggagctgccacagagaa

SEQ ID NO: 3153011 - DNA, 23 bp, Homo sapiens
tctgtggcctgtgtccagcagct

SEQ ID NO: 3153012 - DNA, 18 bp, Homo sapiens
tctgtggttcctctgctc

SEQ ID NO: 3153013 - DNA, 14 bp, Homo sapiens
tctgtgtatatctc

SEQ ID NO: 3153014 - DNA, 18 bp, Homo sapiens
tctgtgtatatctcttgg

SEQ ID NO: 3153015 - DNA, 22 bp, Homo sapiens
tctgtgtatttaattgtaaact

SEQ ID NO: 3153016 - DNA, 18 bp, Homo sapiens
tctgtgtccttccctgca

SEQ ID NO: 3153017 - DNA, 18 bp, Homo sapiens
tctgtgtctaagattcta

SEQ ID NO: 3153018 - DNA, 15 bp, Homo sapiens
tctgtgtctgctctc

SEQ ID NO: 3153019 - DNA, 11 bp, Homo sapiens
tctgtgtcttt

SEQ ID NO: 3153020 - DNA, 14 bp, Homo sapiens
tctgtgtctttctc

SEQ ID NO: 3153021 - DNA, 15 bp, Homo sapiens
tctgtgtctttctct

SEQ ID NO: 3153022 - DNA, 19 bp, Homo sapiens
tctgtgtgaaactttcatt

SEQ ID NO: 3153023 - DNA, 21 bp, Homo sapiens
tctgtgtgaaactttcattcc

SEQ ID NO: 3153024 - DNA, 17 bp, Homo sapiens
tctgtgtggttcagcta

SEQ ID NO: 3153025 - DNA, 23 bp, Homo sapiens
tctgtgtgtgttcttcaagccag

SEQ ID NO: 3153026 - DNA, 13 bp, Homo sapiens
tctgtgttcattt

SEQ ID NO: 3153027 - DNA, 22 bp, Homo sapiens
tctgtgttgcattattcattta

SEQ ID NO: 3153028 - DNA, 14 bp, Homo sapiens
tctgtgttgccaag

SEQ ID NO: 3153029 - DNA, 16 bp, Homo sapiens
tctgtgttgccaagct

SEQ ID NO: 3153030 - DNA, 16 bp, Homo sapiens
tctgtgttgctgttta

SEQ ID NO: 3153031 - DNA, 17 bp, Homo sapiens
tctgtgttgctgtttag

SEQ ID NO: 3153032 - DNA, 19 bp, Homo sapiens
tctgtgtttaatttcttca

SEQ ID NO: 3153033 - DNA, 23 bp, Homo sapiens
tctgtgtttaatttcttcaaaat

SEQ ID NO: 3153034 - DNA, 14 bp, Homo sapiens
tctgtgtttacaga

SEQ ID NO: 3153035 - DNA, 23 bp, Homo sapiens
tctgtgtttatggccaatctatt

SEQ ID NO: 3153036 - DNA, 20 bp, Homo sapiens
tctgttaaaatctattctgt

SEQ ID NO: 3153037 - DNA, 19 bp, Homo sapiens
tctgttaccatgtcactgt

SEQ ID NO: 3153038 - DNA, 16 bp, Homo sapiens
tctgttatgtactgta

SEQ ID NO: 3153039 - DNA, 18 bp, Homo sapiens
tctgttatgtactgtact

SEQ ID NO: 3153040 - DNA, 22 bp, Homo sapiens
tctgttcacaaactacctctgg

SEQ ID NO: 3153041 - DNA, 19 bp, Homo sapiens
tctgttcatttcacacagt

SEQ ID NO: 3153042 - DNA, 13 bp, Homo sapiens
tctgttccaaatg

SEQ ID NO: 3153043 - DNA, 20 bp, Homo sapiens
tctgttccccatggccactt

SEQ ID NO: 3153044 - DNA, 18 bp, Homo sapiens
tctgttctgctgggagtt

SEQ ID NO: 3153045 - DNA, 16 bp, Homo sapiens
tctgttctgtttcaag

SEQ ID NO: 3153046 - DNA, 10 bp, Homo sapiens
tctgttgaag

SEQ ID NO: 3153047 - DNA, 16 bp, Homo sapiens
tctgttgcaattagga

SEQ ID NO: 3153048 - DNA, 15 bp, Homo sapiens
tctgttggcaggctg

SEQ ID NO: 3153049 - DNA, 21 bp, Homo sapiens
tctgttgtaacttatgtagat

SEQ ID NO: 3153050 - DNA, 17 bp, Homo sapiens
tctgttgtactatggaa

SEQ ID NO: 3153051 - DNA, 23 bp, Homo sapiens
tctgttgtcgtaaagatttgggt

SEQ ID NO: 3153052 - DNA, 20 bp, Homo sapiens
tctgtttatggccacattta

SEQ ID NO: 3153053 - DNA, 22 bp, Homo sapiens
tctgtttcaggtttccattctg

SEQ ID NO: 3153054 - DNA, 20 bp, Homo sapiens
tctgtttcctgacattgtct

SEQ ID NO: 3153055 - DNA, 14 bp, Homo sapiens
tctgtttggcactt

SEQ ID NO: 3153056 - DNA, 20 bp, Homo sapiens
tctgtttggcacttgtattt

SEQ ID NO: 3153057 - DNA, 20 bp, Homo sapiens
tctgttttcctttctcaccg

SEQ ID NO: 3153058 - DNA, 20 bp, Homo sapiens
tctgttttgtggtttggaat

SEQ ID NO: 3153059 - DNA, 23 bp, Homo sapiens
tctgttttgtttggcaaggaaag

SEQ ID NO: 3153060 - DNA, 14 bp, Homo sapiens
tctgtttttctttt

SEQ ID NO: 3153061 - DNA, 16 bp, Homo sapiens
tcttaaaaagttgttc

SEQ ID NO: 3153062 - DNA, 15 bp, Homo sapiens
tcttaaaaatattgt

SEQ ID NO: 3153063 - DNA, 14 bp, Homo sapiens
tcttaaaagtactt

SEQ ID NO: 3153064 - DNA, 22 bp, Homo sapiens
tcttaaaagtactttaaaaagg

SEQ ID NO: 3153065 - DNA, 23 bp, Homo sapiens
tcttaaaagttgtgattccagat

SEQ ID NO: 3153066 - DNA, 16 bp, Homo sapiens
tcttaaacaatgtata

SEQ ID NO: 3153067 - DNA, 16 bp, Homo sapiens
tcttaaaccttcagtt

SEQ ID NO: 3153068 - DNA, 16 bp, Homo sapiens
tcttaaacttgtgaat

SEQ ID NO: 3153069 - DNA, 22 bp, Homo sapiens
tcttaaagaaacagctttcaag

SEQ ID NO: 3153070 - DNA, 16 bp, Homo sapiens
tcttaaagctgcctgt

SEQ ID NO: 3153071 - DNA, 21 bp, Homo sapiens
tcttaaagctgcctgtagtta

SEQ ID NO: 3153072 - DNA, 15 bp, Homo sapiens
tcttaaaggcctgga

SEQ ID NO: 3153073 - DNA, 17 bp, Homo sapiens
tcttaaaggcctggaac

SEQ ID NO: 3153074 - DNA, 23 bp, Homo sapiens
tcttaaatatatgatttatatta

SEQ ID NO: 3153075 - DNA, 19 bp, Homo sapiens
tcttaaatctttcttcaaa

SEQ ID NO: 3153076 - DNA, 13 bp, Homo sapiens
tcttaacaaacca

SEQ ID NO: 3153077 - DNA, 22 bp, Homo sapiens
tcttaacaaaccaacatctttg

SEQ ID NO: 3153078 - DNA, 20 bp, Homo sapiens
tcttaactggcctaaatttc

SEQ ID NO: 3153079 - DNA, 13 bp, Homo sapiens
tcttaagcagcat

SEQ ID NO: 3153080 - DNA, 15 bp, Homo sapiens
tcttaagcagcatgg

SEQ ID NO: 3153081 - DNA, 21 bp, Homo sapiens
tcttaagcagcatggaaaaat

SEQ ID NO: 3153082 - DNA, 23 bp, Homo sapiens
tcttaaggattgtgatattttta

SEQ ID NO: 3153083 - DNA, 12 bp, Homo sapiens
tcttaagggcac

SEQ ID NO: 3153084 - DNA, 13 bp, Homo sapiens
tcttaagtcccag

SEQ ID NO: 3153085 - DNA, 11 bp, Homo sapiens
tcttaatctgt

SEQ ID NO: 3153086 - DNA, 22 bp, Homo sapiens
tcttaatgttactcagatataa

SEQ ID NO: 3153087 - DNA, 14 bp, Homo sapiens
tcttaattaatttg

SEQ ID NO: 3153088 - DNA, 12 bp, Homo sapiens
tcttaattatta

SEQ ID NO: 3153089 - DNA, 17 bp, Homo sapiens
tcttaattattataaaa

SEQ ID NO: 3153090 - DNA, 18 bp, Homo sapiens
tcttaattattataaaaa

SEQ ID NO: 3153091 - DNA, 20 bp, Homo sapiens
tcttaattctttgttctgtt

SEQ ID NO: 3153092 - DNA, 23 bp, Homo sapiens
tcttaatttaatcttttttatgt

SEQ ID NO: 3153093 - DNA, 23 bp, Homo sapiens
tcttaatttatttcttaaccttt

SEQ ID NO: 3153094 - DNA, 15 bp, Homo sapiens
tcttaattttgtctt

SEQ ID NO: 3153095 - DNA, 21 bp, Homo sapiens
tcttacaagatattgatgata

SEQ ID NO: 3153096 - DNA, 17 bp, Homo sapiens
tcttacaatcaaatctc

SEQ ID NO: 3153097 - DNA, 19 bp, Homo sapiens
tcttacaattgcactgctg

SEQ ID NO: 3153098 - DNA, 21 bp, Homo sapiens
tcttacaattgcactgctgtt

SEQ ID NO: 3153099 - DNA, 22 bp, Homo sapiens
tcttacaattgcactgctgttc

SEQ ID NO: 3153100 - DNA, 14 bp, Homo sapiens
tcttacacatacag

SEQ ID NO: 3153101 - DNA, 22 bp, Homo sapiens
tcttacactgcctgtatacttt

SEQ ID NO: 3153102 - DNA, 23 bp, Homo sapiens
tcttacactgcctgtatacttta

SEQ ID NO: 3153103 - DNA, 14 bp, Homo sapiens
tcttaccagatgct

SEQ ID NO: 3153104 - DNA, 14 bp, Homo sapiens
tcttacccaaagca

SEQ ID NO: 3153105 - DNA, 15 bp, Homo sapiens
tcttacccaatttcc

SEQ ID NO: 3153106 - DNA, 15 bp, Homo sapiens
tcttaccgtagcctc

SEQ ID NO: 3153107 - DNA, 23 bp, Homo sapiens
tcttactattaagcagtaaaaac

SEQ ID NO: 3153108 - DNA, 14 bp, Homo sapiens
tcttactgataatt

SEQ ID NO: 3153109 - DNA, 20 bp, Homo sapiens
tcttactggggcctggggct

SEQ ID NO: 3153110 - DNA, 16 bp, Homo sapiens
tcttacttgagccttt

SEQ ID NO: 3153111 - DNA, 22 bp, Homo sapiens
tcttacttttcctggacttaaa

SEQ ID NO: 3153112 - DNA, 15 bp, Homo sapiens
tcttagaaatgaagg

SEQ ID NO: 3153113 - DNA, 13 bp, Homo sapiens
tcttagagattaa

SEQ ID NO: 3153114 - DNA, 13 bp, Homo sapiens
tcttagagccttt

SEQ ID NO: 3153115 - DNA, 18 bp, Homo sapiens
tcttagagtgtagctgta

SEQ ID NO: 3153116 - DNA, 15 bp, Homo sapiens
tcttagatgtatata

SEQ ID NO: 3153117 - DNA, 16 bp, Homo sapiens
tcttagcagcttccag

SEQ ID NO: 3153118 - DNA, 15 bp, Homo sapiens
tcttagcctgtggca

SEQ ID NO: 3153119 - DNA, 18 bp, Homo sapiens
tcttagctactgtatgca

SEQ ID NO: 3153120 - DNA, 15 bp, Homo sapiens
tcttagctgtctgct

SEQ ID NO: 3153121 - DNA, 19 bp, Homo sapiens
tcttaggaagagaaaccag

SEQ ID NO: 3153122 - DNA, 15 bp, Homo sapiens
tcttagtgcccgcct

SEQ ID NO: 3153123 - DNA, 19 bp, Homo sapiens
tcttagtgcttcagagttt

SEQ ID NO: 3153124 - DNA, 16 bp, Homo sapiens
tcttagtggatgttct

SEQ ID NO: 3153125 - DNA, 14 bp, Homo sapiens
tcttagtgtatgat

SEQ ID NO: 3153126 - DNA, 16 bp, Homo sapiens
tcttagttctcactgt

SEQ ID NO: 3153127 - DNA, 14 bp, Homo sapiens
tcttataaatttgg

SEQ ID NO: 3153128 - DNA, 20 bp, Homo sapiens
tcttataatactctgttgta

SEQ ID NO: 3153129 - DNA, 14 bp, Homo sapiens
tcttatacacattg

SEQ ID NO: 3153130 - DNA, 15 bp, Homo sapiens
tcttatacatttgat

SEQ ID NO: 3153131 - DNA, 16 bp, Homo sapiens
tcttatacgcttttct

SEQ ID NO: 3153132 - DNA, 20 bp, Homo sapiens
tcttatacgcttttctttgt

SEQ ID NO: 3153133 - DNA, 20 bp, Homo sapiens
tcttatagaatatttattac

SEQ ID NO: 3153134 - DNA, 18 bp, Homo sapiens
tcttatagcactttgaaa

SEQ ID NO: 3153135 - DNA, 20 bp, Homo sapiens
tcttatatatatttctttgt

SEQ ID NO: 3153136 - DNA, 22 bp, Homo sapiens
tcttatattggtttgcacaagt

SEQ ID NO: 3153137 - DNA, 12 bp, Homo sapiens
tcttatctcagt

SEQ ID NO: 3153138 - DNA, 14 bp, Homo sapiens
tcttatgatgtttt

SEQ ID NO: 3153139 - DNA, 14 bp, Homo sapiens
tcttatgccatttg

SEQ ID NO: 3153140 - DNA, 21 bp, Homo sapiens
tcttatgcttccattaacaaa

SEQ ID NO: 3153141 - DNA, 14 bp, Homo sapiens
tcttatggaattga

SEQ ID NO: 3153142 - DNA, 23 bp, Homo sapiens
tcttatgttatcaccttccaaac

SEQ ID NO: 3153143 - DNA, 19 bp, Homo sapiens
tcttattactattattgtt

SEQ ID NO: 3153144 - DNA, 21 bp, Homo sapiens
tcttattcccaaactacagaa

SEQ ID NO: 3153145 - DNA, 13 bp, Homo sapiens
tcttattcttaag

SEQ ID NO: 3153146 - DNA, 21 bp, Homo sapiens
tcttattgggatatcatttta

SEQ ID NO: 3153147 - DNA, 14 bp, Homo sapiens
tcttatttaactta

SEQ ID NO: 3153148 - DNA, 20 bp, Homo sapiens
tcttcaaaatgtatatattt

SEQ ID NO: 3153149 - DNA, 21 bp, Homo sapiens
tcttcaaacacccatttttgc

SEQ ID NO: 3153150 - DNA, 14 bp, Homo sapiens
tcttcaaactttca

SEQ ID NO: 3153151 - DNA, 17 bp, Homo sapiens
tcttcaaactttcactt

SEQ ID NO: 3153152 - DNA, 17 bp, Homo sapiens
tcttcaaatacaaagta

SEQ ID NO: 3153153 - DNA, 13 bp, Homo sapiens
tcttcaaatcctt

SEQ ID NO: 3153154 - DNA, 22 bp, Homo sapiens
tcttcaaatccttccaaaaatt

SEQ ID NO: 3153155 - DNA, 19 bp, Homo sapiens
tcttcaacatcaatgttca

SEQ ID NO: 3153156 - DNA, 24 bp, Homo sapiens
tcttcaacatcaatgttcattgta

SEQ ID NO: 3153157 - DNA, 17 bp, Homo sapiens
tcttcaacatcctgcca

SEQ ID NO: 3153158 - DNA, 19 bp, Homo sapiens
tcttcaacatcctgccagc

SEQ ID NO: 3153159 - DNA, 21 bp, Homo sapiens
tcttcaacatcctgccagccc

SEQ ID NO: 3153160 - DNA, 13 bp, Homo sapiens
tcttcaacattaa

SEQ ID NO: 3153161 - DNA, 19 bp, Homo sapiens
tcttcaagccagctctagg

SEQ ID NO: 3153162 - DNA, 13 bp, Homo sapiens
tcttcaatgatca

SEQ ID NO: 3153163 - DNA, 16 bp, Homo sapiens
tcttcaatgatcaaat

SEQ ID NO: 3153164 - DNA, 19 bp, Homo sapiens
tcttcacccagctaatctg

SEQ ID NO: 3153165 - DNA, 22 bp, Homo sapiens
tcttcaccccccaatctcttgg

SEQ ID NO: 3153166 - DNA, 21 bp, Homo sapiens
tcttcaccccggcaggccctg

SEQ ID NO: 3153167 - DNA, 21 bp, Homo sapiens
tcttcacctgccaccacacac

SEQ ID NO: 3153168 - DNA, 15 bp, Homo sapiens
tcttcactgcaattt

SEQ ID NO: 3153169 - DNA, 20 bp, Homo sapiens
tcttcactgtggccacagcc

SEQ ID NO: 3153170 - DNA, 17 bp, Homo sapiens
tcttcagaacacacaga

SEQ ID NO: 3153171 - DNA, 20 bp, Homo sapiens
tcttcagaacacacagactt

SEQ ID NO: 3153172 - DNA, 23 bp, Homo sapiens
tcttcagaacacacagactttct

SEQ ID NO: 3153173 - DNA, 19 bp, Homo sapiens
tcttcagaactgcccttgc

SEQ ID NO: 3153174 - DNA, 22 bp, Homo sapiens
tcttcagaactgcccttgctgc

SEQ ID NO: 3153175 - DNA, 18 bp, Homo sapiens
tcttcagaagacactgca

SEQ ID NO: 3153176 - DNA, 23 bp, Homo sapiens
tcttcagactctcagcccagaag

SEQ ID NO: 3153177 - DNA, 18 bp, Homo sapiens
tcttcaggcctccctctc

SEQ ID NO: 3153178 - DNA, 16 bp, Homo sapiens
tcttcaggtgaacact

SEQ ID NO: 3153179 - DNA, 20 bp, Homo sapiens
tcttcaggtgaacacttagt

SEQ ID NO: 3153180 - DNA, 16 bp, Homo sapiens
tcttcagtgactcctg

SEQ ID NO: 3153181 - DNA, 18 bp, Homo sapiens
tcttcagttggtgtgttt

SEQ ID NO: 3153182 - DNA, 12 bp, Homo sapiens
tcttcagtttta

SEQ ID NO: 3153183 - DNA, 13 bp, Homo sapiens
tcttcatactttt

SEQ ID NO: 3153184 - DNA, 15 bp, Homo sapiens
tcttcatactttttt

SEQ ID NO: 3153185 - DNA, 19 bp, Homo sapiens
tcttcatatttttgatcat

SEQ ID NO: 3153186 - DNA, 17 bp, Homo sapiens
tcttcatccaacttcca

SEQ ID NO: 3153187 - DNA, 14 bp, Homo sapiens
tcttcatgaacata

SEQ ID NO: 3153188 - DNA, 20 bp, Homo sapiens
tcttcatgagtagtgggcta

SEQ ID NO: 3153189 - DNA, 17 bp, Homo sapiens
tcttcattcaaactgca

SEQ ID NO: 3153190 - DNA, 17 bp, Homo sapiens
tcttcatttcattgtat

SEQ ID NO: 3153191 - DNA, 21 bp, Homo sapiens
tcttcatttcattgtatgatg

SEQ ID NO: 3153192 - DNA, 22 bp, Homo sapiens
tcttcatttcattgtatgatgt

SEQ ID NO: 3153193 - DNA, 24 bp, Homo sapiens
tcttcatttcattgtatgatgtgt

SEQ ID NO: 3153194 - DNA, 23 bp, Homo sapiens
tcttcattttggtttatttttgt

SEQ ID NO: 3153195 - DNA, 21 bp, Homo sapiens
tcttcatttttttttcaatca

SEQ ID NO: 3153196 - DNA, 14 bp, Homo sapiens
tcttccaaagcaca

SEQ ID NO: 3153197 - DNA, 20 bp, Homo sapiens
tcttccaaagtaaaattgct

SEQ ID NO: 3153198 - DNA, 13 bp, Homo sapiens
tcttccaaatttg

SEQ ID NO: 3153199 - DNA, 17 bp, Homo sapiens
tcttccaaggtagctct

SEQ ID NO: 3153200 - DNA, 23 bp, Homo sapiens
tcttccagacctgcttcctgaaa

SEQ ID NO: 3153201 - DNA, 13 bp, Homo sapiens
tcttccatcatgg

SEQ ID NO: 3153202 - DNA, 18 bp, Homo sapiens
tcttccatcatggattca

SEQ ID NO: 3153203 - DNA, 16 bp, Homo sapiens
tcttccatgtatcttt

SEQ ID NO: 3153204 - DNA, 21 bp, Homo sapiens
tcttcccagaaaaccagtctg

SEQ ID NO: 3153205 - DNA, 13 bp, Homo sapiens
tcttcccatgcat

SEQ ID NO: 3153206 - DNA, 11 bp, Homo sapiens
tcttccccaca

SEQ ID NO: 3153207 - DNA, 14 bp, Homo sapiens
tcttccccactccc

SEQ ID NO: 3153208 - DNA, 13 bp, Homo sapiens
tcttccccttgcc

SEQ ID NO: 3153209 - DNA, 20 bp, Homo sapiens
tcttccctagagggttcctg

SEQ ID NO: 3153210 - DNA, 16 bp, Homo sapiens
tcttccctctctgcag

SEQ ID NO: 3153211 - DNA, 21 bp, Homo sapiens
tcttccgtggtcagagtgcca

SEQ ID NO: 3153212 - DNA, 19 bp, Homo sapiens
tcttcctagttttctcctc

SEQ ID NO: 3153213 - DNA, 22 bp, Homo sapiens
tcttcctatccctctcctaact

SEQ ID NO: 3153214 - DNA, 12 bp, Homo sapiens
tcttcctcagct

SEQ ID NO: 3153215 - DNA, 11 bp, Homo sapiens
tcttcctctgc

SEQ ID NO: 3153216 - DNA, 14 bp, Homo sapiens
tcttcctctgctga

SEQ ID NO: 3153217 - DNA, 16 bp, Homo sapiens
tcttcctgacacttta

SEQ ID NO: 3153218 - DNA, 23 bp, Homo sapiens
tcttcctgacgaaactggccccg

SEQ ID NO: 3153219 - DNA, 14 bp, Homo sapiens
tcttcctgagtggt

SEQ ID NO: 3153220 - DNA, 15 bp, Homo sapiens
tcttcctgctgctgt

SEQ ID NO: 3153221 - DNA, 21 bp, Homo sapiens
tcttcctgttttgtacataga

SEQ ID NO: 3153222 - DNA, 21 bp, Homo sapiens
tcttccttgaagaactgcagg

SEQ ID NO: 3153223 - DNA, 18 bp, Homo sapiens
tcttcctttctctttctc

SEQ ID NO: 3153224 - DNA, 20 bp, Homo sapiens
tcttcctttcttgtctttcc

SEQ ID NO: 3153225 - DNA, 19 bp, Homo sapiens
tcttcgatgtgcccagggg

SEQ ID NO: 3153226 - DNA, 23 bp, Homo sapiens
tcttcgcgcccgcccctgcagca

SEQ ID NO: 3153227 - DNA, 15 bp, Homo sapiens
tcttcgctggctcct

SEQ ID NO: 3153228 - DNA, 13 bp, Homo sapiens
tcttcgtcctttt

SEQ ID NO: 3153229 - DNA, 18 bp, Homo sapiens
tcttcgtcttcactctta

SEQ ID NO: 3153230 - DNA, 13 bp, Homo sapiens
tcttctaattatt

SEQ ID NO: 3153231 - DNA, 14 bp, Homo sapiens
tcttctagaagata

SEQ ID NO: 3153232 - DNA, 19 bp, Homo sapiens
tcttctagaagataacatt

SEQ ID NO: 3153233 - DNA, 21 bp, Homo sapiens
tcttctagaagataacatttt

SEQ ID NO: 3153234 - DNA, 17 bp, Homo sapiens
tcttctagagttcagag

SEQ ID NO: 3153235 - DNA, 11 bp, Homo sapiens
tcttctcaagt

SEQ ID NO: 3153236 - DNA, 13 bp, Homo sapiens
tcttctcaagtgc

SEQ ID NO: 3153237 - DNA, 15 bp, Homo sapiens
tcttctcaagtgcct

SEQ ID NO: 3153238 - DNA, 21 bp, Homo sapiens
tcttctcaagttctaagattc

SEQ ID NO: 3153239 - DNA, 14 bp, Homo sapiens
tcttctcagctctt

SEQ ID NO: 3153240 - DNA, 14 bp, Homo sapiens
tcttctcataaatc

SEQ ID NO: 3153241 - DNA, 15 bp, Homo sapiens
tcttctcataaatct

SEQ ID NO: 3153242 - DNA, 18 bp, Homo sapiens
tcttctcatagcattaac

SEQ ID NO: 3153243 - DNA, 12 bp, Homo sapiens
tcttctccactg

SEQ ID NO: 3153244 - DNA, 13 bp, Homo sapiens
tcttctccactgg

SEQ ID NO: 3153245 - DNA, 15 bp, Homo sapiens
tcttctccagatttt

SEQ ID NO: 3153246 - DNA, 12 bp, Homo sapiens
tcttctccaggc

SEQ ID NO: 3153247 - DNA, 21 bp, Homo sapiens
tcttctcccagaatcccagcc

SEQ ID NO: 3153248 - DNA, 14 bp, Homo sapiens
tcttctccccacag

SEQ ID NO: 3153249 - DNA, 19 bp, Homo sapiens
tcttctccccacagcctct

SEQ ID NO: 3153250 - DNA, 13 bp, Homo sapiens
tcttctcggctca

SEQ ID NO: 3153251 - DNA, 17 bp, Homo sapiens
tcttctcggctcaggct

SEQ ID NO: 3153252 - DNA, 13 bp, Homo sapiens
tcttctctagctg

SEQ ID NO: 3153253 - DNA, 15 bp, Homo sapiens
tcttctctagctggt

SEQ ID NO: 3153254 - DNA, 20 bp, Homo sapiens
tcttctctagctggtggttt

SEQ ID NO: 3153255 - DNA, 15 bp, Homo sapiens
tcttctctgcaatgc

SEQ ID NO: 3153256 - DNA, 13 bp, Homo sapiens
tcttctgaaatga

SEQ ID NO: 3153257 - DNA, 19 bp, Homo sapiens
tcttctgaactcaaactga

SEQ ID NO: 3153258 - DNA, 24 bp, Homo sapiens
tcttctgaactcaaactgaggaat

SEQ ID NO: 3153259 - DNA, 15 bp, Homo sapiens
tcttctgacgtgcct

SEQ ID NO: 3153260 - DNA, 17 bp, Homo sapiens
tcttctgacgtgccttt

SEQ ID NO: 3153261 - DNA, 19 bp, Homo sapiens
tcttctgagctatttcatc

SEQ ID NO: 3153262 - DNA, 21 bp, Homo sapiens
tcttctgaggaccgctgataa

SEQ ID NO: 3153263 - DNA, 12 bp, Homo sapiens
tcttctgccctt

SEQ ID NO: 3153264 - DNA, 20 bp, Homo sapiens
tcttctgccctttcctaggc

SEQ ID NO: 3153265 - DNA, 12 bp, Homo sapiens
tcttctgcctgt

SEQ ID NO: 3153266 - DNA, 16 bp, Homo sapiens
tcttctgcctgttata

SEQ ID NO: 3153267 - DNA, 11 bp, Homo sapiens
tcttctgctcc

SEQ ID NO: 3153268 - DNA, 22 bp, Homo sapiens
tcttctgctccacccttggcct

SEQ ID NO: 3153269 - DNA, 19 bp, Homo sapiens
tcttctgcttcagcctccc

SEQ ID NO: 3153270 - DNA, 22 bp, Homo sapiens
tcttctgcttcagcctcccgag

SEQ ID NO: 3153271 - DNA, 14 bp, Homo sapiens
tcttctggaatatt

SEQ ID NO: 3153272 - DNA, 12 bp, Homo sapiens
tcttctggctca

SEQ ID NO: 3153273 - DNA, 20 bp, Homo sapiens
tcttctggggcaggctgggc

SEQ ID NO: 3153274 - DNA, 14 bp, Homo sapiens
tcttctggtagtgt

SEQ ID NO: 3153275 - DNA, 15 bp, Homo sapiens
tcttctggtctgtgt

SEQ ID NO: 3153276 - DNA, 21 bp, Homo sapiens
tcttctggtgctactccatgc

SEQ ID NO: 3153277 - DNA, 22 bp, Homo sapiens
tcttctgtatttctaggcacaa

SEQ ID NO: 3153278 - DNA, 14 bp, Homo sapiens
tcttctgtattttt

SEQ ID NO: 3153279 - DNA, 16 bp, Homo sapiens
tcttctgtgaaatata

SEQ ID NO: 3153280 - DNA, 18 bp, Homo sapiens
tcttcttaagacttttgg

SEQ ID NO: 3153281 - DNA, 15 bp, Homo sapiens
tcttcttacatgcat

SEQ ID NO: 3153282 - DNA, 23 bp, Homo sapiens
tcttcttactcattactgcaaat

SEQ ID NO: 3153283 - DNA, 12 bp, Homo sapiens
tcttcttatgca

SEQ ID NO: 3153284 - DNA, 20 bp, Homo sapiens
tcttcttcaaatacaaagta

SEQ ID NO: 3153285 - DNA, 14 bp, Homo sapiens
tcttcttgtttctc

SEQ ID NO: 3153286 - DNA, 23 bp, Homo sapiens
tcttctttcatctggggatgaca

SEQ ID NO: 3153287 - DNA, 16 bp, Homo sapiens
tcttcttttggcttcc

SEQ ID NO: 3153288 - DNA, 18 bp, Homo sapiens
tcttcttttggcttccat

SEQ ID NO: 3153289 - DNA, 20 bp, Homo sapiens
tcttgaaattaagaaggcaa

SEQ ID NO: 3153290 - DNA, 21 bp, Homo sapiens
tcttgaaattaagaaggcaaa

SEQ ID NO: 3153291 - DNA, 19 bp, Homo sapiens
tcttgaacattgtggacaa

SEQ ID NO: 3153292 - DNA, 12 bp, Homo sapiens
tcttgaactcct

SEQ ID NO: 3153293 - DNA, 17 bp, Homo sapiens
tcttgaactcctggcct

SEQ ID NO: 3153294 - DNA, 19 bp, Homo sapiens
tcttgaagcccccagccct

SEQ ID NO: 3153295 - DNA, 21 bp, Homo sapiens
tcttgaataaagtattctagt

SEQ ID NO: 3153296 - DNA, 14 bp, Homo sapiens
tcttgaatataaaa

SEQ ID NO: 3153297 - DNA, 11 bp, Homo sapiens
tcttgaatgtg

SEQ ID NO: 3153298 - DNA, 22 bp, Homo sapiens
tcttgacaagctgacttggcac

SEQ ID NO: 3153299 - DNA, 23 bp, Homo sapiens
tcttgacaagctgacttggcact

SEQ ID NO: 3153300 - DNA, 16 bp, Homo sapiens
tcttgacatttatcac

SEQ ID NO: 3153301 - DNA, 13 bp, Homo sapiens
tcttgagccagta

SEQ ID NO: 3153302 - DNA, 18 bp, Homo sapiens
tcttgagccagtaatctt

SEQ ID NO: 3153303 - DNA, 21 bp, Homo sapiens
tcttgagctggcctctctagc

SEQ ID NO: 3153304 - DNA, 23 bp, Homo sapiens
tcttgagctggcctctctagcac

SEQ ID NO: 3153305 - DNA, 19 bp, Homo sapiens
tcttgaggaataaatgcct

SEQ ID NO: 3153306 - DNA, 21 bp, Homo sapiens
tcttgaggaataaatgccttt

SEQ ID NO: 3153307 - DNA, 13 bp, Homo sapiens
tcttgagtttgtc

SEQ ID NO: 3153308 - DNA, 14 bp, Homo sapiens
tcttgagtttgtcg

SEQ ID NO: 3153309 - DNA, 20 bp, Homo sapiens
tcttgatacccccctctgtc

SEQ ID NO: 3153310 - DNA, 15 bp, Homo sapiens
tcttgatcttaaaga

SEQ ID NO: 3153311 - DNA, 13 bp, Homo sapiens
tcttgatgtgaag

SEQ ID NO: 3153312 - DNA, 21 bp, Homo sapiens
tcttgatgtgaagataatttg

SEQ ID NO: 3153313 - DNA, 14 bp, Homo sapiens
tcttgcaacttcag

SEQ ID NO: 3153314 - DNA, 16 bp, Homo sapiens
tcttgcaacttcagtt

SEQ ID NO: 3153315 - DNA, 19 bp, Homo sapiens
tcttgcaatggcagccttg

SEQ ID NO: 3153316 - DNA, 23 bp, Homo sapiens
tcttgcaatggcagccttggcaa

SEQ ID NO: 3153317 - DNA, 15 bp, Homo sapiens
tcttgcactccttcc

SEQ ID NO: 3153318 - DNA, 16 bp, Homo sapiens
tcttgcactccttccc

SEQ ID NO: 3153319 - DNA, 22 bp, Homo sapiens
tcttgcataggctcttaagcag

SEQ ID NO: 3153320 - DNA, 16 bp, Homo sapiens
tcttgcatccttccta

SEQ ID NO: 3153321 - DNA, 18 bp, Homo sapiens
tcttgcatccttcctata

SEQ ID NO: 3153322 - DNA, 21 bp, Homo sapiens
tcttgcatccttcctataact

SEQ ID NO: 3153323 - DNA, 13 bp, Homo sapiens
tcttgcattcatt

SEQ ID NO: 3153324 - DNA, 21 bp, Homo sapiens
tcttgccacatttctgatcag

SEQ ID NO: 3153325 - DNA, 16 bp, Homo sapiens
tcttgccactgcctct

SEQ ID NO: 3153326 - DNA, 17 bp, Homo sapiens
tcttgccgaggagccag

SEQ ID NO: 3153327 - DNA, 13 bp, Homo sapiens
tcttgcctaggcc

SEQ ID NO: 3153328 - DNA, 13 bp, Homo sapiens
tcttgcctctctc

SEQ ID NO: 3153329 - DNA, 16 bp, Homo sapiens
tcttgcctctctcagg

SEQ ID NO: 3153330 - DNA, 12 bp, Homo sapiens
tcttgcctctgt

SEQ ID NO: 3153331 - DNA, 16 bp, Homo sapiens
tcttgcctctgtgctg

SEQ ID NO: 3153332 - DNA, 23 bp, Homo sapiens
tcttgcgaatccaagctccctgc

SEQ ID NO: 3153333 - DNA, 23 bp, Homo sapiens
tcttgcgtgtcaatttccctcag

SEQ ID NO: 3153334 - DNA, 22 bp, Homo sapiens
tcttgctaataaacactggctc

SEQ ID NO: 3153335 - DNA, 21 bp, Homo sapiens
tcttgctaatcagtgtctcac

SEQ ID NO: 3153336 - DNA, 17 bp, Homo sapiens
tcttgctctatctctca

SEQ ID NO: 3153337 - DNA, 13 bp, Homo sapiens
tcttgctctgctg

SEQ ID NO: 3153338 - DNA, 14 bp, Homo sapiens
tcttgctctttcta

SEQ ID NO: 3153339 - DNA, 21 bp, Homo sapiens
tcttgctctttctactctgaa

SEQ ID NO: 3153340 - DNA, 14 bp, Homo sapiens
tcttgctgctagaa

SEQ ID NO: 3153341 - DNA, 15 bp, Homo sapiens
tcttgctgctagaac

SEQ ID NO: 3153342 - DNA, 18 bp, Homo sapiens
tcttgctgctagaacttt

SEQ ID NO: 3153343 - DNA, 18 bp, Homo sapiens
tcttgctggattaatgtt

SEQ ID NO: 3153344 - DNA, 18 bp, Homo sapiens
tcttgctggctctgagaa

SEQ ID NO: 3153345 - DNA, 19 bp, Homo sapiens
tcttgctggctctgagaat

SEQ ID NO: 3153346 - DNA, 11 bp, Homo sapiens
tcttgctgggc

SEQ ID NO: 3153347 - DNA, 22 bp, Homo sapiens
tcttgctggttgtcatttttgc

SEQ ID NO: 3153348 - DNA, 14 bp, Homo sapiens
tcttgcttcagtca

SEQ ID NO: 3153349 - DNA, 22 bp, Homo sapiens
tcttgcttccctaatctatggt

SEQ ID NO: 3153350 - DNA, 16 bp, Homo sapiens
tcttgcttctttctag

SEQ ID NO: 3153351 - DNA, 17 bp, Homo sapiens
tcttgcttctttctaga

SEQ ID NO: 3153352 - DNA, 16 bp, Homo sapiens
tcttgcttggaagcca

SEQ ID NO: 3153353 - DNA, 14 bp, Homo sapiens
tcttgcttgtcatt

SEQ ID NO: 3153354 - DNA, 16 bp, Homo sapiens
tcttggaaagaaacaa

SEQ ID NO: 3153355 - DNA, 14 bp, Homo sapiens
tcttggaattacaa

SEQ ID NO: 3153356 - DNA, 20 bp, Homo sapiens
tcttggcaaaagccttgtgt

SEQ ID NO: 3153357 - DNA, 20 bp, Homo sapiens
tcttggcctttgcatttatt

SEQ ID NO: 3153358 - DNA, 15 bp, Homo sapiens
tcttggcttaatcat

SEQ ID NO: 3153359 - DNA, 21 bp, Homo sapiens
tcttggcttaatcattttcat

SEQ ID NO: 3153360 - DNA, 16 bp, Homo sapiens
tcttggcttcccacca

SEQ ID NO: 3153361 - DNA, 13 bp, Homo sapiens
tcttgggaactga

SEQ ID NO: 3153362 - DNA, 20 bp, Homo sapiens
tcttgggcagagctggctct

SEQ ID NO: 3153363 - DNA, 21 bp, Homo sapiens
tcttgggcagagctggctctg

SEQ ID NO: 3153364 - DNA, 23 bp, Homo sapiens
tcttgggcagagctggctctgag

SEQ ID NO: 3153365 - DNA, 15 bp, Homo sapiens
tcttgggctactggc

SEQ ID NO: 3153366 - DNA, 17 bp, Homo sapiens
tcttggggcaagactgc

SEQ ID NO: 3153367 - DNA, 14 bp, Homo sapiens
tcttgggggtcagg

SEQ ID NO: 3153368 - DNA, 21 bp, Homo sapiens
tcttgggggtcaggggggaga

SEQ ID NO: 3153369 - DNA, 15 bp, Homo sapiens
tcttgggtgggtgaa

SEQ ID NO: 3153370 - DNA, 18 bp, Homo sapiens
tcttgggtggttcctaag

SEQ ID NO: 3153371 - DNA, 13 bp, Homo sapiens
tcttggtgctctg

SEQ ID NO: 3153372 - DNA, 15 bp, Homo sapiens
tcttggtgctctgtg

SEQ ID NO: 3153373 - DNA, 16 bp, Homo sapiens
tcttggtgctctgtgt

SEQ ID NO: 3153374 - DNA, 22 bp, Homo sapiens
tcttggtttctctctacagtgc

SEQ ID NO: 3153375 - DNA, 15 bp, Homo sapiens
tcttgtaaagactgg

SEQ ID NO: 3153376 - DNA, 23 bp, Homo sapiens
tcttgtaatttaaacaggcccag

SEQ ID NO: 3153377 - DNA, 14 bp, Homo sapiens
tcttgtacatgtgt

SEQ ID NO: 3153378 - DNA, 14 bp, Homo sapiens
tcttgtacttctgt

SEQ ID NO: 3153379 - DNA, 15 bp, Homo sapiens
tcttgtacttctgtg

SEQ ID NO: 3153380 - DNA, 20 bp, Homo sapiens
tcttgtacttctgtgttcat

SEQ ID NO: 3153381 - DNA, 13 bp, Homo sapiens
tcttgtcagacat

SEQ ID NO: 3153382 - DNA, 14 bp, Homo sapiens
tcttgtctctgggc

SEQ ID NO: 3153383 - DNA, 13 bp, Homo sapiens
tcttgtcttacca

SEQ ID NO: 3153384 - DNA, 12 bp, Homo sapiens
tcttgtctttat

SEQ ID NO: 3153385 - DNA, 14 bp, Homo sapiens
tcttgtgaaatggc

SEQ ID NO: 3153386 - DNA, 15 bp, Homo sapiens
tcttgtgaaggcagg

SEQ ID NO: 3153387 - DNA, 19 bp, Homo sapiens
tcttgtgctcacgctcccc

SEQ ID NO: 3153388 - DNA, 22 bp, Homo sapiens
tcttgtgctcagcatgattctt

SEQ ID NO: 3153389 - DNA, 21 bp, Homo sapiens
tcttgtgcttttcctatttgt

SEQ ID NO: 3153390 - DNA, 20 bp, Homo sapiens
tcttgtggtgtaaagctggc

SEQ ID NO: 3153391 - DNA, 21 bp, Homo sapiens
tcttgtggtgtaaagctggcc

SEQ ID NO: 3153392 - DNA, 18 bp, Homo sapiens
tcttgttagagagctttt

SEQ ID NO: 3153393 - DNA, 15 bp, Homo sapiens
tcttgttcaggaaaa

SEQ ID NO: 3153394 - DNA, 18 bp, Homo sapiens
tcttgttctgtcccttcc

SEQ ID NO: 3153395 - DNA, 16 bp, Homo sapiens
tcttgttgcatctttt

SEQ ID NO: 3153396 - DNA, 14 bp, Homo sapiens
tcttgtttcaattc

SEQ ID NO: 3153397 - DNA, 22 bp, Homo sapiens
tcttgtttcttttcacatagct

SEQ ID NO: 3153398 - DNA, 16 bp, Homo sapiens
tcttgttttacatttg

SEQ ID NO: 3153399 - DNA, 13 bp, Homo sapiens
tcttgttttgaaa

SEQ ID NO: 3153400 - DNA, 16 bp, Homo sapiens
tcttgttttgaaaata

SEQ ID NO: 3153401 - DNA, 22 bp, Homo sapiens
tcttgttttgtcttgaaagtgg

SEQ ID NO: 3153402 - DNA, 15 bp, Homo sapiens
tcttgttttgtttgt

SEQ ID NO: 3153403 - DNA, 22 bp, Homo sapiens
tcttgttttgtttgtctctcct

SEQ ID NO: 3153404 - DNA, 18 bp, Homo sapiens
tcttgttttttttttcca

SEQ ID NO: 3153405 - DNA, 16 bp, Homo sapiens
tctttaaaaaagactg

SEQ ID NO: 3153406 - DNA, 15 bp, Homo sapiens
tctttaaaagaatga

SEQ ID NO: 3153407 - DNA, 16 bp, Homo sapiens
tctttaaaagaatgac

SEQ ID NO: 3153408 - DNA, 17 bp, Homo sapiens
tctttaaaagagagaga

SEQ ID NO: 3153409 - DNA, 16 bp, Homo sapiens
tctttaaaatatttgt

SEQ ID NO: 3153410 - DNA, 21 bp, Homo sapiens
tctttaaaatttaagtatctt

SEQ ID NO: 3153411 - DNA, 23 bp, Homo sapiens
tctttaaacagcaactacagaag

SEQ ID NO: 3153412 - DNA, 23 bp, Homo sapiens
tctttaaacagtatttcattgcc

SEQ ID NO: 3153413 - DNA, 23 bp, Homo sapiens
tctttaaaggcccagcccctaga

SEQ ID NO: 3153414 - DNA, 18 bp, Homo sapiens
tctttaaagtcaggtcca

SEQ ID NO: 3153415 - DNA, 19 bp, Homo sapiens
tctttaaatgttttataag

SEQ ID NO: 3153416 - DNA, 11 bp, Homo sapiens
tctttaagaga

SEQ ID NO: 3153417 - DNA, 14 bp, Homo sapiens
tctttaagagactc

SEQ ID NO: 3153418 - DNA, 18 bp, Homo sapiens
tctttaagggcatgcctt

SEQ ID NO: 3153419 - DNA, 15 bp, Homo sapiens
tctttaagtattgtt

SEQ ID NO: 3153420 - DNA, 18 bp, Homo sapiens
tctttaagtattgtttta

SEQ ID NO: 3153421 - DNA, 23 bp, Homo sapiens
tctttaatcattttgcctctttt

SEQ ID NO: 3153422 - DNA, 14 bp, Homo sapiens
tctttaatcttcag

SEQ ID NO: 3153423 - DNA, 15 bp, Homo sapiens
tctttaatcttcagt

SEQ ID NO: 3153424 - DNA, 11 bp, Homo sapiens
tctttaatgct

SEQ ID NO: 3153425 - DNA, 15 bp, Homo sapiens
tctttaatgtcacag

SEQ ID NO: 3153426 - DNA, 18 bp, Homo sapiens
tctttaatgtcacaggca

SEQ ID NO: 3153427 - DNA, 18 bp, Homo sapiens
tctttacctgagaccagt

SEQ ID NO: 3153428 - DNA, 15 bp, Homo sapiens
tctttactattaaaa

SEQ ID NO: 3153429 - DNA, 19 bp, Homo sapiens
tctttactattaaaatatt

SEQ ID NO: 3153430 - DNA, 12 bp, Homo sapiens
tctttactttta

SEQ ID NO: 3153431 - DNA, 11 bp, Homo sapiens
tctttagaaca

SEQ ID NO: 3153432 - DNA, 13 bp, Homo sapiens
tctttagagcatt

SEQ ID NO: 3153433 - DNA, 14 bp, Homo sapiens
tctttagagcattg

SEQ ID NO: 3153434 - DNA, 20 bp, Homo sapiens
tctttagtatagccacaaat

SEQ ID NO: 3153435 - DNA, 15 bp, Homo sapiens
tctttagtgccggct

SEQ ID NO: 3153436 - DNA, 14 bp, Homo sapiens
tctttatacagctg

SEQ ID NO: 3153437 - DNA, 11 bp, Homo sapiens
tctttatatga

SEQ ID NO: 3153438 - DNA, 15 bp, Homo sapiens
tctttatatgaacat

SEQ ID NO: 3153439 - DNA, 20 bp, Homo sapiens
tctttattcttattactatt

SEQ ID NO: 3153440 - DNA, 16 bp, Homo sapiens
tctttattctttacta

SEQ ID NO: 3153441 - DNA, 12 bp, Homo sapiens
tctttattgaaa

SEQ ID NO: 3153442 - DNA, 15 bp, Homo sapiens
tctttcaacttgcat

SEQ ID NO: 3153443 - DNA, 18 bp, Homo sapiens
tctttcaacttgcatcca

SEQ ID NO: 3153444 - DNA, 21 bp, Homo sapiens
tctttcaagcagtcgtgcctg

SEQ ID NO: 3153445 - DNA, 14 bp, Homo sapiens
tctttcacaaggta

SEQ ID NO: 3153446 - DNA, 23 bp, Homo sapiens
tctttcacattgtttgctgctat

SEQ ID NO: 3153447 - DNA, 14 bp, Homo sapiens
tctttcacttgaaa

SEQ ID NO: 3153448 - DNA, 18 bp, Homo sapiens
tctttcagaaatataaca

SEQ ID NO: 3153449 - DNA, 14 bp, Homo sapiens
tctttcagatgttt

SEQ ID NO: 3153450 - DNA, 18 bp, Homo sapiens
tctttcagatgtttattt

SEQ ID NO: 3153451 - DNA, 16 bp, Homo sapiens
tctttcagtacttttt

SEQ ID NO: 3153452 - DNA, 21 bp, Homo sapiens
tctttcattaaaaagaataga

SEQ ID NO: 3153453 - DNA, 18 bp, Homo sapiens
tctttccaaaacatttct

SEQ ID NO: 3153454 - DNA, 14 bp, Homo sapiens
tctttccaaattat

SEQ ID NO: 3153455 - DNA, 22 bp, Homo sapiens
tctttccaggcttccctgactt

SEQ ID NO: 3153456 - DNA, 15 bp, Homo sapiens
tctttccggccaagg

SEQ ID NO: 3153457 - DNA, 21 bp, Homo sapiens
tctttcctcaagtatcttcta

SEQ ID NO: 3153458 - DNA, 11 bp, Homo sapiens
tctttcctctt

SEQ ID NO: 3153459 - DNA, 16 bp, Homo sapiens
tctttcctgaaccatg

SEQ ID NO: 3153460 - DNA, 15 bp, Homo sapiens
tctttccttccatca

SEQ ID NO: 3153461 - DNA, 17 bp, Homo sapiens
tctttccttccatcaaa

SEQ ID NO: 3153462 - DNA, 17 bp, Homo sapiens
tctttcgcacagcagtt

SEQ ID NO: 3153463 - DNA, 14 bp, Homo sapiens
tctttctaagaaat

SEQ ID NO: 3153464 - DNA, 16 bp, Homo sapiens
tctttctaatgtagct

SEQ ID NO: 3153465 - DNA, 19 bp, Homo sapiens
tctttctaatgtgtgaatc

SEQ ID NO: 3153466 - DNA, 21 bp, Homo sapiens
tctttctacatgactgggcct

SEQ ID NO: 3153467 - DNA, 22 bp, Homo sapiens
tctttctacatgactgggcctc

SEQ ID NO: 3153468 - DNA, 20 bp, Homo sapiens
tctttctagtggtctttgta

SEQ ID NO: 3153469 - DNA, 14 bp, Homo sapiens
tctttctattttca

SEQ ID NO: 3153470 - DNA, 18 bp, Homo sapiens
tctttctccttagtcttc

SEQ ID NO: 3153471 - DNA, 15 bp, Homo sapiens
tctttctctcctttc

SEQ ID NO: 3153472 - DNA, 15 bp, Homo sapiens
tctttctctctctct

SEQ ID NO: 3153473 - DNA, 16 bp, Homo sapiens
tctttctctgccagtg

SEQ ID NO: 3153474 - DNA, 21 bp, Homo sapiens
tctttctgagcacactttagt

SEQ ID NO: 3153475 - DNA, 20 bp, Homo sapiens
tctttctgcacacaaatatt

SEQ ID NO: 3153476 - DNA, 13 bp, Homo sapiens
tctttctgtacaa

SEQ ID NO: 3153477 - DNA, 19 bp, Homo sapiens
tctttctgtgcttggattt

SEQ ID NO: 3153478 - DNA, 20 bp, Homo sapiens
tctttctgtgcttggatttg

SEQ ID NO: 3153479 - DNA, 15 bp, Homo sapiens
tctttcttcctctgc

SEQ ID NO: 3153480 - DNA, 17 bp, Homo sapiens
tctttcttcctctgctg

SEQ ID NO: 3153481 - DNA, 12 bp, Homo sapiens
tctttctttaaa

SEQ ID NO: 3153482 - DNA, 18 bp, Homo sapiens
tctttctttaaatgtttt

SEQ ID NO: 3153483 - DNA, 22 bp, Homo sapiens
tctttctttccaaaacatttct

SEQ ID NO: 3153484 - DNA, 13 bp, Homo sapiens
tctttctttccat

SEQ ID NO: 3153485 - DNA, 19 bp, Homo sapiens
tctttctttgcaccaaaga

SEQ ID NO: 3153486 - DNA, 21 bp, Homo sapiens
tctttgaaatagtctgtgtga

SEQ ID NO: 3153487 - DNA, 22 bp, Homo sapiens
tctttgacaattcctagataaa

SEQ ID NO: 3153488 - DNA, 21 bp, Homo sapiens
tctttgacaattgggagctgc

SEQ ID NO: 3153489 - DNA, 17 bp, Homo sapiens
tctttgacactctgcag

SEQ ID NO: 3153490 - DNA, 13 bp, Homo sapiens
tctttgactgaaa

SEQ ID NO: 3153491 - DNA, 19 bp, Homo sapiens
tctttgagggactgcctct

SEQ ID NO: 3153492 - DNA, 21 bp, Homo sapiens
tctttgataatgttaaatttg

SEQ ID NO: 3153493 - DNA, 18 bp, Homo sapiens
tctttgcaaaccctggtg

SEQ ID NO: 3153494 - DNA, 19 bp, Homo sapiens
tctttgcaccaaagacatc

SEQ ID NO: 3153495 - DNA, 12 bp, Homo sapiens
tctttgcctggt

SEQ ID NO: 3153496 - DNA, 23 bp, Homo sapiens
tctttgctgtactcttgctgatg

SEQ ID NO: 3153497 - DNA, 17 bp, Homo sapiens
tctttgcttgaacacag

SEQ ID NO: 3153498 - DNA, 19 bp, Homo sapiens
tctttgcttgaacacagta

SEQ ID NO: 3153499 - DNA, 18 bp, Homo sapiens
tctttggaaaaatgtttg

SEQ ID NO: 3153500 - DNA, 19 bp, Homo sapiens
tctttggaaaaatgtttgt

SEQ ID NO: 3153501 - DNA, 20 bp, Homo sapiens
tctttggagttaaaatgcac

SEQ ID NO: 3153502 - DNA, 14 bp, Homo sapiens
tctttggctcccct

SEQ ID NO: 3153503 - DNA, 20 bp, Homo sapiens
tctttggggaggtgttcact

SEQ ID NO: 3153504 - DNA, 13 bp, Homo sapiens
tctttggtgcctt

SEQ ID NO: 3153505 - DNA, 15 bp, Homo sapiens
tctttggtgcctttc

SEQ ID NO: 3153506 - DNA, 18 bp, Homo sapiens
tctttggtgcctttcctg

SEQ ID NO: 3153507 - DNA, 22 bp, Homo sapiens
tctttggtgcctttcctgttca

SEQ ID NO: 3153508 - DNA, 23 bp, Homo sapiens
tctttggtgcctttcctgttcag

SEQ ID NO: 3153509 - DNA, 16 bp, Homo sapiens
tctttggttctaagga

SEQ ID NO: 3153510 - DNA, 21 bp, Homo sapiens
tctttgtaatcccttcacagt

SEQ ID NO: 3153511 - DNA, 14 bp, Homo sapiens
tctttgtaccaaaa

SEQ ID NO: 3153512 - DNA, 21 bp, Homo sapiens
tctttgtaccaaaattttaaa

SEQ ID NO: 3153513 - DNA, 14 bp, Homo sapiens
tctttgtataaata

SEQ ID NO: 3153514 - DNA, 12 bp, Homo sapiens
tctttgtatctt

SEQ ID NO: 3153515 - DNA, 16 bp, Homo sapiens
tctttgtatcttccat

SEQ ID NO: 3153516 - DNA, 14 bp, Homo sapiens
tctttgtctgcctt

SEQ ID NO: 3153517 - DNA, 18 bp, Homo sapiens
tctttgtctgccttccca

SEQ ID NO: 3153518 - DNA, 16 bp, Homo sapiens
tctttgtgataattta

SEQ ID NO: 3153519 - DNA, 23 bp, Homo sapiens
tctttgttcatagcccagtagac

SEQ ID NO: 3153520 - DNA, 12 bp, Homo sapiens
tctttgttctca

SEQ ID NO: 3153521 - DNA, 20 bp, Homo sapiens
tctttgttctcagctccccc

SEQ ID NO: 3153522 - DNA, 14 bp, Homo sapiens
tctttgttctgttt

SEQ ID NO: 3153523 - DNA, 16 bp, Homo sapiens
tctttgttgaagtttg

SEQ ID NO: 3153524 - DNA, 18 bp, Homo sapiens
tctttgtttctttttaca

SEQ ID NO: 3153525 - DNA, 18 bp, Homo sapiens
tcttttaaaaattcaaat

SEQ ID NO: 3153526 - DNA, 13 bp, Homo sapiens
tcttttaaagacc

SEQ ID NO: 3153527 - DNA, 17 bp, Homo sapiens
tcttttaaattagaaaa

SEQ ID NO: 3153528 - DNA, 19 bp, Homo sapiens
tcttttaaattagaaaata

SEQ ID NO: 3153529 - DNA, 20 bp, Homo sapiens
tcttttaaattagaaaatat

SEQ ID NO: 3153530 - DNA, 21 bp, Homo sapiens
tcttttaaattagaaaatatt

SEQ ID NO: 3153531 - DNA, 12 bp, Homo sapiens
tcttttacaact

SEQ ID NO: 3153532 - DNA, 23 bp, Homo sapiens
tcttttactttttttagtaagtt

SEQ ID NO: 3153533 - DNA, 18 bp, Homo sapiens
tcttttagttttagttgc

SEQ ID NO: 3153534 - DNA, 11 bp, Homo sapiens
tcttttatagg

SEQ ID NO: 3153535 - DNA, 15 bp, Homo sapiens
tcttttataggaaaa

SEQ ID NO: 3153536 - DNA, 14 bp, Homo sapiens
tcttttatatttgt

SEQ ID NO: 3153537 - DNA, 16 bp, Homo sapiens
tcttttatatttgtat

SEQ ID NO: 3153538 - DNA, 17 bp, Homo sapiens
tcttttatatttgtatc

SEQ ID NO: 3153539 - DNA, 14 bp, Homo sapiens
tcttttcacatttt

SEQ ID NO: 3153540 - DNA, 21 bp, Homo sapiens
tcttttcataaagggttgaaa

SEQ ID NO: 3153541 - DNA, 12 bp, Homo sapiens
tcttttccaagc

SEQ ID NO: 3153542 - DNA, 20 bp, Homo sapiens
tcttttccccgcctgcagtc

SEQ ID NO: 3153543 - DNA, 17 bp, Homo sapiens
tcttttctctgtgcttc

SEQ ID NO: 3153544 - DNA, 17 bp, Homo sapiens
tcttttctcttctacat

SEQ ID NO: 3153545 - DNA, 13 bp, Homo sapiens
tcttttctgctga

SEQ ID NO: 3153546 - DNA, 22 bp, Homo sapiens
tcttttgaactgttagatgctg

SEQ ID NO: 3153547 - DNA, 12 bp, Homo sapiens
tcttttgaagca

SEQ ID NO: 3153548 - DNA, 14 bp, Homo sapiens
tcttttgaagcata

SEQ ID NO: 3153549 - DNA, 23 bp, Homo sapiens
tcttttgaagggagaagacactg

SEQ ID NO: 3153550 - DNA, 23 bp, Homo sapiens
tcttttgaatattcccaagccca

SEQ ID NO: 3153551 - DNA, 20 bp, Homo sapiens
tcttttgacatgtggaaagt

SEQ ID NO: 3153552 - DNA, 16 bp, Homo sapiens
tcttttgattatgttt

SEQ ID NO: 3153553 - DNA, 18 bp, Homo sapiens
tcttttgcatgtcgcaca

SEQ ID NO: 3153554 - DNA, 20 bp, Homo sapiens
tcttttgcattttgccgctg

SEQ ID NO: 3153555 - DNA, 18 bp, Homo sapiens
tcttttgcttttggcaaa

SEQ ID NO: 3153556 - DNA, 13 bp, Homo sapiens
tcttttggcttcc

SEQ ID NO: 3153557 - DNA, 15 bp, Homo sapiens
tcttttgttaaataa

SEQ ID NO: 3153558 - DNA, 12 bp, Homo sapiens
tcttttgttact

SEQ ID NO: 3153559 - DNA, 15 bp, Homo sapiens
tcttttgttactgtt

SEQ ID NO: 3153560 - DNA, 17 bp, Homo sapiens
tcttttgttactgttct

SEQ ID NO: 3153561 - DNA, 22 bp, Homo sapiens
tcttttgttactgttcttgctg

SEQ ID NO: 3153562 - DNA, 16 bp, Homo sapiens
tctttttaaaaactct

SEQ ID NO: 3153563 - DNA, 15 bp, Homo sapiens
tctttttaaaatggt

SEQ ID NO: 3153564 - DNA, 15 bp, Homo sapiens
tctttttaagtaatg

SEQ ID NO: 3153565 - DNA, 16 bp, Homo sapiens
tctttttaagtaatgt

SEQ ID NO: 3153566 - DNA, 13 bp, Homo sapiens
tctttttaattat

SEQ ID NO: 3153567 - DNA, 20 bp, Homo sapiens
tctttttacagcattgtctt

SEQ ID NO: 3153568 - DNA, 12 bp, Homo sapiens
tctttttcatta

SEQ ID NO: 3153569 - DNA, 14 bp, Homo sapiens
tctttttctggact

SEQ ID NO: 3153570 - DNA, 12 bp, Homo sapiens
tctttttcttct

SEQ ID NO: 3153571 - DNA, 15 bp, Homo sapiens
tctttttctttttaa

SEQ ID NO: 3153572 - DNA, 22 bp, Homo sapiens
tctttttgataagcacattaaa

SEQ ID NO: 3153573 - DNA, 12 bp, Homo sapiens
tctttttgtttg

SEQ ID NO: 3153574 - DNA, 15 bp, Homo sapiens
tcttttttaaatgaa

SEQ ID NO: 3153575 - DNA, 22 bp, Homo sapiens
tcttttttaaattttcttcagt

SEQ ID NO: 3153576 - DNA, 14 bp, Homo sapiens
tcttttttactcat

SEQ ID NO: 3153577 - DNA, 21 bp, Homo sapiens
tcttttttactcattgaaatg

SEQ ID NO: 3153578 - DNA, 22 bp, Homo sapiens
tcttttttactcattgaaatgt

SEQ ID NO: 3153579 - DNA, 15 bp, Homo sapiens
tcttttttagcataa

SEQ ID NO: 3153580 - DNA, 16 bp, Homo sapiens
tcttttttagcataaa

SEQ ID NO: 3153581 - DNA, 13 bp, Homo sapiens
tcttttttatgtg

SEQ ID NO: 3153582 - DNA, 20 bp, Homo sapiens
tcttttttttttctgttgaa

SEQ ID NO: 3153583 - DNA, 18 bp, Homo sapiens
tgaaaaaaaaaaagaaga

SEQ ID NO: 3153584 - DNA, 19 bp, Homo sapiens
tgaaaaaaaaaaagaagaa

SEQ ID NO: 3153585 - DNA, 14 bp, Homo sapiens
tgaaaaaaaagttt

SEQ ID NO: 3153586 - DNA, 13 bp, Homo sapiens
tgaaaaaaattat

SEQ ID NO: 3153587 - DNA, 18 bp, Homo sapiens
tgaaaaaaattattcatg

SEQ ID NO: 3153588 - DNA, 23 bp, Homo sapiens
tgaaaaaaattattcatgctctc

SEQ ID NO: 3153589 - DNA, 12 bp, Homo sapiens
tgaaaaatataa

SEQ ID NO: 3153590 - DNA, 13 bp, Homo sapiens
tgaaaaatataaa

SEQ ID NO: 3153591 - DNA, 20 bp, Homo sapiens
tgaaaaatctgctgttaact

SEQ ID NO: 3153592 - DNA, 18 bp, Homo sapiens
tgaaaaatttaagcattg

SEQ ID NO: 3153593 - DNA, 19 bp, Homo sapiens
tgaaaaatttaagcattgt

SEQ ID NO: 3153594 - DNA, 23 bp, Homo sapiens
tgaaaacagatgaccataatttt

SEQ ID NO: 3153595 - DNA, 14 bp, Homo sapiens
tgaaaacatgtaat

SEQ ID NO: 3153596 - DNA, 22 bp, Homo sapiens
tgaaaaccatctggcctggcct

SEQ ID NO: 3153597 - DNA, 15 bp, Homo sapiens
tgaaaacctaccagc

SEQ ID NO: 3153598 - DNA, 16 bp, Homo sapiens
tgaaaacgttttattg

SEQ ID NO: 3153599 - DNA, 17 bp, Homo sapiens
tgaaaacgttttattgt

SEQ ID NO: 3153600 - DNA, 18 bp, Homo sapiens
tgaaaacgttttattgtg

SEQ ID NO: 3153601 - DNA, 19 bp, Homo sapiens
tgaaaacgttttattgtgt

SEQ ID NO: 3153602 - DNA, 21 bp, Homo sapiens
tgaaaactgctgataaaatat

SEQ ID NO: 3153603 - DNA, 17 bp, Homo sapiens
tgaaaacttagccagag

SEQ ID NO: 3153604 - DNA, 12 bp, Homo sapiens
tgaaaacttcaa

SEQ ID NO: 3153605 - DNA, 13 bp, Homo sapiens
tgaaaacttcaaa

SEQ ID NO: 3153606 - DNA, 19 bp, Homo sapiens
tgaaaacttcaaagctgaa

SEQ ID NO: 3153607 - DNA, 15 bp, Homo sapiens
tgaaaagaaggaaag

SEQ ID NO: 3153608 - DNA, 16 bp, Homo sapiens
tgaaaagcaatattgt

SEQ ID NO: 3153609 - DNA, 18 bp, Homo sapiens
tgaaaagcaattgccctg

SEQ ID NO: 3153610 - DNA, 22 bp, Homo sapiens
tgaaaagctgcatttaaatcaa

SEQ ID NO: 3153611 - DNA, 16 bp, Homo sapiens
tgaaaagcttcttaat

SEQ ID NO: 3153612 - DNA, 18 bp, Homo sapiens
tgaaaaggtacaacagaa

SEQ ID NO: 3153613 - DNA, 23 bp, Homo sapiens
tgaaaaggtgaccttgcaacttc

SEQ ID NO: 3153614 - DNA, 21 bp, Homo sapiens
tgaaaagtatattgataacct

SEQ ID NO: 3153615 - DNA, 21 bp, Homo sapiens
tgaaaagtatcactctaaaaa

SEQ ID NO: 3153616 - DNA, 22 bp, Homo sapiens
tgaaaagtatcactctaaaaaa

SEQ ID NO: 3153617 - DNA, 12 bp, Homo sapiens
tgaaaagtcgtt

SEQ ID NO: 3153618 - DNA, 22 bp, Homo sapiens
tgaaaagtcgttttccaaactg

SEQ ID NO: 3153619 - DNA, 14 bp, Homo sapiens
tgaaaagtgtgtat

SEQ ID NO: 3153620 - DNA, 19 bp, Homo sapiens
tgaaaagtgtgtatatatt

SEQ ID NO: 3153621 - DNA, 18 bp, Homo sapiens
tgaaaagttatttatgct

SEQ ID NO: 3153622 - DNA, 20 bp, Homo sapiens
tgaaaataaaaagatcactt

SEQ ID NO: 3153623 - DNA, 21 bp, Homo sapiens
tgaaaataaaaagatcacttt

SEQ ID NO: 3153624 - DNA, 20 bp, Homo sapiens
tgaaaataaagcagaagcaa

SEQ ID NO: 3153625 - DNA, 18 bp, Homo sapiens
tgaaaataactgaaccaa

SEQ ID NO: 3153626 - DNA, 20 bp, Homo sapiens
tgaaaataactgaaccaaat

SEQ ID NO: 3153627 - DNA, 12 bp, Homo sapiens
tgaaaatacaac

SEQ ID NO: 3153628 - DNA, 19 bp, Homo sapiens
tgaaaatacaacttaaata

SEQ ID NO: 3153629 - DNA, 18 bp, Homo sapiens
tgaaaataccatcaggcc

SEQ ID NO: 3153630 - DNA, 21 bp, Homo sapiens
tgaaaatatacttgactctaa

SEQ ID NO: 3153631 - DNA, 23 bp, Homo sapiens
tgaaaatatacttgactctaata

SEQ ID NO: 3153632 - DNA, 22 bp, Homo sapiens
tgaaaatatctcttgtgctttt

SEQ ID NO: 3153633 - DNA, 19 bp, Homo sapiens
tgaaaatcgtgacaacact

SEQ ID NO: 3153634 - DNA, 17 bp, Homo sapiens
tgaaaatctaatattaa

SEQ ID NO: 3153635 - DNA, 14 bp, Homo sapiens
tgaaaatcttggag

SEQ ID NO: 3153636 - DNA, 17 bp, Homo sapiens
tgaaaatgcaaagctga

SEQ ID NO: 3153637 - DNA, 12 bp, Homo sapiens
tgaaaatgtact

SEQ ID NO: 3153638 - DNA, 16 bp, Homo sapiens
tgaaaatgtactgaga

SEQ ID NO: 3153639 - DNA, 17 bp, Homo sapiens
tgaaaatgtatgtgtaa

SEQ ID NO: 3153640 - DNA, 21 bp, Homo sapiens
tgaaaatgtcagaaaccagtt

SEQ ID NO: 3153641 - DNA, 22 bp, Homo sapiens
tgaaaatgtgctatactgcata

SEQ ID NO: 3153642 - DNA, 16 bp, Homo sapiens
tgaaaatgtgtttgct

SEQ ID NO: 3153643 - DNA, 17 bp, Homo sapiens
tgaaaatgtgtttgctg

SEQ ID NO: 3153644 - DNA, 13 bp, Homo sapiens
tgaaaatgttttt

SEQ ID NO: 3153645 - DNA, 19 bp, Homo sapiens
tgaaaattattttaaacaa

SEQ ID NO: 3153646 - DNA, 23 bp, Homo sapiens
tgaaaattcaaaaagtgtttatt

SEQ ID NO: 3153647 - DNA, 13 bp, Homo sapiens
tgaaaattgaaaa

SEQ ID NO: 3153648 - DNA, 13 bp, Homo sapiens
tgaaaatttgaga

SEQ ID NO: 3153649 - DNA, 22 bp, Homo sapiens
tgaaaatttgagactatttaaa

SEQ ID NO: 3153650 - DNA, 19 bp, Homo sapiens
tgaaaattttaaaaataca

SEQ ID NO: 3153651 - DNA, 14 bp, Homo sapiens
tgaaaattttacca

SEQ ID NO: 3153652 - DNA, 15 bp, Homo sapiens
tgaaaattttacttc

SEQ ID NO: 3153653 - DNA, 18 bp, Homo sapiens
tgaaacaaataatcacat

SEQ ID NO: 3153654 - DNA, 19 bp, Homo sapiens
tgaaacaaataatcacatt

SEQ ID NO: 3153655 - DNA, 19 bp, Homo sapiens
tgaaacaatgttgtccaac

SEQ ID NO: 3153656 - DNA, 22 bp, Homo sapiens
tgaaacaatgttgtccaacaat

SEQ ID NO: 3153657 - DNA, 16 bp, Homo sapiens
tgaaacacaataccta

SEQ ID NO: 3153658 - DNA, 15 bp, Homo sapiens
tgaaacacagctgtt

SEQ ID NO: 3153659 - DNA, 17 bp, Homo sapiens
tgaaacacagctgttct

SEQ ID NO: 3153660 - DNA, 18 bp, Homo sapiens
tgaaacacagctgttctt

SEQ ID NO: 3153661 - DNA, 19 bp, Homo sapiens
tgaaacacagctgttcttc

SEQ ID NO: 3153662 - DNA, 15 bp, Homo sapiens
tgaaacacgaaactt

SEQ ID NO: 3153663 - DNA, 20 bp, Homo sapiens
tgaaacacgaaacttgttat

SEQ ID NO: 3153664 - DNA, 21 bp, Homo sapiens
tgaaacacgaaacttgttatt

SEQ ID NO: 3153665 - DNA, 15 bp, Homo sapiens
tgaaacacttgcttg

SEQ ID NO: 3153666 - DNA, 13 bp, Homo sapiens
tgaaacagaaaaa

SEQ ID NO: 3153667 - DNA, 14 bp, Homo sapiens
tgaaacagaaaaat

SEQ ID NO: 3153668 - DNA, 16 bp, Homo sapiens
tgaaacagaaacaaaa

SEQ ID NO: 3153669 - DNA, 16 bp, Homo sapiens
tgaaacagacatgaaa

SEQ ID NO: 3153670 - DNA, 18 bp, Homo sapiens
tgaaacagttccatttat

SEQ ID NO: 3153671 - DNA, 23 bp, Homo sapiens
tgaaacattcacacagggctctt

SEQ ID NO: 3153672 - DNA, 20 bp, Homo sapiens
tgaaacattccgaagaggga

SEQ ID NO: 3153673 - DNA, 14 bp, Homo sapiens
tgaaacattttgtc

SEQ ID NO: 3153674 - DNA, 22 bp, Homo sapiens
tgaaaccaaaacataaaaacca

SEQ ID NO: 3153675 - DNA, 15 bp, Homo sapiens
tgaaaccacagtttc

SEQ ID NO: 3153676 - DNA, 14 bp, Homo sapiens
tgaaaccattttcc

SEQ ID NO: 3153677 - DNA, 15 bp, Homo sapiens
tgaaacccacagttt

SEQ ID NO: 3153678 - DNA, 20 bp, Homo sapiens
tgaaacccacagttttagtt

SEQ ID NO: 3153679 - DNA, 18 bp, Homo sapiens
tgaaacctagtactgccc

SEQ ID NO: 3153680 - DNA, 20 bp, Homo sapiens
tgaaacctttagggcagctt

SEQ ID NO: 3153681 - DNA, 20 bp, Homo sapiens
tgaaaccttttttaagattt

SEQ ID NO: 3153682 - DNA, 21 bp, Homo sapiens
tgaaaccttttttaagatttt

SEQ ID NO: 3153683 - DNA, 20 bp, Homo sapiens
tgaaactcaaaaccatctct

SEQ ID NO: 3153684 - DNA, 19 bp, Homo sapiens
tgaaactcctgattttgta

SEQ ID NO: 3153685 - DNA, 20 bp, Homo sapiens
tgaaactcctgattttgtag

SEQ ID NO: 3153686 - DNA, 17 bp, Homo sapiens
tgaaactctacatttaa

SEQ ID NO: 3153687 - DNA, 19 bp, Homo sapiens
tgaaactttgggaaaacat

SEQ ID NO: 3153688 - DNA, 14 bp, Homo sapiens
tgaaagaaaattga

SEQ ID NO: 3153689 - DNA, 17 bp, Homo sapiens
tgaaagaaaattgagtt

SEQ ID NO: 3153690 - DNA, 19 bp, Homo sapiens
tgaaagaaagctgagaaga

SEQ ID NO: 3153691 - DNA, 16 bp, Homo sapiens
tgaaagaagcaagaca

SEQ ID NO: 3153692 - DNA, 22 bp, Homo sapiens
tgaaagaatatatttatttaaa

SEQ ID NO: 3153693 - DNA, 19 bp, Homo sapiens
tgaaagaccttctccaaat

SEQ ID NO: 3153694 - DNA, 15 bp, Homo sapiens
tgaaagactgtacaa

SEQ ID NO: 3153695 - DNA, 18 bp, Homo sapiens
tgaaagagaaccagtttc

SEQ ID NO: 3153696 - DNA, 19 bp, Homo sapiens
tgaaagaggctgaggcctg

SEQ ID NO: 3153697 - DNA, 16 bp, Homo sapiens
tgaaagagttaagaat

SEQ ID NO: 3153698 - DNA, 12 bp, Homo sapiens
tgaaagattaaa

SEQ ID NO: 3153699 - DNA, 13 bp, Homo sapiens
tgaaagattaaac

SEQ ID NO: 3153700 - DNA, 23 bp, Homo sapiens
tgaaagattatgatgcatacagt

SEQ ID NO: 3153701 - DNA, 19 bp, Homo sapiens
tgaaagcagggaatttcta

SEQ ID NO: 3153702 - DNA, 14 bp, Homo sapiens
tgaaagctgagaac

SEQ ID NO: 3153703 - DNA, 21 bp, Homo sapiens
tgaaagctgattactgtcaat

SEQ ID NO: 3153704 - DNA, 21 bp, Homo sapiens
tgaaagggcacttaatttgta

SEQ ID NO: 3153705 - DNA, 17 bp, Homo sapiens
tgaaagggcccagagag

SEQ ID NO: 3153706 - DNA, 18 bp, Homo sapiens
tgaaagggcccagagagg

SEQ ID NO: 3153707 - DNA, 15 bp, Homo sapiens
tgaaagggctatggc

SEQ ID NO: 3153708 - DNA, 16 bp, Homo sapiens
tgaaaggtaatttgag

SEQ ID NO: 3153709 - DNA, 17 bp, Homo sapiens
tgaaaggttttttttca

SEQ ID NO: 3153710 - DNA, 15 bp, Homo sapiens
tgaaagtagggggct

SEQ ID NO: 3153711 - DNA, 15 bp, Homo sapiens
tgaaagtcagatgcc

SEQ ID NO: 3153712 - DNA, 17 bp, Homo sapiens
tgaaagtgtaaaataga

SEQ ID NO: 3153713 - DNA, 18 bp, Homo sapiens
tgaaagtgtaaaatagaa

SEQ ID NO: 3153714 - DNA, 20 bp, Homo sapiens
tgaaagtgtcgtctccgctt

SEQ ID NO: 3153715 - DNA, 17 bp, Homo sapiens
tgaaagtgttttactct

SEQ ID NO: 3153716 - DNA, 13 bp, Homo sapiens
tgaaagtgttttt

SEQ ID NO: 3153717 - DNA, 18 bp, Homo sapiens
tgaaagttttcagaacct

SEQ ID NO: 3153718 - DNA, 13 bp, Homo sapiens
tgaaagttttcca

SEQ ID NO: 3153719 - DNA, 15 bp, Homo sapiens
tgaaagttttccagt

SEQ ID NO: 3153720 - DNA, 22 bp, Homo sapiens
tgaaataaaaaaaaaaggatga

SEQ ID NO: 3153721 - DNA, 11 bp, Homo sapiens
tgaaataaaac

SEQ ID NO: 3153722 - DNA, 17 bp, Homo sapiens
tgaaataaaatgccata

SEQ ID NO: 3153723 - DNA, 16 bp, Homo sapiens
tgaaataaacactggt

SEQ ID NO: 3153724 - DNA, 15 bp, Homo sapiens
tgaaataaagaattt

SEQ ID NO: 3153725 - DNA, 21 bp, Homo sapiens
tgaaataaagacccaggggga

SEQ ID NO: 3153726 - DNA, 20 bp, Homo sapiens
tgaaataaattggtgataag

SEQ ID NO: 3153727 - DNA, 14 bp, Homo sapiens
tgaaataactggaa

SEQ ID NO: 3153728 - DNA, 12 bp, Homo sapiens
tgaaataatcag

SEQ ID NO: 3153729 - DNA, 15 bp, Homo sapiens
tgaaataatcagtga

SEQ ID NO: 3153730 - DNA, 19 bp, Homo sapiens
tgaaataattaaaaaccac

SEQ ID NO: 3153731 - DNA, 21 bp, Homo sapiens
tgaaataccaacctgaagaca

SEQ ID NO: 3153732 - DNA, 16 bp, Homo sapiens
tgaaatacctttgtag

SEQ ID NO: 3153733 - DNA, 17 bp, Homo sapiens
tgaaatacctttgtagt

SEQ ID NO: 3153734 - DNA, 18 bp, Homo sapiens
tgaaatacctttgtagtt

SEQ ID NO: 3153735 - DNA, 23 bp, Homo sapiens
tgaaatacctttgtagttactca

SEQ ID NO: 3153736 - DNA, 18 bp, Homo sapiens
tgaaatactttttaacaa

SEQ ID NO: 3153737 - DNA, 18 bp, Homo sapiens
tgaaatagtctgtgtgaa

SEQ ID NO: 3153738 - DNA, 16 bp, Homo sapiens
tgaaatagttcaaact

SEQ ID NO: 3153739 - DNA, 11 bp, Homo sapiens
tgaaatataat

SEQ ID NO: 3153740 - DNA, 12 bp, Homo sapiens
tgaaatatgcat

SEQ ID NO: 3153741 - DNA, 18 bp, Homo sapiens
tgaaatcatcaaaaagaa

SEQ ID NO: 3153742 - DNA, 20 bp, Homo sapiens
tgaaatccttgactggacct

SEQ ID NO: 3153743 - DNA, 19 bp, Homo sapiens
tgaaatctcagaattcctt

SEQ ID NO: 3153744 - DNA, 21 bp, Homo sapiens
tgaaatctcagaatttatctc

SEQ ID NO: 3153745 - DNA, 18 bp, Homo sapiens
tgaaatcttcccatgcat

SEQ ID NO: 3153746 - DNA, 19 bp, Homo sapiens
tgaaatcttcccatgcatt

SEQ ID NO: 3153747 - DNA, 16 bp, Homo sapiens
tgaaatgaaatttaaa

SEQ ID NO: 3153748 - DNA, 17 bp, Homo sapiens
tgaaatgagcacctcca

SEQ ID NO: 3153749 - DNA, 16 bp, Homo sapiens
tgaaatgagcatgcat

SEQ ID NO: 3153750 - DNA, 19 bp, Homo sapiens
tgaaatgaggtcagagcct

SEQ ID NO: 3153751 - DNA, 20 bp, Homo sapiens
tgaaatgaggtcagagcctg

SEQ ID NO: 3153752 - DNA, 21 bp, Homo sapiens
tgaaatgaggtcagagcctgc

SEQ ID NO: 3153753 - DNA, 22 bp, Homo sapiens
tgaaatgaggtcagagcctgca

SEQ ID NO: 3153754 - DNA, 16 bp, Homo sapiens
tgaaatgctggcattt

SEQ ID NO: 3153755 - DNA, 16 bp, Homo sapiens
tgaaatggaggtcctt

SEQ ID NO: 3153756 - DNA, 19 bp, Homo sapiens
tgaaatggatactacatct

SEQ ID NO: 3153757 - DNA, 21 bp, Homo sapiens
tgaaatgtcccctcaaactca

SEQ ID NO: 3153758 - DNA, 22 bp, Homo sapiens
tgaaatgttacatgtagaaaaa

SEQ ID NO: 3153759 - DNA, 14 bp, Homo sapiens
tgaaattactgtgt

SEQ ID NO: 3153760 - DNA, 15 bp, Homo sapiens
tgaaattactgtgta

SEQ ID NO: 3153761 - DNA, 16 bp, Homo sapiens
tgaaattactgtgtaa

SEQ ID NO: 3153762 - DNA, 18 bp, Homo sapiens
tgaaattactgtgtaaat

SEQ ID NO: 3153763 - DNA, 18 bp, Homo sapiens
tgaaattatagtttcaag

SEQ ID NO: 3153764 - DNA, 19 bp, Homo sapiens
tgaaattattttctccaaa

SEQ ID NO: 3153765 - DNA, 14 bp, Homo sapiens
tgaaattctcctgg

SEQ ID NO: 3153766 - DNA, 15 bp, Homo sapiens
tgaaattctcctgga

SEQ ID NO: 3153767 - DNA, 17 bp, Homo sapiens
tgaaattgcatactttg

SEQ ID NO: 3153768 - DNA, 18 bp, Homo sapiens
tgaaattgtttaagtgtt

SEQ ID NO: 3153769 - DNA, 18 bp, Homo sapiens
tgaaatttaaacattaaa

SEQ ID NO: 3153770 - DNA, 20 bp, Homo sapiens
tgaaatttattagttaatat

SEQ ID NO: 3153771 - DNA, 18 bp, Homo sapiens
tgaaatttattcacatat

SEQ ID NO: 3153772 - DNA, 14 bp, Homo sapiens
tgaaattttaacct

SEQ ID NO: 3153773 - DNA, 14 bp, Homo sapiens
tgaaattttagaaa

SEQ ID NO: 3153774 - DNA, 18 bp, Homo sapiens
tgaaattttagaaatatt

SEQ ID NO: 3153775 - DNA, 20 bp, Homo sapiens
tgaaattttgcaaatataaa

SEQ ID NO: 3153776 - DNA, 20 bp, Homo sapiens
tgaaatttttattaaattat

SEQ ID NO: 3153777 - DNA, 18 bp, Homo sapiens
tgaaatttttttcctaag

SEQ ID NO: 3153778 - DNA, 15 bp, Homo sapiens
tgaacaaaattattt

SEQ ID NO: 3153779 - DNA, 20 bp, Homo sapiens
tgaacaaatcttgggtgggt

SEQ ID NO: 3153780 - DNA, 12 bp, Homo sapiens
tgaacaagaatt

SEQ ID NO: 3153781 - DNA, 23 bp, Homo sapiens
tgaacaagtgggccattagccag

SEQ ID NO: 3153782 - DNA, 17 bp, Homo sapiens
tgaacacaggcagcttt

SEQ ID NO: 3153783 - DNA, 20 bp, Homo sapiens
tgaacacaggcagctttcta

SEQ ID NO: 3153784 - DNA, 11 bp, Homo sapiens
tgaacacagta

SEQ ID NO: 3153785 - DNA, 20 bp, Homo sapiens
tgaacagaaaacattctgat

SEQ ID NO: 3153786 - DNA, 12 bp, Homo sapiens
tgaacagtggag

SEQ ID NO: 3153787 - DNA, 16 bp, Homo sapiens
tgaacatacttcaaaa

SEQ ID NO: 3153788 - DNA, 20 bp, Homo sapiens
tgaacatagactagagaaac

SEQ ID NO: 3153789 - DNA, 17 bp, Homo sapiens
tgaacatcccctcccat

SEQ ID NO: 3153790 - DNA, 20 bp, Homo sapiens
tgaacatgtgccttttctga

SEQ ID NO: 3153791 - DNA, 21 bp, Homo sapiens
tgaacatgtgccttttctgaa

SEQ ID NO: 3153792 - DNA, 17 bp, Homo sapiens
tgaacatgtttacaggt

SEQ ID NO: 3153793 - DNA, 19 bp, Homo sapiens
tgaacattttaatgggttt

SEQ ID NO: 3153794 - DNA, 15 bp, Homo sapiens
tgaaccaatctggat

SEQ ID NO: 3153795 - DNA, 23 bp, Homo sapiens
tgaaccacatcttgctctgctga

SEQ ID NO: 3153796 - DNA, 16 bp, Homo sapiens
tgaaccacttcattct

SEQ ID NO: 3153797 - DNA, 22 bp, Homo sapiens
tgaaccagctcatctccaagga

SEQ ID NO: 3153798 - DNA, 21 bp, Homo sapiens
tgaaccatcattataaacgtg

SEQ ID NO: 3153799 - DNA, 21 bp, Homo sapiens
tgaacccaggacgcttctgaa

SEQ ID NO: 3153800 - DNA, 22 bp, Homo sapiens
tgaacccaggacgcttctgaat

SEQ ID NO: 3153801 - DNA, 14 bp, Homo sapiens
tgaacccctgtgtc

SEQ ID NO: 3153802 - DNA, 13 bp, Homo sapiens
tgaacccttgctt

SEQ ID NO: 3153803 - DNA, 17 bp, Homo sapiens
tgaacccttgtgcttgg

SEQ ID NO: 3153804 - DNA, 13 bp, Homo sapiens
tgaaccctttgtt

SEQ ID NO: 3153805 - DNA, 14 bp, Homo sapiens
tgaaccgcacagct

SEQ ID NO: 3153806 - DNA, 14 bp, Homo sapiens
tgaacctaccttca

SEQ ID NO: 3153807 - DNA, 20 bp, Homo sapiens
tgaacctattttcatttgta

SEQ ID NO: 3153808 - DNA, 13 bp, Homo sapiens
tgaacctggatcc

SEQ ID NO: 3153809 - DNA, 20 bp, Homo sapiens
tgaacctttttttttgaaac

SEQ ID NO: 3153810 - DNA, 15 bp, Homo sapiens
tgaacgcaggagaat

SEQ ID NO: 3153811 - DNA, 14 bp, Homo sapiens
tgaactaagaaact

SEQ ID NO: 3153812 - DNA, 21 bp, Homo sapiens
tgaactacgcttgctcatttt

SEQ ID NO: 3153813 - DNA, 21 bp, Homo sapiens
tgaactatgtcgatgcacagt

SEQ ID NO: 3153814 - DNA, 16 bp, Homo sapiens
tgaactcaaactgagg

SEQ ID NO: 3153815 - DNA, 18 bp, Homo sapiens
tgaactcaaactgaggaa

SEQ ID NO: 3153816 - DNA, 21 bp, Homo sapiens
tgaactcaccctgggagccag

SEQ ID NO: 3153817 - DNA, 12 bp, Homo sapiens
tgaactcctggc

SEQ ID NO: 3153818 - DNA, 16 bp, Homo sapiens
tgaactcctggcctca

SEQ ID NO: 3153819 - DNA, 12 bp, Homo sapiens
tgaactctcaaa

SEQ ID NO: 3153820 - DNA, 22 bp, Homo sapiens
tgaactctcaaaagtctatttt

SEQ ID NO: 3153821 - DNA, 16 bp, Homo sapiens
tgaactctgttccccc

SEQ ID NO: 3153822 - DNA, 19 bp, Homo sapiens
tgaactctgttcccccacc

SEQ ID NO: 3153823 - DNA, 21 bp, Homo sapiens
tgaactctgttcccccaccct

SEQ ID NO: 3153824 - DNA, 21 bp, Homo sapiens
tgaactcttaatcaaatagca

SEQ ID NO: 3153825 - DNA, 12 bp, Homo sapiens
tgaactcttaga

SEQ ID NO: 3153826 - DNA, 20 bp, Homo sapiens
tgaactctttctggcctgcc

SEQ ID NO: 3153827 - DNA, 22 bp, Homo sapiens
tgaactctttctggcctgcctt

SEQ ID NO: 3153828 - DNA, 23 bp, Homo sapiens
tgaactctttctggcctgccttc

SEQ ID NO: 3153829 - DNA, 18 bp, Homo sapiens
tgaactgcaacaacgcct

SEQ ID NO: 3153830 - DNA, 14 bp, Homo sapiens
tgaactgcccactg

SEQ ID NO: 3153831 - DNA, 18 bp, Homo sapiens
tgaactgctggagtctgg

SEQ ID NO: 3153832 - DNA, 20 bp, Homo sapiens
tgaactgctggagtctggct

SEQ ID NO: 3153833 - DNA, 14 bp, Homo sapiens
tgaactggaagaaa

SEQ ID NO: 3153834 - DNA, 16 bp, Homo sapiens
tgaactggaagaaagc

SEQ ID NO: 3153835 - DNA, 17 bp, Homo sapiens
tgaactggaagaaagca

SEQ ID NO: 3153836 - DNA, 17 bp, Homo sapiens
tgaactggcaattgtct

SEQ ID NO: 3153837 - DNA, 13 bp, Homo sapiens
tgaactggttcat

SEQ ID NO: 3153838 - DNA, 15 bp, Homo sapiens
tgaactgttgtctgg

SEQ ID NO: 3153839 - DNA, 16 bp, Homo sapiens
tgaacttacacttgga

SEQ ID NO: 3153840 - DNA, 18 bp, Homo sapiens
tgaacttctctcagactt

SEQ ID NO: 3153841 - DNA, 14 bp, Homo sapiens
tgaacttggctttc

SEQ ID NO: 3153842 - DNA, 22 bp, Homo sapiens
tgaacttggctttcctgtttct

SEQ ID NO: 3153843 - DNA, 23 bp, Homo sapiens
tgaacttggctttcctgtttcta

SEQ ID NO: 3153844 - DNA, 16 bp, Homo sapiens
tgaacttgtagctgta

SEQ ID NO: 3153845 - DNA, 17 bp, Homo sapiens
tgaacttgtagctgtaa

SEQ ID NO: 3153846 - DNA, 18 bp, Homo sapiens
tgaacttgtagctgtaaa

SEQ ID NO: 3153847 - DNA, 18 bp, Homo sapiens
tgaacttgttacttgcag

SEQ ID NO: 3153848 - DNA, 14 bp, Homo sapiens
tgaactttcattgg

SEQ ID NO: 3153849 - DNA, 21 bp, Homo sapiens
tgaactttcattggatttttg

SEQ ID NO: 3153850 - DNA, 14 bp, Homo sapiens
tgaactttctccct

SEQ ID NO: 3153851 - DNA, 16 bp, Homo sapiens
tgaactttctccctca

SEQ ID NO: 3153852 - DNA, 18 bp, Homo sapiens
tgaactttgccaaaaaaa

SEQ ID NO: 3153853 - DNA, 13 bp, Homo sapiens
tgaagaaaaagta

SEQ ID NO: 3153854 - DNA, 15 bp, Homo sapiens
tgaagaaaatcactt

SEQ ID NO: 3153855 - DNA, 21 bp, Homo sapiens
tgaagaaacagagtggcctcc

SEQ ID NO: 3153856 - DNA, 21 bp, Homo sapiens
tgaagaaaccttcagatttgt

SEQ ID NO: 3153857 - DNA, 17 bp, Homo sapiens
tgaagaacacagcatgt

SEQ ID NO: 3153858 - DNA, 13 bp, Homo sapiens
tgaagaacatgtg

SEQ ID NO: 3153859 - DNA, 13 bp, Homo sapiens
tgaagaactgagg

SEQ ID NO: 3153860 - DNA, 14 bp, Homo sapiens
tgaagaactgcagg

SEQ ID NO: 3153861 - DNA, 20 bp, Homo sapiens
tgaagaactgttgcctaatt

SEQ ID NO: 3153862 - DNA, 16 bp, Homo sapiens
tgaagaaggaagctgt

SEQ ID NO: 3153863 - DNA, 19 bp, Homo sapiens
tgaagaaggaagctgtgtt

SEQ ID NO: 3153864 - DNA, 23 bp, Homo sapiens
tgaagaaggaagctgtgttgaaa

SEQ ID NO: 3153865 - DNA, 20 bp, Homo sapiens
tgaagaatacagttaggcac

SEQ ID NO: 3153866 - DNA, 13 bp, Homo sapiens
tgaagaatattta

SEQ ID NO: 3153867 - DNA, 18 bp, Homo sapiens
tgaagaatatttaagaaa

SEQ ID NO: 3153868 - DNA, 19 bp, Homo sapiens
tgaagaatatttaagaaaa

SEQ ID NO: 3153869 - DNA, 22 bp, Homo sapiens
tgaagaatatttaagaaaagca

SEQ ID NO: 3153870 - DNA, 18 bp, Homo sapiens
tgaagaatgcattcaaaa

SEQ ID NO: 3153871 - DNA, 15 bp, Homo sapiens
tgaagaatgtctgta

SEQ ID NO: 3153872 - DNA, 19 bp, Homo sapiens
tgaagaatgtctgtacctt

SEQ ID NO: 3153873 - DNA, 20 bp, Homo sapiens
tgaagacattttttgctata

SEQ ID NO: 3153874 - DNA, 21 bp, Homo sapiens
tgaagacattttttgctataa

SEQ ID NO: 3153875 - DNA, 15 bp, Homo sapiens
tgaagaccatggatt

SEQ ID NO: 3153876 - DNA, 20 bp, Homo sapiens
tgaagactcattcttctgta

SEQ ID NO: 3153877 - DNA, 15 bp, Homo sapiens
tgaagactgagaact

SEQ ID NO: 3153878 - DNA, 18 bp, Homo sapiens
tgaagactggaagctaat

SEQ ID NO: 3153879 - DNA, 17 bp, Homo sapiens
tgaagagacagttattt

SEQ ID NO: 3153880 - DNA, 20 bp, Homo sapiens
tgaagagagggacaggcact

SEQ ID NO: 3153881 - DNA, 21 bp, Homo sapiens
tgaagagatttcaacaagaat

SEQ ID NO: 3153882 - DNA, 22 bp, Homo sapiens
tgaagagccagaagtgaagagt

SEQ ID NO: 3153883 - DNA, 15 bp, Homo sapiens
tgaagagcttgcttt

SEQ ID NO: 3153884 - DNA, 16 bp, Homo sapiens
tgaagagcttgctttg

SEQ ID NO: 3153885 - DNA, 20 bp, Homo sapiens
tgaagaggcgggccagccag

SEQ ID NO: 3153886 - DNA, 17 bp, Homo sapiens
tgaagaggcttctcctg

SEQ ID NO: 3153887 - DNA, 13 bp, Homo sapiens
tgaagaggggcag

SEQ ID NO: 3153888 - DNA, 14 bp, Homo sapiens
tgaagaggggcagc

SEQ ID NO: 3153889 - DNA, 20 bp, Homo sapiens
tgaagaggggcagcccttgc

SEQ ID NO: 3153890 - DNA, 15 bp, Homo sapiens
tgaagagtatccttc

SEQ ID NO: 3153891 - DNA, 15 bp, Homo sapiens
tgaagatcagaacat

SEQ ID NO: 3153892 - DNA, 21 bp, Homo sapiens
tgaagatcagaacattcagct

SEQ ID NO: 3153893 - DNA, 19 bp, Homo sapiens
tgaagatgaagaagccttt

SEQ ID NO: 3153894 - DNA, 16 bp, Homo sapiens
tgaagatgggaacgca

SEQ ID NO: 3153895 - DNA, 21 bp, Homo sapiens
tgaagatggtttcaattcaga

SEQ ID NO: 3153896 - DNA, 14 bp, Homo sapiens
tgaagatgtttact

SEQ ID NO: 3153897 - DNA, 23 bp, Homo sapiens
tgaagatgtttactcattgcccc

SEQ ID NO: 3153898 - DNA, 19 bp, Homo sapiens
tgaagattaacactaatta

SEQ ID NO: 3153899 - DNA, 21 bp, Homo sapiens
tgaagattaggagaaacacat

SEQ ID NO: 3153900 - DNA, 14 bp, Homo sapiens
tgaagcaaatcaga

SEQ ID NO: 3153901 - DNA, 18 bp, Homo sapiens
tgaagcaaatcagaaact

SEQ ID NO: 3153902 - DNA, 21 bp, Homo sapiens
tgaagcaaggaagatatacat

SEQ ID NO: 3153903 - DNA, 16 bp, Homo sapiens
tgaagcagatttattt

SEQ ID NO: 3153904 - DNA, 19 bp, Homo sapiens
tgaagcagatttatttttg

SEQ ID NO: 3153905 - DNA, 17 bp, Homo sapiens
tgaagcagctttaaaca

SEQ ID NO: 3153906 - DNA, 17 bp, Homo sapiens
tgaagcagggtttcttt

SEQ ID NO: 3153907 - DNA, 16 bp, Homo sapiens
tgaagcagtcttgctc

SEQ ID NO: 3153908 - DNA, 17 bp, Homo sapiens
tgaagcagtcttgctct

SEQ ID NO: 3153909 - DNA, 20 bp, Homo sapiens
tgaagcagtcttgctctgtt

SEQ ID NO: 3153910 - DNA, 18 bp, Homo sapiens
tgaagcagtgcctcgagg

SEQ ID NO: 3153911 - DNA, 21 bp, Homo sapiens
tgaagcagtgcctcgaggcac

SEQ ID NO: 3153912 - DNA, 14 bp, Homo sapiens
tgaagcagttgtgt

SEQ ID NO: 3153913 - DNA, 17 bp, Homo sapiens
tgaagcagttgtgtcag

SEQ ID NO: 3153914 - DNA, 17 bp, Homo sapiens
tgaagcatagataatat

SEQ ID NO: 3153915 - DNA, 14 bp, Homo sapiens
tgaagcatgtttca

SEQ ID NO: 3153916 - DNA, 16 bp, Homo sapiens
tgaagcatgtttcatg

SEQ ID NO: 3153917 - DNA, 21 bp, Homo sapiens
tgaagcattctccccagtgta

SEQ ID NO: 3153918 - DNA, 23 bp, Homo sapiens
tgaagccaagtggggtgctggga

SEQ ID NO: 3153919 - DNA, 13 bp, Homo sapiens
tgaagccagcctt

SEQ ID NO: 3153920 - DNA, 21 bp, Homo sapiens
tgaagcccaggctgatgcttg

SEQ ID NO: 3153921 - DNA, 22 bp, Homo sapiens
tgaagccctccaaaagcactta

SEQ ID NO: 3153922 - DNA, 15 bp, Homo sapiens
tgaagccgactctgg

SEQ ID NO: 3153923 - DNA, 13 bp, Homo sapiens
tgaagcctgccct

SEQ ID NO: 3153924 - DNA, 19 bp, Homo sapiens
tgaagctatttatctgtag

SEQ ID NO: 3153925 - DNA, 16 bp, Homo sapiens
tgaagctcacttctgg

SEQ ID NO: 3153926 - DNA, 14 bp, Homo sapiens
tgaagctgcagtga

SEQ ID NO: 3153927 - DNA, 15 bp, Homo sapiens
tgaagctgttgtgtg

SEQ ID NO: 3153928 - DNA, 16 bp, Homo sapiens
tgaagctgttgtgtga

SEQ ID NO: 3153929 - DNA, 14 bp, Homo sapiens
tgaagcttgactcc

SEQ ID NO: 3153930 - DNA, 14 bp, Homo sapiens
tgaagctttatacg

SEQ ID NO: 3153931 - DNA, 21 bp, Homo sapiens
tgaaggaaaaacacaagcaaa

SEQ ID NO: 3153932 - DNA, 13 bp, Homo sapiens
tgaaggaagaggg

SEQ ID NO: 3153933 - DNA, 20 bp, Homo sapiens
tgaaggaagccaaatttatc

SEQ ID NO: 3153934 - DNA, 22 bp, Homo sapiens
tgaaggaagccaaatttatcaa

SEQ ID NO: 3153935 - DNA, 19 bp, Homo sapiens
tgaaggaatagccagagag

SEQ ID NO: 3153936 - DNA, 19 bp, Homo sapiens
tgaaggaatcattccagtg

SEQ ID NO: 3153937 - DNA, 10 bp, Homo sapiens
tgaaggaatt

SEQ ID NO: 3153938 - DNA, 19 bp, Homo sapiens
tgaaggacattgcggacag

SEQ ID NO: 3153939 - DNA, 18 bp, Homo sapiens
tgaaggacttagccgact

SEQ ID NO: 3153940 - DNA, 20 bp, Homo sapiens
tgaaggagagcccttcattt

SEQ ID NO: 3153941 - DNA, 18 bp, Homo sapiens
tgaaggaggtgagagaag

SEQ ID NO: 3153942 - DNA, 21 bp, Homo sapiens
tgaaggattatggaaaaataa

SEQ ID NO: 3153943 - DNA, 18 bp, Homo sapiens
tgaaggcaaaattgcaaa

SEQ ID NO: 3153944 - DNA, 18 bp, Homo sapiens
tgaaggcagtctgaaccc

SEQ ID NO: 3153945 - DNA, 19 bp, Homo sapiens
tgaaggcagtctgaaccct

SEQ ID NO: 3153946 - DNA, 14 bp, Homo sapiens
tgaaggcctggctg

SEQ ID NO: 3153947 - DNA, 17 bp, Homo sapiens
tgaaggcctggctggaa

SEQ ID NO: 3153948 - DNA, 23 bp, Homo sapiens
tgaaggctctcacccccatccct

SEQ ID NO: 3153949 - DNA, 22 bp, Homo sapiens
tgaagggaaaggatattttctt

SEQ ID NO: 3153950 - DNA, 9 bp, Homo sapiens
tgaagggag

SEQ ID NO: 3153951 - DNA, 12 bp, Homo sapiens
tgaagggagaag

SEQ ID NO: 3153952 - DNA, 14 bp, Homo sapiens
tgaagggagagcca

SEQ ID NO: 3153953 - DNA, 17 bp, Homo sapiens
tgaagggagagccagct

SEQ ID NO: 3153954 - DNA, 17 bp, Homo sapiens
tgaagggcattctttcc

SEQ ID NO: 3153955 - DNA, 13 bp, Homo sapiens
tgaagggcccagg

SEQ ID NO: 3153956 - DNA, 15 bp, Homo sapiens
tgaaggtaattaaag

SEQ ID NO: 3153957 - DNA, 23 bp, Homo sapiens
tgaaggtagcattctttggagtt

SEQ ID NO: 3153958 - DNA, 20 bp, Homo sapiens
tgaaggtctttgttatgaca

SEQ ID NO: 3153959 - DNA, 15 bp, Homo sapiens
tgaaggtggggagaa

SEQ ID NO: 3153960 - DNA, 18 bp, Homo sapiens
tgaaggttttaagtggtt

SEQ ID NO: 3153961 - DNA, 14 bp, Homo sapiens
tgaagtaaactttt

SEQ ID NO: 3153962 - DNA, 19 bp, Homo sapiens
tgaagtaaaggattgatca

SEQ ID NO: 3153963 - DNA, 18 bp, Homo sapiens
tgaagtaacatgcatact

SEQ ID NO: 3153964 - DNA, 20 bp, Homo sapiens
tgaagtacatattaggaaaa

SEQ ID NO: 3153965 - DNA, 13 bp, Homo sapiens
tgaagtatacttt

SEQ ID NO: 3153966 - DNA, 14 bp, Homo sapiens
tgaagtatactttt

SEQ ID NO: 3153967 - DNA, 21 bp, Homo sapiens
tgaagtatacttttcccctgt

SEQ ID NO: 3153968 - DNA, 20 bp, Homo sapiens
tgaagtattttgctggaata

SEQ ID NO: 3153969 - DNA, 19 bp, Homo sapiens
tgaagtcaccgggatgaac

SEQ ID NO: 3153970 - DNA, 14 bp, Homo sapiens
tgaagtcaccttgt

SEQ ID NO: 3153971 - DNA, 14 bp, Homo sapiens
tgaagtcactgcac

SEQ ID NO: 3153972 - DNA, 15 bp, Homo sapiens
tgaagtcactgcaca

SEQ ID NO: 3153973 - DNA, 23 bp, Homo sapiens
tgaagtcagcgggcccaggccta

SEQ ID NO: 3153974 - DNA, 13 bp, Homo sapiens
tgaagtgcgtgaa

SEQ ID NO: 3153975 - DNA, 17 bp, Homo sapiens
tgaagtgcgtgaatgta

SEQ ID NO: 3153976 - DNA, 18 bp, Homo sapiens
tgaagtggttgcattcta

SEQ ID NO: 3153977 - DNA, 16 bp, Homo sapiens
tgaagtgtacctgtgt

SEQ ID NO: 3153978 - DNA, 19 bp, Homo sapiens
tgaagtgtgtggctgggcg

SEQ ID NO: 3153979 - DNA, 15 bp, Homo sapiens
tgaagttagtggaaa

SEQ ID NO: 3153980 - DNA, 16 bp, Homo sapiens
tgaagttatgctgtca

SEQ ID NO: 3153981 - DNA, 16 bp, Homo sapiens
tgaagttcatggtgat

SEQ ID NO: 3153982 - DNA, 19 bp, Homo sapiens
tgaagttcatggtgatcag

SEQ ID NO: 3153983 - DNA, 14 bp, Homo sapiens
tgaagttctcctga

SEQ ID NO: 3153984 - DNA, 14 bp, Homo sapiens
tgaagttgctgttt

SEQ ID NO: 3153985 - DNA, 16 bp, Homo sapiens
tgaagttggcacattt

SEQ ID NO: 3153986 - DNA, 18 bp, Homo sapiens
tgaagttggcacatttca

SEQ ID NO: 3153987 - DNA, 13 bp, Homo sapiens
tgaagtttcaagt

SEQ ID NO: 3153988 - DNA, 13 bp, Homo sapiens
tgaagtttcacat

SEQ ID NO: 3153989 - DNA, 15 bp, Homo sapiens
tgaagttttacattg

SEQ ID NO: 3153990 - DNA, 16 bp, Homo sapiens
tgaagttttactgtct

SEQ ID NO: 3153991 - DNA, 16 bp, Homo sapiens
tgaagtttttgaaata

SEQ ID NO: 3153992 - DNA, 11 bp, Homo sapiens
tgaataaaaca

SEQ ID NO: 3153993 - DNA, 14 bp, Homo sapiens
tgaataaactgaat

SEQ ID NO: 3153994 - DNA, 15 bp, Homo sapiens
tgaataaactgaata

SEQ ID NO: 3153995 - DNA, 16 bp, Homo sapiens
tgaataaactgaatat

SEQ ID NO: 3153996 - DNA, 14 bp, Homo sapiens
tgaataaagacacc

SEQ ID NO: 3153997 - DNA, 17 bp, Homo sapiens
tgaataaagttgaagct

SEQ ID NO: 3153998 - DNA, 12 bp, Homo sapiens
tgaataaatgtc

SEQ ID NO: 3153999 - DNA, 14 bp, Homo sapiens
tgaataaatgtctt

SEQ ID NO: 3154000 - DNA, 19 bp, Homo sapiens
tgaataaattctataggaa

SEQ ID NO: 3154001 - DNA, 15 bp, Homo sapiens
tgaataacttgaaga

SEQ ID NO: 3154002 - DNA, 13 bp, Homo sapiens
tgaataattgcat

SEQ ID NO: 3154003 - DNA, 18 bp, Homo sapiens
tgaatacaattaaaggtc

SEQ ID NO: 3154004 - DNA, 18 bp, Homo sapiens
tgaatacattaaaagaag

SEQ ID NO: 3154005 - DNA, 12 bp, Homo sapiens
tgaataccactt

SEQ ID NO: 3154006 - DNA, 19 bp, Homo sapiens
tgaataccacttacctcaa

SEQ ID NO: 3154007 - DNA, 21 bp, Homo sapiens
tgaataccattaaaactgctt

SEQ ID NO: 3154008 - DNA, 23 bp, Homo sapiens
tgaataccattaaaactgctttt

SEQ ID NO: 3154009 - DNA, 23 bp, Homo sapiens
tgaatacttactataatttgact

SEQ ID NO: 3154010 - DNA, 13 bp, Homo sapiens
tgaatacttattt

SEQ ID NO: 3154011 - DNA, 20 bp, Homo sapiens
tgaatacttattttcagtgc

SEQ ID NO: 3154012 - DNA, 13 bp, Homo sapiens
tgaatactttctt

SEQ ID NO: 3154013 - DNA, 16 bp, Homo sapiens
tgaatactttttacaa

SEQ ID NO: 3154014 - DNA, 16 bp, Homo sapiens
tgaatagatgtgatca

SEQ ID NO: 3154015 - DNA, 16 bp, Homo sapiens
tgaataggtagtatca

SEQ ID NO: 3154016 - DNA, 13 bp, Homo sapiens
tgaatataaaaaa

SEQ ID NO: 3154017 - DNA, 14 bp, Homo sapiens
tgaatataagaaaa

SEQ ID NO: 3154018 - DNA, 15 bp, Homo sapiens
tgaatataagaaaat

SEQ ID NO: 3154019 - DNA, 17 bp, Homo sapiens
tgaatatagcctgcctc

SEQ ID NO: 3154020 - DNA, 18 bp, Homo sapiens
tgaatatagcctgcctca

SEQ ID NO: 3154021 - DNA, 14 bp, Homo sapiens
tgaatatctattaa

SEQ ID NO: 3154022 - DNA, 18 bp, Homo sapiens
tgaatatctattaatata

SEQ ID NO: 3154023 - DNA, 17 bp, Homo sapiens
tgaatattgaagtttca

SEQ ID NO: 3154024 - DNA, 18 bp, Homo sapiens
tgaatatttataacagca

SEQ ID NO: 3154025 - DNA, 19 bp, Homo sapiens
tgaatatttataacagcat

SEQ ID NO: 3154026 - DNA, 21 bp, Homo sapiens
tgaatatttccatatggattt

SEQ ID NO: 3154027 - DNA, 16 bp, Homo sapiens
tgaatattttgataat

SEQ ID NO: 3154028 - DNA, 17 bp, Homo sapiens
tgaatattttggaaact

SEQ ID NO: 3154029 - DNA, 14 bp, Homo sapiens
tgaatcaatgaaaa

SEQ ID NO: 3154030 - DNA, 15 bp, Homo sapiens
tgaatcctaagggct

SEQ ID NO: 3154031 - DNA, 20 bp, Homo sapiens
tgaatcgcttgcttgttgaa

SEQ ID NO: 3154032 - DNA, 23 bp, Homo sapiens
tgaatctgattggacattttctt

SEQ ID NO: 3154033 - DNA, 16 bp, Homo sapiens
tgaatctgctcacttt

SEQ ID NO: 3154034 - DNA, 18 bp, Homo sapiens
tgaatctggtgttgggga

SEQ ID NO: 3154035 - DNA, 18 bp, Homo sapiens
tgaatctgtgcaaacagt

SEQ ID NO: 3154036 - DNA, 21 bp, Homo sapiens
tgaatctgtgcaaacagtaac

SEQ ID NO: 3154037 - DNA, 13 bp, Homo sapiens
tgaatcttaattt

SEQ ID NO: 3154038 - DNA, 20 bp, Homo sapiens
tgaatgaaaaatttaagcat

SEQ ID NO: 3154039 - DNA, 21 bp, Homo sapiens
tgaatgaaaaatttaagcatt

SEQ ID NO: 3154040 - DNA, 12 bp, Homo sapiens
tgaatgaaaaca

SEQ ID NO: 3154041 - DNA, 14 bp, Homo sapiens
tgaatgaaaacatt

SEQ ID NO: 3154042 - DNA, 16 bp, Homo sapiens
tgaatgaaaataactg

SEQ ID NO: 3154043 - DNA, 21 bp, Homo sapiens
tgaatgaaaataactgaacca

SEQ ID NO: 3154044 - DNA, 14 bp, Homo sapiens
tgaatgaaagatta

SEQ ID NO: 3154045 - DNA, 14 bp, Homo sapiens
tgaatgaaatatca

SEQ ID NO: 3154046 - DNA, 14 bp, Homo sapiens
tgaatgagaatcta

SEQ ID NO: 3154047 - DNA, 19 bp, Homo sapiens
tgaatgatttgtgtttctt

SEQ ID NO: 3154048 - DNA, 20 bp, Homo sapiens
tgaatgcaaaattgttttca

SEQ ID NO: 3154049 - DNA, 15 bp, Homo sapiens
tgaatgcacgtttca

SEQ ID NO: 3154050 - DNA, 17 bp, Homo sapiens
tgaatgccggggacaga

SEQ ID NO: 3154051 - DNA, 14 bp, Homo sapiens
tgaatgccgtggat

SEQ ID NO: 3154052 - DNA, 13 bp, Homo sapiens
tgaatgcctcctg

SEQ ID NO: 3154053 - DNA, 16 bp, Homo sapiens
tgaatgcctcctgtgg

SEQ ID NO: 3154054 - DNA, 17 bp, Homo sapiens
tgaatgcctcctgtggg

SEQ ID NO: 3154055 - DNA, 22 bp, Homo sapiens
tgaatgcgctttattgcccatg

SEQ ID NO: 3154056 - DNA, 12 bp, Homo sapiens
tgaatgctggga

SEQ ID NO: 3154057 - DNA, 15 bp, Homo sapiens
tgaatggcctgcctt

SEQ ID NO: 3154058 - DNA, 20 bp, Homo sapiens
tgaatggtgttgtatgcctt

SEQ ID NO: 3154059 - DNA, 21 bp, Homo sapiens
tgaatggttccatgcctgagg

SEQ ID NO: 3154060 - DNA, 15 bp, Homo sapiens
tgaatgtaaaagaaa

SEQ ID NO: 3154061 - DNA, 14 bp, Homo sapiens
tgaatgtaatttgt

SEQ ID NO: 3154062 - DNA, 18 bp, Homo sapiens
tgaatgtaatttgtgtaa

SEQ ID NO: 3154063 - DNA, 16 bp, Homo sapiens
tgaatgtatcaggaaa

SEQ ID NO: 3154064 - DNA, 20 bp, Homo sapiens
tgaatgtatttatgtgtata

SEQ ID NO: 3154065 - DNA, 15 bp, Homo sapiens
tgaatgtatttattt

SEQ ID NO: 3154066 - DNA, 17 bp, Homo sapiens
tgaatgtatttatttgg

SEQ ID NO: 3154067 - DNA, 18 bp, Homo sapiens
tgaatgtcaatatgagat

SEQ ID NO: 3154068 - DNA, 17 bp, Homo sapiens
tgaatgtcacaaattga

SEQ ID NO: 3154069 - DNA, 16 bp, Homo sapiens
tgaatgtctaaaattg

SEQ ID NO: 3154070 - DNA, 18 bp, Homo sapiens
tgaatgtggcttgagaaa

SEQ ID NO: 3154071 - DNA, 16 bp, Homo sapiens
tgaatgtgggcactgg

SEQ ID NO: 3154072 - DNA, 12 bp, Homo sapiens
tgaatgttacaa

SEQ ID NO: 3154073 - DNA, 19 bp, Homo sapiens
tgaatgttcaatctgtgta

SEQ ID NO: 3154074 - DNA, 21 bp, Homo sapiens
tgaatgttctgacattaacag

SEQ ID NO: 3154075 - DNA, 21 bp, Homo sapiens
tgaatgttgtctgtttgttct

SEQ ID NO: 3154076 - DNA, 22 bp, Homo sapiens
tgaatgtttacactctttgtaa

SEQ ID NO: 3154077 - DNA, 16 bp, Homo sapiens
tgaattaaaaaagctc

SEQ ID NO: 3154078 - DNA, 16 bp, Homo sapiens
tgaattaaattaggaa

SEQ ID NO: 3154079 - DNA, 15 bp, Homo sapiens
tgaattaaatttaat

SEQ ID NO: 3154080 - DNA, 16 bp, Homo sapiens
tgaattaatatcccta

SEQ ID NO: 3154081 - DNA, 19 bp, Homo sapiens
tgaattaatatccctacat

SEQ ID NO: 3154082 - DNA, 16 bp, Homo sapiens
tgaattactgtatata

SEQ ID NO: 3154083 - DNA, 18 bp, Homo sapiens
tgaattaggctaaaaggt

SEQ ID NO: 3154084 - DNA, 20 bp, Homo sapiens
tgaattaggctgtaactact

SEQ ID NO: 3154085 - DNA, 22 bp, Homo sapiens
tgaattaggctgtaactacttt

SEQ ID NO: 3154086 - DNA, 15 bp, Homo sapiens
tgaattagtgagtat

SEQ ID NO: 3154087 - DNA, 14 bp, Homo sapiens
tgaattataacagt

SEQ ID NO: 3154088 - DNA, 22 bp, Homo sapiens
tgaattataacagttatatttt

SEQ ID NO: 3154089 - DNA, 20 bp, Homo sapiens
tgaattatcagcaaagaaaa

SEQ ID NO: 3154090 - DNA, 17 bp, Homo sapiens
tgaattatgcttccaca

SEQ ID NO: 3154091 - DNA, 13 bp, Homo sapiens
tgaattatgtgca

SEQ ID NO: 3154092 - DNA, 18 bp, Homo sapiens
tgaattattatatacata

SEQ ID NO: 3154093 - DNA, 19 bp, Homo sapiens
tgaattcaaagcttgtgaa

SEQ ID NO: 3154094 - DNA, 12 bp, Homo sapiens
tgaattcagatt

SEQ ID NO: 3154095 - DNA, 12 bp, Homo sapiens
tgaattgaagtt

SEQ ID NO: 3154096 - DNA, 19 bp, Homo sapiens
tgaattgaagtttcaagtt

SEQ ID NO: 3154097 - DNA, 12 bp, Homo sapiens
tgaattgtcttt

SEQ ID NO: 3154098 - DNA, 18 bp, Homo sapiens
tgaattgtcttttagaca

SEQ ID NO: 3154099 - DNA, 19 bp, Homo sapiens
tgaattgtcttttagacaa

SEQ ID NO: 3154100 - DNA, 20 bp, Homo sapiens
tgaatttagtgagatttacc

SEQ ID NO: 3154101 - DNA, 20 bp, Homo sapiens
tgaatttcttcactgttgaa

SEQ ID NO: 3154102 - DNA, 21 bp, Homo sapiens
tgaatttcttcactgttgaaa

SEQ ID NO: 3154103 - DNA, 23 bp, Homo sapiens
tgaatttcttcactgttgaaaat

SEQ ID NO: 3154104 - DNA, 19 bp, Homo sapiens
tgaatttgaatgaaaaatt

SEQ ID NO: 3154105 - DNA, 11 bp, Homo sapiens
tgaatttggag

SEQ ID NO: 3154106 - DNA, 15 bp, Homo sapiens
tgaatttggagactc

SEQ ID NO: 3154107 - DNA, 20 bp, Homo sapiens
tgaatttggagactctgtgg

SEQ ID NO: 3154108 - DNA, 13 bp, Homo sapiens
tgaatttgtactt

SEQ ID NO: 3154109 - DNA, 14 bp, Homo sapiens
tgaattttaaagta

SEQ ID NO: 3154110 - DNA, 16 bp, Homo sapiens
tgaattttaaagtatg

SEQ ID NO: 3154111 - DNA, 22 bp, Homo sapiens
tgaattttaaagtatgcattat

SEQ ID NO: 3154112 - DNA, 17 bp, Homo sapiens
tgaattttaaatctaaa

SEQ ID NO: 3154113 - DNA, 17 bp, Homo sapiens
tgaattttctaaaagct

SEQ ID NO: 3154114 - DNA, 14 bp, Homo sapiens
tgaattttgttgct

SEQ ID NO: 3154115 - DNA, 22 bp, Homo sapiens
tgaatttttaaaacccatttaa

SEQ ID NO: 3154116 - DNA, 15 bp, Homo sapiens
tgaatttttatttct

SEQ ID NO: 3154117 - DNA, 21 bp, Homo sapiens
tgaatttttatttctttttaa

SEQ ID NO: 3154118 - DNA, 21 bp, Homo sapiens
tgaattttttaaatgaaagaa

SEQ ID NO: 3154119 - DNA, 19 bp, Homo sapiens
tgacaaaaagtttccatat

SEQ ID NO: 3154120 - DNA, 12 bp, Homo sapiens
tgacaaactgtg

SEQ ID NO: 3154121 - DNA, 20 bp, Homo sapiens
tgacaaataaattaggacca

SEQ ID NO: 3154122 - DNA, 23 bp, Homo sapiens
tgacaaatctgtgtatattattt

SEQ ID NO: 3154123 - DNA, 19 bp, Homo sapiens
tgacaacacttaatagcaa

SEQ ID NO: 3154124 - DNA, 20 bp, Homo sapiens
tgacaacacttaatagcaac

SEQ ID NO: 3154125 - DNA, 11 bp, Homo sapiens
tgacaacagaa

SEQ ID NO: 3154126 - DNA, 14 bp, Homo sapiens
tgacaacagaaaaa

SEQ ID NO: 3154127 - DNA, 21 bp, Homo sapiens
tgacaacctgtgtgagagaat

SEQ ID NO: 3154128 - DNA, 21 bp, Homo sapiens
tgacaacgtttcagcgactcc

SEQ ID NO: 3154129 - DNA, 13 bp, Homo sapiens
tgacaactaaaat

SEQ ID NO: 3154130 - DNA, 13 bp, Homo sapiens
tgacaactgtcta

SEQ ID NO: 3154131 - DNA, 16 bp, Homo sapiens
tgacaactgtgactgt

SEQ ID NO: 3154132 - DNA, 22 bp, Homo sapiens
tgacaacttcccagtgaattct

SEQ ID NO: 3154133 - DNA, 23 bp, Homo sapiens
tgacaagaatggaatagaaatgt

SEQ ID NO: 3154134 - DNA, 14 bp, Homo sapiens
tgacaagagcctga

SEQ ID NO: 3154135 - DNA, 18 bp, Homo sapiens
tgacaaggattgctactg

SEQ ID NO: 3154136 - DNA, 22 bp, Homo sapiens
tgacaagggctgacctgcctct

SEQ ID NO: 3154137 - DNA, 14 bp, Homo sapiens
tgacaataaatgtg

SEQ ID NO: 3154138 - DNA, 16 bp, Homo sapiens
tgacaatattccagat

SEQ ID NO: 3154139 - DNA, 24 bp, Homo sapiens
tgacaatattccagatctttcaga

SEQ ID NO: 3154140 - DNA, 18 bp, Homo sapiens
tgacaatcaactctaata

SEQ ID NO: 3154141 - DNA, 13 bp, Homo sapiens
tgacaatcacctt

SEQ ID NO: 3154142 - DNA, 15 bp, Homo sapiens
tgacaatggacctct

SEQ ID NO: 3154143 - DNA, 18 bp, Homo sapiens
tgacaattcagtgactta

SEQ ID NO: 3154144 - DNA, 23 bp, Homo sapiens
tgacaattcctagataaaaagat

SEQ ID NO: 3154145 - DNA, 14 bp, Homo sapiens
tgacaattgggagc

SEQ ID NO: 3154146 - DNA, 22 bp, Homo sapiens
tgacaattttgtacaaatttgt

SEQ ID NO: 3154147 - DNA, 20 bp, Homo sapiens
tgacacaagaggaataagaa

SEQ ID NO: 3154148 - DNA, 16 bp, Homo sapiens
tgacacaagtggacct

SEQ ID NO: 3154149 - DNA, 20 bp, Homo sapiens
tgacacacagctctgtcctg

SEQ ID NO: 3154150 - DNA, 23 bp, Homo sapiens
tgacacaccaggcgctaattcaa

SEQ ID NO: 3154151 - DNA, 23 bp, Homo sapiens
tgacacacgtatttatatttgga

SEQ ID NO: 3154152 - DNA, 20 bp, Homo sapiens
tgacacactaaccaagctga

SEQ ID NO: 3154153 - DNA, 22 bp, Homo sapiens
tgacacagcagcttcaccagag

SEQ ID NO: 3154154 - DNA, 21 bp, Homo sapiens
tgacacagtcagcatgcttcc

SEQ ID NO: 3154155 - DNA, 19 bp, Homo sapiens
tgacacatccgccttttgt

SEQ ID NO: 3154156 - DNA, 16 bp, Homo sapiens
tgacacatggcccctc

SEQ ID NO: 3154157 - DNA, 17 bp, Homo sapiens
tgacaccaaccagacag

SEQ ID NO: 3154158 - DNA, 23 bp, Homo sapiens
tgacaccaaccagacagcacagg

SEQ ID NO: 3154159 - DNA, 21 bp, Homo sapiens
tgacaccatcttttattcttt

SEQ ID NO: 3154160 - DNA, 14 bp, Homo sapiens
tgacaccattctcc

SEQ ID NO: 3154161 - DNA, 19 bp, Homo sapiens
tgacaccattctcctgcct

SEQ ID NO: 3154162 - DNA, 23 bp, Homo sapiens
tgacacccacaatcccacctagc

SEQ ID NO: 3154163 - DNA, 14 bp, Homo sapiens
tgacacccaccctg

SEQ ID NO: 3154164 - DNA, 18 bp, Homo sapiens
tgacacccaccctgtgcc

SEQ ID NO: 3154165 - DNA, 22 bp, Homo sapiens
tgacacccaccctgtgccatca

SEQ ID NO: 3154166 - DNA, 21 bp, Homo sapiens
tgacacccgtgagcgcctgtg

SEQ ID NO: 3154167 - DNA, 14 bp, Homo sapiens
tgacaccctggcct

SEQ ID NO: 3154168 - DNA, 18 bp, Homo sapiens
tgacaccctggcctgaac

SEQ ID NO: 3154169 - DNA, 21 bp, Homo sapiens
tgacaccggggtggtgggaac

SEQ ID NO: 3154170 - DNA, 13 bp, Homo sapiens
tgacacctaccat

SEQ ID NO: 3154171 - DNA, 18 bp, Homo sapiens
tgacacctaccatgctgc

SEQ ID NO: 3154172 - DNA, 19 bp, Homo sapiens
tgacacctaccatgctgct

SEQ ID NO: 3154173 - DNA, 19 bp, Homo sapiens
tgacacgcctaaggtcaca

SEQ ID NO: 3154174 - DNA, 17 bp, Homo sapiens
tgacacgcgctctccac

SEQ ID NO: 3154175 - DNA, 22 bp, Homo sapiens
tgacacgcgctctccaccaccc

SEQ ID NO: 3154176 - DNA, 12 bp, Homo sapiens
tgacacgcttca

SEQ ID NO: 3154177 - DNA, 18 bp, Homo sapiens
tgacactagcccaatgaa

SEQ ID NO: 3154178 - DNA, 21 bp, Homo sapiens
tgacactagcccaatgaaatg

SEQ ID NO: 3154179 - DNA, 23 bp, Homo sapiens
tgacactagcccaatgaaatgaa

SEQ ID NO: 3154180 - DNA, 11 bp, Homo sapiens
tgacactgacc

SEQ ID NO: 3154181 - DNA, 23 bp, Homo sapiens
tgacactgaccttggagagacac

SEQ ID NO: 3154182 - DNA, 15 bp, Homo sapiens
tgacactgagcccca

SEQ ID NO: 3154183 - DNA, 17 bp, Homo sapiens
tgacactgagccccacc

SEQ ID NO: 3154184 - DNA, 16 bp, Homo sapiens
tgacactgctctaaca

SEQ ID NO: 3154185 - DNA, 19 bp, Homo sapiens
tgacactgctctaacagcc

SEQ ID NO: 3154186 - DNA, 18 bp, Homo sapiens
tgacacttcaaggtgaca

SEQ ID NO: 3154187 - DNA, 17 bp, Homo sapiens
tgacacttcagagagct

SEQ ID NO: 3154188 - DNA, 20 bp, Homo sapiens
tgacacttcagagagctggt

SEQ ID NO: 3154189 - DNA, 22 bp, Homo sapiens
tgacacttgattgtctcctaat

SEQ ID NO: 3154190 - DNA, 20 bp, Homo sapiens
tgacagaaggaccagccctt

SEQ ID NO: 3154191 - DNA, 15 bp, Homo sapiens
tgacagaaggtgcca

SEQ ID NO: 3154192 - DNA, 17 bp, Homo sapiens
tgacagaaggtgccact

SEQ ID NO: 3154193 - DNA, 20 bp, Homo sapiens
tgacagacacaggcccggct

SEQ ID NO: 3154194 - DNA, 23 bp, Homo sapiens
tgacagacacaggcccggctcca

SEQ ID NO: 3154195 - DNA, 14 bp, Homo sapiens
tgacagacaggctc

SEQ ID NO: 3154196 - DNA, 18 bp, Homo sapiens
tgacagaccacatcttta

SEQ ID NO: 3154197 - DNA, 21 bp, Homo sapiens
tgacagagcaagactctgtct

SEQ ID NO: 3154198 - DNA, 16 bp, Homo sapiens
tgacagaggcagcccc

SEQ ID NO: 3154199 - DNA, 18 bp, Homo sapiens
tgacagaggcagccccat

SEQ ID NO: 3154200 - DNA, 23 bp, Homo sapiens
tgacagaggcagccccattctgc

SEQ ID NO: 3154201 - DNA, 13 bp, Homo sapiens
tgacagatatatt

SEQ ID NO: 3154202 - DNA, 19 bp, Homo sapiens
tgacagatatatttaagcc

SEQ ID NO: 3154203 - DNA, 20 bp, Homo sapiens
tgacagatatatttaagcct

SEQ ID NO: 3154204 - DNA, 18 bp, Homo sapiens
tgacagatggtgaagtaa

SEQ ID NO: 3154205 - DNA, 19 bp, Homo sapiens
tgacagatgtcagccgagc

SEQ ID NO: 3154206 - DNA, 14 bp, Homo sapiens
tgacagattctgac

SEQ ID NO: 3154207 - DNA, 16 bp, Homo sapiens
tgacagccatttgtaa

SEQ ID NO: 3154208 - DNA, 12 bp, Homo sapiens
tgacagcctccc

SEQ ID NO: 3154209 - DNA, 17 bp, Homo sapiens
tgacaggaaagccctcc

SEQ ID NO: 3154210 - DNA, 19 bp, Homo sapiens
tgacaggcaatgctggctg

SEQ ID NO: 3154211 - DNA, 18 bp, Homo sapiens
tgacaggcctgaagatat

SEQ ID NO: 3154212 - DNA, 11 bp, Homo sapiens
tgacagggcac

SEQ ID NO: 3154213 - DNA, 13 bp, Homo sapiens
tgacagggccagt

SEQ ID NO: 3154214 - DNA, 21 bp, Homo sapiens
tgacagggccagtggggcctg

SEQ ID NO: 3154215 - DNA, 21 bp, Homo sapiens
tgacagtattatacgctggca

SEQ ID NO: 3154216 - DNA, 13 bp, Homo sapiens
tgacagtcatcat

SEQ ID NO: 3154217 - DNA, 17 bp, Homo sapiens
tgacagtcatcatcagg

SEQ ID NO: 3154218 - DNA, 19 bp, Homo sapiens
tgacagtcatcatcagggc

SEQ ID NO: 3154219 - DNA, 20 bp, Homo sapiens
tgacagtcatcatcagggcc

SEQ ID NO: 3154220 - DNA, 17 bp, Homo sapiens
tgacagtgcctgggaat

SEQ ID NO: 3154221 - DNA, 12 bp, Homo sapiens
tgacagtgcctt

SEQ ID NO: 3154222 - DNA, 14 bp, Homo sapiens
tgacagtgccttct

SEQ ID NO: 3154223 - DNA, 16 bp, Homo sapiens
tgacagtggtgtgtgg

SEQ ID NO: 3154224 - DNA, 14 bp, Homo sapiens
tgacagtgttttta

SEQ ID NO: 3154225 - DNA, 13 bp, Homo sapiens
tgacagttatttt

SEQ ID NO: 3154226 - DNA, 17 bp, Homo sapiens
tgacagttctgaagaat

SEQ ID NO: 3154227 - DNA, 16 bp, Homo sapiens
tgacagtttttctgtt

SEQ ID NO: 3154228 - DNA, 17 bp, Homo sapiens
tgacataacactataaa

SEQ ID NO: 3154229 - DNA, 16 bp, Homo sapiens
tgacataatatattct

SEQ ID NO: 3154230 - DNA, 18 bp, Homo sapiens
tgacatagagaaaaggct

SEQ ID NO: 3154231 - DNA, 16 bp, Homo sapiens
tgacatcaaagcctgg

SEQ ID NO: 3154232 - DNA, 14 bp, Homo sapiens
tgacatcacagcag

SEQ ID NO: 3154233 - DNA, 19 bp, Homo sapiens
tgacatcccttcctggaaa

SEQ ID NO: 3154234 - DNA, 19 bp, Homo sapiens
tgacatctcaggggccaga

SEQ ID NO: 3154235 - DNA, 22 bp, Homo sapiens
tgacatctcaggggccagagga

SEQ ID NO: 3154236 - DNA, 16 bp, Homo sapiens
tgacatgaaaagttat

SEQ ID NO: 3154237 - DNA, 14 bp, Homo sapiens
tgacatgcactgac

SEQ ID NO: 3154238 - DNA, 19 bp, Homo sapiens
tgacatgcactgacccttc

SEQ ID NO: 3154239 - DNA, 21 bp, Homo sapiens
tgacatgcactgacccttcca

SEQ ID NO: 3154240 - DNA, 22 bp, Homo sapiens
tgacatgggcctttaagaacct

SEQ ID NO: 3154241 - DNA, 15 bp, Homo sapiens
tgacatggtgcctga

SEQ ID NO: 3154242 - DNA, 16 bp, Homo sapiens
tgacatggtgcctgag

SEQ ID NO: 3154243 - DNA, 17 bp, Homo sapiens
tgacatggtgcctgaga

SEQ ID NO: 3154244 - DNA, 18 bp, Homo sapiens
tgacatggtgcctgagag

SEQ ID NO: 3154245 - DNA, 21 bp, Homo sapiens
tgacatggtgcctgagaggca

SEQ ID NO: 3154246 - DNA, 13 bp, Homo sapiens
tgacatgtgaaac

SEQ ID NO: 3154247 - DNA, 15 bp, Homo sapiens
tgacatgtgaaacct

SEQ ID NO: 3154248 - DNA, 17 bp, Homo sapiens
tgacatgtgaaaccttt

SEQ ID NO: 3154249 - DNA, 21 bp, Homo sapiens
tgacatgtgaaacctttttta

SEQ ID NO: 3154250 - DNA, 14 bp, Homo sapiens
tgacatgtggaaag

SEQ ID NO: 3154251 - DNA, 17 bp, Homo sapiens
tgacatgtggaaagtga

SEQ ID NO: 3154252 - DNA, 15 bp, Homo sapiens
tgacatgttgtcaca

SEQ ID NO: 3154253 - DNA, 19 bp, Homo sapiens
tgacattaagaatgttggt

SEQ ID NO: 3154254 - DNA, 21 bp, Homo sapiens
tgacattaagaatgttggttt

SEQ ID NO: 3154255 - DNA, 15 bp, Homo sapiens
tgacattcaaggcat

SEQ ID NO: 3154256 - DNA, 16 bp, Homo sapiens
tgacattccatgacga

SEQ ID NO: 3154257 - DNA, 17 bp, Homo sapiens
tgacattgcacctggat

SEQ ID NO: 3154258 - DNA, 14 bp, Homo sapiens
tgacattgtctcct

SEQ ID NO: 3154259 - DNA, 19 bp, Homo sapiens
tgacatttacaccacactt

SEQ ID NO: 3154260 - DNA, 15 bp, Homo sapiens
tgacatttatatatt

SEQ ID NO: 3154261 - DNA, 14 bp, Homo sapiens
tgacatttcccaag

SEQ ID NO: 3154262 - DNA, 22 bp, Homo sapiens
tgacatttccttctttgtctta

SEQ ID NO: 3154263 - DNA, 13 bp, Homo sapiens
tgacatttcttct

SEQ ID NO: 3154264 - DNA, 14 bp, Homo sapiens
tgaccaaaatacct

SEQ ID NO: 3154265 - DNA, 15 bp, Homo sapiens
tgaccaaaccagcct

SEQ ID NO: 3154266 - DNA, 23 bp, Homo sapiens
tgaccaacaggctgttctgcact

SEQ ID NO: 3154267 - DNA, 15 bp, Homo sapiens
tgaccaactagacat

SEQ ID NO: 3154268 - DNA, 21 bp, Homo sapiens
tgaccaactagacattctgtc

SEQ ID NO: 3154269 - DNA, 12 bp, Homo sapiens
tgaccaactgtg

SEQ ID NO: 3154270 - DNA, 13 bp, Homo sapiens
tgaccaactgtgt

SEQ ID NO: 3154271 - DNA, 18 bp, Homo sapiens
tgaccaagaactgcatgg

SEQ ID NO: 3154272 - DNA, 19 bp, Homo sapiens
tgaccaagaactgcatgga

SEQ ID NO: 3154273 - DNA, 15 bp, Homo sapiens
tgaccaagagagaaa

SEQ ID NO: 3154274 - DNA, 16 bp, Homo sapiens
tgaccaagagagaaag

SEQ ID NO: 3154275 - DNA, 23 bp, Homo sapiens
tgaccacggacgtttccatcagg

SEQ ID NO: 3154276 - DNA, 17 bp, Homo sapiens
tgaccacttattctgta

SEQ ID NO: 3154277 - DNA, 16 bp, Homo sapiens
tgaccaggatcccaag

SEQ ID NO: 3154278 - DNA, 16 bp, Homo sapiens
tgaccagggatgctgg

SEQ ID NO: 3154279 - DNA, 17 bp, Homo sapiens
tgaccagggatgctggg

SEQ ID NO: 3154280 - DNA, 18 bp, Homo sapiens
tgaccagggatgctgggc

SEQ ID NO: 3154281 - DNA, 20 bp, Homo sapiens
tgaccagggatgctgggctg

SEQ ID NO: 3154282 - DNA, 22 bp, Homo sapiens
tgaccagggatgctgggctggg

SEQ ID NO: 3154283 - DNA, 23 bp, Homo sapiens
tgaccagggatgctgggctgggc

SEQ ID NO: 3154284 - DNA, 19 bp, Homo sapiens
tgaccattgagtccctgct

SEQ ID NO: 3154285 - DNA, 23 bp, Homo sapiens
tgaccatttataatgttagtaga

SEQ ID NO: 3154286 - DNA, 12 bp, Homo sapiens
tgaccatttttt

SEQ ID NO: 3154287 - DNA, 22 bp, Homo sapiens
tgaccattttttaatttacttg

SEQ ID NO: 3154288 - DNA, 15 bp, Homo sapiens
tgacccaccagtgcc

SEQ ID NO: 3154289 - DNA, 17 bp, Homo sapiens
tgacccaccagtgcctt

SEQ ID NO: 3154290 - DNA, 14 bp, Homo sapiens
tgacccacccagtg

SEQ ID NO: 3154291 - DNA, 12 bp, Homo sapiens
tgacccacccct

SEQ ID NO: 3154292 - DNA, 23 bp, Homo sapiens
tgacccacccctgtgctccgtgc

SEQ ID NO: 3154293 - DNA, 12 bp, Homo sapiens
tgacccactgct

SEQ ID NO: 3154294 - DNA, 13 bp, Homo sapiens
tgacccactgctt

SEQ ID NO: 3154295 - DNA, 20 bp, Homo sapiens
tgacccagagtggagtctga

SEQ ID NO: 3154296 - DNA, 20 bp, Homo sapiens
tgacccagcatctcccagca

SEQ ID NO: 3154297 - DNA, 18 bp, Homo sapiens
tgacccagccccttgaga

SEQ ID NO: 3154298 - DNA, 21 bp, Homo sapiens
tgacccagccccttgagaaac

SEQ ID NO: 3154299 - DNA, 22 bp, Homo sapiens
tgacccaggccgcagctcttgc

SEQ ID NO: 3154300 - DNA, 13 bp, Homo sapiens
tgacccagtgaga

SEQ ID NO: 3154301 - DNA, 14 bp, Homo sapiens
tgacccatctgtag

SEQ ID NO: 3154302 - DNA, 18 bp, Homo sapiens
tgaccccagaaaagcata

SEQ ID NO: 3154303 - DNA, 17 bp, Homo sapiens
tgaccccagtttcttct

SEQ ID NO: 3154304 - DNA, 23 bp, Homo sapiens
tgaccccagtttcttcttacact

SEQ ID NO: 3154305 - DNA, 13 bp, Homo sapiens
tgacccctgctca

SEQ ID NO: 3154306 - DNA, 21 bp, Homo sapiens
tgacccggctgggtcggccct

SEQ ID NO: 3154307 - DNA, 21 bp, Homo sapiens
tgaccctgcgaaggggccctg

SEQ ID NO: 3154308 - DNA, 15 bp, Homo sapiens
tgacccttcagggcc

SEQ ID NO: 3154309 - DNA, 20 bp, Homo sapiens
tgacccttccagacatacga

SEQ ID NO: 3154310 - DNA, 21 bp, Homo sapiens
tgacccttcccaatcagcact

SEQ ID NO: 3154311 - DNA, 22 bp, Homo sapiens
tgacccttcccaatcagcactg

SEQ ID NO: 3154312 - DNA, 15 bp, Homo sapiens
tgacccttgaaccaa

SEQ ID NO: 3154313 - DNA, 20 bp, Homo sapiens
tgaccgactaccccagtccc

SEQ ID NO: 3154314 - DNA, 21 bp, Homo sapiens
tgaccgtactctcacatgtgg

SEQ ID NO: 3154315 - DNA, 21 bp, Homo sapiens
tgacctattcaccctccactt

SEQ ID NO: 3154316 - DNA, 18 bp, Homo sapiens
tgacctcaggcactagcc

SEQ ID NO: 3154317 - DNA, 20 bp, Homo sapiens
tgacctcaggtgatccaccc

SEQ ID NO: 3154318 - DNA, 20 bp, Homo sapiens
tgacctcaggtgatccgcct

SEQ ID NO: 3154319 - DNA, 11 bp, Homo sapiens
tgacctcccag

SEQ ID NO: 3154320 - DNA, 23 bp, Homo sapiens
tgacctcccagccctatggatgt

SEQ ID NO: 3154321 - DNA, 14 bp, Homo sapiens
tgacctccctctaa

SEQ ID NO: 3154322 - DNA, 19 bp, Homo sapiens
tgacctccgcccctgcccc

SEQ ID NO: 3154323 - DNA, 18 bp, Homo sapiens
tgacctctcagggcctgg

SEQ ID NO: 3154324 - DNA, 22 bp, Homo sapiens
tgacctctcagggcctggcagg

SEQ ID NO: 3154325 - DNA, 13 bp, Homo sapiens
tgacctcttgctg

SEQ ID NO: 3154326 - DNA, 14 bp, Homo sapiens
tgacctcttgctgt

SEQ ID NO: 3154327 - DNA, 16 bp, Homo sapiens
tgacctcttgctgtct

SEQ ID NO: 3154328 - DNA, 19 bp, Homo sapiens
tgacctcttgctgtctctg

SEQ ID NO: 3154329 - DNA, 15 bp, Homo sapiens
tgacctgatttcaga

SEQ ID NO: 3154330 - DNA, 20 bp, Homo sapiens
tgacctgcaggccaagagca

SEQ ID NO: 3154331 - DNA, 19 bp, Homo sapiens
tgacctgccccgcccagct

SEQ ID NO: 3154332 - DNA, 18 bp, Homo sapiens
tgacctgcctctcacaca

SEQ ID NO: 3154333 - DNA, 12 bp, Homo sapiens
tgacctgctccg

SEQ ID NO: 3154334 - DNA, 17 bp, Homo sapiens
tgacctgctccgctgct

SEQ ID NO: 3154335 - DNA, 15 bp, Homo sapiens
tgacctgtcatgccc

SEQ ID NO: 3154336 - DNA, 16 bp, Homo sapiens
tgaccttcctctgggg

SEQ ID NO: 3154337 - DNA, 17 bp, Homo sapiens
tgaccttcctctggggc

SEQ ID NO: 3154338 - DNA, 18 bp, Homo sapiens
tgaccttcctctggggct

SEQ ID NO: 3154339 - DNA, 14 bp, Homo sapiens
tgaccttctctata

SEQ ID NO: 3154340 - DNA, 16 bp, Homo sapiens
tgaccttgcaacttca

SEQ ID NO: 3154341 - DNA, 18 bp, Homo sapiens
tgaccttggctgactggg

SEQ ID NO: 3154342 - DNA, 20 bp, Homo sapiens
tgaccttggctgactggggc

SEQ ID NO: 3154343 - DNA, 21 bp, Homo sapiens
tgaccttggctgactggggct

SEQ ID NO: 3154344 - DNA, 18 bp, Homo sapiens
tgaccttttatgtagtaa

SEQ ID NO: 3154345 - DNA, 16 bp, Homo sapiens
tgaccttttcttcatt

SEQ ID NO: 3154346 - DNA, 18 bp, Homo sapiens
tgacgaaactggccccgg

SEQ ID NO: 3154347 - DNA, 19 bp, Homo sapiens
tgacgaaactggccccgga

SEQ ID NO: 3154348 - DNA, 20 bp, Homo sapiens
tgacgacaaagctgctaaat

SEQ ID NO: 3154349 - DNA, 17 bp, Homo sapiens
tgacgattccttctctg

SEQ ID NO: 3154350 - DNA, 20 bp, Homo sapiens
tgacgcagacagaggggatg

SEQ ID NO: 3154351 - DNA, 12 bp, Homo sapiens
tgacgccctgcg

SEQ ID NO: 3154352 - DNA, 21 bp, Homo sapiens
tgacgccctgcgttggagcca

SEQ ID NO: 3154353 - DNA, 14 bp, Homo sapiens
tgacgctgatacat

SEQ ID NO: 3154354 - DNA, 15 bp, Homo sapiens
tgacgctgatacata

SEQ ID NO: 3154355 - DNA, 21 bp, Homo sapiens
tgacgctgatacataactaaa

SEQ ID NO: 3154356 - DNA, 20 bp, Homo sapiens
tgacggccctcatctatgag

SEQ ID NO: 3154357 - DNA, 13 bp, Homo sapiens
tgacggccctgca

SEQ ID NO: 3154358 - DNA, 14 bp, Homo sapiens
tgacggccctgcaa

SEQ ID NO: 3154359 - DNA, 18 bp, Homo sapiens
tgacggcgcccccagtgt

SEQ ID NO: 3154360 - DNA, 19 bp, Homo sapiens
tgacggcgcccccagtgtg

SEQ ID NO: 3154361 - DNA, 21 bp, Homo sapiens
tgacggctgggtgtttcagtt

SEQ ID NO: 3154362 - DNA, 22 bp, Homo sapiens
tgacgtgaccggacttttctgc

SEQ ID NO: 3154363 - DNA, 24 bp, Homo sapiens
tgacgtgaccggacttttctgcaa

SEQ ID NO: 3154364 - DNA, 19 bp, Homo sapiens
tgacgtgccttttgcaccc

SEQ ID NO: 3154365 - DNA, 23 bp, Homo sapiens
tgacgtgccttttgcacccctcc

SEQ ID NO: 3154366 - DNA, 14 bp, Homo sapiens
tgactaaaaatatt

SEQ ID NO: 3154367 - DNA, 15 bp, Homo sapiens
tgactaacaagattt

SEQ ID NO: 3154368 - DNA, 21 bp, Homo sapiens
tgactaacaggccaaagagtc

SEQ ID NO: 3154369 - DNA, 11 bp, Homo sapiens
tgactaattag

SEQ ID NO: 3154370 - DNA, 14 bp, Homo sapiens
tgactaattagggt

SEQ ID NO: 3154371 - DNA, 18 bp, Homo sapiens
tgactaattttacatgtt

SEQ ID NO: 3154372 - DNA, 15 bp, Homo sapiens
tgactagaaattctt

SEQ ID NO: 3154373 - DNA, 16 bp, Homo sapiens
tgactagaaattctta

SEQ ID NO: 3154374 - DNA, 22 bp, Homo sapiens
tgactagcactagacatgtcat

SEQ ID NO: 3154375 - DNA, 13 bp, Homo sapiens
tgactagtacaaa

SEQ ID NO: 3154376 - DNA, 15 bp, Homo sapiens
tgactagtacaaatt

SEQ ID NO: 3154377 - DNA, 21 bp, Homo sapiens
tgactagtagatttctatgat

SEQ ID NO: 3154378 - DNA, 16 bp, Homo sapiens
tgactagtcacctggg

SEQ ID NO: 3154379 - DNA, 23 bp, Homo sapiens
tgactatataatttatttccact

SEQ ID NO: 3154380 - DNA, 14 bp, Homo sapiens
tgactatatagaga

SEQ ID NO: 3154381 - DNA, 13 bp, Homo sapiens
tgactattctgta

SEQ ID NO: 3154382 - DNA, 17 bp, Homo sapiens
tgactattttcgttcat

SEQ ID NO: 3154383 - DNA, 14 bp, Homo sapiens
tgactcaagaagtg

SEQ ID NO: 3154384 - DNA, 14 bp, Homo sapiens
tgactcacacctga

SEQ ID NO: 3154385 - DNA, 19 bp, Homo sapiens
tgactcacacctgaactga

SEQ ID NO: 3154386 - DNA, 21 bp, Homo sapiens
tgactcacaggccctggagaa

SEQ ID NO: 3154387 - DNA, 17 bp, Homo sapiens
tgactcacttcaatgtg

SEQ ID NO: 3154388 - DNA, 18 bp, Homo sapiens
tgactcagaggctgggag

SEQ ID NO: 3154389 - DNA, 15 bp, Homo sapiens
tgactcatcatttgt

SEQ ID NO: 3154390 - DNA, 22 bp, Homo sapiens
tgactccacgatcctgccaccc

SEQ ID NO: 3154391 - DNA, 13 bp, Homo sapiens
tgactccagagtc

SEQ ID NO: 3154392 - DNA, 18 bp, Homo sapiens
tgactccagagtctgagc

SEQ ID NO: 3154393 - DNA, 23 bp, Homo sapiens
tgactccagagtctgagcccccg

SEQ ID NO: 3154394 - DNA, 17 bp, Homo sapiens
tgactcctacctgccct

SEQ ID NO: 3154395 - DNA, 15 bp, Homo sapiens
tgactcctgctggta

SEQ ID NO: 3154396 - DNA, 14 bp, Homo sapiens
tgactccttttgga

SEQ ID NO: 3154397 - DNA, 16 bp, Homo sapiens
tgactcgggggtgggg

SEQ ID NO: 3154398 - DNA, 18 bp, Homo sapiens
tgactcggtttctccaaa

SEQ ID NO: 3154399 - DNA, 12 bp, Homo sapiens
tgactctaaatt

SEQ ID NO: 3154400 - DNA, 14 bp, Homo sapiens
tgactctccactcc

SEQ ID NO: 3154401 - DNA, 19 bp, Homo sapiens
tgactctccactcctcctc

SEQ ID NO: 3154402 - DNA, 14 bp, Homo sapiens
tgactctccaggga

SEQ ID NO: 3154403 - DNA, 13 bp, Homo sapiens
tgactctctgtga

SEQ ID NO: 3154404 - DNA, 22 bp, Homo sapiens
tgactctggcaaagcttttaga

SEQ ID NO: 3154405 - DNA, 14 bp, Homo sapiens
tgactctttctgaa

SEQ ID NO: 3154406 - DNA, 22 bp, Homo sapiens
tgactctttctgaaggaagaga

SEQ ID NO: 3154407 - DNA, 23 bp, Homo sapiens
tgactctttctgaaggaagagaa

SEQ ID NO: 3154408 - DNA, 21 bp, Homo sapiens
tgactctttttggactcagcc

SEQ ID NO: 3154409 - DNA, 12 bp, Homo sapiens
tgactgaatgca

SEQ ID NO: 3154410 - DNA, 20 bp, Homo sapiens
tgactgatgctgagattctt

SEQ ID NO: 3154411 - DNA, 16 bp, Homo sapiens
tgactgcacccagctc

SEQ ID NO: 3154412 - DNA, 17 bp, Homo sapiens
tgactgcacccagctcc

SEQ ID NO: 3154413 - DNA, 23 bp, Homo sapiens
tgactggcaagaggcctcatgcc

SEQ ID NO: 3154414 - DNA, 21 bp, Homo sapiens
tgactggcaggtgcagatggg

SEQ ID NO: 3154415 - DNA, 24 bp, Homo sapiens
tgactggcaggtgcagatgggctg

SEQ ID NO: 3154416 - DNA, 20 bp, Homo sapiens
tgactggccaaacccttgct

SEQ ID NO: 3154417 - DNA, 14 bp, Homo sapiens
tgactggccagttg

SEQ ID NO: 3154418 - DNA, 20 bp, Homo sapiens
tgactggccagttgcccaga

SEQ ID NO: 3154419 - DNA, 21 bp, Homo sapiens
tgactggccagttgcccagag

SEQ ID NO: 3154420 - DNA, 14 bp, Homo sapiens
tgactggctgtctg

SEQ ID NO: 3154421 - DNA, 18 bp, Homo sapiens
tgactggctgtctgcctg

SEQ ID NO: 3154422 - DNA, 17 bp, Homo sapiens
tgactgggcctcccttg

SEQ ID NO: 3154423 - DNA, 17 bp, Homo sapiens
tgactggggtgggaggt

SEQ ID NO: 3154424 - DNA, 20 bp, Homo sapiens
tgactggggtgggaggtctt

SEQ ID NO: 3154425 - DNA, 23 bp, Homo sapiens
tgactggtttacaggccctgctc

SEQ ID NO: 3154426 - DNA, 22 bp, Homo sapiens
tgactgtactcctcccaggcgc

SEQ ID NO: 3154427 - DNA, 16 bp, Homo sapiens
tgactgtcccaccggg

SEQ ID NO: 3154428 - DNA, 16 bp, Homo sapiens
tgactgtgaccacctt

SEQ ID NO: 3154429 - DNA, 16 bp, Homo sapiens
tgactgtgctactgtc

SEQ ID NO: 3154430 - DNA, 14 bp, Homo sapiens
tgactgttgatgaa

SEQ ID NO: 3154431 - DNA, 17 bp, Homo sapiens
tgactgttgatgaagta

SEQ ID NO: 3154432 - DNA, 12 bp, Homo sapiens
tgactgtttggc

SEQ ID NO: 3154433 - DNA, 19 bp, Homo sapiens
tgactgtttggcttataaa

SEQ ID NO: 3154434 - DNA, 16 bp, Homo sapiens
tgacttaatgtgatta

SEQ ID NO: 3154435 - DNA, 12 bp, Homo sapiens
tgacttatttct

SEQ ID NO: 3154436 - DNA, 21 bp, Homo sapiens
tgacttatttctgctctggaa

SEQ ID NO: 3154437 - DNA, 23 bp, Homo sapiens
tgacttattttgtcttattctta

SEQ ID NO: 3154438 - DNA, 23 bp, Homo sapiens
tgacttcaatgatagtaagaaaa

SEQ ID NO: 3154439 - DNA, 16 bp, Homo sapiens
tgacttcagctgcctg

SEQ ID NO: 3154440 - DNA, 17 bp, Homo sapiens
tgacttcattttatatt

SEQ ID NO: 3154441 - DNA, 20 bp, Homo sapiens
tgacttctaatatcattcac

SEQ ID NO: 3154442 - DNA, 14 bp, Homo sapiens
tgacttctccaggt

SEQ ID NO: 3154443 - DNA, 23 bp, Homo sapiens
tgacttctccaggtctcacgggc

SEQ ID NO: 3154444 - DNA, 15 bp, Homo sapiens
tgacttctgcctgga

SEQ ID NO: 3154445 - DNA, 16 bp, Homo sapiens
tgacttctgcctggag

SEQ ID NO: 3154446 - DNA, 18 bp, Homo sapiens
tgacttctgcctggagac

SEQ ID NO: 3154447 - DNA, 21 bp, Homo sapiens
tgacttctgctggcatcaaga

SEQ ID NO: 3154448 - DNA, 13 bp, Homo sapiens
tgacttctgtggt

SEQ ID NO: 3154449 - DNA, 21 bp, Homo sapiens
tgacttcttgcttcagtcatc

SEQ ID NO: 3154450 - DNA, 16 bp, Homo sapiens
tgacttgcaaagacct

SEQ ID NO: 3154451 - DNA, 15 bp, Homo sapiens
tgacttggcacttaa

SEQ ID NO: 3154452 - DNA, 19 bp, Homo sapiens
tgacttggcacttaagtgc

SEQ ID NO: 3154453 - DNA, 19 bp, Homo sapiens
tgacttggggagatggagt

SEQ ID NO: 3154454 - DNA, 19 bp, Homo sapiens
tgacttgtttgtcttccat

SEQ ID NO: 3154455 - DNA, 13 bp, Homo sapiens
tgacttgtttgtg

SEQ ID NO: 3154456 - DNA, 14 bp, Homo sapiens
tgacttgtttgtgc

SEQ ID NO: 3154457 - DNA, 14 bp, Homo sapiens
tgactttacttgtg

SEQ ID NO: 3154458 - DNA, 15 bp, Homo sapiens
tgactttataaattt

SEQ ID NO: 3154459 - DNA, 17 bp, Homo sapiens
tgactttatctcctgct

SEQ ID NO: 3154460 - DNA, 15 bp, Homo sapiens
tgactttcaaaatat

SEQ ID NO: 3154461 - DNA, 17 bp, Homo sapiens
tgactttcaaaatatat

SEQ ID NO: 3154462 - DNA, 14 bp, Homo sapiens
tgactttgcagatg

SEQ ID NO: 3154463 - DNA, 13 bp, Homo sapiens
tgactttgcttgc

SEQ ID NO: 3154464 - DNA, 16 bp, Homo sapiens
tgacttttataaagca

SEQ ID NO: 3154465 - DNA, 17 bp, Homo sapiens
tgacttttataaagcat

SEQ ID NO: 3154466 - DNA, 18 bp, Homo sapiens
tgacttttataaagcatg

SEQ ID NO: 3154467 - DNA, 18 bp, Homo sapiens
tgactttttagccagtga

SEQ ID NO: 3154468 - DNA, 22 bp, Homo sapiens
tgactttttctgagcttttcat

SEQ ID NO: 3154469 - DNA, 17 bp, Homo sapiens
tgactttttgcatttaa

SEQ ID NO: 3154470 - DNA, 16 bp, Homo sapiens
tgagaaaaagctcctg

SEQ ID NO: 3154471 - DNA, 18 bp, Homo sapiens
tgagaaaaagctcctgtc

SEQ ID NO: 3154472 - DNA, 15 bp, Homo sapiens
tgagaaacagctcag

SEQ ID NO: 3154473 - DNA, 21 bp, Homo sapiens
tgagaaagaatttgagacgca

SEQ ID NO: 3154474 - DNA, 19 bp, Homo sapiens
tgagaaaggtgaggagggc

SEQ ID NO: 3154475 - DNA, 15 bp, Homo sapiens
tgagaaatatggaca

SEQ ID NO: 3154476 - DNA, 14 bp, Homo sapiens
tgagaaatcctgga

SEQ ID NO: 3154477 - DNA, 22 bp, Homo sapiens
tgagaaatgaataatttcccaa

SEQ ID NO: 3154478 - DNA, 20 bp, Homo sapiens
tgagaacaaagctgttaaac

SEQ ID NO: 3154479 - DNA, 23 bp, Homo sapiens
tgagaacaaagctgttaaactgt

SEQ ID NO: 3154480 - DNA, 20 bp, Homo sapiens
tgagaacaagtcacagctgc

SEQ ID NO: 3154481 - DNA, 21 bp, Homo sapiens
tgagaacaagtcacagctgca

SEQ ID NO: 3154482 - DNA, 17 bp, Homo sapiens
tgagaaccagtctcctc

SEQ ID NO: 3154483 - DNA, 18 bp, Homo sapiens
tgagaaccagtctcctca

SEQ ID NO: 3154484 - DNA, 13 bp, Homo sapiens
tgagaactcctga

SEQ ID NO: 3154485 - DNA, 21 bp, Homo sapiens
tgagaacttttttgaggcctt

SEQ ID NO: 3154486 - DNA, 16 bp, Homo sapiens
tgagaagaatgaaaat

SEQ ID NO: 3154487 - DNA, 15 bp, Homo sapiens
tgagaagagggcctg

SEQ ID NO: 3154488 - DNA, 13 bp, Homo sapiens
tgagaagccttca

SEQ ID NO: 3154489 - DNA, 20 bp, Homo sapiens
tgagaagccttcagctccag

SEQ ID NO: 3154490 - DNA, 21 bp, Homo sapiens
tgagaagcgtttttaacctgt

SEQ ID NO: 3154491 - DNA, 13 bp, Homo sapiens
tgagaagctgctc

SEQ ID NO: 3154492 - DNA, 20 bp, Homo sapiens
tgagaagctgctccaggcct

SEQ ID NO: 3154493 - DNA, 13 bp, Homo sapiens
tgagaaggaacag

SEQ ID NO: 3154494 - DNA, 14 bp, Homo sapiens
tgagaaggagagaa

SEQ ID NO: 3154495 - DNA, 13 bp, Homo sapiens
tgagaagtacttg

SEQ ID NO: 3154496 - DNA, 19 bp, Homo sapiens
tgagaagtgaatgctggga

SEQ ID NO: 3154497 - DNA, 15 bp, Homo sapiens
tgagaagtgccttct

SEQ ID NO: 3154498 - DNA, 16 bp, Homo sapiens
tgagaatcaaaactct

SEQ ID NO: 3154499 - DNA, 22 bp, Homo sapiens
tgagaatcacggtggtaaagaa

SEQ ID NO: 3154500 - DNA, 13 bp, Homo sapiens
tgagaatcccaaa

SEQ ID NO: 3154501 - DNA, 18 bp, Homo sapiens
tgagaatcccttaaaatt

SEQ ID NO: 3154502 - DNA, 13 bp, Homo sapiens
tgagaatttctaa

SEQ ID NO: 3154503 - DNA, 15 bp, Homo sapiens
tgagaatttctaaaa

SEQ ID NO: 3154504 - DNA, 12 bp, Homo sapiens
tgagacaagccc

SEQ ID NO: 3154505 - DNA, 19 bp, Homo sapiens
tgagacaagccctggcaac

SEQ ID NO: 3154506 - DNA, 22 bp, Homo sapiens
tgagacacggagcccagccctc

SEQ ID NO: 3154507 - DNA, 11 bp, Homo sapiens
tgagacagagt

SEQ ID NO: 3154508 - DNA, 14 bp, Homo sapiens
tgagacagtctgga

SEQ ID NO: 3154509 - DNA, 23 bp, Homo sapiens
tgagacagtctggaaagtgatgt

SEQ ID NO: 3154510 - DNA, 15 bp, Homo sapiens
tgagacagtcttgct

SEQ ID NO: 3154511 - DNA, 15 bp, Homo sapiens
tgagacagtgaattt

SEQ ID NO: 3154512 - DNA, 16 bp, Homo sapiens
tgagacagtttcttag

SEQ ID NO: 3154513 - DNA, 19 bp, Homo sapiens
tgagacagtttcttagctt

SEQ ID NO: 3154514 - DNA, 20 bp, Homo sapiens
tgagacagtttcttagcttt

SEQ ID NO: 3154515 - DNA, 21 bp, Homo sapiens
tgagacagtttcttagctttt

SEQ ID NO: 3154516 - DNA, 13 bp, Homo sapiens
tgagaccacagag

SEQ ID NO: 3154517 - DNA, 14 bp, Homo sapiens
tgagaccactgtta

SEQ ID NO: 3154518 - DNA, 21 bp, Homo sapiens
tgagaccagttgggagcactg

SEQ ID NO: 3154519 - DNA, 23 bp, Homo sapiens
tgagaccagttgggagcactgga

SEQ ID NO: 3154520 - DNA, 13 bp, Homo sapiens
tgagacccccaca

SEQ ID NO: 3154521 - DNA, 15 bp, Homo sapiens
tgagaccctgggaga

SEQ ID NO: 3154522 - DNA, 13 bp, Homo sapiens
tgagaccctggtg

SEQ ID NO: 3154523 - DNA, 14 bp, Homo sapiens
tgagaccctgtctc

SEQ ID NO: 3154524 - DNA, 20 bp, Homo sapiens
tgagacctcgccggccttgt

SEQ ID NO: 3154525 - DNA, 21 bp, Homo sapiens
tgagacgccaccattcctgga

SEQ ID NO: 3154526 - DNA, 23 bp, Homo sapiens
tgagacgtttttggaagagtagt

SEQ ID NO: 3154527 - DNA, 13 bp, Homo sapiens
tgagactccagaa

SEQ ID NO: 3154528 - DNA, 22 bp, Homo sapiens
tgagactccagaatctgctgtt

SEQ ID NO: 3154529 - DNA, 12 bp, Homo sapiens
tgagactctgtc

SEQ ID NO: 3154530 - DNA, 13 bp, Homo sapiens
tgagactctgtct

SEQ ID NO: 3154531 - DNA, 23 bp, Homo sapiens
tgagactgcgggatggtcctggg

SEQ ID NO: 3154532 - DNA, 22 bp, Homo sapiens
tgagactttttggtggatgtaa

SEQ ID NO: 3154533 - DNA, 19 bp, Homo sapiens
tgagagaaaaagtgcccct

SEQ ID NO: 3154534 - DNA, 17 bp, Homo sapiens
tgagagaaagagagaag

SEQ ID NO: 3154535 - DNA, 19 bp, Homo sapiens
tgagagaaagagagaagcc

SEQ ID NO: 3154536 - DNA, 17 bp, Homo sapiens
tgagagaagccacgctg

SEQ ID NO: 3154537 - DNA, 15 bp, Homo sapiens
tgagagaatggagac

SEQ ID NO: 3154538 - DNA, 14 bp, Homo sapiens
tgagagacacgctg

SEQ ID NO: 3154539 - DNA, 12 bp, Homo sapiens
tgagagactttt

SEQ ID NO: 3154540 - DNA, 20 bp, Homo sapiens
tgagagagacaggcagctcg

SEQ ID NO: 3154541 - DNA, 18 bp, Homo sapiens
tgagagagagactgtgtg

SEQ ID NO: 3154542 - DNA, 18 bp, Homo sapiens
tgagagagagtcttactc

SEQ ID NO: 3154543 - DNA, 23 bp, Homo sapiens
tgagagcccaagttatctttccc

SEQ ID NO: 3154544 - DNA, 16 bp, Homo sapiens
tgagagcccagaggta

SEQ ID NO: 3154545 - DNA, 15 bp, Homo sapiens
tgagagcgaggctga

SEQ ID NO: 3154546 - DNA, 19 bp, Homo sapiens
tgagagcgaggctgagcct

SEQ ID NO: 3154547 - DNA, 14 bp, Homo sapiens
tgagagctgggtgt

SEQ ID NO: 3154548 - DNA, 22 bp, Homo sapiens
tgagaggatgaatgtatgtgca

SEQ ID NO: 3154549 - DNA, 13 bp, Homo sapiens
tgagaggcaggca

SEQ ID NO: 3154550 - DNA, 16 bp, Homo sapiens
tgagaggcaggcatag

SEQ ID NO: 3154551 - DNA, 22 bp, Homo sapiens
tgagagggcatgcgcacaaggc

SEQ ID NO: 3154552 - DNA, 14 bp, Homo sapiens
tgagaggggaacag

SEQ ID NO: 3154553 - DNA, 12 bp, Homo sapiens
tgagaggggaag

SEQ ID NO: 3154554 - DNA, 14 bp, Homo sapiens
tgagaggtttgact

SEQ ID NO: 3154555 - DNA, 17 bp, Homo sapiens
tgagagtatcaggtctc

SEQ ID NO: 3154556 - DNA, 19 bp, Homo sapiens
tgagagtatcaggtctccc

SEQ ID NO: 3154557 - DNA, 14 bp, Homo sapiens
tgagagtcaaagct

SEQ ID NO: 3154558 - DNA, 15 bp, Homo sapiens
tgagagtctagattc

SEQ ID NO: 3154559 - DNA, 16 bp, Homo sapiens
tgagagtctagattct

SEQ ID NO: 3154560 - DNA, 18 bp, Homo sapiens
tgagagttttgtcttgaa

SEQ ID NO: 3154561 - DNA, 20 bp, Homo sapiens
tgagataagtaggctggttt

SEQ ID NO: 3154562 - DNA, 16 bp, Homo sapiens
tgagataatgttagag

SEQ ID NO: 3154563 - DNA, 14 bp, Homo sapiens
tgagatattaaatt

SEQ ID NO: 3154564 - DNA, 20 bp, Homo sapiens
tgagatcacagcctccaggg

SEQ ID NO: 3154565 - DNA, 23 bp, Homo sapiens
tgagatcctggagtgatatgatc

SEQ ID NO: 3154566 - DNA, 20 bp, Homo sapiens
tgagatcgtgctactgcact

SEQ ID NO: 3154567 - DNA, 23 bp, Homo sapiens
tgagatcgtgctactgcactcca

SEQ ID NO: 3154568 - DNA, 16 bp, Homo sapiens
tgagatgatttggtca

SEQ ID NO: 3154569 - DNA, 16 bp, Homo sapiens
tgagatgctagaactc

SEQ ID NO: 3154570 - DNA, 15 bp, Homo sapiens
tgagatgctggagaa

SEQ ID NO: 3154571 - DNA, 17 bp, Homo sapiens
tgagatgctggagaaga

SEQ ID NO: 3154572 - DNA, 23 bp, Homo sapiens
tgagatgctggagaagagaggag

SEQ ID NO: 3154573 - DNA, 16 bp, Homo sapiens
tgagatggttaaaaag

SEQ ID NO: 3154574 - DNA, 19 bp, Homo sapiens
tgagatggttaaaaaggcc

SEQ ID NO: 3154575 - DNA, 22 bp, Homo sapiens
tgagatggttaaaaaggccaaa

SEQ ID NO: 3154576 - DNA, 17 bp, Homo sapiens
tgagatgtgttcctcct

SEQ ID NO: 3154577 - DNA, 18 bp, Homo sapiens
tgagatgttgtgtggcaa

SEQ ID NO: 3154578 - DNA, 19 bp, Homo sapiens
tgagattacagaggaagtt

SEQ ID NO: 3154579 - DNA, 16 bp, Homo sapiens
tgagattacaggcatg

SEQ ID NO: 3154580 - DNA, 19 bp, Homo sapiens
tgagattgacctgaggaga

SEQ ID NO: 3154581 - DNA, 13 bp, Homo sapiens
tgagattggtttt

SEQ ID NO: 3154582 - DNA, 19 bp, Homo sapiens
tgagattggttttcctgtg

SEQ ID NO: 3154583 - DNA, 18 bp, Homo sapiens
tgagatttcttaaatctt

SEQ ID NO: 3154584 - DNA, 22 bp, Homo sapiens
tgagatttgccagcacaggggc

SEQ ID NO: 3154585 - DNA, 20 bp, Homo sapiens
tgagattttttttaaaagtt

SEQ ID NO: 3154586 - DNA, 19 bp, Homo sapiens
tgagcaaaatatgcccctt

SEQ ID NO: 3154587 - DNA, 20 bp, Homo sapiens
tgagcaaaatatgccccttc

SEQ ID NO: 3154588 - DNA, 15 bp, Homo sapiens
tgagcaaatgtggct

SEQ ID NO: 3154589 - DNA, 16 bp, Homo sapiens
tgagcaaatgtggctc

SEQ ID NO: 3154590 - DNA, 19 bp, Homo sapiens
tgagcaaatgtggctcctg

SEQ ID NO: 3154591 - DNA, 14 bp, Homo sapiens
tgagcacctgggga

SEQ ID NO: 3154592 - DNA, 13 bp, Homo sapiens
tgagcagaaggaa

SEQ ID NO: 3154593 - DNA, 19 bp, Homo sapiens
tgagcagccgccagctggg

SEQ ID NO: 3154594 - DNA, 12 bp, Homo sapiens
tgagcagggctc

SEQ ID NO: 3154595 - DNA, 12 bp, Homo sapiens
tgagcagtggct

SEQ ID NO: 3154596 - DNA, 18 bp, Homo sapiens
tgagcatgtaaaagcgga

SEQ ID NO: 3154597 - DNA, 16 bp, Homo sapiens
tgagccactctcttcc

SEQ ID NO: 3154598 - DNA, 18 bp, Homo sapiens
tgagccactgagcctggc

SEQ ID NO: 3154599 - DNA, 11 bp, Homo sapiens
tgagccactgc

SEQ ID NO: 3154600 - DNA, 13 bp, Homo sapiens
tgagccactgcac

SEQ ID NO: 3154601 - DNA, 14 bp, Homo sapiens
tgagccagacaaat

SEQ ID NO: 3154602 - DNA, 16 bp, Homo sapiens
tgagccagtaatcttt

SEQ ID NO: 3154603 - DNA, 20 bp, Homo sapiens
tgagccatcactagaagaaa

SEQ ID NO: 3154604 - DNA, 16 bp, Homo sapiens
tgagcccacaaagcct

SEQ ID NO: 3154605 - DNA, 17 bp, Homo sapiens
tgagcccacaaagcctt

SEQ ID NO: 3154606 - DNA, 12 bp, Homo sapiens
tgagcccagctg

SEQ ID NO: 3154607 - DNA, 14 bp, Homo sapiens
tgagcccagctgcc

SEQ ID NO: 3154608 - DNA, 20 bp, Homo sapiens
tgagcccagctgcctggaga

SEQ ID NO: 3154609 - DNA, 14 bp, Homo sapiens
tgagcccaggccgt

SEQ ID NO: 3154610 - DNA, 18 bp, Homo sapiens
tgagcccatgttctgccc

SEQ ID NO: 3154611 - DNA, 17 bp, Homo sapiens
tgagccccaagtcctga

SEQ ID NO: 3154612 - DNA, 13 bp, Homo sapiens
tgagccccagggg

SEQ ID NO: 3154613 - DNA, 19 bp, Homo sapiens
tgagccccaggggggcctc

SEQ ID NO: 3154614 - DNA, 20 bp, Homo sapiens
tgagcccccccaacactgtg

SEQ ID NO: 3154615 - DNA, 22 bp, Homo sapiens
tgagcccccccaacactgtgcc

SEQ ID NO: 3154616 - DNA, 23 bp, Homo sapiens
tgagcccccccaacactgtgccc

SEQ ID NO: 3154617 - DNA, 15 bp, Homo sapiens
tgagcccccggctag

SEQ ID NO: 3154618 - DNA, 22 bp, Homo sapiens
tgagccccgcagacctccccag

SEQ ID NO: 3154619 - DNA, 23 bp, Homo sapiens
tgagccccgcagacctccccagc

SEQ ID NO: 3154620 - DNA, 14 bp, Homo sapiens
tgagccccgccctc

SEQ ID NO: 3154621 - DNA, 20 bp, Homo sapiens
tgagccccgccctcttcctg

SEQ ID NO: 3154622 - DNA, 22 bp, Homo sapiens
tgagccccgccctcttcctgac

SEQ ID NO: 3154623 - DNA, 15 bp, Homo sapiens
tgagcccgggctgcc

SEQ ID NO: 3154624 - DNA, 16 bp, Homo sapiens
tgagcccgggctgcct

SEQ ID NO: 3154625 - DNA, 20 bp, Homo sapiens
tgagccctactccctgcaga

SEQ ID NO: 3154626 - DNA, 23 bp, Homo sapiens
tgagccctactccctgcagatgc

SEQ ID NO: 3154627 - DNA, 12 bp, Homo sapiens
tgagccctggct

SEQ ID NO: 3154628 - DNA, 13 bp, Homo sapiens
tgagccctgggga

SEQ ID NO: 3154629 - DNA, 21 bp, Homo sapiens
tgagccgctgtgagcccctgg

SEQ ID NO: 3154630 - DNA, 14 bp, Homo sapiens
tgagccgtgaactg

SEQ ID NO: 3154631 - DNA, 13 bp, Homo sapiens
tgagcctatgata

SEQ ID NO: 3154632 - DNA, 11 bp, Homo sapiens
tgagcctcaga

SEQ ID NO: 3154633 - DNA, 21 bp, Homo sapiens
tgagcctcagcatcctggcac

SEQ ID NO: 3154634 - DNA, 12 bp, Homo sapiens
tgagcctccccc

SEQ ID NO: 3154635 - DNA, 14 bp, Homo sapiens
tgagcctcccccaa

SEQ ID NO: 3154636 - DNA, 12 bp, Homo sapiens
tgagcctctgct

SEQ ID NO: 3154637 - DNA, 17 bp, Homo sapiens
tgagcctctgctcccca

SEQ ID NO: 3154638 - DNA, 15 bp, Homo sapiens
tgagcctgcccgctg

SEQ ID NO: 3154639 - DNA, 18 bp, Homo sapiens
tgagcctgcccgctgcaa

SEQ ID NO: 3154640 - DNA, 21 bp, Homo sapiens
tgagcctgtgggtccccactc

SEQ ID NO: 3154641 - DNA, 23 bp, Homo sapiens
tgagcgattattatctaaagtgt

SEQ ID NO: 3154642 - DNA, 23 bp, Homo sapiens
tgagcgcctccatccaaggccag

SEQ ID NO: 3154643 - DNA, 19 bp, Homo sapiens
tgagcggccgcagagactg

SEQ ID NO: 3154644 - DNA, 13 bp, Homo sapiens
tgagcgggaggca

SEQ ID NO: 3154645 - DNA, 15 bp, Homo sapiens
tgagcgggaggcaga

SEQ ID NO: 3154646 - DNA, 21 bp, Homo sapiens
tgagctatgattatgccactg

SEQ ID NO: 3154647 - DNA, 15 bp, Homo sapiens
tgagctatttcatct

SEQ ID NO: 3154648 - DNA, 13 bp, Homo sapiens
tgagctcaggcat

SEQ ID NO: 3154649 - DNA, 16 bp, Homo sapiens
tgagctccccagatct

SEQ ID NO: 3154650 - DNA, 16 bp, Homo sapiens
tgagctccttgattgc

SEQ ID NO: 3154651 - DNA, 16 bp, Homo sapiens
tgagctctgaaatctt

SEQ ID NO: 3154652 - DNA, 17 bp, Homo sapiens
tgagctctgaaatcttc

SEQ ID NO: 3154653 - DNA, 23 bp, Homo sapiens
tgagctctgacccttgggcctgg

SEQ ID NO: 3154654 - DNA, 12 bp, Homo sapiens
tgagctgccttc

SEQ ID NO: 3154655 - DNA, 17 bp, Homo sapiens
tgagctggaaggggcca

SEQ ID NO: 3154656 - DNA, 19 bp, Homo sapiens
tgagctggaaggggccacg

SEQ ID NO: 3154657 - DNA, 18 bp, Homo sapiens
tgagctggcctctctagc

SEQ ID NO: 3154658 - DNA, 14 bp, Homo sapiens
tgagctgggcccag

SEQ ID NO: 3154659 - DNA, 16 bp, Homo sapiens
tgagctgggcccagcc

SEQ ID NO: 3154660 - DNA, 19 bp, Homo sapiens
tgagctgggcccagcccct

SEQ ID NO: 3154661 - DNA, 18 bp, Homo sapiens
tgagctggggactcaggg

SEQ ID NO: 3154662 - DNA, 15 bp, Homo sapiens
tgagctggggccaca

SEQ ID NO: 3154663 - DNA, 17 bp, Homo sapiens
tgagcttcggttctcca

SEQ ID NO: 3154664 - DNA, 16 bp, Homo sapiens
tgagcttctctgtgaa

SEQ ID NO: 3154665 - DNA, 21 bp, Homo sapiens
tgagcttgtcttttctgctga

SEQ ID NO: 3154666 - DNA, 22 bp, Homo sapiens
tgagcttgtcttttctgctgag

SEQ ID NO: 3154667 - DNA, 21 bp, Homo sapiens
tgagctttggggacagttggc

SEQ ID NO: 3154668 - DNA, 21 bp, Homo sapiens
tgaggaaatccattgtttaaa

SEQ ID NO: 3154669 - DNA, 23 bp, Homo sapiens
tgaggaagatgggggcaagaaga

SEQ ID NO: 3154670 - DNA, 23 bp, Homo sapiens
tgaggaaggaggggaagctgcag

SEQ ID NO: 3154671 - DNA, 19 bp, Homo sapiens
tgaggaatagttgagcccc

SEQ ID NO: 3154672 - DNA, 14 bp, Homo sapiens
tgaggaattttctt

SEQ ID NO: 3154673 - DNA, 22 bp, Homo sapiens
tgaggacaccagtgaaagaagc

SEQ ID NO: 3154674 - DNA, 21 bp, Homo sapiens
tgaggacactaaccacgctgg

SEQ ID NO: 3154675 - DNA, 14 bp, Homo sapiens
tgaggacagagtgg

SEQ ID NO: 3154676 - DNA, 20 bp, Homo sapiens
tgaggaccgctgataagcat

SEQ ID NO: 3154677 - DNA, 24 bp, Homo sapiens
tgaggactctgcaagtgtctggag

SEQ ID NO: 3154678 - DNA, 14 bp, Homo sapiens
tgaggagaatgaaa

SEQ ID NO: 3154679 - DNA, 17 bp, Homo sapiens
tgaggagacattctgtc

SEQ ID NO: 3154680 - DNA, 17 bp, Homo sapiens
tgaggagctgctggctt

SEQ ID NO: 3154681 - DNA, 12 bp, Homo sapiens
tgaggaggaaaa

SEQ ID NO: 3154682 - DNA, 23 bp, Homo sapiens
tgaggaggatgtccctgggccag

SEQ ID NO: 3154683 - DNA, 18 bp, Homo sapiens
tgaggagggtggaggaag

SEQ ID NO: 3154684 - DNA, 16 bp, Homo sapiens
tgaggagtaaaattca

SEQ ID NO: 3154685 - DNA, 21 bp, Homo sapiens
tgaggagtattaagaatgcag

SEQ ID NO: 3154686 - DNA, 17 bp, Homo sapiens
tgaggatgcaacaaata

SEQ ID NO: 3154687 - DNA, 14 bp, Homo sapiens
tgaggattgtggaa

SEQ ID NO: 3154688 - DNA, 17 bp, Homo sapiens
tgaggcaaattaactgt

SEQ ID NO: 3154689 - DNA, 15 bp, Homo sapiens
tgaggcaagtgtggg

SEQ ID NO: 3154690 - DNA, 17 bp, Homo sapiens
tgaggcattcggggaag

SEQ ID NO: 3154691 - DNA, 14 bp, Homo sapiens
tgaggccatctcag

SEQ ID NO: 3154692 - DNA, 15 bp, Homo sapiens
tgaggccatctcagg

SEQ ID NO: 3154693 - DNA, 19 bp, Homo sapiens
tgaggccatctcaggagat

SEQ ID NO: 3154694 - DNA, 14 bp, Homo sapiens
tgaggccctgccca

SEQ ID NO: 3154695 - DNA, 12 bp, Homo sapiens
tgaggcctgagg

SEQ ID NO: 3154696 - DNA, 12 bp, Homo sapiens
tgaggcctggac

SEQ ID NO: 3154697 - DNA, 17 bp, Homo sapiens
tgaggcctggactttcc

SEQ ID NO: 3154698 - DNA, 19 bp, Homo sapiens
tgaggcctggactttcctg

SEQ ID NO: 3154699 - DNA, 20 bp, Homo sapiens
tgaggcctggactttcctgc

SEQ ID NO: 3154700 - DNA, 12 bp, Homo sapiens
tgaggcctgggc

SEQ ID NO: 3154701 - DNA, 22 bp, Homo sapiens
tgaggcctgggccgctgccacg

SEQ ID NO: 3154702 - DNA, 23 bp, Homo sapiens
tgaggcgggtggatcacctgagg

SEQ ID NO: 3154703 - DNA, 18 bp, Homo sapiens
tgaggcggtttcctgaat

SEQ ID NO: 3154704 - DNA, 20 bp, Homo sapiens
tgaggctatggagggtcctc

SEQ ID NO: 3154705 - DNA, 21 bp, Homo sapiens
tgaggctctgacccagtgaga

SEQ ID NO: 3154706 - DNA, 18 bp, Homo sapiens
tgaggctgagactgcggg

SEQ ID NO: 3154707 - DNA, 14 bp, Homo sapiens
tgaggctgtcctgt

SEQ ID NO: 3154708 - DNA, 11 bp, Homo sapiens
tgaggctgtgg

SEQ ID NO: 3154709 - DNA, 16 bp, Homo sapiens
tgaggcttagagagag

SEQ ID NO: 3154710 - DNA, 17 bp, Homo sapiens
tgaggcttccaggctct

SEQ ID NO: 3154711 - DNA, 21 bp, Homo sapiens
tgagggaaagtgcatatgaaa

SEQ ID NO: 3154712 - DNA, 17 bp, Homo sapiens
tgagggaagagtagctg

SEQ ID NO: 3154713 - DNA, 19 bp, Homo sapiens
tgagggactgcctctgcca

SEQ ID NO: 3154714 - DNA, 13 bp, Homo sapiens
tgagggaggaggc

SEQ ID NO: 3154715 - DNA, 14 bp, Homo sapiens
tgagggaggaggcc

SEQ ID NO: 3154716 - DNA, 19 bp, Homo sapiens
tgagggagggggcgctcag

SEQ ID NO: 3154717 - DNA, 17 bp, Homo sapiens
tgagggatcacagggcc

SEQ ID NO: 3154718 - DNA, 21 bp, Homo sapiens
tgagggccactttttttttat

SEQ ID NO: 3154719 - DNA, 12 bp, Homo sapiens
tgagggcccaga

SEQ ID NO: 3154720 - DNA, 15 bp, Homo sapiens
tgagggcccagagca

SEQ ID NO: 3154721 - DNA, 17 bp, Homo sapiens
tgagggcccagagcagg

SEQ ID NO: 3154722 - DNA, 21 bp, Homo sapiens
tgagggcccagagcaggaagc

SEQ ID NO: 3154723 - DNA, 16 bp, Homo sapiens
tgagggcccagccagg

SEQ ID NO: 3154724 - DNA, 19 bp, Homo sapiens
tgagggcccagccaggagc

SEQ ID NO: 3154725 - DNA, 11 bp, Homo sapiens
tgaggggagga

SEQ ID NO: 3154726 - DNA, 19 bp, Homo sapiens
tgaggggccctggccagga

SEQ ID NO: 3154727 - DNA, 15 bp, Homo sapiens
tgaggggctcctgga

SEQ ID NO: 3154728 - DNA, 22 bp, Homo sapiens
tgaggggctggccttcctgccc

SEQ ID NO: 3154729 - DNA, 20 bp, Homo sapiens
tgagggtcattctttattct

SEQ ID NO: 3154730 - DNA, 22 bp, Homo sapiens
tgagggtcattctttattcttt

SEQ ID NO: 3154731 - DNA, 13 bp, Homo sapiens
tgagggtgactgt

SEQ ID NO: 3154732 - DNA, 21 bp, Homo sapiens
tgagggtgcttgttccctctc

SEQ ID NO: 3154733 - DNA, 14 bp, Homo sapiens
tgagggtgtttcct

SEQ ID NO: 3154734 - DNA, 15 bp, Homo sapiens
tgagggtgtttcctc

SEQ ID NO: 3154735 - DNA, 20 bp, Homo sapiens
tgagggtgtttcctctaaac

SEQ ID NO: 3154736 - DNA, 20 bp, Homo sapiens
tgagggttgggctggtgtca

SEQ ID NO: 3154737 - DNA, 22 bp, Homo sapiens
tgaggtaccagttgtatttaat

SEQ ID NO: 3154738 - DNA, 15 bp, Homo sapiens
tgaggtataaagaca

SEQ ID NO: 3154739 - DNA, 16 bp, Homo sapiens
tgaggtataaagacaa

SEQ ID NO: 3154740 - DNA, 13 bp, Homo sapiens
tgaggtcaccagg

SEQ ID NO: 3154741 - DNA, 16 bp, Homo sapiens
tgaggtcaccagggga

SEQ ID NO: 3154742 - DNA, 21 bp, Homo sapiens
tgaggtcaccaggggaggagc

SEQ ID NO: 3154743 - DNA, 13 bp, Homo sapiens
tgaggtcagagcc

SEQ ID NO: 3154744 - DNA, 14 bp, Homo sapiens
tgaggtcagagcct

SEQ ID NO: 3154745 - DNA, 18 bp, Homo sapiens
tgaggtcagggagtgctg

SEQ ID NO: 3154746 - DNA, 19 bp, Homo sapiens
tgaggtccaccggcccctg

SEQ ID NO: 3154747 - DNA, 16 bp, Homo sapiens
tgaggtcccaggaagt

SEQ ID NO: 3154748 - DNA, 12 bp, Homo sapiens
tgaggtccctgt

SEQ ID NO: 3154749 - DNA, 18 bp, Homo sapiens
tgaggtctcttgagggag

SEQ ID NO: 3154750 - DNA, 16 bp, Homo sapiens
tgaggtctgttccttt

SEQ ID NO: 3154751 - DNA, 19 bp, Homo sapiens
tgaggtcttttgacatgtg

SEQ ID NO: 3154752 - DNA, 20 bp, Homo sapiens
tgaggtcttttgacatgtgg

SEQ ID NO: 3154753 - DNA, 16 bp, Homo sapiens
tgaggtgaaagggagc

SEQ ID NO: 3154754 - DNA, 14 bp, Homo sapiens
tgaggtgcctgtcc

SEQ ID NO: 3154755 - DNA, 16 bp, Homo sapiens
tgaggtgcctgtccca

SEQ ID NO: 3154756 - DNA, 21 bp, Homo sapiens
tgaggtggcactttttcattt

SEQ ID NO: 3154757 - DNA, 21 bp, Homo sapiens
tgaggtgggaggtggaagaag

SEQ ID NO: 3154758 - DNA, 13 bp, Homo sapiens
tgaggtgggccca

SEQ ID NO: 3154759 - DNA, 14 bp, Homo sapiens
tgaggtgggcccag

SEQ ID NO: 3154760 - DNA, 14 bp, Homo sapiens
tgaggtggtctgaa

SEQ ID NO: 3154761 - DNA, 20 bp, Homo sapiens
tgaggtggtctgaatgttct

SEQ ID NO: 3154762 - DNA, 21 bp, Homo sapiens
tgaggtggtctgaatgttctg

SEQ ID NO: 3154763 - DNA, 14 bp, Homo sapiens
tgaggtgtgggggc

SEQ ID NO: 3154764 - DNA, 21 bp, Homo sapiens
tgaggtgtgggggctgcagca

SEQ ID NO: 3154765 - DNA, 14 bp, Homo sapiens
tgaggttcctctgc

SEQ ID NO: 3154766 - DNA, 21 bp, Homo sapiens
tgaggttcctctgcctgcccc

SEQ ID NO: 3154767 - DNA, 13 bp, Homo sapiens
tgaggttctgaga

SEQ ID NO: 3154768 - DNA, 17 bp, Homo sapiens
tgaggttctgagaccag

SEQ ID NO: 3154769 - DNA, 19 bp, Homo sapiens
tgaggttgacctgtttctc

SEQ ID NO: 3154770 - DNA, 15 bp, Homo sapiens
tgaggtttggaagag

SEQ ID NO: 3154771 - DNA, 16 bp, Homo sapiens
tgaggtttttaaatat

SEQ ID NO: 3154772 - DNA, 10 bp, Homo sapiens
tgagtaacat

SEQ ID NO: 3154773 - DNA, 16 bp, Homo sapiens
tgagtaacatttgctg

SEQ ID NO: 3154774 - DNA, 21 bp, Homo sapiens
tgagtacagtgaggagggtgg

SEQ ID NO: 3154775 - DNA, 19 bp, Homo sapiens
tgagtactagaatttgtat

SEQ ID NO: 3154776 - DNA, 21 bp, Homo sapiens
tgagtactagaatttgtattt

SEQ ID NO: 3154777 - DNA, 19 bp, Homo sapiens
tgagtagatccatttccat

SEQ ID NO: 3154778 - DNA, 23 bp, Homo sapiens
tgagtaggcggcgatttttgtat

SEQ ID NO: 3154779 - DNA, 19 bp, Homo sapiens
tgagtataaaaacttgaaa

SEQ ID NO: 3154780 - DNA, 13 bp, Homo sapiens
tgagtattctcat

SEQ ID NO: 3154781 - DNA, 22 bp, Homo sapiens
tgagtattctcataggagactg

SEQ ID NO: 3154782 - DNA, 21 bp, Homo sapiens
tgagtattgtttaaaatgtaa

SEQ ID NO: 3154783 - DNA, 14 bp, Homo sapiens
tgagtatttggtaa

SEQ ID NO: 3154784 - DNA, 19 bp, Homo sapiens
tgagtatttggtccaaaaa

SEQ ID NO: 3154785 - DNA, 22 bp, Homo sapiens
tgagtcaccctacctgtgcctg

SEQ ID NO: 3154786 - DNA, 22 bp, Homo sapiens
tgagtcagggcccagaggctga

SEQ ID NO: 3154787 - DNA, 14 bp, Homo sapiens
tgagtcattgactt

SEQ ID NO: 3154788 - DNA, 16 bp, Homo sapiens
tgagtcattgacttca

SEQ ID NO: 3154789 - DNA, 17 bp, Homo sapiens
tgagtccattctcccag

SEQ ID NO: 3154790 - DNA, 19 bp, Homo sapiens
tgagtccattctcccaggt

SEQ ID NO: 3154791 - DNA, 20 bp, Homo sapiens
tgagtccattctcccaggta

SEQ ID NO: 3154792 - DNA, 19 bp, Homo sapiens
tgagtcccctactccctct

SEQ ID NO: 3154793 - DNA, 18 bp, Homo sapiens
tgagtcctgtctctgcct

SEQ ID NO: 3154794 - DNA, 18 bp, Homo sapiens
tgagtccttgaaaatatt

SEQ ID NO: 3154795 - DNA, 18 bp, Homo sapiens
tgagtccttgatttcaaa

SEQ ID NO: 3154796 - DNA, 18 bp, Homo sapiens
tgagtcgaggacagggag

SEQ ID NO: 3154797 - DNA, 15 bp, Homo sapiens
tgagtctcccaaggc

SEQ ID NO: 3154798 - DNA, 16 bp, Homo sapiens
tgagtctcccaaggct

SEQ ID NO: 3154799 - DNA, 14 bp, Homo sapiens
tgagtctctggggc

SEQ ID NO: 3154800 - DNA, 14 bp, Homo sapiens
tgagtctcttcaga

SEQ ID NO: 3154801 - DNA, 15 bp, Homo sapiens
tgagtctcttcagaa

SEQ ID NO: 3154802 - DNA, 15 bp, Homo sapiens
tgagtcttggcggca

SEQ ID NO: 3154803 - DNA, 16 bp, Homo sapiens
tgagtctttggttcta

SEQ ID NO: 3154804 - DNA, 18 bp, Homo sapiens
tgagtctttggttctaag

SEQ ID NO: 3154805 - DNA, 21 bp, Homo sapiens
tgagtctttggttctaaggac

SEQ ID NO: 3154806 - DNA, 23 bp, Homo sapiens
tgagtgaaaatttttacattcat

SEQ ID NO: 3154807 - DNA, 23 bp, Homo sapiens
tgagtgagaggcgacaggagtat

SEQ ID NO: 3154808 - DNA, 20 bp, Homo sapiens
tgagtgatcctccaacttca

SEQ ID NO: 3154809 - DNA, 15 bp, Homo sapiens
tgagtgccttttgca

SEQ ID NO: 3154810 - DNA, 22 bp, Homo sapiens
tgagtgccttttgcagaagagg

SEQ ID NO: 3154811 - DNA, 16 bp, Homo sapiens
tgagtgcgtctgaggg

SEQ ID NO: 3154812 - DNA, 20 bp, Homo sapiens
tgagtgcttgttagagagaa

SEQ ID NO: 3154813 - DNA, 22 bp, Homo sapiens
tgagtgcttgttagagagaaag

SEQ ID NO: 3154814 - DNA, 19 bp, Homo sapiens
tgagtggaatgcagggaag

SEQ ID NO: 3154815 - DNA, 13 bp, Homo sapiens
tgagtggcagggg

SEQ ID NO: 3154816 - DNA, 17 bp, Homo sapiens
tgagtggccagggaatc

SEQ ID NO: 3154817 - DNA, 20 bp, Homo sapiens
tgagtggtggttcctttgca

SEQ ID NO: 3154818 - DNA, 22 bp, Homo sapiens
tgagtgtaaataattttaaata

SEQ ID NO: 3154819 - DNA, 14 bp, Homo sapiens
tgagtgtaagtgtg

SEQ ID NO: 3154820 - DNA, 13 bp, Homo sapiens
tgagtgtaatgtt

SEQ ID NO: 3154821 - DNA, 18 bp, Homo sapiens
tgagtgtatgagtagcca

SEQ ID NO: 3154822 - DNA, 16 bp, Homo sapiens
tgagtgtgacagggcc

SEQ ID NO: 3154823 - DNA, 16 bp, Homo sapiens
tgagtgtgcatggagg

SEQ ID NO: 3154824 - DNA, 23 bp, Homo sapiens
tgagtgttcctttttaaatgtga

SEQ ID NO: 3154825 - DNA, 14 bp, Homo sapiens
tgagtgtttggggg

SEQ ID NO: 3154826 - DNA, 18 bp, Homo sapiens
tgagttacattaaaataa

SEQ ID NO: 3154827 - DNA, 15 bp, Homo sapiens
tgagttactgaaggt

SEQ ID NO: 3154828 - DNA, 18 bp, Homo sapiens
tgagttacttgtctgagg

SEQ ID NO: 3154829 - DNA, 20 bp, Homo sapiens
tgagttacttgtctgaggcc

SEQ ID NO: 3154830 - DNA, 21 bp, Homo sapiens
tgagttacttgtctgaggcct

SEQ ID NO: 3154831 - DNA, 12 bp, Homo sapiens
tgagttatcatg

SEQ ID NO: 3154832 - DNA, 14 bp, Homo sapiens
tgagttattttaat

SEQ ID NO: 3154833 - DNA, 16 bp, Homo sapiens
tgagttcaccatctct

SEQ ID NO: 3154834 - DNA, 18 bp, Homo sapiens
tgagttgccaagacaaat

SEQ ID NO: 3154835 - DNA, 16 bp, Homo sapiens
tgagtttaccttgtat

SEQ ID NO: 3154836 - DNA, 11 bp, Homo sapiens
tgagtttccta

SEQ ID NO: 3154837 - DNA, 18 bp, Homo sapiens
tgagtttttgatagcttt

SEQ ID NO: 3154838 - DNA, 18 bp, Homo sapiens
tgataaaacaacagctcg

SEQ ID NO: 3154839 - DNA, 15 bp, Homo sapiens
tgataaaagttttga

SEQ ID NO: 3154840 - DNA, 12 bp, Homo sapiens
tgataaatatat

SEQ ID NO: 3154841 - DNA, 13 bp, Homo sapiens
tgataaatatata

SEQ ID NO: 3154842 - DNA, 23 bp, Homo sapiens
tgataactctgcaaaggcctggg

SEQ ID NO: 3154843 - DNA, 15 bp, Homo sapiens
tgataacttggggag

SEQ ID NO: 3154844 - DNA, 20 bp, Homo sapiens
tgataagactgtttttaagt

SEQ ID NO: 3154845 - DNA, 13 bp, Homo sapiens
tgataagcacatt

SEQ ID NO: 3154846 - DNA, 15 bp, Homo sapiens
tgataagcattgact

SEQ ID NO: 3154847 - DNA, 20 bp, Homo sapiens
tgataaggatcagaacagca

SEQ ID NO: 3154848 - DNA, 16 bp, Homo sapiens
tgataagggaaaagat

SEQ ID NO: 3154849 - DNA, 12 bp, Homo sapiens
tgataagtaaat

SEQ ID NO: 3154850 - DNA, 13 bp, Homo sapiens
tgataagtggaaa

SEQ ID NO: 3154851 - DNA, 18 bp, Homo sapiens
tgataagtggaaaaaaga

SEQ ID NO: 3154852 - DNA, 20 bp, Homo sapiens
tgataagtggaaaaaagaga

SEQ ID NO: 3154853 - DNA, 23 bp, Homo sapiens
tgataagttcctttccttttctt

SEQ ID NO: 3154854 - DNA, 13 bp, Homo sapiens
tgataataaattg

SEQ ID NO: 3154855 - DNA, 17 bp, Homo sapiens
tgataataatattgttt

SEQ ID NO: 3154856 - DNA, 14 bp, Homo sapiens
tgataatagattct

SEQ ID NO: 3154857 - DNA, 22 bp, Homo sapiens
tgataatcttcaggtgaacact

SEQ ID NO: 3154858 - DNA, 18 bp, Homo sapiens
tgataatgatgatgacga

SEQ ID NO: 3154859 - DNA, 21 bp, Homo sapiens
tgataatgatttgctctttga

SEQ ID NO: 3154860 - DNA, 14 bp, Homo sapiens
tgatacataactaa

SEQ ID NO: 3154861 - DNA, 17 bp, Homo sapiens
tgatacataactaaatt

SEQ ID NO: 3154862 - DNA, 14 bp, Homo sapiens
tgatacatttttgt

SEQ ID NO: 3154863 - DNA, 18 bp, Homo sapiens
tgataccacctttactgt

SEQ ID NO: 3154864 - DNA, 17 bp, Homo sapiens
tgatacgatagttacat

SEQ ID NO: 3154865 - DNA, 17 bp, Homo sapiens
tgatactaaaagttctt

SEQ ID NO: 3154866 - DNA, 14 bp, Homo sapiens
tgatactgcttttc

SEQ ID NO: 3154867 - DNA, 16 bp, Homo sapiens
tgatacttatattttc

SEQ ID NO: 3154868 - DNA, 14 bp, Homo sapiens
tgatacttcactac

SEQ ID NO: 3154869 - DNA, 12 bp, Homo sapiens
tgatagcacttt

SEQ ID NO: 3154870 - DNA, 21 bp, Homo sapiens
tgatagctaacattttaaata

SEQ ID NO: 3154871 - DNA, 13 bp, Homo sapiens
tgatagctttatt

SEQ ID NO: 3154872 - DNA, 14 bp, Homo sapiens
tgatagctttattt

SEQ ID NO: 3154873 - DNA, 21 bp, Homo sapiens
tgataggaagcgtctggcaga

SEQ ID NO: 3154874 - DNA, 12 bp, Homo sapiens
tgatataaattc

SEQ ID NO: 3154875 - DNA, 18 bp, Homo sapiens
tgatataatttccatagt

SEQ ID NO: 3154876 - DNA, 14 bp, Homo sapiens
tgatatacaaagtg

SEQ ID NO: 3154877 - DNA, 15 bp, Homo sapiens
tgatatacattgtgt

SEQ ID NO: 3154878 - DNA, 16 bp, Homo sapiens
tgatataccaaattaa

SEQ ID NO: 3154879 - DNA, 22 bp, Homo sapiens
tgatatacttttttcttattta

SEQ ID NO: 3154880 - DNA, 14 bp, Homo sapiens
tgatatattttaca

SEQ ID NO: 3154881 - DNA, 21 bp, Homo sapiens
tgatatcatgcccctgtactc

SEQ ID NO: 3154882 - DNA, 19 bp, Homo sapiens
tgatatgagtatacaatat

SEQ ID NO: 3154883 - DNA, 18 bp, Homo sapiens
tgatatggcagaagacac

SEQ ID NO: 3154884 - DNA, 15 bp, Homo sapiens
tgatattaatcaaaa

SEQ ID NO: 3154885 - DNA, 21 bp, Homo sapiens
tgatattaatcaaaattgtct

SEQ ID NO: 3154886 - DNA, 16 bp, Homo sapiens
tgatattccatgaatg

SEQ ID NO: 3154887 - DNA, 19 bp, Homo sapiens
tgatattccatgaatgtat

SEQ ID NO: 3154888 - DNA, 20 bp, Homo sapiens
tgatattccatgaatgtatc

SEQ ID NO: 3154889 - DNA, 15 bp, Homo sapiens
tgatattctaagact

SEQ ID NO: 3154890 - DNA, 17 bp, Homo sapiens
tgatattctaagactta

SEQ ID NO: 3154891 - DNA, 16 bp, Homo sapiens
tgatatttggttattt

SEQ ID NO: 3154892 - DNA, 18 bp, Homo sapiens
tgatcaaaacctgtgcca

SEQ ID NO: 3154893 - DNA, 23 bp, Homo sapiens
tgatcaaattcatttttttcact

SEQ ID NO: 3154894 - DNA, 14 bp, Homo sapiens
tgatcaactgttca

SEQ ID NO: 3154895 - DNA, 13 bp, Homo sapiens
tgatcaataaaat

SEQ ID NO: 3154896 - DNA, 16 bp, Homo sapiens
tgatcaattaaatgta

SEQ ID NO: 3154897 - DNA, 18 bp, Homo sapiens
tgatcaattatagtttct

SEQ ID NO: 3154898 - DNA, 20 bp, Homo sapiens
tgatcaattatagtttctga

SEQ ID NO: 3154899 - DNA, 21 bp, Homo sapiens
tgatcaattatagtttctgag

SEQ ID NO: 3154900 - DNA, 16 bp, Homo sapiens
tgatcaattttgactt

SEQ ID NO: 3154901 - DNA, 15 bp, Homo sapiens
tgatcacccaatgca

SEQ ID NO: 3154902 - DNA, 13 bp, Homo sapiens
tgatcacggctca

SEQ ID NO: 3154903 - DNA, 20 bp, Homo sapiens
tgatcacggctcactgcagc

SEQ ID NO: 3154904 - DNA, 21 bp, Homo sapiens
tgatcacggctcactgcagcc

SEQ ID NO: 3154905 - DNA, 19 bp, Homo sapiens
tgatcactcccagcactcc

SEQ ID NO: 3154906 - DNA, 18 bp, Homo sapiens
tgatcactggcaatgaaa

SEQ ID NO: 3154907 - DNA, 21 bp, Homo sapiens
tgatcactttgttaaaaatat

SEQ ID NO: 3154908 - DNA, 18 bp, Homo sapiens
tgatcagtgttgttgctc

SEQ ID NO: 3154909 - DNA, 20 bp, Homo sapiens
tgatcataggtatttcaaaa

SEQ ID NO: 3154910 - DNA, 13 bp, Homo sapiens
tgatcatccactg

SEQ ID NO: 3154911 - DNA, 24 bp, Homo sapiens
tgatcatccactgtgccatgtgcc

SEQ ID NO: 3154912 - DNA, 15 bp, Homo sapiens
tgatcatcgccagag

SEQ ID NO: 3154913 - DNA, 20 bp, Homo sapiens
tgatcatcgccagaggtgct

SEQ ID NO: 3154914 - DNA, 16 bp, Homo sapiens
tgatcatgcattgttg

SEQ ID NO: 3154915 - DNA, 17 bp, Homo sapiens
tgatcatgtacttttta

SEQ ID NO: 3154916 - DNA, 12 bp, Homo sapiens
tgatcattgaaa

SEQ ID NO: 3154917 - DNA, 21 bp, Homo sapiens
tgatcattgaaatacttttta

SEQ ID NO: 3154918 - DNA, 18 bp, Homo sapiens
tgatcattttccccccac

SEQ ID NO: 3154919 - DNA, 17 bp, Homo sapiens
tgatccacccacctcag

SEQ ID NO: 3154920 - DNA, 18 bp, Homo sapiens
tgatccacccacctcagc

SEQ ID NO: 3154921 - DNA, 19 bp, Homo sapiens
tgatccacccacctcagcc

SEQ ID NO: 3154922 - DNA, 21 bp, Homo sapiens
tgatccacccacctcagcctc

SEQ ID NO: 3154923 - DNA, 18 bp, Homo sapiens
tgatccccaagtgtgaac

SEQ ID NO: 3154924 - DNA, 12 bp, Homo sapiens
tgatccgcctgc

SEQ ID NO: 3154925 - DNA, 16 bp, Homo sapiens
tgatccgcctgcctct

SEQ ID NO: 3154926 - DNA, 20 bp, Homo sapiens
tgatccgcctgcctctgcct

SEQ ID NO: 3154927 - DNA, 20 bp, Homo sapiens
tgatcctaactgaagagaca

SEQ ID NO: 3154928 - DNA, 17 bp, Homo sapiens
tgatcctccaacttcat

SEQ ID NO: 3154929 - DNA, 18 bp, Homo sapiens
tgatcctcccacctcagc

SEQ ID NO: 3154930 - DNA, 14 bp, Homo sapiens
tgatcctctatttt

SEQ ID NO: 3154931 - DNA, 15 bp, Homo sapiens
tgatcctctattttg

SEQ ID NO: 3154932 - DNA, 15 bp, Homo sapiens
tgatccttacaagtt

SEQ ID NO: 3154933 - DNA, 19 bp, Homo sapiens
tgatccttttttgtcattt

SEQ ID NO: 3154934 - DNA, 15 bp, Homo sapiens
tgatcgacgtggtga

SEQ ID NO: 3154935 - DNA, 15 bp, Homo sapiens
tgatcgagccactgc

SEQ ID NO: 3154936 - DNA, 18 bp, Homo sapiens
tgatcgagccactgcact

SEQ ID NO: 3154937 - DNA, 17 bp, Homo sapiens
tgatcgtatatttctca

SEQ ID NO: 3154938 - DNA, 19 bp, Homo sapiens
tgatctccatatgttacac

SEQ ID NO: 3154939 - DNA, 23 bp, Homo sapiens
tgatctcggatgaccaaaccagc

SEQ ID NO: 3154940 - DNA, 23 bp, Homo sapiens
tgatctctactaccacaaggaaa

SEQ ID NO: 3154941 - DNA, 14 bp, Homo sapiens
tgatctctccacgg

SEQ ID NO: 3154942 - DNA, 18 bp, Homo sapiens
tgatctgtagacttctgg

SEQ ID NO: 3154943 - DNA, 23 bp, Homo sapiens
tgatcttacaagatattgatgat

SEQ ID NO: 3154944 - DNA, 14 bp, Homo sapiens
tgatcttacagaaa

SEQ ID NO: 3154945 - DNA, 14 bp, Homo sapiens
tgatcttcttcatc

SEQ ID NO: 3154946 - DNA, 20 bp, Homo sapiens
tgatcttctttataattcta

SEQ ID NO: 3154947 - DNA, 17 bp, Homo sapiens
tgatcttgcattcattt

SEQ ID NO: 3154948 - DNA, 21 bp, Homo sapiens
tgatcttggcttactgcagcc

SEQ ID NO: 3154949 - DNA, 18 bp, Homo sapiens
tgatcttgtgctcagcat

SEQ ID NO: 3154950 - DNA, 15 bp, Homo sapiens
tgatctttttatcat

SEQ ID NO: 3154951 - DNA, 20 bp, Homo sapiens
tgatgaaaactaaggatttt

SEQ ID NO: 3154952 - DNA, 14 bp, Homo sapiens
tgatgaaaagattt

SEQ ID NO: 3154953 - DNA, 13 bp, Homo sapiens
tgatgaaatcatt

SEQ ID NO: 3154954 - DNA, 23 bp, Homo sapiens
tgatgaaatgaggtcagagcctg

SEQ ID NO: 3154955 - DNA, 16 bp, Homo sapiens
tgatgaaattcttgaa

SEQ ID NO: 3154956 - DNA, 17 bp, Homo sapiens
tgatgaacttattctgt

SEQ ID NO: 3154957 - DNA, 23 bp, Homo sapiens
tgatgaactttctcttcatactt

SEQ ID NO: 3154958 - DNA, 15 bp, Homo sapiens
tgatgaagaaattta

SEQ ID NO: 3154959 - DNA, 23 bp, Homo sapiens
tgatgaagcaaggaagatataca

SEQ ID NO: 3154960 - DNA, 12 bp, Homo sapiens
tgatgaagtata

SEQ ID NO: 3154961 - DNA, 20 bp, Homo sapiens
tgatgacacccaccctgtgc

SEQ ID NO: 3154962 - DNA, 18 bp, Homo sapiens
tgatgacattccaccatt

SEQ ID NO: 3154963 - DNA, 19 bp, Homo sapiens
tgatgaggtattttttcct

SEQ ID NO: 3154964 - DNA, 13 bp, Homo sapiens
tgatgagttgtga

SEQ ID NO: 3154965 - DNA, 21 bp, Homo sapiens
tgatgatcaaaacctgtgcca

SEQ ID NO: 3154966 - DNA, 21 bp, Homo sapiens
tgatgatcagctgtttgtcat

SEQ ID NO: 3154967 - DNA, 21 bp, Homo sapiens
tgatgatctttgcagacaggc

SEQ ID NO: 3154968 - DNA, 14 bp, Homo sapiens
tgatgatgaaaatt

SEQ ID NO: 3154969 - DNA, 20 bp, Homo sapiens
tgatgatgaaatgaggtcag

SEQ ID NO: 3154970 - DNA, 13 bp, Homo sapiens
tgatgatgatgaa

SEQ ID NO: 3154971 - DNA, 19 bp, Homo sapiens
tgatgatgtctcttgtaga

SEQ ID NO: 3154972 - DNA, 18 bp, Homo sapiens
tgatgattttgcaaaatg

SEQ ID NO: 3154973 - DNA, 20 bp, Homo sapiens
tgatgatttttaacttttta

SEQ ID NO: 3154974 - DNA, 13 bp, Homo sapiens
tgatgcaggcact

SEQ ID NO: 3154975 - DNA, 22 bp, Homo sapiens
tgatgcatacagttttctagca

SEQ ID NO: 3154976 - DNA, 13 bp, Homo sapiens
tgatgcatgtctt

SEQ ID NO: 3154977 - DNA, 19 bp, Homo sapiens
tgatgccctgctccaggga

SEQ ID NO: 3154978 - DNA, 18 bp, Homo sapiens
tgatgctatttatgcaag

SEQ ID NO: 3154979 - DNA, 20 bp, Homo sapiens
tgatgctccctcccctgccc

SEQ ID NO: 3154980 - DNA, 14 bp, Homo sapiens
tgatgctgagattc

SEQ ID NO: 3154981 - DNA, 11 bp, Homo sapiens
tgatgctgccc

SEQ ID NO: 3154982 - DNA, 15 bp, Homo sapiens
tgatgctggagaggt

SEQ ID NO: 3154983 - DNA, 17 bp, Homo sapiens
tgatgctggagaggtta

SEQ ID NO: 3154984 - DNA, 21 bp, Homo sapiens
tgatgcttgtaacaagaaaac

SEQ ID NO: 3154985 - DNA, 14 bp, Homo sapiens
tgatggaaaataaa

SEQ ID NO: 3154986 - DNA, 18 bp, Homo sapiens
tgatggaccgggtgggcc

SEQ ID NO: 3154987 - DNA, 20 bp, Homo sapiens
tgatggaccttctagaatta

SEQ ID NO: 3154988 - DNA, 15 bp, Homo sapiens
tgatggagaggacag

SEQ ID NO: 3154989 - DNA, 17 bp, Homo sapiens
tgatggagaggacagag

SEQ ID NO: 3154990 - DNA, 23 bp, Homo sapiens
tgatggagaggacagagcagggg

SEQ ID NO: 3154991 - DNA, 15 bp, Homo sapiens
tgatggatggcacaa

SEQ ID NO: 3154992 - DNA, 16 bp, Homo sapiens
tgatggatggcacaat

SEQ ID NO: 3154993 - DNA, 17 bp, Homo sapiens
tgatggatggcacaatg

SEQ ID NO: 3154994 - DNA, 22 bp, Homo sapiens
tgatggatgtcttctagctgca

SEQ ID NO: 3154995 - DNA, 15 bp, Homo sapiens
tgatggcaattttgt

SEQ ID NO: 3154996 - DNA, 20 bp, Homo sapiens
tgatggcagccatagtgcat

SEQ ID NO: 3154997 - DNA, 15 bp, Homo sapiens
tgatggccaagagca

SEQ ID NO: 3154998 - DNA, 15 bp, Homo sapiens
tgatggccaaggggg

SEQ ID NO: 3154999 - DNA, 15 bp, Homo sapiens
tgatggctgcccctg

SEQ ID NO: 3155000 - DNA, 16 bp, Homo sapiens
tgatggctgcccctgc

SEQ ID NO: 3155001 - DNA, 13 bp, Homo sapiens
tgatgggaaaata

SEQ ID NO: 3155002 - DNA, 16 bp, Homo sapiens
tgatgggaaaatattt

SEQ ID NO: 3155003 - DNA, 18 bp, Homo sapiens
tgatgggaaaatatttcc

SEQ ID NO: 3155004 - DNA, 24 bp, Homo sapiens
tgatggggcaagggcacaagtcct

SEQ ID NO: 3155005 - DNA, 17 bp, Homo sapiens
tgatgggggagagggtg

SEQ ID NO: 3155006 - DNA, 17 bp, Homo sapiens
tgatgggtcccaaaagc

SEQ ID NO: 3155007 - DNA, 16 bp, Homo sapiens
tgatggtcagctccct

SEQ ID NO: 3155008 - DNA, 16 bp, Homo sapiens
tgatgtacagtctgtc

SEQ ID NO: 3155009 - DNA, 17 bp, Homo sapiens
tgatgtacagtctgtca

SEQ ID NO: 3155010 - DNA, 20 bp, Homo sapiens
tgatgtaccatgaaacaaag

SEQ ID NO: 3155011 - DNA, 14 bp, Homo sapiens
tgatgtatatgttt

SEQ ID NO: 3155012 - DNA, 18 bp, Homo sapiens
tgatgtatctgagttgcc

SEQ ID NO: 3155013 - DNA, 13 bp, Homo sapiens
tgatgtatgtgtg

SEQ ID NO: 3155014 - DNA, 20 bp, Homo sapiens
tgatgtattctagctaatgt

SEQ ID NO: 3155015 - DNA, 18 bp, Homo sapiens
tgatgtcaatttctgtgt

SEQ ID NO: 3155016 - DNA, 17 bp, Homo sapiens
tgatgtcagtatttcaa

SEQ ID NO: 3155017 - DNA, 22 bp, Homo sapiens
tgatgtcagtatttcaactgct

SEQ ID NO: 3155018 - DNA, 23 bp, Homo sapiens
tgatgtccagaagaatattcagg

SEQ ID NO: 3155019 - DNA, 19 bp, Homo sapiens
tgatgtcccaacttgtaaa

SEQ ID NO: 3155020 - DNA, 15 bp, Homo sapiens
tgatgtccccaaagt

SEQ ID NO: 3155021 - DNA, 16 bp, Homo sapiens
tgatgtccccaaagta

SEQ ID NO: 3155022 - DNA, 17 bp, Homo sapiens
tgatgtctcttgtagaa

SEQ ID NO: 3155023 - DNA, 18 bp, Homo sapiens
tgatgtgacaataatatt

SEQ ID NO: 3155024 - DNA, 16 bp, Homo sapiens
tgatgttaaaattcca

SEQ ID NO: 3155025 - DNA, 17 bp, Homo sapiens
tgatgttaaaattccat

SEQ ID NO: 3155026 - DNA, 16 bp, Homo sapiens
tgatgttcagatttct

SEQ ID NO: 3155027 - DNA, 12 bp, Homo sapiens
tgatgttctaag

SEQ ID NO: 3155028 - DNA, 15 bp, Homo sapiens
tgatgttctaaggct

SEQ ID NO: 3155029 - DNA, 17 bp, Homo sapiens
tgatgttctaaggctct

SEQ ID NO: 3155030 - DNA, 13 bp, Homo sapiens
tgatgtttgtcct

SEQ ID NO: 3155031 - DNA, 11 bp, Homo sapiens
tgatgtttgtg

SEQ ID NO: 3155032 - DNA, 18 bp, Homo sapiens
tgatgtttgtggcctcag

SEQ ID NO: 3155033 - DNA, 19 bp, Homo sapiens
tgatgtttgtggcctcaga

SEQ ID NO: 3155034 - DNA, 15 bp, Homo sapiens
tgatgtttttatgat

SEQ ID NO: 3155035 - DNA, 16 bp, Homo sapiens
tgattaaagactgtga

SEQ ID NO: 3155036 - DNA, 22 bp, Homo sapiens
tgattaaataagattctaacgg

SEQ ID NO: 3155037 - DNA, 14 bp, Homo sapiens
tgattaacaaatat

SEQ ID NO: 3155038 - DNA, 13 bp, Homo sapiens
tgattaagatttt

SEQ ID NO: 3155039 - DNA, 11 bp, Homo sapiens
tgattaatcaa

SEQ ID NO: 3155040 - DNA, 12 bp, Homo sapiens
tgattaatcaaa

SEQ ID NO: 3155041 - DNA, 14 bp, Homo sapiens
tgattaatcaaagg

SEQ ID NO: 3155042 - DNA, 15 bp, Homo sapiens
tgattaatgtttctt

SEQ ID NO: 3155043 - DNA, 21 bp, Homo sapiens
tgattaatgttttcattatgt

SEQ ID NO: 3155044 - DNA, 15 bp, Homo sapiens
tgattactgtcaata

SEQ ID NO: 3155045 - DNA, 18 bp, Homo sapiens
tgattagcaagttacagt

SEQ ID NO: 3155046 - DNA, 14 bp, Homo sapiens
tgattatatattgt

SEQ ID NO: 3155047 - DNA, 13 bp, Homo sapiens
tgattatgaaatg

SEQ ID NO: 3155048 - DNA, 20 bp, Homo sapiens
tgattattaacgatgtccaa

SEQ ID NO: 3155049 - DNA, 17 bp, Homo sapiens
tgattattatgtttatt

SEQ ID NO: 3155050 - DNA, 20 bp, Homo sapiens
tgattattatgtttattaca

SEQ ID NO: 3155051 - DNA, 21 bp, Homo sapiens
tgattattatgtttattacaa

SEQ ID NO: 3155052 - DNA, 19 bp, Homo sapiens
tgattattttcttcatcca

SEQ ID NO: 3155053 - DNA, 15 bp, Homo sapiens
tgattcactatttaa

SEQ ID NO: 3155054 - DNA, 17 bp, Homo sapiens
tgattcactgcatggct

SEQ ID NO: 3155055 - DNA, 15 bp, Homo sapiens
tgattcactgtgctt

SEQ ID NO: 3155056 - DNA, 14 bp, Homo sapiens
tgattcagaaattg

SEQ ID NO: 3155057 - DNA, 12 bp, Homo sapiens
tgattcataaca

SEQ ID NO: 3155058 - DNA, 15 bp, Homo sapiens
tgattccacttttat

SEQ ID NO: 3155059 - DNA, 15 bp, Homo sapiens
tgattcccaagctct

SEQ ID NO: 3155060 - DNA, 22 bp, Homo sapiens
tgattcccaagctctgctcctc

SEQ ID NO: 3155061 - DNA, 23 bp, Homo sapiens
tgattcccaagctctgctcctct

SEQ ID NO: 3155062 - DNA, 14 bp, Homo sapiens
tgattctctgagtg

SEQ ID NO: 3155063 - DNA, 15 bp, Homo sapiens
tgattctctgagtgg

SEQ ID NO: 3155064 - DNA, 16 bp, Homo sapiens
tgattctctgagtggt

SEQ ID NO: 3155065 - DNA, 13 bp, Homo sapiens
tgattctgccttt

SEQ ID NO: 3155066 - DNA, 14 bp, Homo sapiens
tgattctttgttac

SEQ ID NO: 3155067 - DNA, 23 bp, Homo sapiens
tgattctttttaaagtgtttctg

SEQ ID NO: 3155068 - DNA, 22 bp, Homo sapiens
tgattgaaaatagtaaatgctt

SEQ ID NO: 3155069 - DNA, 17 bp, Homo sapiens
tgattgaaccagctcat

SEQ ID NO: 3155070 - DNA, 16 bp, Homo sapiens
tgattgacctgctccg

SEQ ID NO: 3155071 - DNA, 17 bp, Homo sapiens
tgattgaggagctgcac

SEQ ID NO: 3155072 - DNA, 20 bp, Homo sapiens
tgattgcacagaatttgtat

SEQ ID NO: 3155073 - DNA, 20 bp, Homo sapiens
tgattgcagaaaggagagac

SEQ ID NO: 3155074 - DNA, 19 bp, Homo sapiens
tgattggaatagcttctgg

SEQ ID NO: 3155075 - DNA, 17 bp, Homo sapiens
tgattggattattcatt

SEQ ID NO: 3155076 - DNA, 18 bp, Homo sapiens
tgattgggaaaacatttg

SEQ ID NO: 3155077 - DNA, 21 bp, Homo sapiens
tgattggtgcaacccttaccc

SEQ ID NO: 3155078 - DNA, 12 bp, Homo sapiens
tgattgtaaaat

SEQ ID NO: 3155079 - DNA, 16 bp, Homo sapiens
tgattgtactttgaat

SEQ ID NO: 3155080 - DNA, 14 bp, Homo sapiens
tgattgtcagctac

SEQ ID NO: 3155081 - DNA, 21 bp, Homo sapiens
tgattgtggaatggagattca

SEQ ID NO: 3155082 - DNA, 15 bp, Homo sapiens
tgattgttatgtaaa

SEQ ID NO: 3155083 - DNA, 18 bp, Homo sapiens
tgattgttcgggtgtgca

SEQ ID NO: 3155084 - DNA, 19 bp, Homo sapiens
tgattgttcgggtgtgcaa

SEQ ID NO: 3155085 - DNA, 15 bp, Homo sapiens
tgatttaataaaata

SEQ ID NO: 3155086 - DNA, 19 bp, Homo sapiens
tgatttaataaaataattc

SEQ ID NO: 3155087 - DNA, 20 bp, Homo sapiens
tgatttaataaaataattct

SEQ ID NO: 3155088 - DNA, 22 bp, Homo sapiens
tgatttaataaaataattctaa

SEQ ID NO: 3155089 - DNA, 12 bp, Homo sapiens
tgatttacatgt

SEQ ID NO: 3155090 - DNA, 17 bp, Homo sapiens
tgatttacatgtatggt

SEQ ID NO: 3155091 - DNA, 21 bp, Homo sapiens
tgatttagaactgtatgtcag

SEQ ID NO: 3155092 - DNA, 20 bp, Homo sapiens
tgatttagattgagtaagat

SEQ ID NO: 3155093 - DNA, 21 bp, Homo sapiens
tgatttaggtagccttgtgtt

SEQ ID NO: 3155094 - DNA, 23 bp, Homo sapiens
tgatttataaacagacaatatgt

SEQ ID NO: 3155095 - DNA, 16 bp, Homo sapiens
tgatttatagtttgta

SEQ ID NO: 3155096 - DNA, 12 bp, Homo sapiens
tgatttatttct

SEQ ID NO: 3155097 - DNA, 20 bp, Homo sapiens
tgatttatttctactatata

SEQ ID NO: 3155098 - DNA, 20 bp, Homo sapiens
tgatttcaaagttttgttgt

SEQ ID NO: 3155099 - DNA, 16 bp, Homo sapiens
tgatttcacaacagat

SEQ ID NO: 3155100 - DNA, 14 bp, Homo sapiens
tgatttcactagaa

SEQ ID NO: 3155101 - DNA, 16 bp, Homo sapiens
tgatttcactttggga

SEQ ID NO: 3155102 - DNA, 11 bp, Homo sapiens
tgatttcagga

SEQ ID NO: 3155103 - DNA, 19 bp, Homo sapiens
tgatttcagtttttcattt

SEQ ID NO: 3155104 - DNA, 21 bp, Homo sapiens
tgatttcagtttttcatttgt

SEQ ID NO: 3155105 - DNA, 22 bp, Homo sapiens
tgatttcagtttttcatttgtt

SEQ ID NO: 3155106 - DNA, 13 bp, Homo sapiens
tgatttcatattg

SEQ ID NO: 3155107 - DNA, 15 bp, Homo sapiens
tgatttcatattgat

SEQ ID NO: 3155108 - DNA, 17 bp, Homo sapiens
tgatttcatcttctgga

SEQ ID NO: 3155109 - DNA, 14 bp, Homo sapiens
tgatttccaggccc

SEQ ID NO: 3155110 - DNA, 20 bp, Homo sapiens
tgatttccagtgagtgtaaa

SEQ ID NO: 3155111 - DNA, 14 bp, Homo sapiens
tgatttccatctct

SEQ ID NO: 3155112 - DNA, 17 bp, Homo sapiens
tgatttccatctctggt

SEQ ID NO: 3155113 - DNA, 22 bp, Homo sapiens
tgatttccatttctgatgtctc

SEQ ID NO: 3155114 - DNA, 13 bp, Homo sapiens
tgatttcccctct

SEQ ID NO: 3155115 - DNA, 18 bp, Homo sapiens
tgatttcctaaacataat

SEQ ID NO: 3155116 - DNA, 14 bp, Homo sapiens
tgatttccttgaat

SEQ ID NO: 3155117 - DNA, 15 bp, Homo sapiens
tgatttccttgaatg

SEQ ID NO: 3155118 - DNA, 23 bp, Homo sapiens
tgatttccttgaatgtggcttga

SEQ ID NO: 3155119 - DNA, 15 bp, Homo sapiens
tgatttctatggctt

SEQ ID NO: 3155120 - DNA, 16 bp, Homo sapiens
tgatttcttcagaatt

SEQ ID NO: 3155121 - DNA, 21 bp, Homo sapiens
tgatttcttcagaattagatg

SEQ ID NO: 3155122 - DNA, 20 bp, Homo sapiens
tgatttcttttcttcctggc

SEQ ID NO: 3155123 - DNA, 17 bp, Homo sapiens
tgatttgaagaacatgt

SEQ ID NO: 3155124 - DNA, 17 bp, Homo sapiens
tgatttgatgtgacttt

SEQ ID NO: 3155125 - DNA, 14 bp, Homo sapiens
tgatttgcattgaa

SEQ ID NO: 3155126 - DNA, 13 bp, Homo sapiens
tgatttgggggag

SEQ ID NO: 3155127 - DNA, 19 bp, Homo sapiens
tgatttggtgaccaactgt

SEQ ID NO: 3155128 - DNA, 16 bp, Homo sapiens
tgatttgtaacattca

SEQ ID NO: 3155129 - DNA, 15 bp, Homo sapiens
tgatttgtactgaaa

SEQ ID NO: 3155130 - DNA, 18 bp, Homo sapiens
tgatttgtactgaaaaat

SEQ ID NO: 3155131 - DNA, 14 bp, Homo sapiens
tgatttgtcccagc

SEQ ID NO: 3155132 - DNA, 22 bp, Homo sapiens
tgatttgtcccagcctggggct

SEQ ID NO: 3155133 - DNA, 22 bp, Homo sapiens
tgatttgtgaaataaaacagga

SEQ ID NO: 3155134 - DNA, 14 bp, Homo sapiens
tgattttaacaata

SEQ ID NO: 3155135 - DNA, 19 bp, Homo sapiens
tgattttaacaataactac

SEQ ID NO: 3155136 - DNA, 22 bp, Homo sapiens
tgattttaacaataactactgt

SEQ ID NO: 3155137 - DNA, 14 bp, Homo sapiens
tgattttataattg

SEQ ID NO: 3155138 - DNA, 17 bp, Homo sapiens
tgattttcaagcagcat

SEQ ID NO: 3155139 - DNA, 19 bp, Homo sapiens
tgattttcaagcagcatct

SEQ ID NO: 3155140 - DNA, 20 bp, Homo sapiens
tgattttgcaaaatgagttg

SEQ ID NO: 3155141 - DNA, 16 bp, Homo sapiens
tgattttgtaaagttg

SEQ ID NO: 3155142 - DNA, 18 bp, Homo sapiens
tgattttgtatatgaaaa

SEQ ID NO: 3155143 - DNA, 20 bp, Homo sapiens
tgatttttatgatgatgaaa

SEQ ID NO: 3155144 - DNA, 16 bp, Homo sapiens
tgatttttctcttcat

SEQ ID NO: 3155145 - DNA, 21 bp, Homo sapiens
tgatttttgcctcttccagtc

SEQ ID NO: 3155146 - DNA, 13 bp, Homo sapiens
tgattttttgcat

SEQ ID NO: 3155147 - DNA, 16 bp, Homo sapiens
tgattttttttccttt

SEQ ID NO: 3155148 - DNA, 15 bp, Homo sapiens
tgatttttttttcca

SEQ ID NO: 3155149 - DNA, 15 bp, Homo sapiens
tgcaaaaaaagcctc

SEQ ID NO: 3155150 - DNA, 15 bp, Homo sapiens
tgcaaaaagaaatga

SEQ ID NO: 3155151 - DNA, 17 bp, Homo sapiens
tgcaaaaataatcatga

SEQ ID NO: 3155152 - DNA, 18 bp, Homo sapiens
tgcaaaaatatttataaa

SEQ ID NO: 3155153 - DNA, 20 bp, Homo sapiens
tgcaaaaattcagagtcctt

SEQ ID NO: 3155154 - DNA, 14 bp, Homo sapiens
tgcaaaacctttga

SEQ ID NO: 3155155 - DNA, 23 bp, Homo sapiens
tgcaaaaggttcactaaagcagt

SEQ ID NO: 3155156 - DNA, 22 bp, Homo sapiens
tgcaaaattgtctaaaatgtca

SEQ ID NO: 3155157 - DNA, 17 bp, Homo sapiens
tgcaaaattgttttcac

SEQ ID NO: 3155158 - DNA, 20 bp, Homo sapiens
tgcaaaattgttttcacttg

SEQ ID NO: 3155159 - DNA, 14 bp, Homo sapiens
tgcaaaatttccag

SEQ ID NO: 3155160 - DNA, 16 bp, Homo sapiens
tgcaaaatttccagta

SEQ ID NO: 3155161 - DNA, 21 bp, Homo sapiens
tgcaaaatttccagtaccttt

SEQ ID NO: 3155162 - DNA, 16 bp, Homo sapiens
tgcaaacaatgaagaa

SEQ ID NO: 3155163 - DNA, 18 bp, Homo sapiens
tgcaaacagaacagggtc

SEQ ID NO: 3155164 - DNA, 13 bp, Homo sapiens
tgcaaacagtaac

SEQ ID NO: 3155165 - DNA, 23 bp, Homo sapiens
tgcaaacctgacccctgctcagt

SEQ ID NO: 3155166 - DNA, 15 bp, Homo sapiens
tgcaaaccttcctgg

SEQ ID NO: 3155167 - DNA, 18 bp, Homo sapiens
tgcaaacttttttatatc

SEQ ID NO: 3155168 - DNA, 22 bp, Homo sapiens
tgcaaaggtctttttaaaccag

SEQ ID NO: 3155169 - DNA, 21 bp, Homo sapiens
tgcaaaggtggcaatgcttaa

SEQ ID NO: 3155170 - DNA, 19 bp, Homo sapiens
tgcaaagtacaatgtgttt

SEQ ID NO: 3155171 - DNA, 21 bp, Homo sapiens
tgcaaagtgttttctcagaac

SEQ ID NO: 3155172 - DNA, 23 bp, Homo sapiens
tgcaaagttccctacttcctgtg

SEQ ID NO: 3155173 - DNA, 13 bp, Homo sapiens
tgcaaagttctgt

SEQ ID NO: 3155174 - DNA, 19 bp, Homo sapiens
tgcaaagttctgtgtttaa

SEQ ID NO: 3155175 - DNA, 13 bp, Homo sapiens
tgcaaataaagcc

SEQ ID NO: 3155176 - DNA, 16 bp, Homo sapiens
tgcaaataaagccttt

SEQ ID NO: 3155177 - DNA, 19 bp, Homo sapiens
tgcaaataggcagaatgga

SEQ ID NO: 3155178 - DNA, 17 bp, Homo sapiens
tgcaaatataaacatct

SEQ ID NO: 3155179 - DNA, 18 bp, Homo sapiens
tgcaaatgagctctgaaa

SEQ ID NO: 3155180 - DNA, 20 bp, Homo sapiens
tgcaaatgagctctgaaatc

SEQ ID NO: 3155181 - DNA, 22 bp, Homo sapiens
tgcaaattaaaacatatttcat

SEQ ID NO: 3155182 - DNA, 17 bp, Homo sapiens
tgcaacagcactggctc

SEQ ID NO: 3155183 - DNA, 16 bp, Homo sapiens
tgcaacaggctgggct

SEQ ID NO: 3155184 - DNA, 17 bp, Homo sapiens
tgcaacaggctgggctt

SEQ ID NO: 3155185 - DNA, 19 bp, Homo sapiens
tgcaacaggctgggcttca

SEQ ID NO: 3155186 - DNA, 21 bp, Homo sapiens
tgcaacaggggaggaaaaaag

SEQ ID NO: 3155187 - DNA, 15 bp, Homo sapiens
tgcaaccactgcaac

SEQ ID NO: 3155188 - DNA, 15 bp, Homo sapiens
tgcaaccagaattgt

SEQ ID NO: 3155189 - DNA, 18 bp, Homo sapiens
tgcaaccagaattgtcct

SEQ ID NO: 3155190 - DNA, 15 bp, Homo sapiens
tgcaacccttacccc

SEQ ID NO: 3155191 - DNA, 21 bp, Homo sapiens
tgcaacctctacctcctgggt

SEQ ID NO: 3155192 - DNA, 21 bp, Homo sapiens
tgcaacctctgcctcccaggt

SEQ ID NO: 3155193 - DNA, 20 bp, Homo sapiens
tgcaacgctttttgggagaa

SEQ ID NO: 3155194 - DNA, 13 bp, Homo sapiens
tgcaactcactga

SEQ ID NO: 3155195 - DNA, 13 bp, Homo sapiens
tgcaacttcagtt

SEQ ID NO: 3155196 - DNA, 19 bp, Homo sapiens
tgcaactttaagcagctct

SEQ ID NO: 3155197 - DNA, 23 bp, Homo sapiens
tgcaactttaagcagctcttgct

SEQ ID NO: 3155198 - DNA, 20 bp, Homo sapiens
tgcaagaaaatgatgtgtac

SEQ ID NO: 3155199 - DNA, 15 bp, Homo sapiens
tgcaagatgcttggt

SEQ ID NO: 3155200 - DNA, 19 bp, Homo sapiens
tgcaagcaggactttgagg

SEQ ID NO: 3155201 - DNA, 14 bp, Homo sapiens
tgcaagccccaccc

SEQ ID NO: 3155202 - DNA, 14 bp, Homo sapiens
tgcaagccccaggg

SEQ ID NO: 3155203 - DNA, 23 bp, Homo sapiens
tgcaagccccagggcctgggggc

SEQ ID NO: 3155204 - DNA, 18 bp, Homo sapiens
tgcaagcctgtctgagac

SEQ ID NO: 3155205 - DNA, 13 bp, Homo sapiens
tgcaaggaccagg

SEQ ID NO: 3155206 - DNA, 14 bp, Homo sapiens
tgcaaggaccagga

SEQ ID NO: 3155207 - DNA, 17 bp, Homo sapiens
tgcaaggattacagaaa

SEQ ID NO: 3155208 - DNA, 21 bp, Homo sapiens
tgcaaggattacagaaactga

SEQ ID NO: 3155209 - DNA, 17 bp, Homo sapiens
tgcaaggcactgtacta

SEQ ID NO: 3155210 - DNA, 13 bp, Homo sapiens
tgcaaggcccaca

SEQ ID NO: 3155211 - DNA, 17 bp, Homo sapiens
tgcaaggcccacaggag

SEQ ID NO: 3155212 - DNA, 18 bp, Homo sapiens
tgcaaggtactctggtga

SEQ ID NO: 3155213 - DNA, 19 bp, Homo sapiens
tgcaaggtatttctccagt

SEQ ID NO: 3155214 - DNA, 16 bp, Homo sapiens
tgcaaggtctttggtt

SEQ ID NO: 3155215 - DNA, 20 bp, Homo sapiens
tgcaagtatactagggagcc

SEQ ID NO: 3155216 - DNA, 15 bp, Homo sapiens
tgcaagtcagaggat

SEQ ID NO: 3155217 - DNA, 12 bp, Homo sapiens
tgcaagtctgtg

SEQ ID NO: 3155218 - DNA, 15 bp, Homo sapiens
tgcaagtctgtgagt

SEQ ID NO: 3155219 - DNA, 17 bp, Homo sapiens
tgcaataaaatttaaaa

SEQ ID NO: 3155220 - DNA, 14 bp, Homo sapiens
tgcaataaagtata

SEQ ID NO: 3155221 - DNA, 15 bp, Homo sapiens
tgcaataaagtataa

SEQ ID NO: 3155222 - DNA, 16 bp, Homo sapiens
tgcaataaagtataat

SEQ ID NO: 3155223 - DNA, 22 bp, Homo sapiens
tgcaataacttctatattttaa

SEQ ID NO: 3155224 - DNA, 14 bp, Homo sapiens
tgcaataacttctg

SEQ ID NO: 3155225 - DNA, 15 bp, Homo sapiens
tgcaataacttctga

SEQ ID NO: 3155226 - DNA, 16 bp, Homo sapiens
tgcaataacttctgac

SEQ ID NO: 3155227 - DNA, 14 bp, Homo sapiens
tgcaatagagactg

SEQ ID NO: 3155228 - DNA, 19 bp, Homo sapiens
tgcaatagcagttataaca

SEQ ID NO: 3155229 - DNA, 14 bp, Homo sapiens
tgcaatatctgaag

SEQ ID NO: 3155230 - DNA, 16 bp, Homo sapiens
tgcaatgacatcttca

SEQ ID NO: 3155231 - DNA, 17 bp, Homo sapiens
tgcaatgacatcttcaa

SEQ ID NO: 3155232 - DNA, 19 bp, Homo sapiens
tgcaatgcttctgtagctt

SEQ ID NO: 3155233 - DNA, 20 bp, Homo sapiens
tgcaatgcttctgtagcttc

SEQ ID NO: 3155234 - DNA, 22 bp, Homo sapiens
tgcaatgcttttatatggccca

SEQ ID NO: 3155235 - DNA, 19 bp, Homo sapiens
tgcaatgtatcccttctca

SEQ ID NO: 3155236 - DNA, 24 bp, Homo sapiens
tgcaatgtatcccttctcacagca

SEQ ID NO: 3155237 - DNA, 20 bp, Homo sapiens
tgcaattaaacttccaaaga

SEQ ID NO: 3155238 - DNA, 23 bp, Homo sapiens
tgcaattaaacttccaaagaaag

SEQ ID NO: 3155239 - DNA, 24 bp, Homo sapiens
tgcaattaaacttccaaagaaagt

SEQ ID NO: 3155240 - DNA, 23 bp, Homo sapiens
tgcaattaggtttttccttattt

SEQ ID NO: 3155241 - DNA, 16 bp, Homo sapiens
tgcaattcaaaagttc

SEQ ID NO: 3155242 - DNA, 19 bp, Homo sapiens
tgcaattcaaaagttccaa

SEQ ID NO: 3155243 - DNA, 13 bp, Homo sapiens
tgcaattcccctc

SEQ ID NO: 3155244 - DNA, 14 bp, Homo sapiens
tgcaattcccctct

SEQ ID NO: 3155245 - DNA, 21 bp, Homo sapiens
tgcaattgtaggggtgtgtgt

SEQ ID NO: 3155246 - DNA, 23 bp, Homo sapiens
tgcaatttaatggatatttctca

SEQ ID NO: 3155247 - DNA, 19 bp, Homo sapiens
tgcaatttcaaggttctaa

SEQ ID NO: 3155248 - DNA, 17 bp, Homo sapiens
tgcacaaagcccttcca

SEQ ID NO: 3155249 - DNA, 16 bp, Homo sapiens
tgcacaagaatggatc

SEQ ID NO: 3155250 - DNA, 20 bp, Homo sapiens
tgcacaagaatggatcacaa

SEQ ID NO: 3155251 - DNA, 14 bp, Homo sapiens
tgcacaagctcaga

SEQ ID NO: 3155252 - DNA, 15 bp, Homo sapiens
tgcacaaggattgaa

SEQ ID NO: 3155253 - DNA, 19 bp, Homo sapiens
tgcacaaggattgaaaatt

SEQ ID NO: 3155254 - DNA, 21 bp, Homo sapiens
tgcacaagttccctggagaaa

SEQ ID NO: 3155255 - DNA, 21 bp, Homo sapiens
tgcacaataaaaatgtttaac

SEQ ID NO: 3155256 - DNA, 18 bp, Homo sapiens
tgcacacaaatattattt

SEQ ID NO: 3155257 - DNA, 22 bp, Homo sapiens
tgcacacaccagagcccacctt

SEQ ID NO: 3155258 - DNA, 17 bp, Homo sapiens
tgcacacacctccgaga

SEQ ID NO: 3155259 - DNA, 22 bp, Homo sapiens
tgcacacagaaatatatataca

SEQ ID NO: 3155260 - DNA, 15 bp, Homo sapiens
tgcacaccaccctcc

SEQ ID NO: 3155261 - DNA, 16 bp, Homo sapiens
tgcacaccaccctccc

SEQ ID NO: 3155262 - DNA, 21 bp, Homo sapiens
tgcacactagcctctccagga

SEQ ID NO: 3155263 - DNA, 22 bp, Homo sapiens
tgcacagaagggctctttctct

SEQ ID NO: 3155264 - DNA, 14 bp, Homo sapiens
tgcacagagcccaa

SEQ ID NO: 3155265 - DNA, 16 bp, Homo sapiens
tgcacagagctctcca

SEQ ID NO: 3155266 - DNA, 19 bp, Homo sapiens
tgcacagagctctccagct

SEQ ID NO: 3155267 - DNA, 18 bp, Homo sapiens
tgcacagatatactttgt

SEQ ID NO: 3155268 - DNA, 19 bp, Homo sapiens
tgcacagatggatttgcct

SEQ ID NO: 3155269 - DNA, 16 bp, Homo sapiens
tgcacagcggcccctg

SEQ ID NO: 3155270 - DNA, 17 bp, Homo sapiens
tgcacagcgtcctgtcc

SEQ ID NO: 3155271 - DNA, 10 bp, Homo sapiens
tgcacagctg

SEQ ID NO: 3155272 - DNA, 11 bp, Homo sapiens
tgcacagctgt

SEQ ID NO: 3155273 - DNA, 13 bp, Homo sapiens
tgcacagctgtcc

SEQ ID NO: 3155274 - DNA, 19 bp, Homo sapiens
tgcacaggcacacagggcc

SEQ ID NO: 3155275 - DNA, 20 bp, Homo sapiens
tgcacaggcacacagggccc

SEQ ID NO: 3155276 - DNA, 19 bp, Homo sapiens
tgcacagggtccccgagtg

SEQ ID NO: 3155277 - DNA, 15 bp, Homo sapiens
tgcacagtgcatctc

SEQ ID NO: 3155278 - DNA, 17 bp, Homo sapiens
tgcacagtgcatctcag

SEQ ID NO: 3155279 - DNA, 18 bp, Homo sapiens
tgcacagtgcatctcagc

SEQ ID NO: 3155280 - DNA, 19 bp, Homo sapiens
tgcacagtgcatctcagcc

SEQ ID NO: 3155281 - DNA, 15 bp, Homo sapiens
tgcacagtgctgttg

SEQ ID NO: 3155282 - DNA, 18 bp, Homo sapiens
tgcacagtgctgttggtg

SEQ ID NO: 3155283 - DNA, 23 bp, Homo sapiens
tgcacagttagttgtgaaagaaa

SEQ ID NO: 3155284 - DNA, 17 bp, Homo sapiens
tgcacatatggactctg

SEQ ID NO: 3155285 - DNA, 18 bp, Homo sapiens
tgcacatccattcccaag

SEQ ID NO: 3155286 - DNA, 12 bp, Homo sapiens
tgcacatccctg

SEQ ID NO: 3155287 - DNA, 21 bp, Homo sapiens
tgcacatgactcgggggtggg

SEQ ID NO: 3155288 - DNA, 19 bp, Homo sapiens
tgcacatgcgcactctcat

SEQ ID NO: 3155289 - DNA, 19 bp, Homo sapiens
tgcacatgtcttgtacatg

SEQ ID NO: 3155290 - DNA, 18 bp, Homo sapiens
tgcacatgtttcctctag

SEQ ID NO: 3155291 - DNA, 12 bp, Homo sapiens
tgcaccaaagac

SEQ ID NO: 3155292 - DNA, 14 bp, Homo sapiens
tgcaccaaagacat

SEQ ID NO: 3155293 - DNA, 12 bp, Homo sapiens
tgcaccaccaag

SEQ ID NO: 3155294 - DNA, 16 bp, Homo sapiens
tgcaccaccaagccaa

SEQ ID NO: 3155295 - DNA, 19 bp, Homo sapiens
tgcaccaccaagccaaggg

SEQ ID NO: 3155296 - DNA, 21 bp, Homo sapiens
tgcaccagagtgaaagggcta

SEQ ID NO: 3155297 - DNA, 13 bp, Homo sapiens
tgcaccagccctt

SEQ ID NO: 3155298 - DNA, 13 bp, Homo sapiens
tgcaccaggagac

SEQ ID NO: 3155299 - DNA, 16 bp, Homo sapiens
tgcacccaactactga

SEQ ID NO: 3155300 - DNA, 15 bp, Homo sapiens
tgcacccactcacca

SEQ ID NO: 3155301 - DNA, 16 bp, Homo sapiens
tgcacccagctccagg

SEQ ID NO: 3155302 - DNA, 18 bp, Homo sapiens
tgcaccccaaagctttcc

SEQ ID NO: 3155303 - DNA, 19 bp, Homo sapiens
tgcaccccaaagctttcct

SEQ ID NO: 3155304 - DNA, 21 bp, Homo sapiens
tgcaccccaaagctttcctgc

SEQ ID NO: 3155305 - DNA, 15 bp, Homo sapiens
tgcacccctcccatt

SEQ ID NO: 3155306 - DNA, 16 bp, Homo sapiens
tgcacccgcctctccc

SEQ ID NO: 3155307 - DNA, 15 bp, Homo sapiens
tgcaccctccaccct

SEQ ID NO: 3155308 - DNA, 18 bp, Homo sapiens
tgcaccgagtgatttcca

SEQ ID NO: 3155309 - DNA, 17 bp, Homo sapiens
tgcaccgggccacagag

SEQ ID NO: 3155310 - DNA, 17 bp, Homo sapiens
tgcacctagctgtgcaa

SEQ ID NO: 3155311 - DNA, 20 bp, Homo sapiens
tgcacctctgttcatttcac

SEQ ID NO: 3155312 - DNA, 17 bp, Homo sapiens
tgcacctgccagcctgg

SEQ ID NO: 3155313 - DNA, 22 bp, Homo sapiens
tgcacctgccagcctggcttct

SEQ ID NO: 3155314 - DNA, 13 bp, Homo sapiens
tgcacctgctgcg

SEQ ID NO: 3155315 - DNA, 22 bp, Homo sapiens
tgcacctgctgcgtccccactc

SEQ ID NO: 3155316 - DNA, 17 bp, Homo sapiens
tgcacctgtccccaccc

SEQ ID NO: 3155317 - DNA, 12 bp, Homo sapiens
tgcacctgtgca

SEQ ID NO: 3155318 - DNA, 20 bp, Homo sapiens
tgcaccttaccaactttctg

SEQ ID NO: 3155319 - DNA, 21 bp, Homo sapiens
tgcaccttcactctccagggt

SEQ ID NO: 3155320 - DNA, 14 bp, Homo sapiens
tgcaccttgtgtct

SEQ ID NO: 3155321 - DNA, 18 bp, Homo sapiens
tgcacgtatacacccaga

SEQ ID NO: 3155322 - DNA, 23 bp, Homo sapiens
tgcacgtatgagaaacctatatt

SEQ ID NO: 3155323 - DNA, 12 bp, Homo sapiens
tgcacgtggaga

SEQ ID NO: 3155324 - DNA, 16 bp, Homo sapiens
tgcacgtggagagctg

SEQ ID NO: 3155325 - DNA, 21 bp, Homo sapiens
tgcacgtggagagctggtgcc

SEQ ID NO: 3155326 - DNA, 15 bp, Homo sapiens
tgcacgtggcctctt

SEQ ID NO: 3155327 - DNA, 14 bp, Homo sapiens
tgcacgtgtgtgca

SEQ ID NO: 3155328 - DNA, 15 bp, Homo sapiens
tgcactactcctctg

SEQ ID NO: 3155329 - DNA, 23 bp, Homo sapiens
tgcactactcctctgcagtgcct

SEQ ID NO: 3155330 - DNA, 15 bp, Homo sapiens
tgcactactgacatg

SEQ ID NO: 3155331 - DNA, 13 bp, Homo sapiens
tgcactatttcca

SEQ ID NO: 3155332 - DNA, 15 bp, Homo sapiens
tgcactcagcttttt

SEQ ID NO: 3155333 - DNA, 15 bp, Homo sapiens
tgcactccagcctgg

SEQ ID NO: 3155334 - DNA, 20 bp, Homo sapiens
tgcactccagcctgggcgac

SEQ ID NO: 3155335 - DNA, 18 bp, Homo sapiens
tgcactccagcctggggg

SEQ ID NO: 3155336 - DNA, 19 bp, Homo sapiens
tgcactccagcctgggtga

SEQ ID NO: 3155337 - DNA, 19 bp, Homo sapiens
tgcactcccacctgacaca

SEQ ID NO: 3155338 - DNA, 18 bp, Homo sapiens
tgcactgaagtttttgaa

SEQ ID NO: 3155339 - DNA, 16 bp, Homo sapiens
tgcactgagggccaca

SEQ ID NO: 3155340 - DNA, 19 bp, Homo sapiens
tgcactgagggccacacta

SEQ ID NO: 3155341 - DNA, 13 bp, Homo sapiens
tgcactgatgttg

SEQ ID NO: 3155342 - DNA, 15 bp, Homo sapiens
tgcactgatgttgtg

SEQ ID NO: 3155343 - DNA, 20 bp, Homo sapiens
tgcactggggagcccgtctc

SEQ ID NO: 3155344 - DNA, 15 bp, Homo sapiens
tgcactgtatgctgg

SEQ ID NO: 3155345 - DNA, 16 bp, Homo sapiens
tgcacttaaaaattag

SEQ ID NO: 3155346 - DNA, 21 bp, Homo sapiens
tgcacttaaggcactctgtta

SEQ ID NO: 3155347 - DNA, 15 bp, Homo sapiens
tgcacttacttgctt

SEQ ID NO: 3155348 - DNA, 20 bp, Homo sapiens
tgcacttatatagcaccttt

SEQ ID NO: 3155349 - DNA, 16 bp, Homo sapiens
tgcacttatgtacttg

SEQ ID NO: 3155350 - DNA, 22 bp, Homo sapiens
tgcacttatttatgaacctgcc

SEQ ID NO: 3155351 - DNA, 23 bp, Homo sapiens
tgcacttgacaccaaccagacag

SEQ ID NO: 3155352 - DNA, 16 bp, Homo sapiens
tgcacttgcagactct

SEQ ID NO: 3155353 - DNA, 21 bp, Homo sapiens
tgcacttgcagactctacaga

SEQ ID NO: 3155354 - DNA, 15 bp, Homo sapiens
tgcacttggcctcag

SEQ ID NO: 3155355 - DNA, 18 bp, Homo sapiens
tgcacttggcctcagctg

SEQ ID NO: 3155356 - DNA, 24 bp, Homo sapiens
tgcacttggcctcagctggctgta

SEQ ID NO: 3155357 - DNA, 17 bp, Homo sapiens
tgcacttgtgattattt

SEQ ID NO: 3155358 - DNA, 16 bp, Homo sapiens
tgcacttttagccaga

SEQ ID NO: 3155359 - DNA, 23 bp, Homo sapiens
tgcacttttagccagagatgcaa

SEQ ID NO: 3155360 - DNA, 15 bp, Homo sapiens
tgcacttttttatga

SEQ ID NO: 3155361 - DNA, 14 bp, Homo sapiens
tgcagaaaggagag

SEQ ID NO: 3155362 - DNA, 15 bp, Homo sapiens
tgcagaacagtgaaa

SEQ ID NO: 3155363 - DNA, 24 bp, Homo sapiens
tgcagaacatcgatatgtatatca

SEQ ID NO: 3155364 - DNA, 20 bp, Homo sapiens
tgcagaactcctccaaagca

SEQ ID NO: 3155365 - DNA, 20 bp, Homo sapiens
tgcagaactgccattatttt

SEQ ID NO: 3155366 - DNA, 23 bp, Homo sapiens
tgcagaactgccattattttctg

SEQ ID NO: 3155367 - DNA, 14 bp, Homo sapiens
tgcagaagaagctg

SEQ ID NO: 3155368 - DNA, 15 bp, Homo sapiens
tgcagaagaagctgg

SEQ ID NO: 3155369 - DNA, 20 bp, Homo sapiens
tgcagaataatggaaacatt

SEQ ID NO: 3155370 - DNA, 22 bp, Homo sapiens
tgcagacaacaccttcctcctg

SEQ ID NO: 3155371 - DNA, 22 bp, Homo sapiens
tgcagacaggcaagcacctcct

SEQ ID NO: 3155372 - DNA, 13 bp, Homo sapiens
tgcagacaggcca

SEQ ID NO: 3155373 - DNA, 23 bp, Homo sapiens
tgcagacaggccatgtgagccac

SEQ ID NO: 3155374 - DNA, 22 bp, Homo sapiens
tgcagacgggcaagaagctgct

SEQ ID NO: 3155375 - DNA, 14 bp, Homo sapiens
tgcagactcagttt

SEQ ID NO: 3155376 - DNA, 19 bp, Homo sapiens
tgcagactcagtttgtcag

SEQ ID NO: 3155377 - DNA, 20 bp, Homo sapiens
tgcagactcagtttgtcaga

SEQ ID NO: 3155378 - DNA, 17 bp, Homo sapiens
tgcagactctacagagg

SEQ ID NO: 3155379 - DNA, 22 bp, Homo sapiens
tgcagactgctagtgttctgtc

SEQ ID NO: 3155380 - DNA, 21 bp, Homo sapiens
tgcagagaagcatcctccaca

SEQ ID NO: 3155381 - DNA, 14 bp, Homo sapiens
tgcagagaagctgg

SEQ ID NO: 3155382 - DNA, 18 bp, Homo sapiens
tgcagagaagctggactt

SEQ ID NO: 3155383 - DNA, 22 bp, Homo sapiens
tgcagagagccattttgtgaat

SEQ ID NO: 3155384 - DNA, 13 bp, Homo sapiens
tgcagagatttct

SEQ ID NO: 3155385 - DNA, 15 bp, Homo sapiens
tgcagagatttctca

SEQ ID NO: 3155386 - DNA, 18 bp, Homo sapiens
tgcagagctgacccagag

SEQ ID NO: 3155387 - DNA, 16 bp, Homo sapiens
tgcagaggaggtgaga

SEQ ID NO: 3155388 - DNA, 15 bp, Homo sapiens
tgcagaggccagagg

SEQ ID NO: 3155389 - DNA, 16 bp, Homo sapiens
tgcagaggggaaagac

SEQ ID NO: 3155390 - DNA, 18 bp, Homo sapiens
tgcagaggggaaagactt

SEQ ID NO: 3155391 - DNA, 19 bp, Homo sapiens
tgcagagggtactttaaga

SEQ ID NO: 3155392 - DNA, 16 bp, Homo sapiens
tgcagataattctgga

SEQ ID NO: 3155393 - DNA, 20 bp, Homo sapiens
tgcagataattctggaccag

SEQ ID NO: 3155394 - DNA, 21 bp, Homo sapiens
tgcagatcttccgtggtcaga

SEQ ID NO: 3155395 - DNA, 20 bp, Homo sapiens
tgcagatgccaccctagcca

SEQ ID NO: 3155396 - DNA, 23 bp, Homo sapiens
tgcagattcctgggcctgtcccc

SEQ ID NO: 3155397 - DNA, 22 bp, Homo sapiens
tgcagcaaacactccaccctcc

SEQ ID NO: 3155398 - DNA, 15 bp, Homo sapiens
tgcagcacctccagg

SEQ ID NO: 3155399 - DNA, 16 bp, Homo sapiens
tgcagcacctccaggc

SEQ ID NO: 3155400 - DNA, 20 bp, Homo sapiens
tgcagcacctccaggcctgt

SEQ ID NO: 3155401 - DNA, 23 bp, Homo sapiens
tgcagcagaaaggctctgaaggt

SEQ ID NO: 3155402 - DNA, 12 bp, Homo sapiens
tgcagcagataa

SEQ ID NO: 3155403 - DNA, 16 bp, Homo sapiens
tgcagcagataacttt

SEQ ID NO: 3155404 - DNA, 15 bp, Homo sapiens
tgcagcagcccagct

SEQ ID NO: 3155405 - DNA, 20 bp, Homo sapiens
tgcagcagcccagcttcctg

SEQ ID NO: 3155406 - DNA, 14 bp, Homo sapiens
tgcagcaggagtgg

SEQ ID NO: 3155407 - DNA, 20 bp, Homo sapiens
tgcagcaggagtggtgcaga

SEQ ID NO: 3155408 - DNA, 17 bp, Homo sapiens
tgcagcatgacctgtga

SEQ ID NO: 3155409 - DNA, 19 bp, Homo sapiens
tgcagcatgacctgtgacc

SEQ ID NO: 3155410 - DNA, 23 bp, Homo sapiens
tgcagcatgacctgtgaccagca

SEQ ID NO: 3155411 - DNA, 17 bp, Homo sapiens
tgcagcatgttgctgag

SEQ ID NO: 3155412 - DNA, 21 bp, Homo sapiens
tgcagcatgttgctgaggagt

SEQ ID NO: 3155413 - DNA, 23 bp, Homo sapiens
tgcagcatgttgctgaggagtga

SEQ ID NO: 3155414 - DNA, 20 bp, Homo sapiens
tgcagccacatggccccatc

SEQ ID NO: 3155415 - DNA, 22 bp, Homo sapiens
tgcagcccggcgccaccatcct

SEQ ID NO: 3155416 - DNA, 13 bp, Homo sapiens
tgcagcccttggg

SEQ ID NO: 3155417 - DNA, 14 bp, Homo sapiens
tgcagcccttgggc

SEQ ID NO: 3155418 - DNA, 17 bp, Homo sapiens
tgcagcccttgggcagt

SEQ ID NO: 3155419 - DNA, 19 bp, Homo sapiens
tgcagcctcaacctcctgg

SEQ ID NO: 3155420 - DNA, 21 bp, Homo sapiens
tgcagcctcaacctcctgggc

SEQ ID NO: 3155421 - DNA, 14 bp, Homo sapiens
tgcagcctcctcct

SEQ ID NO: 3155422 - DNA, 22 bp, Homo sapiens
tgcagcctgctctagtgggaca

SEQ ID NO: 3155423 - DNA, 16 bp, Homo sapiens
tgcagctgatgttgga

SEQ ID NO: 3155424 - DNA, 15 bp, Homo sapiens
tgcagctgattttaa

SEQ ID NO: 3155425 - DNA, 16 bp, Homo sapiens
tgcagctgattttaac

SEQ ID NO: 3155426 - DNA, 22 bp, Homo sapiens
tgcagctgattttaacaataac

SEQ ID NO: 3155427 - DNA, 14 bp, Homo sapiens
tgcagctgggcccc

SEQ ID NO: 3155428 - DNA, 19 bp, Homo sapiens
tgcagctgggccccatgct

SEQ ID NO: 3155429 - DNA, 24 bp, Homo sapiens
tgcagctgggccccatgctctgcc

SEQ ID NO: 3155430 - DNA, 22 bp, Homo sapiens
tgcagcttgggagagcccctgg

SEQ ID NO: 3155431 - DNA, 15 bp, Homo sapiens
tgcagctttacatgc

SEQ ID NO: 3155432 - DNA, 16 bp, Homo sapiens
tgcagctttacatgca

SEQ ID NO: 3155433 - DNA, 20 bp, Homo sapiens
tgcaggaaggaaaactatgt

SEQ ID NO: 3155434 - DNA, 19 bp, Homo sapiens
tgcaggacaggaggcggcc

SEQ ID NO: 3155435 - DNA, 19 bp, Homo sapiens
tgcaggagtgtcctgccca

SEQ ID NO: 3155436 - DNA, 15 bp, Homo sapiens
tgcaggcatgcttct

SEQ ID NO: 3155437 - DNA, 20 bp, Homo sapiens
tgcaggccaagagcagaggc

SEQ ID NO: 3155438 - DNA, 15 bp, Homo sapiens
tgcaggccctggcct

SEQ ID NO: 3155439 - DNA, 17 bp, Homo sapiens
tgcaggccctggcctcc

SEQ ID NO: 3155440 - DNA, 19 bp, Homo sapiens
tgcaggccctggcctcccc

SEQ ID NO: 3155441 - DNA, 11 bp, Homo sapiens
tgcaggccctt

SEQ ID NO: 3155442 - DNA, 12 bp, Homo sapiens
tgcaggctctgg

SEQ ID NO: 3155443 - DNA, 14 bp, Homo sapiens
tgcaggctctgggc

SEQ ID NO: 3155444 - DNA, 15 bp, Homo sapiens
tgcaggctctgggct

SEQ ID NO: 3155445 - DNA, 22 bp, Homo sapiens
tgcaggctctgggctcagggct

SEQ ID NO: 3155446 - DNA, 15 bp, Homo sapiens
tgcagggaagagggc

SEQ ID NO: 3155447 - DNA, 16 bp, Homo sapiens
tgcagggaagagggca

SEQ ID NO: 3155448 - DNA, 18 bp, Homo sapiens
tgcagggaagagggcagt

SEQ ID NO: 3155449 - DNA, 20 bp, Homo sapiens
tgcagggaagagggcagtac

SEQ ID NO: 3155450 - DNA, 13 bp, Homo sapiens
tgcagggcagccc

SEQ ID NO: 3155451 - DNA, 20 bp, Homo sapiens
tgcagggcagccccacaact

SEQ ID NO: 3155452 - DNA, 13 bp, Homo sapiens
tgcagggccagga

SEQ ID NO: 3155453 - DNA, 15 bp, Homo sapiens
tgcagggccaggact

SEQ ID NO: 3155454 - DNA, 23 bp, Homo sapiens
tgcagggccatctgactgccaag

SEQ ID NO: 3155455 - DNA, 16 bp, Homo sapiens
tgcagggcgcccctgg

SEQ ID NO: 3155456 - DNA, 13 bp, Homo sapiens
tgcaggggctctg

SEQ ID NO: 3155457 - DNA, 18 bp, Homo sapiens
tgcaggggctctggagag

SEQ ID NO: 3155458 - DNA, 16 bp, Homo sapiens
tgcaggggtccctgct

SEQ ID NO: 3155459 - DNA, 13 bp, Homo sapiens
tgcaggggtgacg

SEQ ID NO: 3155460 - DNA, 19 bp, Homo sapiens
tgcagggtcctcttctggg

SEQ ID NO: 3155461 - DNA, 15 bp, Homo sapiens
tgcaggtacttcctc

SEQ ID NO: 3155462 - DNA, 20 bp, Homo sapiens
tgcaggtacttcctcctgat

SEQ ID NO: 3155463 - DNA, 12 bp, Homo sapiens
tgcaggtgggca

SEQ ID NO: 3155464 - DNA, 19 bp, Homo sapiens
tgcaggttggaaggggcct

SEQ ID NO: 3155465 - DNA, 14 bp, Homo sapiens
tgcaggttttctgt

SEQ ID NO: 3155466 - DNA, 18 bp, Homo sapiens
tgcagtaaatcttttaca

SEQ ID NO: 3155467 - DNA, 21 bp, Homo sapiens
tgcagtaaatcttttacaact

SEQ ID NO: 3155468 - DNA, 11 bp, Homo sapiens
tgcagtaactg

SEQ ID NO: 3155469 - DNA, 16 bp, Homo sapiens
tgcagtaactgttttt

SEQ ID NO: 3155470 - DNA, 16 bp, Homo sapiens
tgcagtacagtcttat

SEQ ID NO: 3155471 - DNA, 18 bp, Homo sapiens
tgcagtactttacctcct

SEQ ID NO: 3155472 - DNA, 15 bp, Homo sapiens
tgcagtacttttgtt

SEQ ID NO: 3155473 - DNA, 21 bp, Homo sapiens
tgcagtacttttgttgtatgg

SEQ ID NO: 3155474 - DNA, 22 bp, Homo sapiens
tgcagtagctgtggcctcaccc

SEQ ID NO: 3155475 - DNA, 17 bp, Homo sapiens
tgcagtcactggaggtt

SEQ ID NO: 3155476 - DNA, 20 bp, Homo sapiens
tgcagtccgcagtctggcct

SEQ ID NO: 3155477 - DNA, 21 bp, Homo sapiens
tgcagtccgcagtctggcctg

SEQ ID NO: 3155478 - DNA, 21 bp, Homo sapiens
tgcagtcttatttccaagtaa

SEQ ID NO: 3155479 - DNA, 22 bp, Homo sapiens
tgcagtcttctgggctgcggga

SEQ ID NO: 3155480 - DNA, 13 bp, Homo sapiens
tgcagtgaattgt

SEQ ID NO: 3155481 - DNA, 18 bp, Homo sapiens
tgcagtgacgtgcacctg

SEQ ID NO: 3155482 - DNA, 20 bp, Homo sapiens
tgcagtgatatggcagaaga

SEQ ID NO: 3155483 - DNA, 21 bp, Homo sapiens
tgcagtgatatggcagaagac

SEQ ID NO: 3155484 - DNA, 23 bp, Homo sapiens
tgcagtgatatggcagaagacac

SEQ ID NO: 3155485 - DNA, 12 bp, Homo sapiens
tgcagtgccttg

SEQ ID NO: 3155486 - DNA, 16 bp, Homo sapiens
tgcagtgcttccaagg

SEQ ID NO: 3155487 - DNA, 23 bp, Homo sapiens
tgcagtggcgcaatctcggctca

SEQ ID NO: 3155488 - DNA, 15 bp, Homo sapiens
tgcagttcagcacca

SEQ ID NO: 3155489 - DNA, 18 bp, Homo sapiens
tgcagttcagcaccaccc

SEQ ID NO: 3155490 - DNA, 16 bp, Homo sapiens
tgcagttcattatttt

SEQ ID NO: 3155491 - DNA, 15 bp, Homo sapiens
tgcagttcctggccc

SEQ ID NO: 3155492 - DNA, 16 bp, Homo sapiens
tgcagttgactttctc

SEQ ID NO: 3155493 - DNA, 17 bp, Homo sapiens
tgcagttgactttctcc

SEQ ID NO: 3155494 - DNA, 21 bp, Homo sapiens
tgcagttttgtttggtttact

SEQ ID NO: 3155495 - DNA, 23 bp, Homo sapiens
tgcataataagctaaagaggctg

SEQ ID NO: 3155496 - DNA, 24 bp, Homo sapiens
tgcataataagctaaagaggctga

SEQ ID NO: 3155497 - DNA, 15 bp, Homo sapiens
tgcataatgcaatca

SEQ ID NO: 3155498 - DNA, 18 bp, Homo sapiens
tgcataatgcaatcaaaa

SEQ ID NO: 3155499 - DNA, 18 bp, Homo sapiens
tgcataatgtttctggat

SEQ ID NO: 3155500 - DNA, 13 bp, Homo sapiens
tgcatactttatt

SEQ ID NO: 3155501 - DNA, 20 bp, Homo sapiens
tgcatactttgtattttgat

SEQ ID NO: 3155502 - DNA, 19 bp, Homo sapiens
tgcatagaggtaccagcaa

SEQ ID NO: 3155503 - DNA, 16 bp, Homo sapiens
tgcatagcagtatatg

SEQ ID NO: 3155504 - DNA, 15 bp, Homo sapiens
tgcatagctctcctt

SEQ ID NO: 3155505 - DNA, 16 bp, Homo sapiens
tgcatagtcccagcta

SEQ ID NO: 3155506 - DNA, 15 bp, Homo sapiens
tgcatatatgttctt

SEQ ID NO: 3155507 - DNA, 20 bp, Homo sapiens
tgcatatatgttcttcataa

SEQ ID NO: 3155508 - DNA, 17 bp, Homo sapiens
tgcatatcctgagccat

SEQ ID NO: 3155509 - DNA, 18 bp, Homo sapiens
tgcatatcctgagccatc

SEQ ID NO: 3155510 - DNA, 13 bp, Homo sapiens
tgcatatgttgaa

SEQ ID NO: 3155511 - DNA, 13 bp, Homo sapiens
tgcatattccttt

SEQ ID NO: 3155512 - DNA, 13 bp, Homo sapiens
tgcatattctatt

SEQ ID NO: 3155513 - DNA, 15 bp, Homo sapiens
tgcatattctattgt

SEQ ID NO: 3155514 - DNA, 22 bp, Homo sapiens
tgcatattctattgtattattt

SEQ ID NO: 3155515 - DNA, 23 bp, Homo sapiens
tgcatattctattgtattatttg

SEQ ID NO: 3155516 - DNA, 18 bp, Homo sapiens
tgcatatttattgcattg

SEQ ID NO: 3155517 - DNA, 21 bp, Homo sapiens
tgcatcactgtatcattttct

SEQ ID NO: 3155518 - DNA, 14 bp, Homo sapiens
tgcatcagtattaa

SEQ ID NO: 3155519 - DNA, 16 bp, Homo sapiens
tgcatcatctgtagat

SEQ ID NO: 3155520 - DNA, 24 bp, Homo sapiens
tgcatcccgtacctcttcccatga

SEQ ID NO: 3155521 - DNA, 20 bp, Homo sapiens
tgcatcctcctcagccccca

SEQ ID NO: 3155522 - DNA, 17 bp, Homo sapiens
tgcatcgggaaagaaga

SEQ ID NO: 3155523 - DNA, 18 bp, Homo sapiens
tgcatctagattatggag

SEQ ID NO: 3155524 - DNA, 12 bp, Homo sapiens
tgcatctgactc

SEQ ID NO: 3155525 - DNA, 14 bp, Homo sapiens
tgcatctgactctc

SEQ ID NO: 3155526 - DNA, 13 bp, Homo sapiens
tgcatctggggcc

SEQ ID NO: 3155527 - DNA, 18 bp, Homo sapiens
tgcatgaagagaagcaat

SEQ ID NO: 3155528 - DNA, 19 bp, Homo sapiens
tgcatgaatatcatacaaa

SEQ ID NO: 3155529 - DNA, 16 bp, Homo sapiens
tgcatgacctaccagg

SEQ ID NO: 3155530 - DNA, 21 bp, Homo sapiens
tgcatgatatcttcaagcctg

SEQ ID NO: 3155531 - DNA, 16 bp, Homo sapiens
tgcatgatggtgagag

SEQ ID NO: 3155532 - DNA, 17 bp, Homo sapiens
tgcatgcaaacaagaaa

SEQ ID NO: 3155533 - DNA, 21 bp, Homo sapiens
tgcatgccaaggggttaatga

SEQ ID NO: 3155534 - DNA, 14 bp, Homo sapiens
tgcatgcctggtct

SEQ ID NO: 3155535 - DNA, 18 bp, Homo sapiens
tgcatggaggccctcctg

SEQ ID NO: 3155536 - DNA, 22 bp, Homo sapiens
tgcatggctccagaaatgtcta

SEQ ID NO: 3155537 - DNA, 16 bp, Homo sapiens
tgcatgggtgaaggga

SEQ ID NO: 3155538 - DNA, 13 bp, Homo sapiens
tgcatgtatgtct

SEQ ID NO: 3155539 - DNA, 15 bp, Homo sapiens
tgcatgtatgtcttg

SEQ ID NO: 3155540 - DNA, 23 bp, Homo sapiens
tgcatgtcctttgcgcctgtgac

SEQ ID NO: 3155541 - DNA, 17 bp, Homo sapiens
tgcatgtcgcacaatgt

SEQ ID NO: 3155542 - DNA, 15 bp, Homo sapiens
tgcatgtgaagcatg

SEQ ID NO: 3155543 - DNA, 17 bp, Homo sapiens
tgcatgtgaagcatgct

SEQ ID NO: 3155544 - DNA, 15 bp, Homo sapiens
tgcatgtggcttttt

SEQ ID NO: 3155545 - DNA, 15 bp, Homo sapiens
tgcatgttactaaat

SEQ ID NO: 3155546 - DNA, 14 bp, Homo sapiens
tgcattaaacctgt

SEQ ID NO: 3155547 - DNA, 15 bp, Homo sapiens
tgcattaaacctgtc

SEQ ID NO: 3155548 - DNA, 11 bp, Homo sapiens
tgcattacaga

SEQ ID NO: 3155549 - DNA, 12 bp, Homo sapiens
tgcattacagag

SEQ ID NO: 3155550 - DNA, 17 bp, Homo sapiens
tgcattacagagaggag

SEQ ID NO: 3155551 - DNA, 13 bp, Homo sapiens
tgcattagaaatt

SEQ ID NO: 3155552 - DNA, 14 bp, Homo sapiens
tgcattagaaatta

SEQ ID NO: 3155553 - DNA, 17 bp, Homo sapiens
tgcattagcacagattt

SEQ ID NO: 3155554 - DNA, 18 bp, Homo sapiens
tgcattattaaattgtaa

SEQ ID NO: 3155555 - DNA, 15 bp, Homo sapiens
tgcattattatcatt

SEQ ID NO: 3155556 - DNA, 18 bp, Homo sapiens
tgcattcatttttatagc

SEQ ID NO: 3155557 - DNA, 15 bp, Homo sapiens
tgcattcctgtaact

SEQ ID NO: 3155558 - DNA, 23 bp, Homo sapiens
tgcattcctgtaacttttaatcc

SEQ ID NO: 3155559 - DNA, 16 bp, Homo sapiens
tgcattcctttgtctt

SEQ ID NO: 3155560 - DNA, 18 bp, Homo sapiens
tgcattcctttgtcttca

SEQ ID NO: 3155561 - DNA, 23 bp, Homo sapiens
tgcattcgaagaaacccttgctg

SEQ ID NO: 3155562 - DNA, 21 bp, Homo sapiens
tgcattctctcccatcctggg

SEQ ID NO: 3155563 - DNA, 12 bp, Homo sapiens
tgcattcttata

SEQ ID NO: 3155564 - DNA, 20 bp, Homo sapiens
tgcattctttggtaattttt

SEQ ID NO: 3155565 - DNA, 17 bp, Homo sapiens
tgcattgaacacaaact

SEQ ID NO: 3155566 - DNA, 23 bp, Homo sapiens
tgcattgaacacaaactgtaaat

SEQ ID NO: 3155567 - DNA, 15 bp, Homo sapiens
tgcattgaatatatt

SEQ ID NO: 3155568 - DNA, 20 bp, Homo sapiens
tgcattgaccgcgactaatt

SEQ ID NO: 3155569 - DNA, 22 bp, Homo sapiens
tgcattgaccgcgactaatttc

SEQ ID NO: 3155570 - DNA, 19 bp, Homo sapiens
tgcattgcttttttttcct

SEQ ID NO: 3155571 - DNA, 16 bp, Homo sapiens
tgcattgtcttgtgga

SEQ ID NO: 3155572 - DNA, 17 bp, Homo sapiens
tgcattgtgattggcct

SEQ ID NO: 3155573 - DNA, 18 bp, Homo sapiens
tgcattgttattgtggaa

SEQ ID NO: 3155574 - DNA, 20 bp, Homo sapiens
tgcattgttggctatttgaa

SEQ ID NO: 3155575 - DNA, 15 bp, Homo sapiens
tgcatttaaaacaga

SEQ ID NO: 3155576 - DNA, 19 bp, Homo sapiens
tgcatttaaaacagacact

SEQ ID NO: 3155577 - DNA, 14 bp, Homo sapiens
tgcatttaaatcaa

SEQ ID NO: 3155578 - DNA, 23 bp, Homo sapiens
tgcatttcaagcagctgaagaaa

SEQ ID NO: 3155579 - DNA, 18 bp, Homo sapiens
tgcatttcacctgtgaca

SEQ ID NO: 3155580 - DNA, 21 bp, Homo sapiens
tgcatttgagagaagccacgc

SEQ ID NO: 3155581 - DNA, 22 bp, Homo sapiens
tgcatttgagagaagccacgct

SEQ ID NO: 3155582 - DNA, 13 bp, Homo sapiens
tgcatttgaggtc

SEQ ID NO: 3155583 - DNA, 18 bp, Homo sapiens
tgcatttgtgctagaaat

SEQ ID NO: 3155584 - DNA, 20 bp, Homo sapiens
tgcatttttggatcattttt

SEQ ID NO: 3155585 - DNA, 16 bp, Homo sapiens
tgccaaaaaaaaaaga

SEQ ID NO: 3155586 - DNA, 19 bp, Homo sapiens
tgccaaaaaaaaaagaagt

SEQ ID NO: 3155587 - DNA, 19 bp, Homo sapiens
tgccaaaatcattttaatg

SEQ ID NO: 3155588 - DNA, 23 bp, Homo sapiens
tgccaaacaaaaaggttctcagg

SEQ ID NO: 3155589 - DNA, 20 bp, Homo sapiens
tgccaaagctagggtggccc

SEQ ID NO: 3155590 - DNA, 15 bp, Homo sapiens
tgccaaaggatgtga

SEQ ID NO: 3155591 - DNA, 14 bp, Homo sapiens
tgccaaagggaaat

SEQ ID NO: 3155592 - DNA, 11 bp, Homo sapiens
tgccaaagtac

SEQ ID NO: 3155593 - DNA, 19 bp, Homo sapiens
tgccaaagtacagaatttg

SEQ ID NO: 3155594 - DNA, 17 bp, Homo sapiens
tgccaaagtctcccttc

SEQ ID NO: 3155595 - DNA, 15 bp, Homo sapiens
tgccaaataaacagc

SEQ ID NO: 3155596 - DNA, 18 bp, Homo sapiens
tgccaaataaacagctat

SEQ ID NO: 3155597 - DNA, 19 bp, Homo sapiens
tgccaaataaacagctatt

SEQ ID NO: 3155598 - DNA, 18 bp, Homo sapiens
tgccaaatatgtcctggg

SEQ ID NO: 3155599 - DNA, 13 bp, Homo sapiens
tgccaactcctca

SEQ ID NO: 3155600 - DNA, 22 bp, Homo sapiens
tgccaactgttcagctgtcctc

SEQ ID NO: 3155601 - DNA, 14 bp, Homo sapiens
tgccaagaaaatga

SEQ ID NO: 3155602 - DNA, 13 bp, Homo sapiens
tgccaagacaaat

SEQ ID NO: 3155603 - DNA, 22 bp, Homo sapiens
tgccaagacaaatcaacagaag

SEQ ID NO: 3155604 - DNA, 23 bp, Homo sapiens
tgccaagacaaatcaacagaagc

SEQ ID NO: 3155605 - DNA, 20 bp, Homo sapiens
tgccaagagtcaacaggtca

SEQ ID NO: 3155606 - DNA, 18 bp, Homo sapiens
tgccaagattctactctt

SEQ ID NO: 3155607 - DNA, 22 bp, Homo sapiens
tgccaagattctactcttgtca

SEQ ID NO: 3155608 - DNA, 17 bp, Homo sapiens
tgccaagccagattctc

SEQ ID NO: 3155609 - DNA, 22 bp, Homo sapiens
tgccaagctaatttatagcaag

SEQ ID NO: 3155610 - DNA, 13 bp, Homo sapiens
tgccaagctccaa

SEQ ID NO: 3155611 - DNA, 14 bp, Homo sapiens
tgccaaggagcccc

SEQ ID NO: 3155612 - DNA, 20 bp, Homo sapiens
tgccaaggccagagtggcct

SEQ ID NO: 3155613 - DNA, 19 bp, Homo sapiens
tgccaagtggggatggggc

SEQ ID NO: 3155614 - DNA, 16 bp, Homo sapiens
tgccaagttgctgtca

SEQ ID NO: 3155615 - DNA, 23 bp, Homo sapiens
tgccaataaaagttttctccaac

SEQ ID NO: 3155616 - DNA, 21 bp, Homo sapiens
tgccaataaagcttttggaag

SEQ ID NO: 3155617 - DNA, 16 bp, Homo sapiens
tgccaatatgtattgt

SEQ ID NO: 3155618 - DNA, 18 bp, Homo sapiens
tgccaatattaaatctgc

SEQ ID NO: 3155619 - DNA, 20 bp, Homo sapiens
tgccaatgaggtctgaaatg

SEQ ID NO: 3155620 - DNA, 23 bp, Homo sapiens
tgccaattgctaccgagaaggtt

SEQ ID NO: 3155621 - DNA, 17 bp, Homo sapiens
tgccacaacagaataaa

SEQ ID NO: 3155622 - DNA, 23 bp, Homo sapiens
tgccacaacagaataaagcagcc

SEQ ID NO: 3155623 - DNA, 13 bp, Homo sapiens
tgccacacagagt

SEQ ID NO: 3155624 - DNA, 13 bp, Homo sapiens
tgccacaccctcc

SEQ ID NO: 3155625 - DNA, 15 bp, Homo sapiens
tgccacacctggcct

SEQ ID NO: 3155626 - DNA, 18 bp, Homo sapiens
tgccacactctccatcac

SEQ ID NO: 3155627 - DNA, 16 bp, Homo sapiens
tgccacagcttttgca

SEQ ID NO: 3155628 - DNA, 15 bp, Homo sapiens
tgccacaggcctccc

SEQ ID NO: 3155629 - DNA, 17 bp, Homo sapiens
tgccacaggcctccctg

SEQ ID NO: 3155630 - DNA, 17 bp, Homo sapiens
tgccacagtagaactgt

SEQ ID NO: 3155631 - DNA, 17 bp, Homo sapiens
tgccacatacaggtgct

SEQ ID NO: 3155632 - DNA, 11 bp, Homo sapiens
tgccacatttc

SEQ ID NO: 3155633 - DNA, 14 bp, Homo sapiens
tgccacatttctga

SEQ ID NO: 3155634 - DNA, 17 bp, Homo sapiens
tgccacatttctgatca

SEQ ID NO: 3155635 - DNA, 18 bp, Homo sapiens
tgccacatttctgatcag

SEQ ID NO: 3155636 - DNA, 20 bp, Homo sapiens
tgccacatttctgatcagag

SEQ ID NO: 3155637 - DNA, 22 bp, Homo sapiens
tgccacatttctgatcagaggt

SEQ ID NO: 3155638 - DNA, 23 bp, Homo sapiens
tgccaccacgtctgccaggccca

SEQ ID NO: 3155639 - DNA, 18 bp, Homo sapiens
tgccaccagagaccgtcc

SEQ ID NO: 3155640 - DNA, 14 bp, Homo sapiens
tgccaccaggccac

SEQ ID NO: 3155641 - DNA, 12 bp, Homo sapiens
tgccacccacca

SEQ ID NO: 3155642 - DNA, 14 bp, Homo sapiens
tgccacccactcag

SEQ ID NO: 3155643 - DNA, 15 bp, Homo sapiens
tgccacccactcagg

SEQ ID NO: 3155644 - DNA, 19 bp, Homo sapiens
tgccacccactcaggattg

SEQ ID NO: 3155645 - DNA, 14 bp, Homo sapiens
tgccaccccaaccc

SEQ ID NO: 3155646 - DNA, 15 bp, Homo sapiens
tgccaccccaaccca

SEQ ID NO: 3155647 - DNA, 19 bp, Homo sapiens
tgccaccccatgtgccttt

SEQ ID NO: 3155648 - DNA, 15 bp, Homo sapiens
tgccaccctcacaca

SEQ ID NO: 3155649 - DNA, 17 bp, Homo sapiens
tgccaccctcacacaca

SEQ ID NO: 3155650 - DNA, 21 bp, Homo sapiens
tgccaccctcacacacacagc

SEQ ID NO: 3155651 - DNA, 21 bp, Homo sapiens
tgccaccggaggtcactccac

SEQ ID NO: 3155652 - DNA, 16 bp, Homo sapiens
tgccaccttgtggccg

SEQ ID NO: 3155653 - DNA, 17 bp, Homo sapiens
tgccaccttgtggccgc

SEQ ID NO: 3155654 - DNA, 19 bp, Homo sapiens
tgccacgctttgctgctac

SEQ ID NO: 3155655 - DNA, 19 bp, Homo sapiens
tgccacgtggtcactgtgc

SEQ ID NO: 3155656 - DNA, 14 bp, Homo sapiens
tgccacgttccaca

SEQ ID NO: 3155657 - DNA, 16 bp, Homo sapiens
tgccacgttccacagt

SEQ ID NO: 3155658 - DNA, 20 bp, Homo sapiens
tgccacgttccacagttgcc

SEQ ID NO: 3155659 - DNA, 22 bp, Homo sapiens
tgccacgttggagaagcccgtg

SEQ ID NO: 3155660 - DNA, 18 bp, Homo sapiens
tgccactcactaggcccc

SEQ ID NO: 3155661 - DNA, 20 bp, Homo sapiens
tgccactcactaggccccca

SEQ ID NO: 3155662 - DNA, 18 bp, Homo sapiens
tgccactcattcctgtag

SEQ ID NO: 3155663 - DNA, 13 bp, Homo sapiens
tgccactccctga

SEQ ID NO: 3155664 - DNA, 15 bp, Homo sapiens
tgccactccctgagc

SEQ ID NO: 3155665 - DNA, 13 bp, Homo sapiens
tgccactccttgt

SEQ ID NO: 3155666 - DNA, 13 bp, Homo sapiens
tgccactgcactc

SEQ ID NO: 3155667 - DNA, 13 bp, Homo sapiens
tgccactgccagg

SEQ ID NO: 3155668 - DNA, 15 bp, Homo sapiens
tgccactgccaggca

SEQ ID NO: 3155669 - DNA, 16 bp, Homo sapiens
tgccactgccaggcac

SEQ ID NO: 3155670 - DNA, 19 bp, Homo sapiens
tgccactgccaggcacctg

SEQ ID NO: 3155671 - DNA, 18 bp, Homo sapiens
tgccactgccccccgagg

SEQ ID NO: 3155672 - DNA, 18 bp, Homo sapiens
tgccactgcccgagctgg

SEQ ID NO: 3155673 - DNA, 21 bp, Homo sapiens
tgccactgcccgagctggtgc

SEQ ID NO: 3155674 - DNA, 13 bp, Homo sapiens
tgccactgcctct

SEQ ID NO: 3155675 - DNA, 17 bp, Homo sapiens
tgccactgcctcttcct

SEQ ID NO: 3155676 - DNA, 20 bp, Homo sapiens
tgccactgcctcttcctccc

SEQ ID NO: 3155677 - DNA, 19 bp, Homo sapiens
tgccactggggaaaactcc

SEQ ID NO: 3155678 - DNA, 18 bp, Homo sapiens
tgccacttaatgtatgtt

SEQ ID NO: 3155679 - DNA, 18 bp, Homo sapiens
tgccacttcccagaggca

SEQ ID NO: 3155680 - DNA, 21 bp, Homo sapiens
tgccacttcttaaaggcctgg

SEQ ID NO: 3155681 - DNA, 15 bp, Homo sapiens
tgccactttgcacat

SEQ ID NO: 3155682 - DNA, 23 bp, Homo sapiens
tgccactttggtacatggccagt

SEQ ID NO: 3155683 - DNA, 17 bp, Homo sapiens
tgccagaaggataatat

SEQ ID NO: 3155684 - DNA, 13 bp, Homo sapiens
tgccagactctag

SEQ ID NO: 3155685 - DNA, 23 bp, Homo sapiens
tgccagactctaggttatacaat

SEQ ID NO: 3155686 - DNA, 21 bp, Homo sapiens
tgccagagaggggctgctctc

SEQ ID NO: 3155687 - DNA, 22 bp, Homo sapiens
tgccagaggaatcctggcagcc

SEQ ID NO: 3155688 - DNA, 23 bp, Homo sapiens
tgccagaggaatcctggcagccc

SEQ ID NO: 3155689 - DNA, 14 bp, Homo sapiens
tgccagaggggaag

SEQ ID NO: 3155690 - DNA, 16 bp, Homo sapiens
tgccagaggtgggcag

SEQ ID NO: 3155691 - DNA, 20 bp, Homo sapiens
tgccagaggtgggcaggtgg

SEQ ID NO: 3155692 - DNA, 22 bp, Homo sapiens
tgccagcacagagcgtccttcc

SEQ ID NO: 3155693 - DNA, 14 bp, Homo sapiens
tgccagcacagggg

SEQ ID NO: 3155694 - DNA, 15 bp, Homo sapiens
tgccagcacaggggc

SEQ ID NO: 3155695 - DNA, 16 bp, Homo sapiens
tgccagcacaggggcc

SEQ ID NO: 3155696 - DNA, 17 bp, Homo sapiens
tgccagcacaggggccc

SEQ ID NO: 3155697 - DNA, 19 bp, Homo sapiens
tgccagcacaggggcccca

SEQ ID NO: 3155698 - DNA, 14 bp, Homo sapiens
tgccagcagcagca

SEQ ID NO: 3155699 - DNA, 19 bp, Homo sapiens
tgccagcaggggggctgtg

SEQ ID NO: 3155700 - DNA, 21 bp, Homo sapiens
tgccagccccctaaaagcact

SEQ ID NO: 3155701 - DNA, 22 bp, Homo sapiens
tgccagccccctaaaagcactc

SEQ ID NO: 3155702 - DNA, 14 bp, Homo sapiens
tgccagcccctgcc

SEQ ID NO: 3155703 - DNA, 15 bp, Homo sapiens
tgccagcccctgcct

SEQ ID NO: 3155704 - DNA, 19 bp, Homo sapiens
tgccagccgtgatgctcag

SEQ ID NO: 3155705 - DNA, 22 bp, Homo sapiens
tgccagcctgaggcagccactt

SEQ ID NO: 3155706 - DNA, 15 bp, Homo sapiens
tgccagcctggcttc

SEQ ID NO: 3155707 - DNA, 19 bp, Homo sapiens
tgccagccttgagccctgg

SEQ ID NO: 3155708 - DNA, 21 bp, Homo sapiens
tgccagctgccttcctcatcc

SEQ ID NO: 3155709 - DNA, 22 bp, Homo sapiens
tgccagctgccttcctcatccc

SEQ ID NO: 3155710 - DNA, 22 bp, Homo sapiens
tgccaggaacctgtcctaagga

SEQ ID NO: 3155711 - DNA, 13 bp, Homo sapiens
tgccaggacacgc

SEQ ID NO: 3155712 - DNA, 13 bp, Homo sapiens
tgccaggcacctg

SEQ ID NO: 3155713 - DNA, 22 bp, Homo sapiens
tgccaggcacctggcctgctgg

SEQ ID NO: 3155714 - DNA, 23 bp, Homo sapiens
tgccaggcacctggcctgctggg

SEQ ID NO: 3155715 - DNA, 15 bp, Homo sapiens
tgccaggcaggggtg

SEQ ID NO: 3155716 - DNA, 19 bp, Homo sapiens
tgccaggccagagggcagt

SEQ ID NO: 3155717 - DNA, 17 bp, Homo sapiens
tgccaggccagcctccg

SEQ ID NO: 3155718 - DNA, 19 bp, Homo sapiens
tgccaggctccctttctct

SEQ ID NO: 3155719 - DNA, 22 bp, Homo sapiens
tgccaggctgaattacagtgaa

SEQ ID NO: 3155720 - DNA, 18 bp, Homo sapiens
tgccaggttttctgggtg

SEQ ID NO: 3155721 - DNA, 17 bp, Homo sapiens
tgccaggtttttggtct

SEQ ID NO: 3155722 - DNA, 18 bp, Homo sapiens
tgccagtatttttaaagg

SEQ ID NO: 3155723 - DNA, 17 bp, Homo sapiens
tgccagtcaagaagaaa

SEQ ID NO: 3155724 - DNA, 17 bp, Homo sapiens
tgccagtccccctgccc

SEQ ID NO: 3155725 - DNA, 19 bp, Homo sapiens
tgccagtccccctgcccca

SEQ ID NO: 3155726 - DNA, 13 bp, Homo sapiens
tgccagtcctggg

SEQ ID NO: 3155727 - DNA, 14 bp, Homo sapiens
tgccagtcctgggg

SEQ ID NO: 3155728 - DNA, 19 bp, Homo sapiens
tgccagtgacagacaggct

SEQ ID NO: 3155729 - DNA, 14 bp, Homo sapiens
tgccagtgcagcca

SEQ ID NO: 3155730 - DNA, 15 bp, Homo sapiens
tgccagtgcagccac

SEQ ID NO: 3155731 - DNA, 14 bp, Homo sapiens
tgccagtggatccc

SEQ ID NO: 3155732 - DNA, 12 bp, Homo sapiens
tgccagtgtctt

SEQ ID NO: 3155733 - DNA, 14 bp, Homo sapiens
tgccagtgtctttc

SEQ ID NO: 3155734 - DNA, 20 bp, Homo sapiens
tgccagtgtctttctttggt

SEQ ID NO: 3155735 - DNA, 22 bp, Homo sapiens
tgccagttgaaaatggattttt

SEQ ID NO: 3155736 - DNA, 13 bp, Homo sapiens
tgccataattcta

SEQ ID NO: 3155737 - DNA, 17 bp, Homo sapiens
tgccatactttgtctga

SEQ ID NO: 3155738 - DNA, 19 bp, Homo sapiens
tgccatagtcacatggcct

SEQ ID NO: 3155739 - DNA, 17 bp, Homo sapiens
tgccatattctgttggc

SEQ ID NO: 3155740 - DNA, 20 bp, Homo sapiens
tgccatattctgttggccag

SEQ ID NO: 3155741 - DNA, 19 bp, Homo sapiens
tgccatcaccgctgggtgg

SEQ ID NO: 3155742 - DNA, 12 bp, Homo sapiens
tgccatccaggt

SEQ ID NO: 3155743 - DNA, 15 bp, Homo sapiens
tgccatccaggttca

SEQ ID NO: 3155744 - DNA, 15 bp, Homo sapiens
tgccatgatctgtat

SEQ ID NO: 3155745 - DNA, 17 bp, Homo sapiens
tgccatgatctgtattt

SEQ ID NO: 3155746 - DNA, 13 bp, Homo sapiens
tgccatgccactg

SEQ ID NO: 3155747 - DNA, 18 bp, Homo sapiens
tgccatgccactgccagg

SEQ ID NO: 3155748 - DNA, 22 bp, Homo sapiens
tgccatggctaggtagaagtga

SEQ ID NO: 3155749 - DNA, 14 bp, Homo sapiens
tgccatgggccagc

SEQ ID NO: 3155750 - DNA, 20 bp, Homo sapiens
tgccatgggccagcctagcc

SEQ ID NO: 3155751 - DNA, 21 bp, Homo sapiens
tgccatgggccagcctagccc

SEQ ID NO: 3155752 - DNA, 18 bp, Homo sapiens
tgccatgggcttcactgt

SEQ ID NO: 3155753 - DNA, 19 bp, Homo sapiens
tgccatgggcttcactgta

SEQ ID NO: 3155754 - DNA, 22 bp, Homo sapiens
tgccatgtctgcagtgtgcccc

SEQ ID NO: 3155755 - DNA, 15 bp, Homo sapiens
tgccatgtgaagagg

SEQ ID NO: 3155756 - DNA, 17 bp, Homo sapiens
tgccatgtgtgctgaac

SEQ ID NO: 3155757 - DNA, 12 bp, Homo sapiens
tgccatgttggc

SEQ ID NO: 3155758 - DNA, 20 bp, Homo sapiens
tgccatgttggccaggctgg

SEQ ID NO: 3155759 - DNA, 21 bp, Homo sapiens
tgccatgttggccaggctggt

SEQ ID NO: 3155760 - DNA, 20 bp, Homo sapiens
tgccattccaaaatattatg

SEQ ID NO: 3155761 - DNA, 18 bp, Homo sapiens
tgccattccactccactc

SEQ ID NO: 3155762 - DNA, 19 bp, Homo sapiens
tgccattccactccactca

SEQ ID NO: 3155763 - DNA, 20 bp, Homo sapiens
tgccattccactccactcag

SEQ ID NO: 3155764 - DNA, 16 bp, Homo sapiens
tgccattcttctggtg

SEQ ID NO: 3155765 - DNA, 16 bp, Homo sapiens
tgccattgtctttata

SEQ ID NO: 3155766 - DNA, 14 bp, Homo sapiens
tgccatttaaaaag

SEQ ID NO: 3155767 - DNA, 17 bp, Homo sapiens
tgccatttctgaactgt

SEQ ID NO: 3155768 - DNA, 21 bp, Homo sapiens
tgccatttctgaactgttaca

SEQ ID NO: 3155769 - DNA, 22 bp, Homo sapiens
tgccatttctgaactgttacaa

SEQ ID NO: 3155770 - DNA, 17 bp, Homo sapiens
tgccatttgcaccctcc

SEQ ID NO: 3155771 - DNA, 19 bp, Homo sapiens
tgccatttgcaccctccgc

SEQ ID NO: 3155772 - DNA, 18 bp, Homo sapiens
tgccatttttctataaat

SEQ ID NO: 3155773 - DNA, 19 bp, Homo sapiens
tgcccaaaaatatggttga

SEQ ID NO: 3155774 - DNA, 22 bp, Homo sapiens
tgcccaaacccttaactgacat

SEQ ID NO: 3155775 - DNA, 19 bp, Homo sapiens
tgcccaaagattgatttgt

SEQ ID NO: 3155776 - DNA, 17 bp, Homo sapiens
tgcccaaagtggggagg

SEQ ID NO: 3155777 - DNA, 22 bp, Homo sapiens
tgcccaacaccagcccctgccc

SEQ ID NO: 3155778 - DNA, 21 bp, Homo sapiens
tgcccaagaatagatgctgac

SEQ ID NO: 3155779 - DNA, 20 bp, Homo sapiens
tgcccaagccagaggctggg

SEQ ID NO: 3155780 - DNA, 14 bp, Homo sapiens
tgcccaagcccagg

SEQ ID NO: 3155781 - DNA, 18 bp, Homo sapiens
tgcccaagcccaggccac

SEQ ID NO: 3155782 - DNA, 21 bp, Homo sapiens
tgcccaagcccaggccaccct

SEQ ID NO: 3155783 - DNA, 18 bp, Homo sapiens
tgcccaagccctgagagt

SEQ ID NO: 3155784 - DNA, 19 bp, Homo sapiens
tgcccaagggcctcccacc

SEQ ID NO: 3155785 - DNA, 21 bp, Homo sapiens
tgcccaagggcctcccaccag

SEQ ID NO: 3155786 - DNA, 16 bp, Homo sapiens
tgcccaatgctttggg

SEQ ID NO: 3155787 - DNA, 22 bp, Homo sapiens
tgcccaatgctttgggaggcca

SEQ ID NO: 3155788 - DNA, 20 bp, Homo sapiens
tgcccacaactcccttgcac

SEQ ID NO: 3155789 - DNA, 19 bp, Homo sapiens
tgcccacaggatcagtctg

SEQ ID NO: 3155790 - DNA, 16 bp, Homo sapiens
tgcccacatcccaggc

SEQ ID NO: 3155791 - DNA, 19 bp, Homo sapiens
tgcccaccccctgccctgc

SEQ ID NO: 3155792 - DNA, 18 bp, Homo sapiens
tgcccaccctgggagaca

SEQ ID NO: 3155793 - DNA, 22 bp, Homo sapiens
tgcccacctcagcctcccaaag

SEQ ID NO: 3155794 - DNA, 17 bp, Homo sapiens
tgcccacctgcccatca

SEQ ID NO: 3155795 - DNA, 21 bp, Homo sapiens
tgcccacgatcccctccccca

SEQ ID NO: 3155796 - DNA, 20 bp, Homo sapiens
tgcccacgcagaggacgcac

SEQ ID NO: 3155797 - DNA, 18 bp, Homo sapiens
tgcccacgctggagtgca

SEQ ID NO: 3155798 - DNA, 23 bp, Homo sapiens
tgcccagacacagactggcaata

SEQ ID NO: 3155799 - DNA, 18 bp, Homo sapiens
tgcccagacccctctggc

SEQ ID NO: 3155800 - DNA, 18 bp, Homo sapiens
tgcccagagggcccaggc

SEQ ID NO: 3155801 - DNA, 19 bp, Homo sapiens
tgcccagagggcccaggca

SEQ ID NO: 3155802 - DNA, 12 bp, Homo sapiens
tgcccagcaggg

SEQ ID NO: 3155803 - DNA, 19 bp, Homo sapiens
tgcccagccccgctcaggc

SEQ ID NO: 3155804 - DNA, 21 bp, Homo sapiens
tgcccaggacgtcctatctcc

SEQ ID NO: 3155805 - DNA, 13 bp, Homo sapiens
tgcccaggcaggt

SEQ ID NO: 3155806 - DNA, 12 bp, Homo sapiens
tgcccaggccac

SEQ ID NO: 3155807 - DNA, 20 bp, Homo sapiens
tgcccaggccacagccgcct

SEQ ID NO: 3155808 - DNA, 20 bp, Homo sapiens
tgcccaggcccctgccaccc

SEQ ID NO: 3155809 - DNA, 22 bp, Homo sapiens
tgcccaggccggccagcctcac

SEQ ID NO: 3155810 - DNA, 18 bp, Homo sapiens
tgcccaggctggcgtgca

SEQ ID NO: 3155811 - DNA, 15 bp, Homo sapiens
tgcccaggggtgccc

SEQ ID NO: 3155812 - DNA, 16 bp, Homo sapiens
tgcccaggggtgcccc

SEQ ID NO: 3155813 - DNA, 19 bp, Homo sapiens
tgcccaggggtgccccctc

SEQ ID NO: 3155814 - DNA, 15 bp, Homo sapiens
tgcccagtacattta

SEQ ID NO: 3155815 - DNA, 14 bp, Homo sapiens
tgcccagtccccca

SEQ ID NO: 3155816 - DNA, 16 bp, Homo sapiens
tgcccagtcccccaac

SEQ ID NO: 3155817 - DNA, 20 bp, Homo sapiens
tgcccagtcccccaacccca

SEQ ID NO: 3155818 - DNA, 23 bp, Homo sapiens
tgcccagtcccccaaccccagcc

SEQ ID NO: 3155819 - DNA, 18 bp, Homo sapiens
tgcccagtgttgtttgta

SEQ ID NO: 3155820 - DNA, 21 bp, Homo sapiens
tgcccatcatgtggccccacc

SEQ ID NO: 3155821 - DNA, 15 bp, Homo sapiens
tgcccatcctgactg

SEQ ID NO: 3155822 - DNA, 14 bp, Homo sapiens
tgcccatgtgtaca

SEQ ID NO: 3155823 - DNA, 19 bp, Homo sapiens
tgcccatgtgtacattctg

SEQ ID NO: 3155824 - DNA, 14 bp, Homo sapiens
tgcccatgtgtccc

SEQ ID NO: 3155825 - DNA, 13 bp, Homo sapiens
tgcccatgtttca

SEQ ID NO: 3155826 - DNA, 19 bp, Homo sapiens
tgcccattcaccaaaatta

SEQ ID NO: 3155827 - DNA, 22 bp, Homo sapiens
tgccccaaataacttcagtcct

SEQ ID NO: 3155828 - DNA, 23 bp, Homo sapiens
tgccccaaataacttcagtcctg

SEQ ID NO: 3155829 - DNA, 15 bp, Homo sapiens
tgccccaagcagcca

SEQ ID NO: 3155830 - DNA, 16 bp, Homo sapiens
tgccccaagcagccag

SEQ ID NO: 3155831 - DNA, 21 bp, Homo sapiens
tgccccaagcagccagccagt

SEQ ID NO: 3155832 - DNA, 15 bp, Homo sapiens
tgccccaagtcctca

SEQ ID NO: 3155833 - DNA, 21 bp, Homo sapiens
tgccccacacggactcccggg

SEQ ID NO: 3155834 - DNA, 11 bp, Homo sapiens
tgccccacagt

SEQ ID NO: 3155835 - DNA, 17 bp, Homo sapiens
tgccccacagttgtgtt

SEQ ID NO: 3155836 - DNA, 15 bp, Homo sapiens
tgccccacccacccc

SEQ ID NO: 3155837 - DNA, 21 bp, Homo sapiens
tgccccacccaccccacagac

SEQ ID NO: 3155838 - DNA, 13 bp, Homo sapiens
tgccccaccctaa

SEQ ID NO: 3155839 - DNA, 21 bp, Homo sapiens
tgccccacgctgtggccctgg

SEQ ID NO: 3155840 - DNA, 12 bp, Homo sapiens
tgccccagccag

SEQ ID NO: 3155841 - DNA, 17 bp, Homo sapiens
tgccccagcccaagtcc

SEQ ID NO: 3155842 - DNA, 13 bp, Homo sapiens
tgccccagctctg

SEQ ID NO: 3155843 - DNA, 14 bp, Homo sapiens
tgccccagctctgg

SEQ ID NO: 3155844 - DNA, 18 bp, Homo sapiens
tgccccagctctggcttc

SEQ ID NO: 3155845 - DNA, 19 bp, Homo sapiens
tgccccagggcctgcttcc

SEQ ID NO: 3155846 - DNA, 23 bp, Homo sapiens
tgccccatgcctgtccagcctgg

SEQ ID NO: 3155847 - DNA, 18 bp, Homo sapiens
tgcccccaacactccagg

SEQ ID NO: 3155848 - DNA, 23 bp, Homo sapiens
tgcccccaccccggggaccctgt

SEQ ID NO: 3155849 - DNA, 14 bp, Homo sapiens
tgcccccacctctg

SEQ ID NO: 3155850 - DNA, 12 bp, Homo sapiens
tgcccccactgt

SEQ ID NO: 3155851 - DNA, 19 bp, Homo sapiens
tgcccccactgtcccccta

SEQ ID NO: 3155852 - DNA, 17 bp, Homo sapiens
tgcccccagcccaaagg

SEQ ID NO: 3155853 - DNA, 17 bp, Homo sapiens
tgcccccatctccccag

SEQ ID NO: 3155854 - DNA, 18 bp, Homo sapiens
tgcccccatctccccagg

SEQ ID NO: 3155855 - DNA, 21 bp, Homo sapiens
tgcccccatctccccaggcct

SEQ ID NO: 3155856 - DNA, 18 bp, Homo sapiens
tgccccctccaggagaga

SEQ ID NO: 3155857 - DNA, 15 bp, Homo sapiens
tgccccctcccactc

SEQ ID NO: 3155858 - DNA, 19 bp, Homo sapiens
tgccccctcccactcttga

SEQ ID NO: 3155859 - DNA, 11 bp, Homo sapiens
tgccccctcct

SEQ ID NO: 3155860 - DNA, 12 bp, Homo sapiens
tgccccctcctc

SEQ ID NO: 3155861 - DNA, 16 bp, Homo sapiens
tgccccctcctctccc

SEQ ID NO: 3155862 - DNA, 14 bp, Homo sapiens
tgccccctgcagac

SEQ ID NO: 3155863 - DNA, 13 bp, Homo sapiens
tgccccggccacc

SEQ ID NO: 3155864 - DNA, 15 bp, Homo sapiens
tgccccggccacctc

SEQ ID NO: 3155865 - DNA, 16 bp, Homo sapiens
tgccccggccacctct

SEQ ID NO: 3155866 - DNA, 15 bp, Homo sapiens
tgccccggcctcctc

SEQ ID NO: 3155867 - DNA, 20 bp, Homo sapiens
tgcccctaggatgctgcagc

SEQ ID NO: 3155868 - DNA, 23 bp, Homo sapiens
tgcccctaggatgctgcagcaga

SEQ ID NO: 3155869 - DNA, 18 bp, Homo sapiens
tgcccctattgggagagg

SEQ ID NO: 3155870 - DNA, 16 bp, Homo sapiens
tgcccctcccttcaac

SEQ ID NO: 3155871 - DNA, 15 bp, Homo sapiens
tgcccctctcaccaa

SEQ ID NO: 3155872 - DNA, 15 bp, Homo sapiens
tgcccctctccttct

SEQ ID NO: 3155873 - DNA, 11 bp, Homo sapiens
tgcccctgcaa

SEQ ID NO: 3155874 - DNA, 17 bp, Homo sapiens
tgcccctgcgtggcctg

SEQ ID NO: 3155875 - DNA, 20 bp, Homo sapiens
tgcccctgctgtgctgctca

SEQ ID NO: 3155876 - DNA, 19 bp, Homo sapiens
tgccccttcccatctcttc

SEQ ID NO: 3155877 - DNA, 21 bp, Homo sapiens
tgccccttcccatctcttcct

SEQ ID NO: 3155878 - DNA, 16 bp, Homo sapiens
tgccccttcttgggcc

SEQ ID NO: 3155879 - DNA, 13 bp, Homo sapiens
tgccccttgggca

SEQ ID NO: 3155880 - DNA, 16 bp, Homo sapiens
tgcccgagctggtgca

SEQ ID NO: 3155881 - DNA, 22 bp, Homo sapiens
tgcccgcacaccctcactctgc

SEQ ID NO: 3155882 - DNA, 15 bp, Homo sapiens
tgcccgcacagcagc

SEQ ID NO: 3155883 - DNA, 16 bp, Homo sapiens
tgcccgcgctctttct

SEQ ID NO: 3155884 - DNA, 15 bp, Homo sapiens
tgcccgctcccaacc

SEQ ID NO: 3155885 - DNA, 16 bp, Homo sapiens
tgcccgctcccaaccc

SEQ ID NO: 3155886 - DNA, 19 bp, Homo sapiens
tgcccgctgcaatgcctag

SEQ ID NO: 3155887 - DNA, 15 bp, Homo sapiens
tgcccggattctggg

SEQ ID NO: 3155888 - DNA, 22 bp, Homo sapiens
tgcccggattctgggaggaagc

SEQ ID NO: 3155889 - DNA, 14 bp, Homo sapiens
tgcccggctgcgga

SEQ ID NO: 3155890 - DNA, 18 bp, Homo sapiens
tgcccggggaaaggcaag

SEQ ID NO: 3155891 - DNA, 14 bp, Homo sapiens
tgcccggtcccacc

SEQ ID NO: 3155892 - DNA, 13 bp, Homo sapiens
tgccctaagggac

SEQ ID NO: 3155893 - DNA, 18 bp, Homo sapiens
tgccctacagaggtctct

SEQ ID NO: 3155894 - DNA, 19 bp, Homo sapiens
tgccctactcattggggtt

SEQ ID NO: 3155895 - DNA, 15 bp, Homo sapiens
tgccctcaagtaaaa

SEQ ID NO: 3155896 - DNA, 13 bp, Homo sapiens
tgccctcaccacc

SEQ ID NO: 3155897 - DNA, 19 bp, Homo sapiens
tgccctcaccaccacacta

SEQ ID NO: 3155898 - DNA, 17 bp, Homo sapiens
tgccctcatggcccctc

SEQ ID NO: 3155899 - DNA, 21 bp, Homo sapiens
tgccctcatggcccctctgac

SEQ ID NO: 3155900 - DNA, 23 bp, Homo sapiens
tgccctcattactgggccttagt

SEQ ID NO: 3155901 - DNA, 14 bp, Homo sapiens
tgccctccaaagag

SEQ ID NO: 3155902 - DNA, 18 bp, Homo sapiens
tgccctccaaagagcctt

SEQ ID NO: 3155903 - DNA, 17 bp, Homo sapiens
tgccctccccagagcac

SEQ ID NO: 3155904 - DNA, 15 bp, Homo sapiens
tgccctccctccttc

SEQ ID NO: 3155905 - DNA, 16 bp, Homo sapiens
tgccctccctccttcc

SEQ ID NO: 3155906 - DNA, 22 bp, Homo sapiens
tgccctcctaaatgtcagctgt

SEQ ID NO: 3155907 - DNA, 11 bp, Homo sapiens
tgccctcctgg

SEQ ID NO: 3155908 - DNA, 15 bp, Homo sapiens
tgccctcctggacaa

SEQ ID NO: 3155909 - DNA, 15 bp, Homo sapiens
tgccctcgtggccag

SEQ ID NO: 3155910 - DNA, 24 bp, Homo sapiens
tgccctctatttattagccaactg

SEQ ID NO: 3155911 - DNA, 20 bp, Homo sapiens
tgccctcttctcgtgcctcc

SEQ ID NO: 3155912 - DNA, 12 bp, Homo sapiens
tgccctgacctc

SEQ ID NO: 3155913 - DNA, 15 bp, Homo sapiens
tgccctgacctccca

SEQ ID NO: 3155914 - DNA, 16 bp, Homo sapiens
tgccctgacctcccag

SEQ ID NO: 3155915 - DNA, 15 bp, Homo sapiens
tgccctgagaagctg

SEQ ID NO: 3155916 - DNA, 22 bp, Homo sapiens
tgccctgcacgtatacacccag

SEQ ID NO: 3155917 - DNA, 21 bp, Homo sapiens
tgccctgccgccgcctcccgg

SEQ ID NO: 3155918 - DNA, 16 bp, Homo sapiens
tgccctgcctgcccac

SEQ ID NO: 3155919 - DNA, 17 bp, Homo sapiens
tgccctgcctgcccact

SEQ ID NO: 3155920 - DNA, 21 bp, Homo sapiens
tgccctgctgccgcctcccag

SEQ ID NO: 3155921 - DNA, 23 bp, Homo sapiens
tgccctgctgccgcctcccagcc

SEQ ID NO: 3155922 - DNA, 18 bp, Homo sapiens
tgccctggcagcagcagg

SEQ ID NO: 3155923 - DNA, 23 bp, Homo sapiens
tgccctggcagggtcatcctgtg

SEQ ID NO: 3155924 - DNA, 14 bp, Homo sapiens
tgccctggctgctg

SEQ ID NO: 3155925 - DNA, 18 bp, Homo sapiens
tgccctggctgctgcccc

SEQ ID NO: 3155926 - DNA, 20 bp, Homo sapiens
tgccctggctgctgccccca

SEQ ID NO: 3155927 - DNA, 17 bp, Homo sapiens
tgccctgggggccgtgc

SEQ ID NO: 3155928 - DNA, 18 bp, Homo sapiens
tgccctggtccagggaag

SEQ ID NO: 3155929 - DNA, 21 bp, Homo sapiens
tgccctggtccagggaagctg

SEQ ID NO: 3155930 - DNA, 17 bp, Homo sapiens
tgccctggtgctgccac

SEQ ID NO: 3155931 - DNA, 20 bp, Homo sapiens
tgccctggtgctgccacact

SEQ ID NO: 3155932 - DNA, 14 bp, Homo sapiens
tgccctggtggaga

SEQ ID NO: 3155933 - DNA, 17 bp, Homo sapiens
tgccctggtttcactgg

SEQ ID NO: 3155934 - DNA, 18 bp, Homo sapiens
tgccctgtccctgtcccc

SEQ ID NO: 3155935 - DNA, 11 bp, Homo sapiens
tgccctgtgta

SEQ ID NO: 3155936 - DNA, 17 bp, Homo sapiens
tgccctgttcatgtgcc

SEQ ID NO: 3155937 - DNA, 20 bp, Homo sapiens
tgccctgttcatgtgcctct

SEQ ID NO: 3155938 - DNA, 18 bp, Homo sapiens
tgccctgttctcttcaca

SEQ ID NO: 3155939 - DNA, 17 bp, Homo sapiens
tgcccttcacagtgttt

SEQ ID NO: 3155940 - DNA, 20 bp, Homo sapiens
tgcccttccctgtccctcta

SEQ ID NO: 3155941 - DNA, 13 bp, Homo sapiens
tgcccttgccctg

SEQ ID NO: 3155942 - DNA, 14 bp, Homo sapiens
tgcccttgctgccc

SEQ ID NO: 3155943 - DNA, 22 bp, Homo sapiens
tgcccttggggtaagccagagc

SEQ ID NO: 3155944 - DNA, 14 bp, Homo sapiens
tgcccttgtctgag

SEQ ID NO: 3155945 - DNA, 15 bp, Homo sapiens
tgccgacatcagcat

SEQ ID NO: 3155946 - DNA, 15 bp, Homo sapiens
tgccgaccagagccc

SEQ ID NO: 3155947 - DNA, 21 bp, Homo sapiens
tgccgaccagagccccacacg

SEQ ID NO: 3155948 - DNA, 19 bp, Homo sapiens
tgccgacccctagttccct

SEQ ID NO: 3155949 - DNA, 17 bp, Homo sapiens
tgccgagacctcaagcc

SEQ ID NO: 3155950 - DNA, 17 bp, Homo sapiens
tgccgagcctaatgaaa

SEQ ID NO: 3155951 - DNA, 18 bp, Homo sapiens
tgccgagtgctctgatgc

SEQ ID NO: 3155952 - DNA, 21 bp, Homo sapiens
tgccgatatactctagatgaa

SEQ ID NO: 3155953 - DNA, 13 bp, Homo sapiens
tgccgcagacggg

SEQ ID NO: 3155954 - DNA, 15 bp, Homo sapiens
tgccgcagacgggca

SEQ ID NO: 3155955 - DNA, 19 bp, Homo sapiens
tgccgcagacgggcacaga

SEQ ID NO: 3155956 - DNA, 24 bp, Homo sapiens
tgccgcctccccacggccgctcca

SEQ ID NO: 3155957 - DNA, 20 bp, Homo sapiens
tgccgcctgctcctcactgg

SEQ ID NO: 3155958 - DNA, 13 bp, Homo sapiens
tgccgccttcccc

SEQ ID NO: 3155959 - DNA, 15 bp, Homo sapiens
tgccgctacctccct

SEQ ID NO: 3155960 - DNA, 17 bp, Homo sapiens
tgccgctacctccctcc

SEQ ID NO: 3155961 - DNA, 18 bp, Homo sapiens
tgccgctacctccctccc

SEQ ID NO: 3155962 - DNA, 15 bp, Homo sapiens
tgccgctgcaccacg

SEQ ID NO: 3155963 - DNA, 17 bp, Homo sapiens
tgccgctgcaccacggc

SEQ ID NO: 3155964 - DNA, 16 bp, Homo sapiens
tgccgctgccgctgca

SEQ ID NO: 3155965 - DNA, 16 bp, Homo sapiens
tgccggctgtggagca

SEQ ID NO: 3155966 - DNA, 18 bp, Homo sapiens
tgccggtcgggcagccag

SEQ ID NO: 3155967 - DNA, 19 bp, Homo sapiens
tgccggtgggaccctgtcc

SEQ ID NO: 3155968 - DNA, 17 bp, Homo sapiens
tgccggttaaattccat

SEQ ID NO: 3155969 - DNA, 14 bp, Homo sapiens
tgccgtaatttaac

SEQ ID NO: 3155970 - DNA, 20 bp, Homo sapiens
tgccgtctcatcttctctca

SEQ ID NO: 3155971 - DNA, 20 bp, Homo sapiens
tgccgtgggcctgtcgtgcc

SEQ ID NO: 3155972 - DNA, 23 bp, Homo sapiens
tgccgtgggcctgtcgtgccagt

SEQ ID NO: 3155973 - DNA, 22 bp, Homo sapiens
tgccgtgtgagtgtgacagggc

SEQ ID NO: 3155974 - DNA, 19 bp, Homo sapiens
tgcctaaaattgtatgaaa

SEQ ID NO: 3155975 - DNA, 20 bp, Homo sapiens
tgcctaaatttaatgctgcc

SEQ ID NO: 3155976 - DNA, 15 bp, Homo sapiens
tgcctaaccaggccc

SEQ ID NO: 3155977 - DNA, 16 bp, Homo sapiens
tgcctaaccaggccca

SEQ ID NO: 3155978 - DNA, 21 bp, Homo sapiens
tgcctacaaccatccctgcca

SEQ ID NO: 3155979 - DNA, 17 bp, Homo sapiens
tgcctacagaacttcag

SEQ ID NO: 3155980 - DNA, 13 bp, Homo sapiens
tgcctagaatctt

SEQ ID NO: 3155981 - DNA, 16 bp, Homo sapiens
tgcctagacttcccaa

SEQ ID NO: 3155982 - DNA, 21 bp, Homo sapiens
tgcctagacttcccaacagcc

SEQ ID NO: 3155983 - DNA, 22 bp, Homo sapiens
tgcctagacttcccaacagcct

SEQ ID NO: 3155984 - DNA, 22 bp, Homo sapiens
tgcctagagtgtagcctaaagg

SEQ ID NO: 3155985 - DNA, 16 bp, Homo sapiens
tgcctagcaagctggc

SEQ ID NO: 3155986 - DNA, 13 bp, Homo sapiens
tgcctaggccaaa

SEQ ID NO: 3155987 - DNA, 23 bp, Homo sapiens
tgcctaggccaaatgcacaagct

SEQ ID NO: 3155988 - DNA, 15 bp, Homo sapiens
tgcctaggtttttcc

SEQ ID NO: 3155989 - DNA, 17 bp, Homo sapiens
tgcctatagtcccagct

SEQ ID NO: 3155990 - DNA, 13 bp, Homo sapiens
tgcctattcccac

SEQ ID NO: 3155991 - DNA, 22 bp, Homo sapiens
tgcctattcccacacctccaca

SEQ ID NO: 3155992 - DNA, 16 bp, Homo sapiens
tgcctcacgagatttg

SEQ ID NO: 3155993 - DNA, 18 bp, Homo sapiens
tgcctcactaatttttgt

SEQ ID NO: 3155994 - DNA, 20 bp, Homo sapiens
tgcctcactgggggctttgg

SEQ ID NO: 3155995 - DNA, 20 bp, Homo sapiens
tgcctcagactccgccctcc

SEQ ID NO: 3155996 - DNA, 14 bp, Homo sapiens
tgcctcagcctccc

SEQ ID NO: 3155997 - DNA, 18 bp, Homo sapiens
tgcctcagcctcccgagt

SEQ ID NO: 3155998 - DNA, 14 bp, Homo sapiens
tgcctcaggttcct

SEQ ID NO: 3155999 - DNA, 15 bp, Homo sapiens
tgcctcagtggcagc

SEQ ID NO: 3156000 - DNA, 15 bp, Homo sapiens
tgcctcatgccacac

SEQ ID NO: 3156001 - DNA, 12 bp, Homo sapiens
tgcctccaccac

SEQ ID NO: 3156002 - DNA, 14 bp, Homo sapiens
tgcctccaccacca

SEQ ID NO: 3156003 - DNA, 19 bp, Homo sapiens
tgcctccaccaccactggc

SEQ ID NO: 3156004 - DNA, 22 bp, Homo sapiens
tgcctccaccaccactggccac

SEQ ID NO: 3156005 - DNA, 17 bp, Homo sapiens
tgcctccaggtgtgcac

SEQ ID NO: 3156006 - DNA, 18 bp, Homo sapiens
tgcctcccacacttgctg

SEQ ID NO: 3156007 - DNA, 17 bp, Homo sapiens
tgcctcccacttcactg

SEQ ID NO: 3156008 - DNA, 16 bp, Homo sapiens
tgcctcccaggttcca

SEQ ID NO: 3156009 - DNA, 13 bp, Homo sapiens
tgcctcccatgcc

SEQ ID NO: 3156010 - DNA, 20 bp, Homo sapiens
tgcctccccatttcccatct

SEQ ID NO: 3156011 - DNA, 16 bp, Homo sapiens
tgcctccgctggcttt

SEQ ID NO: 3156012 - DNA, 21 bp, Homo sapiens
tgcctcctcaaacccagtctc

SEQ ID NO: 3156013 - DNA, 24 bp, Homo sapiens
tgcctcctcacccccagctttgct

SEQ ID NO: 3156014 - DNA, 16 bp, Homo sapiens
tgcctcctcgttcctt

SEQ ID NO: 3156015 - DNA, 16 bp, Homo sapiens
tgcctcctcttcaact

SEQ ID NO: 3156016 - DNA, 14 bp, Homo sapiens
tgcctcctgttctg

SEQ ID NO: 3156017 - DNA, 18 bp, Homo sapiens
tgcctcctgttctgccca

SEQ ID NO: 3156018 - DNA, 17 bp, Homo sapiens
tgcctcgaaacacagaa

SEQ ID NO: 3156019 - DNA, 13 bp, Homo sapiens
tgcctctcacaca

SEQ ID NO: 3156020 - DNA, 15 bp, Homo sapiens
tgcctctcacacaca

SEQ ID NO: 3156021 - DNA, 11 bp, Homo sapiens
tgcctctgcct

SEQ ID NO: 3156022 - DNA, 12 bp, Homo sapiens
tgcctctgcctc

SEQ ID NO: 3156023 - DNA, 23 bp, Homo sapiens
tgcctctgcctcccaaagtgctg

SEQ ID NO: 3156024 - DNA, 14 bp, Homo sapiens
tgcctctgcctgtc

SEQ ID NO: 3156025 - DNA, 13 bp, Homo sapiens
tgcctctgcctta

SEQ ID NO: 3156026 - DNA, 13 bp, Homo sapiens
tgcctctgctccc

SEQ ID NO: 3156027 - DNA, 16 bp, Homo sapiens
tgcctctgctccctct

SEQ ID NO: 3156028 - DNA, 14 bp, Homo sapiens
tgcctctgggactg

SEQ ID NO: 3156029 - DNA, 13 bp, Homo sapiens
tgcctctgggcca

SEQ ID NO: 3156030 - DNA, 14 bp, Homo sapiens
tgcctctgggccat

SEQ ID NO: 3156031 - DNA, 19 bp, Homo sapiens
tgcctcttaaattatatat

SEQ ID NO: 3156032 - DNA, 23 bp, Homo sapiens
tgcctcttccagtcttcctgaca

SEQ ID NO: 3156033 - DNA, 14 bp, Homo sapiens
tgcctctttcctgt

SEQ ID NO: 3156034 - DNA, 19 bp, Homo sapiens
tgcctgaaacagccatgtc

SEQ ID NO: 3156035 - DNA, 20 bp, Homo sapiens
tgcctgaaacagccatgtcc

SEQ ID NO: 3156036 - DNA, 22 bp, Homo sapiens
tgcctgaagtcacacagtgagt

SEQ ID NO: 3156037 - DNA, 15 bp, Homo sapiens
tgcctgaatatttgt

SEQ ID NO: 3156038 - DNA, 13 bp, Homo sapiens
tgcctgacacact

SEQ ID NO: 3156039 - DNA, 18 bp, Homo sapiens
tgcctgacactgagcccc

SEQ ID NO: 3156040 - DNA, 22 bp, Homo sapiens
tgcctgacactgagccccacct

SEQ ID NO: 3156041 - DNA, 23 bp, Homo sapiens
tgcctgaccctacttcttttgct

SEQ ID NO: 3156042 - DNA, 14 bp, Homo sapiens
tgcctgagaggcag

SEQ ID NO: 3156043 - DNA, 15 bp, Homo sapiens
tgcctgagaggcagg

SEQ ID NO: 3156044 - DNA, 11 bp, Homo sapiens
tgcctgagggt

SEQ ID NO: 3156045 - DNA, 15 bp, Homo sapiens
tgcctgaggtctgta

SEQ ID NO: 3156046 - DNA, 18 bp, Homo sapiens
tgcctgaggtctgtacgt

SEQ ID NO: 3156047 - DNA, 15 bp, Homo sapiens
tgcctgcagccccgc

SEQ ID NO: 3156048 - DNA, 14 bp, Homo sapiens
tgcctgcccaggcc

SEQ ID NO: 3156049 - DNA, 20 bp, Homo sapiens
tgcctgcccaggcccctgcc

SEQ ID NO: 3156050 - DNA, 24 bp, Homo sapiens
tgcctgcccaggcccctgccaccc

SEQ ID NO: 3156051 - DNA, 14 bp, Homo sapiens
tgcctgccccacac

SEQ ID NO: 3156052 - DNA, 15 bp, Homo sapiens
tgcctgccccaccca

SEQ ID NO: 3156053 - DNA, 22 bp, Homo sapiens
tgcctgcccgcacagcagcctg

SEQ ID NO: 3156054 - DNA, 13 bp, Homo sapiens
tgcctgctagagc

SEQ ID NO: 3156055 - DNA, 14 bp, Homo sapiens
tgcctgctagagca

SEQ ID NO: 3156056 - DNA, 18 bp, Homo sapiens
tgcctgctagagcaaccc

SEQ ID NO: 3156057 - DNA, 17 bp, Homo sapiens
tgcctgcttggcccggc

SEQ ID NO: 3156058 - DNA, 17 bp, Homo sapiens
tgcctggagagggtctc

SEQ ID NO: 3156059 - DNA, 23 bp, Homo sapiens
tgcctggatcccctctgtctaca

SEQ ID NO: 3156060 - DNA, 15 bp, Homo sapiens
tgcctggcaggctgt

SEQ ID NO: 3156061 - DNA, 16 bp, Homo sapiens
tgcctggccaggcaga

SEQ ID NO: 3156062 - DNA, 12 bp, Homo sapiens
tgcctggccccc

SEQ ID NO: 3156063 - DNA, 21 bp, Homo sapiens
tgcctggcccctcgcctgtgg

SEQ ID NO: 3156064 - DNA, 20 bp, Homo sapiens
tgcctggcctggcacacatc

SEQ ID NO: 3156065 - DNA, 14 bp, Homo sapiens
tgcctggcctggct

SEQ ID NO: 3156066 - DNA, 19 bp, Homo sapiens
tgcctggcctggctcccca

SEQ ID NO: 3156067 - DNA, 21 bp, Homo sapiens
tgcctggctgtggaggcctga

SEQ ID NO: 3156068 - DNA, 16 bp, Homo sapiens
tgcctgggcctgtgca

SEQ ID NO: 3156069 - DNA, 21 bp, Homo sapiens
tgcctgggcctgtgcagcagc

SEQ ID NO: 3156070 - DNA, 23 bp, Homo sapiens
tgcctgggggcttttgccactcc

SEQ ID NO: 3156071 - DNA, 17 bp, Homo sapiens
tgcctgggtgggacagc

SEQ ID NO: 3156072 - DNA, 18 bp, Homo sapiens
tgcctgggtgggacagcc

SEQ ID NO: 3156073 - DNA, 21 bp, Homo sapiens
tgcctgggtgggacagcctct

SEQ ID NO: 3156074 - DNA, 20 bp, Homo sapiens
tgcctgggttgggggcactc

SEQ ID NO: 3156075 - DNA, 23 bp, Homo sapiens
tgcctggtatatccaaaagcttt

SEQ ID NO: 3156076 - DNA, 14 bp, Homo sapiens
tgcctggtcccaag

SEQ ID NO: 3156077 - DNA, 15 bp, Homo sapiens
tgcctggtggcagct

SEQ ID NO: 3156078 - DNA, 17 bp, Homo sapiens
tgcctggtggcagctgc

SEQ ID NO: 3156079 - DNA, 18 bp, Homo sapiens
tgcctggtggcagctgcg

SEQ ID NO: 3156080 - DNA, 16 bp, Homo sapiens
tgcctgtagctttcct

SEQ ID NO: 3156081 - DNA, 19 bp, Homo sapiens
tgcctgtagctttcctggt

SEQ ID NO: 3156082 - DNA, 23 bp, Homo sapiens
tgcctgtagctttcctggtccct

SEQ ID NO: 3156083 - DNA, 16 bp, Homo sapiens
tgcctgtagtcccagg

SEQ ID NO: 3156084 - DNA, 13 bp, Homo sapiens
tgcctgtagttag

SEQ ID NO: 3156085 - DNA, 16 bp, Homo sapiens
tgcctgtagttaggaa

SEQ ID NO: 3156086 - DNA, 17 bp, Homo sapiens
tgcctgtagttaggaaa

SEQ ID NO: 3156087 - DNA, 20 bp, Homo sapiens
tgcctgtagttaggaaataa

SEQ ID NO: 3156088 - DNA, 21 bp, Homo sapiens
tgcctgtagttaggaaataaa

SEQ ID NO: 3156089 - DNA, 16 bp, Homo sapiens
tgcctgtcaggctctg

SEQ ID NO: 3156090 - DNA, 16 bp, Homo sapiens
tgcctgtcccaccccc

SEQ ID NO: 3156091 - DNA, 19 bp, Homo sapiens
tgcctgtcccacccccacc

SEQ ID NO: 3156092 - DNA, 14 bp, Homo sapiens
tgcctgtctctgtt

SEQ ID NO: 3156093 - DNA, 11 bp, Homo sapiens
tgcctgtgcca

SEQ ID NO: 3156094 - DNA, 19 bp, Homo sapiens
tgcctgtgtccatgcgctc

SEQ ID NO: 3156095 - DNA, 22 bp, Homo sapiens
tgcctgtgtccatgcgctcagg

SEQ ID NO: 3156096 - DNA, 20 bp, Homo sapiens
tgcctgttcagctccagctc

SEQ ID NO: 3156097 - DNA, 22 bp, Homo sapiens
tgccttaaaaccaaagagggct

SEQ ID NO: 3156098 - DNA, 22 bp, Homo sapiens
tgccttaaacactcaccttcta

SEQ ID NO: 3156099 - DNA, 15 bp, Homo sapiens
tgccttactcttctt

SEQ ID NO: 3156100 - DNA, 14 bp, Homo sapiens
tgccttagaggagc

SEQ ID NO: 3156101 - DNA, 18 bp, Homo sapiens
tgccttagaggagcccac

SEQ ID NO: 3156102 - DNA, 19 bp, Homo sapiens
tgccttagaggagcccacg

SEQ ID NO: 3156103 - DNA, 16 bp, Homo sapiens
tgccttaggcctacct

SEQ ID NO: 3156104 - DNA, 21 bp, Homo sapiens
tgccttaggcctacctgatgg

SEQ ID NO: 3156105 - DNA, 20 bp, Homo sapiens
tgccttagtctcagtttgtg

SEQ ID NO: 3156106 - DNA, 17 bp, Homo sapiens
tgccttatgttgaaaaa

SEQ ID NO: 3156107 - DNA, 21 bp, Homo sapiens
tgccttcaacaacgtgagaga

SEQ ID NO: 3156108 - DNA, 23 bp, Homo sapiens
tgccttcaacaacgtgagagaaa

SEQ ID NO: 3156109 - DNA, 13 bp, Homo sapiens
tgccttccctagc

SEQ ID NO: 3156110 - DNA, 14 bp, Homo sapiens
tgccttccctagct

SEQ ID NO: 3156111 - DNA, 16 bp, Homo sapiens
tgccttccctagcttt

SEQ ID NO: 3156112 - DNA, 17 bp, Homo sapiens
tgccttcctcatcccct

SEQ ID NO: 3156113 - DNA, 18 bp, Homo sapiens
tgccttcctttctccagg

SEQ ID NO: 3156114 - DNA, 19 bp, Homo sapiens
tgccttcctttctccagga

SEQ ID NO: 3156115 - DNA, 22 bp, Homo sapiens
tgccttcctttctccaggacca

SEQ ID NO: 3156116 - DNA, 13 bp, Homo sapiens
tgccttcgcttct

SEQ ID NO: 3156117 - DNA, 14 bp, Homo sapiens
tgccttcgcttctt

SEQ ID NO: 3156118 - DNA, 20 bp, Homo sapiens
tgccttcgcttcttgcctct

SEQ ID NO: 3156119 - DNA, 20 bp, Homo sapiens
tgccttcgtctttcccatgg

SEQ ID NO: 3156120 - DNA, 14 bp, Homo sapiens
tgccttctcctctc

SEQ ID NO: 3156121 - DNA, 18 bp, Homo sapiens
tgccttctcctctctggg

SEQ ID NO: 3156122 - DNA, 22 bp, Homo sapiens
tgccttctcctctctgggcctt

SEQ ID NO: 3156123 - DNA, 18 bp, Homo sapiens
tgccttctgacggccctg

SEQ ID NO: 3156124 - DNA, 20 bp, Homo sapiens
tgccttctgacggccctgca

SEQ ID NO: 3156125 - DNA, 22 bp, Homo sapiens
tgccttctgacggccctgcaat

SEQ ID NO: 3156126 - DNA, 15 bp, Homo sapiens
tgccttctgggcttt

SEQ ID NO: 3156127 - DNA, 18 bp, Homo sapiens
tgccttctgtcctggtgt

SEQ ID NO: 3156128 - DNA, 14 bp, Homo sapiens
tgccttcttcaccc

SEQ ID NO: 3156129 - DNA, 17 bp, Homo sapiens
tgccttcttcacccagc

SEQ ID NO: 3156130 - DNA, 19 bp, Homo sapiens
tgccttcttctttttgctg

SEQ ID NO: 3156131 - DNA, 20 bp, Homo sapiens
tgccttcttctttttgctgt

SEQ ID NO: 3156132 - DNA, 21 bp, Homo sapiens
tgccttcttctttttgctgtt

SEQ ID NO: 3156133 - DNA, 16 bp, Homo sapiens
tgccttcttttgatta

SEQ ID NO: 3156134 - DNA, 14 bp, Homo sapiens
tgccttgaagccac

SEQ ID NO: 3156135 - DNA, 18 bp, Homo sapiens
tgccttgataaatatata

SEQ ID NO: 3156136 - DNA, 19 bp, Homo sapiens
tgccttgataaatatatat

SEQ ID NO: 3156137 - DNA, 16 bp, Homo sapiens
tgccttgcagaactgc

SEQ ID NO: 3156138 - DNA, 13 bp, Homo sapiens
tgccttgcagcca

SEQ ID NO: 3156139 - DNA, 15 bp, Homo sapiens
tgccttgcagccaca

SEQ ID NO: 3156140 - DNA, 17 bp, Homo sapiens
tgccttggcctcccaag

SEQ ID NO: 3156141 - DNA, 13 bp, Homo sapiens
tgccttggcctcg

SEQ ID NO: 3156142 - DNA, 17 bp, Homo sapiens
tgccttggctcagacat

SEQ ID NO: 3156143 - DNA, 20 bp, Homo sapiens
tgccttgggccttgctgctg

SEQ ID NO: 3156144 - DNA, 21 bp, Homo sapiens
tgccttgggccttgctgctgc

SEQ ID NO: 3156145 - DNA, 15 bp, Homo sapiens
tgccttgggctgctc

SEQ ID NO: 3156146 - DNA, 16 bp, Homo sapiens
tgccttgggctgctcc

SEQ ID NO: 3156147 - DNA, 20 bp, Homo sapiens
tgccttggggaatttcctct

SEQ ID NO: 3156148 - DNA, 21 bp, Homo sapiens
tgccttggggaatttcctcta

SEQ ID NO: 3156149 - DNA, 13 bp, Homo sapiens
tgccttgtccctc

SEQ ID NO: 3156150 - DNA, 15 bp, Homo sapiens
tgccttgtgctgtta

SEQ ID NO: 3156151 - DNA, 19 bp, Homo sapiens
tgccttgtgtacagttatt

SEQ ID NO: 3156152 - DNA, 16 bp, Homo sapiens
tgccttgttttttgtt

SEQ ID NO: 3156153 - DNA, 20 bp, Homo sapiens
tgccttgttttttgtttgtt

SEQ ID NO: 3156154 - DNA, 15 bp, Homo sapiens
tgcctttaaatctgt

SEQ ID NO: 3156155 - DNA, 19 bp, Homo sapiens
tgcctttaaatctgtgatg

SEQ ID NO: 3156156 - DNA, 16 bp, Homo sapiens
tgcctttaagccaaag

SEQ ID NO: 3156157 - DNA, 16 bp, Homo sapiens
tgcctttatttgctgt

SEQ ID NO: 3156158 - DNA, 18 bp, Homo sapiens
tgcctttatttgctgtta

SEQ ID NO: 3156159 - DNA, 19 bp, Homo sapiens
tgcctttcctgttcagcat

SEQ ID NO: 3156160 - DNA, 20 bp, Homo sapiens
tgcctttcctgttcagcatt

SEQ ID NO: 3156161 - DNA, 11 bp, Homo sapiens
tgcctttctcg

SEQ ID NO: 3156162 - DNA, 11 bp, Homo sapiens
tgcctttctct

SEQ ID NO: 3156163 - DNA, 15 bp, Homo sapiens
tgcctttctgcagtt

SEQ ID NO: 3156164 - DNA, 20 bp, Homo sapiens
tgcctttctgcagtttttca

SEQ ID NO: 3156165 - DNA, 17 bp, Homo sapiens
tgcctttctgggagcag

SEQ ID NO: 3156166 - DNA, 19 bp, Homo sapiens
tgcctttctgggagcagaa

SEQ ID NO: 3156167 - DNA, 20 bp, Homo sapiens
tgcctttctgggagcagaaa

SEQ ID NO: 3156168 - DNA, 16 bp, Homo sapiens
tgcctttcttctgccc

SEQ ID NO: 3156169 - DNA, 18 bp, Homo sapiens
tgcctttcttctgccctt

SEQ ID NO: 3156170 - DNA, 13 bp, Homo sapiens
tgcctttgagaca

SEQ ID NO: 3156171 - DNA, 15 bp, Homo sapiens
tgcctttgagacagt

SEQ ID NO: 3156172 - DNA, 18 bp, Homo sapiens
tgcctttgagacagtttc

SEQ ID NO: 3156173 - DNA, 19 bp, Homo sapiens
tgcctttgagacagtttct

SEQ ID NO: 3156174 - DNA, 21 bp, Homo sapiens
tgcctttgagacagtttctta

SEQ ID NO: 3156175 - DNA, 21 bp, Homo sapiens
tgcctttgcagttggactctc

SEQ ID NO: 3156176 - DNA, 11 bp, Homo sapiens
tgcctttgtaa

SEQ ID NO: 3156177 - DNA, 14 bp, Homo sapiens
tgcctttgtggcct

SEQ ID NO: 3156178 - DNA, 13 bp, Homo sapiens
tgccttttatagc

SEQ ID NO: 3156179 - DNA, 13 bp, Homo sapiens
tgccttttctgaa

SEQ ID NO: 3156180 - DNA, 17 bp, Homo sapiens
tgccttttgcacccctc

SEQ ID NO: 3156181 - DNA, 16 bp, Homo sapiens
tgccttttgcagaaga

SEQ ID NO: 3156182 - DNA, 16 bp, Homo sapiens
tgccttttgctgcgca

SEQ ID NO: 3156183 - DNA, 12 bp, Homo sapiens
tgccttttgtgt

SEQ ID NO: 3156184 - DNA, 17 bp, Homo sapiens
tgccttttgtgtgatgc

SEQ ID NO: 3156185 - DNA, 13 bp, Homo sapiens
tgcctttttccta

SEQ ID NO: 3156186 - DNA, 20 bp, Homo sapiens
tgcgaagaccctcttgccca

SEQ ID NO: 3156187 - DNA, 21 bp, Homo sapiens
tgcgaaggggccctggtcctt

SEQ ID NO: 3156188 - DNA, 22 bp, Homo sapiens
tgcgaatccaagctccctgccc

SEQ ID NO: 3156189 - DNA, 15 bp, Homo sapiens
tgcgacagagagagg

SEQ ID NO: 3156190 - DNA, 16 bp, Homo sapiens
tgcgacagagagaggg

SEQ ID NO: 3156191 - DNA, 18 bp, Homo sapiens
tgcgacagagagagggga

SEQ ID NO: 3156192 - DNA, 16 bp, Homo sapiens
tgcgacggagagaaaa

SEQ ID NO: 3156193 - DNA, 15 bp, Homo sapiens
tgcgactttctgcct

SEQ ID NO: 3156194 - DNA, 22 bp, Homo sapiens
tgcgagacgcacacagctgagc

SEQ ID NO: 3156195 - DNA, 23 bp, Homo sapiens
tgcgagacgcacacagctgagca

SEQ ID NO: 3156196 - DNA, 14 bp, Homo sapiens
tgcgatctgggttc

SEQ ID NO: 3156197 - DNA, 15 bp, Homo sapiens
tgcgatctgggttca

SEQ ID NO: 3156198 - DNA, 20 bp, Homo sapiens
tgcgatctgggttcactgca

SEQ ID NO: 3156199 - DNA, 19 bp, Homo sapiens
tgcgcaccaatgcccagca

SEQ ID NO: 3156200 - DNA, 22 bp, Homo sapiens
tgcgcagtagtttggtttgact

SEQ ID NO: 3156201 - DNA, 17 bp, Homo sapiens
tgcgccaccgcccagag

SEQ ID NO: 3156202 - DNA, 15 bp, Homo sapiens
tgcgccacttccttt

SEQ ID NO: 3156203 - DNA, 14 bp, Homo sapiens
tgcgccccgcccac

SEQ ID NO: 3156204 - DNA, 16 bp, Homo sapiens
tgcgccccgcccacac

SEQ ID NO: 3156205 - DNA, 19 bp, Homo sapiens
tgcgccccgcccacaccct

SEQ ID NO: 3156206 - DNA, 21 bp, Homo sapiens
tgcgctcagggccatgctgag

SEQ ID NO: 3156207 - DNA, 23 bp, Homo sapiens
tgcgctcagggccatgctgaggc

SEQ ID NO: 3156208 - DNA, 12 bp, Homo sapiens
tgcgctcttggt

SEQ ID NO: 3156209 - DNA, 17 bp, Homo sapiens
tgcgctttattgcccat

SEQ ID NO: 3156210 - DNA, 18 bp, Homo sapiens
tgcgctttattgcccatg

SEQ ID NO: 3156211 - DNA, 20 bp, Homo sapiens
tgcggacagccacggccagg

SEQ ID NO: 3156212 - DNA, 22 bp, Homo sapiens
tgcggaccccagctgtgagcct

SEQ ID NO: 3156213 - DNA, 17 bp, Homo sapiens
tgcggaggagctgcctg

SEQ ID NO: 3156214 - DNA, 21 bp, Homo sapiens
tgcggagtgaagaggggcagc

SEQ ID NO: 3156215 - DNA, 20 bp, Homo sapiens
tgcggatactcttggagagt

SEQ ID NO: 3156216 - DNA, 15 bp, Homo sapiens
tgcggatcctgctgg

SEQ ID NO: 3156217 - DNA, 17 bp, Homo sapiens
tgcggatctcagctttg

SEQ ID NO: 3156218 - DNA, 15 bp, Homo sapiens
tgcggcaaaaggaaa

SEQ ID NO: 3156219 - DNA, 14 bp, Homo sapiens
tgcggccccaggag

SEQ ID NO: 3156220 - DNA, 15 bp, Homo sapiens
tgcgggaggccctgg

SEQ ID NO: 3156221 - DNA, 16 bp, Homo sapiens
tgcgggaggccctggc

SEQ ID NO: 3156222 - DNA, 17 bp, Homo sapiens
tgcgggatggtcctggg

SEQ ID NO: 3156223 - DNA, 17 bp, Homo sapiens
tgcgggcacaataaatc

SEQ ID NO: 3156224 - DNA, 22 bp, Homo sapiens
tgcgggcgcgggcagccaccca

SEQ ID NO: 3156225 - DNA, 18 bp, Homo sapiens
tgcggggagacagaagcc

SEQ ID NO: 3156226 - DNA, 22 bp, Homo sapiens
tgcggtcaggctgggcagcccc

SEQ ID NO: 3156227 - DNA, 15 bp, Homo sapiens
tgcggtccacccagg

SEQ ID NO: 3156228 - DNA, 14 bp, Homo sapiens
tgcggtctggtctc

SEQ ID NO: 3156229 - DNA, 20 bp, Homo sapiens
tgcgtcccagctgaaggcag

SEQ ID NO: 3156230 - DNA, 15 bp, Homo sapiens
tgcgtccccactccc

SEQ ID NO: 3156231 - DNA, 14 bp, Homo sapiens
tgcgtcctcctcac

SEQ ID NO: 3156232 - DNA, 19 bp, Homo sapiens
tgcgtcctcctcacctcat

SEQ ID NO: 3156233 - DNA, 22 bp, Homo sapiens
tgcgtcctcctcacctcatgcc

SEQ ID NO: 3156234 - DNA, 19 bp, Homo sapiens
tgcgtcctgcagaggacca

SEQ ID NO: 3156235 - DNA, 15 bp, Homo sapiens
tgcgtgccgtgtgag

SEQ ID NO: 3156236 - DNA, 17 bp, Homo sapiens
tgcgtgccgtgtgagtg

SEQ ID NO: 3156237 - DNA, 16 bp, Homo sapiens
tgcgtggactctgcac

SEQ ID NO: 3156238 - DNA, 22 bp, Homo sapiens
tgcgtggactctgcacatgtct

SEQ ID NO: 3156239 - DNA, 15 bp, Homo sapiens
tgcgtggctgtggca

SEQ ID NO: 3156240 - DNA, 14 bp, Homo sapiens
tgcgtgtgtagagt

SEQ ID NO: 3156241 - DNA, 19 bp, Homo sapiens
tgcgtgtgtagagttaaga

SEQ ID NO: 3156242 - DNA, 24 bp, Homo sapiens
tgcgtgtgtagagttaagaagctg

SEQ ID NO: 3156243 - DNA, 17 bp, Homo sapiens
tgcgttaaataagcaaa

SEQ ID NO: 3156244 - DNA, 23 bp, Homo sapiens
tgcgttggagccactcctgtccc

SEQ ID NO: 3156245 - DNA, 18 bp, Homo sapiens
tgctaaaaaaagtgcatg

SEQ ID NO: 3156246 - DNA, 19 bp, Homo sapiens
tgctaaaaaaagtgcatga

SEQ ID NO: 3156247 - DNA, 18 bp, Homo sapiens
tgctaaacaagtaagaaa

SEQ ID NO: 3156248 - DNA, 21 bp, Homo sapiens
tgctaaacaagtaagaaaaat

SEQ ID NO: 3156249 - DNA, 19 bp, Homo sapiens
tgctaaagcactttgcact

SEQ ID NO: 3156250 - DNA, 23 bp, Homo sapiens
tgctaacaaagacaaaagtctgt

SEQ ID NO: 3156251 - DNA, 16 bp, Homo sapiens
tgctaacatctaaaaa

SEQ ID NO: 3156252 - DNA, 14 bp, Homo sapiens
tgctaacctggaaa

SEQ ID NO: 3156253 - DNA, 19 bp, Homo sapiens
tgctaagaagcctataaga

SEQ ID NO: 3156254 - DNA, 14 bp, Homo sapiens
tgctaaggttctaa

SEQ ID NO: 3156255 - DNA, 16 bp, Homo sapiens
tgctaaggttctaagg

SEQ ID NO: 3156256 - DNA, 18 bp, Homo sapiens
tgctaaggttctaaggcc

SEQ ID NO: 3156257 - DNA, 18 bp, Homo sapiens
tgctaagtaaattagtaa

SEQ ID NO: 3156258 - DNA, 17 bp, Homo sapiens
tgctaatcaaagccagg

SEQ ID NO: 3156259 - DNA, 23 bp, Homo sapiens
tgctaatcatgtgggtgagccag

SEQ ID NO: 3156260 - DNA, 13 bp, Homo sapiens
tgctaatcttctt

SEQ ID NO: 3156261 - DNA, 20 bp, Homo sapiens
tgctaatcttcttatgcaat

SEQ ID NO: 3156262 - DNA, 15 bp, Homo sapiens
tgctacaaatttatg

SEQ ID NO: 3156263 - DNA, 23 bp, Homo sapiens
tgctacaaatttatgcatttcat

SEQ ID NO: 3156264 - DNA, 15 bp, Homo sapiens
tgctacaacatgtga

SEQ ID NO: 3156265 - DNA, 12 bp, Homo sapiens
tgctacaggagg

SEQ ID NO: 3156266 - DNA, 23 bp, Homo sapiens
tgctacatgacgacaaagctgct

SEQ ID NO: 3156267 - DNA, 22 bp, Homo sapiens
tgctaccagtatttagaagcca

SEQ ID NO: 3156268 - DNA, 15 bp, Homo sapiens
tgctaccgccctggg

SEQ ID NO: 3156269 - DNA, 15 bp, Homo sapiens
tgctacctctgagaa

SEQ ID NO: 3156270 - DNA, 17 bp, Homo sapiens
tgctacctctgagaaga

SEQ ID NO: 3156271 - DNA, 20 bp, Homo sapiens
tgctactataatcaaatgat

SEQ ID NO: 3156272 - DNA, 13 bp, Homo sapiens
tgctactccatgc

SEQ ID NO: 3156273 - DNA, 15 bp, Homo sapiens
tgctactcctgtgct

SEQ ID NO: 3156274 - DNA, 14 bp, Homo sapiens
tgctactgattgtt

SEQ ID NO: 3156275 - DNA, 18 bp, Homo sapiens
tgctactgcactccagcc

SEQ ID NO: 3156276 - DNA, 18 bp, Homo sapiens
tgctactggacttgaatg

SEQ ID NO: 3156277 - DNA, 22 bp, Homo sapiens
tgctactgtacataaacaatga

SEQ ID NO: 3156278 - DNA, 16 bp, Homo sapiens
tgctactgtcttacta

SEQ ID NO: 3156279 - DNA, 21 bp, Homo sapiens
tgctagaaaatttagcccttt

SEQ ID NO: 3156280 - DNA, 14 bp, Homo sapiens
tgctagaaattttc

SEQ ID NO: 3156281 - DNA, 15 bp, Homo sapiens
tgctagaaattttca

SEQ ID NO: 3156282 - DNA, 10 bp, Homo sapiens
tgctagaact

SEQ ID NO: 3156283 - DNA, 17 bp, Homo sapiens
tgctagaactccctttc

SEQ ID NO: 3156284 - DNA, 21 bp, Homo sapiens
tgctagaactccctttcaaca

SEQ ID NO: 3156285 - DNA, 11 bp, Homo sapiens
tgctagaactt

SEQ ID NO: 3156286 - DNA, 13 bp, Homo sapiens
tgctagaactttt

SEQ ID NO: 3156287 - DNA, 17 bp, Homo sapiens
tgctagaacttttttaa

SEQ ID NO: 3156288 - DNA, 20 bp, Homo sapiens
tgctagaacttttttaaata

SEQ ID NO: 3156289 - DNA, 21 bp, Homo sapiens
tgctagaacttttttaaataa

SEQ ID NO: 3156290 - DNA, 13 bp, Homo sapiens
tgctagaatactt

SEQ ID NO: 3156291 - DNA, 14 bp, Homo sapiens
tgctagacagccag

SEQ ID NO: 3156292 - DNA, 17 bp, Homo sapiens
tgctagagcaacccctg

SEQ ID NO: 3156293 - DNA, 13 bp, Homo sapiens
tgctagatttcta

SEQ ID NO: 3156294 - DNA, 13 bp, Homo sapiens
tgctagattttaa

SEQ ID NO: 3156295 - DNA, 20 bp, Homo sapiens
tgctagcaaatggcagaacc

SEQ ID NO: 3156296 - DNA, 20 bp, Homo sapiens
tgctagccagcattccatat

SEQ ID NO: 3156297 - DNA, 14 bp, Homo sapiens
tgctagctaaaaga

SEQ ID NO: 3156298 - DNA, 18 bp, Homo sapiens
tgctagctatgtgacctt

SEQ ID NO: 3156299 - DNA, 17 bp, Homo sapiens
tgctagcttgacacagt

SEQ ID NO: 3156300 - DNA, 20 bp, Homo sapiens
tgctagcttgacacagtcag

SEQ ID NO: 3156301 - DNA, 21 bp, Homo sapiens
tgctaggacgcaataaattta

SEQ ID NO: 3156302 - DNA, 15 bp, Homo sapiens
tgctaggggatgagg

SEQ ID NO: 3156303 - DNA, 16 bp, Homo sapiens
tgctagtattcgctgt

SEQ ID NO: 3156304 - DNA, 19 bp, Homo sapiens
tgctagtattcgctgtgtt

SEQ ID NO: 3156305 - DNA, 19 bp, Homo sapiens
tgctagtgggccctctctc

SEQ ID NO: 3156306 - DNA, 22 bp, Homo sapiens
tgctagtgggccctctctctgg

SEQ ID NO: 3156307 - DNA, 18 bp, Homo sapiens
tgctataaattttttgaa

SEQ ID NO: 3156308 - DNA, 23 bp, Homo sapiens
tgctataaattttttgaaacaca

SEQ ID NO: 3156309 - DNA, 18 bp, Homo sapiens
tgctataatctgttttta

SEQ ID NO: 3156310 - DNA, 13 bp, Homo sapiens
tgctatactgcat

SEQ ID NO: 3156311 - DNA, 23 bp, Homo sapiens
tgctatcatgatggaatttcata

SEQ ID NO: 3156312 - DNA, 21 bp, Homo sapiens
tgctatctctgtgtgcacaaa

SEQ ID NO: 3156313 - DNA, 18 bp, Homo sapiens
tgctatgttactattttc

SEQ ID NO: 3156314 - DNA, 14 bp, Homo sapiens
tgctattagactgt

SEQ ID NO: 3156315 - DNA, 16 bp, Homo sapiens
tgctatttaattcttt

SEQ ID NO: 3156316 - DNA, 12 bp, Homo sapiens
tgctatttatgc

SEQ ID NO: 3156317 - DNA, 13 bp, Homo sapiens
tgctatttatgca

SEQ ID NO: 3156318 - DNA, 17 bp, Homo sapiens
tgctatttgaacaagtg

SEQ ID NO: 3156319 - DNA, 20 bp, Homo sapiens
tgctatttgaacaagtgggc

SEQ ID NO: 3156320 - DNA, 15 bp, Homo sapiens
tgctcaaaaatctgt

SEQ ID NO: 3156321 - DNA, 20 bp, Homo sapiens
tgctcaactctacccctgct

SEQ ID NO: 3156322 - DNA, 17 bp, Homo sapiens
tgctcacgtcaaatgca

SEQ ID NO: 3156323 - DNA, 15 bp, Homo sapiens
tgctcactttaaacc

SEQ ID NO: 3156324 - DNA, 16 bp, Homo sapiens
tgctcagaagaggaaa

SEQ ID NO: 3156325 - DNA, 13 bp, Homo sapiens
tgctcagaattca

SEQ ID NO: 3156326 - DNA, 20 bp, Homo sapiens
tgctcagcaaggggctctgc

SEQ ID NO: 3156327 - DNA, 13 bp, Homo sapiens
tgctcagcatgat

SEQ ID NO: 3156328 - DNA, 12 bp, Homo sapiens
tgctcagccaag

SEQ ID NO: 3156329 - DNA, 14 bp, Homo sapiens
tgctcagccaagct

SEQ ID NO: 3156330 - DNA, 16 bp, Homo sapiens
tgctcagggtcaattt

SEQ ID NO: 3156331 - DNA, 17 bp, Homo sapiens
tgctcagtaatttgagg

SEQ ID NO: 3156332 - DNA, 22 bp, Homo sapiens
tgctcagtgcttgggctccacg

SEQ ID NO: 3156333 - DNA, 14 bp, Homo sapiens
tgctcatctgctgg

SEQ ID NO: 3156334 - DNA, 16 bp, Homo sapiens
tgctcatctgctggtc

SEQ ID NO: 3156335 - DNA, 18 bp, Homo sapiens
tgctcatctgctggtccg

SEQ ID NO: 3156336 - DNA, 12 bp, Homo sapiens
tgctcatttaag

SEQ ID NO: 3156337 - DNA, 14 bp, Homo sapiens
tgctccaagattct

SEQ ID NO: 3156338 - DNA, 22 bp, Homo sapiens
tgctccaagggaccctttgcct

SEQ ID NO: 3156339 - DNA, 18 bp, Homo sapiens
tgctccaccagcagcatg

SEQ ID NO: 3156340 - DNA, 18 bp, Homo sapiens
tgctccaccctcccccag

SEQ ID NO: 3156341 - DNA, 17 bp, Homo sapiens
tgctccacccttggcct

SEQ ID NO: 3156342 - DNA, 18 bp, Homo sapiens
tgctccacgaagccttaa

SEQ ID NO: 3156343 - DNA, 14 bp, Homo sapiens
tgctccagaatttg

SEQ ID NO: 3156344 - DNA, 14 bp, Homo sapiens
tgctccaggcctgc

SEQ ID NO: 3156345 - DNA, 16 bp, Homo sapiens
tgctccaggcctgcag

SEQ ID NO: 3156346 - DNA, 23 bp, Homo sapiens
tgctccagggtcttgggctactg

SEQ ID NO: 3156347 - DNA, 23 bp, Homo sapiens
tgctccatttataaccccagcct

SEQ ID NO: 3156348 - DNA, 15 bp, Homo sapiens
tgctcccagcctgct

SEQ ID NO: 3156349 - DNA, 21 bp, Homo sapiens
tgctcccagcctgctgagagc

SEQ ID NO: 3156350 - DNA, 13 bp, Homo sapiens
tgctcccagctgt

SEQ ID NO: 3156351 - DNA, 17 bp, Homo sapiens
tgctcccattcctccct

SEQ ID NO: 3156352 - DNA, 11 bp, Homo sapiens
tgctccccaca

SEQ ID NO: 3156353 - DNA, 14 bp, Homo sapiens
tgctccccacagcg

SEQ ID NO: 3156354 - DNA, 21 bp, Homo sapiens
tgctccccacagcgtccctgg

SEQ ID NO: 3156355 - DNA, 16 bp, Homo sapiens
tgctccccagccctgg

SEQ ID NO: 3156356 - DNA, 17 bp, Homo sapiens
tgctccccagccctggc

SEQ ID NO: 3156357 - DNA, 22 bp, Homo sapiens
tgctccccagccctggctctgc

SEQ ID NO: 3156358 - DNA, 13 bp, Homo sapiens
tgctccctcagcc

SEQ ID NO: 3156359 - DNA, 15 bp, Homo sapiens
tgctccctcagcctc

SEQ ID NO: 3156360 - DNA, 16 bp, Homo sapiens
tgctccctcagcctca

SEQ ID NO: 3156361 - DNA, 17 bp, Homo sapiens
tgctccctcagcctcag

SEQ ID NO: 3156362 - DNA, 20 bp, Homo sapiens
tgctccctcagcctcagagg

SEQ ID NO: 3156363 - DNA, 14 bp, Homo sapiens
tgctccctcccctg

SEQ ID NO: 3156364 - DNA, 15 bp, Homo sapiens
tgctccctcccctgc

SEQ ID NO: 3156365 - DNA, 19 bp, Homo sapiens
tgctccctcccctgccctg

SEQ ID NO: 3156366 - DNA, 20 bp, Homo sapiens
tgctccctgaagccagcctt

SEQ ID NO: 3156367 - DNA, 22 bp, Homo sapiens
tgctccctgaagccagccttct

SEQ ID NO: 3156368 - DNA, 15 bp, Homo sapiens
tgctccctgctttgg

SEQ ID NO: 3156369 - DNA, 17 bp, Homo sapiens
tgctccctgtgtccacc

SEQ ID NO: 3156370 - DNA, 12 bp, Homo sapiens
tgctcccttcaa

SEQ ID NO: 3156371 - DNA, 14 bp, Homo sapiens
tgctccgctcccac

SEQ ID NO: 3156372 - DNA, 15 bp, Homo sapiens
tgctccgctgctcct

SEQ ID NO: 3156373 - DNA, 18 bp, Homo sapiens
tgctccgtgcctccacca

SEQ ID NO: 3156374 - DNA, 19 bp, Homo sapiens
tgctcctcactgcccgcac

SEQ ID NO: 3156375 - DNA, 11 bp, Homo sapiens
tgctcctccct

SEQ ID NO: 3156376 - DNA, 12 bp, Homo sapiens
tgctcctccctg

SEQ ID NO: 3156377 - DNA, 13 bp, Homo sapiens
tgctcctccctgc

SEQ ID NO: 3156378 - DNA, 14 bp, Homo sapiens
tgctcctccctgcc

SEQ ID NO: 3156379 - DNA, 15 bp, Homo sapiens
tgctcctccctggct

SEQ ID NO: 3156380 - DNA, 17 bp, Homo sapiens
tgctcctccctggctgc

SEQ ID NO: 3156381 - DNA, 19 bp, Homo sapiens
tgctcctccctggctgccc

SEQ ID NO: 3156382 - DNA, 11 bp, Homo sapiens
tgctcctcctg

SEQ ID NO: 3156383 - DNA, 15 bp, Homo sapiens
tgctcctcctgccct

SEQ ID NO: 3156384 - DNA, 17 bp, Homo sapiens
tgctcctctccccagca

SEQ ID NO: 3156385 - DNA, 21 bp, Homo sapiens
tgctcctggagcctttgaata

SEQ ID NO: 3156386 - DNA, 17 bp, Homo sapiens
tgctccttcactgttcc

SEQ ID NO: 3156387 - DNA, 15 bp, Homo sapiens
tgctccttggcttac

SEQ ID NO: 3156388 - DNA, 19 bp, Homo sapiens
tgctccttggcttacctga

SEQ ID NO: 3156389 - DNA, 20 bp, Homo sapiens
tgctccttttgtatcttcct

SEQ ID NO: 3156390 - DNA, 15 bp, Homo sapiens
tgctcgcccaggaag

SEQ ID NO: 3156391 - DNA, 17 bp, Homo sapiens
tgctcgcccaggaaggc

SEQ ID NO: 3156392 - DNA, 18 bp, Homo sapiens
tgctcgcccaggaaggcc

SEQ ID NO: 3156393 - DNA, 23 bp, Homo sapiens
tgctcgcccaggaaggcctaggc

SEQ ID NO: 3156394 - DNA, 11 bp, Homo sapiens
tgctctaacac

SEQ ID NO: 3156395 - DNA, 19 bp, Homo sapiens
tgctctaacacctgcctag

SEQ ID NO: 3156396 - DNA, 21 bp, Homo sapiens
tgctctaatgatcaaaacatg

SEQ ID NO: 3156397 - DNA, 19 bp, Homo sapiens
tgctctacccatgagcctg

SEQ ID NO: 3156398 - DNA, 20 bp, Homo sapiens
tgctctacccatgagcctgc

SEQ ID NO: 3156399 - DNA, 16 bp, Homo sapiens
tgctctagccaggagt

SEQ ID NO: 3156400 - DNA, 19 bp, Homo sapiens
tgctctagccaggagtctg

SEQ ID NO: 3156401 - DNA, 17 bp, Homo sapiens
tgctctagctggcagga

SEQ ID NO: 3156402 - DNA, 14 bp, Homo sapiens
tgctctcatcagaa

SEQ ID NO: 3156403 - DNA, 21 bp, Homo sapiens
tgctctccctcttctcaagtg

SEQ ID NO: 3156404 - DNA, 18 bp, Homo sapiens
tgctctgcatgttacata

SEQ ID NO: 3156405 - DNA, 16 bp, Homo sapiens
tgctctgccccaagcc

SEQ ID NO: 3156406 - DNA, 18 bp, Homo sapiens
tgctctgccccaagcccc

SEQ ID NO: 3156407 - DNA, 15 bp, Homo sapiens
tgctctgctgacaga

SEQ ID NO: 3156408 - DNA, 21 bp, Homo sapiens
tgctctgctgacagacacagg

SEQ ID NO: 3156409 - DNA, 23 bp, Homo sapiens
tgctctggaataaagttgcagat

SEQ ID NO: 3156410 - DNA, 14 bp, Homo sapiens
tgctctggacaggc

SEQ ID NO: 3156411 - DNA, 24 bp, Homo sapiens
tgctctggcggcttcctgtccact

SEQ ID NO: 3156412 - DNA, 23 bp, Homo sapiens
tgctctggttgtttctgttccaa

SEQ ID NO: 3156413 - DNA, 16 bp, Homo sapiens
tgctctgtgtatatct

SEQ ID NO: 3156414 - DNA, 22 bp, Homo sapiens
tgctctgtgtatatctcttgga

SEQ ID NO: 3156415 - DNA, 12 bp, Homo sapiens
tgctcttagctg

SEQ ID NO: 3156416 - DNA, 15 bp, Homo sapiens
tgctcttagctgtct

SEQ ID NO: 3156417 - DNA, 18 bp, Homo sapiens
tgctcttagctgtctgct

SEQ ID NO: 3156418 - DNA, 18 bp, Homo sapiens
tgctcttagtgcccgcct

SEQ ID NO: 3156419 - DNA, 23 bp, Homo sapiens
tgctcttctgtggaccactgcat

SEQ ID NO: 3156420 - DNA, 23 bp, Homo sapiens
tgctcttgtttttattaatttat

SEQ ID NO: 3156421 - DNA, 18 bp, Homo sapiens
tgctctttcatctctgct

SEQ ID NO: 3156422 - DNA, 13 bp, Homo sapiens
tgctctttccctt

SEQ ID NO: 3156423 - DNA, 14 bp, Homo sapiens
tgctctttcccttt

SEQ ID NO: 3156424 - DNA, 17 bp, Homo sapiens
tgctctttcccttttct

SEQ ID NO: 3156425 - DNA, 12 bp, Homo sapiens
tgctctttctct

SEQ ID NO: 3156426 - DNA, 15 bp, Homo sapiens
tgctctttctctgcc

SEQ ID NO: 3156427 - DNA, 17 bp, Homo sapiens
tgctctttctctgccag

SEQ ID NO: 3156428 - DNA, 20 bp, Homo sapiens
tgctctttgacaactaaaat

SEQ ID NO: 3156429 - DNA, 16 bp, Homo sapiens
tgctctttttttaaaa

SEQ ID NO: 3156430 - DNA, 16 bp, Homo sapiens
tgctgaaaaatatagc

SEQ ID NO: 3156431 - DNA, 17 bp, Homo sapiens
tgctgaaaaatatagcc

SEQ ID NO: 3156432 - DNA, 19 bp, Homo sapiens
tgctgaaacagacatgaaa

SEQ ID NO: 3156433 - DNA, 18 bp, Homo sapiens
tgctgaacaaaaaataaa

SEQ ID NO: 3156434 - DNA, 21 bp, Homo sapiens
tgctgaacaccttgtggaagc

SEQ ID NO: 3156435 - DNA, 14 bp, Homo sapiens
tgctgaacagtgga

SEQ ID NO: 3156436 - DNA, 18 bp, Homo sapiens
tgctgaatatacagcagg

SEQ ID NO: 3156437 - DNA, 19 bp, Homo sapiens
tgctgaatatctgttcact

SEQ ID NO: 3156438 - DNA, 17 bp, Homo sapiens
tgctgaatggttttcaa

SEQ ID NO: 3156439 - DNA, 20 bp, Homo sapiens
tgctgaatgtaaaagaaaat

SEQ ID NO: 3156440 - DNA, 22 bp, Homo sapiens
tgctgacagacacaggcccggc

SEQ ID NO: 3156441 - DNA, 18 bp, Homo sapiens
tgctgactggcttcagca

SEQ ID NO: 3156442 - DNA, 21 bp, Homo sapiens
tgctgactgtactcctcccag

SEQ ID NO: 3156443 - DNA, 22 bp, Homo sapiens
tgctgagagggctcgaggggtg

SEQ ID NO: 3156444 - DNA, 16 bp, Homo sapiens
tgctgagcctctgctc

SEQ ID NO: 3156445 - DNA, 17 bp, Homo sapiens
tgctgagcctctgctcc

SEQ ID NO: 3156446 - DNA, 20 bp, Homo sapiens
tgctgagcctctgctcccca

SEQ ID NO: 3156447 - DNA, 12 bp, Homo sapiens
tgctgagctggg

SEQ ID NO: 3156448 - DNA, 14 bp, Homo sapiens
tgctgagctgggcc

SEQ ID NO: 3156449 - DNA, 18 bp, Homo sapiens
tgctgagctgggcccagc

SEQ ID NO: 3156450 - DNA, 21 bp, Homo sapiens
tgctgagctgggcccagcccc

SEQ ID NO: 3156451 - DNA, 16 bp, Homo sapiens
tgctgagcttagcctt

SEQ ID NO: 3156452 - DNA, 23 bp, Homo sapiens
tgctgagcttagccttgtgccct

SEQ ID NO: 3156453 - DNA, 22 bp, Homo sapiens
tgctgagcttgtcttttctgct

SEQ ID NO: 3156454 - DNA, 23 bp, Homo sapiens
tgctgagcttgtcttttctgctg

SEQ ID NO: 3156455 - DNA, 16 bp, Homo sapiens
tgctgaggcctgggcc

SEQ ID NO: 3156456 - DNA, 19 bp, Homo sapiens
tgctgagtggcgcaaggcc

SEQ ID NO: 3156457 - DNA, 23 bp, Homo sapiens
tgctgagtggcgcaaggccgagc

SEQ ID NO: 3156458 - DNA, 18 bp, Homo sapiens
tgctgatcgtagaaaatt

SEQ ID NO: 3156459 - DNA, 20 bp, Homo sapiens
tgctgatcgtagaaaatttg

SEQ ID NO: 3156460 - DNA, 22 bp, Homo sapiens
tgctgatcgtagaaaatttgct

SEQ ID NO: 3156461 - DNA, 20 bp, Homo sapiens
tgctgatgaatcactgtttt

SEQ ID NO: 3156462 - DNA, 20 bp, Homo sapiens
tgctgatgattttgcaaaat

SEQ ID NO: 3156463 - DNA, 15 bp, Homo sapiens
tgctgatggagcctt

SEQ ID NO: 3156464 - DNA, 16 bp, Homo sapiens
tgctgatggagccttc

SEQ ID NO: 3156465 - DNA, 21 bp, Homo sapiens
tgctgatggcttgacatgtgc

SEQ ID NO: 3156466 - DNA, 19 bp, Homo sapiens
tgctgatgtatcctttcat

SEQ ID NO: 3156467 - DNA, 16 bp, Homo sapiens
tgctgatttcccctct

SEQ ID NO: 3156468 - DNA, 14 bp, Homo sapiens
tgctgcaaacctga

SEQ ID NO: 3156469 - DNA, 15 bp, Homo sapiens
tgctgcaccagagtg

SEQ ID NO: 3156470 - DNA, 18 bp, Homo sapiens
tgctgcacccaactactg

SEQ ID NO: 3156471 - DNA, 16 bp, Homo sapiens
tgctgcagcagagtga

SEQ ID NO: 3156472 - DNA, 21 bp, Homo sapiens
tgctgcaggacttgagaagac

SEQ ID NO: 3156473 - DNA, 13 bp, Homo sapiens
tgctgcaggggct

SEQ ID NO: 3156474 - DNA, 15 bp, Homo sapiens
tgctgcaggtggcag

SEQ ID NO: 3156475 - DNA, 21 bp, Homo sapiens
tgctgcatagctctattttaa

SEQ ID NO: 3156476 - DNA, 15 bp, Homo sapiens
tgctgccagggcttc

SEQ ID NO: 3156477 - DNA, 21 bp, Homo sapiens
tgctgccatccaggttcagct

SEQ ID NO: 3156478 - DNA, 22 bp, Homo sapiens
tgctgccatccaggttcagctt

SEQ ID NO: 3156479 - DNA, 13 bp, Homo sapiens
tgctgccatgcca

SEQ ID NO: 3156480 - DNA, 20 bp, Homo sapiens
tgctgccatgccactgccag

SEQ ID NO: 3156481 - DNA, 23 bp, Homo sapiens
tgctgccatgccactgccaggca

SEQ ID NO: 3156482 - DNA, 12 bp, Homo sapiens
tgctgcccaggc

SEQ ID NO: 3156483 - DNA, 15 bp, Homo sapiens
tgctgcccaggccac

SEQ ID NO: 3156484 - DNA, 19 bp, Homo sapiens
tgctgcccaggccacagcc

SEQ ID NO: 3156485 - DNA, 16 bp, Homo sapiens
tgctgcccatgtttca

SEQ ID NO: 3156486 - DNA, 17 bp, Homo sapiens
tgctgcccatgtttcaa

SEQ ID NO: 3156487 - DNA, 13 bp, Homo sapiens
tgctgccccagct

SEQ ID NO: 3156488 - DNA, 14 bp, Homo sapiens
tgctgccccagctg

SEQ ID NO: 3156489 - DNA, 22 bp, Homo sapiens
tgctgccccgttccctgtcaga

SEQ ID NO: 3156490 - DNA, 14 bp, Homo sapiens
tgctgccctgtgta

SEQ ID NO: 3156491 - DNA, 20 bp, Homo sapiens
tgctgccgcctcccagcctg

SEQ ID NO: 3156492 - DNA, 19 bp, Homo sapiens
tgctgcctctttccctagg

SEQ ID NO: 3156493 - DNA, 14 bp, Homo sapiens
tgctgcctgagtca

SEQ ID NO: 3156494 - DNA, 21 bp, Homo sapiens
tgctgccttttctttaacttt

SEQ ID NO: 3156495 - DNA, 18 bp, Homo sapiens
tgctgcgcaccaatgccc

SEQ ID NO: 3156496 - DNA, 16 bp, Homo sapiens
tgctgcgtccccactc

SEQ ID NO: 3156497 - DNA, 17 bp, Homo sapiens
tgctgcgtccccactcc

SEQ ID NO: 3156498 - DNA, 22 bp, Homo sapiens
tgctgcgtccccactcccttgg

SEQ ID NO: 3156499 - DNA, 15 bp, Homo sapiens
tgctgctaccagcgc

SEQ ID NO: 3156500 - DNA, 15 bp, Homo sapiens
tgctgctacttaatt

SEQ ID NO: 3156501 - DNA, 16 bp, Homo sapiens
tgctgctagaactttt

SEQ ID NO: 3156502 - DNA, 19 bp, Homo sapiens
tgctgctagaactttttta

SEQ ID NO: 3156503 - DNA, 14 bp, Homo sapiens
tgctgctatgaaaa

SEQ ID NO: 3156504 - DNA, 21 bp, Homo sapiens
tgctgctatgaaaatgagcat

SEQ ID NO: 3156505 - DNA, 17 bp, Homo sapiens
tgctgctccaccctccc

SEQ ID NO: 3156506 - DNA, 15 bp, Homo sapiens
tgctgctccgcccgc

SEQ ID NO: 3156507 - DNA, 16 bp, Homo sapiens
tgctgctccgcccgct

SEQ ID NO: 3156508 - DNA, 14 bp, Homo sapiens
tgctgctctcagcc

SEQ ID NO: 3156509 - DNA, 9 bp, Homo sapiens
tgctgctgt

SEQ ID NO: 3156510 - DNA, 11 bp, Homo sapiens
tgctgctgtaa

SEQ ID NO: 3156511 - DNA, 13 bp, Homo sapiens
tgctgctgtaaat

SEQ ID NO: 3156512 - DNA, 19 bp, Homo sapiens
tgctgctgtaactgctgag

SEQ ID NO: 3156513 - DNA, 21 bp, Homo sapiens
tgctgctgtaactgctgagcc

SEQ ID NO: 3156514 - DNA, 24 bp, Homo sapiens
tgctgctgtaactgctgagccact

SEQ ID NO: 3156515 - DNA, 13 bp, Homo sapiens
tgctgctgtccct

SEQ ID NO: 3156516 - DNA, 13 bp, Homo sapiens
tgctgctgtgcag

SEQ ID NO: 3156517 - DNA, 14 bp, Homo sapiens
tgctgcttctcctc

SEQ ID NO: 3156518 - DNA, 20 bp, Homo sapiens
tgctgcttttgagcctcaga

SEQ ID NO: 3156519 - DNA, 21 bp, Homo sapiens
tgctgcttttgagcctcagac

SEQ ID NO: 3156520 - DNA, 22 bp, Homo sapiens
tgctgctttttgaggtggcact

SEQ ID NO: 3156521 - DNA, 23 bp, Homo sapiens
tgctgctttttgaggtggcactt

SEQ ID NO: 3156522 - DNA, 14 bp, Homo sapiens
tgctggaagaaact

SEQ ID NO: 3156523 - DNA, 18 bp, Homo sapiens
tgctggaagaaactaaaa

SEQ ID NO: 3156524 - DNA, 17 bp, Homo sapiens
tgctggaataagttcaa

SEQ ID NO: 3156525 - DNA, 19 bp, Homo sapiens
tgctggacggcattcctgc

SEQ ID NO: 3156526 - DNA, 11 bp, Homo sapiens
tgctggactgt

SEQ ID NO: 3156527 - DNA, 22 bp, Homo sapiens
tgctggagaagagaggagagga

SEQ ID NO: 3156528 - DNA, 12 bp, Homo sapiens
tgctggagaggt

SEQ ID NO: 3156529 - DNA, 12 bp, Homo sapiens
tgctggagcctg

SEQ ID NO: 3156530 - DNA, 14 bp, Homo sapiens
tgctggaggtggga

SEQ ID NO: 3156531 - DNA, 17 bp, Homo sapiens
tgctggaggtgggagca

SEQ ID NO: 3156532 - DNA, 18 bp, Homo sapiens
tgctggagtctggcttta

SEQ ID NO: 3156533 - DNA, 20 bp, Homo sapiens
tgctggagtttcatgtacaa

SEQ ID NO: 3156534 - DNA, 17 bp, Homo sapiens
tgctggatattttcaaa

SEQ ID NO: 3156535 - DNA, 17 bp, Homo sapiens
tgctggatggagcccag

SEQ ID NO: 3156536 - DNA, 18 bp, Homo sapiens
tgctggatggagcccagg

SEQ ID NO: 3156537 - DNA, 13 bp, Homo sapiens
tgctggatttgat

SEQ ID NO: 3156538 - DNA, 22 bp, Homo sapiens
tgctggcattaccctctgcaga

SEQ ID NO: 3156539 - DNA, 18 bp, Homo sapiens
tgctggccagcctggggc

SEQ ID NO: 3156540 - DNA, 20 bp, Homo sapiens
tgctggccccagccctgctg

SEQ ID NO: 3156541 - DNA, 22 bp, Homo sapiens
tgctggccccagccctgctggg

SEQ ID NO: 3156542 - DNA, 12 bp, Homo sapiens
tgctggcctgga

SEQ ID NO: 3156543 - DNA, 14 bp, Homo sapiens
tgctggcctggatc

SEQ ID NO: 3156544 - DNA, 15 bp, Homo sapiens
tgctggcctggatct

SEQ ID NO: 3156545 - DNA, 13 bp, Homo sapiens
tgctggctgcctt

SEQ ID NO: 3156546 - DNA, 14 bp, Homo sapiens
tgctggctgcctta

SEQ ID NO: 3156547 - DNA, 21 bp, Homo sapiens
tgctggctgccttagaacctt

SEQ ID NO: 3156548 - DNA, 18 bp, Homo sapiens
tgctgggactcagccttc

SEQ ID NO: 3156549 - DNA, 15 bp, Homo sapiens
tgctgggactggcca

SEQ ID NO: 3156550 - DNA, 16 bp, Homo sapiens
tgctgggagctccact

SEQ ID NO: 3156551 - DNA, 17 bp, Homo sapiens
tgctgggagctccactc

SEQ ID NO: 3156552 - DNA, 18 bp, Homo sapiens
tgctgggagctccactct

SEQ ID NO: 3156553 - DNA, 20 bp, Homo sapiens
tgctgggaggagggagaggg

SEQ ID NO: 3156554 - DNA, 16 bp, Homo sapiens
tgctgggatttccaac

SEQ ID NO: 3156555 - DNA, 22 bp, Homo sapiens
tgctgggcatactttctctcta

SEQ ID NO: 3156556 - DNA, 14 bp, Homo sapiens
tgctgggccactgg

SEQ ID NO: 3156557 - DNA, 12 bp, Homo sapiens
tgctgggctggg

SEQ ID NO: 3156558 - DNA, 17 bp, Homo sapiens
tgctgggttggtgcaca

SEQ ID NO: 3156559 - DNA, 17 bp, Homo sapiens
tgctggtaacagtggct

SEQ ID NO: 3156560 - DNA, 19 bp, Homo sapiens
tgctggtagagacccccag

SEQ ID NO: 3156561 - DNA, 21 bp, Homo sapiens
tgctggtcagagacggcagaa

SEQ ID NO: 3156562 - DNA, 16 bp, Homo sapiens
tgctggtccgtgggac

SEQ ID NO: 3156563 - DNA, 19 bp, Homo sapiens
tgctggtggaaagcgattc

SEQ ID NO: 3156564 - DNA, 16 bp, Homo sapiens
tgctggttcctgactg

SEQ ID NO: 3156565 - DNA, 19 bp, Homo sapiens
tgctggttcctgactggca

SEQ ID NO: 3156566 - DNA, 14 bp, Homo sapiens
tgctggttgctgtg

SEQ ID NO: 3156567 - DNA, 16 bp, Homo sapiens
tgctggttgctgtgtg

SEQ ID NO: 3156568 - DNA, 23 bp, Homo sapiens
tgctggttgtcatttttgcagta

SEQ ID NO: 3156569 - DNA, 15 bp, Homo sapiens
tgctggttttcctaa

SEQ ID NO: 3156570 - DNA, 23 bp, Homo sapiens
tgctgtaactgctgagccactcg

SEQ ID NO: 3156571 - DNA, 17 bp, Homo sapiens
tgctgtaacttaaaata

SEQ ID NO: 3156572 - DNA, 21 bp, Homo sapiens
tgctgtacatctattttggat

SEQ ID NO: 3156573 - DNA, 17 bp, Homo sapiens
tgctgtacccagatgcc

SEQ ID NO: 3156574 - DNA, 19 bp, Homo sapiens
tgctgtacccttccacctc

SEQ ID NO: 3156575 - DNA, 20 bp, Homo sapiens
tgctgtacccttccacctcc

SEQ ID NO: 3156576 - DNA, 21 bp, Homo sapiens
tgctgtacccttccacctcct

SEQ ID NO: 3156577 - DNA, 23 bp, Homo sapiens
tgctgtactcttgctgatggctg

SEQ ID NO: 3156578 - DNA, 21 bp, Homo sapiens
tgctgtatatttgtgatagca

SEQ ID NO: 3156579 - DNA, 17 bp, Homo sapiens
tgctgtattttaacact

SEQ ID NO: 3156580 - DNA, 16 bp, Homo sapiens
tgctgtcatggtcctt

SEQ ID NO: 3156581 - DNA, 23 bp, Homo sapiens
tgctgtcctaggccacaccatct

SEQ ID NO: 3156582 - DNA, 19 bp, Homo sapiens
tgctgtctctgctcgccct

SEQ ID NO: 3156583 - DNA, 18 bp, Homo sapiens
tgctgtgaccatttataa

SEQ ID NO: 3156584 - DNA, 19 bp, Homo sapiens
tgctgtgaggaatgctctg

SEQ ID NO: 3156585 - DNA, 17 bp, Homo sapiens
tgctgtgaggctgtcct

SEQ ID NO: 3156586 - DNA, 20 bp, Homo sapiens
tgctgtgatacgatgcttca

SEQ ID NO: 3156587 - DNA, 11 bp, Homo sapiens
tgctgtgcctg

SEQ ID NO: 3156588 - DNA, 12 bp, Homo sapiens
tgctgtgcctgc

SEQ ID NO: 3156589 - DNA, 18 bp, Homo sapiens
tgctgtgcctgctagagc

SEQ ID NO: 3156590 - DNA, 19 bp, Homo sapiens
tgctgtgcctgctagagca

SEQ ID NO: 3156591 - DNA, 12 bp, Homo sapiens
tgctgtgctgct

SEQ ID NO: 3156592 - DNA, 15 bp, Homo sapiens
tgctgtgctgctcaa

SEQ ID NO: 3156593 - DNA, 12 bp, Homo sapiens
tgctgtggcctg

SEQ ID NO: 3156594 - DNA, 16 bp, Homo sapiens
tgctgtggcctgggca

SEQ ID NO: 3156595 - DNA, 14 bp, Homo sapiens
tgctgtgggcagca

SEQ ID NO: 3156596 - DNA, 18 bp, Homo sapiens
tgctgtggggctggtagc

SEQ ID NO: 3156597 - DNA, 11 bp, Homo sapiens
tgctgtgtggt

SEQ ID NO: 3156598 - DNA, 20 bp, Homo sapiens
tgctgtgtgtgagcagtgga

SEQ ID NO: 3156599 - DNA, 23 bp, Homo sapiens
tgctgttaactgttaactatgac

SEQ ID NO: 3156600 - DNA, 17 bp, Homo sapiens
tgctgttaatgtatact

SEQ ID NO: 3156601 - DNA, 21 bp, Homo sapiens
tgctgttcactggacacttca

SEQ ID NO: 3156602 - DNA, 18 bp, Homo sapiens
tgctgttcctgctccatg

SEQ ID NO: 3156603 - DNA, 22 bp, Homo sapiens
tgctgttctcttgggaactgaa

SEQ ID NO: 3156604 - DNA, 15 bp, Homo sapiens
tgctgttgccatagc

SEQ ID NO: 3156605 - DNA, 14 bp, Homo sapiens
tgctgttgtaaaca

SEQ ID NO: 3156606 - DNA, 13 bp, Homo sapiens
tgctgtttatgat

SEQ ID NO: 3156607 - DNA, 14 bp, Homo sapiens
tgctgtttattaat

SEQ ID NO: 3156608 - DNA, 18 bp, Homo sapiens
tgctgtttcacaatacct

SEQ ID NO: 3156609 - DNA, 13 bp, Homo sapiens
tgctgtttgacaa

SEQ ID NO: 3156610 - DNA, 12 bp, Homo sapiens
tgcttaaaagac

SEQ ID NO: 3156611 - DNA, 13 bp, Homo sapiens
tgcttaaacaaag

SEQ ID NO: 3156612 - DNA, 13 bp, Homo sapiens
tgcttaaactaaa

SEQ ID NO: 3156613 - DNA, 14 bp, Homo sapiens
tgcttaatttctaa

SEQ ID NO: 3156614 - DNA, 21 bp, Homo sapiens
tgcttacagtaactaattttg

SEQ ID NO: 3156615 - DNA, 12 bp, Homo sapiens
tgcttacatttt

SEQ ID NO: 3156616 - DNA, 16 bp, Homo sapiens
tgcttactcattaaaa

SEQ ID NO: 3156617 - DNA, 14 bp, Homo sapiens
tgcttactgatata

SEQ ID NO: 3156618 - DNA, 22 bp, Homo sapiens
tgcttactgatatattttacaa

SEQ ID NO: 3156619 - DNA, 16 bp, Homo sapiens
tgcttagcttatcttt

SEQ ID NO: 3156620 - DNA, 21 bp, Homo sapiens
tgcttagcttatctttctttc

SEQ ID NO: 3156621 - DNA, 13 bp, Homo sapiens
tgcttagtaaaat

SEQ ID NO: 3156622 - DNA, 20 bp, Homo sapiens
tgcttagtccaattccttgc

SEQ ID NO: 3156623 - DNA, 23 bp, Homo sapiens
tgcttataacctagttaaagaaa

SEQ ID NO: 3156624 - DNA, 22 bp, Homo sapiens
tgcttattacatttaaatcctt

SEQ ID NO: 3156625 - DNA, 21 bp, Homo sapiens
tgcttattgcttagtaaaatt

SEQ ID NO: 3156626 - DNA, 15 bp, Homo sapiens
tgcttattgttccaa

SEQ ID NO: 3156627 - DNA, 16 bp, Homo sapiens
tgcttattgttccaag

SEQ ID NO: 3156628 - DNA, 17 bp, Homo sapiens
tgcttattgttccaaga

SEQ ID NO: 3156629 - DNA, 21 bp, Homo sapiens
tgcttattgttccaagacatt

SEQ ID NO: 3156630 - DNA, 15 bp, Homo sapiens
tgcttattttattat

SEQ ID NO: 3156631 - DNA, 16 bp, Homo sapiens
tgcttcaagtgttgct

SEQ ID NO: 3156632 - DNA, 22 bp, Homo sapiens
tgcttcaagtgttgctcttgga

SEQ ID NO: 3156633 - DNA, 16 bp, Homo sapiens
tgcttcaattaataaa

SEQ ID NO: 3156634 - DNA, 16 bp, Homo sapiens
tgcttcacagtagagc

SEQ ID NO: 3156635 - DNA, 21 bp, Homo sapiens
tgcttcacagtagagccagct

SEQ ID NO: 3156636 - DNA, 22 bp, Homo sapiens
tgcttcacagtagagccagctt

SEQ ID NO: 3156637 - DNA, 22 bp, Homo sapiens
tgcttcagagtttgtgtgtatt

SEQ ID NO: 3156638 - DNA, 23 bp, Homo sapiens
tgcttcagcctgaggctgagact

SEQ ID NO: 3156639 - DNA, 21 bp, Homo sapiens
tgcttcagggaggtagtttca

SEQ ID NO: 3156640 - DNA, 20 bp, Homo sapiens
tgcttcataaatgaagcagc

SEQ ID NO: 3156641 - DNA, 15 bp, Homo sapiens
tgcttcatgtgaaca

SEQ ID NO: 3156642 - DNA, 11 bp, Homo sapiens
tgcttccagga

SEQ ID NO: 3156643 - DNA, 16 bp, Homo sapiens
tgcttccaggaaactc

SEQ ID NO: 3156644 - DNA, 16 bp, Homo sapiens
tgcttccattaacaaa

SEQ ID NO: 3156645 - DNA, 22 bp, Homo sapiens
tgcttccattaacaaatgctct

SEQ ID NO: 3156646 - DNA, 14 bp, Homo sapiens
tgcttcccacctcc

SEQ ID NO: 3156647 - DNA, 20 bp, Homo sapiens
tgcttcccacctccctgccc

SEQ ID NO: 3156648 - DNA, 13 bp, Homo sapiens
tgcttcccagagg

SEQ ID NO: 3156649 - DNA, 15 bp, Homo sapiens
tgcttcccagaggga

SEQ ID NO: 3156650 - DNA, 19 bp, Homo sapiens
tgcttcccagagggagcag

SEQ ID NO: 3156651 - DNA, 14 bp, Homo sapiens
tgcttcccatccta

SEQ ID NO: 3156652 - DNA, 16 bp, Homo sapiens
tgcttcccatcctacc

SEQ ID NO: 3156653 - DNA, 17 bp, Homo sapiens
tgcttcccattgtggct

SEQ ID NO: 3156654 - DNA, 14 bp, Homo sapiens
tgcttccccttcct

SEQ ID NO: 3156655 - DNA, 15 bp, Homo sapiens
tgcttcccttacttt

SEQ ID NO: 3156656 - DNA, 14 bp, Homo sapiens
tgcttccgccactc

SEQ ID NO: 3156657 - DNA, 22 bp, Homo sapiens
tgcttccggtagggaggcagcc

SEQ ID NO: 3156658 - DNA, 12 bp, Homo sapiens
tgcttcctcctg

SEQ ID NO: 3156659 - DNA, 15 bp, Homo sapiens
tgcttcctgaaataa

SEQ ID NO: 3156660 - DNA, 18 bp, Homo sapiens
tgcttcctgaaataaaca

SEQ ID NO: 3156661 - DNA, 19 bp, Homo sapiens
tgcttcctgaaataaacac

SEQ ID NO: 3156662 - DNA, 21 bp, Homo sapiens
tgcttcctgaaataaacactg

SEQ ID NO: 3156663 - DNA, 22 bp, Homo sapiens
tgcttcctgaaataaacactgg

SEQ ID NO: 3156664 - DNA, 16 bp, Homo sapiens
tgcttcgttttctaaa

SEQ ID NO: 3156665 - DNA, 21 bp, Homo sapiens
tgcttctataattttgccttt

SEQ ID NO: 3156666 - DNA, 19 bp, Homo sapiens
tgcttctcaccgtgcagag

SEQ ID NO: 3156667 - DNA, 15 bp, Homo sapiens
tgcttctcacttttt

SEQ ID NO: 3156668 - DNA, 19 bp, Homo sapiens
tgcttctcatagccccggt

SEQ ID NO: 3156669 - DNA, 14 bp, Homo sapiens
tgcttctcatcccc

SEQ ID NO: 3156670 - DNA, 19 bp, Homo sapiens
tgcttctcatcttgtgaaa

SEQ ID NO: 3156671 - DNA, 15 bp, Homo sapiens
tgcttctccagcctg

SEQ ID NO: 3156672 - DNA, 19 bp, Homo sapiens
tgcttctccccagaattca

SEQ ID NO: 3156673 - DNA, 19 bp, Homo sapiens
tgcttctcctcccagcgtg

SEQ ID NO: 3156674 - DNA, 10 bp, Homo sapiens
tgcttctcta

SEQ ID NO: 3156675 - DNA, 16 bp, Homo sapiens
tgcttctctacagact

SEQ ID NO: 3156676 - DNA, 21 bp, Homo sapiens
tgcttctctagctctctaggc

SEQ ID NO: 3156677 - DNA, 23 bp, Homo sapiens
tgcttctctagctctctaggcct

SEQ ID NO: 3156678 - DNA, 23 bp, Homo sapiens
tgcttctctgacttctgcctgga

SEQ ID NO: 3156679 - DNA, 18 bp, Homo sapiens
tgcttctgaatgtgctga

SEQ ID NO: 3156680 - DNA, 13 bp, Homo sapiens
tgcttctgtagct

SEQ ID NO: 3156681 - DNA, 17 bp, Homo sapiens
tgcttctgtagcttcta

SEQ ID NO: 3156682 - DNA, 17 bp, Homo sapiens
tgcttctgtagtactcc

SEQ ID NO: 3156683 - DNA, 17 bp, Homo sapiens
tgcttcttactgataat

SEQ ID NO: 3156684 - DNA, 14 bp, Homo sapiens
tgcttctttataaa

SEQ ID NO: 3156685 - DNA, 18 bp, Homo sapiens
tgcttgaaattactgtgt

SEQ ID NO: 3156686 - DNA, 20 bp, Homo sapiens
tgcttgaaattactgtgtaa

SEQ ID NO: 3156687 - DNA, 21 bp, Homo sapiens
tgcttgaaattactgtgtaaa

SEQ ID NO: 3156688 - DNA, 21 bp, Homo sapiens
tgcttgacaaatattttcatg

SEQ ID NO: 3156689 - DNA, 19 bp, Homo sapiens
tgcttgaccgtactctcac

SEQ ID NO: 3156690 - DNA, 20 bp, Homo sapiens
tgcttgaccgtactctcaca

SEQ ID NO: 3156691 - DNA, 21 bp, Homo sapiens
tgcttgagccaggaggcctgc

SEQ ID NO: 3156692 - DNA, 14 bp, Homo sapiens
tgcttgatgaagca

SEQ ID NO: 3156693 - DNA, 17 bp, Homo sapiens
tgcttgatgaagcaagg

SEQ ID NO: 3156694 - DNA, 20 bp, Homo sapiens
tgcttgatgaagcaaggaag

SEQ ID NO: 3156695 - DNA, 14 bp, Homo sapiens
tgcttgattttgta

SEQ ID NO: 3156696 - DNA, 16 bp, Homo sapiens
tgcttgcataagagct

SEQ ID NO: 3156697 - DNA, 17 bp, Homo sapiens
tgcttgcggcaaaagga

SEQ ID NO: 3156698 - DNA, 18 bp, Homo sapiens
tgcttggaaattccttgc

SEQ ID NO: 3156699 - DNA, 19 bp, Homo sapiens
tgcttggaaattccttgcc

SEQ ID NO: 3156700 - DNA, 20 bp, Homo sapiens
tgcttggaaattccttgccc

SEQ ID NO: 3156701 - DNA, 22 bp, Homo sapiens
tgcttggaagaaggaaacggaa

SEQ ID NO: 3156702 - DNA, 13 bp, Homo sapiens
tgcttggaagcca

SEQ ID NO: 3156703 - DNA, 14 bp, Homo sapiens
tgcttggaagccag

SEQ ID NO: 3156704 - DNA, 16 bp, Homo sapiens
tgcttggaagccaggt

SEQ ID NO: 3156705 - DNA, 17 bp, Homo sapiens
tgcttggggctatttgt

SEQ ID NO: 3156706 - DNA, 19 bp, Homo sapiens
tgcttggtggggctcgtgg

SEQ ID NO: 3156707 - DNA, 18 bp, Homo sapiens
tgcttgtaacaagaaaac

SEQ ID NO: 3156708 - DNA, 21 bp, Homo sapiens
tgcttgtaacaagaaaacata

SEQ ID NO: 3156709 - DNA, 16 bp, Homo sapiens
tgcttgtactgggaca

SEQ ID NO: 3156710 - DNA, 15 bp, Homo sapiens
tgcttgtcattgact

SEQ ID NO: 3156711 - DNA, 16 bp, Homo sapiens
tgcttgtcctgggcct

SEQ ID NO: 3156712 - DNA, 20 bp, Homo sapiens
tgcttgtcttctggtacttt

SEQ ID NO: 3156713 - DNA, 15 bp, Homo sapiens
tgcttgtgttaagta

SEQ ID NO: 3156714 - DNA, 19 bp, Homo sapiens
tgcttgttgggattcctga

SEQ ID NO: 3156715 - DNA, 22 bp, Homo sapiens
tgcttgttgggattcctgaccc

SEQ ID NO: 3156716 - DNA, 17 bp, Homo sapiens
tgctttaaagtgtaata

SEQ ID NO: 3156717 - DNA, 15 bp, Homo sapiens
tgctttatgccttct

SEQ ID NO: 3156718 - DNA, 18 bp, Homo sapiens
tgctttattaatgttttc

SEQ ID NO: 3156719 - DNA, 20 bp, Homo sapiens
tgctttattaatgttttcaa

SEQ ID NO: 3156720 - DNA, 14 bp, Homo sapiens
tgctttattccaga

SEQ ID NO: 3156721 - DNA, 15 bp, Homo sapiens
tgctttattccagaa

SEQ ID NO: 3156722 - DNA, 12 bp, Homo sapiens
tgctttcaattg

SEQ ID NO: 3156723 - DNA, 14 bp, Homo sapiens
tgctttcaattgac

SEQ ID NO: 3156724 - DNA, 16 bp, Homo sapiens
tgctttcccatatctt

SEQ ID NO: 3156725 - DNA, 21 bp, Homo sapiens
tgctttcccatatcttgcctt

SEQ ID NO: 3156726 - DNA, 15 bp, Homo sapiens
tgctttcccctgtgg

SEQ ID NO: 3156727 - DNA, 17 bp, Homo sapiens
tgctttcggagctcctg

SEQ ID NO: 3156728 - DNA, 12 bp, Homo sapiens
tgctttctgaaa

SEQ ID NO: 3156729 - DNA, 13 bp, Homo sapiens
tgctttctgaaat

SEQ ID NO: 3156730 - DNA, 16 bp, Homo sapiens
tgctttctgttccaaa

SEQ ID NO: 3156731 - DNA, 19 bp, Homo sapiens
tgctttgaagcagttgtgt

SEQ ID NO: 3156732 - DNA, 17 bp, Homo sapiens
tgctttgcacaggaaag

SEQ ID NO: 3156733 - DNA, 13 bp, Homo sapiens
tgctttgccaaaa

SEQ ID NO: 3156734 - DNA, 20 bp, Homo sapiens
tgctttgccaagttgctgtc

SEQ ID NO: 3156735 - DNA, 14 bp, Homo sapiens
tgctttgctcttgt

SEQ ID NO: 3156736 - DNA, 18 bp, Homo sapiens
tgctttggacctaaatgg

SEQ ID NO: 3156737 - DNA, 19 bp, Homo sapiens
tgctttgggaggccaaggc

SEQ ID NO: 3156738 - DNA, 20 bp, Homo sapiens
tgctttgggctgccctggtg

SEQ ID NO: 3156739 - DNA, 15 bp, Homo sapiens
tgctttgggctttgc

SEQ ID NO: 3156740 - DNA, 19 bp, Homo sapiens
tgctttgggctttgcaggc

SEQ ID NO: 3156741 - DNA, 23 bp, Homo sapiens
tgctttgggctttgcaggctctg

SEQ ID NO: 3156742 - DNA, 16 bp, Homo sapiens
tgctttgtaaattgtg

SEQ ID NO: 3156743 - DNA, 22 bp, Homo sapiens
tgctttgtaaattgtgttgtct

SEQ ID NO: 3156744 - DNA, 23 bp, Homo sapiens
tgcttttaggagaattcacagaa

SEQ ID NO: 3156745 - DNA, 19 bp, Homo sapiens
tgcttttagttcatatata

SEQ ID NO: 3156746 - DNA, 21 bp, Homo sapiens
tgcttttattttgaaaagctt

SEQ ID NO: 3156747 - DNA, 19 bp, Homo sapiens
tgcttttcatgtagaactc

SEQ ID NO: 3156748 - DNA, 12 bp, Homo sapiens
tgcttttccagg

SEQ ID NO: 3156749 - DNA, 13 bp, Homo sapiens
tgcttttccagga

SEQ ID NO: 3156750 - DNA, 21 bp, Homo sapiens
tgcttttccaggatcctgcag

SEQ ID NO: 3156751 - DNA, 23 bp, Homo sapiens
tgcttttccaggatcctgcagga

SEQ ID NO: 3156752 - DNA, 16 bp, Homo sapiens
tgcttttcctcaagca

SEQ ID NO: 3156753 - DNA, 18 bp, Homo sapiens
tgcttttcctcaagcaat

SEQ ID NO: 3156754 - DNA, 15 bp, Homo sapiens
tgcttttctgccctg

SEQ ID NO: 3156755 - DNA, 17 bp, Homo sapiens
tgcttttctgtatttta

SEQ ID NO: 3156756 - DNA, 19 bp, Homo sapiens
tgcttttgcataatgcaat

SEQ ID NO: 3156757 - DNA, 17 bp, Homo sapiens
tgcttttgttgtgactt

SEQ ID NO: 3156758 - DNA, 23 bp, Homo sapiens
tgctttttaatattgatatgctt

SEQ ID NO: 3156759 - DNA, 13 bp, Homo sapiens
tgctttttaccta

SEQ ID NO: 3156760 - DNA, 19 bp, Homo sapiens
tgctttttatttctgcata

SEQ ID NO: 3156761 - DNA, 15 bp, Homo sapiens
tgctttttcaccaga

SEQ ID NO: 3156762 - DNA, 14 bp, Homo sapiens
tgctttttcttgtt

SEQ ID NO: 3156763 - DNA, 22 bp, Homo sapiens
tgctttttcttgtttgtttaaa

SEQ ID NO: 3156764 - DNA, 20 bp, Homo sapiens
tgctttttgaggtggcactt

SEQ ID NO: 3156765 - DNA, 21 bp, Homo sapiens
tgctttttgaggtggcacttt

SEQ ID NO: 3156766 - DNA, 14 bp, Homo sapiens
tgctttttggaaag

SEQ ID NO: 3156767 - DNA, 20 bp, Homo sapiens
tgcttttttccaaaacaaaa

SEQ ID NO: 3156768 - DNA, 13 bp, Homo sapiens
tgcttttttgtat

SEQ ID NO: 3156769 - DNA, 15 bp, Homo sapiens
tgctttttttggcct

SEQ ID NO: 3156770 - DNA, 14 bp, Homo sapiens
tgcttttttttcct

SEQ ID NO: 3156771 - DNA, 17 bp, Homo sapiens
tgcttttttttccttct

SEQ ID NO: 3156772 - DNA, 22 bp, Homo sapiens
tgcttttttttttccagcaagt

SEQ ID NO: 3156773 - DNA, 12 bp, Homo sapiens
tggaaaaaaaca

SEQ ID NO: 3156774 - DNA, 21 bp, Homo sapiens
tggaaaaaaacataaaaagca

SEQ ID NO: 3156775 - DNA, 21 bp, Homo sapiens
tggaaaaaagagaaaaaccaa

SEQ ID NO: 3156776 - DNA, 17 bp, Homo sapiens
tggaaaaataaaactgt

SEQ ID NO: 3156777 - DNA, 21 bp, Homo sapiens
tggaaaaatgggtcttttata

SEQ ID NO: 3156778 - DNA, 22 bp, Homo sapiens
tggaaaaatggttgatggaaaa

SEQ ID NO: 3156779 - DNA, 14 bp, Homo sapiens
tggaaaaatgtttg

SEQ ID NO: 3156780 - DNA, 20 bp, Homo sapiens
tggaaaactgtgttgccaca

SEQ ID NO: 3156781 - DNA, 19 bp, Homo sapiens
tggaaaagaatacagaaag

SEQ ID NO: 3156782 - DNA, 22 bp, Homo sapiens
tggaaaaggaaaaaaatccact

SEQ ID NO: 3156783 - DNA, 15 bp, Homo sapiens
tggaaaaggaagact

SEQ ID NO: 3156784 - DNA, 16 bp, Homo sapiens
tggaaaagtgtccttc

SEQ ID NO: 3156785 - DNA, 22 bp, Homo sapiens
tggaaaataagacaatagtatt

SEQ ID NO: 3156786 - DNA, 12 bp, Homo sapiens
tggaaacagcat

SEQ ID NO: 3156787 - DNA, 14 bp, Homo sapiens
tggaaacagcatga

SEQ ID NO: 3156788 - DNA, 19 bp, Homo sapiens
tggaaacagcatgaataaa

SEQ ID NO: 3156789 - DNA, 15 bp, Homo sapiens
tggaaacctgaaaaa

SEQ ID NO: 3156790 - DNA, 18 bp, Homo sapiens
tggaaactatgtgttttt

SEQ ID NO: 3156791 - DNA, 14 bp, Homo sapiens
tggaaactgctaaa

SEQ ID NO: 3156792 - DNA, 17 bp, Homo sapiens
tggaaactgctaaattc

SEQ ID NO: 3156793 - DNA, 20 bp, Homo sapiens
tggaaactgctaaattctat

SEQ ID NO: 3156794 - DNA, 22 bp, Homo sapiens
tggaaagacgtttttgtgctgt

SEQ ID NO: 3156795 - DNA, 12 bp, Homo sapiens
tggaaagagacc

SEQ ID NO: 3156796 - DNA, 15 bp, Homo sapiens
tggaaagatgttaag

SEQ ID NO: 3156797 - DNA, 21 bp, Homo sapiens
tggaaagatgttaagcattta

SEQ ID NO: 3156798 - DNA, 14 bp, Homo sapiens
tggaaagcactttt

SEQ ID NO: 3156799 - DNA, 21 bp, Homo sapiens
tggaaagcactttttggctga

SEQ ID NO: 3156800 - DNA, 21 bp, Homo sapiens
tggaaagcatcacctcaggcc

SEQ ID NO: 3156801 - DNA, 12 bp, Homo sapiens
tggaaagcctct

SEQ ID NO: 3156802 - DNA, 14 bp, Homo sapiens
tggaaagcctctgc

SEQ ID NO: 3156803 - DNA, 15 bp, Homo sapiens
tggaaaggggagagc

SEQ ID NO: 3156804 - DNA, 17 bp, Homo sapiens
tggaaaggggagagcct

SEQ ID NO: 3156805 - DNA, 22 bp, Homo sapiens
tggaaaggtgtgagactgggaa

SEQ ID NO: 3156806 - DNA, 19 bp, Homo sapiens
tggaaagtaactcatttgt

SEQ ID NO: 3156807 - DNA, 20 bp, Homo sapiens
tggaaagtacactctgctgt

SEQ ID NO: 3156808 - DNA, 17 bp, Homo sapiens
tggaaagtgaatttgaa

SEQ ID NO: 3156809 - DNA, 21 bp, Homo sapiens
tggaaagtgaatttgaatgaa

SEQ ID NO: 3156810 - DNA, 21 bp, Homo sapiens
tggaaagtgccagcattccag

SEQ ID NO: 3156811 - DNA, 17 bp, Homo sapiens
tggaaataaactgtgca

SEQ ID NO: 3156812 - DNA, 23 bp, Homo sapiens
tggaaataaatgtatcatagaaa

SEQ ID NO: 3156813 - DNA, 17 bp, Homo sapiens
tggaaataataaaagat

SEQ ID NO: 3156814 - DNA, 15 bp, Homo sapiens
tggaaatattaagaa

SEQ ID NO: 3156815 - DNA, 14 bp, Homo sapiens
tggaaatattttga

SEQ ID NO: 3156816 - DNA, 13 bp, Homo sapiens
tggaaattccttg

SEQ ID NO: 3156817 - DNA, 15 bp, Homo sapiens
tggaaattccttgcc

SEQ ID NO: 3156818 - DNA, 14 bp, Homo sapiens
tggaaatttttacc

SEQ ID NO: 3156819 - DNA, 20 bp, Homo sapiens
tggaacaaagtgaaggacat

SEQ ID NO: 3156820 - DNA, 22 bp, Homo sapiens
tggaacacctaccaaaaaataa

SEQ ID NO: 3156821 - DNA, 16 bp, Homo sapiens
tggaacagaatgtttt

SEQ ID NO: 3156822 - DNA, 17 bp, Homo sapiens
tggaacagtaagaacat

SEQ ID NO: 3156823 - DNA, 22 bp, Homo sapiens
tggaacatcctttgcagggcag

SEQ ID NO: 3156824 - DNA, 13 bp, Homo sapiens
tggaacattggaa

SEQ ID NO: 3156825 - DNA, 17 bp, Homo sapiens
tggaacattggaatgtt

SEQ ID NO: 3156826 - DNA, 23 bp, Homo sapiens
tggaaccttgctgtcctgatctg

SEQ ID NO: 3156827 - DNA, 16 bp, Homo sapiens
tggaactactgtactt

SEQ ID NO: 3156828 - DNA, 17 bp, Homo sapiens
tggaactactgtacttt

SEQ ID NO: 3156829 - DNA, 20 bp, Homo sapiens
tggaactatacccgggacca

SEQ ID NO: 3156830 - DNA, 15 bp, Homo sapiens
tggaactctatctgg

SEQ ID NO: 3156831 - DNA, 23 bp, Homo sapiens
tggaactctatctgggcctgggc

SEQ ID NO: 3156832 - DNA, 16 bp, Homo sapiens
tggaacttacattgtt

SEQ ID NO: 3156833 - DNA, 13 bp, Homo sapiens
tggaacttctaat

SEQ ID NO: 3156834 - DNA, 21 bp, Homo sapiens
tggaagaaaaaaaccacacaa

SEQ ID NO: 3156835 - DNA, 21 bp, Homo sapiens
tggaagaaactaaaaatatag

SEQ ID NO: 3156836 - DNA, 15 bp, Homo sapiens
tggaagaagggagaa

SEQ ID NO: 3156837 - DNA, 17 bp, Homo sapiens
tggaagaagggagaaga

SEQ ID NO: 3156838 - DNA, 19 bp, Homo sapiens
tggaagaagggagaagaaa

SEQ ID NO: 3156839 - DNA, 23 bp, Homo sapiens
tggaagacacttcagatctgagg

SEQ ID NO: 3156840 - DNA, 13 bp, Homo sapiens
tggaagagaaatc

SEQ ID NO: 3156841 - DNA, 15 bp, Homo sapiens
tggaagagcagcctg

SEQ ID NO: 3156842 - DNA, 16 bp, Homo sapiens
tggaagagtgtgtgtg

SEQ ID NO: 3156843 - DNA, 22 bp, Homo sapiens
tggaagatttgcccatttacac

SEQ ID NO: 3156844 - DNA, 16 bp, Homo sapiens
tggaagcacagcttca

SEQ ID NO: 3156845 - DNA, 18 bp, Homo sapiens
tggaagccagctttccct

SEQ ID NO: 3156846 - DNA, 20 bp, Homo sapiens
tggaagccaggtacaggaga

SEQ ID NO: 3156847 - DNA, 17 bp, Homo sapiens
tggaagctaatttgcat

SEQ ID NO: 3156848 - DNA, 13 bp, Homo sapiens
tggaagctccgct

SEQ ID NO: 3156849 - DNA, 18 bp, Homo sapiens
tggaagctgccctgccca

SEQ ID NO: 3156850 - DNA, 20 bp, Homo sapiens
tggaagctgtttggaaaaga

SEQ ID NO: 3156851 - DNA, 18 bp, Homo sapiens
tggaagcttgttttccag

SEQ ID NO: 3156852 - DNA, 17 bp, Homo sapiens
tggaaggcagagaaatc

SEQ ID NO: 3156853 - DNA, 17 bp, Homo sapiens
tggaaggcagggcagag

SEQ ID NO: 3156854 - DNA, 18 bp, Homo sapiens
tggaaggcagggcagagg

SEQ ID NO: 3156855 - DNA, 17 bp, Homo sapiens
tggaaggccttccactg

SEQ ID NO: 3156856 - DNA, 13 bp, Homo sapiens
tggaaggctggct

SEQ ID NO: 3156857 - DNA, 23 bp, Homo sapiens
tggaaggggccacgtggatgggc

SEQ ID NO: 3156858 - DNA, 17 bp, Homo sapiens
tggaagggtttgtggct

SEQ ID NO: 3156859 - DNA, 21 bp, Homo sapiens
tggaaggtatttttttaaatt

SEQ ID NO: 3156860 - DNA, 15 bp, Homo sapiens
tggaaggtctattgg

SEQ ID NO: 3156861 - DNA, 20 bp, Homo sapiens
tggaagtaaccatttgcact

SEQ ID NO: 3156862 - DNA, 16 bp, Homo sapiens
tggaagtctacctgct

SEQ ID NO: 3156863 - DNA, 24 bp, Homo sapiens
tggaagtctacctgctggacagcc

SEQ ID NO: 3156864 - DNA, 17 bp, Homo sapiens
tggaagtggcagtgaaa

SEQ ID NO: 3156865 - DNA, 16 bp, Homo sapiens
tggaagtttgtgttct

SEQ ID NO: 3156866 - DNA, 13 bp, Homo sapiens
tggaagttttcag

SEQ ID NO: 3156867 - DNA, 15 bp, Homo sapiens
tggaataaaaggctt

SEQ ID NO: 3156868 - DNA, 22 bp, Homo sapiens
tggaataaaaggcttgaagctg

SEQ ID NO: 3156869 - DNA, 18 bp, Homo sapiens
tggaataaacattaattt

SEQ ID NO: 3156870 - DNA, 21 bp, Homo sapiens
tggaataaacattaattttgt

SEQ ID NO: 3156871 - DNA, 17 bp, Homo sapiens
tggaataaagttgcaga

SEQ ID NO: 3156872 - DNA, 18 bp, Homo sapiens
tggaatactttttgttat

SEQ ID NO: 3156873 - DNA, 13 bp, Homo sapiens
tggaatatttgaa

SEQ ID NO: 3156874 - DNA, 18 bp, Homo sapiens
tggaatcgatttcctccc

SEQ ID NO: 3156875 - DNA, 16 bp, Homo sapiens
tggaatctagccgatg

SEQ ID NO: 3156876 - DNA, 22 bp, Homo sapiens
tggaatctagccgatggaaaat

SEQ ID NO: 3156877 - DNA, 13 bp, Homo sapiens
tggaatcttctcc

SEQ ID NO: 3156878 - DNA, 16 bp, Homo sapiens
tggaatgaagaaattg

SEQ ID NO: 3156879 - DNA, 22 bp, Homo sapiens
tggaatgactataaacattaaa

SEQ ID NO: 3156880 - DNA, 18 bp, Homo sapiens
tggaatgagtgtgcatgg

SEQ ID NO: 3156881 - DNA, 19 bp, Homo sapiens
tggaatgagtgtgcatgga

SEQ ID NO: 3156882 - DNA, 21 bp, Homo sapiens
tggaatgagtgtgcatggagg

SEQ ID NO: 3156883 - DNA, 18 bp, Homo sapiens
tggaatggaactactgta

SEQ ID NO: 3156884 - DNA, 22 bp, Homo sapiens
tggaatggtacatgtcttccat

SEQ ID NO: 3156885 - DNA, 16 bp, Homo sapiens
tggaatggtttgggaa

SEQ ID NO: 3156886 - DNA, 21 bp, Homo sapiens
tggaattaacctggtgctgga

SEQ ID NO: 3156887 - DNA, 13 bp, Homo sapiens
tggaattctaaca

SEQ ID NO: 3156888 - DNA, 22 bp, Homo sapiens
tggaattcttagtcacaaaata

SEQ ID NO: 3156889 - DNA, 13 bp, Homo sapiens
tggaattcttcct

SEQ ID NO: 3156890 - DNA, 12 bp, Homo sapiens
tggaattgattt

SEQ ID NO: 3156891 - DNA, 15 bp, Homo sapiens
tggaattgatttgca

SEQ ID NO: 3156892 - DNA, 17 bp, Homo sapiens
tggaattgatttgcatt

SEQ ID NO: 3156893 - DNA, 20 bp, Homo sapiens
tggaattgatttgcattgaa

SEQ ID NO: 3156894 - DNA, 11 bp, Homo sapiens
tggaattgctt

SEQ ID NO: 3156895 - DNA, 17 bp, Homo sapiens
tggaattgggagcttgg

SEQ ID NO: 3156896 - DNA, 16 bp, Homo sapiens
tggaatttgtaacctc

SEQ ID NO: 3156897 - DNA, 18 bp, Homo sapiens
tggaatttgtaacctcag

SEQ ID NO: 3156898 - DNA, 15 bp, Homo sapiens
tggaatttgttcaag

SEQ ID NO: 3156899 - DNA, 20 bp, Homo sapiens
tggacacaacagcagtctcc

SEQ ID NO: 3156900 - DNA, 23 bp, Homo sapiens
tggacacagatcccactggaaga

SEQ ID NO: 3156901 - DNA, 14 bp, Homo sapiens
tggacacagctctt

SEQ ID NO: 3156902 - DNA, 16 bp, Homo sapiens
tggacacagctcttca

SEQ ID NO: 3156903 - DNA, 18 bp, Homo sapiens
tggacacagctcttcatt

SEQ ID NO: 3156904 - DNA, 16 bp, Homo sapiens
tggacacagctcttct

SEQ ID NO: 3156905 - DNA, 21 bp, Homo sapiens
tggacacagctcttctccagg

SEQ ID NO: 3156906 - DNA, 23 bp, Homo sapiens
tggacacagctcttctccaggct

SEQ ID NO: 3156907 - DNA, 17 bp, Homo sapiens
tggacactccagtgcca

SEQ ID NO: 3156908 - DNA, 19 bp, Homo sapiens
tggacactccagtgccagc

SEQ ID NO: 3156909 - DNA, 14 bp, Homo sapiens
tggacactgtacaa

SEQ ID NO: 3156910 - DNA, 15 bp, Homo sapiens
tggacagacccaggt

SEQ ID NO: 3156911 - DNA, 22 bp, Homo sapiens
tggacagacccaggtcttccag

SEQ ID NO: 3156912 - DNA, 19 bp, Homo sapiens
tggacagagcgcccctccc

SEQ ID NO: 3156913 - DNA, 12 bp, Homo sapiens
tggacagccccc

SEQ ID NO: 3156914 - DNA, 19 bp, Homo sapiens
tggacaggagtcagtgtct

SEQ ID NO: 3156915 - DNA, 22 bp, Homo sapiens
tggacaggcatgttctctgagg

SEQ ID NO: 3156916 - DNA, 12 bp, Homo sapiens
tggacaggccca

SEQ ID NO: 3156917 - DNA, 13 bp, Homo sapiens
tggacaggcccag

SEQ ID NO: 3156918 - DNA, 14 bp, Homo sapiens
tggacaggcccagc

SEQ ID NO: 3156919 - DNA, 15 bp, Homo sapiens
tggacaggcccagcg

SEQ ID NO: 3156920 - DNA, 22 bp, Homo sapiens
tggacaggcccagcgcggccag

SEQ ID NO: 3156921 - DNA, 13 bp, Homo sapiens
tggacagtcactg

SEQ ID NO: 3156922 - DNA, 20 bp, Homo sapiens
tggacagtcactgccacttt

SEQ ID NO: 3156923 - DNA, 16 bp, Homo sapiens
tggacagtcctgggag

SEQ ID NO: 3156924 - DNA, 18 bp, Homo sapiens
tggacagttcacaccctg

SEQ ID NO: 3156925 - DNA, 19 bp, Homo sapiens
tggacagttcacaccctgc

SEQ ID NO: 3156926 - DNA, 14 bp, Homo sapiens
tggacatcctcctc

SEQ ID NO: 3156927 - DNA, 20 bp, Homo sapiens
tggacatcctcctcccaccc

SEQ ID NO: 3156928 - DNA, 19 bp, Homo sapiens
tggacatcctcttctgctt

SEQ ID NO: 3156929 - DNA, 17 bp, Homo sapiens
tggacatttgccttgct

SEQ ID NO: 3156930 - DNA, 22 bp, Homo sapiens
tggacatttgccttgctggacg

SEQ ID NO: 3156931 - DNA, 19 bp, Homo sapiens
tggaccaattattgatata

SEQ ID NO: 3156932 - DNA, 21 bp, Homo sapiens
tggaccaattattgatatata

SEQ ID NO: 3156933 - DNA, 12 bp, Homo sapiens
tggaccactgca

SEQ ID NO: 3156934 - DNA, 17 bp, Homo sapiens
tggaccagtggtgcctt

SEQ ID NO: 3156935 - DNA, 20 bp, Homo sapiens
tggacccaaggaaaactgca

SEQ ID NO: 3156936 - DNA, 14 bp, Homo sapiens
tggaccccagctgg

SEQ ID NO: 3156937 - DNA, 19 bp, Homo sapiens
tggaccccagctgggaggc

SEQ ID NO: 3156938 - DNA, 20 bp, Homo sapiens
tggaccccagctgggaggca

SEQ ID NO: 3156939 - DNA, 14 bp, Homo sapiens
tggacccccagctt

SEQ ID NO: 3156940 - DNA, 22 bp, Homo sapiens
tggaccctactattcatgtttt

SEQ ID NO: 3156941 - DNA, 22 bp, Homo sapiens
tggaccgggtgggcctggcctg

SEQ ID NO: 3156942 - DNA, 18 bp, Homo sapiens
tggaccgtggacaggccc

SEQ ID NO: 3156943 - DNA, 15 bp, Homo sapiens
tggacctaacattcg

SEQ ID NO: 3156944 - DNA, 14 bp, Homo sapiens
tggacctaatccaa

SEQ ID NO: 3156945 - DNA, 20 bp, Homo sapiens
tggacctctactttccaggc

SEQ ID NO: 3156946 - DNA, 18 bp, Homo sapiens
tggacctgagtcggcccc

SEQ ID NO: 3156947 - DNA, 13 bp, Homo sapiens
tggacctgcccac

SEQ ID NO: 3156948 - DNA, 19 bp, Homo sapiens
tggaccttaggccttcctc

SEQ ID NO: 3156949 - DNA, 20 bp, Homo sapiens
tggaccttgaactgggtact

SEQ ID NO: 3156950 - DNA, 21 bp, Homo sapiens
tggacggcaggctcactgcca

SEQ ID NO: 3156951 - DNA, 22 bp, Homo sapiens
tggacggcaggctcactgccag

SEQ ID NO: 3156952 - DNA, 14 bp, Homo sapiens
tggacgtctttctt

SEQ ID NO: 3156953 - DNA, 17 bp, Homo sapiens
tggacgttcggggcatg

SEQ ID NO: 3156954 - DNA, 18 bp, Homo sapiens
tggactaaatatctgtca

SEQ ID NO: 3156955 - DNA, 14 bp, Homo sapiens
tggactaaatgcct

SEQ ID NO: 3156956 - DNA, 19 bp, Homo sapiens
tggactaattgacttgcaa

SEQ ID NO: 3156957 - DNA, 14 bp, Homo sapiens
tggactccagcctg

SEQ ID NO: 3156958 - DNA, 13 bp, Homo sapiens
tggactcctctgt

SEQ ID NO: 3156959 - DNA, 14 bp, Homo sapiens
tggactcctctgtc

SEQ ID NO: 3156960 - DNA, 18 bp, Homo sapiens
tggactcctgccaccagc

SEQ ID NO: 3156961 - DNA, 14 bp, Homo sapiens
tggactctcaggga

SEQ ID NO: 3156962 - DNA, 17 bp, Homo sapiens
tggactctgcacatgaa

SEQ ID NO: 3156963 - DNA, 15 bp, Homo sapiens
tggactcttctcggc

SEQ ID NO: 3156964 - DNA, 17 bp, Homo sapiens
tggactcttctcggctc

SEQ ID NO: 3156965 - DNA, 18 bp, Homo sapiens
tggactcttctcggctca

SEQ ID NO: 3156966 - DNA, 20 bp, Homo sapiens
tggactcttctcggctcagg

SEQ ID NO: 3156967 - DNA, 21 bp, Homo sapiens
tggactcttctcggctcaggc

SEQ ID NO: 3156968 - DNA, 22 bp, Homo sapiens
tggactcttctcggctcaggct

SEQ ID NO: 3156969 - DNA, 19 bp, Homo sapiens
tggactgaagcctgcagga

SEQ ID NO: 3156970 - DNA, 22 bp, Homo sapiens
tggactgagccaaggaggcctg

SEQ ID NO: 3156971 - DNA, 12 bp, Homo sapiens
tggactgcattt

SEQ ID NO: 3156972 - DNA, 16 bp, Homo sapiens
tggactgcgctggacg

SEQ ID NO: 3156973 - DNA, 17 bp, Homo sapiens
tggactggaggcccctg

SEQ ID NO: 3156974 - DNA, 18 bp, Homo sapiens
tggactggaggtgggcat

SEQ ID NO: 3156975 - DNA, 19 bp, Homo sapiens
tggactggctagagtcctc

SEQ ID NO: 3156976 - DNA, 17 bp, Homo sapiens
tggactgttccaggccc

SEQ ID NO: 3156977 - DNA, 17 bp, Homo sapiens
tggactgttttctctcg

SEQ ID NO: 3156978 - DNA, 20 bp, Homo sapiens
tggactgttttctctcggct

SEQ ID NO: 3156979 - DNA, 22 bp, Homo sapiens
tggactgttttctctcggctcc

SEQ ID NO: 3156980 - DNA, 17 bp, Homo sapiens
tggacttaaccggagtt

SEQ ID NO: 3156981 - DNA, 19 bp, Homo sapiens
tggacttaagcatctggct

SEQ ID NO: 3156982 - DNA, 18 bp, Homo sapiens
tggacttagaaagcaggg

SEQ ID NO: 3156983 - DNA, 15 bp, Homo sapiens
tggacttctgtgggc

SEQ ID NO: 3156984 - DNA, 18 bp, Homo sapiens
tggacttctgtgggcccc

SEQ ID NO: 3156985 - DNA, 23 bp, Homo sapiens
tggacttggtacagttgcaggag

SEQ ID NO: 3156986 - DNA, 15 bp, Homo sapiens
tggacttgtatattt

SEQ ID NO: 3156987 - DNA, 20 bp, Homo sapiens
tggacttgtatatttgtaca

SEQ ID NO: 3156988 - DNA, 22 bp, Homo sapiens
tggacttgtatatttgtacaaa

SEQ ID NO: 3156989 - DNA, 17 bp, Homo sapiens
tggagaaaaaaattgct

SEQ ID NO: 3156990 - DNA, 22 bp, Homo sapiens
tggagaaaatgggtttattcac

SEQ ID NO: 3156991 - DNA, 13 bp, Homo sapiens
tggagaaagaagt

SEQ ID NO: 3156992 - DNA, 18 bp, Homo sapiens
tggagaaagagctgcctg

SEQ ID NO: 3156993 - DNA, 19 bp, Homo sapiens
tggagaaagagctgcctgg

SEQ ID NO: 3156994 - DNA, 18 bp, Homo sapiens
tggagaaagcactgacct

SEQ ID NO: 3156995 - DNA, 16 bp, Homo sapiens
tggagaaatgggagct

SEQ ID NO: 3156996 - DNA, 15 bp, Homo sapiens
tggagaaattattta

SEQ ID NO: 3156997 - DNA, 17 bp, Homo sapiens
tggagaaattatttaat

SEQ ID NO: 3156998 - DNA, 15 bp, Homo sapiens
tggagaacagtggtt

SEQ ID NO: 3156999 - DNA, 21 bp, Homo sapiens
tggagaacagtggttgcctgg

SEQ ID NO: 3157000 - DNA, 23 bp, Homo sapiens
tggagaacgccagtctcccaggc

SEQ ID NO: 3157001 - DNA, 16 bp, Homo sapiens
tggagaagagaggaga

SEQ ID NO: 3157002 - DNA, 19 bp, Homo sapiens
tggagaagagaggagagga

SEQ ID NO: 3157003 - DNA, 17 bp, Homo sapiens
tggagaagttgtgaaag

SEQ ID NO: 3157004 - DNA, 19 bp, Homo sapiens
tggagaattgctgaagggc

SEQ ID NO: 3157005 - DNA, 17 bp, Homo sapiens
tggagacacaactattt

SEQ ID NO: 3157006 - DNA, 19 bp, Homo sapiens
tggagaccctgcaaacaga

SEQ ID NO: 3157007 - DNA, 19 bp, Homo sapiens
tggagactcctgccctgtt

SEQ ID NO: 3157008 - DNA, 17 bp, Homo sapiens
tggagactcctggtctg

SEQ ID NO: 3157009 - DNA, 19 bp, Homo sapiens
tggagactcctggtctgtg

SEQ ID NO: 3157010 - DNA, 20 bp, Homo sapiens
tggagactcctggtctgtga

SEQ ID NO: 3157011 - DNA, 21 bp, Homo sapiens
tggagactggggtggcctcaa

SEQ ID NO: 3157012 - DNA, 14 bp, Homo sapiens
tggagactgtctca

SEQ ID NO: 3157013 - DNA, 16 bp, Homo sapiens
tggagacttagggcac

SEQ ID NO: 3157014 - DNA, 21 bp, Homo sapiens
tggagacttagggcaccaggg

SEQ ID NO: 3157015 - DNA, 13 bp, Homo sapiens
tggagagaagctg

SEQ ID NO: 3157016 - DNA, 11 bp, Homo sapiens
tggagaggaac

SEQ ID NO: 3157017 - DNA, 22 bp, Homo sapiens
tggagaggagggatgctgcctg

SEQ ID NO: 3157018 - DNA, 13 bp, Homo sapiens
tggagaggcggcc

SEQ ID NO: 3157019 - DNA, 14 bp, Homo sapiens
tggagaggcggcct

SEQ ID NO: 3157020 - DNA, 15 bp, Homo sapiens
tggagaggcggcctc

SEQ ID NO: 3157021 - DNA, 20 bp, Homo sapiens
tggagagggacagcccactg

SEQ ID NO: 3157022 - DNA, 19 bp, Homo sapiens
tggagagggctctgtgctg

SEQ ID NO: 3157023 - DNA, 22 bp, Homo sapiens
tggagaggttataggtcactcc

SEQ ID NO: 3157024 - DNA, 15 bp, Homo sapiens
tggagagtaaaaact

SEQ ID NO: 3157025 - DNA, 14 bp, Homo sapiens
tggagatcctcctg

SEQ ID NO: 3157026 - DNA, 20 bp, Homo sapiens
tggagatcctcctgcagacc

SEQ ID NO: 3157027 - DNA, 21 bp, Homo sapiens
tggagatgcatcgggaaagaa

SEQ ID NO: 3157028 - DNA, 18 bp, Homo sapiens
tggagcaaaaggcagctc

SEQ ID NO: 3157029 - DNA, 17 bp, Homo sapiens
tggagcacaaaattcaa

SEQ ID NO: 3157030 - DNA, 14 bp, Homo sapiens
tggagcagctgcag

SEQ ID NO: 3157031 - DNA, 19 bp, Homo sapiens
tggagcaggagccccgcca

SEQ ID NO: 3157032 - DNA, 18 bp, Homo sapiens
tggagcaggcggtgggga

SEQ ID NO: 3157033 - DNA, 14 bp, Homo sapiens
tggagcatgcagag

SEQ ID NO: 3157034 - DNA, 16 bp, Homo sapiens
tggagccaactgctgc

SEQ ID NO: 3157035 - DNA, 17 bp, Homo sapiens
tggagccactcctgtcc

SEQ ID NO: 3157036 - DNA, 14 bp, Homo sapiens
tggagccagggagc

SEQ ID NO: 3157037 - DNA, 12 bp, Homo sapiens
tggagcccccag

SEQ ID NO: 3157038 - DNA, 15 bp, Homo sapiens
tggagcccctgggtg

SEQ ID NO: 3157039 - DNA, 21 bp, Homo sapiens
tggagccctgttggcagctct

SEQ ID NO: 3157040 - DNA, 12 bp, Homo sapiens
tggagccgaggc

SEQ ID NO: 3157041 - DNA, 14 bp, Homo sapiens
tggagcctggcaca

SEQ ID NO: 3157042 - DNA, 19 bp, Homo sapiens
tggagcctggcacaggact

SEQ ID NO: 3157043 - DNA, 13 bp, Homo sapiens
tggagcggctgct

SEQ ID NO: 3157044 - DNA, 14 bp, Homo sapiens
tggagcggctgctc

SEQ ID NO: 3157045 - DNA, 22 bp, Homo sapiens
tggagcggctgctcgcccagga

SEQ ID NO: 3157046 - DNA, 12 bp, Homo sapiens
tggagctcagcc

SEQ ID NO: 3157047 - DNA, 13 bp, Homo sapiens
tggagctcagccc

SEQ ID NO: 3157048 - DNA, 19 bp, Homo sapiens
tggagctgccacagagaag

SEQ ID NO: 3157049 - DNA, 15 bp, Homo sapiens
tggagctggcgtctg

SEQ ID NO: 3157050 - DNA, 21 bp, Homo sapiens
tggagcttttttctttaagat

SEQ ID NO: 3157051 - DNA, 11 bp, Homo sapiens
tggaggaaaaa

SEQ ID NO: 3157052 - DNA, 21 bp, Homo sapiens
tggaggaaaaccaagccgtgg

SEQ ID NO: 3157053 - DNA, 19 bp, Homo sapiens
tggaggaacaactctccag

SEQ ID NO: 3157054 - DNA, 19 bp, Homo sapiens
tggaggaaggattgtaaaa

SEQ ID NO: 3157055 - DNA, 20 bp, Homo sapiens
tggaggaaggattgtaaaaa

SEQ ID NO: 3157056 - DNA, 18 bp, Homo sapiens
tggaggaaggtgctgagc

SEQ ID NO: 3157057 - DNA, 19 bp, Homo sapiens
tggaggaaggtgctgagct

SEQ ID NO: 3157058 - DNA, 16 bp, Homo sapiens
tggaggaattcagctc

SEQ ID NO: 3157059 - DNA, 16 bp, Homo sapiens
tggaggagcagcttcc

SEQ ID NO: 3157060 - DNA, 22 bp, Homo sapiens
tggaggagcttgggggatgact

SEQ ID NO: 3157061 - DNA, 14 bp, Homo sapiens
tggaggaggaaggc

SEQ ID NO: 3157062 - DNA, 20 bp, Homo sapiens
tggaggagggtttgggcaga

SEQ ID NO: 3157063 - DNA, 21 bp, Homo sapiens
tggaggagggtttgggcagag

SEQ ID NO: 3157064 - DNA, 20 bp, Homo sapiens
tggaggatggagagagggga

SEQ ID NO: 3157065 - DNA, 14 bp, Homo sapiens
tggaggcactttag

SEQ ID NO: 3157066 - DNA, 11 bp, Homo sapiens
tggaggcagag

SEQ ID NO: 3157067 - DNA, 20 bp, Homo sapiens
tggaggcattgatgcatgct

SEQ ID NO: 3157068 - DNA, 12 bp, Homo sapiens
tggaggcccagg

SEQ ID NO: 3157069 - DNA, 17 bp, Homo sapiens
tggaggcctctggccct

SEQ ID NO: 3157070 - DNA, 16 bp, Homo sapiens
tggaggctccaggact

SEQ ID NO: 3157071 - DNA, 13 bp, Homo sapiens
tggaggcttcctg

SEQ ID NO: 3157072 - DNA, 22 bp, Homo sapiens
tggaggcttcctgcgtcctcct

SEQ ID NO: 3157073 - DNA, 18 bp, Homo sapiens
tggagggagggggaagtc

SEQ ID NO: 3157074 - DNA, 16 bp, Homo sapiens
tggagggcacagccct

SEQ ID NO: 3157075 - DNA, 15 bp, Homo sapiens
tggagggcttggccc

SEQ ID NO: 3157076 - DNA, 20 bp, Homo sapiens
tggagggggctgggctcaca

SEQ ID NO: 3157077 - DNA, 19 bp, Homo sapiens
tggaggggggtgctggccc

SEQ ID NO: 3157078 - DNA, 13 bp, Homo sapiens
tggaggggtgtgg

SEQ ID NO: 3157079 - DNA, 17 bp, Homo sapiens
tggaggggtgtggcagt

SEQ ID NO: 3157080 - DNA, 23 bp, Homo sapiens
tggaggggtgtggctccttccca

SEQ ID NO: 3157081 - DNA, 15 bp, Homo sapiens
tggaggtctccaggg

SEQ ID NO: 3157082 - DNA, 20 bp, Homo sapiens
tggaggtgagatcacagcct

SEQ ID NO: 3157083 - DNA, 13 bp, Homo sapiens
tggaggtgggagc

SEQ ID NO: 3157084 - DNA, 18 bp, Homo sapiens
tggaggtgggagcaggag

SEQ ID NO: 3157085 - DNA, 14 bp, Homo sapiens
tggaggtgggcatg

SEQ ID NO: 3157086 - DNA, 14 bp, Homo sapiens
tggaggtggggaag

SEQ ID NO: 3157087 - DNA, 22 bp, Homo sapiens
tggaggtggggcgaggcaggcc

SEQ ID NO: 3157088 - DNA, 18 bp, Homo sapiens
tggaggttctcagagcca

SEQ ID NO: 3157089 - DNA, 23 bp, Homo sapiens
tggaggttctcagagccaagtcc

SEQ ID NO: 3157090 - DNA, 17 bp, Homo sapiens
tggaggttgaagccaag

SEQ ID NO: 3157091 - DNA, 22 bp, Homo sapiens
tggagtcagtaggtccaagggc

SEQ ID NO: 3157092 - DNA, 21 bp, Homo sapiens
tggagtcccctcacctcctct

SEQ ID NO: 3157093 - DNA, 16 bp, Homo sapiens
tggagtctgagtctga

SEQ ID NO: 3157094 - DNA, 18 bp, Homo sapiens
tggagtctggagtgggca

SEQ ID NO: 3157095 - DNA, 14 bp, Homo sapiens
tggagtctggcttt

SEQ ID NO: 3157096 - DNA, 21 bp, Homo sapiens
tggagtgaggcttccaggctc

SEQ ID NO: 3157097 - DNA, 22 bp, Homo sapiens
tggagtgatatgatccagagca

SEQ ID NO: 3157098 - DNA, 15 bp, Homo sapiens
tggagtgcagggagg

SEQ ID NO: 3157099 - DNA, 15 bp, Homo sapiens
tggagtgcgctcttg

SEQ ID NO: 3157100 - DNA, 19 bp, Homo sapiens
tggagtgtatgactgcaca

SEQ ID NO: 3157101 - DNA, 15 bp, Homo sapiens
tggagtgtgagccac

SEQ ID NO: 3157102 - DNA, 15 bp, Homo sapiens
tggagtgtgtattgt

SEQ ID NO: 3157103 - DNA, 24 bp, Homo sapiens
tggagtgtttctaataaacttgga

SEQ ID NO: 3157104 - DNA, 22 bp, Homo sapiens
tggagttgaaagagttaagaat

SEQ ID NO: 3157105 - DNA, 19 bp, Homo sapiens
tggagtttaatacagtgag

SEQ ID NO: 3157106 - DNA, 16 bp, Homo sapiens
tggagtttctaaggtc

SEQ ID NO: 3157107 - DNA, 14 bp, Homo sapiens
tggataaatcattt

SEQ ID NO: 3157108 - DNA, 17 bp, Homo sapiens
tggataaattgtttagt

SEQ ID NO: 3157109 - DNA, 19 bp, Homo sapiens
tggataagtttctattctg

SEQ ID NO: 3157110 - DNA, 17 bp, Homo sapiens
tggataatattcattgg

SEQ ID NO: 3157111 - DNA, 13 bp, Homo sapiens
tggatactgtaga

SEQ ID NO: 3157112 - DNA, 15 bp, Homo sapiens
tggatacttggattt

SEQ ID NO: 3157113 - DNA, 15 bp, Homo sapiens
tggatataaaatgtg

SEQ ID NO: 3157114 - DNA, 16 bp, Homo sapiens
tggatatagttttact

SEQ ID NO: 3157115 - DNA, 21 bp, Homo sapiens
tggatatttgcacttatgtac

SEQ ID NO: 3157116 - DNA, 23 bp, Homo sapiens
tggatatttgcacttatgtactt

SEQ ID NO: 3157117 - DNA, 18 bp, Homo sapiens
tggatattttcaaattgt

SEQ ID NO: 3157118 - DNA, 18 bp, Homo sapiens
tggatatttttgtacttg

SEQ ID NO: 3157119 - DNA, 16 bp, Homo sapiens
tggatcacaagatgga

SEQ ID NO: 3157120 - DNA, 19 bp, Homo sapiens
tggatcacgacgctgcaga

SEQ ID NO: 3157121 - DNA, 19 bp, Homo sapiens
tggatcagtcctttgatca

SEQ ID NO: 3157122 - DNA, 14 bp, Homo sapiens
tggatccagcactg

SEQ ID NO: 3157123 - DNA, 20 bp, Homo sapiens
tggatcccctctgtctacaa

SEQ ID NO: 3157124 - DNA, 18 bp, Homo sapiens
tggatcccctgcggtcag

SEQ ID NO: 3157125 - DNA, 19 bp, Homo sapiens
tggatcgctaagctggctc

SEQ ID NO: 3157126 - DNA, 18 bp, Homo sapiens
tggatcttcaatggcttt

SEQ ID NO: 3157127 - DNA, 23 bp, Homo sapiens
tggatcttcagaactgcccttgc

SEQ ID NO: 3157128 - DNA, 14 bp, Homo sapiens
tggatcttgaatgt

SEQ ID NO: 3157129 - DNA, 16 bp, Homo sapiens
tggatcttgaatgtgg

SEQ ID NO: 3157130 - DNA, 12 bp, Homo sapiens
tggatcttgcca

SEQ ID NO: 3157131 - DNA, 14 bp, Homo sapiens
tggatcttgccaca

SEQ ID NO: 3157132 - DNA, 15 bp, Homo sapiens
tggatcttgccacat

SEQ ID NO: 3157133 - DNA, 21 bp, Homo sapiens
tggatcttttgaagggagaag

SEQ ID NO: 3157134 - DNA, 15 bp, Homo sapiens
tggatgaaattttct

SEQ ID NO: 3157135 - DNA, 17 bp, Homo sapiens
tggatgaaattttctag

SEQ ID NO: 3157136 - DNA, 19 bp, Homo sapiens
tggatgaagattctcctgt

SEQ ID NO: 3157137 - DNA, 12 bp, Homo sapiens
tggatgactgtt

SEQ ID NO: 3157138 - DNA, 17 bp, Homo sapiens
tggatgactgttgatga

SEQ ID NO: 3157139 - DNA, 21 bp, Homo sapiens
tggatgagaaacagctcagcc

SEQ ID NO: 3157140 - DNA, 20 bp, Homo sapiens
tggatgagacttccaaacct

SEQ ID NO: 3157141 - DNA, 18 bp, Homo sapiens
tggatgaggcacttctgt

SEQ ID NO: 3157142 - DNA, 22 bp, Homo sapiens
tggatgaggcacttctgtcaat

SEQ ID NO: 3157143 - DNA, 15 bp, Homo sapiens
tggatgattaaattt

SEQ ID NO: 3157144 - DNA, 17 bp, Homo sapiens
tggatgatttcatcttc

SEQ ID NO: 3157145 - DNA, 21 bp, Homo sapiens
tggatgatttcatcttctgga

SEQ ID NO: 3157146 - DNA, 22 bp, Homo sapiens
tggatgcatttcaaatgttaga

SEQ ID NO: 3157147 - DNA, 18 bp, Homo sapiens
tggatgcctggtggcagc

SEQ ID NO: 3157148 - DNA, 16 bp, Homo sapiens
tggatgcgaggaccac

SEQ ID NO: 3157149 - DNA, 15 bp, Homo sapiens
tggatggaaggagac

SEQ ID NO: 3157150 - DNA, 15 bp, Homo sapiens
tggatggagcccagg

SEQ ID NO: 3157151 - DNA, 14 bp, Homo sapiens
tggatggcacaatg

SEQ ID NO: 3157152 - DNA, 20 bp, Homo sapiens
tggatggcacaatgaatgta

SEQ ID NO: 3157153 - DNA, 15 bp, Homo sapiens
tggatggcagactct

SEQ ID NO: 3157154 - DNA, 15 bp, Homo sapiens
tggatggccccagca

SEQ ID NO: 3157155 - DNA, 23 bp, Homo sapiens
tggatggcttgtctatactcctt

SEQ ID NO: 3157156 - DNA, 17 bp, Homo sapiens
tggatgggaatttgtca

SEQ ID NO: 3157157 - DNA, 19 bp, Homo sapiens
tggatgtaattagctctgg

SEQ ID NO: 3157158 - DNA, 22 bp, Homo sapiens
tggatgtaattagctctggggg

SEQ ID NO: 3157159 - DNA, 15 bp, Homo sapiens
tggatgtgttcattc

SEQ ID NO: 3157160 - DNA, 12 bp, Homo sapiens
tggattaaaaca

SEQ ID NO: 3157161 - DNA, 13 bp, Homo sapiens
tggattaaaacaa

SEQ ID NO: 3157162 - DNA, 15 bp, Homo sapiens
tggattaaaacaatt

SEQ ID NO: 3157163 - DNA, 16 bp, Homo sapiens
tggattagaaatttaa

SEQ ID NO: 3157164 - DNA, 18 bp, Homo sapiens
tggattagaaatttaaca

SEQ ID NO: 3157165 - DNA, 22 bp, Homo sapiens
tggattataaaaaatgtaacat

SEQ ID NO: 3157166 - DNA, 22 bp, Homo sapiens
tggattatagagtatactaaaa

SEQ ID NO: 3157167 - DNA, 21 bp, Homo sapiens
tggattatgttatacaaggca

SEQ ID NO: 3157168 - DNA, 22 bp, Homo sapiens
tggattatgttatacaaggcaa

SEQ ID NO: 3157169 - DNA, 13 bp, Homo sapiens
tggattattcatt

SEQ ID NO: 3157170 - DNA, 13 bp, Homo sapiens
tggattatttaat

SEQ ID NO: 3157171 - DNA, 17 bp, Homo sapiens
tggattatttaataaca

SEQ ID NO: 3157172 - DNA, 13 bp, Homo sapiens
tggattcaattac

SEQ ID NO: 3157173 - DNA, 14 bp, Homo sapiens
tggattcattgtct

SEQ ID NO: 3157174 - DNA, 16 bp, Homo sapiens
tggattcattgtctct

SEQ ID NO: 3157175 - DNA, 17 bp, Homo sapiens
tggattcctcacagcct

SEQ ID NO: 3157176 - DNA, 21 bp, Homo sapiens
tggattctcttagctactgta

SEQ ID NO: 3157177 - DNA, 17 bp, Homo sapiens
tggattcttatgtagca

SEQ ID NO: 3157178 - DNA, 17 bp, Homo sapiens
tggattgcacgtggcct

SEQ ID NO: 3157179 - DNA, 21 bp, Homo sapiens
tggattgcacgtggcctcttg

SEQ ID NO: 3157180 - DNA, 15 bp, Homo sapiens
tggattggattattt

SEQ ID NO: 3157181 - DNA, 17 bp, Homo sapiens
tggattggattatttaa

SEQ ID NO: 3157182 - DNA, 21 bp, Homo sapiens
tggattggattatttaataac

SEQ ID NO: 3157183 - DNA, 23 bp, Homo sapiens
tggattggattatttaataacat

SEQ ID NO: 3157184 - DNA, 16 bp, Homo sapiens
tggatttaaaagcctg

SEQ ID NO: 3157185 - DNA, 15 bp, Homo sapiens
tggatttcctaatac

SEQ ID NO: 3157186 - DNA, 13 bp, Homo sapiens
tggatttgacatt

SEQ ID NO: 3157187 - DNA, 14 bp, Homo sapiens
tggatttgacattg

SEQ ID NO: 3157188 - DNA, 24 bp, Homo sapiens
tggatttgatgagttaactgtgaa

SEQ ID NO: 3157189 - DNA, 13 bp, Homo sapiens
tggatttgatgct

SEQ ID NO: 3157190 - DNA, 18 bp, Homo sapiens
tggatttgcctgtgccac

SEQ ID NO: 3157191 - DNA, 19 bp, Homo sapiens
tggatttgctcattgctgt

SEQ ID NO: 3157192 - DNA, 18 bp, Homo sapiens
tggatttggcactagcca

SEQ ID NO: 3157193 - DNA, 21 bp, Homo sapiens
tggatttggcactagccaaag

SEQ ID NO: 3157194 - DNA, 15 bp, Homo sapiens
tggattttctactgt

SEQ ID NO: 3157195 - DNA, 16 bp, Homo sapiens
tggattttctactgta

SEQ ID NO: 3157196 - DNA, 18 bp, Homo sapiens
tggatttttctttaactg

SEQ ID NO: 3157197 - DNA, 15 bp, Homo sapiens
tggcaaaagccttgt

SEQ ID NO: 3157198 - DNA, 12 bp, Homo sapiens
tggcaaaataaa

SEQ ID NO: 3157199 - DNA, 17 bp, Homo sapiens
tggcaaaataaaacatg

SEQ ID NO: 3157200 - DNA, 16 bp, Homo sapiens
tggcaaaatatggttt

SEQ ID NO: 3157201 - DNA, 24 bp, Homo sapiens
tggcaaacgctaaagagcccttgc

SEQ ID NO: 3157202 - DNA, 17 bp, Homo sapiens
tggcaaagcttttagaa

SEQ ID NO: 3157203 - DNA, 17 bp, Homo sapiens
tggcaaaggaaggtgga

SEQ ID NO: 3157204 - DNA, 21 bp, Homo sapiens
tggcaaatggaggcttttcac

SEQ ID NO: 3157205 - DNA, 23 bp, Homo sapiens
tggcaaatgtaactgtgccagtt

SEQ ID NO: 3157206 - DNA, 13 bp, Homo sapiens
tggcaacacagag

SEQ ID NO: 3157207 - DNA, 12 bp, Homo sapiens
tggcaacagaag

SEQ ID NO: 3157208 - DNA, 13 bp, Homo sapiens
tggcaacagaagc

SEQ ID NO: 3157209 - DNA, 15 bp, Homo sapiens
tggcaagaacttgtt

SEQ ID NO: 3157210 - DNA, 17 bp, Homo sapiens
tggcaagaacttgttta

SEQ ID NO: 3157211 - DNA, 20 bp, Homo sapiens
tggcaagaggcctcatgcct

SEQ ID NO: 3157212 - DNA, 18 bp, Homo sapiens
tggcaagagggtgacagc

SEQ ID NO: 3157213 - DNA, 17 bp, Homo sapiens
tggcaagagtgtggagg

SEQ ID NO: 3157214 - DNA, 22 bp, Homo sapiens
tggcaagcagggaaagctccac

SEQ ID NO: 3157215 - DNA, 13 bp, Homo sapiens
tggcaagctgtga

SEQ ID NO: 3157216 - DNA, 11 bp, Homo sapiens
tggcaaggaaa

SEQ ID NO: 3157217 - DNA, 12 bp, Homo sapiens
tggcaatagacc

SEQ ID NO: 3157218 - DNA, 20 bp, Homo sapiens
tggcaatagtgggccctccg

SEQ ID NO: 3157219 - DNA, 17 bp, Homo sapiens
tggcaatagtgtgttct

SEQ ID NO: 3157220 - DNA, 16 bp, Homo sapiens
tggcaatgcttaaact

SEQ ID NO: 3157221 - DNA, 21 bp, Homo sapiens
tggcaatgcttaaactaaata

SEQ ID NO: 3157222 - DNA, 20 bp, Homo sapiens
tggcaattcctcttcattgt

SEQ ID NO: 3157223 - DNA, 14 bp, Homo sapiens
tggcaattgtctat

SEQ ID NO: 3157224 - DNA, 16 bp, Homo sapiens
tggcaattgtctattt

SEQ ID NO: 3157225 - DNA, 18 bp, Homo sapiens
tggcaattgtctatttat

SEQ ID NO: 3157226 - DNA, 21 bp, Homo sapiens
tggcaatttcctggccctcca

SEQ ID NO: 3157227 - DNA, 13 bp, Homo sapiens
tggcaattttgta

SEQ ID NO: 3157228 - DNA, 15 bp, Homo sapiens
tggcaattttgtaac

SEQ ID NO: 3157229 - DNA, 14 bp, Homo sapiens
tggcacagaaacac

SEQ ID NO: 3157230 - DNA, 15 bp, Homo sapiens
tggcacaggactgat

SEQ ID NO: 3157231 - DNA, 21 bp, Homo sapiens
tggcacaggagtgtcctcttc

SEQ ID NO: 3157232 - DNA, 16 bp, Homo sapiens
tggcacaggccccctt

SEQ ID NO: 3157233 - DNA, 15 bp, Homo sapiens
tggcacagggcagtg

SEQ ID NO: 3157234 - DNA, 20 bp, Homo sapiens
tggcaccaaagatgcagccg

SEQ ID NO: 3157235 - DNA, 14 bp, Homo sapiens
tggcaccagatgca

SEQ ID NO: 3157236 - DNA, 19 bp, Homo sapiens
tggcaccagatgcaacctc

SEQ ID NO: 3157237 - DNA, 12 bp, Homo sapiens
tggcaccagccc

SEQ ID NO: 3157238 - DNA, 15 bp, Homo sapiens
tggcaccagccccct

SEQ ID NO: 3157239 - DNA, 19 bp, Homo sapiens
tggcaccagccccctggat

SEQ ID NO: 3157240 - DNA, 22 bp, Homo sapiens
tggcacccaccgtggaggagga

SEQ ID NO: 3157241 - DNA, 13 bp, Homo sapiens
tggcacctcctga

SEQ ID NO: 3157242 - DNA, 15 bp, Homo sapiens
tggcacctcctgaga

SEQ ID NO: 3157243 - DNA, 22 bp, Homo sapiens
tggcaccttcagactttgcttc

SEQ ID NO: 3157244 - DNA, 22 bp, Homo sapiens
tggcactaacgttgagcccctg

SEQ ID NO: 3157245 - DNA, 21 bp, Homo sapiens
tggcactataatgtaagctct

SEQ ID NO: 3157246 - DNA, 19 bp, Homo sapiens
tggcactgactgggcatag

SEQ ID NO: 3157247 - DNA, 15 bp, Homo sapiens
tggcactgagccccc

SEQ ID NO: 3157248 - DNA, 13 bp, Homo sapiens
tggcactggatgc

SEQ ID NO: 3157249 - DNA, 20 bp, Homo sapiens
tggcactggcattgtccctg

SEQ ID NO: 3157250 - DNA, 16 bp, Homo sapiens
tggcacttaagtgcac

SEQ ID NO: 3157251 - DNA, 23 bp, Homo sapiens
tggcacttagcccaagaggtctg

SEQ ID NO: 3157252 - DNA, 12 bp, Homo sapiens
tggcacttgtat

SEQ ID NO: 3157253 - DNA, 18 bp, Homo sapiens
tggcacttgtatttaatt

SEQ ID NO: 3157254 - DNA, 21 bp, Homo sapiens
tggcactttttcatttgccta

SEQ ID NO: 3157255 - DNA, 13 bp, Homo sapiens
tggcagaaaagag

SEQ ID NO: 3157256 - DNA, 22 bp, Homo sapiens
tggcagaaaagaggagaccctg

SEQ ID NO: 3157257 - DNA, 24 bp, Homo sapiens
tggcagaaaagaggagaccctgga

SEQ ID NO: 3157258 - DNA, 15 bp, Homo sapiens
tggcagaagggaatt

SEQ ID NO: 3157259 - DNA, 12 bp, Homo sapiens
tggcagagaagg

SEQ ID NO: 3157260 - DNA, 14 bp, Homo sapiens
tggcagagaaggcc

SEQ ID NO: 3157261 - DNA, 16 bp, Homo sapiens
tggcagagaaggcctc

SEQ ID NO: 3157262 - DNA, 19 bp, Homo sapiens
tggcagagaaggcctcttg

SEQ ID NO: 3157263 - DNA, 12 bp, Homo sapiens
tggcagagagag

SEQ ID NO: 3157264 - DNA, 18 bp, Homo sapiens
tggcagagagagagaaag

SEQ ID NO: 3157265 - DNA, 17 bp, Homo sapiens
tggcagagttacagttc

SEQ ID NO: 3157266 - DNA, 19 bp, Homo sapiens
tggcagagttacagttctg

SEQ ID NO: 3157267 - DNA, 18 bp, Homo sapiens
tggcagagtttgtgtgtt

SEQ ID NO: 3157268 - DNA, 22 bp, Homo sapiens
tggcagagtttgtgtgttgtct

SEQ ID NO: 3157269 - DNA, 20 bp, Homo sapiens
tggcagataatcagcctctt

SEQ ID NO: 3157270 - DNA, 17 bp, Homo sapiens
tggcagattttacaaaa

SEQ ID NO: 3157271 - DNA, 13 bp, Homo sapiens
tggcagcacagcc

SEQ ID NO: 3157272 - DNA, 14 bp, Homo sapiens
tggcagcacagccc

SEQ ID NO: 3157273 - DNA, 17 bp, Homo sapiens
tggcagcacagcccagg

SEQ ID NO: 3157274 - DNA, 19 bp, Homo sapiens
tggcagcacagcccagggc

SEQ ID NO: 3157275 - DNA, 13 bp, Homo sapiens
tggcagccatgcc

SEQ ID NO: 3157276 - DNA, 15 bp, Homo sapiens
tggcagccatgcctc

SEQ ID NO: 3157277 - DNA, 20 bp, Homo sapiens
tggcagccatgcctcatgcc

SEQ ID NO: 3157278 - DNA, 12 bp, Homo sapiens
tggcagccctgt

SEQ ID NO: 3157279 - DNA, 14 bp, Homo sapiens
tggcagctagtgcc

SEQ ID NO: 3157280 - DNA, 14 bp, Homo sapiens
tggcagctcctctc

SEQ ID NO: 3157281 - DNA, 23 bp, Homo sapiens
tggcagctcctctccttgggctc

SEQ ID NO: 3157282 - DNA, 17 bp, Homo sapiens
tggcagctgagagccct

SEQ ID NO: 3157283 - DNA, 17 bp, Homo sapiens
tggcagctgcggtccac

SEQ ID NO: 3157284 - DNA, 21 bp, Homo sapiens
tggcagctgcggtccacccag

SEQ ID NO: 3157285 - DNA, 23 bp, Homo sapiens
tggcagctgcggtccacccagga

SEQ ID NO: 3157286 - DNA, 13 bp, Homo sapiens
tggcagctgcttt

SEQ ID NO: 3157287 - DNA, 14 bp, Homo sapiens
tggcaggatgctga

SEQ ID NO: 3157288 - DNA, 20 bp, Homo sapiens
tggcaggcacacagcagccc

SEQ ID NO: 3157289 - DNA, 15 bp, Homo sapiens
tggcaggcagcgcca

SEQ ID NO: 3157290 - DNA, 23 bp, Homo sapiens
tggcaggcagcgccaagcaacct

SEQ ID NO: 3157291 - DNA, 14 bp, Homo sapiens
tggcaggccagtgt

SEQ ID NO: 3157292 - DNA, 16 bp, Homo sapiens
tggcaggccagtgtct

SEQ ID NO: 3157293 - DNA, 13 bp, Homo sapiens
tggcaggctggcc

SEQ ID NO: 3157294 - DNA, 11 bp, Homo sapiens
tggcagggctc

SEQ ID NO: 3157295 - DNA, 22 bp, Homo sapiens
tggcagtctgaatttttaaaac

SEQ ID NO: 3157296 - DNA, 14 bp, Homo sapiens
tggcagtgactttg

SEQ ID NO: 3157297 - DNA, 14 bp, Homo sapiens
tggcagtgagtgag

SEQ ID NO: 3157298 - DNA, 23 bp, Homo sapiens
tggcagtgagtgagcctggctct

SEQ ID NO: 3157299 - DNA, 12 bp, Homo sapiens
tggcagtggagg

SEQ ID NO: 3157300 - DNA, 15 bp, Homo sapiens
tggcagtggcagaga

SEQ ID NO: 3157301 - DNA, 20 bp, Homo sapiens
tggcagtgggagctgcctgt

SEQ ID NO: 3157302 - DNA, 15 bp, Homo sapiens
tggcataaattgcat

SEQ ID NO: 3157303 - DNA, 15 bp, Homo sapiens
tggcatagccccggc

SEQ ID NO: 3157304 - DNA, 15 bp, Homo sapiens
tggcatcacagggca

SEQ ID NO: 3157305 - DNA, 17 bp, Homo sapiens
tggcatcctccggagag

SEQ ID NO: 3157306 - DNA, 22 bp, Homo sapiens
tggcatcgcaccattctgactc

SEQ ID NO: 3157307 - DNA, 23 bp, Homo sapiens
tggcatcgcaccattctgactcg

SEQ ID NO: 3157308 - DNA, 23 bp, Homo sapiens
tggcatcgtagaagagatgtggc

SEQ ID NO: 3157309 - DNA, 22 bp, Homo sapiens
tggcatctgaatgaaaataact

SEQ ID NO: 3157310 - DNA, 15 bp, Homo sapiens
tggcatctgacacaa

SEQ ID NO: 3157311 - DNA, 22 bp, Homo sapiens
tggcatcttcgtcttcactctt

SEQ ID NO: 3157312 - DNA, 20 bp, Homo sapiens
tggcatctttgccttgggct

SEQ ID NO: 3157313 - DNA, 19 bp, Homo sapiens
tggcatcttttggaggaaa

SEQ ID NO: 3157314 - DNA, 19 bp, Homo sapiens
tggcatgggcgcaggccca

SEQ ID NO: 3157315 - DNA, 17 bp, Homo sapiens
tggcatgtggcctgtgg

SEQ ID NO: 3157316 - DNA, 13 bp, Homo sapiens
tggcatgttttct

SEQ ID NO: 3157317 - DNA, 18 bp, Homo sapiens
tggcattaccctctgcag

SEQ ID NO: 3157318 - DNA, 18 bp, Homo sapiens
tggcattatgtccactgt

SEQ ID NO: 3157319 - DNA, 16 bp, Homo sapiens
tggcattgtccctgtg

SEQ ID NO: 3157320 - DNA, 19 bp, Homo sapiens
tggcattgtccctgtgcct

SEQ ID NO: 3157321 - DNA, 15 bp, Homo sapiens
tggcatttccctact

SEQ ID NO: 3157322 - DNA, 16 bp, Homo sapiens
tggccaaacatcagac

SEQ ID NO: 3157323 - DNA, 23 bp, Homo sapiens
tggccaaagccaaagctaggcct

SEQ ID NO: 3157324 - DNA, 14 bp, Homo sapiens
tggccaaagtgtta

SEQ ID NO: 3157325 - DNA, 18 bp, Homo sapiens
tggccaaattatttgtgt

SEQ ID NO: 3157326 - DNA, 23 bp, Homo sapiens
tggccaactgcaaaaaaagcctc

SEQ ID NO: 3157327 - DNA, 16 bp, Homo sapiens
tggccaagggggtgga

SEQ ID NO: 3157328 - DNA, 14 bp, Homo sapiens
tggccacagccccc

SEQ ID NO: 3157329 - DNA, 15 bp, Homo sapiens
tggccacagccccct

SEQ ID NO: 3157330 - DNA, 19 bp, Homo sapiens
tggccacagcccccttgcc

SEQ ID NO: 3157331 - DNA, 17 bp, Homo sapiens
tggccacagtagtcttg

SEQ ID NO: 3157332 - DNA, 15 bp, Homo sapiens
tggccaccaggctgg

SEQ ID NO: 3157333 - DNA, 21 bp, Homo sapiens
tggccaccaggctggcgcagc

SEQ ID NO: 3157334 - DNA, 23 bp, Homo sapiens
tggccaccaggctggcgcagcca

SEQ ID NO: 3157335 - DNA, 15 bp, Homo sapiens
tggccacccctcccc

SEQ ID NO: 3157336 - DNA, 16 bp, Homo sapiens
tggccacccctcccca

SEQ ID NO: 3157337 - DNA, 19 bp, Homo sapiens
tggccacccgttctgctgg

SEQ ID NO: 3157338 - DNA, 17 bp, Homo sapiens
tggccacctgaggtggg

SEQ ID NO: 3157339 - DNA, 23 bp, Homo sapiens
tggccacctgaggtgggcccagg

SEQ ID NO: 3157340 - DNA, 22 bp, Homo sapiens
tggccactccagacccctggct

SEQ ID NO: 3157341 - DNA, 18 bp, Homo sapiens
tggccactccgagaggtg

SEQ ID NO: 3157342 - DNA, 14 bp, Homo sapiens
tggccactgcacag

SEQ ID NO: 3157343 - DNA, 19 bp, Homo sapiens
tggccactgcacagagctc

SEQ ID NO: 3157344 - DNA, 15 bp, Homo sapiens
tggccagacgctgcc

SEQ ID NO: 3157345 - DNA, 13 bp, Homo sapiens
tggccagagaggg

SEQ ID NO: 3157346 - DNA, 13 bp, Homo sapiens
tggccagagctgg

SEQ ID NO: 3157347 - DNA, 21 bp, Homo sapiens
tggccagagctggaaggcagg

SEQ ID NO: 3157348 - DNA, 14 bp, Homo sapiens
tggccagagctggg

SEQ ID NO: 3157349 - DNA, 20 bp, Homo sapiens
tggccagagctgggaggcat

SEQ ID NO: 3157350 - DNA, 16 bp, Homo sapiens
tggccagcaaggcagg

SEQ ID NO: 3157351 - DNA, 17 bp, Homo sapiens
tggccagcaaggcaggt

SEQ ID NO: 3157352 - DNA, 13 bp, Homo sapiens
tggccagcaccct

SEQ ID NO: 3157353 - DNA, 18 bp, Homo sapiens
tggccagcaccctctcct

SEQ ID NO: 3157354 - DNA, 13 bp, Homo sapiens
tggccagcccggc

SEQ ID NO: 3157355 - DNA, 22 bp, Homo sapiens
tggccagcccttcctctcactc

SEQ ID NO: 3157356 - DNA, 16 bp, Homo sapiens
tggccagcctggatct

SEQ ID NO: 3157357 - DNA, 15 bp, Homo sapiens
tggccagcctggggc

SEQ ID NO: 3157358 - DNA, 23 bp, Homo sapiens
tggccagcctggggcctggcagg

SEQ ID NO: 3157359 - DNA, 12 bp, Homo sapiens
tggccaggagca

SEQ ID NO: 3157360 - DNA, 16 bp, Homo sapiens
tggccaggagctcttc

SEQ ID NO: 3157361 - DNA, 23 bp, Homo sapiens
tggccaggataatatatttgcag

SEQ ID NO: 3157362 - DNA, 20 bp, Homo sapiens
tggccaggcagatctgtgcc

SEQ ID NO: 3157363 - DNA, 19 bp, Homo sapiens
tggccaggcctcttggcag

SEQ ID NO: 3157364 - DNA, 13 bp, Homo sapiens
tggccaggctggt

SEQ ID NO: 3157365 - DNA, 15 bp, Homo sapiens
tggccaggctggtct

SEQ ID NO: 3157366 - DNA, 19 bp, Homo sapiens
tggccagggcagggccacc

SEQ ID NO: 3157367 - DNA, 15 bp, Homo sapiens
tggccaggtggccac

SEQ ID NO: 3157368 - DNA, 16 bp, Homo sapiens
tggccagtccaggctg

SEQ ID NO: 3157369 - DNA, 21 bp, Homo sapiens
tggccagtccaggctgccgtg

SEQ ID NO: 3157370 - DNA, 23 bp, Homo sapiens
tggccagtccaggctgccgtggg

SEQ ID NO: 3157371 - DNA, 14 bp, Homo sapiens
tggccagtgtcatt

SEQ ID NO: 3157372 - DNA, 14 bp, Homo sapiens
tggccagtgtctgt

SEQ ID NO: 3157373 - DNA, 17 bp, Homo sapiens
tggccagttgcccagag

SEQ ID NO: 3157374 - DNA, 16 bp, Homo sapiens
tggccagttggaacca

SEQ ID NO: 3157375 - DNA, 19 bp, Homo sapiens
tggccataggagaggaggg

SEQ ID NO: 3157376 - DNA, 12 bp, Homo sapiens
tggccatccctg

SEQ ID NO: 3157377 - DNA, 13 bp, Homo sapiens
tggccatccctgg

SEQ ID NO: 3157378 - DNA, 15 bp, Homo sapiens
tggccatccctgggc

SEQ ID NO: 3157379 - DNA, 19 bp, Homo sapiens
tggccatccctgggcccct

SEQ ID NO: 3157380 - DNA, 23 bp, Homo sapiens
tggccatccctgggcccctccac

SEQ ID NO: 3157381 - DNA, 18 bp, Homo sapiens
tggccatctccctcccca

SEQ ID NO: 3157382 - DNA, 20 bp, Homo sapiens
tggccatctccctccccaga

SEQ ID NO: 3157383 - DNA, 18 bp, Homo sapiens
tggccatggtaccccctt

SEQ ID NO: 3157384 - DNA, 20 bp, Homo sapiens
tggccattctttttttcttg

SEQ ID NO: 3157385 - DNA, 19 bp, Homo sapiens
tggcccacgccctccctct

SEQ ID NO: 3157386 - DNA, 13 bp, Homo sapiens
tggcccagccggc

SEQ ID NO: 3157387 - DNA, 17 bp, Homo sapiens
tggcccagccggcctct

SEQ ID NO: 3157388 - DNA, 18 bp, Homo sapiens
tggcccagccggcctctc

SEQ ID NO: 3157389 - DNA, 23 bp, Homo sapiens
tggcccagccggcctctctggcc

SEQ ID NO: 3157390 - DNA, 12 bp, Homo sapiens
tggcccagcctt

SEQ ID NO: 3157391 - DNA, 23 bp, Homo sapiens
tggcccaggaattagagaagctg

SEQ ID NO: 3157392 - DNA, 12 bp, Homo sapiens
tggcccagtgtc

SEQ ID NO: 3157393 - DNA, 19 bp, Homo sapiens
tggcccatctcagcctcct

SEQ ID NO: 3157394 - DNA, 20 bp, Homo sapiens
tggcccatctcagcctcctg

SEQ ID NO: 3157395 - DNA, 16 bp, Homo sapiens
tggccccaccctgggc

SEQ ID NO: 3157396 - DNA, 22 bp, Homo sapiens
tggccccaccctgggccctggg

SEQ ID NO: 3157397 - DNA, 19 bp, Homo sapiens
tggccccagccctgctggg

SEQ ID NO: 3157398 - DNA, 13 bp, Homo sapiens
tggcccccaataa

SEQ ID NO: 3157399 - DNA, 14 bp, Homo sapiens
tggcccccaataaa

SEQ ID NO: 3157400 - DNA, 16 bp, Homo sapiens
tggcccccaataaagg

SEQ ID NO: 3157401 - DNA, 17 bp, Homo sapiens
tggcccccaataaaggc

SEQ ID NO: 3157402 - DNA, 19 bp, Homo sapiens
tggcccccaataaaggcag

SEQ ID NO: 3157403 - DNA, 21 bp, Homo sapiens
tggcccccaggattcccccag

SEQ ID NO: 3157404 - DNA, 13 bp, Homo sapiens
tggcccccagggg

SEQ ID NO: 3157405 - DNA, 11 bp, Homo sapiens
tggccccctcc

SEQ ID NO: 3157406 - DNA, 15 bp, Homo sapiens
tggccccctccgtga

SEQ ID NO: 3157407 - DNA, 15 bp, Homo sapiens
tggccccgtttctgg

SEQ ID NO: 3157408 - DNA, 16 bp, Homo sapiens
tggccccgtttctggt

SEQ ID NO: 3157409 - DNA, 20 bp, Homo sapiens
tggcccctaggctgctgctg

SEQ ID NO: 3157410 - DNA, 12 bp, Homo sapiens
tggcccctctga

SEQ ID NO: 3157411 - DNA, 14 bp, Homo sapiens
tggcccctctgacc

SEQ ID NO: 3157412 - DNA, 15 bp, Homo sapiens
tggcccctgcccggc

SEQ ID NO: 3157413 - DNA, 16 bp, Homo sapiens
tggcccctgcccggct

SEQ ID NO: 3157414 - DNA, 20 bp, Homo sapiens
tggcccctgcccggctgcgg

SEQ ID NO: 3157415 - DNA, 14 bp, Homo sapiens
tggcccctgccttg

SEQ ID NO: 3157416 - DNA, 14 bp, Homo sapiens
tggcccggatgctg

SEQ ID NO: 3157417 - DNA, 11 bp, Homo sapiens
tggccctccac

SEQ ID NO: 3157418 - DNA, 23 bp, Homo sapiens
tggccctccaccttgttcctgcc

SEQ ID NO: 3157419 - DNA, 15 bp, Homo sapiens
tggccctccactcct

SEQ ID NO: 3157420 - DNA, 16 bp, Homo sapiens
tggccctcggtggctg

SEQ ID NO: 3157421 - DNA, 18 bp, Homo sapiens
tggccctgaggtgtgggg

SEQ ID NO: 3157422 - DNA, 23 bp, Homo sapiens
tggccctgaggtgtgggggctgc

SEQ ID NO: 3157423 - DNA, 13 bp, Homo sapiens
tggccctgcctcc

SEQ ID NO: 3157424 - DNA, 18 bp, Homo sapiens
tggccctgcctcctggga

SEQ ID NO: 3157425 - DNA, 14 bp, Homo sapiens
tggccctggctctg

SEQ ID NO: 3157426 - DNA, 12 bp, Homo sapiens
tggccctggggt

SEQ ID NO: 3157427 - DNA, 22 bp, Homo sapiens
tggccctgtccctcccacctct

SEQ ID NO: 3157428 - DNA, 23 bp, Homo sapiens
tggcccttgcagttcagcaccac

SEQ ID NO: 3157429 - DNA, 15 bp, Homo sapiens
tggcccttggaataa

SEQ ID NO: 3157430 - DNA, 16 bp, Homo sapiens
tggcccttggaataaa

SEQ ID NO: 3157431 - DNA, 19 bp, Homo sapiens
tggcccttggaataaagtt

SEQ ID NO: 3157432 - DNA, 15 bp, Homo sapiens
tggccctttcccctt

SEQ ID NO: 3157433 - DNA, 18 bp, Homo sapiens
tggccctttccttccaga

SEQ ID NO: 3157434 - DNA, 16 bp, Homo sapiens
tggccgactctgcact

SEQ ID NO: 3157435 - DNA, 13 bp, Homo sapiens
tggccgccacccc

SEQ ID NO: 3157436 - DNA, 16 bp, Homo sapiens
tggccgccacccccat

SEQ ID NO: 3157437 - DNA, 17 bp, Homo sapiens
tggccgccacccccatc

SEQ ID NO: 3157438 - DNA, 19 bp, Homo sapiens
tggccgctaagttgctgat

SEQ ID NO: 3157439 - DNA, 24 bp, Homo sapiens
tggccggcaaccccagttctgctc

SEQ ID NO: 3157440 - DNA, 13 bp, Homo sapiens
tggccggctgtgc

SEQ ID NO: 3157441 - DNA, 21 bp, Homo sapiens
tggccgggcaggcgtgactca

SEQ ID NO: 3157442 - DNA, 15 bp, Homo sapiens
tggccggtctgcaag

SEQ ID NO: 3157443 - DNA, 20 bp, Homo sapiens
tggccggtctgcaagtcaga

SEQ ID NO: 3157444 - DNA, 21 bp, Homo sapiens
tggccggtctgcaagtcagag

SEQ ID NO: 3157445 - DNA, 22 bp, Homo sapiens
tggccggtctgcaagtcagagg

SEQ ID NO: 3157446 - DNA, 14 bp, Homo sapiens
tggccgttatctgg

SEQ ID NO: 3157447 - DNA, 21 bp, Homo sapiens
tggcctaaaactggcctgact

SEQ ID NO: 3157448 - DNA, 17 bp, Homo sapiens
tggcctaaaatcttgga

SEQ ID NO: 3157449 - DNA, 15 bp, Homo sapiens
tggcctaaatttctt

SEQ ID NO: 3157450 - DNA, 17 bp, Homo sapiens
tggcctaaatttcttct

SEQ ID NO: 3157451 - DNA, 22 bp, Homo sapiens
tggcctagcccaccctgctgcc

SEQ ID NO: 3157452 - DNA, 22 bp, Homo sapiens
tggcctaggagatatctgaggg

SEQ ID NO: 3157453 - DNA, 18 bp, Homo sapiens
tggcctatccgctgccag

SEQ ID NO: 3157454 - DNA, 17 bp, Homo sapiens
tggcctatgcacatatg

SEQ ID NO: 3157455 - DNA, 20 bp, Homo sapiens
tggcctattatattaaaata

SEQ ID NO: 3157456 - DNA, 21 bp, Homo sapiens
tggcctattatattaaaatat

SEQ ID NO: 3157457 - DNA, 16 bp, Homo sapiens
tggcctcaagagcaca

SEQ ID NO: 3157458 - DNA, 23 bp, Homo sapiens
tggcctcaagtgattctcctgcc

SEQ ID NO: 3157459 - DNA, 22 bp, Homo sapiens
tggcctcacccacccctgcaca

SEQ ID NO: 3157460 - DNA, 23 bp, Homo sapiens
tggcctcactggctggggcagag

SEQ ID NO: 3157461 - DNA, 17 bp, Homo sapiens
tggcctcagaattcaca

SEQ ID NO: 3157462 - DNA, 12 bp, Homo sapiens
tggcctcagccc

SEQ ID NO: 3157463 - DNA, 19 bp, Homo sapiens
tggcctcagctgcctcact

SEQ ID NO: 3157464 - DNA, 16 bp, Homo sapiens
tggcctcagctggctg

SEQ ID NO: 3157465 - DNA, 17 bp, Homo sapiens
tggcctcagctggctgt

SEQ ID NO: 3157466 - DNA, 20 bp, Homo sapiens
tggcctcagctggctgtatg

SEQ ID NO: 3157467 - DNA, 13 bp, Homo sapiens
tggcctcagggcc

SEQ ID NO: 3157468 - DNA, 13 bp, Homo sapiens
tggcctcatgtgg

SEQ ID NO: 3157469 - DNA, 21 bp, Homo sapiens
tggcctcatgtggctggaaga

SEQ ID NO: 3157470 - DNA, 13 bp, Homo sapiens
tggcctcccaccc

SEQ ID NO: 3157471 - DNA, 15 bp, Homo sapiens
tggcctcccacccga

SEQ ID NO: 3157472 - DNA, 20 bp, Homo sapiens
tggcctcccctgccaccagg

SEQ ID NO: 3157473 - DNA, 12 bp, Homo sapiens
tggcctccctgc

SEQ ID NO: 3157474 - DNA, 13 bp, Homo sapiens
tggcctccctgct

SEQ ID NO: 3157475 - DNA, 20 bp, Homo sapiens
tggcctccctttgtgtgcat

SEQ ID NO: 3157476 - DNA, 23 bp, Homo sapiens
tggcctcggcgggcttttctggg

SEQ ID NO: 3157477 - DNA, 18 bp, Homo sapiens
tggcctcgtgaggggcaa

SEQ ID NO: 3157478 - DNA, 17 bp, Homo sapiens
tggcctctaccacaagg

SEQ ID NO: 3157479 - DNA, 19 bp, Homo sapiens
tggcctcttgagcagtggc

SEQ ID NO: 3157480 - DNA, 17 bp, Homo sapiens
tggcctgaactgaggag

SEQ ID NO: 3157481 - DNA, 12 bp, Homo sapiens
tggcctgagctg

SEQ ID NO: 3157482 - DNA, 14 bp, Homo sapiens
tggcctgagctggg

SEQ ID NO: 3157483 - DNA, 16 bp, Homo sapiens
tggcctgagctggggc

SEQ ID NO: 3157484 - DNA, 12 bp, Homo sapiens
tggcctgctggg

SEQ ID NO: 3157485 - DNA, 13 bp, Homo sapiens
tggcctggactgt

SEQ ID NO: 3157486 - DNA, 12 bp, Homo sapiens
tggcctggatct

SEQ ID NO: 3157487 - DNA, 14 bp, Homo sapiens
tggcctggatctcc

SEQ ID NO: 3157488 - DNA, 21 bp, Homo sapiens
tggcctggatctccccactct

SEQ ID NO: 3157489 - DNA, 10 bp, Homo sapiens
tggcctggcc

SEQ ID NO: 3157490 - DNA, 13 bp, Homo sapiens
tggcctggccatc

SEQ ID NO: 3157491 - DNA, 13 bp, Homo sapiens
tggcctggccctg

SEQ ID NO: 3157492 - DNA, 16 bp, Homo sapiens
tggcctgtctcatccc

SEQ ID NO: 3157493 - DNA, 18 bp, Homo sapiens
tggcctgtgtccagcagc

SEQ ID NO: 3157494 - DNA, 19 bp, Homo sapiens
tggcctgtgtccagcagct

SEQ ID NO: 3157495 - DNA, 18 bp, Homo sapiens
tggcctgtttcaacacag

SEQ ID NO: 3157496 - DNA, 21 bp, Homo sapiens
tggcctgtttctgcagccctt

SEQ ID NO: 3157497 - DNA, 22 bp, Homo sapiens
tggcctgtttctgcagcccttg

SEQ ID NO: 3157498 - DNA, 17 bp, Homo sapiens
tggcctgtttgatgtat

SEQ ID NO: 3157499 - DNA, 21 bp, Homo sapiens
tggcctgtttgatgtatgtgt

SEQ ID NO: 3157500 - DNA, 23 bp, Homo sapiens
tggcctgtttgatgtatgtgtga

SEQ ID NO: 3157501 - DNA, 17 bp, Homo sapiens
tggccttaaagagggac

SEQ ID NO: 3157502 - DNA, 15 bp, Homo sapiens
tggccttacactgaa

SEQ ID NO: 3157503 - DNA, 17 bp, Homo sapiens
tggccttcggcctccat

SEQ ID NO: 3157504 - DNA, 18 bp, Homo sapiens
tggccttcggcctccatc

SEQ ID NO: 3157505 - DNA, 20 bp, Homo sapiens
tggccttcggcctccatcct

SEQ ID NO: 3157506 - DNA, 22 bp, Homo sapiens
tggccttcggcctccatcctga

SEQ ID NO: 3157507 - DNA, 21 bp, Homo sapiens
tggccttctgctgcccaggcc

SEQ ID NO: 3157508 - DNA, 23 bp, Homo sapiens
tggccttctgctgcccaggccac

SEQ ID NO: 3157509 - DNA, 23 bp, Homo sapiens
tggccttgtaagacccttattgc

SEQ ID NO: 3157510 - DNA, 14 bp, Homo sapiens
tggcctttcctctc

SEQ ID NO: 3157511 - DNA, 14 bp, Homo sapiens
tggcctttgcattt

SEQ ID NO: 3157512 - DNA, 16 bp, Homo sapiens
tggcctttttcattta

SEQ ID NO: 3157513 - DNA, 20 bp, Homo sapiens
tggcctttttcatttatcta

SEQ ID NO: 3157514 - DNA, 16 bp, Homo sapiens
tggcgcaaggccgagc

SEQ ID NO: 3157515 - DNA, 18 bp, Homo sapiens
tggcgcaatctcggctca

SEQ ID NO: 3157516 - DNA, 23 bp, Homo sapiens
tggcgcaatctcggctcactgca

SEQ ID NO: 3157517 - DNA, 14 bp, Homo sapiens
tggcgcaggtgggc

SEQ ID NO: 3157518 - DNA, 15 bp, Homo sapiens
tggcgccgtctccag

SEQ ID NO: 3157519 - DNA, 17 bp, Homo sapiens
tggcgccgtctccaggg

SEQ ID NO: 3157520 - DNA, 13 bp, Homo sapiens
tggcgcttagaga

SEQ ID NO: 3157521 - DNA, 19 bp, Homo sapiens
tggcggagaaggagaggaa

SEQ ID NO: 3157522 - DNA, 14 bp, Homo sapiens
tggcggcagcagcc

SEQ ID NO: 3157523 - DNA, 15 bp, Homo sapiens
tggcggcagcagcca

SEQ ID NO: 3157524 - DNA, 13 bp, Homo sapiens
tggcggcttcctg

SEQ ID NO: 3157525 - DNA, 18 bp, Homo sapiens
tggcggcttcctgtccac

SEQ ID NO: 3157526 - DNA, 19 bp, Homo sapiens
tggcggcttcctgtccact

SEQ ID NO: 3157527 - DNA, 14 bp, Homo sapiens
tggcgggcgcctgt

SEQ ID NO: 3157528 - DNA, 20 bp, Homo sapiens
tggcgtaatgggcctgccca

SEQ ID NO: 3157529 - DNA, 20 bp, Homo sapiens
tggcgtagaagtttttgtac

SEQ ID NO: 3157530 - DNA, 22 bp, Homo sapiens
tggcgtagcagagttaaatctc

SEQ ID NO: 3157531 - DNA, 14 bp, Homo sapiens
tggcgtggagcagg

SEQ ID NO: 3157532 - DNA, 17 bp, Homo sapiens
tggcgtgggagccagcc

SEQ ID NO: 3157533 - DNA, 23 bp, Homo sapiens
tggcgttcacctccctgctcagt

SEQ ID NO: 3157534 - DNA, 19 bp, Homo sapiens
tggctaataaactgtatta

SEQ ID NO: 3157535 - DNA, 18 bp, Homo sapiens
tggctacatcccagcctg

SEQ ID NO: 3157536 - DNA, 23 bp, Homo sapiens
tggctactttggtttctgtctgt

SEQ ID NO: 3157537 - DNA, 17 bp, Homo sapiens
tggctaggcctttcctg

SEQ ID NO: 3157538 - DNA, 14 bp, Homo sapiens
tggctagtactgta

SEQ ID NO: 3157539 - DNA, 19 bp, Homo sapiens
tggctataaatatataaaa

SEQ ID NO: 3157540 - DNA, 16 bp, Homo sapiens
tggctatcaaaagaaa

SEQ ID NO: 3157541 - DNA, 14 bp, Homo sapiens
tggctatggccacc

SEQ ID NO: 3157542 - DNA, 22 bp, Homo sapiens
tggctattagagatcaacccct

SEQ ID NO: 3157543 - DNA, 14 bp, Homo sapiens
tggctcaagtagaa

SEQ ID NO: 3157544 - DNA, 18 bp, Homo sapiens
tggctcaagtagaaaagc

SEQ ID NO: 3157545 - DNA, 13 bp, Homo sapiens
tggctcacacctg

SEQ ID NO: 3157546 - DNA, 15 bp, Homo sapiens
tggctcacacctgca

SEQ ID NO: 3157547 - DNA, 14 bp, Homo sapiens
tggctcacgcctgt

SEQ ID NO: 3157548 - DNA, 18 bp, Homo sapiens
tggctcacgcctgtaatc

SEQ ID NO: 3157549 - DNA, 13 bp, Homo sapiens
tggctcaggcaag

SEQ ID NO: 3157550 - DNA, 18 bp, Homo sapiens
tggctcaggcaagcccct

SEQ ID NO: 3157551 - DNA, 21 bp, Homo sapiens
tggctcaggcaagcccctcag

SEQ ID NO: 3157552 - DNA, 11 bp, Homo sapiens
tggctcataaa

SEQ ID NO: 3157553 - DNA, 15 bp, Homo sapiens
tggctccagaaatgt

SEQ ID NO: 3157554 - DNA, 20 bp, Homo sapiens
tggctccatgattctctgag

SEQ ID NO: 3157555 - DNA, 14 bp, Homo sapiens
tggctcccacaggc

SEQ ID NO: 3157556 - DNA, 23 bp, Homo sapiens
tggctccgtggccccgccctcag

SEQ ID NO: 3157557 - DNA, 13 bp, Homo sapiens
tggctcctagggg

SEQ ID NO: 3157558 - DNA, 14 bp, Homo sapiens
tggctcctcaaaca

SEQ ID NO: 3157559 - DNA, 16 bp, Homo sapiens
tggctcctcccggtgc

SEQ ID NO: 3157560 - DNA, 14 bp, Homo sapiens
tggctcctgagggg

SEQ ID NO: 3157561 - DNA, 20 bp, Homo sapiens
tggctcctgaggggcatctg

SEQ ID NO: 3157562 - DNA, 19 bp, Homo sapiens
tggctccttcccatcgctg

SEQ ID NO: 3157563 - DNA, 14 bp, Homo sapiens
tggctcctttacaa

SEQ ID NO: 3157564 - DNA, 19 bp, Homo sapiens
tggctctcattgacttcct

SEQ ID NO: 3157565 - DNA, 20 bp, Homo sapiens
tggctctccaagtgccagag

SEQ ID NO: 3157566 - DNA, 13 bp, Homo sapiens
tggctctctccag

SEQ ID NO: 3157567 - DNA, 22 bp, Homo sapiens
tggctctctcttcctaccctcc

SEQ ID NO: 3157568 - DNA, 20 bp, Homo sapiens
tggctctgaggtgcctgtcc

SEQ ID NO: 3157569 - DNA, 13 bp, Homo sapiens
tggctctgcacta

SEQ ID NO: 3157570 - DNA, 14 bp, Homo sapiens
tggctctgcactaa

SEQ ID NO: 3157571 - DNA, 13 bp, Homo sapiens
tggctctggagac

SEQ ID NO: 3157572 - DNA, 23 bp, Homo sapiens
tggctctggtatgaattcacccg

SEQ ID NO: 3157573 - DNA, 18 bp, Homo sapiens
tggctctgtggcttgcta

SEQ ID NO: 3157574 - DNA, 16 bp, Homo sapiens
tggctcttatttctga

SEQ ID NO: 3157575 - DNA, 17 bp, Homo sapiens
tggctcttatttctgaa

SEQ ID NO: 3157576 - DNA, 21 bp, Homo sapiens
tggctcttatttctgaattca

SEQ ID NO: 3157577 - DNA, 20 bp, Homo sapiens
tggctcttgatacccccctc

SEQ ID NO: 3157578 - DNA, 19 bp, Homo sapiens
tggctgaaattctcctgga

SEQ ID NO: 3157579 - DNA, 20 bp, Homo sapiens
tggctgaaattctcctggag

SEQ ID NO: 3157580 - DNA, 18 bp, Homo sapiens
tggctgacatgaagctgt

SEQ ID NO: 3157581 - DNA, 14 bp, Homo sapiens
tggctgactggggc

SEQ ID NO: 3157582 - DNA, 17 bp, Homo sapiens
tggctgacttcatctgg

SEQ ID NO: 3157583 - DNA, 20 bp, Homo sapiens
tggctgaggatttcaagcct

SEQ ID NO: 3157584 - DNA, 13 bp, Homo sapiens
tggctgagggcag

SEQ ID NO: 3157585 - DNA, 16 bp, Homo sapiens
tggctgaggggcttgg

SEQ ID NO: 3157586 - DNA, 18 bp, Homo sapiens
tggctgaggttcctctgc

SEQ ID NO: 3157587 - DNA, 24 bp, Homo sapiens
tggctgaggttcctctgcctgccc

SEQ ID NO: 3157588 - DNA, 20 bp, Homo sapiens
tggctgagtggaatgcaggg

SEQ ID NO: 3157589 - DNA, 21 bp, Homo sapiens
tggctgagtggaatgcaggga

SEQ ID NO: 3157590 - DNA, 21 bp, Homo sapiens
tggctgcacagaagggctctt

SEQ ID NO: 3157591 - DNA, 22 bp, Homo sapiens
tggctgcaccacttccagggtt

SEQ ID NO: 3157592 - DNA, 12 bp, Homo sapiens
tggctgccaggc

SEQ ID NO: 3157593 - DNA, 13 bp, Homo sapiens
tggctgccaggcg

SEQ ID NO: 3157594 - DNA, 20 bp, Homo sapiens
tggctgcccagacccctctg

SEQ ID NO: 3157595 - DNA, 14 bp, Homo sapiens
tggctgcccaggag

SEQ ID NO: 3157596 - DNA, 22 bp, Homo sapiens
tggctgcccatcatgtggcccc

SEQ ID NO: 3157597 - DNA, 15 bp, Homo sapiens
tggctgccctggccc

SEQ ID NO: 3157598 - DNA, 12 bp, Homo sapiens
tggctgctgccc

SEQ ID NO: 3157599 - DNA, 20 bp, Homo sapiens
tggctgctgcccccaccccg

SEQ ID NO: 3157600 - DNA, 15 bp, Homo sapiens
tggctgcttctctct

SEQ ID NO: 3157601 - DNA, 18 bp, Homo sapiens
tggctggaagagggtgaa

SEQ ID NO: 3157602 - DNA, 20 bp, Homo sapiens
tggctggaagatcctgcggg

SEQ ID NO: 3157603 - DNA, 19 bp, Homo sapiens
tggctggatgaaattttct

SEQ ID NO: 3157604 - DNA, 22 bp, Homo sapiens
tggctggatgaaattttctaga

SEQ ID NO: 3157605 - DNA, 14 bp, Homo sapiens
tggctggctcctag

SEQ ID NO: 3157606 - DNA, 17 bp, Homo sapiens
tggctgggatcagagca

SEQ ID NO: 3157607 - DNA, 22 bp, Homo sapiens
tggctgggatcagagcaggagc

SEQ ID NO: 3157608 - DNA, 15 bp, Homo sapiens
tggctgggggcctca

SEQ ID NO: 3157609 - DNA, 22 bp, Homo sapiens
tggctgggtcagggccagactg

SEQ ID NO: 3157610 - DNA, 15 bp, Homo sapiens
tggctggtccagggc

SEQ ID NO: 3157611 - DNA, 21 bp, Homo sapiens
tggctggtgggaaggccggca

SEQ ID NO: 3157612 - DNA, 14 bp, Homo sapiens
tggctggtttctga

SEQ ID NO: 3157613 - DNA, 19 bp, Homo sapiens
tggctgtaaggctctagat

SEQ ID NO: 3157614 - DNA, 22 bp, Homo sapiens
tggctgtcaggacaccagcctg

SEQ ID NO: 3157615 - DNA, 11 bp, Homo sapiens
tggctgtccct

SEQ ID NO: 3157616 - DNA, 14 bp, Homo sapiens
tggctgtgcctctg

SEQ ID NO: 3157617 - DNA, 15 bp, Homo sapiens
tggctgtgcctctgc

SEQ ID NO: 3157618 - DNA, 18 bp, Homo sapiens
tggctgtgcctctgcctg

SEQ ID NO: 3157619 - DNA, 22 bp, Homo sapiens
tggctgtgcctctgcctgtctc

SEQ ID NO: 3157620 - DNA, 14 bp, Homo sapiens
tggctgtggaggcc

SEQ ID NO: 3157621 - DNA, 13 bp, Homo sapiens
tggctgtggcaca

SEQ ID NO: 3157622 - DNA, 14 bp, Homo sapiens
tggctgtggcacag

SEQ ID NO: 3157623 - DNA, 17 bp, Homo sapiens
tggctgttgagggccac

SEQ ID NO: 3157624 - DNA, 15 bp, Homo sapiens
tggctgttggctggg

SEQ ID NO: 3157625 - DNA, 23 bp, Homo sapiens
tggctgttggctgggggcctcag

SEQ ID NO: 3157626 - DNA, 15 bp, Homo sapiens
tggcttaatgtttat

SEQ ID NO: 3157627 - DNA, 21 bp, Homo sapiens
tggcttacctgacctcttgct

SEQ ID NO: 3157628 - DNA, 13 bp, Homo sapiens
tggcttataaaca

SEQ ID NO: 3157629 - DNA, 21 bp, Homo sapiens
tggcttataaacacattgaat

SEQ ID NO: 3157630 - DNA, 20 bp, Homo sapiens
tggcttcaagttgtaaaaat

SEQ ID NO: 3157631 - DNA, 22 bp, Homo sapiens
tggcttccagaaaaccccagca

SEQ ID NO: 3157632 - DNA, 15 bp, Homo sapiens
tggcttccagcttca

SEQ ID NO: 3157633 - DNA, 16 bp, Homo sapiens
tggcttccatgatggt

SEQ ID NO: 3157634 - DNA, 16 bp, Homo sapiens
tggcttcccgctcagc

SEQ ID NO: 3157635 - DNA, 18 bp, Homo sapiens
tggcttcccgctcagccc

SEQ ID NO: 3157636 - DNA, 19 bp, Homo sapiens
tggcttcccgctcagccct

SEQ ID NO: 3157637 - DNA, 11 bp, Homo sapiens
tggcttcctcc

SEQ ID NO: 3157638 - DNA, 21 bp, Homo sapiens
tggcttcctccgtccacccag

SEQ ID NO: 3157639 - DNA, 13 bp, Homo sapiens
tggcttcctcctg

SEQ ID NO: 3157640 - DNA, 16 bp, Homo sapiens
tggcttcggacaaaat

SEQ ID NO: 3157641 - DNA, 14 bp, Homo sapiens
tggcttctggagcc

SEQ ID NO: 3157642 - DNA, 13 bp, Homo sapiens
tggcttctgtgat

SEQ ID NO: 3157643 - DNA, 15 bp, Homo sapiens
tggcttgacatgtgc

SEQ ID NO: 3157644 - DNA, 18 bp, Homo sapiens
tggcttgacatgtgcaat

SEQ ID NO: 3157645 - DNA, 15 bp, Homo sapiens
tggcttgctccaggg

SEQ ID NO: 3157646 - DNA, 16 bp, Homo sapiens
tggcttgtagaattgt

SEQ ID NO: 3157647 - DNA, 13 bp, Homo sapiens
tggcttgtgaact

SEQ ID NO: 3157648 - DNA, 15 bp, Homo sapiens
tggcttgtgaactgc

SEQ ID NO: 3157649 - DNA, 16 bp, Homo sapiens
tggcttgtgaactgct

SEQ ID NO: 3157650 - DNA, 16 bp, Homo sapiens
tggcttgtgtgtttca

SEQ ID NO: 3157651 - DNA, 15 bp, Homo sapiens
tggcttgtttgattt

SEQ ID NO: 3157652 - DNA, 17 bp, Homo sapiens
tggcttgtttgatttca

SEQ ID NO: 3157653 - DNA, 20 bp, Homo sapiens
tggcttgtttgatttcaaca

SEQ ID NO: 3157654 - DNA, 15 bp, Homo sapiens
tggctttaagccttc

SEQ ID NO: 3157655 - DNA, 14 bp, Homo sapiens
tggctttaattgta

SEQ ID NO: 3157656 - DNA, 23 bp, Homo sapiens
tggctttaattgtataagtcaag

SEQ ID NO: 3157657 - DNA, 14 bp, Homo sapiens
tggctttacctttt

SEQ ID NO: 3157658 - DNA, 23 bp, Homo sapiens
tggctttattactcccctaagtc

SEQ ID NO: 3157659 - DNA, 12 bp, Homo sapiens
tggctttcaaag

SEQ ID NO: 3157660 - DNA, 17 bp, Homo sapiens
tggctttcattattagt

SEQ ID NO: 3157661 - DNA, 14 bp, Homo sapiens
tggctttcccttcc

SEQ ID NO: 3157662 - DNA, 17 bp, Homo sapiens
tggctttccttgtggca

SEQ ID NO: 3157663 - DNA, 15 bp, Homo sapiens
tggctttggcagtgt

SEQ ID NO: 3157664 - DNA, 18 bp, Homo sapiens
tggctttggcagtgtttt

SEQ ID NO: 3157665 - DNA, 16 bp, Homo sapiens
tggctttgggaaagcc

SEQ ID NO: 3157666 - DNA, 17 bp, Homo sapiens
tggctttgggaaagccc

SEQ ID NO: 3157667 - DNA, 19 bp, Homo sapiens
tggctttgggaaagcccag

SEQ ID NO: 3157668 - DNA, 22 bp, Homo sapiens
tggctttgggaaagcccagact

SEQ ID NO: 3157669 - DNA, 14 bp, Homo sapiens
tggcttttcactgc

SEQ ID NO: 3157670 - DNA, 21 bp, Homo sapiens
tggcttttcatgcgtgtgtgt

SEQ ID NO: 3157671 - DNA, 14 bp, Homo sapiens
tggctttttaagaa

SEQ ID NO: 3157672 - DNA, 16 bp, Homo sapiens
tggctttttcctctga

SEQ ID NO: 3157673 - DNA, 23 bp, Homo sapiens
tgggaaaaaaacgatttaccaat

SEQ ID NO: 3157674 - DNA, 19 bp, Homo sapiens
tgggaaaaaaacttggcac

SEQ ID NO: 3157675 - DNA, 22 bp, Homo sapiens
tgggaaaaaagttttgatgaaa

SEQ ID NO: 3157676 - DNA, 23 bp, Homo sapiens
tgggaaaaatgcccttaaatcat

SEQ ID NO: 3157677 - DNA, 14 bp, Homo sapiens
tgggaaaacatttg

SEQ ID NO: 3157678 - DNA, 19 bp, Homo sapiens
tgggaaaggacccacccat

SEQ ID NO: 3157679 - DNA, 21 bp, Homo sapiens
tgggaaaggaggcatgcctct

SEQ ID NO: 3157680 - DNA, 17 bp, Homo sapiens
tgggaaataagagagaa

SEQ ID NO: 3157681 - DNA, 20 bp, Homo sapiens
tgggaaccccgcagcccgtg

SEQ ID NO: 3157682 - DNA, 22 bp, Homo sapiens
tgggaaccccttcatcctctga

SEQ ID NO: 3157683 - DNA, 23 bp, Homo sapiens
tgggaacctagtactctctgctc

SEQ ID NO: 3157684 - DNA, 14 bp, Homo sapiens
tgggaacctcccag

SEQ ID NO: 3157685 - DNA, 15 bp, Homo sapiens
tgggaacctcccaga

SEQ ID NO: 3157686 - DNA, 16 bp, Homo sapiens
tgggaagaccaaagga

SEQ ID NO: 3157687 - DNA, 22 bp, Homo sapiens
tgggaagaccaaaggaaggaac

SEQ ID NO: 3157688 - DNA, 23 bp, Homo sapiens
tgggaagaccagctttgcagtga

SEQ ID NO: 3157689 - DNA, 11 bp, Homo sapiens
tgggaagatga

SEQ ID NO: 3157690 - DNA, 15 bp, Homo sapiens
tgggaagctgtactc

SEQ ID NO: 3157691 - DNA, 19 bp, Homo sapiens
tgggaagcttgagcctccc

SEQ ID NO: 3157692 - DNA, 15 bp, Homo sapiens
tgggaaggccagctg

SEQ ID NO: 3157693 - DNA, 16 bp, Homo sapiens
tgggaatatgtagagg

SEQ ID NO: 3157694 - DNA, 19 bp, Homo sapiens
tgggaatcatgtccatccc

SEQ ID NO: 3157695 - DNA, 20 bp, Homo sapiens
tgggaatgatagcccagaac

SEQ ID NO: 3157696 - DNA, 12 bp, Homo sapiens
tgggaatgggag

SEQ ID NO: 3157697 - DNA, 21 bp, Homo sapiens
tgggaatgtattattctgcag

SEQ ID NO: 3157698 - DNA, 14 bp, Homo sapiens
tgggaatttcaatg

SEQ ID NO: 3157699 - DNA, 15 bp, Homo sapiens
tgggaatttgtcagc

SEQ ID NO: 3157700 - DNA, 20 bp, Homo sapiens
tgggacacaaaactccgccc

SEQ ID NO: 3157701 - DNA, 11 bp, Homo sapiens
tgggacagcca

SEQ ID NO: 3157702 - DNA, 18 bp, Homo sapiens
tgggacagccagagctgg

SEQ ID NO: 3157703 - DNA, 22 bp, Homo sapiens
tgggacccaaaacacaggaagt

SEQ ID NO: 3157704 - DNA, 22 bp, Homo sapiens
tgggacccagctactctgtcca

SEQ ID NO: 3157705 - DNA, 20 bp, Homo sapiens
tgggacccatagatcttctg

SEQ ID NO: 3157706 - DNA, 21 bp, Homo sapiens
tgggacccatagatcttctga

SEQ ID NO: 3157707 - DNA, 20 bp, Homo sapiens
tgggaccctccagtgctgga

SEQ ID NO: 3157708 - DNA, 21 bp, Homo sapiens
tgggaccctccagtgctggat

SEQ ID NO: 3157709 - DNA, 23 bp, Homo sapiens
tgggaccctccagtgctggattt

SEQ ID NO: 3157710 - DNA, 23 bp, Homo sapiens
tgggaccctgtccggcccagtgc

SEQ ID NO: 3157711 - DNA, 17 bp, Homo sapiens
tgggacctaaaaaggtc

SEQ ID NO: 3157712 - DNA, 18 bp, Homo sapiens
tgggacctgccaggcagg

SEQ ID NO: 3157713 - DNA, 13 bp, Homo sapiens
tgggacggaggtc

SEQ ID NO: 3157714 - DNA, 23 bp, Homo sapiens
tgggacggtgcccaagccagagg

SEQ ID NO: 3157715 - DNA, 20 bp, Homo sapiens
tgggactaggacctgagcct

SEQ ID NO: 3157716 - DNA, 20 bp, Homo sapiens
tgggactcaatgcactgaca

SEQ ID NO: 3157717 - DNA, 13 bp, Homo sapiens
tgggactcctggt

SEQ ID NO: 3157718 - DNA, 13 bp, Homo sapiens
tgggactggacag

SEQ ID NO: 3157719 - DNA, 15 bp, Homo sapiens
tgggactgtacacac

SEQ ID NO: 3157720 - DNA, 21 bp, Homo sapiens
tgggactgtacacactttatt

SEQ ID NO: 3157721 - DNA, 17 bp, Homo sapiens
tgggacttccttgctct

SEQ ID NO: 3157722 - DNA, 19 bp, Homo sapiens
tgggacttccttgctctcc

SEQ ID NO: 3157723 - DNA, 16 bp, Homo sapiens
tgggacttctacccag

SEQ ID NO: 3157724 - DNA, 21 bp, Homo sapiens
tgggacttcttacccaaagca

SEQ ID NO: 3157725 - DNA, 23 bp, Homo sapiens
tgggacttcttacccaaagcaca

SEQ ID NO: 3157726 - DNA, 14 bp, Homo sapiens
tgggagaacctcag

SEQ ID NO: 3157727 - DNA, 15 bp, Homo sapiens
tgggagaacctcagg

SEQ ID NO: 3157728 - DNA, 23 bp, Homo sapiens
tgggagaacctcaggcttccttg

SEQ ID NO: 3157729 - DNA, 18 bp, Homo sapiens
tgggagagcccagccatt

SEQ ID NO: 3157730 - DNA, 23 bp, Homo sapiens
tgggagaggatttttttctgagc

SEQ ID NO: 3157731 - DNA, 20 bp, Homo sapiens
tgggagcaaaataaggaaga

SEQ ID NO: 3157732 - DNA, 13 bp, Homo sapiens
tgggagcactgga

SEQ ID NO: 3157733 - DNA, 22 bp, Homo sapiens
tgggagcaggagattgagaagg

SEQ ID NO: 3157734 - DNA, 12 bp, Homo sapiens
tgggagccagct

SEQ ID NO: 3157735 - DNA, 14 bp, Homo sapiens
tgggagccccaggg

SEQ ID NO: 3157736 - DNA, 20 bp, Homo sapiens
tgggagcccccaccacaaac

SEQ ID NO: 3157737 - DNA, 21 bp, Homo sapiens
tgggagccctgaccttggctg

SEQ ID NO: 3157738 - DNA, 22 bp, Homo sapiens
tgggagcctagctcctgccaca

SEQ ID NO: 3157739 - DNA, 15 bp, Homo sapiens
tgggagcctctgggg

SEQ ID NO: 3157740 - DNA, 19 bp, Homo sapiens
tgggagctccactctgctt

SEQ ID NO: 3157741 - DNA, 17 bp, Homo sapiens
tgggagctgcctgttca

SEQ ID NO: 3157742 - DNA, 24 bp, Homo sapiens
tgggagctgcctgttcagctccag

SEQ ID NO: 3157743 - DNA, 11 bp, Homo sapiens
tgggaggaagc

SEQ ID NO: 3157744 - DNA, 18 bp, Homo sapiens
tgggaggagcgaaatcta

SEQ ID NO: 3157745 - DNA, 14 bp, Homo sapiens
tgggaggagggaga

SEQ ID NO: 3157746 - DNA, 18 bp, Homo sapiens
tgggaggagggagaggga

SEQ ID NO: 3157747 - DNA, 13 bp, Homo sapiens
tgggaggcaagaa

SEQ ID NO: 3157748 - DNA, 17 bp, Homo sapiens
tgggaggcaagaaaagg

SEQ ID NO: 3157749 - DNA, 21 bp, Homo sapiens
tgggaggcaagaaaaggacaa

SEQ ID NO: 3157750 - DNA, 16 bp, Homo sapiens
tgggaggcatggccct

SEQ ID NO: 3157751 - DNA, 12 bp, Homo sapiens
tgggaggccaag

SEQ ID NO: 3157752 - DNA, 19 bp, Homo sapiens
tgggaggccaaggcaggta

SEQ ID NO: 3157753 - DNA, 13 bp, Homo sapiens
tgggaggctgagg

SEQ ID NO: 3157754 - DNA, 15 bp, Homo sapiens
tgggaggctgaggca

SEQ ID NO: 3157755 - DNA, 19 bp, Homo sapiens
tgggagggagcagacagga

SEQ ID NO: 3157756 - DNA, 16 bp, Homo sapiens
tgggaggggcaggctg

SEQ ID NO: 3157757 - DNA, 17 bp, Homo sapiens
tgggaggggcaggctga

SEQ ID NO: 3157758 - DNA, 23 bp, Homo sapiens
tgggagggggctatttctctccc

SEQ ID NO: 3157759 - DNA, 22 bp, Homo sapiens
tgggaggtggaagaagggagaa

SEQ ID NO: 3157760 - DNA, 15 bp, Homo sapiens
tgggagtcagagccc

SEQ ID NO: 3157761 - DNA, 16 bp, Homo sapiens
tgggagtcagagccct

SEQ ID NO: 3157762 - DNA, 22 bp, Homo sapiens
tgggagtcagagccctggctgg

SEQ ID NO: 3157763 - DNA, 13 bp, Homo sapiens
tgggagtcccctt

SEQ ID NO: 3157764 - DNA, 15 bp, Homo sapiens
tgggagtgagctggt

SEQ ID NO: 3157765 - DNA, 13 bp, Homo sapiens
tgggagtgggcac

SEQ ID NO: 3157766 - DNA, 17 bp, Homo sapiens
tgggagtgggcacctca

SEQ ID NO: 3157767 - DNA, 17 bp, Homo sapiens
tgggagttctagaacca

SEQ ID NO: 3157768 - DNA, 17 bp, Homo sapiens
tgggataactgatttct

SEQ ID NO: 3157769 - DNA, 18 bp, Homo sapiens
tgggataactgatttcta

SEQ ID NO: 3157770 - DNA, 15 bp, Homo sapiens
tgggatacaacctcc

SEQ ID NO: 3157771 - DNA, 14 bp, Homo sapiens
tgggatatcatttt

SEQ ID NO: 3157772 - DNA, 15 bp, Homo sapiens
tgggatatcatttta

SEQ ID NO: 3157773 - DNA, 16 bp, Homo sapiens
tgggatatcattttaa

SEQ ID NO: 3157774 - DNA, 18 bp, Homo sapiens
tgggatatggctgcccag

SEQ ID NO: 3157775 - DNA, 19 bp, Homo sapiens
tgggatatggctgcccagg

SEQ ID NO: 3157776 - DNA, 14 bp, Homo sapiens
tgggatcagagcag

SEQ ID NO: 3157777 - DNA, 18 bp, Homo sapiens
tgggatcagagcaggagc

SEQ ID NO: 3157778 - DNA, 14 bp, Homo sapiens
tgggatgaggtcac

SEQ ID NO: 3157779 - DNA, 12 bp, Homo sapiens
tgggatgctcct

SEQ ID NO: 3157780 - DNA, 15 bp, Homo sapiens
tgggatgggaccagg

SEQ ID NO: 3157781 - DNA, 15 bp, Homo sapiens
tgggatgtcttattt

SEQ ID NO: 3157782 - DNA, 15 bp, Homo sapiens
tgggattaagggcaa

SEQ ID NO: 3157783 - DNA, 16 bp, Homo sapiens
tgggattacaggtgtg

SEQ ID NO: 3157784 - DNA, 13 bp, Homo sapiens
tgggattattctt

SEQ ID NO: 3157785 - DNA, 14 bp, Homo sapiens
tgggattattcttt

SEQ ID NO: 3157786 - DNA, 20 bp, Homo sapiens
tgggattcctgacccaggcc

SEQ ID NO: 3157787 - DNA, 23 bp, Homo sapiens
tgggattgacagaagcttctgcc

SEQ ID NO: 3157788 - DNA, 16 bp, Homo sapiens
tgggatttaatttcca

SEQ ID NO: 3157789 - DNA, 21 bp, Homo sapiens
tgggatttcttcgctgctcta

SEQ ID NO: 3157790 - DNA, 22 bp, Homo sapiens
tgggcaaaacccaggacatctc

SEQ ID NO: 3157791 - DNA, 15 bp, Homo sapiens
tgggcaaacaggcag

SEQ ID NO: 3157792 - DNA, 14 bp, Homo sapiens
tgggcaaagcttgt

SEQ ID NO: 3157793 - DNA, 19 bp, Homo sapiens
tgggcaatgatggcaattt

SEQ ID NO: 3157794 - DNA, 22 bp, Homo sapiens
tgggcacaactgcaataacttc

SEQ ID NO: 3157795 - DNA, 16 bp, Homo sapiens
tgggcaccccactgca

SEQ ID NO: 3157796 - DNA, 13 bp, Homo sapiens
tgggcacctcaga

SEQ ID NO: 3157797 - DNA, 20 bp, Homo sapiens
tgggcactgcggctgtctcc

SEQ ID NO: 3157798 - DNA, 16 bp, Homo sapiens
tgggcactggcccagg

SEQ ID NO: 3157799 - DNA, 16 bp, Homo sapiens
tgggcagagctggctc

SEQ ID NO: 3157800 - DNA, 23 bp, Homo sapiens
tgggcagaggaccaggctgtagg

SEQ ID NO: 3157801 - DNA, 15 bp, Homo sapiens
tgggcagattttcag

SEQ ID NO: 3157802 - DNA, 14 bp, Homo sapiens
tgggcagcaccctc

SEQ ID NO: 3157803 - DNA, 15 bp, Homo sapiens
tgggcagcaccctcc

SEQ ID NO: 3157804 - DNA, 18 bp, Homo sapiens
tgggcagcaccctccccc

SEQ ID NO: 3157805 - DNA, 12 bp, Homo sapiens
tgggcagccaga

SEQ ID NO: 3157806 - DNA, 14 bp, Homo sapiens
tgggcagccccaga

SEQ ID NO: 3157807 - DNA, 17 bp, Homo sapiens
tgggcagccccagagag

SEQ ID NO: 3157808 - DNA, 21 bp, Homo sapiens
tgggcagggtctgtttggact

SEQ ID NO: 3157809 - DNA, 19 bp, Homo sapiens
tgggcatactttctctcta

SEQ ID NO: 3157810 - DNA, 18 bp, Homo sapiens
tgggcatccacccagtgc

SEQ ID NO: 3157811 - DNA, 20 bp, Homo sapiens
tgggcatccacccagtgctg

SEQ ID NO: 3157812 - DNA, 16 bp, Homo sapiens
tgggcatcttctggct

SEQ ID NO: 3157813 - DNA, 17 bp, Homo sapiens
tgggcatcttctggctt

SEQ ID NO: 3157814 - DNA, 14 bp, Homo sapiens
tgggcatgccaccc

SEQ ID NO: 3157815 - DNA, 15 bp, Homo sapiens
tgggcatgccaccct

SEQ ID NO: 3157816 - DNA, 16 bp, Homo sapiens
tgggcatgccaccctc

SEQ ID NO: 3157817 - DNA, 20 bp, Homo sapiens
tgggcatggtaccagccctg

SEQ ID NO: 3157818 - DNA, 23 bp, Homo sapiens
tgggcattgacaaatctgtgtat

SEQ ID NO: 3157819 - DNA, 15 bp, Homo sapiens
tgggcattgctttcc

SEQ ID NO: 3157820 - DNA, 13 bp, Homo sapiens
tgggcattgggct

SEQ ID NO: 3157821 - DNA, 17 bp, Homo sapiens
tgggcattgggctgaca

SEQ ID NO: 3157822 - DNA, 22 bp, Homo sapiens
tgggccactggggactttattt

SEQ ID NO: 3157823 - DNA, 18 bp, Homo sapiens
tgggccagcctagccctt

SEQ ID NO: 3157824 - DNA, 22 bp, Homo sapiens
tgggccagggctgccctgagaa

SEQ ID NO: 3157825 - DNA, 19 bp, Homo sapiens
tgggccagggtctgtgtga

SEQ ID NO: 3157826 - DNA, 18 bp, Homo sapiens
tgggccatgtccaaagag

SEQ ID NO: 3157827 - DNA, 23 bp, Homo sapiens
tgggccatgtccaaagaggctgc

SEQ ID NO: 3157828 - DNA, 18 bp, Homo sapiens
tgggcccagaactgcccc

SEQ ID NO: 3157829 - DNA, 12 bp, Homo sapiens
tgggcccagccc

SEQ ID NO: 3157830 - DNA, 14 bp, Homo sapiens
tgggcccagcccct

SEQ ID NO: 3157831 - DNA, 18 bp, Homo sapiens
tgggcccaggaccagctg

SEQ ID NO: 3157832 - DNA, 20 bp, Homo sapiens
tgggcccaggaccagctggg

SEQ ID NO: 3157833 - DNA, 21 bp, Homo sapiens
tgggcccataatagttagccc

SEQ ID NO: 3157834 - DNA, 18 bp, Homo sapiens
tgggccccagaccccagg

SEQ ID NO: 3157835 - DNA, 19 bp, Homo sapiens
tgggccccatgctctgccc

SEQ ID NO: 3157836 - DNA, 20 bp, Homo sapiens
tgggccccatgctctgcccc

SEQ ID NO: 3157837 - DNA, 19 bp, Homo sapiens
tgggccccccagctcaggg

SEQ ID NO: 3157838 - DNA, 23 bp, Homo sapiens
tgggcccctcttattcctctagg

SEQ ID NO: 3157839 - DNA, 13 bp, Homo sapiens
tgggcccctgcac

SEQ ID NO: 3157840 - DNA, 13 bp, Homo sapiens
tgggcccctggga

SEQ ID NO: 3157841 - DNA, 16 bp, Homo sapiens
tgggccctctctctgg

SEQ ID NO: 3157842 - DNA, 14 bp, Homo sapiens
tgggccctgggctg

SEQ ID NO: 3157843 - DNA, 16 bp, Homo sapiens
tgggccctgggctgga

SEQ ID NO: 3157844 - DNA, 20 bp, Homo sapiens
tgggccgaatcccccaggga

SEQ ID NO: 3157845 - DNA, 21 bp, Homo sapiens
tgggccgaatcccccagggaa

SEQ ID NO: 3157846 - DNA, 23 bp, Homo sapiens
tgggcctcaaggacttgaaagca

SEQ ID NO: 3157847 - DNA, 11 bp, Homo sapiens
tgggcctcagg

SEQ ID NO: 3157848 - DNA, 18 bp, Homo sapiens
tgggcctcaggctctgca

SEQ ID NO: 3157849 - DNA, 20 bp, Homo sapiens
tgggcctcagttcaacctgg

SEQ ID NO: 3157850 - DNA, 17 bp, Homo sapiens
tgggcctcatcacagca

SEQ ID NO: 3157851 - DNA, 16 bp, Homo sapiens
tgggcctcctgtgtgt

SEQ ID NO: 3157852 - DNA, 22 bp, Homo sapiens
tgggcctcctgtgtgtgcgcct

SEQ ID NO: 3157853 - DNA, 15 bp, Homo sapiens
tgggcctctgcccct

SEQ ID NO: 3157854 - DNA, 16 bp, Homo sapiens
tgggcctctgcccctc

SEQ ID NO: 3157855 - DNA, 16 bp, Homo sapiens
tgggcctgcccaatgc

SEQ ID NO: 3157856 - DNA, 20 bp, Homo sapiens
tgggcctgcttttccaggat

SEQ ID NO: 3157857 - DNA, 11 bp, Homo sapiens
tgggcctggcc

SEQ ID NO: 3157858 - DNA, 23 bp, Homo sapiens
tgggcctggcctgagctggggcc

SEQ ID NO: 3157859 - DNA, 15 bp, Homo sapiens
tgggcctgggcctct

SEQ ID NO: 3157860 - DNA, 17 bp, Homo sapiens
tgggcctgggcctctgc

SEQ ID NO: 3157861 - DNA, 16 bp, Homo sapiens
tgggcctgggcctgct

SEQ ID NO: 3157862 - DNA, 15 bp, Homo sapiens
tgggcctgtgcagca

SEQ ID NO: 3157863 - DNA, 16 bp, Homo sapiens
tgggcctgtgcagcag

SEQ ID NO: 3157864 - DNA, 20 bp, Homo sapiens
tgggcctgtgcagcagccca

SEQ ID NO: 3157865 - DNA, 16 bp, Homo sapiens
tgggccttgctttggg

SEQ ID NO: 3157866 - DNA, 17 bp, Homo sapiens
tgggccttgctttgggc

SEQ ID NO: 3157867 - DNA, 14 bp, Homo sapiens
tgggcgcaggccca

SEQ ID NO: 3157868 - DNA, 18 bp, Homo sapiens
tgggcgcaggcccagtga

SEQ ID NO: 3157869 - DNA, 17 bp, Homo sapiens
tgggcgctgcttccagg

SEQ ID NO: 3157870 - DNA, 16 bp, Homo sapiens
tgggcggcggccacgc

SEQ ID NO: 3157871 - DNA, 17 bp, Homo sapiens
tgggcggcggccacgca

SEQ ID NO: 3157872 - DNA, 18 bp, Homo sapiens
tgggctaccctaaaggga

SEQ ID NO: 3157873 - DNA, 13 bp, Homo sapiens
tgggctactggca

SEQ ID NO: 3157874 - DNA, 14 bp, Homo sapiens
tgggctactggcag

SEQ ID NO: 3157875 - DNA, 19 bp, Homo sapiens
tgggctagtgtgagtggca

SEQ ID NO: 3157876 - DNA, 16 bp, Homo sapiens
tgggctagttgggctt

SEQ ID NO: 3157877 - DNA, 19 bp, Homo sapiens
tgggctatttggactcagg

SEQ ID NO: 3157878 - DNA, 15 bp, Homo sapiens
tgggctcacaggcct

SEQ ID NO: 3157879 - DNA, 17 bp, Homo sapiens
tgggctcacaggcctct

SEQ ID NO: 3157880 - DNA, 16 bp, Homo sapiens
tgggctcagggctgga

SEQ ID NO: 3157881 - DNA, 17 bp, Homo sapiens
tgggctccacgggcagg

SEQ ID NO: 3157882 - DNA, 11 bp, Homo sapiens
tgggctcctgg

SEQ ID NO: 3157883 - DNA, 19 bp, Homo sapiens
tgggctctgccccagctct

SEQ ID NO: 3157884 - DNA, 17 bp, Homo sapiens
tgggctctgtgcagtca

SEQ ID NO: 3157885 - DNA, 16 bp, Homo sapiens
tgggctgacccagcat

SEQ ID NO: 3157886 - DNA, 17 bp, Homo sapiens
tgggctgagccctggca

SEQ ID NO: 3157887 - DNA, 18 bp, Homo sapiens
tgggctgagccctggcag

SEQ ID NO: 3157888 - DNA, 13 bp, Homo sapiens
tgggctgatgctg

SEQ ID NO: 3157889 - DNA, 19 bp, Homo sapiens
tgggctgatgctgggaccc

SEQ ID NO: 3157890 - DNA, 20 bp, Homo sapiens
tgggctgccctggtgctgcc

SEQ ID NO: 3157891 - DNA, 15 bp, Homo sapiens
tgggctgctgcaggc

SEQ ID NO: 3157892 - DNA, 18 bp, Homo sapiens
tgggctggaatcaggaat

SEQ ID NO: 3157893 - DNA, 22 bp, Homo sapiens
tgggctgggccctctcttctca

SEQ ID NO: 3157894 - DNA, 13 bp, Homo sapiens
tgggctggggctg

SEQ ID NO: 3157895 - DNA, 17 bp, Homo sapiens
tgggctggggctgctcc

SEQ ID NO: 3157896 - DNA, 19 bp, Homo sapiens
tgggctggggctgctcccc

SEQ ID NO: 3157897 - DNA, 14 bp, Homo sapiens
tgggctgggtggca

SEQ ID NO: 3157898 - DNA, 20 bp, Homo sapiens
tgggctggtatctcagaaag

SEQ ID NO: 3157899 - DNA, 23 bp, Homo sapiens
tgggctggtatctcagaaagtgc

SEQ ID NO: 3157900 - DNA, 22 bp, Homo sapiens
tgggctggtattggtggctttc

SEQ ID NO: 3157901 - DNA, 14 bp, Homo sapiens
tgggctggtgcccc

SEQ ID NO: 3157902 - DNA, 19 bp, Homo sapiens
tgggctggtgccccacagc

SEQ ID NO: 3157903 - DNA, 20 bp, Homo sapiens
tgggctggtgccccacagct

SEQ ID NO: 3157904 - DNA, 17 bp, Homo sapiens
tgggctggtgtcacctg

SEQ ID NO: 3157905 - DNA, 20 bp, Homo sapiens
tgggctgtaacgtggcactg

SEQ ID NO: 3157906 - DNA, 15 bp, Homo sapiens
tgggctgtgagtgta

SEQ ID NO: 3157907 - DNA, 22 bp, Homo sapiens
tgggctgtgagtgtaagtgtga

SEQ ID NO: 3157908 - DNA, 17 bp, Homo sapiens
tgggcttcagtggcagc

SEQ ID NO: 3157909 - DNA, 18 bp, Homo sapiens
tgggcttcagtggcagct

SEQ ID NO: 3157910 - DNA, 21 bp, Homo sapiens
tgggcttcagtggcagctgct

SEQ ID NO: 3157911 - DNA, 22 bp, Homo sapiens
tgggcttgtgatttccatttct

SEQ ID NO: 3157912 - DNA, 14 bp, Homo sapiens
tgggcttgttttct

SEQ ID NO: 3157913 - DNA, 16 bp, Homo sapiens
tgggctttgcaggctc

SEQ ID NO: 3157914 - DNA, 17 bp, Homo sapiens
tgggctttgcaggctct

SEQ ID NO: 3157915 - DNA, 20 bp, Homo sapiens
tgggcttttggggagccaga

SEQ ID NO: 3157916 - DNA, 14 bp, Homo sapiens
tggggaaaaaagca

SEQ ID NO: 3157917 - DNA, 17 bp, Homo sapiens
tggggaaaaaagcacat

SEQ ID NO: 3157918 - DNA, 21 bp, Homo sapiens
tggggaaacaacatttatatg

SEQ ID NO: 3157919 - DNA, 22 bp, Homo sapiens
tggggaaaggggtcggctgacc

SEQ ID NO: 3157920 - DNA, 18 bp, Homo sapiens
tggggaacatttctgtaa

SEQ ID NO: 3157921 - DNA, 23 bp, Homo sapiens
tggggaacatttctgtaaatacc

SEQ ID NO: 3157922 - DNA, 20 bp, Homo sapiens
tggggaagccaggtgagctc

SEQ ID NO: 3157923 - DNA, 16 bp, Homo sapiens
tggggaagggcctgcc

SEQ ID NO: 3157924 - DNA, 23 bp, Homo sapiens
tggggaaggtggagcagctgcag

SEQ ID NO: 3157925 - DNA, 14 bp, Homo sapiens
tggggaatttcctc

SEQ ID NO: 3157926 - DNA, 13 bp, Homo sapiens
tggggacccaggc

SEQ ID NO: 3157927 - DNA, 14 bp, Homo sapiens
tggggactcaggga

SEQ ID NO: 3157928 - DNA, 14 bp, Homo sapiens
tggggactgctacc

SEQ ID NO: 3157929 - DNA, 23 bp, Homo sapiens
tggggactgttccaaagccagtg

SEQ ID NO: 3157930 - DNA, 12 bp, Homo sapiens
tggggagaaagt

SEQ ID NO: 3157931 - DNA, 19 bp, Homo sapiens
tggggagcagttttcccct

SEQ ID NO: 3157932 - DNA, 20 bp, Homo sapiens
tggggagcagttttcccctg

SEQ ID NO: 3157933 - DNA, 16 bp, Homo sapiens
tggggagccaacagaa

SEQ ID NO: 3157934 - DNA, 21 bp, Homo sapiens
tggggagcccgtctcagtgtt

SEQ ID NO: 3157935 - DNA, 13 bp, Homo sapiens
tggggagctcctg

SEQ ID NO: 3157936 - DNA, 15 bp, Homo sapiens
tggggaggacaaaac

SEQ ID NO: 3157937 - DNA, 18 bp, Homo sapiens
tggggaggacaaaacttc

SEQ ID NO: 3157938 - DNA, 21 bp, Homo sapiens
tggggaggcccaaatgatgga

SEQ ID NO: 3157939 - DNA, 21 bp, Homo sapiens
tggggagggccgtaccccacc

SEQ ID NO: 3157940 - DNA, 12 bp, Homo sapiens
tggggaggggcg

SEQ ID NO: 3157941 - DNA, 23 bp, Homo sapiens
tggggaggggcgctggcccagcc

SEQ ID NO: 3157942 - DNA, 14 bp, Homo sapiens
tggggatagaggaa

SEQ ID NO: 3157943 - DNA, 15 bp, Homo sapiens
tggggatcacagaga

SEQ ID NO: 3157944 - DNA, 15 bp, Homo sapiens
tggggatgaggtcac

SEQ ID NO: 3157945 - DNA, 16 bp, Homo sapiens
tggggatgtgggaggg

SEQ ID NO: 3157946 - DNA, 21 bp, Homo sapiens
tggggcaagactgcaaacttt

SEQ ID NO: 3157947 - DNA, 14 bp, Homo sapiens
tggggcagaggggc

SEQ ID NO: 3157948 - DNA, 10 bp, Homo sapiens
tggggcagca

SEQ ID NO: 3157949 - DNA, 14 bp, Homo sapiens
tggggcaggctggg

SEQ ID NO: 3157950 - DNA, 17 bp, Homo sapiens
tggggcaggctgggcca

SEQ ID NO: 3157951 - DNA, 20 bp, Homo sapiens
tggggccaccaaagctgccc

SEQ ID NO: 3157952 - DNA, 22 bp, Homo sapiens
tggggccataaacggttcctgg

SEQ ID NO: 3157953 - DNA, 13 bp, Homo sapiens
tggggcccaggaa

SEQ ID NO: 3157954 - DNA, 20 bp, Homo sapiens
tggggcccaggaagcccaca

SEQ ID NO: 3157955 - DNA, 16 bp, Homo sapiens
tggggccccgctggga

SEQ ID NO: 3157956 - DNA, 20 bp, Homo sapiens
tggggccctcagctcctggg

SEQ ID NO: 3157957 - DNA, 14 bp, Homo sapiens
tggggccctgcccc

SEQ ID NO: 3157958 - DNA, 18 bp, Homo sapiens
tggggccctgggcctcag

SEQ ID NO: 3157959 - DNA, 19 bp, Homo sapiens
tggggccgccgcctctttc

SEQ ID NO: 3157960 - DNA, 24 bp, Homo sapiens
tggggccggtagaggctccccagg

SEQ ID NO: 3157961 - DNA, 16 bp, Homo sapiens
tggggcctagactctg

SEQ ID NO: 3157962 - DNA, 22 bp, Homo sapiens
tggggcctagcgatctctcctg

SEQ ID NO: 3157963 - DNA, 16 bp, Homo sapiens
tggggcctgagagaat

SEQ ID NO: 3157964 - DNA, 23 bp, Homo sapiens
tggggcctggcccacgccctccc

SEQ ID NO: 3157965 - DNA, 21 bp, Homo sapiens
tggggcctggcttgctccagg

SEQ ID NO: 3157966 - DNA, 14 bp, Homo sapiens
tggggcctgggagg

SEQ ID NO: 3157967 - DNA, 12 bp, Homo sapiens
tggggccttggt

SEQ ID NO: 3157968 - DNA, 13 bp, Homo sapiens
tggggcggggccc

SEQ ID NO: 3157969 - DNA, 15 bp, Homo sapiens
tggggcggggcccag

SEQ ID NO: 3157970 - DNA, 16 bp, Homo sapiens
tggggcggggcccagg

SEQ ID NO: 3157971 - DNA, 14 bp, Homo sapiens
tggggcgtggggag

SEQ ID NO: 3157972 - DNA, 17 bp, Homo sapiens
tggggctcacacacctg

SEQ ID NO: 3157973 - DNA, 21 bp, Homo sapiens
tggggctcacggggcctccaa

SEQ ID NO: 3157974 - DNA, 15 bp, Homo sapiens
tggggctccctctct

SEQ ID NO: 3157975 - DNA, 13 bp, Homo sapiens
tggggctgctccc

SEQ ID NO: 3157976 - DNA, 16 bp, Homo sapiens
tggggctgctccccta

SEQ ID NO: 3157977 - DNA, 18 bp, Homo sapiens
tggggctggggggcaccc

SEQ ID NO: 3157978 - DNA, 19 bp, Homo sapiens
tggggctggtagctcaggt

SEQ ID NO: 3157979 - DNA, 20 bp, Homo sapiens
tggggcttcaccagtctgtc

SEQ ID NO: 3157980 - DNA, 21 bp, Homo sapiens
tggggcttcaccagtctgtct

SEQ ID NO: 3157981 - DNA, 12 bp, Homo sapiens
tggggcttggcg

SEQ ID NO: 3157982 - DNA, 16 bp, Homo sapiens
tggggcttggcgtgga

SEQ ID NO: 3157983 - DNA, 16 bp, Homo sapiens
tggggctttgccttgc

SEQ ID NO: 3157984 - DNA, 14 bp, Homo sapiens
tgggggacagagaa

SEQ ID NO: 3157985 - DNA, 15 bp, Homo sapiens
tgggggagagaggca

SEQ ID NO: 3157986 - DNA, 14 bp, Homo sapiens
tgggggagagcagg

SEQ ID NO: 3157987 - DNA, 19 bp, Homo sapiens
tgggggagagcaggctggc

SEQ ID NO: 3157988 - DNA, 20 bp, Homo sapiens
tgggggatgactagaggcag

SEQ ID NO: 3157989 - DNA, 17 bp, Homo sapiens
tgggggccacatttcac

SEQ ID NO: 3157990 - DNA, 16 bp, Homo sapiens
tgggggcctcagtgcc

SEQ ID NO: 3157991 - DNA, 14 bp, Homo sapiens
tgggggctcctggt

SEQ ID NO: 3157992 - DNA, 15 bp, Homo sapiens
tgggggctcctggtg

SEQ ID NO: 3157993 - DNA, 18 bp, Homo sapiens
tgggggctcctggtggcc

SEQ ID NO: 3157994 - DNA, 14 bp, Homo sapiens
tgggggctgcagca

SEQ ID NO: 3157995 - DNA, 15 bp, Homo sapiens
tggggggacagagac

SEQ ID NO: 3157996 - DNA, 20 bp, Homo sapiens
tggggggatggtaagagaaa

SEQ ID NO: 3157997 - DNA, 15 bp, Homo sapiens
tggggggcattgagt

SEQ ID NO: 3157998 - DNA, 13 bp, Homo sapiens
tgggggggtggcc

SEQ ID NO: 3157999 - DNA, 17 bp, Homo sapiens
tgggggtagcagctgga

SEQ ID NO: 3158000 - DNA, 18 bp, Homo sapiens
tgggggtggaggcttcct

SEQ ID NO: 3158001 - DNA, 10 bp, Homo sapiens
tgggggtggc

SEQ ID NO: 3158002 - DNA, 14 bp, Homo sapiens
tgggggtggcaggc

SEQ ID NO: 3158003 - DNA, 15 bp, Homo sapiens
tgggggttctttctt

SEQ ID NO: 3158004 - DNA, 18 bp, Homo sapiens
tggggtaagccagagcct

SEQ ID NO: 3158005 - DNA, 19 bp, Homo sapiens
tggggtaagccagagcctg

SEQ ID NO: 3158006 - DNA, 16 bp, Homo sapiens
tggggtacatttctct

SEQ ID NO: 3158007 - DNA, 16 bp, Homo sapiens
tggggtacccactgct

SEQ ID NO: 3158008 - DNA, 17 bp, Homo sapiens
tggggtactcttgatgt

SEQ ID NO: 3158009 - DNA, 19 bp, Homo sapiens
tggggtactcttgatgtga

SEQ ID NO: 3158010 - DNA, 13 bp, Homo sapiens
tggggtagggctg

SEQ ID NO: 3158011 - DNA, 19 bp, Homo sapiens
tggggtataggtctcatct

SEQ ID NO: 3158012 - DNA, 21 bp, Homo sapiens
tggggtcaagaaacagccagc

SEQ ID NO: 3158013 - DNA, 23 bp, Homo sapiens
tggggtctcacagtgttgcccag

SEQ ID NO: 3158014 - DNA, 14 bp, Homo sapiens
tggggtctgacccc

SEQ ID NO: 3158015 - DNA, 19 bp, Homo sapiens
tggggtgaatacttatttt

SEQ ID NO: 3158016 - DNA, 14 bp, Homo sapiens
tggggtgaggacca

SEQ ID NO: 3158017 - DNA, 16 bp, Homo sapiens
tggggtgcatcctcct

SEQ ID NO: 3158018 - DNA, 9 bp, Homo sapiens
tggggtggg

SEQ ID NO: 3158019 - DNA, 20 bp, Homo sapiens
tggggtgggaggtcttgcta

SEQ ID NO: 3158020 - DNA, 10 bp, Homo sapiens
tggggtgggg

SEQ ID NO: 3158021 - DNA, 15 bp, Homo sapiens
tggggtggggagaaa

SEQ ID NO: 3158022 - DNA, 19 bp, Homo sapiens
tggggttatctctgtgtta

SEQ ID NO: 3158023 - DNA, 16 bp, Homo sapiens
tggggttgcaaccact

SEQ ID NO: 3158024 - DNA, 15 bp, Homo sapiens
tggggttggcaacag

SEQ ID NO: 3158025 - DNA, 21 bp, Homo sapiens
tggggttggcaacaggacaga

SEQ ID NO: 3158026 - DNA, 12 bp, Homo sapiens
tggggttgtttt

SEQ ID NO: 3158027 - DNA, 19 bp, Homo sapiens
tggggtttatcagaattct

SEQ ID NO: 3158028 - DNA, 18 bp, Homo sapiens
tgggtaaaagcagggcag

SEQ ID NO: 3158029 - DNA, 21 bp, Homo sapiens
tgggtaaaagcagggcagcag

SEQ ID NO: 3158030 - DNA, 18 bp, Homo sapiens
tgggtaaatgcaaagttc

SEQ ID NO: 3158031 - DNA, 14 bp, Homo sapiens
tgggtaagaagaaa

SEQ ID NO: 3158032 - DNA, 16 bp, Homo sapiens
tgggtaagaagaaagc

SEQ ID NO: 3158033 - DNA, 21 bp, Homo sapiens
tgggtagaaagagatacagag

SEQ ID NO: 3158034 - DNA, 18 bp, Homo sapiens
tgggtagatgggtggggg

SEQ ID NO: 3158035 - DNA, 18 bp, Homo sapiens
tgggtatcaagacatagc

SEQ ID NO: 3158036 - DNA, 21 bp, Homo sapiens
tgggtatttattctctattta

SEQ ID NO: 3158037 - DNA, 21 bp, Homo sapiens
tgggtatttgcaatattcctt

SEQ ID NO: 3158038 - DNA, 18 bp, Homo sapiens
tgggtcacccctccagga

SEQ ID NO: 3158039 - DNA, 14 bp, Homo sapiens
tgggtcaggccacc

SEQ ID NO: 3158040 - DNA, 15 bp, Homo sapiens
tgggtcagggccaga

SEQ ID NO: 3158041 - DNA, 19 bp, Homo sapiens
tgggtcattgacctctcag

SEQ ID NO: 3158042 - DNA, 21 bp, Homo sapiens
tgggtcattgacctctcaggg

SEQ ID NO: 3158043 - DNA, 22 bp, Homo sapiens
tgggtccaggaaggcagctgct

SEQ ID NO: 3158044 - DNA, 18 bp, Homo sapiens
tgggtccgataatatctt

SEQ ID NO: 3158045 - DNA, 22 bp, Homo sapiens
tgggtccgccttaatctggaag

SEQ ID NO: 3158046 - DNA, 17 bp, Homo sapiens
tgggtcggccctgccca

SEQ ID NO: 3158047 - DNA, 21 bp, Homo sapiens
tgggtctgggagtcacacagt

SEQ ID NO: 3158048 - DNA, 14 bp, Homo sapiens
tgggtctgtgcatt

SEQ ID NO: 3158049 - DNA, 20 bp, Homo sapiens
tgggtctgtgtctcttttct

SEQ ID NO: 3158050 - DNA, 14 bp, Homo sapiens
tgggtctgttttcc

SEQ ID NO: 3158051 - DNA, 14 bp, Homo sapiens
tgggtcttatgctt

SEQ ID NO: 3158052 - DNA, 22 bp, Homo sapiens
tgggtcttgttttttttttcca

SEQ ID NO: 3158053 - DNA, 20 bp, Homo sapiens
tgggtgaaggcctggctgga

SEQ ID NO: 3158054 - DNA, 21 bp, Homo sapiens
tgggtgaaggcctggctggaa

SEQ ID NO: 3158055 - DNA, 19 bp, Homo sapiens
tgggtgagatgctggagaa

SEQ ID NO: 3158056 - DNA, 12 bp, Homo sapiens
tgggtgagccag

SEQ ID NO: 3158057 - DNA, 14 bp, Homo sapiens
tgggtgaggaaatc

SEQ ID NO: 3158058 - DNA, 15 bp, Homo sapiens
tgggtgctgccctgt

SEQ ID NO: 3158059 - DNA, 18 bp, Homo sapiens
tgggtgctggctgcccag

SEQ ID NO: 3158060 - DNA, 13 bp, Homo sapiens
tgggtgctggtcc

SEQ ID NO: 3158061 - DNA, 16 bp, Homo sapiens
tgggtgctggtcctgt

SEQ ID NO: 3158062 - DNA, 17 bp, Homo sapiens
tgggtggaaactaagac

SEQ ID NO: 3158063 - DNA, 23 bp, Homo sapiens
tgggtggatgcctggtggcagct

SEQ ID NO: 3158064 - DNA, 12 bp, Homo sapiens
tgggtgggagag

SEQ ID NO: 3158065 - DNA, 19 bp, Homo sapiens
tgggtgggctctgtgcagt

SEQ ID NO: 3158066 - DNA, 12 bp, Homo sapiens
tgggtgggggct

SEQ ID NO: 3158067 - DNA, 17 bp, Homo sapiens
tgggtgggggctcctgg

SEQ ID NO: 3158068 - DNA, 20 bp, Homo sapiens
tgggtggggtgaggaccact

SEQ ID NO: 3158069 - DNA, 13 bp, Homo sapiens
tgggtggtaccct

SEQ ID NO: 3158070 - DNA, 14 bp, Homo sapiens
tgggtggtaccctc

SEQ ID NO: 3158071 - DNA, 18 bp, Homo sapiens
tgggtggtaccctctgga

SEQ ID NO: 3158072 - DNA, 14 bp, Homo sapiens
tgggtggtggggag

SEQ ID NO: 3158073 - DNA, 14 bp, Homo sapiens
tgggtggttcctaa

SEQ ID NO: 3158074 - DNA, 15 bp, Homo sapiens
tgggtggttcctaag

SEQ ID NO: 3158075 - DNA, 23 bp, Homo sapiens
tgggtgtcaagagggtctgagga

SEQ ID NO: 3158076 - DNA, 18 bp, Homo sapiens
tgggtgtgtgtagccaag

SEQ ID NO: 3158077 - DNA, 19 bp, Homo sapiens
tgggtgttcctggcagttt

SEQ ID NO: 3158078 - DNA, 15 bp, Homo sapiens
tgggtgttgatctta

SEQ ID NO: 3158079 - DNA, 23 bp, Homo sapiens
tgggttaatggctagtactgtat

SEQ ID NO: 3158080 - DNA, 23 bp, Homo sapiens
tgggttcaagcgattcttctgct

SEQ ID NO: 3158081 - DNA, 16 bp, Homo sapiens
tgggttcactgcaacc

SEQ ID NO: 3158082 - DNA, 13 bp, Homo sapiens
tgggttcattatt

SEQ ID NO: 3158083 - DNA, 20 bp, Homo sapiens
tgggttccctttccttccat

SEQ ID NO: 3158084 - DNA, 21 bp, Homo sapiens
tgggttcctcttccccactcc

SEQ ID NO: 3158085 - DNA, 19 bp, Homo sapiens
tgggttgaatatagcctgc

SEQ ID NO: 3158086 - DNA, 22 bp, Homo sapiens
tgggttgaatatagcctgcctc

SEQ ID NO: 3158087 - DNA, 12 bp, Homo sapiens
tgggttgacccc

SEQ ID NO: 3158088 - DNA, 21 bp, Homo sapiens
tgggttgggggcactcagcca

SEQ ID NO: 3158089 - DNA, 22 bp, Homo sapiens
tgggttgggggcactcagccac

SEQ ID NO: 3158090 - DNA, 19 bp, Homo sapiens
tgggttggtgcacagtgat

SEQ ID NO: 3158091 - DNA, 20 bp, Homo sapiens
tgggttggtgcacagtgatt

SEQ ID NO: 3158092 - DNA, 13 bp, Homo sapiens
tgggtttcaagaa

SEQ ID NO: 3158093 - DNA, 23 bp, Homo sapiens
tgggtttcaagaaaatctttgtt

SEQ ID NO: 3158094 - DNA, 16 bp, Homo sapiens
tgggtttcctgcaggc

SEQ ID NO: 3158095 - DNA, 21 bp, Homo sapiens
tgggtttggaccccagctggg

SEQ ID NO: 3158096 - DNA, 19 bp, Homo sapiens
tgggtttggttagaggaag

SEQ ID NO: 3158097 - DNA, 15 bp, Homo sapiens
tgggtttttgttacc

SEQ ID NO: 3158098 - DNA, 20 bp, Homo sapiens
tggtaaaactcactgtgatc

SEQ ID NO: 3158099 - DNA, 14 bp, Homo sapiens
tggtaacagatttg

SEQ ID NO: 3158100 - DNA, 14 bp, Homo sapiens
tggtaactgctttc

SEQ ID NO: 3158101 - DNA, 14 bp, Homo sapiens
tggtaacttttgtg

SEQ ID NO: 3158102 - DNA, 12 bp, Homo sapiens
tggtaagagaaa

SEQ ID NO: 3158103 - DNA, 13 bp, Homo sapiens
tggtaagagaaaa

SEQ ID NO: 3158104 - DNA, 19 bp, Homo sapiens
tggtaagcaacatggcttt

SEQ ID NO: 3158105 - DNA, 14 bp, Homo sapiens
tggtaatattgact

SEQ ID NO: 3158106 - DNA, 22 bp, Homo sapiens
tggtaattattttggtactttt

SEQ ID NO: 3158107 - DNA, 12 bp, Homo sapiens
tggtaattcact

SEQ ID NO: 3158108 - DNA, 13 bp, Homo sapiens
tggtaattgttgc

SEQ ID NO: 3158109 - DNA, 17 bp, Homo sapiens
tggtacagttgcaggag

SEQ ID NO: 3158110 - DNA, 16 bp, Homo sapiens
tggtacatggccagtg

SEQ ID NO: 3158111 - DNA, 15 bp, Homo sapiens
tggtaccagccctgg

SEQ ID NO: 3158112 - DNA, 17 bp, Homo sapiens
tggtacccagccatctg

SEQ ID NO: 3158113 - DNA, 18 bp, Homo sapiens
tggtacccagccatctgc

SEQ ID NO: 3158114 - DNA, 22 bp, Homo sapiens
tggtacccagccatctgcccag

SEQ ID NO: 3158115 - DNA, 16 bp, Homo sapiens
tggtacccccttctgg

SEQ ID NO: 3158116 - DNA, 20 bp, Homo sapiens
tggtacccccttctgggcat

SEQ ID NO: 3158117 - DNA, 15 bp, Homo sapiens
tggtaccctcctggc

SEQ ID NO: 3158118 - DNA, 14 bp, Homo sapiens
tggtacctgccctc

SEQ ID NO: 3158119 - DNA, 21 bp, Homo sapiens
tggtactagtgtggtgtgttt

SEQ ID NO: 3158120 - DNA, 21 bp, Homo sapiens
tggtactgactttgcttgctt

SEQ ID NO: 3158121 - DNA, 19 bp, Homo sapiens
tggtacttttatgatgtat

SEQ ID NO: 3158122 - DNA, 21 bp, Homo sapiens
tggtacttttatgatgtatat

SEQ ID NO: 3158123 - DNA, 22 bp, Homo sapiens
tggtacttttatgatgtatatt

SEQ ID NO: 3158124 - DNA, 14 bp, Homo sapiens
tggtagctcaggtg

SEQ ID NO: 3158125 - DNA, 22 bp, Homo sapiens
tggtaggatcagccctcatttt

SEQ ID NO: 3158126 - DNA, 15 bp, Homo sapiens
tggtaggcttatcaa

SEQ ID NO: 3158127 - DNA, 20 bp, Homo sapiens
tggtaggcttatcaaaatct

SEQ ID NO: 3158128 - DNA, 19 bp, Homo sapiens
tggtagggtgggagtggtt

SEQ ID NO: 3158129 - DNA, 22 bp, Homo sapiens
tggtagtactcctgcaaaattt

SEQ ID NO: 3158130 - DNA, 16 bp, Homo sapiens
tggtataatgtttaaa

SEQ ID NO: 3158131 - DNA, 22 bp, Homo sapiens
tggtatatccaaaagcttttta

SEQ ID NO: 3158132 - DNA, 18 bp, Homo sapiens
tggtatcaaaattacata

SEQ ID NO: 3158133 - DNA, 20 bp, Homo sapiens
tggtatcctactgagcattt

SEQ ID NO: 3158134 - DNA, 22 bp, Homo sapiens
tggtatctcagaaagtgcctga

SEQ ID NO: 3158135 - DNA, 14 bp, Homo sapiens
tggtatgctggcca

SEQ ID NO: 3158136 - DNA, 18 bp, Homo sapiens
tggtatgctggccagcac

SEQ ID NO: 3158137 - DNA, 18 bp, Homo sapiens
tggtatgtaatttatgca

SEQ ID NO: 3158138 - DNA, 18 bp, Homo sapiens
tggtattacactgtattt

SEQ ID NO: 3158139 - DNA, 19 bp, Homo sapiens
tggtattattctgttttgc

SEQ ID NO: 3158140 - DNA, 22 bp, Homo sapiens
tggtcaagattttgaatgcttc

SEQ ID NO: 3158141 - DNA, 15 bp, Homo sapiens
tggtcacacactgat

SEQ ID NO: 3158142 - DNA, 16 bp, Homo sapiens
tggtcacacactgatg

SEQ ID NO: 3158143 - DNA, 20 bp, Homo sapiens
tggtcacagccatgaagtca

SEQ ID NO: 3158144 - DNA, 22 bp, Homo sapiens
tggtcacaggactctgcctcct

SEQ ID NO: 3158145 - DNA, 15 bp, Homo sapiens
tggtcaccttcgagt

SEQ ID NO: 3158146 - DNA, 16 bp, Homo sapiens
tggtcaccttcgagta

SEQ ID NO: 3158147 - DNA, 18 bp, Homo sapiens
tggtcactaaccaacaag

SEQ ID NO: 3158148 - DNA, 14 bp, Homo sapiens
tggtcactgctgtc

SEQ ID NO: 3158149 - DNA, 14 bp, Homo sapiens
tggtcactgtgcac

SEQ ID NO: 3158150 - DNA, 19 bp, Homo sapiens
tggtcactgtgcactgccc

SEQ ID NO: 3158151 - DNA, 14 bp, Homo sapiens
tggtcagagtgcca

SEQ ID NO: 3158152 - DNA, 15 bp, Homo sapiens
tggtcagatttgaac

SEQ ID NO: 3158153 - DNA, 16 bp, Homo sapiens
tggtcagcgttgcatg

SEQ ID NO: 3158154 - DNA, 13 bp, Homo sapiens
tggtcagctccct

SEQ ID NO: 3158155 - DNA, 17 bp, Homo sapiens
tggtcagtgtggagagg

SEQ ID NO: 3158156 - DNA, 21 bp, Homo sapiens
tggtcagtgtggagaggggtg

SEQ ID NO: 3158157 - DNA, 18 bp, Homo sapiens
tggtccagctctgacatc

SEQ ID NO: 3158158 - DNA, 21 bp, Homo sapiens
tggtccagctctgacatccct

SEQ ID NO: 3158159 - DNA, 23 bp, Homo sapiens
tggtccagctctgacatcccttc

SEQ ID NO: 3158160 - DNA, 19 bp, Homo sapiens
tggtccagggaagctggcc

SEQ ID NO: 3158161 - DNA, 18 bp, Homo sapiens
tggtccatgctgatgatt

SEQ ID NO: 3158162 - DNA, 13 bp, Homo sapiens
tggtcccactcag

SEQ ID NO: 3158163 - DNA, 13 bp, Homo sapiens
tggtcccatccag

SEQ ID NO: 3158164 - DNA, 16 bp, Homo sapiens
tggtcccatccaggca

SEQ ID NO: 3158165 - DNA, 18 bp, Homo sapiens
tggtcccatccaggcagt

SEQ ID NO: 3158166 - DNA, 13 bp, Homo sapiens
tggtccctcaccc

SEQ ID NO: 3158167 - DNA, 13 bp, Homo sapiens
tggtccctcgtcc

SEQ ID NO: 3158168 - DNA, 14 bp, Homo sapiens
tggtccctctgagg

SEQ ID NO: 3158169 - DNA, 15 bp, Homo sapiens
tggtccctctgaggc

SEQ ID NO: 3158170 - DNA, 18 bp, Homo sapiens
tggtccctctgaggcagt

SEQ ID NO: 3158171 - DNA, 19 bp, Homo sapiens
tggtccctgggaggaaatt

SEQ ID NO: 3158172 - DNA, 20 bp, Homo sapiens
tggtcctgagggtccccacc

SEQ ID NO: 3158173 - DNA, 11 bp, Homo sapiens
tggtcctgggg

SEQ ID NO: 3158174 - DNA, 16 bp, Homo sapiens
tggtcctggggctctg

SEQ ID NO: 3158175 - DNA, 22 bp, Homo sapiens
tggtccttaggagacgctgcac

SEQ ID NO: 3158176 - DNA, 16 bp, Homo sapiens
tggtcctttctccaca

SEQ ID NO: 3158177 - DNA, 20 bp, Homo sapiens
tggtcgaggagtaacaatac

SEQ ID NO: 3158178 - DNA, 13 bp, Homo sapiens
tggtcgctcctgc

SEQ ID NO: 3158179 - DNA, 18 bp, Homo sapiens
tggtctaaaaataaacca

SEQ ID NO: 3158180 - DNA, 12 bp, Homo sapiens
tggtctaaaact

SEQ ID NO: 3158181 - DNA, 17 bp, Homo sapiens
tggtctattttctgcag

SEQ ID NO: 3158182 - DNA, 13 bp, Homo sapiens
tggtctcaggata

SEQ ID NO: 3158183 - DNA, 23 bp, Homo sapiens
tggtctcccatatgcagaaatag

SEQ ID NO: 3158184 - DNA, 21 bp, Homo sapiens
tggtctgaactagttgagaga

SEQ ID NO: 3158185 - DNA, 12 bp, Homo sapiens
tggtctgaatgt

SEQ ID NO: 3158186 - DNA, 21 bp, Homo sapiens
tggtctgaatgttctgacatt

SEQ ID NO: 3158187 - DNA, 16 bp, Homo sapiens
tggtctgggacttcct

SEQ ID NO: 3158188 - DNA, 19 bp, Homo sapiens
tggtctgggacttccttgc

SEQ ID NO: 3158189 - DNA, 21 bp, Homo sapiens
tggtctgggacttccttgctc

SEQ ID NO: 3158190 - DNA, 15 bp, Homo sapiens
tggtctggtgttcca

SEQ ID NO: 3158191 - DNA, 16 bp, Homo sapiens
tggtctggttgggcag

SEQ ID NO: 3158192 - DNA, 15 bp, Homo sapiens
tggtctgtgaagagc

SEQ ID NO: 3158193 - DNA, 18 bp, Homo sapiens
tggtctgtgtgtgttctt

SEQ ID NO: 3158194 - DNA, 19 bp, Homo sapiens
tggtctgtgtgtgttcttc

SEQ ID NO: 3158195 - DNA, 18 bp, Homo sapiens
tggtctgttggcaggctg

SEQ ID NO: 3158196 - DNA, 13 bp, Homo sapiens
tggtctttgtaag

SEQ ID NO: 3158197 - DNA, 15 bp, Homo sapiens
tggtgaaaatgtact

SEQ ID NO: 3158198 - DNA, 21 bp, Homo sapiens
tggtgaagtaacatgcatact

SEQ ID NO: 3158199 - DNA, 14 bp, Homo sapiens
tggtgaatggattt

SEQ ID NO: 3158200 - DNA, 17 bp, Homo sapiens
tggtgaatggccttcct

SEQ ID NO: 3158201 - DNA, 16 bp, Homo sapiens
tggtgaatttcacaag

SEQ ID NO: 3158202 - DNA, 15 bp, Homo sapiens
tggtgacatttccca

SEQ ID NO: 3158203 - DNA, 21 bp, Homo sapiens
tggtgacatttcccaagtcag

SEQ ID NO: 3158204 - DNA, 13 bp, Homo sapiens
tggtgacctctgc

SEQ ID NO: 3158205 - DNA, 15 bp, Homo sapiens
tggtgactcacttca

SEQ ID NO: 3158206 - DNA, 15 bp, Homo sapiens
tggtgactgtcccac

SEQ ID NO: 3158207 - DNA, 19 bp, Homo sapiens
tggtgagaaatttctgtga

SEQ ID NO: 3158208 - DNA, 16 bp, Homo sapiens
tggtgagagtcaaagc

SEQ ID NO: 3158209 - DNA, 17 bp, Homo sapiens
tggtgagagtcaaagct

SEQ ID NO: 3158210 - DNA, 13 bp, Homo sapiens
tggtgagctggga

SEQ ID NO: 3158211 - DNA, 21 bp, Homo sapiens
tggtgagctgggaagctgtac

SEQ ID NO: 3158212 - DNA, 13 bp, Homo sapiens
tggtgaggagcac

SEQ ID NO: 3158213 - DNA, 15 bp, Homo sapiens
tggtgatcctctatt

SEQ ID NO: 3158214 - DNA, 13 bp, Homo sapiens
tggtgcagacaga

SEQ ID NO: 3158215 - DNA, 19 bp, Homo sapiens
tggtgcagagaagctggac

SEQ ID NO: 3158216 - DNA, 20 bp, Homo sapiens
tggtgcagagaagctggact

SEQ ID NO: 3158217 - DNA, 19 bp, Homo sapiens
tggtgcattacagagagga

SEQ ID NO: 3158218 - DNA, 15 bp, Homo sapiens
tggtgcccctcgcca

SEQ ID NO: 3158219 - DNA, 15 bp, Homo sapiens
tggtgcctcactggg

SEQ ID NO: 3158220 - DNA, 13 bp, Homo sapiens
tggtgcctccaga

SEQ ID NO: 3158221 - DNA, 18 bp, Homo sapiens
tggtgcctctcttggctc

SEQ ID NO: 3158222 - DNA, 19 bp, Homo sapiens
tggtgcctgagaggcaggc

SEQ ID NO: 3158223 - DNA, 20 bp, Homo sapiens
tggtgcctgagaggcaggca

SEQ ID NO: 3158224 - DNA, 12 bp, Homo sapiens
tggtgcctggcc

SEQ ID NO: 3158225 - DNA, 22 bp, Homo sapiens
tggtgcctggcctggcacacat

SEQ ID NO: 3158226 - DNA, 24 bp, Homo sapiens
tggtgcctggcctggcacacatca

SEQ ID NO: 3158227 - DNA, 19 bp, Homo sapiens
tggtgcctttcctgttcag

SEQ ID NO: 3158228 - DNA, 20 bp, Homo sapiens
tggtgcctttcctgttcagc

SEQ ID NO: 3158229 - DNA, 16 bp, Homo sapiens
tggtgctatttgaaga

SEQ ID NO: 3158230 - DNA, 21 bp, Homo sapiens
tggtgctcaccatgcttccag

SEQ ID NO: 3158231 - DNA, 15 bp, Homo sapiens
tggtgctgcagattt

SEQ ID NO: 3158232 - DNA, 13 bp, Homo sapiens
tggtgctgccaca

SEQ ID NO: 3158233 - DNA, 12 bp, Homo sapiens
tggtgctggata

SEQ ID NO: 3158234 - DNA, 17 bp, Homo sapiens
tggtgcttaagttccag

SEQ ID NO: 3158235 - DNA, 22 bp, Homo sapiens
tggtgcttacacatctcagacc

SEQ ID NO: 3158236 - DNA, 17 bp, Homo sapiens
tggtgctttttataaaa

SEQ ID NO: 3158237 - DNA, 18 bp, Homo sapiens
tggtggacagtcctggga

SEQ ID NO: 3158238 - DNA, 22 bp, Homo sapiens
tggtggaccctactattcatgt

SEQ ID NO: 3158239 - DNA, 15 bp, Homo sapiens
tggtggactacaaaa

SEQ ID NO: 3158240 - DNA, 19 bp, Homo sapiens
tggtggagggggctgggct

SEQ ID NO: 3158241 - DNA, 13 bp, Homo sapiens
tggtggcagtggg

SEQ ID NO: 3158242 - DNA, 18 bp, Homo sapiens
tggtggcagtgggagctg

SEQ ID NO: 3158243 - DNA, 20 bp, Homo sapiens
tggtggcagtgggagctgcc

SEQ ID NO: 3158244 - DNA, 21 bp, Homo sapiens
tggtggcccgacagcctggca

SEQ ID NO: 3158245 - DNA, 13 bp, Homo sapiens
tggtggccttctg

SEQ ID NO: 3158246 - DNA, 19 bp, Homo sapiens
tggtggccttctgctgccc

SEQ ID NO: 3158247 - DNA, 17 bp, Homo sapiens
tggtggctcatgcctgt

SEQ ID NO: 3158248 - DNA, 14 bp, Homo sapiens
tggtggctcatggc

SEQ ID NO: 3158249 - DNA, 23 bp, Homo sapiens
tggtgggaaggccggcagcgggc

SEQ ID NO: 3158250 - DNA, 23 bp, Homo sapiens
tggtgggaggggcgcccacctcc

SEQ ID NO: 3158251 - DNA, 17 bp, Homo sapiens
tggtggggccaggccag

SEQ ID NO: 3158252 - DNA, 21 bp, Homo sapiens
tggtggggccaggccaggacc

SEQ ID NO: 3158253 - DNA, 22 bp, Homo sapiens
tggtggggccaggccaggacca

SEQ ID NO: 3158254 - DNA, 23 bp, Homo sapiens
tggtggggccaggccaggaccac

SEQ ID NO: 3158255 - DNA, 14 bp, Homo sapiens
tggtggtactttat

SEQ ID NO: 3158256 - DNA, 14 bp, Homo sapiens
tggtggtattttat

SEQ ID NO: 3158257 - DNA, 19 bp, Homo sapiens
tggtggttcctttgcaccc

SEQ ID NO: 3158258 - DNA, 17 bp, Homo sapiens
tggtggtttcacggtgc

SEQ ID NO: 3158259 - DNA, 15 bp, Homo sapiens
tggtgtaaagctggc

SEQ ID NO: 3158260 - DNA, 14 bp, Homo sapiens
tggtgtaataagac

SEQ ID NO: 3158261 - DNA, 21 bp, Homo sapiens
tggtgtactgggttaatggct

SEQ ID NO: 3158262 - DNA, 21 bp, Homo sapiens
tggtgtagaacactaattcat

SEQ ID NO: 3158263 - DNA, 23 bp, Homo sapiens
tggtgtatagaagtttgtccatt

SEQ ID NO: 3158264 - DNA, 23 bp, Homo sapiens
tggtgtatcccccccctgtatag

SEQ ID NO: 3158265 - DNA, 18 bp, Homo sapiens
tggtgtcacatggggcct

SEQ ID NO: 3158266 - DNA, 16 bp, Homo sapiens
tggtgtcacctgaaga

SEQ ID NO: 3158267 - DNA, 13 bp, Homo sapiens
tggtgtccagctg

SEQ ID NO: 3158268 - DNA, 15 bp, Homo sapiens
tggtgtcctgaccac

SEQ ID NO: 3158269 - DNA, 17 bp, Homo sapiens
tggtgtcgtctgtgaat

SEQ ID NO: 3158270 - DNA, 11 bp, Homo sapiens
tggtgtcttcc

SEQ ID NO: 3158271 - DNA, 15 bp, Homo sapiens
tggtgtgaaagtcag

SEQ ID NO: 3158272 - DNA, 13 bp, Homo sapiens
tggtgtgaccatg

SEQ ID NO: 3158273 - DNA, 18 bp, Homo sapiens
tggtgtgaccatgttcat

SEQ ID NO: 3158274 - DNA, 18 bp, Homo sapiens
tggtgtgtccctggacac

SEQ ID NO: 3158275 - DNA, 20 bp, Homo sapiens
tggtgtgtccctggacacag

SEQ ID NO: 3158276 - DNA, 23 bp, Homo sapiens
tggtgtgtccctggacacagctc

SEQ ID NO: 3158277 - DNA, 14 bp, Homo sapiens
tggtgtgttggaca

SEQ ID NO: 3158278 - DNA, 21 bp, Homo sapiens
tggtgtgttggacagagaagg

SEQ ID NO: 3158279 - DNA, 11 bp, Homo sapiens
tggtgtgtttc

SEQ ID NO: 3158280 - DNA, 20 bp, Homo sapiens
tggtgttcaccaaaaccaaa

SEQ ID NO: 3158281 - DNA, 13 bp, Homo sapiens
tggtgttccattg

SEQ ID NO: 3158282 - DNA, 16 bp, Homo sapiens
tggtgttcctggaagc

SEQ ID NO: 3158283 - DNA, 16 bp, Homo sapiens
tggtgtttgtctgtgt

SEQ ID NO: 3158284 - DNA, 21 bp, Homo sapiens
tggtgttttaaagagaatgta

SEQ ID NO: 3158285 - DNA, 13 bp, Homo sapiens
tggttaaaaaggc

SEQ ID NO: 3158286 - DNA, 16 bp, Homo sapiens
tggttaaaaaggccaa

SEQ ID NO: 3158287 - DNA, 13 bp, Homo sapiens
tggttaataaaac

SEQ ID NO: 3158288 - DNA, 17 bp, Homo sapiens
tggttaataaaactgca

SEQ ID NO: 3158289 - DNA, 13 bp, Homo sapiens
tggttacactgtt

SEQ ID NO: 3158290 - DNA, 23 bp, Homo sapiens
tggttactcagggttcatctgtc

SEQ ID NO: 3158291 - DNA, 13 bp, Homo sapiens
tggttagaaatgc

SEQ ID NO: 3158292 - DNA, 18 bp, Homo sapiens
tggttatgaaagaatata

SEQ ID NO: 3158293 - DNA, 20 bp, Homo sapiens
tggttatgaaagaatatatt

SEQ ID NO: 3158294 - DNA, 19 bp, Homo sapiens
tggttattctaagcccttt

SEQ ID NO: 3158295 - DNA, 20 bp, Homo sapiens
tggttcagctactttccatt

SEQ ID NO: 3158296 - DNA, 16 bp, Homo sapiens
tggttccaagccctgg

SEQ ID NO: 3158297 - DNA, 22 bp, Homo sapiens
tggttccagggtccctctgtgt

SEQ ID NO: 3158298 - DNA, 22 bp, Homo sapiens
tggttccatgcctgagggtgga

SEQ ID NO: 3158299 - DNA, 18 bp, Homo sapiens
tggttcccctgttcactc

SEQ ID NO: 3158300 - DNA, 19 bp, Homo sapiens
tggttcccctgttcactct

SEQ ID NO: 3158301 - DNA, 13 bp, Homo sapiens
tggttcctctgct

SEQ ID NO: 3158302 - DNA, 16 bp, Homo sapiens
tggttcctgactggca

SEQ ID NO: 3158303 - DNA, 22 bp, Homo sapiens
tggttctaaggacctgaaattc

SEQ ID NO: 3158304 - DNA, 12 bp, Homo sapiens
tggttctatttt

SEQ ID NO: 3158305 - DNA, 13 bp, Homo sapiens
tggttctatttta

SEQ ID NO: 3158306 - DNA, 13 bp, Homo sapiens
tggttctgatgcc

SEQ ID NO: 3158307 - DNA, 13 bp, Homo sapiens
tggttctgtgacc

SEQ ID NO: 3158308 - DNA, 18 bp, Homo sapiens
tggttctgtgacccatct

SEQ ID NO: 3158309 - DNA, 19 bp, Homo sapiens
tggttctgtgacccatctg

SEQ ID NO: 3158310 - DNA, 18 bp, Homo sapiens
tggttgatgatctttgca

SEQ ID NO: 3158311 - DNA, 19 bp, Homo sapiens
tggttgccaccccaaccca

SEQ ID NO: 3158312 - DNA, 12 bp, Homo sapiens
tggttgcctggg

SEQ ID NO: 3158313 - DNA, 18 bp, Homo sapiens
tggttgccttaaagaaag

SEQ ID NO: 3158314 - DNA, 20 bp, Homo sapiens
tggttgtatatttttatatt

SEQ ID NO: 3158315 - DNA, 12 bp, Homo sapiens
tggttgtatttc

SEQ ID NO: 3158316 - DNA, 14 bp, Homo sapiens
tggttgtatttcta

SEQ ID NO: 3158317 - DNA, 12 bp, Homo sapiens
tggttgttgcca

SEQ ID NO: 3158318 - DNA, 15 bp, Homo sapiens
tggttgttgccaact

SEQ ID NO: 3158319 - DNA, 19 bp, Homo sapiens
tggtttaaagaaagtgtat

SEQ ID NO: 3158320 - DNA, 19 bp, Homo sapiens
tggtttaaatacataaata

SEQ ID NO: 3158321 - DNA, 22 bp, Homo sapiens
tggtttacaggccctgctcctg

SEQ ID NO: 3158322 - DNA, 14 bp, Homo sapiens
tggtttactttcaa

SEQ ID NO: 3158323 - DNA, 11 bp, Homo sapiens
tggtttataga

SEQ ID NO: 3158324 - DNA, 22 bp, Homo sapiens
tggtttatatgccctcaagtaa

SEQ ID NO: 3158325 - DNA, 14 bp, Homo sapiens
tggtttatattctt

SEQ ID NO: 3158326 - DNA, 16 bp, Homo sapiens
tggtttattttgtatt

SEQ ID NO: 3158327 - DNA, 16 bp, Homo sapiens
tggtttatttttgtaa

SEQ ID NO: 3158328 - DNA, 19 bp, Homo sapiens
tggtttatttttgtaatgt

SEQ ID NO: 3158329 - DNA, 21 bp, Homo sapiens
tggtttcaagttattcaaatt

SEQ ID NO: 3158330 - DNA, 22 bp, Homo sapiens
tggtttcataacttcctgtact

SEQ ID NO: 3158331 - DNA, 14 bp, Homo sapiens
tggtttccaatgtg

SEQ ID NO: 3158332 - DNA, 16 bp, Homo sapiens
tggtttccaatgtgtt

SEQ ID NO: 3158333 - DNA, 18 bp, Homo sapiens
tggtttccacatgctctg

SEQ ID NO: 3158334 - DNA, 18 bp, Homo sapiens
tggtttccagtcatgagc

SEQ ID NO: 3158335 - DNA, 16 bp, Homo sapiens
tggtttctcattcttg

SEQ ID NO: 3158336 - DNA, 14 bp, Homo sapiens
tggtttctgaaaat

SEQ ID NO: 3158337 - DNA, 22 bp, Homo sapiens
tggtttgaaagattatgatgca

SEQ ID NO: 3158338 - DNA, 13 bp, Homo sapiens
tggtttgagattg

SEQ ID NO: 3158339 - DNA, 22 bp, Homo sapiens
tggtttgcctgcttaaaaggta

SEQ ID NO: 3158340 - DNA, 18 bp, Homo sapiens
tggtttgggggcgccctc

SEQ ID NO: 3158341 - DNA, 17 bp, Homo sapiens
tggtttggttcctctct

SEQ ID NO: 3158342 - DNA, 13 bp, Homo sapiens
tggtttgtatgag

SEQ ID NO: 3158343 - DNA, 15 bp, Homo sapiens
tggttttcaaaataa

SEQ ID NO: 3158344 - DNA, 16 bp, Homo sapiens
tggtttttaattttgt

SEQ ID NO: 3158345 - DNA, 14 bp, Homo sapiens
tggtttttgctctc

SEQ ID NO: 3158346 - DNA, 20 bp, Homo sapiens
tggtttttttttttcttaaa

SEQ ID NO: 3158347 - DNA, 15 bp, Homo sapiens
tgtaaaaaaagcaaa

SEQ ID NO: 3158348 - DNA, 24 bp, Homo sapiens
tgtaaaaacagcattgctttctga

SEQ ID NO: 3158349 - DNA, 22 bp, Homo sapiens
tgtaaaaacccaagtccctgtc

SEQ ID NO: 3158350 - DNA, 17 bp, Homo sapiens
tgtaaaactcgctttta

SEQ ID NO: 3158351 - DNA, 23 bp, Homo sapiens
tgtaaaagaaaattttttttcaa

SEQ ID NO: 3158352 - DNA, 18 bp, Homo sapiens
tgtaaaataagaatgatt

SEQ ID NO: 3158353 - DNA, 12 bp, Homo sapiens
tgtaaaatagct

SEQ ID NO: 3158354 - DNA, 14 bp, Homo sapiens
tgtaaaatagcttg

SEQ ID NO: 3158355 - DNA, 20 bp, Homo sapiens
tgtaaaatagcttgtatagt

SEQ ID NO: 3158356 - DNA, 14 bp, Homo sapiens
tgtaaaatgaaatt

SEQ ID NO: 3158357 - DNA, 20 bp, Homo sapiens
tgtaaaatgtgaagtgaatg

SEQ ID NO: 3158358 - DNA, 18 bp, Homo sapiens
tgtaaaattataaacttt

SEQ ID NO: 3158359 - DNA, 21 bp, Homo sapiens
tgtaaaattataaacttttat

SEQ ID NO: 3158360 - DNA, 17 bp, Homo sapiens
tgtaaacaacgtgtata

SEQ ID NO: 3158361 - DNA, 20 bp, Homo sapiens
tgtaaacagaagcctgtttc

SEQ ID NO: 3158362 - DNA, 18 bp, Homo sapiens
tgtaaacagcctcttttt

SEQ ID NO: 3158363 - DNA, 20 bp, Homo sapiens
tgtaaacaggagacaggaag

SEQ ID NO: 3158364 - DNA, 15 bp, Homo sapiens
tgtaaaccattgtaa

SEQ ID NO: 3158365 - DNA, 15 bp, Homo sapiens
tgtaaactcaaaata

SEQ ID NO: 3158366 - DNA, 20 bp, Homo sapiens
tgtaaactcaaaatatttgt

SEQ ID NO: 3158367 - DNA, 23 bp, Homo sapiens
tgtaaactcaaaatatttgtaca

SEQ ID NO: 3158368 - DNA, 18 bp, Homo sapiens
tgtaaactgcattagaaa

SEQ ID NO: 3158369 - DNA, 13 bp, Homo sapiens
tgtaaactgtgta

SEQ ID NO: 3158370 - DNA, 14 bp, Homo sapiens
tgtaaactgtgtat

SEQ ID NO: 3158371 - DNA, 19 bp, Homo sapiens
tgtaaactgtgtattccaa

SEQ ID NO: 3158372 - DNA, 13 bp, Homo sapiens
tgtaaacttctga

SEQ ID NO: 3158373 - DNA, 14 bp, Homo sapiens
tgtaaacttctgaa

SEQ ID NO: 3158374 - DNA, 17 bp, Homo sapiens
tgtaaacttctgaagac

SEQ ID NO: 3158375 - DNA, 22 bp, Homo sapiens
tgtaaacttctgaagactgaga

SEQ ID NO: 3158376 - DNA, 16 bp, Homo sapiens
tgtaaagctggccctg

SEQ ID NO: 3158377 - DNA, 15 bp, Homo sapiens
tgtaaaggagggaga

SEQ ID NO: 3158378 - DNA, 16 bp, Homo sapiens
tgtaaaggagggagat

SEQ ID NO: 3158379 - DNA, 19 bp, Homo sapiens
tgtaaaggagtcaaaacta

SEQ ID NO: 3158380 - DNA, 16 bp, Homo sapiens
tgtaaagtaagacatc

SEQ ID NO: 3158381 - DNA, 17 bp, Homo sapiens
tgtaaagtgtaaatcct

SEQ ID NO: 3158382 - DNA, 15 bp, Homo sapiens
tgtaaataaaatgtg

SEQ ID NO: 3158383 - DNA, 17 bp, Homo sapiens
tgtaaataaaatgtgta

SEQ ID NO: 3158384 - DNA, 19 bp, Homo sapiens
tgtaaataaaatgtgtaca

SEQ ID NO: 3158385 - DNA, 21 bp, Homo sapiens
tgtaaataaccacaaggtcca

SEQ ID NO: 3158386 - DNA, 12 bp, Homo sapiens
tgtaaataagag

SEQ ID NO: 3158387 - DNA, 12 bp, Homo sapiens
tgtaaatacacc

SEQ ID NO: 3158388 - DNA, 20 bp, Homo sapiens
tgtaaataccagactgcagg

SEQ ID NO: 3158389 - DNA, 20 bp, Homo sapiens
tgtaaataccattgacacat

SEQ ID NO: 3158390 - DNA, 23 bp, Homo sapiens
tgtaaatactttgtcctaagaga

SEQ ID NO: 3158391 - DNA, 22 bp, Homo sapiens
tgtaaatatatgtctgataatg

SEQ ID NO: 3158392 - DNA, 12 bp, Homo sapiens
tgtaaatattta

SEQ ID NO: 3158393 - DNA, 21 bp, Homo sapiens
tgtaaatcatgttgatcatgt

SEQ ID NO: 3158394 - DNA, 19 bp, Homo sapiens
tgtaaatcctagacttgaa

SEQ ID NO: 3158395 - DNA, 12 bp, Homo sapiens
tgtaaatccttt

SEQ ID NO: 3158396 - DNA, 20 bp, Homo sapiens
tgtaaatcctttttctttat

SEQ ID NO: 3158397 - DNA, 13 bp, Homo sapiens
tgtaaatctgcca

SEQ ID NO: 3158398 - DNA, 14 bp, Homo sapiens
tgtaaatctgccac

SEQ ID NO: 3158399 - DNA, 15 bp, Homo sapiens
tgtaaatggtgtaca

SEQ ID NO: 3158400 - DNA, 18 bp, Homo sapiens
tgtaaatggtgtacataa

SEQ ID NO: 3158401 - DNA, 21 bp, Homo sapiens
tgtaaatgtttcttttccctt

SEQ ID NO: 3158402 - DNA, 16 bp, Homo sapiens
tgtaaattatttatgt

SEQ ID NO: 3158403 - DNA, 14 bp, Homo sapiens
tgtaaattgaactt

SEQ ID NO: 3158404 - DNA, 21 bp, Homo sapiens
tgtaacactgtgtacacctca

SEQ ID NO: 3158405 - DNA, 17 bp, Homo sapiens
tgtaacatactggcctg

SEQ ID NO: 3158406 - DNA, 14 bp, Homo sapiens
tgtaacatcataat

SEQ ID NO: 3158407 - DNA, 15 bp, Homo sapiens
tgtaacattggtgaa

SEQ ID NO: 3158408 - DNA, 20 bp, Homo sapiens
tgtaaccagtgcagaaatga

SEQ ID NO: 3158409 - DNA, 23 bp, Homo sapiens
tgtaaccagtgcagaaatgaaat

SEQ ID NO: 3158410 - DNA, 12 bp, Homo sapiens
tgtaacctcagc

SEQ ID NO: 3158411 - DNA, 18 bp, Homo sapiens
tgtaacctcagctctggg

SEQ ID NO: 3158412 - DNA, 23 bp, Homo sapiens
tgtaacctcagctctgggagagg

SEQ ID NO: 3158413 - DNA, 20 bp, Homo sapiens
tgtaactatagactggaaaa

SEQ ID NO: 3158414 - DNA, 12 bp, Homo sapiens
tgtaactgctga

SEQ ID NO: 3158415 - DNA, 20 bp, Homo sapiens
tgtaacttatgtagatattt

SEQ ID NO: 3158416 - DNA, 15 bp, Homo sapiens
tgtaacttttaatcc

SEQ ID NO: 3158417 - DNA, 13 bp, Homo sapiens
tgtaagaaaacaa

SEQ ID NO: 3158418 - DNA, 19 bp, Homo sapiens
tgtaagaaaacaaaatcta

SEQ ID NO: 3158419 - DNA, 20 bp, Homo sapiens
tgtaagaaaatgctgtcaca

SEQ ID NO: 3158420 - DNA, 21 bp, Homo sapiens
tgtaagaacaactacctgagc

SEQ ID NO: 3158421 - DNA, 19 bp, Homo sapiens
tgtaagaagagactgggaa

SEQ ID NO: 3158422 - DNA, 21 bp, Homo sapiens
tgtaagaagagactgggaaga

SEQ ID NO: 3158423 - DNA, 19 bp, Homo sapiens
tgtaagaagccccttattt

SEQ ID NO: 3158424 - DNA, 22 bp, Homo sapiens
tgtaagaataggcattaacaca

SEQ ID NO: 3158425 - DNA, 16 bp, Homo sapiens
tgtaagaattcagaag

SEQ ID NO: 3158426 - DNA, 18 bp, Homo sapiens
tgtaagaattcagaagac

SEQ ID NO: 3158427 - DNA, 17 bp, Homo sapiens
tgtaagaattctgattg

SEQ ID NO: 3158428 - DNA, 21 bp, Homo sapiens
tgtaagacaaaggttttcctc

SEQ ID NO: 3158429 - DNA, 18 bp, Homo sapiens
tgtaagacatttgtatat

SEQ ID NO: 3158430 - DNA, 20 bp, Homo sapiens
tgtaagacatttgtatattg

SEQ ID NO: 3158431 - DNA, 21 bp, Homo sapiens
tgtaagacatttgtatattgt

SEQ ID NO: 3158432 - DNA, 18 bp, Homo sapiens
tgtaagagtgtagaagca

SEQ ID NO: 3158433 - DNA, 17 bp, Homo sapiens
tgtaagatccaccccct

SEQ ID NO: 3158434 - DNA, 23 bp, Homo sapiens
tgtaagatccaccccctgcccac

SEQ ID NO: 3158435 - DNA, 12 bp, Homo sapiens
tgtaagatgctg

SEQ ID NO: 3158436 - DNA, 21 bp, Homo sapiens
tgtaagattatagattctaaa

SEQ ID NO: 3158437 - DNA, 15 bp, Homo sapiens
tgtaagccaaagaaa

SEQ ID NO: 3158438 - DNA, 18 bp, Homo sapiens
tgtaagccaaagaaatga

SEQ ID NO: 3158439 - DNA, 22 bp, Homo sapiens
tgtaagccaaagaaatgaacat

SEQ ID NO: 3158440 - DNA, 16 bp, Homo sapiens
tgtaagctgtttattt

SEQ ID NO: 3158441 - DNA, 22 bp, Homo sapiens
tgtaagctgtttattttatatt

SEQ ID NO: 3158442 - DNA, 13 bp, Homo sapiens
tgtaagggcagtg

SEQ ID NO: 3158443 - DNA, 14 bp, Homo sapiens
tgtaagggcagtgc

SEQ ID NO: 3158444 - DNA, 16 bp, Homo sapiens
tgtaagggcagtgccc

SEQ ID NO: 3158445 - DNA, 14 bp, Homo sapiens
tgtaagtgtgagta

SEQ ID NO: 3158446 - DNA, 17 bp, Homo sapiens
tgtaagtgtgagtaaga

SEQ ID NO: 3158447 - DNA, 22 bp, Homo sapiens
tgtaagttatttcttgtttgtt

SEQ ID NO: 3158448 - DNA, 14 bp, Homo sapiens
tgtaagttcacaac

SEQ ID NO: 3158449 - DNA, 15 bp, Homo sapiens
tgtaagttgtacaaa

SEQ ID NO: 3158450 - DNA, 17 bp, Homo sapiens
tgtaagttgtacaaatg

SEQ ID NO: 3158451 - DNA, 18 bp, Homo sapiens
tgtaagtttcaggtgaca

SEQ ID NO: 3158452 - DNA, 14 bp, Homo sapiens
tgtaataaagtgtt

SEQ ID NO: 3158453 - DNA, 16 bp, Homo sapiens
tgtaataaagtgtttt

SEQ ID NO: 3158454 - DNA, 15 bp, Homo sapiens
tgtaataaattcaaa

SEQ ID NO: 3158455 - DNA, 13 bp, Homo sapiens
tgtaataagacat

SEQ ID NO: 3158456 - DNA, 14 bp, Homo sapiens
tgtaataatacctc

SEQ ID NO: 3158457 - DNA, 20 bp, Homo sapiens
tgtaataatacctcaatgtt

SEQ ID NO: 3158458 - DNA, 23 bp, Homo sapiens
tgtaataatacctcaatgtttga

SEQ ID NO: 3158459 - DNA, 20 bp, Homo sapiens
tgtaatagggaaaattctaa

SEQ ID NO: 3158460 - DNA, 16 bp, Homo sapiens
tgtaatataaagtatt

SEQ ID NO: 3158461 - DNA, 18 bp, Homo sapiens
tgtaatatattgtacaaa

SEQ ID NO: 3158462 - DNA, 20 bp, Homo sapiens
tgtaatatattgtacaaatg

SEQ ID NO: 3158463 - DNA, 21 bp, Homo sapiens
tgtaatatattgtacaaatgt

SEQ ID NO: 3158464 - DNA, 14 bp, Homo sapiens
tgtaatcaatgttt

SEQ ID NO: 3158465 - DNA, 20 bp, Homo sapiens
tgtaatcagctctcctggct

SEQ ID NO: 3158466 - DNA, 20 bp, Homo sapiens
tgtaatccaggggtgtagat

SEQ ID NO: 3158467 - DNA, 13 bp, Homo sapiens
tgtaatcccccag

SEQ ID NO: 3158468 - DNA, 15 bp, Homo sapiens
tgtaatgaaaatgaa

SEQ ID NO: 3158469 - DNA, 13 bp, Homo sapiens
tgtaatgatcata

SEQ ID NO: 3158470 - DNA, 12 bp, Homo sapiens
tgtaatgctgca

SEQ ID NO: 3158471 - DNA, 20 bp, Homo sapiens
tgtaatggtatcttaaagtg

SEQ ID NO: 3158472 - DNA, 21 bp, Homo sapiens
tgtaatgtagcgtgtttacat

SEQ ID NO: 3158473 - DNA, 19 bp, Homo sapiens
tgtaatgtgtgaaaaagat

SEQ ID NO: 3158474 - DNA, 18 bp, Homo sapiens
tgtaatgtgtggtggcct

SEQ ID NO: 3158475 - DNA, 17 bp, Homo sapiens
tgtaattaagtactatg

SEQ ID NO: 3158476 - DNA, 15 bp, Homo sapiens
tgtaattaatatctt

SEQ ID NO: 3158477 - DNA, 17 bp, Homo sapiens
tgtaattacttattgta

SEQ ID NO: 3158478 - DNA, 16 bp, Homo sapiens
tgtaattagctctggg

SEQ ID NO: 3158479 - DNA, 19 bp, Homo sapiens
tgtaattagctctgggggg

SEQ ID NO: 3158480 - DNA, 13 bp, Homo sapiens
tgtaattctaaat

SEQ ID NO: 3158481 - DNA, 14 bp, Homo sapiens
tgtaattctaaatg

SEQ ID NO: 3158482 - DNA, 15 bp, Homo sapiens
tgtaattctaaatga

SEQ ID NO: 3158483 - DNA, 19 bp, Homo sapiens
tgtaattgacggtttttta

SEQ ID NO: 3158484 - DNA, 23 bp, Homo sapiens
tgtaattgacggttttttattat

SEQ ID NO: 3158485 - DNA, 23 bp, Homo sapiens
tgtaattgcttacatttttacaa

SEQ ID NO: 3158486 - DNA, 14 bp, Homo sapiens
tgtaattgtgtaaa

SEQ ID NO: 3158487 - DNA, 21 bp, Homo sapiens
tgtaattgtgtaaaaaatgga

SEQ ID NO: 3158488 - DNA, 22 bp, Homo sapiens
tgtaattgtgtaaaaaatggaa

SEQ ID NO: 3158489 - DNA, 21 bp, Homo sapiens
tgtaattgtgtggattcttta

SEQ ID NO: 3158490 - DNA, 21 bp, Homo sapiens
tgtaatttaaacaggcccagc

SEQ ID NO: 3158491 - DNA, 21 bp, Homo sapiens
tgtaatttagggtactaaatt

SEQ ID NO: 3158492 - DNA, 14 bp, Homo sapiens
tgtaatttatgcaa

SEQ ID NO: 3158493 - DNA, 19 bp, Homo sapiens
tgtaatttgatgaggtatt

SEQ ID NO: 3158494 - DNA, 15 bp, Homo sapiens
tgtaatttgtgtaat

SEQ ID NO: 3158495 - DNA, 17 bp, Homo sapiens
tgtaattttattttaaa

SEQ ID NO: 3158496 - DNA, 18 bp, Homo sapiens
tgtacaaaactgtaaata

SEQ ID NO: 3158497 - DNA, 21 bp, Homo sapiens
tgtacaaaatcgattggcttt

SEQ ID NO: 3158498 - DNA, 13 bp, Homo sapiens
tgtacaaaattaa

SEQ ID NO: 3158499 - DNA, 19 bp, Homo sapiens
tgtacaaagttttcctttg

SEQ ID NO: 3158500 - DNA, 13 bp, Homo sapiens
tgtacaaatgtat

SEQ ID NO: 3158501 - DNA, 18 bp, Homo sapiens
tgtacaaggtaattgttt

SEQ ID NO: 3158502 - DNA, 15 bp, Homo sapiens
tgtacaagttgttat

SEQ ID NO: 3158503 - DNA, 22 bp, Homo sapiens
tgtacaagttgttattgttgaa

SEQ ID NO: 3158504 - DNA, 19 bp, Homo sapiens
tgtacaagttttgtataaa

SEQ ID NO: 3158505 - DNA, 12 bp, Homo sapiens
tgtacaatcaaa

SEQ ID NO: 3158506 - DNA, 16 bp, Homo sapiens
tgtacaattaaaaacc

SEQ ID NO: 3158507 - DNA, 17 bp, Homo sapiens
tgtacactaacatttcc

SEQ ID NO: 3158508 - DNA, 14 bp, Homo sapiens
tgtacactgaatat

SEQ ID NO: 3158509 - DNA, 16 bp, Homo sapiens
tgtacactgaatattt

SEQ ID NO: 3158510 - DNA, 17 bp, Homo sapiens
tgtacactgaatattta

SEQ ID NO: 3158511 - DNA, 18 bp, Homo sapiens
tgtacactgctgtaccca

SEQ ID NO: 3158512 - DNA, 15 bp, Homo sapiens
tgtacacttaattac

SEQ ID NO: 3158513 - DNA, 15 bp, Homo sapiens
tgtacagaatatttc

SEQ ID NO: 3158514 - DNA, 20 bp, Homo sapiens
tgtacagactgttttactgt

SEQ ID NO: 3158515 - DNA, 18 bp, Homo sapiens
tgtacagattctttcagt

SEQ ID NO: 3158516 - DNA, 11 bp, Homo sapiens
tgtacagctct

SEQ ID NO: 3158517 - DNA, 20 bp, Homo sapiens
tgtacaggactgtaaagatt

SEQ ID NO: 3158518 - DNA, 14 bp, Homo sapiens
tgtacagtagattt

SEQ ID NO: 3158519 - DNA, 20 bp, Homo sapiens
tgtacagtagattttccaaa

SEQ ID NO: 3158520 - DNA, 14 bp, Homo sapiens
tgtacagtctgtca

SEQ ID NO: 3158521 - DNA, 23 bp, Homo sapiens
tgtacagtctgtcatgaacatgt

SEQ ID NO: 3158522 - DNA, 17 bp, Homo sapiens
tgtacagtgtgtaaagt

SEQ ID NO: 3158523 - DNA, 19 bp, Homo sapiens
tgtacagtgtgtaaagtgt

SEQ ID NO: 3158524 - DNA, 12 bp, Homo sapiens
tgtacagtgtta

SEQ ID NO: 3158525 - DNA, 13 bp, Homo sapiens
tgtacagtgttac

SEQ ID NO: 3158526 - DNA, 17 bp, Homo sapiens
tgtacagttatttatgc

SEQ ID NO: 3158527 - DNA, 18 bp, Homo sapiens
tgtacataaactgtcact

SEQ ID NO: 3158528 - DNA, 14 bp, Homo sapiens
tgtacataactctg

SEQ ID NO: 3158529 - DNA, 18 bp, Homo sapiens
tgtacataactgaaaatg

SEQ ID NO: 3158530 - DNA, 21 bp, Homo sapiens
tgtacataccctggccgcccc

SEQ ID NO: 3158531 - DNA, 21 bp, Homo sapiens
tgtacatacctccttgcacaa

SEQ ID NO: 3158532 - DNA, 11 bp, Homo sapiens
tgtacatagcc

SEQ ID NO: 3158533 - DNA, 15 bp, Homo sapiens
tgtacatagcctata

SEQ ID NO: 3158534 - DNA, 22 bp, Homo sapiens
tgtacatagcctatatttacag

SEQ ID NO: 3158535 - DNA, 23 bp, Homo sapiens
tgtacatagcctatatttacagt

SEQ ID NO: 3158536 - DNA, 15 bp, Homo sapiens
tgtacatagtgtaat

SEQ ID NO: 3158537 - DNA, 18 bp, Homo sapiens
tgtacatagttatttatt

SEQ ID NO: 3158538 - DNA, 23 bp, Homo sapiens
tgtacatattactgttgcattta

SEQ ID NO: 3158539 - DNA, 19 bp, Homo sapiens
tgtacatctattttggatt

SEQ ID NO: 3158540 - DNA, 14 bp, Homo sapiens
tgtacatctggctt

SEQ ID NO: 3158541 - DNA, 16 bp, Homo sapiens
tgtacatctggcttat

SEQ ID NO: 3158542 - DNA, 21 bp, Homo sapiens
tgtacatctggcttattttaa

SEQ ID NO: 3158543 - DNA, 14 bp, Homo sapiens
tgtacatgcattca

SEQ ID NO: 3158544 - DNA, 21 bp, Homo sapiens
tgtacatggaataacatgtaa

SEQ ID NO: 3158545 - DNA, 11 bp, Homo sapiens
tgtacatgtgt

SEQ ID NO: 3158546 - DNA, 17 bp, Homo sapiens
tgtacatgtgtagcctg

SEQ ID NO: 3158547 - DNA, 20 bp, Homo sapiens
tgtacatttaaaattgctat

SEQ ID NO: 3158548 - DNA, 21 bp, Homo sapiens
tgtacatttatgatttaataa

SEQ ID NO: 3158549 - DNA, 17 bp, Homo sapiens
tgtacatttattcatag

SEQ ID NO: 3158550 - DNA, 23 bp, Homo sapiens
tgtacattttaaaggataatggt

SEQ ID NO: 3158551 - DNA, 21 bp, Homo sapiens
tgtacattttgttgtaaaaag

SEQ ID NO: 3158552 - DNA, 23 bp, Homo sapiens
tgtacattttgttgtaaaaagaa

SEQ ID NO: 3158553 - DNA, 20 bp, Homo sapiens
tgtaccaaatctgacatatt

SEQ ID NO: 3158554 - DNA, 18 bp, Homo sapiens
tgtaccaacctcatagag

SEQ ID NO: 3158555 - DNA, 23 bp, Homo sapiens
tgtaccacagacacaatatgtat

SEQ ID NO: 3158556 - DNA, 18 bp, Homo sapiens
tgtaccacatctgctcta

SEQ ID NO: 3158557 - DNA, 11 bp, Homo sapiens
tgtaccagtta

SEQ ID NO: 3158558 - DNA, 17 bp, Homo sapiens
tgtaccatgtacatgaa

SEQ ID NO: 3158559 - DNA, 16 bp, Homo sapiens
tgtacccagatgccta

SEQ ID NO: 3158560 - DNA, 14 bp, Homo sapiens
tgtaccccccaacc

SEQ ID NO: 3158561 - DNA, 20 bp, Homo sapiens
tgtaccccccaacccctgag

SEQ ID NO: 3158562 - DNA, 23 bp, Homo sapiens
tgtaccccccaacccctgaggaa

SEQ ID NO: 3158563 - DNA, 16 bp, Homo sapiens
tgtacccttccacctc

SEQ ID NO: 3158564 - DNA, 15 bp, Homo sapiens
tgtaccctttaagat

SEQ ID NO: 3158565 - DNA, 18 bp, Homo sapiens
tgtacctaatccaaatat

SEQ ID NO: 3158566 - DNA, 15 bp, Homo sapiens
tgtacctcaaatgaa

SEQ ID NO: 3158567 - DNA, 22 bp, Homo sapiens
tgtacctcagtggatcttcaga

SEQ ID NO: 3158568 - DNA, 17 bp, Homo sapiens
tgtacctgttccttaga

SEQ ID NO: 3158569 - DNA, 21 bp, Homo sapiens
tgtaccttttgaggagcccca

SEQ ID NO: 3158570 - DNA, 16 bp, Homo sapiens
tgtactaattcttaca

SEQ ID NO: 3158571 - DNA, 14 bp, Homo sapiens
tgtactacctgtgt

SEQ ID NO: 3158572 - DNA, 15 bp, Homo sapiens
tgtactagtctgtgt

SEQ ID NO: 3158573 - DNA, 18 bp, Homo sapiens
tgtactcaggaggctgag

SEQ ID NO: 3158574 - DNA, 12 bp, Homo sapiens
tgtactcctccc

SEQ ID NO: 3158575 - DNA, 13 bp, Homo sapiens
tgtactcttagga

SEQ ID NO: 3158576 - DNA, 20 bp, Homo sapiens
tgtactcttaggatatttga

SEQ ID NO: 3158577 - DNA, 12 bp, Homo sapiens
tgtactgaaaaa

SEQ ID NO: 3158578 - DNA, 21 bp, Homo sapiens
tgtactggccagtgtcatttt

SEQ ID NO: 3158579 - DNA, 15 bp, Homo sapiens
tgtactgtactaatt

SEQ ID NO: 3158580 - DNA, 16 bp, Homo sapiens
tgtactgtactaattc

SEQ ID NO: 3158581 - DNA, 12 bp, Homo sapiens
tgtactgtagtt

SEQ ID NO: 3158582 - DNA, 19 bp, Homo sapiens
tgtactgtatggaaacact

SEQ ID NO: 3158583 - DNA, 16 bp, Homo sapiens
tgtactgttctgtgtc

SEQ ID NO: 3158584 - DNA, 15 bp, Homo sapiens
tgtacttaactattc

SEQ ID NO: 3158585 - DNA, 21 bp, Homo sapiens
tgtacttaataaattcagata

SEQ ID NO: 3158586 - DNA, 22 bp, Homo sapiens
tgtacttaataaattcagatat

SEQ ID NO: 3158587 - DNA, 16 bp, Homo sapiens
tgtacttagctgtact

SEQ ID NO: 3158588 - DNA, 17 bp, Homo sapiens
tgtacttagctgtacta

SEQ ID NO: 3158589 - DNA, 18 bp, Homo sapiens
tgtacttccaatttataa

SEQ ID NO: 3158590 - DNA, 12 bp, Homo sapiens
tgtacttcctga

SEQ ID NO: 3158591 - DNA, 23 bp, Homo sapiens
tgtacttgaagtctaaaagcaga

SEQ ID NO: 3158592 - DNA, 15 bp, Homo sapiens
tgtactttgcttgct

SEQ ID NO: 3158593 - DNA, 20 bp, Homo sapiens
tgtacttttttaaaaagaaa

SEQ ID NO: 3158594 - DNA, 18 bp, Homo sapiens
tgtagaacactaattcat

SEQ ID NO: 3158595 - DNA, 20 bp, Homo sapiens
tgtagaacactaattcataa

SEQ ID NO: 3158596 - DNA, 21 bp, Homo sapiens
tgtagaactcactctgggctg

SEQ ID NO: 3158597 - DNA, 16 bp, Homo sapiens
tgtagaactcagcagt

SEQ ID NO: 3158598 - DNA, 13 bp, Homo sapiens
tgtagaagatgga

SEQ ID NO: 3158599 - DNA, 16 bp, Homo sapiens
tgtagaagcattcctt

SEQ ID NO: 3158600 - DNA, 17 bp, Homo sapiens
tgtagaagcattccttc

SEQ ID NO: 3158601 - DNA, 17 bp, Homo sapiens
tgtagaaggagccttgt

SEQ ID NO: 3158602 - DNA, 18 bp, Homo sapiens
tgtagacacttacttgat

SEQ ID NO: 3158603 - DNA, 21 bp, Homo sapiens
tgtagacttctggttgtattt

SEQ ID NO: 3158604 - DNA, 16 bp, Homo sapiens
tgtagagccagggtct

SEQ ID NO: 3158605 - DNA, 17 bp, Homo sapiens
tgtagagtgtagactgt

SEQ ID NO: 3158606 - DNA, 13 bp, Homo sapiens
tgtagagttaaga

SEQ ID NO: 3158607 - DNA, 14 bp, Homo sapiens
tgtagagttaagaa

SEQ ID NO: 3158608 - DNA, 15 bp, Homo sapiens
tgtagagttgctgag

SEQ ID NO: 3158609 - DNA, 19 bp, Homo sapiens
tgtagatattgtgaagtac

SEQ ID NO: 3158610 - DNA, 15 bp, Homo sapiens
tgtagatgttgtctt

SEQ ID NO: 3158611 - DNA, 21 bp, Homo sapiens
tgtagattaaggtgatgtgat

SEQ ID NO: 3158612 - DNA, 15 bp, Homo sapiens
tgtagattctgtgga

SEQ ID NO: 3158613 - DNA, 21 bp, Homo sapiens
tgtagcaagtactttggctta

SEQ ID NO: 3158614 - DNA, 15 bp, Homo sapiens
tgtagcacttactgg

SEQ ID NO: 3158615 - DNA, 23 bp, Homo sapiens
tgtagcagtgagaaaaagctcct

SEQ ID NO: 3158616 - DNA, 15 bp, Homo sapiens
tgtagcataactgta

SEQ ID NO: 3158617 - DNA, 20 bp, Homo sapiens
tgtagcataactgtagctca

SEQ ID NO: 3158618 - DNA, 18 bp, Homo sapiens
tgtagcatttcttgatgt

SEQ ID NO: 3158619 - DNA, 20 bp, Homo sapiens
tgtagccactagtaagtaat

SEQ ID NO: 3158620 - DNA, 15 bp, Homo sapiens
tgtagccagctgtgc

SEQ ID NO: 3158621 - DNA, 18 bp, Homo sapiens
tgtagccagctgtgcact

SEQ ID NO: 3158622 - DNA, 20 bp, Homo sapiens
tgtagccaggtactgcattc

SEQ ID NO: 3158623 - DNA, 14 bp, Homo sapiens
tgtagccatggctc

SEQ ID NO: 3158624 - DNA, 18 bp, Homo sapiens
tgtagccatggctcaggc

SEQ ID NO: 3158625 - DNA, 14 bp, Homo sapiens
tgtagcccacactt

SEQ ID NO: 3158626 - DNA, 23 bp, Homo sapiens
tgtagcccatccttccctttgga

SEQ ID NO: 3158627 - DNA, 18 bp, Homo sapiens
tgtagccccctggcctct

SEQ ID NO: 3158628 - DNA, 20 bp, Homo sapiens
tgtagccccctggcctctgt

SEQ ID NO: 3158629 - DNA, 17 bp, Homo sapiens
tgtagcctaaagggcag

SEQ ID NO: 3158630 - DNA, 19 bp, Homo sapiens
tgtagcctaaagggcaggg

SEQ ID NO: 3158631 - DNA, 16 bp, Homo sapiens
tgtagcctcctttgta

SEQ ID NO: 3158632 - DNA, 23 bp, Homo sapiens
tgtagcctggatattattcttgt

SEQ ID NO: 3158633 - DNA, 13 bp, Homo sapiens
tgtagcctgtgca

SEQ ID NO: 3158634 - DNA, 15 bp, Homo sapiens
tgtagcctgtgcatg

SEQ ID NO: 3158635 - DNA, 20 bp, Homo sapiens
tgtagcctgtgcatgtatgt

SEQ ID NO: 3158636 - DNA, 17 bp, Homo sapiens
tgtagccttgcccggat

SEQ ID NO: 3158637 - DNA, 12 bp, Homo sapiens
tgtagccttttt

SEQ ID NO: 3158638 - DNA, 16 bp, Homo sapiens
tgtagcgtgtttacat

SEQ ID NO: 3158639 - DNA, 20 bp, Homo sapiens
tgtagcgtgtttacatgtgt

SEQ ID NO: 3158640 - DNA, 15 bp, Homo sapiens
tgtagctcaagttta

SEQ ID NO: 3158641 - DNA, 20 bp, Homo sapiens
tgtagctctgcatctcctgt

SEQ ID NO: 3158642 - DNA, 15 bp, Homo sapiens
tgtagctgaggaggc

SEQ ID NO: 3158643 - DNA, 14 bp, Homo sapiens
tgtagctgatgaaa

SEQ ID NO: 3158644 - DNA, 21 bp, Homo sapiens
tgtagctgatgaaactcctga

SEQ ID NO: 3158645 - DNA, 20 bp, Homo sapiens
tgtagctgtaagggcagtgc

SEQ ID NO: 3158646 - DNA, 20 bp, Homo sapiens
tgtagcttctaatgttcccc

SEQ ID NO: 3158647 - DNA, 19 bp, Homo sapiens
tgtaggaagagtagcattt

SEQ ID NO: 3158648 - DNA, 23 bp, Homo sapiens
tgtaggaagagtagcatttcatt

SEQ ID NO: 3158649 - DNA, 20 bp, Homo sapiens
tgtaggaaggtctcattctt

SEQ ID NO: 3158650 - DNA, 20 bp, Homo sapiens
tgtaggaaggttaatgttca

SEQ ID NO: 3158651 - DNA, 17 bp, Homo sapiens
tgtaggagctgaggttt

SEQ ID NO: 3158652 - DNA, 12 bp, Homo sapiens
tgtaggagctgc

SEQ ID NO: 3158653 - DNA, 21 bp, Homo sapiens
tgtaggctggggcggggccca

SEQ ID NO: 3158654 - DNA, 22 bp, Homo sapiens
tgtagggagggcggcaggggcc

SEQ ID NO: 3158655 - DNA, 19 bp, Homo sapiens
tgtaggggacgagaaagat

SEQ ID NO: 3158656 - DNA, 16 bp, Homo sapiens
tgtagggttacagaga

SEQ ID NO: 3158657 - DNA, 16 bp, Homo sapiens
tgtagggttataataa

SEQ ID NO: 3158658 - DNA, 17 bp, Homo sapiens
tgtagggttataataat

SEQ ID NO: 3158659 - DNA, 13 bp, Homo sapiens
tgtaggtaaaatg

SEQ ID NO: 3158660 - DNA, 15 bp, Homo sapiens
tgtaggtaaaatgta

SEQ ID NO: 3158661 - DNA, 20 bp, Homo sapiens
tgtagtaactgcctcagtgt

SEQ ID NO: 3158662 - DNA, 14 bp, Homo sapiens
tgtagtaatttatt

SEQ ID NO: 3158663 - DNA, 13 bp, Homo sapiens
tgtagtagtctca

SEQ ID NO: 3158664 - DNA, 14 bp, Homo sapiens
tgtagtagtctcat

SEQ ID NO: 3158665 - DNA, 20 bp, Homo sapiens
tgtagtattttttgtataat

SEQ ID NO: 3158666 - DNA, 24 bp, Homo sapiens
tgtagtcatttactaaacatatga

SEQ ID NO: 3158667 - DNA, 21 bp, Homo sapiens
tgtagtcctcataaaaagcaa

SEQ ID NO: 3158668 - DNA, 19 bp, Homo sapiens
tgtagtcctttctgccttg

SEQ ID NO: 3158669 - DNA, 19 bp, Homo sapiens
tgtagtggaagagcagcct

SEQ ID NO: 3158670 - DNA, 20 bp, Homo sapiens
tgtagtggaagagcagcctg

SEQ ID NO: 3158671 - DNA, 17 bp, Homo sapiens
tgtagttaaggagccta

SEQ ID NO: 3158672 - DNA, 12 bp, Homo sapiens
tgtagttaggaa

SEQ ID NO: 3158673 - DNA, 15 bp, Homo sapiens
tgtagttaggaaata

SEQ ID NO: 3158674 - DNA, 18 bp, Homo sapiens
tgtagttctgtgtacttt

SEQ ID NO: 3158675 - DNA, 15 bp, Homo sapiens
tgtagttgtcacact

SEQ ID NO: 3158676 - DNA, 13 bp, Homo sapiens
tgtataaaagtgt

SEQ ID NO: 3158677 - DNA, 15 bp, Homo sapiens
tgtataaaatagaca

SEQ ID NO: 3158678 - DNA, 21 bp, Homo sapiens
tgtataaaatccaaaatgaat

SEQ ID NO: 3158679 - DNA, 15 bp, Homo sapiens
tgtataaagattgta

SEQ ID NO: 3158680 - DNA, 17 bp, Homo sapiens
tgtataaagattgtact

SEQ ID NO: 3158681 - DNA, 23 bp, Homo sapiens
tgtataaagcaactgttatgaaa

SEQ ID NO: 3158682 - DNA, 20 bp, Homo sapiens
tgtataaataataaagaact

SEQ ID NO: 3158683 - DNA, 14 bp, Homo sapiens
tgtataaatataca

SEQ ID NO: 3158684 - DNA, 19 bp, Homo sapiens
tgtataaatatacagtata

SEQ ID NO: 3158685 - DNA, 12 bp, Homo sapiens
tgtataaatgta

SEQ ID NO: 3158686 - DNA, 14 bp, Homo sapiens
tgtataaatgtata

SEQ ID NO: 3158687 - DNA, 16 bp, Homo sapiens
tgtataaccaagtgtg

SEQ ID NO: 3158688 - DNA, 21 bp, Homo sapiens
tgtataacttcttaaaagttg

SEQ ID NO: 3158689 - DNA, 17 bp, Homo sapiens
tgtataagatcctagat

SEQ ID NO: 3158690 - DNA, 22 bp, Homo sapiens
tgtataagtgcacacagaaata

SEQ ID NO: 3158691 - DNA, 19 bp, Homo sapiens
tgtataagtggaggcactt

SEQ ID NO: 3158692 - DNA, 21 bp, Homo sapiens
tgtataagtggaggcacttta

SEQ ID NO: 3158693 - DNA, 23 bp, Homo sapiens
tgtataagtggaggcactttagg

SEQ ID NO: 3158694 - DNA, 13 bp, Homo sapiens
tgtataagttatt

SEQ ID NO: 3158695 - DNA, 18 bp, Homo sapiens
tgtataatagagataagt

SEQ ID NO: 3158696 - DNA, 13 bp, Homo sapiens
tgtataatcccac

SEQ ID NO: 3158697 - DNA, 13 bp, Homo sapiens
tgtataatttcga

SEQ ID NO: 3158698 - DNA, 15 bp, Homo sapiens
tgtatacaaatatat

SEQ ID NO: 3158699 - DNA, 15 bp, Homo sapiens
tgtatacatcctggg

SEQ ID NO: 3158700 - DNA, 17 bp, Homo sapiens
tgtatacatcctgggta

SEQ ID NO: 3158701 - DNA, 18 bp, Homo sapiens
tgtatagatgcaagatat

SEQ ID NO: 3158702 - DNA, 19 bp, Homo sapiens
tgtatagatgcaagatatt

SEQ ID NO: 3158703 - DNA, 20 bp, Homo sapiens
tgtatagatgcaagatattt

SEQ ID NO: 3158704 - DNA, 13 bp, Homo sapiens
tgtataggtagat

SEQ ID NO: 3158705 - DNA, 14 bp, Homo sapiens
tgtatagtatctgt

SEQ ID NO: 3158706 - DNA, 17 bp, Homo sapiens
tgtatagtatctgtata

SEQ ID NO: 3158707 - DNA, 15 bp, Homo sapiens
tgtatagtgtaaaat

SEQ ID NO: 3158708 - DNA, 14 bp, Homo sapiens
tgtatataaaaatg

SEQ ID NO: 3158709 - DNA, 20 bp, Homo sapiens
tgtatatacacatataccta

SEQ ID NO: 3158710 - DNA, 15 bp, Homo sapiens
tgtatatacagttat

SEQ ID NO: 3158711 - DNA, 11 bp, Homo sapiens
tgtatatatac

SEQ ID NO: 3158712 - DNA, 17 bp, Homo sapiens
tgtatatatctgcttca

SEQ ID NO: 3158713 - DNA, 20 bp, Homo sapiens
tgtatatatgtgtatatata

SEQ ID NO: 3158714 - DNA, 21 bp, Homo sapiens
tgtatatatgtgtatatatac

SEQ ID NO: 3158715 - DNA, 22 bp, Homo sapiens
tgtatatatgtgtatatataca

SEQ ID NO: 3158716 - DNA, 22 bp, Homo sapiens
tgtatatatttcctatattgtt

SEQ ID NO: 3158717 - DNA, 22 bp, Homo sapiens
tgtatatattttgtgtgaaatt

SEQ ID NO: 3158718 - DNA, 13 bp, Homo sapiens
tgtatatcagaaa

SEQ ID NO: 3158719 - DNA, 17 bp, Homo sapiens
tgtatatcattctacag

SEQ ID NO: 3158720 - DNA, 18 bp, Homo sapiens
tgtatatcattctacaga

SEQ ID NO: 3158721 - DNA, 13 bp, Homo sapiens
tgtatatgaaaac

SEQ ID NO: 3158722 - DNA, 12 bp, Homo sapiens
tgtatatgtatt

SEQ ID NO: 3158723 - DNA, 17 bp, Homo sapiens
tgtatatgtattccctt

SEQ ID NO: 3158724 - DNA, 21 bp, Homo sapiens
tgtatatgtattcccttgtat

SEQ ID NO: 3158725 - DNA, 16 bp, Homo sapiens
tgtatatgttgtaata

SEQ ID NO: 3158726 - DNA, 18 bp, Homo sapiens
tgtatattacacatttgt

SEQ ID NO: 3158727 - DNA, 23 bp, Homo sapiens
tgtatattacacatttgtacaga

SEQ ID NO: 3158728 - DNA, 15 bp, Homo sapiens
tgtatattatttggc

SEQ ID NO: 3158729 - DNA, 16 bp, Homo sapiens
tgtatattatttggca

SEQ ID NO: 3158730 - DNA, 18 bp, Homo sapiens
tgtatattatttggcagt

SEQ ID NO: 3158731 - DNA, 23 bp, Homo sapiens
tgtatattgagaatcccttaaaa

SEQ ID NO: 3158732 - DNA, 20 bp, Homo sapiens
tgtatattgtggatgtgttc

SEQ ID NO: 3158733 - DNA, 20 bp, Homo sapiens
tgtatattgtgtttgtgtat

SEQ ID NO: 3158734 - DNA, 23 bp, Homo sapiens
tgtatatttgtgatagcactttc

SEQ ID NO: 3158735 - DNA, 12 bp, Homo sapiens
tgtatattttat

SEQ ID NO: 3158736 - DNA, 21 bp, Homo sapiens
tgtatcaaatctgtatatgtt

SEQ ID NO: 3158737 - DNA, 18 bp, Homo sapiens
tgtatcagaggcctataa

SEQ ID NO: 3158738 - DNA, 21 bp, Homo sapiens
tgtatcaggaaatatatatgt

SEQ ID NO: 3158739 - DNA, 18 bp, Homo sapiens
tgtatcaggtcagggact

SEQ ID NO: 3158740 - DNA, 19 bp, Homo sapiens
tgtatcccatgagcctcag

SEQ ID NO: 3158741 - DNA, 22 bp, Homo sapiens
tgtatcccccccctgtatagtt

SEQ ID NO: 3158742 - DNA, 17 bp, Homo sapiens
tgtatccgactctaagc

SEQ ID NO: 3158743 - DNA, 20 bp, Homo sapiens
tgtatccgactctaagctgt

SEQ ID NO: 3158744 - DNA, 19 bp, Homo sapiens
tgtatcctccctggcagac

SEQ ID NO: 3158745 - DNA, 22 bp, Homo sapiens
tgtatcctccctggcagacaca

SEQ ID NO: 3158746 - DNA, 21 bp, Homo sapiens
tgtatccttccaatttggaat

SEQ ID NO: 3158747 - DNA, 18 bp, Homo sapiens
tgtatcggagacagtgat

SEQ ID NO: 3158748 - DNA, 19 bp, Homo sapiens
tgtatctaagaataataaa

SEQ ID NO: 3158749 - DNA, 21 bp, Homo sapiens
tgtatctaagaataataaaat

SEQ ID NO: 3158750 - DNA, 18 bp, Homo sapiens
tgtatctctgaagcatgt

SEQ ID NO: 3158751 - DNA, 12 bp, Homo sapiens
tgtatctgagtt

SEQ ID NO: 3158752 - DNA, 15 bp, Homo sapiens
tgtatctgagttgcc

SEQ ID NO: 3158753 - DNA, 13 bp, Homo sapiens
tgtatcttccttt

SEQ ID NO: 3158754 - DNA, 12 bp, Homo sapiens
tgtatctttatg

SEQ ID NO: 3158755 - DNA, 17 bp, Homo sapiens
tgtatctttatgctgta

SEQ ID NO: 3158756 - DNA, 21 bp, Homo sapiens
tgtatgaaaatccttttaacc

SEQ ID NO: 3158757 - DNA, 14 bp, Homo sapiens
tgtatgactaaaga

SEQ ID NO: 3158758 - DNA, 17 bp, Homo sapiens
tgtatgagtagccaggg

SEQ ID NO: 3158759 - DNA, 15 bp, Homo sapiens
tgtatgatttataaa

SEQ ID NO: 3158760 - DNA, 19 bp, Homo sapiens
tgtatgatttgttttgaat

SEQ ID NO: 3158761 - DNA, 18 bp, Homo sapiens
tgtatgccaagtgagaag

SEQ ID NO: 3158762 - DNA, 20 bp, Homo sapiens
tgtatgccaagtgagaagat

SEQ ID NO: 3158763 - DNA, 15 bp, Homo sapiens
tgtatgctgatcatc

SEQ ID NO: 3158764 - DNA, 12 bp, Homo sapiens
tgtatgctggac

SEQ ID NO: 3158765 - DNA, 14 bp, Homo sapiens
tgtatggaaacact

SEQ ID NO: 3158766 - DNA, 18 bp, Homo sapiens
tgtatggaaataaatgta

SEQ ID NO: 3158767 - DNA, 15 bp, Homo sapiens
tgtatggggcagctt

SEQ ID NO: 3158768 - DNA, 13 bp, Homo sapiens
tgtatgtacatat

SEQ ID NO: 3158769 - DNA, 15 bp, Homo sapiens
tgtatgtcaaagctt

SEQ ID NO: 3158770 - DNA, 17 bp, Homo sapiens
tgtatgtcaaagctttg

SEQ ID NO: 3158771 - DNA, 22 bp, Homo sapiens
tgtatgtcaataaacaacagct

SEQ ID NO: 3158772 - DNA, 21 bp, Homo sapiens
tgtatgtcagacatccatgtt

SEQ ID NO: 3158773 - DNA, 14 bp, Homo sapiens
tgtatgtcttggac

SEQ ID NO: 3158774 - DNA, 13 bp, Homo sapiens
tgtatgtgaaagt

SEQ ID NO: 3158775 - DNA, 19 bp, Homo sapiens
tgtatgtgaaagtgtaaaa

SEQ ID NO: 3158776 - DNA, 23 bp, Homo sapiens
tgtatgtgaaagtgtaaaataga

SEQ ID NO: 3158777 - DNA, 12 bp, Homo sapiens
tgtatgtgaaca

SEQ ID NO: 3158778 - DNA, 14 bp, Homo sapiens
tgtatgtgtaagta

SEQ ID NO: 3158779 - DNA, 17 bp, Homo sapiens
tgtatgtgtggtttcag

SEQ ID NO: 3158780 - DNA, 13 bp, Homo sapiens
tgtatgtttacat

SEQ ID NO: 3158781 - DNA, 22 bp, Homo sapiens
tgtatgtttgcacacttgtgtg

SEQ ID NO: 3158782 - DNA, 12 bp, Homo sapiens
tgtattaaatct

SEQ ID NO: 3158783 - DNA, 16 bp, Homo sapiens
tgtattaaatcttaaa

SEQ ID NO: 3158784 - DNA, 14 bp, Homo sapiens
tgtattaacaaaag

SEQ ID NO: 3158785 - DNA, 13 bp, Homo sapiens
tgtattaataaag

SEQ ID NO: 3158786 - DNA, 14 bp, Homo sapiens
tgtattaataaagc

SEQ ID NO: 3158787 - DNA, 10 bp, Homo sapiens
tgtattaatg

SEQ ID NO: 3158788 - DNA, 14 bp, Homo sapiens
tgtattacagatgc

SEQ ID NO: 3158789 - DNA, 19 bp, Homo sapiens
tgtattacatctaatgctt

SEQ ID NO: 3158790 - DNA, 18 bp, Homo sapiens
tgtattactttctctgta

SEQ ID NO: 3158791 - DNA, 13 bp, Homo sapiens
tgtattagatgtg

SEQ ID NO: 3158792 - DNA, 15 bp, Homo sapiens
tgtattagatgtggt

SEQ ID NO: 3158793 - DNA, 12 bp, Homo sapiens
tgtattagtatg

SEQ ID NO: 3158794 - DNA, 15 bp, Homo sapiens
tgtattatcactgtc

SEQ ID NO: 3158795 - DNA, 14 bp, Homo sapiens
tgtattatttataa

SEQ ID NO: 3158796 - DNA, 14 bp, Homo sapiens
tgtattatttggag

SEQ ID NO: 3158797 - DNA, 18 bp, Homo sapiens
tgtattcttgttttacat

SEQ ID NO: 3158798 - DNA, 17 bp, Homo sapiens
tgtattctttactaaag

SEQ ID NO: 3158799 - DNA, 22 bp, Homo sapiens
tgtattcttttccaagctcctt

SEQ ID NO: 3158800 - DNA, 18 bp, Homo sapiens
tgtattcttttctcagtg

SEQ ID NO: 3158801 - DNA, 19 bp, Homo sapiens
tgtattcttttctcagtgt

SEQ ID NO: 3158802 - DNA, 16 bp, Homo sapiens
tgtattgactgtacca

SEQ ID NO: 3158803 - DNA, 19 bp, Homo sapiens
tgtattgatcaatgcatgt

SEQ ID NO: 3158804 - DNA, 14 bp, Homo sapiens
tgtattgcacattg

SEQ ID NO: 3158805 - DNA, 19 bp, Homo sapiens
tgtattgcacattgtaaaa

SEQ ID NO: 3158806 - DNA, 16 bp, Homo sapiens
tgtattggttaaaact

SEQ ID NO: 3158807 - DNA, 18 bp, Homo sapiens
tgtattggttaaaactgt

SEQ ID NO: 3158808 - DNA, 17 bp, Homo sapiens
tgtattgtaatctttca

SEQ ID NO: 3158809 - DNA, 12 bp, Homo sapiens
tgtattgttaat

SEQ ID NO: 3158810 - DNA, 12 bp, Homo sapiens
tgtattgttccc

SEQ ID NO: 3158811 - DNA, 13 bp, Homo sapiens
tgtattgttccca

SEQ ID NO: 3158812 - DNA, 14 bp, Homo sapiens
tgtattgttcccag

SEQ ID NO: 3158813 - DNA, 15 bp, Homo sapiens
tgtattgttcccagt

SEQ ID NO: 3158814 - DNA, 19 bp, Homo sapiens
tgtattgttttctgacagt

SEQ ID NO: 3158815 - DNA, 19 bp, Homo sapiens
tgtatttaattgtaaactg

SEQ ID NO: 3158816 - DNA, 21 bp, Homo sapiens
tgtatttacgctttgattcat

SEQ ID NO: 3158817 - DNA, 23 bp, Homo sapiens
tgtatttacgctttgattcatag

SEQ ID NO: 3158818 - DNA, 21 bp, Homo sapiens
tgtatttataaatatatttaa

SEQ ID NO: 3158819 - DNA, 13 bp, Homo sapiens
tgtatttatgtaa

SEQ ID NO: 3158820 - DNA, 13 bp, Homo sapiens
tgtatttatgtgt

SEQ ID NO: 3158821 - DNA, 16 bp, Homo sapiens
tgtatttatgtgtgag

SEQ ID NO: 3158822 - DNA, 16 bp, Homo sapiens
tgtatttattatttga

SEQ ID NO: 3158823 - DNA, 14 bp, Homo sapiens
tgtatttgcttttt

SEQ ID NO: 3158824 - DNA, 21 bp, Homo sapiens
tgtatttggaaataaagtcag

SEQ ID NO: 3158825 - DNA, 22 bp, Homo sapiens
tgtatttggctgggctacaatt

SEQ ID NO: 3158826 - DNA, 14 bp, Homo sapiens
tgtatttgtattaa

SEQ ID NO: 3158827 - DNA, 17 bp, Homo sapiens
tgtatttgtattaataa

SEQ ID NO: 3158828 - DNA, 16 bp, Homo sapiens
tgtatttgttcatgtt

SEQ ID NO: 3158829 - DNA, 17 bp, Homo sapiens
tgtatttgttcatgttt

SEQ ID NO: 3158830 - DNA, 18 bp, Homo sapiens
tgtatttgttcatgtttg

SEQ ID NO: 3158831 - DNA, 22 bp, Homo sapiens
tgtattttatttagacaagaga

SEQ ID NO: 3158832 - DNA, 20 bp, Homo sapiens
tgtattttcgggattctttg

SEQ ID NO: 3158833 - DNA, 22 bp, Homo sapiens
tgtattttgaagaatatttaag

SEQ ID NO: 3158834 - DNA, 14 bp, Homo sapiens
tgtattttgatgag

SEQ ID NO: 3158835 - DNA, 18 bp, Homo sapiens
tgtattttgatgagatat

SEQ ID NO: 3158836 - DNA, 15 bp, Homo sapiens
tgtattttgtgtgac

SEQ ID NO: 3158837 - DNA, 19 bp, Homo sapiens
tgtattttgtgtgaccaac

SEQ ID NO: 3158838 - DNA, 19 bp, Homo sapiens
tgtatttttctacattatt

SEQ ID NO: 3158839 - DNA, 22 bp, Homo sapiens
tgtatttttgattgttatgtaa

SEQ ID NO: 3158840 - DNA, 21 bp, Homo sapiens
tgtattttttaaaacactaaa

SEQ ID NO: 3158841 - DNA, 22 bp, Homo sapiens
tgtattttttaaaattgatttt

SEQ ID NO: 3158842 - DNA, 19 bp, Homo sapiens
tgtattttttatttacatt

SEQ ID NO: 3158843 - DNA, 22 bp, Homo sapiens
tgtatttttttttctaagagaa

SEQ ID NO: 3158844 - DNA, 15 bp, Homo sapiens
tgtcaaaacactgtg

SEQ ID NO: 3158845 - DNA, 21 bp, Homo sapiens
tgtcaaaagttggactaaatg

SEQ ID NO: 3158846 - DNA, 22 bp, Homo sapiens
tgtcaaaagttggactaaatgc

SEQ ID NO: 3158847 - DNA, 13 bp, Homo sapiens
tgtcaaaattaat

SEQ ID NO: 3158848 - DNA, 15 bp, Homo sapiens
tgtcaactaaatgag

SEQ ID NO: 3158849 - DNA, 15 bp, Homo sapiens
tgtcaactctttgtt

SEQ ID NO: 3158850 - DNA, 19 bp, Homo sapiens
tgtcaagagggtctgagga

SEQ ID NO: 3158851 - DNA, 18 bp, Homo sapiens
tgtcaaggctgcttagaa

SEQ ID NO: 3158852 - DNA, 16 bp, Homo sapiens
tgtcaagtctctgctg

SEQ ID NO: 3158853 - DNA, 17 bp, Homo sapiens
tgtcaagtctctgctgg

SEQ ID NO: 3158854 - DNA, 19 bp, Homo sapiens
tgtcaagttaacaaggaat

SEQ ID NO: 3158855 - DNA, 21 bp, Homo sapiens
tgtcaagttaacaaggaatgc

SEQ ID NO: 3158856 - DNA, 14 bp, Homo sapiens
tgtcaagttgtgct

SEQ ID NO: 3158857 - DNA, 12 bp, Homo sapiens
tgtcaataaaca

SEQ ID NO: 3158858 - DNA, 18 bp, Homo sapiens
tgtcaataaacaacagct

SEQ ID NO: 3158859 - DNA, 15 bp, Homo sapiens
tgtcaataaggagca

SEQ ID NO: 3158860 - DNA, 23 bp, Homo sapiens
tgtcaatattaaatacagacact

SEQ ID NO: 3158861 - DNA, 16 bp, Homo sapiens
tgtcaatttctgtgtt

SEQ ID NO: 3158862 - DNA, 19 bp, Homo sapiens
tgtcacaaattgatcaaga

SEQ ID NO: 3158863 - DNA, 13 bp, Homo sapiens
tgtcacaataaat

SEQ ID NO: 3158864 - DNA, 16 bp, Homo sapiens
tgtcacaataaatgta

SEQ ID NO: 3158865 - DNA, 17 bp, Homo sapiens
tgtcacacactttggct

SEQ ID NO: 3158866 - DNA, 15 bp, Homo sapiens
tgtcacactaaaatt

SEQ ID NO: 3158867 - DNA, 21 bp, Homo sapiens
tgtcacactaaaatttaattg

SEQ ID NO: 3158868 - DNA, 11 bp, Homo sapiens
tgtcacagggc

SEQ ID NO: 3158869 - DNA, 17 bp, Homo sapiens
tgtcacagtaaaaataa

SEQ ID NO: 3158870 - DNA, 18 bp, Homo sapiens
tgtcacagtaaaaataaa

SEQ ID NO: 3158871 - DNA, 19 bp, Homo sapiens
tgtcacatagtttttcctg

SEQ ID NO: 3158872 - DNA, 14 bp, Homo sapiens
tgtcaccaaggaaa

SEQ ID NO: 3158873 - DNA, 18 bp, Homo sapiens
tgtcaccagttaaaagca

SEQ ID NO: 3158874 - DNA, 22 bp, Homo sapiens
tgtcaccctccacctcttcacc

SEQ ID NO: 3158875 - DNA, 17 bp, Homo sapiens
tgtcaccggtcagtgcc

SEQ ID NO: 3158876 - DNA, 23 bp, Homo sapiens
tgtcaccgtgagcagctttggaa

SEQ ID NO: 3158877 - DNA, 18 bp, Homo sapiens
tgtcacctctctcagagc

SEQ ID NO: 3158878 - DNA, 13 bp, Homo sapiens
tgtcacctgaaga

SEQ ID NO: 3158879 - DNA, 22 bp, Homo sapiens
tgtcactactcacagtctcttt

SEQ ID NO: 3158880 - DNA, 16 bp, Homo sapiens
tgtcactcattgctga

SEQ ID NO: 3158881 - DNA, 21 bp, Homo sapiens
tgtcactcattgctgagcctc

SEQ ID NO: 3158882 - DNA, 23 bp, Homo sapiens
tgtcactcattgctgagcctctg

SEQ ID NO: 3158883 - DNA, 17 bp, Homo sapiens
tgtcactctaggaagaa

SEQ ID NO: 3158884 - DNA, 19 bp, Homo sapiens
tgtcactgacacaaaggaa

SEQ ID NO: 3158885 - DNA, 15 bp, Homo sapiens
tgtcactggctggct

SEQ ID NO: 3158886 - DNA, 18 bp, Homo sapiens
tgtcactggctggctcct

SEQ ID NO: 3158887 - DNA, 21 bp, Homo sapiens
tgtcactggtagaccaaaata

SEQ ID NO: 3158888 - DNA, 23 bp, Homo sapiens
tgtcactggtagaccaaaataaa

SEQ ID NO: 3158889 - DNA, 14 bp, Homo sapiens
tgtcacttccacac

SEQ ID NO: 3158890 - DNA, 22 bp, Homo sapiens
tgtcagaaaccctggtctccgt

SEQ ID NO: 3158891 - DNA, 15 bp, Homo sapiens
tgtcagacataaagc

SEQ ID NO: 3158892 - DNA, 23 bp, Homo sapiens
tgtcagactttaaagaataatat

SEQ ID NO: 3158893 - DNA, 16 bp, Homo sapiens
tgtcagagttctgctc

SEQ ID NO: 3158894 - DNA, 17 bp, Homo sapiens
tgtcagatgagaacaaa

SEQ ID NO: 3158895 - DNA, 23 bp, Homo sapiens
tgtcagatgagaacaaagctgtt

SEQ ID NO: 3158896 - DNA, 14 bp, Homo sapiens
tgtcagattccttt

SEQ ID NO: 3158897 - DNA, 15 bp, Homo sapiens
tgtcagattcctttc

SEQ ID NO: 3158898 - DNA, 13 bp, Homo sapiens
tgtcagccagccg

SEQ ID NO: 3158899 - DNA, 18 bp, Homo sapiens
tgtcagccagccgccctg

SEQ ID NO: 3158900 - DNA, 21 bp, Homo sapiens
tgtcagccatcgtcctgggac

SEQ ID NO: 3158901 - DNA, 17 bp, Homo sapiens
tgtcagctgttgtcaca

SEQ ID NO: 3158902 - DNA, 14 bp, Homo sapiens
tgtcagcttcccag

SEQ ID NO: 3158903 - DNA, 15 bp, Homo sapiens
tgtcagcttcccagc

SEQ ID NO: 3158904 - DNA, 14 bp, Homo sapiens
tgtcagctttgact

SEQ ID NO: 3158905 - DNA, 16 bp, Homo sapiens
tgtcaggagagcagcg

SEQ ID NO: 3158906 - DNA, 18 bp, Homo sapiens
tgtcaggcctctgagccc

SEQ ID NO: 3158907 - DNA, 15 bp, Homo sapiens
tgtcagtatccaggc

SEQ ID NO: 3158908 - DNA, 13 bp, Homo sapiens
tgtcagtatttca

SEQ ID NO: 3158909 - DNA, 14 bp, Homo sapiens
tgtcagtatttcaa

SEQ ID NO: 3158910 - DNA, 18 bp, Homo sapiens
tgtcagtatttcagtgta

SEQ ID NO: 3158911 - DNA, 23 bp, Homo sapiens
tgtcagtatttcagtgtagttaa

SEQ ID NO: 3158912 - DNA, 16 bp, Homo sapiens
tgtcagtgattttgta

SEQ ID NO: 3158913 - DNA, 16 bp, Homo sapiens
tgtcagtgtttttgaa

SEQ ID NO: 3158914 - DNA, 17 bp, Homo sapiens
tgtcagttcaactttca

SEQ ID NO: 3158915 - DNA, 18 bp, Homo sapiens
tgtcagttcaactttcag

SEQ ID NO: 3158916 - DNA, 21 bp, Homo sapiens
tgtcagttcttggtgctctgt

SEQ ID NO: 3158917 - DNA, 16 bp, Homo sapiens
tgtcatatgactgatt

SEQ ID NO: 3158918 - DNA, 19 bp, Homo sapiens
tgtcatatgactgattact

SEQ ID NO: 3158919 - DNA, 19 bp, Homo sapiens
tgtcatcagaagataactt

SEQ ID NO: 3158920 - DNA, 15 bp, Homo sapiens
tgtcatcagccacca

SEQ ID NO: 3158921 - DNA, 18 bp, Homo sapiens
tgtcatcagccaccatcc

SEQ ID NO: 3158922 - DNA, 21 bp, Homo sapiens
tgtcatcagccaccatcctat

SEQ ID NO: 3158923 - DNA, 16 bp, Homo sapiens
tgtcatcctcaaagaa

SEQ ID NO: 3158924 - DNA, 21 bp, Homo sapiens
tgtcatcctcaaagaaagtgt

SEQ ID NO: 3158925 - DNA, 14 bp, Homo sapiens
tgtcatctctctgg

SEQ ID NO: 3158926 - DNA, 15 bp, Homo sapiens
tgtcatctgaggagt

SEQ ID NO: 3158927 - DNA, 23 bp, Homo sapiens
tgtcatgcccccctcaaacctcc

SEQ ID NO: 3158928 - DNA, 20 bp, Homo sapiens
tgtcatgctgggatttccaa

SEQ ID NO: 3158929 - DNA, 19 bp, Homo sapiens
tgtcatggtcctttctgga

SEQ ID NO: 3158930 - DNA, 17 bp, Homo sapiens
tgtcatggttacaaact

SEQ ID NO: 3158931 - DNA, 16 bp, Homo sapiens
tgtcatgtttattcta

SEQ ID NO: 3158932 - DNA, 23 bp, Homo sapiens
tgtcattaaatggggctcacaaa

SEQ ID NO: 3158933 - DNA, 15 bp, Homo sapiens
tgtcattaacacatt

SEQ ID NO: 3158934 - DNA, 15 bp, Homo sapiens
tgtcattatattcta

SEQ ID NO: 3158935 - DNA, 21 bp, Homo sapiens
tgtcatttgagcagggctcag

SEQ ID NO: 3158936 - DNA, 12 bp, Homo sapiens
tgtcatttgctt

SEQ ID NO: 3158937 - DNA, 17 bp, Homo sapiens
tgtcatttgttgtgatg

SEQ ID NO: 3158938 - DNA, 18 bp, Homo sapiens
tgtcatttgttgtgatgt

SEQ ID NO: 3158939 - DNA, 22 bp, Homo sapiens
tgtcattttattttttccctcc

SEQ ID NO: 3158940 - DNA, 15 bp, Homo sapiens
tgtcatttttgcagt

SEQ ID NO: 3158941 - DNA, 17 bp, Homo sapiens
tgtccaaacgtcctctt

SEQ ID NO: 3158942 - DNA, 21 bp, Homo sapiens
tgtccaaacgtcctctttagt

SEQ ID NO: 3158943 - DNA, 11 bp, Homo sapiens
tgtccaaagag

SEQ ID NO: 3158944 - DNA, 17 bp, Homo sapiens
tgtccaaagaggctgcc

SEQ ID NO: 3158945 - DNA, 19 bp, Homo sapiens
tgtccaaagaggctgcccc

SEQ ID NO: 3158946 - DNA, 20 bp, Homo sapiens
tgtccaaagaggctgcccct

SEQ ID NO: 3158947 - DNA, 21 bp, Homo sapiens
tgtccaaagaggctgcccctc

SEQ ID NO: 3158948 - DNA, 19 bp, Homo sapiens
tgtccaacatggtaattca

SEQ ID NO: 3158949 - DNA, 20 bp, Homo sapiens
tgtccaacatggtaattcac

SEQ ID NO: 3158950 - DNA, 17 bp, Homo sapiens
tgtccaagttcttcacc

SEQ ID NO: 3158951 - DNA, 18 bp, Homo sapiens
tgtccaagttcttcacct

SEQ ID NO: 3158952 - DNA, 23 bp, Homo sapiens
tgtccaagttcttcacctctatc

SEQ ID NO: 3158953 - DNA, 23 bp, Homo sapiens
tgtccaattgttgacagttctga

SEQ ID NO: 3158954 - DNA, 15 bp, Homo sapiens
tgtccacctgtgggt

SEQ ID NO: 3158955 - DNA, 12 bp, Homo sapiens
tgtccagcagct

SEQ ID NO: 3158956 - DNA, 14 bp, Homo sapiens
tgtccagcagctgc

SEQ ID NO: 3158957 - DNA, 21 bp, Homo sapiens
tgtccagcagctgcgggtctg

SEQ ID NO: 3158958 - DNA, 21 bp, Homo sapiens
tgtccaggcactgctgcccag

SEQ ID NO: 3158959 - DNA, 12 bp, Homo sapiens
tgtccaggccac

SEQ ID NO: 3158960 - DNA, 16 bp, Homo sapiens
tgtccatcccttttcc

SEQ ID NO: 3158961 - DNA, 18 bp, Homo sapiens
tgtccatcccttttcctg

SEQ ID NO: 3158962 - DNA, 22 bp, Homo sapiens
tgtcccaatcttaccagatgct

SEQ ID NO: 3158963 - DNA, 17 bp, Homo sapiens
tgtcccacccccacccc

SEQ ID NO: 3158964 - DNA, 18 bp, Homo sapiens
tgtcccaccgggagcctc

SEQ ID NO: 3158965 - DNA, 22 bp, Homo sapiens
tgtcccacgtgtcttccacttt

SEQ ID NO: 3158966 - DNA, 23 bp, Homo sapiens
tgtcccagaggttatctgcctgg

SEQ ID NO: 3158967 - DNA, 24 bp, Homo sapiens
tgtcccagaggttatctgcctggc

SEQ ID NO: 3158968 - DNA, 14 bp, Homo sapiens
tgtcccaggtcctc

SEQ ID NO: 3158969 - DNA, 17 bp, Homo sapiens
tgtcccaggtcctcact

SEQ ID NO: 3158970 - DNA, 16 bp, Homo sapiens
tgtcccatgacccacc

SEQ ID NO: 3158971 - DNA, 17 bp, Homo sapiens
tgtcccatgacccaccc

SEQ ID NO: 3158972 - DNA, 21 bp, Homo sapiens
tgtcccatgacccacccctgt

SEQ ID NO: 3158973 - DNA, 17 bp, Homo sapiens
tgtcccatggacactcc

SEQ ID NO: 3158974 - DNA, 13 bp, Homo sapiens
tgtccccagggcc

SEQ ID NO: 3158975 - DNA, 14 bp, Homo sapiens
tgtccccagggccc

SEQ ID NO: 3158976 - DNA, 17 bp, Homo sapiens
tgtccccgtgttgcatg

SEQ ID NO: 3158977 - DNA, 16 bp, Homo sapiens
tgtcccctcactctgt

SEQ ID NO: 3158978 - DNA, 13 bp, Homo sapiens
tgtcccctctgtc

SEQ ID NO: 3158979 - DNA, 14 bp, Homo sapiens
tgtcccctgcgggc

SEQ ID NO: 3158980 - DNA, 21 bp, Homo sapiens
tgtccccttggcaggtcctgg

SEQ ID NO: 3158981 - DNA, 20 bp, Homo sapiens
tgtcccggggtcctgtggca

SEQ ID NO: 3158982 - DNA, 19 bp, Homo sapiens
tgtccctaagtaagtttct

SEQ ID NO: 3158983 - DNA, 21 bp, Homo sapiens
tgtccctcactgttgaatttt

SEQ ID NO: 3158984 - DNA, 15 bp, Homo sapiens
tgtccctcccacctc

SEQ ID NO: 3158985 - DNA, 18 bp, Homo sapiens
tgtccctcccacctctgt

SEQ ID NO: 3158986 - DNA, 14 bp, Homo sapiens
tgtccctccccctt

SEQ ID NO: 3158987 - DNA, 13 bp, Homo sapiens
tgtccctctaaag

SEQ ID NO: 3158988 - DNA, 22 bp, Homo sapiens
tgtccctctagtgccttcttta

SEQ ID NO: 3158989 - DNA, 17 bp, Homo sapiens
tgtccctctcactcccc

SEQ ID NO: 3158990 - DNA, 14 bp, Homo sapiens
tgtccctcttcact

SEQ ID NO: 3158991 - DNA, 14 bp, Homo sapiens
tgtccctgcacttg

SEQ ID NO: 3158992 - DNA, 13 bp, Homo sapiens
tgtccctgcaggg

SEQ ID NO: 3158993 - DNA, 15 bp, Homo sapiens
tgtccctgcagggcc

SEQ ID NO: 3158994 - DNA, 19 bp, Homo sapiens
tgtccctggacacagctct

SEQ ID NO: 3158995 - DNA, 20 bp, Homo sapiens
tgtccctgggccagggtctg

SEQ ID NO: 3158996 - DNA, 13 bp, Homo sapiens
tgtcccttccagg

SEQ ID NO: 3158997 - DNA, 14 bp, Homo sapiens
tgtcccttccagga

SEQ ID NO: 3158998 - DNA, 14 bp, Homo sapiens
tgtcccttgctgta

SEQ ID NO: 3158999 - DNA, 15 bp, Homo sapiens
tgtccctttccctac

SEQ ID NO: 3159000 - DNA, 17 bp, Homo sapiens
tgtccctttcttggcca

SEQ ID NO: 3159001 - DNA, 18 bp, Homo sapiens
tgtccctttcttggccag

SEQ ID NO: 3159002 - DNA, 14 bp, Homo sapiens
tgtcccttttgcta

SEQ ID NO: 3159003 - DNA, 22 bp, Homo sapiens
tgtccgagaactaaagccaagg

SEQ ID NO: 3159004 - DNA, 15 bp, Homo sapiens
tgtccgctgggtggt

SEQ ID NO: 3159005 - DNA, 18 bp, Homo sapiens
tgtccggcccagtgccac

SEQ ID NO: 3159006 - DNA, 16 bp, Homo sapiens
tgtcctaattcttctg

SEQ ID NO: 3159007 - DNA, 18 bp, Homo sapiens
tgtcctaattcttctgtc

SEQ ID NO: 3159008 - DNA, 15 bp, Homo sapiens
tgtcctacttctgac

SEQ ID NO: 3159009 - DNA, 14 bp, Homo sapiens
tgtcctatgtgtga

SEQ ID NO: 3159010 - DNA, 14 bp, Homo sapiens
tgtcctcactgctc

SEQ ID NO: 3159011 - DNA, 15 bp, Homo sapiens
tgtcctcactgctcc

SEQ ID NO: 3159012 - DNA, 22 bp, Homo sapiens
tgtcctcactgctccctgaagc

SEQ ID NO: 3159013 - DNA, 16 bp, Homo sapiens
tgtcctcagaggcgtg

SEQ ID NO: 3159014 - DNA, 21 bp, Homo sapiens
tgtcctcagaggcgtgctggt

SEQ ID NO: 3159015 - DNA, 14 bp, Homo sapiens
tgtcctcagggagc

SEQ ID NO: 3159016 - DNA, 18 bp, Homo sapiens
tgtcctccagaagcctct

SEQ ID NO: 3159017 - DNA, 20 bp, Homo sapiens
tgtcctccagaagcctctgg

SEQ ID NO: 3159018 - DNA, 14 bp, Homo sapiens
tgtcctctccctgc

SEQ ID NO: 3159019 - DNA, 13 bp, Homo sapiens
tgtcctctcgagc

SEQ ID NO: 3159020 - DNA, 20 bp, Homo sapiens
tgtcctctcgagcccagatg

SEQ ID NO: 3159021 - DNA, 23 bp, Homo sapiens
tgtcctcttgctcaaaaatctgt

SEQ ID NO: 3159022 - DNA, 17 bp, Homo sapiens
tgtcctctttactccct

SEQ ID NO: 3159023 - DNA, 23 bp, Homo sapiens
tgtcctctttactcccttcctgg

SEQ ID NO: 3159024 - DNA, 17 bp, Homo sapiens
tgtcctgaccaccctcc

SEQ ID NO: 3159025 - DNA, 19 bp, Homo sapiens
tgtcctgatggtcagctcc

SEQ ID NO: 3159026 - DNA, 20 bp, Homo sapiens
tgtcctgatttctacaactg

SEQ ID NO: 3159027 - DNA, 14 bp, Homo sapiens
tgtcctgccagctg

SEQ ID NO: 3159028 - DNA, 16 bp, Homo sapiens
tgtcctgccagctgcc

SEQ ID NO: 3159029 - DNA, 20 bp, Homo sapiens
tgtcctgctggcttccagct

SEQ ID NO: 3159030 - DNA, 20 bp, Homo sapiens
tgtcctgggagtgagctggt

SEQ ID NO: 3159031 - DNA, 13 bp, Homo sapiens
tgtcctggtgtca

SEQ ID NO: 3159032 - DNA, 21 bp, Homo sapiens
tgtcctggttccttcctatgc

SEQ ID NO: 3159033 - DNA, 20 bp, Homo sapiens
tgtcctgtagaggttttgtt

SEQ ID NO: 3159034 - DNA, 24 bp, Homo sapiens
tgtcctgtagttgcgtggactctg

SEQ ID NO: 3159035 - DNA, 17 bp, Homo sapiens
tgtcctgtgaatggaag

SEQ ID NO: 3159036 - DNA, 15 bp, Homo sapiens
tgtccttagtgtata

SEQ ID NO: 3159037 - DNA, 17 bp, Homo sapiens
tgtccttagtgtataaa

SEQ ID NO: 3159038 - DNA, 19 bp, Homo sapiens
tgtccttcagagctcttca

SEQ ID NO: 3159039 - DNA, 17 bp, Homo sapiens
tgtccttccctcaaaga

SEQ ID NO: 3159040 - DNA, 14 bp, Homo sapiens
tgtccttccctgca

SEQ ID NO: 3159041 - DNA, 19 bp, Homo sapiens
tgtcctttaaaaaagaaaa

SEQ ID NO: 3159042 - DNA, 13 bp, Homo sapiens
tgtcctttcccct

SEQ ID NO: 3159043 - DNA, 23 bp, Homo sapiens
tgtcctttcccttcagtaccctc

SEQ ID NO: 3159044 - DNA, 15 bp, Homo sapiens
tgtccttttatttct

SEQ ID NO: 3159045 - DNA, 23 bp, Homo sapiens
tgtccttttatttctccatcttt

SEQ ID NO: 3159046 - DNA, 15 bp, Homo sapiens
tgtcgacatgttttt

SEQ ID NO: 3159047 - DNA, 13 bp, Homo sapiens
tgtcgagacactt

SEQ ID NO: 3159048 - DNA, 15 bp, Homo sapiens
tgtcgagacacttgc

SEQ ID NO: 3159049 - DNA, 14 bp, Homo sapiens
tgtcgatgcacagt

SEQ ID NO: 3159050 - DNA, 15 bp, Homo sapiens
tgtcgatgcacagta

SEQ ID NO: 3159051 - DNA, 13 bp, Homo sapiens
tgtcgcacaatgt

SEQ ID NO: 3159052 - DNA, 21 bp, Homo sapiens
tgtcgccccaggccctccctg

SEQ ID NO: 3159053 - DNA, 23 bp, Homo sapiens
tgtcgccccaggccctccctgac

SEQ ID NO: 3159054 - DNA, 21 bp, Homo sapiens
tgtcgccgcctgctccctgca

SEQ ID NO: 3159055 - DNA, 14 bp, Homo sapiens
tgtcgcctctgcat

SEQ ID NO: 3159056 - DNA, 14 bp, Homo sapiens
tgtcgctcatgtgt

SEQ ID NO: 3159057 - DNA, 20 bp, Homo sapiens
tgtcggagaggctgtctggg

SEQ ID NO: 3159058 - DNA, 22 bp, Homo sapiens
tgtcggagaggctgtctggggc

SEQ ID NO: 3159059 - DNA, 15 bp, Homo sapiens
tgtcgggcaccagcc

SEQ ID NO: 3159060 - DNA, 19 bp, Homo sapiens
tgtcgggcaccagccagcg

SEQ ID NO: 3159061 - DNA, 19 bp, Homo sapiens
tgtcgtctgtgaatgctaa

SEQ ID NO: 3159062 - DNA, 14 bp, Homo sapiens
tgtcgtggttctta

SEQ ID NO: 3159063 - DNA, 23 bp, Homo sapiens
tgtcgttaaaaagttgtttgttt

SEQ ID NO: 3159064 - DNA, 15 bp, Homo sapiens
tgtctaaaaaccaga

SEQ ID NO: 3159065 - DNA, 14 bp, Homo sapiens
tgtctaaaatgtca

SEQ ID NO: 3159066 - DNA, 16 bp, Homo sapiens
tgtctaaacaatgctg

SEQ ID NO: 3159067 - DNA, 17 bp, Homo sapiens
tgtctaaacaatgctga

SEQ ID NO: 3159068 - DNA, 20 bp, Homo sapiens
tgtctaactcagaattattt

SEQ ID NO: 3159069 - DNA, 22 bp, Homo sapiens
tgtctaactttagaagtgcatt

SEQ ID NO: 3159070 - DNA, 15 bp, Homo sapiens
tgtctaagatagtaa

SEQ ID NO: 3159071 - DNA, 22 bp, Homo sapiens
tgtctaatatcttaattctttg

SEQ ID NO: 3159072 - DNA, 12 bp, Homo sapiens
tgtctacaaata

SEQ ID NO: 3159073 - DNA, 13 bp, Homo sapiens
tgtctacaaatat

SEQ ID NO: 3159074 - DNA, 12 bp, Homo sapiens
tgtctactgtgg

SEQ ID NO: 3159075 - DNA, 15 bp, Homo sapiens
tgtctactgtggtga

SEQ ID NO: 3159076 - DNA, 22 bp, Homo sapiens
tgtctagagtcatgtgagcctc

SEQ ID NO: 3159077 - DNA, 18 bp, Homo sapiens
tgtctatgaagttgctgt

SEQ ID NO: 3159078 - DNA, 15 bp, Homo sapiens
tgtctatgggactca

SEQ ID NO: 3159079 - DNA, 14 bp, Homo sapiens
tgtctattctgagc

SEQ ID NO: 3159080 - DNA, 15 bp, Homo sapiens
tgtctattctgagcc

SEQ ID NO: 3159081 - DNA, 12 bp, Homo sapiens
tgtctattttaa

SEQ ID NO: 3159082 - DNA, 14 bp, Homo sapiens
tgtctcaaaaggat

SEQ ID NO: 3159083 - DNA, 19 bp, Homo sapiens
tgtctcaagagggcactgg

SEQ ID NO: 3159084 - DNA, 21 bp, Homo sapiens
tgtctcaagagggcactggtg

SEQ ID NO: 3159085 - DNA, 14 bp, Homo sapiens
tgtctcacactggc

SEQ ID NO: 3159086 - DNA, 16 bp, Homo sapiens
tgtctcactgttctgc

SEQ ID NO: 3159087 - DNA, 19 bp, Homo sapiens
tgtctcactgttctgcaaa

SEQ ID NO: 3159088 - DNA, 23 bp, Homo sapiens
tgtctcactttttacccagaaca

SEQ ID NO: 3159089 - DNA, 22 bp, Homo sapiens
tgtctcagacttttgtacatct

SEQ ID NO: 3159090 - DNA, 13 bp, Homo sapiens
tgtctcagcctcc

SEQ ID NO: 3159091 - DNA, 13 bp, Homo sapiens
tgtctcagggccg

SEQ ID NO: 3159092 - DNA, 16 bp, Homo sapiens
tgtctcaggtccctgc

SEQ ID NO: 3159093 - DNA, 15 bp, Homo sapiens
tgtctcagttggaaa

SEQ ID NO: 3159094 - DNA, 16 bp, Homo sapiens
tgtctcatccccaggg

SEQ ID NO: 3159095 - DNA, 14 bp, Homo sapiens
tgtctcatcctcct

SEQ ID NO: 3159096 - DNA, 18 bp, Homo sapiens
tgtctcatcctcctggaa

SEQ ID NO: 3159097 - DNA, 19 bp, Homo sapiens
tgtctccaggccatgatgg

SEQ ID NO: 3159098 - DNA, 17 bp, Homo sapiens
tgtctcctactcctgac

SEQ ID NO: 3159099 - DNA, 22 bp, Homo sapiens
tgtctcctatatatttctatta

SEQ ID NO: 3159100 - DNA, 18 bp, Homo sapiens
tgtctctcccaccccggc

SEQ ID NO: 3159101 - DNA, 22 bp, Homo sapiens
tgtctctcccaccccggcctcc

SEQ ID NO: 3159102 - DNA, 12 bp, Homo sapiens
tgtctctccttt

SEQ ID NO: 3159103 - DNA, 20 bp, Homo sapiens
tgtctctccttttcttttgt

SEQ ID NO: 3159104 - DNA, 15 bp, Homo sapiens
tgtctctgataaaag

SEQ ID NO: 3159105 - DNA, 12 bp, Homo sapiens
tgtctctgcatc

SEQ ID NO: 3159106 - DNA, 23 bp, Homo sapiens
tgtctctgggcttggggcttcct

SEQ ID NO: 3159107 - DNA, 12 bp, Homo sapiens
tgtctctggggc

SEQ ID NO: 3159108 - DNA, 23 bp, Homo sapiens
tgtctctggggcagatccccact

SEQ ID NO: 3159109 - DNA, 12 bp, Homo sapiens
tgtctctgttca

SEQ ID NO: 3159110 - DNA, 13 bp, Homo sapiens
tgtctcttgaaaa

SEQ ID NO: 3159111 - DNA, 18 bp, Homo sapiens
tgtctcttgtagaagatg

SEQ ID NO: 3159112 - DNA, 17 bp, Homo sapiens
tgtctctttaagggcat

SEQ ID NO: 3159113 - DNA, 21 bp, Homo sapiens
tgtctctttaatgtcacaggc

SEQ ID NO: 3159114 - DNA, 14 bp, Homo sapiens
tgtctcttttctct

SEQ ID NO: 3159115 - DNA, 18 bp, Homo sapiens
tgtctcttttctctttct

SEQ ID NO: 3159116 - DNA, 21 bp, Homo sapiens
tgtctcttttctcttttgctt

SEQ ID NO: 3159117 - DNA, 22 bp, Homo sapiens
tgtctcttttctcttttgcttt

SEQ ID NO: 3159118 - DNA, 22 bp, Homo sapiens
tgtctgaaaaattcctttgtgt

SEQ ID NO: 3159119 - DNA, 13 bp, Homo sapiens
tgtctgaaacatt

SEQ ID NO: 3159120 - DNA, 13 bp, Homo sapiens
tgtctgaacttgc

SEQ ID NO: 3159121 - DNA, 12 bp, Homo sapiens
tgtctgaagcca

SEQ ID NO: 3159122 - DNA, 20 bp, Homo sapiens
tgtctgaagtcactgcacag

SEQ ID NO: 3159123 - DNA, 23 bp, Homo sapiens
tgtctgaatcgagtgagacaaaa

SEQ ID NO: 3159124 - DNA, 13 bp, Homo sapiens
tgtctgactcagg

SEQ ID NO: 3159125 - DNA, 16 bp, Homo sapiens
tgtctgaggcctcatc

SEQ ID NO: 3159126 - DNA, 14 bp, Homo sapiens
tgtctgagtgaacc

SEQ ID NO: 3159127 - DNA, 17 bp, Homo sapiens
tgtctgagtgaacctgt

SEQ ID NO: 3159128 - DNA, 21 bp, Homo sapiens
tgtctgagtgaacctgtataa

SEQ ID NO: 3159129 - DNA, 21 bp, Homo sapiens
tgtctgattggcttgtagaat

SEQ ID NO: 3159130 - DNA, 23 bp, Homo sapiens
tgtctgattggcttgtagaattg

SEQ ID NO: 3159131 - DNA, 15 bp, Homo sapiens
tgtctgcacagggtc

SEQ ID NO: 3159132 - DNA, 15 bp, Homo sapiens
tgtctgcctgtattt

SEQ ID NO: 3159133 - DNA, 16 bp, Homo sapiens
tgtctgccttactggt

SEQ ID NO: 3159134 - DNA, 23 bp, Homo sapiens
tgtctgctctcatccattcctct

SEQ ID NO: 3159135 - DNA, 23 bp, Homo sapiens
tgtctggagtggtaacagctctc

SEQ ID NO: 3159136 - DNA, 20 bp, Homo sapiens
tgtctggctttttcctctga

SEQ ID NO: 3159137 - DNA, 23 bp, Homo sapiens
tgtctggctttttcctctgagcc

SEQ ID NO: 3159138 - DNA, 17 bp, Homo sapiens
tgtctgggtttttcttg

SEQ ID NO: 3159139 - DNA, 12 bp, Homo sapiens
tgtctggtaact

SEQ ID NO: 3159140 - DNA, 13 bp, Homo sapiens
tgtctggtggccc

SEQ ID NO: 3159141 - DNA, 16 bp, Homo sapiens
tgtctggtggccccgt

SEQ ID NO: 3159142 - DNA, 22 bp, Homo sapiens
tgtctggttttaacaatttcct

SEQ ID NO: 3159143 - DNA, 18 bp, Homo sapiens
tgtctgtaaaagagccta

SEQ ID NO: 3159144 - DNA, 19 bp, Homo sapiens
tgtctgtacacgtgtcctg

SEQ ID NO: 3159145 - DNA, 20 bp, Homo sapiens
tgtctgtacacgtgtcctgt

SEQ ID NO: 3159146 - DNA, 17 bp, Homo sapiens
tgtctgtagctcctcaa

SEQ ID NO: 3159147 - DNA, 20 bp, Homo sapiens
tgtctgtatttcatgtggct

SEQ ID NO: 3159148 - DNA, 24 bp, Homo sapiens
tgtctgtcaccagctatctgtcat

SEQ ID NO: 3159149 - DNA, 12 bp, Homo sapiens
tgtctgtctaca

SEQ ID NO: 3159150 - DNA, 16 bp, Homo sapiens
tgtctgtgccatggat

SEQ ID NO: 3159151 - DNA, 19 bp, Homo sapiens
tgtctgtgccctccaaaga

SEQ ID NO: 3159152 - DNA, 17 bp, Homo sapiens
tgtctgtggatggtcat

SEQ ID NO: 3159153 - DNA, 16 bp, Homo sapiens
tgtctgtttgttctct

SEQ ID NO: 3159154 - DNA, 17 bp, Homo sapiens
tgtctgtttttgtatct

SEQ ID NO: 3159155 - DNA, 20 bp, Homo sapiens
tgtcttaaactaaatgtgca

SEQ ID NO: 3159156 - DNA, 14 bp, Homo sapiens
tgtcttaattatta

SEQ ID NO: 3159157 - DNA, 21 bp, Homo sapiens
tgtcttatcccccccagcctg

SEQ ID NO: 3159158 - DNA, 23 bp, Homo sapiens
tgtcttatcccccccagcctggc

SEQ ID NO: 3159159 - DNA, 13 bp, Homo sapiens
tgtcttattctta

SEQ ID NO: 3159160 - DNA, 14 bp, Homo sapiens
tgtcttattgaaaa

SEQ ID NO: 3159161 - DNA, 14 bp, Homo sapiens
tgtcttatttttag

SEQ ID NO: 3159162 - DNA, 23 bp, Homo sapiens
tgtcttatttttagatggttaca

SEQ ID NO: 3159163 - DNA, 19 bp, Homo sapiens
tgtcttcacagctctgtgt

SEQ ID NO: 3159164 - DNA, 17 bp, Homo sapiens
tgtcttcacctgccacc

SEQ ID NO: 3159165 - DNA, 22 bp, Homo sapiens
tgtcttcagcctctccaggcac

SEQ ID NO: 3159166 - DNA, 16 bp, Homo sapiens
tgtcttcatttcattg

SEQ ID NO: 3159167 - DNA, 17 bp, Homo sapiens
tgtcttcatttcattgt

SEQ ID NO: 3159168 - DNA, 21 bp, Homo sapiens
tgtcttcatttcattgtatga

SEQ ID NO: 3159169 - DNA, 12 bp, Homo sapiens
tgtcttccataa

SEQ ID NO: 3159170 - DNA, 14 bp, Homo sapiens
tgtcttccataatg

SEQ ID NO: 3159171 - DNA, 17 bp, Homo sapiens
tgtcttccataatgtat

SEQ ID NO: 3159172 - DNA, 17 bp, Homo sapiens
tgtcttcgctggctcct

SEQ ID NO: 3159173 - DNA, 12 bp, Homo sapiens
tgtcttctgcct

SEQ ID NO: 3159174 - DNA, 14 bp, Homo sapiens
tgtcttctggtctg

SEQ ID NO: 3159175 - DNA, 19 bp, Homo sapiens
tgtcttgaaagattcaggt

SEQ ID NO: 3159176 - DNA, 13 bp, Homo sapiens
tgtcttgcaactt

SEQ ID NO: 3159177 - DNA, 17 bp, Homo sapiens
tgtcttgcaatggcagc

SEQ ID NO: 3159178 - DNA, 18 bp, Homo sapiens
tgtcttgcaatggcagcc

SEQ ID NO: 3159179 - DNA, 20 bp, Homo sapiens
tgtcttgcaatggcagcctt

SEQ ID NO: 3159180 - DNA, 15 bp, Homo sapiens
tgtcttggacactgt

SEQ ID NO: 3159181 - DNA, 16 bp, Homo sapiens
tgtcttgtacatgtgt

SEQ ID NO: 3159182 - DNA, 20 bp, Homo sapiens
tgtcttgtacatgtgtagcc

SEQ ID NO: 3159183 - DNA, 13 bp, Homo sapiens
tgtcttgtacttc

SEQ ID NO: 3159184 - DNA, 15 bp, Homo sapiens
tgtctttaaaagaga

SEQ ID NO: 3159185 - DNA, 20 bp, Homo sapiens
tgtctttactggacctgaaa

SEQ ID NO: 3159186 - DNA, 16 bp, Homo sapiens
tgtctttcaaaaggta

SEQ ID NO: 3159187 - DNA, 16 bp, Homo sapiens
tgtctttcagatacat

SEQ ID NO: 3159188 - DNA, 19 bp, Homo sapiens
tgtctttcagatacatggt

SEQ ID NO: 3159189 - DNA, 12 bp, Homo sapiens
tgtctttcctcc

SEQ ID NO: 3159190 - DNA, 14 bp, Homo sapiens
tgtctttctttggt

SEQ ID NO: 3159191 - DNA, 20 bp, Homo sapiens
tgtctttctttggtgccttt

SEQ ID NO: 3159192 - DNA, 13 bp, Homo sapiens
tgtctttggaaaa

SEQ ID NO: 3159193 - DNA, 16 bp, Homo sapiens
tgtcttttaaaatgca

SEQ ID NO: 3159194 - DNA, 13 bp, Homo sapiens
tgtcttttagaca

SEQ ID NO: 3159195 - DNA, 17 bp, Homo sapiens
tgtcttttatgcagata

SEQ ID NO: 3159196 - DNA, 19 bp, Homo sapiens
tgtcttttatgcagataga

SEQ ID NO: 3159197 - DNA, 22 bp, Homo sapiens
tgtcttttcttggcaaaagcct

SEQ ID NO: 3159198 - DNA, 14 bp, Homo sapiens
tgtcttttgaatat

SEQ ID NO: 3159199 - DNA, 15 bp, Homo sapiens
tgtctttttcttacc

SEQ ID NO: 3159200 - DNA, 18 bp, Homo sapiens
tgtgaaaaaagaaaatgg

SEQ ID NO: 3159201 - DNA, 17 bp, Homo sapiens
tgtgaaaatatacttga

SEQ ID NO: 3159202 - DNA, 20 bp, Homo sapiens
tgtgaaacaatgttgtccaa

SEQ ID NO: 3159203 - DNA, 16 bp, Homo sapiens
tgtgaaacacagctgt

SEQ ID NO: 3159204 - DNA, 17 bp, Homo sapiens
tgtgaaacacagctgtt

SEQ ID NO: 3159205 - DNA, 19 bp, Homo sapiens
tgtgaaacactttgcctcc

SEQ ID NO: 3159206 - DNA, 19 bp, Homo sapiens
tgtgaaactggcactgaat

SEQ ID NO: 3159207 - DNA, 15 bp, Homo sapiens
tgtgaaactttcatt

SEQ ID NO: 3159208 - DNA, 22 bp, Homo sapiens
tgtgaaagaaagctgagaagaa

SEQ ID NO: 3159209 - DNA, 20 bp, Homo sapiens
tgtgaaaggaagctccactg

SEQ ID NO: 3159210 - DNA, 17 bp, Homo sapiens
tgtgaaagttttgagta

SEQ ID NO: 3159211 - DNA, 18 bp, Homo sapiens
tgtgaaatctcagaattt

SEQ ID NO: 3159212 - DNA, 14 bp, Homo sapiens
tgtgaaatgaaaac

SEQ ID NO: 3159213 - DNA, 18 bp, Homo sapiens
tgtgaaattgcatacttt

SEQ ID NO: 3159214 - DNA, 20 bp, Homo sapiens
tgtgaacaaaagatgctctt

SEQ ID NO: 3159215 - DNA, 15 bp, Homo sapiens
tgtgaacagagagac

SEQ ID NO: 3159216 - DNA, 15 bp, Homo sapiens
tgtgaaccaccacac

SEQ ID NO: 3159217 - DNA, 23 bp, Homo sapiens
tgtgaaccaccacacccagccca

SEQ ID NO: 3159218 - DNA, 21 bp, Homo sapiens
tgtgaacgatttagaaagaag

SEQ ID NO: 3159219 - DNA, 15 bp, Homo sapiens
tgtgaactgctttca

SEQ ID NO: 3159220 - DNA, 18 bp, Homo sapiens
tgtgaactgctttcaagt

SEQ ID NO: 3159221 - DNA, 13 bp, Homo sapiens
tgtgaactggaag

SEQ ID NO: 3159222 - DNA, 16 bp, Homo sapiens
tgtgaactggaagaaa

SEQ ID NO: 3159223 - DNA, 18 bp, Homo sapiens
tgtgaagagggagaagca

SEQ ID NO: 3159224 - DNA, 15 bp, Homo sapiens
tgtgaagcatgcttt

SEQ ID NO: 3159225 - DNA, 22 bp, Homo sapiens
tgtgaaggattatggaaaaata

SEQ ID NO: 3159226 - DNA, 23 bp, Homo sapiens
tgtgaagtgatgttcagatttct

SEQ ID NO: 3159227 - DNA, 20 bp, Homo sapiens
tgtgaagtttacattgtaaa

SEQ ID NO: 3159228 - DNA, 17 bp, Homo sapiens
tgtgaatacaattaaag

SEQ ID NO: 3159229 - DNA, 16 bp, Homo sapiens
tgtgaatagattttag

SEQ ID NO: 3159230 - DNA, 23 bp, Homo sapiens
tgtgaatatttccatatggattt

SEQ ID NO: 3159231 - DNA, 20 bp, Homo sapiens
tgtgaatgattcatgttata

SEQ ID NO: 3159232 - DNA, 22 bp, Homo sapiens
tgtgaatgattcatgttatatt

SEQ ID NO: 3159233 - DNA, 14 bp, Homo sapiens
tgtgaatgcttctc

SEQ ID NO: 3159234 - DNA, 15 bp, Homo sapiens
tgtgaatggaagcaa

SEQ ID NO: 3159235 - DNA, 23 bp, Homo sapiens
tgtgaatggaagcaaagtgctgg

SEQ ID NO: 3159236 - DNA, 22 bp, Homo sapiens
tgtgaatggaggcagagacctc

SEQ ID NO: 3159237 - DNA, 15 bp, Homo sapiens
tgtgaatggattgga

SEQ ID NO: 3159238 - DNA, 19 bp, Homo sapiens
tgtgaattaggctgtaact

SEQ ID NO: 3159239 - DNA, 22 bp, Homo sapiens
tgtgaattaggctgtaactact

SEQ ID NO: 3159240 - DNA, 23 bp, Homo sapiens
tgtgaatttcttcactgttgaaa

SEQ ID NO: 3159241 - DNA, 22 bp, Homo sapiens
tgtgaattttctaaaagctttc

SEQ ID NO: 3159242 - DNA, 19 bp, Homo sapiens
tgtgacaaaggatgaagaa

SEQ ID NO: 3159243 - DNA, 20 bp, Homo sapiens
tgtgacaaaggatgaagaac

SEQ ID NO: 3159244 - DNA, 21 bp, Homo sapiens
tgtgacaactgtctaacttta

SEQ ID NO: 3159245 - DNA, 20 bp, Homo sapiens
tgtgacaataatattgttgt

SEQ ID NO: 3159246 - DNA, 22 bp, Homo sapiens
tgtgacaataatattgttgtat

SEQ ID NO: 3159247 - DNA, 19 bp, Homo sapiens
tgtgacaattctgttttta

SEQ ID NO: 3159248 - DNA, 22 bp, Homo sapiens
tgtgacacatatgcaccttgtg

SEQ ID NO: 3159249 - DNA, 18 bp, Homo sapiens
tgtgacacatcaagcttt

SEQ ID NO: 3159250 - DNA, 23 bp, Homo sapiens
tgtgacacctaactcttttctat

SEQ ID NO: 3159251 - DNA, 12 bp, Homo sapiens
tgtgacagggcc

SEQ ID NO: 3159252 - DNA, 18 bp, Homo sapiens
tgtgacatggtgcctgag

SEQ ID NO: 3159253 - DNA, 22 bp, Homo sapiens
tgtgacatggtgcctgagaggc

SEQ ID NO: 3159254 - DNA, 12 bp, Homo sapiens
tgtgacatgtaa

SEQ ID NO: 3159255 - DNA, 18 bp, Homo sapiens
tgtgacattccatgacga

SEQ ID NO: 3159256 - DNA, 12 bp, Homo sapiens
tgtgacatttac

SEQ ID NO: 3159257 - DNA, 15 bp, Homo sapiens
tgtgaccaactgtgt

SEQ ID NO: 3159258 - DNA, 16 bp, Homo sapiens
tgtgaccaactgtgtt

SEQ ID NO: 3159259 - DNA, 22 bp, Homo sapiens
tgtgaccaactgtgttgtatta

SEQ ID NO: 3159260 - DNA, 19 bp, Homo sapiens
tgtgaccacaggctggtgt

SEQ ID NO: 3159261 - DNA, 13 bp, Homo sapiens
tgtgaccaccacc

SEQ ID NO: 3159262 - DNA, 17 bp, Homo sapiens
tgtgaccagcactgtct

SEQ ID NO: 3159263 - DNA, 14 bp, Homo sapiens
tgtgacccaccagt

SEQ ID NO: 3159264 - DNA, 17 bp, Homo sapiens
tgtgacccaccagtgcc

SEQ ID NO: 3159265 - DNA, 15 bp, Homo sapiens
tgtgaccccactgcc

SEQ ID NO: 3159266 - DNA, 13 bp, Homo sapiens
tgtgacctcaggc

SEQ ID NO: 3159267 - DNA, 21 bp, Homo sapiens
tgtgacctcaggcactagcct

SEQ ID NO: 3159268 - DNA, 20 bp, Homo sapiens
tgtgacctgatttcagaaga

SEQ ID NO: 3159269 - DNA, 17 bp, Homo sapiens
tgtgacgcagacagagg

SEQ ID NO: 3159270 - DNA, 18 bp, Homo sapiens
tgtgactatatagagatg

SEQ ID NO: 3159271 - DNA, 16 bp, Homo sapiens
tgtgactctaaattct

SEQ ID NO: 3159272 - DNA, 23 bp, Homo sapiens
tgtgactctttttagggccaggc

SEQ ID NO: 3159273 - DNA, 15 bp, Homo sapiens
tgtgactttgacgct

SEQ ID NO: 3159274 - DNA, 22 bp, Homo sapiens
tgtgagaagtgaatgctgggac

SEQ ID NO: 3159275 - DNA, 14 bp, Homo sapiens
tgtgagacccccac

SEQ ID NO: 3159276 - DNA, 15 bp, Homo sapiens
tgtgagacccccaca

SEQ ID NO: 3159277 - DNA, 16 bp, Homo sapiens
tgtgagacccccacac

SEQ ID NO: 3159278 - DNA, 15 bp, Homo sapiens
tgtgagaggtttgac

SEQ ID NO: 3159279 - DNA, 19 bp, Homo sapiens
tgtgagatgctagaactcc

SEQ ID NO: 3159280 - DNA, 14 bp, Homo sapiens
tgtgagatgtaatt

SEQ ID NO: 3159281 - DNA, 14 bp, Homo sapiens
tgtgagccccaggg

SEQ ID NO: 3159282 - DNA, 15 bp, Homo sapiens
tgtgagccccagggg

SEQ ID NO: 3159283 - DNA, 12 bp, Homo sapiens
tgtgagcccctg

SEQ ID NO: 3159284 - DNA, 21 bp, Homo sapiens
tgtgagcccctggtcctgagg

SEQ ID NO: 3159285 - DNA, 16 bp, Homo sapiens
tgtgagcgccttggta

SEQ ID NO: 3159286 - DNA, 21 bp, Homo sapiens
tgtgaggaatgctctgtgcca

SEQ ID NO: 3159287 - DNA, 20 bp, Homo sapiens
tgtgaggagctgctggcttg

SEQ ID NO: 3159288 - DNA, 22 bp, Homo sapiens
tgtgagggacatgctcacctct

SEQ ID NO: 3159289 - DNA, 15 bp, Homo sapiens
tgtgagtcaccaagc

SEQ ID NO: 3159290 - DNA, 17 bp, Homo sapiens
tgtgagtcaccaagccc

SEQ ID NO: 3159291 - DNA, 16 bp, Homo sapiens
tgtgagtcccagagcc

SEQ ID NO: 3159292 - DNA, 17 bp, Homo sapiens
tgtgagtgccttttgca

SEQ ID NO: 3159293 - DNA, 21 bp, Homo sapiens
tgtgagtgccttttgcagaag

SEQ ID NO: 3159294 - DNA, 22 bp, Homo sapiens
tgtgagtggagttgaggtgtca

SEQ ID NO: 3159295 - DNA, 18 bp, Homo sapiens
tgtgagtggcagccatgc

SEQ ID NO: 3159296 - DNA, 19 bp, Homo sapiens
tgtgagtggcagccatgcc

SEQ ID NO: 3159297 - DNA, 14 bp, Homo sapiens
tgtgagtgtgacag

SEQ ID NO: 3159298 - DNA, 17 bp, Homo sapiens
tgtgagtgtgacagggc

SEQ ID NO: 3159299 - DNA, 18 bp, Homo sapiens
tgtgagtgtgacagggcc

SEQ ID NO: 3159300 - DNA, 17 bp, Homo sapiens
tgtgagtgtttggggga

SEQ ID NO: 3159301 - DNA, 19 bp, Homo sapiens
tgtgagtttaccttgtata

SEQ ID NO: 3159302 - DNA, 21 bp, Homo sapiens
tgtgatacattttttaagctt

SEQ ID NO: 3159303 - DNA, 22 bp, Homo sapiens
tgtgatacccatagcttccatg

SEQ ID NO: 3159304 - DNA, 13 bp, Homo sapiens
tgtgatatataag

SEQ ID NO: 3159305 - DNA, 15 bp, Homo sapiens
tgtgatattctaaga

SEQ ID NO: 3159306 - DNA, 18 bp, Homo sapiens
tgtgatcacgcctggcta

SEQ ID NO: 3159307 - DNA, 17 bp, Homo sapiens
tgtgatgatgtaattga

SEQ ID NO: 3159308 - DNA, 18 bp, Homo sapiens
tgtgatgtaccagtttgt

SEQ ID NO: 3159309 - DNA, 15 bp, Homo sapiens
tgtgatgttctaagg

SEQ ID NO: 3159310 - DNA, 14 bp, Homo sapiens
tgtgattaacttat

SEQ ID NO: 3159311 - DNA, 15 bp, Homo sapiens
tgtgattatttcact

SEQ ID NO: 3159312 - DNA, 17 bp, Homo sapiens
tgtgattatttcacttt

SEQ ID NO: 3159313 - DNA, 15 bp, Homo sapiens
tgtgattcaatctgt

SEQ ID NO: 3159314 - DNA, 21 bp, Homo sapiens
tgtgattctaatgtcttcatt

SEQ ID NO: 3159315 - DNA, 15 bp, Homo sapiens
tgtgattgaatctga

SEQ ID NO: 3159316 - DNA, 14 bp, Homo sapiens
tgtgattgcacaga

SEQ ID NO: 3159317 - DNA, 14 bp, Homo sapiens
tgtgattggcctgt

SEQ ID NO: 3159318 - DNA, 15 bp, Homo sapiens
tgtgattggcctgta

SEQ ID NO: 3159319 - DNA, 14 bp, Homo sapiens
tgtgattgtggaat

SEQ ID NO: 3159320 - DNA, 14 bp, Homo sapiens
tgtgatttcctaaa

SEQ ID NO: 3159321 - DNA, 22 bp, Homo sapiens
tgtgatttctttaaaagaatga

SEQ ID NO: 3159322 - DNA, 16 bp, Homo sapiens
tgtgcaaacagtaacg

SEQ ID NO: 3159323 - DNA, 18 bp, Homo sapiens
tgtgcaacagggtatgga

SEQ ID NO: 3159324 - DNA, 20 bp, Homo sapiens
tgtgcaacagggtatggact

SEQ ID NO: 3159325 - DNA, 16 bp, Homo sapiens
tgtgcaatagaaggtg

SEQ ID NO: 3159326 - DNA, 17 bp, Homo sapiens
tgtgcaattgtgaggga

SEQ ID NO: 3159327 - DNA, 16 bp, Homo sapiens
tgtgcacaccaccctc

SEQ ID NO: 3159328 - DNA, 17 bp, Homo sapiens
tgtgcactgtcactttg

SEQ ID NO: 3159329 - DNA, 21 bp, Homo sapiens
tgtgcactgtcactttgctct

SEQ ID NO: 3159330 - DNA, 13 bp, Homo sapiens
tgtgcagaataat

SEQ ID NO: 3159331 - DNA, 15 bp, Homo sapiens
tgtgcagaataatgg

SEQ ID NO: 3159332 - DNA, 17 bp, Homo sapiens
tgtgcagaataatggaa

SEQ ID NO: 3159333 - DNA, 20 bp, Homo sapiens
tgtgcagaataatggaaaca

SEQ ID NO: 3159334 - DNA, 21 bp, Homo sapiens
tgtgcagcagcccagcttcct

SEQ ID NO: 3159335 - DNA, 23 bp, Homo sapiens
tgtgcagcagcccagcttcctgg

SEQ ID NO: 3159336 - DNA, 20 bp, Homo sapiens
tgtgcagcgcagctggactc

SEQ ID NO: 3159337 - DNA, 12 bp, Homo sapiens
tgtgcagtgttg

SEQ ID NO: 3159338 - DNA, 21 bp, Homo sapiens
tgtgcataatgctttggaaaa

SEQ ID NO: 3159339 - DNA, 17 bp, Homo sapiens
tgtgcatagtgctggga

SEQ ID NO: 3159340 - DNA, 19 bp, Homo sapiens
tgtgcatgggtgaagggag

SEQ ID NO: 3159341 - DNA, 23 bp, Homo sapiens
tgtgcatgtatgtcttggacact

SEQ ID NO: 3159342 - DNA, 22 bp, Homo sapiens
tgtgcatgtgtgtaagtgtgtg

SEQ ID NO: 3159343 - DNA, 18 bp, Homo sapiens
tgtgcatgtgtgtataag

SEQ ID NO: 3159344 - DNA, 13 bp, Homo sapiens
tgtgcattctttg

SEQ ID NO: 3159345 - DNA, 16 bp, Homo sapiens
tgtgcattctttggta

SEQ ID NO: 3159346 - DNA, 21 bp, Homo sapiens
tgtgccactaaactacattgt

SEQ ID NO: 3159347 - DNA, 18 bp, Homo sapiens
tgtgccactttgactcag

SEQ ID NO: 3159348 - DNA, 22 bp, Homo sapiens
tgtgccactttgactcagaggc

SEQ ID NO: 3159349 - DNA, 12 bp, Homo sapiens
tgtgccaggctg

SEQ ID NO: 3159350 - DNA, 13 bp, Homo sapiens
tgtgccaggctga

SEQ ID NO: 3159351 - DNA, 21 bp, Homo sapiens
tgtgccagggcaatgatgaat

SEQ ID NO: 3159352 - DNA, 20 bp, Homo sapiens
tgtgccatagagtttaacac

SEQ ID NO: 3159353 - DNA, 16 bp, Homo sapiens
tgtgccatagtcacat

SEQ ID NO: 3159354 - DNA, 17 bp, Homo sapiens
tgtgcccatggcttctg

SEQ ID NO: 3159355 - DNA, 23 bp, Homo sapiens
tgtgccccatgcctgtccagcct

SEQ ID NO: 3159356 - DNA, 16 bp, Homo sapiens
tgtgccctcaccacca

SEQ ID NO: 3159357 - DNA, 12 bp, Homo sapiens
tgtgcccttggg

SEQ ID NO: 3159358 - DNA, 15 bp, Homo sapiens
tgtgccgaatgtgca

SEQ ID NO: 3159359 - DNA, 17 bp, Homo sapiens
tgtgcctatagtcccag

SEQ ID NO: 3159360 - DNA, 14 bp, Homo sapiens
tgtgcctcctcacc

SEQ ID NO: 3159361 - DNA, 15 bp, Homo sapiens
tgtgcctcctcaccc

SEQ ID NO: 3159362 - DNA, 16 bp, Homo sapiens
tgtgcctcctcacccc

SEQ ID NO: 3159363 - DNA, 12 bp, Homo sapiens
tgtgcctctgcc

SEQ ID NO: 3159364 - DNA, 17 bp, Homo sapiens
tgtgcctctgggactgg

SEQ ID NO: 3159365 - DNA, 16 bp, Homo sapiens
tgtgcctgcaccagga

SEQ ID NO: 3159366 - DNA, 22 bp, Homo sapiens
tgtgcctgtcaggctctggccc

SEQ ID NO: 3159367 - DNA, 14 bp, Homo sapiens
tgtgcctgtggcag

SEQ ID NO: 3159368 - DNA, 20 bp, Homo sapiens
tgtgcctttgcaaatcagtg

SEQ ID NO: 3159369 - DNA, 13 bp, Homo sapiens
tgtgccttttctg

SEQ ID NO: 3159370 - DNA, 15 bp, Homo sapiens
tgtgccttttctgaa

SEQ ID NO: 3159371 - DNA, 14 bp, Homo sapiens
tgtgcgcctacagg

SEQ ID NO: 3159372 - DNA, 13 bp, Homo sapiens
tgtgcgtgaaaca

SEQ ID NO: 3159373 - DNA, 16 bp, Homo sapiens
tgtgctacccctttga

SEQ ID NO: 3159374 - DNA, 20 bp, Homo sapiens
tgtgctagaaattttcaaga

SEQ ID NO: 3159375 - DNA, 14 bp, Homo sapiens
tgtgctagaatact

SEQ ID NO: 3159376 - DNA, 13 bp, Homo sapiens
tgtgctagatgtg

SEQ ID NO: 3159377 - DNA, 17 bp, Homo sapiens
tgtgctatacacacaca

SEQ ID NO: 3159378 - DNA, 13 bp, Homo sapiens
tgtgctatactgc

SEQ ID NO: 3159379 - DNA, 20 bp, Homo sapiens
tgtgctatactgcatacttt

SEQ ID NO: 3159380 - DNA, 21 bp, Homo sapiens
tgtgctatactgcatactttt

SEQ ID NO: 3159381 - DNA, 15 bp, Homo sapiens
tgtgctatgaatttt

SEQ ID NO: 3159382 - DNA, 21 bp, Homo sapiens
tgtgctcacgctcccccgcag

SEQ ID NO: 3159383 - DNA, 22 bp, Homo sapiens
tgtgctcatgcattgcttgtgt

SEQ ID NO: 3159384 - DNA, 16 bp, Homo sapiens
tgtgctccgtgcctcc

SEQ ID NO: 3159385 - DNA, 14 bp, Homo sapiens
tgtgctctctgtgg

SEQ ID NO: 3159386 - DNA, 12 bp, Homo sapiens
tgtgctctgatc

SEQ ID NO: 3159387 - DNA, 16 bp, Homo sapiens
tgtgctctggacaggc

SEQ ID NO: 3159388 - DNA, 19 bp, Homo sapiens
tgtgctcttgttttgtctt

SEQ ID NO: 3159389 - DNA, 15 bp, Homo sapiens
tgtgctctttgaaga

SEQ ID NO: 3159390 - DNA, 13 bp, Homo sapiens
tgtgctgaatgtg

SEQ ID NO: 3159391 - DNA, 19 bp, Homo sapiens
tgtgctggatggagcccag

SEQ ID NO: 3159392 - DNA, 21 bp, Homo sapiens
tgtgctggatggagcccaggc

SEQ ID NO: 3159393 - DNA, 21 bp, Homo sapiens
tgtgctgggagctccactctg

SEQ ID NO: 3159394 - DNA, 23 bp, Homo sapiens
tgtgctgggggaatgagcccaga

SEQ ID NO: 3159395 - DNA, 14 bp, Homo sapiens
tgtgctgggtgcct

SEQ ID NO: 3159396 - DNA, 17 bp, Homo sapiens
tgtgctgggtgcctccc

SEQ ID NO: 3159397 - DNA, 17 bp, Homo sapiens
tgtgctgtgcctgctag

SEQ ID NO: 3159398 - DNA, 13 bp, Homo sapiens
tgtgctgtggaga

SEQ ID NO: 3159399 - DNA, 13 bp, Homo sapiens
tgtgctgtggcat

SEQ ID NO: 3159400 - DNA, 17 bp, Homo sapiens
tgtgctgtggggctggt

SEQ ID NO: 3159401 - DNA, 12 bp, Homo sapiens
tgtgctgtgtgt

SEQ ID NO: 3159402 - DNA, 23 bp, Homo sapiens
tgtgcttcacagtagagccagct

SEQ ID NO: 3159403 - DNA, 15 bp, Homo sapiens
tgtgcttctccccag

SEQ ID NO: 3159404 - DNA, 19 bp, Homo sapiens
tgtgcttgagccaggaggc

SEQ ID NO: 3159405 - DNA, 22 bp, Homo sapiens
tgtgcttggatttgcatattta

SEQ ID NO: 3159406 - DNA, 14 bp, Homo sapiens
tgtgcttggggcta

SEQ ID NO: 3159407 - DNA, 14 bp, Homo sapiens
tgtgcttgttttat

SEQ ID NO: 3159408 - DNA, 12 bp, Homo sapiens
tgtgctttccca

SEQ ID NO: 3159409 - DNA, 17 bp, Homo sapiens
tgtgctttgctcttgtc

SEQ ID NO: 3159410 - DNA, 22 bp, Homo sapiens
tgtgctttgctcttgtcccacg

SEQ ID NO: 3159411 - DNA, 21 bp, Homo sapiens
tgtgcttttcctgataaagca

SEQ ID NO: 3159412 - DNA, 14 bp, Homo sapiens
tgtggaaaaccagg

SEQ ID NO: 3159413 - DNA, 17 bp, Homo sapiens
tgtggaaagcctctgct

SEQ ID NO: 3159414 - DNA, 13 bp, Homo sapiens
tgtggaaatggga

SEQ ID NO: 3159415 - DNA, 22 bp, Homo sapiens
tgtggaactaataaatacatac

SEQ ID NO: 3159416 - DNA, 23 bp, Homo sapiens
tgtggaactaataaatacatacg

SEQ ID NO: 3159417 - DNA, 22 bp, Homo sapiens
tgtggaatggattatagagtat

SEQ ID NO: 3159418 - DNA, 18 bp, Homo sapiens
tgtggacacagctcttct

SEQ ID NO: 3159419 - DNA, 17 bp, Homo sapiens
tgtggaccaattattga

SEQ ID NO: 3159420 - DNA, 20 bp, Homo sapiens
tgtggaccgtggacaggccc

SEQ ID NO: 3159421 - DNA, 22 bp, Homo sapiens
tgtggaccgtggacaggcccag

SEQ ID NO: 3159422 - DNA, 21 bp, Homo sapiens
tgtggacggggaggctctccc

SEQ ID NO: 3159423 - DNA, 15 bp, Homo sapiens
tgtggactgtgatgc

SEQ ID NO: 3159424 - DNA, 14 bp, Homo sapiens
tgtggagaggggtg

SEQ ID NO: 3159425 - DNA, 19 bp, Homo sapiens
tgtggagaggggtgcaccc

SEQ ID NO: 3159426 - DNA, 22 bp, Homo sapiens
tgtggagcaaaaggcagctcac

SEQ ID NO: 3159427 - DNA, 16 bp, Homo sapiens
tgtggagccgaggcct

SEQ ID NO: 3159428 - DNA, 16 bp, Homo sapiens
tgtggaggaaggattg

SEQ ID NO: 3159429 - DNA, 12 bp, Homo sapiens
tgtggaggcctg

SEQ ID NO: 3159430 - DNA, 15 bp, Homo sapiens
tgtggatataaaatg

SEQ ID NO: 3159431 - DNA, 14 bp, Homo sapiens
tgtggatcagagat

SEQ ID NO: 3159432 - DNA, 20 bp, Homo sapiens
tgtggatcttgccacatttc

SEQ ID NO: 3159433 - DNA, 23 bp, Homo sapiens
tgtggatcttgccacatttctga

SEQ ID NO: 3159434 - DNA, 19 bp, Homo sapiens
tgtggatcttttcattctc

SEQ ID NO: 3159435 - DNA, 21 bp, Homo sapiens
tgtggatgtaattagctctgg

SEQ ID NO: 3159436 - DNA, 22 bp, Homo sapiens
tgtggatgtaattagctctggg

SEQ ID NO: 3159437 - DNA, 19 bp, Homo sapiens
tgtggcaaaatatggtttg

SEQ ID NO: 3159438 - DNA, 17 bp, Homo sapiens
tgtggcaaggaaaaaca

SEQ ID NO: 3159439 - DNA, 18 bp, Homo sapiens
tgtggcaatctgtgggct

SEQ ID NO: 3159440 - DNA, 15 bp, Homo sapiens
tgtggcagaaaagag

SEQ ID NO: 3159441 - DNA, 23 bp, Homo sapiens
tgtggcaggcagcgccaagcaac

SEQ ID NO: 3159442 - DNA, 13 bp, Homo sapiens
tgtggcagggcgt

SEQ ID NO: 3159443 - DNA, 22 bp, Homo sapiens
tgtggcagtaaagagaaacttt

SEQ ID NO: 3159444 - DNA, 11 bp, Homo sapiens
tgtggcagtgg

SEQ ID NO: 3159445 - DNA, 16 bp, Homo sapiens
tgtggcagtggttttg

SEQ ID NO: 3159446 - DNA, 23 bp, Homo sapiens
tgtggcataaattgcatcactgt

SEQ ID NO: 3159447 - DNA, 15 bp, Homo sapiens
tgtggccacagcccc

SEQ ID NO: 3159448 - DNA, 18 bp, Homo sapiens
tgtggccacttatttcac

SEQ ID NO: 3159449 - DNA, 15 bp, Homo sapiens
tgtggccagagctgg

SEQ ID NO: 3159450 - DNA, 22 bp, Homo sapiens
tgtggccagagctggaaggcag

SEQ ID NO: 3159451 - DNA, 20 bp, Homo sapiens
tgtggcccatcttactggaa

SEQ ID NO: 3159452 - DNA, 12 bp, Homo sapiens
tgtggccccacc

SEQ ID NO: 3159453 - DNA, 17 bp, Homo sapiens
tgtggccccaccctggg

SEQ ID NO: 3159454 - DNA, 17 bp, Homo sapiens
tgtggcccctgaacaag

SEQ ID NO: 3159455 - DNA, 19 bp, Homo sapiens
tgtggccgactctgcactc

SEQ ID NO: 3159456 - DNA, 17 bp, Homo sapiens
tgtggccgtctcctccc

SEQ ID NO: 3159457 - DNA, 17 bp, Homo sapiens
tgtggcctcagccctca

SEQ ID NO: 3159458 - DNA, 13 bp, Homo sapiens
tgtggcctgtgtc

SEQ ID NO: 3159459 - DNA, 21 bp, Homo sapiens
tgtggcctgtgtccagcagct

SEQ ID NO: 3159460 - DNA, 22 bp, Homo sapiens
tgtggcctgtgtccagcagctg

SEQ ID NO: 3159461 - DNA, 20 bp, Homo sapiens
tgtggccttccatttatatg

SEQ ID NO: 3159462 - DNA, 10 bp, Homo sapiens
tgtggctcac

SEQ ID NO: 3159463 - DNA, 17 bp, Homo sapiens
tgtggctccaagctcag

SEQ ID NO: 3159464 - DNA, 20 bp, Homo sapiens
tgtggctcctatctgtgttt

SEQ ID NO: 3159465 - DNA, 21 bp, Homo sapiens
tgtggctcctgggggttcttt

SEQ ID NO: 3159466 - DNA, 16 bp, Homo sapiens
tgtggctcttatttct

SEQ ID NO: 3159467 - DNA, 18 bp, Homo sapiens
tgtggctcttatttctga

SEQ ID NO: 3159468 - DNA, 12 bp, Homo sapiens
tgtggctgaaaa

SEQ ID NO: 3159469 - DNA, 22 bp, Homo sapiens
tgtggctgaaaatgcaaagctg

SEQ ID NO: 3159470 - DNA, 23 bp, Homo sapiens
tgtggctgaaaatgcaaagctga

SEQ ID NO: 3159471 - DNA, 20 bp, Homo sapiens
tgtggctgtagatcccaaga

SEQ ID NO: 3159472 - DNA, 18 bp, Homo sapiens
tgtggcttttttaaaaaa

SEQ ID NO: 3159473 - DNA, 22 bp, Homo sapiens
tgtgggaagaccaaaggaagga

SEQ ID NO: 3159474 - DNA, 23 bp, Homo sapiens
tgtgggaagaccaaaggaaggaa

SEQ ID NO: 3159475 - DNA, 20 bp, Homo sapiens
tgtgggactgtacacacttt

SEQ ID NO: 3159476 - DNA, 13 bp, Homo sapiens
tgtgggagggagc

SEQ ID NO: 3159477 - DNA, 14 bp, Homo sapiens
tgtgggcactggcc

SEQ ID NO: 3159478 - DNA, 21 bp, Homo sapiens
tgtgggcatttcttgcgagcc

SEQ ID NO: 3159479 - DNA, 22 bp, Homo sapiens
tgtgggctagttgggcttcctc

SEQ ID NO: 3159480 - DNA, 19 bp, Homo sapiens
tgtgggctggtgccccaca

SEQ ID NO: 3159481 - DNA, 14 bp, Homo sapiens
tgtgggctgtgagt

SEQ ID NO: 3159482 - DNA, 13 bp, Homo sapiens
tgtggggaaaggg

SEQ ID NO: 3159483 - DNA, 20 bp, Homo sapiens
tgtggggatctcaggggctg

SEQ ID NO: 3159484 - DNA, 18 bp, Homo sapiens
tgtggggcttggcgtgga

SEQ ID NO: 3159485 - DNA, 21 bp, Homo sapiens
tgtgggggccaaacctgggac

SEQ ID NO: 3159486 - DNA, 16 bp, Homo sapiens
tgtgggggtggccatc

SEQ ID NO: 3159487 - DNA, 20 bp, Homo sapiens
tgtgggggtggccatccctg

SEQ ID NO: 3159488 - DNA, 21 bp, Homo sapiens
tgtgggggtggccatccctgg

SEQ ID NO: 3159489 - DNA, 13 bp, Homo sapiens
tgtggggtggggt

SEQ ID NO: 3159490 - DNA, 21 bp, Homo sapiens
tgtggggtttttggagaaggt

SEQ ID NO: 3159491 - DNA, 15 bp, Homo sapiens
tgtgggtccccactc

SEQ ID NO: 3159492 - DNA, 18 bp, Homo sapiens
tgtgggtttggttagagg

SEQ ID NO: 3159493 - DNA, 16 bp, Homo sapiens
tgtggtacatggtgtt

SEQ ID NO: 3159494 - DNA, 20 bp, Homo sapiens
tgtggtagcttatcttagaa

SEQ ID NO: 3159495 - DNA, 19 bp, Homo sapiens
tgtggtaggccttttaaca

SEQ ID NO: 3159496 - DNA, 24 bp, Homo sapiens
tgtggtaggccttttaacattttg

SEQ ID NO: 3159497 - DNA, 19 bp, Homo sapiens
tgtggtattgaatattgtg

SEQ ID NO: 3159498 - DNA, 11 bp, Homo sapiens
tgtggtctcag

SEQ ID NO: 3159499 - DNA, 22 bp, Homo sapiens
tgtggtgaggggtgtgggaaga

SEQ ID NO: 3159500 - DNA, 16 bp, Homo sapiens
tgtggtgtaaagctgg

SEQ ID NO: 3159501 - DNA, 20 bp, Homo sapiens
tgtggtgtaaagctggccct

SEQ ID NO: 3159502 - DNA, 17 bp, Homo sapiens
tgtggtgtcgtctgtga

SEQ ID NO: 3159503 - DNA, 21 bp, Homo sapiens
tgtggtgtgtttgcttggaaa

SEQ ID NO: 3159504 - DNA, 17 bp, Homo sapiens
tgtggttcctctgctca

SEQ ID NO: 3159505 - DNA, 15 bp, Homo sapiens
tgtggttctatttta

SEQ ID NO: 3159506 - DNA, 22 bp, Homo sapiens
tgtggtttgcattgtctccttc

SEQ ID NO: 3159507 - DNA, 21 bp, Homo sapiens
tgtggtttggttcctctctgg

SEQ ID NO: 3159508 - DNA, 17 bp, Homo sapiens
tgtgtaaaaaatggaaa

SEQ ID NO: 3159509 - DNA, 14 bp, Homo sapiens
tgtgtaaaatgtga

SEQ ID NO: 3159510 - DNA, 21 bp, Homo sapiens
tgtgtaaacacagtcaaaata

SEQ ID NO: 3159511 - DNA, 18 bp, Homo sapiens
tgtgtaaatatgtacatt

SEQ ID NO: 3159512 - DNA, 14 bp, Homo sapiens
tgtgtaaatttctc

SEQ ID NO: 3159513 - DNA, 13 bp, Homo sapiens
tgtgtaacactgt

SEQ ID NO: 3159514 - DNA, 19 bp, Homo sapiens
tgtgtaacctcttcacctt

SEQ ID NO: 3159515 - DNA, 22 bp, Homo sapiens
tgtgtaagaaaacaaactaaat

SEQ ID NO: 3159516 - DNA, 19 bp, Homo sapiens
tgtgtaataaagtgttttc

SEQ ID NO: 3159517 - DNA, 22 bp, Homo sapiens
tgtgtaataaagtgttttcaga

SEQ ID NO: 3159518 - DNA, 13 bp, Homo sapiens
tgtgtaatgaaaa

SEQ ID NO: 3159519 - DNA, 17 bp, Homo sapiens
tgtgtacacctctggat

SEQ ID NO: 3159520 - DNA, 19 bp, Homo sapiens
tgtgtacagtgtgtaaagt

SEQ ID NO: 3159521 - DNA, 15 bp, Homo sapiens
tgtgtacccaaacgt

SEQ ID NO: 3159522 - DNA, 14 bp, Homo sapiens
tgtgtactgtgtca

SEQ ID NO: 3159523 - DNA, 13 bp, Homo sapiens
tgtgtagagttaa

SEQ ID NO: 3159524 - DNA, 18 bp, Homo sapiens
tgtgtagagttaagaagc

SEQ ID NO: 3159525 - DNA, 21 bp, Homo sapiens
tgtgtagagttaagaagctgt

SEQ ID NO: 3159526 - DNA, 15 bp, Homo sapiens
tgtgtagcctgtgca

SEQ ID NO: 3159527 - DNA, 16 bp, Homo sapiens
tgtgtagcctgtgcat

SEQ ID NO: 3159528 - DNA, 18 bp, Homo sapiens
tgtgtagctgcaaaaata

SEQ ID NO: 3159529 - DNA, 12 bp, Homo sapiens
tgtgtagggcgg

SEQ ID NO: 3159530 - DNA, 15 bp, Homo sapiens
tgtgtatacatgcca

SEQ ID NO: 3159531 - DNA, 15 bp, Homo sapiens
tgtgtatatatacat

SEQ ID NO: 3159532 - DNA, 23 bp, Homo sapiens
tgtgtatatatgtgtatatatac

SEQ ID NO: 3159533 - DNA, 19 bp, Homo sapiens
tgtgtatatattttgtgtg

SEQ ID NO: 3159534 - DNA, 19 bp, Homo sapiens
tgtgtatatctcttggaaa

SEQ ID NO: 3159535 - DNA, 16 bp, Homo sapiens
tgtgtatattatttgg

SEQ ID NO: 3159536 - DNA, 21 bp, Homo sapiens
tgtgtatattgagaatccctt

SEQ ID NO: 3159537 - DNA, 18 bp, Homo sapiens
tgtgtatattttaatgaa

SEQ ID NO: 3159538 - DNA, 13 bp, Homo sapiens
tgtgtatccgact

SEQ ID NO: 3159539 - DNA, 15 bp, Homo sapiens
tgtgtatgtacatat

SEQ ID NO: 3159540 - DNA, 20 bp, Homo sapiens
tgtgtatgtacttagctgta

SEQ ID NO: 3159541 - DNA, 12 bp, Homo sapiens
tgtgtattgttc

SEQ ID NO: 3159542 - DNA, 13 bp, Homo sapiens
tgtgtattgttcc

SEQ ID NO: 3159543 - DNA, 15 bp, Homo sapiens
tgtgtattgttccca

SEQ ID NO: 3159544 - DNA, 17 bp, Homo sapiens
tgtgtatttaattgtaa

SEQ ID NO: 3159545 - DNA, 23 bp, Homo sapiens
tgtgtatttaattgtaaactgta

SEQ ID NO: 3159546 - DNA, 15 bp, Homo sapiens
tgtgtatttgtatta

SEQ ID NO: 3159547 - DNA, 16 bp, Homo sapiens
tgtgtatttgtattaa

SEQ ID NO: 3159548 - DNA, 19 bp, Homo sapiens
tgtgtatttgtattaataa

SEQ ID NO: 3159549 - DNA, 15 bp, Homo sapiens
tgtgtattttcagtc

SEQ ID NO: 3159550 - DNA, 17 bp, Homo sapiens
tgtgtcaaccactaaag

SEQ ID NO: 3159551 - DNA, 23 bp, Homo sapiens
tgtgtcaaccactaaagtataga

SEQ ID NO: 3159552 - DNA, 16 bp, Homo sapiens
tgtgtcaatgggcaat

SEQ ID NO: 3159553 - DNA, 14 bp, Homo sapiens
tgtgtcaatgtaaa

SEQ ID NO: 3159554 - DNA, 19 bp, Homo sapiens
tgtgtcaatgtaaagccaa

SEQ ID NO: 3159555 - DNA, 14 bp, Homo sapiens
tgtgtcacttgtgc

SEQ ID NO: 3159556 - DNA, 17 bp, Homo sapiens
tgtgtcacttgtgcttt

SEQ ID NO: 3159557 - DNA, 16 bp, Homo sapiens
tgtgtccaaaactgcc

SEQ ID NO: 3159558 - DNA, 16 bp, Homo sapiens
tgtgtccagcagctgc

SEQ ID NO: 3159559 - DNA, 17 bp, Homo sapiens
tgtgtccctcttctctt

SEQ ID NO: 3159560 - DNA, 18 bp, Homo sapiens
tgtgtccctggacacagc

SEQ ID NO: 3159561 - DNA, 20 bp, Homo sapiens
tgtgtccctggacacagctc

SEQ ID NO: 3159562 - DNA, 21 bp, Homo sapiens
tgtgtccctggacacagctct

SEQ ID NO: 3159563 - DNA, 14 bp, Homo sapiens
tgtgtccttccctg

SEQ ID NO: 3159564 - DNA, 17 bp, Homo sapiens
tgtgtctaagattctag

SEQ ID NO: 3159565 - DNA, 12 bp, Homo sapiens
tgtgtctgactc

SEQ ID NO: 3159566 - DNA, 21 bp, Homo sapiens
tgtgtctgtacacgtgtcctg

SEQ ID NO: 3159567 - DNA, 21 bp, Homo sapiens
tgtgtcttgcaatggcagcct

SEQ ID NO: 3159568 - DNA, 19 bp, Homo sapiens
tgtgtgaaaaaagaaaatg

SEQ ID NO: 3159569 - DNA, 14 bp, Homo sapiens
tgtgtgacaattct

SEQ ID NO: 3159570 - DNA, 15 bp, Homo sapiens
tgtgtgacaattctg

SEQ ID NO: 3159571 - DNA, 12 bp, Homo sapiens
tgtgtgaccaac

SEQ ID NO: 3159572 - DNA, 20 bp, Homo sapiens
tgtgtgaggagctgctggct

SEQ ID NO: 3159573 - DNA, 16 bp, Homo sapiens
tgtgtgatgaactttc

SEQ ID NO: 3159574 - DNA, 17 bp, Homo sapiens
tgtgtgatgaactttct

SEQ ID NO: 3159575 - DNA, 15 bp, Homo sapiens
tgtgtgatgcgcctt

SEQ ID NO: 3159576 - DNA, 13 bp, Homo sapiens
tgtgtgatttcct

SEQ ID NO: 3159577 - DNA, 19 bp, Homo sapiens
tgtgtgatttcctaaacat

SEQ ID NO: 3159578 - DNA, 22 bp, Homo sapiens
tgtgtgcaccttaccaactttc

SEQ ID NO: 3159579 - DNA, 23 bp, Homo sapiens
tgtgtgcaccttaccaactttct

SEQ ID NO: 3159580 - DNA, 14 bp, Homo sapiens
tgtgtgcatgtgtg

SEQ ID NO: 3159581 - DNA, 19 bp, Homo sapiens
tgtgtgcatgtgtgtataa

SEQ ID NO: 3159582 - DNA, 14 bp, Homo sapiens
tgtgtgcttacagt

SEQ ID NO: 3159583 - DNA, 16 bp, Homo sapiens
tgtgtggaaatgggac

SEQ ID NO: 3159584 - DNA, 16 bp, Homo sapiens
tgtgtggactgtgatg

SEQ ID NO: 3159585 - DNA, 12 bp, Homo sapiens
tgtgtggcaggg

SEQ ID NO: 3159586 - DNA, 11 bp, Homo sapiens
tgtgtggcctg

SEQ ID NO: 3159587 - DNA, 14 bp, Homo sapiens
tgtgtgggactgta

SEQ ID NO: 3159588 - DNA, 21 bp, Homo sapiens
tgtgtgggtaaatgcttttaa

SEQ ID NO: 3159589 - DNA, 14 bp, Homo sapiens
tgtgtggtggcctc

SEQ ID NO: 3159590 - DNA, 22 bp, Homo sapiens
tgtgtggtgtcgtctgtgaatg

SEQ ID NO: 3159591 - DNA, 21 bp, Homo sapiens
tgtgtgtactcactgaagcct

SEQ ID NO: 3159592 - DNA, 19 bp, Homo sapiens
tgtgtgtatgtttgcacac

SEQ ID NO: 3159593 - DNA, 14 bp, Homo sapiens
tgtgtgtatttgta

SEQ ID NO: 3159594 - DNA, 15 bp, Homo sapiens
tgtgtgtatttgtat

SEQ ID NO: 3159595 - DNA, 16 bp, Homo sapiens
tgtgtgtatttgtatt

SEQ ID NO: 3159596 - DNA, 20 bp, Homo sapiens
tgtgtgtatttgtattaata

SEQ ID NO: 3159597 - DNA, 9 bp, Homo sapiens
tgtgtgtgt

SEQ ID NO: 3159598 - DNA, 12 bp, Homo sapiens
tgtgtgtgtact

SEQ ID NO: 3159599 - DNA, 14 bp, Homo sapiens
tgtgtgtgtatgtt

SEQ ID NO: 3159600 - DNA, 13 bp, Homo sapiens
tgtgtgtgtgtac

SEQ ID NO: 3159601 - DNA, 13 bp, Homo sapiens
tgtgtgtgtgtgt

SEQ ID NO: 3159602 - DNA, 14 bp, Homo sapiens
tgtgtgtgtgtgtg

SEQ ID NO: 3159603 - DNA, 16 bp, Homo sapiens
tgtgtgttcttcaagc

SEQ ID NO: 3159604 - DNA, 22 bp, Homo sapiens
tgtgtgttgatcccaagacaat

SEQ ID NO: 3159605 - DNA, 21 bp, Homo sapiens
tgtgtgttgtcagcctgtgct

SEQ ID NO: 3159606 - DNA, 14 bp, Homo sapiens
tgtgtgttgtctga

SEQ ID NO: 3159607 - DNA, 17 bp, Homo sapiens
tgtgttaaacatgctaa

SEQ ID NO: 3159608 - DNA, 23 bp, Homo sapiens
tgtgttactaaaaaaaagatgaa

SEQ ID NO: 3159609 - DNA, 14 bp, Homo sapiens
tgtgttattcgtga

SEQ ID NO: 3159610 - DNA, 14 bp, Homo sapiens
tgtgttcattcaag

SEQ ID NO: 3159611 - DNA, 17 bp, Homo sapiens
tgtgttccaagtttcca

SEQ ID NO: 3159612 - DNA, 19 bp, Homo sapiens
tgtgttccaagtttccaaa

SEQ ID NO: 3159613 - DNA, 17 bp, Homo sapiens
tgtgttcccatttcagc

SEQ ID NO: 3159614 - DNA, 13 bp, Homo sapiens
tgtgttcctcctg

SEQ ID NO: 3159615 - DNA, 14 bp, Homo sapiens
tgtgttcctcctgc

SEQ ID NO: 3159616 - DNA, 11 bp, Homo sapiens
tgtgttcctgg

SEQ ID NO: 3159617 - DNA, 17 bp, Homo sapiens
tgtgttctgattagaaa

SEQ ID NO: 3159618 - DNA, 18 bp, Homo sapiens
tgtgttctgtttgttaaa

SEQ ID NO: 3159619 - DNA, 18 bp, Homo sapiens
tgtgttcttcaagccagc

SEQ ID NO: 3159620 - DNA, 13 bp, Homo sapiens
tgtgttgaaactg

SEQ ID NO: 3159621 - DNA, 16 bp, Homo sapiens
tgtgttgccaagctcc

SEQ ID NO: 3159622 - DNA, 15 bp, Homo sapiens
tgtgttgctaaaaaa

SEQ ID NO: 3159623 - DNA, 19 bp, Homo sapiens
tgtgttggacagagaaggg

SEQ ID NO: 3159624 - DNA, 13 bp, Homo sapiens
tgtgttgtctcta

SEQ ID NO: 3159625 - DNA, 19 bp, Homo sapiens
tgtgttgtctcttgagttt

SEQ ID NO: 3159626 - DNA, 14 bp, Homo sapiens
tgtgttgtcttgaa

SEQ ID NO: 3159627 - DNA, 13 bp, Homo sapiens
tgtgttgtttaat

SEQ ID NO: 3159628 - DNA, 13 bp, Homo sapiens
tgtgtttacagac

SEQ ID NO: 3159629 - DNA, 14 bp, Homo sapiens
tgtgtttacagaca

SEQ ID NO: 3159630 - DNA, 15 bp, Homo sapiens
tgtgtttacagacag

SEQ ID NO: 3159631 - DNA, 15 bp, Homo sapiens
tgtgtttcaagttca

SEQ ID NO: 3159632 - DNA, 14 bp, Homo sapiens
tgtgtttctttata

SEQ ID NO: 3159633 - DNA, 15 bp, Homo sapiens
tgtgtttgtgtattt

SEQ ID NO: 3159634 - DNA, 23 bp, Homo sapiens
tgtgtttgtttttcaagaaatga

SEQ ID NO: 3159635 - DNA, 18 bp, Homo sapiens
tgtgttttcttgtaaatg

SEQ ID NO: 3159636 - DNA, 19 bp, Homo sapiens
tgtgtttttattgttaact

SEQ ID NO: 3159637 - DNA, 14 bp, Homo sapiens
tgtgtttttctcca

SEQ ID NO: 3159638 - DNA, 15 bp, Homo sapiens
tgtgttttttaagat

SEQ ID NO: 3159639 - DNA, 18 bp, Homo sapiens
tgttaaaaaatttttgaa

SEQ ID NO: 3159640 - DNA, 16 bp, Homo sapiens
tgttaaaaataaatcc

SEQ ID NO: 3159641 - DNA, 19 bp, Homo sapiens
tgttaaaactggcatctga

SEQ ID NO: 3159642 - DNA, 20 bp, Homo sapiens
tgttaaaagttttatatgct

SEQ ID NO: 3159643 - DNA, 14 bp, Homo sapiens
tgttaaaatctatt

SEQ ID NO: 3159644 - DNA, 23 bp, Homo sapiens
tgttaaaattatcaatatctaat

SEQ ID NO: 3159645 - DNA, 13 bp, Homo sapiens
tgttaaactgtta

SEQ ID NO: 3159646 - DNA, 14 bp, Homo sapiens
tgttaaactgttag

SEQ ID NO: 3159647 - DNA, 16 bp, Homo sapiens
tgttaaagagaatgag

SEQ ID NO: 3159648 - DNA, 12 bp, Homo sapiens
tgttaaatactg

SEQ ID NO: 3159649 - DNA, 15 bp, Homo sapiens
tgttaaatactgtgc

SEQ ID NO: 3159650 - DNA, 20 bp, Homo sapiens
tgttaaatactgtgcagaat

SEQ ID NO: 3159651 - DNA, 19 bp, Homo sapiens
tgttaaatttgtaagtttc

SEQ ID NO: 3159652 - DNA, 21 bp, Homo sapiens
tgttaaatttgtaagtttcag

SEQ ID NO: 3159653 - DNA, 21 bp, Homo sapiens
tgttaacatggacatgatctt

SEQ ID NO: 3159654 - DNA, 15 bp, Homo sapiens
tgttaacattccaag

SEQ ID NO: 3159655 - DNA, 20 bp, Homo sapiens
tgttaacattccaagactct

SEQ ID NO: 3159656 - DNA, 16 bp, Homo sapiens
tgttaaccagaataaa

SEQ ID NO: 3159657 - DNA, 15 bp, Homo sapiens
tgttaaccatttaag

SEQ ID NO: 3159658 - DNA, 19 bp, Homo sapiens
tgttaacctcagtgtcatt

SEQ ID NO: 3159659 - DNA, 19 bp, Homo sapiens
tgttaacctctgcttttat

SEQ ID NO: 3159660 - DNA, 14 bp, Homo sapiens
tgttaactatgaca

SEQ ID NO: 3159661 - DNA, 16 bp, Homo sapiens
tgttaactatgacaga

SEQ ID NO: 3159662 - DNA, 12 bp, Homo sapiens
tgttaagataac

SEQ ID NO: 3159663 - DNA, 15 bp, Homo sapiens
tgttaagcatttatt

SEQ ID NO: 3159664 - DNA, 14 bp, Homo sapiens
tgttaaggaaactc

SEQ ID NO: 3159665 - DNA, 13 bp, Homo sapiens
tgttaatacacag

SEQ ID NO: 3159666 - DNA, 15 bp, Homo sapiens
tgttaatacacagta

SEQ ID NO: 3159667 - DNA, 18 bp, Homo sapiens
tgttaatacacagtactt

SEQ ID NO: 3159668 - DNA, 23 bp, Homo sapiens
tgttaatctctgttatgtactgt

SEQ ID NO: 3159669 - DNA, 20 bp, Homo sapiens
tgttaatggtgcaaatccta

SEQ ID NO: 3159670 - DNA, 14 bp, Homo sapiens
tgttaatgtatact

SEQ ID NO: 3159671 - DNA, 22 bp, Homo sapiens
tgttaatgtatttgttcatgtt

SEQ ID NO: 3159672 - DNA, 14 bp, Homo sapiens
tgttaatgtgatgg

SEQ ID NO: 3159673 - DNA, 16 bp, Homo sapiens
tgttaattcctatgaa

SEQ ID NO: 3159674 - DNA, 15 bp, Homo sapiens
tgttaatttatttag

SEQ ID NO: 3159675 - DNA, 15 bp, Homo sapiens
tgttaattttcctca

SEQ ID NO: 3159676 - DNA, 15 bp, Homo sapiens
tgttacattattatc

SEQ ID NO: 3159677 - DNA, 19 bp, Homo sapiens
tgttaccaaaaataaatat

SEQ ID NO: 3159678 - DNA, 18 bp, Homo sapiens
tgttaccatgtcactgtg

SEQ ID NO: 3159679 - DNA, 18 bp, Homo sapiens
tgttaccctcctgtaaat

SEQ ID NO: 3159680 - DNA, 15 bp, Homo sapiens
tgttaccgcctgtct

SEQ ID NO: 3159681 - DNA, 18 bp, Homo sapiens
tgttacctaaagtatttt

SEQ ID NO: 3159682 - DNA, 16 bp, Homo sapiens
tgttacgtagcctaag

SEQ ID NO: 3159683 - DNA, 17 bp, Homo sapiens
tgttactaaattacgta

SEQ ID NO: 3159684 - DNA, 12 bp, Homo sapiens
tgttactagcct

SEQ ID NO: 3159685 - DNA, 15 bp, Homo sapiens
tgttactattttcta

SEQ ID NO: 3159686 - DNA, 15 bp, Homo sapiens
tgttactctggttct

SEQ ID NO: 3159687 - DNA, 15 bp, Homo sapiens
tgttactgaccagca

SEQ ID NO: 3159688 - DNA, 20 bp, Homo sapiens
tgttactgatcatgcattgt

SEQ ID NO: 3159689 - DNA, 17 bp, Homo sapiens
tgttactgttaaccatt

SEQ ID NO: 3159690 - DNA, 11 bp, Homo sapiens
tgttactgttc

SEQ ID NO: 3159691 - DNA, 13 bp, Homo sapiens
tgttactgttctt

SEQ ID NO: 3159692 - DNA, 15 bp, Homo sapiens
tgttactgttcttgc

SEQ ID NO: 3159693 - DNA, 23 bp, Homo sapiens
tgttactgttcttgctgctagaa

SEQ ID NO: 3159694 - DNA, 17 bp, Homo sapiens
tgttactgttgcactga

SEQ ID NO: 3159695 - DNA, 12 bp, Homo sapiens
tgttacttacct

SEQ ID NO: 3159696 - DNA, 19 bp, Homo sapiens
tgttactttggcaatttcc

SEQ ID NO: 3159697 - DNA, 18 bp, Homo sapiens
tgttagaaaatgacttat

SEQ ID NO: 3159698 - DNA, 20 bp, Homo sapiens
tgttagaacactattttcag

SEQ ID NO: 3159699 - DNA, 23 bp, Homo sapiens
tgttagaacactattttcagaat

SEQ ID NO: 3159700 - DNA, 16 bp, Homo sapiens
tgttagagagaaagag

SEQ ID NO: 3159701 - DNA, 20 bp, Homo sapiens
tgttagaggttttaaagtga

SEQ ID NO: 3159702 - DNA, 19 bp, Homo sapiens
tgttagatagctgcatgtg

SEQ ID NO: 3159703 - DNA, 16 bp, Homo sapiens
tgttagatattgctac

SEQ ID NO: 3159704 - DNA, 12 bp, Homo sapiens
tgttagatgctg

SEQ ID NO: 3159705 - DNA, 17 bp, Homo sapiens
tgttagcactgttgatg

SEQ ID NO: 3159706 - DNA, 17 bp, Homo sapiens
tgttagccccataattt

SEQ ID NO: 3159707 - DNA, 20 bp, Homo sapiens
tgttaggcatgtcccaccca

SEQ ID NO: 3159708 - DNA, 18 bp, Homo sapiens
tgttagtaatggcagagc

SEQ ID NO: 3159709 - DNA, 20 bp, Homo sapiens
tgttagtagaaattttacaa

SEQ ID NO: 3159710 - DNA, 15 bp, Homo sapiens
tgttagtattttaat

SEQ ID NO: 3159711 - DNA, 20 bp, Homo sapiens
tgttagtattttaatcctgt

SEQ ID NO: 3159712 - DNA, 20 bp, Homo sapiens
tgttagttaccttatagtta

SEQ ID NO: 3159713 - DNA, 16 bp, Homo sapiens
tgttagtttagtgtgt

SEQ ID NO: 3159714 - DNA, 15 bp, Homo sapiens
tgttataactctgca

SEQ ID NO: 3159715 - DNA, 18 bp, Homo sapiens
tgttataactctgcacta

SEQ ID NO: 3159716 - DNA, 14 bp, Homo sapiens
tgttatacttcaaa

SEQ ID NO: 3159717 - DNA, 18 bp, Homo sapiens
tgttatatttaatgcatt

SEQ ID NO: 3159718 - DNA, 19 bp, Homo sapiens
tgttatatttaatgcatta

SEQ ID NO: 3159719 - DNA, 20 bp, Homo sapiens
tgttatcaaaactttctttt

SEQ ID NO: 3159720 - DNA, 17 bp, Homo sapiens
tgttatcaccttccaaa

SEQ ID NO: 3159721 - DNA, 15 bp, Homo sapiens
tgttatcttctcaag

SEQ ID NO: 3159722 - DNA, 22 bp, Homo sapiens
tgttatcttctcaagttctaag

SEQ ID NO: 3159723 - DNA, 15 bp, Homo sapiens
tgttatgatattgtt

SEQ ID NO: 3159724 - DNA, 18 bp, Homo sapiens
tgttatgatattgtttaa

SEQ ID NO: 3159725 - DNA, 18 bp, Homo sapiens
tgttatgatttgtaacat

SEQ ID NO: 3159726 - DNA, 12 bp, Homo sapiens
tgttatgtaaaa

SEQ ID NO: 3159727 - DNA, 14 bp, Homo sapiens
tgttatgtaaaact

SEQ ID NO: 3159728 - DNA, 20 bp, Homo sapiens
tgttatgtactagtgttctg

SEQ ID NO: 3159729 - DNA, 14 bp, Homo sapiens
tgttatgtactgta

SEQ ID NO: 3159730 - DNA, 16 bp, Homo sapiens
tgttatgtactgtact

SEQ ID NO: 3159731 - DNA, 19 bp, Homo sapiens
tgttattattttgcactgt

SEQ ID NO: 3159732 - DNA, 13 bp, Homo sapiens
tgttattccatca

SEQ ID NO: 3159733 - DNA, 20 bp, Homo sapiens
tgttattccatcaataaatg

SEQ ID NO: 3159734 - DNA, 22 bp, Homo sapiens
tgttattccatcaataaatgct

SEQ ID NO: 3159735 - DNA, 13 bp, Homo sapiens
tgttattcctagt

SEQ ID NO: 3159736 - DNA, 24 bp, Homo sapiens
tgttattcctagtggatgactgtt

SEQ ID NO: 3159737 - DNA, 17 bp, Homo sapiens
tgttattcgtgaatagt

SEQ ID NO: 3159738 - DNA, 21 bp, Homo sapiens
tgttattgggcaagtgattga

SEQ ID NO: 3159739 - DNA, 22 bp, Homo sapiens
tgttattgggcaagtgattgaa

SEQ ID NO: 3159740 - DNA, 15 bp, Homo sapiens
tgttattgtgaatga

SEQ ID NO: 3159741 - DNA, 16 bp, Homo sapiens
tgttattgtgaatgat

SEQ ID NO: 3159742 - DNA, 14 bp, Homo sapiens
tgttattgtggaag

SEQ ID NO: 3159743 - DNA, 15 bp, Homo sapiens
tgttattgtggaaga

SEQ ID NO: 3159744 - DNA, 17 bp, Homo sapiens
tgttatttagactcatc

SEQ ID NO: 3159745 - DNA, 18 bp, Homo sapiens
tgttattttctgttgaag

SEQ ID NO: 3159746 - DNA, 17 bp, Homo sapiens
tgttatttttcaaggaa

SEQ ID NO: 3159747 - DNA, 21 bp, Homo sapiens
tgttatttttgtttcttccaa

SEQ ID NO: 3159748 - DNA, 19 bp, Homo sapiens
tgttcaaaaaaacactagt

SEQ ID NO: 3159749 - DNA, 13 bp, Homo sapiens
tgttcaaaatact

SEQ ID NO: 3159750 - DNA, 14 bp, Homo sapiens
tgttcaaaatacta

SEQ ID NO: 3159751 - DNA, 13 bp, Homo sapiens
tgttcaaacaata

SEQ ID NO: 3159752 - DNA, 18 bp, Homo sapiens
tgttcaaagccacattat

SEQ ID NO: 3159753 - DNA, 15 bp, Homo sapiens
tgttcaactatttta

SEQ ID NO: 3159754 - DNA, 14 bp, Homo sapiens
tgttcaatctgtgt

SEQ ID NO: 3159755 - DNA, 18 bp, Homo sapiens
tgttcaatctgtgtaaga

SEQ ID NO: 3159756 - DNA, 19 bp, Homo sapiens
tgttcacaaactacctctg

SEQ ID NO: 3159757 - DNA, 19 bp, Homo sapiens
tgttcacggcagaccagaa

SEQ ID NO: 3159758 - DNA, 16 bp, Homo sapiens
tgttcacttttcctcc

SEQ ID NO: 3159759 - DNA, 22 bp, Homo sapiens
tgttcagaaggttgctctagat

SEQ ID NO: 3159760 - DNA, 14 bp, Homo sapiens
tgttcagcactgtc

SEQ ID NO: 3159761 - DNA, 18 bp, Homo sapiens
tgttcagcactgtccctt

SEQ ID NO: 3159762 - DNA, 14 bp, Homo sapiens
tgttcagctccagc

SEQ ID NO: 3159763 - DNA, 21 bp, Homo sapiens
tgttcagctccagctcaccag

SEQ ID NO: 3159764 - DNA, 19 bp, Homo sapiens
tgttcatagcccagtagac

SEQ ID NO: 3159765 - DNA, 23 bp, Homo sapiens
tgttcatagcccagtagaccttg

SEQ ID NO: 3159766 - DNA, 22 bp, Homo sapiens
tgttcatatagtcaatgtaaaa

SEQ ID NO: 3159767 - DNA, 22 bp, Homo sapiens
tgttcatcctcattgcctcctg

SEQ ID NO: 3159768 - DNA, 14 bp, Homo sapiens
tgttcatgctgaat

SEQ ID NO: 3159769 - DNA, 16 bp, Homo sapiens
tgttcatgctgaatcc

SEQ ID NO: 3159770 - DNA, 15 bp, Homo sapiens
tgttcatgtgcctct

SEQ ID NO: 3159771 - DNA, 17 bp, Homo sapiens
tgttcatgtgcctctgc

SEQ ID NO: 3159772 - DNA, 21 bp, Homo sapiens
tgttcattgtaatgttactga

SEQ ID NO: 3159773 - DNA, 23 bp, Homo sapiens
tgttcattgtaatgttactgatc

SEQ ID NO: 3159774 - DNA, 22 bp, Homo sapiens
tgttcatttagataatttgaaa

SEQ ID NO: 3159775 - DNA, 17 bp, Homo sapiens
tgttcatttcacacagt

SEQ ID NO: 3159776 - DNA, 22 bp, Homo sapiens
tgttcatttgaaagaggagtat

SEQ ID NO: 3159777 - DNA, 23 bp, Homo sapiens
tgttcatttggtgttcctggaag

SEQ ID NO: 3159778 - DNA, 18 bp, Homo sapiens
tgttccaaagccagtgaa

SEQ ID NO: 3159779 - DNA, 22 bp, Homo sapiens
tgttccaaattcagtttcataa

SEQ ID NO: 3159780 - DNA, 11 bp, Homo sapiens
tgttccaagac

SEQ ID NO: 3159781 - DNA, 15 bp, Homo sapiens
tgttccaagacattg

SEQ ID NO: 3159782 - DNA, 21 bp, Homo sapiens
tgttccaagacattgtcaata

SEQ ID NO: 3159783 - DNA, 23 bp, Homo sapiens
tgttccactgcaaataaagcctt

SEQ ID NO: 3159784 - DNA, 14 bp, Homo sapiens
tgttccattgcctc

SEQ ID NO: 3159785 - DNA, 16 bp, Homo sapiens
tgttccattttatgca

SEQ ID NO: 3159786 - DNA, 23 bp, Homo sapiens
tgttcccaaggacttccacattt

SEQ ID NO: 3159787 - DNA, 17 bp, Homo sapiens
tgttcccagaggcaggc

SEQ ID NO: 3159788 - DNA, 17 bp, Homo sapiens
tgttcccaggctgcccc

SEQ ID NO: 3159789 - DNA, 16 bp, Homo sapiens
tgttcccattcttgca

SEQ ID NO: 3159790 - DNA, 22 bp, Homo sapiens
tgttccccactgacagcctccc

SEQ ID NO: 3159791 - DNA, 18 bp, Homo sapiens
tgttccccatggccactt

SEQ ID NO: 3159792 - DNA, 16 bp, Homo sapiens
tgttcccccgccgctt

SEQ ID NO: 3159793 - DNA, 18 bp, Homo sapiens
tgttcccctaagtggatt

SEQ ID NO: 3159794 - DNA, 14 bp, Homo sapiens
tgttcccctcactg

SEQ ID NO: 3159795 - DNA, 21 bp, Homo sapiens
tgttcccctgtcctgtgaatg

SEQ ID NO: 3159796 - DNA, 13 bp, Homo sapiens
tgttccctacccc

SEQ ID NO: 3159797 - DNA, 16 bp, Homo sapiens
tgttccctctgctcct

SEQ ID NO: 3159798 - DNA, 18 bp, Homo sapiens
tgttccctctgctcctgg

SEQ ID NO: 3159799 - DNA, 18 bp, Homo sapiens
tgttccctctggcttccc

SEQ ID NO: 3159800 - DNA, 13 bp, Homo sapiens
tgttccctgcacc

SEQ ID NO: 3159801 - DNA, 14 bp, Homo sapiens
tgttccctgcaccc

SEQ ID NO: 3159802 - DNA, 15 bp, Homo sapiens
tgttccctgcaccct

SEQ ID NO: 3159803 - DNA, 20 bp, Homo sapiens
tgttccctgcaccctggaaa

SEQ ID NO: 3159804 - DNA, 19 bp, Homo sapiens
tgttcctacagcccctttt

SEQ ID NO: 3159805 - DNA, 13 bp, Homo sapiens
tgttcctggaagc

SEQ ID NO: 3159806 - DNA, 15 bp, Homo sapiens
tgttcctggcagttt

SEQ ID NO: 3159807 - DNA, 19 bp, Homo sapiens
tgttccttagaccttccat

SEQ ID NO: 3159808 - DNA, 18 bp, Homo sapiens
tgttccttgtactcttag

SEQ ID NO: 3159809 - DNA, 20 bp, Homo sapiens
tgttcctttttaaatgtgaa

SEQ ID NO: 3159810 - DNA, 21 bp, Homo sapiens
tgttcctttttaaatgtgaat

SEQ ID NO: 3159811 - DNA, 14 bp, Homo sapiens
tgttcgcttggctc

SEQ ID NO: 3159812 - DNA, 14 bp, Homo sapiens
tgttctaaagctct

SEQ ID NO: 3159813 - DNA, 19 bp, Homo sapiens
tgttctaaagctctgacat

SEQ ID NO: 3159814 - DNA, 13 bp, Homo sapiens
tgttctaagatgt

SEQ ID NO: 3159815 - DNA, 14 bp, Homo sapiens
tgttctaagatgtg

SEQ ID NO: 3159816 - DNA, 22 bp, Homo sapiens
tgttctaagatgtgatattcta

SEQ ID NO: 3159817 - DNA, 18 bp, Homo sapiens
tgttctaaggctctgaga

SEQ ID NO: 3159818 - DNA, 14 bp, Homo sapiens
tgttctaagtttct

SEQ ID NO: 3159819 - DNA, 16 bp, Homo sapiens
tgttctaagtttctaa

SEQ ID NO: 3159820 - DNA, 23 bp, Homo sapiens
tgttctaagtttctaagattcta

SEQ ID NO: 3159821 - DNA, 19 bp, Homo sapiens
tgttctatccaaacatgta

SEQ ID NO: 3159822 - DNA, 22 bp, Homo sapiens
tgttctattaatcacctctctg

SEQ ID NO: 3159823 - DNA, 18 bp, Homo sapiens
tgttctcagctccccctg

SEQ ID NO: 3159824 - DNA, 20 bp, Homo sapiens
tgttctcagctccccctgtc

SEQ ID NO: 3159825 - DNA, 20 bp, Homo sapiens
tgttctccgggtgtggcctc

SEQ ID NO: 3159826 - DNA, 23 bp, Homo sapiens
tgttctcttgggaactgaactca

SEQ ID NO: 3159827 - DNA, 19 bp, Homo sapiens
tgttctgacattaacagtt

SEQ ID NO: 3159828 - DNA, 19 bp, Homo sapiens
tgttctgagaactgacttt

SEQ ID NO: 3159829 - DNA, 19 bp, Homo sapiens
tgttctgattagaaatgac

SEQ ID NO: 3159830 - DNA, 13 bp, Homo sapiens
tgttctgcactga

SEQ ID NO: 3159831 - DNA, 16 bp, Homo sapiens
tgttctgcactgaaaa

SEQ ID NO: 3159832 - DNA, 17 bp, Homo sapiens
tgttctgcactgaaaag

SEQ ID NO: 3159833 - DNA, 20 bp, Homo sapiens
tgttctgcatggattcagca

SEQ ID NO: 3159834 - DNA, 23 bp, Homo sapiens
tgttctgcccacgatcccctccc

SEQ ID NO: 3159835 - DNA, 12 bp, Homo sapiens
tgttctgggaca

SEQ ID NO: 3159836 - DNA, 13 bp, Homo sapiens
tgttctgggacac

SEQ ID NO: 3159837 - DNA, 12 bp, Homo sapiens
tgttctgggctc

SEQ ID NO: 3159838 - DNA, 23 bp, Homo sapiens
tgttctgtgatgaggggaggggg

SEQ ID NO: 3159839 - DNA, 19 bp, Homo sapiens
tgttctgtggttcctctgc

SEQ ID NO: 3159840 - DNA, 13 bp, Homo sapiens
tgttctgttctgg

SEQ ID NO: 3159841 - DNA, 22 bp, Homo sapiens
tgttctgtttggcacttgtatt

SEQ ID NO: 3159842 - DNA, 14 bp, Homo sapiens
tgttctgtttgtta

SEQ ID NO: 3159843 - DNA, 17 bp, Homo sapiens
tgttctgtttgttaaaa

SEQ ID NO: 3159844 - DNA, 20 bp, Homo sapiens
tgttctgtttgttaaaactg

SEQ ID NO: 3159845 - DNA, 16 bp, Homo sapiens
tgttcttaattgcact

SEQ ID NO: 3159846 - DNA, 15 bp, Homo sapiens
tgttcttagagtgta

SEQ ID NO: 3159847 - DNA, 18 bp, Homo sapiens
tgttcttagtttgcagtt

SEQ ID NO: 3159848 - DNA, 19 bp, Homo sapiens
tgttcttcatctgctatta

SEQ ID NO: 3159849 - DNA, 13 bp, Homo sapiens
tgttcttcctcca

SEQ ID NO: 3159850 - DNA, 14 bp, Homo sapiens
tgttcttcttctct

SEQ ID NO: 3159851 - DNA, 21 bp, Homo sapiens
tgttcttgcataggctcttaa

SEQ ID NO: 3159852 - DNA, 16 bp, Homo sapiens
tgttcttgctgctaga

SEQ ID NO: 3159853 - DNA, 18 bp, Homo sapiens
tgttcttgctgctagaac

SEQ ID NO: 3159854 - DNA, 21 bp, Homo sapiens
tgttcttgctgctagaacttt

SEQ ID NO: 3159855 - DNA, 15 bp, Homo sapiens
tgttctttaggagat

SEQ ID NO: 3159856 - DNA, 18 bp, Homo sapiens
tgttctttggaaagtaca

SEQ ID NO: 3159857 - DNA, 22 bp, Homo sapiens
tgttctttggaaagtacactct

SEQ ID NO: 3159858 - DNA, 12 bp, Homo sapiens
tgttgaaaaaat

SEQ ID NO: 3159859 - DNA, 21 bp, Homo sapiens
tgttgaaaattattttaaaca

SEQ ID NO: 3159860 - DNA, 16 bp, Homo sapiens
tgttgaaattttgcaa

SEQ ID NO: 3159861 - DNA, 22 bp, Homo sapiens
tgttgaatgcccacaggcaaat

SEQ ID NO: 3159862 - DNA, 18 bp, Homo sapiens
tgttgacaactgtgactg

SEQ ID NO: 3159863 - DNA, 17 bp, Homo sapiens
tgttgacagttcatatg

SEQ ID NO: 3159864 - DNA, 22 bp, Homo sapiens
tgttgacattaagaatgttggt

SEQ ID NO: 3159865 - DNA, 13 bp, Homo sapiens
tgttgacttattt

SEQ ID NO: 3159866 - DNA, 13 bp, Homo sapiens
tgttgagaagaat

SEQ ID NO: 3159867 - DNA, 17 bp, Homo sapiens
tgttgagatggtaacag

SEQ ID NO: 3159868 - DNA, 17 bp, Homo sapiens
tgttgagccaggcctgg

SEQ ID NO: 3159869 - DNA, 18 bp, Homo sapiens
tgttgagccttttccctc

SEQ ID NO: 3159870 - DNA, 17 bp, Homo sapiens
tgttgatcatgtacttt

SEQ ID NO: 3159871 - DNA, 20 bp, Homo sapiens
tgttgatcatgtacttttta

SEQ ID NO: 3159872 - DNA, 22 bp, Homo sapiens
tgttgatcatgtactttttagt

SEQ ID NO: 3159873 - DNA, 22 bp, Homo sapiens
tgttgatgggcacttgagaact

SEQ ID NO: 3159874 - DNA, 17 bp, Homo sapiens
tgttgatgtatctgagt

SEQ ID NO: 3159875 - DNA, 21 bp, Homo sapiens
tgttgatgtatctgagttgcc

SEQ ID NO: 3159876 - DNA, 20 bp, Homo sapiens
tgttgcattattcatttagt

SEQ ID NO: 3159877 - DNA, 22 bp, Homo sapiens
tgttgccaaatatgtcctgggg

SEQ ID NO: 3159878 - DNA, 17 bp, Homo sapiens
tgttgccaactaagccc

SEQ ID NO: 3159879 - DNA, 15 bp, Homo sapiens
tgttgcccaggctgg

SEQ ID NO: 3159880 - DNA, 23 bp, Homo sapiens
tgttgcccaggctggcgtgcagt

SEQ ID NO: 3159881 - DNA, 21 bp, Homo sapiens
tgttgccctttctgtaccatt

SEQ ID NO: 3159882 - DNA, 21 bp, Homo sapiens
tgttgcctaattggaaagtgc

SEQ ID NO: 3159883 - DNA, 21 bp, Homo sapiens
tgttgctcaaatctattcaga

SEQ ID NO: 3159884 - DNA, 14 bp, Homo sapiens
tgttgctcttggaa

SEQ ID NO: 3159885 - DNA, 18 bp, Homo sapiens
tgttgctcttggaaagct

SEQ ID NO: 3159886 - DNA, 15 bp, Homo sapiens
tgttgcttagatgag

SEQ ID NO: 3159887 - DNA, 16 bp, Homo sapiens
tgttgcttagtcactt

SEQ ID NO: 3159888 - DNA, 14 bp, Homo sapiens
tgttggaaaaaatt

SEQ ID NO: 3159889 - DNA, 21 bp, Homo sapiens
tgttggaagcttgttttccag

SEQ ID NO: 3159890 - DNA, 12 bp, Homo sapiens
tgttggaatgaa

SEQ ID NO: 3159891 - DNA, 18 bp, Homo sapiens
tgttggagcaaaccatta

SEQ ID NO: 3159892 - DNA, 14 bp, Homo sapiens
tgttggatcttcaa

SEQ ID NO: 3159893 - DNA, 21 bp, Homo sapiens
tgttggcacagaacaggaggt

SEQ ID NO: 3159894 - DNA, 18 bp, Homo sapiens
tgttggcacatgcctgta

SEQ ID NO: 3159895 - DNA, 15 bp, Homo sapiens
tgttggcactcacag

SEQ ID NO: 3159896 - DNA, 23 bp, Homo sapiens
tgttggcactcacagacctggag

SEQ ID NO: 3159897 - DNA, 18 bp, Homo sapiens
tgttggcaggctggccag

SEQ ID NO: 3159898 - DNA, 14 bp, Homo sapiens
tgttggccaggctg

SEQ ID NO: 3159899 - DNA, 15 bp, Homo sapiens
tgttggccaggctgg

SEQ ID NO: 3159900 - DNA, 15 bp, Homo sapiens
tgttggctaatgaag

SEQ ID NO: 3159901 - DNA, 13 bp, Homo sapiens
tgttgggaaaaag

SEQ ID NO: 3159902 - DNA, 23 bp, Homo sapiens
tgttgggaaaaaggcctctgtcc

SEQ ID NO: 3159903 - DNA, 19 bp, Homo sapiens
tgttgggaaacttggctcg

SEQ ID NO: 3159904 - DNA, 21 bp, Homo sapiens
tgttgggaaagataaaactct

SEQ ID NO: 3159905 - DNA, 21 bp, Homo sapiens
tgttggtggagagtggaagga

SEQ ID NO: 3159906 - DNA, 19 bp, Homo sapiens
tgttggtttactttcaaat

SEQ ID NO: 3159907 - DNA, 21 bp, Homo sapiens
tgttggttttgggggtgtgag

SEQ ID NO: 3159908 - DNA, 13 bp, Homo sapiens
tgttgtaaaaaga

SEQ ID NO: 3159909 - DNA, 14 bp, Homo sapiens
tgttgtaaaaagaa

SEQ ID NO: 3159910 - DNA, 17 bp, Homo sapiens
tgttgtaaaacaaaatt

SEQ ID NO: 3159911 - DNA, 23 bp, Homo sapiens
tgttgtaaaacaaaatttgacta

SEQ ID NO: 3159912 - DNA, 14 bp, Homo sapiens
tgttgtaaatattt

SEQ ID NO: 3159913 - DNA, 21 bp, Homo sapiens
tgttgtaaatatttatgtaaa

SEQ ID NO: 3159914 - DNA, 12 bp, Homo sapiens
tgttgtaactta

SEQ ID NO: 3159915 - DNA, 13 bp, Homo sapiens
tgttgtaacttat

SEQ ID NO: 3159916 - DNA, 24 bp, Homo sapiens
tgttgtaacttatgtagatatttg

SEQ ID NO: 3159917 - DNA, 15 bp, Homo sapiens
tgttgtacaatcaaa

SEQ ID NO: 3159918 - DNA, 17 bp, Homo sapiens
tgttgtacatttatgat

SEQ ID NO: 3159919 - DNA, 15 bp, Homo sapiens
tgttgtagatgctaa

SEQ ID NO: 3159920 - DNA, 14 bp, Homo sapiens
tgttgtatgggatt

SEQ ID NO: 3159921 - DNA, 13 bp, Homo sapiens
tgttgtattaaca

SEQ ID NO: 3159922 - DNA, 16 bp, Homo sapiens
tgttgtcagcctgtgc

SEQ ID NO: 3159923 - DNA, 23 bp, Homo sapiens
tgttgtcagcctgtgctgtggca

SEQ ID NO: 3159924 - DNA, 13 bp, Homo sapiens
tgttgtcattgta

SEQ ID NO: 3159925 - DNA, 18 bp, Homo sapiens
tgttgtcgtaaagatttg

SEQ ID NO: 3159926 - DNA, 20 bp, Homo sapiens
tgttgtcgtaaagatttggg

SEQ ID NO: 3159927 - DNA, 17 bp, Homo sapiens
tgttgtctgtttgttct

SEQ ID NO: 3159928 - DNA, 13 bp, Homo sapiens
tgttgtgaatgtt

SEQ ID NO: 3159929 - DNA, 21 bp, Homo sapiens
tgttgtgacacatcaagcttt

SEQ ID NO: 3159930 - DNA, 22 bp, Homo sapiens
tgttgtgacacatcaagctttt

SEQ ID NO: 3159931 - DNA, 12 bp, Homo sapiens
tgttgtgtgtgc

SEQ ID NO: 3159932 - DNA, 14 bp, Homo sapiens
tgttgttaaaatta

SEQ ID NO: 3159933 - DNA, 21 bp, Homo sapiens
tgttgttaatgaaaatgtcag

SEQ ID NO: 3159934 - DNA, 14 bp, Homo sapiens
tgttgttccatttt

SEQ ID NO: 3159935 - DNA, 17 bp, Homo sapiens
tgttgttccattttatg

SEQ ID NO: 3159936 - DNA, 11 bp, Homo sapiens
tgttgttgtgt

SEQ ID NO: 3159937 - DNA, 18 bp, Homo sapiens
tgttgtttaatctgaact

SEQ ID NO: 3159938 - DNA, 14 bp, Homo sapiens
tgttgtttgtaaat

SEQ ID NO: 3159939 - DNA, 17 bp, Homo sapiens
tgtttaaaaagtaagtt

SEQ ID NO: 3159940 - DNA, 12 bp, Homo sapiens
tgtttaaaataa

SEQ ID NO: 3159941 - DNA, 14 bp, Homo sapiens
tgtttaaaataaaa

SEQ ID NO: 3159942 - DNA, 18 bp, Homo sapiens
tgtttaaaataaaatgaa

SEQ ID NO: 3159943 - DNA, 21 bp, Homo sapiens
tgtttaaaataaaatgaaaat

SEQ ID NO: 3159944 - DNA, 22 bp, Homo sapiens
tgtttaaaataaaatgaaaatt

SEQ ID NO: 3159945 - DNA, 22 bp, Homo sapiens
tgtttaaaatgtaatttaaatg

SEQ ID NO: 3159946 - DNA, 21 bp, Homo sapiens
tgtttaaagagaggttataga

SEQ ID NO: 3159947 - DNA, 13 bp, Homo sapiens
tgtttaaatataa

SEQ ID NO: 3159948 - DNA, 16 bp, Homo sapiens
tgtttaaatataaatg

SEQ ID NO: 3159949 - DNA, 21 bp, Homo sapiens
tgtttaacaaatctaatctct

SEQ ID NO: 3159950 - DNA, 18 bp, Homo sapiens
tgtttaacaacatggctt

SEQ ID NO: 3159951 - DNA, 16 bp, Homo sapiens
tgtttaatattgagaa

SEQ ID NO: 3159952 - DNA, 20 bp, Homo sapiens
tgtttaatattgagaaagaa

SEQ ID NO: 3159953 - DNA, 14 bp, Homo sapiens
tgtttaatctgtta

SEQ ID NO: 3159954 - DNA, 20 bp, Homo sapiens
tgtttaatctgttatgtact

SEQ ID NO: 3159955 - DNA, 15 bp, Homo sapiens
tgtttaatgtgaact

SEQ ID NO: 3159956 - DNA, 19 bp, Homo sapiens
tgtttaatttttatttctt

SEQ ID NO: 3159957 - DNA, 21 bp, Homo sapiens
tgtttacaaaaatttctgtaa

SEQ ID NO: 3159958 - DNA, 15 bp, Homo sapiens
tgtttacacaattaa

SEQ ID NO: 3159959 - DNA, 18 bp, Homo sapiens
tgtttacactctttgtaa

SEQ ID NO: 3159960 - DNA, 15 bp, Homo sapiens
tgtttacagacagaa

SEQ ID NO: 3159961 - DNA, 14 bp, Homo sapiens
tgtttaccattttt

SEQ ID NO: 3159962 - DNA, 15 bp, Homo sapiens
tgtttacctttctct

SEQ ID NO: 3159963 - DNA, 16 bp, Homo sapiens
tgtttacctttctctc

SEQ ID NO: 3159964 - DNA, 23 bp, Homo sapiens
tgtttacctttctctctctaagg

SEQ ID NO: 3159965 - DNA, 19 bp, Homo sapiens
tgtttactcattgccccca

SEQ ID NO: 3159966 - DNA, 22 bp, Homo sapiens
tgtttagcagcagcctttaatg

SEQ ID NO: 3159967 - DNA, 19 bp, Homo sapiens
tgtttataaatcttatgct

SEQ ID NO: 3159968 - DNA, 14 bp, Homo sapiens
tgtttataatctga

SEQ ID NO: 3159969 - DNA, 21 bp, Homo sapiens
tgtttatagcaaacttggaat

SEQ ID NO: 3159970 - DNA, 10 bp, Homo sapiens
tgtttatata

SEQ ID NO: 3159971 - DNA, 18 bp, Homo sapiens
tgtttatatactgggttc

SEQ ID NO: 3159972 - DNA, 23 bp, Homo sapiens
tgtttatgatatttcttgctttc

SEQ ID NO: 3159973 - DNA, 21 bp, Homo sapiens
tgtttatgatctatttgtaga

SEQ ID NO: 3159974 - DNA, 13 bp, Homo sapiens
tgtttatggcctc

SEQ ID NO: 3159975 - DNA, 14 bp, Homo sapiens
tgtttatggcctca

SEQ ID NO: 3159976 - DNA, 24 bp, Homo sapiens
tgtttatggcctcagctgcctcac

SEQ ID NO: 3159977 - DNA, 13 bp, Homo sapiens
tgtttattaacaa

SEQ ID NO: 3159978 - DNA, 14 bp, Homo sapiens
tgtttattaacaaa

SEQ ID NO: 3159979 - DNA, 22 bp, Homo sapiens
tgtttattacaatttttaataa

SEQ ID NO: 3159980 - DNA, 13 bp, Homo sapiens
tgtttattcctga

SEQ ID NO: 3159981 - DNA, 13 bp, Homo sapiens
tgtttattccttg

SEQ ID NO: 3159982 - DNA, 24 bp, Homo sapiens
tgtttatttatagagtgtacttaa

SEQ ID NO: 3159983 - DNA, 16 bp, Homo sapiens
tgtttattttatatta

SEQ ID NO: 3159984 - DNA, 15 bp, Homo sapiens
tgtttatttttatat

SEQ ID NO: 3159985 - DNA, 12 bp, Homo sapiens
tgtttatttttc

SEQ ID NO: 3159986 - DNA, 16 bp, Homo sapiens
tgtttcaactgtataa

SEQ ID NO: 3159987 - DNA, 15 bp, Homo sapiens
tgtttcaaggcactc

SEQ ID NO: 3159988 - DNA, 15 bp, Homo sapiens
tgtttcagatttttt

SEQ ID NO: 3159989 - DNA, 16 bp, Homo sapiens
tgtttccaacttgtct

SEQ ID NO: 3159990 - DNA, 13 bp, Homo sapiens
tgtttccagggtc

SEQ ID NO: 3159991 - DNA, 14 bp, Homo sapiens
tgtttccctgctga

SEQ ID NO: 3159992 - DNA, 15 bp, Homo sapiens
tgtttccctgctgaa

SEQ ID NO: 3159993 - DNA, 18 bp, Homo sapiens
tgtttcccttcccttcca

SEQ ID NO: 3159994 - DNA, 18 bp, Homo sapiens
tgtttcccttgctttgtt

SEQ ID NO: 3159995 - DNA, 19 bp, Homo sapiens
tgtttcccttgctttgttt

SEQ ID NO: 3159996 - DNA, 16 bp, Homo sapiens
tgtttcctagctgtgt

SEQ ID NO: 3159997 - DNA, 14 bp, Homo sapiens
tgtttcctcatctt

SEQ ID NO: 3159998 - DNA, 16 bp, Homo sapiens
tgtttcctcttccaaa

SEQ ID NO: 3159999 - DNA, 16 bp, Homo sapiens
tgtttctagttgagga

SEQ ID NO: 3160000 - DNA, 16 bp, Homo sapiens
tgtttctatacaaata

SEQ ID NO: 3160001 - DNA, 16 bp, Homo sapiens
tgtttctatctgattt

SEQ ID NO: 3160002 - DNA, 19 bp, Homo sapiens
tgtttctattgacttcaat

SEQ ID NO: 3160003 - DNA, 15 bp, Homo sapiens
tgtttctccccctgg

SEQ ID NO: 3160004 - DNA, 14 bp, Homo sapiens
tgtttctctgctgt

SEQ ID NO: 3160005 - DNA, 22 bp, Homo sapiens
tgtttctctgttgtaagaatag

SEQ ID NO: 3160006 - DNA, 20 bp, Homo sapiens
tgtttctctttgtctgcctt

SEQ ID NO: 3160007 - DNA, 13 bp, Homo sapiens
tgtttctgaaaat

SEQ ID NO: 3160008 - DNA, 12 bp, Homo sapiens
tgtttctgactc

SEQ ID NO: 3160009 - DNA, 16 bp, Homo sapiens
tgtttctgcagccctt

SEQ ID NO: 3160010 - DNA, 20 bp, Homo sapiens
tgtttctgcagcccttgggc

SEQ ID NO: 3160011 - DNA, 14 bp, Homo sapiens
tgtttctgtcagga

SEQ ID NO: 3160012 - DNA, 15 bp, Homo sapiens
tgtttctgttattaa

SEQ ID NO: 3160013 - DNA, 13 bp, Homo sapiens
tgtttctgttcca

SEQ ID NO: 3160014 - DNA, 22 bp, Homo sapiens
tgtttcttaactataaatatgt

SEQ ID NO: 3160015 - DNA, 17 bp, Homo sapiens
tgtttcttccaaagcac

SEQ ID NO: 3160016 - DNA, 18 bp, Homo sapiens
tgtttcttccaaagcaca

SEQ ID NO: 3160017 - DNA, 19 bp, Homo sapiens
tgtttcttccaaagcacat

SEQ ID NO: 3160018 - DNA, 17 bp, Homo sapiens
tgtttcttcctgttaat

SEQ ID NO: 3160019 - DNA, 18 bp, Homo sapiens
tgtttcttcctgttaatg

SEQ ID NO: 3160020 - DNA, 16 bp, Homo sapiens
tgtttcttgacaagct

SEQ ID NO: 3160021 - DNA, 18 bp, Homo sapiens
tgtttcttgacaagctga

SEQ ID NO: 3160022 - DNA, 19 bp, Homo sapiens
tgtttctttttacagcatt

SEQ ID NO: 3160023 - DNA, 18 bp, Homo sapiens
tgtttgaacacttactgt

SEQ ID NO: 3160024 - DNA, 18 bp, Homo sapiens
tgtttgaggagcatgttt

SEQ ID NO: 3160025 - DNA, 21 bp, Homo sapiens
tgtttgaggcaaattaactgt

SEQ ID NO: 3160026 - DNA, 21 bp, Homo sapiens
tgtttgatataccaaattaaa

SEQ ID NO: 3160027 - DNA, 20 bp, Homo sapiens
tgtttgatgtatgtgtgaaa

SEQ ID NO: 3160028 - DNA, 22 bp, Homo sapiens
tgtttgccatactttgtctgaa

SEQ ID NO: 3160029 - DNA, 10 bp, Homo sapiens
tgtttgcctc

SEQ ID NO: 3160030 - DNA, 16 bp, Homo sapiens
tgtttgcctctgcctc

SEQ ID NO: 3160031 - DNA, 13 bp, Homo sapiens
tgtttgctgctat

SEQ ID NO: 3160032 - DNA, 12 bp, Homo sapiens
tgtttgcttaaa

SEQ ID NO: 3160033 - DNA, 14 bp, Homo sapiens
tgtttgcttaaaca

SEQ ID NO: 3160034 - DNA, 17 bp, Homo sapiens
tgtttggaaaagacagt

SEQ ID NO: 3160035 - DNA, 21 bp, Homo sapiens
tgtttggatgtaatttagggt

SEQ ID NO: 3160036 - DNA, 15 bp, Homo sapiens
tgtttggcaaggaaa

SEQ ID NO: 3160037 - DNA, 16 bp, Homo sapiens
tgtttggcaaggaaag

SEQ ID NO: 3160038 - DNA, 17 bp, Homo sapiens
tgtttggcacttgtatt

SEQ ID NO: 3160039 - DNA, 18 bp, Homo sapiens
tgtttggcacttgtattt

SEQ ID NO: 3160040 - DNA, 22 bp, Homo sapiens
tgtttggcgtagcagagttaaa

SEQ ID NO: 3160041 - DNA, 19 bp, Homo sapiens
tgtttggcttataaacaca

SEQ ID NO: 3160042 - DNA, 20 bp, Homo sapiens
tgtttggcttataaacacat

SEQ ID NO: 3160043 - DNA, 15 bp, Homo sapiens
tgtttgggagactgt

SEQ ID NO: 3160044 - DNA, 21 bp, Homo sapiens
tgtttgggggacgtttctcat

SEQ ID NO: 3160045 - DNA, 22 bp, Homo sapiens
tgtttggtgcatagaactgggt

SEQ ID NO: 3160046 - DNA, 21 bp, Homo sapiens
tgtttgtaaataagagatttg

SEQ ID NO: 3160047 - DNA, 19 bp, Homo sapiens
tgtttgtaaattaatactt

SEQ ID NO: 3160048 - DNA, 15 bp, Homo sapiens
tgtttgtcccttcta

SEQ ID NO: 3160049 - DNA, 16 bp, Homo sapiens
tgtttgtctctccttt

SEQ ID NO: 3160050 - DNA, 17 bp, Homo sapiens
tgtttgtctctcctttt

SEQ ID NO: 3160051 - DNA, 17 bp, Homo sapiens
tgtttgtctgtcttcat

SEQ ID NO: 3160052 - DNA, 15 bp, Homo sapiens
tgtttgtgcatcctg

SEQ ID NO: 3160053 - DNA, 13 bp, Homo sapiens
tgtttgtggcctc

SEQ ID NO: 3160054 - DNA, 15 bp, Homo sapiens
tgtttgtggcctcag

SEQ ID NO: 3160055 - DNA, 17 bp, Homo sapiens
tgtttgtgtgatttcct

SEQ ID NO: 3160056 - DNA, 17 bp, Homo sapiens
tgtttgttaaaactggc

SEQ ID NO: 3160057 - DNA, 14 bp, Homo sapiens
tgtttgtttaattt

SEQ ID NO: 3160058 - DNA, 22 bp, Homo sapiens
tgtttgtttctccccctgggct

SEQ ID NO: 3160059 - DNA, 23 bp, Homo sapiens
tgttttaaaataaaaattctgaa

SEQ ID NO: 3160060 - DNA, 20 bp, Homo sapiens
tgttttaaacatagaaagtt

SEQ ID NO: 3160061 - DNA, 12 bp, Homo sapiens
tgttttaaagaa

SEQ ID NO: 3160062 - DNA, 17 bp, Homo sapiens
tgttttaataaacagta

SEQ ID NO: 3160063 - DNA, 15 bp, Homo sapiens
tgttttaatctgaaa

SEQ ID NO: 3160064 - DNA, 16 bp, Homo sapiens
tgttttagaaccagcc

SEQ ID NO: 3160065 - DNA, 21 bp, Homo sapiens
tgttttatatattatgtgaag

SEQ ID NO: 3160066 - DNA, 15 bp, Homo sapiens
tgttttatctcctgt

SEQ ID NO: 3160067 - DNA, 21 bp, Homo sapiens
tgttttcacttgtattgactt

SEQ ID NO: 3160068 - DNA, 15 bp, Homo sapiens
tgttttcagtgtaca

SEQ ID NO: 3160069 - DNA, 16 bp, Homo sapiens
tgttttcccacgagga

SEQ ID NO: 3160070 - DNA, 21 bp, Homo sapiens
tgttttcccttaacttttcct

SEQ ID NO: 3160071 - DNA, 23 bp, Homo sapiens
tgttttctaaagttgttcacata

SEQ ID NO: 3160072 - DNA, 14 bp, Homo sapiens
tgttttctcagaac

SEQ ID NO: 3160073 - DNA, 20 bp, Homo sapiens
tgttttctcagaacagctga

SEQ ID NO: 3160074 - DNA, 13 bp, Homo sapiens
tgttttctctgtg

SEQ ID NO: 3160075 - DNA, 22 bp, Homo sapiens
tgttttgaatggtgttgtatgc

SEQ ID NO: 3160076 - DNA, 13 bp, Homo sapiens
tgttttgagacat

SEQ ID NO: 3160077 - DNA, 23 bp, Homo sapiens
tgttttgcttttgtttttttcct

SEQ ID NO: 3160078 - DNA, 23 bp, Homo sapiens
tgttttggctgaaattctcctgg

SEQ ID NO: 3160079 - DNA, 16 bp, Homo sapiens
tgttttgggtgaatct

SEQ ID NO: 3160080 - DNA, 22 bp, Homo sapiens
tgttttgggtgaatcttgagga

SEQ ID NO: 3160081 - DNA, 22 bp, Homo sapiens
tgttttggtgtattgtcagcca

SEQ ID NO: 3160082 - DNA, 22 bp, Homo sapiens
tgttttgtacaattactaaatt

SEQ ID NO: 3160083 - DNA, 18 bp, Homo sapiens
tgttttgtacatagattt

SEQ ID NO: 3160084 - DNA, 13 bp, Homo sapiens
tgttttgtataca

SEQ ID NO: 3160085 - DNA, 18 bp, Homo sapiens
tgttttgtatatacagtt

SEQ ID NO: 3160086 - DNA, 20 bp, Homo sapiens
tgttttgtatatacagttat

SEQ ID NO: 3160087 - DNA, 17 bp, Homo sapiens
tgttttgtgaattttct

SEQ ID NO: 3160088 - DNA, 15 bp, Homo sapiens
tgttttgtgcatttg

SEQ ID NO: 3160089 - DNA, 23 bp, Homo sapiens
tgttttgtttgtctctccttttc

SEQ ID NO: 3160090 - DNA, 19 bp, Homo sapiens
tgtttttaacatgtcaatc

SEQ ID NO: 3160091 - DNA, 15 bp, Homo sapiens
tgtttttaagctgtt

SEQ ID NO: 3160092 - DNA, 22 bp, Homo sapiens
tgtttttaagctgtttccatag

SEQ ID NO: 3160093 - DNA, 13 bp, Homo sapiens
tgtttttaatgac

SEQ ID NO: 3160094 - DNA, 13 bp, Homo sapiens
tgtttttaatgct

SEQ ID NO: 3160095 - DNA, 16 bp, Homo sapiens
tgtttttatcttttta

SEQ ID NO: 3160096 - DNA, 13 bp, Homo sapiens
tgtttttcacatt

SEQ ID NO: 3160097 - DNA, 15 bp, Homo sapiens
tgtttttcctttctt

SEQ ID NO: 3160098 - DNA, 16 bp, Homo sapiens
tgtttttcctttctta

SEQ ID NO: 3160099 - DNA, 17 bp, Homo sapiens
tgtttttcctttcttaa

SEQ ID NO: 3160100 - DNA, 12 bp, Homo sapiens
tgtttttctcac

SEQ ID NO: 3160101 - DNA, 17 bp, Homo sapiens
tgtttttctctaatgct

SEQ ID NO: 3160102 - DNA, 12 bp, Homo sapiens
tgtttttctggg

SEQ ID NO: 3160103 - DNA, 16 bp, Homo sapiens
tgtttttctttctaca

SEQ ID NO: 3160104 - DNA, 19 bp, Homo sapiens
tgtttttctttttccacaa

SEQ ID NO: 3160105 - DNA, 19 bp, Homo sapiens
tgtttttgaaacccacagt

SEQ ID NO: 3160106 - DNA, 13 bp, Homo sapiens
tgtttttgaaata

SEQ ID NO: 3160107 - DNA, 16 bp, Homo sapiens
tgtttttgcacatgtt

SEQ ID NO: 3160108 - DNA, 12 bp, Homo sapiens
tgtttttgtaat

SEQ ID NO: 3160109 - DNA, 17 bp, Homo sapiens
tgtttttgtaatgcact

SEQ ID NO: 3160110 - DNA, 13 bp, Homo sapiens
tgtttttgtattt

SEQ ID NO: 3160111 - DNA, 14 bp, Homo sapiens
tgtttttgttgtgt

SEQ ID NO: 3160112 - DNA, 19 bp, Homo sapiens
tgttttttaagatggcaat

SEQ ID NO: 3160113 - DNA, 23 bp, Homo sapiens
tgttttttgccacagcttttgca

SEQ ID NO: 3160114 - DNA, 12 bp, Homo sapiens
tgttttttgtaa

SEQ ID NO: 3160115 - DNA, 14 bp, Homo sapiens
tgttttttgtaact

SEQ ID NO: 3160116 - DNA, 18 bp, Homo sapiens
tgttttttgtaactacaa

SEQ ID NO: 3160117 - DNA, 16 bp, Homo sapiens
tgttttttgttcaatg

SEQ ID NO: 3160118 - DNA, 15 bp, Homo sapiens
tgtttttttaattaa

SEQ ID NO: 3160119 - DNA, 22 bp, Homo sapiens
tgtttttttctttttttataaa

SEQ ID NO: 3160120 - DNA, 19 bp, Homo sapiens
tgttttttttttccactta

SEQ ID NO: 3160121 - DNA, 21 bp, Homo sapiens
tgtttttttttttttacatgt

SEQ ID NO: 3160122 - DNA, 15 bp, Homo sapiens
ttaaaaaaaaaagtc

SEQ ID NO: 3160123 - DNA, 21 bp, Homo sapiens
ttaaaaaaaaaagtcaccaaa

SEQ ID NO: 3160124 - DNA, 18 bp, Homo sapiens
ttaaaaaaaaagatctgt

SEQ ID NO: 3160125 - DNA, 12 bp, Homo sapiens
ttaaaaaaagaa

SEQ ID NO: 3160126 - DNA, 14 bp, Homo sapiens
ttaaaaaaagaaaa

SEQ ID NO: 3160127 - DNA, 12 bp, Homo sapiens
ttaaaaaaatca

SEQ ID NO: 3160128 - DNA, 20 bp, Homo sapiens
ttaaaaaaattggttggaga

SEQ ID NO: 3160129 - DNA, 16 bp, Homo sapiens
ttaaaaaaatttaagt

SEQ ID NO: 3160130 - DNA, 23 bp, Homo sapiens
ttaaaaaacaaaaaccagcaggt

SEQ ID NO: 3160131 - DNA, 13 bp, Homo sapiens
ttaaaaaacttca

SEQ ID NO: 3160132 - DNA, 22 bp, Homo sapiens
ttaaaaaagactgaacatgttt

SEQ ID NO: 3160133 - DNA, 16 bp, Homo sapiens
ttaaaaaatattttct

SEQ ID NO: 3160134 - DNA, 21 bp, Homo sapiens
ttaaaaaattatggaatatca

SEQ ID NO: 3160135 - DNA, 16 bp, Homo sapiens
ttaaaaacatagaaaa

SEQ ID NO: 3160136 - DNA, 16 bp, Homo sapiens
ttaaaaactcttcagt

SEQ ID NO: 3160137 - DNA, 14 bp, Homo sapiens
ttaaaaactttatt

SEQ ID NO: 3160138 - DNA, 16 bp, Homo sapiens
ttaaaaagaatgacgt

SEQ ID NO: 3160139 - DNA, 13 bp, Homo sapiens
ttaaaaagattct

SEQ ID NO: 3160140 - DNA, 17 bp, Homo sapiens
ttaaaaagcagctgcat

SEQ ID NO: 3160141 - DNA, 21 bp, Homo sapiens
ttaaaaaggaaatttgtttgt

SEQ ID NO: 3160142 - DNA, 13 bp, Homo sapiens
ttaaaaaggccaa

SEQ ID NO: 3160143 - DNA, 16 bp, Homo sapiens
ttaaaaaggccaaaga

SEQ ID NO: 3160144 - DNA, 17 bp, Homo sapiens
ttaaaaaggccaaagat

SEQ ID NO: 3160145 - DNA, 14 bp, Homo sapiens
ttaaaaagtcttca

SEQ ID NO: 3160146 - DNA, 11 bp, Homo sapiens
ttaaaaagttt

SEQ ID NO: 3160147 - DNA, 12 bp, Homo sapiens
ttaaaaatacat

SEQ ID NO: 3160148 - DNA, 14 bp, Homo sapiens
ttaaaaatacatat

SEQ ID NO: 3160149 - DNA, 12 bp, Homo sapiens
ttaaaaatggaa

SEQ ID NO: 3160150 - DNA, 24 bp, Homo sapiens
ttaaaaatggtatcaaaattacat

SEQ ID NO: 3160151 - DNA, 19 bp, Homo sapiens
ttaaaaatgtaaatattct

SEQ ID NO: 3160152 - DNA, 20 bp, Homo sapiens
ttaaaaatgtagaaattctt

SEQ ID NO: 3160153 - DNA, 23 bp, Homo sapiens
ttaaaaatgtagaaattcttcat

SEQ ID NO: 3160154 - DNA, 14 bp, Homo sapiens
ttaaaaatgtgtca

SEQ ID NO: 3160155 - DNA, 16 bp, Homo sapiens
ttaaaaatgttctcaa

SEQ ID NO: 3160156 - DNA, 12 bp, Homo sapiens
ttaaaacagctg

SEQ ID NO: 3160157 - DNA, 13 bp, Homo sapiens
ttaaaacagctgt

SEQ ID NO: 3160158 - DNA, 22 bp, Homo sapiens
ttaaaacatatttcattttaac

SEQ ID NO: 3160159 - DNA, 17 bp, Homo sapiens
ttaaaactaggtaatgt

SEQ ID NO: 3160160 - DNA, 22 bp, Homo sapiens
ttaaaactcaacattactgtta

SEQ ID NO: 3160161 - DNA, 12 bp, Homo sapiens
ttaaaactgctt

SEQ ID NO: 3160162 - DNA, 13 bp, Homo sapiens
ttaaaactgcttt

SEQ ID NO: 3160163 - DNA, 16 bp, Homo sapiens
ttaaaagaaatttatt

SEQ ID NO: 3160164 - DNA, 16 bp, Homo sapiens
ttaaaagaagactgga

SEQ ID NO: 3160165 - DNA, 13 bp, Homo sapiens
ttaaaagaatgac

SEQ ID NO: 3160166 - DNA, 14 bp, Homo sapiens
ttaaaagacatttt

SEQ ID NO: 3160167 - DNA, 23 bp, Homo sapiens
ttaaaagagagagagagaaaaaa

SEQ ID NO: 3160168 - DNA, 23 bp, Homo sapiens
ttaaaaggaaagtcaagaagaat

SEQ ID NO: 3160169 - DNA, 23 bp, Homo sapiens
ttaaaaggtataattaaacttct

SEQ ID NO: 3160170 - DNA, 13 bp, Homo sapiens
ttaaaagtaaaat

SEQ ID NO: 3160171 - DNA, 17 bp, Homo sapiens
ttaaaagtaaaatgtct

SEQ ID NO: 3160172 - DNA, 18 bp, Homo sapiens
ttaaaagtaaaatgtctt

SEQ ID NO: 3160173 - DNA, 15 bp, Homo sapiens
ttaaaagttgcattt

SEQ ID NO: 3160174 - DNA, 20 bp, Homo sapiens
ttaaaagttgttaccaaata

SEQ ID NO: 3160175 - DNA, 17 bp, Homo sapiens
ttaaaagtttcaatgtg

SEQ ID NO: 3160176 - DNA, 20 bp, Homo sapiens
ttaaaataaaaattctgaat

SEQ ID NO: 3160177 - DNA, 14 bp, Homo sapiens
ttaaaataaaatga

SEQ ID NO: 3160178 - DNA, 20 bp, Homo sapiens
ttaaaataaaatgaaaattg

SEQ ID NO: 3160179 - DNA, 21 bp, Homo sapiens
ttaaaataaaatgaaaattgt

SEQ ID NO: 3160180 - DNA, 19 bp, Homo sapiens
ttaaaataaacagttgtga

SEQ ID NO: 3160181 - DNA, 16 bp, Homo sapiens
ttaaaataaaccaaat

SEQ ID NO: 3160182 - DNA, 12 bp, Homo sapiens
ttaaaataatat

SEQ ID NO: 3160183 - DNA, 14 bp, Homo sapiens
ttaaaatatggcta

SEQ ID NO: 3160184 - DNA, 18 bp, Homo sapiens
ttaaaatatttgaatgaa

SEQ ID NO: 3160185 - DNA, 21 bp, Homo sapiens
ttaaaatatttgtctttaaac

SEQ ID NO: 3160186 - DNA, 22 bp, Homo sapiens
ttaaaatatttgtctttaaaca

SEQ ID NO: 3160187 - DNA, 17 bp, Homo sapiens
ttaaaatcactaacatt

SEQ ID NO: 3160188 - DNA, 20 bp, Homo sapiens
ttaaaatcactaacattata

SEQ ID NO: 3160189 - DNA, 24 bp, Homo sapiens
ttaaaatctattctgtgttgcatt

SEQ ID NO: 3160190 - DNA, 17 bp, Homo sapiens
ttaaaatctctaataga

SEQ ID NO: 3160191 - DNA, 11 bp, Homo sapiens
ttaaaatgctg

SEQ ID NO: 3160192 - DNA, 21 bp, Homo sapiens
ttaaaatggtgcttaagttcc

SEQ ID NO: 3160193 - DNA, 11 bp, Homo sapiens
ttaaaatgtaa

SEQ ID NO: 3160194 - DNA, 17 bp, Homo sapiens
ttaaaatgtaagattat

SEQ ID NO: 3160195 - DNA, 24 bp, Homo sapiens
ttaaaatgtaagattatagattct

SEQ ID NO: 3160196 - DNA, 13 bp, Homo sapiens
ttaaaatgtaatt

SEQ ID NO: 3160197 - DNA, 21 bp, Homo sapiens
ttaaaatgtaatttaaatgaa

SEQ ID NO: 3160198 - DNA, 21 bp, Homo sapiens
ttaaaatgtcggatttatctt

SEQ ID NO: 3160199 - DNA, 14 bp, Homo sapiens
ttaaaattacagat

SEQ ID NO: 3160200 - DNA, 20 bp, Homo sapiens
ttaaaattacagatgtgaaa

SEQ ID NO: 3160201 - DNA, 22 bp, Homo sapiens
ttaaaattatgaatctgatttt

SEQ ID NO: 3160202 - DNA, 12 bp, Homo sapiens
ttaaaattcagt

SEQ ID NO: 3160203 - DNA, 13 bp, Homo sapiens
ttaaaattcagtt

SEQ ID NO: 3160204 - DNA, 15 bp, Homo sapiens
ttaaaattcagtttt

SEQ ID NO: 3160205 - DNA, 18 bp, Homo sapiens
ttaaaattgccattttat

SEQ ID NO: 3160206 - DNA, 15 bp, Homo sapiens
ttaaaattgctatgt

SEQ ID NO: 3160207 - DNA, 14 bp, Homo sapiens
ttaaacaaagtttc

SEQ ID NO: 3160208 - DNA, 19 bp, Homo sapiens
ttaaacaatataagaagga

SEQ ID NO: 3160209 - DNA, 13 bp, Homo sapiens
ttaaacaatgtat

SEQ ID NO: 3160210 - DNA, 18 bp, Homo sapiens
ttaaacaatgtataaaga

SEQ ID NO: 3160211 - DNA, 21 bp, Homo sapiens
ttaaacacttatcttctggat

SEQ ID NO: 3160212 - DNA, 12 bp, Homo sapiens
ttaaacagatga

SEQ ID NO: 3160213 - DNA, 12 bp, Homo sapiens
ttaaacagcagt

SEQ ID NO: 3160214 - DNA, 14 bp, Homo sapiens
ttaaacagcagtgt

SEQ ID NO: 3160215 - DNA, 16 bp, Homo sapiens
ttaaacaggcccagca

SEQ ID NO: 3160216 - DNA, 19 bp, Homo sapiens
ttaaacataataaatcaca

SEQ ID NO: 3160217 - DNA, 19 bp, Homo sapiens
ttaaacattaatagcagcc

SEQ ID NO: 3160218 - DNA, 15 bp, Homo sapiens
ttaaacattgaagta

SEQ ID NO: 3160219 - DNA, 15 bp, Homo sapiens
ttaaaccaattataa

SEQ ID NO: 3160220 - DNA, 19 bp, Homo sapiens
ttaaacctgtctccactgt

SEQ ID NO: 3160221 - DNA, 21 bp, Homo sapiens
ttaaacctgtctccactgtgc

SEQ ID NO: 3160222 - DNA, 12 bp, Homo sapiens
ttaaactaaata

SEQ ID NO: 3160223 - DNA, 21 bp, Homo sapiens
ttaaactaaataatgaataaa

SEQ ID NO: 3160224 - DNA, 22 bp, Homo sapiens
ttaaactaggagaaccaaatct

SEQ ID NO: 3160225 - DNA, 12 bp, Homo sapiens
ttaaactgtgta

SEQ ID NO: 3160226 - DNA, 19 bp, Homo sapiens
ttaaactgtgtacataact

SEQ ID NO: 3160227 - DNA, 16 bp, Homo sapiens
ttaaactgttagcact

SEQ ID NO: 3160228 - DNA, 21 bp, Homo sapiens
ttaaactgttagcactgttga

SEQ ID NO: 3160229 - DNA, 17 bp, Homo sapiens
ttaaacttccaaagaaa

SEQ ID NO: 3160230 - DNA, 12 bp, Homo sapiens
ttaaacttcttt

SEQ ID NO: 3160231 - DNA, 14 bp, Homo sapiens
ttaaacttgtgaat

SEQ ID NO: 3160232 - DNA, 17 bp, Homo sapiens
ttaaacttttaattcat

SEQ ID NO: 3160233 - DNA, 18 bp, Homo sapiens
ttaaacttttaattcatt

SEQ ID NO: 3160234 - DNA, 13 bp, Homo sapiens
ttaaagaaaaata

SEQ ID NO: 3160235 - DNA, 16 bp, Homo sapiens
ttaaagaaacagcttt

SEQ ID NO: 3160236 - DNA, 14 bp, Homo sapiens
ttaaagaaaggaaa

SEQ ID NO: 3160237 - DNA, 17 bp, Homo sapiens
ttaaagaaaggaaaaga

SEQ ID NO: 3160238 - DNA, 13 bp, Homo sapiens
ttaaagagaggtt

SEQ ID NO: 3160239 - DNA, 20 bp, Homo sapiens
ttaaagagaggttatagagt

SEQ ID NO: 3160240 - DNA, 23 bp, Homo sapiens
ttaaagagtctagattcaaaggt

SEQ ID NO: 3160241 - DNA, 21 bp, Homo sapiens
ttaaagcagagggactttgta

SEQ ID NO: 3160242 - DNA, 18 bp, Homo sapiens
ttaaagccattctgatta

SEQ ID NO: 3160243 - DNA, 13 bp, Homo sapiens
ttaaagcctcctc

SEQ ID NO: 3160244 - DNA, 17 bp, Homo sapiens
ttaaagggcccaatgaa

SEQ ID NO: 3160245 - DNA, 21 bp, Homo sapiens
ttaaaggggcagaaaaactct

SEQ ID NO: 3160246 - DNA, 16 bp, Homo sapiens
ttaaagtatatattta

SEQ ID NO: 3160247 - DNA, 23 bp, Homo sapiens
ttaaagtatgcattattaaattg

SEQ ID NO: 3160248 - DNA, 18 bp, Homo sapiens
ttaaagtatgttattgca

SEQ ID NO: 3160249 - DNA, 12 bp, Homo sapiens
ttaaagtctgaa

SEQ ID NO: 3160250 - DNA, 21 bp, Homo sapiens
ttaaagtgctaaggttctaag

SEQ ID NO: 3160251 - DNA, 12 bp, Homo sapiens
ttaaagttaata

SEQ ID NO: 3160252 - DNA, 13 bp, Homo sapiens
ttaaagttctgtg

SEQ ID NO: 3160253 - DNA, 21 bp, Homo sapiens
ttaaagttgtataaaaacatg

SEQ ID NO: 3160254 - DNA, 19 bp, Homo sapiens
ttaaagtttaagtgtgcag

SEQ ID NO: 3160255 - DNA, 19 bp, Homo sapiens
ttaaataaaagcacaagta

SEQ ID NO: 3160256 - DNA, 14 bp, Homo sapiens
ttaaataaaagtga

SEQ ID NO: 3160257 - DNA, 13 bp, Homo sapiens
ttaaataaaatca

SEQ ID NO: 3160258 - DNA, 15 bp, Homo sapiens
ttaaataaaatcaat

SEQ ID NO: 3160259 - DNA, 12 bp, Homo sapiens
ttaaataaactt

SEQ ID NO: 3160260 - DNA, 15 bp, Homo sapiens
ttaaataaatgaata

SEQ ID NO: 3160261 - DNA, 15 bp, Homo sapiens
ttaaataacctctgg

SEQ ID NO: 3160262 - DNA, 12 bp, Homo sapiens
ttaaataagcaa

SEQ ID NO: 3160263 - DNA, 15 bp, Homo sapiens
ttaaataatatggct

SEQ ID NO: 3160264 - DNA, 16 bp, Homo sapiens
ttaaatacaaaacttc

SEQ ID NO: 3160265 - DNA, 16 bp, Homo sapiens
ttaaatacagacacta

SEQ ID NO: 3160266 - DNA, 19 bp, Homo sapiens
ttaaatacagacactaagt

SEQ ID NO: 3160267 - DNA, 16 bp, Homo sapiens
ttaaatacagataatt

SEQ ID NO: 3160268 - DNA, 20 bp, Homo sapiens
ttaaatactgtgcagaataa

SEQ ID NO: 3160269 - DNA, 21 bp, Homo sapiens
ttaaatactgtgcagaataat

SEQ ID NO: 3160270 - DNA, 18 bp, Homo sapiens
ttaaataggatattaaca

SEQ ID NO: 3160271 - DNA, 12 bp, Homo sapiens
ttaaatataaat

SEQ ID NO: 3160272 - DNA, 18 bp, Homo sapiens
ttaaatataattctgtaa

SEQ ID NO: 3160273 - DNA, 13 bp, Homo sapiens
ttaaatatgtata

SEQ ID NO: 3160274 - DNA, 22 bp, Homo sapiens
ttaaatattttctattttaaga

SEQ ID NO: 3160275 - DNA, 14 bp, Homo sapiens
ttaaatcatgtatg

SEQ ID NO: 3160276 - DNA, 15 bp, Homo sapiens
ttaaatcatgtatgt

SEQ ID NO: 3160277 - DNA, 16 bp, Homo sapiens
ttaaatctgtccctga

SEQ ID NO: 3160278 - DNA, 16 bp, Homo sapiens
ttaaatctgtgatgat

SEQ ID NO: 3160279 - DNA, 16 bp, Homo sapiens
ttaaatcttaaacaat

SEQ ID NO: 3160280 - DNA, 19 bp, Homo sapiens
ttaaatcttaaacaatgta

SEQ ID NO: 3160281 - DNA, 24 bp, Homo sapiens
ttaaatcttaaacaatgtataaag

SEQ ID NO: 3160282 - DNA, 12 bp, Homo sapiens
ttaaatgaaaga

SEQ ID NO: 3160283 - DNA, 13 bp, Homo sapiens
ttaaatgccttgt

SEQ ID NO: 3160284 - DNA, 18 bp, Homo sapiens
ttaaatgccttgtataaa

SEQ ID NO: 3160285 - DNA, 16 bp, Homo sapiens
ttaaatgcttcatttg

SEQ ID NO: 3160286 - DNA, 21 bp, Homo sapiens
ttaaatgggaatatttataaa

SEQ ID NO: 3160287 - DNA, 16 bp, Homo sapiens
ttaaatgtaaataatc

SEQ ID NO: 3160288 - DNA, 14 bp, Homo sapiens
ttaaatgtaactta

SEQ ID NO: 3160289 - DNA, 19 bp, Homo sapiens
ttaaatgtcttatatagca

SEQ ID NO: 3160290 - DNA, 23 bp, Homo sapiens
ttaaatgttctaacagatcagaa

SEQ ID NO: 3160291 - DNA, 17 bp, Homo sapiens
ttaaatgtttatactgt

SEQ ID NO: 3160292 - DNA, 11 bp, Homo sapiens
ttaaatgtttg

SEQ ID NO: 3160293 - DNA, 12 bp, Homo sapiens
ttaaatgtttga

SEQ ID NO: 3160294 - DNA, 14 bp, Homo sapiens
ttaaattaaagcaa

SEQ ID NO: 3160295 - DNA, 16 bp, Homo sapiens
ttaaattaatatcttt

SEQ ID NO: 3160296 - DNA, 22 bp, Homo sapiens
ttaaattaatatctttctgcac

SEQ ID NO: 3160297 - DNA, 16 bp, Homo sapiens
ttaaattacaatttta

SEQ ID NO: 3160298 - DNA, 15 bp, Homo sapiens
ttaaattagaaaata

SEQ ID NO: 3160299 - DNA, 18 bp, Homo sapiens
ttaaattatactgtagct

SEQ ID NO: 3160300 - DNA, 12 bp, Homo sapiens
ttaaattatata

SEQ ID NO: 3160301 - DNA, 17 bp, Homo sapiens
ttaaattctcaaagttt

SEQ ID NO: 3160302 - DNA, 18 bp, Homo sapiens
ttaaattctcaaagtttt

SEQ ID NO: 3160303 - DNA, 14 bp, Homo sapiens
ttaaattctgagac

SEQ ID NO: 3160304 - DNA, 16 bp, Homo sapiens
ttaaattgcttttgtt

SEQ ID NO: 3160305 - DNA, 19 bp, Homo sapiens
ttaaattgcttttgttgtg

SEQ ID NO: 3160306 - DNA, 16 bp, Homo sapiens
ttaaattgtgtacact

SEQ ID NO: 3160307 - DNA, 15 bp, Homo sapiens
ttaaattgtgtttta

SEQ ID NO: 3160308 - DNA, 15 bp, Homo sapiens
ttaaatttaatacca

SEQ ID NO: 3160309 - DNA, 11 bp, Homo sapiens
ttaacaaaagt

SEQ ID NO: 3160310 - DNA, 14 bp, Homo sapiens
ttaacaaactaaaa

SEQ ID NO: 3160311 - DNA, 18 bp, Homo sapiens
ttaacaaactaaaaatat

SEQ ID NO: 3160312 - DNA, 12 bp, Homo sapiens
ttaacaaatatg

SEQ ID NO: 3160313 - DNA, 18 bp, Homo sapiens
ttaacaaatatgctaatt

SEQ ID NO: 3160314 - DNA, 21 bp, Homo sapiens
ttaacaacaataacactgtct

SEQ ID NO: 3160315 - DNA, 14 bp, Homo sapiens
ttaacaagaacttt

SEQ ID NO: 3160316 - DNA, 18 bp, Homo sapiens
ttaacaataactactgtg

SEQ ID NO: 3160317 - DNA, 19 bp, Homo sapiens
ttaacaataactactgtgt

SEQ ID NO: 3160318 - DNA, 20 bp, Homo sapiens
ttaacaataactactgtgtt

SEQ ID NO: 3160319 - DNA, 17 bp, Homo sapiens
ttaacaatttattctga

SEQ ID NO: 3160320 - DNA, 22 bp, Homo sapiens
ttaacacattgttatttctgta

SEQ ID NO: 3160321 - DNA, 21 bp, Homo sapiens
ttaacactttgtattacttag

SEQ ID NO: 3160322 - DNA, 14 bp, Homo sapiens
ttaacagagacaga

SEQ ID NO: 3160323 - DNA, 16 bp, Homo sapiens
ttaacagttttccatg

SEQ ID NO: 3160324 - DNA, 17 bp, Homo sapiens
ttaacatatttactaag

SEQ ID NO: 3160325 - DNA, 16 bp, Homo sapiens
ttaacatgatttcaaa

SEQ ID NO: 3160326 - DNA, 19 bp, Homo sapiens
ttaacatgggctcttcact

SEQ ID NO: 3160327 - DNA, 17 bp, Homo sapiens
ttaacattaacatctat

SEQ ID NO: 3160328 - DNA, 15 bp, Homo sapiens
ttaacattcatagag

SEQ ID NO: 3160329 - DNA, 19 bp, Homo sapiens
ttaacattgaccaagaact

SEQ ID NO: 3160330 - DNA, 22 bp, Homo sapiens
ttaacattgaccaagaactgca

SEQ ID NO: 3160331 - DNA, 16 bp, Homo sapiens
ttaacattttgttctt

SEQ ID NO: 3160332 - DNA, 22 bp, Homo sapiens
ttaacattttgttcttacacat

SEQ ID NO: 3160333 - DNA, 15 bp, Homo sapiens
ttaaccattttaacc

SEQ ID NO: 3160334 - DNA, 13 bp, Homo sapiens
ttaacccaaggag

SEQ ID NO: 3160335 - DNA, 18 bp, Homo sapiens
ttaacccaaggagcacag

SEQ ID NO: 3160336 - DNA, 21 bp, Homo sapiens
ttaaccccgggatgcaaggta

SEQ ID NO: 3160337 - DNA, 21 bp, Homo sapiens
ttaaccccttggtactgaaaa

SEQ ID NO: 3160338 - DNA, 16 bp, Homo sapiens
ttaacctagatgttta

SEQ ID NO: 3160339 - DNA, 14 bp, Homo sapiens
ttaacctatttcca

SEQ ID NO: 3160340 - DNA, 19 bp, Homo sapiens
ttaacctcagtgtcattta

SEQ ID NO: 3160341 - DNA, 12 bp, Homo sapiens
ttaacctctgca

SEQ ID NO: 3160342 - DNA, 15 bp, Homo sapiens
ttaacctctgcacta

SEQ ID NO: 3160343 - DNA, 21 bp, Homo sapiens
ttaaccttactaattatacta

SEQ ID NO: 3160344 - DNA, 14 bp, Homo sapiens
ttaaccttgcctta

SEQ ID NO: 3160345 - DNA, 17 bp, Homo sapiens
ttaacctttccgctgtc

SEQ ID NO: 3160346 - DNA, 14 bp, Homo sapiens
ttaacgatgtccaa

SEQ ID NO: 3160347 - DNA, 18 bp, Homo sapiens
ttaacgatgtccaacccg

SEQ ID NO: 3160348 - DNA, 13 bp, Homo sapiens
ttaacgctgccta

SEQ ID NO: 3160349 - DNA, 17 bp, Homo sapiens
ttaacggctccaggatt

SEQ ID NO: 3160350 - DNA, 20 bp, Homo sapiens
ttaactaaattttaaagcca

SEQ ID NO: 3160351 - DNA, 20 bp, Homo sapiens
ttaactactatattgattgt

SEQ ID NO: 3160352 - DNA, 15 bp, Homo sapiens
ttaactagaatttat

SEQ ID NO: 3160353 - DNA, 21 bp, Homo sapiens
ttaactagaatttattcaatt

SEQ ID NO: 3160354 - DNA, 16 bp, Homo sapiens
ttaactatgacagata

SEQ ID NO: 3160355 - DNA, 21 bp, Homo sapiens
ttaactatgacagatatattt

SEQ ID NO: 3160356 - DNA, 21 bp, Homo sapiens
ttaactgaacaatggccctgt

SEQ ID NO: 3160357 - DNA, 13 bp, Homo sapiens
ttaactgacatgg

SEQ ID NO: 3160358 - DNA, 21 bp, Homo sapiens
ttaactgcagttgactttctc

SEQ ID NO: 3160359 - DNA, 19 bp, Homo sapiens
ttaactgccgtaatttaac

SEQ ID NO: 3160360 - DNA, 20 bp, Homo sapiens
ttaacttaacccagatttta

SEQ ID NO: 3160361 - DNA, 21 bp, Homo sapiens
ttaacttgaaaattttttaac

SEQ ID NO: 3160362 - DNA, 17 bp, Homo sapiens
ttaacttggtcagagcc

SEQ ID NO: 3160363 - DNA, 18 bp, Homo sapiens
ttaacttggtcagagcca

SEQ ID NO: 3160364 - DNA, 22 bp, Homo sapiens
ttaacttttccttgtatgttct

SEQ ID NO: 3160365 - DNA, 20 bp, Homo sapiens
ttaactttttatttctaaat

SEQ ID NO: 3160366 - DNA, 23 bp, Homo sapiens
ttaagaaaagcacttttgttatt

SEQ ID NO: 3160367 - DNA, 12 bp, Homo sapiens
ttaagaaacact

SEQ ID NO: 3160368 - DNA, 20 bp, Homo sapiens
ttaagaagccctgcagagca

SEQ ID NO: 3160369 - DNA, 22 bp, Homo sapiens
ttaagaagccctgcagagcaca

SEQ ID NO: 3160370 - DNA, 14 bp, Homo sapiens
ttaagaagctgttg

SEQ ID NO: 3160371 - DNA, 18 bp, Homo sapiens
ttaagaagctgttgtaca

SEQ ID NO: 3160372 - DNA, 20 bp, Homo sapiens
ttaagaagctgttgtacatt

SEQ ID NO: 3160373 - DNA, 12 bp, Homo sapiens
ttaagaaggcaa

SEQ ID NO: 3160374 - DNA, 20 bp, Homo sapiens
ttaagaatatctgtaatggt

SEQ ID NO: 3160375 - DNA, 16 bp, Homo sapiens
ttaagaatatgtttcc

SEQ ID NO: 3160376 - DNA, 22 bp, Homo sapiens
ttaagaatgttggtttactttc

SEQ ID NO: 3160377 - DNA, 10 bp, Homo sapiens
ttaagacaag

SEQ ID NO: 3160378 - DNA, 22 bp, Homo sapiens
ttaagacagtgtacaaaactgt

SEQ ID NO: 3160379 - DNA, 18 bp, Homo sapiens
ttaagacatgatttcctt

SEQ ID NO: 3160380 - DNA, 15 bp, Homo sapiens
ttaagacattttcat

SEQ ID NO: 3160381 - DNA, 13 bp, Homo sapiens
ttaagagaaatgg

SEQ ID NO: 3160382 - DNA, 11 bp, Homo sapiens
ttaagagactc

SEQ ID NO: 3160383 - DNA, 13 bp, Homo sapiens
ttaagagagaaat

SEQ ID NO: 3160384 - DNA, 13 bp, Homo sapiens
ttaagaggcaggg

SEQ ID NO: 3160385 - DNA, 15 bp, Homo sapiens
ttaagaggcagggtc

SEQ ID NO: 3160386 - DNA, 16 bp, Homo sapiens
ttaagagtgaaataat

SEQ ID NO: 3160387 - DNA, 22 bp, Homo sapiens
ttaagagtggcatataattttc

SEQ ID NO: 3160388 - DNA, 21 bp, Homo sapiens
ttaagagtgggggagagcagg

SEQ ID NO: 3160389 - DNA, 17 bp, Homo sapiens
ttaagataacttactgt

SEQ ID NO: 3160390 - DNA, 19 bp, Homo sapiens
ttaagataacttactgtat

SEQ ID NO: 3160391 - DNA, 15 bp, Homo sapiens
ttaagatacaaatta

SEQ ID NO: 3160392 - DNA, 11 bp, Homo sapiens
ttaagatatcc

SEQ ID NO: 3160393 - DNA, 18 bp, Homo sapiens
ttaagatggattctcaga

SEQ ID NO: 3160394 - DNA, 22 bp, Homo sapiens
ttaagatggattctcagatatt

SEQ ID NO: 3160395 - DNA, 23 bp, Homo sapiens
ttaagatggattctcagatattt

SEQ ID NO: 3160396 - DNA, 13 bp, Homo sapiens
ttaagatggcaat

SEQ ID NO: 3160397 - DNA, 15 bp, Homo sapiens
ttaagattttacaaa

SEQ ID NO: 3160398 - DNA, 15 bp, Homo sapiens
ttaagcagaagcatt

SEQ ID NO: 3160399 - DNA, 19 bp, Homo sapiens
ttaagcagcatggaaaaat

SEQ ID NO: 3160400 - DNA, 17 bp, Homo sapiens
ttaagcagctcttgcta

SEQ ID NO: 3160401 - DNA, 22 bp, Homo sapiens
ttaagcatatgtgttacttcaa

SEQ ID NO: 3160402 - DNA, 14 bp, Homo sapiens
ttaagcatttattt

SEQ ID NO: 3160403 - DNA, 20 bp, Homo sapiens
ttaagccaaagaaacaagct

SEQ ID NO: 3160404 - DNA, 19 bp, Homo sapiens
ttaagcctcatatttaaag

SEQ ID NO: 3160405 - DNA, 22 bp, Homo sapiens
ttaagcctcatatttaaagaca

SEQ ID NO: 3160406 - DNA, 16 bp, Homo sapiens
ttaagctatcagcaat

SEQ ID NO: 3160407 - DNA, 21 bp, Homo sapiens
ttaagctgtaaattacataag

SEQ ID NO: 3160408 - DNA, 16 bp, Homo sapiens
ttaaggaaactcttat

SEQ ID NO: 3160409 - DNA, 17 bp, Homo sapiens
ttaaggacttctgcagc

SEQ ID NO: 3160410 - DNA, 14 bp, Homo sapiens
ttaaggagcctaat

SEQ ID NO: 3160411 - DNA, 14 bp, Homo sapiens
ttaaggataaatca

SEQ ID NO: 3160412 - DNA, 22 bp, Homo sapiens
ttaaggataaatcataaagtca

SEQ ID NO: 3160413 - DNA, 20 bp, Homo sapiens
ttaaggcacagtgggagctg

SEQ ID NO: 3160414 - DNA, 18 bp, Homo sapiens
ttaagggaagaattccag

SEQ ID NO: 3160415 - DNA, 17 bp, Homo sapiens
ttaaggggaagaatgaa

SEQ ID NO: 3160416 - DNA, 15 bp, Homo sapiens
ttaagggggaaaact

SEQ ID NO: 3160417 - DNA, 14 bp, Homo sapiens
ttaaggtctccaaa

SEQ ID NO: 3160418 - DNA, 16 bp, Homo sapiens
ttaaggtctttcagta

SEQ ID NO: 3160419 - DNA, 18 bp, Homo sapiens
ttaaggtgatatatttaa

SEQ ID NO: 3160420 - DNA, 17 bp, Homo sapiens
ttaaggtgggtccagga

SEQ ID NO: 3160421 - DNA, 14 bp, Homo sapiens
ttaagtaagacttt

SEQ ID NO: 3160422 - DNA, 23 bp, Homo sapiens
ttaagtaagacttttattaataa

SEQ ID NO: 3160423 - DNA, 15 bp, Homo sapiens
ttaagtaatgtggaa

SEQ ID NO: 3160424 - DNA, 16 bp, Homo sapiens
ttaagtatttatatat

SEQ ID NO: 3160425 - DNA, 17 bp, Homo sapiens
ttaagtatttatatatt

SEQ ID NO: 3160426 - DNA, 22 bp, Homo sapiens
ttaagtcccagtatacctcatt

SEQ ID NO: 3160427 - DNA, 22 bp, Homo sapiens
ttaagtctgggatgtagaactt

SEQ ID NO: 3160428 - DNA, 18 bp, Homo sapiens
ttaagtgcgtgtgtagag

SEQ ID NO: 3160429 - DNA, 15 bp, Homo sapiens
ttaagtgtgcagcca

SEQ ID NO: 3160430 - DNA, 20 bp, Homo sapiens
ttaagttacaattacatctc

SEQ ID NO: 3160431 - DNA, 14 bp, Homo sapiens
ttaagttagagaat

SEQ ID NO: 3160432 - DNA, 20 bp, Homo sapiens
ttaagttcgaacatgtttca

SEQ ID NO: 3160433 - DNA, 18 bp, Homo sapiens
ttaagttgctgatgaact

SEQ ID NO: 3160434 - DNA, 12 bp, Homo sapiens
ttaagtttgttg

SEQ ID NO: 3160435 - DNA, 13 bp, Homo sapiens
ttaataaaaagac

SEQ ID NO: 3160436 - DNA, 12 bp, Homo sapiens
ttaataaagcat

SEQ ID NO: 3160437 - DNA, 14 bp, Homo sapiens
ttaataaagcattc

SEQ ID NO: 3160438 - DNA, 13 bp, Homo sapiens
ttaataatgtatt

SEQ ID NO: 3160439 - DNA, 23 bp, Homo sapiens
ttaataccagataccttatctta

SEQ ID NO: 3160440 - DNA, 21 bp, Homo sapiens
ttaatagatttaccctttata

SEQ ID NO: 3160441 - DNA, 23 bp, Homo sapiens
ttaatagatttaccctttataga

SEQ ID NO: 3160442 - DNA, 19 bp, Homo sapiens
ttaatagcaacagagcact

SEQ ID NO: 3160443 - DNA, 17 bp, Homo sapiens
ttaatagggaatatatc

SEQ ID NO: 3160444 - DNA, 23 bp, Homo sapiens
ttaatagtcatcacatttctatg

SEQ ID NO: 3160445 - DNA, 23 bp, Homo sapiens
ttaatataaagtagtcctgtgaa

SEQ ID NO: 3160446 - DNA, 21 bp, Homo sapiens
ttaatatatagtccagacact

SEQ ID NO: 3160447 - DNA, 20 bp, Homo sapiens
ttaatatatcccagaaatta

SEQ ID NO: 3160448 - DNA, 20 bp, Homo sapiens
ttaatatattaaaattccaa

SEQ ID NO: 3160449 - DNA, 16 bp, Homo sapiens
ttaatatattgaataa

SEQ ID NO: 3160450 - DNA, 21 bp, Homo sapiens
ttaatatctattccatttgta

SEQ ID NO: 3160451 - DNA, 14 bp, Homo sapiens
ttaatatctggcac

SEQ ID NO: 3160452 - DNA, 14 bp, Homo sapiens
ttaatatctttctg

SEQ ID NO: 3160453 - DNA, 16 bp, Homo sapiens
ttaatatctttctgca

SEQ ID NO: 3160454 - DNA, 22 bp, Homo sapiens
ttaatattactcagcacagaga

SEQ ID NO: 3160455 - DNA, 18 bp, Homo sapiens
ttaatattactgtcttta

SEQ ID NO: 3160456 - DNA, 19 bp, Homo sapiens
ttaatattactgtctttat

SEQ ID NO: 3160457 - DNA, 23 bp, Homo sapiens
ttaatattactgtctttattctt

SEQ ID NO: 3160458 - DNA, 22 bp, Homo sapiens
ttaatattgatatgcttataca

SEQ ID NO: 3160459 - DNA, 20 bp, Homo sapiens
ttaatattgatgtcagtatt

SEQ ID NO: 3160460 - DNA, 12 bp, Homo sapiens
ttaatatttaaa

SEQ ID NO: 3160461 - DNA, 12 bp, Homo sapiens
ttaatatttaac

SEQ ID NO: 3160462 - DNA, 17 bp, Homo sapiens
ttaatatttaacattat

SEQ ID NO: 3160463 - DNA, 13 bp, Homo sapiens
ttaatcaactgta

SEQ ID NO: 3160464 - DNA, 17 bp, Homo sapiens
ttaatcaccatgggaaa

SEQ ID NO: 3160465 - DNA, 20 bp, Homo sapiens
ttaatcacctctctgtagtt

SEQ ID NO: 3160466 - DNA, 22 bp, Homo sapiens
ttaatcagaatatcagaatatg

SEQ ID NO: 3160467 - DNA, 16 bp, Homo sapiens
ttaatcagacaaagta

SEQ ID NO: 3160468 - DNA, 13 bp, Homo sapiens
ttaatcatatttg

SEQ ID NO: 3160469 - DNA, 22 bp, Homo sapiens
ttaatcatatttgaaaaccata

SEQ ID NO: 3160470 - DNA, 15 bp, Homo sapiens
ttaatcatctataaa

SEQ ID NO: 3160471 - DNA, 18 bp, Homo sapiens
ttaatcatgaatatgatg

SEQ ID NO: 3160472 - DNA, 22 bp, Homo sapiens
ttaatcattttgcctcttttct

SEQ ID NO: 3160473 - DNA, 13 bp, Homo sapiens
ttaatcctgtacc

SEQ ID NO: 3160474 - DNA, 22 bp, Homo sapiens
ttaatcctttgttttctgacta

SEQ ID NO: 3160475 - DNA, 20 bp, Homo sapiens
ttaatctagacaatatacaa

SEQ ID NO: 3160476 - DNA, 22 bp, Homo sapiens
ttaatctctgttatgtactgta

SEQ ID NO: 3160477 - DNA, 16 bp, Homo sapiens
ttaatctgaaattcta

SEQ ID NO: 3160478 - DNA, 17 bp, Homo sapiens
ttaatctgaaattctaa

SEQ ID NO: 3160479 - DNA, 22 bp, Homo sapiens
ttaatctggtttatttttgttc

SEQ ID NO: 3160480 - DNA, 18 bp, Homo sapiens
ttaatctgtgtgtatatt

SEQ ID NO: 3160481 - DNA, 20 bp, Homo sapiens
ttaatcttcaaagccttctc

SEQ ID NO: 3160482 - DNA, 15 bp, Homo sapiens
ttaatcttcagtttt

SEQ ID NO: 3160483 - DNA, 17 bp, Homo sapiens
ttaatcttcagttttat

SEQ ID NO: 3160484 - DNA, 21 bp, Homo sapiens
ttaatctttctttacctgaga

SEQ ID NO: 3160485 - DNA, 16 bp, Homo sapiens
ttaatgaaaatgtcag

SEQ ID NO: 3160486 - DNA, 20 bp, Homo sapiens
ttaatgaaagactgtacaaa

SEQ ID NO: 3160487 - DNA, 21 bp, Homo sapiens
ttaatgaatattgatgttaac

SEQ ID NO: 3160488 - DNA, 15 bp, Homo sapiens
ttaatgacaacactt

SEQ ID NO: 3160489 - DNA, 15 bp, Homo sapiens
ttaatgacattcccc

SEQ ID NO: 3160490 - DNA, 16 bp, Homo sapiens
ttaatgactctttctg

SEQ ID NO: 3160491 - DNA, 19 bp, Homo sapiens
ttaatgactctttctgaag

SEQ ID NO: 3160492 - DNA, 19 bp, Homo sapiens
ttaatgcattaaacctgtc

SEQ ID NO: 3160493 - DNA, 20 bp, Homo sapiens
ttaatgcattaaacctgtct

SEQ ID NO: 3160494 - DNA, 18 bp, Homo sapiens
ttaatgcctgctttttgg

SEQ ID NO: 3160495 - DNA, 16 bp, Homo sapiens
ttaatgctatttgaac

SEQ ID NO: 3160496 - DNA, 20 bp, Homo sapiens
ttaatgctatttgaacaagt

SEQ ID NO: 3160497 - DNA, 13 bp, Homo sapiens
ttaatggatattt

SEQ ID NO: 3160498 - DNA, 21 bp, Homo sapiens
ttaatgggggtagcagctgga

SEQ ID NO: 3160499 - DNA, 20 bp, Homo sapiens
ttaatggtatcctactgagc

SEQ ID NO: 3160500 - DNA, 22 bp, Homo sapiens
ttaatggtctaaaaataaacca

SEQ ID NO: 3160501 - DNA, 14 bp, Homo sapiens
ttaatgtatataaa

SEQ ID NO: 3160502 - DNA, 15 bp, Homo sapiens
ttaatgtatgttacc

SEQ ID NO: 3160503 - DNA, 18 bp, Homo sapiens
ttaatgtatgttaccaaa

SEQ ID NO: 3160504 - DNA, 23 bp, Homo sapiens
ttaatgtatttgttcatgtttgg

SEQ ID NO: 3160505 - DNA, 17 bp, Homo sapiens
ttaatgtcacaggcagg

SEQ ID NO: 3160506 - DNA, 18 bp, Homo sapiens
ttaatgtcacaggcaggt

SEQ ID NO: 3160507 - DNA, 22 bp, Homo sapiens
ttaatgtcatggccttgaaaca

SEQ ID NO: 3160508 - DNA, 18 bp, Homo sapiens
ttaatgtctcctttgctc

SEQ ID NO: 3160509 - DNA, 13 bp, Homo sapiens
ttaatgtgaactt

SEQ ID NO: 3160510 - DNA, 12 bp, Homo sapiens
ttaatgtgaaga

SEQ ID NO: 3160511 - DNA, 18 bp, Homo sapiens
ttaatgtgaagacatttt

SEQ ID NO: 3160512 - DNA, 20 bp, Homo sapiens
ttaatgtgatggatggcaca

SEQ ID NO: 3160513 - DNA, 23 bp, Homo sapiens
ttaatgtgatggatggcacaatg

SEQ ID NO: 3160514 - DNA, 22 bp, Homo sapiens
ttaatgtgttgggaaaaaggcc

SEQ ID NO: 3160515 - DNA, 22 bp, Homo sapiens
ttaatgttctgaataatttctt

SEQ ID NO: 3160516 - DNA, 12 bp, Homo sapiens
ttaatgttttca

SEQ ID NO: 3160517 - DNA, 14 bp, Homo sapiens
ttaatgttttcaaa

SEQ ID NO: 3160518 - DNA, 13 bp, Homo sapiens
ttaatgttttcat

SEQ ID NO: 3160519 - DNA, 18 bp, Homo sapiens
ttaatgttttttgccaca

SEQ ID NO: 3160520 - DNA, 14 bp, Homo sapiens
ttaattaaatttca

SEQ ID NO: 3160521 - DNA, 22 bp, Homo sapiens
ttaattaagcaaagcacccatt

SEQ ID NO: 3160522 - DNA, 13 bp, Homo sapiens
ttaattacaccat

SEQ ID NO: 3160523 - DNA, 16 bp, Homo sapiens
ttaattacatacagat

SEQ ID NO: 3160524 - DNA, 19 bp, Homo sapiens
ttaattaggggttgctaag

SEQ ID NO: 3160525 - DNA, 20 bp, Homo sapiens
ttaattaggggttgctaaga

SEQ ID NO: 3160526 - DNA, 15 bp, Homo sapiens
ttaattatcttttct

SEQ ID NO: 3160527 - DNA, 16 bp, Homo sapiens
ttaattattaactaca

SEQ ID NO: 3160528 - DNA, 17 bp, Homo sapiens
ttaattattaactacat

SEQ ID NO: 3160529 - DNA, 14 bp, Homo sapiens
ttaattattatttg

SEQ ID NO: 3160530 - DNA, 21 bp, Homo sapiens
ttaattattatttgtgtttta

SEQ ID NO: 3160531 - DNA, 21 bp, Homo sapiens
ttaattcacagaatagcacaa

SEQ ID NO: 3160532 - DNA, 17 bp, Homo sapiens
ttaattcacctatgtta

SEQ ID NO: 3160533 - DNA, 19 bp, Homo sapiens
ttaattcacctatgttatt

SEQ ID NO: 3160534 - DNA, 16 bp, Homo sapiens
ttaattcctttctcat

SEQ ID NO: 3160535 - DNA, 17 bp, Homo sapiens
ttaattcttattttaga

SEQ ID NO: 3160536 - DNA, 15 bp, Homo sapiens
ttaattcttcacctt

SEQ ID NO: 3160537 - DNA, 22 bp, Homo sapiens
ttaattgtagttctgtgtactt

SEQ ID NO: 3160538 - DNA, 19 bp, Homo sapiens
ttaattgttgtttctttct

SEQ ID NO: 3160539 - DNA, 15 bp, Homo sapiens
ttaatttaacaaact

SEQ ID NO: 3160540 - DNA, 19 bp, Homo sapiens
ttaatttattattgaaatt

SEQ ID NO: 3160541 - DNA, 15 bp, Homo sapiens
ttaatttatttagtt

SEQ ID NO: 3160542 - DNA, 15 bp, Homo sapiens
ttaatttcttcaaaa

SEQ ID NO: 3160543 - DNA, 21 bp, Homo sapiens
ttaatttcttcaaaatgtata

SEQ ID NO: 3160544 - DNA, 20 bp, Homo sapiens
ttaatttgaaaccaggacat

SEQ ID NO: 3160545 - DNA, 14 bp, Homo sapiens
ttaatttgattaac

SEQ ID NO: 3160546 - DNA, 22 bp, Homo sapiens
ttaatttggagcacaaaattca

SEQ ID NO: 3160547 - DNA, 19 bp, Homo sapiens
ttaattttaaagtgcaaaa

SEQ ID NO: 3160548 - DNA, 13 bp, Homo sapiens
ttaattttaccaa

SEQ ID NO: 3160549 - DNA, 17 bp, Homo sapiens
ttaattttcctcatttt

SEQ ID NO: 3160550 - DNA, 20 bp, Homo sapiens
ttaattttcctggaaagact

SEQ ID NO: 3160551 - DNA, 20 bp, Homo sapiens
ttaattttgaagtgctgttt

SEQ ID NO: 3160552 - DNA, 23 bp, Homo sapiens
ttaattttgaagtgctgtttatt

SEQ ID NO: 3160553 - DNA, 19 bp, Homo sapiens
ttaattttgatatacattg

SEQ ID NO: 3160554 - DNA, 14 bp, Homo sapiens
ttaattttgtcttt

SEQ ID NO: 3160555 - DNA, 15 bp, Homo sapiens
ttaattttgtgcatt

SEQ ID NO: 3160556 - DNA, 20 bp, Homo sapiens
ttaattttgtgttgctaaaa

SEQ ID NO: 3160557 - DNA, 13 bp, Homo sapiens
ttaatttttccaa

SEQ ID NO: 3160558 - DNA, 18 bp, Homo sapiens
ttaatttttccaactact

SEQ ID NO: 3160559 - DNA, 15 bp, Homo sapiens
ttaatttttgctttt

SEQ ID NO: 3160560 - DNA, 20 bp, Homo sapiens
ttacaaaactacatgagaac

SEQ ID NO: 3160561 - DNA, 17 bp, Homo sapiens
ttacaaaatccaactct

SEQ ID NO: 3160562 - DNA, 13 bp, Homo sapiens
ttacaaactgcaa

SEQ ID NO: 3160563 - DNA, 14 bp, Homo sapiens
ttacaaactgcaat

SEQ ID NO: 3160564 - DNA, 22 bp, Homo sapiens
ttacaaactgcaatagagactg

SEQ ID NO: 3160565 - DNA, 16 bp, Homo sapiens
ttacaacatttttgca

SEQ ID NO: 3160566 - DNA, 16 bp, Homo sapiens
ttacaaccaagaacat

SEQ ID NO: 3160567 - DNA, 22 bp, Homo sapiens
ttacaactgcctcgaaacacag

SEQ ID NO: 3160568 - DNA, 23 bp, Homo sapiens
ttacaactgcctcgaaacacaga

SEQ ID NO: 3160569 - DNA, 18 bp, Homo sapiens
ttacaagaagtttattct

SEQ ID NO: 3160570 - DNA, 13 bp, Homo sapiens
ttacaagatccat

SEQ ID NO: 3160571 - DNA, 17 bp, Homo sapiens
ttacaagtatacttata

SEQ ID NO: 3160572 - DNA, 21 bp, Homo sapiens
ttacaatattgattgggaaaa

SEQ ID NO: 3160573 - DNA, 17 bp, Homo sapiens
ttacaattgcactgctg

SEQ ID NO: 3160574 - DNA, 19 bp, Homo sapiens
ttacaatttttaataaatt

SEQ ID NO: 3160575 - DNA, 14 bp, Homo sapiens
ttacacattaagta

SEQ ID NO: 3160576 - DNA, 16 bp, Homo sapiens
ttacaccaactcctaa

SEQ ID NO: 3160577 - DNA, 18 bp, Homo sapiens
ttacaccacactttcaaa

SEQ ID NO: 3160578 - DNA, 17 bp, Homo sapiens
ttacactgattggtgtt

SEQ ID NO: 3160579 - DNA, 14 bp, Homo sapiens
ttacactgtatttg

SEQ ID NO: 3160580 - DNA, 18 bp, Homo sapiens
ttacactgtgccttttcc

SEQ ID NO: 3160581 - DNA, 21 bp, Homo sapiens
ttacactgtgccttttcccca

SEQ ID NO: 3160582 - DNA, 13 bp, Homo sapiens
ttacactgttaga

SEQ ID NO: 3160583 - DNA, 18 bp, Homo sapiens
ttacacttcatatagcat

SEQ ID NO: 3160584 - DNA, 22 bp, Homo sapiens
ttacagaaaataccacctcgag

SEQ ID NO: 3160585 - DNA, 14 bp, Homo sapiens
ttacagaaactgat

SEQ ID NO: 3160586 - DNA, 18 bp, Homo sapiens
ttacagaaactgatgcca

SEQ ID NO: 3160587 - DNA, 16 bp, Homo sapiens
ttacagaaatactata

SEQ ID NO: 3160588 - DNA, 19 bp, Homo sapiens
ttacagaaatggactggag

SEQ ID NO: 3160589 - DNA, 14 bp, Homo sapiens
ttacagacagaaga

SEQ ID NO: 3160590 - DNA, 17 bp, Homo sapiens
ttacagagaggagaaac

SEQ ID NO: 3160591 - DNA, 16 bp, Homo sapiens
ttacagatgtgaaaat

SEQ ID NO: 3160592 - DNA, 16 bp, Homo sapiens
ttacagatttaataca

SEQ ID NO: 3160593 - DNA, 19 bp, Homo sapiens
ttacagcttttatggatga

SEQ ID NO: 3160594 - DNA, 22 bp, Homo sapiens
ttacaggaaaaaaaattctgtt

SEQ ID NO: 3160595 - DNA, 15 bp, Homo sapiens
ttacaggaacttcat

SEQ ID NO: 3160596 - DNA, 16 bp, Homo sapiens
ttacaggaatgaagaa

SEQ ID NO: 3160597 - DNA, 18 bp, Homo sapiens
ttacaggagggaacattt

SEQ ID NO: 3160598 - DNA, 20 bp, Homo sapiens
ttacaggagggaacatttcc

SEQ ID NO: 3160599 - DNA, 22 bp, Homo sapiens
ttacaggccctgctcctgcagc

SEQ ID NO: 3160600 - DNA, 14 bp, Homo sapiens
ttacagggagcctc

SEQ ID NO: 3160601 - DNA, 17 bp, Homo sapiens
ttacagggagcctcctg

SEQ ID NO: 3160602 - DNA, 19 bp, Homo sapiens
ttacagggagcctcctgcc

SEQ ID NO: 3160603 - DNA, 20 bp, Homo sapiens
ttacagggagcctcctgccc

SEQ ID NO: 3160604 - DNA, 17 bp, Homo sapiens
ttacagggtgactcaca

SEQ ID NO: 3160605 - DNA, 15 bp, Homo sapiens
ttacaggtttgaatt

SEQ ID NO: 3160606 - DNA, 22 bp, Homo sapiens
ttacagtcattggaataaggca

SEQ ID NO: 3160607 - DNA, 16 bp, Homo sapiens
ttacagtccttcaaaa

SEQ ID NO: 3160608 - DNA, 17 bp, Homo sapiens
ttacagtccttcaaaat

SEQ ID NO: 3160609 - DNA, 19 bp, Homo sapiens
ttacagtgaccttttcttc

SEQ ID NO: 3160610 - DNA, 21 bp, Homo sapiens
ttacagtgaccttttcttcat

SEQ ID NO: 3160611 - DNA, 21 bp, Homo sapiens
ttacagttagggttttgcaat

SEQ ID NO: 3160612 - DNA, 12 bp, Homo sapiens
ttacagttctgt

SEQ ID NO: 3160613 - DNA, 13 bp, Homo sapiens
ttacagttctgtg

SEQ ID NO: 3160614 - DNA, 20 bp, Homo sapiens
ttacataagataaatgtgct

SEQ ID NO: 3160615 - DNA, 16 bp, Homo sapiens
ttacatactttatcaa

SEQ ID NO: 3160616 - DNA, 24 bp, Homo sapiens
ttacatactttatcaatgtgtctt

SEQ ID NO: 3160617 - DNA, 17 bp, Homo sapiens
ttacatacttttgcaaa

SEQ ID NO: 3160618 - DNA, 13 bp, Homo sapiens
ttacatccagagt

SEQ ID NO: 3160619 - DNA, 13 bp, Homo sapiens
ttacatccttaaa

SEQ ID NO: 3160620 - DNA, 12 bp, Homo sapiens
ttacatgaagct

SEQ ID NO: 3160621 - DNA, 23 bp, Homo sapiens
ttacatgcaatttattaaaatga

SEQ ID NO: 3160622 - DNA, 13 bp, Homo sapiens
ttacatgcatttg

SEQ ID NO: 3160623 - DNA, 15 bp, Homo sapiens
ttacatgtaatttga

SEQ ID NO: 3160624 - DNA, 12 bp, Homo sapiens
ttacatgtgatg

SEQ ID NO: 3160625 - DNA, 16 bp, Homo sapiens
ttacattaatgttaat

SEQ ID NO: 3160626 - DNA, 12 bp, Homo sapiens
ttacattgtaaa

SEQ ID NO: 3160627 - DNA, 13 bp, Homo sapiens
ttacattgttcaa

SEQ ID NO: 3160628 - DNA, 17 bp, Homo sapiens
ttacatttaaacctttt

SEQ ID NO: 3160629 - DNA, 10 bp, Homo sapiens
ttacatttca

SEQ ID NO: 3160630 - DNA, 20 bp, Homo sapiens
ttacatttgatgcatgtctt

SEQ ID NO: 3160631 - DNA, 13 bp, Homo sapiens
ttacatttttaca

SEQ ID NO: 3160632 - DNA, 15 bp, Homo sapiens
ttacatttttacaat

SEQ ID NO: 3160633 - DNA, 17 bp, Homo sapiens
ttacatttttacaataa

SEQ ID NO: 3160634 - DNA, 19 bp, Homo sapiens
ttaccaaaggtttttaaag

SEQ ID NO: 3160635 - DNA, 18 bp, Homo sapiens
ttaccaaatacacatttc

SEQ ID NO: 3160636 - DNA, 16 bp, Homo sapiens
ttaccaagagtaactt

SEQ ID NO: 3160637 - DNA, 23 bp, Homo sapiens
ttaccactctaccaaataatttc

SEQ ID NO: 3160638 - DNA, 17 bp, Homo sapiens
ttaccagaagcttccat

SEQ ID NO: 3160639 - DNA, 17 bp, Homo sapiens
ttaccagacaaaaaaat

SEQ ID NO: 3160640 - DNA, 14 bp, Homo sapiens
ttaccagatgctac

SEQ ID NO: 3160641 - DNA, 20 bp, Homo sapiens
ttaccagatgctactggact

SEQ ID NO: 3160642 - DNA, 22 bp, Homo sapiens
ttaccagcaagaataaaaaaga

SEQ ID NO: 3160643 - DNA, 17 bp, Homo sapiens
ttaccaggtgagaagtg

SEQ ID NO: 3160644 - DNA, 14 bp, Homo sapiens
ttaccagttgcctt

SEQ ID NO: 3160645 - DNA, 19 bp, Homo sapiens
ttaccagttgccttttatc

SEQ ID NO: 3160646 - DNA, 20 bp, Homo sapiens
ttaccatgagaagagggcct

SEQ ID NO: 3160647 - DNA, 17 bp, Homo sapiens
ttaccattagcataatt

SEQ ID NO: 3160648 - DNA, 15 bp, Homo sapiens
ttaccattcacaata

SEQ ID NO: 3160649 - DNA, 13 bp, Homo sapiens
ttaccatttgtaa

SEQ ID NO: 3160650 - DNA, 14 bp, Homo sapiens
ttaccatttgtaat

SEQ ID NO: 3160651 - DNA, 15 bp, Homo sapiens
ttaccatttgtaata

SEQ ID NO: 3160652 - DNA, 23 bp, Homo sapiens
ttaccatttgtaataaagtatat

SEQ ID NO: 3160653 - DNA, 20 bp, Homo sapiens
ttaccattttaacgctgcct

SEQ ID NO: 3160654 - DNA, 11 bp, Homo sapiens
ttacccaaagc

SEQ ID NO: 3160655 - DNA, 14 bp, Homo sapiens
ttacccaaagcaca

SEQ ID NO: 3160656 - DNA, 15 bp, Homo sapiens
ttacccaaagcacat

SEQ ID NO: 3160657 - DNA, 16 bp, Homo sapiens
ttacccacctagaaca

SEQ ID NO: 3160658 - DNA, 21 bp, Homo sapiens
ttacccagagaatatatacat

SEQ ID NO: 3160659 - DNA, 14 bp, Homo sapiens
ttaccccttagcct

SEQ ID NO: 3160660 - DNA, 16 bp, Homo sapiens
ttaccctcctgtaaat

SEQ ID NO: 3160661 - DNA, 17 bp, Homo sapiens
ttaccgttgcttgaaat

SEQ ID NO: 3160662 - DNA, 21 bp, Homo sapiens
ttacctaaacagatataaatg

SEQ ID NO: 3160663 - DNA, 20 bp, Homo sapiens
ttacctaagtgacatttgta

SEQ ID NO: 3160664 - DNA, 17 bp, Homo sapiens
ttacctaccacagtgtc

SEQ ID NO: 3160665 - DNA, 15 bp, Homo sapiens
ttacctagcatttca

SEQ ID NO: 3160666 - DNA, 18 bp, Homo sapiens
ttacctccaacagaacta

SEQ ID NO: 3160667 - DNA, 19 bp, Homo sapiens
ttacctccaacagaactaa

SEQ ID NO: 3160668 - DNA, 18 bp, Homo sapiens
ttacctgacctcttgctg

SEQ ID NO: 3160669 - DNA, 19 bp, Homo sapiens
ttacctgacctcttgctgt

SEQ ID NO: 3160670 - DNA, 20 bp, Homo sapiens
ttacctgacctcttgctgtc

SEQ ID NO: 3160671 - DNA, 21 bp, Homo sapiens
ttacctgacctcttgctgtct

SEQ ID NO: 3160672 - DNA, 18 bp, Homo sapiens
ttacctgccaattgctac

SEQ ID NO: 3160673 - DNA, 20 bp, Homo sapiens
ttacctgccaattgctaccg

SEQ ID NO: 3160674 - DNA, 15 bp, Homo sapiens
ttaccttaagatttt

SEQ ID NO: 3160675 - DNA, 17 bp, Homo sapiens
ttaccttattggatatt

SEQ ID NO: 3160676 - DNA, 19 bp, Homo sapiens
ttaccttggccgtgaggac

SEQ ID NO: 3160677 - DNA, 19 bp, Homo sapiens
ttacctttatctttcacct

SEQ ID NO: 3160678 - DNA, 20 bp, Homo sapiens
ttacctttatctttcacctt

SEQ ID NO: 3160679 - DNA, 19 bp, Homo sapiens
ttaccttttttttttcttg

SEQ ID NO: 3160680 - DNA, 22 bp, Homo sapiens
ttacggactctggatatttgca

SEQ ID NO: 3160681 - DNA, 14 bp, Homo sapiens
ttacgtagtaaaag

SEQ ID NO: 3160682 - DNA, 22 bp, Homo sapiens
ttacgtatgcaagtctgtgagt

SEQ ID NO: 3160683 - DNA, 17 bp, Homo sapiens
ttactaaaaaaaagatg

SEQ ID NO: 3160684 - DNA, 22 bp, Homo sapiens
ttactaaacatatgatttcact

SEQ ID NO: 3160685 - DNA, 13 bp, Homo sapiens
ttactaaacattt

SEQ ID NO: 3160686 - DNA, 21 bp, Homo sapiens
ttactaaacattttgttattg

SEQ ID NO: 3160687 - DNA, 15 bp, Homo sapiens
ttactaaattgtata

SEQ ID NO: 3160688 - DNA, 22 bp, Homo sapiens
ttactaagccacaagaaatttg

SEQ ID NO: 3160689 - DNA, 20 bp, Homo sapiens
ttactacaaaatttgaaatt

SEQ ID NO: 3160690 - DNA, 18 bp, Homo sapiens
ttactacagccttaatat

SEQ ID NO: 3160691 - DNA, 15 bp, Homo sapiens
ttactacagttgttt

SEQ ID NO: 3160692 - DNA, 16 bp, Homo sapiens
ttactaggtaacttca

SEQ ID NO: 3160693 - DNA, 19 bp, Homo sapiens
ttactaggtaacttcatat

SEQ ID NO: 3160694 - DNA, 14 bp, Homo sapiens
ttactatatatata

SEQ ID NO: 3160695 - DNA, 14 bp, Homo sapiens
ttactattaagcag

SEQ ID NO: 3160696 - DNA, 23 bp, Homo sapiens
ttactattaagcagtaaaaactg

SEQ ID NO: 3160697 - DNA, 19 bp, Homo sapiens
ttactattcattaaatgtt

SEQ ID NO: 3160698 - DNA, 21 bp, Homo sapiens
ttactattcattaaatgtttg

SEQ ID NO: 3160699 - DNA, 19 bp, Homo sapiens
ttactcagggctcctccca

SEQ ID NO: 3160700 - DNA, 12 bp, Homo sapiens
ttactcagtgtt

SEQ ID NO: 3160701 - DNA, 18 bp, Homo sapiens
ttactcattactgcaaat

SEQ ID NO: 3160702 - DNA, 18 bp, Homo sapiens
ttactcattgaaatgtca

SEQ ID NO: 3160703 - DNA, 16 bp, Homo sapiens
ttactcattgccccca

SEQ ID NO: 3160704 - DNA, 22 bp, Homo sapiens
ttactcattgcccccacctctg

SEQ ID NO: 3160705 - DNA, 22 bp, Homo sapiens
ttactcccctaagtctttactc

SEQ ID NO: 3160706 - DNA, 19 bp, Homo sapiens
ttactccctacactgatgc

SEQ ID NO: 3160707 - DNA, 21 bp, Homo sapiens
ttactccctacactgatgcaa

SEQ ID NO: 3160708 - DNA, 19 bp, Homo sapiens
ttactcccttcctggcctc

SEQ ID NO: 3160709 - DNA, 14 bp, Homo sapiens
ttactctaagatct

SEQ ID NO: 3160710 - DNA, 21 bp, Homo sapiens
ttactctaagatcttagattc

SEQ ID NO: 3160711 - DNA, 19 bp, Homo sapiens
ttactctcaaaatctttgt

SEQ ID NO: 3160712 - DNA, 12 bp, Homo sapiens
ttactgaccagc

SEQ ID NO: 3160713 - DNA, 14 bp, Homo sapiens
ttactgatatattt

SEQ ID NO: 3160714 - DNA, 15 bp, Homo sapiens
ttactgatcatgcat

SEQ ID NO: 3160715 - DNA, 17 bp, Homo sapiens
ttactgatcatgcattg

SEQ ID NO: 3160716 - DNA, 21 bp, Homo sapiens
ttactgcaaattgattgtctt

SEQ ID NO: 3160717 - DNA, 23 bp, Homo sapiens
ttactgcctataatcttatacaa

SEQ ID NO: 3160718 - DNA, 17 bp, Homo sapiens
ttactggacctgaaatt

SEQ ID NO: 3160719 - DNA, 18 bp, Homo sapiens
ttactggcctttttcatt

SEQ ID NO: 3160720 - DNA, 20 bp, Homo sapiens
ttactggcctttttcattta

SEQ ID NO: 3160721 - DNA, 14 bp, Homo sapiens
ttactggtccaaaa

SEQ ID NO: 3160722 - DNA, 12 bp, Homo sapiens
ttactgtaatat

SEQ ID NO: 3160723 - DNA, 15 bp, Homo sapiens
ttactgtaattcctc

SEQ ID NO: 3160724 - DNA, 13 bp, Homo sapiens
ttactgtacctgt

SEQ ID NO: 3160725 - DNA, 15 bp, Homo sapiens
ttactgtcaataaac

SEQ ID NO: 3160726 - DNA, 17 bp, Homo sapiens
ttactgtcaataaacag

SEQ ID NO: 3160727 - DNA, 16 bp, Homo sapiens
ttactgtcagattaaa

SEQ ID NO: 3160728 - DNA, 17 bp, Homo sapiens
ttactgtcagattaaat

SEQ ID NO: 3160729 - DNA, 22 bp, Homo sapiens
ttactgtctggttttaacaatt

SEQ ID NO: 3160730 - DNA, 17 bp, Homo sapiens
ttactgtggaggaagga

SEQ ID NO: 3160731 - DNA, 23 bp, Homo sapiens
ttactgtggaggaaggattgtaa

SEQ ID NO: 3160732 - DNA, 12 bp, Homo sapiens
ttactgtgtaaa

SEQ ID NO: 3160733 - DNA, 18 bp, Homo sapiens
ttactgtgtttcagcatg

SEQ ID NO: 3160734 - DNA, 15 bp, Homo sapiens
ttactgttaaccatt

SEQ ID NO: 3160735 - DNA, 14 bp, Homo sapiens
ttactgttcttgct

SEQ ID NO: 3160736 - DNA, 17 bp, Homo sapiens
ttactgttcttgctgct

SEQ ID NO: 3160737 - DNA, 21 bp, Homo sapiens
ttactgttcttgctgctagaa

SEQ ID NO: 3160738 - DNA, 15 bp, Homo sapiens
ttactgttgcattta

SEQ ID NO: 3160739 - DNA, 16 bp, Homo sapiens
ttactgttgcatttac

SEQ ID NO: 3160740 - DNA, 20 bp, Homo sapiens
ttactgttgcatttactttt

SEQ ID NO: 3160741 - DNA, 17 bp, Homo sapiens
ttactgttttaattgta

SEQ ID NO: 3160742 - DNA, 16 bp, Homo sapiens
ttacttaatcaaaact

SEQ ID NO: 3160743 - DNA, 14 bp, Homo sapiens
ttacttacaaaaat

SEQ ID NO: 3160744 - DNA, 13 bp, Homo sapiens
ttacttacctaaa

SEQ ID NO: 3160745 - DNA, 19 bp, Homo sapiens
ttacttaggttattttgct

SEQ ID NO: 3160746 - DNA, 18 bp, Homo sapiens
ttacttccagcaagcaaa

SEQ ID NO: 3160747 - DNA, 11 bp, Homo sapiens
ttacttctgct

SEQ ID NO: 3160748 - DNA, 23 bp, Homo sapiens
ttacttgctttcaattgacaaat

SEQ ID NO: 3160749 - DNA, 14 bp, Homo sapiens
ttacttgtaaattg

SEQ ID NO: 3160750 - DNA, 14 bp, Homo sapiens
ttacttgtggtgtg

SEQ ID NO: 3160751 - DNA, 20 bp, Homo sapiens
ttacttgtggtgtgaccatg

SEQ ID NO: 3160752 - DNA, 16 bp, Homo sapiens
ttactttatcactttt

SEQ ID NO: 3160753 - DNA, 16 bp, Homo sapiens
ttactttctctgtagt

SEQ ID NO: 3160754 - DNA, 19 bp, Homo sapiens
ttactttctttcagatgtt

SEQ ID NO: 3160755 - DNA, 19 bp, Homo sapiens
ttactttggcaatttcctg

SEQ ID NO: 3160756 - DNA, 14 bp, Homo sapiens
ttacttttaaactg

SEQ ID NO: 3160757 - DNA, 16 bp, Homo sapiens
ttacttttaaactgtg

SEQ ID NO: 3160758 - DNA, 23 bp, Homo sapiens
ttacttttaccactatttaagtt

SEQ ID NO: 3160759 - DNA, 21 bp, Homo sapiens
ttacttttatttgcaacattt

SEQ ID NO: 3160760 - DNA, 23 bp, Homo sapiens
ttacttttatttgcaacatttac

SEQ ID NO: 3160761 - DNA, 20 bp, Homo sapiens
ttacttttgttctgtatttt

SEQ ID NO: 3160762 - DNA, 17 bp, Homo sapiens
ttacttttttacactga

SEQ ID NO: 3160763 - DNA, 16 bp, Homo sapiens
ttagaaaaaaattact

SEQ ID NO: 3160764 - DNA, 17 bp, Homo sapiens
ttagaaaaattcctaag

SEQ ID NO: 3160765 - DNA, 14 bp, Homo sapiens
ttagaaaatgactt

SEQ ID NO: 3160766 - DNA, 20 bp, Homo sapiens
ttagaaaatgacttatttct

SEQ ID NO: 3160767 - DNA, 21 bp, Homo sapiens
ttagaaaatgacttatttctg

SEQ ID NO: 3160768 - DNA, 12 bp, Homo sapiens
ttagaaaatgtg

SEQ ID NO: 3160769 - DNA, 21 bp, Homo sapiens
ttagaaagtagccacgtatgg

SEQ ID NO: 3160770 - DNA, 11 bp, Homo sapiens
ttagaaatatt

SEQ ID NO: 3160771 - DNA, 17 bp, Homo sapiens
ttagaaatgaccaatat

SEQ ID NO: 3160772 - DNA, 18 bp, Homo sapiens
ttagaaatgaccaatatt

SEQ ID NO: 3160773 - DNA, 14 bp, Homo sapiens
ttagaacactattt

SEQ ID NO: 3160774 - DNA, 17 bp, Homo sapiens
ttagaacactattttca

SEQ ID NO: 3160775 - DNA, 18 bp, Homo sapiens
ttagaacattttaattca

SEQ ID NO: 3160776 - DNA, 22 bp, Homo sapiens
ttagaaccagccgtattttaca

SEQ ID NO: 3160777 - DNA, 13 bp, Homo sapiens
ttagaacctttct

SEQ ID NO: 3160778 - DNA, 22 bp, Homo sapiens
ttagaagctaatgtaggactgt

SEQ ID NO: 3160779 - DNA, 19 bp, Homo sapiens
ttagaaggaggttctaata

SEQ ID NO: 3160780 - DNA, 19 bp, Homo sapiens
ttagaaggcttaagaactg

SEQ ID NO: 3160781 - DNA, 15 bp, Homo sapiens
ttagaataatttcat

SEQ ID NO: 3160782 - DNA, 13 bp, Homo sapiens
ttagaattaaaaa

SEQ ID NO: 3160783 - DNA, 17 bp, Homo sapiens
ttagaattaaaaaagca

SEQ ID NO: 3160784 - DNA, 16 bp, Homo sapiens
ttagaattctaattgt

SEQ ID NO: 3160785 - DNA, 14 bp, Homo sapiens
ttagacaactagat

SEQ ID NO: 3160786 - DNA, 15 bp, Homo sapiens
ttagacaactagatt

SEQ ID NO: 3160787 - DNA, 17 bp, Homo sapiens
ttagacaccttcatttt

SEQ ID NO: 3160788 - DNA, 13 bp, Homo sapiens
ttagacataacaa

SEQ ID NO: 3160789 - DNA, 13 bp, Homo sapiens
ttagaccaaggaa

SEQ ID NO: 3160790 - DNA, 16 bp, Homo sapiens
ttagaccgctctcttt

SEQ ID NO: 3160791 - DNA, 18 bp, Homo sapiens
ttagaccgctctcttttc

SEQ ID NO: 3160792 - DNA, 16 bp, Homo sapiens
ttagacctgtgttact

SEQ ID NO: 3160793 - DNA, 14 bp, Homo sapiens
ttagactacattta

SEQ ID NO: 3160794 - DNA, 18 bp, Homo sapiens
ttagactacatttagaga

SEQ ID NO: 3160795 - DNA, 21 bp, Homo sapiens
ttagacttctaaataaggtgt

SEQ ID NO: 3160796 - DNA, 16 bp, Homo sapiens
ttagagaatatatttt

SEQ ID NO: 3160797 - DNA, 15 bp, Homo sapiens
ttagagagaaagaga

SEQ ID NO: 3160798 - DNA, 12 bp, Homo sapiens
ttagagagagga

SEQ ID NO: 3160799 - DNA, 18 bp, Homo sapiens
ttagaggaaaaaaatgac

SEQ ID NO: 3160800 - DNA, 20 bp, Homo sapiens
ttagaggcattgttagttta

SEQ ID NO: 3160801 - DNA, 13 bp, Homo sapiens
ttagagtaaataa

SEQ ID NO: 3160802 - DNA, 20 bp, Homo sapiens
ttagagtatacctcctatat

SEQ ID NO: 3160803 - DNA, 22 bp, Homo sapiens
ttagagttttttttttctttca

SEQ ID NO: 3160804 - DNA, 20 bp, Homo sapiens
ttagatattgctactataat

SEQ ID NO: 3160805 - DNA, 19 bp, Homo sapiens
ttagatgctgaatatctgt

SEQ ID NO: 3160806 - DNA, 22 bp, Homo sapiens
ttagattctctgtgtctaagat

SEQ ID NO: 3160807 - DNA, 22 bp, Homo sapiens
ttagatttcatagttcagaatt

SEQ ID NO: 3160808 - DNA, 22 bp, Homo sapiens
ttagcaaagcaaaaggctgaga

SEQ ID NO: 3160809 - DNA, 18 bp, Homo sapiens
ttagcaaggtcatttctt

SEQ ID NO: 3160810 - DNA, 19 bp, Homo sapiens
ttagcaataaataacactt

SEQ ID NO: 3160811 - DNA, 20 bp, Homo sapiens
ttagcaataaataacacttg

SEQ ID NO: 3160812 - DNA, 19 bp, Homo sapiens
ttagcacagattttaattg

SEQ ID NO: 3160813 - DNA, 15 bp, Homo sapiens
ttagcagcttccaga

SEQ ID NO: 3160814 - DNA, 22 bp, Homo sapiens
ttagcagtcgcgagcacatgtt

SEQ ID NO: 3160815 - DNA, 16 bp, Homo sapiens
ttagcagtttgctttg

SEQ ID NO: 3160816 - DNA, 17 bp, Homo sapiens
ttagcatgtgttgaaaa

SEQ ID NO: 3160817 - DNA, 18 bp, Homo sapiens
ttagcattttaattctct

SEQ ID NO: 3160818 - DNA, 20 bp, Homo sapiens
ttagccaactgtttccctgc

SEQ ID NO: 3160819 - DNA, 23 bp, Homo sapiens
ttagccaactgtttccctgctga

SEQ ID NO: 3160820 - DNA, 17 bp, Homo sapiens
ttagccagatttgtctt

SEQ ID NO: 3160821 - DNA, 17 bp, Homo sapiens
ttagccaggatcatggt

SEQ ID NO: 3160822 - DNA, 21 bp, Homo sapiens
ttagccagttcaaagtgtata

SEQ ID NO: 3160823 - DNA, 22 bp, Homo sapiens
ttagccagttcaaagtgtatat

SEQ ID NO: 3160824 - DNA, 13 bp, Homo sapiens
ttagcccaagagg

SEQ ID NO: 3160825 - DNA, 14 bp, Homo sapiens
ttagccctgtctgc

SEQ ID NO: 3160826 - DNA, 13 bp, Homo sapiens
ttagccgggcgtg

SEQ ID NO: 3160827 - DNA, 22 bp, Homo sapiens
ttagcctgtggcagtaaagaga

SEQ ID NO: 3160828 - DNA, 16 bp, Homo sapiens
ttagctccctcccgca

SEQ ID NO: 3160829 - DNA, 13 bp, Homo sapiens
ttagctctggggg

SEQ ID NO: 3160830 - DNA, 15 bp, Homo sapiens
ttagctggcgcatat

SEQ ID NO: 3160831 - DNA, 13 bp, Homo sapiens
ttagcttatcttt

SEQ ID NO: 3160832 - DNA, 20 bp, Homo sapiens
ttagcttgttcacactttgc

SEQ ID NO: 3160833 - DNA, 16 bp, Homo sapiens
ttagctttttaattgt

SEQ ID NO: 3160834 - DNA, 17 bp, Homo sapiens
ttagctttttaattgtt

SEQ ID NO: 3160835 - DNA, 15 bp, Homo sapiens
ttaggaaataaaacc

SEQ ID NO: 3160836 - DNA, 17 bp, Homo sapiens
ttaggaaataaaacctt

SEQ ID NO: 3160837 - DNA, 20 bp, Homo sapiens
ttaggaagaagtggtactag

SEQ ID NO: 3160838 - DNA, 19 bp, Homo sapiens
ttaggaagtgtaacagctg

SEQ ID NO: 3160839 - DNA, 14 bp, Homo sapiens
ttaggactgtataa

SEQ ID NO: 3160840 - DNA, 16 bp, Homo sapiens
ttaggagctaaggctc

SEQ ID NO: 3160841 - DNA, 22 bp, Homo sapiens
ttaggagtgggtgacaagagcc

SEQ ID NO: 3160842 - DNA, 14 bp, Homo sapiens
ttaggatatttgag

SEQ ID NO: 3160843 - DNA, 14 bp, Homo sapiens
ttaggattgtgggt

SEQ ID NO: 3160844 - DNA, 14 bp, Homo sapiens
ttaggatttaacag

SEQ ID NO: 3160845 - DNA, 16 bp, Homo sapiens
ttaggattttcacatt

SEQ ID NO: 3160846 - DNA, 19 bp, Homo sapiens
ttaggcactgttcaatact

SEQ ID NO: 3160847 - DNA, 18 bp, Homo sapiens
ttaggcatgcacagctgt

SEQ ID NO: 3160848 - DNA, 15 bp, Homo sapiens
ttaggccccgtggtg

SEQ ID NO: 3160849 - DNA, 21 bp, Homo sapiens
ttaggccccgtggtgacattt

SEQ ID NO: 3160850 - DNA, 16 bp, Homo sapiens
ttaggccttcctctct

SEQ ID NO: 3160851 - DNA, 20 bp, Homo sapiens
ttaggctatttgtaaatctg

SEQ ID NO: 3160852 - DNA, 17 bp, Homo sapiens
ttaggctgtaactactt

SEQ ID NO: 3160853 - DNA, 17 bp, Homo sapiens
ttagggcaccaggggtt

SEQ ID NO: 3160854 - DNA, 12 bp, Homo sapiens
ttagggcagctt

SEQ ID NO: 3160855 - DNA, 14 bp, Homo sapiens
ttagggcagcttgc

SEQ ID NO: 3160856 - DNA, 13 bp, Homo sapiens
ttagggttttgca

SEQ ID NO: 3160857 - DNA, 17 bp, Homo sapiens
ttagggttttgcaataa

SEQ ID NO: 3160858 - DNA, 19 bp, Homo sapiens
ttaggtccctcactccaca

SEQ ID NO: 3160859 - DNA, 18 bp, Homo sapiens
ttaggtggcaagctgtga

SEQ ID NO: 3160860 - DNA, 19 bp, Homo sapiens
ttaggtgttgattttctgt

SEQ ID NO: 3160861 - DNA, 12 bp, Homo sapiens
ttaggttaacat

SEQ ID NO: 3160862 - DNA, 18 bp, Homo sapiens
ttaggttattttgctttg

SEQ ID NO: 3160863 - DNA, 20 bp, Homo sapiens
ttaggttctaaagttctaag

SEQ ID NO: 3160864 - DNA, 15 bp, Homo sapiens
ttagtaatctgtaca

SEQ ID NO: 3160865 - DNA, 22 bp, Homo sapiens
ttagtactgaagccaaatgaaa

SEQ ID NO: 3160866 - DNA, 12 bp, Homo sapiens
ttagtagcatgt

SEQ ID NO: 3160867 - DNA, 13 bp, Homo sapiens
ttagtagcatgtt

SEQ ID NO: 3160868 - DNA, 19 bp, Homo sapiens
ttagtagcccttcagtctt

SEQ ID NO: 3160869 - DNA, 19 bp, Homo sapiens
ttagtatcagtgttttaaa

SEQ ID NO: 3160870 - DNA, 20 bp, Homo sapiens
ttagtatggttcaagattgt

SEQ ID NO: 3160871 - DNA, 12 bp, Homo sapiens
ttagtatgtctg

SEQ ID NO: 3160872 - DNA, 15 bp, Homo sapiens
ttagtatgtctgttt

SEQ ID NO: 3160873 - DNA, 22 bp, Homo sapiens
ttagtatgtctgtttttgtatc

SEQ ID NO: 3160874 - DNA, 22 bp, Homo sapiens
ttagtattttaatcctgtacca

SEQ ID NO: 3160875 - DNA, 13 bp, Homo sapiens
ttagtcatgtgac

SEQ ID NO: 3160876 - DNA, 14 bp, Homo sapiens
ttagtcatgtgacc

SEQ ID NO: 3160877 - DNA, 19 bp, Homo sapiens
ttagtcctgtactgtatgg

SEQ ID NO: 3160878 - DNA, 12 bp, Homo sapiens
ttagtctcagtt

SEQ ID NO: 3160879 - DNA, 22 bp, Homo sapiens
ttagtctcagtttgtgtgtctt

SEQ ID NO: 3160880 - DNA, 23 bp, Homo sapiens
ttagtctcagtttgtgtgtctta

SEQ ID NO: 3160881 - DNA, 22 bp, Homo sapiens
ttagtctcttgtattaaactct

SEQ ID NO: 3160882 - DNA, 18 bp, Homo sapiens
ttagtgaaaattctgttg

SEQ ID NO: 3160883 - DNA, 11 bp, Homo sapiens
ttagtgactgt

SEQ ID NO: 3160884 - DNA, 17 bp, Homo sapiens
ttagtgatcttagcata

SEQ ID NO: 3160885 - DNA, 19 bp, Homo sapiens
ttagtgccacttaatgtat

SEQ ID NO: 3160886 - DNA, 14 bp, Homo sapiens
ttagtgccagaatt

SEQ ID NO: 3160887 - DNA, 15 bp, Homo sapiens
ttagtgccctgcccc

SEQ ID NO: 3160888 - DNA, 19 bp, Homo sapiens
ttagtgccctgccccctgg

SEQ ID NO: 3160889 - DNA, 20 bp, Homo sapiens
ttagtgccctgccccctggc

SEQ ID NO: 3160890 - DNA, 20 bp, Homo sapiens
ttagtgccggctgtggagca

SEQ ID NO: 3160891 - DNA, 19 bp, Homo sapiens
ttagtgcggacaagtttta

SEQ ID NO: 3160892 - DNA, 17 bp, Homo sapiens
ttagtgcttcagagttt

SEQ ID NO: 3160893 - DNA, 16 bp, Homo sapiens
ttagtggctcaacatt

SEQ ID NO: 3160894 - DNA, 16 bp, Homo sapiens
ttagtggtatgtctct

SEQ ID NO: 3160895 - DNA, 19 bp, Homo sapiens
ttagtggtatgtctcttta

SEQ ID NO: 3160896 - DNA, 15 bp, Homo sapiens
ttagttaatgagcca

SEQ ID NO: 3160897 - DNA, 16 bp, Homo sapiens
ttagttaccttatagt

SEQ ID NO: 3160898 - DNA, 20 bp, Homo sapiens
ttagttaccttatagttact

SEQ ID NO: 3160899 - DNA, 21 bp, Homo sapiens
ttagttaccttatagttactg

SEQ ID NO: 3160900 - DNA, 22 bp, Homo sapiens
ttagttaccttatagttactgt

SEQ ID NO: 3160901 - DNA, 15 bp, Homo sapiens
ttagttatagtttca

SEQ ID NO: 3160902 - DNA, 13 bp, Homo sapiens
ttagttcaataca

SEQ ID NO: 3160903 - DNA, 16 bp, Homo sapiens
ttagttcatatataca

SEQ ID NO: 3160904 - DNA, 19 bp, Homo sapiens
ttagttccctgtctcttga

SEQ ID NO: 3160905 - DNA, 21 bp, Homo sapiens
ttagttgaatataagaaaatg

SEQ ID NO: 3160906 - DNA, 22 bp, Homo sapiens
ttagttgcctaagcattgcctg

SEQ ID NO: 3160907 - DNA, 19 bp, Homo sapiens
ttagttggtgctgatggag

SEQ ID NO: 3160908 - DNA, 17 bp, Homo sapiens
ttagtttacaatcagcc

SEQ ID NO: 3160909 - DNA, 22 bp, Homo sapiens
ttagtttgtatgccaagtgaga

SEQ ID NO: 3160910 - DNA, 17 bp, Homo sapiens
ttagtttttaacaatct

SEQ ID NO: 3160911 - DNA, 18 bp, Homo sapiens
ttagtttttaacaatcta

SEQ ID NO: 3160912 - DNA, 23 bp, Homo sapiens
ttagtttttaacaatctaacaat

SEQ ID NO: 3160913 - DNA, 19 bp, Homo sapiens
ttagtttttggttgggaat

SEQ ID NO: 3160914 - DNA, 19 bp, Homo sapiens
ttagttttttttgtttgcc

SEQ ID NO: 3160915 - DNA, 14 bp, Homo sapiens
ttataaaaaatggt

SEQ ID NO: 3160916 - DNA, 18 bp, Homo sapiens
ttataaaaaatggttcag

SEQ ID NO: 3160917 - DNA, 14 bp, Homo sapiens
ttataaaaaatgta

SEQ ID NO: 3160918 - DNA, 12 bp, Homo sapiens
ttataaaaagat

SEQ ID NO: 3160919 - DNA, 14 bp, Homo sapiens
ttataaaaagataa

SEQ ID NO: 3160920 - DNA, 22 bp, Homo sapiens
ttataaaaccatcaaaaatatt

SEQ ID NO: 3160921 - DNA, 12 bp, Homo sapiens
ttataaaacttc

SEQ ID NO: 3160922 - DNA, 22 bp, Homo sapiens
ttataaaagggggtccgtggaa

SEQ ID NO: 3160923 - DNA, 16 bp, Homo sapiens
ttataaaatggacaca

SEQ ID NO: 3160924 - DNA, 20 bp, Homo sapiens
ttataaaatggctgtaatca

SEQ ID NO: 3160925 - DNA, 16 bp, Homo sapiens
ttataaaattaagcaa

SEQ ID NO: 3160926 - DNA, 17 bp, Homo sapiens
ttataaaattagaaagc

SEQ ID NO: 3160927 - DNA, 13 bp, Homo sapiens
ttataaacagaaa

SEQ ID NO: 3160928 - DNA, 17 bp, Homo sapiens
ttataaacagaaatgga

SEQ ID NO: 3160929 - DNA, 21 bp, Homo sapiens
ttataaacagacaatatgtga

SEQ ID NO: 3160930 - DNA, 18 bp, Homo sapiens
ttataaaccaatcttaaa

SEQ ID NO: 3160931 - DNA, 12 bp, Homo sapiens
ttataaactttt

SEQ ID NO: 3160932 - DNA, 18 bp, Homo sapiens
ttataaatataagccttt

SEQ ID NO: 3160933 - DNA, 15 bp, Homo sapiens
ttataaatatattta

SEQ ID NO: 3160934 - DNA, 23 bp, Homo sapiens
ttataaatcatattgatgaaaag

SEQ ID NO: 3160935 - DNA, 12 bp, Homo sapiens
ttataaatttcg

SEQ ID NO: 3160936 - DNA, 15 bp, Homo sapiens
ttataacagatgtga

SEQ ID NO: 3160937 - DNA, 16 bp, Homo sapiens
ttataacagttatatt

SEQ ID NO: 3160938 - DNA, 16 bp, Homo sapiens
ttataactctgcacta

SEQ ID NO: 3160939 - DNA, 17 bp, Homo sapiens
ttataactctgtataat

SEQ ID NO: 3160940 - DNA, 18 bp, Homo sapiens
ttataactctgtataata

SEQ ID NO: 3160941 - DNA, 13 bp, Homo sapiens
ttataacttaaaa

SEQ ID NO: 3160942 - DNA, 18 bp, Homo sapiens
ttataagaagaagttcat

SEQ ID NO: 3160943 - DNA, 14 bp, Homo sapiens
ttataagactctca

SEQ ID NO: 3160944 - DNA, 13 bp, Homo sapiens
ttataagcattga

SEQ ID NO: 3160945 - DNA, 11 bp, Homo sapiens
ttataatagca

SEQ ID NO: 3160946 - DNA, 13 bp, Homo sapiens
ttataatatacta

SEQ ID NO: 3160947 - DNA, 20 bp, Homo sapiens
ttataatctcaaaggagaaa

SEQ ID NO: 3160948 - DNA, 13 bp, Homo sapiens
ttataatgggtaa

SEQ ID NO: 3160949 - DNA, 20 bp, Homo sapiens
ttataattgtacaaaattaa

SEQ ID NO: 3160950 - DNA, 14 bp, Homo sapiens
ttataattgtatca

SEQ ID NO: 3160951 - DNA, 22 bp, Homo sapiens
ttataattgtatcagaggccta

SEQ ID NO: 3160952 - DNA, 15 bp, Homo sapiens
ttataattttctgaa

SEQ ID NO: 3160953 - DNA, 21 bp, Homo sapiens
ttatacaaacctaccaaaatg

SEQ ID NO: 3160954 - DNA, 20 bp, Homo sapiens
ttatacagatagagttccat

SEQ ID NO: 3160955 - DNA, 21 bp, Homo sapiens
ttatacagctgtattgtctga

SEQ ID NO: 3160956 - DNA, 21 bp, Homo sapiens
ttatacagttataaaattaaa

SEQ ID NO: 3160957 - DNA, 20 bp, Homo sapiens
ttatacatgtgatacatttt

SEQ ID NO: 3160958 - DNA, 18 bp, Homo sapiens
ttataccccaataatcaa

SEQ ID NO: 3160959 - DNA, 21 bp, Homo sapiens
ttatacgctggcaacacagag

SEQ ID NO: 3160960 - DNA, 22 bp, Homo sapiens
ttatacgctggcaacacagagg

SEQ ID NO: 3160961 - DNA, 18 bp, Homo sapiens
ttatacgtgtagctatat

SEQ ID NO: 3160962 - DNA, 23 bp, Homo sapiens
ttatactactttgttaggatttt

SEQ ID NO: 3160963 - DNA, 19 bp, Homo sapiens
ttatactcttcctattttt

SEQ ID NO: 3160964 - DNA, 20 bp, Homo sapiens
ttatactgggtttcaagaaa

SEQ ID NO: 3160965 - DNA, 22 bp, Homo sapiens
ttatactgtacttaataaattc

SEQ ID NO: 3160966 - DNA, 17 bp, Homo sapiens
ttatactgtatttctaa

SEQ ID NO: 3160967 - DNA, 20 bp, Homo sapiens
ttatactgtatttctaagaa

SEQ ID NO: 3160968 - DNA, 23 bp, Homo sapiens
ttatactttatatctgtaatgat

SEQ ID NO: 3160969 - DNA, 17 bp, Homo sapiens
ttatagaaggaatttgt

SEQ ID NO: 3160970 - DNA, 14 bp, Homo sapiens
ttatagaatacttt

SEQ ID NO: 3160971 - DNA, 19 bp, Homo sapiens
ttatagagggccaagactt

SEQ ID NO: 3160972 - DNA, 23 bp, Homo sapiens
ttatagagtgtacttaactattc

SEQ ID NO: 3160973 - DNA, 15 bp, Homo sapiens
ttatagatgtctagg

SEQ ID NO: 3160974 - DNA, 20 bp, Homo sapiens
ttatagattctaaagattct

SEQ ID NO: 3160975 - DNA, 21 bp, Homo sapiens
ttatagattctaaagattcta

SEQ ID NO: 3160976 - DNA, 22 bp, Homo sapiens
ttatagcaagatattgatcaaa

SEQ ID NO: 3160977 - DNA, 17 bp, Homo sapiens
ttatagctattactgtc

SEQ ID NO: 3160978 - DNA, 22 bp, Homo sapiens
ttataggtaatcaatgaatatt

SEQ ID NO: 3160979 - DNA, 18 bp, Homo sapiens
ttataggtgagaaaaaaa

SEQ ID NO: 3160980 - DNA, 15 bp, Homo sapiens
ttatagtatgtgact

SEQ ID NO: 3160981 - DNA, 22 bp, Homo sapiens
ttatagtcatttattttaaaaa

SEQ ID NO: 3160982 - DNA, 20 bp, Homo sapiens
ttatagtctaagactatata

SEQ ID NO: 3160983 - DNA, 20 bp, Homo sapiens
ttatagtggtgttttaaaga

SEQ ID NO: 3160984 - DNA, 15 bp, Homo sapiens
ttatagttactgtgt

SEQ ID NO: 3160985 - DNA, 14 bp, Homo sapiens
ttatagtttcaagc

SEQ ID NO: 3160986 - DNA, 13 bp, Homo sapiens
ttatagtttctga

SEQ ID NO: 3160987 - DNA, 12 bp, Homo sapiens
ttatagtttgta

SEQ ID NO: 3160988 - DNA, 14 bp, Homo sapiens
ttatataaagtatt

SEQ ID NO: 3160989 - DNA, 18 bp, Homo sapiens
ttatataaagtattcttt

SEQ ID NO: 3160990 - DNA, 13 bp, Homo sapiens
ttatataaatgta

SEQ ID NO: 3160991 - DNA, 15 bp, Homo sapiens
ttatatatacagtaa

SEQ ID NO: 3160992 - DNA, 15 bp, Homo sapiens
ttatatatatagttt

SEQ ID NO: 3160993 - DNA, 14 bp, Homo sapiens
ttatatattatgtg

SEQ ID NO: 3160994 - DNA, 18 bp, Homo sapiens
ttatatattatgtgaaga

SEQ ID NO: 3160995 - DNA, 20 bp, Homo sapiens
ttatatattatgtgaagaat

SEQ ID NO: 3160996 - DNA, 21 bp, Homo sapiens
ttatatattatgtgaagaatt

SEQ ID NO: 3160997 - DNA, 13 bp, Homo sapiens
ttatatatttata

SEQ ID NO: 3160998 - DNA, 14 bp, Homo sapiens
ttatatatttataa

SEQ ID NO: 3160999 - DNA, 23 bp, Homo sapiens
ttatatatttataactcatcata

SEQ ID NO: 3161000 - DNA, 20 bp, Homo sapiens
ttatatattttcatcctata

SEQ ID NO: 3161001 - DNA, 14 bp, Homo sapiens
ttatatcaaagtat

SEQ ID NO: 3161002 - DNA, 15 bp, Homo sapiens
ttatatcaaagtatt

SEQ ID NO: 3161003 - DNA, 19 bp, Homo sapiens
ttatatctaattatttcca

SEQ ID NO: 3161004 - DNA, 12 bp, Homo sapiens
ttatatcttttg

SEQ ID NO: 3161005 - DNA, 17 bp, Homo sapiens
ttatatcttttggttat

SEQ ID NO: 3161006 - DNA, 13 bp, Homo sapiens
ttatatgcttact

SEQ ID NO: 3161007 - DNA, 15 bp, Homo sapiens
ttatatggaagaaag

SEQ ID NO: 3161008 - DNA, 22 bp, Homo sapiens
ttatatggatgattcagaaatt

SEQ ID NO: 3161009 - DNA, 19 bp, Homo sapiens
ttatatgtacatgagaagg

SEQ ID NO: 3161010 - DNA, 18 bp, Homo sapiens
ttatatgttgtaatattt

SEQ ID NO: 3161011 - DNA, 16 bp, Homo sapiens
ttatattctaattaaa

SEQ ID NO: 3161012 - DNA, 23 bp, Homo sapiens
ttatattctcttatgatacttga

SEQ ID NO: 3161013 - DNA, 15 bp, Homo sapiens
ttatattcttatgtt

SEQ ID NO: 3161014 - DNA, 12 bp, Homo sapiens
ttatattgcctt

SEQ ID NO: 3161015 - DNA, 23 bp, Homo sapiens
ttatattggtgcgtttttacagt

SEQ ID NO: 3161016 - DNA, 20 bp, Homo sapiens
ttatattgtttttgtattta

SEQ ID NO: 3161017 - DNA, 19 bp, Homo sapiens
ttatatttagttatagttt

SEQ ID NO: 3161018 - DNA, 13 bp, Homo sapiens
ttatatttattgt

SEQ ID NO: 3161019 - DNA, 13 bp, Homo sapiens
ttatatttggaaa

SEQ ID NO: 3161020 - DNA, 17 bp, Homo sapiens
ttatatttttaataaaa

SEQ ID NO: 3161021 - DNA, 12 bp, Homo sapiens
ttatcaaaatct

SEQ ID NO: 3161022 - DNA, 13 bp, Homo sapiens
ttatcaaagcata

SEQ ID NO: 3161023 - DNA, 15 bp, Homo sapiens
ttatcaacaatagtg

SEQ ID NO: 3161024 - DNA, 17 bp, Homo sapiens
ttatcaaggactctggt

SEQ ID NO: 3161025 - DNA, 17 bp, Homo sapiens
ttatcaagtgtcttcca

SEQ ID NO: 3161026 - DNA, 17 bp, Homo sapiens
ttatcaatatctaatat

SEQ ID NO: 3161027 - DNA, 15 bp, Homo sapiens
ttatcaccttccaaa

SEQ ID NO: 3161028 - DNA, 21 bp, Homo sapiens
ttatcactttttgaactaaga

SEQ ID NO: 3161029 - DNA, 17 bp, Homo sapiens
ttatcagatacatcact

SEQ ID NO: 3161030 - DNA, 22 bp, Homo sapiens
ttatcagctacttaagagaaat

SEQ ID NO: 3161031 - DNA, 21 bp, Homo sapiens
ttatcagtaagaaaaagaaga

SEQ ID NO: 3161032 - DNA, 15 bp, Homo sapiens
ttatcagtcaatatt

SEQ ID NO: 3161033 - DNA, 21 bp, Homo sapiens
ttatcagtcataactaaataa

SEQ ID NO: 3161034 - DNA, 17 bp, Homo sapiens
ttatcagtgacagagtt

SEQ ID NO: 3161035 - DNA, 12 bp, Homo sapiens
ttatcattttca

SEQ ID NO: 3161036 - DNA, 16 bp, Homo sapiens
ttatcattttcaaaat

SEQ ID NO: 3161037 - DNA, 19 bp, Homo sapiens
ttatccatttgtaattaaa

SEQ ID NO: 3161038 - DNA, 15 bp, Homo sapiens
ttatcctcacataaa

SEQ ID NO: 3161039 - DNA, 13 bp, Homo sapiens
ttatcctctttgt

SEQ ID NO: 3161040 - DNA, 13 bp, Homo sapiens
ttatcctttgtga

SEQ ID NO: 3161041 - DNA, 14 bp, Homo sapiens
ttatcgaaataaca

SEQ ID NO: 3161042 - DNA, 16 bp, Homo sapiens
ttatcggaagcagtgc

SEQ ID NO: 3161043 - DNA, 14 bp, Homo sapiens
ttatcgggaacagt

SEQ ID NO: 3161044 - DNA, 17 bp, Homo sapiens
ttatcgggaacagtgtt

SEQ ID NO: 3161045 - DNA, 19 bp, Homo sapiens
ttatcgggagcagtgtctt

SEQ ID NO: 3161046 - DNA, 21 bp, Homo sapiens
ttatctaaaagaaatgtctat

SEQ ID NO: 3161047 - DNA, 14 bp, Homo sapiens
ttatctaaattaaa

SEQ ID NO: 3161048 - DNA, 20 bp, Homo sapiens
ttatctaatacctctgtgtg

SEQ ID NO: 3161049 - DNA, 23 bp, Homo sapiens
ttatctagaaagaaaagaccctg

SEQ ID NO: 3161050 - DNA, 15 bp, Homo sapiens
ttatctataatttac

SEQ ID NO: 3161051 - DNA, 22 bp, Homo sapiens
ttatctattaaaattgccattt

SEQ ID NO: 3161052 - DNA, 17 bp, Homo sapiens
ttatctcagatgttaaa

SEQ ID NO: 3161053 - DNA, 17 bp, Homo sapiens
ttatctcctaattgtat

SEQ ID NO: 3161054 - DNA, 14 bp, Homo sapiens
ttatctctatttaa

SEQ ID NO: 3161055 - DNA, 19 bp, Homo sapiens
ttatctctatttaatattt

SEQ ID NO: 3161056 - DNA, 18 bp, Homo sapiens
ttatctgcaagtgaggtg

SEQ ID NO: 3161057 - DNA, 14 bp, Homo sapiens
ttatctgcctggcc

SEQ ID NO: 3161058 - DNA, 16 bp, Homo sapiens
ttatctgtcagctgca

SEQ ID NO: 3161059 - DNA, 18 bp, Homo sapiens
ttatctgtgcgtgaaaca

SEQ ID NO: 3161060 - DNA, 18 bp, Homo sapiens
ttatctgtgtttttgaaa

SEQ ID NO: 3161061 - DNA, 20 bp, Homo sapiens
ttatcttacaatattgattg

SEQ ID NO: 3161062 - DNA, 17 bp, Homo sapiens
ttatcttatgccacggg

SEQ ID NO: 3161063 - DNA, 17 bp, Homo sapiens
ttatcttggactgacat

SEQ ID NO: 3161064 - DNA, 14 bp, Homo sapiens
ttatcttgggactg

SEQ ID NO: 3161065 - DNA, 16 bp, Homo sapiens
ttatctttacttttaa

SEQ ID NO: 3161066 - DNA, 15 bp, Homo sapiens
ttatctttctttcca

SEQ ID NO: 3161067 - DNA, 23 bp, Homo sapiens
ttatctttctttccatttacagt

SEQ ID NO: 3161068 - DNA, 12 bp, Homo sapiens
ttatcttttcat

SEQ ID NO: 3161069 - DNA, 13 bp, Homo sapiens
ttatctttttaaa

SEQ ID NO: 3161070 - DNA, 15 bp, Homo sapiens
ttatctttttacctt

SEQ ID NO: 3161071 - DNA, 19 bp, Homo sapiens
ttatgaaaaaatatgaacc

SEQ ID NO: 3161072 - DNA, 14 bp, Homo sapiens
ttatgaaataaaga

SEQ ID NO: 3161073 - DNA, 20 bp, Homo sapiens
ttatgaaataaagaaattgc

SEQ ID NO: 3161074 - DNA, 19 bp, Homo sapiens
ttatgaaattcaccccctt

SEQ ID NO: 3161075 - DNA, 13 bp, Homo sapiens
ttatgaagcagat

SEQ ID NO: 3161076 - DNA, 16 bp, Homo sapiens
ttatgaatatcattga

SEQ ID NO: 3161077 - DNA, 19 bp, Homo sapiens
ttatgaatatttataacag

SEQ ID NO: 3161078 - DNA, 22 bp, Homo sapiens
ttatgaatatttataacagcat

SEQ ID NO: 3161079 - DNA, 23 bp, Homo sapiens
ttatgaatttttgtaagaaaccg

SEQ ID NO: 3161080 - DNA, 23 bp, Homo sapiens
ttatgacaatgactgtgctactg

SEQ ID NO: 3161081 - DNA, 22 bp, Homo sapiens
ttatgacagccatttgtaatga

SEQ ID NO: 3161082 - DNA, 16 bp, Homo sapiens
ttatgacatcacttgt

SEQ ID NO: 3161083 - DNA, 18 bp, Homo sapiens
ttatgacatcacttgtac

SEQ ID NO: 3161084 - DNA, 22 bp, Homo sapiens
ttatgaggcaacctgattgtaa

SEQ ID NO: 3161085 - DNA, 20 bp, Homo sapiens
ttatgagtaactattattat

SEQ ID NO: 3161086 - DNA, 19 bp, Homo sapiens
ttatgagttattcatattc

SEQ ID NO: 3161087 - DNA, 16 bp, Homo sapiens
ttatgataatagattc

SEQ ID NO: 3161088 - DNA, 14 bp, Homo sapiens
ttatgatatttctt

SEQ ID NO: 3161089 - DNA, 14 bp, Homo sapiens
ttatgatgatgaaa

SEQ ID NO: 3161090 - DNA, 16 bp, Homo sapiens
ttatgatgtatattta

SEQ ID NO: 3161091 - DNA, 15 bp, Homo sapiens
ttatgatttgtaaca

SEQ ID NO: 3161092 - DNA, 16 bp, Homo sapiens
ttatgatttgtaacat

SEQ ID NO: 3161093 - DNA, 23 bp, Homo sapiens
ttatgcaattaggtttttcctta

SEQ ID NO: 3161094 - DNA, 22 bp, Homo sapiens
ttatgcactaaatatgaaccct

SEQ ID NO: 3161095 - DNA, 13 bp, Homo sapiens
ttatgcatttcat

SEQ ID NO: 3161096 - DNA, 21 bp, Homo sapiens
ttatgctataaattttttgaa

SEQ ID NO: 3161097 - DNA, 22 bp, Homo sapiens
ttatgctataaattttttgaaa

SEQ ID NO: 3161098 - DNA, 14 bp, Homo sapiens
ttatgctcagggtc

SEQ ID NO: 3161099 - DNA, 23 bp, Homo sapiens
ttatgctccatcccattcacttc

SEQ ID NO: 3161100 - DNA, 17 bp, Homo sapiens
ttatgctctcactgttt

SEQ ID NO: 3161101 - DNA, 21 bp, Homo sapiens
ttatgctcttttttactcatt

SEQ ID NO: 3161102 - DNA, 15 bp, Homo sapiens
ttatgctgatttatt

SEQ ID NO: 3161103 - DNA, 17 bp, Homo sapiens
ttatgctgtgacacatg

SEQ ID NO: 3161104 - DNA, 16 bp, Homo sapiens
ttatggaaatatagtt

SEQ ID NO: 3161105 - DNA, 23 bp, Homo sapiens
ttatggaagatagttttctcctt

SEQ ID NO: 3161106 - DNA, 14 bp, Homo sapiens
ttatggaattgatt

SEQ ID NO: 3161107 - DNA, 19 bp, Homo sapiens
ttatggaattgatttgcat

SEQ ID NO: 3161108 - DNA, 20 bp, Homo sapiens
ttatggaattgatttgcatt

SEQ ID NO: 3161109 - DNA, 22 bp, Homo sapiens
ttatggccaatctattctcaaa

SEQ ID NO: 3161110 - DNA, 15 bp, Homo sapiens
ttatggcctttttaa

SEQ ID NO: 3161111 - DNA, 17 bp, Homo sapiens
ttatgggcattgacaaa

SEQ ID NO: 3161112 - DNA, 21 bp, Homo sapiens
ttatggtaactgctttctgtt

SEQ ID NO: 3161113 - DNA, 21 bp, Homo sapiens
ttatggtaatcagttttgtat

SEQ ID NO: 3161114 - DNA, 16 bp, Homo sapiens
ttatgtaaaactcgct

SEQ ID NO: 3161115 - DNA, 18 bp, Homo sapiens
ttatgtaagagcaccttc

SEQ ID NO: 3161116 - DNA, 22 bp, Homo sapiens
ttatgtacaaggatgaaagaaa

SEQ ID NO: 3161117 - DNA, 17 bp, Homo sapiens
ttatgtactgtactaat

SEQ ID NO: 3161118 - DNA, 21 bp, Homo sapiens
ttatgtacttgatactgaatg

SEQ ID NO: 3161119 - DNA, 11 bp, Homo sapiens
ttatgtagttt

SEQ ID NO: 3161120 - DNA, 17 bp, Homo sapiens
ttatgtatcagaagaga

SEQ ID NO: 3161121 - DNA, 14 bp, Homo sapiens
ttatgtatctctat

SEQ ID NO: 3161122 - DNA, 23 bp, Homo sapiens
ttatgtatgaaggaatcattcca

SEQ ID NO: 3161123 - DNA, 15 bp, Homo sapiens
ttatgtccactgtgt

SEQ ID NO: 3161124 - DNA, 12 bp, Homo sapiens
ttatgtgaagaa

SEQ ID NO: 3161125 - DNA, 16 bp, Homo sapiens
ttatgtgatcatgtgt

SEQ ID NO: 3161126 - DNA, 20 bp, Homo sapiens
ttatgtggttttagattttc

SEQ ID NO: 3161127 - DNA, 15 bp, Homo sapiens
ttatgtgtaaataca

SEQ ID NO: 3161128 - DNA, 18 bp, Homo sapiens
ttatgtgtatatttgtag

SEQ ID NO: 3161129 - DNA, 13 bp, Homo sapiens
ttatgttaaaatc

SEQ ID NO: 3161130 - DNA, 22 bp, Homo sapiens
ttatgttaagggaagaattcca

SEQ ID NO: 3161131 - DNA, 15 bp, Homo sapiens
ttatgttacatctgt

SEQ ID NO: 3161132 - DNA, 14 bp, Homo sapiens
ttatgttcatgtaa

SEQ ID NO: 3161133 - DNA, 19 bp, Homo sapiens
ttatgttttgtttctgaaa

SEQ ID NO: 3161134 - DNA, 22 bp, Homo sapiens
ttatgttttttaaaatatttat

SEQ ID NO: 3161135 - DNA, 21 bp, Homo sapiens
ttatgttttttgtaagataaa

SEQ ID NO: 3161136 - DNA, 20 bp, Homo sapiens
ttattaaaaatgttctcaaa

SEQ ID NO: 3161137 - DNA, 20 bp, Homo sapiens
ttattaaaatgattgtaaaa

SEQ ID NO: 3161138 - DNA, 15 bp, Homo sapiens
ttattaaataaaatc

SEQ ID NO: 3161139 - DNA, 13 bp, Homo sapiens
ttattaaattgca

SEQ ID NO: 3161140 - DNA, 19 bp, Homo sapiens
ttattaacaaattatgtta

SEQ ID NO: 3161141 - DNA, 17 bp, Homo sapiens
ttattaagatggattct

SEQ ID NO: 3161142 - DNA, 20 bp, Homo sapiens
ttattaagatggattctcag

SEQ ID NO: 3161143 - DNA, 23 bp, Homo sapiens
ttattaagatggattctcagata

SEQ ID NO: 3161144 - DNA, 15 bp, Homo sapiens
ttattaagctttttg

SEQ ID NO: 3161145 - DNA, 22 bp, Homo sapiens
ttattaagttcgaacatgtttc

SEQ ID NO: 3161146 - DNA, 19 bp, Homo sapiens
ttattaatatgagttactg

SEQ ID NO: 3161147 - DNA, 16 bp, Homo sapiens
ttattaatgttttcaa

SEQ ID NO: 3161148 - DNA, 13 bp, Homo sapiens
ttattacaatttt

SEQ ID NO: 3161149 - DNA, 19 bp, Homo sapiens
ttattaccccctccttcag

SEQ ID NO: 3161150 - DNA, 13 bp, Homo sapiens
ttattacctctga

SEQ ID NO: 3161151 - DNA, 22 bp, Homo sapiens
ttattacttctgtttgggagac

SEQ ID NO: 3161152 - DNA, 20 bp, Homo sapiens
ttattagcaaggctgggtaa

SEQ ID NO: 3161153 - DNA, 22 bp, Homo sapiens
ttattagccaggtaatgtgaat

SEQ ID NO: 3161154 - DNA, 17 bp, Homo sapiens
ttattagggagaaaatt

SEQ ID NO: 3161155 - DNA, 18 bp, Homo sapiens
ttattagggagaaaattc

SEQ ID NO: 3161156 - DNA, 20 bp, Homo sapiens
ttattagggagaaaattcaa

SEQ ID NO: 3161157 - DNA, 23 bp, Homo sapiens
ttattagggagaaaattcaattg

SEQ ID NO: 3161158 - DNA, 14 bp, Homo sapiens
ttattatggcttgt

SEQ ID NO: 3161159 - DNA, 20 bp, Homo sapiens
ttattatggcttgtgaactg

SEQ ID NO: 3161160 - DNA, 19 bp, Homo sapiens
ttattatgtttattacaat

SEQ ID NO: 3161161 - DNA, 15 bp, Homo sapiens
ttattattatttgct

SEQ ID NO: 3161162 - DNA, 16 bp, Homo sapiens
ttattattatttttta

SEQ ID NO: 3161163 - DNA, 16 bp, Homo sapiens
ttattattgaaattgt

SEQ ID NO: 3161164 - DNA, 12 bp, Homo sapiens
ttattatttgaa

SEQ ID NO: 3161165 - DNA, 17 bp, Homo sapiens
ttattcaagtattgaga

SEQ ID NO: 3161166 - DNA, 18 bp, Homo sapiens
ttattcaattcctctggg

SEQ ID NO: 3161167 - DNA, 19 bp, Homo sapiens
ttattcaattcctctggga

SEQ ID NO: 3161168 - DNA, 13 bp, Homo sapiens
ttattcataatga

SEQ ID NO: 3161169 - DNA, 22 bp, Homo sapiens
ttattcataatgaattataaca

SEQ ID NO: 3161170 - DNA, 17 bp, Homo sapiens
ttattcatttaaaatga

SEQ ID NO: 3161171 - DNA, 20 bp, Homo sapiens
ttattcatttaaaatgatta

SEQ ID NO: 3161172 - DNA, 20 bp, Homo sapiens
ttattccaaaccaaatttta

SEQ ID NO: 3161173 - DNA, 15 bp, Homo sapiens
ttattccatcaataa

SEQ ID NO: 3161174 - DNA, 16 bp, Homo sapiens
ttattccgagcattcc

SEQ ID NO: 3161175 - DNA, 16 bp, Homo sapiens
ttattcctcctgctca

SEQ ID NO: 3161176 - DNA, 15 bp, Homo sapiens
ttattcctgtatgtt

SEQ ID NO: 3161177 - DNA, 20 bp, Homo sapiens
ttattcgaaccactgagagc

SEQ ID NO: 3161178 - DNA, 23 bp, Homo sapiens
ttattctaataaatatactatga

SEQ ID NO: 3161179 - DNA, 14 bp, Homo sapiens
ttattctcaaagca

SEQ ID NO: 3161180 - DNA, 13 bp, Homo sapiens
ttattctcataat

SEQ ID NO: 3161181 - DNA, 22 bp, Homo sapiens
ttattctgggcaccacaaaata

SEQ ID NO: 3161182 - DNA, 16 bp, Homo sapiens
ttattctgttttgcac

SEQ ID NO: 3161183 - DNA, 16 bp, Homo sapiens
ttattcttattactat

SEQ ID NO: 3161184 - DNA, 13 bp, Homo sapiens
ttattcttgctgg

SEQ ID NO: 3161185 - DNA, 12 bp, Homo sapiens
ttattcttggtt

SEQ ID NO: 3161186 - DNA, 15 bp, Homo sapiens
ttattctttactatt

SEQ ID NO: 3161187 - DNA, 13 bp, Homo sapiens
ttattctttttaa

SEQ ID NO: 3161188 - DNA, 19 bp, Homo sapiens
ttattgaagatttaccata

SEQ ID NO: 3161189 - DNA, 19 bp, Homo sapiens
ttattgacacagaaaatgt

SEQ ID NO: 3161190 - DNA, 23 bp, Homo sapiens
ttattgacacagaaaatgttgag

SEQ ID NO: 3161191 - DNA, 13 bp, Homo sapiens
ttattgagaattt

SEQ ID NO: 3161192 - DNA, 19 bp, Homo sapiens
ttattgagttccagttgaa

SEQ ID NO: 3161193 - DNA, 14 bp, Homo sapiens
ttattgatatatat

SEQ ID NO: 3161194 - DNA, 21 bp, Homo sapiens
ttattgcaaaatagcatttgt

SEQ ID NO: 3161195 - DNA, 13 bp, Homo sapiens
ttattgcattata

SEQ ID NO: 3161196 - DNA, 14 bp, Homo sapiens
ttattgctattaaa

SEQ ID NO: 3161197 - DNA, 20 bp, Homo sapiens
ttattgcttattgcttagta

SEQ ID NO: 3161198 - DNA, 13 bp, Homo sapiens
ttattgcttttat

SEQ ID NO: 3161199 - DNA, 15 bp, Homo sapiens
ttattggaaatgtac

SEQ ID NO: 3161200 - DNA, 16 bp, Homo sapiens
ttattggatatttgat

SEQ ID NO: 3161201 - DNA, 21 bp, Homo sapiens
ttattgggatatcattttaaa

SEQ ID NO: 3161202 - DNA, 22 bp, Homo sapiens
ttattgtaagttgtacaaatgt

SEQ ID NO: 3161203 - DNA, 14 bp, Homo sapiens
ttattgtacctctc

SEQ ID NO: 3161204 - DNA, 20 bp, Homo sapiens
ttattgtagaataagtcatt

SEQ ID NO: 3161205 - DNA, 16 bp, Homo sapiens
ttattgtataaaaagt

SEQ ID NO: 3161206 - DNA, 14 bp, Homo sapiens
ttattgtataaact

SEQ ID NO: 3161207 - DNA, 22 bp, Homo sapiens
ttattgtataaactatcagttt

SEQ ID NO: 3161208 - DNA, 16 bp, Homo sapiens
ttattgtattttgatg

SEQ ID NO: 3161209 - DNA, 18 bp, Homo sapiens
ttattgtcagacacttat

SEQ ID NO: 3161210 - DNA, 14 bp, Homo sapiens
ttattgtctgtcta

SEQ ID NO: 3161211 - DNA, 13 bp, Homo sapiens
ttattgttccaag

SEQ ID NO: 3161212 - DNA, 16 bp, Homo sapiens
ttattgttccaagaca

SEQ ID NO: 3161213 - DNA, 12 bp, Homo sapiens
ttattgttgaac

SEQ ID NO: 3161214 - DNA, 16 bp, Homo sapiens
ttattgttttattgta

SEQ ID NO: 3161215 - DNA, 14 bp, Homo sapiens
ttatttaaaaatat

SEQ ID NO: 3161216 - DNA, 18 bp, Homo sapiens
ttatttaaataaaatcac

SEQ ID NO: 3161217 - DNA, 12 bp, Homo sapiens
ttatttaaatta

SEQ ID NO: 3161218 - DNA, 14 bp, Homo sapiens
ttatttaaatttta

SEQ ID NO: 3161219 - DNA, 13 bp, Homo sapiens
ttatttaacagct

SEQ ID NO: 3161220 - DNA, 12 bp, Homo sapiens
ttatttaataac

SEQ ID NO: 3161221 - DNA, 19 bp, Homo sapiens
ttatttaataacattacct

SEQ ID NO: 3161222 - DNA, 18 bp, Homo sapiens
ttatttaatgaaagactg

SEQ ID NO: 3161223 - DNA, 17 bp, Homo sapiens
ttatttaattaaatgta

SEQ ID NO: 3161224 - DNA, 19 bp, Homo sapiens
ttatttaattaaatgtatt

SEQ ID NO: 3161225 - DNA, 13 bp, Homo sapiens
ttatttacatttt

SEQ ID NO: 3161226 - DNA, 22 bp, Homo sapiens
ttatttaccgttgcttgaaatt

SEQ ID NO: 3161227 - DNA, 17 bp, Homo sapiens
ttatttactaattttct

SEQ ID NO: 3161228 - DNA, 22 bp, Homo sapiens
ttatttactgagcttctctgtg

SEQ ID NO: 3161229 - DNA, 12 bp, Homo sapiens
ttatttactttt

SEQ ID NO: 3161230 - DNA, 23 bp, Homo sapiens
ttatttagactcatcttactgta

SEQ ID NO: 3161231 - DNA, 14 bp, Homo sapiens
ttatttatagtcat

SEQ ID NO: 3161232 - DNA, 22 bp, Homo sapiens
ttatttatgaaaaaatatgaac

SEQ ID NO: 3161233 - DNA, 13 bp, Homo sapiens
ttatttattaaga

SEQ ID NO: 3161234 - DNA, 18 bp, Homo sapiens
ttatttcataaacaactt

SEQ ID NO: 3161235 - DNA, 19 bp, Homo sapiens
ttatttccaaataaaatga

SEQ ID NO: 3161236 - DNA, 17 bp, Homo sapiens
ttatttctaagtattta

SEQ ID NO: 3161237 - DNA, 19 bp, Homo sapiens
ttatttctaagtatttaaa

SEQ ID NO: 3161238 - DNA, 13 bp, Homo sapiens
ttatttctgcata

SEQ ID NO: 3161239 - DNA, 20 bp, Homo sapiens
ttatttctgcatatgttgaa

SEQ ID NO: 3161240 - DNA, 17 bp, Homo sapiens
ttatttctgctctggaa

SEQ ID NO: 3161241 - DNA, 14 bp, Homo sapiens
ttatttgacaaaat

SEQ ID NO: 3161242 - DNA, 15 bp, Homo sapiens
ttatttgctgttaac

SEQ ID NO: 3161243 - DNA, 22 bp, Homo sapiens
ttatttggcagtttggtatttg

SEQ ID NO: 3161244 - DNA, 20 bp, Homo sapiens
ttatttgtaaaccattgtaa

SEQ ID NO: 3161245 - DNA, 14 bp, Homo sapiens
ttattttaaacaaa

SEQ ID NO: 3161246 - DNA, 16 bp, Homo sapiens
ttattttaaacaaaat

SEQ ID NO: 3161247 - DNA, 20 bp, Homo sapiens
ttattttaatattgatgtca

SEQ ID NO: 3161248 - DNA, 13 bp, Homo sapiens
ttattttaatgta

SEQ ID NO: 3161249 - DNA, 14 bp, Homo sapiens
ttattttaatgtaa

SEQ ID NO: 3161250 - DNA, 16 bp, Homo sapiens
ttattttaatgtgatg

SEQ ID NO: 3161251 - DNA, 22 bp, Homo sapiens
ttattttatgacatgaaaagtt

SEQ ID NO: 3161252 - DNA, 22 bp, Homo sapiens
ttattttcagtgcatcattact

SEQ ID NO: 3161253 - DNA, 21 bp, Homo sapiens
ttattttctggtagatagaaa

SEQ ID NO: 3161254 - DNA, 17 bp, Homo sapiens
ttattttctttgaaatt

SEQ ID NO: 3161255 - DNA, 11 bp, Homo sapiens
ttattttgctg

SEQ ID NO: 3161256 - DNA, 14 bp, Homo sapiens
ttattttgctgagt

SEQ ID NO: 3161257 - DNA, 16 bp, Homo sapiens
ttattttgctgagttg

SEQ ID NO: 3161258 - DNA, 13 bp, Homo sapiens
ttattttggatat

SEQ ID NO: 3161259 - DNA, 15 bp, Homo sapiens
ttattttggggtctc

SEQ ID NO: 3161260 - DNA, 18 bp, Homo sapiens
ttatttttataattgtac

SEQ ID NO: 3161261 - DNA, 16 bp, Homo sapiens
ttatttttcatattgt

SEQ ID NO: 3161262 - DNA, 19 bp, Homo sapiens
ttatttttcatattgtgcc

SEQ ID NO: 3161263 - DNA, 22 bp, Homo sapiens
ttatttttctaaggttctcata

SEQ ID NO: 3161264 - DNA, 14 bp, Homo sapiens
ttatttttcttgtc

SEQ ID NO: 3161265 - DNA, 23 bp, Homo sapiens
ttatttttgacagtgttgaaaat

SEQ ID NO: 3161266 - DNA, 13 bp, Homo sapiens
ttatttttgtaat

SEQ ID NO: 3161267 - DNA, 18 bp, Homo sapiens
ttattttttaagtattta

SEQ ID NO: 3161268 - DNA, 14 bp, Homo sapiens
ttattttttacatt

SEQ ID NO: 3161269 - DNA, 18 bp, Homo sapiens
ttattttttacattatta

SEQ ID NO: 3161270 - DNA, 19 bp, Homo sapiens
ttattttttagtgatgaga

SEQ ID NO: 3161271 - DNA, 13 bp, Homo sapiens
ttattttttattg

SEQ ID NO: 3161272 - DNA, 20 bp, Homo sapiens
ttattttttcttttgtaatt

SEQ ID NO: 3161273 - DNA, 17 bp, Homo sapiens
ttatttttttaaaattt

SEQ ID NO: 3161274 - DNA, 21 bp, Homo sapiens
ttcaaaaataaaaaatctgaa

SEQ ID NO: 3161275 - DNA, 17 bp, Homo sapiens
ttcaaaacattccaaga

SEQ ID NO: 3161276 - DNA, 16 bp, Homo sapiens
ttcaaaacctgcagtt

SEQ ID NO: 3161277 - DNA, 21 bp, Homo sapiens
ttcaaaacctgcagttaacag

SEQ ID NO: 3161278 - DNA, 20 bp, Homo sapiens
ttcaaaaggtattatacatg

SEQ ID NO: 3161279 - DNA, 19 bp, Homo sapiens
ttcaaaatccttccaaaga

SEQ ID NO: 3161280 - DNA, 16 bp, Homo sapiens
ttcaaaatggagggaa

SEQ ID NO: 3161281 - DNA, 16 bp, Homo sapiens
ttcaaaattaaatctg

SEQ ID NO: 3161282 - DNA, 23 bp, Homo sapiens
ttcaaaccaatttcttccttcca

SEQ ID NO: 3161283 - DNA, 14 bp, Homo sapiens
ttcaaactgcagct

SEQ ID NO: 3161284 - DNA, 16 bp, Homo sapiens
ttcaaactggggcctc

SEQ ID NO: 3161285 - DNA, 19 bp, Homo sapiens
ttcaaacttactattttga

SEQ ID NO: 3161286 - DNA, 13 bp, Homo sapiens
ttcaaactttcac

SEQ ID NO: 3161287 - DNA, 17 bp, Homo sapiens
ttcaaactttcactttg

SEQ ID NO: 3161288 - DNA, 22 bp, Homo sapiens
ttcaaacttttattagccagtg

SEQ ID NO: 3161289 - DNA, 15 bp, Homo sapiens
ttcaaagaaacttga

SEQ ID NO: 3161290 - DNA, 17 bp, Homo sapiens
ttcaaagacaatcactg

SEQ ID NO: 3161291 - DNA, 22 bp, Homo sapiens
ttcaaagacaatcactgaaaca

SEQ ID NO: 3161292 - DNA, 12 bp, Homo sapiens
ttcaaagagatg

SEQ ID NO: 3161293 - DNA, 22 bp, Homo sapiens
ttcaaagagatgggccttttct

SEQ ID NO: 3161294 - DNA, 16 bp, Homo sapiens
ttcaaagcttgaagat

SEQ ID NO: 3161295 - DNA, 19 bp, Homo sapiens
ttcaaaggccacatacctc

SEQ ID NO: 3161296 - DNA, 18 bp, Homo sapiens
ttcaaagtaaaggcctcc

SEQ ID NO: 3161297 - DNA, 22 bp, Homo sapiens
ttcaaagtgtatatttattcat

SEQ ID NO: 3161298 - DNA, 14 bp, Homo sapiens
ttcaaatacaaagt

SEQ ID NO: 3161299 - DNA, 15 bp, Homo sapiens
ttcaaattgctgctt

SEQ ID NO: 3161300 - DNA, 22 bp, Homo sapiens
ttcaaattggaatggaactact

SEQ ID NO: 3161301 - DNA, 13 bp, Homo sapiens
ttcaaatttcaca

SEQ ID NO: 3161302 - DNA, 12 bp, Homo sapiens
ttcaaatttgta

SEQ ID NO: 3161303 - DNA, 13 bp, Homo sapiens
ttcaaatttgtac

SEQ ID NO: 3161304 - DNA, 22 bp, Homo sapiens
ttcaacaaatattcactggccc

SEQ ID NO: 3161305 - DNA, 21 bp, Homo sapiens
ttcaacaacgtgagagaaaga

SEQ ID NO: 3161306 - DNA, 15 bp, Homo sapiens
ttcaacaatttcaat

SEQ ID NO: 3161307 - DNA, 22 bp, Homo sapiens
ttcaacatcaatgttcattgta

SEQ ID NO: 3161308 - DNA, 15 bp, Homo sapiens
ttcaacatcctgcca

SEQ ID NO: 3161309 - DNA, 12 bp, Homo sapiens
ttcaacattaag

SEQ ID NO: 3161310 - DNA, 13 bp, Homo sapiens
ttcaacgcagccc

SEQ ID NO: 3161311 - DNA, 20 bp, Homo sapiens
ttcaacgcagccctgctttg

SEQ ID NO: 3161312 - DNA, 17 bp, Homo sapiens
ttcaactgaccagcctc

SEQ ID NO: 3161313 - DNA, 23 bp, Homo sapiens
ttcaactgtgctcttgttttgtc

SEQ ID NO: 3161314 - DNA, 17 bp, Homo sapiens
ttcaagaaaaaataaat

SEQ ID NO: 3161315 - DNA, 23 bp, Homo sapiens
ttcaagaaaaaataaatggaaat

SEQ ID NO: 3161316 - DNA, 13 bp, Homo sapiens
ttcaagaccagcc

SEQ ID NO: 3161317 - DNA, 17 bp, Homo sapiens
ttcaagacgaggggcag

SEQ ID NO: 3161318 - DNA, 17 bp, Homo sapiens
ttcaagcaaacatcaaa

SEQ ID NO: 3161319 - DNA, 20 bp, Homo sapiens
ttcaagcaaacatcaaataa

SEQ ID NO: 3161320 - DNA, 22 bp, Homo sapiens
ttcaagcagtcgtgcctgtgtc

SEQ ID NO: 3161321 - DNA, 20 bp, Homo sapiens
ttcaagctgtcccctctgtc

SEQ ID NO: 3161322 - DNA, 11 bp, Homo sapiens
ttcaaggaagg

SEQ ID NO: 3161323 - DNA, 21 bp, Homo sapiens
ttcaaggatatactgcagctt

SEQ ID NO: 3161324 - DNA, 18 bp, Homo sapiens
ttcaaggcactctagatt

SEQ ID NO: 3161325 - DNA, 19 bp, Homo sapiens
ttcaaggcactctagattc

SEQ ID NO: 3161326 - DNA, 14 bp, Homo sapiens
ttcaaggccttcca

SEQ ID NO: 3161327 - DNA, 15 bp, Homo sapiens
ttcaaggcttccact

SEQ ID NO: 3161328 - DNA, 15 bp, Homo sapiens
ttcaagggaagaaac

SEQ ID NO: 3161329 - DNA, 18 bp, Homo sapiens
ttcaaggtggccaaatta

SEQ ID NO: 3161330 - DNA, 20 bp, Homo sapiens
ttcaaggtggccaaattatt

SEQ ID NO: 3161331 - DNA, 22 bp, Homo sapiens
ttcaaggtggccaaattatttg

SEQ ID NO: 3161332 - DNA, 14 bp, Homo sapiens
ttcaaggttctaac

SEQ ID NO: 3161333 - DNA, 15 bp, Homo sapiens
ttcaaggttctaacc

SEQ ID NO: 3161334 - DNA, 14 bp, Homo sapiens
ttcaagtgccaaac

SEQ ID NO: 3161335 - DNA, 12 bp, Homo sapiens
ttcaagtgccta

SEQ ID NO: 3161336 - DNA, 14 bp, Homo sapiens
ttcaagtgcctaga

SEQ ID NO: 3161337 - DNA, 18 bp, Homo sapiens
ttcaagtgcctagactgt

SEQ ID NO: 3161338 - DNA, 13 bp, Homo sapiens
ttcaagtgccttt

SEQ ID NO: 3161339 - DNA, 22 bp, Homo sapiens
ttcaagtgccttttgctgcgca

SEQ ID NO: 3161340 - DNA, 17 bp, Homo sapiens
ttcaagttattgtacag

SEQ ID NO: 3161341 - DNA, 13 bp, Homo sapiens
ttcaagtttacac

SEQ ID NO: 3161342 - DNA, 19 bp, Homo sapiens
ttcaataaatgtctgttga

SEQ ID NO: 3161343 - DNA, 16 bp, Homo sapiens
ttcaataataaatatt

SEQ ID NO: 3161344 - DNA, 22 bp, Homo sapiens
ttcaatactgtcccacttctca

SEQ ID NO: 3161345 - DNA, 11 bp, Homo sapiens
ttcaatatgca

SEQ ID NO: 3161346 - DNA, 19 bp, Homo sapiens
ttcaatatgcaagcagctt

SEQ ID NO: 3161347 - DNA, 20 bp, Homo sapiens
ttcaatatgcaagcagcttt

SEQ ID NO: 3161348 - DNA, 19 bp, Homo sapiens
ttcaatcaactttactgta

SEQ ID NO: 3161349 - DNA, 17 bp, Homo sapiens
ttcaatcattgaagtat

SEQ ID NO: 3161350 - DNA, 17 bp, Homo sapiens
ttcaatcccaattctgt

SEQ ID NO: 3161351 - DNA, 22 bp, Homo sapiens
ttcaatctgtgtaagaaaacaa

SEQ ID NO: 3161352 - DNA, 12 bp, Homo sapiens
ttcaattcctct

SEQ ID NO: 3161353 - DNA, 16 bp, Homo sapiens
ttcaattcctgggccc

SEQ ID NO: 3161354 - DNA, 15 bp, Homo sapiens
ttcacaaaatttcca

SEQ ID NO: 3161355 - DNA, 15 bp, Homo sapiens
ttcacaagcctcctg

SEQ ID NO: 3161356 - DNA, 16 bp, Homo sapiens
ttcacaaggtataata

SEQ ID NO: 3161357 - DNA, 16 bp, Homo sapiens
ttcacaatgtcagtat

SEQ ID NO: 3161358 - DNA, 13 bp, Homo sapiens
ttcacaccccagg

SEQ ID NO: 3161359 - DNA, 12 bp, Homo sapiens
ttcacaccctgc

SEQ ID NO: 3161360 - DNA, 13 bp, Homo sapiens
ttcacaccctgca

SEQ ID NO: 3161361 - DNA, 14 bp, Homo sapiens
ttcacaccctgcaa

SEQ ID NO: 3161362 - DNA, 19 bp, Homo sapiens
ttcacacctgactctgaaa

SEQ ID NO: 3161363 - DNA, 15 bp, Homo sapiens
ttcacagaaaaagca

SEQ ID NO: 3161364 - DNA, 18 bp, Homo sapiens
ttcacagaaaaagcatga

SEQ ID NO: 3161365 - DNA, 22 bp, Homo sapiens
ttcacaggctgtaaattgaact

SEQ ID NO: 3161366 - DNA, 23 bp, Homo sapiens
ttcacaggggttcccttctctca

SEQ ID NO: 3161367 - DNA, 13 bp, Homo sapiens
ttcacagtcccag

SEQ ID NO: 3161368 - DNA, 15 bp, Homo sapiens
ttcacatagctgtct

SEQ ID NO: 3161369 - DNA, 15 bp, Homo sapiens
ttcacatgttctaat

SEQ ID NO: 3161370 - DNA, 16 bp, Homo sapiens
ttcacatgttctaata

SEQ ID NO: 3161371 - DNA, 23 bp, Homo sapiens
ttcacattaaaaaatgaaatatt

SEQ ID NO: 3161372 - DNA, 20 bp, Homo sapiens
ttcacattgtttgctgctat

SEQ ID NO: 3161373 - DNA, 17 bp, Homo sapiens
ttcacattttttttctt

SEQ ID NO: 3161374 - DNA, 16 bp, Homo sapiens
ttcaccaaaattatcc

SEQ ID NO: 3161375 - DNA, 23 bp, Homo sapiens
ttcaccaaatgatgccacttccc

SEQ ID NO: 3161376 - DNA, 12 bp, Homo sapiens
ttcaccagagca

SEQ ID NO: 3161377 - DNA, 18 bp, Homo sapiens
ttcaccagatttgctaat

SEQ ID NO: 3161378 - DNA, 13 bp, Homo sapiens
ttcaccagtctgt

SEQ ID NO: 3161379 - DNA, 14 bp, Homo sapiens
ttcaccccaccctt

SEQ ID NO: 3161380 - DNA, 22 bp, Homo sapiens
ttcaccccccactcaccagtgt

SEQ ID NO: 3161381 - DNA, 18 bp, Homo sapiens
ttcaccccggcaggccct

SEQ ID NO: 3161382 - DNA, 12 bp, Homo sapiens
ttcacccctgca

SEQ ID NO: 3161383 - DNA, 13 bp, Homo sapiens
ttcacccctgcac

SEQ ID NO: 3161384 - DNA, 14 bp, Homo sapiens
ttcacccctgcact

SEQ ID NO: 3161385 - DNA, 13 bp, Homo sapiens
ttcaccctccact

SEQ ID NO: 3161386 - DNA, 17 bp, Homo sapiens
ttcaccctccacttccc

SEQ ID NO: 3161387 - DNA, 22 bp, Homo sapiens
ttcacccttaacccaaggagca

SEQ ID NO: 3161388 - DNA, 22 bp, Homo sapiens
ttcacccttatagtctaagact

SEQ ID NO: 3161389 - DNA, 18 bp, Homo sapiens
ttcacctaccgagttcaa

SEQ ID NO: 3161390 - DNA, 22 bp, Homo sapiens
ttcacctccctgctcagtgctt

SEQ ID NO: 3161391 - DNA, 23 bp, Homo sapiens
ttcacctcggagggatggagaaa

SEQ ID NO: 3161392 - DNA, 18 bp, Homo sapiens
ttcacctctatccaaaga

SEQ ID NO: 3161393 - DNA, 18 bp, Homo sapiens
ttcacctgggccctggag

SEQ ID NO: 3161394 - DNA, 13 bp, Homo sapiens
ttcacctgtaaac

SEQ ID NO: 3161395 - DNA, 16 bp, Homo sapiens
ttcacctgtgacaaag

SEQ ID NO: 3161396 - DNA, 23 bp, Homo sapiens
ttcacctgtttttaagctgtttc

SEQ ID NO: 3161397 - DNA, 23 bp, Homo sapiens
ttcacctttgtaagacatttgta

SEQ ID NO: 3161398 - DNA, 22 bp, Homo sapiens
ttcaccttttcttcaaaatcga

SEQ ID NO: 3161399 - DNA, 19 bp, Homo sapiens
ttcacgcctgaggcaatta

SEQ ID NO: 3161400 - DNA, 18 bp, Homo sapiens
ttcacgtcttggtgcctt

SEQ ID NO: 3161401 - DNA, 22 bp, Homo sapiens
ttcacgtgcagcagcaacacaa

SEQ ID NO: 3161402 - DNA, 18 bp, Homo sapiens
ttcactatcttcttcaaa

SEQ ID NO: 3161403 - DNA, 14 bp, Homo sapiens
ttcactcaagcact

SEQ ID NO: 3161404 - DNA, 19 bp, Homo sapiens
ttcactcactgtcaatgat

SEQ ID NO: 3161405 - DNA, 21 bp, Homo sapiens
ttcactccggtgtgcctgcag

SEQ ID NO: 3161406 - DNA, 13 bp, Homo sapiens
ttcactcttaggc

SEQ ID NO: 3161407 - DNA, 18 bp, Homo sapiens
ttcactgaaatgtttgga

SEQ ID NO: 3161408 - DNA, 13 bp, Homo sapiens
ttcactgccatga

SEQ ID NO: 3161409 - DNA, 15 bp, Homo sapiens
ttcactgctggctgc

SEQ ID NO: 3161410 - DNA, 16 bp, Homo sapiens
ttcactgctggctgcc

SEQ ID NO: 3161411 - DNA, 18 bp, Homo sapiens
ttcactgctggctgcctt

SEQ ID NO: 3161412 - DNA, 16 bp, Homo sapiens
ttcactggagttacat

SEQ ID NO: 3161413 - DNA, 19 bp, Homo sapiens
ttcactggagttacattaa

SEQ ID NO: 3161414 - DNA, 15 bp, Homo sapiens
ttcactgtataaata

SEQ ID NO: 3161415 - DNA, 18 bp, Homo sapiens
ttcactgtataaatagga

SEQ ID NO: 3161416 - DNA, 23 bp, Homo sapiens
ttcactgtataaataggagagga

SEQ ID NO: 3161417 - DNA, 16 bp, Homo sapiens
ttcactgtcatcttca

SEQ ID NO: 3161418 - DNA, 17 bp, Homo sapiens
ttcactgtcatcttcaa

SEQ ID NO: 3161419 - DNA, 22 bp, Homo sapiens
ttcactgtggccacagccccct

SEQ ID NO: 3161420 - DNA, 21 bp, Homo sapiens
ttcactgttgaaaattatttt

SEQ ID NO: 3161421 - DNA, 20 bp, Homo sapiens
ttcacttcagtttaatgtct

SEQ ID NO: 3161422 - DNA, 23 bp, Homo sapiens
ttcacttctgcattcctgtaact

SEQ ID NO: 3161423 - DNA, 17 bp, Homo sapiens
ttcacttgaaagatttt

SEQ ID NO: 3161424 - DNA, 13 bp, Homo sapiens
ttcacttgtattg

SEQ ID NO: 3161425 - DNA, 19 bp, Homo sapiens
ttcacttgtattgacttta

SEQ ID NO: 3161426 - DNA, 22 bp, Homo sapiens
ttcactttgctctcaattaaag

SEQ ID NO: 3161427 - DNA, 18 bp, Homo sapiens
ttcacttttcaatcccaa

SEQ ID NO: 3161428 - DNA, 16 bp, Homo sapiens
ttcacttttgttctgc

SEQ ID NO: 3161429 - DNA, 13 bp, Homo sapiens
ttcagaaaatatt

SEQ ID NO: 3161430 - DNA, 14 bp, Homo sapiens
ttcagaaaatatta

SEQ ID NO: 3161431 - DNA, 21 bp, Homo sapiens
ttcagaaaatattatgtgttt

SEQ ID NO: 3161432 - DNA, 15 bp, Homo sapiens
ttcagaaaatgttct

SEQ ID NO: 3161433 - DNA, 19 bp, Homo sapiens
ttcagaaaatgttctgttt

SEQ ID NO: 3161434 - DNA, 15 bp, Homo sapiens
ttcagaaatataaca

SEQ ID NO: 3161435 - DNA, 22 bp, Homo sapiens
ttcagaaatataacacattttt

SEQ ID NO: 3161436 - DNA, 23 bp, Homo sapiens
ttcagaacacacagactttctgt

SEQ ID NO: 3161437 - DNA, 16 bp, Homo sapiens
ttcagaaccatccata

SEQ ID NO: 3161438 - DNA, 15 bp, Homo sapiens
ttcagaacctcttcc

SEQ ID NO: 3161439 - DNA, 19 bp, Homo sapiens
ttcagaaggttattttctt

SEQ ID NO: 3161440 - DNA, 21 bp, Homo sapiens
ttcagaataaattgatccttt

SEQ ID NO: 3161441 - DNA, 23 bp, Homo sapiens
ttcagaatcatgtcgatcctggg

SEQ ID NO: 3161442 - DNA, 21 bp, Homo sapiens
ttcagaatctgaatgtaattt

SEQ ID NO: 3161443 - DNA, 16 bp, Homo sapiens
ttcagaattaaacttt

SEQ ID NO: 3161444 - DNA, 15 bp, Homo sapiens
ttcagaatttagtgt

SEQ ID NO: 3161445 - DNA, 21 bp, Homo sapiens
ttcagaatttagtgtatccat

SEQ ID NO: 3161446 - DNA, 15 bp, Homo sapiens
ttcagacactttgga

SEQ ID NO: 3161447 - DNA, 21 bp, Homo sapiens
ttcagacttttatcaaaatcc

SEQ ID NO: 3161448 - DNA, 21 bp, Homo sapiens
ttcagagacagctgatacttc

SEQ ID NO: 3161449 - DNA, 15 bp, Homo sapiens
ttcagagagctggta

SEQ ID NO: 3161450 - DNA, 22 bp, Homo sapiens
ttcagaggataaatatcaatgg

SEQ ID NO: 3161451 - DNA, 17 bp, Homo sapiens
ttcagagggaaagtaaa

SEQ ID NO: 3161452 - DNA, 23 bp, Homo sapiens
ttcagagtcctcattataaaatg

SEQ ID NO: 3161453 - DNA, 15 bp, Homo sapiens
ttcagagtttgtgtg

SEQ ID NO: 3161454 - DNA, 12 bp, Homo sapiens
ttcagatacatg

SEQ ID NO: 3161455 - DNA, 16 bp, Homo sapiens
ttcagatatatttttc

SEQ ID NO: 3161456 - DNA, 18 bp, Homo sapiens
ttcagatattattgcttt

SEQ ID NO: 3161457 - DNA, 19 bp, Homo sapiens
ttcagatcaaaatgccttt

SEQ ID NO: 3161458 - DNA, 22 bp, Homo sapiens
ttcagatctgaggttggatttg

SEQ ID NO: 3161459 - DNA, 13 bp, Homo sapiens
ttcagatgtgcat

SEQ ID NO: 3161460 - DNA, 14 bp, Homo sapiens
ttcagatgtgcatt

SEQ ID NO: 3161461 - DNA, 21 bp, Homo sapiens
ttcagattcccagagcaaaat

SEQ ID NO: 3161462 - DNA, 13 bp, Homo sapiens
ttcagattgtctt

SEQ ID NO: 3161463 - DNA, 12 bp, Homo sapiens
ttcagatttggc

SEQ ID NO: 3161464 - DNA, 13 bp, Homo sapiens
ttcagcaaaccat

SEQ ID NO: 3161465 - DNA, 13 bp, Homo sapiens
ttcagcaccccca

SEQ ID NO: 3161466 - DNA, 23 bp, Homo sapiens
ttcagcaccctgggtgccattcc

SEQ ID NO: 3161467 - DNA, 20 bp, Homo sapiens
ttcagcagcaaattttcagc

SEQ ID NO: 3161468 - DNA, 16 bp, Homo sapiens
ttcagcatatttatag

SEQ ID NO: 3161469 - DNA, 20 bp, Homo sapiens
ttcagcatgactatgtattt

SEQ ID NO: 3161470 - DNA, 16 bp, Homo sapiens
ttcagcattccctccc

SEQ ID NO: 3161471 - DNA, 20 bp, Homo sapiens
ttcagcattcttagcctgtg

SEQ ID NO: 3161472 - DNA, 11 bp, Homo sapiens
ttcagccaagg

SEQ ID NO: 3161473 - DNA, 15 bp, Homo sapiens
ttcagcccccagccc

SEQ ID NO: 3161474 - DNA, 16 bp, Homo sapiens
ttcagcctactgcctc

SEQ ID NO: 3161475 - DNA, 20 bp, Homo sapiens
ttcagcctactgcctcggat

SEQ ID NO: 3161476 - DNA, 20 bp, Homo sapiens
ttcagctaagctaggaatga

SEQ ID NO: 3161477 - DNA, 13 bp, Homo sapiens
ttcagctactttc

SEQ ID NO: 3161478 - DNA, 19 bp, Homo sapiens
ttcagctagcttttaggaa

SEQ ID NO: 3161479 - DNA, 22 bp, Homo sapiens
ttcagctccagctcaccagccc

SEQ ID NO: 3161480 - DNA, 18 bp, Homo sapiens
ttcagctctctgtataaa

SEQ ID NO: 3161481 - DNA, 21 bp, Homo sapiens
ttcagctctctgtataaacat

SEQ ID NO: 3161482 - DNA, 15 bp, Homo sapiens
ttcagctctggagaa

SEQ ID NO: 3161483 - DNA, 18 bp, Homo sapiens
ttcagctgcctgaaacag

SEQ ID NO: 3161484 - DNA, 19 bp, Homo sapiens
ttcagctgctcagaattca

SEQ ID NO: 3161485 - DNA, 16 bp, Homo sapiens
ttcagctgtcctccct

SEQ ID NO: 3161486 - DNA, 21 bp, Homo sapiens
ttcaggaacaagtaatgtatt

SEQ ID NO: 3161487 - DNA, 23 bp, Homo sapiens
ttcaggaacaagtaatgtattag

SEQ ID NO: 3161488 - DNA, 19 bp, Homo sapiens
ttcaggaatgtgtggcctg

SEQ ID NO: 3161489 - DNA, 23 bp, Homo sapiens
ttcaggaattacactgtgccttt

SEQ ID NO: 3161490 - DNA, 17 bp, Homo sapiens
ttcaggatactctgtca

SEQ ID NO: 3161491 - DNA, 14 bp, Homo sapiens
ttcaggcaccagca

SEQ ID NO: 3161492 - DNA, 14 bp, Homo sapiens
ttcaggccagccca

SEQ ID NO: 3161493 - DNA, 16 bp, Homo sapiens
ttcaggccagcccagc

SEQ ID NO: 3161494 - DNA, 18 bp, Homo sapiens
ttcaggccagcccagcca

SEQ ID NO: 3161495 - DNA, 20 bp, Homo sapiens
ttcaggccagcccagccagg

SEQ ID NO: 3161496 - DNA, 15 bp, Homo sapiens
ttcaggctcttctcc

SEQ ID NO: 3161497 - DNA, 18 bp, Homo sapiens
ttcagggaatttcaggaa

SEQ ID NO: 3161498 - DNA, 21 bp, Homo sapiens
ttcagggagaaactccaaagt

SEQ ID NO: 3161499 - DNA, 22 bp, Homo sapiens
ttcagggaggtagtttcaaagg

SEQ ID NO: 3161500 - DNA, 23 bp, Homo sapiens
ttcagggccagtcctcctgggag

SEQ ID NO: 3161501 - DNA, 20 bp, Homo sapiens
ttcaggggactcagccctga

SEQ ID NO: 3161502 - DNA, 23 bp, Homo sapiens
ttcaggggactcagccctgaggt

SEQ ID NO: 3161503 - DNA, 20 bp, Homo sapiens
ttcaggggctgggggtgctg

SEQ ID NO: 3161504 - DNA, 23 bp, Homo sapiens
ttcaggggctgggggtgctggat

SEQ ID NO: 3161505 - DNA, 14 bp, Homo sapiens
ttcagggttggccc

SEQ ID NO: 3161506 - DNA, 16 bp, Homo sapiens
ttcagggttggcccct

SEQ ID NO: 3161507 - DNA, 15 bp, Homo sapiens
ttcaggtaacaggca

SEQ ID NO: 3161508 - DNA, 21 bp, Homo sapiens
ttcaggtaggcccttgtcctg

SEQ ID NO: 3161509 - DNA, 14 bp, Homo sapiens
ttcaggtgaaaatg

SEQ ID NO: 3161510 - DNA, 13 bp, Homo sapiens
ttcaggtgacatg

SEQ ID NO: 3161511 - DNA, 17 bp, Homo sapiens
ttcaggtgacatgtgaa

SEQ ID NO: 3161512 - DNA, 23 bp, Homo sapiens
ttcaggtgacatgtgaaaccttt

SEQ ID NO: 3161513 - DNA, 20 bp, Homo sapiens
ttcaggtggatgaggagaca

SEQ ID NO: 3161514 - DNA, 20 bp, Homo sapiens
ttcaggtgtttagttgcaga

SEQ ID NO: 3161515 - DNA, 19 bp, Homo sapiens
ttcaggttatcgaaataac

SEQ ID NO: 3161516 - DNA, 15 bp, Homo sapiens
ttcaggttctcatga

SEQ ID NO: 3161517 - DNA, 13 bp, Homo sapiens
ttcaggttttcag

SEQ ID NO: 3161518 - DNA, 17 bp, Homo sapiens
ttcagtaaataatgaaa

SEQ ID NO: 3161519 - DNA, 20 bp, Homo sapiens
ttcagtaataaactgtgttt

SEQ ID NO: 3161520 - DNA, 21 bp, Homo sapiens
ttcagtacacttggtgtactg

SEQ ID NO: 3161521 - DNA, 15 bp, Homo sapiens
ttcagtagaattacc

SEQ ID NO: 3161522 - DNA, 16 bp, Homo sapiens
ttcagtataatttaac

SEQ ID NO: 3161523 - DNA, 23 bp, Homo sapiens
ttcagtataatttaacttcagag

SEQ ID NO: 3161524 - DNA, 16 bp, Homo sapiens
ttcagtatcatctcca

SEQ ID NO: 3161525 - DNA, 17 bp, Homo sapiens
ttcagtatttaatgaaa

SEQ ID NO: 3161526 - DNA, 18 bp, Homo sapiens
ttcagtatttaatgaaac

SEQ ID NO: 3161527 - DNA, 19 bp, Homo sapiens
ttcagtatttaatgaaacc

SEQ ID NO: 3161528 - DNA, 20 bp, Homo sapiens
ttcagtattttggagaaatt

SEQ ID NO: 3161529 - DNA, 16 bp, Homo sapiens
ttcagtcctgctccag

SEQ ID NO: 3161530 - DNA, 18 bp, Homo sapiens
ttcagtcctgctccagaa

SEQ ID NO: 3161531 - DNA, 22 bp, Homo sapiens
ttcagtcctgggagacccatgt

SEQ ID NO: 3161532 - DNA, 19 bp, Homo sapiens
ttcagtcctgggcaaaggt

SEQ ID NO: 3161533 - DNA, 18 bp, Homo sapiens
ttcagtgactcctgctgg

SEQ ID NO: 3161534 - DNA, 13 bp, Homo sapiens
ttcagtgctgtgg

SEQ ID NO: 3161535 - DNA, 19 bp, Homo sapiens
ttcagtgctgtggcctggg

SEQ ID NO: 3161536 - DNA, 21 bp, Homo sapiens
ttcagtgctgtggcctgggca

SEQ ID NO: 3161537 - DNA, 12 bp, Homo sapiens
ttcagtggagaa

SEQ ID NO: 3161538 - DNA, 16 bp, Homo sapiens
ttcagtggcagggctc

SEQ ID NO: 3161539 - DNA, 19 bp, Homo sapiens
ttcagtggcttcccagctc

SEQ ID NO: 3161540 - DNA, 16 bp, Homo sapiens
ttcagtgtagttaatt

SEQ ID NO: 3161541 - DNA, 18 bp, Homo sapiens
ttcagtgtcccaccttga

SEQ ID NO: 3161542 - DNA, 10 bp, Homo sapiens
ttcagttcca

SEQ ID NO: 3161543 - DNA, 17 bp, Homo sapiens
ttcagttctgtgtacat

SEQ ID NO: 3161544 - DNA, 18 bp, Homo sapiens
ttcagttggtgtgttttt

SEQ ID NO: 3161545 - DNA, 17 bp, Homo sapiens
ttcagtttaatgtctcc

SEQ ID NO: 3161546 - DNA, 18 bp, Homo sapiens
ttcagtttaatgtctcct

SEQ ID NO: 3161547 - DNA, 17 bp, Homo sapiens
ttcagttttatctttaa

SEQ ID NO: 3161548 - DNA, 19 bp, Homo sapiens
ttcagtttttaacataatt

SEQ ID NO: 3161549 - DNA, 15 bp, Homo sapiens
ttcagtttttgtatc

SEQ ID NO: 3161550 - DNA, 18 bp, Homo sapiens
ttcataaagagaaaatga

SEQ ID NO: 3161551 - DNA, 15 bp, Homo sapiens
ttcataacagtgcca

SEQ ID NO: 3161552 - DNA, 17 bp, Homo sapiens
ttcataacagtgccatt

SEQ ID NO: 3161553 - DNA, 16 bp, Homo sapiens
ttcataacttcctgta

SEQ ID NO: 3161554 - DNA, 15 bp, Homo sapiens
ttcataatcactcta

SEQ ID NO: 3161555 - DNA, 19 bp, Homo sapiens
ttcataatgaattataaca

SEQ ID NO: 3161556 - DNA, 19 bp, Homo sapiens
ttcatagggtctcttcagg

SEQ ID NO: 3161557 - DNA, 14 bp, Homo sapiens
ttcataggtcactg

SEQ ID NO: 3161558 - DNA, 19 bp, Homo sapiens
ttcataggtcactggctct

SEQ ID NO: 3161559 - DNA, 17 bp, Homo sapiens
ttcatagtaacttctta

SEQ ID NO: 3161560 - DNA, 19 bp, Homo sapiens
ttcatagttcagaatttag

SEQ ID NO: 3161561 - DNA, 20 bp, Homo sapiens
ttcatagttcagaatttagt

SEQ ID NO: 3161562 - DNA, 18 bp, Homo sapiens
ttcatatatgaggacttg

SEQ ID NO: 3161563 - DNA, 22 bp, Homo sapiens
ttcatatcatcaatgtgacatt

SEQ ID NO: 3161564 - DNA, 13 bp, Homo sapiens
ttcatatgctctg

SEQ ID NO: 3161565 - DNA, 20 bp, Homo sapiens
ttcatattaagacagtgtac

SEQ ID NO: 3161566 - DNA, 20 bp, Homo sapiens
ttcatattgatctttttatc

SEQ ID NO: 3161567 - DNA, 16 bp, Homo sapiens
ttcatattgtgccaat

SEQ ID NO: 3161568 - DNA, 19 bp, Homo sapiens
ttcatatttaagtgtattt

SEQ ID NO: 3161569 - DNA, 16 bp, Homo sapiens
ttcatatttacttctt

SEQ ID NO: 3161570 - DNA, 13 bp, Homo sapiens
ttcatatttctac

SEQ ID NO: 3161571 - DNA, 13 bp, Homo sapiens
ttcatcactggga

SEQ ID NO: 3161572 - DNA, 19 bp, Homo sapiens
ttcatcattccctctcatc

SEQ ID NO: 3161573 - DNA, 22 bp, Homo sapiens
ttcatcattgtttctgcatgaa

SEQ ID NO: 3161574 - DNA, 16 bp, Homo sapiens
ttcatccaatcctcac

SEQ ID NO: 3161575 - DNA, 16 bp, Homo sapiens
ttcatcccagccccaa

SEQ ID NO: 3161576 - DNA, 18 bp, Homo sapiens
ttcatcgaatctactaat

SEQ ID NO: 3161577 - DNA, 23 bp, Homo sapiens
ttcatcgaatctactaattccac

SEQ ID NO: 3161578 - DNA, 23 bp, Homo sapiens
ttcatctatttttggcagtctga

SEQ ID NO: 3161579 - DNA, 17 bp, Homo sapiens
ttcatctggggatgaca

SEQ ID NO: 3161580 - DNA, 17 bp, Homo sapiens
ttcatctggggtggggt

SEQ ID NO: 3161581 - DNA, 14 bp, Homo sapiens
ttcatcttctggaa

SEQ ID NO: 3161582 - DNA, 22 bp, Homo sapiens
ttcatcttttgaggcttctgtt

SEQ ID NO: 3161583 - DNA, 15 bp, Homo sapiens
ttcatgaaaatacca

SEQ ID NO: 3161584 - DNA, 16 bp, Homo sapiens
ttcatgacagcctcca

SEQ ID NO: 3161585 - DNA, 14 bp, Homo sapiens
ttcatgcaatgaca

SEQ ID NO: 3161586 - DNA, 14 bp, Homo sapiens
ttcatgcagctgtg

SEQ ID NO: 3161587 - DNA, 21 bp, Homo sapiens
ttcatgccaattagcaattga

SEQ ID NO: 3161588 - DNA, 21 bp, Homo sapiens
ttcatgccagctacttcctcc

SEQ ID NO: 3161589 - DNA, 23 bp, Homo sapiens
ttcatgcccttctgattcccctc

SEQ ID NO: 3161590 - DNA, 15 bp, Homo sapiens
ttcatgcctttgtaa

SEQ ID NO: 3161591 - DNA, 17 bp, Homo sapiens
ttcatgctctcatatat

SEQ ID NO: 3161592 - DNA, 22 bp, Homo sapiens
ttcatggaatggacatcctgta

SEQ ID NO: 3161593 - DNA, 21 bp, Homo sapiens
ttcatggcatgcttaaatttt

SEQ ID NO: 3161594 - DNA, 21 bp, Homo sapiens
ttcatggctgctgttgcttaa

SEQ ID NO: 3161595 - DNA, 22 bp, Homo sapiens
ttcatggctgctgttgcttaaa

SEQ ID NO: 3161596 - DNA, 14 bp, Homo sapiens
ttcatggtctagaa

SEQ ID NO: 3161597 - DNA, 19 bp, Homo sapiens
ttcatggtgaaaatgtact

SEQ ID NO: 3161598 - DNA, 21 bp, Homo sapiens
ttcatgtacaagatgaaggag

SEQ ID NO: 3161599 - DNA, 22 bp, Homo sapiens
ttcatgtcaacttctggctcct

SEQ ID NO: 3161600 - DNA, 22 bp, Homo sapiens
ttcatgtcccagaacttagcct

SEQ ID NO: 3161601 - DNA, 17 bp, Homo sapiens
ttcatgtctttactgga

SEQ ID NO: 3161602 - DNA, 13 bp, Homo sapiens
ttcatgtgcctct

SEQ ID NO: 3161603 - DNA, 22 bp, Homo sapiens
ttcatgttagttaccttatagt

SEQ ID NO: 3161604 - DNA, 15 bp, Homo sapiens
ttcatgttcactgtg

SEQ ID NO: 3161605 - DNA, 15 bp, Homo sapiens
ttcatgtttggtgca

SEQ ID NO: 3161606 - DNA, 19 bp, Homo sapiens
ttcatgtttggtgcataga

SEQ ID NO: 3161607 - DNA, 18 bp, Homo sapiens
ttcatgtttgtaaattaa

SEQ ID NO: 3161608 - DNA, 13 bp, Homo sapiens
ttcattaaacttg

SEQ ID NO: 3161609 - DNA, 13 bp, Homo sapiens
ttcattacagctt

SEQ ID NO: 3161610 - DNA, 18 bp, Homo sapiens
ttcattacagcttaatca

SEQ ID NO: 3161611 - DNA, 20 bp, Homo sapiens
ttcattacttttaaaaatgt

SEQ ID NO: 3161612 - DNA, 22 bp, Homo sapiens
ttcattacttttaaaaatgtag

SEQ ID NO: 3161613 - DNA, 22 bp, Homo sapiens
ttcattattagtactgctcttg

SEQ ID NO: 3161614 - DNA, 15 bp, Homo sapiens
ttcattattctcata

SEQ ID NO: 3161615 - DNA, 16 bp, Homo sapiens
ttcattattttgtggt

SEQ ID NO: 3161616 - DNA, 18 bp, Homo sapiens
ttcattcaaactgcactt

SEQ ID NO: 3161617 - DNA, 21 bp, Homo sapiens
ttcattccttcagatttggct

SEQ ID NO: 3161618 - DNA, 13 bp, Homo sapiens
ttcattctcctgc

SEQ ID NO: 3161619 - DNA, 19 bp, Homo sapiens
ttcattgagagttttgtct

SEQ ID NO: 3161620 - DNA, 18 bp, Homo sapiens
ttcattggatttttgtta

SEQ ID NO: 3161621 - DNA, 18 bp, Homo sapiens
ttcattgtaatgttactg

SEQ ID NO: 3161622 - DNA, 20 bp, Homo sapiens
ttcattgtaatgttactgat

SEQ ID NO: 3161623 - DNA, 14 bp, Homo sapiens
ttcattgtatgatg

SEQ ID NO: 3161624 - DNA, 14 bp, Homo sapiens
ttcatttaaaatga

SEQ ID NO: 3161625 - DNA, 19 bp, Homo sapiens
ttcatttagataatttgaa

SEQ ID NO: 3161626 - DNA, 21 bp, Homo sapiens
ttcatttagataatttgaaaa

SEQ ID NO: 3161627 - DNA, 22 bp, Homo sapiens
ttcatttagataatttgaaaaa

SEQ ID NO: 3161628 - DNA, 18 bp, Homo sapiens
ttcatttatctataattt

SEQ ID NO: 3161629 - DNA, 15 bp, Homo sapiens
ttcatttcattgtat

SEQ ID NO: 3161630 - DNA, 15 bp, Homo sapiens
ttcatttcctgtgtc

SEQ ID NO: 3161631 - DNA, 16 bp, Homo sapiens
ttcatttcctgtgtct

SEQ ID NO: 3161632 - DNA, 20 bp, Homo sapiens
ttcatttgagttattttaat

SEQ ID NO: 3161633 - DNA, 15 bp, Homo sapiens
ttcatttggtgctgg

SEQ ID NO: 3161634 - DNA, 19 bp, Homo sapiens
ttcatttggtgttcctgga

SEQ ID NO: 3161635 - DNA, 21 bp, Homo sapiens
ttcatttggtgttcctggaag

SEQ ID NO: 3161636 - DNA, 17 bp, Homo sapiens
ttcatttgtatgtcaaa

SEQ ID NO: 3161637 - DNA, 13 bp, Homo sapiens
ttcatttgtattg

SEQ ID NO: 3161638 - DNA, 15 bp, Homo sapiens
ttcattttaaaaagt

SEQ ID NO: 3161639 - DNA, 21 bp, Homo sapiens
ttcattttaacatgatttcaa

SEQ ID NO: 3161640 - DNA, 17 bp, Homo sapiens
ttcattttatatttaaa

SEQ ID NO: 3161641 - DNA, 16 bp, Homo sapiens
ttcattttcatcactg

SEQ ID NO: 3161642 - DNA, 22 bp, Homo sapiens
ttcattttctgacatgcattgt

SEQ ID NO: 3161643 - DNA, 12 bp, Homo sapiens
ttcatttttcaa

SEQ ID NO: 3161644 - DNA, 21 bp, Homo sapiens
ttccaaaaagattttcagaaa

SEQ ID NO: 3161645 - DNA, 13 bp, Homo sapiens
ttccaaaataatt

SEQ ID NO: 3161646 - DNA, 18 bp, Homo sapiens
ttccaaaatctcccattt

SEQ ID NO: 3161647 - DNA, 19 bp, Homo sapiens
ttccaaaatctcccatttt

SEQ ID NO: 3161648 - DNA, 13 bp, Homo sapiens
ttccaaaattctt

SEQ ID NO: 3161649 - DNA, 21 bp, Homo sapiens
ttccaaacaacagaaagtcat

SEQ ID NO: 3161650 - DNA, 12 bp, Homo sapiens
ttccaaagaaag

SEQ ID NO: 3161651 - DNA, 19 bp, Homo sapiens
ttccaaagcacattgaaag

SEQ ID NO: 3161652 - DNA, 14 bp, Homo sapiens
ttccaaagtctcta

SEQ ID NO: 3161653 - DNA, 16 bp, Homo sapiens
ttccaaagtctctaat

SEQ ID NO: 3161654 - DNA, 19 bp, Homo sapiens
ttccaaataataaagtcta

SEQ ID NO: 3161655 - DNA, 17 bp, Homo sapiens
ttccaaatgtgtataat

SEQ ID NO: 3161656 - DNA, 23 bp, Homo sapiens
ttccaaattatttcttaattatt

SEQ ID NO: 3161657 - DNA, 15 bp, Homo sapiens
ttccaaattcagttt

SEQ ID NO: 3161658 - DNA, 18 bp, Homo sapiens
ttccaaattcagtttcat

SEQ ID NO: 3161659 - DNA, 15 bp, Homo sapiens
ttccaaattctgctt

SEQ ID NO: 3161660 - DNA, 16 bp, Homo sapiens
ttccaaatttggctca

SEQ ID NO: 3161661 - DNA, 21 bp, Homo sapiens
ttccaacaatggggtgggccc

SEQ ID NO: 3161662 - DNA, 22 bp, Homo sapiens
ttccaacaccacagacacacac

SEQ ID NO: 3161663 - DNA, 13 bp, Homo sapiens
ttccaaccaggca

SEQ ID NO: 3161664 - DNA, 23 bp, Homo sapiens
ttccaagaaagatgaatacattt

SEQ ID NO: 3161665 - DNA, 12 bp, Homo sapiens
ttccaagacatt

SEQ ID NO: 3161666 - DNA, 17 bp, Homo sapiens
ttccaagactctagagt

SEQ ID NO: 3161667 - DNA, 17 bp, Homo sapiens
ttccaagagtctaaaga

SEQ ID NO: 3161668 - DNA, 15 bp, Homo sapiens
ttccaagcatgacaa

SEQ ID NO: 3161669 - DNA, 13 bp, Homo sapiens
ttccaaggagacc

SEQ ID NO: 3161670 - DNA, 18 bp, Homo sapiens
ttccaaggccctgctttt

SEQ ID NO: 3161671 - DNA, 15 bp, Homo sapiens
ttccaagggtactaa

SEQ ID NO: 3161672 - DNA, 17 bp, Homo sapiens
ttccaagggtactaagg

SEQ ID NO: 3161673 - DNA, 19 bp, Homo sapiens
ttccaagtaatataatgga

SEQ ID NO: 3161674 - DNA, 17 bp, Homo sapiens
ttccaagttgaagggaa

SEQ ID NO: 3161675 - DNA, 18 bp, Homo sapiens
ttccaatttataatgaat

SEQ ID NO: 3161676 - DNA, 11 bp, Homo sapiens
ttccacaaaat

SEQ ID NO: 3161677 - DNA, 20 bp, Homo sapiens
ttccacagatatctttttca

SEQ ID NO: 3161678 - DNA, 22 bp, Homo sapiens
ttccacagcagcagaacaagtg

SEQ ID NO: 3161679 - DNA, 13 bp, Homo sapiens
ttccacagccgcc

SEQ ID NO: 3161680 - DNA, 13 bp, Homo sapiens
ttccacagttatc

SEQ ID NO: 3161681 - DNA, 20 bp, Homo sapiens
ttccacagttatcttagctg

SEQ ID NO: 3161682 - DNA, 16 bp, Homo sapiens
ttccacagttgccacc

SEQ ID NO: 3161683 - DNA, 17 bp, Homo sapiens
ttccacagttgccacca

SEQ ID NO: 3161684 - DNA, 15 bp, Homo sapiens
ttccacatgttactg

SEQ ID NO: 3161685 - DNA, 21 bp, Homo sapiens
ttccaccacagccagcacctg

SEQ ID NO: 3161686 - DNA, 19 bp, Homo sapiens
ttccaccccaagagaactc

SEQ ID NO: 3161687 - DNA, 11 bp, Homo sapiens
ttccaccctgg

SEQ ID NO: 3161688 - DNA, 13 bp, Homo sapiens
ttccaccctggaa

SEQ ID NO: 3161689 - DNA, 12 bp, Homo sapiens
ttccacctccct

SEQ ID NO: 3161690 - DNA, 21 bp, Homo sapiens
ttccacctgtgccctcaccac

SEQ ID NO: 3161691 - DNA, 17 bp, Homo sapiens
ttccactacacctggct

SEQ ID NO: 3161692 - DNA, 18 bp, Homo sapiens
ttccactacacctggctg

SEQ ID NO: 3161693 - DNA, 21 bp, Homo sapiens
ttccactatcccaatcaaaga

SEQ ID NO: 3161694 - DNA, 21 bp, Homo sapiens
ttccactgcaaataaagcctt

SEQ ID NO: 3161695 - DNA, 23 bp, Homo sapiens
ttccactgcaaataaagcctttt

SEQ ID NO: 3161696 - DNA, 12 bp, Homo sapiens
ttccactggact

SEQ ID NO: 3161697 - DNA, 19 bp, Homo sapiens
ttccacttctaactccact

SEQ ID NO: 3161698 - DNA, 18 bp, Homo sapiens
ttccacttcttcctttct

SEQ ID NO: 3161699 - DNA, 19 bp, Homo sapiens
ttccacttcttcctttctc

SEQ ID NO: 3161700 - DNA, 21 bp, Homo sapiens
ttccacttgagtgtcaagctg

SEQ ID NO: 3161701 - DNA, 17 bp, Homo sapiens
ttccagaaaaccccagc

SEQ ID NO: 3161702 - DNA, 14 bp, Homo sapiens
ttccagaaaggata

SEQ ID NO: 3161703 - DNA, 19 bp, Homo sapiens
ttccagaatgctgtacatc

SEQ ID NO: 3161704 - DNA, 14 bp, Homo sapiens
ttccagacttcaaa

SEQ ID NO: 3161705 - DNA, 20 bp, Homo sapiens
ttccagacttcaaaaataaa

SEQ ID NO: 3161706 - DNA, 17 bp, Homo sapiens
ttccagagagtggctcc

SEQ ID NO: 3161707 - DNA, 23 bp, Homo sapiens
ttccagataaccagctgtaacac

SEQ ID NO: 3161708 - DNA, 18 bp, Homo sapiens
ttccagatcactgccaca

SEQ ID NO: 3161709 - DNA, 18 bp, Homo sapiens
ttccagcaagtacagaga

SEQ ID NO: 3161710 - DNA, 24 bp, Homo sapiens
ttccagcatgaggtatctaaggat

SEQ ID NO: 3161711 - DNA, 14 bp, Homo sapiens
ttccagcccctctg

SEQ ID NO: 3161712 - DNA, 13 bp, Homo sapiens
ttccagcttcagg

SEQ ID NO: 3161713 - DNA, 16 bp, Homo sapiens
ttccagcttcaggcac

SEQ ID NO: 3161714 - DNA, 22 bp, Homo sapiens
ttccagcttcaggcaccagcat

SEQ ID NO: 3161715 - DNA, 16 bp, Homo sapiens
ttccaggatcctgcag

SEQ ID NO: 3161716 - DNA, 11 bp, Homo sapiens
ttccaggcccc

SEQ ID NO: 3161717 - DNA, 16 bp, Homo sapiens
ttccaggcccctgagg

SEQ ID NO: 3161718 - DNA, 13 bp, Homo sapiens
ttccaggccctcc

SEQ ID NO: 3161719 - DNA, 21 bp, Homo sapiens
ttccaggctagtccggaccca

SEQ ID NO: 3161720 - DNA, 21 bp, Homo sapiens
ttccaggctcttcctggacct

SEQ ID NO: 3161721 - DNA, 15 bp, Homo sapiens
ttccaggggaacctg

SEQ ID NO: 3161722 - DNA, 16 bp, Homo sapiens
ttccagggtccctctg

SEQ ID NO: 3161723 - DNA, 18 bp, Homo sapiens
ttccagggtccctctgtg

SEQ ID NO: 3161724 - DNA, 19 bp, Homo sapiens
ttccagggtccctctgtgt

SEQ ID NO: 3161725 - DNA, 20 bp, Homo sapiens
ttccagggtccctctgtgta

SEQ ID NO: 3161726 - DNA, 17 bp, Homo sapiens
ttccaggtgtttatagt

SEQ ID NO: 3161727 - DNA, 20 bp, Homo sapiens
ttccagtaacttttttgtgt

SEQ ID NO: 3161728 - DNA, 17 bp, Homo sapiens
ttccagtacctttgtca

SEQ ID NO: 3161729 - DNA, 13 bp, Homo sapiens
ttccagtattgaa

SEQ ID NO: 3161730 - DNA, 12 bp, Homo sapiens
ttccagtcacat

SEQ ID NO: 3161731 - DNA, 17 bp, Homo sapiens
ttccagtcacattgcca

SEQ ID NO: 3161732 - DNA, 14 bp, Homo sapiens
ttccagtctcaaaa

SEQ ID NO: 3161733 - DNA, 14 bp, Homo sapiens
ttccagtgagtgta

SEQ ID NO: 3161734 - DNA, 11 bp, Homo sapiens
ttccagttccc

SEQ ID NO: 3161735 - DNA, 19 bp, Homo sapiens
ttccagttctgacacacgt

SEQ ID NO: 3161736 - DNA, 17 bp, Homo sapiens
ttccataaggaatgtag

SEQ ID NO: 3161737 - DNA, 19 bp, Homo sapiens
ttccataatctggactcct

SEQ ID NO: 3161738 - DNA, 16 bp, Homo sapiens
ttccataattatgaca

SEQ ID NO: 3161739 - DNA, 18 bp, Homo sapiens
ttccataattatgacagt

SEQ ID NO: 3161740 - DNA, 23 bp, Homo sapiens
ttccatacagggtctcttccttc

SEQ ID NO: 3161741 - DNA, 14 bp, Homo sapiens
ttccatatgctcca

SEQ ID NO: 3161742 - DNA, 22 bp, Homo sapiens
ttccatatttaacctatttcca

SEQ ID NO: 3161743 - DNA, 13 bp, Homo sapiens
ttccatatttttt

SEQ ID NO: 3161744 - DNA, 19 bp, Homo sapiens
ttccatcaggttccatccc

SEQ ID NO: 3161745 - DNA, 17 bp, Homo sapiens
ttccatcattttacagt

SEQ ID NO: 3161746 - DNA, 17 bp, Homo sapiens
ttccatccataaatcca

SEQ ID NO: 3161747 - DNA, 18 bp, Homo sapiens
ttccatcccaaccagtgc

SEQ ID NO: 3161748 - DNA, 15 bp, Homo sapiens
ttccatccctacccc

SEQ ID NO: 3161749 - DNA, 21 bp, Homo sapiens
ttccatccctaccccctaaga

SEQ ID NO: 3161750 - DNA, 14 bp, Homo sapiens
ttccatctctgact

SEQ ID NO: 3161751 - DNA, 13 bp, Homo sapiens
ttccatctctggt

SEQ ID NO: 3161752 - DNA, 13 bp, Homo sapiens
ttccatcttgcta

SEQ ID NO: 3161753 - DNA, 20 bp, Homo sapiens
ttccatgatggattcccccc

SEQ ID NO: 3161754 - DNA, 17 bp, Homo sapiens
ttccatgattctattta

SEQ ID NO: 3161755 - DNA, 17 bp, Homo sapiens
ttccatgcagccttggg

SEQ ID NO: 3161756 - DNA, 23 bp, Homo sapiens
ttccatgcctgtagctttcctgg

SEQ ID NO: 3161757 - DNA, 16 bp, Homo sapiens
ttccatgtcgcctctg

SEQ ID NO: 3161758 - DNA, 20 bp, Homo sapiens
ttccatgtcgcctctgcatt

SEQ ID NO: 3161759 - DNA, 21 bp, Homo sapiens
ttccatgtcgcctctgcattc

SEQ ID NO: 3161760 - DNA, 15 bp, Homo sapiens
ttccatgtgaacagc

SEQ ID NO: 3161761 - DNA, 14 bp, Homo sapiens
ttccatgtggagaa

SEQ ID NO: 3161762 - DNA, 23 bp, Homo sapiens
ttccattacaaaatccaactctc

SEQ ID NO: 3161763 - DNA, 16 bp, Homo sapiens
ttccattatgattctt

SEQ ID NO: 3161764 - DNA, 18 bp, Homo sapiens
ttccattgcctcttttca

SEQ ID NO: 3161765 - DNA, 22 bp, Homo sapiens
ttccattgcctcttttcacatt

SEQ ID NO: 3161766 - DNA, 20 bp, Homo sapiens
ttccattggtccaagattcc

SEQ ID NO: 3161767 - DNA, 15 bp, Homo sapiens
ttccatttacagtct

SEQ ID NO: 3161768 - DNA, 17 bp, Homo sapiens
ttccatttacagtctct

SEQ ID NO: 3161769 - DNA, 22 bp, Homo sapiens
ttccatttatttatgaaaaaat

SEQ ID NO: 3161770 - DNA, 11 bp, Homo sapiens
ttccatttctg

SEQ ID NO: 3161771 - DNA, 14 bp, Homo sapiens
ttccatttctgatg

SEQ ID NO: 3161772 - DNA, 16 bp, Homo sapiens
ttccattttcccccac

SEQ ID NO: 3161773 - DNA, 23 bp, Homo sapiens
ttccattttggcgctattacaaa

SEQ ID NO: 3161774 - DNA, 20 bp, Homo sapiens
ttccatttttcctctgttca

SEQ ID NO: 3161775 - DNA, 16 bp, Homo sapiens
ttcccaaacgcctccc

SEQ ID NO: 3161776 - DNA, 18 bp, Homo sapiens
ttcccaaactacagaata

SEQ ID NO: 3161777 - DNA, 20 bp, Homo sapiens
ttcccaaactacagaataat

SEQ ID NO: 3161778 - DNA, 13 bp, Homo sapiens
ttcccaagctctg

SEQ ID NO: 3161779 - DNA, 18 bp, Homo sapiens
ttcccaagctctgctcct

SEQ ID NO: 3161780 - DNA, 12 bp, Homo sapiens
ttcccaataaat

SEQ ID NO: 3161781 - DNA, 23 bp, Homo sapiens
ttcccaatagcaacgtagcttct

SEQ ID NO: 3161782 - DNA, 21 bp, Homo sapiens
ttcccaatagcactttcattg

SEQ ID NO: 3161783 - DNA, 17 bp, Homo sapiens
ttcccaatcagcactga

SEQ ID NO: 3161784 - DNA, 19 bp, Homo sapiens
ttcccaatcagcactgaaa

SEQ ID NO: 3161785 - DNA, 14 bp, Homo sapiens
ttcccaattaggaa

SEQ ID NO: 3161786 - DNA, 16 bp, Homo sapiens
ttcccacacctccaca

SEQ ID NO: 3161787 - DNA, 15 bp, Homo sapiens
ttcccacatctttcc

SEQ ID NO: 3161788 - DNA, 18 bp, Homo sapiens
ttcccacatctttcctca

SEQ ID NO: 3161789 - DNA, 13 bp, Homo sapiens
ttcccacattcca

SEQ ID NO: 3161790 - DNA, 19 bp, Homo sapiens
ttcccaccattcctgcctt

SEQ ID NO: 3161791 - DNA, 17 bp, Homo sapiens
ttcccaccgccctccct

SEQ ID NO: 3161792 - DNA, 15 bp, Homo sapiens
ttcccagaggcaggc

SEQ ID NO: 3161793 - DNA, 15 bp, Homo sapiens
ttcccagagggagca

SEQ ID NO: 3161794 - DNA, 22 bp, Homo sapiens
ttcccagagtcagaggagaaga

SEQ ID NO: 3161795 - DNA, 14 bp, Homo sapiens
ttcccagatacttc

SEQ ID NO: 3161796 - DNA, 19 bp, Homo sapiens
ttcccagccatgcccagga

SEQ ID NO: 3161797 - DNA, 15 bp, Homo sapiens
ttcccaggctgcccc

SEQ ID NO: 3161798 - DNA, 17 bp, Homo sapiens
ttcccagtgaattcttg

SEQ ID NO: 3161799 - DNA, 23 bp, Homo sapiens
ttcccagtgacacttcagagagc

SEQ ID NO: 3161800 - DNA, 22 bp, Homo sapiens
ttcccatagtggggcctgggag

SEQ ID NO: 3161801 - DNA, 23 bp, Homo sapiens
ttcccattgcatcacctctgtaa

SEQ ID NO: 3161802 - DNA, 14 bp, Homo sapiens
ttcccatttcagct

SEQ ID NO: 3161803 - DNA, 18 bp, Homo sapiens
ttcccatttctctacact

SEQ ID NO: 3161804 - DNA, 17 bp, Homo sapiens
ttcccatttgtgccaga

SEQ ID NO: 3161805 - DNA, 19 bp, Homo sapiens
ttcccattttgcaaaattt

SEQ ID NO: 3161806 - DNA, 16 bp, Homo sapiens
ttccccaacttcccta

SEQ ID NO: 3161807 - DNA, 17 bp, Homo sapiens
ttccccactgacagcct

SEQ ID NO: 3161808 - DNA, 21 bp, Homo sapiens
ttccccactgacagcctccca

SEQ ID NO: 3161809 - DNA, 16 bp, Homo sapiens
ttccccaggcccacca

SEQ ID NO: 3161810 - DNA, 16 bp, Homo sapiens
ttccccagggaaggaa

SEQ ID NO: 3161811 - DNA, 17 bp, Homo sapiens
ttccccagggaaggaaa

SEQ ID NO: 3161812 - DNA, 11 bp, Homo sapiens
ttccccatggg

SEQ ID NO: 3161813 - DNA, 18 bp, Homo sapiens
ttcccccaacctcagact

SEQ ID NO: 3161814 - DNA, 23 bp, Homo sapiens
ttcccccaccggtccagctggcc

SEQ ID NO: 3161815 - DNA, 18 bp, Homo sapiens
ttcccccatgtggctgaa

SEQ ID NO: 3161816 - DNA, 12 bp, Homo sapiens
ttccccccactc

SEQ ID NO: 3161817 - DNA, 20 bp, Homo sapiens
ttcccccgagctcttggcct

SEQ ID NO: 3161818 - DNA, 21 bp, Homo sapiens
ttcccccgagctcttggcctt

SEQ ID NO: 3161819 - DNA, 19 bp, Homo sapiens
ttccccctccaatcccacc

SEQ ID NO: 3161820 - DNA, 19 bp, Homo sapiens
ttccccctcttcttctgaa

SEQ ID NO: 3161821 - DNA, 19 bp, Homo sapiens
ttcccctaacctcattccc

SEQ ID NO: 3161822 - DNA, 13 bp, Homo sapiens
ttcccctcccctc

SEQ ID NO: 3161823 - DNA, 15 bp, Homo sapiens
ttcccctcccctcct

SEQ ID NO: 3161824 - DNA, 13 bp, Homo sapiens
ttcccctccctgg

SEQ ID NO: 3161825 - DNA, 16 bp, Homo sapiens
ttcccctctctgcccc

SEQ ID NO: 3161826 - DNA, 19 bp, Homo sapiens
ttcccctcttcccttcaac

SEQ ID NO: 3161827 - DNA, 13 bp, Homo sapiens
ttcccctggcctc

SEQ ID NO: 3161828 - DNA, 13 bp, Homo sapiens
ttcccctggcctt

SEQ ID NO: 3161829 - DNA, 14 bp, Homo sapiens
ttcccctggcctta

SEQ ID NO: 3161830 - DNA, 12 bp, Homo sapiens
ttcccctgtctt

SEQ ID NO: 3161831 - DNA, 15 bp, Homo sapiens
ttcccctgtggggat

SEQ ID NO: 3161832 - DNA, 14 bp, Homo sapiens
ttcccctgttcact

SEQ ID NO: 3161833 - DNA, 11 bp, Homo sapiens
ttccccttccc

SEQ ID NO: 3161834 - DNA, 11 bp, Homo sapiens
ttccccttcct

SEQ ID NO: 3161835 - DNA, 13 bp, Homo sapiens
ttccccttcctaa

SEQ ID NO: 3161836 - DNA, 19 bp, Homo sapiens
ttccccttctgtgtcacag

SEQ ID NO: 3161837 - DNA, 12 bp, Homo sapiens
ttccccttggac

SEQ ID NO: 3161838 - DNA, 14 bp, Homo sapiens
ttcccctttcccca

SEQ ID NO: 3161839 - DNA, 22 bp, Homo sapiens
ttccccttttgcctggctgtgg

SEQ ID NO: 3161840 - DNA, 20 bp, Homo sapiens
ttcccgattcacgtttttct

SEQ ID NO: 3161841 - DNA, 12 bp, Homo sapiens
ttcccgcctccc

SEQ ID NO: 3161842 - DNA, 14 bp, Homo sapiens
ttcccgtctcagaa

SEQ ID NO: 3161843 - DNA, 19 bp, Homo sapiens
ttccctaaaatacatttaa

SEQ ID NO: 3161844 - DNA, 16 bp, Homo sapiens
ttccctaatctatggt

SEQ ID NO: 3161845 - DNA, 13 bp, Homo sapiens
ttccctacttcct

SEQ ID NO: 3161846 - DNA, 17 bp, Homo sapiens
ttccctacttcctgtga

SEQ ID NO: 3161847 - DNA, 20 bp, Homo sapiens
ttccctcacctttcccatct

SEQ ID NO: 3161848 - DNA, 14 bp, Homo sapiens
ttccctcctgacaa

SEQ ID NO: 3161849 - DNA, 20 bp, Homo sapiens
ttccctctttggctcccctg

SEQ ID NO: 3161850 - DNA, 21 bp, Homo sapiens
ttccctgaaacacgaaacttg

SEQ ID NO: 3161851 - DNA, 22 bp, Homo sapiens
ttccctgaaacacgaaacttgt

SEQ ID NO: 3161852 - DNA, 23 bp, Homo sapiens
ttccctgaaacacgaaacttgtt

SEQ ID NO: 3161853 - DNA, 15 bp, Homo sapiens
ttccctgattattta

SEQ ID NO: 3161854 - DNA, 19 bp, Homo sapiens
ttccctgattatttatcct

SEQ ID NO: 3161855 - DNA, 22 bp, Homo sapiens
ttccctgcccaaacccttaact

SEQ ID NO: 3161856 - DNA, 23 bp, Homo sapiens
ttccctgcccaaacccttaactg

SEQ ID NO: 3161857 - DNA, 23 bp, Homo sapiens
ttccctgcctctcatcaactgaa

SEQ ID NO: 3161858 - DNA, 22 bp, Homo sapiens
ttccctgcgagacgcacacagc

SEQ ID NO: 3161859 - DNA, 12 bp, Homo sapiens
ttccctgctgaa

SEQ ID NO: 3161860 - DNA, 14 bp, Homo sapiens
ttccctgcttccag

SEQ ID NO: 3161861 - DNA, 15 bp, Homo sapiens
ttccctgcttccagg

SEQ ID NO: 3161862 - DNA, 16 bp, Homo sapiens
ttccctgcttccagga
